United States Patent 12,644,137 (MATERIALS AND METHODS FOR TREATMENT OF HEMOGLOBINOPATHIES) - sequence listing, part 8

SEQ ID NO: 155365 - DNA, 22 bp, Artificial Sequence
  Synthetic oligonucleotide; CTA chr11 5155633 5155654 5155638 5155633 -
gaaaccagctgtaaaatgtcaa

SEQ ID NO: 155366 - DNA, 22 bp, Artificial Sequence
  Synthetic oligonucleotide; CTG chr11 5155622 5155643 5155627 5155622 -
taaaatgtcaaggagaatagtg

SEQ ID NO: 155367 - DNA, 22 bp, Artificial Sequence
  Synthetic oligonucleotide; CTT chr11 5155583 5155604 5155588 5155583 -
gcttagaatttatcagatactt

SEQ ID NO: 155368 - DNA, 22 bp, Artificial Sequence
  Synthetic oligonucleotide; TTG chr11 5155582 5155603 5155587 5155582 -
cttagaatttatcagatactta

SEQ ID NO: 155369 - DNA, 22 bp, Artificial Sequence
  Synthetic oligonucleotide; CTT chr11 5155579 5155600 5155584 5155579 -
agaatttatcagatacttacgt

SEQ ID NO: 155370 - DNA, 22 bp, Artificial Sequence
  Synthetic oligonucleotide; TTA chr11 5155578 5155599 5155583 5155578 -
gaatttatcagatacttacgtg

SEQ ID NO: 155371 - DNA, 22 bp, Artificial Sequence
  Synthetic oligonucleotide; TTT chr11 5155572 5155593 5155577 5155572 -
atcagatacttacgtgataaat

SEQ ID NO: 155372 - DNA, 22 bp, Artificial Sequence
  Synthetic oligonucleotide; TTA chr11 5155571 5155592 5155576 5155571 -
tcagatacttacgtgataaatg

SEQ ID NO: 155373 - DNA, 22 bp, Artificial Sequence
  Synthetic oligonucleotide; CTT chr11 5155561 5155582 5155566 5155561 -
acgtgataaatgaaattgtaat

SEQ ID NO: 155374 - DNA, 22 bp, Artificial Sequence
  Synthetic oligonucleotide; TTA chr11 5155560 5155581 5155565 5155560 -
cgtgataaatgaaattgtaatg

SEQ ID NO: 155375 - DNA, 22 bp, Artificial Sequence
  Synthetic oligonucleotide; TTG chr11 5155543 5155564 5155548 5155543 -
taatgcataatcccattttact

SEQ ID NO: 155376 - DNA, 22 bp, Artificial Sequence
  Synthetic oligonucleotide; TTT chr11 5155525 5155546 5155530 5155525 -
tactaataatttaaaggtaaga

SEQ ID NO: 155377 - DNA, 22 bp, Artificial Sequence
  Synthetic oligonucleotide; TTT chr11 5155524 5155545 5155529 5155524 -
actaataatttaaaggtaagac

SEQ ID NO: 155378 - DNA, 22 bp, Artificial Sequence
  Synthetic oligonucleotide; TTA chr11 5155523 5155544 5155528 5155523 -
ctaataatttaaaggtaagact

SEQ ID NO: 155379 - DNA, 22 bp, Artificial Sequence
  Synthetic oligonucleotide; CTA chr11 5155520 5155541 5155525 5155520 -
ataatttaaaggtaagactata

SEQ ID NO: 155380 - DNA, 22 bp, Artificial Sequence
  Synthetic oligonucleotide; TTT chr11 5155513 5155534 5155518 5155513 -
aaaggtaagactataatttttt

SEQ ID NO: 155381 - DNA, 22 bp, Artificial Sequence
  Synthetic oligonucleotide; TTA chr11 5155512 5155533 5155517 5155512 -
aaggtaagactataattttttt

SEQ ID NO: 155382 - DNA, 22 bp, Artificial Sequence
  Synthetic oligonucleotide; CTA chr11 5155500 5155521 5155505 5155500 -
taatttttttcatttcatttag

SEQ ID NO: 155383 - DNA, 22 bp, Artificial Sequence
  Synthetic oligonucleotide; TTT chr11 5155494 5155515 5155499 5155494 -
ttttcatttcatttagaatata

SEQ ID NO: 155384 - DNA, 22 bp, Artificial Sequence
  Synthetic oligonucleotide; TTT chr11 5155493 5155514 5155498 5155493 -
tttcatttcatttagaatatat

SEQ ID NO: 155385 - DNA, 22 bp, Artificial Sequence
  Synthetic oligonucleotide; TTT chr11 5155492 5155513 5155497 5155492 -
ttcatttcatttagaatatata

SEQ ID NO: 155386 - DNA, 22 bp, Artificial Sequence
  Synthetic oligonucleotide; TTT chr11 5155491 5155512 5155496 5155491 -
tcatttcatttagaatatataa

SEQ ID NO: 155387 - DNA, 22 bp, Artificial Sequence
  Synthetic oligonucleotide; TTT chr11 5155490 5155511 5155495 5155490 -
catttcatttagaatatataac

SEQ ID NO: 155388 - DNA, 22 bp, Artificial Sequence
  Synthetic oligonucleotide; TTC chr11 5155489 5155510 5155494 5155489 -
atttcatttagaatatataaca

SEQ ID NO: 155389 - DNA, 22 bp, Artificial Sequence
  Synthetic oligonucleotide; TTT chr11 5155485 5155506 5155490 5155485 -
catttagaatatataacatctc

SEQ ID NO: 155390 - DNA, 22 bp, Artificial Sequence
  Synthetic oligonucleotide; TTC chr11 5155484 5155505 5155489 5155484 -
atttagaatatataacatctca

SEQ ID NO: 155391 - DNA, 22 bp, Artificial Sequence
  Synthetic oligonucleotide; TTT chr11 5155480 5155501 5155485 5155480 -
agaatatataacatctcactca

SEQ ID NO: 155392 - DNA, 22 bp, Artificial Sequence
  Synthetic oligonucleotide; TTA chr11 5155479 5155500 5155484 5155479 -
gaatatataacatctcactcat

SEQ ID NO: 155393 - DNA, 22 bp, Artificial Sequence
  Synthetic oligonucleotide; CTC chr11 5155463 5155484 5155468 5155463 -
actcataaatagtaggaatata

SEQ ID NO: 155394 - DNA, 22 bp, Artificial Sequence
  Synthetic oligonucleotide; CTC chr11 5155459 5155480 5155464 5155459 -
ataaatagtaggaatataatga

SEQ ID NO: 155395 - DNA, 22 bp, Artificial Sequence
  Synthetic oligonucleotide; CTG chr11 5155434 5155455 5155439 5155434 -
ttttttgaaagaaaaagaagga

SEQ ID NO: 155396 - DNA, 22 bp, Artificial Sequence
  Synthetic oligonucleotide; TTT chr11 5155431 5155452 5155436 5155431 -
tttgaaagaaaaagaaggaagg

SEQ ID NO: 155397 - DNA, 22 bp, Artificial Sequence
  Synthetic oligonucleotide; TTT chr11 5155430 5155451 5155435 5155430 -
ttgaaagaaaaagaaggaagga

SEQ ID NO: 155398 - DNA, 22 bp, Artificial Sequence
  Synthetic oligonucleotide; TTT chr11 5155429 5155450 5155434 5155429 -
tgaaagaaaaagaaggaaggaa

SEQ ID NO: 155399 - DNA, 22 bp, Artificial Sequence
  Synthetic oligonucleotide; TTT chr11 5155428 5155449 5155433 5155428 -
gaaagaaaaagaaggaaggaaa

SEQ ID NO: 155400 - DNA, 22 bp, Artificial Sequence
  Synthetic oligonucleotide; TTG chr11 5155427 5155448 5155432 5155427 -
aaagaaaaagaaggaaggaaag

SEQ ID NO: 155401 - DNA, 22 bp, Artificial Sequence
  Synthetic oligonucleotide; TTT chr11 5155362 5155383 5155367 5155362 -
actcaaatgttcaacaacttgc

SEQ ID NO: 155402 - DNA, 22 bp, Artificial Sequence
  Synthetic oligonucleotide; TTA chr11 5155361 5155382 5155366 5155361 -
ctcaaatgttcaacaacttgct

SEQ ID NO: 155403 - DNA, 22 bp, Artificial Sequence
  Synthetic oligonucleotide; CTC chr11 5155358 5155379 5155363 5155358 -
aaatgttcaacaacttgcttcc

SEQ ID NO: 155404 - DNA, 22 bp, Artificial Sequence
  Synthetic oligonucleotide; TTC chr11 5155350 5155371 5155355 5155350 -
aacaacttgcttccagctttac

SEQ ID NO: 155405 - DNA, 22 bp, Artificial Sequence
  Synthetic oligonucleotide; CTT chr11 5155342 5155363 5155347 5155342 -
gcttccagctttacatttgtag

SEQ ID NO: 155406 - DNA, 22 bp, Artificial Sequence
  Synthetic oligonucleotide; TTG chr11 5155341 5155362 5155346 5155341 -
cttccagctttacatttgtagg

SEQ ID NO: 155407 - DNA, 22 bp, Artificial Sequence
  Synthetic oligonucleotide; CTT chr11 5155338 5155359 5155343 5155338 -
ccagctttacatttgtaggact

SEQ ID NO: 155408 - DNA, 22 bp, Artificial Sequence
  Synthetic oligonucleotide; TTC chr11 5155337 5155358 5155342 5155337 -
cagctttacatttgtaggactt

SEQ ID NO: 155409 - DNA, 22 bp, Artificial Sequence
  Synthetic oligonucleotide; CTT chr11 5155331 5155352 5155336 5155331 -
tacatttgtaggacttagaaat

SEQ ID NO: 155410 - DNA, 22 bp, Artificial Sequence
  Synthetic oligonucleotide; TTT chr11 5155330 5155351 5155335 5155330 -
acatttgtaggacttagaaatg

SEQ ID NO: 155411 - DNA, 22 bp, Artificial Sequence
  Synthetic oligonucleotide; TTA chr11 5155329 5155350 5155334 5155329 -
catttgtaggacttagaaatgt

SEQ ID NO: 155412 - DNA, 22 bp, Artificial Sequence
  Synthetic oligonucleotide; TTT chr11 5155324 5155345 5155329 5155324 -
gtaggacttagaaatgtccatt

SEQ ID NO: 155413 - DNA, 22 bp, Artificial Sequence
  Synthetic oligonucleotide; TTG chr11 5155323 5155344 5155328 5155323 -
taggacttagaaatgtccatta

SEQ ID NO: 155414 - DNA, 22 bp, Artificial Sequence
  Synthetic oligonucleotide; CTT chr11 5155315 5155336 5155320 5155315 -
agaaatgtccattataatttgt

SEQ ID NO: 155415 - DNA, 22 bp, Artificial Sequence
  Synthetic oligonucleotide; TTA chr11 5155314 5155335 5155319 5155314 -
gaaatgtccattataatttgtc

SEQ ID NO: 155416 - DNA, 22 bp, Artificial Sequence
  Synthetic oligonucleotide; TTA chr11 5155301 5155322 5155306 5155301 -
taatttgtcactataagaatgt

SEQ ID NO: 155417 - DNA, 22 bp, Artificial Sequence
  Synthetic oligonucleotide; TTT chr11 5155295 5155316 5155300 5155295 -
gtcactataagaatgttactta

SEQ ID NO: 155418 - DNA, 22 bp, Artificial Sequence
  Synthetic oligonucleotide; TTG chr11 5155294 5155315 5155299 5155294 -
tcactataagaatgttacttaa

SEQ ID NO: 155419 - DNA, 22 bp, Artificial Sequence
  Synthetic oligonucleotide; CTA chr11 5155288 5155309 5155293 5155288 -
taagaatgttacttaatttact

SEQ ID NO: 155420 - DNA, 22 bp, Artificial Sequence
  Synthetic oligonucleotide; TTA chr11 5155277 5155298 5155282 5155277 -
cttaatttactaaaagataaaa

SEQ ID NO: 155421 - DNA, 22 bp, Artificial Sequence
  Synthetic oligonucleotide; CTT chr11 5155274 5155295 5155279 5155274 -
aatttactaaaagataaaaaaa

SEQ ID NO: 155422 - DNA, 22 bp, Artificial Sequence
  Synthetic oligonucleotide; TTA chr11 5155273 5155294 5155278 5155273 -
atttactaaaagataaaaaaaa

SEQ ID NO: 155423 - DNA, 22 bp, Artificial Sequence
  Synthetic oligonucleotide; TTT chr11 5155269 5155290 5155274 5155269 -
actaaaagataaaaaaaacttc

SEQ ID NO: 155424 - DNA, 22 bp, Artificial Sequence
  Synthetic oligonucleotide; TTA chr11 5155268 5155289 5155273 5155268 -
ctaaaagataaaaaaaacttca

SEQ ID NO: 155425 - DNA, 22 bp, Artificial Sequence
  Synthetic oligonucleotide; CTA chr11 5155265 5155286 5155270 5155265 -
aaagataaaaaaaacttcaata

SEQ ID NO: 155426 - DNA, 22 bp, Artificial Sequence
  Synthetic oligonucleotide; CTT chr11 5155248 5155269 5155253 5155248 -
caataaaataaaatgggaagaa

SEQ ID NO: 155427 - DNA, 22 bp, Artificial Sequence
  Synthetic oligonucleotide; TTC chr11 5155247 5155268 5155252 5155247 -
aataaaataaaatgggaagaat

SEQ ID NO: 155428 - DNA, 22 bp, Artificial Sequence
  Synthetic oligonucleotide; CTG chr11 5155218 5155239 5155223 5155218 -
aagaagactgaggaagtaattg

SEQ ID NO: 155429 - DNA, 22 bp, Artificial Sequence
  Synthetic oligonucleotide; CTG chr11 5155208 5155229 5155213 5155208 -
aggaagtaattgtgtggtaaaa

SEQ ID NO: 155430 - DNA, 22 bp, Artificial Sequence
  Synthetic oligonucleotide; TTG chr11 5155196 5155217 5155201 5155196 -
tgtggtaaaaagtagttatgaa

SEQ ID NO: 155431 - DNA, 22 bp, Artificial Sequence
  Synthetic oligonucleotide; TTA chr11 5155178 5155199 5155183 5155178 -
tgaatacagatttttcttttct

SEQ ID NO: 155432 - DNA, 22 bp, Artificial Sequence
  Synthetic oligonucleotide; TTT chr11 5155165 5155186 5155170 5155165 -
ttcttttctgaataaaaagaga

SEQ ID NO: 155433 - DNA, 22 bp, Artificial Sequence
  Synthetic oligonucleotide; TTT chr11 5155164 5155185 5155169 5155164 -
tcttttctgaataaaaagagaa

SEQ ID NO: 155434 - DNA, 22 bp, Artificial Sequence
  Synthetic oligonucleotide; TTT chr11 5155163 5155184 5155168 5155163 -
cttttctgaataaaaagagaaa

SEQ ID NO: 155435 - DNA, 22 bp, Artificial Sequence
  Synthetic oligonucleotide; TTC chr11 5155162 5155183 5155167 5155162 -
ttttctgaataaaaagagaaaa

SEQ ID NO: 155436 - DNA, 22 bp, Artificial Sequence
  Synthetic oligonucleotide; CTT chr11 5155160 5155181 5155165 5155160 -
ttctgaataaaaagagaaaaac

SEQ ID NO: 155437 - DNA, 22 bp, Artificial Sequence
  Synthetic oligonucleotide; TTT chr11 5155159 5155180 5155164 5155159 -
tctgaataaaaagagaaaaacc

SEQ ID NO: 155438 - DNA, 22 bp, Artificial Sequence
  Synthetic oligonucleotide; TTT chr11 5155158 5155179 5155163 5155158 -
ctgaataaaaagagaaaaacct

SEQ ID NO: 155439 - DNA, 22 bp, Artificial Sequence
  Synthetic oligonucleotide; TTC chr11 5155157 5155178 5155162 5155157 -
tgaataaaaagagaaaaacctt

SEQ ID NO: 155440 - DNA, 22 bp, Artificial Sequence
  Synthetic oligonucleotide; CTG chr11 5155155 5155176 5155160 5155155 -
aataaaaagagaaaaaccttgc

SEQ ID NO: 155441 - DNA, 22 bp, Artificial Sequence
  Synthetic oligonucleotide; CTT chr11 5155135 5155156 5155140 5155135 -
gcctcagtgaaaatgtcaccaa

SEQ ID NO: 155442 - DNA, 22 bp, Artificial Sequence
  Synthetic oligonucleotide; TTG chr11 5155134 5155155 5155139 5155134 -
cctcagtgaaaatgtcaccaag

SEQ ID NO: 155443 - DNA, 22 bp, Artificial Sequence
  Synthetic oligonucleotide; CTC chr11 5155130 5155151 5155135 5155130 -
agtgaaaatgtcaccaagatat

SEQ ID NO: 155444 - DNA, 22 bp, Artificial Sequence
  Synthetic oligonucleotide; TTT chr11 5155106 5155127 5155111 5155106 -
atttaaataggaattggcatag

SEQ ID NO: 155445 - DNA, 22 bp, Artificial Sequence
  Synthetic oligonucleotide; TTA chr11 5155105 5155126 5155110 5155105 -
tttaaataggaattggcataga

SEQ ID NO: 155446 - DNA, 22 bp, Artificial Sequence
  Synthetic oligonucleotide; TTT chr11 5155102 5155123 5155107 5155102 -
aaataggaattggcatagaaac

SEQ ID NO: 155447 - DNA, 22 bp, Artificial Sequence
  Synthetic oligonucleotide; TTA chr11 5155101 5155122 5155106 5155101 -
aataggaattggcatagaaaca

SEQ ID NO: 155448 - DNA, 22 bp, Artificial Sequence
  Synthetic oligonucleotide; TTG chr11 5155090 5155111 5155095 5155090 -
gcatagaaacatgtttgcatta

SEQ ID NO: 155449 - DNA, 22 bp, Artificial Sequence
  Synthetic oligonucleotide; TTT chr11 5155074 5155095 5155079 5155074 -
gcattaaatgggctttagaatt

SEQ ID NO: 155450 - DNA, 22 bp, Artificial Sequence
  Synthetic oligonucleotide; TTG chr11 5155073 5155094 5155078 5155073 -
cattaaatgggctttagaattt

SEQ ID NO: 155451 - DNA, 22 bp, Artificial Sequence
  Synthetic oligonucleotide; TTA chr11 5155068 5155089 5155073 5155068 -
aatgggctttagaattttgcaa

SEQ ID NO: 155452 - DNA, 22 bp, Artificial Sequence
  Synthetic oligonucleotide; CTT chr11 5155059 5155080 5155064 5155059 -
tagaattttgcaaatagaaatg

SEQ ID NO: 155453 - DNA, 22 bp, Artificial Sequence
  Synthetic oligonucleotide; TTT chr11 5155058 5155079 5155063 5155058 -
agaattttgcaaatagaaatgg

SEQ ID NO: 155454 - DNA, 22 bp, Artificial Sequence
  Synthetic oligonucleotide; TTA chr11 5155057 5155078 5155062 5155057 -
gaattttgcaaatagaaatggc

SEQ ID NO: 155455 - DNA, 22 bp, Artificial Sequence
  Synthetic oligonucleotide; TTT chr11 5155051 5155072 5155056 5155051 -
tgcaaatagaaatggcagaaaa

SEQ ID NO: 155456 - DNA, 22 bp, Artificial Sequence
  Synthetic oligonucleotide; TTT chr11 5155050 5155071 5155055 5155050 -
gcaaatagaaatggcagaaaag

SEQ ID NO: 155457 - DNA, 22 bp, Artificial Sequence
  Synthetic oligonucleotide; TTG chr11 5155049 5155070 5155054 5155049 -
caaatagaaatggcagaaaagg

SEQ ID NO: 155458 - DNA, 22 bp, Artificial Sequence
  Synthetic oligonucleotide; CTT chr11 5155017 5155038 5155022 5155017 -
gtaaaaaaattttttgcatatg

SEQ ID NO: 155459 - DNA, 22 bp, Artificial Sequence
  Synthetic oligonucleotide; TTG chr11 5155016 5155037 5155021 5155016 -
taaaaaaattttttgcatatga

SEQ ID NO: 155460 - DNA, 22 bp, Artificial Sequence
  Synthetic oligonucleotide; TTT chr11 5155005 5155026 5155010 5155005 -
tttgcatatgaattattctgca

SEQ ID NO: 155461 - DNA, 22 bp, Artificial Sequence
  Synthetic oligonucleotide; TTT chr11 5155004 5155025 5155009 5155004 -
ttgcatatgaattattctgcat

SEQ ID NO: 155462 - DNA, 22 bp, Artificial Sequence
  Synthetic oligonucleotide; TTT chr11 5155003 5155024 5155008 5155003 -
tgcatatgaattattctgcatt

SEQ ID NO: 155463 - DNA, 22 bp, Artificial Sequence
  Synthetic oligonucleotide; TTT chr11 5155002 5155023 5155007 5155002 -
gcatatgaattattctgcattt

SEQ ID NO: 155464 - DNA, 22 bp, Artificial Sequence
  Synthetic oligonucleotide; TTG chr11 5155001 5155022 5155006 5155001 -
catatgaattattctgcattta

SEQ ID NO: 155465 - DNA, 22 bp, Artificial Sequence
  Synthetic oligonucleotide; TTA chr11 5154990 5155011 5154995 5154990 -
ttctgcatttagcctgtgggaa

SEQ ID NO: 155466 - DNA, 22 bp, Artificial Sequence
  Synthetic oligonucleotide; TTC chr11 5154987 5155008 5154992 5154987 -
tgcatttagcctgtgggaaaag

SEQ ID NO: 155467 - DNA, 22 bp, Artificial Sequence
  Synthetic oligonucleotide; CTG chr11 5154985 5155006 5154990 5154985 -
catttagcctgtgggaaaagag

SEQ ID NO: 155468 - DNA, 22 bp, Artificial Sequence
  Synthetic oligonucleotide; TTT chr11 5154980 5155001 5154985 5154980 -
agcctgtgggaaaagagaaaaa

SEQ ID NO: 155469 - DNA, 22 bp, Artificial Sequence
  Synthetic oligonucleotide; TTA chr11 5154979 5155000 5154984 5154979 -
gcctgtgggaaaagagaaaaag

SEQ ID NO: 155470 - DNA, 22 bp, Artificial Sequence
  Synthetic oligonucleotide; CTG chr11 5154974 5154995 5154979 5154974 -
tgggaaaagagaaaaagagaga

SEQ ID NO: 155471 - DNA, 22 bp, Artificial Sequence
  Synthetic oligonucleotide; TTT chr11 5154942 5154963 5154947 5154942 -
ctgcaagtgtagaaataattac

SEQ ID NO: 155472 - DNA, 22 bp, Artificial Sequence
  Synthetic oligonucleotide; TTC chr11 5154941 5154962 5154946 5154941 -
tgcaagtgtagaaataattacg

SEQ ID NO: 155473 - DNA, 22 bp, Artificial Sequence
  Synthetic oligonucleotide; CTG chr11 5154939 5154960 5154944 5154939 -
caagtgtagaaataattacggg

SEQ ID NO: 155474 - DNA, 22 bp, Artificial Sequence
  Synthetic oligonucleotide; TTA chr11 5154921 5154942 5154926 5154921 -
cggggatattaggtgccagtga

SEQ ID NO: 155475 - DNA, 22 bp, Artificial Sequence
  Synthetic oligonucleotide; TTA chr11 5154910 5154931 5154915 5154910 -
ggtgccagtgaacccaagaggg

SEQ ID NO: 155476 - DNA, 22 bp, Artificial Sequence
  Synthetic oligonucleotide; CTG chr11 5154885 5154906 5154890 5154885 -
acttaaaatttgctgggtccct

SEQ ID NO: 155477 - DNA, 22 bp, Artificial Sequence
  Synthetic oligonucleotide; CTT chr11 5154881 5154902 5154886 5154881 -
aaaatttgctgggtccctcgtg

SEQ ID NO: 155478 - DNA, 22 bp, Artificial Sequence
  Synthetic oligonucleotide; TTA chr11 5154880 5154901 5154885 5154880 -
aaatttgctgggtccctcgtgg

SEQ ID NO: 155479 - DNA, 22 bp, Artificial Sequence
  Synthetic oligonucleotide; TTT chr11 5154874 5154895 5154879 5154874 -
gctgggtccctcgtggttttgg

SEQ ID NO: 155480 - DNA, 22 bp, Artificial Sequence
  Synthetic oligonucleotide; TTG chr11 5154873 5154894 5154878 5154873 -
ctgggtccctcgtggttttggc

SEQ ID NO: 155481 - DNA, 22 bp, Artificial Sequence
  Synthetic oligonucleotide; CTG chr11 5154870 5154891 5154875 5154870 -
ggtccctcgtggttttggctat

SEQ ID NO: 155482 - DNA, 22 bp, Artificial Sequence
  Synthetic oligonucleotide; CTC chr11 5154862 5154883 5154867 5154862 -
gtggttttggctatcaactagg

SEQ ID NO: 155483 - DNA, 22 bp, Artificial Sequence
  Synthetic oligonucleotide; TTT chr11 5154855 5154876 5154860 5154855 -
tggctatcaactaggaaatccc

SEQ ID NO: 155484 - DNA, 22 bp, Artificial Sequence
  Synthetic oligonucleotide; TTT chr11 5154854 5154875 5154859 5154854 -
ggctatcaactaggaaatccct

SEQ ID NO: 155485 - DNA, 22 bp, Artificial Sequence
  Synthetic oligonucleotide; TTG chr11 5154853 5154874 5154858 5154853 -
gctatcaactaggaaatccctc

SEQ ID NO: 155486 - DNA, 22 bp, Artificial Sequence
  Synthetic oligonucleotide; CTA chr11 5154849 5154870 5154854 5154849 -
tcaactaggaaatccctcattt

SEQ ID NO: 155487 - DNA, 22 bp, Artificial Sequence
  Synthetic oligonucleotide; CTA chr11 5154842 5154863 5154847 5154842 -
ggaaatccctcatttcatgctc

SEQ ID NO: 155488 - DNA, 22 bp, Artificial Sequence
  Synthetic oligonucleotide; CTC chr11 5154831 5154852 5154836 5154831 -
atttcatgctcataactcctcc

SEQ ID NO: 155489 - DNA, 22 bp, Artificial Sequence
  Synthetic oligonucleotide; TTT chr11 5154827 5154848 5154832 5154827 -
catgctcataactcctcctact

SEQ ID NO: 155490 - DNA, 22 bp, Artificial Sequence
  Synthetic oligonucleotide; TTC chr11 5154826 5154847 5154831 5154826 -
atgctcataactcctcctactt

SEQ ID NO: 155491 - DNA, 22 bp, Artificial Sequence
  Synthetic oligonucleotide; CTC chr11 5154820 5154841 5154825 5154820 -
ataactcctcctacttctccac

SEQ ID NO: 155492 - DNA, 22 bp, Artificial Sequence
  Synthetic oligonucleotide; CTC chr11 5154813 5154834 5154818 5154813 -
ctcctacttctccacacattca

SEQ ID NO: 155493 - DNA, 22 bp, Artificial Sequence
  Synthetic oligonucleotide; CTC chr11 5154810 5154831 5154815 5154810 -
ctacttctccacacattcataa

SEQ ID NO: 155494 - DNA, 22 bp, Artificial Sequence
  Synthetic oligonucleotide; CTA chr11 5154807 5154828 5154812 5154807 -
cttctccacacattcataaagg

SEQ ID NO: 155495 - DNA, 22 bp, Artificial Sequence
  Synthetic oligonucleotide; CTT chr11 5154804 5154825 5154809 5154804 -
ctccacacattcataaaggaat

SEQ ID NO: 155496 - DNA, 22 bp, Artificial Sequence
  Synthetic oligonucleotide; TTC chr11 5154803 5154824 5154808 5154803 -
tccacacattcataaaggaata

SEQ ID NO: 155497 - DNA, 22 bp, Artificial Sequence
  Synthetic oligonucleotide; CTC chr11 5154801 5154822 5154806 5154801 -
cacacattcataaaggaatatt

SEQ ID NO: 155498 - DNA, 22 bp, Artificial Sequence
  Synthetic oligonucleotide; TTC chr11 5154792 5154813 5154797 5154792 -
ataaaggaatattaaattggtg

SEQ ID NO: 155499 - DNA, 22 bp, Artificial Sequence
  Synthetic oligonucleotide; TTA chr11 5154778 5154799 5154783 5154778 -
aattggtggatagccacttttt

SEQ ID NO: 155500 - DNA, 22 bp, Artificial Sequence
  Synthetic oligonucleotide; TTG chr11 5154773 5154794 5154778 5154773 -
gtggatagccacttttttctcc

SEQ ID NO: 155501 - DNA, 22 bp, Artificial Sequence
  Synthetic oligonucleotide; CTT chr11 5154759 5154780 5154764 5154759 -
ttttctccaatttgagctcaat

SEQ ID NO: 155502 - DNA, 22 bp, Artificial Sequence
  Synthetic oligonucleotide; TTT chr11 5154758 5154779 5154763 5154758 -
tttctccaatttgagctcaata

SEQ ID NO: 155503 - DNA, 22 bp, Artificial Sequence
  Synthetic oligonucleotide; TTT chr11 5154757 5154778 5154762 5154757 -
ttctccaatttgagctcaataa

SEQ ID NO: 155504 - DNA, 22 bp, Artificial Sequence
  Synthetic oligonucleotide; TTT chr11 5154756 5154777 5154761 5154756 -
tctccaatttgagctcaataaa

SEQ ID NO: 155505 - DNA, 22 bp, Artificial Sequence
  Synthetic oligonucleotide; TTT chr11 5154755 5154776 5154760 5154755 -
ctccaatttgagctcaataaat

SEQ ID NO: 155506 - DNA, 22 bp, Artificial Sequence
  Synthetic oligonucleotide; TTC chr11 5154754 5154775 5154759 5154754 -
tccaatttgagctcaataaatt

SEQ ID NO: 155507 - DNA, 22 bp, Artificial Sequence
  Synthetic oligonucleotide; CTC chr11 5154752 5154773 5154757 5154752 -
caatttgagctcaataaattca

SEQ ID NO: 155508 - DNA, 22 bp, Artificial Sequence
  Synthetic oligonucleotide; TTT chr11 5154746 5154767 5154751 5154746 -
gagctcaataaattcatcccgt

SEQ ID NO: 155509 - DNA, 22 bp, Artificial Sequence
  Synthetic oligonucleotide; TTG chr11 5154745 5154766 5154750 5154745 -
agctcaataaattcatcccgtg

SEQ ID NO: 155510 - DNA, 22 bp, Artificial Sequence
  Synthetic oligonucleotide; CTC chr11 5154740 5154761 5154745 5154740 -
aataaattcatcccgtgtttca

SEQ ID NO: 155511 - DNA, 22 bp, Artificial Sequence
  Synthetic oligonucleotide; TTC chr11 5154731 5154752 5154736 5154731 -
atcccgtgtttcagaatgctac

SEQ ID NO: 155512 - DNA, 22 bp, Artificial Sequence
  Synthetic oligonucleotide; TTT chr11 5154720 5154741 5154725 5154720 -
cagaatgctacagacctcacta

SEQ ID NO: 155513 - DNA, 22 bp, Artificial Sequence
  Synthetic oligonucleotide; TTC chr11 5154719 5154740 5154724 5154719 -
agaatgctacagacctcactat

SEQ ID NO: 155514 - DNA, 22 bp, Artificial Sequence
  Synthetic oligonucleotide; CTA chr11 5154710 5154731 5154715 5154710 -
cagacctcactatgagttttac

SEQ ID NO: 155515 - DNA, 22 bp, Artificial Sequence
  Synthetic oligonucleotide; CTC chr11 5154702 5154723 5154707 5154702 -
actatgagttttactgggggat

SEQ ID NO: 155516 - DNA, 22 bp, Artificial Sequence
  Synthetic oligonucleotide; CTA chr11 5154698 5154719 5154703 5154698 -
tgagttttactgggggatgagc

SEQ ID NO: 155517 - DNA, 22 bp, Artificial Sequence
  Synthetic oligonucleotide; TTT chr11 5154691 5154712 5154696 5154691 -
tactgggggatgagcacacaaa

SEQ ID NO: 155518 - DNA, 22 bp, Artificial Sequence
  Synthetic oligonucleotide; TTT chr11 5154690 5154711 5154695 5154690 -
actgggggatgagcacacaaag

SEQ ID NO: 155519 - DNA, 22 bp, Artificial Sequence
  Synthetic oligonucleotide; TTA chr11 5154689 5154710 5154694 5154689 -
ctgggggatgagcacacaaaga

SEQ ID NO: 155520 - DNA, 22 bp, Artificial Sequence
  Synthetic oligonucleotide; CTG chr11 5154686 5154707 5154691 5154686 -
ggggatgagcacacaaagatgg

SEQ ID NO: 155521 - DNA, 22 bp, Artificial Sequence
  Synthetic oligonucleotide; CTG chr11 5154660 5154681 5154665 5154660 -
agacagacttccagaagaagaa

SEQ ID NO: 155522 - DNA, 22 bp, Artificial Sequence
  Synthetic oligonucleotide; CTT chr11 5154650 5154671 5154655 5154650 -
ccagaagaagaagaagatgtcc

SEQ ID NO: 155523 - DNA, 22 bp, Artificial Sequence
  Synthetic oligonucleotide; TTC chr11 5154649 5154670 5154654 5154649 -
cagaagaagaagaagatgtccg

SEQ ID NO: 155524 - DNA, 22 bp, Artificial Sequence
  Synthetic oligonucleotide; TTA chr11 5154622 5154643 5154627 5154622 -
gagataaatgaaaagtgtaaaa

SEQ ID NO: 155525 - DNA, 22 bp, Artificial Sequence
  Synthetic oligonucleotide; CTG chr11 5154591 5154612 5154596 5154591 -
caaaatgtccacagtatattat

SEQ ID NO: 155526 - DNA, 22 bp, Artificial Sequence
  Synthetic oligonucleotide; TTA chr11 5154570 5154591 5154575 5154570 -
tattggcacatatcctggcacc

SEQ ID NO: 155527 - DNA, 22 bp, Artificial Sequence
  Synthetic oligonucleotide; TTG chr11 5154565 5154586 5154570 5154565 -
gcacatatcctggcaccaaaca

SEQ ID NO: 155528 - DNA, 22 bp, Artificial Sequence
  Synthetic oligonucleotide; CTG chr11 5154553 5154574 5154558 5154553 -
gcaccaaacagagtaaaattta

SEQ ID NO: 155529 - DNA, 22 bp, Artificial Sequence
  Synthetic oligonucleotide; TTT chr11 5154532 5154553 5154537 5154532 -
atgacattagctggatgctgtt

SEQ ID NO: 155530 - DNA, 22 bp, Artificial Sequence
  Synthetic oligonucleotide; TTA chr11 5154531 5154552 5154536 5154531 -
tgacattagctggatgctgtta

SEQ ID NO: 155531 - DNA, 22 bp, Artificial Sequence
  Synthetic oligonucleotide; TTA chr11 5154523 5154544 5154528 5154523 -
gctggatgctgttacacagagt

SEQ ID NO: 155532 - DNA, 22 bp, Artificial Sequence
  Synthetic oligonucleotide; CTG chr11 5154519 5154540 5154524 5154519 -
gatgctgttacacagagtgcag

SEQ ID NO: 155533 - DNA, 22 bp, Artificial Sequence
  Synthetic oligonucleotide; CTG chr11 5154512 5154533 5154517 5154512 -
ttacacagagtgcagacagaaa

SEQ ID NO: 155534 - DNA, 22 bp, Artificial Sequence
  Synthetic oligonucleotide; TTA chr11 5154509 5154530 5154514 5154509 -
cacagagtgcagacagaaagta

SEQ ID NO: 155535 - DNA, 22 bp, Artificial Sequence
  Synthetic oligonucleotide; CTT chr11 5154463 5154484 5154468 5154463 -
aagggaatgaagctggaatcct

SEQ ID NO: 155536 - DNA, 22 bp, Artificial Sequence
  Synthetic oligonucleotide; TTA chr11 5154462 5154483 5154467 5154462 -
agggaatgaagctggaatcctt

SEQ ID NO: 155537 - DNA, 22 bp, Artificial Sequence
  Synthetic oligonucleotide; CTG chr11 5154448 5154469 5154453 5154448 -
gaatccttggagaagaaaaatt

SEQ ID NO: 155538 - DNA, 22 bp, Artificial Sequence
  Synthetic oligonucleotide; CTT chr11 5154440 5154461 5154445 5154440 -
ggagaagaaaaattggtgagtg

SEQ ID NO: 155539 - DNA, 22 bp, Artificial Sequence
  Synthetic oligonucleotide; TTG chr11 5154439 5154460 5154444 5154439 -
gagaagaaaaattggtgagtga

SEQ ID NO: 155540 - DNA, 22 bp, Artificial Sequence
  Synthetic oligonucleotide; TTG chr11 5154425 5154446 5154430 5154425 -
gtgagtgatgaatgaaagtgtt

SEQ ID NO: 155541 - DNA, 22 bp, Artificial Sequence
  Synthetic oligonucleotide; TTA chr11 5154402 5154423 5154407 5154402 -
tgaaaaatggacaatattcttc

SEQ ID NO: 155542 - DNA, 22 bp, Artificial Sequence
  Synthetic oligonucleotide; TTC chr11 5154383 5154404 5154388 5154383 -
ttcaggtatctggtaagagcaa

SEQ ID NO: 155543 - DNA, 22 bp, Artificial Sequence
  Synthetic oligonucleotide; CTT chr11 5154381 5154402 5154386 5154381 -
caggtatctggtaagagcaaaa

SEQ ID NO: 155544 - DNA, 22 bp, Artificial Sequence
  Synthetic oligonucleotide; TTC chr11 5154380 5154401 5154385 5154380 -
aggtatctggtaagagcaaaac

SEQ ID NO: 155545 - DNA, 22 bp, Artificial Sequence
  Synthetic oligonucleotide; CTG chr11 5154371 5154392 5154376 5154371 -
gtaagagcaaaaccagctctca

SEQ ID NO: 155546 - DNA, 22 bp, Artificial Sequence
  Synthetic oligonucleotide; CTC chr11 5154352 5154373 5154357 5154352 -
tcaataataattgaggagtaag

SEQ ID NO: 155547 - DNA, 22 bp, Artificial Sequence
  Synthetic oligonucleotide; CTC chr11 5154350 5154371 5154355 5154350 -
aataataattgaggagtaagtc

SEQ ID NO: 155548 - DNA, 22 bp, Artificial Sequence
  Synthetic oligonucleotide; TTG chr11 5154339 5154360 5154344 5154339 -
aggagtaagtctcacgattcca

SEQ ID NO: 155549 - DNA, 22 bp, Artificial Sequence
  Synthetic oligonucleotide; CTC chr11 5154326 5154347 5154331 5154326 -
acgattccaagtttcctctcca

SEQ ID NO: 155550 - DNA, 22 bp, Artificial Sequence
  Synthetic oligonucleotide; TTC chr11 5154319 5154340 5154324 5154319 -
caagtttcctctccataattta

SEQ ID NO: 155551 - DNA, 22 bp, Artificial Sequence
  Synthetic oligonucleotide; TTT chr11 5154312 5154333 5154317 5154312 -
cctctccataatttaattacca

SEQ ID NO: 155552 - DNA, 22 bp, Artificial Sequence
  Synthetic oligonucleotide; TTC chr11 5154311 5154332 5154316 5154311 -
ctctccataatttaattaccag

SEQ ID NO: 155553 - DNA, 22 bp, Artificial Sequence
  Synthetic oligonucleotide; CTC chr11 5154308 5154329 5154313 5154308 -
tccataatttaattaccagctt

SEQ ID NO: 155554 - DNA, 22 bp, Artificial Sequence
  Synthetic oligonucleotide; CTC chr11 5154306 5154327 5154311 5154306 -
cataatttaattaccagcttct

SEQ ID NO: 155555 - DNA, 22 bp, Artificial Sequence
  Synthetic oligonucleotide; TTT chr11 5154298 5154319 5154303 5154298 -
aattaccagcttctccaataac

SEQ ID NO: 155556 - DNA, 22 bp, Artificial Sequence
  Synthetic oligonucleotide; TTA chr11 5154297 5154318 5154302 5154297 -
attaccagcttctccaataaca

SEQ ID NO: 155557 - DNA, 22 bp, Artificial Sequence
  Synthetic oligonucleotide; TTA chr11 5154293 5154314 5154298 5154293 -
ccagcttctccaataacaatca

SEQ ID NO: 155558 - DNA, 22 bp, Artificial Sequence
  Synthetic oligonucleotide; CTT chr11 5154286 5154307 5154291 5154286 -
ctccaataacaatcactctatc

SEQ ID NO: 155559 - DNA, 22 bp, Artificial Sequence
  Synthetic oligonucleotide; TTC chr11 5154285 5154306 5154290 5154285 -
tccaataacaatcactctatcc

SEQ ID NO: 155560 - DNA, 22 bp, Artificial Sequence
  Synthetic oligonucleotide; CTC chr11 5154283 5154304 5154288 5154283 -
caataacaatcactctatccaa

SEQ ID NO: 155561 - DNA, 22 bp, Artificial Sequence
  Synthetic oligonucleotide; CTC chr11 5154268 5154289 5154273 5154268 -
tatccaactaaccaggaactta

SEQ ID NO: 155562 - DNA, 22 bp, Artificial Sequence
  Synthetic oligonucleotide; CTA chr11 5154266 5154287 5154271 5154266 -
tccaactaaccaggaacttaca

SEQ ID NO: 155563 - DNA, 22 bp, Artificial Sequence
  Synthetic oligonucleotide; CTA chr11 5154258 5154279 5154263 5154258 -
accaggaacttacatacaccac

SEQ ID NO: 155564 - DNA, 22 bp, Artificial Sequence
  Synthetic oligonucleotide; CTT chr11 5154247 5154268 5154252 5154247 -
acatacaccaccacctgcaacc

SEQ ID NO: 155565 - DNA, 22 bp, Artificial Sequence
  Synthetic oligonucleotide; TTA chr11 5154246 5154267 5154251 5154246 -
catacaccaccacctgcaaccc

SEQ ID NO: 155566 - DNA, 22 bp, Artificial Sequence
  Synthetic oligonucleotide; CTG chr11 5154230 5154251 5154235 5154230 -
caaccctgctatctgtgcctgt

SEQ ID NO: 155567 - DNA, 22 bp, Artificial Sequence
  Synthetic oligonucleotide; CTG chr11 5154222 5154243 5154227 5154222 -
ctatctgtgcctgtcaggtagt

SEQ ID NO: 155568 - DNA, 22 bp, Artificial Sequence
  Synthetic oligonucleotide; CTA chr11 5154219 5154240 5154224 5154219 -
tctgtgcctgtcaggtagtact

SEQ ID NO: 155569 - DNA, 22 bp, Artificial Sequence
  Synthetic oligonucleotide; CTG chr11 5154215 5154236 5154220 5154215 -
tgcctgtcaggtagtactcaca

SEQ ID NO: 155570 - DNA, 22 bp, Artificial Sequence
  Synthetic oligonucleotide; CTG chr11 5154209 5154230 5154214 5154209 -
tcaggtagtactcacatgtcag

SEQ ID NO: 155571 - DNA, 22 bp, Artificial Sequence
  Synthetic oligonucleotide; CTC chr11 5154196 5154217 5154201 5154196 -
acatgtcagctctttggtcttg

SEQ ID NO: 155572 - DNA, 22 bp, Artificial Sequence
  Synthetic oligonucleotide; CTC chr11 5154184 5154205 5154189 5154184 -
tttggtcttgaataagtcagac

SEQ ID NO: 155573 - DNA, 22 bp, Artificial Sequence
  Synthetic oligonucleotide; CTT chr11 5154182 5154203 5154187 5154182 -
tggtcttgaataagtcagacat

SEQ ID NO: 155574 - DNA, 22 bp, Artificial Sequence
  Synthetic oligonucleotide; TTT chr11 5154181 5154202 5154186 5154181 -
ggtcttgaataagtcagacatt

SEQ ID NO: 155575 - DNA, 22 bp, Artificial Sequence
  Synthetic oligonucleotide; TTG chr11 5154180 5154201 5154185 5154180 -
gtcttgaataagtcagacattg

SEQ ID NO: 155576 - DNA, 22 bp, Artificial Sequence
  Synthetic oligonucleotide; CTT chr11 5154175 5154196 5154180 5154175 -
gaataagtcagacattgtgatt

SEQ ID NO: 155577 - DNA, 22 bp, Artificial Sequence
  Synthetic oligonucleotide; TTG chr11 5154174 5154195 5154179 5154174 -
aataagtcagacattgtgattg

SEQ ID NO: 155578 - DNA, 22 bp, Artificial Sequence
  Synthetic oligonucleotide; TTG chr11 5154158 5154179 5154163 5154158 -
tgattgccattaaaggattctt

SEQ ID NO: 155579 - DNA, 22 bp, Artificial Sequence
  Synthetic oligonucleotide; TTG chr11 5154152 5154173 5154157 5154152 -
ccattaaaggattcttattcta

SEQ ID NO: 155580 - DNA, 22 bp, Artificial Sequence
  Synthetic oligonucleotide; TTA chr11 5154146 5154167 5154151 5154146 -
aaggattcttattctaattgtg

SEQ ID NO: 155581 - DNA, 22 bp, Artificial Sequence
  Synthetic oligonucleotide; TTC chr11 5154138 5154159 5154143 5154138 -
ttattctaattgtgattatctt

SEQ ID NO: 155582 - DNA, 22 bp, Artificial Sequence
  Synthetic oligonucleotide; CTT chr11 5154136 5154157 5154141 5154136 -
attctaattgtgattatctttg

SEQ ID NO: 155583 - DNA, 22 bp, Artificial Sequence
  Synthetic oligonucleotide; TTA chr11 5154135 5154156 5154140 5154135 -
ttctaattgtgattatctttgg

SEQ ID NO: 155584 - DNA, 22 bp, Artificial Sequence
  Synthetic oligonucleotide; TTC chr11 5154132 5154153 5154137 5154132 -
taattgtgattatctttggaga

SEQ ID NO: 155585 - DNA, 22 bp, Artificial Sequence
  Synthetic oligonucleotide; CTA chr11 5154130 5154151 5154135 5154130 -
attgtgattatctttggagaag

SEQ ID NO: 155586 - DNA, 22 bp, Artificial Sequence
  Synthetic oligonucleotide; TTG chr11 5154126 5154147 5154131 5154126 -
tgattatctttggagaagaaaa

SEQ ID NO: 155587 - DNA, 22 bp, Artificial Sequence
  Synthetic oligonucleotide; TTA chr11 5154120 5154141 5154125 5154120 -
tctttggagaagaaaaaatttg

SEQ ID NO: 155588 - DNA, 22 bp, Artificial Sequence
  Synthetic oligonucleotide; CTT chr11 5154116 5154137 5154121 5154116 -
tggagaagaaaaaatttgcccc

SEQ ID NO: 155589 - DNA, 22 bp, Artificial Sequence
  Synthetic oligonucleotide; TTT chr11 5154115 5154136 5154120 5154115 -
ggagaagaaaaaatttgcccct

SEQ ID NO: 155590 - DNA, 22 bp, Artificial Sequence
  Synthetic oligonucleotide; TTG chr11 5154114 5154135 5154119 5154114 -
gagaagaaaaaatttgccccta

SEQ ID NO: 155591 - DNA, 22 bp, Artificial Sequence
  Synthetic oligonucleotide; TTT chr11 5154099 5154120 5154104 5154099 -
gcccctattagaaaaagccagt

SEQ ID NO: 155592 - DNA, 22 bp, Artificial Sequence
  Synthetic oligonucleotide; TTG chr11 5154098 5154119 5154103 5154098 -
cccctattagaaaaagccagtg

SEQ ID NO: 155593 - DNA, 22 bp, Artificial Sequence
  Synthetic oligonucleotide; CTA chr11 5154092 5154113 5154097 5154092 -
ttagaaaaagccagtgacttat

SEQ ID NO: 155594 - DNA, 22 bp, Artificial Sequence
  Synthetic oligonucleotide; TTA chr11 5154089 5154110 5154094 5154089 -
gaaaaagccagtgacttatgga

SEQ ID NO: 155595 - DNA, 22 bp, Artificial Sequence
  Synthetic oligonucleotide; CTT chr11 5154072 5154093 5154077 5154072 -
atggatgggagtgtcataaaac

SEQ ID NO: 155596 - DNA, 22 bp, Artificial Sequence
  Synthetic oligonucleotide; TTA chr11 5154071 5154092 5154076 5154071 -
tggatgggagtgtcataaaact

SEQ ID NO: 155597 - DNA, 22 bp, Artificial Sequence
  Synthetic oligonucleotide; CTA chr11 5154048 5154069 5154053 5154048 -
agcattggggatcaaatctgtg

SEQ ID NO: 155598 - DNA, 22 bp, Artificial Sequence
  Synthetic oligonucleotide; TTG chr11 5154041 5154062 5154046 5154041 -
gggatcaaatctgtggaaatca

SEQ ID NO: 155599 - DNA, 22 bp, Artificial Sequence
  Synthetic oligonucleotide; CTG chr11 5154028 5154049 5154033 5154028 -
tggaaatcaaagtatttaattg

SEQ ID NO: 155600 - DNA, 22 bp, Artificial Sequence
  Synthetic oligonucleotide; TTT chr11 5154011 5154032 5154016 5154011 -
aattgacctactagtttacggt

SEQ ID NO: 155601 - DNA, 22 bp, Artificial Sequence
  Synthetic oligonucleotide; TTA chr11 5154010 5154031 5154015 5154010 -
attgacctactagtttacggta

SEQ ID NO: 155602 - DNA, 22 bp, Artificial Sequence
  Synthetic oligonucleotide; TTG chr11 5154006 5154027 5154011 5154006 -
acctactagtttacggtaaatg

SEQ ID NO: 155603 - DNA, 22 bp, Artificial Sequence
  Synthetic oligonucleotide; CTA chr11 5154001 5154022 5154006 5154001 -
ctagtttacggtaaatgtatgt

SEQ ID NO: 155604 - DNA, 22 bp, Artificial Sequence
  Synthetic oligonucleotide; CTA chr11 5153998 5154019 5154003 5153998 -
gtttacggtaaatgtatgttag

SEQ ID NO: 155605 - DNA, 22 bp, Artificial Sequence
  Synthetic oligonucleotide; TTT chr11 5153994 5154015 5153999 5153994 -
acggtaaatgtatgttagctga

SEQ ID NO: 155606 - DNA, 22 bp, Artificial Sequence
  Synthetic oligonucleotide; TTA chr11 5153993 5154014 5153998 5153993 -
cggtaaatgtatgttagctgat

SEQ ID NO: 155607 - DNA, 22 bp, Artificial Sequence
  Synthetic oligonucleotide; TTA chr11 5153977 5153998 5153982 5153977 -
gctgatacagcctccctgtcat

SEQ ID NO: 155608 - DNA, 22 bp, Artificial Sequence
  Synthetic oligonucleotide; CTG chr11 5153973 5153994 5153978 5153973 -
atacagcctccctgtcatgaaa

SEQ ID NO: 155609 - DNA, 22 bp, Artificial Sequence
  Synthetic oligonucleotide; CTC chr11 5153963 5153984 5153968 5153963 -
cctgtcatgaaatgtcctctgc

SEQ ID NO: 155610 - DNA, 22 bp, Artificial Sequence
  Synthetic oligonucleotide; CTG chr11 5153959 5153980 5153964 5153959 -
tcatgaaatgtcctctgctgat

SEQ ID NO: 155611 - DNA, 22 bp, Artificial Sequence
  Synthetic oligonucleotide; CTC chr11 5153944 5153965 5153949 5153944 -
tgctgatttggttctttcattt

SEQ ID NO: 155612 - DNA, 22 bp, Artificial Sequence
  Synthetic oligonucleotide; CTG chr11 5153942 5153963 5153947 5153942 -
ctgatttggttctttcatttga

SEQ ID NO: 155613 - DNA, 22 bp, Artificial Sequence
  Synthetic oligonucleotide; CTG chr11 5153939 5153960 5153944 5153939 -
atttggttctttcatttgaagt

SEQ ID NO: 155614 - DNA, 22 bp, Artificial Sequence
  Synthetic oligonucleotide; TTT chr11 5153935 5153956 5153940 5153935 -
ggttctttcatttgaagtttag

SEQ ID NO: 155615 - DNA, 22 bp, Artificial Sequence
  Synthetic oligonucleotide; TTG chr11 5153934 5153955 5153939 5153934 -
gttctttcatttgaagtttagc

SEQ ID NO: 155616 - DNA, 22 bp, Artificial Sequence
  Synthetic oligonucleotide; TTC chr11 5153930 5153951 5153935 5153930 -
tttcatttgaagtttagcagca

SEQ ID NO: 155617 - DNA, 22 bp, Artificial Sequence
  Synthetic oligonucleotide; CTT chr11 5153928 5153949 5153933 5153928 -
tcatttgaagtttagcagcagt

SEQ ID NO: 155618 - DNA, 22 bp, Artificial Sequence
  Synthetic oligonucleotide; TTT chr11 5153927 5153948 5153932 5153927 -
catttgaagtttagcagcagtt

SEQ ID NO: 155619 - DNA, 22 bp, Artificial Sequence
  Synthetic oligonucleotide; TTC chr11 5153926 5153947 5153931 5153926 -
atttgaagtttagcagcagttg

SEQ ID NO: 155620 - DNA, 22 bp, Artificial Sequence
  Synthetic oligonucleotide; TTT chr11 5153922 5153943 5153927 5153922 -
gaagtttagcagcagttgaaca

SEQ ID NO: 155621 - DNA, 22 bp, Artificial Sequence
  Synthetic oligonucleotide; TTG chr11 5153921 5153942 5153926 5153921 -
aagtttagcagcagttgaacat

SEQ ID NO: 155622 - DNA, 22 bp, Artificial Sequence
  Synthetic oligonucleotide; TTT chr11 5153915 5153936 5153920 5153915 -
agcagcagttgaacatttgttg

SEQ ID NO: 155623 - DNA, 22 bp, Artificial Sequence
  Synthetic oligonucleotide; TTA chr11 5153914 5153935 5153919 5153914 -
gcagcagttgaacatttgttgt

SEQ ID NO: 155624 - DNA, 22 bp, Artificial Sequence
  Synthetic oligonucleotide; TTG chr11 5153904 5153925 5153909 5153904 -
aacatttgttgttgaatatttg

SEQ ID NO: 155625 - DNA, 22 bp, Artificial Sequence
  Synthetic oligonucleotide; TTT chr11 5153897 5153918 5153902 5153897 -
gttgttgaatatttgagtaaac

SEQ ID NO: 155626 - DNA, 22 bp, Artificial Sequence
  Synthetic oligonucleotide; TTG chr11 5153896 5153917 5153901 5153896 -
ttgttgaatatttgagtaaact

SEQ ID NO: 155627 - DNA, 22 bp, Artificial Sequence
  Synthetic oligonucleotide; TTG chr11 5153893 5153914 5153898 5153893 -
ttgaatatttgagtaaacttgt

SEQ ID NO: 155628 - DNA, 22 bp, Artificial Sequence
  Synthetic oligonucleotide; TTG chr11 5153890 5153911 5153895 5153890 -
aatatttgagtaaacttgtatc

SEQ ID NO: 155629 - DNA, 22 bp, Artificial Sequence
  Synthetic oligonucleotide; TTT chr11 5153883 5153904 5153888 5153883 -
gagtaaacttgtatccatttcc

SEQ ID NO: 155630 - DNA, 22 bp, Artificial Sequence
  Synthetic oligonucleotide; TTG chr11 5153882 5153903 5153887 5153882 -
agtaaacttgtatccatttcct

SEQ ID NO: 155631 - DNA, 22 bp, Artificial Sequence
  Synthetic oligonucleotide; CTT chr11 5153873 5153894 5153878 5153873 -
gtatccatttcctcttttctct

SEQ ID NO: 155632 - DNA, 22 bp, Artificial Sequence
  Synthetic oligonucleotide; TTG chr11 5153872 5153893 5153877 5153872 -
tatccatttcctcttttctctt

SEQ ID NO: 155633 - DNA, 22 bp, Artificial Sequence
  Synthetic oligonucleotide; TTT chr11 5153863 5153884 5153868 5153863 -
cctcttttctctttcttccttg

SEQ ID NO: 155634 - DNA, 22 bp, Artificial Sequence
  Synthetic oligonucleotide; TTC chr11 5153862 5153883 5153867 5153862 -
ctcttttctctttcttccttgt

SEQ ID NO: 155635 - DNA, 22 bp, Artificial Sequence
  Synthetic oligonucleotide; CTC chr11 5153859 5153880 5153864 5153859 -
ttttctctttcttccttgttac

SEQ ID NO: 155636 - DNA, 22 bp, Artificial Sequence
  Synthetic oligonucleotide; CTT chr11 5153857 5153878 5153862 5153857 -
ttctctttcttccttgttactt

SEQ ID NO: 155637 - DNA, 22 bp, Artificial Sequence
  Synthetic oligonucleotide; TTT chr11 5153856 5153877 5153861 5153856 -
tctctttcttccttgttactta

SEQ ID NO: 155638 - DNA, 22 bp, Artificial Sequence
  Synthetic oligonucleotide; TTT chr11 5153855 5153876 5153860 5153855 -
ctctttcttccttgttacttac

SEQ ID NO: 155639 - DNA, 22 bp, Artificial Sequence
  Synthetic oligonucleotide; TTC chr11 5153854 5153875 5153859 5153854 -
tctttcttccttgttacttacc

SEQ ID NO: 155640 - DNA, 22 bp, Artificial Sequence
  Synthetic oligonucleotide; CTC chr11 5153852 5153873 5153857 5153852 -
tttcttccttgttacttacctt

SEQ ID NO: 155641 - DNA, 22 bp, Artificial Sequence
  Synthetic oligonucleotide; CTT chr11 5153850 5153871 5153855 5153850 -
tcttccttgttacttaccttcc

SEQ ID NO: 155642 - DNA, 22 bp, Artificial Sequence
  Synthetic oligonucleotide; TTT chr11 5153849 5153870 5153854 5153849 -
cttccttgttacttaccttcct

SEQ ID NO: 155643 - DNA, 22 bp, Artificial Sequence
  Synthetic oligonucleotide; TTC chr11 5153848 5153869 5153853 5153848 -
ttccttgttacttaccttcctt

SEQ ID NO: 155644 - DNA, 22 bp, Artificial Sequence
  Synthetic oligonucleotide; CTT chr11 5153846 5153867 5153851 5153846 -
ccttgttacttaccttcctttt

SEQ ID NO: 155645 - DNA, 22 bp, Artificial Sequence
  Synthetic oligonucleotide; TTC chr11 5153845 5153866 5153850 5153845 -
cttgttacttaccttccttttc

SEQ ID NO: 155646 - DNA, 22 bp, Artificial Sequence
  Synthetic oligonucleotide; CTT chr11 5153842 5153863 5153847 5153842 -
gttacttaccttccttttcttt

SEQ ID NO: 155647 - DNA, 22 bp, Artificial Sequence
  Synthetic oligonucleotide; TTG chr11 5153841 5153862 5153846 5153841 -
ttacttaccttccttttctttc

SEQ ID NO: 155648 - DNA, 22 bp, Artificial Sequence
  Synthetic oligonucleotide; TTA chr11 5153838 5153859 5153843 5153838 -
cttaccttccttttctttcaaa

SEQ ID NO: 155649 - DNA, 22 bp, Artificial Sequence
  Synthetic oligonucleotide; CTT chr11 5153835 5153856 5153840 5153835 -
accttccttttctttcaaaaaa

SEQ ID NO: 155650 - DNA, 22 bp, Artificial Sequence
  Synthetic oligonucleotide; TTA chr11 5153834 5153855 5153839 5153834 -
ccttccttttctttcaaaaaaa

SEQ ID NO: 155651 - DNA, 22 bp, Artificial Sequence
  Synthetic oligonucleotide; CTT chr11 5153830 5153851 5153835 5153830 -
ccttttctttcaaaaaaaaaaa

SEQ ID NO: 155652 - DNA, 22 bp, Artificial Sequence
  Synthetic oligonucleotide; TTC chr11 5153829 5153850 5153834 5153829 -
cttttctttcaaaaaaaaaaaa

SEQ ID NO: 155653 - DNA, 22 bp, Artificial Sequence
  Synthetic oligonucleotide; CTT chr11 5153826 5153847 5153831 5153826 -
ttctttcaaaaaaaaaaaaaaa

SEQ ID NO: 155654 - DNA, 22 bp, Artificial Sequence
  Synthetic oligonucleotide; TTT chr11 5153825 5153846 5153830 5153825 -
tctttcaaaaaaaaaaaaaaaa

SEQ ID NO: 155655 - DNA, 22 bp, Artificial Sequence
  Synthetic oligonucleotide; TTT chr11 5153824 5153845 5153829 5153824 -
ctttcaaaaaaaaaaaaaaaaa

SEQ ID NO: 155656 - DNA, 22 bp, Artificial Sequence
  Synthetic oligonucleotide; TTC chr11 5153823 5153844 5153828 5153823 -
tttcaaaaaaaaaaaaaaaaaa

SEQ ID NO: 155657 - DNA, 22 bp, Artificial Sequence
  Synthetic oligonucleotide; CTT chr11 5153821 5153842 5153826 5153821 -
tcaaaaaaaaaaaaaaaaaaaa

SEQ ID NO: 155658 - DNA, 22 bp, Artificial Sequence
  Synthetic oligonucleotide; TTT chr11 5153820 5153841 5153825 5153820 -
caaaaaaaaaaaaaaaaaaaaa

SEQ ID NO: 155659 - DNA, 22 bp, Artificial Sequence
  Synthetic oligonucleotide; TTC chr11 5153819 5153840 5153824 5153819 -
aaaaaaaaaaaaaaaaaaaaag

SEQ ID NO: 155660 - DNA, 22 bp, Artificial Sequence
  Synthetic oligonucleotide; CTG chr11 5153794 5153815 5153799 5153794 -
ctttttctttcaaagaacagct

SEQ ID NO: 155661 - DNA, 22 bp, Artificial Sequence
  Synthetic oligonucleotide; CTT chr11 5153791 5153812 5153796 5153791 -
tttctttcaaagaacagctact

SEQ ID NO: 155662 - DNA, 22 bp, Artificial Sequence
  Synthetic oligonucleotide; TTT chr11 5153790 5153811 5153795 5153790 -
ttctttcaaagaacagctactt

SEQ ID NO: 155663 - DNA, 22 bp, Artificial Sequence
  Synthetic oligonucleotide; TTT chr11 5153789 5153810 5153794 5153789 -
tctttcaaagaacagctacttc

SEQ ID NO: 155664 - DNA, 22 bp, Artificial Sequence
  Synthetic oligonucleotide; TTT chr11 5153788 5153809 5153793 5153788 -
ctttcaaagaacagctacttcc

SEQ ID NO: 155665 - DNA, 22 bp, Artificial Sequence
  Synthetic oligonucleotide; TTC chr11 5153787 5153808 5153792 5153787 -
tttcaaagaacagctacttcct

SEQ ID NO: 155666 - DNA, 22 bp, Artificial Sequence
  Synthetic oligonucleotide; CTT chr11 5153785 5153806 5153790 5153785 -
tcaaagaacagctacttcctga

SEQ ID NO: 155667 - DNA, 22 bp, Artificial Sequence
  Synthetic oligonucleotide; TTT chr11 5153784 5153805 5153789 5153784 -
caaagaacagctacttcctgaa

SEQ ID NO: 155668 - DNA, 22 bp, Artificial Sequence
  Synthetic oligonucleotide; TTC chr11 5153783 5153804 5153788 5153783 -
aaagaacagctacttcctgaat

SEQ ID NO: 155669 - DNA, 22 bp, Artificial Sequence
  Synthetic oligonucleotide; CTA chr11 5153771 5153792 5153776 5153771 -
cttcctgaatttccagcatatt

SEQ ID NO: 155670 - DNA, 22 bp, Artificial Sequence
  Synthetic oligonucleotide; CTT chr11 5153768 5153789 5153773 5153768 -
cctgaatttccagcatattggt

SEQ ID NO: 155671 - DNA, 22 bp, Artificial Sequence
  Synthetic oligonucleotide; TTC chr11 5153767 5153788 5153772 5153767 -
ctgaatttccagcatattggtg

SEQ ID NO: 155672 - DNA, 22 bp, Artificial Sequence
  Synthetic oligonucleotide; CTG chr11 5153764 5153785 5153769 5153764 -
aatttccagcatattggtgaca

SEQ ID NO: 155673 - DNA, 22 bp, Artificial Sequence
  Synthetic oligonucleotide; TTT chr11 5153759 5153780 5153764 5153759 -
ccagcatattggtgacatgaag

SEQ ID NO: 155674 - DNA, 22 bp, Artificial Sequence
  Synthetic oligonucleotide; TTC chr11 5153758 5153779 5153763 5153758 -
cagcatattggtgacatgaagc

SEQ ID NO: 155675 - DNA, 22 bp, Artificial Sequence
  Synthetic oligonucleotide; TTG chr11 5153748 5153769 5153753 5153748 -
gtgacatgaagcatacggttag

SEQ ID NO: 155676 - DNA, 22 bp, Artificial Sequence
  Synthetic oligonucleotide; TTA chr11 5153727 5153748 5153732 5153727 -
gctgattcatgagcttactgag

SEQ ID NO: 155677 - DNA, 22 bp, Artificial Sequence
  Synthetic oligonucleotide; CTG chr11 5153723 5153744 5153728 5153723 -
attcatgagcttactgagataa

SEQ ID NO: 155678 - DNA, 22 bp, Artificial Sequence
  Synthetic oligonucleotide; TTC chr11 5153719 5153740 5153724 5153719 -
atgagcttactgagataaaaca

SEQ ID NO: 155679 - DNA, 22 bp, Artificial Sequence
  Synthetic oligonucleotide; CTT chr11 5153711 5153732 5153716 5153711 -
actgagataaaacaactttatt

SEQ ID NO: 155680 - DNA, 22 bp, Artificial Sequence
  Synthetic oligonucleotide; TTA chr11 5153710 5153731 5153715 5153710 -
ctgagataaaacaactttattg

SEQ ID NO: 155681 - DNA, 22 bp, Artificial Sequence
  Synthetic oligonucleotide; CTG chr11 5153707 5153728 5153712 5153707 -
agataaaacaactttattgaag

SEQ ID NO: 155682 - DNA, 22 bp, Artificial Sequence
  Synthetic oligonucleotide; CTT chr11 5153693 5153714 5153698 5153693 -
tattgaagtgtctaggaaagaa

SEQ ID NO: 155683 - DNA, 22 bp, Artificial Sequence
  Synthetic oligonucleotide; TTT chr11 5153692 5153713 5153697 5153692 -
attgaagtgtctaggaaagaat

SEQ ID NO: 155684 - DNA, 22 bp, Artificial Sequence
  Synthetic oligonucleotide; TTA chr11 5153691 5153712 5153696 5153691 -
ttgaagtgtctaggaaagaatg

SEQ ID NO: 155685 - DNA, 22 bp, Artificial Sequence
  Synthetic oligonucleotide; TTG chr11 5153688 5153709 5153693 5153688 -
aagtgtctaggaaagaatgaag

SEQ ID NO: 155686 - DNA, 22 bp, Artificial Sequence
  Synthetic oligonucleotide; CTA chr11 5153679 5153700 5153684 5153679 -
ggaaagaatgaagtaactttac

SEQ ID NO: 155687 - DNA, 22 bp, Artificial Sequence
  Synthetic oligonucleotide; CTT chr11 5153660 5153681 5153665 5153660 -
tacttttcactgtatcacaaac

SEQ ID NO: 155688 - DNA, 22 bp, Artificial Sequence
  Synthetic oligonucleotide; TTT chr11 5153659 5153680 5153664 5153659 -
acttttcactgtatcacaaaca

SEQ ID NO: 155689 - DNA, 22 bp, Artificial Sequence
  Synthetic oligonucleotide; TTA chr11 5153658 5153679 5153663 5153658 -
cttttcactgtatcacaaacat

SEQ ID NO: 155690 - DNA, 22 bp, Artificial Sequence
  Synthetic oligonucleotide; CTT chr11 5153655 5153676 5153660 5153655 -
ttcactgtatcacaaacatttc

SEQ ID NO: 155691 - DNA, 22 bp, Artificial Sequence
  Synthetic oligonucleotide; TTT chr11 5153654 5153675 5153659 5153654 -
tcactgtatcacaaacatttct

SEQ ID NO: 155692 - DNA, 22 bp, Artificial Sequence
  Synthetic oligonucleotide; TTT chr11 5153653 5153674 5153658 5153653 -
cactgtatcacaaacatttctc

SEQ ID NO: 155693 - DNA, 22 bp, Artificial Sequence
  Synthetic oligonucleotide; TTC chr11 5153652 5153673 5153657 5153652 -
actgtatcacaaacatttctct

SEQ ID NO: 155694 - DNA, 22 bp, Artificial Sequence
  Synthetic oligonucleotide; CTG chr11 5153648 5153669 5153653 5153648 -
tatcacaaacatttctctaatg

SEQ ID NO: 155695 - DNA, 22 bp, Artificial Sequence
  Synthetic oligonucleotide; TTT chr11 5153634 5153655 5153639 5153634 -
ctctaatgtatagcttaaaatg

SEQ ID NO: 155696 - DNA, 22 bp, Artificial Sequence
  Synthetic oligonucleotide; TTC chr11 5153633 5153654 5153638 5153633 -
tctaatgtatagcttaaaatgt

SEQ ID NO: 155697 - DNA, 22 bp, Artificial Sequence
  Synthetic oligonucleotide; CTC chr11 5153631 5153652 5153636 5153631 -
taatgtatagcttaaaatgtac

SEQ ID NO: 155698 - DNA, 22 bp, Artificial Sequence
  Synthetic oligonucleotide; CTA chr11 5153629 5153650 5153634 5153629 -
atgtatagcttaaaatgtactg

SEQ ID NO: 155699 - DNA, 22 bp, Artificial Sequence
  Synthetic oligonucleotide; CTT chr11 5153618 5153639 5153623 5153618 -
aaaatgtactgattcaaaatat

SEQ ID NO: 155700 - DNA, 22 bp, Artificial Sequence
  Synthetic oligonucleotide; TTA chr11 5153617 5153638 5153622 5153617 -
aaatgtactgattcaaaatatg

SEQ ID NO: 155701 - DNA, 22 bp, Artificial Sequence
  Synthetic oligonucleotide; CTG chr11 5153607 5153628 5153612 5153607 -
attcaaaatatgtaatttttag

SEQ ID NO: 155702 - DNA, 22 bp, Artificial Sequence
  Synthetic oligonucleotide; TTC chr11 5153603 5153624 5153608 5153603 -
aaaatatgtaatttttagaaaa

SEQ ID NO: 155703 - DNA, 22 bp, Artificial Sequence
  Synthetic oligonucleotide; TTT chr11 5153589 5153610 5153594 5153589 -
ttagaaaataactattttgatc

SEQ ID NO: 155704 - DNA, 22 bp, Artificial Sequence
  Synthetic oligonucleotide; TTT chr11 5153588 5153609 5153593 5153588 -
tagaaaataactattttgatca

SEQ ID NO: 155705 - DNA, 22 bp, Artificial Sequence
  Synthetic oligonucleotide; TTT chr11 5153587 5153608 5153592 5153587 -
agaaaataactattttgatcag

SEQ ID NO: 155706 - DNA, 22 bp, Artificial Sequence
  Synthetic oligonucleotide; TTA chr11 5153586 5153607 5153591 5153586 -
gaaaataactattttgatcaga

SEQ ID NO: 155707 - DNA, 22 bp, Artificial Sequence
  Synthetic oligonucleotide; CTA chr11 5153575 5153596 5153580 5153575 -
ttttgatcagagaacttttata

SEQ ID NO: 155708 - DNA, 22 bp, Artificial Sequence
  Synthetic oligonucleotide; TTT chr11 5153572 5153593 5153577 5153572 -
tgatcagagaacttttatataa

SEQ ID NO: 155709 - DNA, 22 bp, Artificial Sequence
  Synthetic oligonucleotide; TTT chr11 5153571 5153592 5153576 5153571 -
gatcagagaacttttatataaa

SEQ ID NO: 155710 - DNA, 22 bp, Artificial Sequence
  Synthetic oligonucleotide; TTG chr11 5153570 5153591 5153575 5153570 -
atcagagaacttttatataaag

SEQ ID NO: 155711 - DNA, 22 bp, Artificial Sequence
  Synthetic oligonucleotide; CTT chr11 5153558 5153579 5153563 5153558 -
ttatataaagcataagagccca

SEQ ID NO: 155712 - DNA, 22 bp, Artificial Sequence
  Synthetic oligonucleotide; TTT chr11 5153557 5153578 5153562 5153557 -
tatataaagcataagagcccag

SEQ ID NO: 155713 - DNA, 22 bp, Artificial Sequence
  Synthetic oligonucleotide; TTT chr11 5153556 5153577 5153561 5153556 -
atataaagcataagagcccagg

SEQ ID NO: 155714 - DNA, 22 bp, Artificial Sequence
  Synthetic oligonucleotide; TTA chr11 5153555 5153576 5153560 5153555 -
tataaagcataagagcccaggt

SEQ ID NO: 155715 - DNA, 22 bp, Artificial Sequence
  Synthetic oligonucleotide; TTT chr11 5153531 5153552 5153536 5153531 -
ttcagaaaattcaatcatcagt

SEQ ID NO: 155716 - DNA, 22 bp, Artificial Sequence
  Synthetic oligonucleotide; TTT chr11 5153530 5153551 5153535 5153530 -
tcagaaaattcaatcatcagtg

SEQ ID NO: 155717 - DNA, 22 bp, Artificial Sequence
  Synthetic oligonucleotide; TTT chr11 5153529 5153550 5153534 5153529 -
cagaaaattcaatcatcagtga

SEQ ID NO: 155718 - DNA, 22 bp, Artificial Sequence
  Synthetic oligonucleotide; TTC chr11 5153528 5153549 5153533 5153528 -
agaaaattcaatcatcagtgaa

SEQ ID NO: 155719 - DNA, 22 bp, Artificial Sequence
  Synthetic oligonucleotide; TTC chr11 5153519 5153540 5153524 5153519 -
aatcatcagtgaaattgaaaag

SEQ ID NO: 155720 - DNA, 22 bp, Artificial Sequence
  Synthetic oligonucleotide; TTG chr11 5153502 5153523 5153507 5153502 -
aaaagtgactaaattttctttg

SEQ ID NO: 155721 - DNA, 22 bp, Artificial Sequence
  Synthetic oligonucleotide; CTA chr11 5153491 5153512 5153496 5153491 -
aattttctttggttattcatag

SEQ ID NO: 155722 - DNA, 22 bp, Artificial Sequence
  Synthetic oligonucleotide; TTT chr11 5153486 5153507 5153491 5153486 -
tctttggttattcatagtgctt

SEQ ID NO: 155723 - DNA, 22 bp, Artificial Sequence
  Synthetic oligonucleotide; TTT chr11 5153485 5153506 5153490 5153485 -
ctttggttattcatagtgcttt

SEQ ID NO: 155724 - DNA, 22 bp, Artificial Sequence
  Synthetic oligonucleotide; TTC chr11 5153484 5153505 5153489 5153484 -
tttggttattcatagtgctttc

SEQ ID NO: 155725 - DNA, 22 bp, Artificial Sequence
  Synthetic oligonucleotide; CTT chr11 5153482 5153503 5153487 5153482 -
tggttattcatagtgctttcct

SEQ ID NO: 155726 - DNA, 22 bp, Artificial Sequence
  Synthetic oligonucleotide; TTT chr11 5153481 5153502 5153486 5153481 -
ggttattcatagtgctttcctc

SEQ ID NO: 155727 - DNA, 22 bp, Artificial Sequence
  Synthetic oligonucleotide; TTG chr11 5153480 5153501 5153485 5153480 -
gttattcatagtgctttcctca

SEQ ID NO: 155728 - DNA, 22 bp, Artificial Sequence
  Synthetic oligonucleotide; TTA chr11 5153476 5153497 5153481 5153476 -
ttcatagtgctttcctcaattt

SEQ ID NO: 155729 - DNA, 22 bp, Artificial Sequence
  Synthetic oligonucleotide; TTC chr11 5153473 5153494 5153478 5153473 -
atagtgctttcctcaattttag

SEQ ID NO: 155730 - DNA, 22 bp, Artificial Sequence
  Synthetic oligonucleotide; CTT chr11 5153464 5153485 5153469 5153464 -
tcctcaattttagtctccccaa

SEQ ID NO: 155731 - DNA, 22 bp, Artificial Sequence
  Synthetic oligonucleotide; TTT chr11 5153463 5153484 5153468 5153463 -
cctcaattttagtctccccaag

SEQ ID NO: 155732 - DNA, 22 bp, Artificial Sequence
  Synthetic oligonucleotide; TTC chr11 5153462 5153483 5153467 5153462 -
ctcaattttagtctccccaagt

SEQ ID NO: 155733 - DNA, 22 bp, Artificial Sequence
  Synthetic oligonucleotide; CTC chr11 5153459 5153480 5153464 5153459 -
aattttagtctccccaagtttg

SEQ ID NO: 155734 - DNA, 22 bp, Artificial Sequence
  Synthetic oligonucleotide; TTT chr11 5153454 5153475 5153459 5153454 -
tagtctccccaagtttgtcctg

SEQ ID NO: 155735 - DNA, 22 bp, Artificial Sequence
  Synthetic oligonucleotide; TTT chr11 5153453 5153474 5153458 5153453 -
agtctccccaagtttgtcctgt

SEQ ID NO: 155736 - DNA, 22 bp, Artificial Sequence
  Synthetic oligonucleotide; TTA chr11 5153452 5153473 5153457 5153452 -
gtctccccaagtttgtcctgtc

SEQ ID NO: 155737 - DNA, 22 bp, Artificial Sequence
  Synthetic oligonucleotide; CTC chr11 5153447 5153468 5153452 5153447 -
cccaagtttgtcctgtcttccc

SEQ ID NO: 155738 - DNA, 22 bp, Artificial Sequence
  Synthetic oligonucleotide; TTT chr11 5153438 5153459 5153443 5153438 -
gtcctgtcttccctgtctagtt

SEQ ID NO: 155739 - DNA, 22 bp, Artificial Sequence
  Synthetic oligonucleotide; TTG chr11 5153437 5153458 5153442 5153437 -
tcctgtcttccctgtctagttc

SEQ ID NO: 155740 - DNA, 22 bp, Artificial Sequence
  Synthetic oligonucleotide; CTG chr11 5153432 5153453 5153437 5153432 -
tcttccctgtctagttctacat

SEQ ID NO: 155741 - DNA, 22 bp, Artificial Sequence
  Synthetic oligonucleotide; CTT chr11 5153428 5153449 5153433 5153428 -
ccctgtctagttctacatttga

SEQ ID NO: 155742 - DNA, 22 bp, Artificial Sequence
  Synthetic oligonucleotide; TTC chr11 5153427 5153448 5153432 5153427 -
cctgtctagttctacatttgac

SEQ ID NO: 155743 - DNA, 22 bp, Artificial Sequence
  Synthetic oligonucleotide; CTG chr11 5153423 5153444 5153428 5153423 -
tctagttctacatttgacttct

SEQ ID NO: 155744 - DNA, 22 bp, Artificial Sequence
  Synthetic oligonucleotide; CTA chr11 5153419 5153440 5153424 5153419 -
gttctacatttgacttcttcta

SEQ ID NO: 155745 - DNA, 22 bp, Artificial Sequence
  Synthetic oligonucleotide; TTC chr11 5153415 5153436 5153420 5153415 -
tacatttgacttcttctaagaa

SEQ ID NO: 155746 - DNA, 22 bp, Artificial Sequence
  Synthetic oligonucleotide; CTA chr11 5153413 5153434 5153418 5153413 -
catttgacttcttctaagaaat

SEQ ID NO: 155747 - DNA, 22 bp, Artificial Sequence
  Synthetic oligonucleotide; TTT chr11 5153408 5153429 5153413 5153408 -
gacttcttctaagaaatctgtc

SEQ ID NO: 155748 - DNA, 22 bp, Artificial Sequence
  Synthetic oligonucleotide; TTG chr11 5153407 5153428 5153412 5153407 -
acttcttctaagaaatctgtcc

SEQ ID NO: 155749 - DNA, 22 bp, Artificial Sequence
  Synthetic oligonucleotide; CTT chr11 5153403 5153424 5153408 5153403 -
cttctaagaaatctgtccttta

SEQ ID NO: 155750 - DNA, 22 bp, Artificial Sequence
  Synthetic oligonucleotide; TTC chr11 5153402 5153423 5153407 5153402 -
ttctaagaaatctgtcctttag

SEQ ID NO: 155751 - DNA, 22 bp, Artificial Sequence
  Synthetic oligonucleotide; CTT chr11 5153400 5153421 5153405 5153400 -
ctaagaaatctgtcctttagct

SEQ ID NO: 155752 - DNA, 22 bp, Artificial Sequence
  Synthetic oligonucleotide; TTC chr11 5153399 5153420 5153404 5153399 -
taagaaatctgtcctttagctt

SEQ ID NO: 155753 - DNA, 22 bp, Artificial Sequence
  Synthetic oligonucleotide; CTA chr11 5153397 5153418 5153402 5153397 -
agaaatctgtcctttagctttt

SEQ ID NO: 155754 - DNA, 22 bp, Artificial Sequence
  Synthetic oligonucleotide; CTG chr11 5153388 5153409 5153393 5153388 -
tcctttagcttttttattttta

SEQ ID NO: 155755 - DNA, 22 bp, Artificial Sequence
  Synthetic oligonucleotide; CTT chr11 5153383 5153404 5153388 5153383 -
tagcttttttatttttactaat

SEQ ID NO: 155756 - DNA, 22 bp, Artificial Sequence
  Synthetic oligonucleotide; TTT chr11 5153382 5153403 5153387 5153382 -
agcttttttatttttactaatt

SEQ ID NO: 155757 - DNA, 22 bp, Artificial Sequence
  Synthetic oligonucleotide; TTA chr11 5153381 5153402 5153386 5153381 -
gcttttttatttttactaattt

SEQ ID NO: 155758 - DNA, 22 bp, Artificial Sequence
  Synthetic oligonucleotide; CTT chr11 5153377 5153398 5153382 5153377 -
ttttatttttactaatttctta

SEQ ID NO: 155759 - DNA, 22 bp, Artificial Sequence
  Synthetic oligonucleotide; TTT chr11 5153376 5153397 5153381 5153376 -
tttatttttactaatttcttat

SEQ ID NO: 155760 - DNA, 22 bp, Artificial Sequence
  Synthetic oligonucleotide; TTT chr11 5153375 5153396 5153380 5153375 -
ttatttttactaatttcttatg

SEQ ID NO: 155761 - DNA, 22 bp, Artificial Sequence
  Synthetic oligonucleotide; TTT chr11 5153374 5153395 5153379 5153374 -
tatttttactaatttcttatgt

SEQ ID NO: 155762 - DNA, 22 bp, Artificial Sequence
  Synthetic oligonucleotide; TTT chr11 5153373 5153394 5153378 5153373 -
atttttactaatttcttatgtc

SEQ ID NO: 155763 - DNA, 22 bp, Artificial Sequence
  Synthetic oligonucleotide; TTA chr11 5153372 5153393 5153377 5153372 -
tttttactaatttcttatgtca

SEQ ID NO: 155764 - DNA, 22 bp, Artificial Sequence
  Synthetic oligonucleotide; TTT chr11 5153369 5153390 5153374 5153369 -
ttactaatttcttatgtcagag

SEQ ID NO: 155765 - DNA, 22 bp, Artificial Sequence
  Synthetic oligonucleotide; TTT chr11 5153368 5153389 5153373 5153368 -
tactaatttcttatgtcagagc

SEQ ID NO: 155766 - DNA, 22 bp, Artificial Sequence
  Synthetic oligonucleotide; TTT chr11 5153367 5153388 5153372 5153367 -
actaatttcttatgtcagagct

SEQ ID NO: 155767 - DNA, 22 bp, Artificial Sequence
  Synthetic oligonucleotide; TTA chr11 5153366 5153387 5153371 5153366 -
ctaatttcttatgtcagagctc

SEQ ID NO: 155768 - DNA, 22 bp, Artificial Sequence
  Synthetic oligonucleotide; CTA chr11 5153363 5153384 5153368 5153363 -
atttcttatgtcagagctcaca

SEQ ID NO: 155769 - DNA, 22 bp, Artificial Sequence
  Synthetic oligonucleotide; TTT chr11 5153359 5153380 5153364 5153359 -
cttatgtcagagctcacaaaat

SEQ ID NO: 155770 - DNA, 22 bp, Artificial Sequence
  Synthetic oligonucleotide; TTC chr11 5153358 5153379 5153363 5153358 -
ttatgtcagagctcacaaaatt

SEQ ID NO: 155771 - DNA, 22 bp, Artificial Sequence
  Synthetic oligonucleotide; CTT chr11 5153356 5153377 5153361 5153356 -
atgtcagagctcacaaaattat

SEQ ID NO: 155772 - DNA, 22 bp, Artificial Sequence
  Synthetic oligonucleotide; TTA chr11 5153355 5153376 5153360 5153355 -
tgtcagagctcacaaaattata

SEQ ID NO: 155773 - DNA, 22 bp, Artificial Sequence
  Synthetic oligonucleotide; CTC chr11 5153344 5153365 5153349 5153344 -
acaaaattatataagcatctca

SEQ ID NO: 155774 - DNA, 22 bp, Artificial Sequence
  Synthetic oligonucleotide; TTA chr11 5153335 5153356 5153340 5153335 -
tataagcatctcacctatattt

SEQ ID NO: 155775 - DNA, 22 bp, Artificial Sequence
  Synthetic oligonucleotide; CTC chr11 5153323 5153344 5153328 5153323 -
acctatatttcattaagaacta

SEQ ID NO: 155776 - DNA, 22 bp, Artificial Sequence
  Synthetic oligonucleotide; CTA chr11 5153318 5153339 5153323 5153318 -
tatttcattaagaactaatgag

SEQ ID NO: 155777 - DNA, 22 bp, Artificial Sequence
  Synthetic oligonucleotide; TTT chr11 5153313 5153334 5153318 5153313 -
cattaagaactaatgagccttt

SEQ ID NO: 155778 - DNA, 22 bp, Artificial Sequence
  Synthetic oligonucleotide; TTC chr11 5153312 5153333 5153317 5153312 -
attaagaactaatgagccttta

SEQ ID NO: 155779 - DNA, 22 bp, Artificial Sequence
  Synthetic oligonucleotide; TTA chr11 5153308 5153329 5153313 5153308 -
agaactaatgagcctttattgg

SEQ ID NO: 155780 - DNA, 22 bp, Artificial Sequence
  Synthetic oligonucleotide; CTA chr11 5153301 5153322 5153306 5153301 -
atgagcctttattgggctatat

SEQ ID NO: 155781 - DNA, 22 bp, Artificial Sequence
  Synthetic oligonucleotide; CTT chr11 5153292 5153313 5153297 5153292 -
tattgggctatattatgctaat

SEQ ID NO: 155782 - DNA, 22 bp, Artificial Sequence
  Synthetic oligonucleotide; TTT chr11 5153291 5153312 5153296 5153291 -
attgggctatattatgctaatt

SEQ ID NO: 155783 - DNA, 22 bp, Artificial Sequence
  Synthetic oligonucleotide; TTA chr11 5153290 5153311 5153295 5153290 -
ttgggctatattatgctaatta

SEQ ID NO: 155784 - DNA, 22 bp, Artificial Sequence
  Synthetic oligonucleotide; TTG chr11 5153287 5153308 5153292 5153287 -
ggctatattatgctaattataa

SEQ ID NO: 155785 - DNA, 22 bp, Artificial Sequence
  Synthetic oligonucleotide; CTA chr11 5153282 5153303 5153287 5153282 -
tattatgctaattataactctg

SEQ ID NO: 155786 - DNA, 22 bp, Artificial Sequence
  Synthetic oligonucleotide; TTA chr11 5153277 5153298 5153282 5153277 -
tgctaattataactctgaacat

SEQ ID NO: 155787 - DNA, 22 bp, Artificial Sequence
  Synthetic oligonucleotide; CTA chr11 5153272 5153293 5153277 5153272 -
attataactctgaacattttaa

SEQ ID NO: 155788 - DNA, 22 bp, Artificial Sequence
  Synthetic oligonucleotide; TTA chr11 5153268 5153289 5153273 5153268 -
taactctgaacattttaaaacc

SEQ ID NO: 155789 - DNA, 22 bp, Artificial Sequence
  Synthetic oligonucleotide; CTC chr11 5153262 5153283 5153267 5153262 -
tgaacattttaaaaccaggaaa

SEQ ID NO: 155790 - DNA, 22 bp, Artificial Sequence
  Synthetic oligonucleotide; CTG chr11 5153260 5153281 5153265 5153260 -
aacattttaaaaccaggaaact

SEQ ID NO: 155791 - DNA, 22 bp, Artificial Sequence
  Synthetic oligonucleotide; TTT chr11 5153253 5153274 5153258 5153253 -
taaaaccaggaaactggactct

SEQ ID NO: 155792 - DNA, 22 bp, Artificial Sequence
  Synthetic oligonucleotide; TTT chr11 5153252 5153273 5153257 5153252 -
aaaaccaggaaactggactcta

SEQ ID NO: 155793 - DNA, 22 bp, Artificial Sequence
  Synthetic oligonucleotide; TTA chr11 5153251 5153272 5153256 5153251 -
aaaccaggaaactggactctat

SEQ ID NO: 155794 - DNA, 22 bp, Artificial Sequence
  Synthetic oligonucleotide; CTG chr11 5153237 5153258 5153242 5153237 -
gactctattctggctaaatgat

SEQ ID NO: 155795 - DNA, 22 bp, Artificial Sequence
  Synthetic oligonucleotide; CTC chr11 5153232 5153253 5153237 5153232 -
tattctggctaaatgattcatt

SEQ ID NO: 155796 - DNA, 22 bp, Artificial Sequence
  Synthetic oligonucleotide; CTA chr11 5153230 5153251 5153235 5153230 -
ttctggctaaatgattcatttg

SEQ ID NO: 155797 - DNA, 22 bp, Artificial Sequence
  Synthetic oligonucleotide; TTC chr11 5153227 5153248 5153232 5153227 -
tggctaaatgattcatttgccc

SEQ ID NO: 155798 - DNA, 22 bp, Artificial Sequence
  Synthetic oligonucleotide; CTG chr11 5153225 5153246 5153230 5153225 -
gctaaatgattcatttgcccat

SEQ ID NO: 155799 - DNA, 22 bp, Artificial Sequence
  Synthetic oligonucleotide; CTA chr11 5153221 5153242 5153226 5153221 -
aatgattcatttgcccattatt

SEQ ID NO: 155800 - DNA, 22 bp, Artificial Sequence
  Synthetic oligonucleotide; TTC chr11 5153213 5153234 5153218 5153213 -
atttgcccattattcagtatct

SEQ ID NO: 155801 - DNA, 22 bp, Artificial Sequence
  Synthetic oligonucleotide; TTT chr11 5153209 5153230 5153214 5153209 -
gcccattattcagtatctgtgg

SEQ ID NO: 155802 - DNA, 22 bp, Artificial Sequence
  Synthetic oligonucleotide; TTG chr11 5153208 5153229 5153213 5153208 -
cccattattcagtatctgtggt

SEQ ID NO: 155803 - DNA, 22 bp, Artificial Sequence
  Synthetic oligonucleotide; TTA chr11 5153201 5153222 5153206 5153201 -
ttcagtatctgtggtttatcag

SEQ ID NO: 155804 - DNA, 22 bp, Artificial Sequence
  Synthetic oligonucleotide; TTC chr11 5153198 5153219 5153203 5153198 -
agtatctgtggtttatcaggag

SEQ ID NO: 155805 - DNA, 22 bp, Artificial Sequence
  Synthetic oligonucleotide; CTG chr11 5153190 5153211 5153195 5153190 -
tggtttatcaggagcaagttct

SEQ ID NO: 155806 - DNA, 22 bp, Artificial Sequence
  Synthetic oligonucleotide; TTT chr11 5153184 5153205 5153189 5153184 -
atcaggagcaagttctcttgcc

SEQ ID NO: 155807 - DNA, 22 bp, Artificial Sequence
  Synthetic oligonucleotide; TTA chr11 5153183 5153204 5153188 5153183 -
tcaggagcaagttctcttgccg

SEQ ID NO: 155808 - DNA, 22 bp, Artificial Sequence
  Synthetic oligonucleotide; TTC chr11 5153169 5153190 5153174 5153169 -
tcttgccgtaggcattgctgct

SEQ ID NO: 155809 - DNA, 22 bp, Artificial Sequence
  Synthetic oligonucleotide; CTC chr11 5153167 5153188 5153172 5153167 -
ttgccgtaggcattgctgctgc

SEQ ID NO: 155810 - DNA, 22 bp, Artificial Sequence
  Synthetic oligonucleotide; CTT chr11 5153165 5153186 5153170 5153165 -
gccgtaggcattgctgctgctc

SEQ ID NO: 155811 - DNA, 22 bp, Artificial Sequence
  Synthetic oligonucleotide; TTG chr11 5153164 5153185 5153169 5153164 -
ccgtaggcattgctgctgctca

SEQ ID NO: 155812 - DNA, 22 bp, Artificial Sequence
  Synthetic oligonucleotide; TTG chr11 5153152 5153173 5153157 5153152 -
ctgctgctcatcttgtccctta

SEQ ID NO: 155813 - DNA, 22 bp, Artificial Sequence
  Synthetic oligonucleotide; CTG chr11 5153149 5153170 5153154 5153149 -
ctgctcatcttgtcccttagca

SEQ ID NO: 155814 - DNA, 22 bp, Artificial Sequence
  Synthetic oligonucleotide; CTG chr11 5153146 5153167 5153151 5153146 -
ctcatcttgtcccttagcagtt

SEQ ID NO: 155815 - DNA, 22 bp, Artificial Sequence
  Synthetic oligonucleotide; CTC chr11 5153143 5153164 5153148 5153143 -
atcttgtcccttagcagttcct

SEQ ID NO: 155816 - DNA, 22 bp, Artificial Sequence
  Synthetic oligonucleotide; CTT chr11 5153138 5153159 5153143 5153138 -
gtcccttagcagttccttctct

SEQ ID NO: 155817 - DNA, 22 bp, Artificial Sequence
  Synthetic oligonucleotide; TTG chr11 5153137 5153158 5153142 5153137 -
tcccttagcagttccttctctc

SEQ ID NO: 155818 - DNA, 22 bp, Artificial Sequence
  Synthetic oligonucleotide; CTT chr11 5153131 5153152 5153136 5153131 -
agcagttccttctctctagata

SEQ ID NO: 155819 - DNA, 22 bp, Artificial Sequence
  Synthetic oligonucleotide; TTA chr11 5153130 5153151 5153135 5153130 -
gcagttccttctctctagatat

SEQ ID NO: 155820 - DNA, 22 bp, Artificial Sequence
  Synthetic oligonucleotide; TTC chr11 5153123 5153144 5153128 5153123 -
cttctctctagatattccataa

SEQ ID NO: 155821 - DNA, 22 bp, Artificial Sequence
  Synthetic oligonucleotide; CTT chr11 5153120 5153141 5153125 5153120 -
ctctctagatattccataaagt

SEQ ID NO: 155822 - DNA, 22 bp, Artificial Sequence
  Synthetic oligonucleotide; TTC chr11 5153119 5153140 5153124 5153119 -
tctctagatattccataaagtg

SEQ ID NO: 155823 - DNA, 22 bp, Artificial Sequence
  Synthetic oligonucleotide; CTC chr11 5153117 5153138 5153122 5153117 -
tctagatattccataaagtgta

SEQ ID NO: 155824 - DNA, 22 bp, Artificial Sequence
  Synthetic oligonucleotide; CTC chr11 5153115 5153136 5153120 5153115 -
tagatattccataaagtgtatt

SEQ ID NO: 155825 - DNA, 22 bp, Artificial Sequence
  Synthetic oligonucleotide; CTA chr11 5153113 5153134 5153118 5153113 -
gatattccataaagtgtattaa

SEQ ID NO: 155826 - DNA, 22 bp, Artificial Sequence
  Synthetic oligonucleotide; TTC chr11 5153106 5153127 5153111 5153106 -
cataaagtgtattaaaatttta

SEQ ID NO: 155827 - DNA, 22 bp, Artificial Sequence
  Synthetic oligonucleotide; TTA chr11 5153092 5153113 5153097 5153092 -
aaattttaaactcacaacattt

SEQ ID NO: 155828 - DNA, 22 bp, Artificial Sequence
  Synthetic oligonucleotide; TTT chr11 5153086 5153107 5153091 5153086 -
taaactcacaacatttcaagag

SEQ ID NO: 155829 - DNA, 22 bp, Artificial Sequence
  Synthetic oligonucleotide; TTT chr11 5153085 5153106 5153090 5153085 -
aaactcacaacatttcaagagt

SEQ ID NO: 155830 - DNA, 22 bp, Artificial Sequence
  Synthetic oligonucleotide; TTA chr11 5153084 5153105 5153089 5153084 -
aactcacaacatttcaagagtt

SEQ ID NO: 155831 - DNA, 22 bp, Artificial Sequence
  Synthetic oligonucleotide; CTC chr11 5153079 5153100 5153084 5153079 -
acaacatttcaagagtttcagc

SEQ ID NO: 155832 - DNA, 22 bp, Artificial Sequence
  Synthetic oligonucleotide; TTT chr11 5153070 5153091 5153075 5153070 -
caagagtttcagctgtttaaaa

SEQ ID NO: 155833 - DNA, 22 bp, Artificial Sequence
  Synthetic oligonucleotide; TTC chr11 5153069 5153090 5153074 5153069 -
aagagtttcagctgtttaaaat

SEQ ID NO: 155834 - DNA, 22 bp, Artificial Sequence
  Synthetic oligonucleotide; TTT chr11 5153061 5153082 5153066 5153061 -
cagctgtttaaaatatatagga

SEQ ID NO: 155835 - DNA, 22 bp, Artificial Sequence
  Synthetic oligonucleotide; TTC chr11 5153060 5153081 5153065 5153060 -
agctgtttaaaatatataggaa

SEQ ID NO: 155836 - DNA, 22 bp, Artificial Sequence
  Synthetic oligonucleotide; CTG chr11 5153055 5153076 5153060 5153055 -
tttaaaatatataggaaaaaat

SEQ ID NO: 155837 - DNA, 22 bp, Artificial Sequence
  Synthetic oligonucleotide; TTT chr11 5153052 5153073 5153057 5153052 -
aaaatatataggaaaaaatata

SEQ ID NO: 155838 - DNA, 22 bp, Artificial Sequence
  Synthetic oligonucleotide; TTA chr11 5153051 5153072 5153056 5153051 -
aaatatataggaaaaaatataa

SEQ ID NO: 155839 - DNA, 22 bp, Artificial Sequence
  Synthetic oligonucleotide; TTC chr11 5153026 5153047 5153031 5153026 -
cctttaactttaaagaaatata

SEQ ID NO: 155840 - DNA, 22 bp, Artificial Sequence
  Synthetic oligonucleotide; CTT chr11 5153022 5153043 5153027 5153022 -
taactttaaagaaatataaaaa

SEQ ID NO: 155841 - DNA, 22 bp, Artificial Sequence
  Synthetic oligonucleotide; TTT chr11 5153021 5153042 5153026 5153021 -
aactttaaagaaatataaaaag

SEQ ID NO: 155842 - DNA, 22 bp, Artificial Sequence
  Synthetic oligonucleotide; TTA chr11 5153020 5153041 5153025 5153020 -
actttaaagaaatataaaaagc

SEQ ID NO: 155843 - DNA, 22 bp, Artificial Sequence
  Synthetic oligonucleotide; CTT chr11 5153016 5153037 5153021 5153016 -
taaagaaatataaaaagcaacc

SEQ ID NO: 155844 - DNA, 22 bp, Artificial Sequence
  Synthetic oligonucleotide; TTT chr11 5153015 5153036 5153020 5153015 -
aaagaaatataaaaagcaacca

SEQ ID NO: 155845 - DNA, 22 bp, Artificial Sequence
  Synthetic oligonucleotide; TTA chr11 5153014 5153035 5153019 5153014 -
aagaaatataaaaagcaaccag

SEQ ID NO: 155846 - DNA, 22 bp, Artificial Sequence
  Synthetic oligonucleotide; CTT chr11 5152986 5153007 5152991 5152986 -
tggctcagatttgtcaaaagta

SEQ ID NO: 155847 - DNA, 22 bp, Artificial Sequence
  Synthetic oligonucleotide; TTT chr11 5152985 5153006 5152990 5152985 -
ggctcagatttgtcaaaagtat

SEQ ID NO: 155848 - DNA, 22 bp, Artificial Sequence
  Synthetic oligonucleotide; TTG chr11 5152984 5153005 5152989 5152984 -
gctcagatttgtcaaaagtata

SEQ ID NO: 155849 - DNA, 22 bp, Artificial Sequence
  Synthetic oligonucleotide; CTC chr11 5152980 5153001 5152985 5152980 -
agatttgtcaaaagtataaaga

SEQ ID NO: 155850 - DNA, 22 bp, Artificial Sequence
  Synthetic oligonucleotide; TTT chr11 5152974 5152995 5152979 5152974 -
gtcaaaagtataaagatttcaa

SEQ ID NO: 155851 - DNA, 22 bp, Artificial Sequence
  Synthetic oligonucleotide; TTG chr11 5152973 5152994 5152978 5152973 -
tcaaaagtataaagatttcaat

SEQ ID NO: 155852 - DNA, 22 bp, Artificial Sequence
  Synthetic oligonucleotide; TTT chr11 5152955 5152976 5152960 5152955 -
caattatttctaaagcattctc

SEQ ID NO: 155853 - DNA, 22 bp, Artificial Sequence
  Synthetic oligonucleotide; TTC chr11 5152954 5152975 5152959 5152954 -
aattatttctaaagcattctct

SEQ ID NO: 155854 - DNA, 22 bp, Artificial Sequence
  Synthetic oligonucleotide; TTA chr11 5152949 5152970 5152954 5152949 -
tttctaaagcattctctttaca

SEQ ID NO: 155855 - DNA, 22 bp, Artificial Sequence
  Synthetic oligonucleotide; TTT chr11 5152946 5152967 5152951 5152946 -
ctaaagcattctctttacatta

SEQ ID NO: 155856 - DNA, 22 bp, Artificial Sequence
  Synthetic oligonucleotide; TTC chr11 5152945 5152966 5152950 5152945 -
taaagcattctctttacattat

SEQ ID NO: 155857 - DNA, 22 bp, Artificial Sequence
  Synthetic oligonucleotide; CTA chr11 5152943 5152964 5152948 5152943 -
aagcattctctttacattattc

SEQ ID NO: 155858 - DNA, 22 bp, Artificial Sequence
  Synthetic oligonucleotide; TTC chr11 5152935 5152956 5152940 5152935 -
tctttacattattctgaatata

SEQ ID NO: 155859 - DNA, 22 bp, Artificial Sequence
  Synthetic oligonucleotide; CTC chr11 5152933 5152954 5152938 5152933 -
tttacattattctgaatataaa

SEQ ID NO: 155860 - DNA, 22 bp, Artificial Sequence
  Synthetic oligonucleotide; CTT chr11 5152931 5152952 5152936 5152931 -
tacattattctgaatataaaaa

SEQ ID NO: 155861 - DNA, 22 bp, Artificial Sequence
  Synthetic oligonucleotide; TTT chr11 5152930 5152951 5152935 5152930 -
acattattctgaatataaaaag

SEQ ID NO: 155862 - DNA, 22 bp, Artificial Sequence
  Synthetic oligonucleotide; TTA chr11 5152929 5152950 5152934 5152929 -
cattattctgaatataaaaaga

SEQ ID NO: 155863 - DNA, 22 bp, Artificial Sequence
  Synthetic oligonucleotide; TTA chr11 5152924 5152945 5152929 5152924 -
ttctgaatataaaaagaaatat

SEQ ID NO: 155864 - DNA, 22 bp, Artificial Sequence
  Synthetic oligonucleotide; TTC chr11 5152921 5152942 5152926 5152921 -
tgaatataaaaagaaatatatt

SEQ ID NO: 155865 - DNA, 22 bp, Artificial Sequence
  Synthetic oligonucleotide; CTG chr11 5152919 5152940 5152924 5152919 -
aatataaaaagaaatatattat

SEQ ID NO: 155866 - DNA, 22 bp, Artificial Sequence
  Synthetic oligonucleotide; TTA chr11 5152898 5152919 5152903 5152898 -
tgttcttgggtgtcaattattt

SEQ ID NO: 155867 - DNA, 22 bp, Artificial Sequence
  Synthetic oligonucleotide; TTC chr11 5152893 5152914 5152898 5152893 -
ttgggtgtcaattatttctacc

SEQ ID NO: 155868 - DNA, 22 bp, Artificial Sequence
  Synthetic oligonucleotide; CTT chr11 5152891 5152912 5152896 5152891 -
gggtgtcaattatttctacctc

SEQ ID NO: 155869 - DNA, 22 bp, Artificial Sequence
  Synthetic oligonucleotide; TTG chr11 5152890 5152911 5152895 5152890 -
ggtgtcaattatttctacctct

SEQ ID NO: 155870 - DNA, 22 bp, Artificial Sequence
  Synthetic oligonucleotide; TTA chr11 5152879 5152900 5152884 5152879 -
tttctacctctattctctttca

SEQ ID NO: 155871 - DNA, 22 bp, Artificial Sequence
  Synthetic oligonucleotide; TTT chr11 5152876 5152897 5152881 5152876 -
ctacctctattctctttcattg

SEQ ID NO: 155872 - DNA, 22 bp, Artificial Sequence
  Synthetic oligonucleotide; TTC chr11 5152875 5152896 5152880 5152875 -
tacctctattctctttcattgg

SEQ ID NO: 155873 - DNA, 22 bp, Artificial Sequence
  Synthetic oligonucleotide; CTA chr11 5152873 5152894 5152878 5152873 -
cctctattctctttcattggga

SEQ ID NO: 155874 - DNA, 22 bp, Artificial Sequence
  Synthetic oligonucleotide; CTC chr11 5152869 5152890 5152874 5152869 -
tattctctttcattgggaatct

SEQ ID NO: 155875 - DNA, 22 bp, Artificial Sequence
  Synthetic oligonucleotide; CTA chr11 5152867 5152888 5152872 5152867 -
ttctctttcattgggaatcttt

SEQ ID NO: 155876 - DNA, 22 bp, Artificial Sequence
  Synthetic oligonucleotide; TTC chr11 5152864 5152885 5152869 5152864 -
tctttcattgggaatcttttac

SEQ ID NO: 155877 - DNA, 22 bp, Artificial Sequence
  Synthetic oligonucleotide; CTC chr11 5152862 5152883 5152867 5152862 -
tttcattgggaatcttttacac

SEQ ID NO: 155878 - DNA, 22 bp, Artificial Sequence
  Synthetic oligonucleotide; CTT chr11 5152860 5152881 5152865 5152860 -
tcattgggaatcttttacacca

SEQ ID NO: 155879 - DNA, 22 bp, Artificial Sequence
  Synthetic oligonucleotide; TTT chr11 5152859 5152880 5152864 5152859 -
cattgggaatcttttacaccaa

SEQ ID NO: 155880 - DNA, 22 bp, Artificial Sequence
  Synthetic oligonucleotide; TTC chr11 5152858 5152879 5152863 5152858 -
attgggaatcttttacaccaat

SEQ ID NO: 155881 - DNA, 22 bp, Artificial Sequence
  Synthetic oligonucleotide; TTG chr11 5152854 5152875 5152859 5152854 -
ggaatcttttacaccaatgtac

SEQ ID NO: 155882 - DNA, 22 bp, Artificial Sequence
  Synthetic oligonucleotide; CTT chr11 5152846 5152867 5152851 5152846 -
ttacaccaatgtactggtcaga

SEQ ID NO: 155883 - DNA, 22 bp, Artificial Sequence
  Synthetic oligonucleotide; TTT chr11 5152845 5152866 5152850 5152845 -
tacaccaatgtactggtcagag

SEQ ID NO: 155884 - DNA, 22 bp, Artificial Sequence
  Synthetic oligonucleotide; TTT chr11 5152844 5152865 5152849 5152844 -
acaccaatgtactggtcagagt

SEQ ID NO: 155885 - DNA, 22 bp, Artificial Sequence
  Synthetic oligonucleotide; TTA chr11 5152843 5152864 5152848 5152843 -
caccaatgtactggtcagagtc

SEQ ID NO: 155886 - DNA, 22 bp, Artificial Sequence
  Synthetic oligonucleotide; CTG chr11 5152830 5152851 5152835 5152830 -
gtcagagtctgttaatttgctt

SEQ ID NO: 155887 - DNA, 22 bp, Artificial Sequence
  Synthetic oligonucleotide; CTG chr11 5152819 5152840 5152824 5152819 -
ttaatttgcttgtctaaaatgt

SEQ ID NO: 155888 - DNA, 22 bp, Artificial Sequence
  Synthetic oligonucleotide; TTA chr11 5152816 5152837 5152821 5152816 -
atttgcttgtctaaaatgttct

SEQ ID NO: 155889 - DNA, 22 bp, Artificial Sequence
  Synthetic oligonucleotide; TTT chr11 5152812 5152833 5152817 5152812 -
gcttgtctaaaatgttcttaaa

SEQ ID NO: 155890 - DNA, 22 bp, Artificial Sequence
  Synthetic oligonucleotide; TTG chr11 5152811 5152832 5152816 5152811 -
cttgtctaaaatgttcttaaag

SEQ ID NO: 155891 - DNA, 22 bp, Artificial Sequence
  Synthetic oligonucleotide; CTT chr11 5152808 5152829 5152813 5152808 -
gtctaaaatgttcttaaagaaa

SEQ ID NO: 155892 - DNA, 22 bp, Artificial Sequence
  Synthetic oligonucleotide; TTG chr11 5152807 5152828 5152812 5152807 -
tctaaaatgttcttaaagaaaa

SEQ ID NO: 155893 - DNA, 22 bp, Artificial Sequence
  Synthetic oligonucleotide; CTA chr11 5152803 5152824 5152808 5152803 -
aaatgttcttaaagaaaattgg

SEQ ID NO: 155894 - DNA, 22 bp, Artificial Sequence
  Synthetic oligonucleotide; TTC chr11 5152795 5152816 5152800 5152795 -
ttaaagaaaattggaaatagtt

SEQ ID NO: 155895 - DNA, 22 bp, Artificial Sequence
  Synthetic oligonucleotide; CTT chr11 5152793 5152814 5152798 5152793 -
aaagaaaattggaaatagttaa

SEQ ID NO: 155896 - DNA, 22 bp, Artificial Sequence
  Synthetic oligonucleotide; TTA chr11 5152792 5152813 5152797 5152792 -
aagaaaattggaaatagttaaa

SEQ ID NO: 155897 - DNA, 22 bp, Artificial Sequence
  Synthetic oligonucleotide; TTG chr11 5152782 5152803 5152787 5152782 -
gaaatagttaaatactagagga

SEQ ID NO: 155898 - DNA, 22 bp, Artificial Sequence
  Synthetic oligonucleotide; TTA chr11 5152772 5152793 5152777 5152772 -
aatactagaggaatagctgaaa

SEQ ID NO: 155899 - DNA, 22 bp, Artificial Sequence
  Synthetic oligonucleotide; CTA chr11 5152765 5152786 5152770 5152765 -
gaggaatagctgaaatgtgaaa

SEQ ID NO: 155900 - DNA, 22 bp, Artificial Sequence
  Synthetic oligonucleotide; CTG chr11 5152753 5152774 5152758 5152753 -
aaatgtgaaatatggagaggtt

SEQ ID NO: 155901 - DNA, 22 bp, Artificial Sequence
  Synthetic oligonucleotide; TTT chr11 5152730 5152751 5152735 5152730 -
attaaccaaattaaaatgcaat

SEQ ID NO: 155902 - DNA, 22 bp, Artificial Sequence
  Synthetic oligonucleotide; TTA chr11 5152729 5152750 5152734 5152729 -
ttaaccaaattaaaatgcaatg

SEQ ID NO: 155903 - DNA, 22 bp, Artificial Sequence
  Synthetic oligonucleotide; TTA chr11 5152726 5152747 5152731 5152726 -
accaaattaaaatgcaatgtcc

SEQ ID NO: 155904 - DNA, 22 bp, Artificial Sequence
  Synthetic oligonucleotide; TTA chr11 5152717 5152738 5152722 5152717 -
aaatgcaatgtccaataaaaat

SEQ ID NO: 155905 - DNA, 22 bp, Artificial Sequence
  Synthetic oligonucleotide; CTT chr11 5152689 5152710 5152694 5152689 -
ctttttttttttgtccacaggt

SEQ ID NO: 155906 - DNA, 22 bp, Artificial Sequence
  Synthetic oligonucleotide; TTC chr11 5152688 5152709 5152693 5152688 -
tttttttttttgtccacaggtc

SEQ ID NO: 155907 - DNA, 22 bp, Artificial Sequence
  Synthetic oligonucleotide; CTT chr11 5152686 5152707 5152691 5152686 -
tttttttttgtccacaggtctg

SEQ ID NO: 155908 - DNA, 22 bp, Artificial Sequence
  Synthetic oligonucleotide; TTT chr11 5152685 5152706 5152690 5152685 -
ttttttttgtccacaggtctgg

SEQ ID NO: 155909 - DNA, 22 bp, Artificial Sequence
  Synthetic oligonucleotide; TTT chr11 5152684 5152705 5152689 5152684 -
tttttttgtccacaggtctgga

SEQ ID NO: 155910 - DNA, 22 bp, Artificial Sequence
  Synthetic oligonucleotide; TTT chr11 5152683 5152704 5152688 5152683 -
ttttttgtccacaggtctggaa

SEQ ID NO: 155911 - DNA, 22 bp, Artificial Sequence
  Synthetic oligonucleotide; TTT chr11 5152682 5152703 5152687 5152682 -
tttttgtccacaggtctggaaa

SEQ ID NO: 155912 - DNA, 22 bp, Artificial Sequence
  Synthetic oligonucleotide; TTT chr11 5152681 5152702 5152686 5152681 -
ttttgtccacaggtctggaaag

SEQ ID NO: 155913 - DNA, 22 bp, Artificial Sequence
  Synthetic oligonucleotide; TTT chr11 5152680 5152701 5152685 5152680 -
tttgtccacaggtctggaaaga

SEQ ID NO: 155914 - DNA, 22 bp, Artificial Sequence
  Synthetic oligonucleotide; TTT chr11 5152679 5152700 5152684 5152679 -
ttgtccacaggtctggaaagaa

SEQ ID NO: 155915 - DNA, 22 bp, Artificial Sequence
  Synthetic oligonucleotide; TTT chr11 5152678 5152699 5152683 5152678 -
tgtccacaggtctggaaagaaa

SEQ ID NO: 155916 - DNA, 22 bp, Artificial Sequence
  Synthetic oligonucleotide; TTT chr11 5152677 5152698 5152682 5152677 -
gtccacaggtctggaaagaaat

SEQ ID NO: 155917 - DNA, 22 bp, Artificial Sequence
  Synthetic oligonucleotide; TTG chr11 5152676 5152697 5152681 5152676 -
tccacaggtctggaaagaaata

SEQ ID NO: 155918 - DNA, 22 bp, Artificial Sequence
  Synthetic oligonucleotide; CTG chr11 5152664 5152685 5152669 5152664 -
gaaagaaataacagactggcca

SEQ ID NO: 155919 - DNA, 22 bp, Artificial Sequence
  Synthetic oligonucleotide; CTG chr11 5152646 5152667 5152651 5152646 -
gccagtagtccaatcccctgtc

SEQ ID NO: 155920 - DNA, 22 bp, Artificial Sequence
  Synthetic oligonucleotide; CTG chr11 5152626 5152647 5152631 5152626 -
tccaggtgattttgctggttct

SEQ ID NO: 155921 - DNA, 22 bp, Artificial Sequence
  Synthetic oligonucleotide; TTT chr11 5152614 5152635 5152619 5152614 -
tgctggttctaatgtatttgga

SEQ ID NO: 155922 - DNA, 22 bp, Artificial Sequence
  Synthetic oligonucleotide; TTT chr11 5152613 5152634 5152618 5152613 -
gctggttctaatgtatttggat

SEQ ID NO: 155923 - DNA, 22 bp, Artificial Sequence
  Synthetic oligonucleotide; TTG chr11 5152612 5152633 5152617 5152612 -
ctggttctaatgtatttggatt

SEQ ID NO: 155924 - DNA, 22 bp, Artificial Sequence
  Synthetic oligonucleotide; CTG chr11 5152609 5152630 5152614 5152609 -
gttctaatgtatttggattgcc

SEQ ID NO: 155925 - DNA, 22 bp, Artificial Sequence
  Synthetic oligonucleotide; TTC chr11 5152605 5152626 5152610 5152605 -
taatgtatttggattgccatgc

SEQ ID NO: 155926 - DNA, 22 bp, Artificial Sequence
  Synthetic oligonucleotide; CTA chr11 5152603 5152624 5152608 5152603 -
atgtatttggattgccatgcac

SEQ ID NO: 155927 - DNA, 22 bp, Artificial Sequence
  Synthetic oligonucleotide; TTT chr11 5152595 5152616 5152600 5152595 -
ggattgccatgcacataacatc

SEQ ID NO: 155928 - DNA, 22 bp, Artificial Sequence
  Synthetic oligonucleotide; TTG chr11 5152594 5152615 5152599 5152594 -
gattgccatgcacataacatcc

SEQ ID NO: 155929 - DNA, 22 bp, Artificial Sequence
  Synthetic oligonucleotide; TTG chr11 5152589 5152610 5152594 5152589 -
ccatgcacataacatcctatta

SEQ ID NO: 155930 - DNA, 22 bp, Artificial Sequence
  Synthetic oligonucleotide; CTA chr11 5152570 5152591 5152575 5152570 -
ttatggcacagtgcctgtgaat

SEQ ID NO: 155931 - DNA, 22 bp, Artificial Sequence
  Synthetic oligonucleotide; TTA chr11 5152567 5152588 5152572 5152567 -
tggcacagtgcctgtgaatgcc

SEQ ID NO: 155932 - DNA, 22 bp, Artificial Sequence
  Synthetic oligonucleotide; CTG chr11 5152553 5152574 5152558 5152553 -
tgaatgccccacctgaaaacag

SEQ ID NO: 155933 - DNA, 22 bp, Artificial Sequence
  Synthetic oligonucleotide; CTG chr11 5152538 5152559 5152543 5152538 -
aaaacagtgatgtatctccatg

SEQ ID NO: 155934 - DNA, 22 bp, Artificial Sequence
  Synthetic oligonucleotide; CTC chr11 5152520 5152541 5152525 5152520 -
catgaatccatcttttcctttc

SEQ ID NO: 155935 - DNA, 22 bp, Artificial Sequence
  Synthetic oligonucleotide; CTT chr11 5152506 5152527 5152511 5152506 -
ttcctttcaaaactgtgaataa

SEQ ID NO: 155936 - DNA, 22 bp, Artificial Sequence
  Synthetic oligonucleotide; TTT chr11 5152505 5152526 5152510 5152505 -
tcctttcaaaactgtgaataag

SEQ ID NO: 155937 - DNA, 22 bp, Artificial Sequence
  Synthetic oligonucleotide; TTT chr11 5152504 5152525 5152509 5152504 -
cctttcaaaactgtgaataaga

SEQ ID NO: 155938 - DNA, 22 bp, Artificial Sequence
  Synthetic oligonucleotide; TTC chr11 5152503 5152524 5152508 5152503 -
ctttcaaaactgtgaataagat

SEQ ID NO: 155939 - DNA, 22 bp, Artificial Sequence
  Synthetic oligonucleotide; CTT chr11 5152500 5152521 5152505 5152500 -
tcaaaactgtgaataagatgga

SEQ ID NO: 155940 - DNA, 22 bp, Artificial Sequence
  Synthetic oligonucleotide; TTT chr11 5152499 5152520 5152504 5152499 -
caaaactgtgaataagatggat

SEQ ID NO: 155941 - DNA, 22 bp, Artificial Sequence
  Synthetic oligonucleotide; TTC chr11 5152498 5152519 5152503 5152498 -
aaaactgtgaataagatggatg

SEQ ID NO: 155942 - DNA, 22 bp, Artificial Sequence
  Synthetic oligonucleotide; CTG chr11 5152491 5152512 5152496 5152491 -
tgaataagatggatgattttag

SEQ ID NO: 155943 - DNA, 22 bp, Artificial Sequence
  Synthetic oligonucleotide; TTT chr11 5152472 5152493 5152477 5152472 -
tagagttatacccaaatcagac

SEQ ID NO: 155944 - DNA, 22 bp, Artificial Sequence
  Synthetic oligonucleotide; TTT chr11 5152471 5152492 5152476 5152471 -
agagttatacccaaatcagaca

SEQ ID NO: 155945 - DNA, 22 bp, Artificial Sequence
  Synthetic oligonucleotide; TTA chr11 5152470 5152491 5152475 5152470 -
gagttatacccaaatcagacag

SEQ ID NO: 155946 - DNA, 22 bp, Artificial Sequence
  Synthetic oligonucleotide; TTA chr11 5152464 5152485 5152469 5152464 -
tacccaaatcagacagactcaa

SEQ ID NO: 155947 - DNA, 22 bp, Artificial Sequence
  Synthetic oligonucleotide; CTC chr11 5152444 5152465 5152449 5152444 -
aatataatgagtttggagaaaa

SEQ ID NO: 155948 - DNA, 22 bp, Artificial Sequence
  Synthetic oligonucleotide; TTT chr11 5152430 5152451 5152435 5152430 -
ggagaaaatcagaaagcagaag

SEQ ID NO: 155949 - DNA, 22 bp, Artificial Sequence
  Synthetic oligonucleotide; TTG chr11 5152429 5152450 5152434 5152429 -
gagaaaatcagaaagcagaaga

SEQ ID NO: 155950 - DNA, 22 bp, Artificial Sequence
  Synthetic oligonucleotide; CTG chr11 5152392 5152413 5152397 5152392 -
actgagaaacttcttttgtttg

SEQ ID NO: 155951 - DNA, 22 bp, Artificial Sequence
  Synthetic oligonucleotide; CTG chr11 5152388 5152409 5152393 5152388 -
agaaacttcttttgtttgcatc

SEQ ID NO: 155952 - DNA, 22 bp, Artificial Sequence
  Synthetic oligonucleotide; CTT chr11 5152380 5152401 5152385 5152380 -
cttttgtttgcatcaggagacc

SEQ ID NO: 155953 - DNA, 22 bp, Artificial Sequence
  Synthetic oligonucleotide; TTC chr11 5152379 5152400 5152384 5152379 -
ttttgtttgcatcaggagaccc

SEQ ID NO: 155954 - DNA, 22 bp, Artificial Sequence
  Synthetic oligonucleotide; CTT chr11 5152377 5152398 5152382 5152377 -
ttgtttgcatcaggagacccaa

SEQ ID NO: 155955 - DNA, 22 bp, Artificial Sequence
  Synthetic oligonucleotide; TTT chr11 5152376 5152397 5152381 5152376 -
tgtttgcatcaggagacccaac

SEQ ID NO: 155956 - DNA, 22 bp, Artificial Sequence
  Synthetic oligonucleotide; TTT chr11 5152375 5152396 5152380 5152375 -
gtttgcatcaggagacccaacg

SEQ ID NO: 155957 - DNA, 22 bp, Artificial Sequence
  Synthetic oligonucleotide; TTG chr11 5152374 5152395 5152379 5152374 -
tttgcatcaggagacccaacga

SEQ ID NO: 155958 - DNA, 22 bp, Artificial Sequence
  Synthetic oligonucleotide; TTT chr11 5152371 5152392 5152376 5152371 -
gcatcaggagacccaacgacac

SEQ ID NO: 155959 - DNA, 22 bp, Artificial Sequence
  Synthetic oligonucleotide; TTG chr11 5152370 5152391 5152375 5152370 -
catcaggagacccaacgacact

SEQ ID NO: 155960 - DNA, 22 bp, Artificial Sequence
  Synthetic oligonucleotide; CTA chr11 5152347 5152368 5152352 5152347 -
tgtccatttccaacatcacagt

SEQ ID NO: 155961 - DNA, 22 bp, Artificial Sequence
  Synthetic oligonucleotide; TTT chr11 5152338 5152359 5152343 5152338 -
ccaacatcacagtctacatgcc

SEQ ID NO: 155962 - DNA, 22 bp, Artificial Sequence
  Synthetic oligonucleotide; TTC chr11 5152337 5152358 5152342 5152337 -
caacatcacagtctacatgccc

SEQ ID NO: 155963 - DNA, 22 bp, Artificial Sequence
  Synthetic oligonucleotide; CTA chr11 5152322 5152343 5152327 5152322 -
catgccctctgtgttgacacta

SEQ ID NO: 155964 - DNA, 22 bp, Artificial Sequence
  Synthetic oligonucleotide; CTC chr11 5152313 5152334 5152318 5152313 -
tgtgttgacactagtagggatc

SEQ ID NO: 155965 - DNA, 22 bp, Artificial Sequence
  Synthetic oligonucleotide; CTG chr11 5152311 5152332 5152316 5152311 -
tgttgacactagtagggatccc

SEQ ID NO: 155966 - DNA, 22 bp, Artificial Sequence
  Synthetic oligonucleotide; TTG chr11 5152306 5152327 5152311 5152306 -
acactagtagggatcccaggcc

SEQ ID NO: 155967 - DNA, 22 bp, Artificial Sequence
  Synthetic oligonucleotide; CTA chr11 5152300 5152321 5152305 5152300 -
gtagggatcccaggcctagaat

SEQ ID NO: 155968 - DNA, 22 bp, Artificial Sequence
  Synthetic oligonucleotide; CTA chr11 5152282 5152303 5152287 5152282 -
gaatctgtgcagtgctggattg

SEQ ID NO: 155969 - DNA, 22 bp, Artificial Sequence
  Synthetic oligonucleotide; CTG chr11 5152275 5152296 5152280 5152275 -
tgcagtgctggattgggattcc

SEQ ID NO: 155970 - DNA, 22 bp, Artificial Sequence
  Synthetic oligonucleotide; CTG chr11 5152265 5152286 5152270 5152265 -
gattgggattccattctgtgcc

SEQ ID NO: 155971 - DNA, 22 bp, Artificial Sequence
  Synthetic oligonucleotide; TTG chr11 5152260 5152281 5152265 5152260 -
ggattccattctgtgccattta

SEQ ID NO: 155972 - DNA, 22 bp, Artificial Sequence
  Synthetic oligonucleotide; TTC chr11 5152254 5152275 5152259 5152254 -
cattctgtgccatttatctcat

SEQ ID NO: 155973 - DNA, 22 bp, Artificial Sequence
  Synthetic oligonucleotide; TTC chr11 5152249 5152270 5152254 5152249 -
tgtgccatttatctcattgcta

SEQ ID NO: 155974 - DNA, 22 bp, Artificial Sequence
  Synthetic oligonucleotide; CTG chr11 5152247 5152268 5152252 5152247 -
tgccatttatctcattgctatg

SEQ ID NO: 155975 - DNA, 22 bp, Artificial Sequence
  Synthetic oligonucleotide; TTT chr11 5152239 5152260 5152244 5152239 -
atctcattgctatgattggaaa

SEQ ID NO: 155976 - DNA, 22 bp, Artificial Sequence
  Synthetic oligonucleotide; TTA chr11 5152238 5152259 5152243 5152238 -
tctcattgctatgattggaaat

SEQ ID NO: 155977 - DNA, 22 bp, Artificial Sequence
  Synthetic oligonucleotide; CTC chr11 5152234 5152255 5152239 5152234 -
attgctatgattggaaattcct

SEQ ID NO: 155978 - DNA, 22 bp, Artificial Sequence
  Synthetic oligonucleotide; TTG chr11 5152230 5152251 5152235 5152230 -
ctatgattggaaattccttgct

SEQ ID NO: 155979 - DNA, 22 bp, Artificial Sequence
  Synthetic oligonucleotide; CTA chr11 5152227 5152248 5152232 5152227 -
tgattggaaattccttgcttct

SEQ ID NO: 155980 - DNA, 22 bp, Artificial Sequence
  Synthetic oligonucleotide; TTG chr11 5152221 5152242 5152226 5152221 -
gaaattccttgcttctgagcat

SEQ ID NO: 155981 - DNA, 22 bp, Artificial Sequence
  Synthetic oligonucleotide; TTC chr11 5152214 5152235 5152219 5152214 -
cttgcttctgagcatcatcaaa

SEQ ID NO: 155982 - DNA, 22 bp, Artificial Sequence
  Synthetic oligonucleotide; CTT chr11 5152211 5152232 5152216 5152211 -
gcttctgagcatcatcaaatct

SEQ ID NO: 155983 - DNA, 22 bp, Artificial Sequence
  Synthetic oligonucleotide; TTG chr11 5152210 5152231 5152215 5152210 -
cttctgagcatcatcaaatctg

SEQ ID NO: 155984 - DNA, 22 bp, Artificial Sequence
  Synthetic oligonucleotide; CTT chr11 5152207 5152228 5152212 5152207 -
ctgagcatcatcaaatctgagc

SEQ ID NO: 155985 - DNA, 22 bp, Artificial Sequence
  Synthetic oligonucleotide; TTC chr11 5152206 5152227 5152211 5152206 -
tgagcatcatcaaatctgagcg

SEQ ID NO: 155986 - DNA, 22 bp, Artificial Sequence
  Synthetic oligonucleotide; CTG chr11 5152204 5152225 5152209 5152204 -
agcatcatcaaatctgagcgca

SEQ ID NO: 155987 - DNA, 22 bp, Artificial Sequence
  Synthetic oligonucleotide; CTG chr11 5152188 5152209 5152193 5152188 -
agcgcagtctccatgagccctt

SEQ ID NO: 155988 - DNA, 22 bp, Artificial Sequence
  Synthetic oligonucleotide; CTC chr11 5152177 5152198 5152182 5152177 -
catgagcccttgtacattttct

SEQ ID NO: 155989 - DNA, 22 bp, Artificial Sequence
  Synthetic oligonucleotide; CTT chr11 5152166 5152187 5152171 5152166 -
gtacattttcttaggcatgcta

SEQ ID NO: 155990 - DNA, 22 bp, Artificial Sequence
  Synthetic oligonucleotide; TTG chr11 5152165 5152186 5152170 5152165 -
tacattttcttaggcatgctag

SEQ ID NO: 155991 - DNA, 22 bp, Artificial Sequence
  Synthetic oligonucleotide; TTT chr11 5152158 5152179 5152163 5152158 -
tcttaggcatgctaggagccac

SEQ ID NO: 155992 - DNA, 22 bp, Artificial Sequence
  Synthetic oligonucleotide; TTT chr11 5152157 5152178 5152162 5152157 -
cttaggcatgctaggagccaca

SEQ ID NO: 155993 - DNA, 22 bp, Artificial Sequence
  Synthetic oligonucleotide; TTC chr11 5152156 5152177 5152161 5152156 -
ttaggcatgctaggagccacag

SEQ ID NO: 155994 - DNA, 22 bp, Artificial Sequence
  Synthetic oligonucleotide; CTT chr11 5152154 5152175 5152159 5152154 -
aggcatgctaggagccacagac

SEQ ID NO: 155995 - DNA, 22 bp, Artificial Sequence
  Synthetic oligonucleotide; TTA chr11 5152153 5152174 5152158 5152153 -
ggcatgctaggagccacagaca

SEQ ID NO: 155996 - DNA, 22 bp, Artificial Sequence
  Synthetic oligonucleotide; CTA chr11 5152144 5152165 5152149 5152144 -
ggagccacagacattgcacttg

SEQ ID NO: 155997 - DNA, 22 bp, Artificial Sequence
  Synthetic oligonucleotide; TTG chr11 5152128 5152149 5152133 5152128 -
cacttgctagcagcattatgcc

SEQ ID NO: 155998 - DNA, 22 bp, Artificial Sequence
  Synthetic oligonucleotide; CTT chr11 5152123 5152144 5152128 5152123 -
gctagcagcattatgccaaaga

SEQ ID NO: 155999 - DNA, 22 bp, Artificial Sequence
  Synthetic oligonucleotide; TTG chr11 5152122 5152143 5152127 5152122 -
ctagcagcattatgccaaagat

SEQ ID NO: 156000 - DNA, 22 bp, Artificial Sequence
  Synthetic oligonucleotide; CTA chr11 5152119 5152140 5152124 5152119 -
gcagcattatgccaaagatgct

SEQ ID NO: 156001 - DNA, 22 bp, Artificial Sequence
  Synthetic oligonucleotide; TTA chr11 5152110 5152131 5152115 5152110 -
tgccaaagatgcttggaatatt

SEQ ID NO: 156002 - DNA, 22 bp, Artificial Sequence
  Synthetic oligonucleotide; CTT chr11 5152096 5152117 5152101 5152096 -
ggaatattctggtttaatgtgc

SEQ ID NO: 156003 - DNA, 22 bp, Artificial Sequence
  Synthetic oligonucleotide; TTG chr11 5152095 5152116 5152100 5152095 -
gaatattctggtttaatgtgcc

SEQ ID NO: 156004 - DNA, 22 bp, Artificial Sequence
  Synthetic oligonucleotide; TTC chr11 5152087 5152108 5152092 5152087 -
tggtttaatgtgcctgaaatct

SEQ ID NO: 156005 - DNA, 22 bp, Artificial Sequence
  Synthetic oligonucleotide; CTG chr11 5152085 5152106 5152090 5152085 -
gtttaatgtgcctgaaatctat

SEQ ID NO: 156006 - DNA, 22 bp, Artificial Sequence
  Synthetic oligonucleotide; TTT chr11 5152081 5152102 5152086 5152081 -
aatgtgcctgaaatctattttg

SEQ ID NO: 156007 - DNA, 22 bp, Artificial Sequence
  Synthetic oligonucleotide; TTA chr11 5152080 5152101 5152085 5152080 -
atgtgcctgaaatctattttga

SEQ ID NO: 156008 - DNA, 22 bp, Artificial Sequence
  Synthetic oligonucleotide; CTG chr11 5152071 5152092 5152076 5152071 -
aaatctattttgattcctgctt

SEQ ID NO: 156009 - DNA, 22 bp, Artificial Sequence
  Synthetic oligonucleotide; CTA chr11 5152064 5152085 5152069 5152064 -
ttttgattcctgcttgcttcaa

SEQ ID NO: 156010 - DNA, 22 bp, Artificial Sequence
  Synthetic oligonucleotide; TTT chr11 5152061 5152082 5152066 5152061 -
tgattcctgcttgcttcaaatg

SEQ ID NO: 156011 - DNA, 22 bp, Artificial Sequence
  Synthetic oligonucleotide; TTT chr11 5152060 5152081 5152065 5152060 -
gattcctgcttgcttcaaatgt

SEQ ID NO: 156012 - DNA, 22 bp, Artificial Sequence
  Synthetic oligonucleotide; TTG chr11 5152059 5152080 5152064 5152059 -
attcctgcttgcttcaaatgtg

SEQ ID NO: 156013 - DNA, 22 bp, Artificial Sequence
  Synthetic oligonucleotide; TTC chr11 5152055 5152076 5152060 5152055 -
ctgcttgcttcaaatgtggttc

SEQ ID NO: 156014 - DNA, 22 bp, Artificial Sequence
  Synthetic oligonucleotide; CTG chr11 5152052 5152073 5152057 5152052 -
cttgcttcaaatgtggttcatc

SEQ ID NO: 156015 - DNA, 22 bp, Artificial Sequence
  Synthetic oligonucleotide; CTT chr11 5152049 5152070 5152054 5152049 -
gcttcaaatgtggttcatccac

SEQ ID NO: 156016 - DNA, 22 bp, Artificial Sequence
  Synthetic oligonucleotide; TTG chr11 5152048 5152069 5152053 5152048 -
cttcaaatgtggttcatccaca

SEQ ID NO: 156017 - DNA, 22 bp, Artificial Sequence
  Synthetic oligonucleotide; CTT chr11 5152045 5152066 5152050 5152045 -
caaatgtggttcatccacacat

SEQ ID NO: 156018 - DNA, 22 bp, Artificial Sequence
  Synthetic oligonucleotide; TTC chr11 5152044 5152065 5152049 5152044 -
aaatgtggttcatccacacatt

SEQ ID NO: 156019 - DNA, 22 bp, Artificial Sequence
  Synthetic oligonucleotide; TTC chr11 5152033 5152054 5152038 5152033 -
atccacacattgcagggtatag

SEQ ID NO: 156020 - DNA, 22 bp, Artificial Sequence
  Synthetic oligonucleotide; TTG chr11 5152021 5152042 5152026 5152021 -
cagggtatagagtcaggcatcc

SEQ ID NO: 156021 - DNA, 22 bp, Artificial Sequence
  Synthetic oligonucleotide; CTT chr11 5151997 5152018 5152002 5151997 -
gtggccatggccctggaccgtt

SEQ ID NO: 156022 - DNA, 22 bp, Artificial Sequence
  Synthetic oligonucleotide; TTG chr11 5151996 5152017 5152001 5151996 -
tggccatggccctggaccgtta

SEQ ID NO: 156023 - DNA, 22 bp, Artificial Sequence
  Synthetic oligonucleotide; CTG chr11 5151982 5152003 5151987 5151982 -
gaccgttatgtggccatctgtt

SEQ ID NO: 156024 - DNA, 22 bp, Artificial Sequence
  Synthetic oligonucleotide; TTA chr11 5151974 5151995 5151979 5151974 -
tgtggccatctgttatccacta

SEQ ID NO: 156025 - DNA, 22 bp, Artificial Sequence
  Synthetic oligonucleotide; CTG chr11 5151962 5151983 5151967 5151962 -
ttatccactaagacatgccaac

SEQ ID NO: 156026 - DNA, 22 bp, Artificial Sequence
  Synthetic oligonucleotide; TTA chr11 5151959 5151980 5151964 5151959 -
tccactaagacatgccaacatc

SEQ ID NO: 156027 - DNA, 22 bp, Artificial Sequence
  Synthetic oligonucleotide; CTA chr11 5151952 5151973 5151957 5151952 -
agacatgccaacatcttcaccc

SEQ ID NO: 156028 - DNA, 22 bp, Artificial Sequence
  Synthetic oligonucleotide; CTT chr11 5151935 5151956 5151940 5151935 -
cacccaccagcttgtcattcag

SEQ ID NO: 156029 - DNA, 22 bp, Artificial Sequence
  Synthetic oligonucleotide; TTC chr11 5151934 5151955 5151939 5151934 -
acccaccagcttgtcattcaga

SEQ ID NO: 156030 - DNA, 22 bp, Artificial Sequence
  Synthetic oligonucleotide; CTT chr11 5151922 5151943 5151927 5151922 -
gtcattcagataggaactatgg

SEQ ID NO: 156031 - DNA, 22 bp, Artificial Sequence
  Synthetic oligonucleotide; TTG chr11 5151921 5151942 5151926 5151921 -
tcattcagataggaactatggt

SEQ ID NO: 156032 - DNA, 22 bp, Artificial Sequence
  Synthetic oligonucleotide; TTC chr11 5151915 5151936 5151920 5151915 -
agataggaactatggtcgtact

SEQ ID NO: 156033 - DNA, 22 bp, Artificial Sequence
  Synthetic oligonucleotide; CTA chr11 5151903 5151924 5151908 5151903 -
tggtcgtactcagggctgctat

SEQ ID NO: 156034 - DNA, 22 bp, Artificial Sequence
  Synthetic oligonucleotide; CTC chr11 5151892 5151913 5151897 5151892 -
agggctgctattcttgtagccc

SEQ ID NO: 156035 - DNA, 22 bp, Artificial Sequence
  Synthetic oligonucleotide; CTG chr11 5151885 5151906 5151890 5151885 -
ctattcttgtagccccatgcct

SEQ ID NO: 156036 - DNA, 22 bp, Artificial Sequence
  Synthetic oligonucleotide; CTA chr11 5151882 5151903 5151887 5151882 -
ttcttgtagccccatgcctagt

SEQ ID NO: 156037 - DNA, 22 bp, Artificial Sequence
  Synthetic oligonucleotide; TTC chr11 5151879 5151900 5151884 5151879 -
ttgtagccccatgcctagtact

SEQ ID NO: 156038 - DNA, 22 bp, Artificial Sequence
  Synthetic oligonucleotide; CTT chr11 5151877 5151898 5151882 5151877 -
gtagccccatgcctagtactga

SEQ ID NO: 156039 - DNA, 22 bp, Artificial Sequence
  Synthetic oligonucleotide; TTG chr11 5151876 5151897 5151881 5151876 -
tagccccatgcctagtactgat

SEQ ID NO: 156040 - DNA, 22 bp, Artificial Sequence
  Synthetic oligonucleotide; CTA chr11 5151862 5151883 5151867 5151862 -
gtactgataaagtgccggtttc

SEQ ID NO: 156041 - DNA, 22 bp, Artificial Sequence
  Synthetic oligonucleotide; CTG chr11 5151856 5151877 5151861 5151856 -
ataaagtgccggtttcaatttt

SEQ ID NO: 156042 - DNA, 22 bp, Artificial Sequence
  Synthetic oligonucleotide; TTT chr11 5151841 5151862 5151846 5151841 -
caattttatcacacaacagtca

SEQ ID NO: 156043 - DNA, 22 bp, Artificial Sequence
  Synthetic oligonucleotide; TTC chr11 5151840 5151861 5151845 5151840 -
aattttatcacacaacagtcat

SEQ ID NO: 156044 - DNA, 22 bp, Artificial Sequence
  Synthetic oligonucleotide; TTT chr11 5151835 5151856 5151840 5151835 -
tatcacacaacagtcatctccc

SEQ ID NO: 156045 - DNA, 22 bp, Artificial Sequence
  Synthetic oligonucleotide; TTT chr11 5151834 5151855 5151839 5151834 -
atcacacaacagtcatctccca

SEQ ID NO: 156046 - DNA, 22 bp, Artificial Sequence
  Synthetic oligonucleotide; TTA chr11 5151833 5151854 5151838 5151833 -
tcacacaacagtcatctcccac

SEQ ID NO: 156047 - DNA, 22 bp, Artificial Sequence
  Synthetic oligonucleotide; CTC chr11 5151815 5151836 5151820 5151815 -
ccactcctactgtgagcatatg

SEQ ID NO: 156048 - DNA, 22 bp, Artificial Sequence
  Synthetic oligonucleotide; CTC chr11 5151809 5151830 5151814 5151809 -
ctactgtgagcatatggccatt

SEQ ID NO: 156049 - DNA, 22 bp, Artificial Sequence
  Synthetic oligonucleotide; CTA chr11 5151806 5151827 5151811 5151806 -
ctgtgagcatatggccattgtg

SEQ ID NO: 156050 - DNA, 22 bp, Artificial Sequence
  Synthetic oligonucleotide; CTG chr11 5151803 5151824 5151808 5151803 -
tgagcatatggccattgtgaaa

SEQ ID NO: 156051 - DNA, 22 bp, Artificial Sequence
  Synthetic oligonucleotide; TTG chr11 5151786 5151807 5151791 5151786 -
tgaaactagcagcagcaaatgt

SEQ ID NO: 156052 - DNA, 22 bp, Artificial Sequence
  Synthetic oligonucleotide; CTA chr11 5151778 5151799 5151783 5151778 -
gcagcagcaaatgttcaagtca

SEQ ID NO: 156053 - DNA, 22 bp, Artificial Sequence
  Synthetic oligonucleotide; TTC chr11 5151762 5151783 5151767 5151762 -
aagtcaacaaaatctatggttt

SEQ ID NO: 156054 - DNA, 22 bp, Artificial Sequence
  Synthetic oligonucleotide; CTA chr11 5151746 5151767 5151751 5151746 -
tggtttgtttgtggccttcact

SEQ ID NO: 156055 - DNA, 22 bp, Artificial Sequence
  Synthetic oligonucleotide; TTT chr11 5151740 5151761 5151745 5151740 -
gtttgtggccttcactgtagca

SEQ ID NO: 156056 - DNA, 22 bp, Artificial Sequence
  Synthetic oligonucleotide; TTG chr11 5151739 5151760 5151744 5151739 -
tttgtggccttcactgtagcag

SEQ ID NO: 156057 - DNA, 22 bp, Artificial Sequence
  Synthetic oligonucleotide; TTT chr11 5151736 5151757 5151741 5151736 -
gtggccttcactgtagcaggat

SEQ ID NO: 156058 - DNA, 22 bp, Artificial Sequence
  Synthetic oligonucleotide; TTG chr11 5151735 5151756 5151740 5151735 -
tggccttcactgtagcaggatt

SEQ ID NO: 156059 - DNA, 22 bp, Artificial Sequence
  Synthetic oligonucleotide; CTT chr11 5151728 5151749 5151733 5151728 -
cactgtagcaggatttgacctc

SEQ ID NO: 156060 - DNA, 22 bp, Artificial Sequence
  Synthetic oligonucleotide; TTC chr11 5151727 5151748 5151732 5151727 -
actgtagcaggatttgacctca

SEQ ID NO: 156061 - DNA, 22 bp, Artificial Sequence
  Synthetic oligonucleotide; CTG chr11 5151723 5151744 5151728 5151723 -
tagcaggatttgacctcacatt

SEQ ID NO: 156062 - DNA, 22 bp, Artificial Sequence
  Synthetic oligonucleotide; TTT chr11 5151712 5151733 5151717 5151712 -
gacctcacattcatcacattgt

SEQ ID NO: 156063 - DNA, 22 bp, Artificial Sequence
  Synthetic oligonucleotide; TTG chr11 5151711 5151732 5151716 5151711 -
acctcacattcatcacattgtc

SEQ ID NO: 156064 - DNA, 22 bp, Artificial Sequence
  Synthetic oligonucleotide; CTC chr11 5151706 5151727 5151711 5151706 -
acattcatcacattgtcctaca

SEQ ID NO: 156065 - DNA, 22 bp, Artificial Sequence
  Synthetic oligonucleotide; TTC chr11 5151700 5151721 5151705 5151700 -
atcacattgtcctacatccaga

SEQ ID NO: 156066 - DNA, 22 bp, Artificial Sequence
  Synthetic oligonucleotide; TTG chr11 5151691 5151712 5151696 5151691 -
tcctacatccagatatttatca

SEQ ID NO: 156067 - DNA, 22 bp, Artificial Sequence
  Synthetic oligonucleotide; CTA chr11 5151686 5151707 5151691 5151686 -
catccagatatttatcacagtt

SEQ ID NO: 156068 - DNA, 22 bp, Artificial Sequence
  Synthetic oligonucleotide; TTT chr11 5151673 5151694 5151678 5151673 -
atcacagtttttcgtttgcccc

SEQ ID NO: 156069 - DNA, 22 bp, Artificial Sequence
  Synthetic oligonucleotide; TTA chr11 5151672 5151693 5151677 5151672 -
tcacagtttttcgtttgcccca

SEQ ID NO: 156070 - DNA, 22 bp, Artificial Sequence
  Synthetic oligonucleotide; TTT chr11 5151663 5151684 5151668 5151663 -
ttcgtttgccccagaaggaggc

SEQ ID NO: 156071 - DNA, 22 bp, Artificial Sequence
  Synthetic oligonucleotide; TTT chr11 5151662 5151683 5151667 5151662 -
tcgtttgccccagaaggaggct

SEQ ID NO: 156072 - DNA, 22 bp, Artificial Sequence
  Synthetic oligonucleotide; TTT chr11 5151661 5151682 5151666 5151661 -
cgtttgccccagaaggaggcta

SEQ ID NO: 156073 - DNA, 22 bp, Artificial Sequence
  Synthetic oligonucleotide; TTC chr11 5151660 5151681 5151665 5151660 -
gtttgccccagaaggaggctag

SEQ ID NO: 156074 - DNA, 22 bp, Artificial Sequence
  Synthetic oligonucleotide; TTT chr11 5151656 5151677 5151661 5151656 -
gccccagaaggaggctaggttt

SEQ ID NO: 156075 - DNA, 22 bp, Artificial Sequence
  Synthetic oligonucleotide; TTG chr11 5151655 5151676 5151660 5151655 -
ccccagaaggaggctaggttta

SEQ ID NO: 156076 - DNA, 22 bp, Artificial Sequence
  Synthetic oligonucleotide; CTA chr11 5151639 5151660 5151644 5151639 -
ggtttaaagcattcaatacctg

SEQ ID NO: 156077 - DNA, 22 bp, Artificial Sequence
  Synthetic oligonucleotide; TTT chr11 5151634 5151655 5151639 5151634 -
aaagcattcaatacctgcattg

SEQ ID NO: 156078 - DNA, 22 bp, Artificial Sequence
  Synthetic oligonucleotide; TTA chr11 5151633 5151654 5151638 5151633 -
aagcattcaatacctgcattgc

SEQ ID NO: 156079 - DNA, 22 bp, Artificial Sequence
  Synthetic oligonucleotide; TTC chr11 5151625 5151646 5151630 5151625 -
aatacctgcattgctcacatct

SEQ ID NO: 156080 - DNA, 22 bp, Artificial Sequence
  Synthetic oligonucleotide; CTG chr11 5151617 5151638 5151622 5151617 -
cattgctcacatctgtgtcttc

SEQ ID NO: 156081 - DNA, 22 bp, Artificial Sequence
  Synthetic oligonucleotide; TTG chr11 5151612 5151633 5151617 5151612 -
ctcacatctgtgtcttcctcca

SEQ ID NO: 156082 - DNA, 22 bp, Artificial Sequence
  Synthetic oligonucleotide; CTC chr11 5151609 5151630 5151614 5151609 -
acatctgtgtcttcctccagtt

SEQ ID NO: 156083 - DNA, 22 bp, Artificial Sequence
  Synthetic oligonucleotide; CTG chr11 5151602 5151623 5151607 5151602 -
tgtcttcctccagttctacctc

SEQ ID NO: 156084 - DNA, 22 bp, Artificial Sequence
  Synthetic oligonucleotide; CTT chr11 5151596 5151617 5151601 5151596 -
cctccagttctacctccttgcc

SEQ ID NO: 156085 - DNA, 22 bp, Artificial Sequence
  Synthetic oligonucleotide; TTC chr11 5151595 5151616 5151600 5151595 -
ctccagttctacctccttgcct

SEQ ID NO: 156086 - DNA, 22 bp, Artificial Sequence
  Synthetic oligonucleotide; CTC chr11 5151592 5151613 5151597 5151592 -
cagttctacctccttgccttct

SEQ ID NO: 156087 - DNA, 22 bp, Artificial Sequence
  Synthetic oligonucleotide; TTC chr11 5151586 5151607 5151591 5151586 -
tacctccttgccttcttctcct

SEQ ID NO: 156088 - DNA, 22 bp, Artificial Sequence
  Synthetic oligonucleotide; CTA chr11 5151584 5151605 5151589 5151584 -
cctccttgccttcttctccttc

SEQ ID NO: 156089 - DNA, 22 bp, Artificial Sequence
  Synthetic oligonucleotide; CTC chr11 5151580 5151601 5151585 5151580 -
cttgccttcttctccttcttca

SEQ ID NO: 156090 - DNA, 22 bp, Artificial Sequence
  Synthetic oligonucleotide; CTT chr11 5151577 5151598 5151582 5151577 -
gccttcttctccttcttcacac

SEQ ID NO: 156091 - DNA, 22 bp, Artificial Sequence
  Synthetic oligonucleotide; TTG chr11 5151576 5151597 5151581 5151576 -
ccttcttctccttcttcacaca

SEQ ID NO: 156092 - DNA, 22 bp, Artificial Sequence
  Synthetic oligonucleotide; CTT chr11 5151572 5151593 5151577 5151572 -
cttctccttcttcacacatagg

SEQ ID NO: 156093 - DNA, 22 bp, Artificial Sequence
  Synthetic oligonucleotide; TTC chr11 5151571 5151592 5151576 5151571 -
ttctccttcttcacacataggt

SEQ ID NO: 156094 - DNA, 22 bp, Artificial Sequence
  Synthetic oligonucleotide; CTT chr11 5151569 5151590 5151574 5151569 -
ctccttcttcacacataggttt

SEQ ID NO: 156095 - DNA, 22 bp, Artificial Sequence
  Synthetic oligonucleotide; TTC chr11 5151568 5151589 5151573 5151568 -
tccttcttcacacataggtttg

SEQ ID NO: 156096 - DNA, 22 bp, Artificial Sequence
  Synthetic oligonucleotide; CTC chr11 5151566 5151587 5151571 5151566 -
cttcttcacacataggtttggg

SEQ ID NO: 156097 - DNA, 22 bp, Artificial Sequence
  Synthetic oligonucleotide; CTT chr11 5151563 5151584 5151568 5151563 -
cttcacacataggtttgggtct

SEQ ID NO: 156098 - DNA, 22 bp, Artificial Sequence
  Synthetic oligonucleotide; TTC chr11 5151562 5151583 5151567 5151562 -
ttcacacataggtttgggtctc

SEQ ID NO: 156099 - DNA, 22 bp, Artificial Sequence
  Synthetic oligonucleotide; CTT chr11 5151560 5151581 5151565 5151560 -
cacacataggtttgggtctcac

SEQ ID NO: 156100 - DNA, 22 bp, Artificial Sequence
  Synthetic oligonucleotide; TTC chr11 5151559 5151580 5151564 5151559 -
acacataggtttgggtctcaca

SEQ ID NO: 156101 - DNA, 22 bp, Artificial Sequence
  Synthetic oligonucleotide; TTT chr11 5151547 5151568 5151552 5151547 -
gggtctcacatctccccttata

SEQ ID NO: 156102 - DNA, 22 bp, Artificial Sequence
  Synthetic oligonucleotide; TTG chr11 5151546 5151567 5151551 5151546 -
ggtctcacatctccccttatat

SEQ ID NO: 156103 - DNA, 22 bp, Artificial Sequence
  Synthetic oligonucleotide; CTC chr11 5151540 5151561 5151545 5151540 -
acatctccccttatatccatat

SEQ ID NO: 156104 - DNA, 22 bp, Artificial Sequence
  Synthetic oligonucleotide; CTC chr11 5151533 5151554 5151538 5151533 -
cccttatatccatattctcttt

SEQ ID NO: 156105 - DNA, 22 bp, Artificial Sequence
  Synthetic oligonucleotide; CTT chr11 5151528 5151549 5151533 5151528 -
atatccatattctcttttctag

SEQ ID NO: 156106 - DNA, 22 bp, Artificial Sequence
  Synthetic oligonucleotide; TTA chr11 5151527 5151548 5151532 5151527 -
tatccatattctcttttctagc

SEQ ID NO: 156107 - DNA, 22 bp, Artificial Sequence
  Synthetic oligonucleotide; TTC chr11 5151516 5151537 5151521 5151516 -
tcttttctagcatttacttgct

SEQ ID NO: 156108 - DNA, 22 bp, Artificial Sequence
  Synthetic oligonucleotide; CTC chr11 5151514 5151535 5151519 5151514 -
ttttctagcatttacttgctgg

SEQ ID NO: 156109 - DNA, 22 bp, Artificial Sequence
  Synthetic oligonucleotide; CTT chr11 5151512 5151533 5151517 5151512 -
ttctagcatttacttgctggtc

SEQ ID NO: 156110 - DNA, 22 bp, Artificial Sequence
  Synthetic oligonucleotide; TTT chr11 5151511 5151532 5151516 5151511 -
tctagcatttacttgctggtcc

SEQ ID NO: 156111 - DNA, 22 bp, Artificial Sequence
  Synthetic oligonucleotide; TTT chr11 5151510 5151531 5151515 5151510 -
ctagcatttacttgctggtccc

SEQ ID NO: 156112 - DNA, 22 bp, Artificial Sequence
  Synthetic oligonucleotide; TTC chr11 5151509 5151530 5151514 5151509 -
tagcatttacttgctggtccct

SEQ ID NO: 156113 - DNA, 22 bp, Artificial Sequence
  Synthetic oligonucleotide; CTA chr11 5151507 5151528 5151512 5151507 -
gcatttacttgctggtccctcc

SEQ ID NO: 156114 - DNA, 22 bp, Artificial Sequence
  Synthetic oligonucleotide; TTT chr11 5151501 5151522 5151506 5151501 -
acttgctggtccctccatttct

SEQ ID NO: 156115 - DNA, 22 bp, Artificial Sequence
  Synthetic oligonucleotide; TTA chr11 5151500 5151521 5151505 5151500 -
cttgctggtccctccatttctc

SEQ ID NO: 156116 - DNA, 22 bp, Artificial Sequence
  Synthetic oligonucleotide; CTT chr11 5151497 5151518 5151502 5151497 -
gctggtccctccatttctcaat

SEQ ID NO: 156117 - DNA, 22 bp, Artificial Sequence
  Synthetic oligonucleotide; TTG chr11 5151496 5151517 5151501 5151496 -
ctggtccctccatttctcaatc

SEQ ID NO: 156118 - DNA, 22 bp, Artificial Sequence
  Synthetic oligonucleotide; CTG chr11 5151493 5151514 5151498 5151493 -
gtccctccatttctcaatccac

SEQ ID NO: 156119 - DNA, 22 bp, Artificial Sequence
  Synthetic oligonucleotide; CTC chr11 5151486 5151507 5151491 5151486 -
catttctcaatccacttgtcta

SEQ ID NO: 156120 - DNA, 22 bp, Artificial Sequence
  Synthetic oligonucleotide; TTT chr11 5151481 5151502 5151486 5151481 -
ctcaatccacttgtctatggtg

SEQ ID NO: 156121 - DNA, 22 bp, Artificial Sequence
  Synthetic oligonucleotide; TTC chr11 5151480 5151501 5151485 5151480 -
tcaatccacttgtctatggtgc

SEQ ID NO: 156122 - DNA, 22 bp, Artificial Sequence
  Synthetic oligonucleotide; CTC chr11 5151478 5151499 5151483 5151478 -
aatccacttgtctatggtgcaa

SEQ ID NO: 156123 - DNA, 22 bp, Artificial Sequence
  Synthetic oligonucleotide; CTT chr11 5151469 5151490 5151474 5151469 -
gtctatggtgcaaagaccacac

SEQ ID NO: 156124 - DNA, 22 bp, Artificial Sequence
  Synthetic oligonucleotide; TTG chr11 5151468 5151489 5151473 5151468 -
tctatggtgcaaagaccacaca

SEQ ID NO: 156125 - DNA, 22 bp, Artificial Sequence
  Synthetic oligonucleotide; CTA chr11 5151464 5151485 5151469 5151464 -
tggtgcaaagaccacacagatt

SEQ ID NO: 156126 - DNA, 22 bp, Artificial Sequence
  Synthetic oligonucleotide; TTC chr11 5151441 5151462 5151446 5151441 -
gcattcatgtggtaaaaatgtt

SEQ ID NO: 156127 - DNA, 22 bp, Artificial Sequence
  Synthetic oligonucleotide; TTC chr11 5151435 5151456 5151440 5151435 -
atgtggtaaaaatgttctgttc

SEQ ID NO: 156128 - DNA, 22 bp, Artificial Sequence
  Synthetic oligonucleotide; TTC chr11 5151418 5151439 5151423 5151418 -
tgttcataaaatccaccttaat

SEQ ID NO: 156129 - DNA, 22 bp, Artificial Sequence
  Synthetic oligonucleotide; CTG chr11 5151416 5151437 5151421 5151416 -
ttcataaaatccaccttaatta

SEQ ID NO: 156130 - DNA, 22 bp, Artificial Sequence
  Synthetic oligonucleotide; TTC chr11 5151413 5151434 5151418 5151413 -
ataaaatccaccttaattaatg

SEQ ID NO: 156131 - DNA, 22 bp, Artificial Sequence
  Synthetic oligonucleotide; CTT chr11 5151399 5151420 5151404 5151399 -
aattaatgcctacatgcttttt

SEQ ID NO: 156132 - DNA, 22 bp, Artificial Sequence
  Synthetic oligonucleotide; TTA chr11 5151398 5151419 5151403 5151398 -
attaatgcctacatgctttttt

SEQ ID NO: 156133 - DNA, 22 bp, Artificial Sequence
  Synthetic oligonucleotide; TTA chr11 5151394 5151415 5151399 5151394 -
atgcctacatgcttttttcttt

SEQ ID NO: 156134 - DNA, 22 bp, Artificial Sequence
  Synthetic oligonucleotide; CTA chr11 5151387 5151408 5151392 5151387 -
catgcttttttcttttgcagta

SEQ ID NO: 156135 - DNA, 22 bp, Artificial Sequence
  Synthetic oligonucleotide; CTT chr11 5151380 5151401 5151385 5151380 -
ttttcttttgcagtagtaacca

SEQ ID NO: 156136 - DNA, 22 bp, Artificial Sequence
  Synthetic oligonucleotide; TTT chr11 5151379 5151400 5151384 5151379 -
tttcttttgcagtagtaaccat

SEQ ID NO: 156137 - DNA, 22 bp, Artificial Sequence
  Synthetic oligonucleotide; TTT chr11 5151378 5151399 5151383 5151378 -
ttcttttgcagtagtaaccata

SEQ ID NO: 156138 - DNA, 22 bp, Artificial Sequence
  Synthetic oligonucleotide; TTT chr11 5151377 5151398 5151382 5151377 -
tcttttgcagtagtaaccatat

SEQ ID NO: 156139 - DNA, 22 bp, Artificial Sequence
  Synthetic oligonucleotide; TTT chr11 5151376 5151397 5151381 5151376 -
cttttgcagtagtaaccatatc

SEQ ID NO: 156140 - DNA, 22 bp, Artificial Sequence
  Synthetic oligonucleotide; TTC chr11 5151375 5151396 5151380 5151375 -
ttttgcagtagtaaccatatca

SEQ ID NO: 156141 - DNA, 22 bp, Artificial Sequence
  Synthetic oligonucleotide; CTT chr11 5151373 5151394 5151378 5151373 -
ttgcagtagtaaccatatcaaa

SEQ ID NO: 156142 - DNA, 22 bp, Artificial Sequence
  Synthetic oligonucleotide; TTT chr11 5151372 5151393 5151377 5151372 -
tgcagtagtaaccatatcaaaa

SEQ ID NO: 156143 - DNA, 22 bp, Artificial Sequence
  Synthetic oligonucleotide; TTT chr11 5151371 5151392 5151376 5151371 -
gcagtagtaaccatatcaaaac

SEQ ID NO: 156144 - DNA, 22 bp, Artificial Sequence
  Synthetic oligonucleotide; TTG chr11 5151370 5151391 5151375 5151370 -
cagtagtaaccatatcaaaaca

SEQ ID NO: 156145 - DNA, 22 bp, Artificial Sequence
  Synthetic oligonucleotide; TTA chr11 5151331 5151352 5151336 5151331 -
tttgagatgctgggtttgtgaa

SEQ ID NO: 156146 - DNA, 22 bp, Artificial Sequence
  Synthetic oligonucleotide; TTT chr11 5151328 5151349 5151333 5151328 -
gagatgctgggtttgtgaaatc

SEQ ID NO: 156147 - DNA, 22 bp, Artificial Sequence
  Synthetic oligonucleotide; TTG chr11 5151327 5151348 5151332 5151327 -
agatgctgggtttgtgaaatct

SEQ ID NO: 156148 - DNA, 22 bp, Artificial Sequence
  Synthetic oligonucleotide; CTG chr11 5151319 5151340 5151324 5151319 -
ggtttgtgaaatctgccagcac

SEQ ID NO: 156149 - DNA, 22 bp, Artificial Sequence
  Synthetic oligonucleotide; TTT chr11 5151314 5151335 5151319 5151314 -
gtgaaatctgccagcacaatag

SEQ ID NO: 156150 - DNA, 22 bp, Artificial Sequence
  Synthetic oligonucleotide; TTG chr11 5151313 5151334 5151318 5151313 -
tgaaatctgccagcacaatagc

SEQ ID NO: 156151 - DNA, 22 bp, Artificial Sequence
  Synthetic oligonucleotide; CTG chr11 5151304 5151325 5151309 5151304 -
ccagcacaatagctggttttag

SEQ ID NO: 156152 - DNA, 22 bp, Artificial Sequence
  Synthetic oligonucleotide; CTG chr11 5151289 5151310 5151294 5151289 -
gttttagatcatcatggctcat

SEQ ID NO: 156153 - DNA, 22 bp, Artificial Sequence
  Synthetic oligonucleotide; TTT chr11 5151285 5151306 5151290 5151285 -
tagatcatcatggctcatatca

SEQ ID NO: 156154 - DNA, 22 bp, Artificial Sequence
  Synthetic oligonucleotide; TTT chr11 5151284 5151305 5151289 5151284 -
agatcatcatggctcatatcaa

SEQ ID NO: 156155 - DNA, 22 bp, Artificial Sequence
  Synthetic oligonucleotide; TTA chr11 5151283 5151304 5151288 5151283 -
gatcatcatggctcatatcaat

SEQ ID NO: 156156 - DNA, 22 bp, Artificial Sequence
  Synthetic oligonucleotide; CTC chr11 5151269 5151290 5151274 5151269 -
atatcaatcagtgggattgtga

SEQ ID NO: 156157 - DNA, 22 bp, Artificial Sequence
  Synthetic oligonucleotide; TTG chr11 5151250 5151271 5151255 5151250 -
tgaattctacgtgactaatgaa

SEQ ID NO: 156158 - DNA, 22 bp, Artificial Sequence
  Synthetic oligonucleotide; TTC chr11 5151243 5151264 5151248 5151243 -
tacgtgactaatgaaagtgaga

SEQ ID NO: 156159 - DNA, 22 bp, Artificial Sequence
  Synthetic oligonucleotide; CTA chr11 5151241 5151262 5151246 5151241 -
cgtgactaatgaaagtgagaag

SEQ ID NO: 156160 - DNA, 22 bp, Artificial Sequence
  Synthetic oligonucleotide; CTA chr11 5151233 5151254 5151238 5151233 -
atgaaagtgagaagtgtgaaat

SEQ ID NO: 156161 - DNA, 22 bp, Artificial Sequence
  Synthetic oligonucleotide; TTA chr11 5151187 5151208 5151192 5151187 -
ttttttctcttttattctttag

SEQ ID NO: 156162 - DNA, 22 bp, Artificial Sequence
  Synthetic oligonucleotide; TTT chr11 5151184 5151205 5151189 5151184 -
tttctcttttattctttagccc

SEQ ID NO: 156163 - DNA, 22 bp, Artificial Sequence
  Synthetic oligonucleotide; TTT chr11 5151183 5151204 5151188 5151183 -
ttctcttttattctttagcccc

SEQ ID NO: 156164 - DNA, 22 bp, Artificial Sequence
  Synthetic oligonucleotide; TTT chr11 5151182 5151203 5151187 5151182 -
tctcttttattctttagcccct

SEQ ID NO: 156165 - DNA, 22 bp, Artificial Sequence
  Synthetic oligonucleotide; TTT chr11 5151181 5151202 5151186 5151181 -
ctcttttattctttagcccctg

SEQ ID NO: 156166 - DNA, 22 bp, Artificial Sequence
  Synthetic oligonucleotide; TTC chr11 5151180 5151201 5151185 5151180 -
tcttttattctttagcccctgg

SEQ ID NO: 156167 - DNA, 22 bp, Artificial Sequence
  Synthetic oligonucleotide; CTC chr11 5151178 5151199 5151183 5151178 -
ttttattctttagcccctggtt

SEQ ID NO: 156168 - DNA, 22 bp, Artificial Sequence
  Synthetic oligonucleotide; CTT chr11 5151176 5151197 5151181 5151176 -
ttattctttagcccctggttga

SEQ ID NO: 156169 - DNA, 22 bp, Artificial Sequence
  Synthetic oligonucleotide; TTT chr11 5151175 5151196 5151180 5151175 -
tattctttagcccctggttgag

SEQ ID NO: 156170 - DNA, 22 bp, Artificial Sequence
  Synthetic oligonucleotide; TTT chr11 5151174 5151195 5151179 5151174 -
attctttagcccctggttgagt

SEQ ID NO: 156171 - DNA, 22 bp, Artificial Sequence
  Synthetic oligonucleotide; TTA chr11 5151173 5151194 5151178 5151173 -
ttctttagcccctggttgagtt

SEQ ID NO: 156172 - DNA, 22 bp, Artificial Sequence
  Synthetic oligonucleotide; TTC chr11 5151170 5151191 5151175 5151170 -
tttagcccctggttgagttatt

SEQ ID NO: 156173 - DNA, 22 bp, Artificial Sequence
  Synthetic oligonucleotide; CTT chr11 5151168 5151189 5151173 5151168 -
tagcccctggttgagttattct

SEQ ID NO: 156174 - DNA, 22 bp, Artificial Sequence
  Synthetic oligonucleotide; TTT chr11 5151167 5151188 5151172 5151167 -
agcccctggttgagttattctt

SEQ ID NO: 156175 - DNA, 22 bp, Artificial Sequence
  Synthetic oligonucleotide; TTA chr11 5151166 5151187 5151171 5151166 -
gcccctggttgagttattcttc

SEQ ID NO: 156176 - DNA, 22 bp, Artificial Sequence
  Synthetic oligonucleotide; CTG chr11 5151159 5151180 5151164 5151159 -
gttgagttattcttctaagaat

SEQ ID NO: 156177 - DNA, 22 bp, Artificial Sequence
  Synthetic oligonucleotide; TTG chr11 5151155 5151176 5151160 5151155 -
agttattcttctaagaatattt

SEQ ID NO: 156178 - DNA, 22 bp, Artificial Sequence
  Synthetic oligonucleotide; TTA chr11 5151150 5151171 5151155 5151150 -
ttcttctaagaatatttctcca

SEQ ID NO: 156179 - DNA, 22 bp, Artificial Sequence
  Synthetic oligonucleotide; TTC chr11 5151147 5151168 5151152 5151147 -
ttctaagaatatttctccagga

SEQ ID NO: 156180 - DNA, 22 bp, Artificial Sequence
  Synthetic oligonucleotide; CTT chr11 5151145 5151166 5151150 5151145 -
ctaagaatatttctccaggagg

SEQ ID NO: 156181 - DNA, 22 bp, Artificial Sequence
  Synthetic oligonucleotide; TTC chr11 5151144 5151165 5151149 5151144 -
taagaatatttctccaggagga

SEQ ID NO: 156182 - DNA, 22 bp, Artificial Sequence
  Synthetic oligonucleotide; CTA chr11 5151142 5151163 5151147 5151142 -
agaatatttctccaggaggatt

SEQ ID NO: 156183 - DNA, 22 bp, Artificial Sequence
  Synthetic oligonucleotide; TTT chr11 5151133 5151154 5151138 5151133 -
ctccaggaggatttataaatta

SEQ ID NO: 156184 - DNA, 22 bp, Artificial Sequence
  Synthetic oligonucleotide; TTC chr11 5151132 5151153 5151137 5151132 -
tccaggaggatttataaattat

SEQ ID NO: 156185 - DNA, 22 bp, Artificial Sequence
  Synthetic oligonucleotide; CTC chr11 5151130 5151151 5151135 5151130 -
caggaggatttataaattatgc

SEQ ID NO: 156186 - DNA, 22 bp, Artificial Sequence
  Synthetic oligonucleotide; TTT chr11 5151119 5151140 5151124 5151119 -
ataaattatgcctttgtcactg

SEQ ID NO: 156187 - DNA, 22 bp, Artificial Sequence
  Synthetic oligonucleotide; TTA chr11 5151118 5151139 5151123 5151118 -
taaattatgcctttgtcactga

SEQ ID NO: 156188 - DNA, 22 bp, Artificial Sequence
  Synthetic oligonucleotide; TTA chr11 5151111 5151132 5151116 5151111 -
tgcctttgtcactgaatttaaa

SEQ ID NO: 156189 - DNA, 22 bp, Artificial Sequence
  Synthetic oligonucleotide; CTT chr11 5151105 5151126 5151110 5151105 -
tgtcactgaatttaaatgcacc

SEQ ID NO: 156190 - DNA, 22 bp, Artificial Sequence
  Synthetic oligonucleotide; TTT chr11 5151104 5151125 5151109 5151104 -
gtcactgaatttaaatgcacct

SEQ ID NO: 156191 - DNA, 22 bp, Artificial Sequence
  Synthetic oligonucleotide; TTG chr11 5151103 5151124 5151108 5151103 -
tcactgaatttaaatgcaccta

SEQ ID NO: 156192 - DNA, 22 bp, Artificial Sequence
  Synthetic oligonucleotide; CTG chr11 5151097 5151118 5151102 5151097 -
aatttaaatgcacctaaggctc

SEQ ID NO: 156193 - DNA, 22 bp, Artificial Sequence
  Synthetic oligonucleotide; TTT chr11 5151092 5151113 5151097 5151092 -
aaatgcacctaaggctcgttgt

SEQ ID NO: 156194 - DNA, 22 bp, Artificial Sequence
  Synthetic oligonucleotide; TTA chr11 5151091 5151112 5151096 5151091 -
aatgcacctaaggctcgttgtt

SEQ ID NO: 156195 - DNA, 22 bp, Artificial Sequence
  Synthetic oligonucleotide; CTA chr11 5151081 5151102 5151086 5151081 -
aggctcgttgttctgaaacatc

SEQ ID NO: 156196 - DNA, 22 bp, Artificial Sequence
  Synthetic oligonucleotide; CTC chr11 5151075 5151096 5151080 5151075 -
gttgttctgaaacatccaggga

SEQ ID NO: 156197 - DNA, 22 bp, Artificial Sequence
  Synthetic oligonucleotide; TTG chr11 5151071 5151092 5151076 5151071 -
ttctgaaacatccagggactca

SEQ ID NO: 156198 - DNA, 22 bp, Artificial Sequence
  Synthetic oligonucleotide; TTC chr11 5151068 5151089 5151073 5151068 -
tgaaacatccagggactcaatg

SEQ ID NO: 156199 - DNA, 22 bp, Artificial Sequence
  Synthetic oligonucleotide; CTG chr11 5151066 5151087 5151071 5151066 -
aaacatccagggactcaatgaa

SEQ ID NO: 156200 - DNA, 22 bp, Artificial Sequence
  Synthetic oligonucleotide; CTC chr11 5151050 5151071 5151055 5151050 -
aatgaaaacaagttgttgactc

SEQ ID NO: 156201 - DNA, 22 bp, Artificial Sequence
  Synthetic oligonucleotide; TTG chr11 5151035 5151056 5151040 5151035 -
ttgactctcattttcttgatca

SEQ ID NO: 156202 - DNA, 22 bp, Artificial Sequence
  Synthetic oligonucleotide; TTG chr11 5151032 5151053 5151037 5151032 -
actctcattttcttgatcatcc

SEQ ID NO: 156203 - DNA, 22 bp, Artificial Sequence
  Synthetic oligonucleotide; CTC chr11 5151028 5151049 5151033 5151028 -
tcattttcttgatcatccctgc

SEQ ID NO: 156204 - DNA, 22 bp, Artificial Sequence
  Synthetic oligonucleotide; CTC chr11 5151026 5151047 5151031 5151026 -
attttcttgatcatccctgcct

SEQ ID NO: 156205 - DNA, 22 bp, Artificial Sequence
  Synthetic oligonucleotide; TTT chr11 5151022 5151043 5151027 5151022 -
tcttgatcatccctgccttaaa

SEQ ID NO: 156206 - DNA, 22 bp, Artificial Sequence
  Synthetic oligonucleotide; TTT chr11 5151021 5151042 5151026 5151021 -
cttgatcatccctgccttaaaa

SEQ ID NO: 156207 - DNA, 22 bp, Artificial Sequence
  Synthetic oligonucleotide; TTC chr11 5151020 5151041 5151025 5151020 -
ttgatcatccctgccttaaaaa

SEQ ID NO: 156208 - DNA, 22 bp, Artificial Sequence
  Synthetic oligonucleotide; CTT chr11 5151018 5151039 5151023 5151018 -
gatcatccctgccttaaaaaaa

SEQ ID NO: 156209 - DNA, 22 bp, Artificial Sequence
  Synthetic oligonucleotide; TTG chr11 5151017 5151038 5151022 5151017 -
atcatccctgccttaaaaaaaa

SEQ ID NO: 156210 - DNA, 22 bp, Artificial Sequence
  Synthetic oligonucleotide; CTG chr11 5151007 5151028 5151012 5151007 -
ccttaaaaaaaaaaatcaaagg

SEQ ID NO: 156211 - DNA, 22 bp, Artificial Sequence
  Synthetic oligonucleotide; CTT chr11 5151003 5151024 5151008 5151003 -
aaaaaaaaaaatcaaaggaagt

SEQ ID NO: 156212 - DNA, 22 bp, Artificial Sequence
  Synthetic oligonucleotide; TTA chr11 5151002 5151023 5151007 5151002 -
aaaaaaaaaatcaaaggaagta

SEQ ID NO: 156213 - DNA, 22 bp, Artificial Sequence
  Synthetic oligonucleotide; TTA chr11 5150973 5150994 5150978 5150973 -
actgtgttcttgtcaaagaaaa

SEQ ID NO: 156214 - DNA, 22 bp, Artificial Sequence
  Synthetic oligonucleotide; CTG chr11 5150969 5150990 5150974 5150969 -
tgttcttgtcaaagaaaatctt

SEQ ID NO: 156215 - DNA, 22 bp, Artificial Sequence
  Synthetic oligonucleotide; TTC chr11 5150964 5150985 5150969 5150964 -
ttgtcaaagaaaatcttatgaa

SEQ ID NO: 156216 - DNA, 22 bp, Artificial Sequence
  Synthetic oligonucleotide; CTT chr11 5150962 5150983 5150967 5150962 -
gtcaaagaaaatcttatgaata

SEQ ID NO: 156217 - DNA, 22 bp, Artificial Sequence
  Synthetic oligonucleotide; TTG chr11 5150961 5150982 5150966 5150961 -
tcaaagaaaatcttatgaatat

SEQ ID NO: 156218 - DNA, 22 bp, Artificial Sequence
  Synthetic oligonucleotide; CTT chr11 5150947 5150968 5150952 5150947 -
atgaatatcaagagacaataaa

SEQ ID NO: 156219 - DNA, 22 bp, Artificial Sequence
  Synthetic oligonucleotide; TTA chr11 5150946 5150967 5150951 5150946 -
tgaatatcaagagacaataaag

SEQ ID NO: 156220 - DNA, 22 bp, Artificial Sequence
  Synthetic oligonucleotide; CTA chr11 5150920 5150941 5150925 5150920 -
aaaatttaaatacattttcaga

SEQ ID NO: 156221 - DNA, 22 bp, Artificial Sequence
  Synthetic oligonucleotide; TTT chr11 5150913 5150934 5150918 5150913 -
aaatacattttcagagtcatac

SEQ ID NO: 156222 - DNA, 22 bp, Artificial Sequence
  Synthetic oligonucleotide; TTA chr11 5150912 5150933 5150917 5150912 -
aatacattttcagagtcataca

SEQ ID NO: 156223 - DNA, 22 bp, Artificial Sequence
  Synthetic oligonucleotide; TTT chr11 5150903 5150924 5150908 5150903 -
tcagagtcatacaaggaattac

SEQ ID NO: 156224 - DNA, 22 bp, Artificial Sequence
  Synthetic oligonucleotide; TTT chr11 5150902 5150923 5150907 5150902 -
cagagtcatacaaggaattaca

SEQ ID NO: 156225 - DNA, 22 bp, Artificial Sequence
  Synthetic oligonucleotide; TTC chr11 5150901 5150922 5150906 5150901 -
agagtcatacaaggaattacag

SEQ ID NO: 156226 - DNA, 22 bp, Artificial Sequence
  Synthetic oligonucleotide; TTA chr11 5150882 5150903 5150887 5150882 -
caggcacaaaaattagaaccag

SEQ ID NO: 156227 - DNA, 22 bp, Artificial Sequence
  Synthetic oligonucleotide; TTA chr11 5150867 5150888 5150872 5150867 -
gaaccaggtgttgcatttgaca

SEQ ID NO: 156228 - DNA, 22 bp, Artificial Sequence
  Synthetic oligonucleotide; TTG chr11 5150854 5150875 5150859 5150854 -
catttgacacatcaatgttgtt

SEQ ID NO: 156229 - DNA, 22 bp, Artificial Sequence
  Synthetic oligonucleotide; TTT chr11 5150849 5150870 5150854 5150849 -
gacacatcaatgttgttgtttt

SEQ ID NO: 156230 - DNA, 22 bp, Artificial Sequence
  Synthetic oligonucleotide; TTG chr11 5150848 5150869 5150853 5150848 -
acacatcaatgttgttgttttt

SEQ ID NO: 156231 - DNA, 22 bp, Artificial Sequence
  Synthetic oligonucleotide; TTG chr11 5150834 5150855 5150839 5150834 -
ttgtttttttttttgctaacct

SEQ ID NO: 156232 - DNA, 22 bp, Artificial Sequence
  Synthetic oligonucleotide; TTG chr11 5150831 5150852 5150836 5150831 -
tttttttttttgctaacctcaa

SEQ ID NO: 156233 - DNA, 22 bp, Artificial Sequence
  Synthetic oligonucleotide; TTT chr11 5150828 5150849 5150833 5150828 -
ttttttttgctaacctcaaaat

SEQ ID NO: 156234 - DNA, 22 bp, Artificial Sequence
  Synthetic oligonucleotide; TTT chr11 5150827 5150848 5150832 5150827 -
tttttttgctaacctcaaaatt

SEQ ID NO: 156235 - DNA, 22 bp, Artificial Sequence
  Synthetic oligonucleotide; TTT chr11 5150826 5150847 5150831 5150826 -
ttttttgctaacctcaaaattt

SEQ ID NO: 156236 - DNA, 22 bp, Artificial Sequence
  Synthetic oligonucleotide; TTT chr11 5150825 5150846 5150830 5150825 -
tttttgctaacctcaaaattta

SEQ ID NO: 156237 - DNA, 22 bp, Artificial Sequence
  Synthetic oligonucleotide; TTT chr11 5150824 5150845 5150829 5150824 -
ttttgctaacctcaaaatttac

SEQ ID NO: 156238 - DNA, 22 bp, Artificial Sequence
  Synthetic oligonucleotide; TTT chr11 5150823 5150844 5150828 5150823 -
tttgctaacctcaaaatttact

SEQ ID NO: 156239 - DNA, 22 bp, Artificial Sequence
  Synthetic oligonucleotide; TTT chr11 5150822 5150843 5150827 5150822 -
ttgctaacctcaaaatttactt

SEQ ID NO: 156240 - DNA, 22 bp, Artificial Sequence
  Synthetic oligonucleotide; TTT chr11 5150821 5150842 5150826 5150821 -
tgctaacctcaaaatttacttc

SEQ ID NO: 156241 - DNA, 22 bp, Artificial Sequence
  Synthetic oligonucleotide; TTT chr11 5150820 5150841 5150825 5150820 -
gctaacctcaaaatttacttct

SEQ ID NO: 156242 - DNA, 22 bp, Artificial Sequence
  Synthetic oligonucleotide; TTG chr11 5150819 5150840 5150824 5150819 -
ctaacctcaaaatttacttctt

SEQ ID NO: 156243 - DNA, 22 bp, Artificial Sequence
  Synthetic oligonucleotide; CTA chr11 5150816 5150837 5150821 5150816 -
acctcaaaatttacttctttat

SEQ ID NO: 156244 - DNA, 22 bp, Artificial Sequence
  Synthetic oligonucleotide; CTC chr11 5150811 5150832 5150816 5150811 -
aaaatttacttctttattaatt

SEQ ID NO: 156245 - DNA, 22 bp, Artificial Sequence
  Synthetic oligonucleotide; TTT chr11 5150804 5150825 5150809 5150804 -
acttctttattaattcatcatt

SEQ ID NO: 156246 - DNA, 22 bp, Artificial Sequence
  Synthetic oligonucleotide; TTA chr11 5150803 5150824 5150808 5150803 -
cttctttattaattcatcattt

SEQ ID NO: 156247 - DNA, 22 bp, Artificial Sequence
  Synthetic oligonucleotide; CTT chr11 5150800 5150821 5150805 5150800 -
ctttattaattcatcattttat

SEQ ID NO: 156248 - DNA, 22 bp, Artificial Sequence
  Synthetic oligonucleotide; TTC chr11 5150799 5150820 5150804 5150799 -
tttattaattcatcattttatc

SEQ ID NO: 156249 - DNA, 22 bp, Artificial Sequence
  Synthetic oligonucleotide; CTT chr11 5150797 5150818 5150802 5150797 -
tattaattcatcattttatcaa

SEQ ID NO: 156250 - DNA, 22 bp, Artificial Sequence
  Synthetic oligonucleotide; TTT chr11 5150796 5150817 5150801 5150796 -
attaattcatcattttatcaaa

SEQ ID NO: 156251 - DNA, 22 bp, Artificial Sequence
  Synthetic oligonucleotide; TTA chr11 5150795 5150816 5150800 5150795 -
ttaattcatcattttatcaaaa

SEQ ID NO: 156252 - DNA, 22 bp, Artificial Sequence
  Synthetic oligonucleotide; TTA chr11 5150792 5150813 5150797 5150792 -
attcatcattttatcaaaaacc

SEQ ID NO: 156253 - DNA, 22 bp, Artificial Sequence
  Synthetic oligonucleotide; TTC chr11 5150788 5150809 5150793 5150788 -
atcattttatcaaaaacctgca

SEQ ID NO: 156254 - DNA, 22 bp, Artificial Sequence
  Synthetic oligonucleotide; TTT chr11 5150781 5150802 5150786 5150781 -
tatcaaaaacctgcaatattaa

SEQ ID NO: 156255 - DNA, 22 bp, Artificial Sequence
  Synthetic oligonucleotide; TTT chr11 5150780 5150801 5150785 5150780 -
atcaaaaacctgcaatattaaa

SEQ ID NO: 156256 - DNA, 22 bp, Artificial Sequence
  Synthetic oligonucleotide; TTA chr11 5150779 5150800 5150784 5150779 -
tcaaaaacctgcaatattaaaa

SEQ ID NO: 156257 - DNA, 22 bp, Artificial Sequence
  Synthetic oligonucleotide; CTG chr11 5150768 5150789 5150773 5150768 -
caatattaaaaatactatacta

SEQ ID NO: 156258 - DNA, 22 bp, Artificial Sequence
  Synthetic oligonucleotide; TTA chr11 5150760 5150781 5150765 5150760 -
aaaatactatactacagaatcg

SEQ ID NO: 156259 - DNA, 22 bp, Artificial Sequence
  Synthetic oligonucleotide; CTA chr11 5150751 5150772 5150756 5150751 -
tactacagaatcgtgacataat

SEQ ID NO: 156260 - DNA, 22 bp, Artificial Sequence
  Synthetic oligonucleotide; CTA chr11 5150746 5150767 5150751 5150746 -
cagaatcgtgacataatagtaa

SEQ ID NO: 156261 - DNA, 22 bp, Artificial Sequence
  Synthetic oligonucleotide; CTG chr11 5150719 5150740 5150724 5150719 -
gcacagtgaataattctcatga

SEQ ID NO: 156262 - DNA, 22 bp, Artificial Sequence
  Synthetic oligonucleotide; TTC chr11 5150703 5150724 5150708 5150703 -
tcatgagtttgtacctatgtaa

SEQ ID NO: 156263 - DNA, 22 bp, Artificial Sequence
  Synthetic oligonucleotide; CTC chr11 5150701 5150722 5150706 5150701 -
atgagtttgtacctatgtaatt

SEQ ID NO: 156264 - DNA, 22 bp, Artificial Sequence
  Synthetic oligonucleotide; TTT chr11 5150693 5150714 5150698 5150693 -
gtacctatgtaattctggaaaa

SEQ ID NO: 156265 - DNA, 22 bp, Artificial Sequence
  Synthetic oligonucleotide; TTG chr11 5150692 5150713 5150697 5150692 -
tacctatgtaattctggaaaag

SEQ ID NO: 156266 - DNA, 22 bp, Artificial Sequence
  Synthetic oligonucleotide; CTA chr11 5150686 5150707 5150691 5150686 -
tgtaattctggaaaagagagac

SEQ ID NO: 156267 - DNA, 22 bp, Artificial Sequence
  Synthetic oligonucleotide; TTC chr11 5150678 5150699 5150683 5150678 -
tggaaaagagagactgaaagga

SEQ ID NO: 156268 - DNA, 22 bp, Artificial Sequence
  Synthetic oligonucleotide; CTG chr11 5150676 5150697 5150681 5150676 -
gaaaagagagactgaaaggaag

SEQ ID NO: 156269 - DNA, 22 bp, Artificial Sequence
  Synthetic oligonucleotide; CTG chr11 5150662 5150683 5150667 5150662 -
aaaggaagagaggtggggaatg

SEQ ID NO: 156270 - DNA, 22 bp, Artificial Sequence
  Synthetic oligonucleotide; TTC chr11 5150584 5150605 5150589 5150584 -
agagagaatgaagcattgaaat

SEQ ID NO: 156271 - DNA, 22 bp, Artificial Sequence
  Synthetic oligonucleotide; TTG chr11 5150566 5150587 5150571 5150566 -
aaatctaaccaaagcaggggag

SEQ ID NO: 156272 - DNA, 22 bp, Artificial Sequence
  Synthetic oligonucleotide; CTA chr11 5150559 5150580 5150564 5150559 -
accaaagcaggggagttgcatt

SEQ ID NO: 156273 - DNA, 22 bp, Artificial Sequence
  Synthetic oligonucleotide; TTG chr11 5150541 5150562 5150546 5150541 -
catttattgtattttgtttttt

SEQ ID NO: 156274 - DNA, 22 bp, Artificial Sequence
  Synthetic oligonucleotide; TTT chr11 5150536 5150557 5150541 5150536 -
attgtattttgttttttggtta

SEQ ID NO: 156275 - DNA, 22 bp, Artificial Sequence
  Synthetic oligonucleotide; TTA chr11 5150535 5150556 5150540 5150535 -
ttgtattttgttttttggttag

SEQ ID NO: 156276 - DNA, 22 bp, Artificial Sequence
  Synthetic oligonucleotide; TTG chr11 5150532 5150553 5150537 5150532 -
tattttgttttttggttaggta

SEQ ID NO: 156277 - DNA, 22 bp, Artificial Sequence
  Synthetic oligonucleotide; TTT chr11 5150527 5150548 5150532 5150527 -
tgttttttggttaggtagttac

SEQ ID NO: 156278 - DNA, 22 bp, Artificial Sequence
  Synthetic oligonucleotide; TTT chr11 5150526 5150547 5150531 5150526 -
gttttttggttaggtagttacc

SEQ ID NO: 156279 - DNA, 22 bp, Artificial Sequence
  Synthetic oligonucleotide; TTG chr11 5150525 5150546 5150530 5150525 -
ttttttggttaggtagttacct

SEQ ID NO: 156280 - DNA, 22 bp, Artificial Sequence
  Synthetic oligonucleotide; TTT chr11 5150522 5150543 5150527 5150522 -
tttggttaggtagttacctctg

SEQ ID NO: 156281 - DNA, 22 bp, Artificial Sequence
  Synthetic oligonucleotide; TTT chr11 5150521 5150542 5150526 5150521 -
ttggttaggtagttacctctga

SEQ ID NO: 156282 - DNA, 22 bp, Artificial Sequence
  Synthetic oligonucleotide; TTT chr11 5150520 5150541 5150525 5150520 -
tggttaggtagttacctctgat

SEQ ID NO: 156283 - DNA, 22 bp, Artificial Sequence
  Synthetic oligonucleotide; TTT chr11 5150519 5150540 5150524 5150519 -
ggttaggtagttacctctgatt

SEQ ID NO: 156284 - DNA, 22 bp, Artificial Sequence
  Synthetic oligonucleotide; TTG chr11 5150518 5150539 5150523 5150518 -
gttaggtagttacctctgattc

SEQ ID NO: 156285 - DNA, 22 bp, Artificial Sequence
  Synthetic oligonucleotide; TTA chr11 5150514 5150535 5150519 5150514 -
ggtagttacctctgattcttga

SEQ ID NO: 156286 - DNA, 22 bp, Artificial Sequence
  Synthetic oligonucleotide; TTA chr11 5150506 5150527 5150511 5150506 -
cctctgattcttgaggaatgat

SEQ ID NO: 156287 - DNA, 22 bp, Artificial Sequence
  Synthetic oligonucleotide; CTC chr11 5150502 5150523 5150507 5150502 -
tgattcttgaggaatgatggat

SEQ ID NO: 156288 - DNA, 22 bp, Artificial Sequence
  Synthetic oligonucleotide; CTG chr11 5150500 5150521 5150505 5150500 -
attcttgaggaatgatggatga

SEQ ID NO: 156289 - DNA, 22 bp, Artificial Sequence
  Synthetic oligonucleotide; TTC chr11 5150496 5150517 5150501 5150496 -
ttgaggaatgatggatgagtag

SEQ ID NO: 156290 - DNA, 22 bp, Artificial Sequence
  Synthetic oligonucleotide; CTT chr11 5150494 5150515 5150499 5150494 -
gaggaatgatggatgagtagcc

SEQ ID NO: 156291 - DNA, 22 bp, Artificial Sequence
  Synthetic oligonucleotide; TTG chr11 5150493 5150514 5150498 5150493 -
aggaatgatggatgagtagcca

SEQ ID NO: 156292 - DNA, 22 bp, Artificial Sequence
  Synthetic oligonucleotide; TTT chr11 5150426 5150447 5150431 5150426 -
aaactagataatgtagtttaag

SEQ ID NO: 156293 - DNA, 22 bp, Artificial Sequence
  Synthetic oligonucleotide; TTA chr11 5150425 5150446 5150430 5150425 -
aactagataatgtagtttaagg

SEQ ID NO: 156294 - DNA, 22 bp, Artificial Sequence
  Synthetic oligonucleotide; CTA chr11 5150420 5150441 5150425 5150420 -
gataatgtagtttaaggtaact

SEQ ID NO: 156295 - DNA, 22 bp, Artificial Sequence
  Synthetic oligonucleotide; TTT chr11 5150407 5150428 5150412 5150407 -
aaggtaactctagttttttcaa

SEQ ID NO: 156296 - DNA, 22 bp, Artificial Sequence
  Synthetic oligonucleotide; TTA chr11 5150406 5150427 5150411 5150406 -
aggtaactctagttttttcaat

SEQ ID NO: 156297 - DNA, 22 bp, Artificial Sequence
  Synthetic oligonucleotide; CTC chr11 5150397 5150418 5150402 5150397 -
tagttttttcaatatggtatga

SEQ ID NO: 156298 - DNA, 22 bp, Artificial Sequence
  Synthetic oligonucleotide; CTA chr11 5150395 5150416 5150400 5150395 -
gttttttcaatatggtatgagt

SEQ ID NO: 156299 - DNA, 22 bp, Artificial Sequence
  Synthetic oligonucleotide; TTT chr11 5150391 5150412 5150396 5150391 -
tttcaatatggtatgagtgcaa

SEQ ID NO: 156300 - DNA, 22 bp, Artificial Sequence
  Synthetic oligonucleotide; TTT chr11 5150390 5150411 5150395 5150390 -
ttcaatatggtatgagtgcaag

SEQ ID NO: 156301 - DNA, 22 bp, Artificial Sequence
  Synthetic oligonucleotide; TTT chr11 5150389 5150410 5150394 5150389 -
tcaatatggtatgagtgcaagg

SEQ ID NO: 156302 - DNA, 22 bp, Artificial Sequence
  Synthetic oligonucleotide; TTT chr11 5150388 5150409 5150393 5150388 -
caatatggtatgagtgcaaggt

SEQ ID NO: 156303 - DNA, 22 bp, Artificial Sequence
  Synthetic oligonucleotide; TTC chr11 5150387 5150408 5150392 5150387 -
aatatggtatgagtgcaaggta

SEQ ID NO: 156304 - DNA, 22 bp, Artificial Sequence
  Synthetic oligonucleotide; CTT chr11 5150359 5150380 5150364 5150359 -
ggggagacaaggaaaatatgaa

SEQ ID NO: 156305 - DNA, 22 bp, Artificial Sequence
  Synthetic oligonucleotide; TTG chr11 5150358 5150379 5150363 5150358 -
gggagacaaggaaaatatgaat

SEQ ID NO: 156306 - DNA, 22 bp, Artificial Sequence
  Synthetic oligonucleotide; CTA chr11 5150322 5150343 5150327 5150322 -
ttaatgttgtgcagagttgctg

SEQ ID NO: 156307 - DNA, 22 bp, Artificial Sequence
  Synthetic oligonucleotide; TTA chr11 5150319 5150340 5150324 5150319 -
atgttgtgcagagttgctggac

SEQ ID NO: 156308 - DNA, 22 bp, Artificial Sequence
  Synthetic oligonucleotide; TTG chr11 5150313 5150334 5150318 5150313 -
tgcagagttgctggactttatt

SEQ ID NO: 156309 - DNA, 22 bp, Artificial Sequence
  Synthetic oligonucleotide; TTG chr11 5150303 5150324 5150308 5150303 -
ctggactttattccaaaagcta

SEQ ID NO: 156310 - DNA, 22 bp, Artificial Sequence
  Synthetic oligonucleotide; CTG chr11 5150300 5150321 5150305 5150300 -
gactttattccaaaagctataa

SEQ ID NO: 156311 - DNA, 22 bp, Artificial Sequence
  Synthetic oligonucleotide; CTT chr11 5150295 5150316 5150300 5150295 -
tattccaaaagctataatgtgc

SEQ ID NO: 156312 - DNA, 22 bp, Artificial Sequence
  Synthetic oligonucleotide; TTT chr11 5150294 5150315 5150299 5150294 -
attccaaaagctataatgtgcc

SEQ ID NO: 156313 - DNA, 22 bp, Artificial Sequence
  Synthetic oligonucleotide; TTA chr11 5150293 5150314 5150298 5150293 -
ttccaaaagctataatgtgcca

SEQ ID NO: 156314 - DNA, 22 bp, Artificial Sequence
  Synthetic oligonucleotide; TTC chr11 5150290 5150311 5150295 5150290 -
caaaagctataatgtgccattg

SEQ ID NO: 156315 - DNA, 22 bp, Artificial Sequence
  Synthetic oligonucleotide; CTA chr11 5150281 5150302 5150286 5150281 -
taatgtgccattggagagtatt

SEQ ID NO: 156316 - DNA, 22 bp, Artificial Sequence
  Synthetic oligonucleotide; TTG chr11 5150268 5150289 5150273 5150268 -
gagagtattcatttgtttgctt

SEQ ID NO: 156317 - DNA, 22 bp, Artificial Sequence
  Synthetic oligonucleotide; TTC chr11 5150258 5150279 5150263 5150258 -
atttgtttgcttgtgttctaca

SEQ ID NO: 156318 - DNA, 22 bp, Artificial Sequence
  Synthetic oligonucleotide; TTT chr11 5150254 5150275 5150259 5150254 -
gtttgcttgtgttctacaagta

SEQ ID NO: 156319 - DNA, 22 bp, Artificial Sequence
  Synthetic oligonucleotide; TTG chr11 5150253 5150274 5150258 5150253 -
tttgcttgtgttctacaagtaa

SEQ ID NO: 156320 - DNA, 22 bp, Artificial Sequence
  Synthetic oligonucleotide; TTT chr11 5150250 5150271 5150255 5150250 -
gcttgtgttctacaagtaagac

SEQ ID NO: 156321 - DNA, 22 bp, Artificial Sequence
  Synthetic oligonucleotide; TTG chr11 5150249 5150270 5150254 5150249 -
cttgtgttctacaagtaagacg

SEQ ID NO: 156322 - DNA, 22 bp, Artificial Sequence
  Synthetic oligonucleotide; CTT chr11 5150246 5150267 5150251 5150246 -
gtgttctacaagtaagacgtgt

SEQ ID NO: 156323 - DNA, 22 bp, Artificial Sequence
  Synthetic oligonucleotide; TTG chr11 5150245 5150266 5150250 5150245 -
tgttctacaagtaagacgtgtg

SEQ ID NO: 156324 - DNA, 22 bp, Artificial Sequence
  Synthetic oligonucleotide; TTC chr11 5150240 5150261 5150245 5150240 -
tacaagtaagacgtgtgtgtgt

SEQ ID NO: 156325 - DNA, 22 bp, Artificial Sequence
  Synthetic oligonucleotide; CTA chr11 5150238 5150259 5150243 5150238 -
caagtaagacgtgtgtgtgtgt

SEQ ID NO: 156326 - DNA, 22 bp, Artificial Sequence
  Synthetic oligonucleotide; CTG chr11 5150189 5150210 5150194 5150189 -
cttgggcatgtggcagcatacc

SEQ ID NO: 156327 - DNA, 22 bp, Artificial Sequence
  Synthetic oligonucleotide; CTT chr11 5150186 5150207 5150191 5150186 -
gggcatgtggcagcataccaca

SEQ ID NO: 156328 - DNA, 22 bp, Artificial Sequence
  Synthetic oligonucleotide; TTG chr11 5150185 5150206 5150190 5150185 -
ggcatgtggcagcataccacac

SEQ ID NO: 156329 - DNA, 22 bp, Artificial Sequence
  Synthetic oligonucleotide; CTA chr11 5150143 5150164 5150148 5150143 -
gggctattgtgttagtgaagag

SEQ ID NO: 156330 - DNA, 22 bp, Artificial Sequence
  Synthetic oligonucleotide; CTA chr11 5150137 5150158 5150142 5150137 -
ttgtgttagtgaagaggaggac

SEQ ID NO: 156331 - DNA, 22 bp, Artificial Sequence
  Synthetic oligonucleotide; TTG chr11 5150134 5150155 5150139 5150134 -
tgttagtgaagaggaggactat

SEQ ID NO: 156332 - DNA, 22 bp, Artificial Sequence
  Synthetic oligonucleotide; TTA chr11 5150129 5150150 5150134 5150129 -
gtgaagaggaggactatattgt

SEQ ID NO: 156333 - DNA, 22 bp, Artificial Sequence
  Synthetic oligonucleotide; CTA chr11 5150113 5150134 5150118 5150113 -
tattgtctaaaattagtggcat

SEQ ID NO: 156334 - DNA, 22 bp, Artificial Sequence
  Synthetic oligonucleotide; TTG chr11 5150108 5150129 5150113 5150108 -
tctaaaattagtggcataagaa

SEQ ID NO: 156335 - DNA, 22 bp, Artificial Sequence
  Synthetic oligonucleotide; CTA chr11 5150104 5150125 5150109 5150104 -
aaattagtggcataagaattta

SEQ ID NO: 156336 - DNA, 22 bp, Artificial Sequence
  Synthetic oligonucleotide; TTA chr11 5150098 5150119 5150103 5150098 -
gtggcataagaatttacggcta

SEQ ID NO: 156337 - DNA, 22 bp, Artificial Sequence
  Synthetic oligonucleotide; TTT chr11 5150083 5150104 5150088 5150083 -
acggctagtcaattgttcttga

SEQ ID NO: 156338 - DNA, 22 bp, Artificial Sequence
  Synthetic oligonucleotide; TTA chr11 5150082 5150103 5150087 5150082 -
cggctagtcaattgttcttgaa

SEQ ID NO: 156339 - DNA, 22 bp, Artificial Sequence
  Synthetic oligonucleotide; CTA chr11 5150076 5150097 5150081 5150076 -
gtcaattgttcttgaaaaacct

SEQ ID NO: 156340 - DNA, 22 bp, Artificial Sequence
  Synthetic oligonucleotide; TTG chr11 5150068 5150089 5150073 5150068 -
ttcttgaaaaacctcaggtcat

SEQ ID NO: 156341 - DNA, 22 bp, Artificial Sequence
  Synthetic oligonucleotide; TTC chr11 5150065 5150086 5150070 5150065 -
ttgaaaaacctcaggtcataga

SEQ ID NO: 156342 - DNA, 22 bp, Artificial Sequence
  Synthetic oligonucleotide; CTT chr11 5150063 5150084 5150068 5150063 -
gaaaaacctcaggtcatagatc

SEQ ID NO: 156343 - DNA, 22 bp, Artificial Sequence
  Synthetic oligonucleotide; TTG chr11 5150062 5150083 5150067 5150062 -
aaaaacctcaggtcatagatca

SEQ ID NO: 156344 - DNA, 22 bp, Artificial Sequence
  Synthetic oligonucleotide; CTC chr11 5150053 5150074 5150058 5150053 -
aggtcatagatcatttttttca

SEQ ID NO: 156345 - DNA, 22 bp, Artificial Sequence
  Synthetic oligonucleotide; TTT chr11 5150037 5150058 5150042 5150037 -
ttttcaaggttatggaaaatat

SEQ ID NO: 156346 - DNA, 22 bp, Artificial Sequence
  Synthetic oligonucleotide; TTT chr11 5150036 5150057 5150041 5150036 -
tttcaaggttatggaaaatatt

SEQ ID NO: 156347 - DNA, 22 bp, Artificial Sequence
  Synthetic oligonucleotide; TTT chr11 5150035 5150056 5150040 5150035 -
ttcaaggttatggaaaatattc

SEQ ID NO: 156348 - DNA, 22 bp, Artificial Sequence
  Synthetic oligonucleotide; TTT chr11 5150034 5150055 5150039 5150034 -
tcaaggttatggaaaatattca

SEQ ID NO: 156349 - DNA, 22 bp, Artificial Sequence
  Synthetic oligonucleotide; TTT chr11 5150033 5150054 5150038 5150033 -
caaggttatggaaaatattcac

SEQ ID NO: 156350 - DNA, 22 bp, Artificial Sequence
  Synthetic oligonucleotide; TTC chr11 5150032 5150053 5150037 5150032 -
aaggttatggaaaatattcaca

SEQ ID NO: 156351 - DNA, 22 bp, Artificial Sequence
  Synthetic oligonucleotide; TTA chr11 5150025 5150046 5150030 5150025 -
tggaaaatattcacatatgggc

SEQ ID NO: 156352 - DNA, 22 bp, Artificial Sequence
  Synthetic oligonucleotide; TTC chr11 5150013 5150034 5150018 5150013 -
acatatgggcagatgtccatac

SEQ ID NO: 156353 - DNA, 20 bp, Artificial Sequence
  Synthetic oligonucleotide; TAG chr2 60448190 60448209 60448206 +
tttttttcacactgtgatct

SEQ ID NO: 156354 - DNA, 20 bp, Artificial Sequence
  Synthetic oligonucleotide; AGG chr2 60448191 60448210 60448207 +
ttttttcacactgtgatctt

SEQ ID NO: 156355 - DNA, 20 bp, Artificial Sequence
  Synthetic oligonucleotide; TGG chr2 60448210 60448229 60448226 +
taggtacttcacttaatctt

SEQ ID NO: 156356 - DNA, 20 bp, Artificial Sequence
  Synthetic oligonucleotide; GGG chr2 60448211 60448230 60448227 +
aggtacttcacttaatcttt

SEQ ID NO: 156357 - DNA, 20 bp, Artificial Sequence
  Synthetic oligonucleotide; GAG chr2 60448239 60448258 60448255 +
attattctgatctctaaaat

SEQ ID NO: 156358 - DNA, 20 bp, Artificial Sequence
  Synthetic oligonucleotide; TAG chr2 60448249 60448268 60448265 +
tctctaaaatgagtgattac

SEQ ID NO: 156359 - DNA, 20 bp, Artificial Sequence
  Synthetic oligonucleotide; AGG chr2 60448250 60448269 60448266 +
ctctaaaatgagtgattact

SEQ ID NO: 156360 - DNA, 20 bp, Artificial Sequence
  Synthetic oligonucleotide; CAG chr2 60448267 60448286 60448283 +
actaggattcctttcaactt

SEQ ID NO: 156361 - DNA, 20 bp, Artificial Sequence
  Synthetic oligonucleotide; TAG chr2 60448294 60448313 60448310 +
ttcttttcttatctaattta

SEQ ID NO: 156362 - DNA, 20 bp, Artificial Sequence
  Synthetic oligonucleotide; AAG chr2 60448303 60448322 60448319 +
tatctaatttatagaatcac

SEQ ID NO: 156363 - DNA, 20 bp, Artificial Sequence
  Synthetic oligonucleotide; AGG chr2 60448304 60448323 60448320 +
atctaatttatagaatcaca

SEQ ID NO: 156364 - DNA, 20 bp, Artificial Sequence
  Synthetic oligonucleotide; AAG chr2 60448332 60448351 60448348 +
tgattctatcatgtatataa

SEQ ID NO: 156365 - DNA, 20 bp, Artificial Sequence
  Synthetic oligonucleotide; AAG chr2 60448344 60448363 60448360 +
gtatataaaagtattctata

SEQ ID NO: 156366 - DNA, 20 bp, Artificial Sequence
  Synthetic oligonucleotide; AAG chr2 60448350 60448369 60448366 +
aaaagtattctataaagctt

SEQ ID NO: 156367 - DNA, 20 bp, Artificial Sequence
  Synthetic oligonucleotide; TGG chr2 60448360 60448379 60448376 +
tataaagcttaagtacttcc

SEQ ID NO: 156368 - DNA, 20 bp, Artificial Sequence
  Synthetic oligonucleotide; GGG chr2 60448361 60448380 60448377 +
ataaagcttaagtacttcct

SEQ ID NO: 156369 - DNA, 20 bp, Artificial Sequence
  Synthetic oligonucleotide; GAG chr2 60448363 60448382 60448379 +
aaagcttaagtacttcctgg

SEQ ID NO: 156370 - DNA, 20 bp, Artificial Sequence
  Synthetic oligonucleotide; AAG chr2 60448382 60448401 60448398 +
ggagcattttttaaaataca

SEQ ID NO: 156371 - DNA, 20 bp, Artificial Sequence
  Synthetic oligonucleotide; AAG chr2 60448389 60448408 60448405 +
tttttaaaatacaaagcaaa

SEQ ID NO: 156372 - DNA, 20 bp, Artificial Sequence
  Synthetic oligonucleotide; AAG chr2 60448393 60448412 60448409 +
taaaatacaaagcaaaaaga

SEQ ID NO: 156373 - DNA, 20 bp, Artificial Sequence
  Synthetic oligonucleotide; AGG chr2 60448394 60448413 60448410 +
aaaatacaaagcaaaaagaa

SEQ ID NO: 156374 - DNA, 20 bp, Artificial Sequence
  Synthetic oligonucleotide; TGG chr2 60448402 60448421 60448418 +
aagcaaaaagaaaggccatg

SEQ ID NO: 156375 - DNA, 20 bp, Artificial Sequence
  Synthetic oligonucleotide; AAG chr2 60448413 60448432 60448429 +
aaggccatgtggttcgtaat

SEQ ID NO: 156376 - DNA, 20 bp, Artificial Sequence
  Synthetic oligonucleotide; AAG chr2 60448433 60448452 60448449 +
aagatatcctaatttaaact

SEQ ID NO: 156377 - DNA, 20 bp, Artificial Sequence
  Synthetic oligonucleotide; TAG chr2 60448437 60448456 60448453 +
tatcctaatttaaactaaga

SEQ ID NO: 156378 - DNA, 20 bp, Artificial Sequence
  Synthetic oligonucleotide; CAG chr2 60448445 60448464 60448461 +
tttaaactaagatagaaaaa

SEQ ID NO: 156379 - DNA, 20 bp, Artificial Sequence
  Synthetic oligonucleotide; TGG chr2 60448462 60448481 60448478 +
aaacagacaatgactgcttc

SEQ ID NO: 156380 - DNA, 20 bp, Artificial Sequence
  Synthetic oligonucleotide; TGG chr2 60448472 60448491 60448488 +
tgactgcttctggattttac

SEQ ID NO: 156381 - DNA, 20 bp, Artificial Sequence
  Synthetic oligonucleotide; AAG chr2 60448475 60448494 60448491 +
ctgcttctggattttactgg

SEQ ID NO: 156382 - DNA, 20 bp, Artificial Sequence
  Synthetic oligonucleotide; GAG chr2 60448479 60448498 60448495 +
ttctggattttactggaagt

SEQ ID NO: 156383 - DNA, 20 bp, Artificial Sequence
  Synthetic oligonucleotide; AAG chr2 60448482 60448501 60448498 +
tggattttactggaagtgag

SEQ ID NO: 156384 - DNA, 20 bp, Artificial Sequence
  Synthetic oligonucleotide; CAG chr2 60448506 60448525 60448522 +
tccatgacttaatgtaactc

SEQ ID NO: 156385 - DNA, 20 bp, Artificial Sequence
  Synthetic oligonucleotide; AGG chr2 60448507 60448526 60448523 +
ccatgacttaatgtaactcc

SEQ ID NO: 156386 - DNA, 20 bp, Artificial Sequence
  Synthetic oligonucleotide; GGG chr2 60448508 60448527 60448524 +
catgacttaatgtaactcca

SEQ ID NO: 156387 - DNA, 20 bp, Artificial Sequence
  Synthetic oligonucleotide; GGG chr2 60448509 60448528 60448525 +
atgacttaatgtaactccag

SEQ ID NO: 156388 - DNA, 20 bp, Artificial Sequence
  Synthetic oligonucleotide; AAG chr2 60448523 60448542 60448539 +
ctccaggggaatgcaaactg

SEQ ID NO: 156389 - DNA, 20 bp, Artificial Sequence
  Synthetic oligonucleotide; GAG chr2 60448525 60448544 60448541 +
ccaggggaatgcaaactgaa

SEQ ID NO: 156390 - DNA, 20 bp, Artificial Sequence
  Synthetic oligonucleotide; TAG chr2 60448540 60448559 60448556 +
ctgaagagtactgtctctcc

SEQ ID NO: 156391 - DNA, 20 bp, Artificial Sequence
  Synthetic oligonucleotide; AGG chr2 60448541 60448560 60448557 +
tgaagagtactgtctctcct

SEQ ID NO: 156392 - DNA, 20 bp, Artificial Sequence
  Synthetic oligonucleotide; CAG chr2 60448544 60448563 60448560 +
agagtactgtctctcctagg

SEQ ID NO: 156393 - DNA, 20 bp, Artificial Sequence
  Synthetic oligonucleotide; CAG chr2 60448548 60448567 60448564 +
tactgtctctcctaggcagt

SEQ ID NO: 156394 - DNA, 20 bp, Artificial Sequence
  Synthetic oligonucleotide; GAG chr2 60448550 60448569 60448566 +
ctgtctctcctaggcagtca

SEQ ID NO: 156395 - DNA, 20 bp, Artificial Sequence
  Synthetic oligonucleotide; AGG chr2 60448551 60448570 60448567 +
tgtctctcctaggcagtcag

SEQ ID NO: 156396 - DNA, 20 bp, Artificial Sequence
  Synthetic oligonucleotide; AAG chr2 60448555 60448574 60448571 +
tctcctaggcagtcagagga

SEQ ID NO: 156397 - DNA, 20 bp, Artificial Sequence
  Synthetic oligonucleotide; TGG chr2 60448580 60448599 60448596 +
atataatattgtttctctgc

SEQ ID NO: 156398 - DNA, 20 bp, Artificial Sequence
  Synthetic oligonucleotide; TAG chr2 60448584 60448603 60448600 +
aatattgtttctctgctggt

SEQ ID NO: 156399 - DNA, 20 bp, Artificial Sequence
  Synthetic oligonucleotide; AGG chr2 60448585 60448604 60448601 +
atattgtttctctgctggtt

SEQ ID NO: 156400 - DNA, 20 bp, Artificial Sequence
  Synthetic oligonucleotide; AAG chr2 60448593 60448612 60448609 +
tctctgctggttaggaactc

SEQ ID NO: 156401 - DNA, 20 bp, Artificial Sequence
  Synthetic oligonucleotide; AAG chr2 60448607 60448626 60448623 +
gaactcaagatgaactcttg

SEQ ID NO: 156402 - DNA, 20 bp, Artificial Sequence
  Synthetic oligonucleotide; AAG chr2 60448610 60448629 60448626 +
ctcaagatgaactcttgaag

SEQ ID NO: 156403 - DNA, 20 bp, Artificial Sequence
  Synthetic oligonucleotide; AGG chr2 60448611 60448630 60448627 +
tcaagatgaactcttgaaga

SEQ ID NO: 156404 - DNA, 20 bp, Artificial Sequence
  Synthetic oligonucleotide; AAG chr2 60448614 60448633 60448630 +
agatgaactcttgaagaagg

SEQ ID NO: 156405 - DNA, 20 bp, Artificial Sequence
  Synthetic oligonucleotide; AGG chr2 60448615 60448634 60448631 +
gatgaactcttgaagaagga

SEQ ID NO: 156406 - DNA, 20 bp, Artificial Sequence
  Synthetic oligonucleotide; CAG chr2 60448632 60448651 60448648 +
ggaaggtgtgcttgcatcac

SEQ ID NO: 156407 - DNA, 20 bp, Artificial Sequence
  Synthetic oligonucleotide; TGG chr2 60448641 60448660 60448657 +
gcttgcatcaccagttattt

SEQ ID NO: 156408 - DNA, 20 bp, Artificial Sequence
  Synthetic oligonucleotide; CAG chr2 60448653 60448672 60448669 +
agttattttggaacttccac

SEQ ID NO: 156409 - DNA, 20 bp, Artificial Sequence
  Synthetic oligonucleotide; AAG chr2 60448699 60448718 60448715 +
tccttcacactatactccaa

SEQ ID NO: 156410 - DNA, 20 bp, Artificial Sequence
  Synthetic oligonucleotide; AGG chr2 60448700 60448719 60448716 +
ccttcacactatactccaaa

SEQ ID NO: 156411 - DNA, 20 bp, Artificial Sequence
  Synthetic oligonucleotide; GAG chr2 60448702 60448721 60448718 +
ttcacactatactccaaaag

SEQ ID NO: 156412 - DNA, 20 bp, Artificial Sequence
  Synthetic oligonucleotide; AAG chr2 60448708 60448727 60448724 +
ctatactccaaaaggagtca

SEQ ID NO: 156413 - DNA, 20 bp, Artificial Sequence
  Synthetic oligonucleotide; TGG chr2 60448716 60448735 60448732 +
caaaaggagtcaaagctatg

SEQ ID NO: 156414 - DNA, 20 bp, Artificial Sequence
  Synthetic oligonucleotide; AAG chr2 60448727 60448746 60448743 +
aaagctatgtggcatactgt

SEQ ID NO: 156415 - DNA, 20 bp, Artificial Sequence
  Synthetic oligonucleotide; CAG chr2 60448732 60448751 60448748 +
tatgtggcatactgtaagaa

SEQ ID NO: 156416 - DNA, 20 bp, Artificial Sequence
  Synthetic oligonucleotide; CAG chr2 60448741 60448760 60448757 +
tactgtaagaacagaaccaa

SEQ ID NO: 156417 - DNA, 20 bp, Artificial Sequence
  Synthetic oligonucleotide; CGG chr2 60448782 60448801 60448798 +
tctaatcctactattacttc

SEQ ID NO: 156418 - DNA, 20 bp, Artificial Sequence
  Synthetic oligonucleotide; GGG chr2 60448783 60448802 60448799 +
ctaatcctactattacttcc

SEQ ID NO: 156419 - DNA, 20 bp, Artificial Sequence
  Synthetic oligonucleotide; GGG chr2 60448784 60448803 60448800 +
taatcctactattacttccg

SEQ ID NO: 156420 - DNA, 20 bp, Artificial Sequence
  Synthetic oligonucleotide; AAG chr2 60448804 60448823 60448820 +
gggacactgatttataaaat

SEQ ID NO: 156421 - DNA, 20 bp, Artificial Sequence
  Synthetic oligonucleotide; AAG chr2 60448818 60448837 60448834 +
taaaataagaattataaaat

SEQ ID NO: 156422 - DNA, 20 bp, Artificial Sequence
  Synthetic oligonucleotide; TAG chr2 60448833 60448852 60448849 +
aaaataagaatttttaaaaa

SEQ ID NO: 156423 - DNA, 20 bp, Artificial Sequence
  Synthetic oligonucleotide; AGG chr2 60448834 60448853 60448850 +
aaataagaatttttaaaaat

SEQ ID NO: 156424 - DNA, 20 bp, Artificial Sequence
  Synthetic oligonucleotide; TAG chr2 60448845 60448864 60448861 +
tttaaaaataggaataaata

SEQ ID NO: 156425 - DNA, 20 bp, Artificial Sequence
  Synthetic oligonucleotide; AAG chr2 60448917 60448936 60448933 +
tcaacgcatacaaaacctga

SEQ ID NO: 156426 - DNA, 20 bp, Artificial Sequence
  Synthetic oligonucleotide; AAG chr2 60448937 60448956 60448953 +
aagatattcctgaccacttg

SEQ ID NO: 156427 - DNA, 20 bp, Artificial Sequence
  Synthetic oligonucleotide; AGG chr2 60448938 60448957 60448954 +
agatattcctgaccacttga

SEQ ID NO: 156428 - DNA, 20 bp, Artificial Sequence
  Synthetic oligonucleotide; GGG chr2 60448939 60448958 60448955 +
gatattcctgaccacttgaa

SEQ ID NO: 156429 - DNA, 20 bp, Artificial Sequence
  Synthetic oligonucleotide; TGG chr2 60448944 60448963 60448960 +
tcctgaccacttgaagggct

SEQ ID NO: 156430 - DNA, 20 bp, Artificial Sequence
  Synthetic oligonucleotide; TGG chr2 60448965 60448984 60448981 +
ggttttaatctgaatgctct

SEQ ID NO: 156431 - DNA, 20 bp, Artificial Sequence
  Synthetic oligonucleotide; AAG chr2 60448975 60448994 60448991 +
tgaatgctcttggaaactcc

SEQ ID NO: 156432 - DNA, 20 bp, Artificial Sequence
  Synthetic oligonucleotide; AAG chr2 60448981 60449000 60448997 +
ctcttggaaactccaagcaa

SEQ ID NO: 156433 - DNA, 20 bp, Artificial Sequence
  Synthetic oligonucleotide; CAG chr2 60448988 60449007 60449004 +
aaactccaagcaaaagtgcc

SEQ ID NO: 156434 - DNA, 20 bp, Artificial Sequence
  Synthetic oligonucleotide; AAG chr2 60449004 60449023 60449020 +
tgcccagaaaatatgctgcc

SEQ ID NO: 156435 - DNA, 20 bp, Artificial Sequence
  Synthetic oligonucleotide; AGG chr2 60449005 60449024 60449021 +
gcccagaaaatatgctgcca

SEQ ID NO: 156436 - DNA, 20 bp, Artificial Sequence
  Synthetic oligonucleotide; TGG chr2 60449010 60449029 60449026 +
gaaaatatgctgccaaggtt

SEQ ID NO: 156437 - DNA, 20 bp, Artificial Sequence
  Synthetic oligonucleotide; GGG chr2 60449011 60449030 60449027 +
aaaatatgctgccaaggttt

SEQ ID NO: 156438 - DNA, 20 bp, Artificial Sequence
  Synthetic oligonucleotide; GGG chr2 60449012 60449031 60449028 +
aaatatgctgccaaggtttg

SEQ ID NO: 156439 - DNA, 20 bp, Artificial Sequence
  Synthetic oligonucleotide; CAG chr2 60449019 60449038 60449035 +
ctgccaaggtttggggcact

SEQ ID NO: 156440 - DNA, 20 bp, Artificial Sequence
  Synthetic oligonucleotide; TAG chr2 60449023 60449042 60449039 +
caaggtttggggcactcagt

SEQ ID NO: 156441 - DNA, 20 bp, Artificial Sequence
  Synthetic oligonucleotide; CAG chr2 60449030 60449049 60449046 +
tggggcactcagttagacct

SEQ ID NO: 156442 - DNA, 20 bp, Artificial Sequence
  Synthetic oligonucleotide; CAG chr2 60449033 60449052 60449049 +
ggcactcagttagacctcag

SEQ ID NO: 156443 - DNA, 20 bp, Artificial Sequence
  Synthetic oligonucleotide; AAG chr2 60449041 60449060 60449057 +
gttagacctcagcagattcc

SEQ ID NO: 156444 - DNA, 20 bp, Artificial Sequence
  Synthetic oligonucleotide; AAG chr2 60449060 60449079 60449076 +
caagattgcactccttgcct

SEQ ID NO: 156445 - DNA, 20 bp, Artificial Sequence
  Synthetic oligonucleotide; GAG chr2 60449062 60449081 60449078 +
agattgcactccttgcctaa

SEQ ID NO: 156446 - DNA, 20 bp, Artificial Sequence
  Synthetic oligonucleotide; TGG chr2 60449083 60449102 60449099 +
agttttctttaaatgatcac

SEQ ID NO: 156447 - DNA, 20 bp, Artificial Sequence
  Synthetic oligonucleotide; CAG chr2 60449110 60449129 60449126 +
tgaaacaattatttctcaaa

SEQ ID NO: 156448 - DNA, 20 bp, Artificial Sequence
  Synthetic oligonucleotide; AGG chr2 60449111 60449130 60449127 +
gaaacaattatttctcaaac

SEQ ID NO: 156449 - DNA, 20 bp, Artificial Sequence
  Synthetic oligonucleotide; TGG chr2 60449130 60449149 60449146 +
caggctgatattcaacatgc

SEQ ID NO: 156450 - DNA, 20 bp, Artificial Sequence
  Synthetic oligonucleotide; TGG chr2 60449137 60449156 60449153 +
atattcaacatgctggatgc

SEQ ID NO: 156451 - DNA, 20 bp, Artificial Sequence
  Synthetic oligonucleotide; GGG chr2 60449138 60449157 60449154 +
tattcaacatgctggatgct

SEQ ID NO: 156452 - DNA, 20 bp, Artificial Sequence
  Synthetic oligonucleotide; CAG chr2 60449146 60449165 60449162 +
atgctggatgctgggtgctg

SEQ ID NO: 156453 - DNA, 20 bp, Artificial Sequence
  Synthetic oligonucleotide; AGG chr2 60449147 60449166 60449163 +
tgctggatgctgggtgctgc

SEQ ID NO: 156454 - DNA, 20 bp, Artificial Sequence
  Synthetic oligonucleotide; GGG chr2 60449148 60449167 60449164 +
gctggatgctgggtgctgca

SEQ ID NO: 156455 - DNA, 20 bp, Artificial Sequence
  Synthetic oligonucleotide; GGG chr2 60449149 60449168 60449165 +
ctggatgctgggtgctgcag

SEQ ID NO: 156456 - DNA, 20 bp, Artificial Sequence
  Synthetic oligonucleotide; GAG chr2 60449156 60449175 60449172 +
ctgggtgctgcaggggcttt

SEQ ID NO: 156457 - DNA, 20 bp, Artificial Sequence
  Synthetic oligonucleotide; TGG chr2 60449177 60449196 60449193 +
agtgtctttctctcccatca

SEQ ID NO: 156458 - DNA, 20 bp, Artificial Sequence
  Synthetic oligonucleotide; CAG chr2 60449193 60449212 60449209 +
atcatggaccccaattctaa

SEQ ID NO: 156459 - DNA, 20 bp, Artificial Sequence
  Synthetic oligonucleotide; CAG chr2 60449208 60449227 60449224 +
tctaacagaccttttttata

SEQ ID NO: 156460 - DNA, 20 bp, Artificial Sequence
  Synthetic oligonucleotide; CGG chr2 60449225 60449244 60449241 +
atacagtgtaataatctgtc

SEQ ID NO: 156461 - DNA, 20 bp, Artificial Sequence
  Synthetic oligonucleotide; GGG chr2 60449226 60449245 60449242 +
tacagtgtaataatctgtcc

SEQ ID NO: 156462 - DNA, 20 bp, Artificial Sequence
  Synthetic oligonucleotide; CGG chr2 60449231 60449250 60449247 +
tgtaataatctgtccgggcg

SEQ ID NO: 156463 - DNA, 20 bp, Artificial Sequence
  Synthetic oligonucleotide; TGG chr2 60449234 60449253 60449250 +
aataatctgtccgggcgcgg

SEQ ID NO: 156464 - DNA, 20 bp, Artificial Sequence
  Synthetic oligonucleotide; CAG chr2 60449253 60449272 60449269 +
gtggcttacacctgtaatcc

SEQ ID NO: 156465 - DNA, 20 bp, Artificial Sequence
  Synthetic oligonucleotide; TGG chr2 60449261 60449280 60449277 +
cacctgtaatcccagcactt

SEQ ID NO: 156466 - DNA, 20 bp, Artificial Sequence
  Synthetic oligonucleotide; GGG chr2 60449262 60449281 60449278 +
acctgtaatcccagcacttt

SEQ ID NO: 156467 - DNA, 20 bp, Artificial Sequence
  Synthetic oligonucleotide; GAG chr2 60449264 60449283 60449280 +
ctgtaatcccagcactttgg

SEQ ID NO: 156468 - DNA, 20 bp, Artificial Sequence
  Synthetic oligonucleotide; AGG chr2 60449265 60449284 60449281 +
tgtaatcccagcactttggg

SEQ ID NO: 156469 - DNA, 20 bp, Artificial Sequence
  Synthetic oligonucleotide; GAG chr2 60449270 60449289 60449286 +
tcccagcactttgggaggcc

SEQ ID NO: 156470 - DNA, 20 bp, Artificial Sequence
  Synthetic oligonucleotide; AGG chr2 60449271 60449290 60449287 +
cccagcactttgggaggccg

SEQ ID NO: 156471 - DNA, 20 bp, Artificial Sequence
  Synthetic oligonucleotide; CAG chr2 60449274 60449293 60449290 +
agcactttgggaggccgagg

SEQ ID NO: 156472 - DNA, 20 bp, Artificial Sequence
  Synthetic oligonucleotide; AGG chr2 60449275 60449294 60449291 +
gcactttgggaggccgaggc

SEQ ID NO: 156473 - DNA, 20 bp, Artificial Sequence
  Synthetic oligonucleotide; TGG chr2 60449278 60449297 60449294 +
ctttgggaggccgaggcagg

SEQ ID NO: 156474 - DNA, 20 bp, Artificial Sequence
  Synthetic oligonucleotide; GAG chr2 60449286 60449305 60449302 +
ggccgaggcaggtggctcat

SEQ ID NO: 156475 - DNA, 20 bp, Artificial Sequence
  Synthetic oligonucleotide; AGG chr2 60449287 60449306 60449303 +
gccgaggcaggtggctcatg

SEQ ID NO: 156476 - DNA, 20 bp, Artificial Sequence
  Synthetic oligonucleotide; CAG chr2 60449291 60449310 60449307 +
aggcaggtggctcatgaggt

SEQ ID NO: 156477 - DNA, 20 bp, Artificial Sequence
  Synthetic oligonucleotide; AGG chr2 60449292 60449311 60449308 +
ggcaggtggctcatgaggtc

SEQ ID NO: 156478 - DNA, 20 bp, Artificial Sequence
  Synthetic oligonucleotide; GAG chr2 60449294 60449313 60449310 +
caggtggctcatgaggtcag

SEQ ID NO: 156479 - DNA, 20 bp, Artificial Sequence
  Synthetic oligonucleotide; GAG chr2 60449300 60449319 60449316 +
gctcatgaggtcaggagttc

SEQ ID NO: 156480 - DNA, 20 bp, Artificial Sequence
  Synthetic oligonucleotide; CAG chr2 60449305 60449324 60449321 +
tgaggtcaggagttcgagac

SEQ ID NO: 156481 - DNA, 20 bp, Artificial Sequence
  Synthetic oligonucleotide; TGG chr2 60449319 60449338 60449335 +
cgagaccagcctgaccaaca

SEQ ID NO: 156482 - DNA, 20 bp, Artificial Sequence
  Synthetic oligonucleotide; TAG chr2 60449354 60449373 60449370 +
tctactaaaaatacaaaaat

SEQ ID NO: 156483 - DNA, 20 bp, Artificial Sequence
  Synthetic oligonucleotide; CAG chr2 60449358 60449377 60449374 +
ctaaaaatacaaaaattagc

SEQ ID NO: 156484 - DNA, 20 bp, Artificial Sequence
  Synthetic oligonucleotide; AGG chr2 60449359 60449378 60449375 +
taaaaatacaaaaattagcc

SEQ ID NO: 156485 - DNA, 20 bp, Artificial Sequence
  Synthetic oligonucleotide; TGG chr2 60449362 60449381 60449378 +
aaatacaaaaattagccagg

SEQ ID NO: 156486 - DNA, 20 bp, Artificial Sequence
  Synthetic oligonucleotide; CAG chr2 60449381 60449400 60449397 +
gtggtacgcacctgtaatcc

SEQ ID NO: 156487 - DNA, 20 bp, Artificial Sequence
  Synthetic oligonucleotide; CAG chr2 60449389 60449408 60449405 +
cacctgtaatcccagccact

SEQ ID NO: 156488 - DNA, 20 bp, Artificial Sequence
  Synthetic oligonucleotide; AGG chr2 60449390 60449409 60449406 +
acctgtaatcccagccactc

SEQ ID NO: 156489 - DNA, 20 bp, Artificial Sequence
  Synthetic oligonucleotide; GAG chr2 60449392 60449411 60449408 +
ctgtaatcccagccactcag

SEQ ID NO: 156490 - DNA, 20 bp, Artificial Sequence
  Synthetic oligonucleotide; AGG chr2 60449393 60449412 60449409 +
tgtaatcccagccactcagg

SEQ ID NO: 156491 - DNA, 20 bp, Artificial Sequence
  Synthetic oligonucleotide; GAG chr2 60449398 60449417 60449414 +
tcccagccactcaggaggct

SEQ ID NO: 156492 - DNA, 20 bp, Artificial Sequence
  Synthetic oligonucleotide; AGG chr2 60449399 60449418 60449415 +
cccagccactcaggaggctg

SEQ ID NO: 156493 - DNA, 20 bp, Artificial Sequence
  Synthetic oligonucleotide; CAG chr2 60449402 60449421 60449418 +
agccactcaggaggctgagg

SEQ ID NO: 156494 - DNA, 20 bp, Artificial Sequence
  Synthetic oligonucleotide; AGG chr2 60449403 60449422 60449419 +
gccactcaggaggctgaggc

SEQ ID NO: 156495 - DNA, 20 bp, Artificial Sequence
  Synthetic oligonucleotide; GAG chr2 60449405 60449424 60449421 +
cactcaggaggctgaggcag

SEQ ID NO: 156496 - DNA, 20 bp, Artificial Sequence
  Synthetic oligonucleotide; CGG chr2 60449421 60449440 60449437 +
gcaggagaaccacttgaacc

SEQ ID NO: 156497 - DNA, 20 bp, Artificial Sequence
  Synthetic oligonucleotide; GGG chr2 60449422 60449441 60449438 +
caggagaaccacttgaaccc

SEQ ID NO: 156498 - DNA, 20 bp, Artificial Sequence
  Synthetic oligonucleotide; GAG chr2 60449424 60449443 60449440 +
ggagaaccacttgaacccgg

SEQ ID NO: 156499 - DNA, 20 bp, Artificial Sequence
  Synthetic oligonucleotide; AGG chr2 60449425 60449444 60449441 +
gagaaccacttgaacccggg

SEQ ID NO: 156500 - DNA, 20 bp, Artificial Sequence
  Synthetic oligonucleotide; TAG chr2 60449428 60449447 60449444 +
aaccacttgaacccgggagg

SEQ ID NO: 156501 - DNA, 20 bp, Artificial Sequence
  Synthetic oligonucleotide; GAG chr2 60449430 60449449 60449446 +
ccacttgaacccgggaggta

SEQ ID NO: 156502 - DNA, 20 bp, Artificial Sequence
  Synthetic oligonucleotide; AGG chr2 60449431 60449450 60449447 +
cacttgaacccgggaggtag

SEQ ID NO: 156503 - DNA, 20 bp, Artificial Sequence
  Synthetic oligonucleotide; CAG chr2 60449437 60449456 60449453 +
aacccgggaggtagaggttg

SEQ ID NO: 156504 - DNA, 20 bp, Artificial Sequence
  Synthetic oligonucleotide; GAG chr2 60449441 60449460 60449457 +
cgggaggtagaggttgcagt

SEQ ID NO: 156505 - DNA, 20 bp, Artificial Sequence
  Synthetic oligonucleotide; AAG chr2 60449446 60449465 60449462 +
ggtagaggttgcagtgagcc

SEQ ID NO: 156506 - DNA, 20 bp, Artificial Sequence
  Synthetic oligonucleotide; CAG chr2 60449466 60449485 60449482 +
aagatcgtgccattgcactc

SEQ ID NO: 156507 - DNA, 20 bp, Artificial Sequence
  Synthetic oligonucleotide; TGG chr2 60449471 60449490 60449487 +
cgtgccattgcactccagcc

SEQ ID NO: 156508 - DNA, 20 bp, Artificial Sequence
  Synthetic oligonucleotide; GGG chr2 60449472 60449491 60449488 +
gtgccattgcactccagcct

SEQ ID NO: 156509 - DNA, 20 bp, Artificial Sequence
  Synthetic oligonucleotide; TAG chr2 60449478 60449497 60449494 +
ttgcactccagcctgggcaa

SEQ ID NO: 156510 - DNA, 20 bp, Artificial Sequence
  Synthetic oligonucleotide; GAG chr2 60449480 60449499 60449496 +
gcactccagcctgggcaata

SEQ ID NO: 156511 - DNA, 20 bp, Artificial Sequence
  Synthetic oligonucleotide; GAG chr2 60449484 60449503 60449500 +
tccagcctgggcaatagagt

SEQ ID NO: 156512 - DNA, 20 bp, Artificial Sequence
  Synthetic oligonucleotide; CAG chr2 60449553 60449572 60449569 +
aataataataataatctgaa

SEQ ID NO: 156513 - DNA, 20 bp, Artificial Sequence
  Synthetic oligonucleotide; AAG chr2 60449563 60449582 60449579 +
ataatctgaacagcccacaa

SEQ ID NO: 156514 - DNA, 20 bp, Artificial Sequence
  Synthetic oligonucleotide; AGG chr2 60449564 60449583 60449580 +
taatctgaacagcccacaaa

SEQ ID NO: 156515 - DNA, 20 bp, Artificial Sequence
  Synthetic oligonucleotide; TGG chr2 60449569 60449588 60449585 +
tgaacagcccacaaaaggct

SEQ ID NO: 156516 - DNA, 20 bp, Artificial Sequence
  Synthetic oligonucleotide; GGG chr2 60449570 60449589 60449586 +
gaacagcccacaaaaggctt

SEQ ID NO: 156517 - DNA, 20 bp, Artificial Sequence
  Synthetic oligonucleotide; AAG chr2 60449574 60449593 60449590 +
agcccacaaaaggcttggga

SEQ ID NO: 156518 - DNA, 20 bp, Artificial Sequence
  Synthetic oligonucleotide; TGG chr2 60449597 60449616 60449613 +
taaaaacaatgccctgtatt

SEQ ID NO: 156519 - DNA, 20 bp, Artificial Sequence
  Synthetic oligonucleotide; AAG chr2 60449612 60449631 60449628 +
gtatttggtctcctccatcc

SEQ ID NO: 156520 - DNA, 20 bp, Artificial Sequence
  Synthetic oligonucleotide; TGG chr2 60449615 60449634 60449631 +
tttggtctcctccatccaag

SEQ ID NO: 156521 - DNA, 20 bp, Artificial Sequence
  Synthetic oligonucleotide; TGG chr2 60449619 60449638 60449635 +
gtctcctccatccaagtggc

SEQ ID NO: 156522 - DNA, 20 bp, Artificial Sequence
  Synthetic oligonucleotide; GGG chr2 60449620 60449639 60449636 +
tctcctccatccaagtggct

SEQ ID NO: 156523 - DNA, 20 bp, Artificial Sequence
  Synthetic oligonucleotide; TAG chr2 60449634 60449653 60449650 +
gtggctgggactctgtcctc

SEQ ID NO: 156524 - DNA, 20 bp, Artificial Sequence
  Synthetic oligonucleotide; CAG chr2 60449650 60449669 60449666 +
cctctagtctgtgctcatgt

SEQ ID NO: 156525 - DNA, 20 bp, Artificial Sequence
  Synthetic oligonucleotide; AGG chr2 60449651 60449670 60449667 +
ctctagtctgtgctcatgtc

SEQ ID NO: 156526 - DNA, 20 bp, Artificial Sequence
  Synthetic oligonucleotide; AAG chr2 60449680 60449699 60449696 +
atttatctctctgcaatctg

SEQ ID NO: 156527 - DNA, 20 bp, Artificial Sequence
  Synthetic oligonucleotide; CAG chr2 60449693 60449712 60449709 +
caatctgaagttccactctg

SEQ ID NO: 156528 - DNA, 20 bp, Artificial Sequence
  Synthetic oligonucleotide; GAG chr2 60449695 60449714 60449711 +
atctgaagttccactctgca

SEQ ID NO: 156529 - DNA, 20 bp, Artificial Sequence
  Synthetic oligonucleotide; GAG chr2 60449697 60449716 60449713 +
ctgaagttccactctgcaga

SEQ ID NO: 156530 - DNA, 20 bp, Artificial Sequence
  Synthetic oligonucleotide; AGG chr2 60449698 60449717 60449714 +
tgaagttccactctgcagag

SEQ ID NO: 156531 - DNA, 20 bp, Artificial Sequence
  Synthetic oligonucleotide; CAG chr2 60449704 60449723 60449720 +
tccactctgcagagaggaca

SEQ ID NO: 156532 - DNA, 20 bp, Artificial Sequence
  Synthetic oligonucleotide; GAG chr2 60449708 60449727 60449724 +
ctctgcagagaggacacagt

SEQ ID NO: 156533 - DNA, 20 bp, Artificial Sequence
  Synthetic oligonucleotide; TGG chr2 60449717 60449736 60449733 +
gaggacacagtgagaacccc

SEQ ID NO: 156534 - DNA, 20 bp, Artificial Sequence
  Synthetic oligonucleotide; CAG chr2 60449720 60449739 60449736 +
gacacagtgagaacccctgg

SEQ ID NO: 156535 - DNA, 20 bp, Artificial Sequence
  Synthetic oligonucleotide; GAG chr2 60449729 60449748 60449745 +
agaacccctggcagatttgt

SEQ ID NO: 156536 - DNA, 20 bp, Artificial Sequence
  Synthetic oligonucleotide; TGG chr2 60449756 60449775 60449772 +
ttccctgcttctgccattca

SEQ ID NO: 156537 - DNA, 20 bp, Artificial Sequence
  Synthetic oligonucleotide; CAG chr2 60449784 60449803 60449800 +
catgatcttgactcatcaca

SEQ ID NO: 156538 - DNA, 20 bp, Artificial Sequence
  Synthetic oligonucleotide; GAG chr2 60449786 60449805 60449802 +
tgatcttgactcatcacaca

SEQ ID NO: 156539 - DNA, 20 bp, Artificial Sequence
  Synthetic oligonucleotide; GAG chr2 60449788 60449807 60449804 +
atcttgactcatcacacaga

SEQ ID NO: 156540 - DNA, 20 bp, Artificial Sequence
  Synthetic oligonucleotide; TGG chr2 60449818 60449837 60449834 +
cccaaattgtcaatcttgta

SEQ ID NO: 156541 - DNA, 20 bp, Artificial Sequence
  Synthetic oligonucleotide; GGG chr2 60449819 60449838 60449835 +
ccaaattgtcaatcttgtat

SEQ ID NO: 156542 - DNA, 20 bp, Artificial Sequence
  Synthetic oligonucleotide; GGG chr2 60449820 60449839 60449836 +
caaattgtcaatcttgtatg

SEQ ID NO: 156543 - DNA, 20 bp, Artificial Sequence
  Synthetic oligonucleotide; AAG chr2 60449829 60449848 60449845 +
aatcttgtatggggtttcaa

SEQ ID NO: 156544 - DNA, 20 bp, Artificial Sequence
  Synthetic oligonucleotide; TAG chr2 60449834 60449853 60449850 +
tgtatggggtttcaaaagtc

SEQ ID NO: 156545 - DNA, 20 bp, Artificial Sequence
  Synthetic oligonucleotide; TAG chr2 60449840 60449859 60449856 +
gggtttcaaaagtctagccc

SEQ ID NO: 156546 - DNA, 20 bp, Artificial Sequence
  Synthetic oligonucleotide; AGG chr2 60449841 60449860 60449857 +
ggtttcaaaagtctagccct

SEQ ID NO: 156547 - DNA, 20 bp, Artificial Sequence
  Synthetic oligonucleotide; CAG chr2 60449845 60449864 60449861 +
tcaaaagtctagccctaggc

SEQ ID NO: 156548 - DNA, 20 bp, Artificial Sequence
  Synthetic oligonucleotide; AGG chr2 60449846 60449865 60449862 +
caaaagtctagccctaggcc

SEQ ID NO: 156549 - DNA, 20 bp, Artificial Sequence
  Synthetic oligonucleotide; GAG chr2 60449850 60449869 60449866 +
agtctagccctaggccaggt

SEQ ID NO: 156550 - DNA, 20 bp, Artificial Sequence
  Synthetic oligonucleotide; AGG chr2 60449851 60449870 60449867 +
gtctagccctaggccaggtg

SEQ ID NO: 156551 - DNA, 20 bp, Artificial Sequence
  Synthetic oligonucleotide; TAG chr2 60449854 60449873 60449870 +
tagccctaggccaggtgagg

SEQ ID NO: 156552 - DNA, 20 bp, Artificial Sequence
  Synthetic oligonucleotide; CAG chr2 60449874 60449893 60449890 +
tagtgcaatgcctctaatcc

SEQ ID NO: 156553 - DNA, 20 bp, Artificial Sequence
  Synthetic oligonucleotide; TGG chr2 60449882 60449901 60449898 +
tgcctctaatcccagcacta

SEQ ID NO: 156554 - DNA, 20 bp, Artificial Sequence
  Synthetic oligonucleotide; GGG chr2 60449883 60449902 60449899 +
gcctctaatcccagcactat

SEQ ID NO: 156555 - DNA, 20 bp, Artificial Sequence
  Synthetic oligonucleotide; GAG chr2 60449885 60449904 60449901 +
ctctaatcccagcactatgg

SEQ ID NO: 156556 - DNA, 20 bp, Artificial Sequence
  Synthetic oligonucleotide; AGG chr2 60449886 60449905 60449902 +
tctaatcccagcactatggg

SEQ ID NO: 156557 - DNA, 20 bp, Artificial Sequence
  Synthetic oligonucleotide; TAG chr2 60449891 60449910 60449907 +
tcccagcactatgggaggcc

SEQ ID NO: 156558 - DNA, 20 bp, Artificial Sequence
  Synthetic oligonucleotide; AGG chr2 60449892 60449911 60449908 +
cccagcactatgggaggcct

SEQ ID NO: 156559 - DNA, 20 bp, Artificial Sequence
  Synthetic oligonucleotide; GAG chr2 60449894 60449913 60449910 +
cagcactatgggaggcctag

SEQ ID NO: 156560 - DNA, 20 bp, Artificial Sequence
  Synthetic oligonucleotide; AGG chr2 60449895 60449914 60449911 +
agcactatgggaggcctagg

SEQ ID NO: 156561 - DNA, 20 bp, Artificial Sequence
  Synthetic oligonucleotide; GGG chr2 60449896 60449915 60449912 +
gcactatgggaggcctagga

SEQ ID NO: 156562 - DNA, 20 bp, Artificial Sequence
  Synthetic oligonucleotide; TGG chr2 60449899 60449918 60449915 +
ctatgggaggcctaggaggg

SEQ ID NO: 156563 - DNA, 20 bp, Artificial Sequence
  Synthetic oligonucleotide; GAG chr2 60449907 60449926 60449923 +
ggcctaggagggtggatcac

SEQ ID NO: 156564 - DNA, 20 bp, Artificial Sequence
  Synthetic oligonucleotide; CAG chr2 60449912 60449931 60449928 +
aggagggtggatcacgagat

SEQ ID NO: 156565 - DNA, 20 bp, Artificial Sequence
  Synthetic oligonucleotide; AGG chr2 60449913 60449932 60449929 +
ggagggtggatcacgagatc

SEQ ID NO: 156566 - DNA, 20 bp, Artificial Sequence
  Synthetic oligonucleotide; GAG chr2 60449915 60449934 60449931 +
agggtggatcacgagatcag

SEQ ID NO: 156567 - DNA, 20 bp, Artificial Sequence
  Synthetic oligonucleotide; TGG chr2 60449919 60449938 60449935 +
tggatcacgagatcaggaga

SEQ ID NO: 156568 - DNA, 20 bp, Artificial Sequence
  Synthetic oligonucleotide; GAG chr2 60449921 60449940 60449937 +
gatcacgagatcaggagatg

SEQ ID NO: 156569 - DNA, 20 bp, Artificial Sequence
  Synthetic oligonucleotide; TGG chr2 60449931 60449950 60449947 +
tcaggagatggagaccatcc

SEQ ID NO: 156570 - DNA, 20 bp, Artificial Sequence
  Synthetic oligonucleotide; CGG chr2 60449940 60449959 60449956 +
ggagaccatcctggctaaca

SEQ ID NO: 156571 - DNA, 20 bp, Artificial Sequence
  Synthetic oligonucleotide; TAG chr2 60449978 60449997 60449994 +
actaaaaatacaaaaaatat

SEQ ID NO: 156572 - DNA, 20 bp, Artificial Sequence
  Synthetic oligonucleotide; TGG chr2 60449982 60450001 60449998 +
aaaatacaaaaaatattagc

SEQ ID NO: 156573 - DNA, 20 bp, Artificial Sequence
  Synthetic oligonucleotide; GGG chr2 60449983 60450002 60449999 +
aaatacaaaaaatattagct

SEQ ID NO: 156574 - DNA, 20 bp, Artificial Sequence
  Synthetic oligonucleotide; TGG chr2 60449988 60450007 60450004 +
caaaaaatattagctgggcg

SEQ ID NO: 156575 - DNA, 20 bp, Artificial Sequence
  Synthetic oligonucleotide; TGG chr2 60449991 60450010 60450007 +
aaaatattagctgggcgtgg

SEQ ID NO: 156576 - DNA, 20 bp, Artificial Sequence
  Synthetic oligonucleotide; TAG chr2 60450004 60450023 60450020 +
ggcgtggtggcgcgtgcctg

SEQ ID NO: 156577 - DNA, 20 bp, Artificial Sequence
  Synthetic oligonucleotide; CAG chr2 60450010 60450029 60450026 +
gtggcgcgtgcctgtagtcc

SEQ ID NO: 156578 - DNA, 20 bp, Artificial Sequence
  Synthetic oligonucleotide; TGG chr2 60450018 60450037 60450034 +
tgcctgtagtcccagctact

SEQ ID NO: 156579 - DNA, 20 bp, Artificial Sequence
  Synthetic oligonucleotide; GGG chr2 60450019 60450038 60450035 +
gcctgtagtcccagctactt

SEQ ID NO: 156580 - DNA, 20 bp, Artificial Sequence
  Synthetic oligonucleotide; AAG chr2 60450022 60450041 60450038 +
tgtagtcccagctacttggg

SEQ ID NO: 156581 - DNA, 20 bp, Artificial Sequence
  Synthetic oligonucleotide; GAG chr2 60450027 60450046 60450043 +
tcccagctacttgggaagct

SEQ ID NO: 156582 - DNA, 20 bp, Artificial Sequence
  Synthetic oligonucleotide; AGG chr2 60450028 60450047 60450044 +
cccagctacttgggaagctg

SEQ ID NO: 156583 - DNA, 20 bp, Artificial Sequence
  Synthetic oligonucleotide; CAG chr2 60450031 60450050 60450047 +
agctacttgggaagctgagg

SEQ ID NO: 156584 - DNA, 20 bp, Artificial Sequence
  Synthetic oligonucleotide; AGG chr2 60450032 60450051 60450048 +
gctacttgggaagctgaggc

SEQ ID NO: 156585 - DNA, 20 bp, Artificial Sequence
  Synthetic oligonucleotide; GAG chr2 60450034 60450053 60450050 +
tacttgggaagctgaggcag

SEQ ID NO: 156586 - DNA, 20 bp, Artificial Sequence
  Synthetic oligonucleotide; AGG chr2 60450035 60450054 60450051 +
acttgggaagctgaggcagg

SEQ ID NO: 156587 - DNA, 20 bp, Artificial Sequence
  Synthetic oligonucleotide; CAG chr2 60450050 60450069 60450066 +
gcaggaggatcccttgaacc

SEQ ID NO: 156588 - DNA, 20 bp, Artificial Sequence
  Synthetic oligonucleotide; TAG chr2 60450053 60450072 60450069 +
ggaggatcccttgaacccag

SEQ ID NO: 156589 - DNA, 20 bp, Artificial Sequence
  Synthetic oligonucleotide; AGG chr2 60450054 60450073 60450070 +
gaggatcccttgaacccagt

SEQ ID NO: 156590 - DNA, 20 bp, Artificial Sequence
  Synthetic oligonucleotide; CGG chr2 60450057 60450076 60450073 +
gatcccttgaacccagtagg

SEQ ID NO: 156591 - DNA, 20 bp, Artificial Sequence
  Synthetic oligonucleotide; GAG chr2 60450059 60450078 60450075 +
tcccttgaacccagtaggcg

SEQ ID NO: 156592 - DNA, 20 bp, Artificial Sequence
  Synthetic oligonucleotide; AGG chr2 60450060 60450079 60450076 +
cccttgaacccagtaggcgg

SEQ ID NO: 156593 - DNA, 20 bp, Artificial Sequence
  Synthetic oligonucleotide; TGG chr2 60450066 60450085 60450082 +
aacccagtaggcggaggttg

SEQ ID NO: 156594 - DNA, 20 bp, Artificial Sequence
  Synthetic oligonucleotide; GAG chr2 60450070 60450089 60450086 +
cagtaggcggaggttgtggt

SEQ ID NO: 156595 - DNA, 20 bp, Artificial Sequence
  Synthetic oligonucleotide; GAG chr2 60450075 60450094 60450091 +
ggcggaggttgtggtgagct

SEQ ID NO: 156596 - DNA, 20 bp, Artificial Sequence
  Synthetic oligonucleotide; CAG chr2 60450095 60450114 60450111 +
gagtccttgccactgcactc

SEQ ID NO: 156597 - DNA, 20 bp, Artificial Sequence
  Synthetic oligonucleotide; TGG chr2 60450100 60450119 60450116 +
cttgccactgcactccagcc

SEQ ID NO: 156598 - DNA, 20 bp, Artificial Sequence
  Synthetic oligonucleotide; GGG chr2 60450101 60450120 60450117 +
ttgccactgcactccagcct

SEQ ID NO: 156599 - DNA, 20 bp, Artificial Sequence
  Synthetic oligonucleotide; CAG chr2 60450107 60450126 60450123 +
ctgcactccagcctgggtga

SEQ ID NO: 156600 - DNA, 20 bp, Artificial Sequence
  Synthetic oligonucleotide; GAG chr2 60450109 60450128 60450125 +
gcactccagcctgggtgaca

SEQ ID NO: 156601 - DNA, 20 bp, Artificial Sequence
  Synthetic oligonucleotide; GAG chr2 60450113 60450132 60450129 +
tccagcctgggtgacagagc

SEQ ID NO: 156602 - DNA, 20 bp, Artificial Sequence
  Synthetic oligonucleotide; TGG chr2 60450151 60450170 60450167 +
aaaaaaaaaaaaaaaaaaaa

SEQ ID NO: 156603 - DNA, 20 bp, Artificial Sequence
  Synthetic oligonucleotide; TAG chr2 60450155 60450174 60450171 +
aaaaaaaaaaaaaaaatggc

SEQ ID NO: 156604 - DNA, 20 bp, Artificial Sequence
  Synthetic oligonucleotide; AAG chr2 60450222 60450241 60450238 +
ttgttgtctttcaactttaa

SEQ ID NO: 156605 - DNA, 20 bp, Artificial Sequence
  Synthetic oligonucleotide; TGG chr2 60450228 60450247 60450244 +
tctttcaactttaaaagcca

SEQ ID NO: 156606 - DNA, 20 bp, Artificial Sequence
  Synthetic oligonucleotide; GGG chr2 60450229 60450248 60450245 +
ctttcaactttaaaagccat

SEQ ID NO: 156607 - DNA, 20 bp, Artificial Sequence
  Synthetic oligonucleotide; AAG chr2 60450234 60450253 60450250 +
aactttaaaagccatgggaa

SEQ ID NO: 156608 - DNA, 20 bp, Artificial Sequence
  Synthetic oligonucleotide; CAG chr2 60450238 60450257 60450254 +
ttaaaagccatgggaaaaga

SEQ ID NO: 156609 - DNA, 20 bp, Artificial Sequence
  Synthetic oligonucleotide; GAG chr2 60450262 60450281 60450278 +
ctttttgttctgtttgtttt

SEQ ID NO: 156610 - DNA, 20 bp, Artificial Sequence
  Synthetic oligonucleotide; AGG chr2 60450263 60450282 60450279 +
tttttgttctgtttgttttg

SEQ ID NO: 156611 - DNA, 20 bp, Artificial Sequence
  Synthetic oligonucleotide; GGG chr2 60450264 60450283 60450280 +
ttttgttctgtttgttttga

SEQ ID NO: 156612 - DNA, 20 bp, Artificial Sequence
  Synthetic oligonucleotide; GGG chr2 60450265 60450284 60450281 +
tttgttctgtttgttttgag

SEQ ID NO: 156613 - DNA, 20 bp, Artificial Sequence
  Synthetic oligonucleotide; GGG chr2 60450266 60450285 60450282 +
ttgttctgtttgttttgagg

SEQ ID NO: 156614 - DNA, 20 bp, Artificial Sequence
  Synthetic oligonucleotide; CAG chr2 60450279 60450298 60450295 +
tttgagggggttcttctcca

SEQ ID NO: 156615 - DNA, 20 bp, Artificial Sequence
  Synthetic oligonucleotide; AAG chr2 60450284 60450303 60450300 +
gggggttcttctccacagtg

SEQ ID NO: 156616 - DNA, 20 bp, Artificial Sequence
  Synthetic oligonucleotide; GAG chr2 60450286 60450305 60450302 +
gggttcttctccacagtgaa

SEQ ID NO: 156617 - DNA, 20 bp, Artificial Sequence
  Synthetic oligonucleotide; AGG chr2 60450287 60450306 60450303 +
ggttcttctccacagtgaag

SEQ ID NO: 156618 - DNA, 20 bp, Artificial Sequence
  Synthetic oligonucleotide; TAG chr2 60450349 60450368 60450365 +
ccccttaaaaatcccacttt

SEQ ID NO: 156619 - DNA, 20 bp, Artificial Sequence
  Synthetic oligonucleotide; GAG chr2 60450351 60450370 60450367 +
ccttaaaaatcccactttta

SEQ ID NO: 156620 - DNA, 20 bp, Artificial Sequence
  Synthetic oligonucleotide; GAG chr2 60450381 60450400 60450397 +
cttatttacaaactgactct

SEQ ID NO: 156621 - DNA, 20 bp, Artificial Sequence
  Synthetic oligonucleotide; AAG chr2 60450384 60450403 60450400 +
atttacaaactgactctgag

SEQ ID NO: 156622 - DNA, 20 bp, Artificial Sequence
  Synthetic oligonucleotide; AAG chr2 60450398 60450417 60450414 +
tctgagaagaaatatataaa

SEQ ID NO: 156623 - DNA, 20 bp, Artificial Sequence
  Synthetic oligonucleotide; TGG chr2 60450401 60450420 60450417 +
gagaagaaatatataaaaag

SEQ ID NO: 156624 - DNA, 20 bp, Artificial Sequence
  Synthetic oligonucleotide; GGG chr2 60450402 60450421 60450418 +
agaagaaatatataaaaagt

SEQ ID NO: 156625 - DNA, 20 bp, Artificial Sequence
  Synthetic oligonucleotide; GGG chr2 60450403 60450422 60450419 +
gaagaaatatataaaaagtg

SEQ ID NO: 156626 - DNA, 20 bp, Artificial Sequence
  Synthetic oligonucleotide; GGG chr2 60450404 60450423 60450420 +
aagaaatatataaaaagtgg

SEQ ID NO: 156627 - DNA, 20 bp, Artificial Sequence
  Synthetic oligonucleotide; TAG chr2 60450407 60450426 60450423 +
aaatatataaaaagtggggg

SEQ ID NO: 156628 - DNA, 20 bp, Artificial Sequence
  Synthetic oligonucleotide; CAG chr2 60450415 60450434 60450431 +
aaaaagtgggggtagaaaca

SEQ ID NO: 156629 - DNA, 20 bp, Artificial Sequence
  Synthetic oligonucleotide; CAG chr2 60450420 60450439 60450436 +
gtgggggtagaaacacagac

SEQ ID NO: 156630 - DNA, 20 bp, Artificial Sequence
  Synthetic oligonucleotide; AAG chr2 60450429 60450448 60450445 +
gaaacacagaccagaaatga

SEQ ID NO: 156631 - DNA, 20 bp, Artificial Sequence
  Synthetic oligonucleotide; TAG chr2 60450434 60450453 60450450 +
acagaccagaaatgaaagtg

SEQ ID NO: 156632 - DNA, 20 bp, Artificial Sequence
  Synthetic oligonucleotide; AAG chr2 60450445 60450464 60450461 +
atgaaagtgtagtgaccacc

SEQ ID NO: 156633 - DNA, 20 bp, Artificial Sequence
  Synthetic oligonucleotide; CAG chr2 60450450 60450469 60450466 +
agtgtagtgaccaccaagtg

SEQ ID NO: 156634 - DNA, 20 bp, Artificial Sequence
  Synthetic oligonucleotide; AAG chr2 60450458 60450477 60450474 +
gaccaccaagtgcagttaca

SEQ ID NO: 156635 - DNA, 20 bp, Artificial Sequence
  Synthetic oligonucleotide; AGG chr2 60450459 60450478 60450475 +
accaccaagtgcagttacaa

SEQ ID NO: 156636 - DNA, 20 bp, Artificial Sequence
  Synthetic oligonucleotide; AAG chr2 60450475 60450494 60450491 +
acaaaggctgaacttgtctc

SEQ ID NO: 156637 - DNA, 20 bp, Artificial Sequence
  Synthetic oligonucleotide; CAG chr2 60450481 60450500 60450497 +
gctgaacttgtctcaagacc

SEQ ID NO: 156638 - DNA, 20 bp, Artificial Sequence
  Synthetic oligonucleotide; AGG chr2 60450482 60450501 60450498 +
ctgaacttgtctcaagaccc

SEQ ID NO: 156639 - DNA, 20 bp, Artificial Sequence
  Synthetic oligonucleotide; CAG chr2 60450495 60450514 60450511 +
aagacccaggattgttgttt

SEQ ID NO: 156640 - DNA, 20 bp, Artificial Sequence
  Synthetic oligonucleotide; TGG chr2 60450501 60450520 60450517 +
caggattgttgtttcagttc

SEQ ID NO: 156641 - DNA, 20 bp, Artificial Sequence
  Synthetic oligonucleotide; TGG chr2 60450512 60450531 60450528 +
tttcagttctggcctccctt

SEQ ID NO: 156642 - DNA, 20 bp, Artificial Sequence
  Synthetic oligonucleotide; AAG chr2 60450515 60450534 60450531 +
cagttctggcctccctttgg

SEQ ID NO: 156643 - DNA, 20 bp, Artificial Sequence
  Synthetic oligonucleotide; TGG chr2 60450518 60450537 60450534 +
ttctggcctccctttggaag

SEQ ID NO: 156644 - DNA, 20 bp, Artificial Sequence
  Synthetic oligonucleotide; TAG chr2 60450533 60450552 60450549 +
ggaagtggtgtcactctttc

SEQ ID NO: 156645 - DNA, 20 bp, Artificial Sequence
  Synthetic oligonucleotide; AGG chr2 60450534 60450553 60450550 +
gaagtggtgtcactctttct

SEQ ID NO: 156646 - DNA, 20 bp, Artificial Sequence
  Synthetic oligonucleotide; CAG chr2 60450540 60450559 60450556 +
gtgtcactctttctaggcat

SEQ ID NO: 156647 - DNA, 20 bp, Artificial Sequence
  Synthetic oligonucleotide; AAG chr2 60450544 60450563 60450560 +
cactctttctaggcatcagc

SEQ ID NO: 156648 - DNA, 20 bp, Artificial Sequence
  Synthetic oligonucleotide; AGG chr2 60450545 60450564 60450561 +
actctttctaggcatcagca

SEQ ID NO: 156649 - DNA, 20 bp, Artificial Sequence
  Synthetic oligonucleotide; GAG chr2 60450547 60450566 60450563 +
tctttctaggcatcagcaag

SEQ ID NO: 156650 - DNA, 20 bp, Artificial Sequence
  Synthetic oligonucleotide; CAG chr2 60450552 60450571 60450568 +
ctaggcatcagcaaggagtt

SEQ ID NO: 156651 - DNA, 20 bp, Artificial Sequence
  Synthetic oligonucleotide; TAG chr2 60450561 60450580 60450577 +
agcaaggagttcagcacatt

SEQ ID NO: 156652 - DNA, 20 bp, Artificial Sequence
  Synthetic oligonucleotide; AGG chr2 60450562 60450581 60450578 +
gcaaggagttcagcacattt

SEQ ID NO: 156653 - DNA, 20 bp, Artificial Sequence
  Synthetic oligonucleotide; GGG chr2 60450563 60450582 60450579 +
caaggagttcagcacattta

SEQ ID NO: 156654 - DNA, 20 bp, Artificial Sequence
  Synthetic oligonucleotide; GAG chr2 60450565 60450584 60450581 +
aggagttcagcacatttagg

SEQ ID NO: 156655 - DNA, 20 bp, Artificial Sequence
  Synthetic oligonucleotide; AGG chr2 60450566 60450585 60450582 +
ggagttcagcacatttaggg

SEQ ID NO: 156656 - DNA, 20 bp, Artificial Sequence
  Synthetic oligonucleotide; AAG chr2 60450569 60450588 60450585 +
gttcagcacatttagggagg

SEQ ID NO: 156657 - DNA, 20 bp, Artificial Sequence
  Synthetic oligonucleotide; CAG chr2 60450578 60450597 60450594 +
atttagggaggaagccatca

SEQ ID NO: 156658 - DNA, 20 bp, Artificial Sequence
  Synthetic oligonucleotide; TGG chr2 60450590 60450609 60450606 +
agccatcacagaaaccctaa

SEQ ID NO: 156659 - DNA, 20 bp, Artificial Sequence
  Synthetic oligonucleotide; CAG chr2 60450603 60450622 60450619 +
accctaatggtcttatgttt

SEQ ID NO: 156660 - DNA, 20 bp, Artificial Sequence
  Synthetic oligonucleotide; TAG chr2 60450613 60450632 60450629 +
tcttatgtttcagcaacaca

SEQ ID NO: 156661 - DNA, 20 bp, Artificial Sequence
  Synthetic oligonucleotide; AGG chr2 60450614 60450633 60450630 +
cttatgtttcagcaacacat

SEQ ID NO: 156662 - DNA, 20 bp, Artificial Sequence
  Synthetic oligonucleotide; CAG chr2 60450617 60450636 60450633 +
atgtttcagcaacacatagg

SEQ ID NO: 156663 - DNA, 20 bp, Artificial Sequence
  Synthetic oligonucleotide; GAG chr2 60450619 60450638 60450635 +
gtttcagcaacacataggca

SEQ ID NO: 156664 - DNA, 20 bp, Artificial Sequence
  Synthetic oligonucleotide; TGG chr2 60450624 60450643 60450640 +
agcaacacataggcagagca

SEQ ID NO: 156665 - DNA, 20 bp, Artificial Sequence
  Synthetic oligonucleotide; GGG chr2 60450625 60450644 60450641 +
gcaacacataggcagagcat

SEQ ID NO: 156666 - DNA, 20 bp, Artificial Sequence
  Synthetic oligonucleotide; GGG chr2 60450626 60450645 60450642 +
caacacataggcagagcatg

SEQ ID NO: 156667 - DNA, 20 bp, Artificial Sequence
  Synthetic oligonucleotide; CAG chr2 60450629 60450648 60450645 +
cacataggcagagcatgggg

SEQ ID NO: 156668 - DNA, 20 bp, Artificial Sequence
  Synthetic oligonucleotide; AGG chr2 60450630 60450649 60450646 +
acataggcagagcatggggc

SEQ ID NO: 156669 - DNA, 20 bp, Artificial Sequence
  Synthetic oligonucleotide; GGG chr2 60450631 60450650 60450647 +
cataggcagagcatggggca

SEQ ID NO: 156670 - DNA, 20 bp, Artificial Sequence
  Synthetic oligonucleotide; GAG chr2 60450633 60450652 60450649 +
taggcagagcatggggcagg

SEQ ID NO: 156671 - DNA, 20 bp, Artificial Sequence
  Synthetic oligonucleotide; GAG chr2 60450635 60450654 60450651 +
ggcagagcatggggcaggga

SEQ ID NO: 156672 - DNA, 20 bp, Artificial Sequence
  Synthetic oligonucleotide; AGG chr2 60450636 60450655 60450652 +
gcagagcatggggcagggag

SEQ ID NO: 156673 - DNA, 20 bp, Artificial Sequence
  Synthetic oligonucleotide; GGG chr2 60450637 60450656 60450653 +
cagagcatggggcagggaga

SEQ ID NO: 156674 - DNA, 20 bp, Artificial Sequence
  Synthetic oligonucleotide; TGG chr2 60450665 60450684 60450681 +
ttatgaaataacttcttgtc

SEQ ID NO: 156675 - DNA, 20 bp, Artificial Sequence
  Synthetic oligonucleotide; AAG chr2 60450668 60450687 60450684 +
tgaaataacttcttgtctgg

SEQ ID NO: 156676 - DNA, 20 bp, Artificial Sequence
  Synthetic oligonucleotide; TAG chr2 60450685 60450704 60450701 +
tggaagtcccaactaattga

SEQ ID NO: 156677 - DNA, 20 bp, Artificial Sequence
  Synthetic oligonucleotide; AGG chr2 60450686 60450705 60450702 +
ggaagtcccaactaattgat

SEQ ID NO: 156678 - DNA, 20 bp, Artificial Sequence
  Synthetic oligonucleotide; AAG chr2 60450689 60450708 60450705 +
agtcccaactaattgatagg

SEQ ID NO: 156679 - DNA, 20 bp, Artificial Sequence
  Synthetic oligonucleotide; CAG chr2 60450699 60450718 60450715 +
aattgataggaagtcacaaa

SEQ ID NO: 156680 - DNA, 20 bp, Artificial Sequence
  Synthetic oligonucleotide; AGG chr2 60450700 60450719 60450716 +
attgataggaagtcacaaac

SEQ ID NO: 156681 - DNA, 20 bp, Artificial Sequence
  Synthetic oligonucleotide; CAG chr2 60450716 60450735 60450732 +
aaacaggccactcgtgcaat

SEQ ID NO: 156682 - DNA, 20 bp, Artificial Sequence
  Synthetic oligonucleotide; AGG chr2 60450717 60450736 60450733 +
aacaggccactcgtgcaatc

SEQ ID NO: 156683 - DNA, 20 bp, Artificial Sequence
  Synthetic oligonucleotide; GGG chr2 60450718 60450737 60450734 +
acaggccactcgtgcaatca

SEQ ID NO: 156684 - DNA, 20 bp, Artificial Sequence
  Synthetic oligonucleotide; TGG chr2 60450731 60450750 60450747 +
gcaatcagggttatttgtca

SEQ ID NO: 156685 - DNA, 20 bp, Artificial Sequence
  Synthetic oligonucleotide; AAG chr2 60450736 60450755 60450752 +
cagggttatttgtcatggaa

SEQ ID NO: 156686 - DNA, 20 bp, Artificial Sequence
  Synthetic oligonucleotide; CAG chr2 60450742 60450761 60450758 +
tatttgtcatggaaaagcca

SEQ ID NO: 156687 - DNA, 20 bp, Artificial Sequence
  Synthetic oligonucleotide; AGG chr2 60450743 60450762 60450759 +
atttgtcatggaaaagccac

SEQ ID NO: 156688 - DNA, 20 bp, Artificial Sequence
  Synthetic oligonucleotide; GGG chr2 60450744 60450763 60450760 +
tttgtcatggaaaagccaca

SEQ ID NO: 156689 - DNA, 20 bp, Artificial Sequence
  Synthetic oligonucleotide; GGG chr2 60450745 60450764 60450761 +
ttgtcatggaaaagccacag

SEQ ID NO: 156690 - DNA, 20 bp, Artificial Sequence
  Synthetic oligonucleotide; AAG chr2 60450749 60450768 60450765 +
catggaaaagccacagggga

SEQ ID NO: 156691 - DNA, 20 bp, Artificial Sequence
  Synthetic oligonucleotide; AGG chr2 60450750 60450769 60450766 +
atggaaaagccacaggggaa

SEQ ID NO: 156692 - DNA, 20 bp, Artificial Sequence
  Synthetic oligonucleotide; TGG chr2 60450756 60450775 60450772 +
aagccacaggggaaaggtga

SEQ ID NO: 156693 - DNA, 20 bp, Artificial Sequence
  Synthetic oligonucleotide; AAG chr2 60450760 60450779 60450776 +
cacaggggaaaggtgatggc

SEQ ID NO: 156694 - DNA, 20 bp, Artificial Sequence
  Synthetic oligonucleotide; AGG chr2 60450761 60450780 60450777 +
acaggggaaaggtgatggca

SEQ ID NO: 156695 - DNA, 20 bp, Artificial Sequence
  Synthetic oligonucleotide; GAG chr2 60450763 60450782 60450779 +
aggggaaaggtgatggcaag

SEQ ID NO: 156696 - DNA, 20 bp, Artificial Sequence
  Synthetic oligonucleotide; AGG chr2 60450764 60450783 60450780 +
ggggaaaggtgatggcaagg

SEQ ID NO: 156697 - DNA, 20 bp, Artificial Sequence
  Synthetic oligonucleotide; CAG chr2 60450784 60450803 60450800 +
aggctgcaacctccctttct

SEQ ID NO: 156698 - DNA, 20 bp, Artificial Sequence
  Synthetic oligonucleotide; TGG chr2 60450800 60450819 60450816 +
ttctcagtgcacacatctgt

SEQ ID NO: 156699 - DNA, 20 bp, Artificial Sequence
  Synthetic oligonucleotide; TAG chr2 60450803 60450822 60450819 +
tcagtgcacacatctgttgg

SEQ ID NO: 156700 - DNA, 20 bp, Artificial Sequence
  Synthetic oligonucleotide; AGG chr2 60450804 60450823 60450820 +
cagtgcacacatctgttggt

SEQ ID NO: 156701 - DNA, 20 bp, Artificial Sequence
  Synthetic oligonucleotide; AAG chr2 60450807 60450826 60450823 +
tgcacacatctgttggtagg

SEQ ID NO: 156702 - DNA, 20 bp, Artificial Sequence
  Synthetic oligonucleotide; GAG chr2 60450809 60450828 60450825 +
cacacatctgttggtaggaa

SEQ ID NO: 156703 - DNA, 20 bp, Artificial Sequence
  Synthetic oligonucleotide; AGG chr2 60450810 60450829 60450826 +
acacatctgttggtaggaag

SEQ ID NO: 156704 - DNA, 20 bp, Artificial Sequence
  Synthetic oligonucleotide; AAG chr2 60450834 60450853 60450850 +
aactctgcatgcctttacca

SEQ ID NO: 156705 - DNA, 20 bp, Artificial Sequence
  Synthetic oligonucleotide; AGG chr2 60450835 60450854 60450851 +
actctgcatgcctttaccaa

SEQ ID NO: 156706 - DNA, 20 bp, Artificial Sequence
  Synthetic oligonucleotide; TGG chr2 60450844 60450863 60450860 +
gcctttaccaaaggccatcc

SEQ ID NO: 156707 - DNA, 20 bp, Artificial Sequence
  Synthetic oligonucleotide; GGG chr2 60450845 60450864 60450861 +
cctttaccaaaggccatcct

SEQ ID NO: 156708 - DNA, 20 bp, Artificial Sequence
  Synthetic oligonucleotide; AAG chr2 60450859 60450878 60450875 +
catcctgggtctgtatgtgt

SEQ ID NO: 156709 - DNA, 20 bp, Artificial Sequence
  Synthetic oligonucleotide; CAG chr2 60450906 60450925 60450922 +
ttatgacttatgtgctaaca

SEQ ID NO: 156710 - DNA, 20 bp, Artificial Sequence
  Synthetic oligonucleotide; AGG chr2 60450907 60450926 60450923 +
tatgacttatgtgctaacac

SEQ ID NO: 156711 - DNA, 20 bp, Artificial Sequence
  Synthetic oligonucleotide; AAG chr2 60450912 60450931 60450928 +
cttatgtgctaacacaggaa

SEQ ID NO: 156712 - DNA, 20 bp, Artificial Sequence
  Synthetic oligonucleotide; CAG chr2 60450929 60450948 60450945 +
gaaaagatactccctttgat

SEQ ID NO: 156713 - DNA, 20 bp, Artificial Sequence
  Synthetic oligonucleotide; CAG chr2 60450937 60450956 60450953 +
actccctttgatcagttaaa

SEQ ID NO: 156714 - DNA, 20 bp, Artificial Sequence
  Synthetic oligonucleotide; GAG chr2 60450939 60450958 60450955 +
tccctttgatcagttaaaca

SEQ ID NO: 156715 - DNA, 20 bp, Artificial Sequence
  Synthetic oligonucleotide; TGG chr2 60450944 60450963 60450960 +
ttgatcagttaaacagagtt

SEQ ID NO: 156716 - DNA, 20 bp, Artificial Sequence
  Synthetic oligonucleotide; TAG chr2 60450953 60450972 60450969 +
taaacagagtttggtgaaat

SEQ ID NO: 156717 - DNA, 20 bp, Artificial Sequence
  Synthetic oligonucleotide; TGG chr2 60450959 60450978 60450975 +
gagtttggtgaaattagctc

SEQ ID NO: 156718 - DNA, 20 bp, Artificial Sequence
  Synthetic oligonucleotide; AAG chr2 60450964 60450983 60450980 +
tggtgaaattagctctggac

SEQ ID NO: 156719 - DNA, 20 bp, Artificial Sequence
  Synthetic oligonucleotide; CAG chr2 60450971 60450990 60450987 +
attagctctggacaagaaac

SEQ ID NO: 156720 - DNA, 20 bp, Artificial Sequence
  Synthetic oligonucleotide; TGG chr2 60450980 60450999 60450996 +
ggacaagaaaccagaaaacc

SEQ ID NO: 156721 - DNA, 20 bp, Artificial Sequence
  Synthetic oligonucleotide; TGG chr2 60451009 60451028 60451025 +
tgctttctctcttactgatg

SEQ ID NO: 156722 - DNA, 20 bp, Artificial Sequence
  Synthetic oligonucleotide; TGG chr2 60451016 60451035 60451032 +
tctcttactgatgtggcctc

SEQ ID NO: 156723 - DNA, 20 bp, Artificial Sequence
  Synthetic oligonucleotide; AAG chr2 60451020 60451039 60451036 +
ttactgatgtggcctctggc

SEQ ID NO: 156724 - DNA, 20 bp, Artificial Sequence
  Synthetic oligonucleotide; TGG chr2 60451033 60451052 60451049 +
ctctggcaagcccttaacct

SEQ ID NO: 156725 - DNA, 20 bp, Artificial Sequence
  Synthetic oligonucleotide; AAG chr2 60451037 60451056 60451053 +
ggcaagcccttaaccttggt

SEQ ID NO: 156726 - DNA, 20 bp, Artificial Sequence
  Synthetic oligonucleotide; AAG chr2 60451060 60451079 60451076 +
cctcaatctccacctccata

SEQ ID NO: 156727 - DNA, 20 bp, Artificial Sequence
  Synthetic oligonucleotide; TAG chr2 60451063 60451082 60451079 +
caatctccacctccataaag

SEQ ID NO: 156728 - DNA, 20 bp, Artificial Sequence
  Synthetic oligonucleotide; AAG chr2 60451066 60451085 60451082 +
tctccacctccataaagtag

SEQ ID NO: 156729 - DNA, 20 bp, Artificial Sequence
  Synthetic oligonucleotide; GAG chr2 60451073 60451092 60451089 +
ctccataaagtagaagtcgt

SEQ ID NO: 156730 - DNA, 20 bp, Artificial Sequence
  Synthetic oligonucleotide; CAG chr2 60451084 60451103 60451100 +
agaagtcgtgagatctgtcc

SEQ ID NO: 156731 - DNA, 20 bp, Artificial Sequence
  Synthetic oligonucleotide; GAG chr2 60451086 60451105 60451102 +
aagtcgtgagatctgtccca

SEQ ID NO: 156732 - DNA, 20 bp, Artificial Sequence
  Synthetic oligonucleotide; GAG chr2 60451088 60451107 60451104 +
gtcgtgagatctgtcccaga

SEQ ID NO: 156733 - DNA, 20 bp, Artificial Sequence
  Synthetic oligonucleotide; CAG chr2 60451091 60451110 60451107 +
gtgagatctgtcccagagag

SEQ ID NO: 156734 - DNA, 20 bp, Artificial Sequence
  Synthetic oligonucleotide; AGG chr2 60451092 60451111 60451108 +
tgagatctgtcccagagagc

SEQ ID NO: 156735 - DNA, 20 bp, Artificial Sequence
  Synthetic oligonucleotide; GAG chr2 60451108 60451127 60451124 +
gagcaggtgaaataatgcac

SEQ ID NO: 156736 - DNA, 20 bp, Artificial Sequence
  Synthetic oligonucleotide; CAG chr2 60451112 60451131 60451128 +
aggtgaaataatgcacgaga

SEQ ID NO: 156737 - DNA, 20 bp, Artificial Sequence
  Synthetic oligonucleotide; CAG chr2 60451124 60451143 60451140 +
gcacgagacagcactgtata

SEQ ID NO: 156738 - DNA, 20 bp, Artificial Sequence
  Synthetic oligonucleotide; AAG chr2 60451130 60451149 60451146 +
gacagcactgtatacagtat

SEQ ID NO: 156739 - DNA, 20 bp, Artificial Sequence
  Synthetic oligonucleotide; AGG chr2 60451131 60451150 60451147 +
acagcactgtatacagtata

SEQ ID NO: 156740 - DNA, 20 bp, Artificial Sequence
  Synthetic oligonucleotide; TAG chr2 60451134 60451153 60451150 +
gcactgtatacagtataagg

SEQ ID NO: 156741 - DNA, 20 bp, Artificial Sequence
  Synthetic oligonucleotide; TAG chr2 60451147 60451166 60451163 +
tataaggtagttcactactg

SEQ ID NO: 156742 - DNA, 20 bp, Artificial Sequence
  Synthetic oligonucleotide; CAG chr2 60451151 60451170 60451167 +
aggtagttcactactgtaga

SEQ ID NO: 156743 - DNA, 20 bp, Artificial Sequence
  Synthetic oligonucleotide; AAG chr2 60451172 60451191 60451188 +
agtcattatttattatgaat

SEQ ID NO: 156744 - DNA, 20 bp, Artificial Sequence
  Synthetic oligonucleotide; CAG chr2 60451175 60451194 60451191 +
cattatttattatgaataag

SEQ ID NO: 156745 - DNA, 20 bp, Artificial Sequence
  Synthetic oligonucleotide; AGG chr2 60451176 60451195 60451192 +
attatttattatgaataagc

SEQ ID NO: 156746 - DNA, 20 bp, Artificial Sequence
  Synthetic oligonucleotide; TGG chr2 60451202 60451221 60451218 +
taattcacatgccaattatt

SEQ ID NO: 156747 - DNA, 20 bp, Artificial Sequence
  Synthetic oligonucleotide; AAG chr2 60451218 60451237 60451234 +
tatttggctatcttttcact

SEQ ID NO: 156748 - DNA, 20 bp, Artificial Sequence
  Synthetic oligonucleotide; TAG chr2 60451222 60451241 60451238 +
tggctatcttttcactaagc

SEQ ID NO: 156749 - DNA, 20 bp, Artificial Sequence
  Synthetic oligonucleotide; AGG chr2 60451223 60451242 60451239 +
ggctatcttttcactaagct

SEQ ID NO: 156750 - DNA, 20 bp, Artificial Sequence
  Synthetic oligonucleotide; TAG chr2 60451231 60451250 60451247 +
tttcactaagctaggtaatc

SEQ ID NO: 156751 - DNA, 20 bp, Artificial Sequence
  Synthetic oligonucleotide; CAG chr2 60451235 60451254 60451251 +
actaagctaggtaatctagc

SEQ ID NO: 156752 - DNA, 20 bp, Artificial Sequence
  Synthetic oligonucleotide; AAG chr2 60451238 60451257 60451254 +
aagctaggtaatctagccag

SEQ ID NO: 156753 - DNA, 20 bp, Artificial Sequence
  Synthetic oligonucleotide; AGG chr2 60451239 60451258 60451255 +
agctaggtaatctagccaga

SEQ ID NO: 156754 - DNA, 20 bp, Artificial Sequence
  Synthetic oligonucleotide; TGG chr2 60451242 60451261 60451258 +
taggtaatctagccagaagg

SEQ ID NO: 156755 - DNA, 20 bp, Artificial Sequence
  Synthetic oligonucleotide; TAG chr2 60451246 60451265 60451262 +
taatctagccagaaggtgga

SEQ ID NO: 156756 - DNA, 20 bp, Artificial Sequence
  Synthetic oligonucleotide; AGG chr2 60451247 60451266 60451263 +
aatctagccagaaggtggat

SEQ ID NO: 156757 - DNA, 20 bp, Artificial Sequence
  Synthetic oligonucleotide; TAG chr2 60451250 60451269 60451266 +
ctagccagaaggtggatagg

SEQ ID NO: 156758 - DNA, 20 bp, Artificial Sequence
  Synthetic oligonucleotide; AGG chr2 60451251 60451270 60451267 +
tagccagaaggtggataggt

SEQ ID NO: 156759 - DNA, 20 bp, Artificial Sequence
  Synthetic oligonucleotide; TAG chr2 60451266 60451285 60451282 +
taggtaggattttccccact

SEQ ID NO: 156760 - DNA, 20 bp, Artificial Sequence
  Synthetic oligonucleotide; AGG chr2 60451267 60451286 60451283 +
aggtaggattttccccactt

SEQ ID NO: 156761 - DNA, 20 bp, Artificial Sequence
  Synthetic oligonucleotide; CGG chr2 60451274 60451293 60451290 +
attttccccacttaggttca

SEQ ID NO: 156762 - DNA, 20 bp, Artificial Sequence
  Synthetic oligonucleotide; CAG chr2 60451293 60451312 60451309 +
acggcctgtatgtgaatcta

SEQ ID NO: 156763 - DNA, 20 bp, Artificial Sequence
  Synthetic oligonucleotide; CAG chr2 60451300 60451319 60451316 +
gtatgtgaatctacagcaca

SEQ ID NO: 156764 - DNA, 20 bp, Artificial Sequence
  Synthetic oligonucleotide; AGG chr2 60451301 60451320 60451317 +
tatgtgaatctacagcacac

SEQ ID NO: 156765 - DNA, 20 bp, Artificial Sequence
  Synthetic oligonucleotide; GAG chr2 60451309 60451328 60451325 +
tctacagcacacaggtgtct

SEQ ID NO: 156766 - DNA, 20 bp, Artificial Sequence
  Synthetic oligonucleotide; TGG chr2 60451365 60451384 60451381 +
tgttgtttctaattctcttc

SEQ ID NO: 156767 - DNA, 20 bp, Artificial Sequence
  Synthetic oligonucleotide; AAG chr2 60451374 60451393 60451390 +
taattctcttctggatctcc

SEQ ID NO: 156768 - DNA, 20 bp, Artificial Sequence
  Synthetic oligonucleotide; CAG chr2 60451377 60451396 60451393 +
ttctcttctggatctccaag

SEQ ID NO: 156769 - DNA, 20 bp, Artificial Sequence
  Synthetic oligonucleotide; GAG chr2 60451396 60451415 60451412 +
gcagtaaaaaataccaaact

SEQ ID NO: 156770 - DNA, 20 bp, Artificial Sequence
  Synthetic oligonucleotide; AAG chr2 60451401 60451420 60451417 +
aaaaaataccaaactgagaa

SEQ ID NO: 156771 - DNA, 20 bp, Artificial Sequence
  Synthetic oligonucleotide; TGG chr2 60451420 60451439 60451436 +
aaagttctgtgcaaattaac

SEQ ID NO: 156772 - DNA, 20 bp, Artificial Sequence
  Synthetic oligonucleotide; GGG chr2 60451421 60451440 60451437 +
aagttctgtgcaaattaact

SEQ ID NO: 156773 - DNA, 20 bp, Artificial Sequence
  Synthetic oligonucleotide; CAG chr2 60451425 60451444 60451441 +
tctgtgcaaattaactgggc

SEQ ID NO: 156774 - DNA, 20 bp, Artificial Sequence
  Synthetic oligonucleotide; AAG chr2 60451429 60451448 60451445 +
tgcaaattaactgggccaga

SEQ ID NO: 156775 - DNA, 20 bp, Artificial Sequence
  Synthetic oligonucleotide; TAG chr2 60451451 60451470 60451467 +
gaatttttaccacctgtttg

SEQ ID NO: 156776 - DNA, 20 bp, Artificial Sequence
  Synthetic oligonucleotide; TGG chr2 60451468 60451487 60451484 +
ttgtagatgtaacttatttg

SEQ ID NO: 156777 - DNA, 20 bp, Artificial Sequence
  Synthetic oligonucleotide; AAG chr2 60451482 60451501 60451498 +
tatttgtggcactaatttct

SEQ ID NO: 156778 - DNA, 20 bp, Artificial Sequence
  Synthetic oligonucleotide; AGG chr2 60451483 60451502 60451499 +
atttgtggcactaatttcta

SEQ ID NO: 156779 - DNA, 20 bp, Artificial Sequence
  Synthetic oligonucleotide; TAG chr2 60451488 60451507 60451504 +
tggcactaatttctaaggaa

SEQ ID NO: 156780 - DNA, 20 bp, Artificial Sequence
  Synthetic oligonucleotide; GAG chr2 60451490 60451509 60451506 +
gcactaatttctaaggaata

SEQ ID NO: 156781 - DNA, 20 bp, Artificial Sequence
  Synthetic oligonucleotide; AAG chr2 60451578 60451597 60451594 +
tgccccaaatttcctgatgt

SEQ ID NO: 156782 - DNA, 20 bp, Artificial Sequence
  Synthetic oligonucleotide; AAG chr2 60451586 60451605 60451602 +
atttcctgatgtaagtacta

SEQ ID NO: 156783 - DNA, 20 bp, Artificial Sequence
  Synthetic oligonucleotide; AAG chr2 60451589 60451608 60451605 +
tcctgatgtaagtactaaag

SEQ ID NO: 156784 - DNA, 20 bp, Artificial Sequence
  Synthetic oligonucleotide; AAG chr2 60451615 60451634 60451631 +
tatgtttgtttgtctgcatt

SEQ ID NO: 156785 - DNA, 20 bp, Artificial Sequence
  Synthetic oligonucleotide; AAG chr2 60451630 60451649 60451646 +
gcattaagatatatttcctg

SEQ ID NO: 156786 - DNA, 20 bp, Artificial Sequence
  Synthetic oligonucleotide; AGG chr2 60451631 60451650 60451647 +
cattaagatatatttcctga

SEQ ID NO: 156787 - DNA, 20 bp, Artificial Sequence
  Synthetic oligonucleotide; TGG chr2 60451636 60451655 60451652 +
agatatatttcctgaaggtt

SEQ ID NO: 156788 - DNA, 20 bp, Artificial Sequence
  Synthetic oligonucleotide; GGG chr2 60451637 60451656 60451653 +
gatatatttcctgaaggttt

SEQ ID NO: 156789 - DNA, 20 bp, Artificial Sequence
  Synthetic oligonucleotide; TAG chr2 60451650 60451669 60451666 +
aaggtttgggaacctaaaat

SEQ ID NO: 156790 - DNA, 20 bp, Artificial Sequence
  Synthetic oligonucleotide; AAG chr2 60451663 60451682 60451679 +
ctaaaattagaatatttaat

SEQ ID NO: 156791 - DNA, 20 bp, Artificial Sequence
  Synthetic oligonucleotide; TAG chr2 60451692 60451711 60451708 +
ctgacatttatcaccttctt

SEQ ID NO: 156792 - DNA, 20 bp, Artificial Sequence
  Synthetic oligonucleotide; AGG chr2 60451693 60451712 60451709 +
tgacatttatcaccttcttt

SEQ ID NO: 156793 - DNA, 20 bp, Artificial Sequence
  Synthetic oligonucleotide; CAG chr2 60451710 60451729 60451726 +
tttaggatttaccgctcgcc

SEQ ID NO: 156794 - DNA, 20 bp, Artificial Sequence
  Synthetic oligonucleotide; AAG chr2 60451727 60451746 60451743 +
gcccagtgatgttctttcct

SEQ ID NO: 156795 - DNA, 20 bp, Artificial Sequence
  Synthetic oligonucleotide; AAG chr2 60451739 60451758 60451755 +
tctttcctaagctaaattaa

SEQ ID NO: 156796 - DNA, 20 bp, Artificial Sequence
  Synthetic oligonucleotide; TGG chr2 60451760 60451779 60451776 +
agacaaattcaaatcctgca

SEQ ID NO: 156797 - DNA, 20 bp, Artificial Sequence
  Synthetic oligonucleotide; TAG chr2 60451763 60451782 60451779 +
caaattcaaatcctgcatgg

SEQ ID NO: 156798 - DNA, 20 bp, Artificial Sequence
  Synthetic oligonucleotide; AAG chr2 60451773 60451792 60451789 +
tcctgcatggtagccaccaa

SEQ ID NO: 156799 - DNA, 20 bp, Artificial Sequence
  Synthetic oligonucleotide; CAG chr2 60451791 60451810 60451807 +
aaaagcatatatttgaaaaa

SEQ ID NO: 156800 - DNA, 20 bp, Artificial Sequence
  Synthetic oligonucleotide; AGG chr2 60451792 60451811 60451808 +
aaagcatatatttgaaaaac

SEQ ID NO: 156801 - DNA, 20 bp, Artificial Sequence
  Synthetic oligonucleotide; CGG chr2 60451798 60451817 60451814 +
tatatttgaaaaacaggatt

SEQ ID NO: 156802 - DNA, 20 bp, Artificial Sequence
  Synthetic oligonucleotide; TGG chr2 60451825 60451844 60451841 +
ccatattatgcattatttaa

SEQ ID NO: 156803 - DNA, 20 bp, Artificial Sequence
  Synthetic oligonucleotide; AAG chr2 60451840 60451859 60451856 +
tttaatggtatgcaaattat

SEQ ID NO: 156804 - DNA, 20 bp, Artificial Sequence
  Synthetic oligonucleotide; CAG chr2 60451844 60451863 60451860 +
atggtatgcaaattataagt

SEQ ID NO: 156805 - DNA, 20 bp, Artificial Sequence
  Synthetic oligonucleotide; CAG chr2 60451848 60451867 60451864 +
tatgcaaattataagtcaga

SEQ ID NO: 156806 - DNA, 20 bp, Artificial Sequence
  Synthetic oligonucleotide; TAG chr2 60451852 60451871 60451868 +
caaattataagtcagacagt

SEQ ID NO: 156807 - DNA, 20 bp, Artificial Sequence
  Synthetic oligonucleotide; AGG chr2 60451853 60451872 60451869 +
aaattataagtcagacagtt

SEQ ID NO: 156808 - DNA, 20 bp, Artificial Sequence
  Synthetic oligonucleotide; CAG chr2 60451868 60451887 60451884 +
cagttaggaaaaccacactt

SEQ ID NO: 156809 - DNA, 20 bp, Artificial Sequence
  Synthetic oligonucleotide; CAG chr2 60451881 60451900 60451897 +
cacacttcagcattaataaa

SEQ ID NO: 156810 - DNA, 20 bp, Artificial Sequence
  Synthetic oligonucleotide; AAG chr2 60451930 60451949 60451946 +
tattgctatgatttattccc

SEQ ID NO: 156811 - DNA, 20 bp, Artificial Sequence
  Synthetic oligonucleotide; AAG chr2 60451974 60451993 60451990 +
gaaaatttatgccatctgat

SEQ ID NO: 156812 - DNA, 20 bp, Artificial Sequence
  Synthetic oligonucleotide; CGG chr2 60451977 60451996 60451993 +
aatttatgccatctgataag

SEQ ID NO: 156813 - DNA, 20 bp, Artificial Sequence
  Synthetic oligonucleotide; TAG chr2 60451985 60452004 60452001 +
ccatctgataagcggtaacc

SEQ ID NO: 156814 - DNA, 20 bp, Artificial Sequence
  Synthetic oligonucleotide; TGG chr2 60452043 60452062 60452059 +
tgttcctcctacccacccga

SEQ ID NO: 156815 - DNA, 20 bp, Artificial Sequence
  Synthetic oligonucleotide; GGG chr2 60452044 60452063 60452060 +
gttcctcctacccacccgat

SEQ ID NO: 156816 - DNA, 20 bp, Artificial Sequence
  Synthetic oligonucleotide; TAG chr2 60452053 60452072 60452069 +
acccacccgatgggtgtctg

SEQ ID NO: 156817 - DNA, 20 bp, Artificial Sequence
  Synthetic oligonucleotide; AGG chr2 60452054 60452073 60452070 +
cccacccgatgggtgtctgt

SEQ ID NO: 156818 - DNA, 20 bp, Artificial Sequence
  Synthetic oligonucleotide; CAG chr2 60452060 60452079 60452076 +
cgatgggtgtctgtaggaaa

SEQ ID NO: 156819 - DNA, 20 bp, Artificial Sequence
  Synthetic oligonucleotide; AGG chr2 60452061 60452080 60452077 +
gatgggtgtctgtaggaaac

SEQ ID NO: 156820 - DNA, 20 bp, Artificial Sequence
  Synthetic oligonucleotide; CAG chr2 60452066 60452085 60452082 +
gtgtctgtaggaaacaggta

SEQ ID NO: 156821 - DNA, 20 bp, Artificial Sequence
  Synthetic oligonucleotide; AAG chr2 60452069 60452088 60452085 +
tctgtaggaaacaggtacag

SEQ ID NO: 156822 - DNA, 20 bp, Artificial Sequence
  Synthetic oligonucleotide; AAG chr2 60452083 60452102 60452099 +
gtacagaagtacaaaatcat

SEQ ID NO: 156823 - DNA, 20 bp, Artificial Sequence
  Synthetic oligonucleotide; CAG chr2 60452086 60452105 60452102 +
cagaagtacaaaatcataag

SEQ ID NO: 156824 - DNA, 20 bp, Artificial Sequence
  Synthetic oligonucleotide; AAG chr2 60452103 60452122 60452119 +
aagcagcctcattgtcttat

SEQ ID NO: 156825 - DNA, 20 bp, Artificial Sequence
  Synthetic oligonucleotide; AAG chr2 60452118 60452137 60452134 +
cttataagcattaaaaatta

SEQ ID NO: 156826 - DNA, 20 bp, Artificial Sequence
  Synthetic oligonucleotide; AAG chr2 60452124 60452143 60452140 +
agcattaaaaattaaagaac

SEQ ID NO: 156827 - DNA, 20 bp, Artificial Sequence
  Synthetic oligonucleotide; AAG chr2 60452140 60452159 60452156 +
gaacaagcaaacaccaccta

SEQ ID NO: 156828 - DNA, 20 bp, Artificial Sequence
  Synthetic oligonucleotide; AAG chr2 60452168 60452187 60452184 +
acatttattgtgtcaatgtt

SEQ ID NO: 156829 - DNA, 20 bp, Artificial Sequence
  Synthetic oligonucleotide; AAG chr2 60452183 60452202 60452199 +
atgttaagcacactttttaa

SEQ ID NO: 156830 - DNA, 20 bp, Artificial Sequence
  Synthetic oligonucleotide; TAG chr2 60452192 60452211 60452208 +
acactttttaaaagacaaca

SEQ ID NO: 156831 - DNA, 20 bp, Artificial Sequence
  Synthetic oligonucleotide; TAG chr2 60452201 60452220 60452217 +
aaaagacaacatagaatgta

SEQ ID NO: 156832 - DNA, 20 bp, Artificial Sequence
  Synthetic oligonucleotide; AAG chr2 60452208 60452227 60452224 +
aacatagaatgtatagaaac

SEQ ID NO: 156833 - DNA, 20 bp, Artificial Sequence
  Synthetic oligonucleotide; AGG chr2 60452209 60452228 60452225 +
acatagaatgtatagaaaca

SEQ ID NO: 156834 - DNA, 20 bp, Artificial Sequence
  Synthetic oligonucleotide; GGG chr2 60452210 60452229 60452226 +
catagaatgtatagaaacaa

SEQ ID NO: 156835 - DNA, 20 bp, Artificial Sequence
  Synthetic oligonucleotide; GGG chr2 60452211 60452230 60452227 +
atagaatgtatagaaacaag

SEQ ID NO: 156836 - DNA, 20 bp, Artificial Sequence
  Synthetic oligonucleotide; TGG chr2 60452215 60452234 60452231 +
aatgtatagaaacaaggggt

SEQ ID NO: 156837 - DNA, 20 bp, Artificial Sequence
  Synthetic oligonucleotide; GGG chr2 60452216 60452235 60452232 +
atgtatagaaacaaggggtt

SEQ ID NO: 156838 - DNA, 20 bp, Artificial Sequence
  Synthetic oligonucleotide; GGG chr2 60452217 60452236 60452233 +
tgtatagaaacaaggggttg

SEQ ID NO: 156839 - DNA, 20 bp, Artificial Sequence
  Synthetic oligonucleotide; CAG chr2 60452242 60452261 60452258 +
tcatgcgcatttccacaata

SEQ ID NO: 156840 - DNA, 20 bp, Artificial Sequence
  Synthetic oligonucleotide; AGG chr2 60452243 60452262 60452259 +
catgcgcatttccacaatac

SEQ ID NO: 156841 - DNA, 20 bp, Artificial Sequence
  Synthetic oligonucleotide; TAG chr2 60452250 60452269 60452266 +
atttccacaatacaggtaat

SEQ ID NO: 156842 - DNA, 20 bp, Artificial Sequence
  Synthetic oligonucleotide; AGG chr2 60452251 60452270 60452267 +
tttccacaatacaggtaatt

SEQ ID NO: 156843 - DNA, 20 bp, Artificial Sequence
  Synthetic oligonucleotide; TGG chr2 60452255 60452274 60452271 +
cacaatacaggtaattaggt

SEQ ID NO: 156844 - DNA, 20 bp, Artificial Sequence
  Synthetic oligonucleotide; TGG chr2 60452259 60452278 60452275 +
atacaggtaattaggttggc

SEQ ID NO: 156845 - DNA, 20 bp, Artificial Sequence
  Synthetic oligonucleotide; CAG chr2 60452265 60452284 60452281 +
gtaattaggttggctggttt

SEQ ID NO: 156846 - DNA, 20 bp, Artificial Sequence
  Synthetic oligonucleotide; AAG chr2 60452268 60452287 60452284 +
attaggttggctggtttcag

SEQ ID NO: 156847 - DNA, 20 bp, Artificial Sequence
  Synthetic oligonucleotide; AGG chr2 60452269 60452288 60452285 +
ttaggttggctggtttcaga

SEQ ID NO: 156848 - DNA, 20 bp, Artificial Sequence
  Synthetic oligonucleotide; GGG chr2 60452270 60452289 60452286 +
taggttggctggtttcagaa

SEQ ID NO: 156849 - DNA, 20 bp, Artificial Sequence
  Synthetic oligonucleotide; CAG chr2 60452274 60452293 60452290 +
ttggctggtttcagaagggc

SEQ ID NO: 156850 - DNA, 20 bp, Artificial Sequence
  Synthetic oligonucleotide; AGG chr2 60452275 60452294 60452291 +
tggctggtttcagaagggcc

SEQ ID NO: 156851 - DNA, 20 bp, Artificial Sequence
  Synthetic oligonucleotide; GGG chr2 60452276 60452295 60452292 +
ggctggtttcagaagggcca

SEQ ID NO: 156852 - DNA, 20 bp, Artificial Sequence
  Synthetic oligonucleotide; CAG chr2 60452291 60452310 60452307 +
ggccagggcatcactcatga

SEQ ID NO: 156853 - DNA, 20 bp, Artificial Sequence
  Synthetic oligonucleotide; TGG chr2 60452297 60452316 60452313 +
ggcatcactcatgacagcga

SEQ ID NO: 156854 - DNA, 20 bp, Artificial Sequence
  Synthetic oligonucleotide; CGG chr2 60452304 60452323 60452320 +
ctcatgacagcgatggtcca

SEQ ID NO: 156855 - DNA, 20 bp, Artificial Sequence
  Synthetic oligonucleotide; GGG chr2 60452305 60452324 60452321 +
tcatgacagcgatggtccac

SEQ ID NO: 156856 - DNA, 20 bp, Artificial Sequence
  Synthetic oligonucleotide; TGG chr2 60452317 60452336 60452333 +
tggtccacgggccctctcta

SEQ ID NO: 156857 - DNA, 20 bp, Artificial Sequence
  Synthetic oligonucleotide; GGG chr2 60452318 60452337 60452334 +
ggtccacgggccctctctat

SEQ ID NO: 156858 - DNA, 20 bp, Artificial Sequence
  Synthetic oligonucleotide; TGG chr2 60452341 60452360 60452357 +
actgattcactgttccaatg

SEQ ID NO: 156859 - DNA, 20 bp, Artificial Sequence
  Synthetic oligonucleotide; GGG chr2 60452342 60452361 60452358 +
ctgattcactgttccaatgt

SEQ ID NO: 156860 - DNA, 20 bp, Artificial Sequence
  Synthetic oligonucleotide; TGG chr2 60452389 60452408 60452405 +
attaaaaaatataaataaaa

SEQ ID NO: 156861 - DNA, 20 bp, Artificial Sequence
  Synthetic oligonucleotide; CAG chr2 60452397 60452416 60452413 +
atataaataaaatggcgctg

SEQ ID NO: 156862 - DNA, 20 bp, Artificial Sequence
  Synthetic oligonucleotide; AGG chr2 60452398 60452417 60452414 +
tataaataaaatggcgctgc

SEQ ID NO: 156863 - DNA, 20 bp, Artificial Sequence
  Synthetic oligonucleotide; TAG chr2 60452403 60452422 60452419 +
ataaaatggcgctgcaggcc

SEQ ID NO: 156864 - DNA, 20 bp, Artificial Sequence
  Synthetic oligonucleotide; AGG chr2 60452404 60452423 60452420 +
taaaatggcgctgcaggcct

SEQ ID NO: 156865 - DNA, 20 bp, Artificial Sequence
  Synthetic oligonucleotide; TGG chr2 60452408 60452427 60452424 +
atggcgctgcaggcctaggc

SEQ ID NO: 156866 - DNA, 20 bp, Artificial Sequence
  Synthetic oligonucleotide; AAG chr2 60452411 60452430 60452427 +
gcgctgcaggcctaggctgg

SEQ ID NO: 156867 - DNA, 20 bp, Artificial Sequence
  Synthetic oligonucleotide; AGG chr2 60452412 60452431 60452428 +
cgctgcaggcctaggctgga

SEQ ID NO: 156868 - DNA, 20 bp, Artificial Sequence
  Synthetic oligonucleotide; CAG chr2 60452421 60452440 60452437 +
cctaggctggaaggactctg

SEQ ID NO: 156869 - DNA, 20 bp, Artificial Sequence
  Synthetic oligonucleotide; AGG chr2 60452422 60452441 60452438 +
ctaggctggaaggactctgc

SEQ ID NO: 156870 - DNA, 20 bp, Artificial Sequence
  Synthetic oligonucleotide; CGG chr2 60452442 60452461 60452458 +
aggactctgtcttcgcacaa

SEQ ID NO: 156871 - DNA, 20 bp, Artificial Sequence
  Synthetic oligonucleotide; TGG chr2 60452450 60452469 60452466 +
gtcttcgcacaacggcttct

SEQ ID NO: 156872 - DNA, 20 bp, Artificial Sequence
  Synthetic oligonucleotide; GAG chr2 60452452 60452471 60452468 +
cttcgcacaacggcttcttg

SEQ ID NO: 156873 - DNA, 20 bp, Artificial Sequence
  Synthetic oligonucleotide; AGG chr2 60452453 60452472 60452469 +
ttcgcacaacggcttcttgg

SEQ ID NO: 156874 - DNA, 20 bp, Artificial Sequence
  Synthetic oligonucleotide; CAG chr2 60452463 60452482 60452479 +
ggcttcttggaggctactgt

SEQ ID NO: 156875 - DNA, 20 bp, Artificial Sequence
  Synthetic oligonucleotide; TAG chr2 60452480 60452499 60452496 +
tgtcagaaaacatcacaaac

SEQ ID NO: 156876 - DNA, 20 bp, Artificial Sequence
  Synthetic oligonucleotide; CAG chr2 60452483 60452502 60452499 +
cagaaaacatcacaaactag

SEQ ID NO: 156877 - DNA, 20 bp, Artificial Sequence
  Synthetic oligonucleotide; AGG chr2 60452484 60452503 60452500 +
agaaaacatcacaaactagc

SEQ ID NO: 156878 - DNA, 20 bp, Artificial Sequence
  Synthetic oligonucleotide; CAG chr2 60452491 60452510 60452507 +
atcacaaactagcaggatga

SEQ ID NO: 156879 - DNA, 20 bp, Artificial Sequence
  Synthetic oligonucleotide; TGG chr2 60452511 60452530 60452527 +
cagaccacgctgacgtcgac

SEQ ID NO: 156880 - DNA, 20 bp, Artificial Sequence
  Synthetic oligonucleotide; GGG chr2 60452512 60452531 60452528 +
agaccacgctgacgtcgact

SEQ ID NO: 156881 - DNA, 20 bp, Artificial Sequence
  Synthetic oligonucleotide; CGG chr2 60452515 60452534 60452531 +
ccacgctgacgtcgactggg

SEQ ID NO: 156882 - DNA, 20 bp, Artificial Sequence
  Synthetic oligonucleotide; TGG chr2 60452537 60452556 60452553 +
gcacgcgtccaccccacccc

SEQ ID NO: 156883 - DNA, 20 bp, Artificial Sequence
  Synthetic oligonucleotide; GGG chr2 60452538 60452557 60452554 +
cacgcgtccaccccacccct

SEQ ID NO: 156884 - DNA, 20 bp, Artificial Sequence
  Synthetic oligonucleotide; GGG chr2 60452539 60452558 60452555 +
acgcgtccaccccacccctg

SEQ ID NO: 156885 - DNA, 20 bp, Artificial Sequence
  Synthetic oligonucleotide; GGG chr2 60452540 60452559 60452556 +
cgcgtccaccccacccctgg

SEQ ID NO: 156886 - DNA, 20 bp, Artificial Sequence
  Synthetic oligonucleotide; CAG chr2 60452556 60452575 60452572 +
ctgggggcttcaaattttct

SEQ ID NO: 156887 - DNA, 20 bp, Artificial Sequence
  Synthetic oligonucleotide; AAG chr2 60452564 60452583 60452580 +
ttcaaattttctcagaactt

SEQ ID NO: 156888 - DNA, 20 bp, Artificial Sequence
  Synthetic oligonucleotide; AGG chr2 60452565 60452584 60452581 +
tcaaattttctcagaactta

SEQ ID NO: 156889 - DNA, 20 bp, Artificial Sequence
  Synthetic oligonucleotide; GGG chr2 60452566 60452585 60452582 +
caaattttctcagaacttaa

SEQ ID NO: 156890 - DNA, 20 bp, Artificial Sequence
  Synthetic oligonucleotide; GAG chr2 60452574 60452593 60452590 +
ctcagaacttaagggctctc

SEQ ID NO: 156891 - DNA, 20 bp, Artificial Sequence
  Synthetic oligonucleotide; GAG chr2 60452605 60452624 60452621 +
cgaaaactgccacacatctt

SEQ ID NO: 156892 - DNA, 20 bp, Artificial Sequence
  Synthetic oligonucleotide; TGG chr2 60452613 60452632 60452629 +
gccacacatcttgagctctc

SEQ ID NO: 156893 - DNA, 20 bp, Artificial Sequence
  Synthetic oligonucleotide; GGG chr2 60452614 60452633 60452630 +
ccacacatcttgagctctct

SEQ ID NO: 156894 - DNA, 20 bp, Artificial Sequence
  Synthetic oligonucleotide; TGG chr2 60452629 60452648 60452645 +
tctctgggtactacgccgaa

SEQ ID NO: 156895 - DNA, 20 bp, Artificial Sequence
  Synthetic oligonucleotide; GGG chr2 60452630 60452649 60452646 +
ctctgggtactacgccgaat

SEQ ID NO: 156896 - DNA, 20 bp, Artificial Sequence
  Synthetic oligonucleotide; GGG chr2 60452631 60452650 60452647 +
tctgggtactacgccgaatg

SEQ ID NO: 156897 - DNA, 20 bp, Artificial Sequence
  Synthetic oligonucleotide; GGG chr2 60452632 60452651 60452648 +
ctgggtactacgccgaatgg

SEQ ID NO: 156898 - DNA, 20 bp, Artificial Sequence
  Synthetic oligonucleotide; AAG chr2 60452641 60452660 60452657 +
acgccgaatgggggtgtgtg

SEQ ID NO: 156899 - DNA, 20 bp, Artificial Sequence
  Synthetic oligonucleotide; TAG chr2 60452648 60452667 60452664 +
atgggggtgtgtgaagaacc

SEQ ID NO: 156900 - DNA, 20 bp, Artificial Sequence
  Synthetic oligonucleotide; AAG chr2 60452652 60452671 60452668 +
gggtgtgtgaagaacctaga

SEQ ID NO: 156901 - DNA, 20 bp, Artificial Sequence
  Synthetic oligonucleotide; GAG chr2 60452654 60452673 60452670 +
gtgtgtgaagaacctagaaa

SEQ ID NO: 156902 - DNA, 20 bp, Artificial Sequence
  Synthetic oligonucleotide; AGG chr2 60452655 60452674 60452671 +
tgtgtgaagaacctagaaag

SEQ ID NO: 156903 - DNA, 20 bp, Artificial Sequence
  Synthetic oligonucleotide; TGG chr2 60452659 60452678 60452675 +
tgaagaacctagaaagaggt

SEQ ID NO: 156904 - DNA, 20 bp, Artificial Sequence
  Synthetic oligonucleotide; GAG chr2 60452661 60452680 60452677 +
aagaacctagaaagaggttg

SEQ ID NO: 156905 - DNA, 20 bp, Artificial Sequence
  Synthetic oligonucleotide; CAG chr2 60452665 60452684 60452681 +
acctagaaagaggttggaga

SEQ ID NO: 156906 - DNA, 20 bp, Artificial Sequence
  Synthetic oligonucleotide; GAG chr2 60452667 60452686 60452683 +
ctagaaagaggttggagaca

SEQ ID NO: 156907 - DNA, 20 bp, Artificial Sequence
  Synthetic oligonucleotide; AGG chr2 60452668 60452687 60452684 +
tagaaagaggttggagacag

SEQ ID NO: 156908 - DNA, 20 bp, Artificial Sequence
  Synthetic oligonucleotide; GAG chr2 60452670 60452689 60452686 +
gaaagaggttggagacagag

SEQ ID NO: 156909 - DNA, 20 bp, Artificial Sequence
  Synthetic oligonucleotide; AGG chr2 60452671 60452690 60452687 +
aaagaggttggagacagagg

SEQ ID NO: 156910 - DNA, 20 bp, Artificial Sequence
  Synthetic oligonucleotide; GGG chr2 60452672 60452691 60452688 +
aagaggttggagacagagga

SEQ ID NO: 156911 - DNA, 20 bp, Artificial Sequence
  Synthetic oligonucleotide; GGG chr2 60452673 60452692 60452689 +
agaggttggagacagaggag

SEQ ID NO: 156912 - DNA, 20 bp, Artificial Sequence
  Synthetic oligonucleotide; GGG chr2 60452674 60452693 60452690 +
gaggttggagacagaggagg

SEQ ID NO: 156913 - DNA, 20 bp, Artificial Sequence
  Synthetic oligonucleotide; AAG chr2 60452684 60452703 60452700 +
acagaggagggggaaaaaaa

SEQ ID NO: 156914 - DNA, 20 bp, Artificial Sequence
  Synthetic oligonucleotide; CAG chr2 60452689 60452708 60452705 +
ggagggggaaaaaaaaagta

SEQ ID NO: 156915 - DNA, 20 bp, Artificial Sequence
  Synthetic oligonucleotide; AGG chr2 60452690 60452709 60452706 +
gagggggaaaaaaaaagtac

SEQ ID NO: 156916 - DNA, 20 bp, Artificial Sequence
  Synthetic oligonucleotide; TGG chr2 60452700 60452719 60452716 +
aaaaaagtacaggtgtgact

SEQ ID NO: 156917 - DNA, 20 bp, Artificial Sequence
  Synthetic oligonucleotide; TAG chr2 60452727 60452746 60452743 +
atgattttctgttctctaac

SEQ ID NO: 156918 - DNA, 20 bp, Artificial Sequence
  Synthetic oligonucleotide; TAG chr2 60452742 60452761 60452758 +
ctaactagctttttaaaaat

SEQ ID NO: 156919 - DNA, 20 bp, Artificial Sequence
  Synthetic oligonucleotide; CAG chr2 60452760 60452779 60452776 +
attagaacttaaaccaacca

SEQ ID NO: 156920 - DNA, 20 bp, Artificial Sequence
  Synthetic oligonucleotide; AGG chr2 60452761 60452780 60452777 +
ttagaacttaaaccaaccac

SEQ ID NO: 156921 - DNA, 20 bp, Artificial Sequence
  Synthetic oligonucleotide; GAG chr2 60452766 60452785 60452782 +
acttaaaccaaccacaggtc

SEQ ID NO: 156922 - DNA, 20 bp, Artificial Sequence
  Synthetic oligonucleotide; TGG chr2 60452773 60452792 60452789 +
ccaaccacaggtcgagccac

SEQ ID NO: 156923 - DNA, 20 bp, Artificial Sequence
  Synthetic oligonucleotide; AAG chr2 60452782 60452801 60452798 +
ggtcgagccactggcatctt

SEQ ID NO: 156924 - DNA, 20 bp, Artificial Sequence
  Synthetic oligonucleotide; CAG chr2 60452799 60452818 60452815 +
cttaagcatgatttcaaact

SEQ ID NO: 156925 - DNA, 20 bp, Artificial Sequence
  Synthetic oligonucleotide; AAG chr2 60452814 60452833 60452830 +
aaactcagcctcccctcccc

SEQ ID NO: 156926 - DNA, 20 bp, Artificial Sequence
  Synthetic oligonucleotide; GAG chr2 60452831 60452850 60452847 +
cccaagtatctctgacctct

SEQ ID NO: 156927 - DNA, 20 bp, Artificial Sequence
  Synthetic oligonucleotide; AAG chr2 60452869 60452888 60452885 +
tccctcccttccgtcccccc

SEQ ID NO: 156928 - DNA, 20 bp, Artificial Sequence
  Synthetic oligonucleotide; AGG chr2 60452870 60452889 60452886 +
ccctcccttccgtcccccca

SEQ ID NO: 156929 - DNA, 20 bp, Artificial Sequence
  Synthetic oligonucleotide; GAG chr2 60452872 60452891 60452888 +
ctcccttccgtccccccaag

SEQ ID NO: 156930 - DNA, 20 bp, Artificial Sequence
  Synthetic oligonucleotide; AGG chr2 60452873 60452892 60452889 +
tcccttccgtccccccaagg

SEQ ID NO: 156931 - DNA, 20 bp, Artificial Sequence
  Synthetic oligonucleotide; CAG chr2 60452879 60452898 60452895 +
ccgtccccccaaggaggacc

SEQ ID NO: 156932 - DNA, 20 bp, Artificial Sequence
  Synthetic oligonucleotide; AGG chr2 60452880 60452899 60452896 +
cgtccccccaaggaggaccc

SEQ ID NO: 156933 - DNA, 20 bp, Artificial Sequence
  Synthetic oligonucleotide; TAG chr2 60452910 60452929 60452926 +
acccctgcccaattgtatga

SEQ ID NO: 156934 - DNA, 20 bp, Artificial Sequence
  Synthetic oligonucleotide; CGG chr2 60452925 60452944 60452941 +
tatgatagtcctaataaact

SEQ ID NO: 156935 - DNA, 20 bp, Artificial Sequence
  Synthetic oligonucleotide; GGG chr2 60452926 60452945 60452942 +
atgatagtcctaataaactc

SEQ ID NO: 156936 - DNA, 20 bp, Artificial Sequence
  Synthetic oligonucleotide; TGG chr2 60452936 60452955 60452952 +
taataaactcgggacacacc

SEQ ID NO: 156937 - DNA, 20 bp, Artificial Sequence
  Synthetic oligonucleotide; AAG chr2 60452939 60452958 60452955 +
taaactcgggacacacctgg

SEQ ID NO: 156938 - DNA, 20 bp, Artificial Sequence
  Synthetic oligonucleotide; AGG chr2 60452940 60452959 60452956 +
aaactcgggacacacctgga

SEQ ID NO: 156939 - DNA, 20 bp, Artificial Sequence
  Synthetic oligonucleotide; GAG chr2 60452963 60452982 60452979 +
aaacacttgcccttatgact

SEQ ID NO: 156940 - DNA, 20 bp, Artificial Sequence
  Synthetic oligonucleotide; TAG chr2 60452972 60452991 60452988 +
cccttatgactgagaaaact

SEQ ID NO: 156941 - DNA, 20 bp, Artificial Sequence
  Synthetic oligonucleotide; AAG chr2 60452976 60452995 60452992 +
tatgactgagaaaacttagt

SEQ ID NO: 156942 - DNA, 20 bp, Artificial Sequence
  Synthetic oligonucleotide; CAG chr2 60452982 60453001 60452998 +
tgagaaaacttagtaagaaa

SEQ ID NO: 156943 - DNA, 20 bp, Artificial Sequence
  Synthetic oligonucleotide; TGG chr2 60452990 60453009 60453006 +
cttagtaagaaacagtcctt

SEQ ID NO: 156944 - DNA, 20 bp, Artificial Sequence
  Synthetic oligonucleotide; GAG chr2 60452995 60453014 60453011 +
taagaaacagtcctttggtt

SEQ ID NO: 156945 - DNA, 20 bp, Artificial Sequence
  Synthetic oligonucleotide; AGG chr2 60452996 60453015 60453012 +
aagaaacagtcctttggttg

SEQ ID NO: 156946 - DNA, 20 bp, Artificial Sequence
  Synthetic oligonucleotide; GAG chr2 60452998 60453017 60453014 +
gaaacagtcctttggttgag

SEQ ID NO: 156947 - DNA, 20 bp, Artificial Sequence
  Synthetic oligonucleotide; GAG chr2 60453000 60453019 60453016 +
aacagtcctttggttgagga

SEQ ID NO: 156948 - DNA, 20 bp, Artificial Sequence
  Synthetic oligonucleotide; CGG chr2 60453003 60453022 60453019 +
agtcctttggttgaggagag

SEQ ID NO: 156949 - DNA, 20 bp, Artificial Sequence
  Synthetic oligonucleotide; GGG chr2 60453004 60453023 60453020 +
gtcctttggttgaggagagc

SEQ ID NO: 156950 - DNA, 20 bp, Artificial Sequence
  Synthetic oligonucleotide; GAG chr2 60453006 60453025 60453022 +
cctttggttgaggagagcgg

SEQ ID NO: 156951 - DNA, 20 bp, Artificial Sequence
  Synthetic oligonucleotide; GAG chr2 60453008 60453027 60453024 +
tttggttgaggagagcggga

SEQ ID NO: 156952 - DNA, 20 bp, Artificial Sequence
  Synthetic oligonucleotide; AGG chr2 60453009 60453028 60453025 +
ttggttgaggagagcgggag

SEQ ID NO: 156953 - DNA, 20 bp, Artificial Sequence
  Synthetic oligonucleotide; GGG chr2 60453010 60453029 60453026 +
tggttgaggagagcgggaga

SEQ ID NO: 156954 - DNA, 20 bp, Artificial Sequence
  Synthetic oligonucleotide; GAG chr2 60453012 60453031 60453028 +
gttgaggagagcgggagagg

SEQ ID NO: 156955 - DNA, 20 bp, Artificial Sequence
  Synthetic oligonucleotide; AGG chr2 60453013 60453032 60453029 +
ttgaggagagcgggagaggg

SEQ ID NO: 156956 - DNA, 20 bp, Artificial Sequence
  Synthetic oligonucleotide; GAG chr2 60453015 60453034 60453031 +
gaggagagcgggagagggag

SEQ ID NO: 156957 - DNA, 20 bp, Artificial Sequence
  Synthetic oligonucleotide; AGG chr2 60453016 60453035 60453032 +
aggagagcgggagagggagg

SEQ ID NO: 156958 - DNA, 20 bp, Artificial Sequence
  Synthetic oligonucleotide; GGG chr2 60453017 60453036 60453033 +
ggagagcgggagagggagga

SEQ ID NO: 156959 - DNA, 20 bp, Artificial Sequence
  Synthetic oligonucleotide; AAG chr2 60453021 60453040 60453037 +
agcgggagagggaggaggga

SEQ ID NO: 156960 - DNA, 20 bp, Artificial Sequence
  Synthetic oligonucleotide; AGG chr2 60453022 60453041 60453038 +
gcgggagagggaggagggaa

SEQ ID NO: 156961 - DNA, 20 bp, Artificial Sequence
  Synthetic oligonucleotide; GGG chr2 60453023 60453042 60453039 +
cgggagagggaggagggaaa

SEQ ID NO: 156962 - DNA, 20 bp, Artificial Sequence
  Synthetic oligonucleotide; GGG chr2 60453024 60453043 60453040 +
gggagagggaggagggaaag

SEQ ID NO: 156963 - DNA, 20 bp, Artificial Sequence
  Synthetic oligonucleotide; AAG chr2 60453057 60453076 60453073 +
aaaataataataaaattata

SEQ ID NO: 156964 - DNA, 20 bp, Artificial Sequence
  Synthetic oligonucleotide; AAG chr2 60453085 60453104 60453101 +
aaaaatcaaaactgatgtaa

SEQ ID NO: 156965 - DNA, 20 bp, Artificial Sequence
  Synthetic oligonucleotide; CAG chr2 60453088 60453107 60453104 +
aatcaaaactgatgtaaaag

SEQ ID NO: 156966 - DNA, 20 bp, Artificial Sequence
  Synthetic oligonucleotide; AAG chr2 60453116 60453135 60453132 +
cgaaaacatgaaatgtcatc

SEQ ID NO: 156967 - DNA, 20 bp, Artificial Sequence
  Synthetic oligonucleotide; AAG chr2 60453129 60453148 60453145 +
tgtcatcaagttcaacgtca

SEQ ID NO: 156968 - DNA, 20 bp, Artificial Sequence
  Synthetic oligonucleotide; CAG chr2 60453132 60453151 60453148 +
catcaagttcaacgtcaaag

SEQ ID NO: 156969 - DNA, 20 bp, Artificial Sequence
  Synthetic oligonucleotide; AAG chr2 60453147 60453166 60453163 +
caaagcagccaatgatttac

SEQ ID NO: 156970 - DNA, 20 bp, Artificial Sequence
  Synthetic oligonucleotide; GAG chr2 60453149 60453168 60453165 +
aagcagccaatgatttacaa

SEQ ID NO: 156971 - DNA, 20 bp, Artificial Sequence
  Synthetic oligonucleotide; AGG chr2 60453150 60453169 60453166 +
agcagccaatgatttacaag

SEQ ID NO: 156972 - DNA, 20 bp, Artificial Sequence
  Synthetic oligonucleotide; AAG chr2 60453167 60453186 60453183 +
aagaggcgaacaaatctctg

SEQ ID NO: 156973 - DNA, 20 bp, Artificial Sequence
  Synthetic oligonucleotide; GAG chr2 60453169 60453188 60453185 +
gaggcgaacaaatctctgaa

SEQ ID NO: 156974 - DNA, 20 bp, Artificial Sequence
  Synthetic oligonucleotide; CAG chr2 60453177 60453196 60453193 +
caaatctctgaagagaaaac

SEQ ID NO: 156975 - DNA, 20 bp, Artificial Sequence
  Synthetic oligonucleotide; AAG chr2 60453187 60453206 60453203 +
aagagaaaaccagaacccaa

SEQ ID NO: 156976 - DNA, 20 bp, Artificial Sequence
  Synthetic oligonucleotide; GAG chr2 60453189 60453208 60453205 +
gagaaaaccagaacccaaaa

SEQ ID NO: 156977 - DNA, 20 bp, Artificial Sequence
  Synthetic oligonucleotide; TAG chr2 60453222 60453241 60453238 +
attgcaccaaaaactgcctg

SEQ ID NO: 156978 - DNA, 20 bp, Artificial Sequence
  Synthetic oligonucleotide; CAG chr2 60453240 60453259 60453256 +
tgtagtttctttcaaacatg

SEQ ID NO: 156979 - DNA, 20 bp, Artificial Sequence
  Synthetic oligonucleotide; TGG chr2 60453258 60453277 60453274 +
tgcagttttcttttcttttt

SEQ ID NO: 156980 - DNA, 20 bp, Artificial Sequence
  Synthetic oligonucleotide; AAG chr2 60453261 60453280 60453277 +
agttttcttttcttttttgg

SEQ ID NO: 156981 - DNA, 20 bp, Artificial Sequence
  Synthetic oligonucleotide; AGG chr2 60453262 60453281 60453278 +
gttttcttttcttttttgga

SEQ ID NO: 156982 - DNA, 20 bp, Artificial Sequence
  Synthetic oligonucleotide; GGG chr2 60453263 60453282 60453279 +
ttttcttttcttttttggaa

SEQ ID NO: 156983 - DNA, 20 bp, Artificial Sequence
  Synthetic oligonucleotide; GGG chr2 60453264 60453283 60453280 +
tttcttttcttttttggaag

SEQ ID NO: 156984 - DNA, 20 bp, Artificial Sequence
  Synthetic oligonucleotide; GGG chr2 60453265 60453284 60453281 +
ttcttttcttttttggaagg

SEQ ID NO: 156985 - DNA, 20 bp, Artificial Sequence
  Synthetic oligonucleotide; AAG chr2 60453268 60453287 60453284 +
ttttcttttttggaaggggg

SEQ ID NO: 156986 - DNA, 20 bp, Artificial Sequence
  Synthetic oligonucleotide; AGG chr2 60453269 60453288 60453285 +
tttcttttttggaaggggga

SEQ ID NO: 156987 - DNA, 20 bp, Artificial Sequence
  Synthetic oligonucleotide; TGG chr2 60453275 60453294 60453291 +
ttttggaagggggaaggcaa

SEQ ID NO: 156988 - DNA, 20 bp, Artificial Sequence
  Synthetic oligonucleotide; AAG chr2 60453280 60453299 60453296 +
gaagggggaaggcaatggtg

SEQ ID NO: 156989 - DNA, 20 bp, Artificial Sequence
  Synthetic oligonucleotide; AGG chr2 60453281 60453300 60453297 +
aagggggaaggcaatggtga

SEQ ID NO: 156990 - DNA, 20 bp, Artificial Sequence
  Synthetic oligonucleotide; GGG chr2 60453282 60453301 60453298 +
agggggaaggcaatggtgaa

SEQ ID NO: 156991 - DNA, 20 bp, Artificial Sequence
  Synthetic oligonucleotide; AAG chr2 60453285 60453304 60453301 +
gggaaggcaatggtgaaggg

SEQ ID NO: 156992 - DNA, 20 bp, Artificial Sequence
  Synthetic oligonucleotide; AAG chr2 60453288 60453307 60453304 +
aaggcaatggtgaagggaag

SEQ ID NO: 156993 - DNA, 20 bp, Artificial Sequence
  Synthetic oligonucleotide; AGG chr2 60453289 60453308 60453305 +
aggcaatggtgaagggaaga

SEQ ID NO: 156994 - DNA, 20 bp, Artificial Sequence
  Synthetic oligonucleotide; GGG chr2 60453290 60453309 60453306 +
ggcaatggtgaagggaagaa

SEQ ID NO: 156995 - DNA, 20 bp, Artificial Sequence
  Synthetic oligonucleotide; GAG chr2 60453292 60453311 60453308 +
caatggtgaagggaagaagg

SEQ ID NO: 156996 - DNA, 20 bp, Artificial Sequence
  Synthetic oligonucleotide; TGG chr2 60453295 60453314 60453311 +
tggtgaagggaagaagggag

SEQ ID NO: 156997 - DNA, 20 bp, Artificial Sequence
  Synthetic oligonucleotide; CGG chr2 60453309 60453328 60453325 +
agggagtggttattttcctc

SEQ ID NO: 156998 - DNA, 20 bp, Artificial Sequence
  Synthetic oligonucleotide; GGG chr2 60453310 60453329 60453326 +
gggagtggttattttcctcc

SEQ ID NO: 156999 - DNA, 20 bp, Artificial Sequence
  Synthetic oligonucleotide; GGG chr2 60453311 60453330 60453327 +
ggagtggttattttcctccg

SEQ ID NO: 157000 - DNA, 20 bp, Artificial Sequence
  Synthetic oligonucleotide; TGG chr2 60453328 60453347 60453344 +
ccggggttcctcccttgctg

SEQ ID NO: 157001 - DNA, 20 bp, Artificial Sequence
  Synthetic oligonucleotide; AAG chr2 60453342 60453361 60453358 +
ttgctgtggacattgacttg

SEQ ID NO: 157002 - DNA, 20 bp, Artificial Sequence
  Synthetic oligonucleotide; CAG chr2 60453345 60453364 60453361 +
ctgtggacattgacttgaag

SEQ ID NO: 157003 - DNA, 20 bp, Artificial Sequence
  Synthetic oligonucleotide; CAG chr2 60453348 60453367 60453364 +
tggacattgacttgaagcag

SEQ ID NO: 157004 - DNA, 20 bp, Artificial Sequence
  Synthetic oligonucleotide; TGG chr2 60453354 60453373 60453370 +
ttgacttgaagcagcagaac

SEQ ID NO: 157005 - DNA, 20 bp, Artificial Sequence
  Synthetic oligonucleotide; GGG chr2 60453355 60453374 60453371 +
tgacttgaagcagcagaact

SEQ ID NO: 157006 - DNA, 20 bp, Artificial Sequence
  Synthetic oligonucleotide; GAG chr2 60453357 60453376 60453373 +
acttgaagcagcagaactgg

SEQ ID NO: 157007 - DNA, 20 bp, Artificial Sequence
  Synthetic oligonucleotide; CGG chr2 60453362 60453381 60453378 +
aagcagcagaactgggagtc

SEQ ID NO: 157008 - DNA, 20 bp, Artificial Sequence
  Synthetic oligonucleotide; GAG chr2 60453372 60453391 60453388 +
actgggagtccggatgtgcc

SEQ ID NO: 157009 - DNA, 20 bp, Artificial Sequence
  Synthetic oligonucleotide; AGG chr2 60453373 60453392 60453389 +
ctgggagtccggatgtgccg

SEQ ID NO: 157010 - DNA, 20 bp, Artificial Sequence
  Synthetic oligonucleotide; AAG chr2 60453376 60453395 60453392 +
ggagtccggatgtgccgagg

SEQ ID NO: 157011 - DNA, 20 bp, Artificial Sequence
  Synthetic oligonucleotide; GAG chr2 60453378 60453397 60453394 +
agtccggatgtgccgaggaa

SEQ ID NO: 157012 - DNA, 20 bp, Artificial Sequence
  Synthetic oligonucleotide; AGG chr2 60453379 60453398 60453395 +
gtccggatgtgccgaggaag

SEQ ID NO: 157013 - DNA, 20 bp, Artificial Sequence
  Synthetic oligonucleotide; GGG chr2 60453380 60453399 60453396 +
tccggatgtgccgaggaaga

SEQ ID NO: 157014 - DNA, 20 bp, Artificial Sequence
  Synthetic oligonucleotide; TGG chr2 60453392 60453411 60453408 +
gaggaagagggctaccactg

SEQ ID NO: 157015 - DNA, 20 bp, Artificial Sequence
  Synthetic oligonucleotide; CAG chr2 60453400 60453419 60453416 +
gggctaccactgtggcattc

SEQ ID NO: 157016 - DNA, 20 bp, Artificial Sequence
  Synthetic oligonucleotide; AGG chr2 60453401 60453420 60453417 +
ggctaccactgtggcattcc

SEQ ID NO: 157017 - DNA, 20 bp, Artificial Sequence
  Synthetic oligonucleotide; TGG chr2 60453415 60453434 60453431 +
cattccaggcctcgttgcca

SEQ ID NO: 157018 - DNA, 20 bp, Artificial Sequence
  Synthetic oligonucleotide; AAG chr2 60453425 60453444 60453441 +
ctcgttgccatggcgacccg

SEQ ID NO: 157019 - DNA, 20 bp, Artificial Sequence
  Synthetic oligonucleotide; CAG chr2 60453428 60453447 60453444 +
gttgccatggcgacccgaag

SEQ ID NO: 157020 - DNA, 20 bp, Artificial Sequence
  Synthetic oligonucleotide; AGG chr2 60453429 60453448 60453445 +
ttgccatggcgacccgaagc

SEQ ID NO: 157021 - DNA, 20 bp, Artificial Sequence
  Synthetic oligonucleotide; GGG chr2 60453430 60453449 60453446 +
tgccatggcgacccgaagca

SEQ ID NO: 157022 - DNA, 20 bp, Artificial Sequence
  Synthetic oligonucleotide; GGG chr2 60453431 60453450 60453447 +
gccatggcgacccgaagcag

SEQ ID NO: 157023 - DNA, 20 bp, Artificial Sequence
  Synthetic oligonucleotide; TGG chr2 60453436 60453455 60453452 +
ggcgacccgaagcaggggcc

SEQ ID NO: 157024 - DNA, 20 bp, Artificial Sequence
  Synthetic oligonucleotide; GGG chr2 60453437 60453456 60453453 +
gcgacccgaagcaggggcct

SEQ ID NO: 157025 - DNA, 20 bp, Artificial Sequence
  Synthetic oligonucleotide; GGG chr2 60453438 60453457 60453454 +
cgacccgaagcaggggcctg

SEQ ID NO: 157026 - DNA, 20 bp, Artificial Sequence
  Synthetic oligonucleotide; TGG chr2 60453458 60453477 60453474 +
gggcctcctctcccctgact

SEQ ID NO: 157027 - DNA, 20 bp, Artificial Sequence
  Synthetic oligonucleotide; CAG chr2 60453466 60453485 60453482 +
tctcccctgacttggcgccg

SEQ ID NO: 157028 - DNA, 20 bp, Artificial Sequence
  Synthetic oligonucleotide; AGG chr2 60453467 60453486 60453483 +
ctcccctgacttggcgccgc

SEQ ID NO: 157029 - DNA, 20 bp, Artificial Sequence
  Synthetic oligonucleotide; GAG chr2 60453469 60453488 60453485 +
cccctgacttggcgccgcag

SEQ ID NO: 157030 - DNA, 20 bp, Artificial Sequence
  Synthetic oligonucleotide; AGG chr2 60453470 60453489 60453486 +
ccctgacttggcgccgcagg

SEQ ID NO: 157031 - DNA, 20 bp, Artificial Sequence
  Synthetic oligonucleotide; CGG chr2 60453475 60453494 60453491 +
acttggcgccgcaggaggcc

SEQ ID NO: 157032 - DNA, 20 bp, Artificial Sequence
  Synthetic oligonucleotide; GGG chr2 60453476 60453495 60453492 +
cttggcgccgcaggaggccc

SEQ ID NO: 157033 - DNA, 20 bp, Artificial Sequence
  Synthetic oligonucleotide; GGG chr2 60453477 60453496 60453493 +
ttggcgccgcaggaggcccg

SEQ ID NO: 157034 - DNA, 20 bp, Artificial Sequence
  Synthetic oligonucleotide; TGG chr2 60453482 60453501 60453498 +
gccgcaggaggcccggggtc

SEQ ID NO: 157035 - DNA, 20 bp, Artificial Sequence
  Synthetic oligonucleotide; CAG chr2 60453489 60453508 60453505 +
gaggcccggggtctggatct

SEQ ID NO: 157036 - DNA, 20 bp, Artificial Sequence
  Synthetic oligonucleotide; GAG chr2 60453515 60453534 60453531 +
ctctcacgcatcccacccct

SEQ ID NO: 157037 - DNA, 20 bp, Artificial Sequence
  Synthetic oligonucleotide; CAG chr2 60453518 60453537 60453534 +
tcacgcatcccacccctgag

SEQ ID NO: 157038 - DNA, 20 bp, Artificial Sequence
  Synthetic oligonucleotide; GAG chr2 60453520 60453539 60453536 +
acgcatcccacccctgagca

SEQ ID NO: 157039 - DNA, 20 bp, Artificial Sequence
  Synthetic oligonucleotide; CAG chr2 60453523 60453542 60453539 +
catcccacccctgagcagag

SEQ ID NO: 157040 - DNA, 20 bp, Artificial Sequence
  Synthetic oligonucleotide; CGG chr2 60453526 60453545 60453542 +
cccacccctgagcagagcag

SEQ ID NO: 157041 - DNA, 20 bp, Artificial Sequence
  Synthetic oligonucleotide; GAG chr2 60453528 60453547 60453544 +
cacccctgagcagagcagcg

SEQ ID NO: 157042 - DNA, 20 bp, Artificial Sequence
  Synthetic oligonucleotide; TGG chr2 60453534 60453553 60453550 +
tgagcagagcagcggagacc

SEQ ID NO: 157043 - DNA, 20 bp, Artificial Sequence
  Synthetic oligonucleotide; GGG chr2 60453535 60453554 60453551 +
gagcagagcagcggagacct

SEQ ID NO: 157044 - DNA, 20 bp, Artificial Sequence
  Synthetic oligonucleotide; GAG chr2 60453540 60453559 60453556 +
gagcagcggagacctgggct

SEQ ID NO: 157045 - DNA, 20 bp, Artificial Sequence
  Synthetic oligonucleotide; AGG chr2 60453541 60453560 60453557 +
agcagcggagacctgggctg

SEQ ID NO: 157046 - DNA, 20 bp, Artificial Sequence
  Synthetic oligonucleotide; GGG chr2 60453542 60453561 60453558 +
gcagcggagacctgggctga

SEQ ID NO: 157047 - DNA, 20 bp, Artificial Sequence
  Synthetic oligonucleotide; GGG chr2 60453543 60453562 60453559 +
cagcggagacctgggctgag

SEQ ID NO: 157048 - DNA, 20 bp, Artificial Sequence
  Synthetic oligonucleotide; CAG chr2 60453557 60453576 60453573 +
gctgaggggcatgctgcgtc

SEQ ID NO: 157049 - DNA, 20 bp, Artificial Sequence
  Synthetic oligonucleotide; AGG chr2 60453558 60453577 60453574 +
ctgaggggcatgctgcgtcc

SEQ ID NO: 157050 - DNA, 20 bp, Artificial Sequence
  Synthetic oligonucleotide; TGG chr2 60453561 60453580 60453577 +
aggggcatgctgcgtccagg

SEQ ID NO: 157051 - DNA, 20 bp, Artificial Sequence
  Synthetic oligonucleotide; GGG chr2 60453562 60453581 60453578 +
ggggcatgctgcgtccaggt

SEQ ID NO: 157052 - DNA, 20 bp, Artificial Sequence
  Synthetic oligonucleotide; TGG chr2 60453568 60453587 60453584 +
tgctgcgtccaggtgggttc

SEQ ID NO: 157053 - DNA, 20 bp, Artificial Sequence
  Synthetic oligonucleotide; GGG chr2 60453569 60453588 60453585 +
gctgcgtccaggtgggttct

SEQ ID NO: 157054 - DNA, 20 bp, Artificial Sequence
  Synthetic oligonucleotide; GGG chr2 60453570 60453589 60453586 +
ctgcgtccaggtgggttctg

SEQ ID NO: 157055 - DNA, 20 bp, Artificial Sequence
  Synthetic oligonucleotide; CAG chr2 60453584 60453603 60453600 +
gttctggggaatcccattcc

SEQ ID NO: 157056 - DNA, 20 bp, Artificial Sequence
  Synthetic oligonucleotide; CAG chr2 60453589 60453608 60453605 +
ggggaatcccattcccagtc

SEQ ID NO: 157057 - DNA, 20 bp, Artificial Sequence
  Synthetic oligonucleotide; AAG chr2 60453596 60453615 60453612 +
cccattcccagtccagcgct

SEQ ID NO: 157058 - DNA, 20 bp, Artificial Sequence
  Synthetic oligonucleotide; GAG chr2 60453610 60453629 60453626 +
agcgctaagtcactgtcgtc

SEQ ID NO: 157059 - DNA, 20 bp, Artificial Sequence
  Synthetic oligonucleotide; AGG chr2 60453611 60453630 60453627 +
gcgctaagtcactgtcgtcg

SEQ ID NO: 157060 - DNA, 20 bp, Artificial Sequence
  Synthetic oligonucleotide; TAG chr2 60453620 60453639 60453636 +
cactgtcgtcgaggcccctt

SEQ ID NO: 157061 - DNA, 20 bp, Artificial Sequence
  Synthetic oligonucleotide; TAG chr2 60453678 60453697 60453694 +
taccaatattcaaattctaa

SEQ ID NO: 157062 - DNA, 20 bp, Artificial Sequence
  Synthetic oligonucleotide; AAG chr2 60453684 60453703 60453700 +
tattcaaattctaatagaca

SEQ ID NO: 157063 - DNA, 20 bp, Artificial Sequence
  Synthetic oligonucleotide; TGG chr2 60453694 60453713 60453710 +
ctaatagacaaagtatatca

SEQ ID NO: 157064 - DNA, 20 bp, Artificial Sequence
  Synthetic oligonucleotide; GGG chr2 60453695 60453714 60453711 +
taatagacaaagtatatcat

SEQ ID NO: 157065 - DNA, 20 bp, Artificial Sequence
  Synthetic oligonucleotide; CAG chr2 60453713 60453732 60453729 +
atgggcatgtaccacgttca

SEQ ID NO: 157066 - DNA, 20 bp, Artificial Sequence
  Synthetic oligonucleotide; AAG chr2 60453724 60453743 60453740 +
ccacgttcacagctatttaa

SEQ ID NO: 157067 - DNA, 20 bp, Artificial Sequence
  Synthetic oligonucleotide; CAG chr2 60453729 60453748 60453745 +
ttcacagctatttaaaagca

SEQ ID NO: 157068 - DNA, 20 bp, Artificial Sequence
  Synthetic oligonucleotide; TGG chr2 60453740 60453759 60453756 +
ttaaaagcacagccccccta

SEQ ID NO: 157069 - DNA, 20 bp, Artificial Sequence
  Synthetic oligonucleotide; GGG chr2 60453741 60453760 60453757 +
taaaagcacagcccccctat

SEQ ID NO: 157070 - DNA, 20 bp, Artificial Sequence
  Synthetic oligonucleotide; TAG chr2 60453746 60453765 60453762 +
gcacagcccccctatgggtt

SEQ ID NO: 157071 - DNA, 20 bp, Artificial Sequence
  Synthetic oligonucleotide; AGG chr2 60453747 60453766 60453763 +
cacagcccccctatgggttt

SEQ ID NO: 157072 - DNA, 20 bp, Artificial Sequence
  Synthetic oligonucleotide; GGG chr2 60453748 60453767 60453764 +
acagcccccctatgggttta

SEQ ID NO: 157073 - DNA, 20 bp, Artificial Sequence
  Synthetic oligonucleotide; GGG chr2 60453749 60453768 60453765 +
cagcccccctatgggtttag

SEQ ID NO: 157074 - DNA, 20 bp, Artificial Sequence
  Synthetic oligonucleotide; TAG chr2 60453761 60453780 60453777 +
gggtttaggggctcccgctt

SEQ ID NO: 157075 - DNA, 20 bp, Artificial Sequence
  Synthetic oligonucleotide; GAG chr2 60453763 60453782 60453779 +
gtttaggggctcccgcttta

SEQ ID NO: 157076 - DNA, 20 bp, Artificial Sequence
  Synthetic oligonucleotide; AGG chr2 60453764 60453783 60453780 +
tttaggggctcccgctttag

SEQ ID NO: 157077 - DNA, 20 bp, Artificial Sequence
  Synthetic oligonucleotide; TGG chr2 60453772 60453791 60453788 +
ctcccgctttagaggatact

SEQ ID NO: 157078 - DNA, 20 bp, Artificial Sequence
  Synthetic oligonucleotide; GGG chr2 60453773 60453792 60453789 +
tcccgctttagaggatactt

SEQ ID NO: 157079 - DNA, 20 bp, Artificial Sequence
  Synthetic oligonucleotide; GGG chr2 60453774 60453793 60453790 +
cccgctttagaggatacttg

SEQ ID NO: 157080 - DNA, 20 bp, Artificial Sequence
  Synthetic oligonucleotide; TGG chr2 60453780 60453799 60453796 +
ttagaggatacttggggaaa

SEQ ID NO: 157081 - DNA, 20 bp, Artificial Sequence
  Synthetic oligonucleotide; AAG chr2 60453813 60453832 60453829 +
cttttctaccatccctatga

SEQ ID NO: 157082 - DNA, 20 bp, Artificial Sequence
  Synthetic oligonucleotide; TAG chr2 60453841 60453860 60453857 +
atacacgtgctcccttgaaa

SEQ ID NO: 157083 - DNA, 20 bp, Artificial Sequence
  Synthetic oligonucleotide; CAG chr2 60453858 60453877 60453874 +
aaatagtttttgccacttta

SEQ ID NO: 157084 - DNA, 20 bp, Artificial Sequence
  Synthetic oligonucleotide; AAG chr2 60453862 60453881 60453878 +
agtttttgccactttacaga

SEQ ID NO: 157085 - DNA, 20 bp, Artificial Sequence
  Synthetic oligonucleotide; AGG chr2 60453863 60453882 60453879 +
gtttttgccactttacagaa

SEQ ID NO: 157086 - DNA, 20 bp, Artificial Sequence
  Synthetic oligonucleotide; TGG chr2 60453877 60453896 60453893 +
acagaaaggaaaaacgtatt

SEQ ID NO: 157087 - DNA, 20 bp, Artificial Sequence
  Synthetic oligonucleotide; GAG chr2 60453890 60453909 60453906 +
acgtatttggatcaaccatc

SEQ ID NO: 157088 - DNA, 20 bp, Artificial Sequence
  Synthetic oligonucleotide; CAG chr2 60453900 60453919 60453916 +
atcaaccatcgagctgtgtt

SEQ ID NO: 157089 - DNA, 20 bp, Artificial Sequence
  Synthetic oligonucleotide; AAG chr2 60453905 60453924 60453921 +
ccatcgagctgtgttcagcc

SEQ ID NO: 157090 - DNA, 20 bp, Artificial Sequence
  Synthetic oligonucleotide; TAG chr2 60453910 60453929 60453926 +
gagctgtgttcagccaagtt

SEQ ID NO: 157091 - DNA, 20 bp, Artificial Sequence
  Synthetic oligonucleotide; AGG chr2 60453911 60453930 60453927 +
agctgtgttcagccaagttt

SEQ ID NO: 157092 - DNA, 20 bp, Artificial Sequence
  Synthetic oligonucleotide; AAG chr2 60453919 60453938 60453935 +
tcagccaagtttaggttctc

SEQ ID NO: 157093 - DNA, 20 bp, Artificial Sequence
  Synthetic oligonucleotide; TGG chr2 60453941 60453960 60453957 +
gtacaatgacccgtgtgaac

SEQ ID NO: 157094 - DNA, 20 bp, Artificial Sequence
  Synthetic oligonucleotide; TGG chr2 60453946 60453965 60453962 +
atgacccgtgtgaactggat

SEQ ID NO: 157095 - DNA, 20 bp, Artificial Sequence
  Synthetic oligonucleotide; TGG chr2 60453962 60453981 60453978 +
ggattggtctctttcccatt

SEQ ID NO: 157096 - DNA, 20 bp, Artificial Sequence
  Synthetic oligonucleotide; AAG chr2 60453965 60453984 60453981 +
ttggtctctttcccatttgg

SEQ ID NO: 157097 - DNA, 20 bp, Artificial Sequence
  Synthetic oligonucleotide; AGG chr2 60453966 60453985 60453982 +
tggtctctttcccatttgga

SEQ ID NO: 157098 - DNA, 20 bp, Artificial Sequence
  Synthetic oligonucleotide; GGG chr2 60453967 60453986 60453983 +
ggtctctttcccatttggaa

SEQ ID NO: 157099 - DNA, 20 bp, Artificial Sequence
  Synthetic oligonucleotide; GAG chr2 60453969 60453988 60453985 +
tctctttcccatttggaagg

SEQ ID NO: 157100 - DNA, 20 bp, Artificial Sequence
  Synthetic oligonucleotide; AGG chr2 60453970 60453989 60453986 +
ctctttcccatttggaaggg

SEQ ID NO: 157101 - DNA, 20 bp, Artificial Sequence
  Synthetic oligonucleotide; TGG chr2 60453979 60453998 60453995 +
atttggaagggaggaattaa

SEQ ID NO: 157102 - DNA, 20 bp, Artificial Sequence
  Synthetic oligonucleotide; TAG chr2 60453995 60454014 60454011 +
ttaatggtatcccatgaccg

SEQ ID NO: 157103 - DNA, 20 bp, Artificial Sequence
  Synthetic oligonucleotide; TGG chr2 60454005 60454024 60454021 +
cccatgaccgtagatgacgc

SEQ ID NO: 157104 - DNA, 20 bp, Artificial Sequence
  Synthetic oligonucleotide; GGG chr2 60454006 60454025 60454022 +
ccatgaccgtagatgacgct

SEQ ID NO: 157105 - DNA, 20 bp, Artificial Sequence
  Synthetic oligonucleotide; TAG chr2 60454012 60454031 60454028 +
ccgtagatgacgctgggaaa

SEQ ID NO: 157106 - DNA, 20 bp, Artificial Sequence
  Synthetic oligonucleotide; GAG chr2 60454014 60454033 60454030 +
gtagatgacgctgggaaata

SEQ ID NO: 157107 - DNA, 20 bp, Artificial Sequence
  Synthetic oligonucleotide; GAG chr2 60454016 60454035 60454032 +
agatgacgctgggaaataga

SEQ ID NO: 157108 - DNA, 20 bp, Artificial Sequence
  Synthetic oligonucleotide; GAG chr2 60454018 60454037 60454034 +
atgacgctgggaaatagaga

SEQ ID NO: 157109 - DNA, 20 bp, Artificial Sequence
  Synthetic oligonucleotide; GAG chr2 60454020 60454039 60454036 +
gacgctgggaaatagagaga

SEQ ID NO: 157110 - DNA, 20 bp, Artificial Sequence
  Synthetic oligonucleotide; AAG chr2 60454024 60454043 60454040 +
ctgggaaatagagagagaga

SEQ ID NO: 157111 - DNA, 20 bp, Artificial Sequence
  Synthetic oligonucleotide; GAG chr2 60454026 60454045 60454042 +
gggaaatagagagagagaaa

SEQ ID NO: 157112 - DNA, 20 bp, Artificial Sequence
  Synthetic oligonucleotide; GAG chr2 60454028 60454047 60454044 +
gaaatagagagagagaaaga

SEQ ID NO: 157113 - DNA, 20 bp, Artificial Sequence
  Synthetic oligonucleotide; GAG chr2 60454030 60454049 60454046 +
aatagagagagagaaagaga

SEQ ID NO: 157114 - DNA, 20 bp, Artificial Sequence
  Synthetic oligonucleotide; GAG chr2 60454032 60454051 60454048 +
tagagagagagaaagagaga

SEQ ID NO: 157115 - DNA, 20 bp, Artificial Sequence
  Synthetic oligonucleotide; GAG chr2 60454034 60454053 60454050 +
gagagagagaaagagagaga

SEQ ID NO: 157116 - DNA, 20 bp, Artificial Sequence
  Synthetic oligonucleotide; GAG chr2 60454036 60454055 60454052 +
gagagagaaagagagagaga

SEQ ID NO: 157117 - DNA, 20 bp, Artificial Sequence
  Synthetic oligonucleotide; GAG chr2 60454038 60454057 60454054 +
gagagaaagagagagagaga

SEQ ID NO: 157118 - DNA, 20 bp, Artificial Sequence
  Synthetic oligonucleotide; GAG chr2 60454040 60454059 60454056 +
gagaaagagagagagagaga

SEQ ID NO: 157119 - DNA, 20 bp, Artificial Sequence
  Synthetic oligonucleotide; CAG chr2 60454046 60454065 60454062 +
gagagagagagagagagaaa

SEQ ID NO: 157120 - DNA, 20 bp, Artificial Sequence
  Synthetic oligonucleotide; AAG chr2 60454062 60454081 60454078 +
gaaacagccccattccccta

SEQ ID NO: 157121 - DNA, 20 bp, Artificial Sequence
  Synthetic oligonucleotide; AGG chr2 60454063 60454082 60454079 +
aaacagccccattcccctaa

SEQ ID NO: 157122 - DNA, 20 bp, Artificial Sequence
  Synthetic oligonucleotide; GAG chr2 60454068 60454087 60454084 +
gccccattcccctaaaggct

SEQ ID NO: 157123 - DNA, 20 bp, Artificial Sequence
  Synthetic oligonucleotide; TGG chr2 60454075 60454094 60454091 +
tcccctaaaggctgagtcac

SEQ ID NO: 157124 - DNA, 20 bp, Artificial Sequence
  Synthetic oligonucleotide; TAG chr2 60454092 60454111 60454108 +
cactggcctcgtgctgtatg

SEQ ID NO: 157125 - DNA, 20 bp, Artificial Sequence
  Synthetic oligonucleotide; CAG chr2 60454104 60454123 60454120 +
gctgtatgtagtaaattaaa

SEQ ID NO: 157126 - DNA, 20 bp, Artificial Sequence
  Synthetic oligonucleotide; CGG chr2 60454107 60454126 60454123 +
gtatgtagtaaattaaacag

SEQ ID NO: 157127 - DNA, 20 bp, Artificial Sequence
  Synthetic oligonucleotide; GGG chr2 60454108 60454127 60454124 +
tatgtagtaaattaaacagc

SEQ ID NO: 157128 - DNA, 20 bp, Artificial Sequence
  Synthetic oligonucleotide; TGG chr2 60454115 60454134 60454131 +
taaattaaacagcgggctaa

SEQ ID NO: 157129 - DNA, 20 bp, Artificial Sequence
  Synthetic oligonucleotide; GGG chr2 60454116 60454135 60454132 +
aaattaaacagcgggctaat

SEQ ID NO: 157130 - DNA, 20 bp, Artificial Sequence
  Synthetic oligonucleotide; GAG chr2 60454124 60454143 60454140 +
cagcgggctaatgggataac

SEQ ID NO: 157131 - DNA, 20 bp, Artificial Sequence
  Synthetic oligonucleotide; CAG chr2 60454131 60454150 60454147 +
ctaatgggataacgagatgc

SEQ ID NO: 157132 - DNA, 20 bp, Artificial Sequence
  Synthetic oligonucleotide; AAG chr2 60454135 60454154 60454151 +
tgggataacgagatgccagc

SEQ ID NO: 157133 - DNA, 20 bp, Artificial Sequence
  Synthetic oligonucleotide; CAG chr2 60454138 60454157 60454154 +
gataacgagatgccagcaag

SEQ ID NO: 157134 - DNA, 20 bp, Artificial Sequence
  Synthetic oligonucleotide; AAG chr2 60454141 60454160 60454157 +
aacgagatgccagcaagcag

SEQ ID NO: 157135 - DNA, 20 bp, Artificial Sequence
  Synthetic oligonucleotide; CAG chr2 60454146 60454165 60454162 +
gatgccagcaagcagaagtg

SEQ ID NO: 157136 - DNA, 20 bp, Artificial Sequence
  Synthetic oligonucleotide; CGG chr2 60454151 60454170 60454167 +
cagcaagcagaagtgcagac

SEQ ID NO: 157137 - DNA, 20 bp, Artificial Sequence
  Synthetic oligonucleotide; CAG chr2 60454168 60454187 60454184 +
gaccggacaacccatgtcca

SEQ ID NO: 157138 - DNA, 20 bp, Artificial Sequence
  Synthetic oligonucleotide; TAG chr2 60454175 60454194 60454191 +
caacccatgtccacagttca

SEQ ID NO: 157139 - DNA, 20 bp, Artificial Sequence
  Synthetic oligonucleotide; TAG chr2 60454181 60454200 60454197 +
atgtccacagttcatagcta

SEQ ID NO: 157140 - DNA, 20 bp, Artificial Sequence
  Synthetic oligonucleotide; CAG chr2 60454184 60454203 60454200 +
tccacagttcatagctatag

SEQ ID NO: 157141 - DNA, 20 bp, Artificial Sequence
  Synthetic oligonucleotide; TAG chr2 60454190 60454209 60454206 +
gttcatagctatagcagccc

SEQ ID NO: 157142 - DNA, 20 bp, Artificial Sequence
  Synthetic oligonucleotide; GAG chr2 60454192 60454211 60454208 +
tcatagctatagcagcccta

SEQ ID NO: 157143 - DNA, 20 bp, Artificial Sequence
  Synthetic oligonucleotide; TGG chr2 60454251 60454270 60454267 +
gatgtccatttctctaacaa

SEQ ID NO: 157144 - DNA, 20 bp, Artificial Sequence
  Synthetic oligonucleotide; GGG chr2 60454252 60454271 60454268 +
atgtccatttctctaacaat

SEQ ID NO: 157145 - DNA, 20 bp, Artificial Sequence
  Synthetic oligonucleotide; TGG chr2 60454271 60454290 60454287 +
tgggttcgtttattttctat

SEQ ID NO: 157146 - DNA, 20 bp, Artificial Sequence
  Synthetic oligonucleotide; GGG chr2 60454272 60454291 60454288 +
gggttcgtttattttctatt

SEQ ID NO: 157147 - DNA, 20 bp, Artificial Sequence
  Synthetic oligonucleotide; CAG chr2 60454282 60454301 60454298 +
attttctattgggaaatatg

SEQ ID NO: 157148 - DNA, 20 bp, Artificial Sequence
  Synthetic oligonucleotide; AGG chr2 60454283 60454302 60454299 +
ttttctattgggaaatatgc

SEQ ID NO: 157149 - DNA, 20 bp, Artificial Sequence
  Synthetic oligonucleotide; GGG chr2 60454284 60454303 60454300 +
tttctattgggaaatatgca

SEQ ID NO: 157150 - DNA, 20 bp, Artificial Sequence
  Synthetic oligonucleotide; TAG chr2 60454290 60454309 60454306 +
ttgggaaatatgcagggctt

SEQ ID NO: 157151 - DNA, 20 bp, Artificial Sequence
  Synthetic oligonucleotide; AGG chr2 60454291 60454310 60454307 +
tgggaaatatgcagggcttt

SEQ ID NO: 157152 - DNA, 20 bp, Artificial Sequence
  Synthetic oligonucleotide; GAG chr2 60454293 60454312 60454309 +
ggaaatatgcagggctttag

SEQ ID NO: 157153 - DNA, 20 bp, Artificial Sequence
  Synthetic oligonucleotide; TAG chr2 60454301 60454320 60454317 +
gcagggctttaggagacaac

SEQ ID NO: 157154 - DNA, 20 bp, Artificial Sequence
  Synthetic oligonucleotide; AGG chr2 60454302 60454321 60454318 +
cagggctttaggagacaact

SEQ ID NO: 157155 - DNA, 20 bp, Artificial Sequence
  Synthetic oligonucleotide; TAG chr2 60454314 60454333 60454330 +
agacaactaggaaaatctgc

SEQ ID NO: 157156 - DNA, 20 bp, Artificial Sequence
  Synthetic oligonucleotide; TGG chr2 60454318 60454337 60454334 +
aactaggaaaatctgctaga

SEQ ID NO: 157157 - DNA, 20 bp, Artificial Sequence
  Synthetic oligonucleotide; AAG chr2 60454335 60454354 60454351 +
agatggctcatgccttttaa

SEQ ID NO: 157158 - DNA, 20 bp, Artificial Sequence
  Synthetic oligonucleotide; TAG chr2 60454339 60454358 60454355 +
ggctcatgccttttaaaagt

SEQ ID NO: 157159 - DNA, 20 bp, Artificial Sequence
  Synthetic oligonucleotide; CAG chr2 60454342 60454361 60454358 +
tcatgccttttaaaagttag

SEQ ID NO: 157160 - DNA, 20 bp, Artificial Sequence
  Synthetic oligonucleotide; AAG chr2 60454351 60454370 60454367 +
ttaaaagttagcagtctttt

SEQ ID NO: 157161 - DNA, 20 bp, Artificial Sequence
  Synthetic oligonucleotide; AAG chr2 60454366 60454385 60454382 +
cttttaagaaacatttttcc

SEQ ID NO: 157162 - DNA, 20 bp, Artificial Sequence
  Synthetic oligonucleotide; CAG chr2 60454369 60454388 60454385 +
ttaagaaacatttttccaag

SEQ ID NO: 157163 - DNA, 20 bp, Artificial Sequence
  Synthetic oligonucleotide; AGG chr2 60454370 60454389 60454386 +
taagaaacatttttccaagc

SEQ ID NO: 157164 - DNA, 20 bp, Artificial Sequence
  Synthetic oligonucleotide; GAG chr2 60454375 60454394 60454391 +
aacatttttccaagcaggtt

SEQ ID NO: 157165 - DNA, 20 bp, Artificial Sequence
  Synthetic oligonucleotide; GAG chr2 60454377 60454396 60454393 +
catttttccaagcaggttga

SEQ ID NO: 157166 - DNA, 20 bp, Artificial Sequence
  Synthetic oligonucleotide; CGG chr2 60454405 60454424 60454421 +
tgccaatcccatcctcatat

SEQ ID NO: 157167 - DNA, 20 bp, Artificial Sequence
  Synthetic oligonucleotide; AAG chr2 60454410 60454429 60454426 +
atcccatcctcatatcggca

SEQ ID NO: 157168 - DNA, 20 bp, Artificial Sequence
  Synthetic oligonucleotide; TGG chr2 60454433 60454452 60454449 +
ttcccacaatttttttttta

SEQ ID NO: 157169 - DNA, 20 bp, Artificial Sequence
  Synthetic oligonucleotide; GGG chr2 60454434 60454453 60454450 +
tcccacaattttttttttat

SEQ ID NO: 157170 - DNA, 20 bp, Artificial Sequence
  Synthetic oligonucleotide; AAG chr2 60454437 60454456 60454453 +
cacaattttttttttatggg

SEQ ID NO: 157171 - DNA, 20 bp, Artificial Sequence
  Synthetic oligonucleotide; AAG chr2 60454452 60454471 60454468 +
atgggaagttgtctgaaaaa

SEQ ID NO: 157172 - DNA, 20 bp, Artificial Sequence
  Synthetic oligonucleotide; GAG chr2 60454454 60454473 60454470 +
gggaagttgtctgaaaaaaa

SEQ ID NO: 157173 - DNA, 20 bp, Artificial Sequence
  Synthetic oligonucleotide; TGG chr2 60454459 60454478 60454475 +
gttgtctgaaaaaaagagaa

SEQ ID NO: 157174 - DNA, 20 bp, Artificial Sequence
  Synthetic oligonucleotide; GGG chr2 60454460 60454479 60454476 +
ttgtctgaaaaaaagagaat

SEQ ID NO: 157175 - DNA, 20 bp, Artificial Sequence
  Synthetic oligonucleotide; TGG chr2 60454464 60454483 60454480 +
ctgaaaaaaagagaatggga

SEQ ID NO: 157176 - DNA, 20 bp, Artificial Sequence
  Synthetic oligonucleotide; GGG chr2 60454465 60454484 60454481 +
tgaaaaaaagagaatgggat

SEQ ID NO: 157177 - DNA, 20 bp, Artificial Sequence
  Synthetic oligonucleotide; CAG chr2 60454485 60454504 60454501 +
gggtacattcctgaacacac

SEQ ID NO: 157178 - DNA, 20 bp, Artificial Sequence
  Synthetic oligonucleotide; AGG chr2 60454486 60454505 60454502 +
ggtacattcctgaacacacc

SEQ ID NO: 157179 - DNA, 20 bp, Artificial Sequence
  Synthetic oligonucleotide; CAG chr2 60454491 60454510 60454507 +
attcctgaacacaccaggcc

SEQ ID NO: 157180 - DNA, 20 bp, Artificial Sequence
  Synthetic oligonucleotide; AGG chr2 60454492 60454511 60454508 +
ttcctgaacacaccaggccc

SEQ ID NO: 157181 - DNA, 20 bp, Artificial Sequence
  Synthetic oligonucleotide; GGG chr2 60454493 60454512 60454509 +
tcctgaacacaccaggccca

SEQ ID NO: 157182 - DNA, 20 bp, Artificial Sequence
  Synthetic oligonucleotide; TGG chr2 60454500 60454519 60454516 +
cacaccaggcccagggacaa

SEQ ID NO: 157183 - DNA, 20 bp, Artificial Sequence
  Synthetic oligonucleotide; GAG chr2 60454502 60454521 60454518 +
caccaggcccagggacaatg

SEQ ID NO: 157184 - DNA, 20 bp, Artificial Sequence
  Synthetic oligonucleotide; CAG chr2 60454508 60454527 60454524 +
gcccagggacaatggagtaa

SEQ ID NO: 157185 - DNA, 20 bp, Artificial Sequence
  Synthetic oligonucleotide; GAG chr2 60454520 60454539 60454536 +
tggagtaacagaatcgtaat

SEQ ID NO: 157186 - DNA, 20 bp, Artificial Sequence
  Synthetic oligonucleotide; AGG chr2 60454521 60454540 60454537 +
ggagtaacagaatcgtaatg

SEQ ID NO: 157187 - DNA, 20 bp, Artificial Sequence
  Synthetic oligonucleotide; CAG chr2 60454530 60454549 60454546 +
gaatcgtaatgaggaacaca

SEQ ID NO: 157188 - DNA, 20 bp, Artificial Sequence
  Synthetic oligonucleotide; CAG chr2 60454541 60454560 60454557 +
aggaacacacagttacaaca

SEQ ID NO: 157189 - DNA, 20 bp, Artificial Sequence
  Synthetic oligonucleotide; AAG chr2 60454548 60454567 60454564 +
cacagttacaacacagtcat

SEQ ID NO: 157190 - DNA, 20 bp, Artificial Sequence
  Synthetic oligonucleotide; AAG chr2 60454551 60454570 60454567 +
agttacaacacagtcataag

SEQ ID NO: 157191 - DNA, 20 bp, Artificial Sequence
  Synthetic oligonucleotide; CGG chr2 60454571 60454590 60454587 +
aagtcatgttcatgtgtgta

SEQ ID NO: 157192 - DNA, 20 bp, Artificial Sequence
  Synthetic oligonucleotide; GAG chr2 60454573 60454592 60454589 +
gtcatgttcatgtgtgtacg

SEQ ID NO: 157193 - DNA, 20 bp, Artificial Sequence
  Synthetic oligonucleotide; AGG chr2 60454574 60454593 60454590 +
tcatgttcatgtgtgtacgg

SEQ ID NO: 157194 - DNA, 20 bp, Artificial Sequence
  Synthetic oligonucleotide; GGG chr2 60454575 60454594 60454591 +
catgttcatgtgtgtacgga

SEQ ID NO: 157195 - DNA, 20 bp, Artificial Sequence
  Synthetic oligonucleotide; GGG chr2 60454576 60454595 60454592 +
atgttcatgtgtgtacggag

SEQ ID NO: 157196 - DNA, 20 bp, Artificial Sequence
  Synthetic oligonucleotide; GGG chr2 60454577 60454596 60454593 +
tgttcatgtgtgtacggagg

SEQ ID NO: 157197 - DNA, 20 bp, Artificial Sequence
  Synthetic oligonucleotide; AAG chr2 60454582 60454601 60454598 +
atgtgtgtacggagggggaa

SEQ ID NO: 157198 - DNA, 20 bp, Artificial Sequence
  Synthetic oligonucleotide; GAG chr2 60454584 60454603 60454600 +
gtgtgtacggagggggaaaa

SEQ ID NO: 157199 - DNA, 20 bp, Artificial Sequence
  Synthetic oligonucleotide; AGG chr2 60454585 60454604 60454601 +
tgtgtacggagggggaaaag

SEQ ID NO: 157200 - DNA, 20 bp, Artificial Sequence
  Synthetic oligonucleotide; AAG chr2 60454596 60454615 60454612 +
ggggaaaagaggcttaaaac

SEQ ID NO: 157201 - DNA, 20 bp, Artificial Sequence
  Synthetic oligonucleotide; CAG chr2 60454620 60454639 60454636 +
aaacactgtatttcctccct

SEQ ID NO: 157202 - DNA, 20 bp, Artificial Sequence
  Synthetic oligonucleotide; GAG chr2 60454630 60454649 60454646 +
tttcctccctcagtctctgt

SEQ ID NO: 157203 - DNA, 20 bp, Artificial Sequence
  Synthetic oligonucleotide; AAG chr2 60454635 60454654 60454651 +
tccctcagtctctgtgagca

SEQ ID NO: 157204 - DNA, 20 bp, Artificial Sequence
  Synthetic oligonucleotide; AAG chr2 60454644 60454663 60454660 +
ctctgtgagcaaagtactac

SEQ ID NO: 157205 - DNA, 20 bp, Artificial Sequence
  Synthetic oligonucleotide; CAG chr2 60454647 60454666 60454663 +
tgtgagcaaagtactacaag

SEQ ID NO: 157206 - DNA, 20 bp, Artificial Sequence
  Synthetic oligonucleotide; AGG chr2 60454648 60454667 60454664 +
gtgagcaaagtactacaagc

SEQ ID NO: 157207 - DNA, 20 bp, Artificial Sequence
  Synthetic oligonucleotide; GAG chr2 60454650 60454669 60454666 +
gagcaaagtactacaagcag

SEQ ID NO: 157208 - DNA, 20 bp, Artificial Sequence
  Synthetic oligonucleotide; GAG chr2 60454652 60454671 60454668 +
gcaaagtactacaagcagga

SEQ ID NO: 157209 - DNA, 20 bp, Artificial Sequence
  Synthetic oligonucleotide; AGG chr2 60454653 60454672 60454669 +
caaagtactacaagcaggag

SEQ ID NO: 157210 - DNA, 20 bp, Artificial Sequence
  Synthetic oligonucleotide; TGG chr2 60454657 60454676 60454673 +
gtactacaagcaggagagga

SEQ ID NO: 157211 - DNA, 20 bp, Artificial Sequence
  Synthetic oligonucleotide; GGG chr2 60454658 60454677 60454674 +
tactacaagcaggagaggat

SEQ ID NO: 157212 - DNA, 20 bp, Artificial Sequence
  Synthetic oligonucleotide; GGG chr2 60454659 60454678 60454675 +
actacaagcaggagaggatg

SEQ ID NO: 157213 - DNA, 20 bp, Artificial Sequence
  Synthetic oligonucleotide; GAG chr2 60454665 60454684 60454681 +
agcaggagaggatggggcct

SEQ ID NO: 157214 - DNA, 20 bp, Artificial Sequence
  Synthetic oligonucleotide; AGG chr2 60454666 60454685 60454682 +
gcaggagaggatggggcctg

SEQ ID NO: 157215 - DNA, 20 bp, Artificial Sequence
  Synthetic oligonucleotide; CAG chr2 60454685 60454704 60454701 +
gaggcttctcaactcctttt

SEQ ID NO: 157216 - DNA, 20 bp, Artificial Sequence
  Synthetic oligonucleotide; AGG chr2 60454686 60454705 60454702 +
aggcttctcaactccttttc

SEQ ID NO: 157217 - DNA, 20 bp, Artificial Sequence
  Synthetic oligonucleotide; AAG chr2 60454689 60454708 60454705 +
cttctcaactccttttcagg

SEQ ID NO: 157218 - DNA, 20 bp, Artificial Sequence
  Synthetic oligonucleotide; AGG chr2 60454690 60454709 60454706 +
ttctcaactccttttcagga

SEQ ID NO: 157219 - DNA, 20 bp, Artificial Sequence
  Synthetic oligonucleotide; CAG chr2 60454706 60454725 60454722 +
aggaaggcccgaaataatcc

SEQ ID NO: 157220 - DNA, 20 bp, Artificial Sequence
  Synthetic oligonucleotide; CAG chr2 60454716 60454735 60454732 +
gaaataatcccagtaccttt

SEQ ID NO: 157221 - DNA, 20 bp, Artificial Sequence
  Synthetic oligonucleotide; TGG chr2 60454766 60454785 60454782 +
catttccttatttctccaat

SEQ ID NO: 157222 - DNA, 20 bp, Artificial Sequence
  Synthetic oligonucleotide; AAG chr2 60454779 60454798 60454795 +
ctccaattggaattatacct

SEQ ID NO: 157223 - DNA, 20 bp, Artificial Sequence
  Synthetic oligonucleotide; AAG chr2 60454804 60454823 60454820 +
atctcccgccacttcctttc

SEQ ID NO: 157224 - DNA, 20 bp, Artificial Sequence
  Synthetic oligonucleotide; TAG chr2 60454817 60454836 60454833 +
tcctttcaagttctcacttc

SEQ ID NO: 157225 - DNA, 20 bp, Artificial Sequence
  Synthetic oligonucleotide; TGG chr2 60454863 60454882 60454879 +
acttattgcatatacaaaaa

SEQ ID NO: 157226 - DNA, 20 bp, Artificial Sequence
  Synthetic oligonucleotide; CAG chr2 60454878 60454897 60454894 +
aaaaatggtatttaaataaa

SEQ ID NO: 157227 - DNA, 20 bp, Artificial Sequence
  Synthetic oligonucleotide; CAG chr2 60454892 60454911 60454908 +
aataaacagttctatatcta

SEQ ID NO: 157228 - DNA, 20 bp, Artificial Sequence
  Synthetic oligonucleotide; TGG chr2 60454902 60454921 60454918 +
tctatatctacagaatgccc

SEQ ID NO: 157229 - DNA, 20 bp, Artificial Sequence
  Synthetic oligonucleotide; GGG chr2 60454903 60454922 60454919 +
ctatatctacagaatgccct

SEQ ID NO: 157230 - DNA, 20 bp, Artificial Sequence
  Synthetic oligonucleotide; TGG chr2 60454936 60454955 60454952 +
ctacttcacactttctgcca

SEQ ID NO: 157231 - DNA, 20 bp, Artificial Sequence
  Synthetic oligonucleotide; CAG chr2 60454940 60454959 60454956 +
ttcacactttctgccatggc

SEQ ID NO: 157232 - DNA, 20 bp, Artificial Sequence
  Synthetic oligonucleotide; AAG chr2 60454951 60454970 60454967 +
tgccatggccagtgcaaatg

SEQ ID NO: 157233 - DNA, 20 bp, Artificial Sequence
  Synthetic oligonucleotide; TAG chr2 60454975 60454994 60454991 +
actgtgttcacctcacttct

SEQ ID NO: 157234 - DNA, 20 bp, Artificial Sequence
  Synthetic oligonucleotide; TGG chr2 60454995 60455014 60455011 +
tagcaacctttgtaatgtgt

SEQ ID NO: 157235 - DNA, 20 bp, Artificial Sequence
  Synthetic oligonucleotide; CAG chr2 60455001 60455020 60455017 +
cctttgtaatgtgttggttc

SEQ ID NO: 157236 - DNA, 20 bp, Artificial Sequence
  Synthetic oligonucleotide; TAG chr2 60455012 60455031 60455028 +
tgttggttccagcctttttg

SEQ ID NO: 157237 - DNA, 20 bp, Artificial Sequence
  Synthetic oligonucleotide; AGG chr2 60455013 60455032 60455029 +
gttggttccagcctttttgt

SEQ ID NO: 157238 - DNA, 20 bp, Artificial Sequence
  Synthetic oligonucleotide; AAG chr2 60455025 60455044 60455041 +
ctttttgtaggtcctaaaca

SEQ ID NO: 157239 - DNA, 20 bp, Artificial Sequence
  Synthetic oligonucleotide; GAG chr2 60455027 60455046 60455043 +
ttttgtaggtcctaaacaaa

SEQ ID NO: 157240 - DNA, 20 bp, Artificial Sequence
  Synthetic oligonucleotide; GAG chr2 60455029 60455048 60455045 +
ttgtaggtcctaaacaaaga

SEQ ID NO: 157241 - DNA, 20 bp, Artificial Sequence
  Synthetic oligonucleotide; AGG chr2 60455030 60455049 60455046 +
tgtaggtcctaaacaaagag

SEQ ID NO: 157242 - DNA, 20 bp, Artificial Sequence
  Synthetic oligonucleotide; TAG chr2 60455034 60455053 60455050 +
ggtcctaaacaaagagagga

SEQ ID NO: 157243 - DNA, 20 bp, Artificial Sequence
  Synthetic oligonucleotide; TGG chr2 60455041 60455060 60455057 +
aacaaagagaggatagcaaa

SEQ ID NO: 157244 - DNA, 20 bp, Artificial Sequence
  Synthetic oligonucleotide; GGG chr2 60455042 60455061 60455058 +
acaaagagaggatagcaaat

SEQ ID NO: 157245 - DNA, 20 bp, Artificial Sequence
  Synthetic oligonucleotide; CAG chr2 60455047 60455066 60455063 +
gagaggatagcaaatgggtt

SEQ ID NO: 157246 - DNA, 20 bp, Artificial Sequence
  Synthetic oligonucleotide; AGG chr2 60455048 60455067 60455064 +
agaggatagcaaatgggttc

SEQ ID NO: 157247 - DNA, 20 bp, Artificial Sequence
  Synthetic oligonucleotide; AAG chr2 60455051 60455070 60455067 +
ggatagcaaatgggttcagg

SEQ ID NO: 157248 - DNA, 20 bp, Artificial Sequence
  Synthetic oligonucleotide; AGG chr2 60455052 60455071 60455068 +
gatagcaaatgggttcagga

SEQ ID NO: 157249 - DNA, 20 bp, Artificial Sequence
  Synthetic oligonucleotide; GAG chr2 60455054 60455073 60455070 +
tagcaaatgggttcaggaag

SEQ ID NO: 157250 - DNA, 20 bp, Artificial Sequence
  Synthetic oligonucleotide; AGG chr2 60455055 60455074 60455071 +
agcaaatgggttcaggaagg

SEQ ID NO: 157251 - DNA, 20 bp, Artificial Sequence
  Synthetic oligonucleotide; TAG chr2 60455063 60455082 60455079 +
ggttcaggaaggaggtaata

SEQ ID NO: 157252 - DNA, 20 bp, Artificial Sequence
  Synthetic oligonucleotide; AGG chr2 60455064 60455083 60455080 +
gttcaggaaggaggtaatat

SEQ ID NO: 157253 - DNA, 20 bp, Artificial Sequence
  Synthetic oligonucleotide; TGG chr2 60455070 60455089 60455086 +
gaaggaggtaatataggcac

SEQ ID NO: 157254 - DNA, 20 bp, Artificial Sequence
  Synthetic oligonucleotide; AAG chr2 60455073 60455092 60455089 +
ggaggtaatataggcactgg

SEQ ID NO: 157255 - DNA, 20 bp, Artificial Sequence
  Synthetic oligonucleotide; GAG chr2 60455075 60455094 60455091 +
aggtaatataggcactggaa

SEQ ID NO: 157256 - DNA, 20 bp, Artificial Sequence
  Synthetic oligonucleotide; TGG chr2 60455082 60455101 60455098 +
ataggcactggaagagtttc

SEQ ID NO: 157257 - DNA, 20 bp, Artificial Sequence
  Synthetic oligonucleotide; GAG chr2 60455097 60455116 60455113 +
gtttctggtttaaaatctgt

SEQ ID NO: 157258 - DNA, 20 bp, Artificial Sequence
  Synthetic oligonucleotide; TAG chr2 60455103 60455122 60455119 +
ggtttaaaatctgtgagaaa

SEQ ID NO: 157259 - DNA, 20 bp, Artificial Sequence
  Synthetic oligonucleotide; CGG chr2 60455112 60455131 60455128 +
tctgtgagaaatagaatttg

SEQ ID NO: 157260 - DNA, 20 bp, Artificial Sequence
  Synthetic oligonucleotide; AAG chr2 60455129 60455148 60455145 +
ttgcggtattcctgtttatt

SEQ ID NO: 157261 - DNA, 20 bp, Artificial Sequence
  Synthetic oligonucleotide; AAG chr2 60455145 60455164 60455161 +
tattaagttgttctcaaatg

SEQ ID NO: 157262 - DNA, 20 bp, Artificial Sequence
  Synthetic oligonucleotide; AAG chr2 60455154 60455173 60455170 +
gttctcaaatgaagattaaa

SEQ ID NO: 157263 - DNA, 20 bp, Artificial Sequence
  Synthetic oligonucleotide; AAG chr2 60455165 60455184 60455181 +
aagattaaaaagaacatttt

SEQ ID NO: 157264 - DNA, 20 bp, Artificial Sequence
  Synthetic oligonucleotide; CAG chr2 60455171 60455190 60455187 +
aaaaagaacattttaagcat

SEQ ID NO: 157265 - DNA, 20 bp, Artificial Sequence
  Synthetic oligonucleotide; CAG chr2 60455176 60455195 60455192 +
gaacattttaagcatcagtt

SEQ ID NO: 157266 - DNA, 20 bp, Artificial Sequence
  Synthetic oligonucleotide; AGG chr2 60455177 60455196 60455193 +
aacattttaagcatcagttc

SEQ ID NO: 157267 - DNA, 20 bp, Artificial Sequence
  Synthetic oligonucleotide; TAG chr2 60455184 60455203 60455200 +
taagcatcagttcaggtatg

SEQ ID NO: 157268 - DNA, 20 bp, Artificial Sequence
  Synthetic oligonucleotide; GAG chr2 60455186 60455205 60455202 +
agcatcagttcaggtatgta

SEQ ID NO: 157269 - DNA, 20 bp, Artificial Sequence
  Synthetic oligonucleotide; CAG chr2 60455199 60455218 60455215 +
gtatgtagagaacattccat

SEQ ID NO: 157270 - DNA, 20 bp, Artificial Sequence
  Synthetic oligonucleotide; AAG chr2 60455208 60455227 60455224 +
gaacattccatcagcacgtc

SEQ ID NO: 157271 - DNA, 20 bp, Artificial Sequence
  Synthetic oligonucleotide; GAG chr2 60455231 60455250 60455247 +
cctgttacaaaaacttactt

SEQ ID NO: 157272 - DNA, 20 bp, Artificial Sequence
  Synthetic oligonucleotide; AGG chr2 60455232 60455251 60455248 +
ctgttacaaaaacttacttg

SEQ ID NO: 157273 - DNA, 20 bp, Artificial Sequence
  Synthetic oligonucleotide; AAG chr2 60455240 60455259 60455256 +
aaaacttacttgaggatttt

SEQ ID NO: 157274 - DNA, 20 bp, Artificial Sequence
  Synthetic oligonucleotide; GAG chr2 60455242 60455261 60455258 +
aacttacttgaggattttaa

SEQ ID NO: 157275 - DNA, 20 bp, Artificial Sequence
  Synthetic oligonucleotide; TAG chr2 60455258 60455277 60455274 +
ttaagagacattaatgttct

SEQ ID NO: 157276 - DNA, 20 bp, Artificial Sequence
  Synthetic oligonucleotide; TAG chr2 60455261 60455280 60455277 +
agagacattaatgttcttag

SEQ ID NO: 157277 - DNA, 20 bp, Artificial Sequence
  Synthetic oligonucleotide; AAG chr2 60455282 60455301 60455298 +
agttcctcatttaaaaaaaa

SEQ ID NO: 157278 - DNA, 20 bp, Artificial Sequence
  Synthetic oligonucleotide; TGG chr2 60455306 60455325 60455322 +
tcatgaattcatcttactat

SEQ ID NO: 157279 - DNA, 20 bp, Artificial Sequence
  Synthetic oligonucleotide; AAG chr2 60455332 60455351 60455348 +
tgtgcatgttattttatatt

SEQ ID NO: 157280 - DNA, 20 bp, Artificial Sequence
  Synthetic oligonucleotide; TAG chr2 60455346 60455365 60455362 +
tatattaagattttaaattt

SEQ ID NO: 157281 - DNA, 20 bp, Artificial Sequence
  Synthetic oligonucleotide; GAG chr2 60455348 60455367 60455364 +
tattaagattttaaatttta

SEQ ID NO: 157282 - DNA, 20 bp, Artificial Sequence
  Synthetic oligonucleotide; TGG chr2 60455354 60455373 60455370 +
gattttaaattttagagttc

SEQ ID NO: 157283 - DNA, 20 bp, Artificial Sequence
  Synthetic oligonucleotide; AAG chr2 60455375 60455394 60455391 +
ggatacaaaatatcatttat

SEQ ID NO: 157284 - DNA, 20 bp, Artificial Sequence
  Synthetic oligonucleotide; TGG chr2 60455389 60455408 60455405 +
atttataagtgatatcatgt

SEQ ID NO: 157285 - DNA, 20 bp, Artificial Sequence
  Synthetic oligonucleotide; TAG chr2 60455393 60455412 60455409 +
ataagtgatatcatgttggc

SEQ ID NO: 157286 - DNA, 20 bp, Artificial Sequence
  Synthetic oligonucleotide; AGG chr2 60455394 60455413 60455410 +
taagtgatatcatgttggct

SEQ ID NO: 157287 - DNA, 20 bp, Artificial Sequence
  Synthetic oligonucleotide; CAG chr2 60455419 60455438 60455435 +
ctcatgtttctattgttcat

SEQ ID NO: 157288 - DNA, 20 bp, Artificial Sequence
  Synthetic oligonucleotide; CAG chr2 60455425 60455444 60455441 +
tttctattgttcatcagctt

SEQ ID NO: 157289 - DNA, 20 bp, Artificial Sequence
  Synthetic oligonucleotide; CAG chr2 60455442 60455461 60455458 +
cttcagaaataatattttat

SEQ ID NO: 157290 - DNA, 20 bp, Artificial Sequence
  Synthetic oligonucleotide; AAG chr2 60455445 60455464 60455461 +
cagaaataatattttatcag

SEQ ID NO: 157291 - DNA, 20 bp, Artificial Sequence
  Synthetic oligonucleotide; AGG chr2 60455446 60455465 60455462 +
agaaataatattttatcaga

SEQ ID NO: 157292 - DNA, 20 bp, Artificial Sequence
  Synthetic oligonucleotide; AAG chr2 60455456 60455475 60455472 +
ttttatcagaaggcgtcaat

SEQ ID NO: 157293 - DNA, 20 bp, Artificial Sequence
  Synthetic oligonucleotide; CAG chr2 60455460 60455479 60455476 +
atcagaaggcgtcaataagt

SEQ ID NO: 157294 - DNA, 20 bp, Artificial Sequence
  Synthetic oligonucleotide; AGG chr2 60455461 60455480 60455477 +
tcagaaggcgtcaataagtc

SEQ ID NO: 157295 - DNA, 20 bp, Artificial Sequence
  Synthetic oligonucleotide; GAG chr2 60455463 60455482 60455479 +
agaaggcgtcaataagtcag

SEQ ID NO: 157296 - DNA, 20 bp, Artificial Sequence
  Synthetic oligonucleotide; AAG chr2 60455469 60455488 60455485 +
cgtcaataagtcaggagact

SEQ ID NO: 157297 - DNA, 20 bp, Artificial Sequence
  Synthetic oligonucleotide; AAG chr2 60455479 60455498 60455495 +
tcaggagactaagtaacctg

SEQ ID NO: 157298 - DNA, 20 bp, Artificial Sequence
  Synthetic oligonucleotide; CAG chr2 60455493 60455512 60455509 +
aacctgaagaacccatctcc

SEQ ID NO: 157299 - DNA, 20 bp, Artificial Sequence
  Synthetic oligonucleotide; TGG chr2 60455512 60455531 60455528 +
ccagtaaatttatttaactt

SEQ ID NO: 157300 - DNA, 20 bp, Artificial Sequence
  Synthetic oligonucleotide; GGG chr2 60455513 60455532 60455529 +
cagtaaatttatttaacttt

SEQ ID NO: 157301 - DNA, 20 bp, Artificial Sequence
  Synthetic oligonucleotide; CAG chr2 60455551 60455570 60455567 +
cataatctgtgatttatcac

SEQ ID NO: 157302 - DNA, 20 bp, Artificial Sequence
  Synthetic oligonucleotide; AAG chr2 60455588 60455607 60455604 +
ccccattccccatttgattt

SEQ ID NO: 157303 - DNA, 20 bp, Artificial Sequence
  Synthetic oligonucleotide; CAG chr2 60455600 60455619 60455616 +
tttgatttaagaaatttgaa

SEQ ID NO: 157304 - DNA, 20 bp, Artificial Sequence
  Synthetic oligonucleotide; AAG chr2 60455605 60455624 60455621 +
tttaagaaatttgaacagac

SEQ ID NO: 157305 - DNA, 20 bp, Artificial Sequence
  Synthetic oligonucleotide; CAG chr2 60455612 60455631 60455628 +
aatttgaacagacaagtgta

SEQ ID NO: 157306 - DNA, 20 bp, Artificial Sequence
  Synthetic oligonucleotide; CAG chr2 60455638 60455657 60455654 +
ccaccattaattctgtctgt

SEQ ID NO: 157307 - DNA, 20 bp, Artificial Sequence
  Synthetic oligonucleotide; AGG chr2 60455639 60455658 60455655 +
caccattaattctgtctgtc

SEQ ID NO: 157308 - DNA, 20 bp, Artificial Sequence
  Synthetic oligonucleotide; AAG chr2 60455662 60455681 60455678 +
atgcaaaacctaattacgct

SEQ ID NO: 157309 - DNA, 20 bp, Artificial Sequence
  Synthetic oligonucleotide; GAG chr2 60455664 60455683 60455680 +
gcaaaacctaattacgctaa

SEQ ID NO: 157310 - DNA, 20 bp, Artificial Sequence
  Synthetic oligonucleotide; CAG chr2 60455667 60455686 60455683 +
aaacctaattacgctaagag

SEQ ID NO: 157311 - DNA, 20 bp, Artificial Sequence
  Synthetic oligonucleotide; GAG chr2 60455678 60455697 60455694 +
cgctaagagcagcatatact

SEQ ID NO: 157312 - DNA, 20 bp, Artificial Sequence
  Synthetic oligonucleotide; CAG chr2 60455714 60455733 60455730 +
tactgtatataaaacctaca

SEQ ID NO: 157313 - DNA, 20 bp, Artificial Sequence
  Synthetic oligonucleotide; TAG chr2 60455726 60455745 60455742 +
aacctacacagttgcactca

SEQ ID NO: 157314 - DNA, 20 bp, Artificial Sequence
  Synthetic oligonucleotide; AAG chr2 60455739 60455758 60455755 +
gcactcatagctcctaataa

SEQ ID NO: 157315 - DNA, 20 bp, Artificial Sequence
  Synthetic oligonucleotide; GAG chr2 60455741 60455760 60455757 +
actcatagctcctaataaaa

SEQ ID NO: 157316 - DNA, 20 bp, Artificial Sequence
  Synthetic oligonucleotide; TAG chr2 60455747 60455766 60455763 +
agctcctaataaaagagtaa

SEQ ID NO: 157317 - DNA, 20 bp, Artificial Sequence
  Synthetic oligonucleotide; AGG chr2 60455748 60455767 60455764 +
gctcctaataaaagagtaat

SEQ ID NO: 157318 - DNA, 20 bp, Artificial Sequence
  Synthetic oligonucleotide; GGG chr2 60455749 60455768 60455765 +
ctcctaataaaagagtaata

SEQ ID NO: 157319 - DNA, 20 bp, Artificial Sequence
  Synthetic oligonucleotide; CAG chr2 60455757 60455776 60455773 +
aaaagagtaatagggacaca

SEQ ID NO: 157320 - DNA, 20 bp, Artificial Sequence
  Synthetic oligonucleotide; GAG chr2 60455759 60455778 60455775 +
aagagtaatagggacacaca

SEQ ID NO: 157321 - DNA, 20 bp, Artificial Sequence
  Synthetic oligonucleotide; AGG chr2 60455760 60455779 60455776 +
agagtaatagggacacacag

SEQ ID NO: 157322 - DNA, 20 bp, Artificial Sequence
  Synthetic oligonucleotide; TGG chr2 60455768 60455787 60455784 +
agggacacacagaggtttta

SEQ ID NO: 157323 - DNA, 20 bp, Artificial Sequence
  Synthetic oligonucleotide; TAG chr2 60455779 60455798 60455795 +
gaggttttatggacatttaa

SEQ ID NO: 157324 - DNA, 20 bp, Artificial Sequence
  Synthetic oligonucleotide; AGG chr2 60455780 60455799 60455796 +
aggttttatggacatttaat

SEQ ID NO: 157325 - DNA, 20 bp, Artificial Sequence
  Synthetic oligonucleotide; GGG chr2 60455781 60455800 60455797 +
ggttttatggacatttaata

SEQ ID NO: 157326 - DNA, 20 bp, Artificial Sequence
  Synthetic oligonucleotide; TGG chr2 60455784 60455803 60455800 +
tttatggacatttaataggg

SEQ ID NO: 157327 - DNA, 20 bp, Artificial Sequence
  Synthetic oligonucleotide; GAG chr2 60455786 60455805 60455802 +
tatggacatttaatagggtg

SEQ ID NO: 157328 - DNA, 20 bp, Artificial Sequence
  Synthetic oligonucleotide; AAG chr2 60455792 60455811 60455808 +
catttaatagggtggagtcg

SEQ ID NO: 157329 - DNA, 20 bp, Artificial Sequence
  Synthetic oligonucleotide; AAG chr2 60455807 60455826 60455823 +
agtcgaagtcaccacatcta

SEQ ID NO: 157330 - DNA, 20 bp, Artificial Sequence
  Synthetic oligonucleotide; TGG chr2 60455811 60455830 60455827 +
gaagtcaccacatctaaagc

SEQ ID NO: 157331 - DNA, 20 bp, Artificial Sequence
  Synthetic oligonucleotide; TGG chr2 60455816 60455835 60455832 +
caccacatctaaagctggca

SEQ ID NO: 157332 - DNA, 20 bp, Artificial Sequence
  Synthetic oligonucleotide; TGG chr2 60455822 60455841 60455838 +
atctaaagctggcatggcac

SEQ ID NO: 157333 - DNA, 20 bp, Artificial Sequence
  Synthetic oligonucleotide; GGG chr2 60455823 60455842 60455839 +
tctaaagctggcatggcact

SEQ ID NO: 157334 - DNA, 20 bp, Artificial Sequence
  Synthetic oligonucleotide; GGG chr2 60455824 60455843 60455840 +
ctaaagctggcatggcactg

SEQ ID NO: 157335 - DNA, 20 bp, Artificial Sequence
  Synthetic oligonucleotide; GAG chr2 60455846 60455865 60455862 +
gaattatttctatctgtctt

SEQ ID NO: 157336 - DNA, 20 bp, Artificial Sequence
  Synthetic oligonucleotide; CAG chr2 60455849 60455868 60455865 +
ttatttctatctgtcttgag

SEQ ID NO: 157337 - DNA, 20 bp, Artificial Sequence
  Synthetic oligonucleotide; TGG chr2 60455857 60455876 60455873 +
atctgtcttgagcagcattt

SEQ ID NO: 157338 - DNA, 20 bp, Artificial Sequence
  Synthetic oligonucleotide; CAG chr2 60455863 60455882 60455879 +
cttgagcagcattttggatt

SEQ ID NO: 157339 - DNA, 20 bp, Artificial Sequence
  Synthetic oligonucleotide; TGG chr2 60455869 60455888 60455885 +
cagcattttggattcagttt

SEQ ID NO: 157340 - DNA, 20 bp, Artificial Sequence
  Synthetic oligonucleotide; GAG chr2 60455871 60455890 60455887 +
gcattttggattcagttttg

SEQ ID NO: 157341 - DNA, 20 bp, Artificial Sequence
  Synthetic oligonucleotide; CAG chr2 60455895 60455914 60455911 +
aacctaatccaaaacacata

SEQ ID NO: 157342 - DNA, 20 bp, Artificial Sequence
  Synthetic oligonucleotide; AAG chr2 60455910 60455929 60455926 +
acatacagtatatcttttct

SEQ ID NO: 157343 - DNA, 20 bp, Artificial Sequence
  Synthetic oligonucleotide; CAG chr2 60455915 60455934 60455931 +
cagtatatcttttctaagtt

SEQ ID NO: 157344 - DNA, 20 bp, Artificial Sequence
  Synthetic oligonucleotide; AAG chr2 60455929 60455948 60455945 +
taagttcagtgacaaacatc

SEQ ID NO: 157345 - DNA, 20 bp, Artificial Sequence
  Synthetic oligonucleotide; AAG chr2 60455937 60455956 60455953 +
gtgacaaacatcaagttctc

SEQ ID NO: 157346 - DNA, 20 bp, Artificial Sequence
  Synthetic oligonucleotide; AGG chr2 60455938 60455957 60455954 +
tgacaaacatcaagttctca

SEQ ID NO: 157347 - DNA, 20 bp, Artificial Sequence
  Synthetic oligonucleotide; CAG chr2 60455996 60456015 60456012 +
tattctccaacatcctttct

SEQ ID NO: 157348 - DNA, 20 bp, Artificial Sequence
  Synthetic oligonucleotide; TGG chr2 60455999 60456018 60456015 +
tctccaacatcctttctcag

SEQ ID NO: 157349 - DNA, 20 bp, Artificial Sequence
  Synthetic oligonucleotide; TAG chr2 60456009 60456028 60456025 +
cctttctcagtggattcctc

SEQ ID NO: 157350 - DNA, 20 bp, Artificial Sequence
  Synthetic oligonucleotide; TGG chr2 60456038 60456057 60456054 +
tctctccttcccacccaaac

SEQ ID NO: 157351 - DNA, 20 bp, Artificial Sequence
  Synthetic oligonucleotide; CAG chr2 60456046 60456065 60456062 +
tcccacccaaactggctttt

SEQ ID NO: 157352 - DNA, 20 bp, Artificial Sequence
  Synthetic oligonucleotide; TAG chr2 60456073 60456092 60456089 +
cattgactttctttatactt

SEQ ID NO: 157353 - DNA, 20 bp, Artificial Sequence
  Synthetic oligonucleotide; AAG chr2 60456077 60456096 60456093 +
gactttctttatactttaga

SEQ ID NO: 157354 - DNA, 20 bp, Artificial Sequence
  Synthetic oligonucleotide; CAG chr2 60456098 60456117 60456114 +
agataaaactattcttgcct

SEQ ID NO: 157355 - DNA, 20 bp, Artificial Sequence
  Synthetic oligonucleotide; AAG chr2 60456105 60456124 60456121 +
actattcttgcctcagataa

SEQ ID NO: 157356 - DNA, 20 bp, Artificial Sequence
  Synthetic oligonucleotide; AGG chr2 60456106 60456125 60456122 +
ctattcttgcctcagataaa

SEQ ID NO: 157357 - DNA, 20 bp, Artificial Sequence
  Synthetic oligonucleotide; AAG chr2 60456120 60456139 60456136 +
gataaaaggcatgacatgaa

SEQ ID NO: 157358 - DNA, 20 bp, Artificial Sequence
  Synthetic oligonucleotide; AGG chr2 60456121 60456140 60456137 +
ataaaaggcatgacatgaaa

SEQ ID NO: 157359 - DNA, 20 bp, Artificial Sequence
  Synthetic oligonucleotide; CAG chr2 60456132 60456151 60456148 +
gacatgaaaaggccacctca

SEQ ID NO: 157360 - DNA, 20 bp, Artificial Sequence
  Synthetic oligonucleotide; AGG chr2 60456133 60456152 60456149 +
acatgaaaaggccacctcac

SEQ ID NO: 157361 - DNA, 20 bp, Artificial Sequence
  Synthetic oligonucleotide; TAG chr2 60456139 60456158 60456155 +
aaaggccacctcacaggcac

SEQ ID NO: 157362 - DNA, 20 bp, Artificial Sequence
  Synthetic oligonucleotide; AGG chr2 60456140 60456159 60456156 +
aaggccacctcacaggcact

SEQ ID NO: 157363 - DNA, 20 bp, Artificial Sequence
  Synthetic oligonucleotide; GGG chr2 60456141 60456160 60456157 +
aggccacctcacaggcacta

SEQ ID NO: 157364 - DNA, 20 bp, Artificial Sequence
  Synthetic oligonucleotide; AAG chr2 60456147 60456166 60456163 +
cctcacaggcactagggcat

SEQ ID NO: 157365 - DNA, 20 bp, Artificial Sequence
  Synthetic oligonucleotide; GAG chr2 60456154 60456173 60456170 +
ggcactagggcataagaact

SEQ ID NO: 157366 - DNA, 20 bp, Artificial Sequence
  Synthetic oligonucleotide; AAG chr2 60456176 60456195 60456192 +
gcgacaaaaaatgctaccac

SEQ ID NO: 157367 - DNA, 20 bp, Artificial Sequence
  Synthetic oligonucleotide; AAG chr2 60456179 60456198 60456195 +
acaaaaaatgctaccacaag

SEQ ID NO: 157368 - DNA, 20 bp, Artificial Sequence
  Synthetic oligonucleotide; CAG chr2 60456186 60456205 60456202 +
atgctaccacaagaagacaa

SEQ ID NO: 157369 - DNA, 20 bp, Artificial Sequence
  Synthetic oligonucleotide; CGG chr2 60456191 60456210 60456207 +
accacaagaagacaacagaa

SEQ ID NO: 157370 - DNA, 20 bp, Artificial Sequence
  Synthetic oligonucleotide; TGG chr2 60456203 60456222 60456219 +
caacagaacggcttttgttt

SEQ ID NO: 157371 - DNA, 20 bp, Artificial Sequence
  Synthetic oligonucleotide; AAG chr2 60456220 60456239 60456236 +
ttttggttttttacaaaaat

SEQ ID NO: 157372 - DNA, 20 bp, Artificial Sequence
  Synthetic oligonucleotide; TGG chr2 60456250 60456269 60456266 +
tcgtattcattcatctacac

SEQ ID NO: 157373 - DNA, 20 bp, Artificial Sequence
  Synthetic oligonucleotide; GGG chr2 60456251 60456270 60456267 +
cgtattcattcatctacact

SEQ ID NO: 157374 - DNA, 20 bp, Artificial Sequence
  Synthetic oligonucleotide; CAG chr2 60456256 60456275 60456272 +
tcattcatctacactgggaa

SEQ ID NO: 157375 - DNA, 20 bp, Artificial Sequence
  Synthetic oligonucleotide; AGG chr2 60456257 60456276 60456273 +
cattcatctacactgggaac

SEQ ID NO: 157376 - DNA, 20 bp, Artificial Sequence
  Synthetic oligonucleotide; GGG chr2 60456258 60456277 60456274 +
attcatctacactgggaaca

SEQ ID NO: 157377 - DNA, 20 bp, Artificial Sequence
  Synthetic oligonucleotide; CAG chr2 60456272 60456291 60456288 +
ggaacagggacacgatatca

SEQ ID NO: 157378 - DNA, 20 bp, Artificial Sequence
  Synthetic oligonucleotide; GAG chr2 60456274 60456293 60456290 +
aacagggacacgatatcaca

SEQ ID NO: 157379 - DNA, 20 bp, Artificial Sequence
  Synthetic oligonucleotide; AGG chr2 60456275 60456294 60456291 +
acagggacacgatatcacag

SEQ ID NO: 157380 - DNA, 20 bp, Artificial Sequence
  Synthetic oligonucleotide; TAG chr2 60456286 60456305 60456302 +
atatcacagaggtatgtgtt

SEQ ID NO: 157381 - DNA, 20 bp, Artificial Sequence
  Synthetic oligonucleotide; AAG chr2 60456291 60456310 60456307 +
acagaggtatgtgtttagta

SEQ ID NO: 157382 - DNA, 20 bp, Artificial Sequence
  Synthetic oligonucleotide; TAG chr2 60456298 60456317 60456314 +
tatgtgtttagtaaagcaaa

SEQ ID NO: 157383 - DNA, 20 bp, Artificial Sequence
  Synthetic oligonucleotide; CAG chr2 60456314 60456333 60456330 +
caaatagatgctgcaacatg

SEQ ID NO: 157384 - DNA, 20 bp, Artificial Sequence
  Synthetic oligonucleotide; AAG chr2 60456326 60456345 60456342 +
gcaacatgcagtatttgtaa

SEQ ID NO: 157385 - DNA, 20 bp, Artificial Sequence
  Synthetic oligonucleotide; CAG chr2 60456337 60456356 60456353 +
tatttgtaaaagtgacaaca

SEQ ID NO: 157386 - DNA, 20 bp, Artificial Sequence
  Synthetic oligonucleotide; AAG chr2 60456346 60456365 60456362 +
aagtgacaacacagatttct

SEQ ID NO: 157387 - DNA, 20 bp, Artificial Sequence
  Synthetic oligonucleotide; AGG chr2 60456347 60456366 60456363 +
agtgacaacacagatttcta

SEQ ID NO: 157388 - DNA, 20 bp, Artificial Sequence
  Synthetic oligonucleotide; TAG chr2 60456360 60456379 60456376 +
atttctaaggatttttaaaa

SEQ ID NO: 157389 - DNA, 20 bp, Artificial Sequence
  Synthetic oligonucleotide; TGG chr2 60456370 60456389 60456386 +
atttttaaaatagacctaac

SEQ ID NO: 157390 - DNA, 20 bp, Artificial Sequence
  Synthetic oligonucleotide; TGG chr2 60456374 60456393 60456390 +
ttaaaatagacctaactggc

SEQ ID NO: 157391 - DNA, 20 bp, Artificial Sequence
  Synthetic oligonucleotide; CAG chr2 60456378 60456397 60456394 +
aatagacctaactggctggt

SEQ ID NO: 157392 - DNA, 20 bp, Artificial Sequence
  Synthetic oligonucleotide; AAG chr2 60456381 60456400 60456397 +
agacctaactggctggtcag

SEQ ID NO: 157393 - DNA, 20 bp, Artificial Sequence
  Synthetic oligonucleotide; AAG chr2 60456391 60456410 60456407 +
ggctggtcagaagataattg

SEQ ID NO: 157394 - DNA, 20 bp, Artificial Sequence
  Synthetic oligonucleotide; AGG chr2 60456392 60456411 60456408 +
gctggtcagaagataattga

SEQ ID NO: 157395 - DNA, 20 bp, Artificial Sequence
  Synthetic oligonucleotide; GGG chr2 60456393 60456412 60456409 +
ctggtcagaagataattgaa

SEQ ID NO: 157396 - DNA, 20 bp, Artificial Sequence
  Synthetic oligonucleotide; CAG chr2 60456422 60456441 60456438 +
cgcccttatttgctgtcatc

SEQ ID NO: 157397 - DNA, 20 bp, Artificial Sequence
  Synthetic oligonucleotide; AGG chr2 60456423 60456442 60456439 +
gcccttatttgctgtcatcc

SEQ ID NO: 157398 - DNA, 20 bp, Artificial Sequence
  Synthetic oligonucleotide; AAG chr2 60456426 60456445 60456442 +
cttatttgctgtcatccagg

SEQ ID NO: 157399 - DNA, 20 bp, Artificial Sequence
  Synthetic oligonucleotide; AAG chr2 60456447 60456466 60456463 +
agaccctatcaaaacaccta

SEQ ID NO: 157400 - DNA, 20 bp, Artificial Sequence
  Synthetic oligonucleotide; TAG chr2 60456457 60456476 60456473 +
aaaacacctaaagtaatctg

SEQ ID NO: 157401 - DNA, 20 bp, Artificial Sequence
  Synthetic oligonucleotide; TAG chr2 60456464 60456483 60456480 +
ctaaagtaatctgtagcatc

SEQ ID NO: 157402 - DNA, 20 bp, Artificial Sequence
  Synthetic oligonucleotide; AGG chr2 60456465 60456484 60456481 +
taaagtaatctgtagcatct

SEQ ID NO: 157403 - DNA, 20 bp, Artificial Sequence
  Synthetic oligonucleotide; GGG chr2 60456466 60456485 60456482 +
aaagtaatctgtagcatcta

SEQ ID NO: 157404 - DNA, 20 bp, Artificial Sequence
  Synthetic oligonucleotide; TGG chr2 60456473 60456492 60456489 +
tctgtagcatctagggttcc

SEQ ID NO: 157405 - DNA, 20 bp, Artificial Sequence
  Synthetic oligonucleotide; GGG chr2 60456474 60456493 60456490 +
ctgtagcatctagggttcct

SEQ ID NO: 157406 - DNA, 20 bp, Artificial Sequence
  Synthetic oligonucleotide; CAG chr2 60456481 60456500 60456497 +
atctagggttcctgggatct

SEQ ID NO: 157407 - DNA, 20 bp, Artificial Sequence
  Synthetic oligonucleotide; AAG chr2 60456490 60456509 60456506 +
tcctgggatctcagaaccac

SEQ ID NO: 157408 - DNA, 20 bp, Artificial Sequence
  Synthetic oligonucleotide; AGG chr2 60456491 60456510 60456507 +
cctgggatctcagaaccaca

SEQ ID NO: 157409 - DNA, 20 bp, Artificial Sequence
  Synthetic oligonucleotide; CAG chr2 60456511 60456530 60456527 +
aggcaaaccactatgcatct

SEQ ID NO: 157410 - DNA, 20 bp, Artificial Sequence
  Synthetic oligonucleotide; AGG chr2 60456512 60456531 60456528 +
ggcaaaccactatgcatctc

SEQ ID NO: 157411 - DNA, 20 bp, Artificial Sequence
  Synthetic oligonucleotide; CAG chr2 60456519 60456538 60456535 +
cactatgcatctcaggaaat

SEQ ID NO: 157412 - DNA, 20 bp, Artificial Sequence
  Synthetic oligonucleotide; TGG chr2 60456522 60456541 60456538 +
tatgcatctcaggaaatcag

SEQ ID NO: 157413 - DNA, 20 bp, Artificial Sequence
  Synthetic oligonucleotide; AAG chr2 60456534 60456553 60456550 +
gaaatcagtggctgattcca

SEQ ID NO: 157414 - DNA, 20 bp, Artificial Sequence
  Synthetic oligonucleotide; TGG chr2 60456550 60456569 60456566 +
tccaaagatttcactatgtc

SEQ ID NO: 157415 - DNA, 20 bp, Artificial Sequence
  Synthetic oligonucleotide; TAG chr2 60456562 60456581 60456578 +
actatgtctggctacacccc

SEQ ID NO: 157416 - DNA, 20 bp, Artificial Sequence
  Synthetic oligonucleotide; TGG chr2 60456565 60456584 60456581 +
atgtctggctacacccctag

SEQ ID NO: 157417 - DNA, 20 bp, Artificial Sequence
  Synthetic oligonucleotide; CAG chr2 60456659 60456678 60456675 +
aaacctgatgcctttgtttc

SEQ ID NO: 157418 - DNA, 20 bp, Artificial Sequence
  Synthetic oligonucleotide; TAG chr2 60456667 60456686 60456683 +
tgcctttgtttccagatttt

SEQ ID NO: 157419 - DNA, 20 bp, Artificial Sequence
  Synthetic oligonucleotide; AAG chr2 60456677 60456696 60456693 +
tccagatttttagatttcaa

SEQ ID NO: 157420 - DNA, 20 bp, Artificial Sequence
  Synthetic oligonucleotide; TGG chr2 60456680 60456699 60456696 +
agatttttagatttcaaaag

SEQ ID NO: 157421 - DNA, 20 bp, Artificial Sequence
  Synthetic oligonucleotide; GGG chr2 60456681 60456700 60456697 +
gatttttagatttcaaaagt

SEQ ID NO: 157422 - DNA, 20 bp, Artificial Sequence
  Synthetic oligonucleotide; GGG chr2 60456682 60456701 60456698 +
atttttagatttcaaaagtg

SEQ ID NO: 157423 - DNA, 20 bp, Artificial Sequence
  Synthetic oligonucleotide; GAG chr2 60456697 60456716 60456713 +
aagtggggttattttgttat

SEQ ID NO: 157424 - DNA, 20 bp, Artificial Sequence
  Synthetic oligonucleotide; AAG chr2 60456702 60456721 60456718 +
gggttattttgttatgagaa

SEQ ID NO: 157425 - DNA, 20 bp, Artificial Sequence
  Synthetic oligonucleotide; TGG chr2 60456714 60456733 60456730 +
tatgagaaaagactcttaca

SEQ ID NO: 157426 - DNA, 20 bp, Artificial Sequence
  Synthetic oligonucleotide; AAG chr2 60456723 60456742 60456739 +
agactcttacatggaaacca

SEQ ID NO: 157427 - DNA, 20 bp, Artificial Sequence
  Synthetic oligonucleotide; GAG chr2 60456725 60456744 60456741 +
actcttacatggaaaccaaa

SEQ ID NO: 157428 - DNA, 20 bp, Artificial Sequence
  Synthetic oligonucleotide; AAG chr2 60456767 60456786 60456783 +
tcttttttacattatgttct

SEQ ID NO: 157429 - DNA, 20 bp, Artificial Sequence
  Synthetic oligonucleotide; AAG chr2 60456773 60456792 60456789 +
ttacattatgttctaagata

SEQ ID NO: 157430 - DNA, 20 bp, Artificial Sequence
  Synthetic oligonucleotide; AAG chr2 60456777 60456796 60456793 +
attatgttctaagataaagc

SEQ ID NO: 157431 - DNA, 20 bp, Artificial Sequence
  Synthetic oligonucleotide; AGG chr2 60456778 60456797 60456794 +
ttatgttctaagataaagca

SEQ ID NO: 157432 - DNA, 20 bp, Artificial Sequence
  Synthetic oligonucleotide; TGG chr2 60456782 60456801 60456798 +
gttctaagataaagcaagga

SEQ ID NO: 157433 - DNA, 20 bp, Artificial Sequence
  Synthetic oligonucleotide; GGG chr2 60456783 60456802 60456799 +
ttctaagataaagcaaggat

SEQ ID NO: 157434 - DNA, 20 bp, Artificial Sequence
  Synthetic oligonucleotide; GAG chr2 60456785 60456804 60456801 +
ctaagataaagcaaggatgg

SEQ ID NO: 157435 - DNA, 20 bp, Artificial Sequence
  Synthetic oligonucleotide; TAG chr2 60456790 60456809 60456806 +
ataaagcaaggatgggagaa

SEQ ID NO: 157436 - DNA, 20 bp, Artificial Sequence
  Synthetic oligonucleotide; AAG chr2 60456795 60456814 60456811 +
gcaaggatgggagaatagaa

SEQ ID NO: 157437 - DNA, 20 bp, Artificial Sequence
  Synthetic oligonucleotide; TAG chr2 60456804 60456823 60456820 +
ggagaatagaaaagaacttt

SEQ ID NO: 157438 - DNA, 20 bp, Artificial Sequence
  Synthetic oligonucleotide; AAG chr2 60456812 60456831 60456828 +
gaaaagaacttttagacaac

SEQ ID NO: 157439 - DNA, 20 bp, Artificial Sequence
  Synthetic oligonucleotide; CAG chr2 60456817 60456836 60456833 +
gaacttttagacaacaagaa

SEQ ID NO: 157440 - DNA, 20 bp, Artificial Sequence
  Synthetic oligonucleotide; AAG chr2 60456831 60456850 60456847 +
caagaacagcaaaaaattta

SEQ ID NO: 157441 - DNA, 20 bp, Artificial Sequence
  Synthetic oligonucleotide; AGG chr2 60456832 60456851 60456848 +
aagaacagcaaaaaatttaa

SEQ ID NO: 157442 - DNA, 20 bp, Artificial Sequence
  Synthetic oligonucleotide; AAG chr2 60456841 60456860 60456857 +
aaaaaatttaaaggaaataa

SEQ ID NO: 157443 - DNA, 20 bp, Artificial Sequence
  Synthetic oligonucleotide; AAG chr2 60456847 60456866 60456863 +
tttaaaggaaataaaagttt

SEQ ID NO: 157444 - DNA, 20 bp, Artificial Sequence
  Synthetic oligonucleotide; CAG chr2 60456860 60456879 60456876 +
aaagtttaagatgctattac

SEQ ID NO: 157445 - DNA, 20 bp, Artificial Sequence
  Synthetic oligonucleotide; AAG chr2 60456864 60456883 60456880 +
tttaagatgctattaccagc

SEQ ID NO: 157446 - DNA, 20 bp, Artificial Sequence
  Synthetic oligonucleotide; TGG chr2 60456887 60456906 60456903 +
ttttttcacttatgtttgaa

SEQ ID NO: 157447 - DNA, 20 bp, Artificial Sequence
  Synthetic oligonucleotide; AAG chr2 60456899 60456918 60456915 +
tgtttgaatggatttctgct

SEQ ID NO: 157448 - DNA, 20 bp, Artificial Sequence
  Synthetic oligonucleotide; GAG chr2 60456901 60456920 60456917 +
tttgaatggatttctgctaa

SEQ ID NO: 157449 - DNA, 20 bp, Artificial Sequence
  Synthetic oligonucleotide; TGG chr2 60456905 60456924 60456921 +
aatggatttctgctaagaga

SEQ ID NO: 157450 - DNA, 20 bp, Artificial Sequence
  Synthetic oligonucleotide; GAG chr2 60456907 60456926 60456923 +
tggatttctgctaagagatg

SEQ ID NO: 157451 - DNA, 20 bp, Artificial Sequence
  Synthetic oligonucleotide; AAG chr2 60456911 60456930 60456927 +
tttctgctaagagatggagt

SEQ ID NO: 157452 - DNA, 20 bp, Artificial Sequence
  Synthetic oligonucleotide; CAG chr2 60456924 60456943 60456940 +
atggagtaagtttttaacat

SEQ ID NO: 157453 - DNA, 20 bp, Artificial Sequence
  Synthetic oligonucleotide; TGG chr2 60456966 60456985 60456982 +
tcttgaaaactattctaaac

SEQ ID NO: 157454 - DNA, 20 bp, Artificial Sequence
  Synthetic oligonucleotide; AAG chr2 60456970 60456989 60456986 +
gaaaactattctaaactgga

SEQ ID NO: 157455 - DNA, 20 bp, Artificial Sequence
  Synthetic oligonucleotide; CAG chr2 60456988 60457007 60457004 +
gaaagccttaaaactatgtc

SEQ ID NO: 157456 - DNA, 20 bp, Artificial Sequence
  Synthetic oligonucleotide; AGG chr2 60456989 60457008 60457005 +
aaagccttaaaactatgtcc

SEQ ID NO: 157457 - DNA, 20 bp, Artificial Sequence
  Synthetic oligonucleotide; GGG chr2 60456990 60457009 60457006 +
aagccttaaaactatgtcca

SEQ ID NO: 157458 - DNA, 20 bp, Artificial Sequence
  Synthetic oligonucleotide; GAG chr2 60456996 60457015 60457012 +
taaaactatgtccagggttt

SEQ ID NO: 157459 - DNA, 20 bp, Artificial Sequence
  Synthetic oligonucleotide; TAG chr2 60457016 60457035 60457032 +
gagatatgtctattttaata

SEQ ID NO: 157460 - DNA, 20 bp, Artificial Sequence
  Synthetic oligonucleotide; AAG chr2 60457020 60457039 60457036 +
tatgtctattttaatatagt

SEQ ID NO: 157461 - DNA, 20 bp, Artificial Sequence
  Synthetic oligonucleotide; TAG chr2 60457038 60457057 60457054 +
gtaagtactttatgttcctt

SEQ ID NO: 157462 - DNA, 20 bp, Artificial Sequence
  Synthetic oligonucleotide; AGG chr2 60457039 60457058 60457055 +
taagtactttatgttccttt

SEQ ID NO: 157463 - DNA, 20 bp, Artificial Sequence
  Synthetic oligonucleotide; GGG chr2 60457040 60457059 60457056 +
aagtactttatgttccttta

SEQ ID NO: 157464 - DNA, 20 bp, Artificial Sequence
  Synthetic oligonucleotide; CAG chr2 60457057 60457076 60457073 +
ttagggtataatacacgcat

SEQ ID NO: 157465 - DNA, 20 bp, Artificial Sequence
  Synthetic oligonucleotide; TAG chr2 60457068 60457087 60457084 +
tacacgcatcagaatgccca

SEQ ID NO: 157466 - DNA, 20 bp, Artificial Sequence
  Synthetic oligonucleotide; AAG chr2 60457085 60457104 60457101 +
ccatagaaataatcctgaaa

SEQ ID NO: 157467 - DNA, 20 bp, Artificial Sequence
  Synthetic oligonucleotide; TGG chr2 60457094 60457113 60457110 +
taatcctgaaaaagactgac

SEQ ID NO: 157468 - DNA, 20 bp, Artificial Sequence
  Synthetic oligonucleotide; AAG chr2 60457126 60457145 60457142 +
aaaacctgttattttcttgc

SEQ ID NO: 157469 - DNA, 20 bp, Artificial Sequence
  Synthetic oligonucleotide; CAG chr2 60457136 60457155 60457152 +
attttcttgcaagtaattta

SEQ ID NO: 157470 - DNA, 20 bp, Artificial Sequence
  Synthetic oligonucleotide; GAG chr2 60457138 60457157 60457154 +
tttcttgcaagtaatttaca

SEQ ID NO: 157471 - DNA, 20 bp, Artificial Sequence
  Synthetic oligonucleotide; GAG chr2 60457151 60457170 60457167 +
atttacagagtgtgtcaaat

SEQ ID NO: 157472 - DNA, 20 bp, Artificial Sequence
  Synthetic oligonucleotide; AGG chr2 60457152 60457171 60457168 +
tttacagagtgtgtcaaatg

SEQ ID NO: 157473 - DNA, 20 bp, Artificial Sequence
  Synthetic oligonucleotide; AAG chr2 60457159 60457178 60457175 +
agtgtgtcaaatgaggacac

SEQ ID NO: 157474 - DNA, 20 bp, Artificial Sequence
  Synthetic oligonucleotide; AAG chr2 60457162 60457181 60457178 +
gtgtcaaatgaggacacaag

SEQ ID NO: 157475 - DNA, 20 bp, Artificial Sequence
  Synthetic oligonucleotide; AAG chr2 60457204 60457223 60457220 +
ttttttttattttttcaata

SEQ ID NO: 157476 - DNA, 20 bp, Artificial Sequence
  Synthetic oligonucleotide; AGG chr2 60457205 60457224 60457221 +
tttttttattttttcaataa

SEQ ID NO: 157477 - DNA, 20 bp, Artificial Sequence
  Synthetic oligonucleotide; GGG chr2 60457206 60457225 60457222 +
ttttttattttttcaataaa

SEQ ID NO: 157478 - DNA, 20 bp, Artificial Sequence
  Synthetic oligonucleotide; TGG chr2 60457215 60457234 60457231 +
ttttcaataaagggacaaaa

SEQ ID NO: 157479 - DNA, 20 bp, Artificial Sequence
  Synthetic oligonucleotide; GGG chr2 60457216 60457235 60457232 +
tttcaataaagggacaaaat

SEQ ID NO: 157480 - DNA, 20 bp, Artificial Sequence
  Synthetic oligonucleotide; CAG chr2 60457227 60457246 60457243 +
ggacaaaatgggtgtatgaa

SEQ ID NO: 157481 - DNA, 20 bp, Artificial Sequence
  Synthetic oligonucleotide; AGG chr2 60457228 60457247 60457244 +
gacaaaatgggtgtatgaac

SEQ ID NO: 157482 - DNA, 20 bp, Artificial Sequence
  Synthetic oligonucleotide; CAG chr2 60457237 60457256 60457253 +
ggtgtatgaacaggttaatg

SEQ ID NO: 157483 - DNA, 20 bp, Artificial Sequence
  Synthetic oligonucleotide; CAG chr2 60457258 60457277 60457274 +
agacaactgccaaaaaaaca

SEQ ID NO: 157484 - DNA, 20 bp, Artificial Sequence
  Synthetic oligonucleotide; CAG chr2 60457262 60457281 60457278 +
aactgccaaaaaaacacaga

SEQ ID NO: 157485 - DNA, 20 bp, Artificial Sequence
  Synthetic oligonucleotide; TGG chr2 60457265 60457284 60457281 +
tgccaaaaaaacacagacag

SEQ ID NO: 157486 - DNA, 20 bp, Artificial Sequence
  Synthetic oligonucleotide; TAG chr2 60457277 60457296 60457293 +
acagacagtggtttttccaa

SEQ ID NO: 157487 - DNA, 20 bp, Artificial Sequence
  Synthetic oligonucleotide; AAG chr2 60457289 60457308 60457305 +
ttttccaatagaacttaaca

SEQ ID NO: 157488 - DNA, 20 bp, Artificial Sequence
  Synthetic oligonucleotide; CAG chr2 60457294 60457313 60457310 +
caatagaacttaacaaagac

SEQ ID NO: 157489 - DNA, 20 bp, Artificial Sequence
  Synthetic oligonucleotide; AAG chr2 60457313 60457332 60457329 +
ccagaaacaaatacaataaa

SEQ ID NO: 157490 - DNA, 20 bp, Artificial Sequence
  Synthetic oligonucleotide; CAG chr2 60457317 60457336 60457333 +
aaacaaatacaataaaaagc

SEQ ID NO: 157491 - DNA, 20 bp, Artificial Sequence
  Synthetic oligonucleotide; AGG chr2 60457318 60457337 60457334 +
aacaaatacaataaaaagcc

SEQ ID NO: 157492 - DNA, 20 bp, Artificial Sequence
  Synthetic oligonucleotide; TGG chr2 60457334 60457353 60457350 +
agccaggttgtaatgacctt

SEQ ID NO: 157493 - DNA, 20 bp, Artificial Sequence
  Synthetic oligonucleotide; AAG chr2 60457366 60457385 60457382 +
taaaaaaaaaaataaaaaca

SEQ ID NO: 157494 - DNA, 20 bp, Artificial Sequence
  Synthetic oligonucleotide; AAG chr2 60457377 60457396 60457393 +
ataaaaacaaagaaaaataa

SEQ ID NO: 157495 - DNA, 20 bp, Artificial Sequence
  Synthetic oligonucleotide; AAG chr2 60457388 60457407 60457404 +
gaaaaataaaagatcaaatt

SEQ ID NO: 157496 - DNA, 20 bp, Artificial Sequence
  Synthetic oligonucleotide; CAG chr2 60457406 60457425 60457422 +
ttaagtgcctctgttttgaa

SEQ ID NO: 157497 - DNA, 20 bp, Artificial Sequence
  Synthetic oligonucleotide; AGG chr2 60457407 60457426 60457423 +
taagtgcctctgttttgaac

SEQ ID NO: 157498 - DNA, 20 bp, Artificial Sequence
  Synthetic oligonucleotide; GGG chr2 60457408 60457427 60457424 +
aagtgcctctgttttgaaca

SEQ ID NO: 157499 - DNA, 20 bp, Artificial Sequence
  Synthetic oligonucleotide; AAG chr2 60457416 60457435 60457432 +
ctgttttgaacagggcacat

SEQ ID NO: 157500 - DNA, 20 bp, Artificial Sequence
  Synthetic oligonucleotide; TAG chr2 60457429 60457448 60457445 +
ggcacataagcaataataaa

SEQ ID NO: 157501 - DNA, 20 bp, Artificial Sequence
  Synthetic oligonucleotide; TAG chr2 60457441 60457460 60457457 +
ataataaatagtgactccca

SEQ ID NO: 157502 - DNA, 20 bp, Artificial Sequence
  Synthetic oligonucleotide; AAG chr2 60457447 60457466 60457463 +
aatagtgactcccatagtaa

SEQ ID NO: 157503 - DNA, 20 bp, Artificial Sequence
  Synthetic oligonucleotide; AAG chr2 60457460 60457479 60457476 +
atagtaaaagataaaatttc

SEQ ID NO: 157504 - DNA, 20 bp, Artificial Sequence
  Synthetic oligonucleotide; CAG chr2 60457473 60457492 60457489 +
aaatttcaagttacgacaaa

SEQ ID NO: 157505 - DNA, 20 bp, Artificial Sequence
  Synthetic oligonucleotide; CAG chr2 60457485 60457504 60457501 +
acgacaaacagctttcatta

SEQ ID NO: 157506 - DNA, 20 bp, Artificial Sequence
  Synthetic oligonucleotide; AGG chr2 60457486 60457505 60457502 +
cgacaaacagctttcattac

SEQ ID NO: 157507 - DNA, 20 bp, Artificial Sequence
  Synthetic oligonucleotide; TAG chr2 60457491 60457510 60457507 +
aacagctttcattacaggaa

SEQ ID NO: 157508 - DNA, 20 bp, Artificial Sequence
  Synthetic oligonucleotide; AAG chr2 60457496 60457515 60457512 +
ctttcattacaggaatagaa

SEQ ID NO: 157509 - DNA, 20 bp, Artificial Sequence
  Synthetic oligonucleotide; AGG chr2 60457497 60457516 60457513 +
tttcattacaggaatagaaa

SEQ ID NO: 157510 - DNA, 20 bp, Artificial Sequence
  Synthetic oligonucleotide; AAG chr2 60457536 60457555 60457552 +
ctgcattgccatttacaaaa

SEQ ID NO: 157511 - DNA, 20 bp, Artificial Sequence
  Synthetic oligonucleotide; AAG chr2 60457548 60457567 60457564 +
ttacaaaaaagtattgacta

SEQ ID NO: 157512 - DNA, 20 bp, Artificial Sequence
  Synthetic oligonucleotide; CGG chr2 60457551 60457570 60457567 +
caaaaaagtattgactaaag

SEQ ID NO: 157513 - DNA, 20 bp, Artificial Sequence
  Synthetic oligonucleotide; GGG chr2 60457552 60457571 60457568 +
aaaaaagtattgactaaagc

SEQ ID NO: 157514 - DNA, 20 bp, Artificial Sequence
  Synthetic oligonucleotide; AAG chr2 60457605 60457624 60457621 +
ttctttccaatctaaatata

SEQ ID NO: 157515 - DNA, 20 bp, Artificial Sequence
  Synthetic oligonucleotide; TAG chr2 60457615 60457634 60457631 +
tctaaatataaagcaccatt

SEQ ID NO: 157516 - DNA, 20 bp, Artificial Sequence
  Synthetic oligonucleotide; TGG chr2 60457622 60457641 60457638 +
ataaagcaccatttagtttt

SEQ ID NO: 157517 - DNA, 20 bp, Artificial Sequence
  Synthetic oligonucleotide; TGG chr2 60457648 60457667 60457664 +
tgaaaaaaactgcaaaacat

SEQ ID NO: 157518 - DNA, 20 bp, Artificial Sequence
  Synthetic oligonucleotide; AAG chr2 60457700 60457719 60457716 +
tctttcttttactgcatatg

SEQ ID NO: 157519 - DNA, 20 bp, Artificial Sequence
  Synthetic oligonucleotide; AGG chr2 60457701 60457720 60457717 +
ctttcttttactgcatatga

SEQ ID NO: 157520 - DNA, 20 bp, Artificial Sequence
  Synthetic oligonucleotide; AAG chr2 60457705 60457724 60457721 +
cttttactgcatatgaaggt

SEQ ID NO: 157521 - DNA, 20 bp, Artificial Sequence
  Synthetic oligonucleotide; TGG chr2 60457712 60457731 60457728 +
tgcatatgaaggtaagatgc

SEQ ID NO: 157522 - DNA, 20 bp, Artificial Sequence
  Synthetic oligonucleotide; TAG chr2 60457719 60457738 60457735 +
gaaggtaagatgctggaatg

SEQ ID NO: 157523 - DNA, 20 bp, Artificial Sequence
  Synthetic oligonucleotide; AGG chr2 60457720 60457739 60457736 +
aaggtaagatgctggaatgt

SEQ ID NO: 157524 - DNA, 20 bp, Artificial Sequence
  Synthetic oligonucleotide; GGG chr2 60457721 60457740 60457737 +
aggtaagatgctggaatgta

SEQ ID NO: 157525 - DNA, 20 bp, Artificial Sequence
  Synthetic oligonucleotide; TAG chr2 60457727 60457746 60457743 +
gatgctggaatgtagggtga

SEQ ID NO: 157526 - DNA, 20 bp, Artificial Sequence
  Synthetic oligonucleotide; AAG chr2 60457730 60457749 60457746 +
gctggaatgtagggtgatag

SEQ ID NO: 157527 - DNA, 20 bp, Artificial Sequence
  Synthetic oligonucleotide; AGG chr2 60457731 60457750 60457747 +
ctggaatgtagggtgataga

SEQ ID NO: 157528 - DNA, 20 bp, Artificial Sequence
  Synthetic oligonucleotide; AAG chr2 60457735 60457754 60457751 +
aatgtagggtgatagaagga

SEQ ID NO: 157529 - DNA, 20 bp, Artificial Sequence
  Synthetic oligonucleotide; AGG chr2 60457736 60457755 60457752 +
atgtagggtgatagaaggaa

SEQ ID NO: 157530 - DNA, 20 bp, Artificial Sequence
  Synthetic oligonucleotide; GGG chr2 60457737 60457756 60457753 +
tgtagggtgatagaaggaaa

SEQ ID NO: 157531 - DNA, 20 bp, Artificial Sequence
  Synthetic oligonucleotide; AAG chr2 60457745 60457764 60457761 +
gatagaaggaaagggacaaa

SEQ ID NO: 157532 - DNA, 20 bp, Artificial Sequence
  Synthetic oligonucleotide; TAG chr2 60457774 60457793 60457790 +
acataacaaaccaacgttat

SEQ ID NO: 157533 - DNA, 20 bp, Artificial Sequence
  Synthetic oligonucleotide; CAG chr2 60457781 60457800 60457797 +
aaaccaacgttattagcttg

SEQ ID NO: 157534 - DNA, 20 bp, Artificial Sequence
  Synthetic oligonucleotide; CAG chr2 60457793 60457812 60457809 +
ttagcttgcagtactgcata

SEQ ID NO: 157535 - DNA, 20 bp, Artificial Sequence
  Synthetic oligonucleotide; TGG chr2 60457798 60457817 60457814 +
ttgcagtactgcatacagta

SEQ ID NO: 157536 - DNA, 20 bp, Artificial Sequence
  Synthetic oligonucleotide; CAG chr2 60457801 60457820 60457817 +
cagtactgcatacagtatgg

SEQ ID NO: 157537 - DNA, 20 bp, Artificial Sequence
  Synthetic oligonucleotide; CAG chr2 60457804 60457823 60457820 +
tactgcatacagtatggcag

SEQ ID NO: 157538 - DNA, 20 bp, Artificial Sequence
  Synthetic oligonucleotide; AGG chr2 60457805 60457824 60457821 +
actgcatacagtatggcagc

SEQ ID NO: 157539 - DNA, 20 bp, Artificial Sequence
  Synthetic oligonucleotide; AAG chr2 60457811 60457830 60457827 +
tacagtatggcagcaggaaa

SEQ ID NO: 157540 - DNA, 20 bp, Artificial Sequence
  Synthetic oligonucleotide; AGG chr2 60457812 60457831 60457828 +
acagtatggcagcaggaaaa

SEQ ID NO: 157541 - DNA, 20 bp, Artificial Sequence
  Synthetic oligonucleotide; AAG chr2 60457822 60457841 60457838 +
agcaggaaaaaggaacaaaa

SEQ ID NO: 157542 - DNA, 20 bp, Artificial Sequence
  Synthetic oligonucleotide; AGG chr2 60457823 60457842 60457839 +
gcaggaaaaaggaacaaaaa

SEQ ID NO: 157543 - DNA, 20 bp, Artificial Sequence
  Synthetic oligonucleotide; CAG chr2 60457845 60457864 60457861 +
gatatgtacaacccctatga

SEQ ID NO: 157544 - DNA, 20 bp, Artificial Sequence
  Synthetic oligonucleotide; TAG chr2 60457865 60457884 60457881 +
cagccatccatgtgacattc

SEQ ID NO: 157545 - DNA, 20 bp, Artificial Sequence
  Synthetic oligonucleotide; CAG chr2 60457868 60457887 60457884 +
ccatccatgtgacattctag

SEQ ID NO: 157546 - DNA, 20 bp, Artificial Sequence
  Synthetic oligonucleotide; AGG chr2 60457869 60457888 60457885 +
catccatgtgacattctagc

SEQ ID NO: 157547 - DNA, 20 bp, Artificial Sequence
  Synthetic oligonucleotide; TGG chr2 60457893 60457912 60457909 +
tcccccaaaccgccattata

SEQ ID NO: 157548 - DNA, 20 bp, Artificial Sequence
  Synthetic oligonucleotide; AAG chr2 60457948 60457967 60457964 +
ctctcttttttttttttttg

SEQ ID NO: 157549 - DNA, 20 bp, Artificial Sequence
  Synthetic oligonucleotide; TGG chr2 60458002 60458021 60458018 +
caaattaaaaaaatatactg

SEQ ID NO: 157550 - DNA, 20 bp, Artificial Sequence
  Synthetic oligonucleotide; CAG chr2 60458005 60458024 60458021 +
attaaaaaaatatactgtgg

SEQ ID NO: 157551 - DNA, 20 bp, Artificial Sequence
  Synthetic oligonucleotide; AAG chr2 60458036 60458055 60458052 +
ttttttttccactaccaaaa

SEQ ID NO: 157552 - DNA, 20 bp, Artificial Sequence
  Synthetic oligonucleotide; AGG chr2 60458037 60458056 60458053 +
tttttttccactaccaaaaa

SEQ ID NO: 157553 - DNA, 20 bp, Artificial Sequence
  Synthetic oligonucleotide; AAG chr2 60458056 60458075 60458072 +
aaggtacattgatacctttt

SEQ ID NO: 157554 - DNA, 20 bp, Artificial Sequence
  Synthetic oligonucleotide; GAG chr2 60458058 60458077 60458074 +
ggtacattgataccttttaa

SEQ ID NO: 157555 - DNA, 20 bp, Artificial Sequence
  Synthetic oligonucleotide; AAG chr2 60458064 60458083 60458080 +
ttgataccttttaagagaac

SEQ ID NO: 157556 - DNA, 20 bp, Artificial Sequence
  Synthetic oligonucleotide; CAG chr2 60458070 60458089 60458086 +
ccttttaagagaacaagcaa

SEQ ID NO: 157557 - DNA, 20 bp, Artificial Sequence
  Synthetic oligonucleotide; AAG chr2 60458083 60458102 60458099 +
caagcaacagttaaaaatac

SEQ ID NO: 157558 - DNA, 20 bp, Artificial Sequence
  Synthetic oligonucleotide; TAG chr2 60458103 60458122 60458119 +
aagcttcaatataaatacta

SEQ ID NO: 157559 - DNA, 20 bp, Artificial Sequence
  Synthetic oligonucleotide; TAG chr2 60458116 60458135 60458132 +
aatactatagtgcctaacac

SEQ ID NO: 157560 - DNA, 20 bp, Artificial Sequence
  Synthetic oligonucleotide; TAG chr2 60458145 60458164 60458161 +
atttaattcaaataccattc

SEQ ID NO: 157561 - DNA, 20 bp, Artificial Sequence
  Synthetic oligonucleotide; CAG chr2 60458153 60458172 60458169 +
caaataccattctagaaata

SEQ ID NO: 157562 - DNA, 20 bp, Artificial Sequence
  Synthetic oligonucleotide; AAG chr2 60458160 60458179 60458176 +
cattctagaaatacagaaaa

SEQ ID NO: 157563 - DNA, 20 bp, Artificial Sequence
  Synthetic oligonucleotide; TAG chr2 60458178 60458197 60458194 +
aaaagaccataaatgtattt

SEQ ID NO: 157564 - DNA, 20 bp, Artificial Sequence
  Synthetic oligonucleotide; TAG chr2 60458183 60458202 60458199 +
accataaatgtattttagca

SEQ ID NO: 157565 - DNA, 20 bp, Artificial Sequence
  Synthetic oligonucleotide; AGG chr2 60458184 60458203 60458200 +
ccataaatgtattttagcat

SEQ ID NO: 157566 - DNA, 20 bp, Artificial Sequence
  Synthetic oligonucleotide; GAG chr2 60458196 60458215 60458212 +
tttagcataggaatcaacat

SEQ ID NO: 157567 - DNA, 20 bp, Artificial Sequence
  Synthetic oligonucleotide; AAG chr2 60458218 60458237 60458234 +
gtgtgcattttcctatattt

SEQ ID NO: 157568 - DNA, 20 bp, Artificial Sequence
  Synthetic oligonucleotide; AAG chr2 60458275 60458294 60458291 +
ttttttttttttacaacctg

SEQ ID NO: 157569 - DNA, 20 bp, Artificial Sequence
  Synthetic oligonucleotide; GAG chr2 60458277 60458296 60458293 +
ttttttttttacaacctgaa

SEQ ID NO: 157570 - DNA, 20 bp, Artificial Sequence
  Synthetic oligonucleotide; CGG chr2 60458280 60458299 60458296 +
tttttttacaacctgaagag

SEQ ID NO: 157571 - DNA, 20 bp, Artificial Sequence
  Synthetic oligonucleotide; AAG chr2 60458292 60458311 60458308 +
ctgaagagcggtgtgtatcc

SEQ ID NO: 157572 - DNA, 20 bp, Artificial Sequence
  Synthetic oligonucleotide; AGG chr2 60458293 60458312 60458309 +
tgaagagcggtgtgtatcca

SEQ ID NO: 157573 - DNA, 20 bp, Artificial Sequence
  Synthetic oligonucleotide; TAG chr2 60458298 60458317 60458314 +
agcggtgtgtatccaaggca

SEQ ID NO: 157574 - DNA, 20 bp, Artificial Sequence
  Synthetic oligonucleotide; TGG chr2 60458323 60458342 60458339 +
tttccactaccatttttaaa

SEQ ID NO: 157575 - DNA, 20 bp, Artificial Sequence
  Synthetic oligonucleotide; AAG chr2 60458331 60458350 60458347 +
accatttttaaatggataac

SEQ ID NO: 157576 - DNA, 20 bp, Artificial Sequence
  Synthetic oligonucleotide; AAG chr2 60458349 60458368 60458365 +
acaagtcttgtaacaccacc

SEQ ID NO: 157577 - DNA, 20 bp, Artificial Sequence
  Synthetic oligonucleotide; TGG chr2 60458356 60458375 60458372 +
ttgtaacaccaccaagacaa

SEQ ID NO: 157578 - DNA, 20 bp, Artificial Sequence
  Synthetic oligonucleotide; CAG chr2 60458371 60458390 60458387 +
gacaatggaaccctaaaatg

SEQ ID NO: 157579 - DNA, 20 bp, Artificial Sequence
  Synthetic oligonucleotide; AAG chr2 60458393 60458412 60458409 +
gttcccccctaaacataatg

SEQ ID NO: 157580 - DNA, 20 bp, Artificial Sequence
  Synthetic oligonucleotide; AAG chr2 60458437 60458456 60458453 +
cttaacatttatatttaaaa

SEQ ID NO: 157581 - DNA, 20 bp, Artificial Sequence
  Synthetic oligonucleotide; TAG chr2 60458466 60458485 60458482 +
acaaaaaaatccttgcactg

SEQ ID NO: 157582 - DNA, 20 bp, Artificial Sequence
  Synthetic oligonucleotide; AAG chr2 60458469 60458488 60458485 +
aaaaaatccttgcactgtag

SEQ ID NO: 157583 - DNA, 20 bp, Artificial Sequence
  Synthetic oligonucleotide; AAG chr2 60458475 60458494 60458491 +
tccttgcactgtagaagcga

SEQ ID NO: 157584 - DNA, 20 bp, Artificial Sequence
  Synthetic oligonucleotide; AAG chr2 60458498 60458517 60458514 +
caatcattcatttctatgtt

SEQ ID NO: 157585 - DNA, 20 bp, Artificial Sequence
  Synthetic oligonucleotide; CAG chr2 60458520 60458539 60458536 +
gtgtattctgtttccattca

SEQ ID NO: 157586 - DNA, 20 bp, Artificial Sequence
  Synthetic oligonucleotide; AAG chr2 60458542 60458561 60458558 +
gcgcttgcaatgttgcgtcc

SEQ ID NO: 157587 - DNA, 20 bp, Artificial Sequence
  Synthetic oligonucleotide; AAG chr2 60458546 60458565 60458562 +
ttgcaatgttgcgtccaagt

SEQ ID NO: 157588 - DNA, 20 bp, Artificial Sequence
  Synthetic oligonucleotide; AAG chr2 60458550 60458569 60458566 +
aatgttgcgtccaagtaagt

SEQ ID NO: 157589 - DNA, 20 bp, Artificial Sequence
  Synthetic oligonucleotide; TAG chr2 60458558 60458577 60458574 +
gtccaagtaagtaagctcaa

SEQ ID NO: 157590 - DNA, 20 bp, Artificial Sequence
  Synthetic oligonucleotide; AAG chr2 60458563 60458582 60458579 +
agtaagtaagctcaatagtc

SEQ ID NO: 157591 - DNA, 20 bp, Artificial Sequence
  Synthetic oligonucleotide; TGG chr2 60458570 60458589 60458586 +
aagctcaatagtcaagtaaa

SEQ ID NO: 157592 - DNA, 20 bp, Artificial Sequence
  Synthetic oligonucleotide; TGG chr2 60458574 60458593 60458590 +
tcaatagtcaagtaaatggc

SEQ ID NO: 157593 - DNA, 20 bp, Artificial Sequence
  Synthetic oligonucleotide; AAG chr2 60458579 60458598 60458595 +
agtcaagtaaatggctggca

SEQ ID NO: 157594 - DNA, 20 bp, Artificial Sequence
  Synthetic oligonucleotide; TAG chr2 60458594 60458613 60458610 +
tggcaaagtttttttttttt

SEQ ID NO: 157595 - DNA, 20 bp, Artificial Sequence
  Synthetic oligonucleotide; GAG chr2 60458619 60458638 60458635 +
tttaaaaaatgctcctcaat

SEQ ID NO: 157596 - DNA, 20 bp, Artificial Sequence
  Synthetic oligonucleotide; CAG chr2 60458641 60458660 60458657 +
gattgtgttcaatttttttt

SEQ ID NO: 157597 - DNA, 20 bp, Artificial Sequence
  Synthetic oligonucleotide; AAG chr2 60458665 60458684 60458681 +
attcttgcaacttttccctt

SEQ ID NO: 157598 - DNA, 20 bp, Artificial Sequence
  Synthetic oligonucleotide; TAG chr2 60458670 60458689 60458686 +
tgcaacttttcccttaagta

SEQ ID NO: 157599 - DNA, 20 bp, Artificial Sequence
  Synthetic oligonucleotide; TGG chr2 60458683 60458702 60458699 +
ttaagtatagacctgtaaac

SEQ ID NO: 157600 - DNA, 20 bp, Artificial Sequence
  Synthetic oligonucleotide; GGG chr2 60458684 60458703 60458700 +
taagtatagacctgtaaact

SEQ ID NO: 157601 - DNA, 20 bp, Artificial Sequence
  Synthetic oligonucleotide; CAG chr2 60458696 60458715 60458712 +
tgtaaactgggaaaattgta

SEQ ID NO: 157602 - DNA, 20 bp, Artificial Sequence
  Synthetic oligonucleotide; GAG chr2 60458719 60458738 60458735 +
tgcacttaattgtcctatct

SEQ ID NO: 157603 - DNA, 20 bp, Artificial Sequence
  Synthetic oligonucleotide; CAG chr2 60458722 60458741 60458738 +
acttaattgtcctatctgag

SEQ ID NO: 157604 - DNA, 20 bp, Artificial Sequence
  Synthetic oligonucleotide; AGG chr2 60458723 60458742 60458739 +
cttaattgtcctatctgagc

SEQ ID NO: 157605 - DNA, 20 bp, Artificial Sequence
  Synthetic oligonucleotide; TAG chr2 60458758 60458777 60458774 +
tcaacctctgtatctctgat

SEQ ID NO: 157606 - DNA, 20 bp, Artificial Sequence
  Synthetic oligonucleotide; GAG chr2 60458760 60458779 60458776 +
aacctctgtatctctgatta

SEQ ID NO: 157607 - DNA, 20 bp, Artificial Sequence
  Synthetic oligonucleotide; AAG chr2 60458765 60458784 60458781 +
ctgtatctctgattagagaa

SEQ ID NO: 157608 - DNA, 20 bp, Artificial Sequence
  Synthetic oligonucleotide; CAG chr2 60458771 60458790 60458787 +
ctctgattagagaaaagata

SEQ ID NO: 157609 - DNA, 20 bp, Artificial Sequence
  Synthetic oligonucleotide; CAG chr2 60458780 60458799 60458796 +
gagaaaagatacagatatca

SEQ ID NO: 157610 - DNA, 20 bp, Artificial Sequence
  Synthetic oligonucleotide; AGG chr2 60458781 60458800 60458797 +
agaaaagatacagatatcac

SEQ ID NO: 157611 - DNA, 20 bp, Artificial Sequence
  Synthetic oligonucleotide; CAG chr2 60458784 60458803 60458800 +
aaagatacagatatcacagg

SEQ ID NO: 157612 - DNA, 20 bp, Artificial Sequence
  Synthetic oligonucleotide; GAG chr2 60458786 60458805 60458802 +
agatacagatatcacaggca

SEQ ID NO: 157613 - DNA, 20 bp, Artificial Sequence
  Synthetic oligonucleotide; AAG chr2 60458791 60458810 60458807 +
cagatatcacaggcagagtc

SEQ ID NO: 157614 - DNA, 20 bp, Artificial Sequence
  Synthetic oligonucleotide; TGG chr2 60458812 60458831 60458828 +
agtgctatttgaacaccaac

SEQ ID NO: 157615 - DNA, 20 bp, Artificial Sequence
  Synthetic oligonucleotide; GGG chr2 60458813 60458832 60458829 +
gtgctatttgaacaccaact

SEQ ID NO: 157616 - DNA, 20 bp, Artificial Sequence
  Synthetic oligonucleotide; GGG chr2 60458814 60458833 60458830 +
tgctatttgaacaccaactg

SEQ ID NO: 157617 - DNA, 20 bp, Artificial Sequence
  Synthetic oligonucleotide; CAG chr2 60458817 60458836 60458833 +
tatttgaacaccaactgggg

SEQ ID NO: 157618 - DNA, 20 bp, Artificial Sequence
  Synthetic oligonucleotide; TAG chr2 60458824 60458843 60458840 +
acaccaactggggcagatgc

SEQ ID NO: 157619 - DNA, 20 bp, Artificial Sequence
  Synthetic oligonucleotide; AAG chr2 60458837 60458856 60458853 +
cagatgctagcttaataaaa

SEQ ID NO: 157620 - DNA, 20 bp, Artificial Sequence
  Synthetic oligonucleotide; TAG chr2 60458896 60458915 60458912 +
ctcttccatgttaacacaaa

SEQ ID NO: 157621 - DNA, 20 bp, Artificial Sequence
  Synthetic oligonucleotide; CAG chr2 60458903 60458922 60458919 +
atgttaacacaaatagcaca

SEQ ID NO: 157622 - DNA, 20 bp, Artificial Sequence
  Synthetic oligonucleotide; TGG chr2 60458910 60458929 60458926 +
cacaaatagcacacagtgta

SEQ ID NO: 157623 - DNA, 20 bp, Artificial Sequence
  Synthetic oligonucleotide; AAG chr2 60458915 60458934 60458931 +
atagcacacagtgtatggaa

SEQ ID NO: 157624 - DNA, 20 bp, Artificial Sequence
  Synthetic oligonucleotide; AAG chr2 60458923 60458942 60458939 +
cagtgtatggaaaagaaatg

SEQ ID NO: 157625 - DNA, 20 bp, Artificial Sequence
  Synthetic oligonucleotide; TAG chr2 60458935 60458954 60458951 +
aagaaatgaagtacaacttt

SEQ ID NO: 157626 - DNA, 20 bp, Artificial Sequence
  Synthetic oligonucleotide; AGG chr2 60458936 60458955 60458952 +
agaaatgaagtacaactttt

SEQ ID NO: 157627 - DNA, 20 bp, Artificial Sequence
  Synthetic oligonucleotide; GGG chr2 60458937 60458956 60458953 +
gaaatgaagtacaactttta

SEQ ID NO: 157628 - DNA, 20 bp, Artificial Sequence
  Synthetic oligonucleotide; GAG chr2 60458939 60458958 60458955 +
aatgaagtacaacttttagg

SEQ ID NO: 157629 - DNA, 20 bp, Artificial Sequence
  Synthetic oligonucleotide; CAG chr2 60458944 60458963 60458960 +
agtacaacttttagggagca

SEQ ID NO: 157630 - DNA, 20 bp, Artificial Sequence
  Synthetic oligonucleotide; AAG chr2 60458990 60459009 60459006 +
attctttctcttcttttttt

SEQ ID NO: 157631 - DNA, 20 bp, Artificial Sequence
  Synthetic oligonucleotide; AAG chr2 60459011 60459030 60459027 +
agaatgtcacatttaaatgc

SEQ ID NO: 157632 - DNA, 20 bp, Artificial Sequence
  Synthetic oligonucleotide; AAG chr2 60459018 60459037 60459034 +
cacatttaaatgcaagtctt

SEQ ID NO: 157633 - DNA, 20 bp, Artificial Sequence
  Synthetic oligonucleotide; TAG chr2 60459027 60459046 60459043 +
atgcaagtcttaagaattca

SEQ ID NO: 157634 - DNA, 20 bp, Artificial Sequence
  Synthetic oligonucleotide; TAG chr2 60459052 60459071 60459068 +
aatcatcattgtatcaatat

SEQ ID NO: 157635 - DNA, 20 bp, Artificial Sequence
  Synthetic oligonucleotide; TAG chr2 60459070 60459089 60459086 +
attagcttatatacctgttc

SEQ ID NO: 157636 - DNA, 20 bp, Artificial Sequence
  Synthetic oligonucleotide; TGG chr2 60459080 60459099 60459096 +
atacctgttctagttttaaa

SEQ ID NO: 157637 - DNA, 20 bp, Artificial Sequence
  Synthetic oligonucleotide; TAG chr2 60459087 60459106 60459103 +
ttctagttttaaatggcaaa

SEQ ID NO: 157638 - DNA, 20 bp, Artificial Sequence
  Synthetic oligonucleotide; CAG chr2 60459152 60459171 60459168 +
cctctgtcaaaccttattgt

SEQ ID NO: 157639 - DNA, 20 bp, Artificial Sequence
  Synthetic oligonucleotide; TGG chr2 60459171 60459190 60459187 +
tcagcctcttcctttcaata

SEQ ID NO: 157640 - DNA, 20 bp, Artificial Sequence
  Synthetic oligonucleotide; AAG chr2 60459179 60459198 60459195 +
ttcctttcaatatggtatac

SEQ ID NO: 157641 - DNA, 20 bp, Artificial Sequence
  Synthetic oligonucleotide; AGG chr2 60459180 60459199 60459196 +
tcctttcaatatggtataca

SEQ ID NO: 157642 - DNA, 20 bp, Artificial Sequence
  Synthetic oligonucleotide; AAG chr2 60459188 60459207 60459204 +
atatggtatacaaggtctta

SEQ ID NO: 157643 - DNA, 20 bp, Artificial Sequence
  Synthetic oligonucleotide; AAG chr2 60459220 60459239 60459236 +
tgattgtccacttgacaacc

SEQ ID NO: 157644 - DNA, 20 bp, Artificial Sequence
  Synthetic oligonucleotide; TAG chr2 60459223 60459242 60459239 +
ttgtccacttgacaaccaag

SEQ ID NO: 157645 - DNA, 20 bp, Artificial Sequence
  Synthetic oligonucleotide; TGG chr2 60459229 60459248 60459245 +
acttgacaaccaagtagatc

SEQ ID NO: 157646 - DNA, 20 bp, Artificial Sequence
  Synthetic oligonucleotide; TGG chr2 60459244 60459263 60459260 +
agatctggatctatttcttt

SEQ ID NO: 157647 - DNA, 20 bp, Artificial Sequence
  Synthetic oligonucleotide; CAG chr2 60459250 60459269 60459266 +
ggatctatttcttttggtgc

SEQ ID NO: 157648 - DNA, 20 bp, Artificial Sequence
  Synthetic oligonucleotide; AAG chr2 60459263 60459282 60459279 +
ttggtgccagtatttttaaa

SEQ ID NO: 157649 - DNA, 20 bp, Artificial Sequence
  Synthetic oligonucleotide; AAG chr2 60459275 60459294 60459291 +
tttttaaaaagacattatta

SEQ ID NO: 157650 - DNA, 20 bp, Artificial Sequence
  Synthetic oligonucleotide; TAG chr2 60459307 60459326 60459323 +
tcataaaatgaactccttac

SEQ ID NO: 157651 - DNA, 20 bp, Artificial Sequence
  Synthetic oligonucleotide; CAG chr2 60459327 60459346 60459343 +
tagtgtatttaattgcgttc

SEQ ID NO: 157652 - DNA, 20 bp, Artificial Sequence
  Synthetic oligonucleotide; AGG chr2 60459328 60459347 60459344 +
agtgtatttaattgcgttcc

SEQ ID NO: 157653 - DNA, 20 bp, Artificial Sequence
  Synthetic oligonucleotide; GGG chr2 60459329 60459348 60459345 +
gtgtatttaattgcgttcca

SEQ ID NO: 157654 - DNA, 20 bp, Artificial Sequence
  Synthetic oligonucleotide; TGG chr2 60459384 60459403 60459400 +
gtttaaaaaaaataaaactt

SEQ ID NO: 157655 - DNA, 20 bp, Artificial Sequence
  Synthetic oligonucleotide; GGG chr2 60459385 60459404 60459401 +
tttaaaaaaaataaaacttt

SEQ ID NO: 157656 - DNA, 20 bp, Artificial Sequence
  Synthetic oligonucleotide; CAG chr2 60459393 60459412 60459409 +
aaataaaactttgggcaaaa

SEQ ID NO: 157657 - DNA, 20 bp, Artificial Sequence
  Synthetic oligonucleotide; AAG chr2 60459408 60459427 60459424 +
caaaacagcccatttctttt

SEQ ID NO: 157658 - DNA, 20 bp, Artificial Sequence
  Synthetic oligonucleotide; CAG chr2 60459418 60459437 60459434 +
catttcttttaagctctcac

SEQ ID NO: 157659 - DNA, 20 bp, Artificial Sequence
  Synthetic oligonucleotide; AGG chr2 60459419 60459438 60459435 +
atttcttttaagctctcacc

SEQ ID NO: 157660 - DNA, 20 bp, Artificial Sequence
  Synthetic oligonucleotide; GAG chr2 60459421 60459440 60459437 +
ttcttttaagctctcaccag

SEQ ID NO: 157661 - DNA, 20 bp, Artificial Sequence
  Synthetic oligonucleotide; AAG chr2 60459426 60459445 60459442 +
ttaagctctcaccaggagca

SEQ ID NO: 157662 - DNA, 20 bp, Artificial Sequence
  Synthetic oligonucleotide; TAG chr2 60459429 60459448 60459445 +
agctctcaccaggagcaaag

SEQ ID NO: 157663 - DNA, 20 bp, Artificial Sequence
  Synthetic oligonucleotide; TGG chr2 60459441 60459460 60459457 +
gagcaaagtagcttttatac

SEQ ID NO: 157664 - DNA, 20 bp, Artificial Sequence
  Synthetic oligonucleotide; CAG chr2 60459450 60459469 60459466 +
agcttttatactggtataat

SEQ ID NO: 157665 - DNA, 20 bp, Artificial Sequence
  Synthetic oligonucleotide; AAG chr2 60459475 60459494 60459491 +
ttgtttataaaattaaacta

SEQ ID NO: 157666 - DNA, 20 bp, Artificial Sequence
  Synthetic oligonucleotide; AGG chr2 60459476 60459495 60459492 +
tgtttataaaattaaactaa

SEQ ID NO: 157667 - DNA, 20 bp, Artificial Sequence
  Synthetic oligonucleotide; TAG chr2 60459495 60459514 60459511 +
aaggaaaaatgatgattaac

SEQ ID NO: 157668 - DNA, 20 bp, Artificial Sequence
  Synthetic oligonucleotide; AGG chr2 60459496 60459515 60459512 +
aggaaaaatgatgattaact

SEQ ID NO: 157669 - DNA, 20 bp, Artificial Sequence
  Synthetic oligonucleotide; TGG chr2 60459505 60459524 60459521 +
gatgattaactaggacataa

SEQ ID NO: 157670 - DNA, 20 bp, Artificial Sequence
  Synthetic oligonucleotide; GGG chr2 60459506 60459525 60459522 +
atgattaactaggacataat

SEQ ID NO: 157671 - DNA, 20 bp, Artificial Sequence
  Synthetic oligonucleotide; TAG chr2 60459518 60459537 60459534 +
gacataatgggtcatctttt

SEQ ID NO: 157672 - DNA, 20 bp, Artificial Sequence
  Synthetic oligonucleotide; AGG chr2 60459519 60459538 60459535 +
acataatgggtcatcttttt

SEQ ID NO: 157673 - DNA, 20 bp, Artificial Sequence
  Synthetic oligonucleotide; TAG chr2 60459522 60459541 60459538 +
taatgggtcatctttttagg

SEQ ID NO: 157674 - DNA, 20 bp, Artificial Sequence
  Synthetic oligonucleotide; GAG chr2 60459535 60459554 60459551 +
ttttaggtagccattgttgt

SEQ ID NO: 157675 - DNA, 20 bp, Artificial Sequence
  Synthetic oligonucleotide; TAG chr2 60459548 60459567 60459564 +
ttgttgtgagaaatacaata

SEQ ID NO: 157676 - DNA, 20 bp, Artificial Sequence
  Synthetic oligonucleotide; TAG chr2 60459561 60459580 60459577 +
tacaatatagaattatatgc

SEQ ID NO: 157677 - DNA, 20 bp, Artificial Sequence
  Synthetic oligonucleotide; AAG chr2 60459569 60459588 60459585 +
agaattatatgctagttcct

SEQ ID NO: 157678 - DNA, 20 bp, Artificial Sequence
  Synthetic oligonucleotide; AGG chr2 60459570 60459589 60459586 +
gaattatatgctagttccta

SEQ ID NO: 157679 - DNA, 20 bp, Artificial Sequence
  Synthetic oligonucleotide; AAG chr2 60459599 60459618 60459615 +
acctcacccaatgctgaatt

SEQ ID NO: 157680 - DNA, 20 bp, Artificial Sequence
  Synthetic oligonucleotide; AAG chr2 60459606 60459625 60459622 +
ccaatgctgaattaagctac

SEQ ID NO: 157681 - DNA, 20 bp, Artificial Sequence
  Synthetic oligonucleotide; AAG chr2 60459617 60459636 60459633 +
ttaagctacaagtttataac

SEQ ID NO: 157682 - DNA, 20 bp, Artificial Sequence
  Synthetic oligonucleotide; TAG chr2 60459620 60459639 60459636 +
agctacaagtttataacaag

SEQ ID NO: 157683 - DNA, 20 bp, Artificial Sequence
  Synthetic oligonucleotide; AAG chr2 60459624 60459643 60459640 +
acaagtttataacaagtaga

SEQ ID NO: 157684 - DNA, 20 bp, Artificial Sequence
  Synthetic oligonucleotide; TGG chr2 60459638 60459657 60459654 +
agtagaaagaaccatcgatg

SEQ ID NO: 157685 - DNA, 20 bp, Artificial Sequence
  Synthetic oligonucleotide; TAG chr2 60459647 60459666 60459663 +
aaccatcgatgtggttttaa

SEQ ID NO: 157686 - DNA, 20 bp, Artificial Sequence
  Synthetic oligonucleotide; AAG chr2 60459654 60459673 60459670 +
gatgtggttttaatagatcc

SEQ ID NO: 157687 - DNA, 20 bp, Artificial Sequence
  Synthetic oligonucleotide; AGG chr2 60459655 60459674 60459671 +
atgtggttttaatagatcca

SEQ ID NO: 157688 - DNA, 20 bp, Artificial Sequence
  Synthetic oligonucleotide; TAG chr2 60459682 60459701 60459698 +
catattttaaaaccaaatga

SEQ ID NO: 157689 - DNA, 20 bp, Artificial Sequence
  Synthetic oligonucleotide; AAG chr2 60459723 60459742 60459739 +
ttctgttaatttgtcaattc

SEQ ID NO: 157690 - DNA, 20 bp, Artificial Sequence
  Synthetic oligonucleotide; AGG chr2 60459724 60459743 60459740 +
tctgttaatttgtcaattca

SEQ ID NO: 157691 - DNA, 20 bp, Artificial Sequence
  Synthetic oligonucleotide; TAG chr2 60459765 60459784 60459781 +
aattgatacatttaaccctt

SEQ ID NO: 157692 - DNA, 20 bp, Artificial Sequence
  Synthetic oligonucleotide; GAG chr2 60459767 60459786 60459783 +
ttgatacatttaacccttta

SEQ ID NO: 157693 - DNA, 20 bp, Artificial Sequence
  Synthetic oligonucleotide; CAG chr2 60459771 60459790 60459787 +
tacatttaaccctttagaga

SEQ ID NO: 157694 - DNA, 20 bp, Artificial Sequence
  Synthetic oligonucleotide; TAG chr2 60459779 60459798 60459795 +
accctttagagacagacatt

SEQ ID NO: 157695 - DNA, 20 bp, Artificial Sequence
  Synthetic oligonucleotide; TAG chr2 60459786 60459805 60459802 +
agagacagacatttagctca

SEQ ID NO: 157696 - DNA, 20 bp, Artificial Sequence
  Synthetic oligonucleotide; GAG chr2 60459788 60459807 60459804 +
agacagacatttagctcata

SEQ ID NO: 157697 - DNA, 20 bp, Artificial Sequence
  Synthetic oligonucleotide; CAG chr2 60459800 60459819 60459816 +
agctcatagagatttttttt

SEQ ID NO: 157698 - DNA, 20 bp, Artificial Sequence
  Synthetic oligonucleotide; TAG chr2 60459821 60459840 60459837 +
agtgctatctattctgtcta

SEQ ID NO: 157699 - DNA, 20 bp, Artificial Sequence
  Synthetic oligonucleotide; GAG chr2 60459823 60459842 60459839 +
tgctatctattctgtctata

SEQ ID NO: 157700 - DNA, 20 bp, Artificial Sequence
  Synthetic oligonucleotide; AGG chr2 60459824 60459843 60459840 +
gctatctattctgtctatag

SEQ ID NO: 157701 - DNA, 20 bp, Artificial Sequence
  Synthetic oligonucleotide; GGG chr2 60459825 60459844 60459841 +
ctatctattctgtctataga

SEQ ID NO: 157702 - DNA, 20 bp, Artificial Sequence
  Synthetic oligonucleotide; AAG chr2 60459836 60459855 60459852 +
gtctatagagggttaatcca

SEQ ID NO: 157703 - DNA, 20 bp, Artificial Sequence
  Synthetic oligonucleotide; CAG chr2 60459890 60459909 60459906 +
actgtacatgatatgtatta

SEQ ID NO: 157704 - DNA, 20 bp, Artificial Sequence
  Synthetic oligonucleotide; CAG chr2 60459901 60459920 60459917 +
tatgtattacagaatgtatg

SEQ ID NO: 157705 - DNA, 20 bp, Artificial Sequence
  Synthetic oligonucleotide; TGG chr2 60459906 60459925 60459922 +
attacagaatgtatgcagca

SEQ ID NO: 157706 - DNA, 20 bp, Artificial Sequence
  Synthetic oligonucleotide; CAG chr2 60459938 60459957 60459954 +
ctctctctctctttttctct

SEQ ID NO: 157707 - DNA, 20 bp, Artificial Sequence
  Synthetic oligonucleotide; CGG chr2 60459943 60459962 60459959 +
tctctctttttctctcagaa

SEQ ID NO: 157708 - DNA, 20 bp, Artificial Sequence
  Synthetic oligonucleotide; TGG chr2 60459949 60459968 60459965 +
tttttctctcagaacggaac

SEQ ID NO: 157709 - DNA, 20 bp, Artificial Sequence
  Synthetic oligonucleotide; CAG chr2 60459955 60459974 60459971 +
tctcagaacggaactggaaa

SEQ ID NO: 157710 - DNA, 20 bp, Artificial Sequence
  Synthetic oligonucleotide; CAG chr2 60459971 60459990 60459987 +
gaaacagcaacatgtttgct

SEQ ID NO: 157711 - DNA, 20 bp, Artificial Sequence
  Synthetic oligonucleotide; TAG chr2 60459982 60460001 60459998 +
atgtttgctcagcaacgaat

SEQ ID NO: 157712 - DNA, 20 bp, Artificial Sequence
  Synthetic oligonucleotide; AGG chr2 60459983 60460002 60459999 +
tgtttgctcagcaacgaatt

SEQ ID NO: 157713 - DNA, 20 bp, Artificial Sequence
  Synthetic oligonucleotide; GGG chr2 60459984 60460003 60460000 +
gtttgctcagcaacgaatta

SEQ ID NO: 157714 - DNA, 20 bp, Artificial Sequence
  Synthetic oligonucleotide; TAG chr2 60459998 60460017 60460014 +
gaattagggacaatttaaaa

SEQ ID NO: 157715 - DNA, 20 bp, Artificial Sequence
  Synthetic oligonucleotide; AAG chr2 60460026 60460045 60460042 +
acataccatacatgctgtct

SEQ ID NO: 157716 - DNA, 20 bp, Artificial Sequence
  Synthetic oligonucleotide; AAG chr2 60460067 60460086 60460083 +
caacatgtaaattattgcac

SEQ ID NO: 157717 - DNA, 20 bp, Artificial Sequence
  Synthetic oligonucleotide; GAG chr2 60460069 60460088 60460085 +
acatgtaaattattgcacaa

SEQ ID NO: 157718 - DNA, 20 bp, Artificial Sequence
  Synthetic oligonucleotide; AAG chr2 60460073 60460092 60460089 +
gtaaattattgcacaagaga

SEQ ID NO: 157719 - DNA, 20 bp, Artificial Sequence
  Synthetic oligonucleotide; AGG chr2 60460074 60460093 60460090 +
taaattattgcacaagagaa

SEQ ID NO: 157720 - DNA, 20 bp, Artificial Sequence
  Synthetic oligonucleotide; AAG chr2 60460081 60460100 60460097 +
ttgcacaagagaaaggctca

SEQ ID NO: 157721 - DNA, 20 bp, Artificial Sequence
  Synthetic oligonucleotide; TAG chr2 60460100 60460119 60460116 +
aaagtttgcgtaaaatgcaa

SEQ ID NO: 157722 - DNA, 20 bp, Artificial Sequence
  Synthetic oligonucleotide; CAG chr2 60460115 60460134 60460131 +
tgcaatagtattgccccata

SEQ ID NO: 157723 - DNA, 20 bp, Artificial Sequence
  Synthetic oligonucleotide; CGG chr2 60460132 60460151 60460148 +
atacagatcatgcattcaaa

SEQ ID NO: 157724 - DNA, 20 bp, Artificial Sequence
  Synthetic oligonucleotide; GAG chr2 60460136 60460155 60460152 +
agatcatgcattcaaacggt

SEQ ID NO: 157725 - DNA, 20 bp, Artificial Sequence
  Synthetic oligonucleotide; AAG chr2 60460145 60460164 60460161 +
attcaaacggtgagaacata

SEQ ID NO: 157726 - DNA, 20 bp, Artificial Sequence
  Synthetic oligonucleotide; AGG chr2 60460146 60460165 60460162 +
ttcaaacggtgagaacataa

SEQ ID NO: 157727 - DNA, 20 bp, Artificial Sequence
  Synthetic oligonucleotide; AAG chr2 60460161 60460180 60460177 +
cataaaggaaaaaaaaaaaa

SEQ ID NO: 157728 - DNA, 20 bp, Artificial Sequence
  Synthetic oligonucleotide; AGG chr2 60460162 60460181 60460178 +
ataaaggaaaaaaaaaaaaa

SEQ ID NO: 157729 - DNA, 20 bp, Artificial Sequence
  Synthetic oligonucleotide; AAG chr2 60460168 60460187 60460184 +
gaaaaaaaaaaaaaaggaaa

SEQ ID NO: 157730 - DNA, 20 bp, Artificial Sequence
  Synthetic oligonucleotide; AAG chr2 60460175 60460194 60460191 +
aaaaaaaaggaaaaagaaaa

SEQ ID NO: 157731 - DNA, 20 bp, Artificial Sequence
  Synthetic oligonucleotide; AAG chr2 60460181 60460200 60460197 +
aaggaaaaagaaaaaagaaa

SEQ ID NO: 157732 - DNA, 20 bp, Artificial Sequence
  Synthetic oligonucleotide; AAG chr2 60460187 60460206 60460203 +
aaagaaaaaagaaaaagaaa

SEQ ID NO: 157733 - DNA, 20 bp, Artificial Sequence
  Synthetic oligonucleotide; CAG chr2 60460198 60460217 60460214 +
aaaaagaaaaagaaaaaaaa

SEQ ID NO: 157734 - DNA, 20 bp, Artificial Sequence
  Synthetic oligonucleotide; AGG chr2 60460199 60460218 60460215 +
aaaagaaaaagaaaaaaaac

SEQ ID NO: 157735 - DNA, 20 bp, Artificial Sequence
  Synthetic oligonucleotide; TGG chr2 60460207 60460226 60460223 +
aagaaaaaaaacaggtgtgc

SEQ ID NO: 157736 - DNA, 20 bp, Artificial Sequence
  Synthetic oligonucleotide; AAG chr2 60460214 60460233 60460230 +
aaaacaggtgtgctggtgac

SEQ ID NO: 157737 - DNA, 20 bp, Artificial Sequence
  Synthetic oligonucleotide; TAG chr2 60460231 60460250 60460247 +
gacaagcactctcatattct

SEQ ID NO: 157738 - DNA, 20 bp, Artificial Sequence
  Synthetic oligonucleotide; TGG chr2 60460275 60460294 60460291 +
gtttgtttgtttaaatcaca

SEQ ID NO: 157739 - DNA, 20 bp, Artificial Sequence
  Synthetic oligonucleotide; GGG chr2 60460276 60460295 60460292 +
tttgtttgtttaaatcacat

SEQ ID NO: 157740 - DNA, 20 bp, Artificial Sequence
  Synthetic oligonucleotide; TAG chr2 60460281 60460300 60460297 +
ttgtttaaatcacatgggac

SEQ ID NO: 157741 - DNA, 20 bp, Artificial Sequence
  Synthetic oligonucleotide; CAG chr2 60460296 60460315 60460312 +
gggactagaaaaaaatccta

SEQ ID NO: 157742 - DNA, 20 bp, Artificial Sequence
  Synthetic oligonucleotide; AGG chr2 60460297 60460316 60460313 +
ggactagaaaaaaatcctac

SEQ ID NO: 157743 - DNA, 20 bp, Artificial Sequence
  Synthetic oligonucleotide; GGG chr2 60460298 60460317 60460314 +
gactagaaaaaaatcctaca

SEQ ID NO: 157744 - DNA, 20 bp, Artificial Sequence
  Synthetic oligonucleotide; GAG chr2 60460300 60460319 60460316 +
ctagaaaaaaatcctacagg

SEQ ID NO: 157745 - DNA, 20 bp, Artificial Sequence
  Synthetic oligonucleotide; TGG chr2 60460303 60460322 60460319 +
gaaaaaaatcctacagggag

SEQ ID NO: 157746 - DNA, 20 bp, Artificial Sequence
  Synthetic oligonucleotide; GGG chr2 60460304 60460323 60460320 +
aaaaaaatcctacagggagt

SEQ ID NO: 157747 - DNA, 20 bp, Artificial Sequence
  Synthetic oligonucleotide; GGG chr2 60460305 60460324 60460321 +
aaaaaatcctacagggagtg

SEQ ID NO: 157748 - DNA, 20 bp, Artificial Sequence
  Synthetic oligonucleotide; TGG chr2 60460309 60460328 60460325 +
aatcctacagggagtggggc

SEQ ID NO: 157749 - DNA, 20 bp, Artificial Sequence
  Synthetic oligonucleotide; GAG chr2 60460311 60460330 60460327 +
tcctacagggagtggggctg

SEQ ID NO: 157750 - DNA, 20 bp, Artificial Sequence
  Synthetic oligonucleotide; AGG chr2 60460312 60460331 60460328 +
cctacagggagtggggctgg

SEQ ID NO: 157751 - DNA, 20 bp, Artificial Sequence
  Synthetic oligonucleotide; GGG chr2 60460313 60460332 60460329 +
ctacagggagtggggctgga

SEQ ID NO: 157752 - DNA, 20 bp, Artificial Sequence
  Synthetic oligonucleotide; TGG chr2 60460319 60460338 60460335 +
ggagtggggctggagggcga

SEQ ID NO: 157753 - DNA, 20 bp, Artificial Sequence
  Synthetic oligonucleotide; GGG chr2 60460320 60460339 60460336 +
gagtggggctggagggcgat

SEQ ID NO: 157754 - DNA, 20 bp, Artificial Sequence
  Synthetic oligonucleotide; GGG chr2 60460321 60460340 60460337 +
agtggggctggagggcgatg

SEQ ID NO: 157755 - DNA, 20 bp, Artificial Sequence
  Synthetic oligonucleotide; AAG chr2 60460324 60460343 60460340 +
ggggctggagggcgatgggg

SEQ ID NO: 157756 - DNA, 20 bp, Artificial Sequence
  Synthetic oligonucleotide; AGG chr2 60460325 60460344 60460341 +
gggctggagggcgatgggga

SEQ ID NO: 157757 - DNA, 20 bp, Artificial Sequence
  Synthetic oligonucleotide; GGG chr2 60460326 60460345 60460342 +
ggctggagggcgatggggaa

SEQ ID NO: 157758 - DNA, 20 bp, Artificial Sequence
  Synthetic oligonucleotide; GGG chr2 60460327 60460346 60460343 +
gctggagggcgatggggaag

SEQ ID NO: 157759 - DNA, 20 bp, Artificial Sequence
  Synthetic oligonucleotide; GAG chr2 60460329 60460348 60460345 +
tggagggcgatggggaaggg

SEQ ID NO: 157760 - DNA, 20 bp, Artificial Sequence
  Synthetic oligonucleotide; TGG chr2 60460332 60460351 60460348 +
agggcgatggggaaggggag

SEQ ID NO: 157761 - DNA, 20 bp, Artificial Sequence
  Synthetic oligonucleotide; AAG chr2 60460340 60460359 60460356 +
ggggaaggggagtggtgaaa

SEQ ID NO: 157762 - DNA, 20 bp, Artificial Sequence
  Synthetic oligonucleotide; AGG chr2 60460341 60460360 60460357 +
gggaaggggagtggtgaaaa

SEQ ID NO: 157763 - DNA, 20 bp, Artificial Sequence
  Synthetic oligonucleotide; GGG chr2 60460342 60460361 60460358 +
ggaaggggagtggtgaaaaa

SEQ ID NO: 157764 - DNA, 20 bp, Artificial Sequence
  Synthetic oligonucleotide; GGG chr2 60460343 60460362 60460359 +
gaaggggagtggtgaaaaag

SEQ ID NO: 157765 - DNA, 20 bp, Artificial Sequence
  Synthetic oligonucleotide; GGG chr2 60460344 60460363 60460360 +
aaggggagtggtgaaaaagg

SEQ ID NO: 157766 - DNA, 20 bp, Artificial Sequence
  Synthetic oligonucleotide; CAG chr2 60460350 60460369 60460366 +
agtggtgaaaaagggggtgt

SEQ ID NO: 157767 - DNA, 20 bp, Artificial Sequence
  Synthetic oligonucleotide; AGG chr2 60460351 60460370 60460367 +
gtggtgaaaaagggggtgtc

SEQ ID NO: 157768 - DNA, 20 bp, Artificial Sequence
  Synthetic oligonucleotide; TGG chr2 60460354 60460373 60460370 +
gtgaaaaagggggtgtcagg

SEQ ID NO: 157769 - DNA, 20 bp, Artificial Sequence
  Synthetic oligonucleotide; GGG chr2 60460355 60460374 60460371 +
tgaaaaagggggtgtcaggt

SEQ ID NO: 157770 - DNA, 20 bp, Artificial Sequence
  Synthetic oligonucleotide; GAG chr2 60460357 60460376 60460373 +
aaaaagggggtgtcaggtgg

SEQ ID NO: 157771 - DNA, 20 bp, Artificial Sequence
  Synthetic oligonucleotide; GAG chr2 60460361 60460380 60460377 +
agggggtgtcaggtgggagt

SEQ ID NO: 157772 - DNA, 20 bp, Artificial Sequence
  Synthetic oligonucleotide; AGG chr2 60460362 60460381 60460378 +
gggggtgtcaggtgggagtg

SEQ ID NO: 157773 - DNA, 20 bp, Artificial Sequence
  Synthetic oligonucleotide; GGG chr2 60460363 60460382 60460379 +
ggggtgtcaggtgggagtga

SEQ ID NO: 157774 - DNA, 20 bp, Artificial Sequence
  Synthetic oligonucleotide; GAG chr2 60460365 60460384 60460381 +
ggtgtcaggtgggagtgagg

SEQ ID NO: 157775 - DNA, 20 bp, Artificial Sequence
  Synthetic oligonucleotide; AGG chr2 60460366 60460385 60460382 +
gtgtcaggtgggagtgaggg

SEQ ID NO: 157776 - DNA, 20 bp, Artificial Sequence
  Synthetic oligonucleotide; GGG chr2 60460367 60460386 60460383 +
tgtcaggtgggagtgaggga

SEQ ID NO: 157777 - DNA, 20 bp, Artificial Sequence
  Synthetic oligonucleotide; GGG chr2 60460368 60460387 60460384 +
gtcaggtgggagtgagggag

SEQ ID NO: 157778 - DNA, 20 bp, Artificial Sequence
  Synthetic oligonucleotide; CAG chr2 60460389 60460408 60460405 +
ggtattaatatacctctatt

SEQ ID NO: 157779 - DNA, 20 bp, Artificial Sequence
  Synthetic oligonucleotide; CAG chr2 60460447 60460466 60460463 +
cattttttcatgtgtttctc

SEQ ID NO: 157780 - DNA, 20 bp, Artificial Sequence
  Synthetic oligonucleotide; AGG chr2 60460448 60460467 60460464 +
attttttcatgtgtttctcc

SEQ ID NO: 157781 - DNA, 20 bp, Artificial Sequence
  Synthetic oligonucleotide; GGG chr2 60460449 60460468 60460465 +
ttttttcatgtgtttctcca

SEQ ID NO: 157782 - DNA, 20 bp, Artificial Sequence
  Synthetic oligonucleotide; AAG chr2 60460467 60460486 60460483 +
cagggtactgtacacgctaa

SEQ ID NO: 157783 - DNA, 20 bp, Artificial Sequence
  Synthetic oligonucleotide; AGG chr2 60460468 60460487 60460484 +
agggtactgtacacgctaaa

SEQ ID NO: 157784 - DNA, 20 bp, Artificial Sequence
  Synthetic oligonucleotide; TGG chr2 60460511 60460530 60460527 +
tgtaaacgtccttccccacc

SEQ ID NO: 157785 - DNA, 20 bp, Artificial Sequence
  Synthetic oligonucleotide; TGG chr2 60460533 60460552 60460549 +
gccatgcgttttcatgtgcc

SEQ ID NO: 157786 - DNA, 20 bp, Artificial Sequence
  Synthetic oligonucleotide; GAG chr2 60460537 60460556 60460553 +
tgcgttttcatgtgcctggt

SEQ ID NO: 157787 - DNA, 20 bp, Artificial Sequence
  Synthetic oligonucleotide; TGG chr2 60460550 60460569 60460566 +
gcctggtgagcttgctactc

SEQ ID NO: 157788 - DNA, 20 bp, Artificial Sequence
  Synthetic oligonucleotide; GGG chr2 60460551 60460570 60460567 +
cctggtgagcttgctactct

SEQ ID NO: 157789 - DNA, 20 bp, Artificial Sequence
  Synthetic oligonucleotide; CAG chr2 60460556 60460575 60460572 +
tgagcttgctactctgggca

SEQ ID NO: 157790 - DNA, 20 bp, Artificial Sequence
  Synthetic oligonucleotide; AGG chr2 60460557 60460576 60460573 +
gagcttgctactctgggcac

SEQ ID NO: 157791 - DNA, 20 bp, Artificial Sequence
  Synthetic oligonucleotide; TAG chr2 60460562 60460581 60460578 +
tgctactctgggcacaggca

SEQ ID NO: 157792 - DNA, 20 bp, Artificial Sequence
  Synthetic oligonucleotide; CAG chr2 60460570 60460589 60460586 +
tgggcacaggcatagttgca

SEQ ID NO: 157793 - DNA, 20 bp, Artificial Sequence
  Synthetic oligonucleotide; AAG chr2 60460584 60460603 60460600 +
gttgcacagctcgcatttat

SEQ ID NO: 157794 - DNA, 20 bp, Artificial Sequence
  Synthetic oligonucleotide; AGG chr2 60460585 60460604 60460601 +
ttgcacagctcgcatttata

SEQ ID NO: 157795 - DNA, 20 bp, Artificial Sequence
  Synthetic oligonucleotide; TGG chr2 60460601 60460620 60460617 +
tataaggcctttcgcccgtg

SEQ ID NO: 157796 - DNA, 20 bp, Artificial Sequence
  Synthetic oligonucleotide; TGG chr2 60460613 60460632 60460629 +
cgcccgtgtggcttctcctg

SEQ ID NO: 157797 - DNA, 20 bp, Artificial Sequence
  Synthetic oligonucleotide; CAG chr2 60460617 60460636 60460633 +
cgtgtggcttctcctgtgga

SEQ ID NO: 157798 - DNA, 20 bp, Artificial Sequence
  Synthetic oligonucleotide; GAG chr2 60460621 60460640 60460637 +
tggcttctcctgtggacagt

SEQ ID NO: 157799 - DNA, 20 bp, Artificial Sequence
  Synthetic oligonucleotide; CAG chr2 60460631 60460650 60460647 +
tgtggacagtgagattgcta

SEQ ID NO: 157800 - DNA, 20 bp, Artificial Sequence
  Synthetic oligonucleotide; AAG chr2 60460640 60460659 60460656 +
tgagattgctacagttcttg

SEQ ID NO: 157801 - DNA, 20 bp, Artificial Sequence
  Synthetic oligonucleotide; CAG chr2 60460652 60460671 60460668 +
agttcttgaagactttccca

SEQ ID NO: 157802 - DNA, 20 bp, Artificial Sequence
  Synthetic oligonucleotide; AAG chr2 60460662 60460681 60460678 +
gactttcccacagtactcac

SEQ ID NO: 157803 - DNA, 20 bp, Artificial Sequence
  Synthetic oligonucleotide; GAG chr2 60460688 60460707 60460704 +
cgctgcgtctgccctctttt

SEQ ID NO: 157804 - DNA, 20 bp, Artificial Sequence
  Synthetic oligonucleotide; TGG chr2 60460692 60460711 60460708 +
gcgtctgccctcttttgagc

SEQ ID NO: 157805 - DNA, 20 bp, Artificial Sequence
  Synthetic oligonucleotide; GGG chr2 60460693 60460712 60460709 +
cgtctgccctcttttgagct

SEQ ID NO: 157806 - DNA, 20 bp, Artificial Sequence
  Synthetic oligonucleotide; CGG chr2 60460702 60460721 60460718 +
tcttttgagctgggcctgcc

SEQ ID NO: 157807 - DNA, 20 bp, Artificial Sequence
  Synthetic oligonucleotide; GGG chr2 60460703 60460722 60460719 +
cttttgagctgggcctgccc

SEQ ID NO: 157808 - DNA, 20 bp, Artificial Sequence
  Synthetic oligonucleotide; CGG chr2 60460708 60460727 60460724 +
gagctgggcctgcccgggcc

SEQ ID NO: 157809 - DNA, 20 bp, Artificial Sequence
  Synthetic oligonucleotide; TGG chr2 60460721 60460740 60460737 +
ccgggcccggaccactaata

SEQ ID NO: 157810 - DNA, 20 bp, Artificial Sequence
  Synthetic oligonucleotide; GGG chr2 60460722 60460741 60460738 +
cgggcccggaccactaatat

SEQ ID NO: 157811 - DNA, 20 bp, Artificial Sequence
  Synthetic oligonucleotide; GGG chr2 60460723 60460742 60460739 +
gggcccggaccactaatatg

SEQ ID NO: 157812 - DNA, 20 bp, Artificial Sequence
  Synthetic oligonucleotide; GAG chr2 60460760 60460779 60460776 +
ttcccgtgccgctgcgcccc

SEQ ID NO: 157813 - DNA, 20 bp, Artificial Sequence
  Synthetic oligonucleotide; CAG chr2 60460774 60460793 60460790 +
cgccccgagatccctccgtc

SEQ ID NO: 157814 - DNA, 20 bp, Artificial Sequence
  Synthetic oligonucleotide; CGG chr2 60460782 60460801 60460798 +
gatccctccgtccagctccc

SEQ ID NO: 157815 - DNA, 20 bp, Artificial Sequence
  Synthetic oligonucleotide; GGG chr2 60460783 60460802 60460799 +
atccctccgtccagctcccc

SEQ ID NO: 157816 - DNA, 20 bp, Artificial Sequence
  Synthetic oligonucleotide; CGG chr2 60460786 60460805 60460802 +
cctccgtccagctccccggg

SEQ ID NO: 157817 - DNA, 20 bp, Artificial Sequence
  Synthetic oligonucleotide; TGG chr2 60460791 60460810 60460807 +
gtccagctccccgggcggtg

SEQ ID NO: 157818 - DNA, 20 bp, Artificial Sequence
  Synthetic oligonucleotide; GAG chr2 60460793 60460812 60460809 +
ccagctccccgggcggtgtg

SEQ ID NO: 157819 - DNA, 20 bp, Artificial Sequence
  Synthetic oligonucleotide; AAG chr2 60460796 60460815 60460812 +
gctccccgggcggtgtggag

SEQ ID NO: 157820 - DNA, 20 bp, Artificial Sequence
  Synthetic oligonucleotide; GAG chr2 60460817 60460836 60460833 +
agcgcaaactcccgttctcc

SEQ ID NO: 157821 - DNA, 20 bp, Artificial Sequence
  Synthetic oligonucleotide; AGG chr2 60460818 60460837 60460834 +
gcgcaaactcccgttctccg

SEQ ID NO: 157822 - DNA, 20 bp, Artificial Sequence
  Synthetic oligonucleotide; GAG chr2 60460820 60460839 60460836 +
gcaaactcccgttctccgag

SEQ ID NO: 157823 - DNA, 20 bp, Artificial Sequence
  Synthetic oligonucleotide; GAG chr2 60460832 60460851 60460848 +
tctccgaggagtgctccgac

SEQ ID NO: 157824 - DNA, 20 bp, Artificial Sequence
  Synthetic oligonucleotide; AGG chr2 60460833 60460852 60460849 +
ctccgaggagtgctccgacg

SEQ ID NO: 157825 - DNA, 20 bp, Artificial Sequence
  Synthetic oligonucleotide; GAG chr2 60460835 60460854 60460851 +
ccgaggagtgctccgacgag

SEQ ID NO: 157826 - DNA, 20 bp, Artificial Sequence
  Synthetic oligonucleotide; AGG chr2 60460836 60460855 60460852 +
cgaggagtgctccgacgagg

SEQ ID NO: 157827 - DNA, 20 bp, Artificial Sequence
  Synthetic oligonucleotide; AAG chr2 60460842 60460861 60460858 +
gtgctccgacgaggaggcaa

SEQ ID NO: 157828 - DNA, 20 bp, Artificial Sequence
  Synthetic oligonucleotide; AGG chr2 60460843 60460862 60460859 +
tgctccgacgaggaggcaaa

SEQ ID NO: 157829 - DNA, 20 bp, Artificial Sequence
  Synthetic oligonucleotide; TGG chr2 60460854 60460873 60460870 +
ggaggcaaaaggcgattgtc

SEQ ID NO: 157830 - DNA, 20 bp, Artificial Sequence
  Synthetic oligonucleotide; GAG chr2 60460856 60460875 60460872 +
aggcaaaaggcgattgtctg

SEQ ID NO: 157831 - DNA, 20 bp, Artificial Sequence
  Synthetic oligonucleotide; AAG chr2 60460865 60460884 60460881 +
gcgattgtctggagtctccg

SEQ ID NO: 157832 - DNA, 20 bp, Artificial Sequence
  Synthetic oligonucleotide; AAG chr2 60460870 60460889 60460886 +
tgtctggagtctccgaagct

SEQ ID NO: 157833 - DNA, 20 bp, Artificial Sequence
  Synthetic oligonucleotide; AGG chr2 60460871 60460890 60460887 +
gtctggagtctccgaagcta

SEQ ID NO: 157834 - DNA, 20 bp, Artificial Sequence
  Synthetic oligonucleotide; AAG chr2 60460874 60460893 60460890 +
tggagtctccgaagctaagg

SEQ ID NO: 157835 - DNA, 20 bp, Artificial Sequence
  Synthetic oligonucleotide; AGG chr2 60460875 60460894 60460891 +
ggagtctccgaagctaagga

SEQ ID NO: 157836 - DNA, 20 bp, Artificial Sequence
  Synthetic oligonucleotide; GGG chr2 60460876 60460895 60460892 +
gagtctccgaagctaaggaa

SEQ ID NO: 157837 - DNA, 20 bp, Artificial Sequence
  Synthetic oligonucleotide; GAG chr2 60460885 60460904 60460901 +
aagctaaggaagggatcttt

SEQ ID NO: 157838 - DNA, 20 bp, Artificial Sequence
  Synthetic oligonucleotide; TGG chr2 60460893 60460912 60460909 +
gaagggatctttgagctgcc

SEQ ID NO: 157839 - DNA, 20 bp, Artificial Sequence
  Synthetic oligonucleotide; GAG chr2 60460895 60460914 60460911 +
agggatctttgagctgcctg

SEQ ID NO: 157840 - DNA, 20 bp, Artificial Sequence
  Synthetic oligonucleotide; AGG chr2 60460896 60460915 60460912 +
gggatctttgagctgcctgg

SEQ ID NO: 157841 - DNA, 20 bp, Artificial Sequence
  Synthetic oligonucleotide; TAG chr2 60460904 60460923 60460920 +
tgagctgcctggaggccgcg

SEQ ID NO: 157842 - DNA, 20 bp, Artificial Sequence
  Synthetic oligonucleotide; CGG chr2 60460908 60460927 60460924 +
ctgcctggaggccgcgtagc

SEQ ID NO: 157843 - DNA, 20 bp, Artificial Sequence
  Synthetic oligonucleotide; GAG chr2 60460912 60460931 60460928 +
ctggaggccgcgtagccggc

SEQ ID NO: 157844 - DNA, 20 bp, Artificial Sequence
  Synthetic oligonucleotide; GAG chr2 60460922 60460941 60460938 +
cgtagccggcgagccactgc

SEQ ID NO: 157845 - DNA, 20 bp, Artificial Sequence
  Synthetic oligonucleotide; TGG chr2 60460941 60460960 60460957 +
cgagtacacgttctccgtgt

SEQ ID NO: 157846 - DNA, 20 bp, Artificial Sequence
  Synthetic oligonucleotide; GGG chr2 60460942 60460961 60460958 +
gagtacacgttctccgtgtt

SEQ ID NO: 157847 - DNA, 20 bp, Artificial Sequence
  Synthetic oligonucleotide; CGG chr2 60460950 60460969 60460966 +
gttctccgtgttgggcatcg

SEQ ID NO: 157848 - DNA, 20 bp, Artificial Sequence
  Synthetic oligonucleotide; CGG chr2 60460954 60460973 60460970 +
tccgtgttgggcatcgcggc

SEQ ID NO: 157849 - DNA, 20 bp, Artificial Sequence
  Synthetic oligonucleotide; GGG chr2 60460955 60460974 60460971 +
ccgtgttgggcatcgcggcc

SEQ ID NO: 157850 - DNA, 20 bp, Artificial Sequence
  Synthetic oligonucleotide; GGG chr2 60460956 60460975 60460972 +
cgtgttgggcatcgcggccg

SEQ ID NO: 157851 - DNA, 20 bp, Artificial Sequence
  Synthetic oligonucleotide; GGG chr2 60460957 60460976 60460973 +
gtgttgggcatcgcggccgg

SEQ ID NO: 157852 - DNA, 20 bp, Artificial Sequence
  Synthetic oligonucleotide; CAG chr2 60460960 60460979 60460976 +
ttgggcatcgcggccggggg

SEQ ID NO: 157853 - DNA, 20 bp, Artificial Sequence
  Synthetic oligonucleotide; AGG chr2 60460961 60460980 60460977 +
tgggcatcgcggccgggggc

SEQ ID NO: 157854 - DNA, 20 bp, Artificial Sequence
  Synthetic oligonucleotide; GAG chr2 60460978 60460997 60460994 +
ggcaggtcgaactccttctc

SEQ ID NO: 157855 - DNA, 20 bp, Artificial Sequence
  Synthetic oligonucleotide; TAG chr2 60460992 60461011 60461008 +
cttctcgagcttgatgcgct

SEQ ID NO: 157856 - DNA, 20 bp, Artificial Sequence
  Synthetic oligonucleotide; GAG chr2 60460994 60461013 60461010 +
tctcgagcttgatgcgctta

SEQ ID NO: 157857 - DNA, 20 bp, Artificial Sequence
  Synthetic oligonucleotide; AAG chr2 60460997 60461016 60461013 +
cgagcttgatgcgcttagag

SEQ ID NO: 157858 - DNA, 20 bp, Artificial Sequence
  Synthetic oligonucleotide; AGG chr2 60460998 60461017 60461014 +
gagcttgatgcgcttagaga

SEQ ID NO: 157859 - DNA, 20 bp, Artificial Sequence
  Synthetic oligonucleotide; GGG chr2 60460999 60461018 60461015 +
agcttgatgcgcttagagaa

SEQ ID NO: 157860 - DNA, 20 bp, Artificial Sequence
  Synthetic oligonucleotide; GGG chr2 60461000 60461019 60461016 +
gcttgatgcgcttagagaag

SEQ ID NO: 157861 - DNA, 20 bp, Artificial Sequence
  Synthetic oligonucleotide; CAG chr2 60461005 60461024 60461021 +
atgcgcttagagaaggggct

SEQ ID NO: 157862 - DNA, 20 bp, Artificial Sequence
  Synthetic oligonucleotide; GAG chr2 60461009 60461028 60461025 +
gcttagagaaggggctcagc

SEQ ID NO: 157863 - DNA, 20 bp, Artificial Sequence
  Synthetic oligonucleotide; TGG chr2 60461013 60461032 60461029 +
agagaaggggctcagcgagc

SEQ ID NO: 157864 - DNA, 20 bp, Artificial Sequence
  Synthetic oligonucleotide; GGG chr2 60461014 60461033 60461030 +
gagaaggggctcagcgagct

SEQ ID NO: 157865 - DNA, 20 bp, Artificial Sequence
  Synthetic oligonucleotide; GGG chr2 60461015 60461034 60461031 +
agaaggggctcagcgagctg

SEQ ID NO: 157866 - DNA, 20 bp, Artificial Sequence
  Synthetic oligonucleotide; CAG chr2 60461023 60461042 60461039 +
ctcagcgagctggggctgcc

SEQ ID NO: 157867 - DNA, 20 bp, Artificial Sequence
  Synthetic oligonucleotide; CAG chr2 60461026 60461045 60461042 +
agcgagctggggctgcccag

SEQ ID NO: 157868 - DNA, 20 bp, Artificial Sequence
  Synthetic oligonucleotide; CAG chr2 60461029 60461048 60461045 +
gagctggggctgcccagcag

SEQ ID NO: 157869 - DNA, 20 bp, Artificial Sequence
  Synthetic oligonucleotide; TGG chr2 60461037 60461056 60461053 +
gctgcccagcagcagctttt

SEQ ID NO: 157870 - DNA, 20 bp, Artificial Sequence
  Synthetic oligonucleotide; CAG chr2 60461041 60461060 60461057 +
cccagcagcagctttttgga

SEQ ID NO: 157871 - DNA, 20 bp, Artificial Sequence
  Synthetic oligonucleotide; AGG chr2 60461042 60461061 60461058 +
ccagcagcagctttttggac

SEQ ID NO: 157872 - DNA, 20 bp, Artificial Sequence
  Synthetic oligonucleotide; GAG chr2 60461051 60461070 60461067 +
gctttttggacaggcccccc

SEQ ID NO: 157873 - DNA, 20 bp, Artificial Sequence
  Synthetic oligonucleotide; AGG chr2 60461052 60461071 60461068 +
ctttttggacaggccccccg

SEQ ID NO: 157874 - DNA, 20 bp, Artificial Sequence
  Synthetic oligonucleotide; CGG chr2 60461065 60461084 60461081 +
ccccccgaggccgactcgcc

SEQ ID NO: 157875 - DNA, 20 bp, Artificial Sequence
  Synthetic oligonucleotide; GGG chr2 60461066 60461085 60461082 +
cccccgaggccgactcgccc

SEQ ID NO: 157876 - DNA, 20 bp, Artificial Sequence
  Synthetic oligonucleotide; GGG chr2 60461067 60461086 60461083 +
ccccgaggccgactcgcccg

SEQ ID NO: 157877 - DNA, 20 bp, Artificial Sequence
  Synthetic oligonucleotide; GAG chr2 60461069 60461088 60461085 +
ccgaggccgactcgcccggg

SEQ ID NO: 157878 - DNA, 20 bp, Artificial Sequence
  Synthetic oligonucleotide; CAG chr2 60461072 60461091 60461088 +
aggccgactcgcccggggag

SEQ ID NO: 157879 - DNA, 20 bp, Artificial Sequence
  Synthetic oligonucleotide; CGG chr2 60461078 60461097 60461094 +
actcgcccggggagcagccg

SEQ ID NO: 157880 - DNA, 20 bp, Artificial Sequence
  Synthetic oligonucleotide; CAG chr2 60461088 60461107 60461104 +
ggagcagccgcggccattaa

SEQ ID NO: 157881 - DNA, 20 bp, Artificial Sequence
  Synthetic oligonucleotide; CGG chr2 60461105 60461124 60461121 +
taacagtgccatcgtctatg

SEQ ID NO: 157882 - DNA, 20 bp, Artificial Sequence
  Synthetic oligonucleotide; CGG chr2 60461118 60461137 60461134 +
gtctatgcggtccgactcgc

SEQ ID NO: 157883 - DNA, 20 bp, Artificial Sequence
  Synthetic oligonucleotide; GAG chr2 60461126 60461145 60461142 +
ggtccgactcgccggccacc

SEQ ID NO: 157884 - DNA, 20 bp, Artificial Sequence
  Synthetic oligonucleotide; AAG chr2 60461139 60461158 60461155 +
ggccaccgagtcttcgtcgc

SEQ ID NO: 157885 - DNA, 20 bp, Artificial Sequence
  Synthetic oligonucleotide; TGG chr2 60461150 60461169 60461166 +
cttcgtcgcaagtgtccctg

SEQ ID NO: 157886 - DNA, 20 bp, Artificial Sequence
  Synthetic oligonucleotide; CGG chr2 60461157 60461176 60461173 +
gcaagtgtccctgtggccct

SEQ ID NO: 157887 - DNA, 20 bp, Artificial Sequence
  Synthetic oligonucleotide; CGG chr2 60461163 60461182 60461179 +
gtccctgtggccctcggcct

SEQ ID NO: 157888 - DNA, 20 bp, Artificial Sequence
  Synthetic oligonucleotide; CAG chr2 60461167 60461186 60461183 +
ctgtggccctcggcctcggc

SEQ ID NO: 157889 - DNA, 20 bp, Artificial Sequence
  Synthetic oligonucleotide; AGG chr2 60461168 60461187 60461184 +
tgtggccctcggcctcggcc

SEQ ID NO: 157890 - DNA, 20 bp, Artificial Sequence
  Synthetic oligonucleotide; TGG chr2 60461171 60461190 60461187 +
ggccctcggcctcggccagg

SEQ ID NO: 157891 - DNA, 20 bp, Artificial Sequence
  Synthetic oligonucleotide; CAG chr2 60461194 60461213 60461210 +
ccgcgcttatgcttctcgcc

SEQ ID NO: 157892 - DNA, 20 bp, Artificial Sequence
  Synthetic oligonucleotide; AGG chr2 60461195 60461214 60461211 +
cgcgcttatgcttctcgccc

SEQ ID NO: 157893 - DNA, 20 bp, Artificial Sequence
  Synthetic oligonucleotide; TGG chr2 60461201 60461220 60461217 +
tatgcttctcgcccaggacc

SEQ ID NO: 157894 - DNA, 20 bp, Artificial Sequence
  Synthetic oligonucleotide; TGG chr2 60461204 60461223 60461220 +
gcttctcgcccaggacctgg

SEQ ID NO: 157895 - DNA, 20 bp, Artificial Sequence
  Synthetic oligonucleotide; AAG chr2 60461207 60461226 60461223 +
tctcgcccaggacctggtgg

SEQ ID NO: 157896 - DNA, 20 bp, Artificial Sequence
  Synthetic oligonucleotide; AGG chr2 60461208 60461227 60461224 +
ctcgcccaggacctggtgga

SEQ ID NO: 157897 - DNA, 20 bp, Artificial Sequence
  Synthetic oligonucleotide; AAG chr2 60461219 60461238 60461235 +
cctggtggaaggcctcgctg

SEQ ID NO: 157898 - DNA, 20 bp, Artificial Sequence
  Synthetic oligonucleotide; TGG chr2 60461229 60461248 60461245 +
ggcctcgctgaagtgctgca

SEQ ID NO: 157899 - DNA, 20 bp, Artificial Sequence
  Synthetic oligonucleotide; GAG chr2 60461231 60461250 60461247 +
cctcgctgaagtgctgcatg

SEQ ID NO: 157900 - DNA, 20 bp, Artificial Sequence
  Synthetic oligonucleotide; GAG chr2 60461236 60461255 60461252 +
ctgaagtgctgcatggagct

SEQ ID NO: 157901 - DNA, 20 bp, Artificial Sequence
  Synthetic oligonucleotide; CGG chr2 60461259 60461278 60461275 +
caccatgccctgcatgacgt

SEQ ID NO: 157902 - DNA, 20 bp, Artificial Sequence
  Synthetic oligonucleotide; GGG chr2 60461260 60461279 60461276 +
accatgccctgcatgacgtc

SEQ ID NO: 157903 - DNA, 20 bp, Artificial Sequence
  Synthetic oligonucleotide; CAG chr2 60461263 60461282 60461279 +
atgccctgcatgacgtcggg

SEQ ID NO: 157904 - DNA, 20 bp, Artificial Sequence
  Synthetic oligonucleotide; AGG chr2 60461264 60461283 60461280 +
tgccctgcatgacgtcgggc

SEQ ID NO: 157905 - DNA, 20 bp, Artificial Sequence
  Synthetic oligonucleotide; GGG chr2 60461265 60461284 60461281 +
gccctgcatgacgtcgggca

SEQ ID NO: 157906 - DNA, 20 bp, Artificial Sequence
  Synthetic oligonucleotide; CGG chr2 60461270 60461289 60461286 +
gcatgacgtcgggcagggcg

SEQ ID NO: 157907 - DNA, 20 bp, Artificial Sequence
  Synthetic oligonucleotide; GAG chr2 60461306 60461325 60461322 +
cgcccacgaccgcgccccgc

SEQ ID NO: 157908 - DNA, 20 bp, Artificial Sequence
  Synthetic oligonucleotide; TGG chr2 60461318 60461337 60461334 +
cgccccgcgagctgttctcg

SEQ ID NO: 157909 - DNA, 20 bp, Artificial Sequence
  Synthetic oligonucleotide; TGG chr2 60461321 60461340 60461337 +
cccgcgagctgttctcgtgg

SEQ ID NO: 157910 - DNA, 20 bp, Artificial Sequence
  Synthetic oligonucleotide; CAG chr2 60461335 60461354 60461351 +
tcgtggtggcgcgccgcctc

SEQ ID NO: 157911 - DNA, 20 bp, Artificial Sequence
  Synthetic oligonucleotide; AGG chr2 60461336 60461355 60461352 +
cgtggtggcgcgccgcctcc

SEQ ID NO: 157912 - DNA, 20 bp, Artificial Sequence
  Synthetic oligonucleotide; CAG chr2 60461341 60461360 60461357 +
tggcgcgccgcctccaggct

SEQ ID NO: 157913 - DNA, 20 bp, Artificial Sequence
  Synthetic oligonucleotide; AAG chr2 60461348 60461367 60461364 +
ccgcctccaggctcagcccg

SEQ ID NO: 157914 - DNA, 20 bp, Artificial Sequence
  Synthetic oligonucleotide; TAG chr2 60461354 60461373 60461370 +
ccaggctcagcccgaagccg

SEQ ID NO: 157915 - DNA, 20 bp, Artificial Sequence
  Synthetic oligonucleotide; CAG chr2 60461377 60461396 60461393 +
tccaccctctcgctctccgt

SEQ ID NO: 157916 - DNA, 20 bp, Artificial Sequence
  Synthetic oligonucleotide; CGG chr2 60461452 60461471 60461468 +
tcctcctcgtccccgttctc

SEQ ID NO: 157917 - DNA, 20 bp, Artificial Sequence
  Synthetic oligonucleotide; GGG chr2 60461453 60461472 60461469 +
cctcctcgtccccgttctcc

SEQ ID NO: 157918 - DNA, 20 bp, Artificial Sequence
  Synthetic oligonucleotide; CAG chr2 60461458 60461477 60461474 +
tcgtccccgttctccgggat

SEQ ID NO: 157919 - DNA, 20 bp, Artificial Sequence
  Synthetic oligonucleotide; AGG chr2 60461459 60461478 60461475 +
cgtccccgttctccgggatc

SEQ ID NO: 157920 - DNA, 20 bp, Artificial Sequence
  Synthetic oligonucleotide; TGG chr2 60461463 60461482 60461479 +
cccgttctccgggatcaggt

SEQ ID NO: 157921 - DNA, 20 bp, Artificial Sequence
  Synthetic oligonucleotide; GGG chr2 60461464 60461483 60461480 +
ccgttctccgggatcaggtt

SEQ ID NO: 157922 - DNA, 20 bp, Artificial Sequence
  Synthetic oligonucleotide; GGG chr2 60461465 60461484 60461481 +
cgttctccgggatcaggttg

SEQ ID NO: 157923 - DNA, 20 bp, Artificial Sequence
  Synthetic oligonucleotide; TGG chr2 60461487 60461506 60461503 +
gtcgttctcgctcttgaact

SEQ ID NO: 157924 - DNA, 20 bp, Artificial Sequence
  Synthetic oligonucleotide; CGG chr2 60461496 60461515 60461512 +
gctcttgaacttggccacca

SEQ ID NO: 157925 - DNA, 20 bp, Artificial Sequence
  Synthetic oligonucleotide; GAG chr2 60461503 60461522 60461519 +
aacttggccaccacggactt

SEQ ID NO: 157926 - DNA, 20 bp, Artificial Sequence
  Synthetic oligonucleotide; TGG chr2 60461514 60461533 60461530 +
cacggacttgagcgcgctgc

SEQ ID NO: 157927 - DNA, 20 bp, Artificial Sequence
  Synthetic oligonucleotide; AAG chr2 60461528 60461547 60461544 +
cgctgctggcgctgcccacc

SEQ ID NO: 157928 - DNA, 20 bp, Artificial Sequence
  Synthetic oligonucleotide; TGG chr2 60461535 60461554 60461551 +
ggcgctgcccaccaagtcgc

SEQ ID NO: 157929 - DNA, 20 bp, Artificial Sequence
  Synthetic oligonucleotide; CGG chr2 60461541 60461560 60461557 +
gcccaccaagtcgctggtgc

SEQ ID NO: 157930 - DNA, 20 bp, Artificial Sequence
  Synthetic oligonucleotide; GGG chr2 60461542 60461561 60461558 +
cccaccaagtcgctggtgcc

SEQ ID NO: 157931 - DNA, 20 bp, Artificial Sequence
  Synthetic oligonucleotide; CGG chr2 60461548 60461567 60461564 +
aagtcgctggtgccgggttc

SEQ ID NO: 157932 - DNA, 20 bp, Artificial Sequence
  Synthetic oligonucleotide; GGG chr2 60461549 60461568 60461565 +
agtcgctggtgccgggttcc

SEQ ID NO: 157933 - DNA, 20 bp, Artificial Sequence
  Synthetic oligonucleotide; GGG chr2 60461550 60461569 60461566 +
gtcgctggtgccgggttccg

SEQ ID NO: 157934 - DNA, 20 bp, Artificial Sequence
  Synthetic oligonucleotide; GAG chr2 60461552 60461571 60461568 +
cgctggtgccgggttccggg

SEQ ID NO: 157935 - DNA, 20 bp, Artificial Sequence
  Synthetic oligonucleotide; TGG chr2 60461556 60461575 60461572 +
ggtgccgggttccggggagc

SEQ ID NO: 157936 - DNA, 20 bp, Artificial Sequence
  Synthetic oligonucleotide; CGG chr2 60461559 60461578 60461575 +
gccgggttccggggagctgg

SEQ ID NO: 157937 - DNA, 20 bp, Artificial Sequence
  Synthetic oligonucleotide; TGG chr2 60461562 60461581 60461578 +
gggttccggggagctggcgg

SEQ ID NO: 157938 - DNA, 20 bp, Artificial Sequence
  Synthetic oligonucleotide; GAG chr2 60461564 60461583 60461580 +
gttccggggagctggcggtg

SEQ ID NO: 157939 - DNA, 20 bp, Artificial Sequence
  Synthetic oligonucleotide; GAG chr2 60461566 60461585 60461582 +
tccggggagctggcggtgga

SEQ ID NO: 157940 - DNA, 20 bp, Artificial Sequence
  Synthetic oligonucleotide; CGG chr2 60461577 60461596 60461593 +
ggcggtggagagaccgtcgt

SEQ ID NO: 157941 - DNA, 20 bp, Artificial Sequence
  Synthetic oligonucleotide; TGG chr2 60461592 60461611 60461608 +
gtcgtcggacttgaccgtca

SEQ ID NO: 157942 - DNA, 20 bp, Artificial Sequence
  Synthetic oligonucleotide; GGG chr2 60461593 60461612 60461609 +
tcgtcggacttgaccgtcat

SEQ ID NO: 157943 - DNA, 20 bp, Artificial Sequence
  Synthetic oligonucleotide; GGG chr2 60461594 60461613 60461610 +
cgtcggacttgaccgtcatg

SEQ ID NO: 157944 - DNA, 20 bp, Artificial Sequence
  Synthetic oligonucleotide; GGG chr2 60461595 60461614 60461611 +
gtcggacttgaccgtcatgg

SEQ ID NO: 157945 - DNA, 20 bp, Artificial Sequence
  Synthetic oligonucleotide; TGG chr2 60461624 60461643 60461640 +
tgtgcatgtgcgtcttcatg

SEQ ID NO: 157946 - DNA, 20 bp, Artificial Sequence
  Synthetic oligonucleotide; CAG chr2 60461632 60461651 60461648 +
tgcgtcttcatgtggcgctt

SEQ ID NO: 157947 - DNA, 20 bp, Artificial Sequence
  Synthetic oligonucleotide; TGG chr2 60461640 60461659 60461656 +
catgtggcgcttcagcttgc

SEQ ID NO: 157948 - DNA, 20 bp, Artificial Sequence
  Synthetic oligonucleotide; TGG chr2 60461645 60461664 60461661 +
ggcgcttcagcttgctggcc

SEQ ID NO: 157949 - DNA, 20 bp, Artificial Sequence
  Synthetic oligonucleotide; GGG chr2 60461646 60461665 60461662 +
gcgcttcagcttgctggcct

SEQ ID NO: 157950 - DNA, 20 bp, Artificial Sequence
  Synthetic oligonucleotide; TGG chr2 60461657 60461676 60461673 +
tgctggcctgggtgcacgcg

SEQ ID NO: 157951 - DNA, 20 bp, Artificial Sequence
  Synthetic oligonucleotide; CAG chr2 60461665 60461684 60461681 +
tgggtgcacgcgtggtcgca

SEQ ID NO: 157952 - DNA, 20 bp, Artificial Sequence
  Synthetic oligonucleotide; AGG chr2 60461666 60461685 60461682 +
gggtgcacgcgtggtcgcac

SEQ ID NO: 157953 - DNA, 20 bp, Artificial Sequence
  Synthetic oligonucleotide; TAG chr2 60461678 60461697 60461694 +
ggtcgcacaggttgcacttg

SEQ ID NO: 157954 - DNA, 20 bp, Artificial Sequence
  Synthetic oligonucleotide; AGG chr2 60461679 60461698 60461695 +
gtcgcacaggttgcacttgt

SEQ ID NO: 157955 - DNA, 20 bp, Artificial Sequence
  Synthetic oligonucleotide; GGG chr2 60461680 60461699 60461696 +
tcgcacaggttgcacttgta

SEQ ID NO: 157956 - DNA, 20 bp, Artificial Sequence
  Synthetic oligonucleotide; TGG chr2 60461696 60461715 60461712 +
tgtagggcttctcgcccgtg

SEQ ID NO: 157957 - DNA, 20 bp, Artificial Sequence
  Synthetic oligonucleotide; CGG chr2 60461705 60461724 60461721 +
tctcgcccgtgtggctgcgc

SEQ ID NO: 157958 - DNA, 20 bp, Artificial Sequence
  Synthetic oligonucleotide; CAG chr2 60461716 60461735 60461732 +
tggctgcgccggtgcaccac

SEQ ID NO: 157959 - DNA, 20 bp, Artificial Sequence
  Synthetic oligonucleotide; AGG chr2 60461717 60461736 60461733 +
ggctgcgccggtgcaccacc

SEQ ID NO: 157960 - DNA, 20 bp, Artificial Sequence
  Synthetic oligonucleotide; CAG chr2 60461747 60461766 60461763 +
gaaatttgaacgtcttgccg

SEQ ID NO: 157961 - DNA, 20 bp, Artificial Sequence
  Synthetic oligonucleotide; TGG chr2 60461763 60461782 60461779 +
gccgcagaactcgcatgact

SEQ ID NO: 157962 - DNA, 20 bp, Artificial Sequence
  Synthetic oligonucleotide; CGG chr2 60461773 60461792 60461789 +
tcgcatgacttggacttgac

SEQ ID NO: 157963 - DNA, 20 bp, Artificial Sequence
  Synthetic oligonucleotide; GGG chr2 60461774 60461793 60461790 +
cgcatgacttggacttgacc

SEQ ID NO: 157964 - DNA, 20 bp, Artificial Sequence
  Synthetic oligonucleotide; GGG chr2 60461775 60461794 60461791 +
gcatgacttggacttgaccg

SEQ ID NO: 157965 - DNA, 20 bp, Artificial Sequence
  Synthetic oligonucleotide; GGG chr2 60461776 60461795 60461792 +
catgacttggacttgaccgg

SEQ ID NO: 157966 - DNA, 20 bp, Artificial Sequence
  Synthetic oligonucleotide; TGG chr2 60461780 60461799 60461796 +
acttggacttgaccgggggc

SEQ ID NO: 157967 - DNA, 20 bp, Artificial Sequence
  Synthetic oligonucleotide; GGG chr2 60461781 60461800 60461797 +
cttggacttgaccgggggct

SEQ ID NO: 157968 - DNA, 20 bp, Artificial Sequence
  Synthetic oligonucleotide; GAG chr2 60461783 60461802 60461799 +
tggacttgaccgggggctgg

SEQ ID NO: 157969 - DNA, 20 bp, Artificial Sequence
  Synthetic oligonucleotide; AGG chr2 60461784 60461803 60461800 +
ggacttgaccgggggctggg

SEQ ID NO: 157970 - DNA, 20 bp, Artificial Sequence
  Synthetic oligonucleotide; GGG chr2 60461785 60461804 60461801 +
gacttgaccgggggctggga

SEQ ID NO: 157971 - DNA, 20 bp, Artificial Sequence
  Synthetic oligonucleotide; GAG chr2 60461787 60461806 60461803 +
cttgaccgggggctgggagg

SEQ ID NO: 157972 - DNA, 20 bp, Artificial Sequence
  Synthetic oligonucleotide; AGG chr2 60461788 60461807 60461804 +
ttgaccgggggctgggaggg

SEQ ID NO: 157973 - DNA, 20 bp, Artificial Sequence
  Synthetic oligonucleotide; GAG chr2 60461790 60461809 60461806 +
gaccgggggctgggagggag

SEQ ID NO: 157974 - DNA, 20 bp, Artificial Sequence
  Synthetic oligonucleotide; AGG chr2 60461791 60461810 60461807 +
accgggggctgggagggagg

SEQ ID NO: 157975 - DNA, 20 bp, Artificial Sequence
  Synthetic oligonucleotide; GGG chr2 60461792 60461811 60461808 +
ccgggggctgggagggagga

SEQ ID NO: 157976 - DNA, 20 bp, Artificial Sequence
  Synthetic oligonucleotide; GGG chr2 60461793 60461812 60461809 +
cgggggctgggagggaggag

SEQ ID NO: 157977 - DNA, 20 bp, Artificial Sequence
  Synthetic oligonucleotide; CGG chr2 60461796 60461815 60461812 +
gggctgggagggaggagggg

SEQ ID NO: 157978 - DNA, 20 bp, Artificial Sequence
  Synthetic oligonucleotide; CAG chr2 60461803 60461822 60461819 +
gagggaggaggggcggattg

SEQ ID NO: 157979 - DNA, 20 bp, Artificial Sequence
  Synthetic oligonucleotide; GAG chr2 60461805 60461824 60461821 +
gggaggaggggcggattgca

SEQ ID NO: 157980 - DNA, 20 bp, Artificial Sequence
  Synthetic oligonucleotide; AGG chr2 60461806 60461825 60461822 +
ggaggaggggcggattgcag

SEQ ID NO: 157981 - DNA, 20 bp, Artificial Sequence
  Synthetic oligonucleotide; GAG chr2 60461808 60461827 60461824 +
aggaggggcggattgcagag

SEQ ID NO: 157982 - DNA, 20 bp, Artificial Sequence
  Synthetic oligonucleotide; AGG chr2 60461809 60461828 60461825 +
ggaggggcggattgcagagg

SEQ ID NO: 157983 - DNA, 20 bp, Artificial Sequence
  Synthetic oligonucleotide; GGG chr2 60461810 60461829 60461826 +
gaggggcggattgcagagga

SEQ ID NO: 157984 - DNA, 20 bp, Artificial Sequence
  Synthetic oligonucleotide; GAG chr2 60461812 60461831 60461828 +
ggggcggattgcagaggagg

SEQ ID NO: 157985 - DNA, 20 bp, Artificial Sequence
  Synthetic oligonucleotide; AGG chr2 60461813 60461832 60461829 +
gggcggattgcagaggaggg

SEQ ID NO: 157986 - DNA, 20 bp, Artificial Sequence
  Synthetic oligonucleotide; GGG chr2 60461814 60461833 60461830 +
ggcggattgcagaggaggga

SEQ ID NO: 157987 - DNA, 20 bp, Artificial Sequence
  Synthetic oligonucleotide; GGG chr2 60461815 60461834 60461831 +
gcggattgcagaggagggag

SEQ ID NO: 157988 - DNA, 20 bp, Artificial Sequence
  Synthetic oligonucleotide; GGG chr2 60461816 60461835 60461832 +
cggattgcagaggagggagg

SEQ ID NO: 157989 - DNA, 20 bp, Artificial Sequence
  Synthetic oligonucleotide; GGG chr2 60461817 60461836 60461833 +
ggattgcagaggagggaggg

SEQ ID NO: 157990 - DNA, 20 bp, Artificial Sequence
  Synthetic oligonucleotide; GGG chr2 60461818 60461837 60461834 +
gattgcagaggagggagggg

SEQ ID NO: 157991 - DNA, 20 bp, Artificial Sequence
  Synthetic oligonucleotide; CAG chr2 60461827 60461846 60461843 +
ggagggagggggggcgtcgc

SEQ ID NO: 157992 - DNA, 20 bp, Artificial Sequence
  Synthetic oligonucleotide; AGG chr2 60461828 60461847 60461844 +
gagggagggggggcgtcgcc

SEQ ID NO: 157993 - DNA, 20 bp, Artificial Sequence
  Synthetic oligonucleotide; AAG chr2 60461831 60461850 60461847 +
ggagggggggcgtcgccagg

SEQ ID NO: 157994 - DNA, 20 bp, Artificial Sequence
  Synthetic oligonucleotide; AGG chr2 60461832 60461851 60461848 +
gagggggggcgtcgccagga

SEQ ID NO: 157995 - DNA, 20 bp, Artificial Sequence
  Synthetic oligonucleotide; GGG chr2 60461833 60461852 60461849 +
agggggggcgtcgccaggaa

SEQ ID NO: 157996 - DNA, 20 bp, Artificial Sequence
  Synthetic oligonucleotide; CGG chr2 60461836 60461855 60461852 +
gggggcgtcgccaggaaggg

SEQ ID NO: 157997 - DNA, 20 bp, Artificial Sequence
  Synthetic oligonucleotide; TGG chr2 60461848 60461867 60461864 +
aggaagggcggcttgctacc

SEQ ID NO: 157998 - DNA, 20 bp, Artificial Sequence
  Synthetic oligonucleotide; TGG chr2 60461852 60461871 60461868 +
agggcggcttgctacctggc

SEQ ID NO: 157999 - DNA, 20 bp, Artificial Sequence
  Synthetic oligonucleotide; TGG chr2 60461857 60461876 60461873 +
ggcttgctacctggctggaa

SEQ ID NO: 158000 - DNA, 20 bp, Artificial Sequence
  Synthetic oligonucleotide; CAG chr2 60461863 60461882 60461879 +
ctacctggctggaatggttg

SEQ ID NO: 158001 - DNA, 20 bp, Artificial Sequence
  Synthetic oligonucleotide; TAG chr2 60461877 60461896 60461893 +
tggttgcagtaacctttgca

SEQ ID NO: 158002 - DNA, 20 bp, Artificial Sequence
  Synthetic oligonucleotide; AGG chr2 60461878 60461897 60461894 +
ggttgcagtaacctttgcat

SEQ ID NO: 158003 - DNA, 20 bp, Artificial Sequence
  Synthetic oligonucleotide; GGG chr2 60461879 60461898 60461895 +
gttgcagtaacctttgcata

SEQ ID NO: 158004 - DNA, 20 bp, Artificial Sequence
  Synthetic oligonucleotide; TGG chr2 60461883 60461902 60461899 +
cagtaacctttgcatagggc

SEQ ID NO: 158005 - DNA, 20 bp, Artificial Sequence
  Synthetic oligonucleotide; GGG chr2 60461884 60461903 60461900 +
agtaacctttgcatagggct

SEQ ID NO: 158006 - DNA, 20 bp, Artificial Sequence
  Synthetic oligonucleotide; CGG chr2 60461888 60461907 60461904 +
acctttgcatagggctgggc

SEQ ID NO: 158007 - DNA, 20 bp, Artificial Sequence
  Synthetic oligonucleotide; TGG chr2 60461893 60461912 60461909 +
tgcatagggctgggccggcc

SEQ ID NO: 158008 - DNA, 20 bp, Artificial Sequence
  Synthetic oligonucleotide; GGG chr2 60461894 60461913 60461910 +
gcatagggctgggccggcct

SEQ ID NO: 158009 - DNA, 20 bp, Artificial Sequence
  Synthetic oligonucleotide; GGG chr2 60461895 60461914 60461911 +
catagggctgggccggcctg

SEQ ID NO: 158010 - DNA, 20 bp, Artificial Sequence
  Synthetic oligonucleotide; CAG chr2 60461899 60461918 60461915 +
gggctgggccggcctgggga

SEQ ID NO: 158011 - DNA, 20 bp, Artificial Sequence
  Synthetic oligonucleotide; CGG chr2 60461902 60461921 60461918 +
ctgggccggcctggggacag

SEQ ID NO: 158012 - DNA, 20 bp, Artificial Sequence
  Synthetic oligonucleotide; TGG chr2 60461905 60461924 60461921 +
ggccggcctggggacagcgg

SEQ ID NO: 158013 - DNA, 20 bp, Artificial Sequence
  Synthetic oligonucleotide; GGG chr2 60461906 60461925 60461922 +
gccggcctggggacagcggt

SEQ ID NO: 158014 - DNA, 20 bp, Artificial Sequence
  Synthetic oligonucleotide; TAG chr2 60461910 60461929 60461926 +
gcctggggacagcggtgggc

SEQ ID NO: 158015 - DNA, 20 bp, Artificial Sequence
  Synthetic oligonucleotide; CAG chr2 60461926 60461945 60461942 +
gggctagacgtgttccctgc

SEQ ID NO: 158016 - DNA, 20 bp, Artificial Sequence
  Synthetic oligonucleotide; AAG chr2 60461935 60461954 60461951 +
gtgttccctgccagctctct

SEQ ID NO: 158017 - DNA, 20 bp, Artificial Sequence
  Synthetic oligonucleotide; TAG chr2 60461943 60461962 60461959 +
tgccagctctctaagtctcc

SEQ ID NO: 158018 - DNA, 20 bp, Artificial Sequence
  Synthetic oligonucleotide; GAG chr2 60461945 60461964 60461961 +
ccagctctctaagtctccta

SEQ ID NO: 158019 - DNA, 20 bp, Artificial Sequence
  Synthetic oligonucleotide; TGG chr2 60461955 60461974 60461971 +
aagtctcctagagaaatcca

SEQ ID NO: 158020 - DNA, 20 bp, Artificial Sequence
  Synthetic oligonucleotide; CGG chr2 60461958 60461977 60461974 +
tctcctagagaaatccatgg

SEQ ID NO: 158021 - DNA, 20 bp, Artificial Sequence
  Synthetic oligonucleotide; GGG chr2 60461959 60461978 60461975 +
ctcctagagaaatccatggc

SEQ ID NO: 158022 - DNA, 20 bp, Artificial Sequence
  Synthetic oligonucleotide; GAG chr2 60461961 60461980 60461977 +
cctagagaaatccatggcgg

SEQ ID NO: 158023 - DNA, 20 bp, Artificial Sequence
  Synthetic oligonucleotide; AGG chr2 60461962 60461981 60461978 +
ctagagaaatccatggcggg

SEQ ID NO: 158024 - DNA, 20 bp, Artificial Sequence
  Synthetic oligonucleotide; TAG chr2 60461970 60461989 60461986 +
atccatggcgggaggctcca

SEQ ID NO: 158025 - DNA, 20 bp, Artificial Sequence
  Synthetic oligonucleotide; TGG chr2 60461977 60461996 60461993 +
gcgggaggctccatagccat

SEQ ID NO: 158026 - DNA, 20 bp, Artificial Sequence
  Synthetic oligonucleotide; CAG chr2 60461989 60462008 60462005 +
atagccattggattcaaccg

SEQ ID NO: 158027 - DNA, 20 bp, Artificial Sequence
  Synthetic oligonucleotide; AAG chr2 60462002 60462021 60462018 +
tcaaccgcagcaccctgtca

SEQ ID NO: 158028 - DNA, 20 bp, Artificial Sequence
  Synthetic oligonucleotide; AGG chr2 60462003 60462022 60462019 +
caaccgcagcaccctgtcaa

SEQ ID NO: 158029 - DNA, 20 bp, Artificial Sequence
  Synthetic oligonucleotide; CGG chr2 60462010 60462029 60462026 +
agcaccctgtcaaaggcact

SEQ ID NO: 158030 - DNA, 20 bp, Artificial Sequence
  Synthetic oligonucleotide; GGG chr2 60462011 60462030 60462027 +
gcaccctgtcaaaggcactc

SEQ ID NO: 158031 - DNA, 20 bp, Artificial Sequence
  Synthetic oligonucleotide; TGG chr2 60462017 60462036 60462033 +
tgtcaaaggcactcgggtga

SEQ ID NO: 158032 - DNA, 20 bp, Artificial Sequence
  Synthetic oligonucleotide; GGG chr2 60462018 60462037 60462034 +
gtcaaaggcactcgggtgat

SEQ ID NO: 158033 - DNA, 20 bp, Artificial Sequence
  Synthetic oligonucleotide; TGG chr2 60462021 60462040 60462037 +
aaaggcactcgggtgatggg

SEQ ID NO: 158034 - DNA, 20 bp, Artificial Sequence
  Synthetic oligonucleotide; CAG chr2 60462025 60462044 60462041 +
gcactcgggtgatgggtggc

SEQ ID NO: 158035 - DNA, 20 bp, Artificial Sequence
  Synthetic oligonucleotide; AGG chr2 60462026 60462045 60462042 +
cactcgggtgatgggtggcc

SEQ ID NO: 158036 - DNA, 20 bp, Artificial Sequence
  Synthetic oligonucleotide; GGG chr2 60462027 60462046 60462043 +
actcgggtgatgggtggcca

SEQ ID NO: 158037 - DNA, 20 bp, Artificial Sequence
  Synthetic oligonucleotide; CAG chr2 60462046 60462065 60462062 +
agggccatctcttccgcccc

SEQ ID NO: 158038 - DNA, 20 bp, Artificial Sequence
  Synthetic oligonucleotide; AGG chr2 60462047 60462066 60462063 +
gggccatctcttccgccccc

SEQ ID NO: 158039 - DNA, 20 bp, Artificial Sequence
  Synthetic oligonucleotide; CGG chr2 60462059 60462078 60462075 +
ccgcccccaggcgctctatg

SEQ ID NO: 158040 - DNA, 20 bp, Artificial Sequence
  Synthetic oligonucleotide; TGG chr2 60462062 60462081 60462078 +
cccccaggcgctctatgcgg

SEQ ID NO: 158041 - DNA, 20 bp, Artificial Sequence
  Synthetic oligonucleotide; GGG chr2 60462063 60462082 60462079 +
ccccaggcgctctatgcggt

SEQ ID NO: 158042 - DNA, 20 bp, Artificial Sequence
  Synthetic oligonucleotide; GGG chr2 60462064 60462083 60462080 +
cccaggcgctctatgcggtg

SEQ ID NO: 158043 - DNA, 20 bp, Artificial Sequence
  Synthetic oligonucleotide; GGG chr2 60462065 60462084 60462081 +
ccaggcgctctatgcggtgg

SEQ ID NO: 158044 - DNA, 20 bp, Artificial Sequence
  Synthetic oligonucleotide; AAG chr2 60462071 60462090 60462087 +
gctctatgcggtgggggtcc

SEQ ID NO: 158045 - DNA, 20 bp, Artificial Sequence
  Synthetic oligonucleotide; CGG chr2 60462082 60462101 60462098 +
tgggggtccaagtgatgtct

SEQ ID NO: 158046 - DNA, 20 bp, Artificial Sequence
  Synthetic oligonucleotide; TGG chr2 60462085 60462104 60462101 +
gggtccaagtgatgtctcgg

SEQ ID NO: 158047 - DNA, 20 bp, Artificial Sequence
  Synthetic oligonucleotide; TGG chr2 60462088 60462107 60462104 +
tccaagtgatgtctcggtgg

SEQ ID NO: 158048 - DNA, 20 bp, Artificial Sequence
  Synthetic oligonucleotide; CAG chr2 60462097 60462116 60462113 +
tgtctcggtggtggactaaa

SEQ ID NO: 158049 - DNA, 20 bp, Artificial Sequence
  Synthetic oligonucleotide; AGG chr2 60462098 60462117 60462114 +
gtctcggtggtggactaaac

SEQ ID NO: 158050 - DNA, 20 bp, Artificial Sequence
  Synthetic oligonucleotide; GGG chr2 60462099 60462118 60462115 +
tctcggtggtggactaaaca

SEQ ID NO: 158051 - DNA, 20 bp, Artificial Sequence
  Synthetic oligonucleotide; GGG chr2 60462100 60462119 60462116 +
ctcggtggtggactaaacag

SEQ ID NO: 158052 - DNA, 20 bp, Artificial Sequence
  Synthetic oligonucleotide; GGG chr2 60462101 60462120 60462117 +
tcggtggtggactaaacagg

SEQ ID NO: 158053 - DNA, 20 bp, Artificial Sequence
  Synthetic oligonucleotide; GGG chr2 60462102 60462121 60462118 +
cggtggtggactaaacaggg

SEQ ID NO: 158054 - DNA, 20 bp, Artificial Sequence
  Synthetic oligonucleotide; GGG chr2 60462103 60462122 60462119 +
ggtggtggactaaacagggg

SEQ ID NO: 158055 - DNA, 20 bp, Artificial Sequence
  Synthetic oligonucleotide; GAG chr2 60462105 60462124 60462121 +
tggtggactaaacagggggg

SEQ ID NO: 158056 - DNA, 20 bp, Artificial Sequence
  Synthetic oligonucleotide; TGG chr2 60462108 60462127 60462124 +
tggactaaacagggggggag

SEQ ID NO: 158057 - DNA, 20 bp, Artificial Sequence
  Synthetic oligonucleotide; GGG chr2 60462109 60462128 60462125 +
ggactaaacagggggggagt

SEQ ID NO: 158058 - DNA, 20 bp, Artificial Sequence
  Synthetic oligonucleotide; TGG chr2 60462112 60462131 60462128 +
ctaaacagggggggagtggg

SEQ ID NO: 158059 - DNA, 20 bp, Artificial Sequence
  Synthetic oligonucleotide; AAG chr2 60462116 60462135 60462132 +
acagggggggagtgggtgga

SEQ ID NO: 158060 - DNA, 20 bp, Artificial Sequence
  Synthetic oligonucleotide; CAG chr2 60462130 60462149 60462146 +
ggtggaaagcgcccttctgc

SEQ ID NO: 158061 - DNA, 20 bp, Artificial Sequence
  Synthetic oligonucleotide; AGG chr2 60462131 60462150 60462147 +
gtggaaagcgcccttctgcc

SEQ ID NO: 158062 - DNA, 20 bp, Artificial Sequence
  Synthetic oligonucleotide; CGG chr2 60462135 60462154 60462151 +
aaagcgcccttctgccaggc

SEQ ID NO: 158063 - DNA, 20 bp, Artificial Sequence
  Synthetic oligonucleotide; AAG chr2 60462138 60462157 60462154 +
gcgcccttctgccaggccgg

SEQ ID NO: 158064 - DNA, 20 bp, Artificial Sequence
  Synthetic oligonucleotide; TGG chr2 60462160 60462179 60462176 +
gcctctctcgatactgatcc

SEQ ID NO: 158065 - DNA, 20 bp, Artificial Sequence
  Synthetic oligonucleotide; TAG chr2 60462169 60462188 60462185 +
gatactgatcctggtattct

SEQ ID NO: 158066 - DNA, 20 bp, Artificial Sequence
  Synthetic oligonucleotide; CAG chr2 60462172 60462191 60462188 +
actgatcctggtattcttag

SEQ ID NO: 158067 - DNA, 20 bp, Artificial Sequence
  Synthetic oligonucleotide; AGG chr2 60462173 60462192 60462189 +
ctgatcctggtattcttagc

SEQ ID NO: 158068 - DNA, 20 bp, Artificial Sequence
  Synthetic oligonucleotide; AAG chr2 60462179 60462198 60462195 +
ctggtattcttagcaggtta

SEQ ID NO: 158069 - DNA, 20 bp, Artificial Sequence
  Synthetic oligonucleotide; AGG chr2 60462180 60462199 60462196 +
tggtattcttagcaggttaa

SEQ ID NO: 158070 - DNA, 20 bp, Artificial Sequence
  Synthetic oligonucleotide; GGG chr2 60462181 60462200 60462197 +
ggtattcttagcaggttaaa

SEQ ID NO: 158071 - DNA, 20 bp, Artificial Sequence
  Synthetic oligonucleotide; GGG chr2 60462182 60462201 60462198 +
gtattcttagcaggttaaag

SEQ ID NO: 158072 - DNA, 20 bp, Artificial Sequence
  Synthetic oligonucleotide; TGG chr2 60462209 60462228 60462225 +
tgtctgcaatatgaatccca

SEQ ID NO: 158073 - DNA, 20 bp, Artificial Sequence
  Synthetic oligonucleotide; GAG chr2 60462211 60462230 60462227 +
tctgcaatatgaatcccatg

SEQ ID NO: 158074 - DNA, 20 bp, Artificial Sequence
  Synthetic oligonucleotide; GAG chr2 60462213 60462232 60462229 +
tgcaatatgaatcccatgga

SEQ ID NO: 158075 - DNA, 20 bp, Artificial Sequence
  Synthetic oligonucleotide; AGG chr2 60462214 60462233 60462230 +
gcaatatgaatcccatggag

SEQ ID NO: 158076 - DNA, 20 bp, Artificial Sequence
  Synthetic oligonucleotide; TGG chr2 60462217 60462236 60462233 +
atatgaatcccatggagagg

SEQ ID NO: 158077 - DNA, 20 bp, Artificial Sequence
  Synthetic oligonucleotide; TGG chr2 60462221 60462240 60462237 +
gaatcccatggagaggtggc

SEQ ID NO: 158078 - DNA, 20 bp, Artificial Sequence
  Synthetic oligonucleotide; GGG chr2 60462222 60462241 60462238 +
aatcccatggagaggtggct

SEQ ID NO: 158079 - DNA, 20 bp, Artificial Sequence
  Synthetic oligonucleotide; AAG chr2 60462225 60462244 60462241 +
cccatggagaggtggctggg

SEQ ID NO: 158080 - DNA, 20 bp, Artificial Sequence
  Synthetic oligonucleotide; AGG chr2 60462226 60462245 60462242 +
ccatggagaggtggctggga

SEQ ID NO: 158081 - DNA, 20 bp, Artificial Sequence
  Synthetic oligonucleotide; TAG chr2 60462241 60462260 60462257 +
tgggaaggacattctgcacc

SEQ ID NO: 158082 - DNA, 20 bp, Artificial Sequence
  Synthetic oligonucleotide; AAG chr2 60462249 60462268 60462265 +
acattctgcacctagtcctg

SEQ ID NO: 158083 - DNA, 20 bp, Artificial Sequence
  Synthetic oligonucleotide; AGG chr2 60462250 60462269 60462266 +
cattctgcacctagtcctga

SEQ ID NO: 158084 - DNA, 20 bp, Artificial Sequence
  Synthetic oligonucleotide; GGG chr2 60462251 60462270 60462267 +
attctgcacctagtcctgaa

SEQ ID NO: 158085 - DNA, 20 bp, Artificial Sequence
  Synthetic oligonucleotide; CGG chr2 60462265 60462284 60462281 +
cctgaagggataccaacccg

SEQ ID NO: 158086 - DNA, 20 bp, Artificial Sequence
  Synthetic oligonucleotide; GGG chr2 60462266 60462285 60462282 +
ctgaagggataccaacccgc

SEQ ID NO: 158087 - DNA, 20 bp, Artificial Sequence
  Synthetic oligonucleotide; GGG chr2 60462267 60462286 60462283 +
tgaagggataccaacccgcg

SEQ ID NO: 158088 - DNA, 20 bp, Artificial Sequence
  Synthetic oligonucleotide; CAG chr2 60462271 60462290 60462287 +
gggataccaacccgcggggt

SEQ ID NO: 158089 - DNA, 20 bp, Artificial Sequence
  Synthetic oligonucleotide; AGG chr2 60462272 60462291 60462288 +
ggataccaacccgcggggtc

SEQ ID NO: 158090 - DNA, 20 bp, Artificial Sequence
  Synthetic oligonucleotide; GGG chr2 60462273 60462292 60462289 +
gataccaacccgcggggtca

SEQ ID NO: 158091 - DNA, 20 bp, Artificial Sequence
  Synthetic oligonucleotide; GGG chr2 60462274 60462293 60462290 +
ataccaacccgcggggtcag

SEQ ID NO: 158092 - DNA, 20 bp, Artificial Sequence
  Synthetic oligonucleotide; AAG chr2 60462296 60462315 60462312 +
gacttccgtgttcgctttct

SEQ ID NO: 158093 - DNA, 20 bp, Artificial Sequence
  Synthetic oligonucleotide; TAG chr2 60462299 60462318 60462315 +
ttccgtgttcgctttctaag

SEQ ID NO: 158094 - DNA, 20 bp, Artificial Sequence
  Synthetic oligonucleotide; GAG chr2 60462315 60462334 60462331 +
taagtagattcttaatccat

SEQ ID NO: 158095 - DNA, 20 bp, Artificial Sequence
  Synthetic oligonucleotide; AAG chr2 60462335 60462354 60462351 +
gagtgttctgtgcgtgttgc

SEQ ID NO: 158096 - DNA, 20 bp, Artificial Sequence
  Synthetic oligonucleotide; GAG chr2 60462337 60462356 60462353 +
gtgttctgtgcgtgttgcaa

SEQ ID NO: 158097 - DNA, 20 bp, Artificial Sequence
  Synthetic oligonucleotide; TGG chr2 60462351 60462370 60462367 +
ttgcaagagaaaccatgcac

SEQ ID NO: 158098 - DNA, 20 bp, Artificial Sequence
  Synthetic oligonucleotide; TGG chr2 60462358 60462377 60462374 +
agaaaccatgcactggtgaa

SEQ ID NO: 158099 - DNA, 20 bp, Artificial Sequence
  Synthetic oligonucleotide; AAG chr2 60462369 60462388 60462385 +
actggtgaatggctgtttgc

SEQ ID NO: 158100 - DNA, 20 bp, Artificial Sequence
  Synthetic oligonucleotide; TAG chr2 60462383 60462402 60462399 +
gtttgcaagttgtacatgtg

SEQ ID NO: 158101 - DNA, 20 bp, Artificial Sequence
  Synthetic oligonucleotide; TGG chr2 60462390 60462409 60462406 +
agttgtacatgtgtagctgc

SEQ ID NO: 158102 - DNA, 20 bp, Artificial Sequence
  Synthetic oligonucleotide; GGG chr2 60462391 60462410 60462407 +
gttgtacatgtgtagctgct

SEQ ID NO: 158103 - DNA, 20 bp, Artificial Sequence
  Synthetic oligonucleotide; GAG chr2 60462445 60462464 60462461 +
aacatcaatgtttaatcact

SEQ ID NO: 158104 - DNA, 20 bp, Artificial Sequence
  Synthetic oligonucleotide; AGG chr2 60462446 60462465 60462462 +
acatcaatgtttaatcactg

SEQ ID NO: 158105 - DNA, 20 bp, Artificial Sequence
  Synthetic oligonucleotide; CGG chr2 60462449 60462468 60462465 +
tcaatgtttaatcactgagg

SEQ ID NO: 158106 - DNA, 20 bp, Artificial Sequence
  Synthetic oligonucleotide; GGG chr2 60462450 60462469 60462466 +
caatgtttaatcactgaggc

SEQ ID NO: 158107 - DNA, 20 bp, Artificial Sequence
  Synthetic oligonucleotide; CAG chr2 60462456 60462475 60462472 +
ttaatcactgaggcgggcat

SEQ ID NO: 158108 - DNA, 20 bp, Artificial Sequence
  Synthetic oligonucleotide; CAG chr2 60462484 60462503 60462500 +
gcttatttatgttccacctc

SEQ ID NO: 158109 - DNA, 20 bp, Artificial Sequence
  Synthetic oligonucleotide; AAG chr2 60462514 60462533 60462530 +
tgcccccacccctcaacccc

SEQ ID NO: 158110 - DNA, 20 bp, Artificial Sequence
  Synthetic oligonucleotide; AGG chr2 60462515 60462534 60462531 +
gcccccacccctcaacccca

SEQ ID NO: 158111 - DNA, 20 bp, Artificial Sequence
  Synthetic oligonucleotide; AAG chr2 60462521 60462540 60462537 +
acccctcaaccccaaggcct

SEQ ID NO: 158112 - DNA, 20 bp, Artificial Sequence
  Synthetic oligonucleotide; TGG chr2 60462549 60462568 60462565 +
actgacctaccccctgtgcc

SEQ ID NO: 158113 - DNA, 20 bp, Artificial Sequence
  Synthetic oligonucleotide; GAG chr2 60462559 60462578 60462575 +
cccctgtgcctggcacgtct

SEQ ID NO: 158114 - DNA, 20 bp, Artificial Sequence
  Synthetic oligonucleotide; TGG chr2 60462564 60462583 60462580 +
gtgcctggcacgtctgagca

SEQ ID NO: 158115 - DNA, 20 bp, Artificial Sequence
  Synthetic oligonucleotide; GGG chr2 60462565 60462584 60462581 +
tgcctggcacgtctgagcat

SEQ ID NO: 158116 - DNA, 20 bp, Artificial Sequence
  Synthetic oligonucleotide; CAG chr2 60462572 60462591 60462588 +
cacgtctgagcatgggtacc

SEQ ID NO: 158117 - DNA, 20 bp, Artificial Sequence
  Synthetic oligonucleotide; TGG chr2 60462582 60462601 60462598 +
catgggtacccagtaaatat

SEQ ID NO: 158118 - DNA, 20 bp, Artificial Sequence
  Synthetic oligonucleotide; CAG chr2 60462612 60462631 60462628 +
gatcttcctgccattaaact

SEQ ID NO: 158119 - DNA, 20 bp, Artificial Sequence
  Synthetic oligonucleotide; TAG chr2 60462618 60462637 60462634 +
cctgccattaaactcagttc

SEQ ID NO: 158120 - DNA, 20 bp, Artificial Sequence
  Synthetic oligonucleotide; AAG chr2 60462642 60462661 60462658 +
aattttatatccaatcccca

SEQ ID NO: 158121 - DNA, 20 bp, Artificial Sequence
  Synthetic oligonucleotide; CAG chr2 60462645 60462664 60462661 +
tttatatccaatccccaaag

SEQ ID NO: 158122 - DNA, 20 bp, Artificial Sequence
  Synthetic oligonucleotide; CAG chr2 60462660 60462679 60462676 +
caaagcagaaaaatcctgac

SEQ ID NO: 158123 - DNA, 20 bp, Artificial Sequence
  Synthetic oligonucleotide; TGG chr2 60462666 60462685 60462682 +
agaaaaatcctgaccagttc

SEQ ID NO: 158124 - DNA, 20 bp, Artificial Sequence
  Synthetic oligonucleotide; GAG chr2 60462672 60462691 60462688 +
atcctgaccagttctggctt

SEQ ID NO: 158125 - DNA, 20 bp, Artificial Sequence
  Synthetic oligonucleotide; AGG chr2 60462673 60462692 60462689 +
tcctgaccagttctggcttg

SEQ ID NO: 158126 - DNA, 20 bp, Artificial Sequence
  Synthetic oligonucleotide; AAG chr2 60462679 60462698 60462695 +
ccagttctggcttgaggatg

SEQ ID NO: 158127 - DNA, 20 bp, Artificial Sequence
  Synthetic oligonucleotide; AGG chr2 60462680 60462699 60462696 +
cagttctggcttgaggatga

SEQ ID NO: 158128 - DNA, 20 bp, Artificial Sequence
  Synthetic oligonucleotide; TAG chr2 60462694 60462713 60462710 +
ggatgaaggtccctacattc

SEQ ID NO: 158129 - DNA, 20 bp, Artificial Sequence
  Synthetic oligonucleotide; AGG chr2 60462695 60462714 60462711 +
gatgaaggtccctacattct

SEQ ID NO: 158130 - DNA, 20 bp, Artificial Sequence
  Synthetic oligonucleotide; CAG chr2 60462726 60462745 60462742 +
caaatgtcttctaaactttc

SEQ ID NO: 158131 - DNA, 20 bp, Artificial Sequence
  Synthetic oligonucleotide; CAG chr2 60462735 60462754 60462751 +
tctaaactttccagttccat

SEQ ID NO: 158132 - DNA, 20 bp, Artificial Sequence
  Synthetic oligonucleotide; TAG chr2 60462741 60462760 60462757 +
ctttccagttccatcagctg

SEQ ID NO: 158133 - DNA, 20 bp, Artificial Sequence
  Synthetic oligonucleotide; TGG chr2 60462746 60462765 60462762 +
cagttccatcagctgtagtt

SEQ ID NO: 158134 - DNA, 20 bp, Artificial Sequence
  Synthetic oligonucleotide; GGG chr2 60462747 60462766 60462763 +
agttccatcagctgtagttt

SEQ ID NO: 158135 - DNA, 20 bp, Artificial Sequence
  Synthetic oligonucleotide; GGG chr2 60462748 60462767 60462764 +
gttccatcagctgtagtttg

SEQ ID NO: 158136 - DNA, 20 bp, Artificial Sequence
  Synthetic oligonucleotide; AAG chr2 60462752 60462771 60462768 +
catcagctgtagtttggggc

SEQ ID NO: 158137 - DNA, 20 bp, Artificial Sequence
  Synthetic oligonucleotide; AAG chr2 60462792 60462811 60462808 +
gcctctgtttcctccttgtt

SEQ ID NO: 158138 - DNA, 20 bp, Artificial Sequence
  Synthetic oligonucleotide; GAG chr2 60462796 60462815 60462812 +
ctgtttcctccttgttaagt

SEQ ID NO: 158139 - DNA, 20 bp, Artificial Sequence
  Synthetic oligonucleotide; TGG chr2 60462804 60462823 60462820 +
tccttgttaagtgagaaact

SEQ ID NO: 158140 - DNA, 20 bp, Artificial Sequence
  Synthetic oligonucleotide; AAG chr2 60462809 60462828 60462825 +
gttaagtgagaaacttggac

SEQ ID NO: 158141 - DNA, 20 bp, Artificial Sequence
  Synthetic oligonucleotide; AGG chr2 60462810 60462829 60462826 +
ttaagtgagaaacttggaca

SEQ ID NO: 158142 - DNA, 20 bp, Artificial Sequence
  Synthetic oligonucleotide; AAG chr2 60462819 60462838 60462835 +
aaacttggacaaggtgaccc

SEQ ID NO: 158143 - DNA, 20 bp, Artificial Sequence
  Synthetic oligonucleotide; AGG chr2 60462820 60462839 60462836 +
aacttggacaaggtgaccca

SEQ ID NO: 158144 - DNA, 20 bp, Artificial Sequence
  Synthetic oligonucleotide; TGG chr2 60462831 60462850 60462847 +
ggtgacccaaggaaactttt

SEQ ID NO: 158145 - DNA, 20 bp, Artificial Sequence
  Synthetic oligonucleotide; CAG chr2 60462846 60462865 60462862 +
ctttttggcttcctaaatcc

SEQ ID NO: 158146 - DNA, 20 bp, Artificial Sequence
  Synthetic oligonucleotide; TGG chr2 60462864 60462883 60462880 +
cccagctttctattcccccc

SEQ ID NO: 158147 - DNA, 20 bp, Artificial Sequence
  Synthetic oligonucleotide; GGG chr2 60462865 60462884 60462881 +
ccagctttctattcccccct

SEQ ID NO: 158148 - DNA, 20 bp, Artificial Sequence
  Synthetic oligonucleotide; CAG chr2 60462871 60462890 60462887 +
ttctattcccccctgggtga

SEQ ID NO: 158149 - DNA, 20 bp, Artificial Sequence
  Synthetic oligonucleotide; AGG chr2 60462872 60462891 60462888 +
tctattcccccctgggtgac

SEQ ID NO: 158150 - DNA, 20 bp, Artificial Sequence
  Synthetic oligonucleotide; TAG chr2 60462888 60462907 60462904 +
tgacaggtgaactttctaaa

SEQ ID NO: 158151 - DNA, 20 bp, Artificial Sequence
  Synthetic oligonucleotide; AGG chr2 60462889 60462908 60462905 +
gacaggtgaactttctaaat

SEQ ID NO: 158152 - DNA, 20 bp, Artificial Sequence
  Synthetic oligonucleotide; TAG chr2 60462903 60462922 60462919 +
ctaaataggcaaacatttca

SEQ ID NO: 158153 - DNA, 20 bp, Artificial Sequence
  Synthetic oligonucleotide; GAG chr2 60462905 60462924 60462921 +
aaataggcaaacatttcata

SEQ ID NO: 158154 - DNA, 20 bp, Artificial Sequence
  Synthetic oligonucleotide; AGG chr2 60462906 60462925 60462922 +
aataggcaaacatttcatag

SEQ ID NO: 158155 - DNA, 20 bp, Artificial Sequence
  Synthetic oligonucleotide; AAG chr2 60462917 60462936 60462933 +
atttcatagaggtatcaaaa

SEQ ID NO: 158156 - DNA, 20 bp, Artificial Sequence
  Synthetic oligonucleotide; AGG chr2 60462918 60462937 60462934 +
tttcatagaggtatcaaaaa

SEQ ID NO: 158157 - DNA, 20 bp, Artificial Sequence
  Synthetic oligonucleotide; GGG chr2 60462919 60462938 60462935 +
ttcatagaggtatcaaaaaa

SEQ ID NO: 158158 - DNA, 20 bp, Artificial Sequence
  Synthetic oligonucleotide; GGG chr2 60462920 60462939 60462936 +
tcatagaggtatcaaaaaag

SEQ ID NO: 158159 - DNA, 20 bp, Artificial Sequence
  Synthetic oligonucleotide; AAG chr2 60462923 60462942 60462939 +
tagaggtatcaaaaaagggg

SEQ ID NO: 158160 - DNA, 20 bp, Artificial Sequence
  Synthetic oligonucleotide; AAG chr2 60462926 60462945 60462942 +
aggtatcaaaaaaggggaag

SEQ ID NO: 158161 - DNA, 20 bp, Artificial Sequence
  Synthetic oligonucleotide; AGG chr2 60462927 60462946 60462943 +
ggtatcaaaaaaggggaaga

SEQ ID NO: 158162 - DNA, 20 bp, Artificial Sequence
  Synthetic oligonucleotide; TGG chr2 60462951 60462970 60462967 +
caactcactacaatgttcta

SEQ ID NO: 158163 - DNA, 20 bp, Artificial Sequence
  Synthetic oligonucleotide; AAG chr2 60462959 60462978 60462975 +
tacaatgttctatggcccta

SEQ ID NO: 158164 - DNA, 20 bp, Artificial Sequence
  Synthetic oligonucleotide; CAG chr2 60462969 60462988 60462985 +
tatggccctaaagatgcttt

SEQ ID NO: 158165 - DNA, 20 bp, Artificial Sequence
  Synthetic oligonucleotide; TAG chr2 60462975 60462994 60462991 +
cctaaagatgctttcagcat

SEQ ID NO: 158166 - DNA, 20 bp, Artificial Sequence
  Synthetic oligonucleotide; GAG chr2 60463012 60463031 60463028 +
attgttgatattgttaaaat

SEQ ID NO: 158167 - DNA, 20 bp, Artificial Sequence
  Synthetic oligonucleotide; GAG chr2 60463014 60463033 60463030 +
tgttgatattgttaaaatga

SEQ ID NO: 158168 - DNA, 20 bp, Artificial Sequence
  Synthetic oligonucleotide; AGG chr2 60463015 60463034 60463031 +
gttgatattgttaaaatgag

SEQ ID NO: 158169 - DNA, 20 bp, Artificial Sequence
  Synthetic oligonucleotide; GGG chr2 60463016 60463035 60463032 +
ttgatattgttaaaatgaga

SEQ ID NO: 158170 - DNA, 20 bp, Artificial Sequence
  Synthetic oligonucleotide; TGG chr2 60463038 60463057 60463054 +
gtactcataaaatacttccg

SEQ ID NO: 158171 - DNA, 20 bp, Artificial Sequence
  Synthetic oligonucleotide; AAG chr2 60463045 60463064 60463061 +
taaaatacttccgtggaaaa

SEQ ID NO: 158172 - DNA, 20 bp, Artificial Sequence
  Synthetic oligonucleotide; TAG chr2 60463050 60463069 60463066 +
tacttccgtggaaaaaagac

SEQ ID NO: 158173 - DNA, 20 bp, Artificial Sequence
  Synthetic oligonucleotide; CAG chr2 60463069 60463088 60463085 +
ctagcaacattctcacaccc

SEQ ID NO: 158174 - DNA, 20 bp, Artificial Sequence
  Synthetic oligonucleotide; TGG chr2 60463076 60463095 60463092 +
cattctcacaccccagactg

SEQ ID NO: 158175 - DNA, 20 bp, Artificial Sequence
  Synthetic oligonucleotide; GGG chr2 60463077 60463096 60463093 +
attctcacaccccagactgt

SEQ ID NO: 158176 - DNA, 20 bp, Artificial Sequence
  Synthetic oligonucleotide; GAG chr2 60463079 60463098 60463095 +
tctcacaccccagactgtgg

SEQ ID NO: 158177 - DNA, 20 bp, Artificial Sequence
  Synthetic oligonucleotide; AGG chr2 60463080 60463099 60463096 +
ctcacaccccagactgtggg

SEQ ID NO: 158178 - DNA, 20 bp, Artificial Sequence
  Synthetic oligonucleotide; CAG chr2 60463085 60463104 60463101 +
accccagactgtgggaggat

SEQ ID NO: 158179 - DNA, 20 bp, Artificial Sequence
  Synthetic oligonucleotide; GAG chr2 60463089 60463108 60463105 +
cagactgtgggaggatcagt

SEQ ID NO: 158180 - DNA, 20 bp, Artificial Sequence
  Synthetic oligonucleotide; TGG chr2 60463101 60463120 60463117 +
ggatcagtgagtcccaattt

SEQ ID NO: 158181 - DNA, 20 bp, Artificial Sequence
  Synthetic oligonucleotide; TGG chr2 60463119 60463138 60463135 +
tttggttccacaacacccca

SEQ ID NO: 158182 - DNA, 20 bp, Artificial Sequence
  Synthetic oligonucleotide; GGG chr2 60463120 60463139 60463136 +
ttggttccacaacaccccat

SEQ ID NO: 158183 - DNA, 20 bp, Artificial Sequence
  Synthetic oligonucleotide; GGG chr2 60463121 60463140 60463137 +
tggttccacaacaccccatg

SEQ ID NO: 158184 - DNA, 20 bp, Artificial Sequence
  Synthetic oligonucleotide; AAG chr2 60463142 60463161 60463158 +
ggacgtccatttttatctca

SEQ ID NO: 158185 - DNA, 20 bp, Artificial Sequence
  Synthetic oligonucleotide; AAG chr2 60463163 60463182 60463179 +
agaatgtttaaaaaatctga

SEQ ID NO: 158186 - DNA, 20 bp, Artificial Sequence
  Synthetic oligonucleotide; CAG chr2 60463178 60463197 60463194 +
tctgaaagaaaaacttcatt

SEQ ID NO: 158187 - DNA, 20 bp, Artificial Sequence
  Synthetic oligonucleotide; CGG chr2 60463187 60463206 60463203 +
aaaacttcattcagatttaa

SEQ ID NO: 158188 - DNA, 20 bp, Artificial Sequence
  Synthetic oligonucleotide; TAG chr2 60463191 60463210 60463207 +
cttcattcagatttaacgga

SEQ ID NO: 158189 - DNA, 20 bp, Artificial Sequence
  Synthetic oligonucleotide; AGG chr2 60463192 60463211 60463208 +
ttcattcagatttaacggat

SEQ ID NO: 158190 - DNA, 20 bp, Artificial Sequence
  Synthetic oligonucleotide; TAG chr2 60463209 60463228 60463225 +
gataggctgtatccaatctt

SEQ ID NO: 158191 - DNA, 20 bp, Artificial Sequence
  Synthetic oligonucleotide; AGG chr2 60463210 60463229 60463226 +
ataggctgtatccaatcttt

SEQ ID NO: 158192 - DNA, 20 bp, Artificial Sequence
  Synthetic oligonucleotide; GAG chr2 60463212 60463231 60463228 +
aggctgtatccaatctttag

SEQ ID NO: 158193 - DNA, 20 bp, Artificial Sequence
  Synthetic oligonucleotide; CGG chr2 60463223 60463242 60463239 +
aatctttaggagttgtcccc

SEQ ID NO: 158194 - DNA, 20 bp, Artificial Sequence
  Synthetic oligonucleotide; CAG chr2 60463227 60463246 60463243 +
tttaggagttgtcccccggt

SEQ ID NO: 158195 - DNA, 20 bp, Artificial Sequence
  Synthetic oligonucleotide; AAG chr2 60463238 60463257 60463254 +
tcccccggtcagacaaatgc

SEQ ID NO: 158196 - DNA, 20 bp, Artificial Sequence
  Synthetic oligonucleotide; TGG chr2 60463243 60463262 60463259 +
cggtcagacaaatgcaagtc

SEQ ID NO: 158197 - DNA, 20 bp, Artificial Sequence
  Synthetic oligonucleotide; AAG chr2 60463248 60463267 60463264 +
agacaaatgcaagtctggaa

SEQ ID NO: 158198 - DNA, 20 bp, Artificial Sequence
  Synthetic oligonucleotide; TAG chr2 60463252 60463271 60463268 +
aaatgcaagtctggaaaagt

SEQ ID NO: 158199 - DNA, 20 bp, Artificial Sequence
  Synthetic oligonucleotide; AGG chr2 60463253 60463272 60463269 +
aatgcaagtctggaaaagtt

SEQ ID NO: 158200 - DNA, 20 bp, Artificial Sequence
  Synthetic oligonucleotide; GAG chr2 60463255 60463274 60463271 +
tgcaagtctggaaaagttag

SEQ ID NO: 158201 - DNA, 20 bp, Artificial Sequence
  Synthetic oligonucleotide; AGG chr2 60463256 60463275 60463272 +
gcaagtctggaaaagttagg

SEQ ID NO: 158202 - DNA, 20 bp, Artificial Sequence
  Synthetic oligonucleotide; GAG chr2 60463258 60463277 60463274 +
aagtctggaaaagttaggag

SEQ ID NO: 158203 - DNA, 20 bp, Artificial Sequence
  Synthetic oligonucleotide; TGG chr2 60463261 60463280 60463277 +
tctggaaaagttaggaggag

SEQ ID NO: 158204 - DNA, 20 bp, Artificial Sequence
  Synthetic oligonucleotide; TGG chr2 60463265 60463284 60463281 +
gaaaagttaggaggagtggc

SEQ ID NO: 158205 - DNA, 20 bp, Artificial Sequence
  Synthetic oligonucleotide; AAG chr2 60463277 60463296 60463293 +
ggagtggctggtgccgactt

SEQ ID NO: 158206 - DNA, 20 bp, Artificial Sequence
  Synthetic oligonucleotide; CAG chr2 60463280 60463299 60463296 +
gtggctggtgccgacttaag

SEQ ID NO: 158207 - DNA, 20 bp, Artificial Sequence
  Synthetic oligonucleotide; CAG chr2 60463286 60463305 60463302 +
ggtgccgacttaagcagaca

SEQ ID NO: 158208 - DNA, 20 bp, Artificial Sequence
  Synthetic oligonucleotide; TAG chr2 60463294 60463313 60463310 +
cttaagcagacacagcatcc

SEQ ID NO: 158209 - DNA, 20 bp, Artificial Sequence
  Synthetic oligonucleotide; AAG chr2 60463300 60463319 60463316 +
cagacacagcatcctagttt

SEQ ID NO: 158210 - DNA, 20 bp, Artificial Sequence
  Synthetic oligonucleotide; AGG chr2 60463301 60463320 60463317 +
agacacagcatcctagttta

SEQ ID NO: 158211 - DNA, 20 bp, Artificial Sequence
  Synthetic oligonucleotide; CAG chr2 60463306 60463325 60463322 +
cagcatcctagtttaaggaa

SEQ ID NO: 158212 - DNA, 20 bp, Artificial Sequence
  Synthetic oligonucleotide; CAG chr2 60463315 60463334 60463331 +
agtttaaggaacagttaaaa

SEQ ID NO: 158213 - DNA, 20 bp, Artificial Sequence
  Synthetic oligonucleotide; CAG chr2 60463319 60463338 60463335 +
taaggaacagttaaaacagc

SEQ ID NO: 158214 - DNA, 20 bp, Artificial Sequence
  Synthetic oligonucleotide; CAG chr2 60463330 60463349 60463346 +
taaaacagccagcgccatga

SEQ ID NO: 158215 - DNA, 20 bp, Artificial Sequence
  Synthetic oligonucleotide; AGG chr2 60463331 60463350 60463347 +
aaaacagccagcgccatgac

SEQ ID NO: 158216 - DNA, 20 bp, Artificial Sequence
  Synthetic oligonucleotide; CAG chr2 60463334 60463353 60463350 +
acagccagcgccatgacagg

SEQ ID NO: 158217 - DNA, 20 bp, Artificial Sequence
  Synthetic oligonucleotide; CAG chr2 60463337 60463356 60463353 +
gccagcgccatgacaggcag

SEQ ID NO: 158218 - DNA, 20 bp, Artificial Sequence
  Synthetic oligonucleotide; AGG chr2 60463338 60463357 60463354 +
ccagcgccatgacaggcagc

SEQ ID NO: 158219 - DNA, 20 bp, Artificial Sequence
  Synthetic oligonucleotide; GAG chr2 60463343 60463362 60463359 +
gccatgacaggcagcaggct

SEQ ID NO: 158220 - DNA, 20 bp, Artificial Sequence
  Synthetic oligonucleotide; GAG chr2 60463378 60463397 60463394 +
atcctcctcctcattgtttt

SEQ ID NO: 158221 - DNA, 20 bp, Artificial Sequence
  Synthetic oligonucleotide; GAG chr2 60463380 60463399 60463396 +
cctcctcctcattgttttga

SEQ ID NO: 158222 - DNA, 20 bp, Artificial Sequence
  Synthetic oligonucleotide; AGG chr2 60463381 60463400 60463397 +
ctcctcctcattgttttgag

SEQ ID NO: 158223 - DNA, 20 bp, Artificial Sequence
  Synthetic oligonucleotide; CGG chr2 60463423 60463442 60463439 +
tatacaacatcctgcgccct

SEQ ID NO: 158224 - DNA, 20 bp, Artificial Sequence
  Synthetic oligonucleotide; TGG chr2 60463427 60463446 60463443 +
caacatcctgcgccctcggc

SEQ ID NO: 158225 - DNA, 20 bp, Artificial Sequence
  Synthetic oligonucleotide; GGG chr2 60463428 60463447 60463444 +
aacatcctgcgccctcggct

SEQ ID NO: 158226 - DNA, 20 bp, Artificial Sequence
  Synthetic oligonucleotide; CAG chr2 60463434 60463453 60463450 +
ctgcgccctcggctgggact

SEQ ID NO: 158227 - DNA, 20 bp, Artificial Sequence
  Synthetic oligonucleotide; CAG chr2 60463440 60463459 60463456 +
cctcggctgggactcagctc

SEQ ID NO: 158228 - DNA, 20 bp, Artificial Sequence
  Synthetic oligonucleotide; GAG chr2 60463445 60463464 60463461 +
gctgggactcagctccagtt

SEQ ID NO: 158229 - DNA, 20 bp, Artificial Sequence
  Synthetic oligonucleotide; AAG chr2 60463449 60463468 60463465 +
ggactcagctccagttgaga

SEQ ID NO: 158230 - DNA, 20 bp, Artificial Sequence
  Synthetic oligonucleotide; CAG chr2 60463455 60463474 60463471 +
agctccagttgagaaagaaa

SEQ ID NO: 158231 - DNA, 20 bp, Artificial Sequence
  Synthetic oligonucleotide; AAG chr2 60463459 60463478 60463475 +
ccagttgagaaagaaacaga

SEQ ID NO: 158232 - DNA, 20 bp, Artificial Sequence
  Synthetic oligonucleotide; CAG chr2 60463465 60463484 60463481 +
gagaaagaaacagaaagata

SEQ ID NO: 158233 - DNA, 20 bp, Artificial Sequence
  Synthetic oligonucleotide; CAG chr2 60463470 60463489 60463486 +
agaaacagaaagatacagtt

SEQ ID NO: 158234 - DNA, 20 bp, Artificial Sequence
  Synthetic oligonucleotide; TAG chr2 60463474 60463493 60463490 +
acagaaagatacagttcagc

SEQ ID NO: 158235 - DNA, 20 bp, Artificial Sequence
  Synthetic oligonucleotide; TGG chr2 60463484 60463503 60463500 +
acagttcagctagtcaactc

SEQ ID NO: 158236 - DNA, 20 bp, Artificial Sequence
  Synthetic oligonucleotide; CAG chr2 60463488 60463507 60463504 +
ttcagctagtcaactctggc

SEQ ID NO: 158237 - DNA, 20 bp, Artificial Sequence
  Synthetic oligonucleotide; TAG chr2 60463491 60463510 60463507 +
agctagtcaactctggccag

SEQ ID NO: 158238 - DNA, 20 bp, Artificial Sequence
  Synthetic oligonucleotide; AAG chr2 60463496 60463515 60463512 +
gtcaactctggccagtagcc

SEQ ID NO: 158239 - DNA, 20 bp, Artificial Sequence
  Synthetic oligonucleotide; TGG chr2 60463504 60463523 60463520 +
tggccagtagccaagccgtc

SEQ ID NO: 158240 - DNA, 20 bp, Artificial Sequence
  Synthetic oligonucleotide; GAG chr2 60463506 60463525 60463522 +
gccagtagccaagccgtctg

SEQ ID NO: 158241 - DNA, 20 bp, Artificial Sequence
  Synthetic oligonucleotide; GAG chr2 60463508 60463527 60463524 +
cagtagccaagccgtctgga

SEQ ID NO: 158242 - DNA, 20 bp, Artificial Sequence
  Synthetic oligonucleotide; AGG chr2 60463509 60463528 60463525 +
agtagccaagccgtctggag

SEQ ID NO: 158243 - DNA, 20 bp, Artificial Sequence
  Synthetic oligonucleotide; GGG chr2 60463510 60463529 60463526 +
gtagccaagccgtctggaga

SEQ ID NO: 158244 - DNA, 20 bp, Artificial Sequence
  Synthetic oligonucleotide; GGG chr2 60463511 60463530 60463527 +
tagccaagccgtctggagag

SEQ ID NO: 158245 - DNA, 20 bp, Artificial Sequence
  Synthetic oligonucleotide; AAG chr2 60463522 60463541 60463538 +
tctggagaggggccctgctt

SEQ ID NO: 158246 - DNA, 20 bp, Artificial Sequence
  Synthetic oligonucleotide; AAG chr2 60463547 60463566 60463563 +
acattatttcccttgctgaa

SEQ ID NO: 158247 - DNA, 20 bp, Artificial Sequence
  Synthetic oligonucleotide; AAG chr2 60463555 60463574 60463571 +
tcccttgctgaaaagaaccc

SEQ ID NO: 158248 - DNA, 20 bp, Artificial Sequence
  Synthetic oligonucleotide; GAG chr2 60463557 60463576 60463573 +
ccttgctgaaaagaacccaa

SEQ ID NO: 158249 - DNA, 20 bp, Artificial Sequence
  Synthetic oligonucleotide; TGG chr2 60463560 60463579 60463576 +
tgctgaaaagaacccaagag

SEQ ID NO: 158250 - DNA, 20 bp, Artificial Sequence
  Synthetic oligonucleotide; TGG chr2 60463575 60463594 60463591 +
aagagtggtaaatgccactt

SEQ ID NO: 158251 - DNA, 20 bp, Artificial Sequence
  Synthetic oligonucleotide; AAG chr2 60463580 60463599 60463596 +
tggtaaatgccactttggca

SEQ ID NO: 158252 - DNA, 20 bp, Artificial Sequence
  Synthetic oligonucleotide; AAG chr2 60463583 60463602 60463599 +
taaatgccactttggcaaag

SEQ ID NO: 158253 - DNA, 20 bp, Artificial Sequence
  Synthetic oligonucleotide; AGG chr2 60463584 60463603 60463600 +
aaatgccactttggcaaaga

SEQ ID NO: 158254 - DNA, 20 bp, Artificial Sequence
  Synthetic oligonucleotide; GGG chr2 60463585 60463604 60463601 +
aatgccactttggcaaagaa

SEQ ID NO: 158255 - DNA, 20 bp, Artificial Sequence
  Synthetic oligonucleotide; CAG chr2 60463589 60463608 60463605 +
ccactttggcaaagaagggc

SEQ ID NO: 158256 - DNA, 20 bp, Artificial Sequence
  Synthetic oligonucleotide; TGG chr2 60463616 60463635 60463632 +
acttcacaaaatatttcatt

SEQ ID NO: 158257 - DNA, 20 bp, Artificial Sequence
  Synthetic oligonucleotide; GGG chr2 60463617 60463636 60463633 +
cttcacaaaatatttcattt

SEQ ID NO: 158258 - DNA, 20 bp, Artificial Sequence
  Synthetic oligonucleotide; GGG chr2 60463618 60463637 60463634 +
ttcacaaaatatttcatttg

SEQ ID NO: 158259 - DNA, 20 bp, Artificial Sequence
  Synthetic oligonucleotide; GAG chr2 60463620 60463639 60463636 +
cacaaaatatttcatttggg

SEQ ID NO: 158260 - DNA, 20 bp, Artificial Sequence
  Synthetic oligonucleotide; TGG chr2 60463624 60463643 60463640 +
aaatatttcatttggggaga

SEQ ID NO: 158261 - DNA, 20 bp, Artificial Sequence
  Synthetic oligonucleotide; TGG chr2 60463643 60463662 60463659 +
atggctaaattaaatatata

SEQ ID NO: 158262 - DNA, 20 bp, Artificial Sequence
  Synthetic oligonucleotide; GGG chr2 60463644 60463663 60463660 +
tggctaaattaaatatatat

SEQ ID NO: 158263 - DNA, 20 bp, Artificial Sequence
  Synthetic oligonucleotide; GGG chr2 60463645 60463664 60463661 +
ggctaaattaaatatatatg

SEQ ID NO: 158264 - DNA, 20 bp, Artificial Sequence
  Synthetic oligonucleotide; GAG chr2 60463647 60463666 60463663 +
ctaaattaaatatatatggg

SEQ ID NO: 158265 - DNA, 20 bp, Artificial Sequence
  Synthetic oligonucleotide; TAG chr2 60463651 60463670 60463667 +
attaaatatatatggggaga

SEQ ID NO: 158266 - DNA, 20 bp, Artificial Sequence
  Synthetic oligonucleotide; TGG chr2 60463676 60463695 60463692 +
acattaaatatatatatata

SEQ ID NO: 158267 - DNA, 20 bp, Artificial Sequence
  Synthetic oligonucleotide; CAG chr2 60463692 60463711 60463708 +
tatatggaataactgaccaa

SEQ ID NO: 158268 - DNA, 20 bp, Artificial Sequence
  Synthetic oligonucleotide; TAG chr2 60463700 60463719 60463716 +
ataactgaccaacagtttac

SEQ ID NO: 158269 - DNA, 20 bp, Artificial Sequence
  Synthetic oligonucleotide; AAG chr2 60463720 60463739 60463736 +
tagtcaactgcaacattaaa

SEQ ID NO: 158270 - DNA, 20 bp, Artificial Sequence
  Synthetic oligonucleotide; AGG chr2 60463721 60463740 60463737 +
agtcaactgcaacattaaaa

SEQ ID NO: 158271 - DNA, 20 bp, Artificial Sequence
  Synthetic oligonucleotide; GGG chr2 60463722 60463741 60463738 +
gtcaactgcaacattaaaaa

SEQ ID NO: 158272 - DNA, 20 bp, Artificial Sequence
  Synthetic oligonucleotide; CAG chr2 60463725 60463744 60463741 +
aactgcaacattaaaaaggg

SEQ ID NO: 158273 - DNA, 20 bp, Artificial Sequence
  Synthetic oligonucleotide; AAG chr2 60463728 60463747 60463744 +
tgcaacattaaaaagggcag

SEQ ID NO: 158274 - DNA, 20 bp, Artificial Sequence
  Synthetic oligonucleotide; TGG chr2 60463734 60463753 60463750 +
attaaaaagggcagaagtaa

SEQ ID NO: 158275 - DNA, 20 bp, Artificial Sequence
  Synthetic oligonucleotide; TAG chr2 60463737 60463756 60463753 +
aaaaagggcagaagtaatgg

SEQ ID NO: 158276 - DNA, 20 bp, Artificial Sequence
  Synthetic oligonucleotide; AAG chr2 60463743 60463762 60463759 +
ggcagaagtaatggtagcca

SEQ ID NO: 158277 - DNA, 20 bp, Artificial Sequence
  Synthetic oligonucleotide; AGG chr2 60463744 60463763 60463760 +
gcagaagtaatggtagccaa

SEQ ID NO: 158278 - DNA, 20 bp, Artificial Sequence
  Synthetic oligonucleotide; GAG chr2 60463749 60463768 60463765 +
agtaatggtagccaaaggac

SEQ ID NO: 158279 - DNA, 20 bp, Artificial Sequence
  Synthetic oligonucleotide; AGG chr2 60463750 60463769 60463766 +
gtaatggtagccaaaggacg

SEQ ID NO: 158280 - DNA, 20 bp, Artificial Sequence
  Synthetic oligonucleotide; GAG chr2 60463755 60463774 60463771 +
ggtagccaaaggacgaggat

SEQ ID NO: 158281 - DNA, 20 bp, Artificial Sequence
  Synthetic oligonucleotide; CAG chr2 60463773 60463792 60463789 +
atgagaaaaacaaaacttcc

SEQ ID NO: 158282 - DNA, 20 bp, Artificial Sequence
  Synthetic oligonucleotide; GAG chr2 60463775 60463794 60463791 +
gagaaaaacaaaacttccca

SEQ ID NO: 158283 - DNA, 20 bp, Artificial Sequence
  Synthetic oligonucleotide; AAG chr2 60463791 60463810 60463807 +
cccagagattctgaaaaaaa

SEQ ID NO: 158284 - DNA, 20 bp, Artificial Sequence
  Synthetic oligonucleotide; GAG chr2 60463809 60463828 60463825 +
aaaagccttaaaatataact

SEQ ID NO: 158285 - DNA, 20 bp, Artificial Sequence
  Synthetic oligonucleotide; AAG chr2 60463840 60463859 60463856 +
aacttttctccttcttttaa

SEQ ID NO: 158286 - DNA, 20 bp, Artificial Sequence
  Synthetic oligonucleotide; AAG chr2 60463843 60463862 60463859 +
ttttctccttcttttaaaag

SEQ ID NO: 158287 - DNA, 20 bp, Artificial Sequence
  Synthetic oligonucleotide; AGG chr2 60463844 60463863 60463860 +
tttctccttcttttaaaaga

SEQ ID NO: 158288 - DNA, 20 bp, Artificial Sequence
  Synthetic oligonucleotide; GGG chr2 60463845 60463864 60463861 +
ttctccttcttttaaaagaa

SEQ ID NO: 158289 - DNA, 20 bp, Artificial Sequence
  Synthetic oligonucleotide; AAG chr2 60463852 60463871 60463868 +
tcttttaaaagaagggctgc

SEQ ID NO: 158290 - DNA, 20 bp, Artificial Sequence
  Synthetic oligonucleotide; GAG chr2 60463854 60463873 60463870 +
ttttaaaagaagggctgcaa

SEQ ID NO: 158291 - DNA, 20 bp, Artificial Sequence
  Synthetic oligonucleotide; AAG chr2 60463863 60463882 60463879 +
aagggctgcaagagttcttt

SEQ ID NO: 158292 - DNA, 20 bp, Artificial Sequence
  Synthetic oligonucleotide; AGG chr2 60463864 60463883 60463880 +
agggctgcaagagttcttta

SEQ ID NO: 158293 - DNA, 20 bp, Artificial Sequence
  Synthetic oligonucleotide; CAG chr2 60463870 60463889 60463886 +
gcaagagttctttaaggcca

SEQ ID NO: 158294 - DNA, 20 bp, Artificial Sequence
  Synthetic oligonucleotide; TAG chr2 60463874 60463893 60463890 +
gagttctttaaggccacagc

SEQ ID NO: 158295 - DNA, 20 bp, Artificial Sequence
  Synthetic oligonucleotide; CAG chr2 60463884 60463903 60463900 +
aggccacagctagtatttgt

SEQ ID NO: 158296 - DNA, 20 bp, Artificial Sequence
  Synthetic oligonucleotide; AAG chr2 60463896 60463915 60463912 +
gtatttgtcagtaactttct

SEQ ID NO: 158297 - DNA, 20 bp, Artificial Sequence
  Synthetic oligonucleotide; AAG chr2 60463899 60463918 60463915 +
tttgtcagtaactttctaag

SEQ ID NO: 158298 - DNA, 20 bp, Artificial Sequence
  Synthetic oligonucleotide; AGG chr2 60463900 60463919 60463916 +
ttgtcagtaactttctaaga

SEQ ID NO: 158299 - DNA, 20 bp, Artificial Sequence
  Synthetic oligonucleotide; CAG chr2 60463922 60463941 60463938 +
gaaaaaaaaaaaaaatctac

SEQ ID NO: 158300 - DNA, 20 bp, Artificial Sequence
  Synthetic oligonucleotide; AGG chr2 60463923 60463942 60463939 +
aaaaaaaaaaaaaatctacc

SEQ ID NO: 158301 - DNA, 20 bp, Artificial Sequence
  Synthetic oligonucleotide; GGG chr2 60463924 60463943 60463940 +
aaaaaaaaaaaaatctacca

SEQ ID NO: 158302 - DNA, 20 bp, Artificial Sequence
  Synthetic oligonucleotide; GAG chr2 60463926 60463945 60463942 +
aaaaaaaaaaatctaccagg

SEQ ID NO: 158303 - DNA, 20 bp, Artificial Sequence
  Synthetic oligonucleotide; AGG chr2 60463927 60463946 60463943 +
aaaaaaaaaatctaccaggg

SEQ ID NO: 158304 - DNA, 20 bp, Artificial Sequence
  Synthetic oligonucleotide; AAG chr2 60463932 60463951 60463948 +
aaaaatctaccagggaggtt

SEQ ID NO: 158305 - DNA, 20 bp, Artificial Sequence
  Synthetic oligonucleotide; GAG chr2 60463934 60463953 60463950 +
aaatctaccagggaggttaa

SEQ ID NO: 158306 - DNA, 20 bp, Artificial Sequence
  Synthetic oligonucleotide; GAG chr2 60463938 60463957 60463954 +
ctaccagggaggttaagagt

SEQ ID NO: 158307 - DNA, 20 bp, Artificial Sequence
  Synthetic oligonucleotide; GAG chr2 60463944 60463963 60463960 +
gggaggttaagagtgagaat

SEQ ID NO: 158308 - DNA, 20 bp, Artificial Sequence
  Synthetic oligonucleotide; AGG chr2 60463945 60463964 60463961 +
ggaggttaagagtgagaatg

SEQ ID NO: 158309 - DNA, 20 bp, Artificial Sequence
  Synthetic oligonucleotide; TAG chr2 60463976 60463995 60463992 +
aattatatgatgcctccatt

SEQ ID NO: 158310 - DNA, 20 bp, Artificial Sequence
  Synthetic oligonucleotide; AAG chr2 60463980 60463999 60463996 +
atatgatgcctccatttagc

SEQ ID NO: 158311 - DNA, 20 bp, Artificial Sequence
  Synthetic oligonucleotide; CAG chr2 60463984 60464003 60464000 +
gatgcctccatttagcaagt

SEQ ID NO: 158312 - DNA, 20 bp, Artificial Sequence
  Synthetic oligonucleotide; AAG chr2 60463988 60464007 60464004 +
cctccatttagcaagtcaga

SEQ ID NO: 158313 - DNA, 20 bp, Artificial Sequence
  Synthetic oligonucleotide; AAG chr2 60463993 60464012 60464009 +
atttagcaagtcagaaagaa

SEQ ID NO: 158314 - DNA, 20 bp, Artificial Sequence
  Synthetic oligonucleotide; CGG chr2 60463997 60464016 60464013 +
agcaagtcagaaagaaaagc

SEQ ID NO: 158315 - DNA, 20 bp, Artificial Sequence
  Synthetic oligonucleotide; CAG chr2 60464000 60464019 60464016 +
aagtcagaaagaaaagccgg

SEQ ID NO: 158316 - DNA, 20 bp, Artificial Sequence
  Synthetic oligonucleotide; AGG chr2 60464001 60464020 60464017 +
agtcagaaagaaaagccggc

SEQ ID NO: 158317 - DNA, 20 bp, Artificial Sequence
  Synthetic oligonucleotide; GGG chr2 60464002 60464021 60464018 +
gtcagaaagaaaagccggca

SEQ ID NO: 158318 - DNA, 20 bp, Artificial Sequence
  Synthetic oligonucleotide; CAG chr2 60464011 60464030 60464027 +
aaaagccggcagggtcttct

SEQ ID NO: 158319 - DNA, 20 bp, Artificial Sequence
  Synthetic oligonucleotide; AGG chr2 60464012 60464031 60464028 +
aaagccggcagggtcttctc

SEQ ID NO: 158320 - DNA, 20 bp, Artificial Sequence
  Synthetic oligonucleotide; GAG chr2 60464014 60464033 60464030 +
agccggcagggtcttctcag

SEQ ID NO: 158321 - DNA, 20 bp, Artificial Sequence
  Synthetic oligonucleotide; TGG chr2 60464028 60464047 60464044 +
tctcaggagcccccaaacac

SEQ ID NO: 158322 - DNA, 20 bp, Artificial Sequence
  Synthetic oligonucleotide; AAG chr2 60464042 60464061 60464058 +
aaacactggtattccaaaat

SEQ ID NO: 158323 - DNA, 20 bp, Artificial Sequence
  Synthetic oligonucleotide; CAG chr2 60464046 60464065 60464062 +
actggtattccaaaataagc

SEQ ID NO: 158324 - DNA, 20 bp, Artificial Sequence
  Synthetic oligonucleotide; AAG chr2 60464057 60464076 60464073 +
aaaataagccagcctcgctc

SEQ ID NO: 158325 - DNA, 20 bp, Artificial Sequence
  Synthetic oligonucleotide; TGG chr2 60464075 60464094 60464091 +
tcaagcacttgtctaaataa

SEQ ID NO: 158326 - DNA, 20 bp, Artificial Sequence
  Synthetic oligonucleotide; TGG chr2 60464145 60464164 60464161 +
cactcaatatatctcactcc

SEQ ID NO: 158327 - DNA, 20 bp, Artificial Sequence
  Synthetic oligonucleotide; GGG chr2 60464146 60464165 60464162 +
actcaatatatctcactcct

SEQ ID NO: 158328 - DNA, 20 bp, Artificial Sequence
  Synthetic oligonucleotide; AAG chr2 60464163 60464182 60464179 +
cctgggtaaatctcttaaac

SEQ ID NO: 158329 - DNA, 20 bp, Artificial Sequence
  Synthetic oligonucleotide; TAG chr2 60464168 60464187 60464184 +
gtaaatctcttaaacaagat

SEQ ID NO: 158330 - DNA, 20 bp, Artificial Sequence
  Synthetic oligonucleotide; TGG chr2 60464172 60464191 60464188 +
atctcttaaacaagattaga

SEQ ID NO: 158331 - DNA, 20 bp, Artificial Sequence
  Synthetic oligonucleotide; AAG chr2 60464176 60464195 60464192 +
cttaaacaagattagatggt

SEQ ID NO: 158332 - DNA, 20 bp, Artificial Sequence
  Synthetic oligonucleotide; TAG chr2 60464189 60464208 60464205 +
agatggtaagataccaaaat

SEQ ID NO: 158333 - DNA, 20 bp, Artificial Sequence
  Synthetic oligonucleotide; AGG chr2 60464190 60464209 60464206 +
gatggtaagataccaaaatt

SEQ ID NO: 158334 - DNA, 20 bp, Artificial Sequence
  Synthetic oligonucleotide; TGG chr2 60464213 60464232 60464229 +
tttcaaacatttgtctaatg

SEQ ID NO: 158335 - DNA, 20 bp, Artificial Sequence
  Synthetic oligonucleotide; AAG chr2 60464216 60464235 60464232 +
caaacatttgtctaatgtgg

SEQ ID NO: 158336 - DNA, 20 bp, Artificial Sequence
  Synthetic oligonucleotide; AGG chr2 60464217 60464236 60464233 +
aaacatttgtctaatgtgga

SEQ ID NO: 158337 - DNA, 20 bp, Artificial Sequence
  Synthetic oligonucleotide; GGG chr2 60464218 60464237 60464234 +
aacatttgtctaatgtggaa

SEQ ID NO: 158338 - DNA, 20 bp, Artificial Sequence
  Synthetic oligonucleotide; GGG chr2 60464219 60464238 60464235 +
acatttgtctaatgtggaag

SEQ ID NO: 158339 - DNA, 20 bp, Artificial Sequence
  Synthetic oligonucleotide; GGG chr2 60464220 60464239 60464236 +
catttgtctaatgtggaagg

SEQ ID NO: 158340 - DNA, 20 bp, Artificial Sequence
  Synthetic oligonucleotide; AAG chr2 60464227 60464246 60464243 +
ctaatgtggaagggggaaaa

SEQ ID NO: 158341 - DNA, 20 bp, Artificial Sequence
  Synthetic oligonucleotide; AGG chr2 60464228 60464247 60464244 +
taatgtggaagggggaaaaa

SEQ ID NO: 158342 - DNA, 20 bp, Artificial Sequence
  Synthetic oligonucleotide; CAG chr2 60464231 60464250 60464247 +
tgtggaagggggaaaaaagg

SEQ ID NO: 158343 - DNA, 20 bp, Artificial Sequence
  Synthetic oligonucleotide; AAG chr2 60464235 60464254 60464251 +
gaagggggaaaaaaggcaga

SEQ ID NO: 158344 - DNA, 20 bp, Artificial Sequence
  Synthetic oligonucleotide; AAG chr2 60464245 60464264 60464261 +
aaaaggcagaaagattttga

SEQ ID NO: 158345 - DNA, 20 bp, Artificial Sequence
  Synthetic oligonucleotide; TAG chr2 60464261 60464280 60464277 +
ttgaaagaaaacgctgacat

SEQ ID NO: 158346 - DNA, 20 bp, Artificial Sequence
  Synthetic oligonucleotide; AAG chr2 60464305 60464324 60464321 +
ttgtttgcctcctctcttca

SEQ ID NO: 158347 - DNA, 20 bp, Artificial Sequence
  Synthetic oligonucleotide; AGG chr2 60464306 60464325 60464322 +
tgtttgcctcctctcttcaa

SEQ ID NO: 158348 - DNA, 20 bp, Artificial Sequence
  Synthetic oligonucleotide; GGG chr2 60464307 60464326 60464323 +
gtttgcctcctctcttcaaa

SEQ ID NO: 158349 - DNA, 20 bp, Artificial Sequence
  Synthetic oligonucleotide; AAG chr2 60464317 60464336 60464333 +
tctcttcaaagggaaataaa

SEQ ID NO: 158350 - DNA, 20 bp, Artificial Sequence
  Synthetic oligonucleotide; GAG chr2 60464327 60464346 60464343 +
gggaaataaaaagcttcatt

SEQ ID NO: 158351 - DNA, 20 bp, Artificial Sequence
  Synthetic oligonucleotide; TGG chr2 60464370 60464389 60464386 +
gttgttgttgaacaataact

SEQ ID NO: 158352 - DNA, 20 bp, Artificial Sequence
  Synthetic oligonucleotide; GGG chr2 60464371 60464390 60464387 +
ttgttgttgaacaataactt

SEQ ID NO: 158353 - DNA, 20 bp, Artificial Sequence
  Synthetic oligonucleotide; TAG chr2 60464381 60464400 60464397 +
acaataacttgggtcccaaa

SEQ ID NO: 158354 - DNA, 20 bp, Artificial Sequence
  Synthetic oligonucleotide; AGG chr2 60464382 60464401 60464398 +
caataacttgggtcccaaat

SEQ ID NO: 158355 - DNA, 20 bp, Artificial Sequence
  Synthetic oligonucleotide; TGG chr2 60464386 60464405 60464402 +
aacttgggtcccaaataggc

SEQ ID NO: 158356 - DNA, 20 bp, Artificial Sequence
  Synthetic oligonucleotide; TGG chr2 60464402 60464421 60464418 +
aggctggaaaaaaaactatc

SEQ ID NO: 158357 - DNA, 20 bp, Artificial Sequence
  Synthetic oligonucleotide; TGG chr2 60464426 60464445 60464442 +
tccaactacatgatcctctg

SEQ ID NO: 158358 - DNA, 20 bp, Artificial Sequence
  Synthetic oligonucleotide; TAG chr2 60464447 60464466 60464463 +
ggcttcctccttgtcctccc

SEQ ID NO: 158359 - DNA, 20 bp, Artificial Sequence
  Synthetic oligonucleotide; TGG chr2 60464455 60464474 60464471 +
ccttgtcctccctagatctc

SEQ ID NO: 158360 - DNA, 20 bp, Artificial Sequence
  Synthetic oligonucleotide; GGG chr2 60464456 60464475 60464472 +
cttgtcctccctagatctct

SEQ ID NO: 158361 - DNA, 20 bp, Artificial Sequence
  Synthetic oligonucleotide; TAG chr2 60464476 60464495 60464492 +
gggtgactatcattcctatt

SEQ ID NO: 158362 - DNA, 20 bp, Artificial Sequence
  Synthetic oligonucleotide; GAG chr2 60464490 60464509 60464506 +
cctatttagcctgacgatct

SEQ ID NO: 158363 - DNA, 20 bp, Artificial Sequence
  Synthetic oligonucleotide; TGG chr2 60464494 60464513 60464510 +
tttagcctgacgatctgagt

SEQ ID NO: 158364 - DNA, 20 bp, Artificial Sequence
  Synthetic oligonucleotide; GGG chr2 60464495 60464514 60464511 +
ttagcctgacgatctgagtt

SEQ ID NO: 158365 - DNA, 20 bp, Artificial Sequence
  Synthetic oligonucleotide; AAG chr2 60464499 60464518 60464515 +
cctgacgatctgagttgggc

SEQ ID NO: 158366 - DNA, 20 bp, Artificial Sequence
  Synthetic oligonucleotide; AAG chr2 60464506 60464525 60464522 +
atctgagttgggcaagtaaa

SEQ ID NO: 158367 - DNA, 20 bp, Artificial Sequence
  Synthetic oligonucleotide; AAG chr2 60464525 60464544 60464541 +
aaagatttgtctgataatcc

SEQ ID NO: 158368 - DNA, 20 bp, Artificial Sequence
  Synthetic oligonucleotide; CAG chr2 60464597 60464616 60464613 +
ataaaacatcgattgaaatc

SEQ ID NO: 158369 - DNA, 20 bp, Artificial Sequence
  Synthetic oligonucleotide; AGG chr2 60464598 60464617 60464614 +
taaaacatcgattgaaatcc

SEQ ID NO: 158370 - DNA, 20 bp, Artificial Sequence
  Synthetic oligonucleotide; TAG chr2 60464603 60464622 60464619 +
catcgattgaaatccaggac

SEQ ID NO: 158371 - DNA, 20 bp, Artificial Sequence
  Synthetic oligonucleotide; TAG chr2 60464615 60464634 60464631 +
tccaggactagactcataat

SEQ ID NO: 158372 - DNA, 20 bp, Artificial Sequence
  Synthetic oligonucleotide; TGG chr2 60464618 60464637 60464634 +
aggactagactcataattag

SEQ ID NO: 158373 - DNA, 20 bp, Artificial Sequence
  Synthetic oligonucleotide; TGG chr2 60464624 60464643 60464640 +
agactcataattagtggtgc

SEQ ID NO: 158374 - DNA, 20 bp, Artificial Sequence
  Synthetic oligonucleotide; TAG chr2 60464648 60464667 60464664 +
ttcacatgtgccatgaattg

SEQ ID NO: 158375 - DNA, 20 bp, Artificial Sequence
  Synthetic oligonucleotide; TGG chr2 60464674 60464693 60464690 +
ttgataaatgccaaaatctg

SEQ ID NO: 158376 - DNA, 20 bp, Artificial Sequence
  Synthetic oligonucleotide; CAG chr2 60464681 60464700 60464697 +
atgccaaaatctgtggcata

SEQ ID NO: 158377 - DNA, 20 bp, Artificial Sequence
  Synthetic oligonucleotide; AAG chr2 60464693 60464712 60464709 +
gtggcatacagcactacatc

SEQ ID NO: 158378 - DNA, 20 bp, Artificial Sequence
  Synthetic oligonucleotide; AGG chr2 60464694 60464713 60464710 +
tggcatacagcactacatca

SEQ ID NO: 158379 - DNA, 20 bp, Artificial Sequence
  Synthetic oligonucleotide; AAG chr2 60464719 60464738 60464735 +
ctcatttgtatcctttcaaa

SEQ ID NO: 158380 - DNA, 20 bp, Artificial Sequence
  Synthetic oligonucleotide; AGG chr2 60464720 60464739 60464736 +
tcatttgtatcctttcaaaa

SEQ ID NO: 158381 - DNA, 20 bp, Artificial Sequence
  Synthetic oligonucleotide; GAG chr2 60464730 60464749 60464746 +
cctttcaaaaaggcttaaat

SEQ ID NO: 158382 - DNA, 20 bp, Artificial Sequence
  Synthetic oligonucleotide; AAG chr2 60464735 60464754 60464751 +
caaaaaggcttaaatgagaa

SEQ ID NO: 158383 - DNA, 20 bp, Artificial Sequence
  Synthetic oligonucleotide; GAG chr2 60464759 60464778 60464775 +
ccattttattttgctgccct

SEQ ID NO: 158384 - DNA, 20 bp, Artificial Sequence
  Synthetic oligonucleotide; CAG chr2 60464779 60464798 60464795 +
gagcatcctaaacttttttt

SEQ ID NO: 158385 - DNA, 20 bp, Artificial Sequence
  Synthetic oligonucleotide; GAG chr2 60464781 60464800 60464797 +
gcatcctaaactttttttca

SEQ ID NO: 158386 - DNA, 20 bp, Artificial Sequence
  Synthetic oligonucleotide; CAG chr2 60464785 60464804 60464801 +
cctaaactttttttcagagc

SEQ ID NO: 158387 - DNA, 20 bp, Artificial Sequence
  Synthetic oligonucleotide; CAG chr2 60464804 60464823 60464820 +
ccagttatgtgatcatgcta

SEQ ID NO: 158388 - DNA, 20 bp, Artificial Sequence
  Synthetic oligonucleotide; CAG chr2 60464850 60464869 60464866 +
ctcccctctctctcatacat

SEQ ID NO: 158389 - DNA, 20 bp, Artificial Sequence
  Synthetic oligonucleotide; AGG chr2 60464851 60464870 60464867 +
tcccctctctctcatacatc

SEQ ID NO: 158390 - DNA, 20 bp, Artificial Sequence
  Synthetic oligonucleotide; CAG chr2 60464855 60464874 60464871 +
ctctctctcatacatcaggt

SEQ ID NO: 158391 - DNA, 20 bp, Artificial Sequence
  Synthetic oligonucleotide; GAG chr2 60464857 60464876 60464873 +
ctctctcatacatcaggtca

SEQ ID NO: 158392 - DNA, 20 bp, Artificial Sequence
  Synthetic oligonucleotide; TGG chr2 60464864 60464883 60464880 +
atacatcaggtcagagaaaa

SEQ ID NO: 158393 - DNA, 20 bp, Artificial Sequence
  Synthetic oligonucleotide; GAG chr2 60464883 60464902 60464899 +
atggcattttatcttataat

SEQ ID NO: 158394 - DNA, 20 bp, Artificial Sequence
  Synthetic oligonucleotide; CAG chr2 60464897 60464916 60464913 +
tataatgagcatacaacata

SEQ ID NO: 158395 - DNA, 20 bp, Artificial Sequence
  Synthetic oligonucleotide; TAG chr2 60464917 60464936 60464933 +
cagttttcactatcgcattt

SEQ ID NO: 158396 - DNA, 20 bp, Artificial Sequence
  Synthetic oligonucleotide; TAG chr2 60464933 60464952 60464949 +
attttagtattcccatcaac

SEQ ID NO: 158397 - DNA, 20 bp, Artificial Sequence
  Synthetic oligonucleotide; TAG chr2 60464942 60464961 60464958 +
ttcccatcaactagatattc

SEQ ID NO: 158398 - DNA, 20 bp, Artificial Sequence
  Synthetic oligonucleotide; GAG chr2 60464950 60464969 60464966 +
aactagatattctagatcat

SEQ ID NO: 158399 - DNA, 20 bp, Artificial Sequence
  Synthetic oligonucleotide; AGG chr2 60464951 60464970 60464967 +
actagatattctagatcatg

SEQ ID NO: 158400 - DNA, 20 bp, Artificial Sequence
  Synthetic oligonucleotide; GGG chr2 60464952 60464971 60464968 +
ctagatattctagatcatga

SEQ ID NO: 158401 - DNA, 20 bp, Artificial Sequence
  Synthetic oligonucleotide; CAG chr2 60464955 60464974 60464971 +
gatattctagatcatgaggg

SEQ ID NO: 158402 - DNA, 20 bp, Artificial Sequence
  Synthetic oligonucleotide; TAG chr2 60464959 60464978 60464975 +
ttctagatcatgagggcagc

SEQ ID NO: 158403 - DNA, 20 bp, Artificial Sequence
  Synthetic oligonucleotide; GAG chr2 60464980 60464999 60464996 +
agtgtaatcataatgtcaat

SEQ ID NO: 158404 - DNA, 20 bp, Artificial Sequence
  Synthetic oligonucleotide; AAG chr2 60464983 60465002 60464999 +
gtaatcataatgtcaatgag

SEQ ID NO: 158405 - DNA, 20 bp, Artificial Sequence
  Synthetic oligonucleotide; AGG chr2 60464984 60465003 60465000 +
taatcataatgtcaatgaga

SEQ ID NO: 158406 - DNA, 20 bp, Artificial Sequence
  Synthetic oligonucleotide; GGG chr2 60464985 60465004 60465001 +
aatcataatgtcaatgagaa

SEQ ID NO: 158407 - DNA, 20 bp, Artificial Sequence
  Synthetic oligonucleotide; GAG chr2 60464999 60465018 60465015 +
tgagaagggctgttacgatt

SEQ ID NO: 158408 - DNA, 20 bp, Artificial Sequence
  Synthetic oligonucleotide; AAG chr2 60465006 60465025 60465022 +
ggctgttacgattgagacta

SEQ ID NO: 158409 - DNA, 20 bp, Artificial Sequence
  Synthetic oligonucleotide; TGG chr2 60465015 60465034 60465031 +
gattgagactaaagattaca

SEQ ID NO: 158410 - DNA, 20 bp, Artificial Sequence
  Synthetic oligonucleotide; GAG chr2 60465017 60465036 60465033 +
ttgagactaaagattacatg

SEQ ID NO: 158411 - DNA, 20 bp, Artificial Sequence
  Synthetic oligonucleotide; GAG chr2 60465019 60465038 60465035 +
gagactaaagattacatgga

SEQ ID NO: 158412 - DNA, 20 bp, Artificial Sequence
  Synthetic oligonucleotide; GAG chr2 60465021 60465040 60465037 +
gactaaagattacatggaga

SEQ ID NO: 158413 - DNA, 20 bp, Artificial Sequence
  Synthetic oligonucleotide; TGG chr2 60465036 60465055 60465052 +
ggagagagctgctttgaaac

SEQ ID NO: 158414 - DNA, 20 bp, Artificial Sequence
  Synthetic oligonucleotide; CAG chr2 60465049 60465068 60465065 +
ttgaaactggtaattattac

SEQ ID NO: 158415 - DNA, 20 bp, Artificial Sequence
  Synthetic oligonucleotide; TAG chr2 60465060 60465079 60465076 +
aattattaccagtccactaa

SEQ ID NO: 158416 - DNA, 20 bp, Artificial Sequence
  Synthetic oligonucleotide; CAG chr2 60465106 60465125 60465122 +
catataatctgtatttcact

SEQ ID NO: 158417 - DNA, 20 bp, Artificial Sequence
  Synthetic oligonucleotide; CGG chr2 60465116 60465135 60465132 +
gtatttcactcagctcatgc

SEQ ID NO: 158418 - DNA, 20 bp, Artificial Sequence
  Synthetic oligonucleotide; CAG chr2 60465136 60465155 60465152 +
cggtgtaccatattatatta

SEQ ID NO: 158419 - DNA, 20 bp, Artificial Sequence
  Synthetic oligonucleotide; CAG chr2 60465145 60465164 60465161 +
atattatattacagtgctca

SEQ ID NO: 158420 - DNA, 20 bp, Artificial Sequence
  Synthetic oligonucleotide; CAG chr2 60465167 60465186 60465183 +
gattctaaattcctaaactg

SEQ ID NO: 158421 - DNA, 20 bp, Artificial Sequence
  Synthetic oligonucleotide; TAG chr2 60465236 60465255 60465252 +
tcataacatctttgatgatt

SEQ ID NO: 158422 - DNA, 20 bp, Artificial Sequence
  Synthetic oligonucleotide; AAG chr2 60465240 60465259 60465256 +
aacatctttgatgatttaga

SEQ ID NO: 158423 - DNA, 20 bp, Artificial Sequence
  Synthetic oligonucleotide; TGG chr2 60465245 60465264 60465261 +
ctttgatgatttagaaagac

SEQ ID NO: 158424 - DNA, 20 bp, Artificial Sequence
  Synthetic oligonucleotide; TGG chr2 60465263 60465282 60465279 +
actggaattgatttcctgtg

SEQ ID NO: 158425 - DNA, 20 bp, Artificial Sequence
  Synthetic oligonucleotide; TAG chr2 60465272 60465291 60465288 +
gatttcctgtgtggcaaaat

SEQ ID NO: 158426 - DNA, 20 bp, Artificial Sequence
  Synthetic oligonucleotide; AGG chr2 60465273 60465292 60465289 +
atttcctgtgtggcaaaatt

SEQ ID NO: 158427 - DNA, 20 bp, Artificial Sequence
  Synthetic oligonucleotide; GGG chr2 60465274 60465293 60465290 +
tttcctgtgtggcaaaatta

SEQ ID NO: 158428 - DNA, 20 bp, Artificial Sequence
  Synthetic oligonucleotide; GAG chr2 60465351 60465370 60465367 +
gaaaatcaacttctcaattt

SEQ ID NO: 158429 - DNA, 20 bp, Artificial Sequence
  Synthetic oligonucleotide; GAG chr2 60465353 60465372 60465369 +
aaatcaacttctcaatttga

SEQ ID NO: 158430 - DNA, 20 bp, Artificial Sequence
  Synthetic oligonucleotide; TGG chr2 60465362 60465381 60465378 +
tctcaatttgagagcctcat

SEQ ID NO: 158431 - DNA, 20 bp, Artificial Sequence
  Synthetic oligonucleotide; GGG chr2 60465363 60465382 60465379 +
ctcaatttgagagcctcatt

SEQ ID NO: 158432 - DNA, 20 bp, Artificial Sequence
  Synthetic oligonucleotide; CGG chr2 60465372 60465391 60465388 +
agagcctcattgggcattta

SEQ ID NO: 158433 - DNA, 20 bp, Artificial Sequence
  Synthetic oligonucleotide; GGG chr2 60465373 60465392 60465389 +
gagcctcattgggcatttac

SEQ ID NO: 158434 - DNA, 20 bp, Artificial Sequence
  Synthetic oligonucleotide; GGG chr2 60465374 60465393 60465390 +
agcctcattgggcatttacg

SEQ ID NO: 158435 - DNA, 20 bp, Artificial Sequence
  Synthetic oligonucleotide; TAG chr2 60465389 60465408 60465405 +
ttacggggattgttttgatt

SEQ ID NO: 158436 - DNA, 20 bp, Artificial Sequence
  Synthetic oligonucleotide; GAG chr2 60465391 60465410 60465407 +
acggggattgttttgattta

SEQ ID NO: 158437 - DNA, 20 bp, Artificial Sequence
  Synthetic oligonucleotide; TGG chr2 60465409 60465428 60465425 +
tagagcaataaactgacacc

SEQ ID NO: 158438 - DNA, 20 bp, Artificial Sequence
  Synthetic oligonucleotide; AAG chr2 60465417 60465436 60465433 +
taaactgacacctggcccct

SEQ ID NO: 158439 - DNA, 20 bp, Artificial Sequence
  Synthetic oligonucleotide; TAG chr2 60465422 60465441 60465438 +
tgacacctggcccctaagca

SEQ ID NO: 158440 - DNA, 20 bp, Artificial Sequence
  Synthetic oligonucleotide; AGG chr2 60465423 60465442 60465439 +
gacacctggcccctaagcat

SEQ ID NO: 158441 - DNA, 20 bp, Artificial Sequence
  Synthetic oligonucleotide; GAG chr2 60465431 60465450 60465447 +
gcccctaagcataggaactt

SEQ ID NO: 158442 - DNA, 20 bp, Artificial Sequence
  Synthetic oligonucleotide; AAG chr2 60465441 60465460 60465457 +
ataggaacttgagacatcaa

SEQ ID NO: 158443 - DNA, 20 bp, Artificial Sequence
  Synthetic oligonucleotide; AGG chr2 60465442 60465461 60465458 +
taggaacttgagacatcaaa

SEQ ID NO: 158444 - DNA, 20 bp, Artificial Sequence
  Synthetic oligonucleotide; GGG chr2 60465443 60465462 60465459 +
aggaacttgagacatcaaaa

SEQ ID NO: 158445 - DNA, 20 bp, Artificial Sequence
  Synthetic oligonucleotide; CAG chr2 60465453 60465472 60465469 +
gacatcaaaagggttaaaat

SEQ ID NO: 158446 - DNA, 20 bp, Artificial Sequence
  Synthetic oligonucleotide; TAG chr2 60465460 60465479 60465476 +
aaagggttaaaatcagctat

SEQ ID NO: 158447 - DNA, 20 bp, Artificial Sequence
  Synthetic oligonucleotide; TGG chr2 60465472 60465491 60465488 +
tcagctattagcccacctac

SEQ ID NO: 158448 - DNA, 20 bp, Artificial Sequence
  Synthetic oligonucleotide; TGG chr2 60465501 60465520 60465517 +
ttttatttcattttacttta

SEQ ID NO: 158449 - DNA, 20 bp, Artificial Sequence
  Synthetic oligonucleotide; GGG chr2 60465502 60465521 60465518 +
tttatttcattttactttat

SEQ ID NO: 158450 - DNA, 20 bp, Artificial Sequence
  Synthetic oligonucleotide; AAG chr2 60465505 60465524 60465521 +
atttcattttactttatggg

SEQ ID NO: 158451 - DNA, 20 bp, Artificial Sequence
  Synthetic oligonucleotide; AGG chr2 60465506 60465525 60465522 +
tttcattttactttatggga

SEQ ID NO: 158452 - DNA, 20 bp, Artificial Sequence
  Synthetic oligonucleotide; TAG chr2 60465524 60465543 60465540 +
gaaggaatgacccccatttc

SEQ ID NO: 158453 - DNA, 20 bp, Artificial Sequence
  Synthetic oligonucleotide; AAG chr2 60465545 60465564 60465561 +
agtatgtcaccaatgtgaaa

SEQ ID NO: 158454 - DNA, 20 bp, Artificial Sequence
  Synthetic oligonucleotide; AAG chr2 60465559 60465578 60465575 +
gtgaaaaagtcatgtgatct

SEQ ID NO: 158455 - DNA, 20 bp, Artificial Sequence
  Synthetic oligonucleotide; AAG chr2 60465566 60465585 60465582 +
agtcatgtgatctaagcctc

SEQ ID NO: 158456 - DNA, 20 bp, Artificial Sequence
  Synthetic oligonucleotide; CAG chr2 60465572 60465591 60465588 +
gtgatctaagcctcaagatt

SEQ ID NO: 158457 - DNA, 20 bp, Artificial Sequence
  Synthetic oligonucleotide; AAG chr2 60465575 60465594 60465591 +
atctaagcctcaagattcag

SEQ ID NO: 158458 - DNA, 20 bp, Artificial Sequence
  Synthetic oligonucleotide; AAG chr2 60465581 60465600 60465597 +
gcctcaagattcagaagaac

SEQ ID NO: 158459 - DNA, 20 bp, Artificial Sequence
  Synthetic oligonucleotide; AGG chr2 60465582 60465601 60465598 +
cctcaagattcagaagaaca

SEQ ID NO: 158460 - DNA, 20 bp, Artificial Sequence
  Synthetic oligonucleotide; GAG chr2 60465584 60465603 60465600 +
tcaagattcagaagaacaag

SEQ ID NO: 158461 - DNA, 20 bp, Artificial Sequence
  Synthetic oligonucleotide; AGG chr2 60465585 60465604 60465601 +
caagattcagaagaacaagg

SEQ ID NO: 158462 - DNA, 20 bp, Artificial Sequence
  Synthetic oligonucleotide; GAG chr2 60465591 60465610 60465607 +
tcagaagaacaaggaggtct

SEQ ID NO: 158463 - DNA, 20 bp, Artificial Sequence
  Synthetic oligonucleotide; TGG chr2 60465596 60465615 60465612 +
agaacaaggaggtctgagac

SEQ ID NO: 158464 - DNA, 20 bp, Artificial Sequence
  Synthetic oligonucleotide; GAG chr2 60465598 60465617 60465614 +
aacaaggaggtctgagactg

SEQ ID NO: 158465 - DNA, 20 bp, Artificial Sequence
  Synthetic oligonucleotide; AGG chr2 60465599 60465618 60465615 +
acaaggaggtctgagactgg

SEQ ID NO: 158466 - DNA, 20 bp, Artificial Sequence
  Synthetic oligonucleotide; TAG chr2 60465604 60465623 60465620 +
gaggtctgagactggaggcc

SEQ ID NO: 158467 - DNA, 20 bp, Artificial Sequence
  Synthetic oligonucleotide; TAG chr2 60465620 60465639 60465636 +
ggcctagctctattatccac

SEQ ID NO: 158468 - DNA, 20 bp, Artificial Sequence
  Synthetic oligonucleotide; TGG chr2 60465633 60465652 60465649 +
tatccactagattgtaactc

SEQ ID NO: 158469 - DNA, 20 bp, Artificial Sequence
  Synthetic oligonucleotide; GGG chr2 60465634 60465653 60465650 +
atccactagattgtaactct

SEQ ID NO: 158470 - DNA, 20 bp, Artificial Sequence
  Synthetic oligonucleotide; TAG chr2 60465638 60465657 60465654 +
actagattgtaactctggga

SEQ ID NO: 158471 - DNA, 20 bp, Artificial Sequence
  Synthetic oligonucleotide; GAG chr2 60465656 60465675 60465672 +
gatagtcatttgatttctct

SEQ ID NO: 158472 - DNA, 20 bp, Artificial Sequence
  Synthetic oligonucleotide; TGG chr2 60465662 60465681 60465678 +
catttgatttctctgagtct

SEQ ID NO: 158473 - DNA, 20 bp, Artificial Sequence
  Synthetic oligonucleotide; GAG chr2 60465683 60465702 60465699 +
ggaattcctatctgtaaaat

SEQ ID NO: 158474 - DNA, 20 bp, Artificial Sequence
  Synthetic oligonucleotide; CAG chr2 60465694 60465713 60465710 +
ctgtaaaatgagcataaaaa

SEQ ID NO: 158475 - DNA, 20 bp, Artificial Sequence
  Synthetic oligonucleotide; AAG chr2 60465704 60465723 60465720 +
agcataaaaacagtacctgt

SEQ ID NO: 158476 - DNA, 20 bp, Artificial Sequence
  Synthetic oligonucleotide; TGG chr2 60465713 60465732 60465729 +
acagtacctgtaagaattgt

SEQ ID NO: 158477 - DNA, 20 bp, Artificial Sequence
  Synthetic oligonucleotide; GGG chr2 60465714 60465733 60465730 +
cagtacctgtaagaattgtt

SEQ ID NO: 158478 - DNA, 20 bp, Artificial Sequence
  Synthetic oligonucleotide; AAG chr2 60465717 60465736 60465733 +
tacctgtaagaattgttggg

SEQ ID NO: 158479 - DNA, 20 bp, Artificial Sequence
  Synthetic oligonucleotide; CAG chr2 60465729 60465748 60465745 +
ttgttgggaagttcaaatga

SEQ ID NO: 158480 - DNA, 20 bp, Artificial Sequence
  Synthetic oligonucleotide; AAG chr2 60465732 60465751 60465748 +
ttgggaagttcaaatgacag

SEQ ID NO: 158481 - DNA, 20 bp, Artificial Sequence
  Synthetic oligonucleotide; AAG chr2 60465742 60465761 60465758 +
caaatgacagaagtatataa

SEQ ID NO: 158482 - DNA, 20 bp, Artificial Sequence
  Synthetic oligonucleotide; CAG chr2 60465760 60465779 60465776 +
aaaagccctctgtaaactat

SEQ ID NO: 158483 - DNA, 20 bp, Artificial Sequence
  Synthetic oligonucleotide; AGG chr2 60465761 60465780 60465777 +
aaagccctctgtaaactatc

SEQ ID NO: 158484 - DNA, 20 bp, Artificial Sequence
  Synthetic oligonucleotide; GAG chr2 60465778 60465797 60465794 +
atcaggtcgaatgtgaatgt

SEQ ID NO: 158485 - DNA, 20 bp, Artificial Sequence
  Synthetic oligonucleotide; CAG chr2 60465794 60465813 60465810 +
atgtgagttttcattactac

SEQ ID NO: 158486 - DNA, 20 bp, Artificial Sequence
  Synthetic oligonucleotide; AGG chr2 60465795 60465814 60465811 +
tgtgagttttcattactacc

SEQ ID NO: 158487 - DNA, 20 bp, Artificial Sequence
  Synthetic oligonucleotide; GGG chr2 60465796 60465815 60465812 +
gtgagttttcattactacca

SEQ ID NO: 158488 - DNA, 20 bp, Artificial Sequence
  Synthetic oligonucleotide; GGG chr2 60465797 60465816 60465813 +
tgagttttcattactaccag

SEQ ID NO: 158489 - DNA, 20 bp, Artificial Sequence
  Synthetic oligonucleotide; GAG chr2 60465812 60465831 60465828 +
accaggggtgattaattact

SEQ ID NO: 158490 - DNA, 20 bp, Artificial Sequence
  Synthetic oligonucleotide; AGG chr2 60465813 60465832 60465829 +
ccaggggtgattaattactg

SEQ ID NO: 158491 - DNA, 20 bp, Artificial Sequence
  Synthetic oligonucleotide; GGG chr2 60465814 60465833 60465830 +
caggggtgattaattactga

SEQ ID NO: 158492 - DNA, 20 bp, Artificial Sequence
  Synthetic oligonucleotide; CGG chr2 60465846 60465865 60465862 +
accacattacacaccccgaa

SEQ ID NO: 158493 - DNA, 20 bp, Artificial Sequence
  Synthetic oligonucleotide; CAG chr2 60465853 60465872 60465869 +
tacacaccccgaacggcttc

SEQ ID NO: 158494 - DNA, 20 bp, Artificial Sequence
  Synthetic oligonucleotide; GAG chr2 60465855 60465874 60465871 +
cacaccccgaacggcttcca

SEQ ID NO: 158495 - DNA, 20 bp, Artificial Sequence
  Synthetic oligonucleotide; AGG chr2 60465856 60465875 60465872 +
acaccccgaacggcttccag

SEQ ID NO: 158496 - DNA, 20 bp, Artificial Sequence
  Synthetic oligonucleotide; AAG chr2 60465859 60465878 60465875 +
ccccgaacggcttccagagg

SEQ ID NO: 158497 - DNA, 20 bp, Artificial Sequence
  Synthetic oligonucleotide; AGG chr2 60465860 60465879 60465876 +
cccgaacggcttccagagga

SEQ ID NO: 158498 - DNA, 20 bp, Artificial Sequence
  Synthetic oligonucleotide; CAG chr2 60465866 60465885 60465882 +
cggcttccagaggaaggtcc

SEQ ID NO: 158499 - DNA, 20 bp, Artificial Sequence
  Synthetic oligonucleotide; CAG chr2 60465871 60465890 60465887 +
tccagaggaaggtcccagtc

SEQ ID NO: 158500 - DNA, 20 bp, Artificial Sequence
  Synthetic oligonucleotide; AGG chr2 60465872 60465891 60465888 +
ccagaggaaggtcccagtcc

SEQ ID NO: 158501 - DNA, 20 bp, Artificial Sequence
  Synthetic oligonucleotide; CAG chr2 60465883 60465902 60465899 +
tcccagtccaggccttaacc

SEQ ID NO: 158502 - DNA, 20 bp, Artificial Sequence
  Synthetic oligonucleotide; AGG chr2 60465884 60465903 60465900 +
cccagtccaggccttaaccc

SEQ ID NO: 158503 - DNA, 20 bp, Artificial Sequence
  Synthetic oligonucleotide; AAG chr2 60465891 60465910 60465907 +
caggccttaacccaggccaa

SEQ ID NO: 158504 - DNA, 20 bp, Artificial Sequence
  Synthetic oligonucleotide; AGG chr2 60465892 60465911 60465908 +
aggccttaacccaggccaaa

SEQ ID NO: 158505 - DNA, 20 bp, Artificial Sequence
  Synthetic oligonucleotide; GAG chr2 60465894 60465913 60465910 +
gccttaacccaggccaaaag

SEQ ID NO: 158506 - DNA, 20 bp, Artificial Sequence
  Synthetic oligonucleotide; AGG chr2 60465895 60465914 60465911 +
ccttaacccaggccaaaagg

SEQ ID NO: 158507 - DNA, 20 bp, Artificial Sequence
  Synthetic oligonucleotide; TAG chr2 60465901 60465920 60465917 +
cccaggccaaaaggaggctc

SEQ ID NO: 158508 - DNA, 20 bp, Artificial Sequence
  Synthetic oligonucleotide; AAG chr2 60465907 60465926 60465923 +
ccaaaaggaggctctagtta

SEQ ID NO: 158509 - DNA, 20 bp, Artificial Sequence
  Synthetic oligonucleotide; GAG chr2 60465909 60465928 60465925 +
aaaaggaggctctagttaaa

SEQ ID NO: 158510 - DNA, 20 bp, Artificial Sequence
  Synthetic oligonucleotide; CAG chr2 60465912 60465931 60465928 +
aggaggctctagttaaagag

SEQ ID NO: 158511 - DNA, 20 bp, Artificial Sequence
  Synthetic oligonucleotide; AGG chr2 60465913 60465932 60465929 +
ggaggctctagttaaagagc

SEQ ID NO: 158512 - DNA, 20 bp, Artificial Sequence
  Synthetic oligonucleotide; GGG chr2 60465914 60465933 60465930 +
gaggctctagttaaagagca

SEQ ID NO: 158513 - DNA, 20 bp, Artificial Sequence
  Synthetic oligonucleotide; GGG chr2 60465915 60465934 60465931 +
aggctctagttaaagagcag

SEQ ID NO: 158514 - DNA, 20 bp, Artificial Sequence
  Synthetic oligonucleotide; TGG chr2 60465922 60465941 60465938 +
agttaaagagcaggggtgac

SEQ ID NO: 158515 - DNA, 20 bp, Artificial Sequence
  Synthetic oligonucleotide; CAG chr2 60465929 60465948 60465945 +
gagcaggggtgactggcaca

SEQ ID NO: 158516 - DNA, 20 bp, Artificial Sequence
  Synthetic oligonucleotide; CAG chr2 60465932 60465951 60465948 +
caggggtgactggcacacag

SEQ ID NO: 158517 - DNA, 20 bp, Artificial Sequence
  Synthetic oligonucleotide; GAG chr2 60465934 60465953 60465950 +
ggggtgactggcacacagca

SEQ ID NO: 158518 - DNA, 20 bp, Artificial Sequence
  Synthetic oligonucleotide; TGG chr2 60465937 60465956 60465953 +
gtgactggcacacagcagag

SEQ ID NO: 158519 - DNA, 20 bp, Artificial Sequence
  Synthetic oligonucleotide; CAG chr2 60465943 60465962 60465959 +
ggcacacagcagagtggcca

SEQ ID NO: 158520 - DNA, 20 bp, Artificial Sequence
  Synthetic oligonucleotide; AGG chr2 60465944 60465963 60465960 +
gcacacagcagagtggccac

SEQ ID NO: 158521 - DNA, 20 bp, Artificial Sequence
  Synthetic oligonucleotide; GGG chr2 60465945 60465964 60465961 +
cacacagcagagtggccaca

SEQ ID NO: 158522 - DNA, 20 bp, Artificial Sequence
  Synthetic oligonucleotide; AAG chr2 60465948 60465967 60465964 +
acagcagagtggccacaggg

SEQ ID NO: 158523 - DNA, 20 bp, Artificial Sequence
  Synthetic oligonucleotide; GAG chr2 60465957 60465976 60465973 +
tggccacagggaagtgctat

SEQ ID NO: 158524 - DNA, 20 bp, Artificial Sequence
  Synthetic oligonucleotide; TGG chr2 60465963 60465982 60465979 +
cagggaagtgctatgagctc

SEQ ID NO: 158525 - DNA, 20 bp, Artificial Sequence
  Synthetic oligonucleotide; AAG chr2 60465966 60465985 60465982 +
ggaagtgctatgagctctgg

SEQ ID NO: 158526 - DNA, 20 bp, Artificial Sequence
  Synthetic oligonucleotide; CAG chr2 60465970 60465989 60465986 +
gtgctatgagctctggaagc

SEQ ID NO: 158527 - DNA, 20 bp, Artificial Sequence
  Synthetic oligonucleotide; AGG chr2 60465971 60465990 60465987 +
tgctatgagctctggaagcc

SEQ ID NO: 158528 - DNA, 20 bp, Artificial Sequence
  Synthetic oligonucleotide; GGG chr2 60465972 60465991 60465988 +
gctatgagctctggaagcca

SEQ ID NO: 158529 - DNA, 20 bp, Artificial Sequence
  Synthetic oligonucleotide; GGG chr2 60465973 60465992 60465989 +
ctatgagctctggaagccag

SEQ ID NO: 158530 - DNA, 20 bp, Artificial Sequence
  Synthetic oligonucleotide; CAG chr2 60465976 60465995 60465992 +
tgagctctggaagccagggg

SEQ ID NO: 158531 - DNA, 20 bp, Artificial Sequence
  Synthetic oligonucleotide; CAG chr2 60465979 60465998 60465995 +
gctctggaagccaggggcag

SEQ ID NO: 158532 - DNA, 20 bp, Artificial Sequence
  Synthetic oligonucleotide; AGG chr2 60465980 60465999 60465996 +
ctctggaagccaggggcagc

SEQ ID NO: 158533 - DNA, 20 bp, Artificial Sequence
  Synthetic oligonucleotide; AAG chr2 60465994 60466013 60466010 +
ggcagcaggttaatgccgcc

SEQ ID NO: 158534 - DNA, 20 bp, Artificial Sequence
  Synthetic oligonucleotide; TGG chr2 60465997 60466016 60466013 +
agcaggttaatgccgccaag

SEQ ID NO: 158535 - DNA, 20 bp, Artificial Sequence
  Synthetic oligonucleotide; TGG chr2 60466002 60466021 60466018 +
gttaatgccgccaagtggaa

SEQ ID NO: 158536 - DNA, 20 bp, Artificial Sequence
  Synthetic oligonucleotide; GGG chr2 60466003 60466022 60466019 +
ttaatgccgccaagtggaat

SEQ ID NO: 158537 - DNA, 20 bp, Artificial Sequence
  Synthetic oligonucleotide; CAG chr2 60466009 60466028 60466025 +
ccgccaagtggaatgggcat

SEQ ID NO: 158538 - DNA, 20 bp, Artificial Sequence
  Synthetic oligonucleotide; AGG chr2 60466010 60466029 60466026 +
cgccaagtggaatgggcatc

SEQ ID NO: 158539 - DNA, 20 bp, Artificial Sequence
  Synthetic oligonucleotide; TAG chr2 60466020 60466039 60466036 +
aatgggcatcaggtttgttc

SEQ ID NO: 158540 - DNA, 20 bp, Artificial Sequence
  Synthetic oligonucleotide; GAG chr2 60466022 60466041 60466038 +
tgggcatcaggtttgttcta

SEQ ID NO: 158541 - DNA, 20 bp, Artificial Sequence
  Synthetic oligonucleotide; TGG chr2 60466030 60466049 60466046 +
aggtttgttctagagctttc

SEQ ID NO: 158542 - DNA, 20 bp, Artificial Sequence
  Synthetic oligonucleotide; TGG chr2 60466065 60466084 60466081 +
cacttccacataccttgttc

SEQ ID NO: 158543 - DNA, 20 bp, Artificial Sequence
  Synthetic oligonucleotide; TGG chr2 60466080 60466099 60466096 +
tgttctggtcactcctaaat

SEQ ID NO: 158544 - DNA, 20 bp, Artificial Sequence
  Synthetic oligonucleotide; CAG chr2 60466089 60466108 60466105 +
cactcctaaattggtcctgc

SEQ ID NO: 158545 - DNA, 20 bp, Artificial Sequence
  Synthetic oligonucleotide; CAG chr2 60466092 60466111 60466108 +
tcctaaattggtcctgccag

SEQ ID NO: 158546 - DNA, 20 bp, Artificial Sequence
  Synthetic oligonucleotide; AGG chr2 60466093 60466112 60466109 +
cctaaattggtcctgccagc

SEQ ID NO: 158547 - DNA, 20 bp, Artificial Sequence
  Synthetic oligonucleotide; GGG chr2 60466094 60466113 60466110 +
ctaaattggtcctgccagca

SEQ ID NO: 158548 - DNA, 20 bp, Artificial Sequence
  Synthetic oligonucleotide; GGG chr2 60466095 60466114 60466111 +
taaattggtcctgccagcag

SEQ ID NO: 158549 - DNA, 20 bp, Artificial Sequence
  Synthetic oligonucleotide; CAG chr2 60466101 60466120 60466117 +
ggtcctgccagcaggggcac

SEQ ID NO: 158550 - DNA, 20 bp, Artificial Sequence
  Synthetic oligonucleotide; TGG chr2 60466126 60466145 60466142 +
aactatgtaccctccctttg

SEQ ID NO: 158551 - DNA, 20 bp, Artificial Sequence
  Synthetic oligonucleotide; GGG chr2 60466127 60466146 60466143 +
actatgtaccctccctttgt

SEQ ID NO: 158552 - DNA, 20 bp, Artificial Sequence
  Synthetic oligonucleotide; AAG chr2 60466130 60466149 60466146 +
atgtaccctccctttgtggg

SEQ ID NO: 158553 - DNA, 20 bp, Artificial Sequence
  Synthetic oligonucleotide; AGG chr2 60466131 60466150 60466147 +
tgtaccctccctttgtggga

SEQ ID NO: 158554 - DNA, 20 bp, Artificial Sequence
  Synthetic oligonucleotide; TGG chr2 60466134 60466153 60466150 +
accctccctttgtgggaagg

SEQ ID NO: 158555 - DNA, 20 bp, Artificial Sequence
  Synthetic oligonucleotide; GGG chr2 60466135 60466154 60466151 +
ccctccctttgtgggaaggt

SEQ ID NO: 158556 - DNA, 20 bp, Artificial Sequence
  Synthetic oligonucleotide; GAG chr2 60466137 60466156 60466153 +
ctccctttgtgggaaggtgg

SEQ ID NO: 158557 - DNA, 20 bp, Artificial Sequence
  Synthetic oligonucleotide; GAG chr2 60466139 60466158 60466155 +
ccctttgtgggaaggtggga

SEQ ID NO: 158558 - DNA, 20 bp, Artificial Sequence
  Synthetic oligonucleotide; AGG chr2 60466140 60466159 60466156 +
cctttgtgggaaggtgggag

SEQ ID NO: 158559 - DNA, 20 bp, Artificial Sequence
  Synthetic oligonucleotide; CAG chr2 60466144 60466163 60466160 +
tgtgggaaggtgggagagga

SEQ ID NO: 158560 - DNA, 20 bp, Artificial Sequence
  Synthetic oligonucleotide; AGG chr2 60466145 60466164 60466161 +
gtgggaaggtgggagaggac

SEQ ID NO: 158561 - DNA, 20 bp, Artificial Sequence
  Synthetic oligonucleotide; GGG chr2 60466146 60466165 60466162 +
tgggaaggtgggagaggaca

SEQ ID NO: 158562 - DNA, 20 bp, Artificial Sequence
  Synthetic oligonucleotide; GGG chr2 60466147 60466166 60466163 +
gggaaggtgggagaggacag

SEQ ID NO: 158563 - DNA, 20 bp, Artificial Sequence
  Synthetic oligonucleotide; AAG chr2 60466159 60466178 60466175 +
gaggacaggggttccctatc

SEQ ID NO: 158564 - DNA, 20 bp, Artificial Sequence
  Synthetic oligonucleotide; CAG chr2 60466164 60466183 60466180 +
caggggttccctatcaagct

SEQ ID NO: 158565 - DNA, 20 bp, Artificial Sequence
  Synthetic oligonucleotide; CAG chr2 60466177 60466196 60466193 +
tcaagctcagactttcctac

SEQ ID NO: 158566 - DNA, 20 bp, Artificial Sequence
  Synthetic oligonucleotide; CAG chr2 60466194 60466213 60466210 +
taccagtcaaatcaaactcc

SEQ ID NO: 158567 - DNA, 20 bp, Artificial Sequence
  Synthetic oligonucleotide; CAG chr2 60466201 60466220 60466217 +
caaatcaaactcccagccct

SEQ ID NO: 158568 - DNA, 20 bp, Artificial Sequence
  Synthetic oligonucleotide; AGG chr2 60466202 60466221 60466218 +
aaatcaaactcccagccctc

SEQ ID NO: 158569 - DNA, 20 bp, Artificial Sequence
  Synthetic oligonucleotide; AAG chr2 60466205 60466224 60466221 +
tcaaactcccagccctcagg

SEQ ID NO: 158570 - DNA, 20 bp, Artificial Sequence
  Synthetic oligonucleotide; CAG chr2 60466210 60466229 60466226 +
ctcccagccctcaggaagac

SEQ ID NO: 158571 - DNA, 20 bp, Artificial Sequence
  Synthetic oligonucleotide; AGG chr2 60466211 60466230 60466227 +
tcccagccctcaggaagacc

SEQ ID NO: 158572 - DNA, 20 bp, Artificial Sequence
  Synthetic oligonucleotide; AAG chr2 60466217 60466236 60466233 +
ccctcaggaagaccaggctg

SEQ ID NO: 158573 - DNA, 20 bp, Artificial Sequence
  Synthetic oligonucleotide; GAG chr2 60466223 60466242 60466239 +
ggaagaccaggctgaagacc

SEQ ID NO: 158574 - DNA, 20 bp, Artificial Sequence
  Synthetic oligonucleotide; TGG chr2 60466239 60466258 60466255 +
gaccgagaactatgtttccc

SEQ ID NO: 158575 - DNA, 20 bp, Artificial Sequence
  Synthetic oligonucleotide; CAG chr2 60466245 60466264 60466261 +
gaactatgtttccctggcaa

SEQ ID NO: 158576 - DNA, 20 bp, Artificial Sequence
  Synthetic oligonucleotide; TGG chr2 60466252 60466271 60466268 +
gtttccctggcaacagccct

SEQ ID NO: 158577 - DNA, 20 bp, Artificial Sequence
  Synthetic oligonucleotide; AAG chr2 60466312 60466331 60466328 +
cttctatcccttccctccaa

SEQ ID NO: 158578 - DNA, 20 bp, Artificial Sequence
  Synthetic oligonucleotide; TGG chr2 60466315 60466334 60466331 +
ctatcccttccctccaaaag

SEQ ID NO: 158579 - DNA, 20 bp, Artificial Sequence
  Synthetic oligonucleotide; CAG chr2 60466329 60466348 60466345 +
caaaagtggctccgtttcca

SEQ ID NO: 158580 - DNA, 20 bp, Artificial Sequence
  Synthetic oligonucleotide; CAG chr2 60466339 60466358 60466355 +
tccgtttccacagccccatg

SEQ ID NO: 158581 - DNA, 20 bp, Artificial Sequence
  Synthetic oligonucleotide; AGG chr2 60466340 60466359 60466356 +
ccgtttccacagccccatgc

SEQ ID NO: 158582 - DNA, 20 bp, Artificial Sequence
  Synthetic oligonucleotide; CAG chr2 60466346 60466365 60466362 +
ccacagccccatgcaggccc

SEQ ID NO: 158583 - DNA, 20 bp, Artificial Sequence
  Synthetic oligonucleotide; CAG chr2 60466356 60466375 60466372 +
atgcaggccccagatgcccc

SEQ ID NO: 158584 - DNA, 20 bp, Artificial Sequence
  Synthetic oligonucleotide; CAG chr2 60466362 60466381 60466378 +
gccccagatgcccccagcaa

SEQ ID NO: 158585 - DNA, 20 bp, Artificial Sequence
  Synthetic oligonucleotide; AGG chr2 60466363 60466382 60466379 +
ccccagatgcccccagcaac

SEQ ID NO: 158586 - DNA, 20 bp, Artificial Sequence
  Synthetic oligonucleotide; GAG chr2 60466365 60466384 60466381 +
ccagatgcccccagcaacag

SEQ ID NO: 158587 - DNA, 20 bp, Artificial Sequence
  Synthetic oligonucleotide; GAG chr2 60466367 60466386 60466383 +
agatgcccccagcaacagga

SEQ ID NO: 158588 - DNA, 20 bp, Artificial Sequence
  Synthetic oligonucleotide; CAG chr2 60466381 60466400 60466397 +
acaggagagctctccccacc

SEQ ID NO: 158589 - DNA, 20 bp, Artificial Sequence
  Synthetic oligonucleotide; CAG chr2 60466385 60466404 60466401 +
gagagctctccccacccagc

SEQ ID NO: 158590 - DNA, 20 bp, Artificial Sequence
  Synthetic oligonucleotide; CAG chr2 60466392 60466411 60466408 +
ctccccacccagccagcatg

SEQ ID NO: 158591 - DNA, 20 bp, Artificial Sequence
  Synthetic oligonucleotide; AGG chr2 60466393 60466412 60466409 +
tccccacccagccagcatgc

SEQ ID NO: 158592 - DNA, 20 bp, Artificial Sequence
  Synthetic oligonucleotide; GGG chr2 60466394 60466413 60466410 +
ccccacccagccagcatgca

SEQ ID NO: 158593 - DNA, 20 bp, Artificial Sequence
  Synthetic oligonucleotide; TAG chr2 60466399 60466418 60466415 +
cccagccagcatgcagggac

SEQ ID NO: 158594 - DNA, 20 bp, Artificial Sequence
  Synthetic oligonucleotide; GAG chr2 60466409 60466428 60466425 +
atgcagggactagaaaccgt

SEQ ID NO: 158595 - DNA, 20 bp, Artificial Sequence
  Synthetic oligonucleotide; CAG chr2 60466450 60466469 60466466 +
ctgcaatctgtgacctaacc

SEQ ID NO: 158596 - DNA, 20 bp, Artificial Sequence
  Synthetic oligonucleotide; AGG chr2 60466451 60466470 60466467 +
tgcaatctgtgacctaaccc

SEQ ID NO: 158597 - DNA, 20 bp, Artificial Sequence
  Synthetic oligonucleotide; TAG chr2 60466456 60466475 60466472 +
tctgtgacctaacccaggct

SEQ ID NO: 158598 - DNA, 20 bp, Artificial Sequence
  Synthetic oligonucleotide; AGG chr2 60466457 60466476 60466473 +
ctgtgacctaacccaggctt

SEQ ID NO: 158599 - DNA, 20 bp, Artificial Sequence
  Synthetic oligonucleotide; CAG chr2 60466462 60466481 60466478 +
acctaacccaggcttaggcc

SEQ ID NO: 158600 - DNA, 20 bp, Artificial Sequence
  Synthetic oligonucleotide; TGG chr2 60466467 60466486 60466483 +
acccaggcttaggcccagct

SEQ ID NO: 158601 - DNA, 20 bp, Artificial Sequence
  Synthetic oligonucleotide; GGG chr2 60466468 60466487 60466484 +
cccaggcttaggcccagctt

SEQ ID NO: 158602 - DNA, 20 bp, Artificial Sequence
  Synthetic oligonucleotide; GGG chr2 60466469 60466488 60466485 +
ccaggcttaggcccagcttg

SEQ ID NO: 158603 - DNA, 20 bp, Artificial Sequence
  Synthetic oligonucleotide; GGG chr2 60466470 60466489 60466486 +
caggcttaggcccagcttgg

SEQ ID NO: 158604 - DNA, 20 bp, Artificial Sequence
  Synthetic oligonucleotide; AAG chr2 60466473 60466492 60466489 +
gcttaggcccagcttggggg

SEQ ID NO: 158605 - DNA, 20 bp, Artificial Sequence
  Synthetic oligonucleotide; AGG chr2 60466474 60466493 60466490 +
cttaggcccagcttggggga

SEQ ID NO: 158606 - DNA, 20 bp, Artificial Sequence
  Synthetic oligonucleotide; GGG chr2 60466475 60466494 60466491 +
ttaggcccagcttgggggaa

SEQ ID NO: 158607 - DNA, 20 bp, Artificial Sequence
  Synthetic oligonucleotide; GAG chr2 60466477 60466496 60466493 +
aggcccagcttgggggaagg

SEQ ID NO: 158608 - DNA, 20 bp, Artificial Sequence
  Synthetic oligonucleotide; CAG chr2 60466480 60466499 60466496 +
cccagcttgggggaagggag

SEQ ID NO: 158609 - DNA, 20 bp, Artificial Sequence
  Synthetic oligonucleotide; GAG chr2 60466485 60466504 60466501 +
cttgggggaagggagcagat

SEQ ID NO: 158610 - DNA, 20 bp, Artificial Sequence
  Synthetic oligonucleotide; AGG chr2 60466486 60466505 60466502 +
ttgggggaagggagcagatg

SEQ ID NO: 158611 - DNA, 20 bp, Artificial Sequence
  Synthetic oligonucleotide; CAG chr2 60466511 60466530 60466527 +
cttttaacccctgaaccacc

SEQ ID NO: 158612 - DNA, 20 bp, Artificial Sequence
  Synthetic oligonucleotide; CAG chr2 60466518 60466537 60466534 +
cccctgaaccacccagccct

SEQ ID NO: 158613 - DNA, 20 bp, Artificial Sequence
  Synthetic oligonucleotide; AGG chr2 60466519 60466538 60466535 +
ccctgaaccacccagccctc

SEQ ID NO: 158614 - DNA, 20 bp, Artificial Sequence
  Synthetic oligonucleotide; GAG chr2 60466526 60466545 60466542 +
ccacccagccctcaggacct

SEQ ID NO: 158615 - DNA, 20 bp, Artificial Sequence
  Synthetic oligonucleotide; AGG chr2 60466527 60466546 60466543 +
cacccagccctcaggacctg

SEQ ID NO: 158616 - DNA, 20 bp, Artificial Sequence
  Synthetic oligonucleotide; GGG chr2 60466528 60466547 60466544 +
acccagccctcaggacctga

SEQ ID NO: 158617 - DNA, 20 bp, Artificial Sequence
  Synthetic oligonucleotide; TAG chr2 60466564 60466583 60466580 +
cacaataactctttgttacc

SEQ ID NO: 158618 - DNA, 20 bp, Artificial Sequence
  Synthetic oligonucleotide; AGG chr2 60466565 60466584 60466581 +
acaataactctttgttacct

SEQ ID NO: 158619 - DNA, 20 bp, Artificial Sequence
  Synthetic oligonucleotide; TAG chr2 60466574 60466593 60466590 +
ctttgttacctaggattacc

SEQ ID NO: 158620 - DNA, 20 bp, Artificial Sequence
  Synthetic oligonucleotide; AGG chr2 60466575 60466594 60466591 +
tttgttacctaggattacct

SEQ ID NO: 158621 - DNA, 20 bp, Artificial Sequence
  Synthetic oligonucleotide; GAG chr2 60466577 60466596 60466593 +
tgttacctaggattacctag

SEQ ID NO: 158622 - DNA, 20 bp, Artificial Sequence
  Synthetic oligonucleotide; TGG chr2 60466598 60466617 60466614 +
agttaacaaaaataaacaac

SEQ ID NO: 158623 - DNA, 20 bp, Artificial Sequence
  Synthetic oligonucleotide; TGG chr2 60466610 60466629 60466626 +
taaacaactggctttgaatc

SEQ ID NO: 158624 - DNA, 20 bp, Artificial Sequence
  Synthetic oligonucleotide; CAG chr2 60466616 60466635 60466632 +
actggctttgaatctggtct

SEQ ID NO: 158625 - DNA, 20 bp, Artificial Sequence
  Synthetic oligonucleotide; AGG chr2 60466617 60466636 60466633 +
ctggctttgaatctggtctc

SEQ ID NO: 158626 - DNA, 20 bp, Artificial Sequence
  Synthetic oligonucleotide; GGG chr2 60466618 60466637 60466634 +
tggctttgaatctggtctca

SEQ ID NO: 158627 - DNA, 20 bp, Artificial Sequence
  Synthetic oligonucleotide; CAG chr2 60466637 60466656 60466653 +
agggtgcatgccctgctctt

SEQ ID NO: 158628 - DNA, 20 bp, Artificial Sequence
  Synthetic oligonucleotide; AAG chr2 60466651 60466670 60466667 +
gctcttcagataccatttac

SEQ ID NO: 158629 - DNA, 20 bp, Artificial Sequence
  Synthetic oligonucleotide; TGG chr2 60466655 60466674 60466671 +
ttcagataccatttacaaga

SEQ ID NO: 158630 - DNA, 20 bp, Artificial Sequence
  Synthetic oligonucleotide; GGG chr2 60466656 60466675 60466672 +
tcagataccatttacaagat

SEQ ID NO: 158631 - DNA, 20 bp, Artificial Sequence
  Synthetic oligonucleotide; AAG chr2 60466660 60466679 60466676 +
ataccatttacaagatgggt

SEQ ID NO: 158632 - DNA, 20 bp, Artificial Sequence
  Synthetic oligonucleotide; CAG chr2 60466687 60466706 60466703 +
atctccctcccatctaaaaa

SEQ ID NO: 158633 - DNA, 20 bp, Artificial Sequence
  Synthetic oligonucleotide; TAG chr2 60466697 60466716 60466713 +
catctaaaaacagtccccct

SEQ ID NO: 158634 - DNA, 20 bp, Artificial Sequence
  Synthetic oligonucleotide; GAG chr2 60466699 60466718 60466715 +
tctaaaaacagtccccctta

SEQ ID NO: 158635 - DNA, 20 bp, Artificial Sequence
  Synthetic oligonucleotide; TGG chr2 60466711 60466730 60466727 +
cccccttagagccttaactc

SEQ ID NO: 158636 - DNA, 20 bp, Artificial Sequence
  Synthetic oligonucleotide; CAG chr2 60466775 60466794 60466791 +
tttctttttttttctttcca

SEQ ID NO: 158637 - DNA, 20 bp, Artificial Sequence
  Synthetic oligonucleotide; CAG chr2 60466778 60466797 60466794 +
ctttttttttctttccacag

SEQ ID NO: 158638 - DNA, 20 bp, Artificial Sequence
  Synthetic oligonucleotide; AGG chr2 60466779 60466798 60466795 +
tttttttttctttccacagc

SEQ ID NO: 158639 - DNA, 20 bp, Artificial Sequence
  Synthetic oligonucleotide; TAG chr2 60466811 60466830 60466827 +
atttactttcaaataaaaat

SEQ ID NO: 158640 - DNA, 20 bp, Artificial Sequence
  Synthetic oligonucleotide; TAG chr2 60466855 60466874 60466871 +
tgaacctgcttttttgtgtt

SEQ ID NO: 158641 - DNA, 20 bp, Artificial Sequence
  Synthetic oligonucleotide; AGG chr2 60466856 60466875 60466872 +
gaacctgcttttttgtgttt

SEQ ID NO: 158642 - DNA, 20 bp, Artificial Sequence
  Synthetic oligonucleotide; GGG chr2 60466857 60466876 60466873 +
aacctgcttttttgtgttta

SEQ ID NO: 158643 - DNA, 20 bp, Artificial Sequence
  Synthetic oligonucleotide; TGG chr2 60466860 60466879 60466876 +
ctgcttttttgtgtttaggg

SEQ ID NO: 158644 - DNA, 20 bp, Artificial Sequence
  Synthetic oligonucleotide; TAG chr2 60466888 60466907 60466904 +
ctgcccaccccctaaccttt

SEQ ID NO: 158645 - DNA, 20 bp, Artificial Sequence
  Synthetic oligonucleotide; CAG chr2 60466922 60466941 60466938 +
tcataccatgtgttcctaca

SEQ ID NO: 158646 - DNA, 20 bp, Artificial Sequence
  Synthetic oligonucleotide; GAG chr2 60466924 60466943 60466940 +
ataccatgtgttcctacaca

SEQ ID NO: 158647 - DNA, 20 bp, Artificial Sequence
  Synthetic oligonucleotide; AAG chr2 60466927 60466946 60466943 +
ccatgtgttcctacacagag

SEQ ID NO: 158648 - DNA, 20 bp, Artificial Sequence
  Synthetic oligonucleotide; CAG chr2 60466952 60466971 60466968 +
aactgtattattttctaaaa

SEQ ID NO: 158649 - DNA, 20 bp, Artificial Sequence
  Synthetic oligonucleotide; CAG chr2 60466962 60466981 60466978 +
ttttctaaaacagtatcttt

SEQ ID NO: 158650 - DNA, 20 bp, Artificial Sequence
  Synthetic oligonucleotide; TGG chr2 60466981 60467000 60466997 +
tcagaaaacatttgtataaa

SEQ ID NO: 158651 - DNA, 20 bp, Artificial Sequence
  Synthetic oligonucleotide; AAG chr2 60466992 60467011 60467008 +
ttgtataaatggacaaattt

SEQ ID NO: 158652 - DNA, 20 bp, Artificial Sequence
  Synthetic oligonucleotide; TGG chr2 60467005 60467024 60467021 +
caaatttaagtttcataaaa

SEQ ID NO: 158653 - DNA, 20 bp, Artificial Sequence
  Synthetic oligonucleotide; AAG chr2 60467020 60467039 60467036 +
taaaatggtccctactataa

SEQ ID NO: 158654 - DNA, 20 bp, Artificial Sequence
  Synthetic oligonucleotide; AAG chr2 60467034 60467053 60467050 +
ctataaaagctcacttgaac

SEQ ID NO: 158655 - DNA, 20 bp, Artificial Sequence
  Synthetic oligonucleotide; TGG chr2 60467041 60467060 60467057 +
agctcacttgaacaagtaaa

SEQ ID NO: 158656 - DNA, 20 bp, Artificial Sequence
  Synthetic oligonucleotide; TGG chr2 60467044 60467063 60467060 +
tcacttgaacaagtaaatgg

SEQ ID NO: 158657 - DNA, 20 bp, Artificial Sequence
  Synthetic oligonucleotide; TGG chr2 60467047 60467066 60467063 +
cttgaacaagtaaatggtgg

SEQ ID NO: 158658 - DNA, 20 bp, Artificial Sequence
  Synthetic oligonucleotide; CAG chr2 60467050 60467069 60467066 +
gaacaagtaaatggtggtgg

SEQ ID NO: 158659 - DNA, 20 bp, Artificial Sequence
  Synthetic oligonucleotide; TGG chr2 60467053 60467072 60467069 +
caagtaaatggtggtggcag

SEQ ID NO: 158660 - DNA, 20 bp, Artificial Sequence
  Synthetic oligonucleotide; TGG chr2 60467056 60467075 60467072 +
gtaaatggtggtggcagtgg

SEQ ID NO: 158661 - DNA, 20 bp, Artificial Sequence
  Synthetic oligonucleotide; TGG chr2 60467059 60467078 60467075 +
aatggtggtggcagtggtgg

SEQ ID NO: 158662 - DNA, 20 bp, Artificial Sequence
  Synthetic oligonucleotide; TGG chr2 60467062 60467081 60467078 +
ggtggtggcagtggtggtgg

SEQ ID NO: 158663 - DNA, 20 bp, Artificial Sequence
  Synthetic oligonucleotide; TGG chr2 60467065 60467084 60467081 +
ggtggcagtggtggtggtgg

SEQ ID NO: 158664 - DNA, 20 bp, Artificial Sequence
  Synthetic oligonucleotide; TGG chr2 60467068 60467087 60467084 +
ggcagtggtggtggtggtgg

SEQ ID NO: 158665 - DNA, 20 bp, Artificial Sequence
  Synthetic oligonucleotide; TGG chr2 60467071 60467090 60467087 +
agtggtggtggtggtggtgg

SEQ ID NO: 158666 - DNA, 20 bp, Artificial Sequence
  Synthetic oligonucleotide; TGG chr2 60467080 60467099 60467096 +
ggtggtggtggtggtgatga

SEQ ID NO: 158667 - DNA, 20 bp, Artificial Sequence
  Synthetic oligonucleotide; TGG chr2 60467083 60467102 60467099 +
ggtggtggtggtgatgatgg

SEQ ID NO: 158668 - DNA, 20 bp, Artificial Sequence
  Synthetic oligonucleotide; TGG chr2 60467086 60467105 60467102 +
ggtggtggtgatgatggtgg

SEQ ID NO: 158669 - DNA, 20 bp, Artificial Sequence
  Synthetic oligonucleotide; TAG chr2 60467089 60467108 60467105 +
ggtggtgatgatggtggtgg

SEQ ID NO: 158670 - DNA, 20 bp, Artificial Sequence
  Synthetic oligonucleotide; TGG chr2 60467092 60467111 60467108 +
ggtgatgatggtggtggtag

SEQ ID NO: 158671 - DNA, 20 bp, Artificial Sequence
  Synthetic oligonucleotide; TGG chr2 60467095 60467114 60467111 +
gatgatggtggtggtagtgg

SEQ ID NO: 158672 - DNA, 20 bp, Artificial Sequence
  Synthetic oligonucleotide; TGG chr2 60467098 60467117 60467114 +
gatggtggtggtagtggtgg

SEQ ID NO: 158673 - DNA, 20 bp, Artificial Sequence
  Synthetic oligonucleotide; TGG chr2 60467101 60467120 60467117 +
ggtggtggtagtggtggtgg

SEQ ID NO: 158674 - DNA, 20 bp, Artificial Sequence
  Synthetic oligonucleotide; TGG chr2 60467104 60467123 60467120 +
ggtggtagtggtggtggtgg

SEQ ID NO: 158675 - DNA, 20 bp, Artificial Sequence
  Synthetic oligonucleotide; TGG chr2 60467110 60467129 60467126 +
agtggtggtggtggtggtga

SEQ ID NO: 158676 - DNA, 20 bp, Artificial Sequence
  Synthetic oligonucleotide; TGG chr2 60467113 60467132 60467129 +
ggtggtggtggtggtgatgg

SEQ ID NO: 158677 - DNA, 20 bp, Artificial Sequence
  Synthetic oligonucleotide; TGG chr2 60467119 60467138 60467135 +
ggtggtggtgatggtggtgt

SEQ ID NO: 158678 - DNA, 20 bp, Artificial Sequence
  Synthetic oligonucleotide; TGG chr2 60467122 60467141 60467138 +
ggtggtgatggtggtgttgg

SEQ ID NO: 158679 - DNA, 20 bp, Artificial Sequence
  Synthetic oligonucleotide; TGG chr2 60467128 60467147 60467144 +
gatggtggtgttggtggtga

SEQ ID NO: 158680 - DNA, 20 bp, Artificial Sequence
  Synthetic oligonucleotide; TGG chr2 60467131 60467150 60467147 +
ggtggtgttggtggtgatgg

SEQ ID NO: 158681 - DNA, 20 bp, Artificial Sequence
  Synthetic oligonucleotide; TGG chr2 60467134 60467153 60467150 +
ggtgttggtggtgatggtgg

SEQ ID NO: 158682 - DNA, 20 bp, Artificial Sequence
  Synthetic oligonucleotide; TGG chr2 60467137 60467156 60467153 +
gttggtggtgatggtggtgg

SEQ ID NO: 158683 - DNA, 20 bp, Artificial Sequence
  Synthetic oligonucleotide; TGG chr2 60467140 60467159 60467156 +
ggtggtgatggtggtggtgg

SEQ ID NO: 158684 - DNA, 20 bp, Artificial Sequence
  Synthetic oligonucleotide; TGG chr2 60467143 60467162 60467159 +
ggtgatggtggtggtggtgg

SEQ ID NO: 158685 - DNA, 20 bp, Artificial Sequence
  Synthetic oligonucleotide; TGG chr2 60467149 60467168 60467165 +
ggtggtggtggtggtggtga

SEQ ID NO: 158686 - DNA, 20 bp, Artificial Sequence
  Synthetic oligonucleotide; TGG chr2 60467152 60467171 60467168 +
ggtggtggtggtggtgatgg

SEQ ID NO: 158687 - DNA, 20 bp, Artificial Sequence
  Synthetic oligonucleotide; TGG chr2 60467155 60467174 60467171 +
ggtggtggtggtgatggtgg

SEQ ID NO: 158688 - DNA, 20 bp, Artificial Sequence
  Synthetic oligonucleotide; TGG chr2 60467158 60467177 60467174 +
ggtggtggtgatggtggtgg

SEQ ID NO: 158689 - DNA, 20 bp, Artificial Sequence
  Synthetic oligonucleotide; TGG chr2 60467161 60467180 60467177 +
ggtggtgatggtggtggtgg

SEQ ID NO: 158690 - DNA, 20 bp, Artificial Sequence
  Synthetic oligonucleotide; TGG chr2 60467164 60467183 60467180 +
ggtgatggtggtggtggtgg

SEQ ID NO: 158691 - DNA, 20 bp, Artificial Sequence
  Synthetic oligonucleotide; TGG chr2 60467170 60467189 60467186 +
ggtggtggtggtggtggtga

SEQ ID NO: 158692 - DNA, 20 bp, Artificial Sequence
  Synthetic oligonucleotide; TGG chr2 60467173 60467192 60467189 +
ggtggtggtggtggtgatgg

SEQ ID NO: 158693 - DNA, 20 bp, Artificial Sequence
  Synthetic oligonucleotide; TGG chr2 60467176 60467195 60467192 +
ggtggtggtggtgatggtgg

SEQ ID NO: 158694 - DNA, 20 bp, Artificial Sequence
  Synthetic oligonucleotide; TGG chr2 60467182 60467201 60467198 +
ggtggtgatggtggtggtga

SEQ ID NO: 158695 - DNA, 20 bp, Artificial Sequence
  Synthetic oligonucleotide; CGG chr2 60467185 60467204 60467201 +
ggtgatggtggtggtgatgg

SEQ ID NO: 158696 - DNA, 20 bp, Artificial Sequence
  Synthetic oligonucleotide; TGG chr2 60467191 60467210 60467207 +
ggtggtggtgatggcggtga

SEQ ID NO: 158697 - DNA, 20 bp, Artificial Sequence
  Synthetic oligonucleotide; TGG chr2 60467197 60467216 60467213 +
ggtgatggcggtgatggtac

SEQ ID NO: 158698 - DNA, 20 bp, Artificial Sequence
  Synthetic oligonucleotide; TGG chr2 60467203 60467222 60467219 +
ggcggtgatggtactggtga

SEQ ID NO: 158699 - DNA, 20 bp, Artificial Sequence
  Synthetic oligonucleotide; TGG chr2 60467206 60467225 60467222 +
ggtgatggtactggtgatgg

SEQ ID NO: 158700 - DNA, 20 bp, Artificial Sequence
  Synthetic oligonucleotide; TGG chr2 60467209 60467228 60467225 +
gatggtactggtgatggtgg

SEQ ID NO: 158701 - DNA, 20 bp, Artificial Sequence
  Synthetic oligonucleotide; TGG chr2 60467212 60467231 60467228 +
ggtactggtgatggtggtgg

SEQ ID NO: 158702 - DNA, 20 bp, Artificial Sequence
  Synthetic oligonucleotide; TAG chr2 60467215 60467234 60467231 +
actggtgatggtggtggtgg

SEQ ID NO: 158703 - DNA, 20 bp, Artificial Sequence
  Synthetic oligonucleotide; TGG chr2 60467221 60467240 60467237 +
gatggtggtggtggtagtga

SEQ ID NO: 158704 - DNA, 20 bp, Artificial Sequence
  Synthetic oligonucleotide; TGG chr2 60467224 60467243 60467240 +
ggtggtggtggtagtgatgg

SEQ ID NO: 158705 - DNA, 20 bp, Artificial Sequence
  Synthetic oligonucleotide; TGG chr2 60467227 60467246 60467243 +
ggtggtggtagtgatggtgg

SEQ ID NO: 158706 - DNA, 20 bp, Artificial Sequence
  Synthetic oligonucleotide; TGG chr2 60467233 60467252 60467249 +
ggtagtgatggtggtggtaa

SEQ ID NO: 158707 - DNA, 20 bp, Artificial Sequence
  Synthetic oligonucleotide; TGG chr2 60467236 60467255 60467252 +
agtgatggtggtggtaatgg

SEQ ID NO: 158708 - DNA, 20 bp, Artificial Sequence
  Synthetic oligonucleotide; TGG chr2 60467239 60467258 60467255 +
gatggtggtggtaatggtgg

SEQ ID NO: 158709 - DNA, 20 bp, Artificial Sequence
  Synthetic oligonucleotide; TGG chr2 60467242 60467261 60467258 +
ggtggtggtaatggtggtgg

SEQ ID NO: 158710 - DNA, 20 bp, Artificial Sequence
  Synthetic oligonucleotide; TGG chr2 60467248 60467267 60467264 +
ggtaatggtggtggtggtga

SEQ ID NO: 158711 - DNA, 20 bp, Artificial Sequence
  Synthetic oligonucleotide; TGG chr2 60467251 60467270 60467267 +
aatggtggtggtggtgatgg

SEQ ID NO: 158712 - DNA, 20 bp, Artificial Sequence
  Synthetic oligonucleotide; TGG chr2 60467254 60467273 60467270 +
ggtggtggtggtgatggtgg

SEQ ID NO: 158713 - DNA, 20 bp, Artificial Sequence
  Synthetic oligonucleotide; TGG chr2 60467257 60467276 60467273 +
ggtggtggtgatggtggtgg

SEQ ID NO: 158714 - DNA, 20 bp, Artificial Sequence
  Synthetic oligonucleotide; TGG chr2 60467260 60467279 60467276 +
ggtggtgatggtggtggtgg

SEQ ID NO: 158715 - DNA, 20 bp, Artificial Sequence
  Synthetic oligonucleotide; TAG chr2 60467263 60467282 60467279 +
ggtgatggtggtggtggtgg

SEQ ID NO: 158716 - DNA, 20 bp, Artificial Sequence
  Synthetic oligonucleotide; TGG chr2 60467269 60467288 60467285 +
ggtggtggtggtggtagtga

SEQ ID NO: 158717 - DNA, 20 bp, Artificial Sequence
  Synthetic oligonucleotide; TGG chr2 60467272 60467291 60467288 +
ggtggtggtggtagtgatgg

SEQ ID NO: 158718 - DNA, 20 bp, Artificial Sequence
  Synthetic oligonucleotide; TGG chr2 60467275 60467294 60467291 +
ggtggtggtagtgatggtgg

SEQ ID NO: 158719 - DNA, 20 bp, Artificial Sequence
  Synthetic oligonucleotide; TGG chr2 60467281 60467300 60467297 +
ggtagtgatggtggtggtaa

SEQ ID NO: 158720 - DNA, 20 bp, Artificial Sequence
  Synthetic oligonucleotide; TGG chr2 60467284 60467303 60467300 +
agtgatggtggtggtaatgg

SEQ ID NO: 158721 - DNA, 20 bp, Artificial Sequence
  Synthetic oligonucleotide; TGG chr2 60467287 60467306 60467303 +
gatggtggtggtaatggtgg

SEQ ID NO: 158722 - DNA, 20 bp, Artificial Sequence
  Synthetic oligonucleotide; TGG chr2 60467290 60467309 60467306 +
ggtggtggtaatggtggtgg

SEQ ID NO: 158723 - DNA, 20 bp, Artificial Sequence
  Synthetic oligonucleotide; TGG chr2 60467296 60467315 60467312 +
ggtaatggtggtggtggtga

SEQ ID NO: 158724 - DNA, 20 bp, Artificial Sequence
  Synthetic oligonucleotide; TGG chr2 60467299 60467318 60467315 +
aatggtggtggtggtgatgg

SEQ ID NO: 158725 - DNA, 20 bp, Artificial Sequence
  Synthetic oligonucleotide; TGG chr2 60467302 60467321 60467318 +
ggtggtggtggtgatggtgg

SEQ ID NO: 158726 - DNA, 20 bp, Artificial Sequence
  Synthetic oligonucleotide; TGG chr2 60467305 60467324 60467321 +
ggtggtggtgatggtggtgg

SEQ ID NO: 158727 - DNA, 20 bp, Artificial Sequence
  Synthetic oligonucleotide; TGG chr2 60467308 60467327 60467324 +
ggtggtgatggtggtggtgg

SEQ ID NO: 158728 - DNA, 20 bp, Artificial Sequence
  Synthetic oligonucleotide; TAG chr2 60467311 60467330 60467327 +
ggtgatggtggtggtggtgg

SEQ ID NO: 158729 - DNA, 20 bp, Artificial Sequence
  Synthetic oligonucleotide; TGG chr2 60467317 60467336 60467333 +
ggtggtggtggtggtagtga

SEQ ID NO: 158730 - DNA, 20 bp, Artificial Sequence
  Synthetic oligonucleotide; TGG chr2 60467320 60467339 60467336 +
ggtggtggtggtagtgatgg

SEQ ID NO: 158731 - DNA, 20 bp, Artificial Sequence
  Synthetic oligonucleotide; TGG chr2 60467323 60467342 60467339 +
ggtggtggtagtgatggtgg

SEQ ID NO: 158732 - DNA, 20 bp, Artificial Sequence
  Synthetic oligonucleotide; TGG chr2 60467329 60467348 60467345 +
ggtagtgatggtggtggtaa

SEQ ID NO: 158733 - DNA, 20 bp, Artificial Sequence
  Synthetic oligonucleotide; TGG chr2 60467332 60467351 60467348 +
agtgatggtggtggtaatgg

SEQ ID NO: 158734 - DNA, 20 bp, Artificial Sequence
  Synthetic oligonucleotide; TGG chr2 60467335 60467354 60467351 +
gatggtggtggtaatggtgg

SEQ ID NO: 158735 - DNA, 20 bp, Artificial Sequence
  Synthetic oligonucleotide; TGG chr2 60467338 60467357 60467354 +
ggtggtggtaatggtggtgg

SEQ ID NO: 158736 - DNA, 20 bp, Artificial Sequence
  Synthetic oligonucleotide; TGG chr2 60467344 60467363 60467360 +
ggtaatggtggtggtggtga

SEQ ID NO: 158737 - DNA, 20 bp, Artificial Sequence
  Synthetic oligonucleotide; TGG chr2 60467347 60467366 60467363 +
aatggtggtggtggtgatgg

SEQ ID NO: 158738 - DNA, 20 bp, Artificial Sequence
  Synthetic oligonucleotide; TGG chr2 60467356 60467375 60467372 +
ggtggtgatggtggtgatga

SEQ ID NO: 158739 - DNA, 20 bp, Artificial Sequence
  Synthetic oligonucleotide; TGG chr2 60467362 60467381 60467378 +
gatggtggtgatgatggtga

SEQ ID NO: 158740 - DNA, 20 bp, Artificial Sequence
  Synthetic oligonucleotide; TGG chr2 60467368 60467387 60467384 +
ggtgatgatggtgatggtac

SEQ ID NO: 158741 - DNA, 20 bp, Artificial Sequence
  Synthetic oligonucleotide; TGG chr2 60467371 60467390 60467387 +
gatgatggtgatggtactgg

SEQ ID NO: 158742 - DNA, 20 bp, Artificial Sequence
  Synthetic oligonucleotide; TGG chr2 60467377 60467396 60467393 +
ggtgatggtactggtggtga

SEQ ID NO: 158743 - DNA, 20 bp, Artificial Sequence
  Synthetic oligonucleotide; TGG chr2 60467383 60467402 60467399 +
ggtactggtggtgatggtga

SEQ ID NO: 158744 - DNA, 20 bp, Artificial Sequence
  Synthetic oligonucleotide; TGG chr2 60467389 60467408 60467405 +
ggtggtgatggtgatggtga

SEQ ID NO: 158745 - DNA, 20 bp, Artificial Sequence
  Synthetic oligonucleotide; TGG chr2 60467395 60467414 60467411 +
gatggtgatggtgatggtac

SEQ ID NO: 158746 - DNA, 20 bp, Artificial Sequence
  Synthetic oligonucleotide; TGG chr2 60467401 60467420 60467417 +
gatggtgatggtactggtga

SEQ ID NO: 158747 - DNA, 20 bp, Artificial Sequence
  Synthetic oligonucleotide; TGG chr2 60467404 60467423 60467420 +
ggtgatggtactggtgatgg

SEQ ID NO: 158748 - DNA, 20 bp, Artificial Sequence
  Synthetic oligonucleotide; TGG chr2 60467407 60467426 60467423 +
gatggtactggtgatggtgg

SEQ ID NO: 158749 - DNA, 20 bp, Artificial Sequence
  Synthetic oligonucleotide; TGG chr2 60467410 60467429 60467426 +
ggtactggtgatggtggtgg

SEQ ID NO: 158750 - DNA, 20 bp, Artificial Sequence
  Synthetic oligonucleotide; TAG chr2 60467413 60467432 60467429 +
actggtgatggtggtggtgg

SEQ ID NO: 158751 - DNA, 20 bp, Artificial Sequence
  Synthetic oligonucleotide; TGG chr2 60467419 60467438 60467435 +
gatggtggtggtggtagtga

SEQ ID NO: 158752 - DNA, 20 bp, Artificial Sequence
  Synthetic oligonucleotide; TGG chr2 60467422 60467441 60467438 +
ggtggtggtggtagtgatgg

SEQ ID NO: 158753 - DNA, 20 bp, Artificial Sequence
  Synthetic oligonucleotide; TGG chr2 60467425 60467444 60467441 +
ggtggtggtagtgatggtgg

SEQ ID NO: 158754 - DNA, 20 bp, Artificial Sequence
  Synthetic oligonucleotide; TGG chr2 60467431 60467450 60467447 +
ggtagtgatggtggtggtaa

SEQ ID NO: 158755 - DNA, 20 bp, Artificial Sequence
  Synthetic oligonucleotide; TGG chr2 60467434 60467453 60467450 +
agtgatggtggtggtaatgg

SEQ ID NO: 158756 - DNA, 20 bp, Artificial Sequence
  Synthetic oligonucleotide; TGG chr2 60467437 60467456 60467453 +
gatggtggtggtaatggtgg

SEQ ID NO: 158757 - DNA, 20 bp, Artificial Sequence
  Synthetic oligonucleotide; TGG chr2 60467440 60467459 60467456 +
ggtggtggtaatggtggtgg

SEQ ID NO: 158758 - DNA, 20 bp, Artificial Sequence
  Synthetic oligonucleotide; TGG chr2 60467446 60467465 60467462 +
ggtaatggtggtggtggtga

SEQ ID NO: 158759 - DNA, 20 bp, Artificial Sequence
  Synthetic oligonucleotide; TGG chr2 60467449 60467468 60467465 +
aatggtggtggtggtgatgg

SEQ ID NO: 158760 - DNA, 20 bp, Artificial Sequence
  Synthetic oligonucleotide; TGG chr2 60467452 60467471 60467468 +
ggtggtggtggtgatggtgg

SEQ ID NO: 158761 - DNA, 20 bp, Artificial Sequence
  Synthetic oligonucleotide; TGG chr2 60467458 60467477 60467474 +
ggtggtgatggtggtggtaa

SEQ ID NO: 158762 - DNA, 20 bp, Artificial Sequence
  Synthetic oligonucleotide; TGG chr2 60467461 60467480 60467477 +
ggtgatggtggtggtaatgg

SEQ ID NO: 158763 - DNA, 20 bp, Artificial Sequence
  Synthetic oligonucleotide; TGG chr2 60467464 60467483 60467480 +
gatggtggtggtaatggtgg

SEQ ID NO: 158764 - DNA, 20 bp, Artificial Sequence
  Synthetic oligonucleotide; TGG chr2 60467467 60467486 60467483 +
ggtggtggtaatggtggtgg

SEQ ID NO: 158765 - DNA, 20 bp, Artificial Sequence
  Synthetic oligonucleotide; TGG chr2 60467473 60467492 60467489 +
ggtaatggtggtggtggtga

SEQ ID NO: 158766 - DNA, 20 bp, Artificial Sequence
  Synthetic oligonucleotide; TGG chr2 60467476 60467495 60467492 +
aatggtggtggtggtgatgg

SEQ ID NO: 158767 - DNA, 20 bp, Artificial Sequence
  Synthetic oligonucleotide; TGG chr2 60467485 60467504 60467501 +
ggtggtgatggtggtgatga

SEQ ID NO: 158768 - DNA, 20 bp, Artificial Sequence
  Synthetic oligonucleotide; TGG chr2 60467491 60467510 60467507 +
gatggtggtgatgatggtga

SEQ ID NO: 158769 - DNA, 20 bp, Artificial Sequence
  Synthetic oligonucleotide; TGG chr2 60467497 60467516 60467513 +
ggtgatgatggtgatggtac

SEQ ID NO: 158770 - DNA, 20 bp, Artificial Sequence
  Synthetic oligonucleotide; TGG chr2 60467500 60467519 60467516 +
gatgatggtgatggtactgg

SEQ ID NO: 158771 - DNA, 20 bp, Artificial Sequence
  Synthetic oligonucleotide; TGG chr2 60467506 60467525 60467522 +
ggtgatggtactggtggtga

SEQ ID NO: 158772 - DNA, 20 bp, Artificial Sequence
  Synthetic oligonucleotide; TGG chr2 60467512 60467531 60467528 +
ggtactggtggtgatggtga

SEQ ID NO: 158773 - DNA, 20 bp, Artificial Sequence
  Synthetic oligonucleotide; TGG chr2 60467518 60467537 60467534 +
ggtggtgatggtgatggtga

SEQ ID NO: 158774 - DNA, 20 bp, Artificial Sequence
  Synthetic oligonucleotide; TGG chr2 60467524 60467543 60467540 +
gatggtgatggtgatggtac

SEQ ID NO: 158775 - DNA, 20 bp, Artificial Sequence
  Synthetic oligonucleotide; TGG chr2 60467530 60467549 60467546 +
gatggtgatggtactggtga

SEQ ID NO: 158776 - DNA, 20 bp, Artificial Sequence
  Synthetic oligonucleotide; TGG chr2 60467533 60467552 60467549 +
ggtgatggtactggtgatgg

SEQ ID NO: 158777 - DNA, 20 bp, Artificial Sequence
  Synthetic oligonucleotide; TGG chr2 60467536 60467555 60467552 +
gatggtactggtgatggtgg

SEQ ID NO: 158778 - DNA, 20 bp, Artificial Sequence
  Synthetic oligonucleotide; TGG chr2 60467539 60467558 60467555 +
ggtactggtgatggtggtgg

SEQ ID NO: 158779 - DNA, 20 bp, Artificial Sequence
  Synthetic oligonucleotide; TAG chr2 60467542 60467561 60467558 +
actggtgatggtggtggtgg

SEQ ID NO: 158780 - DNA, 20 bp, Artificial Sequence
  Synthetic oligonucleotide; TGG chr2 60467548 60467567 60467564 +
gatggtggtggtggtagtga

SEQ ID NO: 158781 - DNA, 20 bp, Artificial Sequence
  Synthetic oligonucleotide; TGG chr2 60467551 60467570 60467567 +
ggtggtggtggtagtgatgg

SEQ ID NO: 158782 - DNA, 20 bp, Artificial Sequence
  Synthetic oligonucleotide; TGG chr2 60467554 60467573 60467570 +
ggtggtggtagtgatggtgg

SEQ ID NO: 158783 - DNA, 20 bp, Artificial Sequence
  Synthetic oligonucleotide; TGG chr2 60467560 60467579 60467576 +
ggtagtgatggtggtggtaa

SEQ ID NO: 158784 - DNA, 20 bp, Artificial Sequence
  Synthetic oligonucleotide; TGG chr2 60467563 60467582 60467579 +
agtgatggtggtggtaatgg

SEQ ID NO: 158785 - DNA, 20 bp, Artificial Sequence
  Synthetic oligonucleotide; TGG chr2 60467566 60467585 60467582 +
gatggtggtggtaatggtgg

SEQ ID NO: 158786 - DNA, 20 bp, Artificial Sequence
  Synthetic oligonucleotide; TGG chr2 60467569 60467588 60467585 +
ggtggtggtaatggtggtgg

SEQ ID NO: 158787 - DNA, 20 bp, Artificial Sequence
  Synthetic oligonucleotide; TGG chr2 60467575 60467594 60467591 +
ggtaatggtggtggtggtga

SEQ ID NO: 158788 - DNA, 20 bp, Artificial Sequence
  Synthetic oligonucleotide; TGG chr2 60467578 60467597 60467594 +
aatggtggtggtggtgatgg

SEQ ID NO: 158789 - DNA, 20 bp, Artificial Sequence
  Synthetic oligonucleotide; TGG chr2 60467581 60467600 60467597 +
ggtggtggtggtgatggtgg

SEQ ID NO: 158790 - DNA, 20 bp, Artificial Sequence
  Synthetic oligonucleotide; TGG chr2 60467584 60467603 60467600 +
ggtggtggtgatggtggtgg

SEQ ID NO: 158791 - DNA, 20 bp, Artificial Sequence
  Synthetic oligonucleotide; TGG chr2 60467587 60467606 60467603 +
ggtggtgatggtggtggtgg

SEQ ID NO: 158792 - DNA, 20 bp, Artificial Sequence
  Synthetic oligonucleotide; TAG chr2 60467590 60467609 60467606 +
ggtgatggtggtggtggtgg

SEQ ID NO: 158793 - DNA, 20 bp, Artificial Sequence
  Synthetic oligonucleotide; TGG chr2 60467596 60467615 60467612 +
ggtggtggtggtggtagtga

SEQ ID NO: 158794 - DNA, 20 bp, Artificial Sequence
  Synthetic oligonucleotide; TGG chr2 60467599 60467618 60467615 +
ggtggtggtggtagtgatgg

SEQ ID NO: 158795 - DNA, 20 bp, Artificial Sequence
  Synthetic oligonucleotide; TGG chr2 60467602 60467621 60467618 +
ggtggtggtagtgatggtgg

SEQ ID NO: 158796 - DNA, 20 bp, Artificial Sequence
  Synthetic oligonucleotide; TGG chr2 60467608 60467627 60467624 +
ggtagtgatggtggtggtaa

SEQ ID NO: 158797 - DNA, 20 bp, Artificial Sequence
  Synthetic oligonucleotide; TGG chr2 60467611 60467630 60467627 +
agtgatggtggtggtaatgg

SEQ ID NO: 158798 - DNA, 20 bp, Artificial Sequence
  Synthetic oligonucleotide; TGG chr2 60467614 60467633 60467630 +
gatggtggtggtaatggtgg

SEQ ID NO: 158799 - DNA, 20 bp, Artificial Sequence
  Synthetic oligonucleotide; TGG chr2 60467617 60467636 60467633 +
ggtggtggtaatggtggtgg

SEQ ID NO: 158800 - DNA, 20 bp, Artificial Sequence
  Synthetic oligonucleotide; TGG chr2 60467623 60467642 60467639 +
ggtaatggtggtggtggtga

SEQ ID NO: 158801 - DNA, 20 bp, Artificial Sequence
  Synthetic oligonucleotide; TGG chr2 60467626 60467645 60467642 +
aatggtggtggtggtgatgg

SEQ ID NO: 158802 - DNA, 20 bp, Artificial Sequence
  Synthetic oligonucleotide; TGG chr2 60467635 60467654 60467651 +
ggtggtgatggtggtgatga

SEQ ID NO: 158803 - DNA, 20 bp, Artificial Sequence
  Synthetic oligonucleotide; TGG chr2 60467641 60467660 60467657 +
gatggtggtgatgatggtga

SEQ ID NO: 158804 - DNA, 20 bp, Artificial Sequence
  Synthetic oligonucleotide; TGG chr2 60467647 60467666 60467663 +
ggtgatgatggtgatggtac

SEQ ID NO: 158805 - DNA, 20 bp, Artificial Sequence
  Synthetic oligonucleotide; TGG chr2 60467650 60467669 60467666 +
gatgatggtgatggtactgg

SEQ ID NO: 158806 - DNA, 20 bp, Artificial Sequence
  Synthetic oligonucleotide; TGG chr2 60467656 60467675 60467672 +
ggtgatggtactggtggtga

SEQ ID NO: 158807 - DNA, 20 bp, Artificial Sequence
  Synthetic oligonucleotide; TGG chr2 60467662 60467681 60467678 +
ggtactggtggtgatggtga

SEQ ID NO: 158808 - DNA, 20 bp, Artificial Sequence
  Synthetic oligonucleotide; TGG chr2 60467665 60467684 60467681 +
actggtggtgatggtgatgg

SEQ ID NO: 158809 - DNA, 20 bp, Artificial Sequence
  Synthetic oligonucleotide; TGG chr2 60467668 60467687 60467684 +
ggtggtgatggtgatggtgg

SEQ ID NO: 158810 - DNA, 20 bp, Artificial Sequence
  Synthetic oligonucleotide; TGG chr2 60467671 60467690 60467687 +
ggtgatggtgatggtggtgg

SEQ ID NO: 158811 - DNA, 20 bp, Artificial Sequence
  Synthetic oligonucleotide; TGG chr2 60467674 60467693 60467690 +
gatggtgatggtggtggtgg

SEQ ID NO: 158812 - DNA, 20 bp, Artificial Sequence
  Synthetic oligonucleotide; TGG chr2 60467680 60467699 60467696 +
gatggtggtggtggtggtga

SEQ ID NO: 158813 - DNA, 20 bp, Artificial Sequence
  Synthetic oligonucleotide; TGG chr2 60467686 60467705 60467702 +
ggtggtggtggtgatggtac

SEQ ID NO: 158814 - DNA, 20 bp, Artificial Sequence
  Synthetic oligonucleotide; TGG chr2 60467689 60467708 60467705 +
ggtggtggtgatggtactgg

SEQ ID NO: 158815 - DNA, 20 bp, Artificial Sequence
  Synthetic oligonucleotide; TGG chr2 60467695 60467714 60467711 +
ggtgatggtactggtggtga

SEQ ID NO: 158816 - DNA, 20 bp, Artificial Sequence
  Synthetic oligonucleotide; TGG chr2 60467701 60467720 60467717 +
ggtactggtggtgatggtac

SEQ ID NO: 158817 - DNA, 20 bp, Artificial Sequence
  Synthetic oligonucleotide; TGG chr2 60467704 60467723 60467720 +
actggtggtgatggtactgg

SEQ ID NO: 158818 - DNA, 20 bp, Artificial Sequence
  Synthetic oligonucleotide; TGG chr2 60467710 60467729 60467726 +
ggtgatggtactggtggtga

SEQ ID NO: 158819 - DNA, 20 bp, Artificial Sequence
  Synthetic oligonucleotide; TGG chr2 60467713 60467732 60467729 +
gatggtactggtggtgatgg

SEQ ID NO: 158820 - DNA, 20 bp, Artificial Sequence
  Synthetic oligonucleotide; TGG chr2 60467716 60467735 60467732 +
ggtactggtggtgatggtgg

SEQ ID NO: 158821 - DNA, 20 bp, Artificial Sequence
  Synthetic oligonucleotide; TGG chr2 60467719 60467738 60467735 +
actggtggtgatggtggtgg

SEQ ID NO: 158822 - DNA, 20 bp, Artificial Sequence
  Synthetic oligonucleotide; TAG chr2 60467722 60467741 60467738 +
ggtggtgatggtggtggtgg

SEQ ID NO: 158823 - DNA, 20 bp, Artificial Sequence
  Synthetic oligonucleotide; TGG chr2 60467728 60467747 60467744 +
gatggtggtggtggtagtga

SEQ ID NO: 158824 - DNA, 20 bp, Artificial Sequence
  Synthetic oligonucleotide; TGG chr2 60467731 60467750 60467747 +
ggtggtggtggtagtgatgg

SEQ ID NO: 158825 - DNA, 20 bp, Artificial Sequence
  Synthetic oligonucleotide; TGG chr2 60467734 60467753 60467750 +
ggtggtggtagtgatggtgg

SEQ ID NO: 158826 - DNA, 20 bp, Artificial Sequence
  Synthetic oligonucleotide; TGG chr2 60467740 60467759 60467756 +
ggtagtgatggtggtggtaa

SEQ ID NO: 158827 - DNA, 20 bp, Artificial Sequence
  Synthetic oligonucleotide; TGG chr2 60467743 60467762 60467759 +
agtgatggtggtggtaatgg

SEQ ID NO: 158828 - DNA, 20 bp, Artificial Sequence
  Synthetic oligonucleotide; TGG chr2 60467746 60467765 60467762 +
gatggtggtggtaatggtgg

SEQ ID NO: 158829 - DNA, 20 bp, Artificial Sequence
  Synthetic oligonucleotide; TGG chr2 60467749 60467768 60467765 +
ggtggtggtaatggtggtgg

SEQ ID NO: 158830 - DNA, 20 bp, Artificial Sequence
  Synthetic oligonucleotide; GAG chr2 60467751 60467770 60467767 +
tggtggtaatggtggtggtg

SEQ ID NO: 158831 - DNA, 20 bp, Artificial Sequence
  Synthetic oligonucleotide; TGG chr2 60467755 60467774 60467771 +
ggtaatggtggtggtggaga

SEQ ID NO: 158832 - DNA, 20 bp, Artificial Sequence
  Synthetic oligonucleotide; TGG chr2 60467758 60467777 60467774 +
aatggtggtggtggagatgg

SEQ ID NO: 158833 - DNA, 20 bp, Artificial Sequence
  Synthetic oligonucleotide; TGG chr2 60467767 60467786 60467783 +
ggtggagatggtggtgttga

SEQ ID NO: 158834 - DNA, 20 bp, Artificial Sequence
  Synthetic oligonucleotide; TGG chr2 60467773 60467792 60467789 +
gatggtggtgttgatggtga

SEQ ID NO: 158835 - DNA, 20 bp, Artificial Sequence
  Synthetic oligonucleotide; TGG chr2 60467779 60467798 60467795 +
ggtgttgatggtgatggtac

SEQ ID NO: 158836 - DNA, 20 bp, Artificial Sequence
  Synthetic oligonucleotide; TGG chr2 60467782 60467801 60467798 +
gttgatggtgatggtactgg

SEQ ID NO: 158837 - DNA, 20 bp, Artificial Sequence
  Synthetic oligonucleotide; TGG chr2 60467788 60467807 60467804 +
ggtgatggtactggtggtga

SEQ ID NO: 158838 - DNA, 20 bp, Artificial Sequence
  Synthetic oligonucleotide; TGG chr2 60467794 60467813 60467810 +
ggtactggtggtgatggtac

SEQ ID NO: 158839 - DNA, 20 bp, Artificial Sequence
  Synthetic oligonucleotide; TGG chr2 60467797 60467816 60467813 +
actggtggtgatggtactgg

SEQ ID NO: 158840 - DNA, 20 bp, Artificial Sequence
  Synthetic oligonucleotide; TGG chr2 60467803 60467822 60467819 +
ggtgatggtactggtggtga

SEQ ID NO: 158841 - DNA, 20 bp, Artificial Sequence
  Synthetic oligonucleotide; TGG chr2 60467809 60467828 60467825 +
ggtactggtggtgatggtga

SEQ ID NO: 158842 - DNA, 20 bp, Artificial Sequence
  Synthetic oligonucleotide; TGG chr2 60467812 60467831 60467828 +
actggtggtgatggtgatgg

SEQ ID NO: 158843 - DNA, 20 bp, Artificial Sequence
  Synthetic oligonucleotide; TGG chr2 60467815 60467834 60467831 +
ggtggtgatggtgatggtgg

SEQ ID NO: 158844 - DNA, 20 bp, Artificial Sequence
  Synthetic oligonucleotide; TGG chr2 60467818 60467837 60467834 +
ggtgatggtgatggtggtgg

SEQ ID NO: 158845 - DNA, 20 bp, Artificial Sequence
  Synthetic oligonucleotide; TGG chr2 60467821 60467840 60467837 +
gatggtgatggtggtggtgg

SEQ ID NO: 158846 - DNA, 20 bp, Artificial Sequence
  Synthetic oligonucleotide; TGG chr2 60467833 60467852 60467849 +
ggtggtggtggtgatgctac

SEQ ID NO: 158847 - DNA, 20 bp, Artificial Sequence
  Synthetic oligonucleotide; TGG chr2 60467836 60467855 60467852 +
ggtggtggtgatgctactgg

SEQ ID NO: 158848 - DNA, 20 bp, Artificial Sequence
  Synthetic oligonucleotide; TGG chr2 60467842 60467861 60467858 +
ggtgatgctactggtggtga

SEQ ID NO: 158849 - DNA, 20 bp, Artificial Sequence
  Synthetic oligonucleotide; TGG chr2 60467848 60467867 60467864 +
gctactggtggtgatggtac

SEQ ID NO: 158850 - DNA, 20 bp, Artificial Sequence
  Synthetic oligonucleotide; TGG chr2 60467851 60467870 60467867 +
actggtggtgatggtactgg

SEQ ID NO: 158851 - DNA, 20 bp, Artificial Sequence
  Synthetic oligonucleotide; TGG chr2 60467857 60467876 60467873 +
ggtgatggtactggtggtga

SEQ ID NO: 158852 - DNA, 20 bp, Artificial Sequence
  Synthetic oligonucleotide; TGG chr2 60467860 60467879 60467876 +
gatggtactggtggtgatgg

SEQ ID NO: 158853 - DNA, 20 bp, Artificial Sequence
  Synthetic oligonucleotide; TGG chr2 60467863 60467882 60467879 +
ggtactggtggtgatggtgg

SEQ ID NO: 158854 - DNA, 20 bp, Artificial Sequence
  Synthetic oligonucleotide; TGG chr2 60467866 60467885 60467882 +
actggtggtgatggtggtgg

SEQ ID NO: 158855 - DNA, 20 bp, Artificial Sequence
  Synthetic oligonucleotide; TAG chr2 60467869 60467888 60467885 +
ggtggtgatggtggtggtgg

SEQ ID NO: 158856 - DNA, 20 bp, Artificial Sequence
  Synthetic oligonucleotide; TGG chr2 60467875 60467894 60467891 +
gatggtggtggtggtagtga

SEQ ID NO: 158857 - DNA, 20 bp, Artificial Sequence
  Synthetic oligonucleotide; TGG chr2 60467878 60467897 60467894 +
ggtggtggtggtagtgatgg

SEQ ID NO: 158858 - DNA, 20 bp, Artificial Sequence
  Synthetic oligonucleotide; TGG chr2 60467881 60467900 60467897 +
ggtggtggtagtgatggtgg

SEQ ID NO: 158859 - DNA, 20 bp, Artificial Sequence
  Synthetic oligonucleotide; TGG chr2 60467887 60467906 60467903 +
ggtagtgatggtggtggtaa

SEQ ID NO: 158860 - DNA, 20 bp, Artificial Sequence
  Synthetic oligonucleotide; TGG chr2 60467890 60467909 60467906 +
agtgatggtggtggtaatgg

SEQ ID NO: 158861 - DNA, 20 bp, Artificial Sequence
  Synthetic oligonucleotide; TGG chr2 60467893 60467912 60467909 +
gatggtggtggtaatggtgg

SEQ ID NO: 158862 - DNA, 20 bp, Artificial Sequence
  Synthetic oligonucleotide; TGG chr2 60467896 60467915 60467912 +
ggtggtggtaatggtggtgg

SEQ ID NO: 158863 - DNA, 20 bp, Artificial Sequence
  Synthetic oligonucleotide; TGG chr2 60467899 60467918 60467915 +
ggtggtaatggtggtggtgg

SEQ ID NO: 158864 - DNA, 20 bp, Artificial Sequence
  Synthetic oligonucleotide; TGG chr2 60467902 60467921 60467918 +
ggtaatggtggtggtggtgg

SEQ ID NO: 158865 - DNA, 20 bp, Artificial Sequence
  Synthetic oligonucleotide; TGG chr2 60467905 60467924 60467921 +
aatggtggtggtggtggtgg

SEQ ID NO: 158866 - DNA, 20 bp, Artificial Sequence
  Synthetic oligonucleotide; TAG chr2 60467908 60467927 60467924 +
ggtggtggtggtggtggtgg

SEQ ID NO: 158867 - DNA, 20 bp, Artificial Sequence
  Synthetic oligonucleotide; TGG chr2 60467914 60467933 60467930 +
ggtggtggtggtggtagtga

SEQ ID NO: 158868 - DNA, 20 bp, Artificial Sequence
  Synthetic oligonucleotide; TGG chr2 60467917 60467936 60467933 +
ggtggtggtggtagtgatgg

SEQ ID NO: 158869 - DNA, 20 bp, Artificial Sequence
  Synthetic oligonucleotide; TGG chr2 60467920 60467939 60467936 +
ggtggtggtagtgatggtgg

SEQ ID NO: 158870 - DNA, 20 bp, Artificial Sequence
  Synthetic oligonucleotide; TGG chr2 60467923 60467942 60467939 +
ggtggtagtgatggtggtgg

SEQ ID NO: 158871 - DNA, 20 bp, Artificial Sequence
  Synthetic oligonucleotide; TGG chr2 60467929 60467948 60467945 +
agtgatggtggtggtggtga

SEQ ID NO: 158872 - DNA, 20 bp, Artificial Sequence
  Synthetic oligonucleotide; TGG chr2 60467935 60467954 60467951 +
ggtggtggtggtgatggtac

SEQ ID NO: 158873 - DNA, 20 bp, Artificial Sequence
  Synthetic oligonucleotide; TGG chr2 60467938 60467957 60467954 +
ggtggtggtgatggtactgg

SEQ ID NO: 158874 - DNA, 20 bp, Artificial Sequence
  Synthetic oligonucleotide; TGG chr2 60467944 60467963 60467960 +
ggtgatggtactggtggtga

SEQ ID NO: 158875 - DNA, 20 bp, Artificial Sequence
  Synthetic oligonucleotide; TGG chr2 60467947 60467966 60467963 +
gatggtactggtggtgatgg

SEQ ID NO: 158876 - DNA, 20 bp, Artificial Sequence
  Synthetic oligonucleotide; TGG chr2 60467950 60467969 60467966 +
ggtactggtggtgatggtgg

SEQ ID NO: 158877 - DNA, 20 bp, Artificial Sequence
  Synthetic oligonucleotide; TGG chr2 60467953 60467972 60467969 +
actggtggtgatggtggtgg

SEQ ID NO: 158878 - DNA, 20 bp, Artificial Sequence
  Synthetic oligonucleotide; TAG chr2 60467956 60467975 60467972 +
ggtggtgatggtggtggtgg

SEQ ID NO: 158879 - DNA, 20 bp, Artificial Sequence
  Synthetic oligonucleotide; TGG chr2 60467962 60467981 60467978 +
gatggtggtggtggtagtga

SEQ ID NO: 158880 - DNA, 20 bp, Artificial Sequence
  Synthetic oligonucleotide; TGG chr2 60467965 60467984 60467981 +
ggtggtggtggtagtgatgg

SEQ ID NO: 158881 - DNA, 20 bp, Artificial Sequence
  Synthetic oligonucleotide; TGG chr2 60467968 60467987 60467984 +
ggtggtggtagtgatggtgg

SEQ ID NO: 158882 - DNA, 20 bp, Artificial Sequence
  Synthetic oligonucleotide; TGG chr2 60467974 60467993 60467990 +
ggtagtgatggtggtggtaa

SEQ ID NO: 158883 - DNA, 20 bp, Artificial Sequence
  Synthetic oligonucleotide; TGG chr2 60467977 60467996 60467993 +
agtgatggtggtggtaatgg

SEQ ID NO: 158884 - DNA, 20 bp, Artificial Sequence
  Synthetic oligonucleotide; TGG chr2 60467980 60467999 60467996 +
gatggtggtggtaatggtgg

SEQ ID NO: 158885 - DNA, 20 bp, Artificial Sequence
  Synthetic oligonucleotide; TGG chr2 60467983 60468002 60467999 +
ggtggtggtaatggtggtgg

SEQ ID NO: 158886 - DNA, 20 bp, Artificial Sequence
  Synthetic oligonucleotide; TGG chr2 60467989 60468008 60468005 +
ggtaatggtggtggtggtga

SEQ ID NO: 158887 - DNA, 20 bp, Artificial Sequence
  Synthetic oligonucleotide; TGG chr2 60467992 60468011 60468008 +
aatggtggtggtggtgatgg

SEQ ID NO: 158888 - DNA, 20 bp, Artificial Sequence
  Synthetic oligonucleotide; TGG chr2 60467995 60468014 60468011 +
ggtggtggtggtgatggtgg

SEQ ID NO: 158889 - DNA, 20 bp, Artificial Sequence
  Synthetic oligonucleotide; TGG chr2 60467998 60468017 60468014 +
ggtggtggtgatggtggtgg

SEQ ID NO: 158890 - DNA, 20 bp, Artificial Sequence
  Synthetic oligonucleotide; TGG chr2 60468001 60468020 60468017 +
ggtggtgatggtggtggtgg

SEQ ID NO: 158891 - DNA, 20 bp, Artificial Sequence
  Synthetic oligonucleotide; TAG chr2 60468004 60468023 60468020 +
ggtgatggtggtggtggtgg

SEQ ID NO: 158892 - DNA, 20 bp, Artificial Sequence
  Synthetic oligonucleotide; TGG chr2 60468007 60468026 60468023 +
gatggtggtggtggtggtag

SEQ ID NO: 158893 - DNA, 20 bp, Artificial Sequence
  Synthetic oligonucleotide; TGG chr2 60468010 60468029 60468026 +
ggtggtggtggtggtagtgg

SEQ ID NO: 158894 - DNA, 20 bp, Artificial Sequence
  Synthetic oligonucleotide; TGG chr2 60468016 60468035 60468032 +
ggtggtggtagtggtggtga

SEQ ID NO: 158895 - DNA, 20 bp, Artificial Sequence
  Synthetic oligonucleotide; TGG chr2 60468019 60468038 60468035 +
ggtggtagtggtggtgatgg

SEQ ID NO: 158896 - DNA, 20 bp, Artificial Sequence
  Synthetic oligonucleotide; TGG chr2 60468025 60468044 60468041 +
agtggtggtgatggtggtga

SEQ ID NO: 158897 - DNA, 20 bp, Artificial Sequence
  Synthetic oligonucleotide; TGG chr2 60468031 60468050 60468047 +
ggtgatggtggtgatggtac

SEQ ID NO: 158898 - DNA, 20 bp, Artificial Sequence
  Synthetic oligonucleotide; TGG chr2 60468034 60468053 60468050 +
gatggtggtgatggtactgg

SEQ ID NO: 158899 - DNA, 20 bp, Artificial Sequence
  Synthetic oligonucleotide; TGG chr2 60468040 60468059 60468056 +
ggtgatggtactggtggtga

SEQ ID NO: 158900 - DNA, 20 bp, Artificial Sequence
  Synthetic oligonucleotide; TGG chr2 60468043 60468062 60468059 +
gatggtactggtggtgatgg

SEQ ID NO: 158901 - DNA, 20 bp, Artificial Sequence
  Synthetic oligonucleotide; TGG chr2 60468046 60468065 60468062 +
ggtactggtggtgatggtgg

SEQ ID NO: 158902 - DNA, 20 bp, Artificial Sequence
  Synthetic oligonucleotide; TGG chr2 60468049 60468068 60468065 +
actggtggtgatggtggtgg

SEQ ID NO: 158903 - DNA, 20 bp, Artificial Sequence
  Synthetic oligonucleotide; TAG chr2 60468052 60468071 60468068 +
ggtggtgatggtggtggtgg

SEQ ID NO: 158904 - DNA, 20 bp, Artificial Sequence
  Synthetic oligonucleotide; TGG chr2 60468058 60468077 60468074 +
gatggtggtggtggtagtga

SEQ ID NO: 158905 - DNA, 20 bp, Artificial Sequence
  Synthetic oligonucleotide; TGG chr2 60468061 60468080 60468077 +
ggtggtggtggtagtgatgg

SEQ ID NO: 158906 - DNA, 20 bp, Artificial Sequence
  Synthetic oligonucleotide; TGG chr2 60468064 60468083 60468080 +
ggtggtggtagtgatggtgg

SEQ ID NO: 158907 - DNA, 20 bp, Artificial Sequence
  Synthetic oligonucleotide; TGG chr2 60468070 60468089 60468086 +
ggtagtgatggtggtggttg

SEQ ID NO: 158908 - DNA, 20 bp, Artificial Sequence
  Synthetic oligonucleotide; TGG chr2 60468073 60468092 60468089 +
agtgatggtggtggttgtgg

SEQ ID NO: 158909 - DNA, 20 bp, Artificial Sequence
  Synthetic oligonucleotide; TGG chr2 60468076 60468095 60468092 +
gatggtggtggttgtggtgg

SEQ ID NO: 158910 - DNA, 20 bp, Artificial Sequence
  Synthetic oligonucleotide; TGG chr2 60468079 60468098 60468095 +
ggtggtggttgtggtggtgg

SEQ ID NO: 158911 - DNA, 20 bp, Artificial Sequence
  Synthetic oligonucleotide; TGG chr2 60468085 60468104 60468101 +
ggttgtggtggtggtggtga

SEQ ID NO: 158912 - DNA, 20 bp, Artificial Sequence
  Synthetic oligonucleotide; TGG chr2 60468088 60468107 60468104 +
tgtggtggtggtggtgatgg

SEQ ID NO: 158913 - DNA, 20 bp, Artificial Sequence
  Synthetic oligonucleotide; CAG chr2 60468091 60468110 60468107 +
ggtggtggtggtgatggtgg

SEQ ID NO: 158914 - DNA, 20 bp, Artificial Sequence
  Synthetic oligonucleotide; TGG chr2 60468094 60468113 60468110 +
ggtggtggtgatggtggcag

SEQ ID NO: 158915 - DNA, 20 bp, Artificial Sequence
  Synthetic oligonucleotide; TGG chr2 60468097 60468116 60468113 +
ggtggtgatggtggcagtgg

SEQ ID NO: 158916 - DNA, 20 bp, Artificial Sequence
  Synthetic oligonucleotide; TGG chr2 60468103 60468122 60468119 +
gatggtggcagtggtggttg

SEQ ID NO: 158917 - DNA, 20 bp, Artificial Sequence
  Synthetic oligonucleotide; TGG chr2 60468106 60468125 60468122 +
ggtggcagtggtggttgtgg

SEQ ID NO: 158918 - DNA, 20 bp, Artificial Sequence
  Synthetic oligonucleotide; TGG chr2 60468109 60468128 60468125 +
ggcagtggtggttgtggtgg

SEQ ID NO: 158919 - DNA, 20 bp, Artificial Sequence
  Synthetic oligonucleotide; TGG chr2 60468112 60468131 60468128 +
agtggtggttgtggtggtgg

SEQ ID NO: 158920 - DNA, 20 bp, Artificial Sequence
  Synthetic oligonucleotide; TGG chr2 60468118 60468137 60468134 +
ggttgtggtggtggtggtga

SEQ ID NO: 158921 - DNA, 20 bp, Artificial Sequence
  Synthetic oligonucleotide; TGG chr2 60468121 60468140 60468137 +
tgtggtggtggtggtgatgg

SEQ ID NO: 158922 - DNA, 20 bp, Artificial Sequence
  Synthetic oligonucleotide; TGG chr2 60468124 60468143 60468140 +
ggtggtggtggtgatggtgg

SEQ ID NO: 158923 - DNA, 20 bp, Artificial Sequence
  Synthetic oligonucleotide; TGG chr2 60468127 60468146 60468143 +
ggtggtggtgatggtggtgg

SEQ ID NO: 158924 - DNA, 20 bp, Artificial Sequence
  Synthetic oligonucleotide; TGG chr2 60468130 60468149 60468146 +
ggtggtgatggtggtggtgg

SEQ ID NO: 158925 - DNA, 20 bp, Artificial Sequence
  Synthetic oligonucleotide; TGG chr2 60468133 60468152 60468149 +
ggtgatggtggtggtggtgg

SEQ ID NO: 158926 - DNA, 20 bp, Artificial Sequence
  Synthetic oligonucleotide; TAG chr2 60468139 60468158 60468155 +
ggtggtggtggtggtggtga

SEQ ID NO: 158927 - DNA, 20 bp, Artificial Sequence
  Synthetic oligonucleotide; TAG chr2 60468142 60468161 60468158 +
ggtggtggtggtggtgatag

SEQ ID NO: 158928 - DNA, 20 bp, Artificial Sequence
  Synthetic oligonucleotide; GAG chr2 60468144 60468163 60468160 +
tggtggtggtggtgatagta

SEQ ID NO: 158929 - DNA, 20 bp, Artificial Sequence
  Synthetic oligonucleotide; CAG chr2 60468190 60468209 60468206 +
tgtgcatttttctctaaaac

SEQ ID NO: 158930 - DNA, 20 bp, Artificial Sequence
  Synthetic oligonucleotide; AGG chr2 60468191 60468210 60468207 +
gtgcatttttctctaaaacc

SEQ ID NO: 158931 - DNA, 20 bp, Artificial Sequence
  Synthetic oligonucleotide; GAG chr2 60468193 60468212 60468209 +
gcatttttctctaaaaccag

SEQ ID NO: 158932 - DNA, 20 bp, Artificial Sequence
  Synthetic oligonucleotide; TAG chr2 60468202 60468221 60468218 +
tctaaaaccaggagaaaaat

SEQ ID NO: 158933 - DNA, 20 bp, Artificial Sequence
  Synthetic oligonucleotide; TGG chr2 60468218 60468237 60468234 +
aaattagtcaaaattatgtg

SEQ ID NO: 158934 - DNA, 20 bp, Artificial Sequence
  Synthetic oligonucleotide; GGG chr2 60468219 60468238 60468235 +
aattagtcaaaattatgtgt

SEQ ID NO: 158935 - DNA, 20 bp, Artificial Sequence
  Synthetic oligonucleotide; AAG chr2 60468269 60468288 60468285 +
aaatacacatgtaaatacat

SEQ ID NO: 158936 - DNA, 20 bp, Artificial Sequence
  Synthetic oligonucleotide; AGG chr2 60468270 60468289 60468286 +
aatacacatgtaaatacata

SEQ ID NO: 158937 - DNA, 20 bp, Artificial Sequence
  Synthetic oligonucleotide; TGG chr2 60468282 60468301 60468298 +
aatacataaggaatatgcat

SEQ ID NO: 158938 - DNA, 20 bp, Artificial Sequence
  Synthetic oligonucleotide; TGG chr2 60468293 60468312 60468309 +
aatatgcattggaataactc

SEQ ID NO: 158939 - DNA, 20 bp, Artificial Sequence
  Synthetic oligonucleotide; TGG chr2 60468325 60468344 60468341 +
aaactgactccttttgattc

SEQ ID NO: 158940 - DNA, 20 bp, Artificial Sequence
  Synthetic oligonucleotide; TGG chr2 60468331 60468350 60468347 +
actccttttgattctggcct

SEQ ID NO: 158941 - DNA, 20 bp, Artificial Sequence
  Synthetic oligonucleotide; AAG chr2 60468337 60468356 60468353 +
tttgattctggccttggcta

SEQ ID NO: 158942 - DNA, 20 bp, Artificial Sequence
  Synthetic oligonucleotide; TGG chr2 60468350 60468369 60468366 +
ttggctaaagatgtgtgcca

SEQ ID NO: 158943 - DNA, 20 bp, Artificial Sequence
  Synthetic oligonucleotide; AAG chr2 60468363 60468382 60468379 +
tgtgccatggactataccca

SEQ ID NO: 158944 - DNA, 20 bp, Artificial Sequence
  Synthetic oligonucleotide; GAG chr2 60468374 60468393 60468390 +
ctatacccaaagtcctaaat

SEQ ID NO: 158945 - DNA, 20 bp, Artificial Sequence
  Synthetic oligonucleotide; AGG chr2 60468375 60468394 60468391 +
tatacccaaagtcctaaatg

SEQ ID NO: 158946 - DNA, 20 bp, Artificial Sequence
  Synthetic oligonucleotide; CAG chr2 60468381 60468400 60468397 +
caaagtcctaaatgaggcca

SEQ ID NO: 158947 - DNA, 20 bp, Artificial Sequence
  Synthetic oligonucleotide; AGG chr2 60468382 60468401 60468398 +
aaagtcctaaatgaggccac

SEQ ID NO: 158948 - DNA, 20 bp, Artificial Sequence
  Synthetic oligonucleotide; GAG chr2 60468384 60468403 60468400 +
agtcctaaatgaggccacag

SEQ ID NO: 158949 - DNA, 20 bp, Artificial Sequence
  Synthetic oligonucleotide; CAG chr2 60468395 60468414 60468411 +
aggccacaggagtgaatgtc

SEQ ID NO: 158950 - DNA, 20 bp, Artificial Sequence
  Synthetic oligonucleotide; TGG chr2 60468406 60468425 60468422 +
gtgaatgtccagtaataaaa

SEQ ID NO: 158951 - DNA, 20 bp, Artificial Sequence
  Synthetic oligonucleotide; GGG chr2 60468407 60468426 60468423 +
tgaatgtccagtaataaaat

SEQ ID NO: 158952 - DNA, 20 bp, Artificial Sequence
  Synthetic oligonucleotide; CAG chr2 60468413 60468432 60468429 +
tccagtaataaaatgggctc

SEQ ID NO: 158953 - DNA, 20 bp, Artificial Sequence
  Synthetic oligonucleotide; GAG chr2 60468415 60468434 60468431 +
cagtaataaaatgggctcca

SEQ ID NO: 158954 - DNA, 20 bp, Artificial Sequence
  Synthetic oligonucleotide; AGG chr2 60468416 60468435 60468432 +
agtaataaaatgggctccag

SEQ ID NO: 158955 - DNA, 20 bp, Artificial Sequence
  Synthetic oligonucleotide; CAG chr2 60468421 60468440 60468437 +
taaaatgggctccagaggca

SEQ ID NO: 158956 - DNA, 20 bp, Artificial Sequence
  Synthetic oligonucleotide; AGG chr2 60468422 60468441 60468438 +
aaaatgggctccagaggcac

SEQ ID NO: 158957 - DNA, 20 bp, Artificial Sequence
  Synthetic oligonucleotide; TAG chr2 60468438 60468457 60468454 +
gcacaggcatcttcaatcac

SEQ ID NO: 158958 - DNA, 20 bp, Artificial Sequence
  Synthetic oligonucleotide; CGG chr2 60468444 60468463 60468460 +
gcatcttcaatcactagcca

SEQ ID NO: 158959 - DNA, 20 bp, Artificial Sequence
  Synthetic oligonucleotide; GAG chr2 60468446 60468465 60468462 +
atcttcaatcactagccacg

SEQ ID NO: 158960 - DNA, 20 bp, Artificial Sequence
  Synthetic oligonucleotide; AAG chr2 60468450 60468469 60468466 +
tcaatcactagccacggagc

SEQ ID NO: 158961 - DNA, 20 bp, Artificial Sequence
  Synthetic oligonucleotide; AAG chr2 60468455 60468474 60468471 +
cactagccacggagcaagac

SEQ ID NO: 158962 - DNA, 20 bp, Artificial Sequence
  Synthetic oligonucleotide; TGG chr2 60468462 60468481 60468478 +
cacggagcaagacaagaccc

SEQ ID NO: 158963 - DNA, 20 bp, Artificial Sequence
  Synthetic oligonucleotide; GGG chr2 60468463 60468482 60468479 +
acggagcaagacaagaccct

SEQ ID NO: 158964 - DNA, 20 bp, Artificial Sequence
  Synthetic oligonucleotide; GGG chr2 60468464 60468483 60468480 +
cggagcaagacaagaccctg

SEQ ID NO: 158965 - DNA, 20 bp, Artificial Sequence
  Synthetic oligonucleotide; GAG chr2 60468466 60468485 60468482 +
gagcaagacaagaccctggg

SEQ ID NO: 158966 - DNA, 20 bp, Artificial Sequence
  Synthetic oligonucleotide; AAG chr2 60468469 60468488 60468485 +
caagacaagaccctggggag

SEQ ID NO: 158967 - DNA, 20 bp, Artificial Sequence
  Synthetic oligonucleotide; CAG chr2 60468477 60468496 60468493 +
gaccctggggagaagaccca

SEQ ID NO: 158968 - DNA, 20 bp, Artificial Sequence
  Synthetic oligonucleotide; AGG chr2 60468478 60468497 60468494 +
accctggggagaagacccac

SEQ ID NO: 158969 - DNA, 20 bp, Artificial Sequence
  Synthetic oligonucleotide; GGG chr2 60468479 60468498 60468495 +
ccctggggagaagacccaca

SEQ ID NO: 158970 - DNA, 20 bp, Artificial Sequence
  Synthetic oligonucleotide; GAG chr2 60468484 60468503 60468500 +
gggagaagacccacagggat

SEQ ID NO: 158971 - DNA, 20 bp, Artificial Sequence
  Synthetic oligonucleotide; CAG chr2 60468494 60468513 60468510 +
ccacagggatgagctactat

SEQ ID NO: 158972 - DNA, 20 bp, Artificial Sequence
  Synthetic oligonucleotide; CAG chr2 60468501 60468520 60468517 +
gatgagctactatcagctcc

SEQ ID NO: 158973 - DNA, 20 bp, Artificial Sequence
  Synthetic oligonucleotide; CAG chr2 60468508 60468527 60468524 +
tactatcagctcccagcctc

SEQ ID NO: 158974 - DNA, 20 bp, Artificial Sequence
  Synthetic oligonucleotide; GAG chr2 60468512 60468531 60468528 +
atcagctcccagcctccagt

SEQ ID NO: 158975 - DNA, 20 bp, Artificial Sequence
  Synthetic oligonucleotide; AGG chr2 60468513 60468532 60468529 +
tcagctcccagcctccagtg

SEQ ID NO: 158976 - DNA, 20 bp, Artificial Sequence
  Synthetic oligonucleotide; AAG chr2 60468517 60468536 60468533 +
ctcccagcctccagtgagga

SEQ ID NO: 158977 - DNA, 20 bp, Artificial Sequence
  Synthetic oligonucleotide; AAG chr2 60468523 60468542 60468539 +
gcctccagtgaggaaagaaa

SEQ ID NO: 158978 - DNA, 20 bp, Artificial Sequence
  Synthetic oligonucleotide; AGG chr2 60468524 60468543 60468540 +
cctccagtgaggaaagaaaa

SEQ ID NO: 158979 - DNA, 20 bp, Artificial Sequence
  Synthetic oligonucleotide; GGG chr2 60468525 60468544 60468541 +
ctccagtgaggaaagaaaaa

SEQ ID NO: 158980 - DNA, 20 bp, Artificial Sequence
  Synthetic oligonucleotide; GGG chr2 60468526 60468545 60468542 +
tccagtgaggaaagaaaaag

SEQ ID NO: 158981 - DNA, 20 bp, Artificial Sequence
  Synthetic oligonucleotide; GAG chr2 60468528 60468547 60468544 +
cagtgaggaaagaaaaaggg

SEQ ID NO: 158982 - DNA, 20 bp, Artificial Sequence
  Synthetic oligonucleotide; AGG chr2 60468529 60468548 60468545 +
agtgaggaaagaaaaagggg

SEQ ID NO: 158983 - DNA, 20 bp, Artificial Sequence
  Synthetic oligonucleotide; GGG chr2 60468530 60468549 60468546 +
gtgaggaaagaaaaagggga

SEQ ID NO: 158984 - DNA, 20 bp, Artificial Sequence
  Synthetic oligonucleotide; AAG chr2 60468533 60468552 60468549 +
aggaaagaaaaaggggaggg

SEQ ID NO: 158985 - DNA, 20 bp, Artificial Sequence
  Synthetic oligonucleotide; AAG chr2 60468536 60468555 60468552 +
aaagaaaaaggggagggaag

SEQ ID NO: 158986 - DNA, 20 bp, Artificial Sequence
  Synthetic oligonucleotide; TGG chr2 60468545 60468564 60468561 +
ggggagggaagaagtccctc

SEQ ID NO: 158987 - DNA, 20 bp, Artificial Sequence
  Synthetic oligonucleotide; GGG chr2 60468546 60468565 60468562 +
gggagggaagaagtccctct

SEQ ID NO: 158988 - DNA, 20 bp, Artificial Sequence
  Synthetic oligonucleotide; GGG chr2 60468547 60468566 60468563 +
ggagggaagaagtccctctg

SEQ ID NO: 158989 - DNA, 20 bp, Artificial Sequence
  Synthetic oligonucleotide; GAG chr2 60468552 60468571 60468568 +
gaagaagtccctctggggct

SEQ ID NO: 158990 - DNA, 20 bp, Artificial Sequence
  Synthetic oligonucleotide; TGG chr2 60468555 60468574 60468571 +
gaagtccctctggggctgag

SEQ ID NO: 158991 - DNA, 20 bp, Artificial Sequence
  Synthetic oligonucleotide; GAG chr2 60468557 60468576 60468573 +
agtccctctggggctgagtg

SEQ ID NO: 158992 - DNA, 20 bp, Artificial Sequence
  Synthetic oligonucleotide; TGG chr2 60468560 60468579 60468576 +
ccctctggggctgagtggag

SEQ ID NO: 158993 - DNA, 20 bp, Artificial Sequence
  Synthetic oligonucleotide; GGG chr2 60468561 60468580 60468577 +
cctctggggctgagtggagt

SEQ ID NO: 158994 - DNA, 20 bp, Artificial Sequence
  Synthetic oligonucleotide; GGG chr2 60468562 60468581 60468578 +
ctctggggctgagtggagtg

SEQ ID NO: 158995 - DNA, 20 bp, Artificial Sequence
  Synthetic oligonucleotide; GAG chr2 60468564 60468583 60468580 +
ctggggctgagtggagtggg

SEQ ID NO: 158996 - DNA, 20 bp, Artificial Sequence
  Synthetic oligonucleotide; CGG chr2 60468567 60468586 60468583 +
gggctgagtggagtggggag

SEQ ID NO: 158997 - DNA, 20 bp, Artificial Sequence
  Synthetic oligonucleotide; AAG chr2 60468575 60468594 60468591 +
tggagtggggagcggctgcc

SEQ ID NO: 158998 - DNA, 20 bp, Artificial Sequence
  Synthetic oligonucleotide; GAG chr2 60468579 60468598 60468595 +
gtggggagcggctgccaagt

SEQ ID NO: 158999 - DNA, 20 bp, Artificial Sequence
  Synthetic oligonucleotide; TGG chr2 60468585 60468604 60468601 +
agcggctgccaagtgagtaa

SEQ ID NO: 159000 - DNA, 20 bp, Artificial Sequence
  Synthetic oligonucleotide; TGG chr2 60468612 60468631 60468628 +
atacatatgacaatctattt

SEQ ID NO: 159001 - DNA, 20 bp, Artificial Sequence
  Synthetic oligonucleotide; AAG chr2 60468615 60468634 60468631 +
catatgacaatctattttgg

SEQ ID NO: 159002 - DNA, 20 bp, Artificial Sequence
  Synthetic oligonucleotide; CAG chr2 60468627 60468646 60468643 +
tattttggaagtaactcctt

SEQ ID NO: 159003 - DNA, 20 bp, Artificial Sequence
  Synthetic oligonucleotide; AAG chr2 60468638 60468657 60468654 +
taactccttcagtacttaaa

SEQ ID NO: 159004 - DNA, 20 bp, Artificial Sequence
  Synthetic oligonucleotide; AAG chr2 60468642 60468661 60468658 +
tccttcagtacttaaaaagt

SEQ ID NO: 159005 - DNA, 20 bp, Artificial Sequence
  Synthetic oligonucleotide; AGG chr2 60468643 60468662 60468659 +
ccttcagtacttaaaaagta

SEQ ID NO: 159006 - DNA, 20 bp, Artificial Sequence
  Synthetic oligonucleotide; GGG chr2 60468644 60468663 60468660 +
cttcagtacttaaaaagtaa

SEQ ID NO: 159007 - DNA, 20 bp, Artificial Sequence
  Synthetic oligonucleotide; CAG chr2 60468654 60468673 60468670 +
taaaaagtaagggcaatttc

SEQ ID NO: 159008 - DNA, 20 bp, Artificial Sequence
  Synthetic oligonucleotide; TGG chr2 60468678 60468697 60468694 +
aattctcatctctatacaca

SEQ ID NO: 159009 - DNA, 20 bp, Artificial Sequence
  Synthetic oligonucleotide; TAG chr2 60468688 60468707 60468704 +
tctatacacatggacatttg

SEQ ID NO: 159010 - DNA, 20 bp, Artificial Sequence
  Synthetic oligonucleotide; AAG chr2 60468691 60468710 60468707 +
atacacatggacatttgtag

SEQ ID NO: 159011 - DNA, 20 bp, Artificial Sequence
  Synthetic oligonucleotide; AAG chr2 60468698 60468717 60468714 +
tggacatttgtagaagaaat

SEQ ID NO: 159012 - DNA, 20 bp, Artificial Sequence
  Synthetic oligonucleotide; AGG chr2 60468699 60468718 60468715 +
ggacatttgtagaagaaata

SEQ ID NO: 159013 - DNA, 20 bp, Artificial Sequence
  Synthetic oligonucleotide; CGG chr2 60468722 60468741 60468738 +
ctcaacttacaaataccctg

SEQ ID NO: 159014 - DNA, 20 bp, Artificial Sequence
  Synthetic oligonucleotide; GGG chr2 60468723 60468742 60468739 +
tcaacttacaaataccctgc

SEQ ID NO: 159015 - DNA, 20 bp, Artificial Sequence
  Synthetic oligonucleotide; GGG chr2 60468724 60468743 60468740 +
caacttacaaataccctgcg

SEQ ID NO: 159016 - DNA, 20 bp, Artificial Sequence
  Synthetic oligonucleotide; CAG chr2 60468745 60468764 60468761 +
ggcatattctgcactcatcc

SEQ ID NO: 159017 - DNA, 20 bp, Artificial Sequence
  Synthetic oligonucleotide; AGG chr2 60468746 60468765 60468762 +
gcatattctgcactcatccc

SEQ ID NO: 159018 - DNA, 20 bp, Artificial Sequence
  Synthetic oligonucleotide; TGG chr2 60468751 60468770 60468767 +
ttctgcactcatcccaggcg

SEQ ID NO: 159019 - DNA, 20 bp, Artificial Sequence
  Synthetic oligonucleotide; GGG chr2 60468752 60468771 60468768 +
tctgcactcatcccaggcgt

SEQ ID NO: 159020 - DNA, 20 bp, Artificial Sequence
  Synthetic oligonucleotide; GGG chr2 60468753 60468772 60468769 +
ctgcactcatcccaggcgtg

SEQ ID NO: 159021 - DNA, 20 bp, Artificial Sequence
  Synthetic oligonucleotide; TAG chr2 60468758 60468777 60468774 +
ctcatcccaggcgtggggat

SEQ ID NO: 159022 - DNA, 20 bp, Artificial Sequence
  Synthetic oligonucleotide; GAG chr2 60468760 60468779 60468776 +
catcccaggcgtggggatta

SEQ ID NO: 159023 - DNA, 20 bp, Artificial Sequence
  Synthetic oligonucleotide; CAG chr2 60468772 60468791 60468788 +
ggggattagagctccatgtg

SEQ ID NO: 159024 - DNA, 20 bp, Artificial Sequence
  Synthetic oligonucleotide; GAG chr2 60468778 60468797 60468794 +
tagagctccatgtgcagaac

SEQ ID NO: 159025 - DNA, 20 bp, Artificial Sequence
  Synthetic oligonucleotide; AGG chr2 60468779 60468798 60468795 +
agagctccatgtgcagaacg

SEQ ID NO: 159026 - DNA, 20 bp, Artificial Sequence
  Synthetic oligonucleotide; GGG chr2 60468780 60468799 60468796 +
gagctccatgtgcagaacga

SEQ ID NO: 159027 - DNA, 20 bp, Artificial Sequence
  Synthetic oligonucleotide; GGG chr2 60468781 60468800 60468797 +
agctccatgtgcagaacgag

SEQ ID NO: 159028 - DNA, 20 bp, Artificial Sequence
  Synthetic oligonucleotide; GAG chr2 60468783 60468802 60468799 +
ctccatgtgcagaacgaggg

SEQ ID NO: 159029 - DNA, 20 bp, Artificial Sequence
  Synthetic oligonucleotide; AGG chr2 60468784 60468803 60468800 +
tccatgtgcagaacgagggg

SEQ ID NO: 159030 - DNA, 20 bp, Artificial Sequence
  Synthetic oligonucleotide; GAG chr2 60468786 60468805 60468802 +
catgtgcagaacgaggggag

SEQ ID NO: 159031 - DNA, 20 bp, Artificial Sequence
  Synthetic oligonucleotide; GAG chr2 60468788 60468807 60468804 +
tgtgcagaacgaggggagga

SEQ ID NO: 159032 - DNA, 20 bp, Artificial Sequence
  Synthetic oligonucleotide; AGG chr2 60468789 60468808 60468805 +
gtgcagaacgaggggaggag

SEQ ID NO: 159033 - DNA, 20 bp, Artificial Sequence
  Synthetic oligonucleotide; CAG chr2 60468798 60468817 60468814 +
gaggggaggagaggcccctc

SEQ ID NO: 159034 - DNA, 20 bp, Artificial Sequence
  Synthetic oligonucleotide; CAG chr2 60468803 60468822 60468819 +
gaggagaggcccctccagtg

SEQ ID NO: 159035 - DNA, 20 bp, Artificial Sequence
  Synthetic oligonucleotide; AAG chr2 60468806 60468825 60468822 +
gagaggcccctccagtgcag

SEQ ID NO: 159036 - DNA, 20 bp, Artificial Sequence
  Synthetic oligonucleotide; AAG chr2 60468820 60468839 60468836 +
gtgcagaagtttatctgtga

SEQ ID NO: 159037 - DNA, 20 bp, Artificial Sequence
  Synthetic oligonucleotide; AAG chr2 60468835 60468854 60468851 +
tgtgaaagaaacccaaaatc

SEQ ID NO: 159038 - DNA, 20 bp, Artificial Sequence
  Synthetic oligonucleotide; CAG chr2 60468843 60468862 60468859 +
aaacccaaaatcaagcacta

SEQ ID NO: 159039 - DNA, 20 bp, Artificial Sequence
  Synthetic oligonucleotide; CAG chr2 60468872 60468891 60468888 +
acaacgtgcatcataaacca

SEQ ID NO: 159040 - DNA, 20 bp, Artificial Sequence
  Synthetic oligonucleotide; AGG chr2 60468873 60468892 60468889 +
caacgtgcatcataaaccac

SEQ ID NO: 159041 - DNA, 20 bp, Artificial Sequence
  Synthetic oligonucleotide; TAG chr2 60468901 60468920 60468917 +
acatttcaattccattaaaa

SEQ ID NO: 159042 - DNA, 20 bp, Artificial Sequence
  Synthetic oligonucleotide; CAG chr2 60468922 60468941 60468938 +
agattacaacatcattacaa

SEQ ID NO: 159043 - DNA, 20 bp, Artificial Sequence
  Synthetic oligonucleotide; CAG chr2 60468930 60468949 60468946 +
acatcattacaacagccttg

SEQ ID NO: 159044 - DNA, 20 bp, Artificial Sequence
  Synthetic oligonucleotide; TAG chr2 60468934 60468953 60468950 +
cattacaacagccttgcaga

SEQ ID NO: 159045 - DNA, 20 bp, Artificial Sequence
  Synthetic oligonucleotide; CAG chr2 60468941 60468960 60468957 +
acagccttgcagatagttaa

SEQ ID NO: 159046 - DNA, 20 bp, Artificial Sequence
  Synthetic oligonucleotide; AGG chr2 60468942 60468961 60468958 +
cagccttgcagatagttaac

SEQ ID NO: 159047 - DNA, 20 bp, Artificial Sequence
  Synthetic oligonucleotide; AAG chr2 60468948 60468967 60468964 +
tgcagatagttaacaggccc

SEQ ID NO: 159048 - DNA, 20 bp, Artificial Sequence
  Synthetic oligonucleotide; AGG chr2 60468949 60468968 60468965 +
gcagatagttaacaggccca

SEQ ID NO: 159049 - DNA, 20 bp, Artificial Sequence
  Synthetic oligonucleotide; AAG chr2 60468962 60468981 60468978 +
aggcccaaggcctgaaacaa

SEQ ID NO: 159050 - DNA, 20 bp, Artificial Sequence
  Synthetic oligonucleotide; AAG chr2 60468965 60468984 60468981 +
cccaaggcctgaaacaaaag

SEQ ID NO: 159051 - DNA, 20 bp, Artificial Sequence
  Synthetic oligonucleotide; GAG chr2 60468967 60468986 60468983 +
caaggcctgaaacaaaagaa

SEQ ID NO: 159052 - DNA, 20 bp, Artificial Sequence
  Synthetic oligonucleotide; TGG chr2 60468970 60468989 60468986 +
ggcctgaaacaaaagaagag

SEQ ID NO: 159053 - DNA, 20 bp, Artificial Sequence
  Synthetic oligonucleotide; GAG chr2 60468974 60468993 60468990 +
tgaaacaaaagaagagtggt

SEQ ID NO: 159054 - DNA, 20 bp, Artificial Sequence
  Synthetic oligonucleotide; CAG chr2 60468985 60469004 60469001 +
aagagtggtgagttatttcc

SEQ ID NO: 159055 - DNA, 20 bp, Artificial Sequence
  Synthetic oligonucleotide; GAG chr2 60468987 60469006 60469003 +
gagtggtgagttatttccca

SEQ ID NO: 159056 - DNA, 20 bp, Artificial Sequence
  Synthetic oligonucleotide; CGG chr2 60469011 60469030 60469027 +
ttctgttttgttttcaattt

SEQ ID NO: 159057 - DNA, 20 bp, Artificial Sequence
  Synthetic oligonucleotide; AAG chr2 60469026 60469045 60469042 +
aatttcggtctttttgacaa

SEQ ID NO: 159058 - DNA, 20 bp, Artificial Sequence
  Synthetic oligonucleotide; AAG chr2 60469032 60469051 60469048 +
ggtctttttgacaaaagtga

SEQ ID NO: 159059 - DNA, 20 bp, Artificial Sequence
  Synthetic oligonucleotide; AGG chr2 60469033 60469052 60469049 +
gtctttttgacaaaagtgaa

SEQ ID NO: 159060 - DNA, 20 bp, Artificial Sequence
  Synthetic oligonucleotide; GGG chr2 60469034 60469053 60469050 +
tctttttgacaaaagtgaaa

SEQ ID NO: 159061 - DNA, 20 bp, Artificial Sequence
  Synthetic oligonucleotide; TAG chr2 60469044 60469063 60469060 +
aaaagtgaaagggtttgttt

SEQ ID NO: 159062 - DNA, 20 bp, Artificial Sequence
  Synthetic oligonucleotide; AGG chr2 60469045 60469064 60469061 +
aaagtgaaagggtttgtttt

SEQ ID NO: 159063 - DNA, 20 bp, Artificial Sequence
  Synthetic oligonucleotide; AAG chr2 60469049 60469068 60469065 +
tgaaagggtttgttttagga

SEQ ID NO: 159064 - DNA, 20 bp, Artificial Sequence
  Synthetic oligonucleotide; AGG chr2 60469050 60469069 60469066 +
gaaagggtttgttttaggaa

SEQ ID NO: 159065 - DNA, 20 bp, Artificial Sequence
  Synthetic oligonucleotide; GGG chr2 60469051 60469070 60469067 +
aaagggtttgttttaggaaa

SEQ ID NO: 159066 - DNA, 20 bp, Artificial Sequence
  Synthetic oligonucleotide; GGG chr2 60469052 60469071 60469068 +
aagggtttgttttaggaaag

SEQ ID NO: 159067 - DNA, 20 bp, Artificial Sequence
  Synthetic oligonucleotide; GAG chr2 60469054 60469073 60469070 +
gggtttgttttaggaaaggg

SEQ ID NO: 159068 - DNA, 20 bp, Artificial Sequence
  Synthetic oligonucleotide; GAG chr2 60469056 60469075 60469072 +
gtttgttttaggaaagggga

SEQ ID NO: 159069 - DNA, 20 bp, Artificial Sequence
  Synthetic oligonucleotide; AGG chr2 60469057 60469076 60469073 +
tttgttttaggaaaggggag

SEQ ID NO: 159070 - DNA, 20 bp, Artificial Sequence
  Synthetic oligonucleotide; TGG chr2 60469060 60469079 60469076 +
gttttaggaaaggggagagg

SEQ ID NO: 159071 - DNA, 20 bp, Artificial Sequence
  Synthetic oligonucleotide; TGG chr2 60469067 60469086 60469083 +
gaaaggggagaggtggtctt

SEQ ID NO: 159072 - DNA, 20 bp, Artificial Sequence
  Synthetic oligonucleotide; TGG chr2 60469112 60469131 60469128 +
gttgtttgattattgtcttg

SEQ ID NO: 159073 - DNA, 20 bp, Artificial Sequence
  Synthetic oligonucleotide; AAG chr2 60469116 60469135 60469132 +
tttgattattgtcttgtgga

SEQ ID NO: 159074 - DNA, 20 bp, Artificial Sequence
  Synthetic oligonucleotide; AAG chr2 60469119 60469138 60469135 +
gattattgtcttgtggaaag

SEQ ID NO: 159075 - DNA, 20 bp, Artificial Sequence
  Synthetic oligonucleotide; AAG chr2 60469128 60469147 60469144 +
cttgtggaaagaagatgtgt

SEQ ID NO: 159076 - DNA, 20 bp, Artificial Sequence
  Synthetic oligonucleotide; CAG chr2 60469131 60469150 60469147 +
gtggaaagaagatgtgtaag

SEQ ID NO: 159077 - DNA, 20 bp, Artificial Sequence
  Synthetic oligonucleotide; AAG chr2 60469135 60469154 60469151 +
aaagaagatgtgtaagcagc

SEQ ID NO: 159078 - DNA, 20 bp, Artificial Sequence
  Synthetic oligonucleotide; AGG chr2 60469136 60469155 60469152 +
aagaagatgtgtaagcagca

SEQ ID NO: 159079 - DNA, 20 bp, Artificial Sequence
  Synthetic oligonucleotide; GGG chr2 60469137 60469156 60469153 +
agaagatgtgtaagcagcaa

SEQ ID NO: 159080 - DNA, 20 bp, Artificial Sequence
  Synthetic oligonucleotide; GGG chr2 60469138 60469157 60469154 +
gaagatgtgtaagcagcaag

SEQ ID NO: 159081 - DNA, 20 bp, Artificial Sequence
  Synthetic oligonucleotide; TGG chr2 60469146 60469165 60469162 +
gtaagcagcaaggggaaaac

SEQ ID NO: 159082 - DNA, 20 bp, Artificial Sequence
  Synthetic oligonucleotide; TGG chr2 60469157 60469176 60469173 +
ggggaaaactggtaatattg

SEQ ID NO: 159083 - DNA, 20 bp, Artificial Sequence
  Synthetic oligonucleotide; GGG chr2 60469158 60469177 60469174 +
gggaaaactggtaatattgt

SEQ ID NO: 159084 - DNA, 20 bp, Artificial Sequence
  Synthetic oligonucleotide; TAG chr2 60469161 60469180 60469177 +
aaaactggtaatattgtggg

SEQ ID NO: 159085 - DNA, 20 bp, Artificial Sequence
  Synthetic oligonucleotide; TGG chr2 60469166 60469185 60469182 +
tggtaatattgtgggtagcc

SEQ ID NO: 159086 - DNA, 20 bp, Artificial Sequence
  Synthetic oligonucleotide; TGG chr2 60469174 60469193 60469190 +
ttgtgggtagcctggaaaca

SEQ ID NO: 159087 - DNA, 20 bp, Artificial Sequence
  Synthetic oligonucleotide; GGG chr2 60469175 60469194 60469191 +
tgtgggtagcctggaaacat

SEQ ID NO: 159088 - DNA, 20 bp, Artificial Sequence
  Synthetic oligonucleotide; GGG chr2 60469176 60469195 60469192 +
gtgggtagcctggaaacatg

SEQ ID NO: 159089 - DNA, 20 bp, Artificial Sequence
  Synthetic oligonucleotide; GGG chr2 60469177 60469196 60469193 +
tgggtagcctggaaacatgg

SEQ ID NO: 159090 - DNA, 20 bp, Artificial Sequence
  Synthetic oligonucleotide; GGG chr2 60469178 60469197 60469194 +
gggtagcctggaaacatggg

SEQ ID NO: 159091 - DNA, 20 bp, Artificial Sequence
  Synthetic oligonucleotide; AAG chr2 60469192 60469211 60469208 +
catggggggattttatctgc

SEQ ID NO: 159092 - DNA, 20 bp, Artificial Sequence
  Synthetic oligonucleotide; AGG chr2 60469193 60469212 60469209 +
atggggggattttatctgca

SEQ ID NO: 159093 - DNA, 20 bp, Artificial Sequence
  Synthetic oligonucleotide; TGG chr2 60469197 60469216 60469213 +
ggggattttatctgcaaggc

SEQ ID NO: 159094 - DNA, 20 bp, Artificial Sequence
  Synthetic oligonucleotide; TAG chr2 60469228 60469247 60469244 +
catacattaactttacttta

SEQ ID NO: 159095 - DNA, 20 bp, Artificial Sequence
  Synthetic oligonucleotide; AAG chr2 60469239 60469258 60469255 +
tttactttatagacaaaccc

SEQ ID NO: 159096 - DNA, 20 bp, Artificial Sequence
  Synthetic oligonucleotide; AAG chr2 60469246 60469265 60469262 +
tatagacaaacccaagcaaa

SEQ ID NO: 159097 - DNA, 20 bp, Artificial Sequence
  Synthetic oligonucleotide; TAG chr2 60469260 60469279 60469276 +
agcaaaaagcaaaatgctga

SEQ ID NO: 159098 - DNA, 20 bp, Artificial Sequence
  Synthetic oligonucleotide; AGG chr2 60469261 60469280 60469277 +
gcaaaaagcaaaatgctgat

SEQ ID NO: 159099 - DNA, 20 bp, Artificial Sequence
  Synthetic oligonucleotide; GAG chr2 60469268 60469287 60469284 +
gcaaaatgctgataggaaat

SEQ ID NO: 159100 - DNA, 20 bp, Artificial Sequence
  Synthetic oligonucleotide; TAG chr2 60469271 60469290 60469287 +
aaatgctgataggaaatgag

SEQ ID NO: 159101 - DNA, 20 bp, Artificial Sequence
  Synthetic oligonucleotide; TGG chr2 60469293 60469312 60469309 +
gatttgtgaatcgtttttta

SEQ ID NO: 159102 - DNA, 20 bp, Artificial Sequence
  Synthetic oligonucleotide; GGG chr2 60469294 60469313 60469310 +
atttgtgaatcgttttttat

SEQ ID NO: 159103 - DNA, 20 bp, Artificial Sequence
  Synthetic oligonucleotide; CAG chr2 60469298 60469317 60469314 +
gtgaatcgttttttatggga

SEQ ID NO: 159104 - DNA, 20 bp, Artificial Sequence
  Synthetic oligonucleotide; GAG chr2 60469300 60469319 60469316 +
gaatcgttttttatgggaca

SEQ ID NO: 159105 - DNA, 20 bp, Artificial Sequence
  Synthetic oligonucleotide; TAG chr2 60469358 60469377 60469374 +
ttcccatgctatatttatga

SEQ ID NO: 159106 - DNA, 20 bp, Artificial Sequence
  Synthetic oligonucleotide; CAG chr2 60469367 60469386 60469383 +
tatatttatgatagcgcctt

SEQ ID NO: 159107 - DNA, 20 bp, Artificial Sequence
  Synthetic oligonucleotide; TAG chr2 60469373 60469392 60469389 +
tatgatagcgccttcagtga

SEQ ID NO: 159108 - DNA, 20 bp, Artificial Sequence
  Synthetic oligonucleotide; AGG chr2 60469374 60469393 60469390 +
atgatagcgccttcagtgat

SEQ ID NO: 159109 - DNA, 20 bp, Artificial Sequence
  Synthetic oligonucleotide; GGG chr2 60469375 60469394 60469391 +
tgatagcgccttcagtgata

SEQ ID NO: 159110 - DNA, 20 bp, Artificial Sequence
  Synthetic oligonucleotide; GGG chr2 60469376 60469395 60469392 +
gatagcgccttcagtgatag

SEQ ID NO: 159111 - DNA, 20 bp, Artificial Sequence
  Synthetic oligonucleotide; TGG chr2 60469384 60469403 60469400 +
cttcagtgataggggaaacc

SEQ ID NO: 159112 - DNA, 20 bp, Artificial Sequence
  Synthetic oligonucleotide; GGG chr2 60469385 60469404 60469401 +
ttcagtgataggggaaacct

SEQ ID NO: 159113 - DNA, 20 bp, Artificial Sequence
  Synthetic oligonucleotide; TGG chr2 60469394 60469413 60469410 +
aggggaaacctgggcatttc

SEQ ID NO: 159114 - DNA, 20 bp, Artificial Sequence
  Synthetic oligonucleotide; GAG chr2 60469400 60469419 60469416 +
aacctgggcatttctggact

SEQ ID NO: 159115 - DNA, 20 bp, Artificial Sequence
  Synthetic oligonucleotide; TGG chr2 60469404 60469423 60469420 +
tgggcatttctggactgagc

SEQ ID NO: 159116 - DNA, 20 bp, Artificial Sequence
  Synthetic oligonucleotide; GGG chr2 60469405 60469424 60469421 +
gggcatttctggactgagct

SEQ ID NO: 159117 - DNA, 20 bp, Artificial Sequence
  Synthetic oligonucleotide; TAG chr2 60469416 60469435 60469432 +
gactgagctgggccatactc

SEQ ID NO: 159118 - DNA, 20 bp, Artificial Sequence
  Synthetic oligonucleotide; TGG chr2 60469431 60469450 60469447 +
tactctagaatcctgtcaac

SEQ ID NO: 159119 - DNA, 20 bp, Artificial Sequence
  Synthetic oligonucleotide; CAG chr2 60469444 60469463 60469460 +
tgtcaactggaaaccttaca

SEQ ID NO: 159120 - DNA, 20 bp, Artificial Sequence
  Synthetic oligonucleotide; TGG chr2 60469450 60469469 60469466 +
ctggaaaccttacacagatg

SEQ ID NO: 159121 - DNA, 20 bp, Artificial Sequence
  Synthetic oligonucleotide; AAG chr2 60469467 60469486 60469483 +
atgtggcttctcacaataca

SEQ ID NO: 159122 - DNA, 20 bp, Artificial Sequence
  Synthetic oligonucleotide; TGG chr2 60469473 60469492 60469489 +
cttctcacaatacaaagcaa

SEQ ID NO: 159123 - DNA, 20 bp, Artificial Sequence
  Synthetic oligonucleotide; AAG chr2 60469476 60469495 60469492 +
ctcacaatacaaagcaatgg

SEQ ID NO: 159124 - DNA, 20 bp, Artificial Sequence
  Synthetic oligonucleotide; AAG chr2 60469482 60469501 60469498 +
atacaaagcaatggaagata

SEQ ID NO: 159125 - DNA, 20 bp, Artificial Sequence
  Synthetic oligonucleotide; TAG chr2 60469487 60469506 60469503 +
aagcaatggaagataaagat

SEQ ID NO: 159126 - DNA, 20 bp, Artificial Sequence
  Synthetic oligonucleotide; TGG chr2 60469495 60469514 60469511 +
gaagataaagattagacttc

SEQ ID NO: 159127 - DNA, 20 bp, Artificial Sequence
  Synthetic oligonucleotide; GGG chr2 60469496 60469515 60469512 +
aagataaagattagacttct

SEQ ID NO: 159128 - DNA, 20 bp, Artificial Sequence
  Synthetic oligonucleotide; GGG chr2 60469497 60469516 60469513 +
agataaagattagacttctg

SEQ ID NO: 159129 - DNA, 20 bp, Artificial Sequence
  Synthetic oligonucleotide; AAG chr2 60469527 60469546 60469543 +
aactttgaccattaaatgac

SEQ ID NO: 159130 - DNA, 20 bp, Artificial Sequence
  Synthetic oligonucleotide; AGG chr2 60469528 60469547 60469544 +
actttgaccattaaatgaca

SEQ ID NO: 159131 - DNA, 20 bp, Artificial Sequence
  Synthetic oligonucleotide; AAG chr2 60469532 60469551 60469548 +
tgaccattaaatgacaagga

SEQ ID NO: 159132 - DNA, 20 bp, Artificial Sequence
  Synthetic oligonucleotide; CAG chr2 60469538 60469557 60469554 +
ttaaatgacaaggaaagaac

SEQ ID NO: 159133 - DNA, 20 bp, Artificial Sequence
  Synthetic oligonucleotide; CAG chr2 60469555 60469574 60469571 +
aaccagcattccaataatgc

SEQ ID NO: 159134 - DNA, 20 bp, Artificial Sequence
  Synthetic oligonucleotide; CAG chr2 60469562 60469581 60469578 +
attccaataatgccagcacc

SEQ ID NO: 159135 - DNA, 20 bp, Artificial Sequence
  Synthetic oligonucleotide; TGG chr2 60469610 60469629 60469626 +
tactgcactttgttgtactc

SEQ ID NO: 159136 - DNA, 20 bp, Artificial Sequence
  Synthetic oligonucleotide; AAG chr2 60469615 60469634 60469631 +
cactttgttgtactctggtg

SEQ ID NO: 159137 - DNA, 20 bp, Artificial Sequence
  Synthetic oligonucleotide; AAG chr2 60469620 60469639 60469636 +
tgttgtactctggtgaagac

SEQ ID NO: 159138 - DNA, 20 bp, Artificial Sequence
  Synthetic oligonucleotide; TAG chr2 60469653 60469672 60469669 +
cactaataaaatgaatctaa

SEQ ID NO: 159139 - DNA, 20 bp, Artificial Sequence
  Synthetic oligonucleotide; TAG chr2 60469671 60469690 60469687 +
aatagtcaatgaaacatttg

SEQ ID NO: 159140 - DNA, 20 bp, Artificial Sequence
  Synthetic oligonucleotide; GAG chr2 60469678 60469697 60469694 +
aatgaaacatttgtagcact

SEQ ID NO: 159141 - DNA, 20 bp, Artificial Sequence
  Synthetic oligonucleotide; GAG chr2 60469689 60469708 60469705 +
tgtagcactgagattttttt

SEQ ID NO: 159142 - DNA, 20 bp, Artificial Sequence
  Synthetic oligonucleotide; AAG chr2 60469692 60469711 60469708 +
agcactgagatttttttgag

SEQ ID NO: 159143 - DNA, 20 bp, Artificial Sequence
  Synthetic oligonucleotide; GAG chr2 60469694 60469713 60469710 +
cactgagatttttttgagaa

SEQ ID NO: 159144 - DNA, 20 bp, Artificial Sequence
  Synthetic oligonucleotide; AGG chr2 60469695 60469714 60469711 +
actgagatttttttgagaag

SEQ ID NO: 159145 - DNA, 20 bp, Artificial Sequence
  Synthetic oligonucleotide; TGG chr2 60469704 60469723 60469720 +
tttttgagaagaggaaaatt

SEQ ID NO: 159146 - DNA, 20 bp, Artificial Sequence
  Synthetic oligonucleotide; TGG chr2 60469718 60469737 60469734 +
aaaatttggtttgtgcaatc

SEQ ID NO: 159147 - DNA, 20 bp, Artificial Sequence
  Synthetic oligonucleotide; GGG chr2 60469719 60469738 60469735 +
aaatttggtttgtgcaatct

SEQ ID NO: 159148 - DNA, 20 bp, Artificial Sequence
  Synthetic oligonucleotide; GGG chr2 60469720 60469739 60469736 +
aatttggtttgtgcaatctg

SEQ ID NO: 159149 - DNA, 20 bp, Artificial Sequence
  Synthetic oligonucleotide; CGG chr2 60469729 60469748 60469745 +
tgtgcaatctggggatttta

SEQ ID NO: 159150 - DNA, 20 bp, Artificial Sequence
  Synthetic oligonucleotide; TGG chr2 60469738 60469757 60469754 +
tggggattttacggtttatg

SEQ ID NO: 159151 - DNA, 20 bp, Artificial Sequence
  Synthetic oligonucleotide; AAG chr2 60469742 60469761 60469758 +
gattttacggtttatgtggt

SEQ ID NO: 159152 - DNA, 20 bp, Artificial Sequence
  Synthetic oligonucleotide; TAG chr2 60469749 60469768 60469765 +
cggtttatgtggtaagtgcc

SEQ ID NO: 159153 - DNA, 20 bp, Artificial Sequence
  Synthetic oligonucleotide; AAG chr2 60469759 60469778 60469775 +
ggtaagtgcctagcttttcc

SEQ ID NO: 159154 - DNA, 20 bp, Artificial Sequence
  Synthetic oligonucleotide; TAG chr2 60469770 60469789 60469786 +
agcttttccaagtcctcctc

SEQ ID NO: 159155 - DNA, 20 bp, Artificial Sequence
  Synthetic oligonucleotide; TAG chr2 60469786 60469805 60469802 +
cctctagctaactaaccatg

SEQ ID NO: 159156 - DNA, 20 bp, Artificial Sequence
  Synthetic oligonucleotide; GAG chr2 60469800 60469819 60469816 +
accatgtagctgtccatctt

SEQ ID NO: 159157 - DNA, 20 bp, Artificial Sequence
  Synthetic oligonucleotide; CAG chr2 60469804 60469823 60469820 +
tgtagctgtccatcttgaga

SEQ ID NO: 159158 - DNA, 20 bp, Artificial Sequence
  Synthetic oligonucleotide; TGG chr2 60469809 60469828 60469825 +
ctgtccatcttgagacagac

SEQ ID NO: 159159 - DNA, 20 bp, Artificial Sequence
  Synthetic oligonucleotide; GAG chr2 60469811 60469830 60469827 +
gtccatcttgagacagactg

SEQ ID NO: 159160 - DNA, 20 bp, Artificial Sequence
  Synthetic oligonucleotide; AGG chr2 60469812 60469831 60469828 +
tccatcttgagacagactgg

SEQ ID NO: 159161 - DNA, 20 bp, Artificial Sequence
  Synthetic oligonucleotide; TAG chr2 60469816 60469835 60469832 +
tcttgagacagactggagga

SEQ ID NO: 159162 - DNA, 20 bp, Artificial Sequence
  Synthetic oligonucleotide; TGG chr2 60469820 60469839 60469836 +
gagacagactggaggataga

SEQ ID NO: 159163 - DNA, 20 bp, Artificial Sequence
  Synthetic oligonucleotide; CAG chr2 60469825 60469844 60469841 +
agactggaggatagatggtg

SEQ ID NO: 159164 - DNA, 20 bp, Artificial Sequence
  Synthetic oligonucleotide; AGG chr2 60469826 60469845 60469842 +
gactggaggatagatggtgc

SEQ ID NO: 159165 - DNA, 20 bp, Artificial Sequence
  Synthetic oligonucleotide; GAG chr2 60469828 60469847 60469844 +
ctggaggatagatggtgcag

SEQ ID NO: 159166 - DNA, 20 bp, Artificial Sequence
  Synthetic oligonucleotide; TAG chr2 60469846 60469865 60469862 +
aggagacgctctgtgtgttc

SEQ ID NO: 159167 - DNA, 20 bp, Artificial Sequence
  Synthetic oligonucleotide; GAG chr2 60469848 60469867 60469864 +
gagacgctctgtgtgttcta

SEQ ID NO: 159168 - DNA, 20 bp, Artificial Sequence
  Synthetic oligonucleotide; AGG chr2 60469849 60469868 60469865 +
agacgctctgtgtgttctag

SEQ ID NO: 159169 - DNA, 20 bp, Artificial Sequence
  Synthetic oligonucleotide; TGG chr2 60469854 60469873 60469870 +
ctctgtgtgttctagaggtt

SEQ ID NO: 159170 - DNA, 20 bp, Artificial Sequence
  Synthetic oligonucleotide; GAG chr2 60469856 60469875 60469872 +
ctgtgtgttctagaggtttg

SEQ ID NO: 159171 - DNA, 20 bp, Artificial Sequence
  Synthetic oligonucleotide; TGG chr2 60469870 60469889 60469886 +
ggtttggagttcatgatgat

SEQ ID NO: 159172 - DNA, 20 bp, Artificial Sequence
  Synthetic oligonucleotide; GGG chr2 60469871 60469890 60469887 +
gtttggagttcatgatgatt

SEQ ID NO: 159173 - DNA, 20 bp, Artificial Sequence
  Synthetic oligonucleotide; GGG chr2 60469872 60469891 60469888 +
tttggagttcatgatgattg

SEQ ID NO: 159174 - DNA, 20 bp, Artificial Sequence
  Synthetic oligonucleotide; GAG chr2 60469874 60469893 60469890 +
tggagttcatgatgattggg

SEQ ID NO: 159175 - DNA, 20 bp, Artificial Sequence
  Synthetic oligonucleotide; AGG chr2 60469875 60469894 60469891 +
ggagttcatgatgattgggg

SEQ ID NO: 159176 - DNA, 20 bp, Artificial Sequence
  Synthetic oligonucleotide; GGG chr2 60469876 60469895 60469892 +
gagttcatgatgattgggga

SEQ ID NO: 159177 - DNA, 20 bp, Artificial Sequence
  Synthetic oligonucleotide; CGG chr2 60469879 60469898 60469895 +
ttcatgatgattggggaggg

SEQ ID NO: 159178 - DNA, 20 bp, Artificial Sequence
  Synthetic oligonucleotide; GGG chr2 60469880 60469899 60469896 +
tcatgatgattggggagggc

SEQ ID NO: 159179 - DNA, 20 bp, Artificial Sequence
  Synthetic oligonucleotide; GAG chr2 60469882 60469901 60469898 +
atgatgattggggagggcgg

SEQ ID NO: 159180 - DNA, 20 bp, Artificial Sequence
  Synthetic oligonucleotide; AAG chr2 60469887 60469906 60469903 +
gattggggagggcgggagac

SEQ ID NO: 159181 - DNA, 20 bp, Artificial Sequence
  Synthetic oligonucleotide; CAG chr2 60469895 60469914 60469911 +
agggcgggagacaagaaaaa

SEQ ID NO: 159182 - DNA, 20 bp, Artificial Sequence
  Synthetic oligonucleotide; TGG chr2 60469905 60469924 60469921 +
acaagaaaaacagactttga

SEQ ID NO: 159183 - DNA, 20 bp, Artificial Sequence
  Synthetic oligonucleotide; CAG chr2 60469916 60469935 60469932 +
agactttgatggtgaacaaa

SEQ ID NO: 159184 - DNA, 20 bp, Artificial Sequence
  Synthetic oligonucleotide; TAG chr2 60469931 60469950 60469947 +
acaaacagtatgttttccat

SEQ ID NO: 159185 - DNA, 20 bp, Artificial Sequence
  Synthetic oligonucleotide; AAG chr2 60469943 60469962 60469959 +
ttttccattagcttaatatt

SEQ ID NO: 159186 - DNA, 20 bp, Artificial Sequence
  Synthetic oligonucleotide; GAG chr2 60469945 60469964 60469961 +
ttccattagcttaatattaa

SEQ ID NO: 159187 - DNA, 20 bp, Artificial Sequence
  Synthetic oligonucleotide; TAG chr2 60469952 60469971 60469968 +
agcttaatattaagagcact

SEQ ID NO: 159188 - DNA, 20 bp, Artificial Sequence
  Synthetic oligonucleotide; AAG chr2 60469955 60469974 60469971 +
ttaatattaagagcacttag

SEQ ID NO: 159189 - DNA, 20 bp, Artificial Sequence
  Synthetic oligonucleotide; TAG chr2 60469974 60469993 60469990 +
gaagtgttgttgttgtactc

SEQ ID NO: 159190 - DNA, 20 bp, Artificial Sequence
  Synthetic oligonucleotide; AGG chr2 60469975 60469994 60469991 +
aagtgttgttgttgtactct

SEQ ID NO: 159191 - DNA, 20 bp, Artificial Sequence
  Synthetic oligonucleotide; TAG chr2 60469979 60469998 60469995 +
gttgttgttgtactctagga

SEQ ID NO: 159192 - DNA, 20 bp, Artificial Sequence
  Synthetic oligonucleotide; CAG chr2 60469982 60470001 60469998 +
gttgttgtactctaggatag

SEQ ID NO: 159193 - DNA, 20 bp, Artificial Sequence
  Synthetic oligonucleotide; AGG chr2 60469983 60470002 60469999 +
ttgttgtactctaggatagc

SEQ ID NO: 159194 - DNA, 20 bp, Artificial Sequence
  Synthetic oligonucleotide; AAG chr2 60469990 60470009 60470006 +
actctaggatagcaggtctc

SEQ ID NO: 159195 - DNA, 20 bp, Artificial Sequence
  Synthetic oligonucleotide; TAG chr2 60470020 60470039 60470036 +
tacatcctgttctccttata

SEQ ID NO: 159196 - DNA, 20 bp, Artificial Sequence
  Synthetic oligonucleotide; GAG chr2 60470022 60470041 60470038 +
catcctgttctccttatata

SEQ ID NO: 159197 - DNA, 20 bp, Artificial Sequence
  Synthetic oligonucleotide; AAG chr2 60470034 60470053 60470050 +
cttatatagagcacactgcc

SEQ ID NO: 159198 - DNA, 20 bp, Artificial Sequence
  Synthetic oligonucleotide; CAG chr2 60470039 60470058 60470055 +
atagagcacactgccaagca

SEQ ID NO: 159199 - DNA, 20 bp, Artificial Sequence
  Synthetic oligonucleotide; AAG chr2 60470044 60470063 60470060 +
gcacactgccaagcacagcc

SEQ ID NO: 159200 - DNA, 20 bp, Artificial Sequence
  Synthetic oligonucleotide; AGG chr2 60470045 60470064 60470061 +
cacactgccaagcacagcca

SEQ ID NO: 159201 - DNA, 20 bp, Artificial Sequence
  Synthetic oligonucleotide; CAG chr2 60470048 60470067 60470064 +
actgccaagcacagccaagg

SEQ ID NO: 159202 - DNA, 20 bp, Artificial Sequence
  Synthetic oligonucleotide; TGG chr2 60470052 60470071 60470068 +
ccaagcacagccaaggcagt

SEQ ID NO: 159203 - DNA, 20 bp, Artificial Sequence
  Synthetic oligonucleotide; GGG chr2 60470053 60470072 60470069 +
caagcacagccaaggcagtt

SEQ ID NO: 159204 - DNA, 20 bp, Artificial Sequence
  Synthetic oligonucleotide; AAG chr2 60470058 60470077 60470074 +
acagccaaggcagttgggac

SEQ ID NO: 159205 - DNA, 20 bp, Artificial Sequence
  Synthetic oligonucleotide; AAG chr2 60470073 60470092 60470089 +
gggacaagatttcctttcgc

SEQ ID NO: 159206 - DNA, 20 bp, Artificial Sequence
  Synthetic oligonucleotide; AGG chr2 60470074 60470093 60470090 +
ggacaagatttcctttcgca

SEQ ID NO: 159207 - DNA, 20 bp, Artificial Sequence
  Synthetic oligonucleotide; GAG chr2 60470076 60470095 60470092 +
acaagatttcctttcgcaag

SEQ ID NO: 159208 - DNA, 20 bp, Artificial Sequence
  Synthetic oligonucleotide; TGG chr2 60470081 60470100 60470097 +
atttcctttcgcaaggagcc

SEQ ID NO: 159209 - DNA, 20 bp, Artificial Sequence
  Synthetic oligonucleotide; TGG chr2 60470084 60470103 60470100 +
tcctttcgcaaggagcctgg

SEQ ID NO: 159210 - DNA, 20 bp, Artificial Sequence
  Synthetic oligonucleotide; GGG chr2 60470085 60470104 60470101 +
cctttcgcaaggagcctggt

SEQ ID NO: 159211 - DNA, 20 bp, Artificial Sequence
  Synthetic oligonucleotide; TGG chr2 60470094 60470113 60470110 +
aggagcctggtgggtaacga

SEQ ID NO: 159212 - DNA, 20 bp, Artificial Sequence
  Synthetic oligonucleotide; GAG chr2 60470106 60470125 60470122 +
ggtaacgatggtgtgctgct

SEQ ID NO: 159213 - DNA, 20 bp, Artificial Sequence
  Synthetic oligonucleotide; AAG chr2 60470109 60470128 60470125 +
aacgatggtgtgctgctgag

SEQ ID NO: 159214 - DNA, 20 bp, Artificial Sequence
  Synthetic oligonucleotide; AGG chr2 60470110 60470129 60470126 +
acgatggtgtgctgctgaga

SEQ ID NO: 159215 - DNA, 20 bp, Artificial Sequence
  Synthetic oligonucleotide; CAG chr2 60470121 60470140 60470137 +
ctgctgagaaggctcttaca

SEQ ID NO: 159216 - DNA, 20 bp, Artificial Sequence
  Synthetic oligonucleotide; CAG chr2 60470125 60470144 60470141 +
tgagaaggctcttacacaga

SEQ ID NO: 159217 - DNA, 20 bp, Artificial Sequence
  Synthetic oligonucleotide; TAG chr2 60470130 60470149 60470146 +
aggctcttacacagacagca

SEQ ID NO: 159218 - DNA, 20 bp, Artificial Sequence
  Synthetic oligonucleotide; AGG chr2 60470131 60470150 60470147 +
ggctcttacacagacagcat

SEQ ID NO: 159219 - DNA, 20 bp, Artificial Sequence
  Synthetic oligonucleotide; CAG chr2 60470145 60470164 60470161 +
cagcataggtctgctgttac

SEQ ID NO: 159220 - DNA, 20 bp, Artificial Sequence
  Synthetic oligonucleotide; AGG chr2 60470146 60470165 60470162 +
agcataggtctgctgttacc

SEQ ID NO: 159221 - DNA, 20 bp, Artificial Sequence
  Synthetic oligonucleotide; CAG chr2 60470153 60470172 60470169 +
gtctgctgttaccaggcctg

SEQ ID NO: 159222 - DNA, 20 bp, Artificial Sequence
  Synthetic oligonucleotide; GAG chr2 60470155 60470174 60470171 +
ctgctgttaccaggcctgca

SEQ ID NO: 159223 - DNA, 20 bp, Artificial Sequence
  Synthetic oligonucleotide; AGG chr2 60470156 60470175 60470172 +
tgctgttaccaggcctgcag

SEQ ID NO: 159224 - DNA, 20 bp, Artificial Sequence
  Synthetic oligonucleotide; GGG chr2 60470157 60470176 60470173 +
gctgttaccaggcctgcaga

SEQ ID NO: 159225 - DNA, 20 bp, Artificial Sequence
  Synthetic oligonucleotide; AAG chr2 60470160 60470179 60470176 +
gttaccaggcctgcagaggg

SEQ ID NO: 159226 - DNA, 20 bp, Artificial Sequence
  Synthetic oligonucleotide; TGG chr2 60470166 60470185 60470182 +
aggcctgcagagggaagccc

SEQ ID NO: 159227 - DNA, 20 bp, Artificial Sequence
  Synthetic oligonucleotide; TGG chr2 60470169 60470188 60470185 +
cctgcagagggaagccctgg

SEQ ID NO: 159228 - DNA, 20 bp, Artificial Sequence
  Synthetic oligonucleotide; AAG chr2 60470172 60470191 60470188 +
gcagagggaagccctggtgg

SEQ ID NO: 159229 - DNA, 20 bp, Artificial Sequence
  Synthetic oligonucleotide; TAG chr2 60470182 60470201 60470198 +
gccctggtggaagcaccacc

SEQ ID NO: 159230 - DNA, 20 bp, Artificial Sequence
  Synthetic oligonucleotide; GAG chr2 60470188 60470207 60470204 +
gtggaagcaccacctagcct

SEQ ID NO: 159231 - DNA, 20 bp, Artificial Sequence
  Synthetic oligonucleotide; CAG chr2 60470199 60470218 60470215 +
acctagcctgagaacatcta

SEQ ID NO: 159232 - DNA, 20 bp, Artificial Sequence
  Synthetic oligonucleotide; GAG chr2 60470201 60470220 60470217 +
ctagcctgagaacatctaca

SEQ ID NO: 159233 - DNA, 20 bp, Artificial Sequence
  Synthetic oligonucleotide; AAG chr2 60470245 60470264 60470261 +
aaaacaaaataaacaccaca

SEQ ID NO: 159234 - DNA, 20 bp, Artificial Sequence
  Synthetic oligonucleotide; AAG chr2 60470259 60470278 60470275 +
accacaaagtgaaccaacac

SEQ ID NO: 159235 - DNA, 20 bp, Artificial Sequence
  Synthetic oligonucleotide; CAG chr2 60470262 60470281 60470278 +
acaaagtgaaccaacacaag

SEQ ID NO: 159236 - DNA, 20 bp, Artificial Sequence
  Synthetic oligonucleotide; AGG chr2 60470263 60470282 60470279 +
caaagtgaaccaacacaagc

SEQ ID NO: 159237 - DNA, 20 bp, Artificial Sequence
  Synthetic oligonucleotide; AAG chr2 60470266 60470285 60470282 +
agtgaaccaacacaagcagg

SEQ ID NO: 159238 - DNA, 20 bp, Artificial Sequence
  Synthetic oligonucleotide; CGG chr2 60470271 60470290 60470287 +
accaacacaagcaggaagac

SEQ ID NO: 159239 - DNA, 20 bp, Artificial Sequence
  Synthetic oligonucleotide; AAG chr2 60470285 60470304 60470301 +
gaagaccggacttaacaaac

SEQ ID NO: 159240 - DNA, 20 bp, Artificial Sequence
  Synthetic oligonucleotide; AAG chr2 60470314 60470333 60470330 +
tacatttgactgtttacgtc

SEQ ID NO: 159241 - DNA, 20 bp, Artificial Sequence
  Synthetic oligonucleotide; GAG chr2 60470323 60470342 60470339 +
ctgtttacgtcaagtgaatt

SEQ ID NO: 159242 - DNA, 20 bp, Artificial Sequence
  Synthetic oligonucleotide; GAG chr2 60470325 60470344 60470341 +
gtttacgtcaagtgaattga

SEQ ID NO: 159243 - DNA, 20 bp, Artificial Sequence
  Synthetic oligonucleotide; TGG chr2 60470330 60470349 60470346 +
cgtcaagtgaattgagagtg

SEQ ID NO: 159244 - DNA, 20 bp, Artificial Sequence
  Synthetic oligonucleotide; CAG chr2 60470346 60470365 60470362 +
agtgtggcgtaaaattacta

SEQ ID NO: 159245 - DNA, 20 bp, Artificial Sequence
  Synthetic oligonucleotide; TGG chr2 60470358 60470377 60470374 +
aattactacagattttgtca

SEQ ID NO: 159246 - DNA, 20 bp, Artificial Sequence
  Synthetic oligonucleotide; GAG chr2 60470372 60470391 60470388 +
ttgtcatggtatttttcaat

SEQ ID NO: 159247 - DNA, 20 bp, Artificial Sequence
  Synthetic oligonucleotide; GAG chr2 60470381 60470400 60470397 +
tatttttcaatgagaaatct

SEQ ID NO: 159248 - DNA, 20 bp, Artificial Sequence
  Synthetic oligonucleotide; CAG chr2 60470411 60470430 60470427 +
ctttgcacttgtttttgcct

SEQ ID NO: 159249 - DNA, 20 bp, Artificial Sequence
  Synthetic oligonucleotide; AAG chr2 60470423 60470442 60470439 +
ttttgcctcagccgttcact

SEQ ID NO: 159250 - DNA, 20 bp, Artificial Sequence
  Synthetic oligonucleotide; CAG chr2 60470439 60470458 60470455 +
cactaagtttgctgccaaaa

SEQ ID NO: 159251 - DNA, 20 bp, Artificial Sequence
  Synthetic oligonucleotide; TAG chr2 60470454 60470473 60470470 +
caaaacagacatccttttct

SEQ ID NO: 159252 - DNA, 20 bp, Artificial Sequence
  Synthetic oligonucleotide; AGG chr2 60470455 60470474 60470471 +
aaaacagacatccttttctt

SEQ ID NO: 159253 - DNA, 20 bp, Artificial Sequence
  Synthetic oligonucleotide; CAG chr2 60470463 60470482 60470479 +
catccttttcttaggaaaca

SEQ ID NO: 159254 - DNA, 20 bp, Artificial Sequence
  Synthetic oligonucleotide; AGG chr2 60470464 60470483 60470480 +
atccttttcttaggaaacac

SEQ ID NO: 159255 - DNA, 20 bp, Artificial Sequence
  Synthetic oligonucleotide; CAG chr2 60470472 60470491 60470488 +
cttaggaaacacaggcaacc

SEQ ID NO: 159256 - DNA, 20 bp, Artificial Sequence
  Synthetic oligonucleotide; AGG chr2 60470473 60470492 60470489 +
ttaggaaacacaggcaaccc

SEQ ID NO: 159257 - DNA, 20 bp, Artificial Sequence
  Synthetic oligonucleotide; CAG chr2 60470490 60470509 60470506 +
cccaggtatctctgtgatcc

SEQ ID NO: 159258 - DNA, 20 bp, Artificial Sequence
  Synthetic oligonucleotide; CAG chr2 60470504 60470523 60470520 +
tgatcccagcataaacgcaa

SEQ ID NO: 159259 - DNA, 20 bp, Artificial Sequence
  Synthetic oligonucleotide; AGG chr2 60470505 60470524 60470521 +
gatcccagcataaacgcaac

SEQ ID NO: 159260 - DNA, 20 bp, Artificial Sequence
  Synthetic oligonucleotide; TGG chr2 60470512 60470531 60470528 +
gcataaacgcaacaggtact

SEQ ID NO: 159261 - DNA, 20 bp, Artificial Sequence
  Synthetic oligonucleotide; TGG chr2 60470524 60470543 60470540 +
caggtacttggatccttgta

SEQ ID NO: 159262 - DNA, 20 bp, Artificial Sequence
  Synthetic oligonucleotide; GGG chr2 60470525 60470544 60470541 +
aggtacttggatccttgtat

SEQ ID NO: 159263 - DNA, 20 bp, Artificial Sequence
  Synthetic oligonucleotide; GGG chr2 60470526 60470545 60470542 +
ggtacttggatccttgtatg

SEQ ID NO: 159264 - DNA, 20 bp, Artificial Sequence
  Synthetic oligonucleotide; GAG chr2 60470528 60470547 60470544 +
tacttggatccttgtatggg

SEQ ID NO: 159265 - DNA, 20 bp, Artificial Sequence
  Synthetic oligonucleotide; TGG chr2 60470562 60470581 60470578 +
aaattctctgccacttactc

SEQ ID NO: 159266 - DNA, 20 bp, Artificial Sequence
  Synthetic oligonucleotide; GGG chr2 60470563 60470582 60470579 +
aattctctgccacttactct

SEQ ID NO: 159267 - DNA, 20 bp, Artificial Sequence
  Synthetic oligonucleotide; AAG chr2 60470566 60470585 60470582 +
tctctgccacttactctggg

SEQ ID NO: 159268 - DNA, 20 bp, Artificial Sequence
  Synthetic oligonucleotide; GAG chr2 60470568 60470587 60470584 +
tctgccacttactctgggaa

SEQ ID NO: 159269 - DNA, 20 bp, Artificial Sequence
  Synthetic oligonucleotide; AAG chr2 60470577 60470596 60470593 +
tactctgggaagagaccctg

SEQ ID NO: 159270 - DNA, 20 bp, Artificial Sequence
  Synthetic oligonucleotide; CAG chr2 60470585 60470604 60470601 +
gaagagaccctgaagtgctt

SEQ ID NO: 159271 - DNA, 20 bp, Artificial Sequence
  Synthetic oligonucleotide; CAG chr2 60470588 60470607 60470604 +
gagaccctgaagtgcttcag

SEQ ID NO: 159272 - DNA, 20 bp, Artificial Sequence
  Synthetic oligonucleotide; AGG chr2 60470589 60470608 60470605 +
agaccctgaagtgcttcagc

SEQ ID NO: 159273 - DNA, 20 bp, Artificial Sequence
  Synthetic oligonucleotide; CAG chr2 60470596 60470615 60470612 +
gaagtgcttcagcaggcctc

SEQ ID NO: 159274 - DNA, 20 bp, Artificial Sequence
  Synthetic oligonucleotide; AAG chr2 60470600 60470619 60470616 +
tgcttcagcaggcctccagc

SEQ ID NO: 159275 - DNA, 20 bp, Artificial Sequence
  Synthetic oligonucleotide; TGG chr2 60470606 60470625 60470622 +
agcaggcctccagcaagaaa

SEQ ID NO: 159276 - DNA, 20 bp, Artificial Sequence
  Synthetic oligonucleotide; GGG chr2 60470607 60470626 60470623 +
gcaggcctccagcaagaaat

SEQ ID NO: 159277 - DNA, 20 bp, Artificial Sequence
  Synthetic oligonucleotide; GAG chr2 60470609 60470628 60470625 +
aggcctccagcaagaaatgg

SEQ ID NO: 159278 - DNA, 20 bp, Artificial Sequence
  Synthetic oligonucleotide; TAG chr2 60470634 60470653 60470650 +
ctgctaacctaatccatgcc

SEQ ID NO: 159279 - DNA, 20 bp, Artificial Sequence
  Synthetic oligonucleotide; TGG chr2 60470658 60470677 60470674 +
ccctcgcatgaatctcttgt

SEQ ID NO: 159280 - DNA, 20 bp, Artificial Sequence
  Synthetic oligonucleotide; TAG chr2 60470682 60470701 60470698 +
aaacttgtctacaaacccat

SEQ ID NO: 159281 - DNA, 20 bp, Artificial Sequence
  Synthetic oligonucleotide; AAG chr2 60470693 60470712 60470709 +
caaacccattagccctaaac

SEQ ID NO: 159282 - DNA, 20 bp, Artificial Sequence
  Synthetic oligonucleotide; CGG chr2 60470700 60470719 60470716 +
attagccctaaacaagctga

SEQ ID NO: 159283 - DNA, 20 bp, Artificial Sequence
  Synthetic oligonucleotide; CAG chr2 60470703 60470722 60470719 +
agccctaaacaagctgacgg

SEQ ID NO: 159284 - DNA, 20 bp, Artificial Sequence
  Synthetic oligonucleotide; AGG chr2 60470704 60470723 60470720 +
gccctaaacaagctgacggc

SEQ ID NO: 159285 - DNA, 20 bp, Artificial Sequence
  Synthetic oligonucleotide; CAG chr2 60470709 60470728 60470725 +
aaacaagctgacggcaggac

SEQ ID NO: 159286 - DNA, 20 bp, Artificial Sequence
  Synthetic oligonucleotide; CAG chr2 60470719 60470738 60470735 +
acggcaggaccagatctcta

SEQ ID NO: 159287 - DNA, 20 bp, Artificial Sequence
  Synthetic oligonucleotide; TGG chr2 60470726 60470745 60470742 +
gaccagatctctacagtgtc

SEQ ID NO: 159288 - DNA, 20 bp, Artificial Sequence
  Synthetic oligonucleotide; TGG chr2 60470734 60470753 60470750 +
ctctacagtgtctggccgtg

SEQ ID NO: 159289 - DNA, 20 bp, Artificial Sequence
  Synthetic oligonucleotide; AAG chr2 60470739 60470758 60470755 +
cagtgtctggccgtgtggca

SEQ ID NO: 159290 - DNA, 20 bp, Artificial Sequence
  Synthetic oligonucleotide; GAG chr2 60470743 60470762 60470759 +
gtctggccgtgtggcaaagt

SEQ ID NO: 159291 - DNA, 20 bp, Artificial Sequence
  Synthetic oligonucleotide; AGG chr2 60470744 60470763 60470760 +
tctggccgtgtggcaaagtg

SEQ ID NO: 159292 - DNA, 20 bp, Artificial Sequence
  Synthetic oligonucleotide; TGG chr2 60470762 60470781 60470778 +
tgaggtctcatctgactatc

SEQ ID NO: 159293 - DNA, 20 bp, Artificial Sequence
  Synthetic oligonucleotide; CAG chr2 60470765 60470784 60470781 +
ggtctcatctgactatctgg

SEQ ID NO: 159294 - DNA, 20 bp, Artificial Sequence
  Synthetic oligonucleotide; TAG chr2 60470770 60470789 60470786 +
catctgactatctggcagca

SEQ ID NO: 159295 - DNA, 20 bp, Artificial Sequence
  Synthetic oligonucleotide; AAG chr2 60470807 60470826 60470823 +
tgtttttgtttttgttttct

SEQ ID NO: 159296 - DNA, 20 bp, Artificial Sequence
  Synthetic oligonucleotide; TAG chr2 60470823 60470842 60470839 +
ttctaagttgtaaaaaaccc

SEQ ID NO: 159297 - DNA, 20 bp, Artificial Sequence
  Synthetic oligonucleotide; AAG chr2 60470834 60470853 60470850 +
aaaaaaccctagctatcatc

SEQ ID NO: 159298 - DNA, 20 bp, Artificial Sequence
  Synthetic oligonucleotide; CAG chr2 60470854 60470873 60470870 +
aagtctgtcccttcatttta

SEQ ID NO: 159299 - DNA, 20 bp, Artificial Sequence
  Synthetic oligonucleotide; TGG chr2 60470858 60470877 60470874 +
ctgtcccttcattttacaga

SEQ ID NO: 159300 - DNA, 20 bp, Artificial Sequence
  Synthetic oligonucleotide; GGG chr2 60470859 60470878 60470875 +
tgtcccttcattttacagat

SEQ ID NO: 159301 - DNA, 20 bp, Artificial Sequence
  Synthetic oligonucleotide; GGG chr2 60470860 60470879 60470876 +
gtcccttcattttacagatg

SEQ ID NO: 159302 - DNA, 20 bp, Artificial Sequence
  Synthetic oligonucleotide; GAG chr2 60470868 60470887 60470884 +
attttacagatggggaaact

SEQ ID NO: 159303 - DNA, 20 bp, Artificial Sequence
  Synthetic oligonucleotide; AGG chr2 60470869 60470888 60470885 +
ttttacagatggggaaactg

SEQ ID NO: 159304 - DNA, 20 bp, Artificial Sequence
  Synthetic oligonucleotide; GAG chr2 60470876 60470895 60470892 +
gatggggaaactgaggccat

SEQ ID NO: 159305 - DNA, 20 bp, Artificial Sequence
  Synthetic oligonucleotide; AAG chr2 60470884 60470903 60470900 +
aactgaggccatgagaaatt

SEQ ID NO: 159306 - DNA, 20 bp, Artificial Sequence
  Synthetic oligonucleotide; TGG chr2 60470898 60470917 60470914 +
gaaattaagtgacttgccca

SEQ ID NO: 159307 - DNA, 20 bp, Artificial Sequence
  Synthetic oligonucleotide; AAG chr2 60470927 60470946 60470943 +
tgatgattaaccacaatgtg

SEQ ID NO: 159308 - DNA, 20 bp, Artificial Sequence
  Synthetic oligonucleotide; TAG chr2 60470932 60470951 60470948 +
attaaccacaatgtgaagat

SEQ ID NO: 159309 - DNA, 20 bp, Artificial Sequence
  Synthetic oligonucleotide; CAG chr2 60470958 60470977 60470974 +
taatctcctgactcctgatc

SEQ ID NO: 159310 - DNA, 20 bp, Artificial Sequence
  Synthetic oligonucleotide; TGG chr2 60470961 60470980 60470977 +
tctcctgactcctgatccag

SEQ ID NO: 159311 - DNA, 20 bp, Artificial Sequence
  Synthetic oligonucleotide; TGG chr2 60470971 60470990 60470987 +
cctgatccagtggtctttcc

SEQ ID NO: 159312 - DNA, 20 bp, Artificial Sequence
  Synthetic oligonucleotide; GGG chr2 60470972 60470991 60470988 +
ctgatccagtggtctttcct

SEQ ID NO: 159313 - DNA, 20 bp, Artificial Sequence
  Synthetic oligonucleotide; TGG chr2 60471007 60471026 60471023 +
cccccctgctgctcctgccg

SEQ ID NO: 159314 - DNA, 20 bp, Artificial Sequence
  Synthetic oligonucleotide; AAG chr2 60471025 60471044 60471041 +
cgtggtcttcactgcccaac

SEQ ID NO: 159315 - DNA, 20 bp, Artificial Sequence
  Synthetic oligonucleotide; AAG chr2 60471028 60471047 60471044 +
ggtcttcactgcccaacaag

SEQ ID NO: 159316 - DNA, 20 bp, Artificial Sequence
  Synthetic oligonucleotide; AGG chr2 60471029 60471048 60471045 +
gtcttcactgcccaacaaga

SEQ ID NO: 159317 - DNA, 20 bp, Artificial Sequence
  Synthetic oligonucleotide; AAG chr2 60471053 60471072 60471069 +
cctgtttctactgatccatt

SEQ ID NO: 159318 - DNA, 20 bp, Artificial Sequence
  Synthetic oligonucleotide; CAG chr2 60471056 60471075 60471072 +
gtttctactgatccattaag

SEQ ID NO: 159319 - DNA, 20 bp, Artificial Sequence
  Synthetic oligonucleotide; TGG chr2 60471072 60471091 60471088 +
taagcagtacttaaccgtct

SEQ ID NO: 159320 - DNA, 20 bp, Artificial Sequence
  Synthetic oligonucleotide; GGG chr2 60471073 60471092 60471089 +
aagcagtacttaaccgtctt

SEQ ID NO: 159321 - DNA, 20 bp, Artificial Sequence
  Synthetic oligonucleotide; GGG chr2 60471074 60471093 60471090 +
agcagtacttaaccgtcttg

SEQ ID NO: 159322 - DNA, 20 bp, Artificial Sequence
  Synthetic oligonucleotide; GGG chr2 60471075 60471094 60471091 +
gcagtacttaaccgtcttgg

SEQ ID NO: 159323 - DNA, 20 bp, Artificial Sequence
  Synthetic oligonucleotide; GAG chr2 60471077 60471096 60471093 +
agtacttaaccgtcttgggg

SEQ ID NO: 159324 - DNA, 20 bp, Artificial Sequence
  Synthetic oligonucleotide; AGG chr2 60471078 60471097 60471094 +
gtacttaaccgtcttggggg

SEQ ID NO: 159325 - DNA, 20 bp, Artificial Sequence
  Synthetic oligonucleotide; GGG chr2 60471079 60471098 60471095 +
tacttaaccgtcttggggga

SEQ ID NO: 159326 - DNA, 20 bp, Artificial Sequence
  Synthetic oligonucleotide; CAG chr2 60471084 60471103 60471100 +
aaccgtcttgggggagggtc

SEQ ID NO: 159327 - DNA, 20 bp, Artificial Sequence
  Synthetic oligonucleotide; CAG chr2 60471089 60471108 60471105 +
tcttgggggagggtccagcc

SEQ ID NO: 159328 - DNA, 20 bp, Artificial Sequence
  Synthetic oligonucleotide; CAG chr2 60471092 60471111 60471108 +
tgggggagggtccagcccag

SEQ ID NO: 159329 - DNA, 20 bp, Artificial Sequence
  Synthetic oligonucleotide; TGG chr2 60471102 60471121 60471118 +
tccagcccagcagcgctaca

SEQ ID NO: 159330 - DNA, 20 bp, Artificial Sequence
  Synthetic oligonucleotide; GGG chr2 60471103 60471122 60471119 +
ccagcccagcagcgctacat

SEQ ID NO: 159331 - DNA, 20 bp, Artificial Sequence
  Synthetic oligonucleotide; GGG chr2 60471104 60471123 60471120 +
cagcccagcagcgctacatg

SEQ ID NO: 159332 - DNA, 20 bp, Artificial Sequence
  Synthetic oligonucleotide; AAG chr2 60471114 60471133 60471130 +
gcgctacatggggctttcga

SEQ ID NO: 159333 - DNA, 20 bp, Artificial Sequence
  Synthetic oligonucleotide; AGG chr2 60471115 60471134 60471131 +
cgctacatggggctttcgaa

SEQ ID NO: 159334 - DNA, 20 bp, Artificial Sequence
  Synthetic oligonucleotide; TGG chr2 60471134 60471153 60471150 +
aaggtgccaatgaactgact

SEQ ID NO: 159335 - DNA, 20 bp, Artificial Sequence
  Synthetic oligonucleotide; TGG chr2 60471146 60471165 60471162 +
aactgacttggtctcacaat

SEQ ID NO: 159336 - DNA, 20 bp, Artificial Sequence
  Synthetic oligonucleotide; AAG chr2 60471154 60471173 60471170 +
tggtctcacaattggaaaac

SEQ ID NO: 159337 - DNA, 20 bp, Artificial Sequence
  Synthetic oligonucleotide; AGG chr2 60471155 60471174 60471171 +
ggtctcacaattggaaaaca

SEQ ID NO: 159338 - DNA, 20 bp, Artificial Sequence
  Synthetic oligonucleotide; TGG chr2 60471172 60471191 60471188 +
acaaggcctgctctgctgcc

SEQ ID NO: 159339 - DNA, 20 bp, Artificial Sequence
  Synthetic oligonucleotide; GGG chr2 60471173 60471192 60471189 +
caaggcctgctctgctgcct

SEQ ID NO: 159340 - DNA, 20 bp, Artificial Sequence
  Synthetic oligonucleotide; TGG chr2 60471181 60471200 60471197 +
gctctgctgcctgggcctcc

SEQ ID NO: 159341 - DNA, 20 bp, Artificial Sequence
  Synthetic oligonucleotide; CAG chr2 60471226 60471245 60471242 +
ctctacctctgcttcccctg

SEQ ID NO: 159342 - DNA, 20 bp, Artificial Sequence
  Synthetic oligonucleotide; TAG chr2 60471232 60471251 60471248 +
ctctgcttcccctgcagaat

SEQ ID NO: 159343 - DNA, 20 bp, Artificial Sequence
  Synthetic oligonucleotide; CAG chr2 60471236 60471255 60471252 +
gcttcccctgcagaattaga

SEQ ID NO: 159344 - DNA, 20 bp, Artificial Sequence
  Synthetic oligonucleotide; CAG chr2 60471255 60471274 60471271 +
acagctaaaaacatttctat

SEQ ID NO: 159345 - DNA, 20 bp, Artificial Sequence
  Synthetic oligonucleotide; AAG chr2 60471261 60471280 60471277 +
aaaaacatttctatcagcct

SEQ ID NO: 159346 - DNA, 20 bp, Artificial Sequence
  Synthetic oligonucleotide; AAG chr2 60471264 60471283 60471280 +
aacatttctatcagcctaag

SEQ ID NO: 159347 - DNA, 20 bp, Artificial Sequence
  Synthetic oligonucleotide; TAG chr2 60471277 60471296 60471293 +
gcctaagaagctatttactt

SEQ ID NO: 159348 - DNA, 20 bp, Artificial Sequence
  Synthetic oligonucleotide; AAG chr2 60471285 60471304 60471301 +
agctatttactttagaaaaa

SEQ ID NO: 159349 - DNA, 20 bp, Artificial Sequence
  Synthetic oligonucleotide; GAG chr2 60471302 60471321 60471318 +
aaaaagcacactgtctttgt

SEQ ID NO: 159350 - DNA, 20 bp, Artificial Sequence
  Synthetic oligonucleotide; CAG chr2 60471330 60471349 60471346 +
cccttgcatttatcttcctt

SEQ ID NO: 159351 - DNA, 20 bp, Artificial Sequence
  Synthetic oligonucleotide; AGG chr2 60471331 60471350 60471347 +
ccttgcatttatcttccttc

SEQ ID NO: 159352 - DNA, 20 bp, Artificial Sequence
  Synthetic oligonucleotide; AAG chr2 60471334 60471353 60471350 +
tgcatttatcttccttcagg

SEQ ID NO: 159353 - DNA, 20 bp, Artificial Sequence
  Synthetic oligonucleotide; GAG chr2 60471336 60471355 60471352 +
catttatcttccttcaggaa

SEQ ID NO: 159354 - DNA, 20 bp, Artificial Sequence
  Synthetic oligonucleotide; AGG chr2 60471337 60471356 60471353 +
atttatcttccttcaggaag

SEQ ID NO: 159355 - DNA, 20 bp, Artificial Sequence
  Synthetic oligonucleotide; GGG chr2 60471338 60471357 60471354 +
tttatcttccttcaggaaga

SEQ ID NO: 159356 - DNA, 20 bp, Artificial Sequence
  Synthetic oligonucleotide; AAG chr2 60471344 60471363 60471360 +
ttccttcaggaagagggtca

SEQ ID NO: 159357 - DNA, 20 bp, Artificial Sequence
  Synthetic oligonucleotide; AAG chr2 60471349 60471368 60471365 +
tcaggaagagggtcaaagca

SEQ ID NO: 159358 - DNA, 20 bp, Artificial Sequence
  Synthetic oligonucleotide; TGG chr2 60471357 60471376 60471373 +
agggtcaaagcaaagccaac

SEQ ID NO: 159359 - DNA, 20 bp, Artificial Sequence
  Synthetic oligonucleotide; GGG chr2 60471358 60471377 60471374 +
gggtcaaagcaaagccaact

SEQ ID NO: 159360 - DNA, 20 bp, Artificial Sequence
  Synthetic oligonucleotide; GGG chr2 60471359 60471378 60471375 +
ggtcaaagcaaagccaactg

SEQ ID NO: 159361 - DNA, 20 bp, Artificial Sequence
  Synthetic oligonucleotide; CAG chr2 60471366 60471385 60471382 +
gcaaagccaactggggaccc

SEQ ID NO: 159362 - DNA, 20 bp, Artificial Sequence
  Synthetic oligonucleotide; TGG chr2 60471415 60471434 60471431 +
cacatccataatattctctt

SEQ ID NO: 159363 - DNA, 20 bp, Artificial Sequence
  Synthetic oligonucleotide; AAG chr2 60471419 60471438 60471435 +
tccataatattctctttggt

SEQ ID NO: 159364 - DNA, 20 bp, Artificial Sequence
  Synthetic oligonucleotide; TGG chr2 60471446 60471465 60471462 +
atcgacattcccacatgaac

SEQ ID NO: 159365 - DNA, 20 bp, Artificial Sequence
  Synthetic oligonucleotide; TAG chr2 60471466 60471485 60471482 +
tggaaatgctaaattgttaa

SEQ ID NO: 159366 - DNA, 20 bp, Artificial Sequence
  Synthetic oligonucleotide; TAG chr2 60471475 60471494 60471491 +
taaattgttaatagcctccc

SEQ ID NO: 159367 - DNA, 20 bp, Artificial Sequence
  Synthetic oligonucleotide; AGG chr2 60471476 60471495 60471492 +
aaattgttaatagcctccct

SEQ ID NO: 159368 - DNA, 20 bp, Artificial Sequence
  Synthetic oligonucleotide; GGG chr2 60471477 60471496 60471493 +
aattgttaatagcctcccta

SEQ ID NO: 159369 - DNA, 20 bp, Artificial Sequence
  Synthetic oligonucleotide; CGG chr2 60471518 60471537 60471534 +
tgccttcaattatttcatca

SEQ ID NO: 159370 - DNA, 20 bp, Artificial Sequence
  Synthetic oligonucleotide; TAG chr2 60471523 60471542 60471539 +
tcaattatttcatcacggct

SEQ ID NO: 159371 - DNA, 20 bp, Artificial Sequence
  Synthetic oligonucleotide; AGG chr2 60471524 60471543 60471540 +
caattatttcatcacggctt

SEQ ID NO: 159372 - DNA, 20 bp, Artificial Sequence
  Synthetic oligonucleotide; AAG chr2 60471529 60471548 60471545 +
atttcatcacggcttaggca

SEQ ID NO: 159373 - DNA, 20 bp, Artificial Sequence
  Synthetic oligonucleotide; AAG chr2 60471534 60471553 60471550 +
atcacggcttaggcaaagta

SEQ ID NO: 159374 - DNA, 20 bp, Artificial Sequence
  Synthetic oligonucleotide; GAG chr2 60471556 60471575 60471572 +
gtatcacaattaatgcttct

SEQ ID NO: 159375 - DNA, 20 bp, Artificial Sequence
  Synthetic oligonucleotide; GAG chr2 60471569 60471588 60471585 +
tgcttctgagcgtcaaactc

SEQ ID NO: 159376 - DNA, 20 bp, Artificial Sequence
  Synthetic oligonucleotide; AGG chr2 60471570 60471589 60471586 +
gcttctgagcgtcaaactcg

SEQ ID NO: 159377 - DNA, 20 bp, Artificial Sequence
  Synthetic oligonucleotide; GAG chr2 60471572 60471591 60471588 +
ttctgagcgtcaaactcgag

SEQ ID NO: 159378 - DNA, 20 bp, Artificial Sequence
  Synthetic oligonucleotide; CAG chr2 60471575 60471594 60471591 +
tgagcgtcaaactcgaggag

SEQ ID NO: 159379 - DNA, 20 bp, Artificial Sequence
  Synthetic oligonucleotide; CAG chr2 60471589 60471608 60471605 +
gaggagcagctctgccttcc

SEQ ID NO: 159380 - DNA, 20 bp, Artificial Sequence
  Synthetic oligonucleotide; AGG chr2 60471590 60471609 60471606 +
aggagcagctctgccttccc

SEQ ID NO: 159381 - DNA, 20 bp, Artificial Sequence
  Synthetic oligonucleotide; AAG chr2 60471595 60471614 60471611 +
cagctctgccttcccaggcc

SEQ ID NO: 159382 - DNA, 20 bp, Artificial Sequence
  Synthetic oligonucleotide; AGG chr2 60471596 60471615 60471612 +
agctctgccttcccaggcca

SEQ ID NO: 159383 - DNA, 20 bp, Artificial Sequence
  Synthetic oligonucleotide; TGG chr2 60471599 60471618 60471615 +
tctgccttcccaggccaagg

SEQ ID NO: 159384 - DNA, 20 bp, Artificial Sequence
  Synthetic oligonucleotide; GGG chr2 60471600 60471619 60471616 +
ctgccttcccaggccaaggt

SEQ ID NO: 159385 - DNA, 20 bp, Artificial Sequence
  Synthetic oligonucleotide; GGG chr2 60471601 60471620 60471617 +
tgccttcccaggccaaggtg

SEQ ID NO: 159386 - DNA, 20 bp, Artificial Sequence
  Synthetic oligonucleotide; AAG chr2 60471606 60471625 60471622 +
tcccaggccaaggtggggaa

SEQ ID NO: 159387 - DNA, 20 bp, Artificial Sequence
  Synthetic oligonucleotide; AGG chr2 60471607 60471626 60471623 +
cccaggccaaggtggggaaa

SEQ ID NO: 159388 - DNA, 20 bp, Artificial Sequence
  Synthetic oligonucleotide; GAG chr2 60471609 60471628 60471625 +
caggccaaggtggggaaaag

SEQ ID NO: 159389 - DNA, 20 bp, Artificial Sequence
  Synthetic oligonucleotide; TGG chr2 60471619 60471638 60471635 +
tggggaaaaggagctgcccc

SEQ ID NO: 159390 - DNA, 20 bp, Artificial Sequence
  Synthetic oligonucleotide; GAG chr2 60471624 60471643 60471640 +
aaaaggagctgcccctggtt

SEQ ID NO: 159391 - DNA, 20 bp, Artificial Sequence
  Synthetic oligonucleotide; AGG chr2 60471625 60471644 60471641 +
aaaggagctgcccctggttg

SEQ ID NO: 159392 - DNA, 20 bp, Artificial Sequence
  Synthetic oligonucleotide; GGG chr2 60471626 60471645 60471642 +
aaggagctgcccctggttga

SEQ ID NO: 159393 - DNA, 20 bp, Artificial Sequence
  Synthetic oligonucleotide; CAG chr2 60471663 60471682 60471679 +
accttcgctttcattctccc

SEQ ID NO: 159394 - DNA, 20 bp, Artificial Sequence
  Synthetic oligonucleotide; CAG chr2 60471667 60471686 60471683 +
tcgctttcattctccccagc

SEQ ID NO: 159395 - DNA, 20 bp, Artificial Sequence
  Synthetic oligonucleotide; GAG chr2 60471669 60471688 60471685 +
gctttcattctccccagcca

SEQ ID NO: 159396 - DNA, 20 bp, Artificial Sequence
  Synthetic oligonucleotide; TGG chr2 60471673 60471692 60471689 +
tcattctccccagccagaga

SEQ ID NO: 159397 - DNA, 20 bp, Artificial Sequence
  Synthetic oligonucleotide; GGG chr2 60471674 60471693 60471690 +
cattctccccagccagagat

SEQ ID NO: 159398 - DNA, 20 bp, Artificial Sequence
  Synthetic oligonucleotide; TGG chr2 60471680 60471699 60471696 +
ccccagccagagatgggctc

SEQ ID NO: 159399 - DNA, 20 bp, Artificial Sequence
  Synthetic oligonucleotide; TGG chr2 60471687 60471706 60471703 +
cagagatgggctctggttgc

SEQ ID NO: 159400 - DNA, 20 bp, Artificial Sequence
  Synthetic oligonucleotide; TAG chr2 60471691 60471710 60471707 +
gatgggctctggttgctggc

SEQ ID NO: 159401 - DNA, 20 bp, Artificial Sequence
  Synthetic oligonucleotide; AGG chr2 60471692 60471711 60471708 +
atgggctctggttgctggct

SEQ ID NO: 159402 - DNA, 20 bp, Artificial Sequence
  Synthetic oligonucleotide; AAG chr2 60471695 60471714 60471711 +
ggctctggttgctggctagg

SEQ ID NO: 159403 - DNA, 20 bp, Artificial Sequence
  Synthetic oligonucleotide; TGG chr2 60471698 60471717 60471714 +
tctggttgctggctaggaag

SEQ ID NO: 159404 - DNA, 20 bp, Artificial Sequence
  Synthetic oligonucleotide; GGG chr2 60471699 60471718 60471715 +
ctggttgctggctaggaagt

SEQ ID NO: 159405 - DNA, 20 bp, Artificial Sequence
  Synthetic oligonucleotide; TAG chr2 60471707 60471726 60471723 +
tggctaggaagtgggtgatc

SEQ ID NO: 159406 - DNA, 20 bp, Artificial Sequence
  Synthetic oligonucleotide; TAG chr2 60471733 60471752 60471749 +
tgtcctctttttttctttgt

SEQ ID NO: 159407 - DNA, 20 bp, Artificial Sequence
  Synthetic oligonucleotide; TAG chr2 60471742 60471761 60471758 +
tttttctttgttagtgctct

SEQ ID NO: 159408 - DNA, 20 bp, Artificial Sequence
  Synthetic oligonucleotide; AGG chr2 60471743 60471762 60471759 +
ttttctttgttagtgctctt

SEQ ID NO: 159409 - DNA, 20 bp, Artificial Sequence
  Synthetic oligonucleotide; AAG chr2 60471747 60471766 60471763 +
ctttgttagtgctcttaggc

SEQ ID NO: 159410 - DNA, 20 bp, Artificial Sequence
  Synthetic oligonucleotide; CAG chr2 60471759 60471778 60471775 +
tcttaggcaagtgattctca

SEQ ID NO: 159411 - DNA, 20 bp, Artificial Sequence
  Synthetic oligonucleotide; CAG chr2 60471764 60471783 60471780 +
ggcaagtgattctcacagcg

SEQ ID NO: 159412 - DNA, 20 bp, Artificial Sequence
  Synthetic oligonucleotide; CAG chr2 60471770 60471789 60471786 +
tgattctcacagcgcagacc

SEQ ID NO: 159413 - DNA, 20 bp, Artificial Sequence
  Synthetic oligonucleotide; AGG chr2 60471771 60471790 60471787 +
gattctcacagcgcagaccc

SEQ ID NO: 159414 - DNA, 20 bp, Artificial Sequence
  Synthetic oligonucleotide; CAG chr2 60471786 60471805 60471802 +
gacccaggcccacccccgat

SEQ ID NO: 159415 - DNA, 20 bp, Artificial Sequence
  Synthetic oligonucleotide; TGG chr2 60471796 60471815 60471812 +
cacccccgatcagcatcacc

SEQ ID NO: 159416 - DNA, 20 bp, Artificial Sequence
  Synthetic oligonucleotide; GGG chr2 60471797 60471816 60471813 +
acccccgatcagcatcacct

SEQ ID NO: 159417 - DNA, 20 bp, Artificial Sequence
  Synthetic oligonucleotide; GAG chr2 60471799 60471818 60471815 +
ccccgatcagcatcacctgg

SEQ ID NO: 159418 - DNA, 20 bp, Artificial Sequence
  Synthetic oligonucleotide; TGG chr2 60471823 60471842 60471839 +
ttgttcaaaatgcaaattct

SEQ ID NO: 159419 - DNA, 20 bp, Artificial Sequence
  Synthetic oligonucleotide; GGG chr2 60471824 60471843 60471840 +
tgttcaaaatgcaaattctt

SEQ ID NO: 159420 - DNA, 20 bp, Artificial Sequence
  Synthetic oligonucleotide; CAG chr2 60471835 60471854 60471851 +
caaattcttgggcaccacct

SEQ ID NO: 159421 - DNA, 20 bp, Artificial Sequence
  Synthetic oligonucleotide; CAG chr2 60471849 60471868 60471865 +
ccacctcagacttactgaat

SEQ ID NO: 159422 - DNA, 20 bp, Artificial Sequence
  Synthetic oligonucleotide; GAG chr2 60471857 60471876 60471873 +
gacttactgaatcagaaatt

SEQ ID NO: 159423 - DNA, 20 bp, Artificial Sequence
  Synthetic oligonucleotide; AGG chr2 60471858 60471877 60471874 +
acttactgaatcagaaattg

SEQ ID NO: 159424 - DNA, 20 bp, Artificial Sequence
  Synthetic oligonucleotide; GGG chr2 60471859 60471878 60471875 +
cttactgaatcagaaattga

SEQ ID NO: 159425 - DNA, 20 bp, Artificial Sequence
  Synthetic oligonucleotide; TGG chr2 60471862 60471881 60471878 +
actgaatcagaaattgaggg

SEQ ID NO: 159426 - DNA, 20 bp, Artificial Sequence
  Synthetic oligonucleotide; GGG chr2 60471863 60471882 60471879 +
ctgaatcagaaattgagggt

SEQ ID NO: 159427 - DNA, 20 bp, Artificial Sequence
  Synthetic oligonucleotide; GGG chr2 60471864 60471883 60471880 +
tgaatcagaaattgagggtg

SEQ ID NO: 159428 - DNA, 20 bp, Artificial Sequence
  Synthetic oligonucleotide; AAG chr2 60471867 60471886 60471883 +
atcagaaattgagggtgggg

SEQ ID NO: 159429 - DNA, 20 bp, Artificial Sequence
  Synthetic oligonucleotide; CAG chr2 60471870 60471889 60471886 +
agaaattgagggtggggaag

SEQ ID NO: 159430 - DNA, 20 bp, Artificial Sequence
  Synthetic oligonucleotide; CAG chr2 60471896 60471915 60471912 +
tctatgttgaataaattctc

SEQ ID NO: 159431 - DNA, 20 bp, Artificial Sequence
  Synthetic oligonucleotide; AGG chr2 60471897 60471916 60471913 +
ctatgttgaataaattctcc

SEQ ID NO: 159432 - DNA, 20 bp, Artificial Sequence
  Synthetic oligonucleotide; AAG chr2 60471918 60471937 60471934 +
ggtgattctcatgcacactc

SEQ ID NO: 159433 - DNA, 20 bp, Artificial Sequence
  Synthetic oligonucleotide; CAG chr2 60471927 60471946 60471943 +
catgcacactcaagctgaat

SEQ ID NO: 159434 - DNA, 20 bp, Artificial Sequence
  Synthetic oligonucleotide; TAG chr2 60471941 60471960 60471957 +
ctgaatcagcactgctgtct

SEQ ID NO: 159435 - DNA, 20 bp, Artificial Sequence
  Synthetic oligonucleotide; AGG chr2 60471942 60471961 60471958 +
tgaatcagcactgctgtctt

SEQ ID NO: 159436 - DNA, 20 bp, Artificial Sequence
  Synthetic oligonucleotide; GGG chr2 60471943 60471962 60471959 +
gaatcagcactgctgtctta

SEQ ID NO: 159437 - DNA, 20 bp, Artificial Sequence
  Synthetic oligonucleotide; AAG chr2 60471947 60471966 60471963 +
cagcactgctgtcttagggt

SEQ ID NO: 159438 - DNA, 20 bp, Artificial Sequence
  Synthetic oligonucleotide; AGG chr2 60471948 60471967 60471964 +
agcactgctgtcttagggta

SEQ ID NO: 159439 - DNA, 20 bp, Artificial Sequence
  Synthetic oligonucleotide; GGG chr2 60471949 60471968 60471965 +
gcactgctgtcttagggtaa

SEQ ID NO: 159440 - DNA, 20 bp, Artificial Sequence
  Synthetic oligonucleotide; AAG chr2 60471952 60471971 60471968 +
ctgctgtcttagggtaaggg

SEQ ID NO: 159441 - DNA, 20 bp, Artificial Sequence
  Synthetic oligonucleotide; TGG chr2 60471964 60471983 60471980 +
ggtaagggaagtatgaacgc

SEQ ID NO: 159442 - DNA, 20 bp, Artificial Sequence
  Synthetic oligonucleotide; AAG chr2 60471967 60471986 60471983 +
aagggaagtatgaacgctgg

SEQ ID NO: 159443 - DNA, 20 bp, Artificial Sequence
  Synthetic oligonucleotide; TGG chr2 60471983 60472002 60471999 +
ctggaagctttgaaattccc

SEQ ID NO: 159444 - DNA, 20 bp, Artificial Sequence
  Synthetic oligonucleotide; GGG chr2 60471984 60472003 60472000 +
tggaagctttgaaattccct

SEQ ID NO: 159445 - DNA, 20 bp, Artificial Sequence
  Synthetic oligonucleotide; CAG chr2 60471987 60472006 60472003 +
aagctttgaaattccctggg

SEQ ID NO: 159446 - DNA, 20 bp, Artificial Sequence
  Synthetic oligonucleotide; GAG chr2 60471989 60472008 60472005 +
gctttgaaattccctgggca

SEQ ID NO: 159447 - DNA, 20 bp, Artificial Sequence
  Synthetic oligonucleotide; TGG chr2 60471997 60472016 60472013 +
attccctgggcagagaccca

SEQ ID NO: 159448 - DNA, 20 bp, Artificial Sequence
  Synthetic oligonucleotide; GGG chr2 60471998 60472017 60472014 +
ttccctgggcagagacccat

SEQ ID NO: 159449 - DNA, 20 bp, Artificial Sequence
  Synthetic oligonucleotide; GAG chr2 60472005 60472024 60472021 +
ggcagagacccatgggccat

SEQ ID NO: 159450 - DNA, 20 bp, Artificial Sequence
  Synthetic oligonucleotide; AGG chr2 60472006 60472025 60472022 +
gcagagacccatgggccatg

SEQ ID NO: 159451 - DNA, 20 bp, Artificial Sequence
  Synthetic oligonucleotide; CAG chr2 60472026 60472045 60472042 +
aggctgttttccctcctgtc

SEQ ID NO: 159452 - DNA, 20 bp, Artificial Sequence
  Synthetic oligonucleotide; AGG chr2 60472027 60472046 60472043 +
ggctgttttccctcctgtcc

SEQ ID NO: 159453 - DNA, 20 bp, Artificial Sequence
  Synthetic oligonucleotide; TAG chr2 60472042 60472061 60472058 +
tgtccaggacccacctcctt

SEQ ID NO: 159454 - DNA, 20 bp, Artificial Sequence
  Synthetic oligonucleotide; AGG chr2 60472043 60472062 60472059 +
gtccaggacccacctccttt

SEQ ID NO: 159455 - DNA, 20 bp, Artificial Sequence
  Synthetic oligonucleotide; TGG chr2 60472048 60472067 60472064 +
ggacccacctcctttaggac

SEQ ID NO: 159456 - DNA, 20 bp, Artificial Sequence
  Synthetic oligonucleotide; CAG chr2 60472053 60472072 60472069 +
cacctcctttaggactggaa

SEQ ID NO: 159457 - DNA, 20 bp, Artificial Sequence
  Synthetic oligonucleotide; AAG chr2 60472069 60472088 60472085 +
ggaacagtcaaaaacaaatt

SEQ ID NO: 159458 - DNA, 20 bp, Artificial Sequence
  Synthetic oligonucleotide; TAG chr2 60472074 60472093 60472090 +
agtcaaaaacaaattaagct

SEQ ID NO: 159459 - DNA, 20 bp, Artificial Sequence
  Synthetic oligonucleotide; AGG chr2 60472075 60472094 60472091 +
gtcaaaaacaaattaagctt

SEQ ID NO: 159460 - DNA, 20 bp, Artificial Sequence
  Synthetic oligonucleotide; GGG chr2 60472076 60472095 60472092 +
tcaaaaacaaattaagctta

SEQ ID NO: 159461 - DNA, 20 bp, Artificial Sequence
  Synthetic oligonucleotide; AAG chr2 60472086 60472105 60472102 +
attaagcttagggaatccct

SEQ ID NO: 159462 - DNA, 20 bp, Artificial Sequence
  Synthetic oligonucleotide; AGG chr2 60472087 60472106 60472103 +
ttaagcttagggaatcccta

SEQ ID NO: 159463 - DNA, 20 bp, Artificial Sequence
  Synthetic oligonucleotide; TAG chr2 60472100 60472119 60472116 +
atccctaaggatccctccat

SEQ ID NO: 159464 - DNA, 20 bp, Artificial Sequence
  Synthetic oligonucleotide; AGG chr2 60472101 60472120 60472117 +
tccctaaggatccctccatt

SEQ ID NO: 159465 - DNA, 20 bp, Artificial Sequence
  Synthetic oligonucleotide; CAG chr2 60472109 60472128 60472125 +
gatccctccattaggaaatt

SEQ ID NO: 159466 - DNA, 20 bp, Artificial Sequence
  Synthetic oligonucleotide; AGG chr2 60472110 60472129 60472126 +
atccctccattaggaaattc

SEQ ID NO: 159467 - DNA, 20 bp, Artificial Sequence
  Synthetic oligonucleotide; AAG chr2 60472137 60472156 60472153 +
accctccgtctgtcattgat

SEQ ID NO: 159468 - DNA, 20 bp, Artificial Sequence
  Synthetic oligonucleotide; AGG chr2 60472138 60472157 60472154 +
ccctccgtctgtcattgata

SEQ ID NO: 159469 - DNA, 20 bp, Artificial Sequence
  Synthetic oligonucleotide; CAG chr2 60472142 60472161 60472158 +
ccgtctgtcattgataagga

SEQ ID NO: 159470 - DNA, 20 bp, Artificial Sequence
  Synthetic oligonucleotide; AGG chr2 60472143 60472162 60472159 +
cgtctgtcattgataaggac

SEQ ID NO: 159471 - DNA, 20 bp, Artificial Sequence
  Synthetic oligonucleotide; GGG chr2 60472144 60472163 60472160 +
gtctgtcattgataaggaca

SEQ ID NO: 159472 - DNA, 20 bp, Artificial Sequence
  Synthetic oligonucleotide; CAG chr2 60472149 60472168 60472165 +
tcattgataaggacagggaa

SEQ ID NO: 159473 - DNA, 20 bp, Artificial Sequence
  Synthetic oligonucleotide; AGG chr2 60472150 60472169 60472166 +
cattgataaggacagggaac

SEQ ID NO: 159474 - DNA, 20 bp, Artificial Sequence
  Synthetic oligonucleotide; CAG chr2 60472155 60472174 60472171 +
ataaggacagggaacaggtc

SEQ ID NO: 159475 - DNA, 20 bp, Artificial Sequence
  Synthetic oligonucleotide; AGG chr2 60472156 60472175 60472172 +
taaggacagggaacaggtcc

SEQ ID NO: 159476 - DNA, 20 bp, Artificial Sequence
  Synthetic oligonucleotide; CAG chr2 60472167 60472186 60472183 +
aacaggtccaggctctccat

SEQ ID NO: 159477 - DNA, 20 bp, Artificial Sequence
  Synthetic oligonucleotide; AGG chr2 60472168 60472187 60472184 +
acaggtccaggctctccatc

SEQ ID NO: 159478 - DNA, 20 bp, Artificial Sequence
  Synthetic oligonucleotide; CAG chr2 60472173 60472192 60472189 +
tccaggctctccatcaggtc

SEQ ID NO: 159479 - DNA, 20 bp, Artificial Sequence
  Synthetic oligonucleotide; AGG chr2 60472174 60472193 60472190 +
ccaggctctccatcaggtcc

SEQ ID NO: 159480 - DNA, 20 bp, Artificial Sequence
  Synthetic oligonucleotide; GGG chr2 60472175 60472194 60472191 +
caggctctccatcaggtcca

SEQ ID NO: 159481 - DNA, 20 bp, Artificial Sequence
  Synthetic oligonucleotide; TAG chr2 60472184 60472203 60472200 +
catcaggtccagggccttct

SEQ ID NO: 159482 - DNA, 20 bp, Artificial Sequence
  Synthetic oligonucleotide; GAG chr2 60472190 60472209 60472206 +
gtccagggccttcttagcat

SEQ ID NO: 159483 - DNA, 20 bp, Artificial Sequence
  Synthetic oligonucleotide; CAG chr2 60472206 60472225 60472222 +
gcatgagacaacacccaaac

SEQ ID NO: 159484 - DNA, 20 bp, Artificial Sequence
  Synthetic oligonucleotide; CAG chr2 60472216 60472235 60472232 +
acacccaaaccagcttgtgc

SEQ ID NO: 159485 - DNA, 20 bp, Artificial Sequence
  Synthetic oligonucleotide; CAG chr2 60472220 60472239 60472236 +
ccaaaccagcttgtgccaga

SEQ ID NO: 159486 - DNA, 20 bp, Artificial Sequence
  Synthetic oligonucleotide; AAG chr2 60472247 60472266 60472263 +
tgtcctcactgcttccatta

SEQ ID NO: 159487 - DNA, 20 bp, Artificial Sequence
  Synthetic oligonucleotide; CAG chr2 60472259 60472278 60472275 +
ttccattaaagccgacatgt

SEQ ID NO: 159488 - DNA, 20 bp, Artificial Sequence
  Synthetic oligonucleotide; CAG chr2 60472268 60472287 60472284 +
agccgacatgtcagcgaacg

SEQ ID NO: 159489 - DNA, 20 bp, Artificial Sequence
  Synthetic oligonucleotide; TGG chr2 60472274 60472293 60472290 +
catgtcagcgaacgcagctg

SEQ ID NO: 159490 - DNA, 20 bp, Artificial Sequence
  Synthetic oligonucleotide; CGG chr2 60472285 60472304 60472301 +
acgcagctgtggcaactgca

SEQ ID NO: 159491 - DNA, 20 bp, Artificial Sequence
  Synthetic oligonucleotide; CAG chr2 60472291 60472310 60472307 +
ctgtggcaactgcacggaca

SEQ ID NO: 159492 - DNA, 20 bp, Artificial Sequence
  Synthetic oligonucleotide; CAG chr2 60472294 60472313 60472310 +
tggcaactgcacggacacag

SEQ ID NO: 159493 - DNA, 20 bp, Artificial Sequence
  Synthetic oligonucleotide; AGG chr2 60472295 60472314 60472311 +
ggcaactgcacggacacagc

SEQ ID NO: 159494 - DNA, 20 bp, Artificial Sequence
  Synthetic oligonucleotide; TGG chr2 60472301 60472320 60472317 +
tgcacggacacagcaggaac

SEQ ID NO: 159495 - DNA, 20 bp, Artificial Sequence
  Synthetic oligonucleotide; TGG chr2 60472321 60472340 60472337 +
tggactcttgtttccctttc

SEQ ID NO: 159496 - DNA, 20 bp, Artificial Sequence
  Synthetic oligonucleotide; TGG chr2 60472333 60472352 60472349 +
tccctttctggtctctcaaa

SEQ ID NO: 159497 - DNA, 20 bp, Artificial Sequence
  Synthetic oligonucleotide; GGG chr2 60472334 60472353 60472350 +
ccctttctggtctctcaaat

SEQ ID NO: 159498 - DNA, 20 bp, Artificial Sequence
  Synthetic oligonucleotide; TGG chr2 60472388 60472407 60472404 +
tcaaatgtcttacacttttc

SEQ ID NO: 159499 - DNA, 20 bp, Artificial Sequence
  Synthetic oligonucleotide; TGG chr2 60472391 60472410 60472407 +
aatgtcttacacttttctgg

SEQ ID NO: 159500 - DNA, 20 bp, Artificial Sequence
  Synthetic oligonucleotide; AAG chr2 60472394 60472413 60472410 +
gtcttacacttttctggtgg

SEQ ID NO: 159501 - DNA, 20 bp, Artificial Sequence
  Synthetic oligonucleotide; AGG chr2 60472395 60472414 60472411 +
tcttacacttttctggtgga

SEQ ID NO: 159502 - DNA, 20 bp, Artificial Sequence
  Synthetic oligonucleotide; AAG chr2 60472422 60472441 60472438 +
tcaacctgttctatttcata

SEQ ID NO: 159503 - DNA, 20 bp, Artificial Sequence
  Synthetic oligonucleotide; AGG chr2 60472423 60472442 60472439 +
caacctgttctatttcataa

SEQ ID NO: 159504 - DNA, 20 bp, Artificial Sequence
  Synthetic oligonucleotide; TAG chr2 60472432 60472451 60472448 +
ctatttcataaaggtctctc

SEQ ID NO: 159505 - DNA, 20 bp, Artificial Sequence
  Synthetic oligonucleotide; CAG chr2 60472438 60472457 60472454 +
cataaaggtctctctagacc

SEQ ID NO: 159506 - DNA, 20 bp, Artificial Sequence
  Synthetic oligonucleotide; TGG chr2 60472451 60472470 60472467 +
ctagacccagtatttccact

SEQ ID NO: 159507 - DNA, 20 bp, Artificial Sequence
  Synthetic oligonucleotide; GGG chr2 60472452 60472471 60472468 +
tagacccagtatttccactt

SEQ ID NO: 159508 - DNA, 20 bp, Artificial Sequence
  Synthetic oligonucleotide; GGG chr2 60472453 60472472 60472469 +
agacccagtatttccacttg

SEQ ID NO: 159509 - DNA, 20 bp, Artificial Sequence
  Synthetic oligonucleotide; CAG chr2 60472459 60472478 60472475 +
agtatttccacttggggcct

SEQ ID NO: 159510 - DNA, 20 bp, Artificial Sequence
  Synthetic oligonucleotide; TAG chr2 60472480 60472499 60472496 +
agaaatgccttacacattat

SEQ ID NO: 159511 - DNA, 20 bp, Artificial Sequence
  Synthetic oligonucleotide; AGG chr2 60472481 60472500 60472497 +
gaaatgccttacacattatt

SEQ ID NO: 159512 - DNA, 20 bp, Artificial Sequence
  Synthetic oligonucleotide; AAG chr2 60472489 60472508 60472505 +
ttacacattattaggttgca

SEQ ID NO: 159513 - DNA, 20 bp, Artificial Sequence
  Synthetic oligonucleotide; TGG chr2 60472500 60472519 60472516 +
taggttgcaaagtttcctta

SEQ ID NO: 159514 - DNA, 20 bp, Artificial Sequence
  Synthetic oligonucleotide; TAG chr2 60472516 60472535 60472532 +
cttatggctgaatttaaaaa

SEQ ID NO: 159515 - DNA, 20 bp, Artificial Sequence
  Synthetic oligonucleotide; CAG chr2 60472533 60472552 60472549 +
aaatagtgactcttattttt

SEQ ID NO: 159516 - DNA, 20 bp, Artificial Sequence
  Synthetic oligonucleotide; AGG chr2 60472534 60472553 60472550 +
aatagtgactcttatttttc

SEQ ID NO: 159517 - DNA, 20 bp, Artificial Sequence
  Synthetic oligonucleotide; CAG chr2 60472554 60472573 60472570 +
aggtttcattaaaaaatatg

SEQ ID NO: 159518 - DNA, 20 bp, Artificial Sequence
  Synthetic oligonucleotide; TGG chr2 60472562 60472581 60472578 +
ttaaaaaatatgcagcaaac

SEQ ID NO: 159519 - DNA, 20 bp, Artificial Sequence
  Synthetic oligonucleotide; GGG chr2 60472563 60472582 60472579 +
taaaaaatatgcagcaaact

SEQ ID NO: 159520 - DNA, 20 bp, Artificial Sequence
  Synthetic oligonucleotide; TGG chr2 60472568 60472587 60472584 +
aatatgcagcaaactgggaa

SEQ ID NO: 159521 - DNA, 20 bp, Artificial Sequence
  Synthetic oligonucleotide; TGG chr2 60472593 60472612 60472609 +
ttgatttaatgttatacatt

SEQ ID NO: 159522 - DNA, 20 bp, Artificial Sequence
  Synthetic oligonucleotide; TGG chr2 60472619 60472638 60472635 +
ctttacatttctacatatat

SEQ ID NO: 159523 - DNA, 20 bp, Artificial Sequence
  Synthetic oligonucleotide; GGG chr2 60472620 60472639 60472636 +
tttacatttctacatatatt

SEQ ID NO: 159524 - DNA, 20 bp, Artificial Sequence
  Synthetic oligonucleotide; AAG chr2 60472638 60472657 60472654 +
ttgggtaccaacttttgaca

SEQ ID NO: 159525 - DNA, 20 bp, Artificial Sequence
  Synthetic oligonucleotide; GAG chr2 60472640 60472659 60472656 +
gggtaccaacttttgacaaa

SEQ ID NO: 159526 - DNA, 20 bp, Artificial Sequence
  Synthetic oligonucleotide; AAG chr2 60472647 60472666 60472663 +
aacttttgacaaagagctct

SEQ ID NO: 159527 - DNA, 20 bp, Artificial Sequence
  Synthetic oligonucleotide; CAG chr2 60472652 60472671 60472668 +
ttgacaaagagctctaagcc

SEQ ID NO: 159528 - DNA, 20 bp, Artificial Sequence
  Synthetic oligonucleotide; TGG chr2 60472655 60472674 60472671 +
acaaagagctctaagcccag

SEQ ID NO: 159529 - DNA, 20 bp, Artificial Sequence
  Synthetic oligonucleotide; GGG chr2 60472656 60472675 60472672 +
caaagagctctaagcccagt

SEQ ID NO: 159530 - DNA, 20 bp, Artificial Sequence
  Synthetic oligonucleotide; TGG chr2 60472666 60472685 60472682 +
taagcccagtgggatgttcc

SEQ ID NO: 159531 - DNA, 20 bp, Artificial Sequence
  Synthetic oligonucleotide; AAG chr2 60472674 60472693 60472690 +
gtgggatgttcctggaattt

SEQ ID NO: 159532 - DNA, 20 bp, Artificial Sequence
  Synthetic oligonucleotide; AAG chr2 60472687 60472706 60472703 +
ggaatttaagtcattaaatc

SEQ ID NO: 159533 - DNA, 20 bp, Artificial Sequence
  Synthetic oligonucleotide; TGG chr2 60472695 60472714 60472711 +
agtcattaaatcaagttttt

SEQ ID NO: 159534 - DNA, 20 bp, Artificial Sequence
  Synthetic oligonucleotide; AAG chr2 60472705 60472724 60472721 +
tcaagttttttggtttcctc

SEQ ID NO: 159535 - DNA, 20 bp, Artificial Sequence
  Synthetic oligonucleotide; AAG chr2 60472717 60472736 60472733 +
gtttcctcaagaacatctca

SEQ ID NO: 159536 - DNA, 20 bp, Artificial Sequence
  Synthetic oligonucleotide; TGG chr2 60472764 60472783 60472780 +
ttgtttctgaaactaatcac

SEQ ID NO: 159537 - DNA, 20 bp, Artificial Sequence
  Synthetic oligonucleotide; GGG chr2 60472765 60472784 60472781 +
tgtttctgaaactaatcact

SEQ ID NO: 159538 - DNA, 20 bp, Artificial Sequence
  Synthetic oligonucleotide; CAG chr2 60472777 60472796 60472793 +
taatcactgggtgtgtaata

SEQ ID NO: 159539 - DNA, 20 bp, Artificial Sequence
  Synthetic oligonucleotide; CAG chr2 60472803 60472822 60472819 +
cattactgtctactaatcaa

SEQ ID NO: 159540 - DNA, 20 bp, Artificial Sequence
  Synthetic oligonucleotide; AGG chr2 60472804 60472823 60472820 +
attactgtctactaatcaac

SEQ ID NO: 159541 - DNA, 20 bp, Artificial Sequence
  Synthetic oligonucleotide; CAG chr2 60472815 60472834 60472831 +
ctaatcaacaggtaatactg

SEQ ID NO: 159542 - DNA, 20 bp, Artificial Sequence
  Synthetic oligonucleotide; CAG chr2 60472837 60472856 60472853 +
gatttccaaatgtgccaaaa

SEQ ID NO: 159543 - DNA, 20 bp, Artificial Sequence
  Synthetic oligonucleotide; AAG chr2 60472842 60472861 60472858 +
ccaaatgtgccaaaacagct

SEQ ID NO: 159544 - DNA, 20 bp, Artificial Sequence
  Synthetic oligonucleotide; AAG chr2 60472849 60472868 60472865 +
tgccaaaacagctaagcaaa

SEQ ID NO: 159545 - DNA, 20 bp, Artificial Sequence
  Synthetic oligonucleotide; TGG chr2 60472881 60472900 60472897 +
aacacgtttaatgactgctt

SEQ ID NO: 159546 - DNA, 20 bp, Artificial Sequence
  Synthetic oligonucleotide; GGG chr2 60472882 60472901 60472898 +
acacgtttaatgactgcttt

SEQ ID NO: 159547 - DNA, 20 bp, Artificial Sequence
  Synthetic oligonucleotide; GAG chr2 60472884 60472903 60472900 +
acgtttaatgactgctttgg

SEQ ID NO: 159548 - DNA, 20 bp, Artificial Sequence
  Synthetic oligonucleotide; CAG chr2 60472898 60472917 60472914 +
ctttgggagcccaactttaa

SEQ ID NO: 159549 - DNA, 20 bp, Artificial Sequence
  Synthetic oligonucleotide; AGG chr2 60472899 60472918 60472915 +
tttgggagcccaactttaac

SEQ ID NO: 159550 - DNA, 20 bp, Artificial Sequence
  Synthetic oligonucleotide; CAG chr2 60472913 60472932 60472929 +
tttaacaggtattaaaacca

SEQ ID NO: 159551 - DNA, 20 bp, Artificial Sequence
  Synthetic oligonucleotide; AGG chr2 60472914 60472933 60472930 +
ttaacaggtattaaaaccac

SEQ ID NO: 159552 - DNA, 20 bp, Artificial Sequence
  Synthetic oligonucleotide; CAG chr2 60472925 60472944 60472941 +
taaaaccacaggactctcca

SEQ ID NO: 159553 - DNA, 20 bp, Artificial Sequence
  Synthetic oligonucleotide; AGG chr2 60472926 60472945 60472942 +
aaaaccacaggactctccac

SEQ ID NO: 159554 - DNA, 20 bp, Artificial Sequence
  Synthetic oligonucleotide; GAG chr2 60472928 60472947 60472944 +
aaccacaggactctccacag

SEQ ID NO: 159555 - DNA, 20 bp, Artificial Sequence
  Synthetic oligonucleotide; TAG chr2 60472935 60472954 60472951 +
ggactctccacaggagtaca

SEQ ID NO: 159556 - DNA, 20 bp, Artificial Sequence
  Synthetic oligonucleotide; AAG chr2 60472979 60472998 60472995 +
gtacgtgtgtgtgtgtttgc

SEQ ID NO: 159557 - DNA, 20 bp, Artificial Sequence
  Synthetic oligonucleotide; TAG chr2 60473005 60473024 60473021 +
ttatgtgtacatatgtgtgt

SEQ ID NO: 159558 - DNA, 20 bp, Artificial Sequence
  Synthetic oligonucleotide; GAG chr2 60473031 60473050 60473047 +
gtgcatgcatatgtgtttgt

SEQ ID NO: 159559 - DNA, 20 bp, Artificial Sequence
  Synthetic oligonucleotide; TAG chr2 60473092 60473111 60473108 +
gtgtatgcttgtgcatgtgt

SEQ ID NO: 159560 - DNA, 20 bp, Artificial Sequence
  Synthetic oligonucleotide; TAG chr2 60473116 60473135 60473132 +
atgtgcatgcacatgtgtgt

SEQ ID NO: 159561 - DNA, 20 bp, Artificial Sequence
  Synthetic oligonucleotide; GAG chr2 60473142 60473161 60473158 +
gttcatgtgtgtgtatatgt

SEQ ID NO: 159562 - DNA, 20 bp, Artificial Sequence
  Synthetic oligonucleotide; TAG chr2 60473206 60473225 60473222 +
atttcctaaacatatgtttt

SEQ ID NO: 159563 - DNA, 20 bp, Artificial Sequence
  Synthetic oligonucleotide; CAG chr2 60473236 60473255 60473252 +
ccctgttttttttttttttt

SEQ ID NO: 159564 - DNA, 20 bp, Artificial Sequence
  Synthetic oligonucleotide; GAG chr2 60473240 60473259 60473256 +
gtttttttttttttttcagt

SEQ ID NO: 159565 - DNA, 20 bp, Artificial Sequence
  Synthetic oligonucleotide; CAG chr2 60473244 60473263 60473260 +
ttttttttttttcagtgaga

SEQ ID NO: 159566 - DNA, 20 bp, Artificial Sequence
  Synthetic oligonucleotide; AGG chr2 60473245 60473264 60473261 +
tttttttttttcagtgagac

SEQ ID NO: 159567 - DNA, 20 bp, Artificial Sequence
  Synthetic oligonucleotide; AAG chr2 60473253 60473272 60473269 +
tttcagtgagacaggcacaa

SEQ ID NO: 159568 - DNA, 20 bp, Artificial Sequence
  Synthetic oligonucleotide; CAG chr2 60473256 60473275 60473272 +
cagtgagacaggcacaaaag

SEQ ID NO: 159569 - DNA, 20 bp, Artificial Sequence
  Synthetic oligonucleotide; TAG chr2 60473259 60473278 60473275 +
tgagacaggcacaaaagcag

SEQ ID NO: 159570 - DNA, 20 bp, Artificial Sequence
  Synthetic oligonucleotide; GAG chr2 60473261 60473280 60473277 +
agacaggcacaaaagcagta

SEQ ID NO: 159571 - DNA, 20 bp, Artificial Sequence
  Synthetic oligonucleotide; TGG chr2 60473274 60473293 60473290 +
agcagtagagctgtcccacg

SEQ ID NO: 159572 - DNA, 20 bp, Artificial Sequence
  Synthetic oligonucleotide; TGG chr2 60473279 60473298 60473295 +
tagagctgtcccacgtggaa

SEQ ID NO: 159573 - DNA, 20 bp, Artificial Sequence
  Synthetic oligonucleotide; GGG chr2 60473280 60473299 60473296 +
agagctgtcccacgtggaat

SEQ ID NO: 159574 - DNA, 20 bp, Artificial Sequence
  Synthetic oligonucleotide; TGG chr2 60473319 60473338 60473335 +
tgaccccctttctttcaccc

SEQ ID NO: 159575 - DNA, 20 bp, Artificial Sequence
  Synthetic oligonucleotide; GGG chr2 60473320 60473339 60473336 +
gaccccctttctttcaccct

SEQ ID NO: 159576 - DNA, 20 bp, Artificial Sequence
  Synthetic oligonucleotide; AAG chr2 60473331 60473350 60473347 +
tttcaccctgggtcttcaaa

SEQ ID NO: 159577 - DNA, 20 bp, Artificial Sequence
  Synthetic oligonucleotide; GAG chr2 60473333 60473352 60473349 +
tcaccctgggtcttcaaaaa

SEQ ID NO: 159578 - DNA, 20 bp, Artificial Sequence
  Synthetic oligonucleotide; TGG chr2 60473338 60473357 60473354 +
ctgggtcttcaaaaagagaa

SEQ ID NO: 159579 - DNA, 20 bp, Artificial Sequence
  Synthetic oligonucleotide; GAG chr2 60473354 60473373 60473370 +
agaatggatgacactatgat

SEQ ID NO: 159580 - DNA, 20 bp, Artificial Sequence
  Synthetic oligonucleotide; AGG chr2 60473355 60473374 60473371 +
gaatggatgacactatgatg

SEQ ID NO: 159581 - DNA, 20 bp, Artificial Sequence
  Synthetic oligonucleotide; GAG chr2 60473357 60473376 60473373 +
atggatgacactatgatgag

SEQ ID NO: 159582 - DNA, 20 bp, Artificial Sequence
  Synthetic oligonucleotide; AGG chr2 60473358 60473377 60473374 +
tggatgacactatgatgagg

SEQ ID NO: 159583 - DNA, 20 bp, Artificial Sequence
  Synthetic oligonucleotide; GGG chr2 60473359 60473378 60473375 +
ggatgacactatgatgagga

SEQ ID NO: 159584 - DNA, 20 bp, Artificial Sequence
  Synthetic oligonucleotide; GGG chr2 60473360 60473379 60473376 +
gatgacactatgatgaggag

SEQ ID NO: 159585 - DNA, 20 bp, Artificial Sequence
  Synthetic oligonucleotide; TGG chr2 60473372 60473391 60473388 +
atgaggaggggtctctatat

SEQ ID NO: 159586 - DNA, 20 bp, Artificial Sequence
  Synthetic oligonucleotide; CAG chr2 60473378 60473397 60473394 +
aggggtctctatattggtga

SEQ ID NO: 159587 - DNA, 20 bp, Artificial Sequence
  Synthetic oligonucleotide; AGG chr2 60473379 60473398 60473395 +
ggggtctctatattggtgac

SEQ ID NO: 159588 - DNA, 20 bp, Artificial Sequence
  Synthetic oligonucleotide; CAG chr2 60473390 60473409 60473406 +
attggtgacaggccaaaata

SEQ ID NO: 159589 - DNA, 20 bp, Artificial Sequence
  Synthetic oligonucleotide; AGG chr2 60473391 60473410 60473407 +
ttggtgacaggccaaaatac

SEQ ID NO: 159590 - DNA, 20 bp, Artificial Sequence
  Synthetic oligonucleotide; CAG chr2 60473402 60473421 60473418 +
ccaaaatacaggactaccta

SEQ ID NO: 159591 - DNA, 20 bp, Artificial Sequence
  Synthetic oligonucleotide; CAG chr2 60473413 60473432 60473429 +
gactacctacagtcctttcg

SEQ ID NO: 159592 - DNA, 20 bp, Artificial Sequence
  Synthetic oligonucleotide; AAG chr2 60473428 60473447 60473444 +
tttcgcagtccataatcctc

SEQ ID NO: 159593 - DNA, 20 bp, Artificial Sequence
  Synthetic oligonucleotide; CAG chr2 60473436 60473455 60473452 +
tccataatcctcaagtccct

SEQ ID NO: 159594 - DNA, 20 bp, Artificial Sequence
  Synthetic oligonucleotide; TAG chr2 60473459 60473478 60473475 +
ctcttccatgtaccaccttc

SEQ ID NO: 159595 - DNA, 20 bp, Artificial Sequence
  Synthetic oligonucleotide; AAG chr2 60473494 60473513 60473510 +
atgcatcctgaacgtttgta

SEQ ID NO: 159596 - DNA, 20 bp, Artificial Sequence
  Synthetic oligonucleotide; AAG chr2 60473504 60473523 60473520 +
aacgtttgtaaagtaccctg

SEQ ID NO: 159597 - DNA, 20 bp, Artificial Sequence
  Synthetic oligonucleotide; AGG chr2 60473505 60473524 60473521 +
acgtttgtaaagtaccctga

SEQ ID NO: 159598 - DNA, 20 bp, Artificial Sequence
  Synthetic oligonucleotide; CAG chr2 60473517 60473536 60473533 +
taccctgaaggaacccattc

SEQ ID NO: 159599 - DNA, 20 bp, Artificial Sequence
  Synthetic oligonucleotide; TAG chr2 60473536 60473555 60473552 +
ccagttctgaatccgattac

SEQ ID NO: 159600 - DNA, 20 bp, Artificial Sequence
  Synthetic oligonucleotide; AGG chr2 60473537 60473556 60473553 +
cagttctgaatccgattact

SEQ ID NO: 159601 - DNA, 20 bp, Artificial Sequence
  Synthetic oligonucleotide; AAG chr2 60473543 60473562 60473559 +
tgaatccgattactaggttc

SEQ ID NO: 159602 - DNA, 20 bp, Artificial Sequence
  Synthetic oligonucleotide; CAG chr2 60473561 60473580 60473577 +
tcaagccacacaaataacaa

SEQ ID NO: 159603 - DNA, 20 bp, Artificial Sequence
  Synthetic oligonucleotide; CAG chr2 60473566 60473585 60473582 +
ccacacaaataacaacagtg

SEQ ID NO: 159604 - DNA, 20 bp, Artificial Sequence
  Synthetic oligonucleotide; TAG chr2 60473570 60473589 60473586 +
acaaataacaacagtgcagc

SEQ ID NO: 159605 - DNA, 20 bp, Artificial Sequence
  Synthetic oligonucleotide; GAG chr2 60473576 60473595 60473592 +
aacaacagtgcagctagtct

SEQ ID NO: 159606 - DNA, 20 bp, Artificial Sequence
  Synthetic oligonucleotide; TAG chr2 60473580 60473599 60473596 +
acagtgcagctagtctgagc

SEQ ID NO: 159607 - DNA, 20 bp, Artificial Sequence
  Synthetic oligonucleotide; GAG chr2 60473582 60473601 60473598 +
agtgcagctagtctgagcta

SEQ ID NO: 159608 - DNA, 20 bp, Artificial Sequence
  Synthetic oligonucleotide; AGG chr2 60473583 60473602 60473599 +
gtgcagctagtctgagctag

SEQ ID NO: 159609 - DNA, 20 bp, Artificial Sequence
  Synthetic oligonucleotide; AAG chr2 60473604 60473623 60473620 +
ggcttctttacctaactgca

SEQ ID NO: 159610 - DNA, 20 bp, Artificial Sequence
  Synthetic oligonucleotide; CAG chr2 60473624 60473643 60473640 +
aagtaaatgtcctttctatt

SEQ ID NO: 159611 - DNA, 20 bp, Artificial Sequence
  Synthetic oligonucleotide; TAG chr2 60473634 60473653 60473650 +
cctttctattcagccgcatc

SEQ ID NO: 159612 - DNA, 20 bp, Artificial Sequence
  Synthetic oligonucleotide; TAG chr2 60473658 60473677 60473674 +
tcttgaccctatgtttacca

SEQ ID NO: 159613 - DNA, 20 bp, Artificial Sequence
  Synthetic oligonucleotide; CAG chr2 60473665 60473684 60473681 +
cctatgtttaccatagatac

SEQ ID NO: 159614 - DNA, 20 bp, Artificial Sequence
  Synthetic oligonucleotide; TAG chr2 60473679 60473698 60473695 +
agataccagttcttctcact

SEQ ID NO: 159615 - DNA, 20 bp, Artificial Sequence
  Synthetic oligonucleotide; CAG chr2 60473696 60473715 60473712 +
acttagattctctgacttat

SEQ ID NO: 159616 - DNA, 20 bp, Artificial Sequence
  Synthetic oligonucleotide; GAG chr2 60473698 60473717 60473714 +
ttagattctctgacttatca

SEQ ID NO: 159617 - DNA, 20 bp, Artificial Sequence
  Synthetic oligonucleotide; TAG chr2 60473706 60473725 60473722 +
tctgacttatcagagtatta

SEQ ID NO: 159618 - DNA, 20 bp, Artificial Sequence
  Synthetic oligonucleotide; GAG chr2 60473708 60473727 60473724 +
tgacttatcagagtattata

SEQ ID NO: 159619 - DNA, 20 bp, Artificial Sequence
  Synthetic oligonucleotide; TAG chr2 60473718 60473737 60473734 +
gagtattatagagcaaacat

SEQ ID NO: 159620 - DNA, 20 bp, Artificial Sequence
  Synthetic oligonucleotide; GAG chr2 60473736 60473755 60473752 +
attagctatgcctgtgactt

SEQ ID NO: 159621 - DNA, 20 bp, Artificial Sequence
  Synthetic oligonucleotide; CAG chr2 60473766 60473785 60473782 +
aatctgtaatgaaaatgtgc

SEQ ID NO: 159622 - DNA, 20 bp, Artificial Sequence
  Synthetic oligonucleotide; CAG chr2 60473784 60473803 60473800 +
gccagctttatcatcactca

SEQ ID NO: 159623 - DNA, 20 bp, Artificial Sequence
  Synthetic oligonucleotide; TAG chr2 60473837 60473856 60473853 +
aatcgcactctcttttgttc

SEQ ID NO: 159624 - DNA, 20 bp, Artificial Sequence
  Synthetic oligonucleotide; GAG chr2 60473844 60473863 60473860 +
ctctcttttgttctagaaat

SEQ ID NO: 159625 - DNA, 20 bp, Artificial Sequence
  Synthetic oligonucleotide; TGG chr2 60473887 60473906 60473903 +
ttccttcattgcttttttac

SEQ ID NO: 159626 - DNA, 20 bp, Artificial Sequence
  Synthetic oligonucleotide; AAG chr2 60473920 60473939 60473936 +
aaatcctgatgttctttaaa

SEQ ID NO: 159627 - DNA, 20 bp, Artificial Sequence
  Synthetic oligonucleotide; AAG chr2 60473941 60473960 60473957 +
agtgtattctgcaaaaacaa

SEQ ID NO: 159628 - DNA, 20 bp, Artificial Sequence
  Synthetic oligonucleotide; AAG chr2 60473945 60473964 60473961 +
tattctgcaaaaacaaaaga

SEQ ID NO: 159629 - DNA, 20 bp, Artificial Sequence
  Synthetic oligonucleotide; TAG chr2 60473957 60473976 60473973 +
acaaaagaaagcaataatta

SEQ ID NO: 159630 - DNA, 20 bp, Artificial Sequence
  Synthetic oligonucleotide; TAG chr2 60473971 60473990 60473987 +
taattatagacactacaata

SEQ ID NO: 159631 - DNA, 20 bp, Artificial Sequence
  Synthetic oligonucleotide; TGG chr2 60473998 60474017 60474014 +
tcttccctgaaactctctca

SEQ ID NO: 159632 - DNA, 20 bp, Artificial Sequence
  Synthetic oligonucleotide; TAG chr2 60474005 60474024 60474021 +
tgaaactctctcatggtcct

SEQ ID NO: 159633 - DNA, 20 bp, Artificial Sequence
  Synthetic oligonucleotide; CAG chr2 60474025 60474044 60474041 +
tagattccttgatacttcac

SEQ ID NO: 159634 - DNA, 20 bp, Artificial Sequence
  Synthetic oligonucleotide; TAG chr2 60474087 60474106 60474103 +
tttgatcaatgctatcctct

SEQ ID NO: 159635 - DNA, 20 bp, Artificial Sequence
  Synthetic oligonucleotide; GAG chr2 60474089 60474108 60474105 +
tgatcaatgctatcctctta

SEQ ID NO: 159636 - DNA, 20 bp, Artificial Sequence
  Synthetic oligonucleotide; CAG chr2 60474110 60474129 60474126 +
agccttgattactcaaacaa

SEQ ID NO: 159637 - DNA, 20 bp, Artificial Sequence
  Synthetic oligonucleotide; AGG chr2 60474111 60474130 60474127 +
gccttgattactcaaacaac

SEQ ID NO: 159638 - DNA, 20 bp, Artificial Sequence
  Synthetic oligonucleotide; AAG chr2 60474132 60474151 60474148 +
ggttactaacttcacctttt

SEQ ID NO: 159639 - DNA, 20 bp, Artificial Sequence
  Synthetic oligonucleotide; GAG chr2 60474134 60474153 60474150 +
ttactaacttcaccttttaa

SEQ ID NO: 159640 - DNA, 20 bp, Artificial Sequence
  Synthetic oligonucleotide; TAG chr2 60474146 60474165 60474162 +
ccttttaagagttctcctcc

SEQ ID NO: 159641 - DNA, 20 bp, Artificial Sequence
  Synthetic oligonucleotide; AGG chr2 60474147 60474166 60474163 +
cttttaagagttctcctcct

SEQ ID NO: 159642 - DNA, 20 bp, Artificial Sequence
  Synthetic oligonucleotide; AAG chr2 60474163 60474182 60474179 +
tcctaggctttttctcaata

SEQ ID NO: 159643 - DNA, 20 bp, Artificial Sequence
  Synthetic oligonucleotide; AGG chr2 60474164 60474183 60474180 +
cctaggctttttctcaataa

SEQ ID NO: 159644 - DNA, 20 bp, Artificial Sequence
  Synthetic oligonucleotide; GGG chr2 60474165 60474184 60474181 +
ctaggctttttctcaataaa

SEQ ID NO: 159645 - DNA, 20 bp, Artificial Sequence
  Synthetic oligonucleotide; GAG chr2 60474167 60474186 60474183 +
aggctttttctcaataaagg

SEQ ID NO: 159646 - DNA, 20 bp, Artificial Sequence
  Synthetic oligonucleotide; AGG chr2 60474168 60474187 60474184 +
ggctttttctcaataaaggg

SEQ ID NO: 159647 - DNA, 20 bp, Artificial Sequence
  Synthetic oligonucleotide; AAG chr2 60474171 60474190 60474187 +
tttttctcaataaagggagg

SEQ ID NO: 159648 - DNA, 20 bp, Artificial Sequence
  Synthetic oligonucleotide; TAG chr2 60474174 60474193 60474190 +
ttctcaataaagggaggaag

SEQ ID NO: 159649 - DNA, 20 bp, Artificial Sequence
  Synthetic oligonucleotide; GAG chr2 60474176 60474195 60474192 +
ctcaataaagggaggaagta

SEQ ID NO: 159650 - DNA, 20 bp, Artificial Sequence
  Synthetic oligonucleotide; CAG chr2 60474215 60474234 60474231 +
ccctttatctataaaaatgc

SEQ ID NO: 159651 - DNA, 20 bp, Artificial Sequence
  Synthetic oligonucleotide; CAG chr2 60474230 60474249 60474246 +
aatgccagccaccaatctgt

SEQ ID NO: 159652 - DNA, 20 bp, Artificial Sequence
  Synthetic oligonucleotide; AGG chr2 60474231 60474250 60474247 +
atgccagccaccaatctgtc

SEQ ID NO: 159653 - DNA, 20 bp, Artificial Sequence
  Synthetic oligonucleotide; AAG chr2 60474254 60474273 60474270 +
cctaaacaaaatttttctgc

SEQ ID NO: 159654 - DNA, 20 bp, Artificial Sequence
  Synthetic oligonucleotide; AAG chr2 60474272 60474291 60474288 +
gcaagctgtgtctttaacat

SEQ ID NO: 159655 - DNA, 20 bp, Artificial Sequence
  Synthetic oligonucleotide; AAG chr2 60474277 60474296 60474293 +
ctgtgtctttaacataagca

SEQ ID NO: 159656 - DNA, 20 bp, Artificial Sequence
  Synthetic oligonucleotide; AAG chr2 60474318 60474337 60474334 +
aaaaatcttgcttttctgaa

SEQ ID NO: 159657 - DNA, 20 bp, Artificial Sequence
  Synthetic oligonucleotide; AAG chr2 60474326 60474345 60474342 +
tgcttttctgaaaagcaact

SEQ ID NO: 159658 - DNA, 20 bp, Artificial Sequence
  Synthetic oligonucleotide; AAG chr2 60474332 60474351 60474348 +
tctgaaaagcaactaagcca

SEQ ID NO: 159659 - DNA, 20 bp, Artificial Sequence
  Synthetic oligonucleotide; CAG chr2 60474364 60474383 60474380 +
tccatctttgtgttgaaatg

SEQ ID NO: 159660 - DNA, 20 bp, Artificial Sequence
  Synthetic oligonucleotide; AAG chr2 60474379 60474398 60474395 +
aaatgcagatttcccactaa

SEQ ID NO: 159661 - DNA, 20 bp, Artificial Sequence
  Synthetic oligonucleotide; AGG chr2 60474380 60474399 60474396 +
aatgcagatttcccactaaa

SEQ ID NO: 159662 - DNA, 20 bp, Artificial Sequence
  Synthetic oligonucleotide; AAG chr2 60474400 60474419 60474416 +
aggcaaatccttcatttcaa

SEQ ID NO: 159663 - DNA, 20 bp, Artificial Sequence
  Synthetic oligonucleotide; AGG chr2 60474401 60474420 60474417 +
ggcaaatccttcatttcaaa

SEQ ID NO: 159664 - DNA, 20 bp, Artificial Sequence
  Synthetic oligonucleotide; TAG chr2 60474409 60474428 60474425 +
cttcatttcaaaaggttgaa

SEQ ID NO: 159665 - DNA, 20 bp, Artificial Sequence
  Synthetic oligonucleotide; AGG chr2 60474410 60474429 60474426 +
ttcatttcaaaaggttgaat

SEQ ID NO: 159666 - DNA, 20 bp, Artificial Sequence
  Synthetic oligonucleotide; TGG chr2 60474414 60474433 60474430 +
tttcaaaaggttgaatagga

SEQ ID NO: 159667 - DNA, 20 bp, Artificial Sequence
  Synthetic oligonucleotide; AAG chr2 60474427 60474446 60474443 +
aataggatggtacttaaaaa

SEQ ID NO: 159668 - DNA, 20 bp, Artificial Sequence
  Synthetic oligonucleotide; CAG chr2 60474435 60474454 60474451 +
ggtacttaaaaaaagaattc

SEQ ID NO: 159669 - DNA, 20 bp, Artificial Sequence
  Synthetic oligonucleotide; TGG chr2 60474439 60474458 60474455 +
cttaaaaaaagaattccagc

SEQ ID NO: 159670 - DNA, 20 bp, Artificial Sequence
  Synthetic oligonucleotide; TAG chr2 60474449 60474468 60474465 +
gaattccagctggttaaatt

SEQ ID NO: 159671 - DNA, 20 bp, Artificial Sequence
  Synthetic oligonucleotide; AGG chr2 60474450 60474469 60474466 +
aattccagctggttaaattt

SEQ ID NO: 159672 - DNA, 20 bp, Artificial Sequence
  Synthetic oligonucleotide; GGG chr2 60474451 60474470 60474467 +
attccagctggttaaattta

SEQ ID NO: 159673 - DNA, 20 bp, Artificial Sequence
  Synthetic oligonucleotide; AAG chr2 60474463 60474482 60474479 +
taaatttagggtgttaaaaa

SEQ ID NO: 159674 - DNA, 20 bp, Artificial Sequence
  Synthetic oligonucleotide; TGG chr2 60474486 60474505 60474502 +
ttcactccaataatattctt

SEQ ID NO: 159675 - DNA, 20 bp, Artificial Sequence
  Synthetic oligonucleotide; TGG chr2 60474492 60474511 60474508 +
ccaataatattctttggctc

SEQ ID NO: 159676 - DNA, 20 bp, Artificial Sequence
  Synthetic oligonucleotide; GGG chr2 60474493 60474512 60474509 +
caataatattctttggctct

SEQ ID NO: 159677 - DNA, 20 bp, Artificial Sequence
  Synthetic oligonucleotide; AAG chr2 60474500 60474519 60474516 +
attctttggctctgggccca

SEQ ID NO: 159678 - DNA, 20 bp, Artificial Sequence
  Synthetic oligonucleotide; TAG chr2 60474524 60474543 60474540 +
attttcacttgatcgtgaat

SEQ ID NO: 159679 - DNA, 20 bp, Artificial Sequence
  Synthetic oligonucleotide; AAG chr2 60474547 60474566 60474563 +
ataaatttttattacacttt

SEQ ID NO: 159680 - DNA, 20 bp, Artificial Sequence
  Synthetic oligonucleotide; TAG chr2 60474559 60474578 60474575 +
tacactttaagcttttgcct

SEQ ID NO: 159681 - DNA, 20 bp, Artificial Sequence
  Synthetic oligonucleotide; TGG chr2 60474564 60474583 60474580 +
tttaagcttttgccttagaa

SEQ ID NO: 159682 - DNA, 20 bp, Artificial Sequence
  Synthetic oligonucleotide; CGG chr2 60474567 60474586 60474583 +
aagcttttgccttagaatgg

SEQ ID NO: 159683 - DNA, 20 bp, Artificial Sequence
  Synthetic oligonucleotide; TAG chr2 60474578 60474597 60474594 +
ttagaatggcggaacttatc

SEQ ID NO: 159684 - DNA, 20 bp, Artificial Sequence
  Synthetic oligonucleotide; AGG chr2 60474579 60474598 60474595 +
tagaatggcggaacttatct

SEQ ID NO: 159685 - DNA, 20 bp, Artificial Sequence
  Synthetic oligonucleotide; GAG chr2 60474581 60474600 60474597 +
gaatggcggaacttatctag

SEQ ID NO: 159686 - DNA, 20 bp, Artificial Sequence
  Synthetic oligonucleotide; GAG chr2 60474587 60474606 60474603 +
cggaacttatctaggagact

SEQ ID NO: 159687 - DNA, 20 bp, Artificial Sequence
  Synthetic oligonucleotide; GAG chr2 60474589 60474608 60474605 +
gaacttatctaggagactga

SEQ ID NO: 159688 - DNA, 20 bp, Artificial Sequence
  Synthetic oligonucleotide; AGG chr2 60474590 60474609 60474606 +
aacttatctaggagactgag

SEQ ID NO: 159689 - DNA, 20 bp, Artificial Sequence
  Synthetic oligonucleotide; GGG chr2 60474591 60474610 60474607 +
acttatctaggagactgaga

SEQ ID NO: 159690 - DNA, 20 bp, Artificial Sequence
  Synthetic oligonucleotide; CAG chr2 60474594 60474613 60474610 +
tatctaggagactgagaggg

SEQ ID NO: 159691 - DNA, 20 bp, Artificial Sequence
  Synthetic oligonucleotide; AAG chr2 60474606 60474625 60474622 +
tgagagggcagctgcataaa

SEQ ID NO: 159692 - DNA, 20 bp, Artificial Sequence
  Synthetic oligonucleotide; TAG chr2 60474620 60474639 60474636 +
cataaaaagacaaattgtct

SEQ ID NO: 159693 - DNA, 20 bp, Artificial Sequence
  Synthetic oligonucleotide; AGG chr2 60474621 60474640 60474637 +
ataaaaagacaaattgtctt

SEQ ID NO: 159694 - DNA, 20 bp, Artificial Sequence
  Synthetic oligonucleotide; CAG chr2 60474679 60474698 60474695 +
ctatgcaaaatgtgtgttcc

SEQ ID NO: 159695 - DNA, 20 bp, Artificial Sequence
  Synthetic oligonucleotide; AGG chr2 60474680 60474699 60474696 +
tatgcaaaatgtgtgttccc

SEQ ID NO: 159696 - DNA, 20 bp, Artificial Sequence
  Synthetic oligonucleotide; GAG chr2 60474754 60474773 60474770 +
tcattcaacaaatatttacc

SEQ ID NO: 159697 - DNA, 20 bp, Artificial Sequence
  Synthetic oligonucleotide; AAG chr2 60474772 60474791 60474788 +
ccgagtgcctacaatgccca

SEQ ID NO: 159698 - DNA, 20 bp, Artificial Sequence
  Synthetic oligonucleotide; TGG chr2 60474778 60474797 60474794 +
gcctacaatgcccaaagcaa

SEQ ID NO: 159699 - DNA, 20 bp, Artificial Sequence
  Synthetic oligonucleotide; GGG chr2 60474779 60474798 60474795 +
cctacaatgcccaaagcaat

SEQ ID NO: 159700 - DNA, 20 bp, Artificial Sequence
  Synthetic oligonucleotide; TAG chr2 60474783 60474802 60474799 +
caatgcccaaagcaatgggc

SEQ ID NO: 159701 - DNA, 20 bp, Artificial Sequence
  Synthetic oligonucleotide; TGG chr2 60474792 60474811 60474808 +
aagcaatgggctagccgctg

SEQ ID NO: 159702 - DNA, 20 bp, Artificial Sequence
  Synthetic oligonucleotide; GGG chr2 60474793 60474812 60474809 +
agcaatgggctagccgctgt

SEQ ID NO: 159703 - DNA, 20 bp, Artificial Sequence
  Synthetic oligonucleotide; CAG chr2 60474796 60474815 60474812 +
aatgggctagccgctgtggg

SEQ ID NO: 159704 - DNA, 20 bp, Artificial Sequence
  Synthetic oligonucleotide; AAG chr2 60474803 60474822 60474819 +
tagccgctgtgggcagtaca

SEQ ID NO: 159705 - DNA, 20 bp, Artificial Sequence
  Synthetic oligonucleotide; CGG chr2 60474812 60474831 60474828 +
tgggcagtacaaagaaaaca

SEQ ID NO: 159706 - DNA, 20 bp, Artificial Sequence
  Synthetic oligonucleotide; CAG chr2 60474818 60474837 60474834 +
gtacaaagaaaacacggaca

SEQ ID NO: 159707 - DNA, 20 bp, Artificial Sequence
  Synthetic oligonucleotide; CAG chr2 60474831 60474850 60474847 +
acggacacagatttctccca

SEQ ID NO: 159708 - DNA, 20 bp, Artificial Sequence
  Synthetic oligonucleotide; CAG chr2 60474834 60474853 60474850 +
gacacagatttctcccacag

SEQ ID NO: 159709 - DNA, 20 bp, Artificial Sequence
  Synthetic oligonucleotide; AGG chr2 60474835 60474854 60474851 +
acacagatttctcccacagc

SEQ ID NO: 159710 - DNA, 20 bp, Artificial Sequence
  Synthetic oligonucleotide; TAG chr2 60474845 60474864 60474861 +
ctcccacagcaggcttcatt

SEQ ID NO: 159711 - DNA, 20 bp, Artificial Sequence
  Synthetic oligonucleotide; TAG chr2 60474848 60474867 60474864 +
ccacagcaggcttcatttag

SEQ ID NO: 159712 - DNA, 20 bp, Artificial Sequence
  Synthetic oligonucleotide; AAG chr2 60474853 60474872 60474869 +
gcaggcttcatttagtagaa

SEQ ID NO: 159713 - DNA, 20 bp, Artificial Sequence
  Synthetic oligonucleotide; AGG chr2 60474854 60474873 60474870 +
caggcttcatttagtagaaa

SEQ ID NO: 159714 - DNA, 20 bp, Artificial Sequence
  Synthetic oligonucleotide; AAG chr2 60474858 60474877 60474874 +
cttcatttagtagaaaaggt

SEQ ID NO: 159715 - DNA, 20 bp, Artificial Sequence
  Synthetic oligonucleotide; AGG chr2 60474859 60474878 60474875 +
ttcatttagtagaaaaggta

SEQ ID NO: 159716 - DNA, 20 bp, Artificial Sequence
  Synthetic oligonucleotide; CAG chr2 60474868 60474887 60474884 +
tagaaaaggtaaggcctgca

SEQ ID NO: 159717 - DNA, 20 bp, Artificial Sequence
  Synthetic oligonucleotide; TAG chr2 60474890 60474909 60474906 +
gaaattgctctacccccatg

SEQ ID NO: 159718 - DNA, 20 bp, Artificial Sequence
  Synthetic oligonucleotide; AAG chr2 60474894 60474913 60474910 +
ttgctctacccccatgtaga

SEQ ID NO: 159719 - DNA, 20 bp, Artificial Sequence
  Synthetic oligonucleotide; GAG chr2 60474905 60474924 60474921 +
ccatgtagaaagtgtgtcat

SEQ ID NO: 159720 - DNA, 20 bp, Artificial Sequence
  Synthetic oligonucleotide; GAG chr2 60474907 60474926 60474923 +
atgtagaaagtgtgtcatga

SEQ ID NO: 159721 - DNA, 20 bp, Artificial Sequence
  Synthetic oligonucleotide; GAG chr2 60474909 60474928 60474925 +
gtagaaagtgtgtcatgaga

SEQ ID NO: 159722 - DNA, 20 bp, Artificial Sequence
  Synthetic oligonucleotide; AGG chr2 60474910 60474929 60474926 +
tagaaagtgtgtcatgagag

SEQ ID NO: 159723 - DNA, 20 bp, Artificial Sequence
  Synthetic oligonucleotide; CAG chr2 60474915 60474934 60474931 +
agtgtgtcatgagagaggta

SEQ ID NO: 159724 - DNA, 20 bp, Artificial Sequence
  Synthetic oligonucleotide; GAG chr2 60474920 60474939 60474936 +
gtcatgagagaggtacagat

SEQ ID NO: 159725 - DNA, 20 bp, Artificial Sequence
  Synthetic oligonucleotide; TGG chr2 60474929 60474948 60474945 +
gaggtacagatgagctgcta

SEQ ID NO: 159726 - DNA, 20 bp, Artificial Sequence
  Synthetic oligonucleotide; AAG chr2 60474939 60474958 60474955 +
tgagctgctatggaaattca

SEQ ID NO: 159727 - DNA, 20 bp, Artificial Sequence
  Synthetic oligonucleotide; AGG chr2 60474940 60474959 60474956 +
gagctgctatggaaattcaa

SEQ ID NO: 159728 - DNA, 20 bp, Artificial Sequence
  Synthetic oligonucleotide; AAG chr2 60474943 60474962 60474959 +
ctgctatggaaattcaaagg

SEQ ID NO: 159729 - DNA, 20 bp, Artificial Sequence
  Synthetic oligonucleotide; GAG chr2 60474945 60474964 60474961 +
gctatggaaattcaaaggaa

SEQ ID NO: 159730 - DNA, 20 bp, Artificial Sequence
  Synthetic oligonucleotide; TGG chr2 60474962 60474981 60474978 +
gaagagaaattatttccatt

SEQ ID NO: 159731 - DNA, 20 bp, Artificial Sequence
  Synthetic oligonucleotide; AAG chr2 60474965 60474984 60474981 +
gagaaattatttccatttgg

SEQ ID NO: 159732 - DNA, 20 bp, Artificial Sequence
  Synthetic oligonucleotide; AGG chr2 60474966 60474985 60474982 +
agaaattatttccatttgga

SEQ ID NO: 159733 - DNA, 20 bp, Artificial Sequence
  Synthetic oligonucleotide; GGG chr2 60474967 60474986 60474983 +
gaaattatttccatttggaa

SEQ ID NO: 159734 - DNA, 20 bp, Artificial Sequence
  Synthetic oligonucleotide; GAG chr2 60474969 60474988 60474985 +
aattatttccatttggaagg

SEQ ID NO: 159735 - DNA, 20 bp, Artificial Sequence
  Synthetic oligonucleotide; AGG chr2 60474970 60474989 60474986 +
attatttccatttggaaggg

SEQ ID NO: 159736 - DNA, 20 bp, Artificial Sequence
  Synthetic oligonucleotide; GGG chr2 60474971 60474990 60474987 +
ttatttccatttggaaggga

SEQ ID NO: 159737 - DNA, 20 bp, Artificial Sequence
  Synthetic oligonucleotide; GAG chr2 60474973 60474992 60474989 +
atttccatttggaagggagg

SEQ ID NO: 159738 - DNA, 20 bp, Artificial Sequence
  Synthetic oligonucleotide; GAG chr2 60474975 60474994 60474991 +
ttccatttggaagggaggga

SEQ ID NO: 159739 - DNA, 20 bp, Artificial Sequence
  Synthetic oligonucleotide; GAG chr2 60474977 60474996 60474993 +
ccatttggaagggagggaga

SEQ ID NO: 159740 - DNA, 20 bp, Artificial Sequence
  Synthetic oligonucleotide; AGG chr2 60474978 60474997 60474994 +
catttggaagggagggagag

SEQ ID NO: 159741 - DNA, 20 bp, Artificial Sequence
  Synthetic oligonucleotide; TGG chr2 60474984 60475003 60475000 +
gaagggagggagagaggctt

SEQ ID NO: 159742 - DNA, 20 bp, Artificial Sequence
  Synthetic oligonucleotide; GGG chr2 60474985 60475004 60475001 +
aagggagggagagaggcttt

SEQ ID NO: 159743 - DNA, 20 bp, Artificial Sequence
  Synthetic oligonucleotide; AAG chr2 60474989 60475008 60475005 +
gagggagagaggctttggga

SEQ ID NO: 159744 - DNA, 20 bp, Artificial Sequence
  Synthetic oligonucleotide; GAG chr2 60474991 60475010 60475007 +
gggagagaggctttgggaaa

SEQ ID NO: 159745 - DNA, 20 bp, Artificial Sequence
  Synthetic oligonucleotide; AGG chr2 60474992 60475011 60475008 +
ggagagaggctttgggaaag

SEQ ID NO: 159746 - DNA, 20 bp, Artificial Sequence
  Synthetic oligonucleotide; GAG chr2 60475004 60475023 60475020 +
tgggaaagaggaaaacttat

SEQ ID NO: 159747 - DNA, 20 bp, Artificial Sequence
  Synthetic oligonucleotide; TGG chr2 60475014 60475033 60475030 +
gaaaacttatgagttaaacc

SEQ ID NO: 159748 - DNA, 20 bp, Artificial Sequence
  Synthetic oligonucleotide; GAG chr2 60475016 60475035 60475032 +
aaacttatgagttaaacctg

SEQ ID NO: 159749 - DNA, 20 bp, Artificial Sequence
  Synthetic oligonucleotide; GAG chr2 60475018 60475037 60475034 +
acttatgagttaaacctgga

SEQ ID NO: 159750 - DNA, 20 bp, Artificial Sequence
  Synthetic oligonucleotide; AAG chr2 60475023 60475042 60475039 +
tgagttaaacctggagagcc

SEQ ID NO: 159751 - DNA, 20 bp, Artificial Sequence
  Synthetic oligonucleotide; GAG chr2 60475025 60475044 60475041 +
agttaaacctggagagccaa

SEQ ID NO: 159752 - DNA, 20 bp, Artificial Sequence
  Synthetic oligonucleotide; AAG chr2 60475029 60475048 60475045 +
aaacctggagagccaagaga

SEQ ID NO: 159753 - DNA, 20 bp, Artificial Sequence
  Synthetic oligonucleotide; AGG chr2 60475030 60475049 60475046 +
aacctggagagccaagagaa

SEQ ID NO: 159754 - DNA, 20 bp, Artificial Sequence
  Synthetic oligonucleotide; TAG chr2 60475039 60475058 60475055 +
agccaagagaaaggatatcc

SEQ ID NO: 159755 - DNA, 20 bp, Artificial Sequence
  Synthetic oligonucleotide; AAG chr2 60475047 60475066 60475063 +
gaaaggatatcctagataaa

SEQ ID NO: 159756 - DNA, 20 bp, Artificial Sequence
  Synthetic oligonucleotide; AAG chr2 60475053 60475072 60475069 +
atatcctagataaaaagaaa

SEQ ID NO: 159757 - DNA, 20 bp, Artificial Sequence
  Synthetic oligonucleotide; CAG chr2 60475056 60475075 60475072 +
tcctagataaaaagaaaaag

SEQ ID NO: 159758 - DNA, 20 bp, Artificial Sequence
  Synthetic oligonucleotide; AGG chr2 60475057 60475076 60475073 +
cctagataaaaagaaaaagc

SEQ ID NO: 159759 - DNA, 20 bp, Artificial Sequence
  Synthetic oligonucleotide; AAG chr2 60475062 60475081 60475078 +
ataaaaagaaaaagcaggta

SEQ ID NO: 159760 - DNA, 20 bp, Artificial Sequence
  Synthetic oligonucleotide; TAG chr2 60475070 60475089 60475086 +
aaaaagcaggtaaagatgct

SEQ ID NO: 159761 - DNA, 20 bp, Artificial Sequence
  Synthetic oligonucleotide; GAG chr2 60475072 60475091 60475088 +
aaagcaggtaaagatgctta

SEQ ID NO: 159762 - DNA, 20 bp, Artificial Sequence
  Synthetic oligonucleotide; GAG chr2 60475074 60475093 60475090 +
agcaggtaaagatgcttaga

SEQ ID NO: 159763 - DNA, 20 bp, Artificial Sequence
  Synthetic oligonucleotide; AAG chr2 60475077 60475096 60475093 +
aggtaaagatgcttagagag

SEQ ID NO: 159764 - DNA, 20 bp, Artificial Sequence
  Synthetic oligonucleotide; AAG chr2 60475082 60475101 60475098 +
aagatgcttagagagaagca

SEQ ID NO: 159765 - DNA, 20 bp, Artificial Sequence
  Synthetic oligonucleotide; AAG chr2 60475088 60475107 60475104 +
cttagagagaagcaaagccc

SEQ ID NO: 159766 - DNA, 20 bp, Artificial Sequence
  Synthetic oligonucleotide; AGG chr2 60475089 60475108 60475105 +
ttagagagaagcaaagccca

SEQ ID NO: 159767 - DNA, 20 bp, Artificial Sequence
  Synthetic oligonucleotide; TGG chr2 60475092 60475111 60475108 +
gagagaagcaaagcccaagg

SEQ ID NO: 159768 - DNA, 20 bp, Artificial Sequence
  Synthetic oligonucleotide; GGG chr2 60475093 60475112 60475109 +
agagaagcaaagcccaaggt

SEQ ID NO: 159769 - DNA, 20 bp, Artificial Sequence
  Synthetic oligonucleotide; CAG chr2 60475098 60475117 60475114 +
agcaaagcccaaggtgggca

SEQ ID NO: 159770 - DNA, 20 bp, Artificial Sequence
  Synthetic oligonucleotide; GAG chr2 60475100 60475119 60475116 +
caaagcccaaggtgggcaca

SEQ ID NO: 159771 - DNA, 20 bp, Artificial Sequence
  Synthetic oligonucleotide; TGG chr2 60475107 60475126 60475123 +
caaggtgggcacagagtaaa

SEQ ID NO: 159772 - DNA, 20 bp, Artificial Sequence
  Synthetic oligonucleotide; GGG chr2 60475108 60475127 60475124 +
aaggtgggcacagagtaaat

SEQ ID NO: 159773 - DNA, 20 bp, Artificial Sequence
  Synthetic oligonucleotide; GGG chr2 60475109 60475128 60475125 +
aggtgggcacagagtaaatg

SEQ ID NO: 159774 - DNA, 20 bp, Artificial Sequence
  Synthetic oligonucleotide; TAG chr2 60475117 60475136 60475133 +
acagagtaaatggggcccaa

SEQ ID NO: 159775 - DNA, 20 bp, Artificial Sequence
  Synthetic oligonucleotide; AGG chr2 60475118 60475137 60475134 +
cagagtaaatggggcccaat

SEQ ID NO: 159776 - DNA, 20 bp, Artificial Sequence
  Synthetic oligonucleotide; CGG chr2 60475121 60475140 60475137 +
agtaaatggggcccaatagg

SEQ ID NO: 159777 - DNA, 20 bp, Artificial Sequence
  Synthetic oligonucleotide; CAG chr2 60475160 60475179 60475176 +
atattgcacactgattcatc

SEQ ID NO: 159778 - DNA, 20 bp, Artificial Sequence
  Synthetic oligonucleotide; CAG chr2 60475167 60475186 60475183 +
acactgattcatccagttga

SEQ ID NO: 159779 - DNA, 20 bp, Artificial Sequence
  Synthetic oligonucleotide; CGG chr2 60475170 60475189 60475186 +
ctgattcatccagttgacag

SEQ ID NO: 159780 - DNA, 20 bp, Artificial Sequence
  Synthetic oligonucleotide; GAG chr2 60475172 60475191 60475188 +
gattcatccagttgacagcg

SEQ ID NO: 159781 - DNA, 20 bp, Artificial Sequence
  Synthetic oligonucleotide; AGG chr2 60475173 60475192 60475189 +
attcatccagttgacagcgg

SEQ ID NO: 159782 - DNA, 20 bp, Artificial Sequence
  Synthetic oligonucleotide; AAG chr2 60475202 60475221 60475218 +
ccatctaaataaatcctctg

SEQ ID NO: 159783 - DNA, 20 bp, Artificial Sequence
  Synthetic oligonucleotide; CAG chr2 60475221 60475240 60475237 +
gaagatttctgtgacatctt

SEQ ID NO: 159784 - DNA, 20 bp, Artificial Sequence
  Synthetic oligonucleotide; AAG chr2 60475231 60475250 60475247 +
gtgacatcttcagctttcac

SEQ ID NO: 159785 - DNA, 20 bp, Artificial Sequence
  Synthetic oligonucleotide; AAG chr2 60475267 60475286 60475283 +
atttcacattttctgaaaat

SEQ ID NO: 159786 - DNA, 20 bp, Artificial Sequence
  Synthetic oligonucleotide; AGG chr2 60475268 60475287 60475284 +
tttcacattttctgaaaata

SEQ ID NO: 159787 - DNA, 20 bp, Artificial Sequence
  Synthetic oligonucleotide; GGG chr2 60475269 60475288 60475285 +
ttcacattttctgaaaataa

SEQ ID NO: 159788 - DNA, 20 bp, Artificial Sequence
  Synthetic oligonucleotide; TGG chr2 60475283 60475302 60475299 +
aaataagggacacaaccatg

SEQ ID NO: 159789 - DNA, 20 bp, Artificial Sequence
  Synthetic oligonucleotide; AAG chr2 60475305 60475324 60475321 +
gactcttgtgaaactccatg

SEQ ID NO: 159790 - DNA, 20 bp, Artificial Sequence
  Synthetic oligonucleotide; AGG chr2 60475306 60475325 60475322 +
actcttgtgaaactccatga

SEQ ID NO: 159791 - DNA, 20 bp, Artificial Sequence
  Synthetic oligonucleotide; TGG chr2 60475361 60475380 60475377 +
gtttcttcccccaatgaatg

SEQ ID NO: 159792 - DNA, 20 bp, Artificial Sequence
  Synthetic oligonucleotide; GGG chr2 60475362 60475381 60475378 +
tttcttcccccaatgaatgt

SEQ ID NO: 159793 - DNA, 20 bp, Artificial Sequence
  Synthetic oligonucleotide; TGG chr2 60475365 60475384 60475381 +
cttcccccaatgaatgtggg

SEQ ID NO: 159794 - DNA, 20 bp, Artificial Sequence
  Synthetic oligonucleotide; AAG chr2 60475374 60475393 60475390 +
atgaatgtgggtggcccgct

SEQ ID NO: 159795 - DNA, 20 bp, Artificial Sequence
  Synthetic oligonucleotide; AGG chr2 60475375 60475394 60475391 +
tgaatgtgggtggcccgcta

SEQ ID NO: 159796 - DNA, 20 bp, Artificial Sequence
  Synthetic oligonucleotide; GAG chr2 60475404 60475423 60475420 +
ttactatgttttattcctct

SEQ ID NO: 159797 - DNA, 20 bp, Artificial Sequence
  Synthetic oligonucleotide; CAG chr2 60475408 60475427 60475424 +
tatgttttattcctctgagt

SEQ ID NO: 159798 - DNA, 20 bp, Artificial Sequence
  Synthetic oligonucleotide; AAG chr2 60475417 60475436 60475433 +
ttcctctgagtcagacaaac

SEQ ID NO: 159799 - DNA, 20 bp, Artificial Sequence
  Synthetic oligonucleotide; TAG chr2 60475426 60475445 60475442 +
gtcagacaaacaagtgttga

SEQ ID NO: 159800 - DNA, 20 bp, Artificial Sequence
  Synthetic oligonucleotide; TGG chr2 60475458 60475477 60475474 +
tccttgcaatactgcctccc

SEQ ID NO: 159801 - DNA, 20 bp, Artificial Sequence
  Synthetic oligonucleotide; CAG chr2 60475477 60475496 60475493 +
ctggcttaaataatctattt

SEQ ID NO: 159802 - DNA, 20 bp, Artificial Sequence
  Synthetic oligonucleotide; CAG chr2 60475492 60475511 60475508 +
tatttcagatgtctcattgc

SEQ ID NO: 159803 - DNA, 20 bp, Artificial Sequence
  Synthetic oligonucleotide; AAG chr2 60475498 60475517 60475514 +
agatgtctcattgccagttt

SEQ ID NO: 159804 - DNA, 20 bp, Artificial Sequence
  Synthetic oligonucleotide; TGG chr2 60475502 60475521 60475518 +
gtctcattgccagtttaaga

SEQ ID NO: 159805 - DNA, 20 bp, Artificial Sequence
  Synthetic oligonucleotide; GGG chr2 60475503 60475522 60475519 +
tctcattgccagtttaagat

SEQ ID NO: 159806 - DNA, 20 bp, Artificial Sequence
  Synthetic oligonucleotide; AAG chr2 60475544 60475563 60475560 +
ttttcaacaaatgactgtgc

SEQ ID NO: 159807 - DNA, 20 bp, Artificial Sequence
  Synthetic oligonucleotide; GAG chr2 60475554 60475573 60475570 +
atgactgtgcaagaaacatt

SEQ ID NO: 159808 - DNA, 20 bp, Artificial Sequence
  Synthetic oligonucleotide; AAG chr2 60475632 60475651 60475648 +
tcccctctttcttcttttca

SEQ ID NO: 159809 - DNA, 20 bp, Artificial Sequence
  Synthetic oligonucleotide; TGG chr2 60475638 60475657 60475654 +
ctttcttcttttcaaagcca

SEQ ID NO: 159810 - DNA, 20 bp, Artificial Sequence
  Synthetic oligonucleotide; GGG chr2 60475639 60475658 60475655 +
tttcttcttttcaaagccat

SEQ ID NO: 159811 - DNA, 20 bp, Artificial Sequence
  Synthetic oligonucleotide; GGG chr2 60475640 60475659 60475656 +
ttcttcttttcaaagccatg

SEQ ID NO: 159812 - DNA, 20 bp, Artificial Sequence
  Synthetic oligonucleotide; GAG chr2 60475642 60475661 60475658 +
cttcttttcaaagccatggg

SEQ ID NO: 159813 - DNA, 20 bp, Artificial Sequence
  Synthetic oligonucleotide; AGG chr2 60475643 60475662 60475659 +
ttcttttcaaagccatgggg

SEQ ID NO: 159814 - DNA, 20 bp, Artificial Sequence
  Synthetic oligonucleotide; TAG chr2 60475647 60475666 60475663 +
tttcaaagccatggggagga

SEQ ID NO: 159815 - DNA, 20 bp, Artificial Sequence
  Synthetic oligonucleotide; AGG chr2 60475648 60475667 60475664 +
ttcaaagccatggggaggat

SEQ ID NO: 159816 - DNA, 20 bp, Artificial Sequence
  Synthetic oligonucleotide; GGG chr2 60475649 60475668 60475665 +
tcaaagccatggggaggata

SEQ ID NO: 159817 - DNA, 20 bp, Artificial Sequence
  Synthetic oligonucleotide; GGG chr2 60475650 60475669 60475666 +
caaagccatggggaggatag

SEQ ID NO: 159818 - DNA, 20 bp, Artificial Sequence
  Synthetic oligonucleotide; GAG chr2 60475671 60475690 60475687 +
ggtgcccttactcctgctct

SEQ ID NO: 159819 - DNA, 20 bp, Artificial Sequence
  Synthetic oligonucleotide; CAG chr2 60475678 60475697 60475694 +
ttactcctgctctgagtcct

SEQ ID NO: 159820 - DNA, 20 bp, Artificial Sequence
  Synthetic oligonucleotide; GAG chr2 60475683 60475702 60475699 +
cctgctctgagtcctcagct

SEQ ID NO: 159821 - DNA, 20 bp, Artificial Sequence
  Synthetic oligonucleotide; AGG chr2 60475684 60475703 60475700 +
ctgctctgagtcctcagctg

SEQ ID NO: 159822 - DNA, 20 bp, Artificial Sequence
  Synthetic oligonucleotide; TAG chr2 60475701 60475720 60475717 +
ctgaggatcttgtttgtgtg

SEQ ID NO: 159823 - DNA, 20 bp, Artificial Sequence
  Synthetic oligonucleotide; TGG chr2 60475704 60475723 60475720 +
aggatcttgtttgtgtgtag

SEQ ID NO: 159824 - DNA, 20 bp, Artificial Sequence
  Synthetic oligonucleotide; GGG chr2 60475705 60475724 60475721 +
ggatcttgtttgtgtgtagt

SEQ ID NO: 159825 - DNA, 20 bp, Artificial Sequence
  Synthetic oligonucleotide; GGG chr2 60475706 60475725 60475722 +
gatcttgtttgtgtgtagtg

SEQ ID NO: 159826 - DNA, 20 bp, Artificial Sequence
  Synthetic oligonucleotide; GGG chr2 60475707 60475726 60475723 +
atcttgtttgtgtgtagtgg

SEQ ID NO: 159827 - DNA, 20 bp, Artificial Sequence
  Synthetic oligonucleotide; CAG chr2 60475710 60475729 60475726 +
ttgtttgtgtgtagtggggg

SEQ ID NO: 159828 - DNA, 20 bp, Artificial Sequence
  Synthetic oligonucleotide; AGG chr2 60475711 60475730 60475727 +
tgtttgtgtgtagtgggggc

SEQ ID NO: 159829 - DNA, 20 bp, Artificial Sequence
  Synthetic oligonucleotide; GGG chr2 60475712 60475731 60475728 +
gtttgtgtgtagtgggggca

SEQ ID NO: 159830 - DNA, 20 bp, Artificial Sequence
  Synthetic oligonucleotide; GGG chr2 60475713 60475732 60475729 +
tttgtgtgtagtgggggcag

SEQ ID NO: 159831 - DNA, 20 bp, Artificial Sequence
  Synthetic oligonucleotide; GGG chr2 60475714 60475733 60475730 +
ttgtgtgtagtgggggcagg

SEQ ID NO: 159832 - DNA, 20 bp, Artificial Sequence
  Synthetic oligonucleotide; GAG chr2 60475716 60475735 60475732 +
gtgtgtagtgggggcagggg

SEQ ID NO: 159833 - DNA, 20 bp, Artificial Sequence
  Synthetic oligonucleotide; AGG chr2 60475717 60475736 60475733 +
tgtgtagtgggggcaggggg

SEQ ID NO: 159834 - DNA, 20 bp, Artificial Sequence
  Synthetic oligonucleotide; GGG chr2 60475718 60475737 60475734 +
gtgtagtgggggcaggggga

SEQ ID NO: 159835 - DNA, 20 bp, Artificial Sequence
  Synthetic oligonucleotide; GGG chr2 60475719 60475738 60475735 +
tgtagtgggggcagggggag

SEQ ID NO: 159836 - DNA, 20 bp, Artificial Sequence
  Synthetic oligonucleotide; TAG chr2 60475724 60475743 60475740 +
tgggggcagggggaggggtg

SEQ ID NO: 159837 - DNA, 20 bp, Artificial Sequence
  Synthetic oligonucleotide; GAG chr2 60475741 60475760 60475757 +
gtgtagccttgcctctatcc

SEQ ID NO: 159838 - DNA, 20 bp, Artificial Sequence
  Synthetic oligonucleotide; AGG chr2 60475742 60475761 60475758 +
tgtagccttgcctctatccg

SEQ ID NO: 159839 - DNA, 20 bp, Artificial Sequence
  Synthetic oligonucleotide; CAG chr2 60475752 60475771 60475768 +
cctctatccgaggtatttat

SEQ ID NO: 159840 - DNA, 20 bp, Artificial Sequence
  Synthetic oligonucleotide; AGG chr2 60475753 60475772 60475769 +
ctctatccgaggtatttatc

SEQ ID NO: 159841 - DNA, 20 bp, Artificial Sequence
  Synthetic oligonucleotide; TGG chr2 60475761 60475780 60475777 +
gaggtatttatcaggttatt

SEQ ID NO: 159842 - DNA, 20 bp, Artificial Sequence
  Synthetic oligonucleotide; GGG chr2 60475762 60475781 60475778 +
aggtatttatcaggttattt

SEQ ID NO: 159843 - DNA, 20 bp, Artificial Sequence
  Synthetic oligonucleotide; GAG chr2 60475764 60475783 60475780 +
gtatttatcaggttatttgg

SEQ ID NO: 159844 - DNA, 20 bp, Artificial Sequence
  Synthetic oligonucleotide; CAG chr2 60475774 60475793 60475790 +
ggttatttgggagctacttt

SEQ ID NO: 159845 - DNA, 20 bp, Artificial Sequence
  Synthetic oligonucleotide; GAG chr2 60475776 60475795 60475792 +
ttatttgggagctactttca

SEQ ID NO: 159846 - DNA, 20 bp, Artificial Sequence
  Synthetic oligonucleotide; CGG chr2 60475817 60475836 60475833 +
ttcccactgccaccactccc

SEQ ID NO: 159847 - DNA, 20 bp, Artificial Sequence
  Synthetic oligonucleotide; TAG chr2 60475835 60475854 60475851 +
cccggattcttttcttcctt

SEQ ID NO: 159848 - DNA, 20 bp, Artificial Sequence
  Synthetic oligonucleotide; AGG chr2 60475836 60475855 60475852 +
ccggattcttttcttccttt

SEQ ID NO: 159849 - DNA, 20 bp, Artificial Sequence
  Synthetic oligonucleotide; AAG chr2 60475839 60475858 60475855 +
gattcttttcttcctttagg

SEQ ID NO: 159850 - DNA, 20 bp, Artificial Sequence
  Synthetic oligonucleotide; CAG chr2 60475842 60475861 60475858 +
tcttttcttcctttaggaag

SEQ ID NO: 159851 - DNA, 20 bp, Artificial Sequence
  Synthetic oligonucleotide; AGG chr2 60475843 60475862 60475859 +
cttttcttcctttaggaagc

SEQ ID NO: 159852 - DNA, 20 bp, Artificial Sequence
  Synthetic oligonucleotide; GGG chr2 60475844 60475863 60475860 +
ttttcttcctttaggaagca

SEQ ID NO: 159853 - DNA, 20 bp, Artificial Sequence
  Synthetic oligonucleotide; TGG chr2 60475858 60475877 60475874 +
gaagcagggacttgttcctc

SEQ ID NO: 159854 - DNA, 20 bp, Artificial Sequence
  Synthetic oligonucleotide; GAG chr2 60475860 60475879 60475876 +
agcagggacttgttcctctg

SEQ ID NO: 159855 - DNA, 20 bp, Artificial Sequence
  Synthetic oligonucleotide; GAG chr2 60475862 60475881 60475878 +
cagggacttgttcctctgga

SEQ ID NO: 159856 - DNA, 20 bp, Artificial Sequence
  Synthetic oligonucleotide; TAG chr2 60475870 60475889 60475886 +
tgttcctctggagagactgc

SEQ ID NO: 159857 - DNA, 20 bp, Artificial Sequence
  Synthetic oligonucleotide; GAG chr2 60475872 60475891 60475888 +
ttcctctggagagactgcta

SEQ ID NO: 159858 - DNA, 20 bp, Artificial Sequence
  Synthetic oligonucleotide; AGG chr2 60475873 60475892 60475889 +
tcctctggagagactgctag

SEQ ID NO: 159859 - DNA, 20 bp, Artificial Sequence
  Synthetic oligonucleotide; AAG chr2 60475877 60475896 60475893 +
ctggagagactgctagagga

SEQ ID NO: 159860 - DNA, 20 bp, Artificial Sequence
  Synthetic oligonucleotide; CAG chr2 60475881 60475900 60475897 +
agagactgctagaggaaagt

SEQ ID NO: 159861 - DNA, 20 bp, Artificial Sequence
  Synthetic oligonucleotide; AGG chr2 60475882 60475901 60475898 +
gagactgctagaggaaagtc

SEQ ID NO: 159862 - DNA, 20 bp, Artificial Sequence
  Synthetic oligonucleotide; AAG chr2 60475890 60475909 60475906 +
tagaggaaagtcaggaacct

SEQ ID NO: 159863 - DNA, 20 bp, Artificial Sequence
  Synthetic oligonucleotide; CAG chr2 60475920 60475939 60475936 +
accccaactctgccactcac

SEQ ID NO: 159864 - DNA, 20 bp, Artificial Sequence
  Synthetic oligonucleotide; TGG chr2 60475956 60475975 60475972 +
ttgaataaatcctttctttc

SEQ ID NO: 159865 - DNA, 20 bp, Artificial Sequence
  Synthetic oligonucleotide; AAG chr2 60475963 60475982 60475979 +
aatcctttctttctggccct

SEQ ID NO: 159866 - DNA, 20 bp, Artificial Sequence
  Synthetic oligonucleotide; AAG chr2 60475981 60476000 60475997 +
ctaagtgtttccatctttaa

SEQ ID NO: 159867 - DNA, 20 bp, Artificial Sequence
  Synthetic oligonucleotide; AGG chr2 60475982 60476001 60475998 +
taagtgtttccatctttaaa

SEQ ID NO: 159868 - DNA, 20 bp, Artificial Sequence
  Synthetic oligonucleotide; GAG chr2 60475984 60476003 60476000 +
agtgtttccatctttaaaag

SEQ ID NO: 159869 - DNA, 20 bp, Artificial Sequence
  Synthetic oligonucleotide; AAG chr2 60475987 60476006 60476003 +
gtttccatctttaaaaggag

SEQ ID NO: 159870 - DNA, 20 bp, Artificial Sequence
  Synthetic oligonucleotide; TGG chr2 60475992 60476011 60476008 +
catctttaaaaggagaagac

SEQ ID NO: 159871 - DNA, 20 bp, Artificial Sequence
  Synthetic oligonucleotide; TAG chr2 60475997 60476016 60476013 +
ttaaaaggagaagactggat

SEQ ID NO: 159872 - DNA, 20 bp, Artificial Sequence
  Synthetic oligonucleotide; TGG chr2 60476001 60476020 60476017 +
aaggagaagactggattaga

SEQ ID NO: 159873 - DNA, 20 bp, Artificial Sequence
  Synthetic oligonucleotide; GGG chr2 60476002 60476021 60476018 +
aggagaagactggattagat

SEQ ID NO: 159874 - DNA, 20 bp, Artificial Sequence
  Synthetic oligonucleotide; GGG chr2 60476003 60476022 60476019 +
ggagaagactggattagatg

SEQ ID NO: 159875 - DNA, 20 bp, Artificial Sequence
  Synthetic oligonucleotide; TGG chr2 60476006 60476025 60476022 +
gaagactggattagatgggg

SEQ ID NO: 159876 - DNA, 20 bp, Artificial Sequence
  Synthetic oligonucleotide; AAG chr2 60476032 60476051 60476048 +
ctctctcctgcctcccatgc

SEQ ID NO: 159877 - DNA, 20 bp, Artificial Sequence
  Synthetic oligonucleotide; CAG chr2 60476037 60476056 60476053 +
tcctgcctcccatgcaagtc

SEQ ID NO: 159878 - DNA, 20 bp, Artificial Sequence
  Synthetic oligonucleotide; AGG chr2 60476038 60476057 60476054 +
cctgcctcccatgcaagtcc

SEQ ID NO: 159879 - DNA, 20 bp, Artificial Sequence
  Synthetic oligonucleotide; TGG chr2 60476048 60476067 60476064 +
atgcaagtccaggcctcctt

SEQ ID NO: 159880 - DNA, 20 bp, Artificial Sequence
  Synthetic oligonucleotide; AAG chr2 60476058 60476077 60476074 +
aggcctcctttggaccaacc

SEQ ID NO: 159881 - DNA, 20 bp, Artificial Sequence
  Synthetic oligonucleotide; GAG chr2 60476060 60476079 60476076 +
gcctcctttggaccaaccaa

SEQ ID NO: 159882 - DNA, 20 bp, Artificial Sequence
  Synthetic oligonucleotide; TAG chr2 60476071 60476090 60476087 +
accaaccaagagacctacta

SEQ ID NO: 159883 - DNA, 20 bp, Artificial Sequence
  Synthetic oligonucleotide; AGG chr2 60476072 60476091 60476088 +
ccaaccaagagacctactat

SEQ ID NO: 159884 - DNA, 20 bp, Artificial Sequence
  Synthetic oligonucleotide; TAG chr2 60476081 60476100 60476097 +
agacctactataggccgtgc

SEQ ID NO: 159885 - DNA, 20 bp, Artificial Sequence
  Synthetic oligonucleotide; AAG chr2 60476084 60476103 60476100 +
cctactataggccgtgctag

SEQ ID NO: 159886 - DNA, 20 bp, Artificial Sequence
  Synthetic oligonucleotide; TGG chr2 60476088 60476107 60476104 +
ctataggccgtgctagaagc

SEQ ID NO: 159887 - DNA, 20 bp, Artificial Sequence
  Synthetic oligonucleotide; CAG chr2 60476092 60476111 60476108 +
aggccgtgctagaagctggc

SEQ ID NO: 159888 - DNA, 20 bp, Artificial Sequence
  Synthetic oligonucleotide; AGG chr2 60476093 60476112 60476109 +
ggccgtgctagaagctggcc

SEQ ID NO: 159889 - DNA, 20 bp, Artificial Sequence
  Synthetic oligonucleotide; TGG chr2 60476125 60476144 60476141 +
ttcccctcatgaccttgacc

SEQ ID NO: 159890 - DNA, 20 bp, Artificial Sequence
  Synthetic oligonucleotide; GAG chr2 60476130 60476149 60476146 +
ctcatgaccttgacctggat

SEQ ID NO: 159891 - DNA, 20 bp, Artificial Sequence
  Synthetic oligonucleotide; AGG chr2 60476131 60476150 60476147 +
tcatgaccttgacctggatg

SEQ ID NO: 159892 - DNA, 20 bp, Artificial Sequence
  Synthetic oligonucleotide; GAG chr2 60476133 60476152 60476149 +
atgaccttgacctggatgag

SEQ ID NO: 159893 - DNA, 20 bp, Artificial Sequence
  Synthetic oligonucleotide; AGG chr2 60476134 60476153 60476150 +
tgaccttgacctggatgagg

SEQ ID NO: 159894 - DNA, 20 bp, Artificial Sequence
  Synthetic oligonucleotide; GGG chr2 60476135 60476154 60476151 +
gaccttgacctggatgagga

SEQ ID NO: 159895 - DNA, 20 bp, Artificial Sequence
  Synthetic oligonucleotide; TAG chr2 60476143 60476162 60476159 +
cctggatgaggagggcctta

SEQ ID NO: 159896 - DNA, 20 bp, Artificial Sequence
  Synthetic oligonucleotide; AGG chr2 60476144 60476163 60476160 +
ctggatgaggagggccttat

SEQ ID NO: 159897 - DNA, 20 bp, Artificial Sequence
  Synthetic oligonucleotide; GAG chr2 60476146 60476165 60476162 +
ggatgaggagggccttatag

SEQ ID NO: 159898 - DNA, 20 bp, Artificial Sequence
  Synthetic oligonucleotide; GAG chr2 60476148 60476167 60476164 +
atgaggagggccttatagga

SEQ ID NO: 159899 - DNA, 20 bp, Artificial Sequence
  Synthetic oligonucleotide; CAG chr2 60476153 60476172 60476169 +
gagggccttataggagagtt

SEQ ID NO: 159900 - DNA, 20 bp, Artificial Sequence
  Synthetic oligonucleotide; AGG chr2 60476154 60476173 60476170 +
agggccttataggagagttc

SEQ ID NO: 159901 - DNA, 20 bp, Artificial Sequence
  Synthetic oligonucleotide; GGG chr2 60476155 60476174 60476171 +
gggccttataggagagttca

SEQ ID NO: 159902 - DNA, 20 bp, Artificial Sequence
  Synthetic oligonucleotide; TGG chr2 60476159 60476178 60476175 +
cttataggagagttcagggc

SEQ ID NO: 159903 - DNA, 20 bp, Artificial Sequence
  Synthetic oligonucleotide; GGG chr2 60476160 60476179 60476176 +
ttataggagagttcagggct

SEQ ID NO: 159904 - DNA, 20 bp, Artificial Sequence
  Synthetic oligonucleotide; TGG chr2 60476165 60476184 60476181 +
ggagagttcagggctgggct

SEQ ID NO: 159905 - DNA, 20 bp, Artificial Sequence
  Synthetic oligonucleotide; CAG chr2 60476172 60476191 60476188 +
tcagggctgggcttggtccc

SEQ ID NO: 159906 - DNA, 20 bp, Artificial Sequence
  Synthetic oligonucleotide; AGG chr2 60476173 60476192 60476189 +
cagggctgggcttggtcccc

SEQ ID NO: 159907 - DNA, 20 bp, Artificial Sequence
  Synthetic oligonucleotide; TAG chr2 60476184 60476203 60476200 +
ttggtccccaggctaatcct

SEQ ID NO: 159908 - DNA, 20 bp, Artificial Sequence
  Synthetic oligonucleotide; AGG chr2 60476185 60476204 60476201 +
tggtccccaggctaatcctt

SEQ ID NO: 159909 - DNA, 20 bp, Artificial Sequence
  Synthetic oligonucleotide; TAG chr2 60476190 60476209 60476206 +
cccaggctaatccttaggct

SEQ ID NO: 159910 - DNA, 20 bp, Artificial Sequence
  Synthetic oligonucleotide; GAG chr2 60476192 60476211 60476208 +
caggctaatccttaggctta

SEQ ID NO: 159911 - DNA, 20 bp, Artificial Sequence
  Synthetic oligonucleotide; GAG chr2 60476194 60476213 60476210 +
ggctaatccttaggcttaga

SEQ ID NO: 159912 - DNA, 20 bp, Artificial Sequence
  Synthetic oligonucleotide; GAG chr2 60476198 60476217 60476214 +
aatccttaggcttagagagt

SEQ ID NO: 159913 - DNA, 20 bp, Artificial Sequence
  Synthetic oligonucleotide; TGG chr2 60476209 60476228 60476225 +
ttagagagtgagcctgatga

SEQ ID NO: 159914 - DNA, 20 bp, Artificial Sequence
  Synthetic oligonucleotide; TGG chr2 60476224 60476243 60476240 +
gatgatggatttcaacctcc

SEQ ID NO: 159915 - DNA, 20 bp, Artificial Sequence
  Synthetic oligonucleotide; GGG chr2 60476225 60476244 60476241 +
atgatggatttcaacctcct

SEQ ID NO: 159916 - DNA, 20 bp, Artificial Sequence
  Synthetic oligonucleotide; CAG chr2 60476231 60476250 60476247 +
gatttcaacctcctgggaca

SEQ ID NO: 159917 - DNA, 20 bp, Artificial Sequence
  Synthetic oligonucleotide; AAG chr2 60476241 60476260 60476257 +
tcctgggacacagtcttgca

SEQ ID NO: 159918 - DNA, 20 bp, Artificial Sequence
  Synthetic oligonucleotide; GAG chr2 60476255 60476274 60476271 +
cttgcaaagtttacatgtct

SEQ ID NO: 159919 - DNA, 20 bp, Artificial Sequence
  Synthetic oligonucleotide; AAG chr2 60476262 60476281 60476278 +
agtttacatgtctgagcttc

SEQ ID NO: 159920 - DNA, 20 bp, Artificial Sequence
  Synthetic oligonucleotide; AGG chr2 60476263 60476282 60476279 +
gtttacatgtctgagcttca

SEQ ID NO: 159921 - DNA, 20 bp, Artificial Sequence
  Synthetic oligonucleotide; GAG chr2 60476265 60476284 60476281 +
ttacatgtctgagcttcaag

SEQ ID NO: 159922 - DNA, 20 bp, Artificial Sequence
  Synthetic oligonucleotide; AGG chr2 60476266 60476285 60476282 +
tacatgtctgagcttcaagg

SEQ ID NO: 159923 - DNA, 20 bp, Artificial Sequence
  Synthetic oligonucleotide; TAG chr2 60476274 60476293 60476290 +
tgagcttcaaggaggaaacc

SEQ ID NO: 159924 - DNA, 20 bp, Artificial Sequence
  Synthetic oligonucleotide; AGG chr2 60476275 60476294 60476291 +
gagcttcaaggaggaaacct

SEQ ID NO: 159925 - DNA, 20 bp, Artificial Sequence
  Synthetic oligonucleotide; GAG chr2 60476286 60476305 60476302 +
aggaaacctaggtgtgtcct

SEQ ID NO: 159926 - DNA, 20 bp, Artificial Sequence
  Synthetic oligonucleotide; GAG chr2 60476294 60476313 60476310 +
taggtgtgtcctgagccaat

SEQ ID NO: 159927 - DNA, 20 bp, Artificial Sequence
  Synthetic oligonucleotide; AAG chr2 60476301 60476320 60476317 +
gtcctgagccaatgagactg

SEQ ID NO: 159928 - DNA, 20 bp, Artificial Sequence
  Synthetic oligonucleotide; AGG chr2 60476302 60476321 60476318 +
tcctgagccaatgagactga

SEQ ID NO: 159929 - DNA, 20 bp, Artificial Sequence
  Synthetic oligonucleotide; CAG chr2 60476306 60476325 60476322 +
gagccaatgagactgaaggt

SEQ ID NO: 159930 - DNA, 20 bp, Artificial Sequence
  Synthetic oligonucleotide; GAG chr2 60476308 60476327 60476324 +
gccaatgagactgaaggtca

SEQ ID NO: 159931 - DNA, 20 bp, Artificial Sequence
  Synthetic oligonucleotide; CAG chr2 60476314 60476333 60476330 +
gagactgaaggtcagagaac

SEQ ID NO: 159932 - DNA, 20 bp, Artificial Sequence
  Synthetic oligonucleotide; AGG chr2 60476315 60476334 60476331 +
agactgaaggtcagagaacc

SEQ ID NO: 159933 - DNA, 20 bp, Artificial Sequence
  Synthetic oligonucleotide; AAG chr2 60476318 60476337 60476334 +
ctgaaggtcagagaaccagg

SEQ ID NO: 159934 - DNA, 20 bp, Artificial Sequence
  Synthetic oligonucleotide; CAG chr2 60476336 60476355 60476352 +
ggaagaaacttccccaaacc

SEQ ID NO: 159935 - DNA, 20 bp, Artificial Sequence
  Synthetic oligonucleotide; AGG chr2 60476337 60476356 60476353 +
gaagaaacttccccaaaccc

SEQ ID NO: 159936 - DNA, 20 bp, Artificial Sequence
  Synthetic oligonucleotide; AAG chr2 60476349 60476368 60476365 +
ccaaacccaggctaaatgtc

SEQ ID NO: 159937 - DNA, 20 bp, Artificial Sequence
  Synthetic oligonucleotide; AGG chr2 60476350 60476369 60476366 +
caaacccaggctaaatgtca

SEQ ID NO: 159938 - DNA, 20 bp, Artificial Sequence
  Synthetic oligonucleotide; GGG chr2 60476351 60476370 60476367 +
aaacccaggctaaatgtcaa

SEQ ID NO: 159939 - DNA, 20 bp, Artificial Sequence
  Synthetic oligonucleotide; AAG chr2 60476356 60476375 60476372 +
caggctaaatgtcaagggaa

SEQ ID NO: 159940 - DNA, 20 bp, Artificial Sequence
  Synthetic oligonucleotide; AGG chr2 60476357 60476376 60476373 +
aggctaaatgtcaagggaaa

SEQ ID NO: 159941 - DNA, 20 bp, Artificial Sequence
  Synthetic oligonucleotide; CAG chr2 60476363 60476382 60476379 +
aatgtcaagggaaaaggtct

SEQ ID NO: 159942 - DNA, 20 bp, Artificial Sequence
  Synthetic oligonucleotide; TGG chr2 60476366 60476385 60476382 +
gtcaagggaaaaggtctcag

SEQ ID NO: 159943 - DNA, 20 bp, Artificial Sequence
  Synthetic oligonucleotide; CAG chr2 60476376 60476395 60476392 +
aaggtctcagtggctcatgc

SEQ ID NO: 159944 - DNA, 20 bp, Artificial Sequence
  Synthetic oligonucleotide; AAG chr2 60476379 60476398 60476395 +
gtctcagtggctcatgccag

SEQ ID NO: 159945 - DNA, 20 bp, Artificial Sequence
  Synthetic oligonucleotide; CAG chr2 60476384 60476403 60476400 +
agtggctcatgccagaagtc

SEQ ID NO: 159946 - DNA, 20 bp, Artificial Sequence
  Synthetic oligonucleotide; TAG chr2 60476387 60476406 60476403 +
ggctcatgccagaagtccag

SEQ ID NO: 159947 - DNA, 20 bp, Artificial Sequence
  Synthetic oligonucleotide; AAG chr2 60476392 60476411 60476408 +
atgccagaagtccagtagca

SEQ ID NO: 159948 - DNA, 20 bp, Artificial Sequence
  Synthetic oligonucleotide; CGG chr2 60476397 60476416 60476413 +
agaagtccagtagcaaagct

SEQ ID NO: 159949 - DNA, 20 bp, Artificial Sequence
  Synthetic oligonucleotide; CAG chr2 60476408 60476427 60476424 +
agcaaagctcggcctcatgc

SEQ ID NO: 159950 - DNA, 20 bp, Artificial Sequence
  Synthetic oligonucleotide; GAG chr2 60476410 60476429 60476426 +
caaagctcggcctcatgcca

SEQ ID NO: 159951 - DNA, 20 bp, Artificial Sequence
  Synthetic oligonucleotide; TGG chr2 60476415 60476434 60476431 +
ctcggcctcatgccagagcc

SEQ ID NO: 159952 - DNA, 20 bp, Artificial Sequence
  Synthetic oligonucleotide; AAG chr2 60476433 60476452 60476449 +
cctggcacccattgctcaca

SEQ ID NO: 159953 - DNA, 20 bp, Artificial Sequence
  Synthetic oligonucleotide; AGG chr2 60476434 60476453 60476450 +
ctggcacccattgctcacaa

SEQ ID NO: 159954 - DNA, 20 bp, Artificial Sequence
  Synthetic oligonucleotide; CAG chr2 60476443 60476462 60476459 +
attgctcacaaaggcacaca

SEQ ID NO: 159955 - DNA, 20 bp, Artificial Sequence
  Synthetic oligonucleotide; AGG chr2 60476444 60476463 60476460 +
ttgctcacaaaggcacacac

SEQ ID NO: 159956 - DNA, 20 bp, Artificial Sequence
  Synthetic oligonucleotide; AAG chr2 60476452 60476471 60476468 +
aaaggcacacacaggactct

SEQ ID NO: 159957 - DNA, 20 bp, Artificial Sequence
  Synthetic oligonucleotide; AAG chr2 60476457 60476476 60476473 +
cacacacaggactctaagaa

SEQ ID NO: 159958 - DNA, 20 bp, Artificial Sequence
  Synthetic oligonucleotide; AGG chr2 60476458 60476477 60476474 +
acacacaggactctaagaaa

SEQ ID NO: 159959 - DNA, 20 bp, Artificial Sequence
  Synthetic oligonucleotide; GGG chr2 60476459 60476478 60476475 +
cacacaggactctaagaaaa

SEQ ID NO: 159960 - DNA, 20 bp, Artificial Sequence
  Synthetic oligonucleotide; GAG chr2 60476461 60476480 60476477 +
cacaggactctaagaaaagg

SEQ ID NO: 159961 - DNA, 20 bp, Artificial Sequence
  Synthetic oligonucleotide; CAG chr2 60476473 60476492 60476489 +
agaaaagggagtcctctccc

SEQ ID NO: 159962 - DNA, 20 bp, Artificial Sequence
  Synthetic oligonucleotide; CAG chr2 60476487 60476506 60476503 +
tctccccagccaccacaaac

SEQ ID NO: 159963 - DNA, 20 bp, Artificial Sequence
  Synthetic oligonucleotide; AGG chr2 60476488 60476507 60476504 +
ctccccagccaccacaaacc

SEQ ID NO: 159964 - DNA, 20 bp, Artificial Sequence
  Synthetic oligonucleotide; CAG chr2 60476492 60476511 60476508 +
ccagccaccacaaaccagga

SEQ ID NO: 159965 - DNA, 20 bp, Artificial Sequence
  Synthetic oligonucleotide; AAG chr2 60476497 60476516 60476513 +
caccacaaaccaggacagca

SEQ ID NO: 159966 - DNA, 20 bp, Artificial Sequence
  Synthetic oligonucleotide; CAG chr2 60476502 60476521 60476518 +
caaaccaggacagcaaagcc

SEQ ID NO: 159967 - DNA, 20 bp, Artificial Sequence
  Synthetic oligonucleotide; TGG chr2 60476512 60476531 60476528 +
cagcaaagcccagcaccctg

SEQ ID NO: 159968 - DNA, 20 bp, Artificial Sequence
  Synthetic oligonucleotide; CAG chr2 60476540 60476559 60476556 +
gacctcccaccacaccccat

SEQ ID NO: 159969 - DNA, 20 bp, Artificial Sequence
  Synthetic oligonucleotide; TGG chr2 60476545 60476564 60476561 +
cccaccacaccccatcagca

SEQ ID NO: 159970 - DNA, 20 bp, Artificial Sequence
  Synthetic oligonucleotide; GAG chr2 60476547 60476566 60476563 +
caccacaccccatcagcatg

SEQ ID NO: 159971 - DNA, 20 bp, Artificial Sequence
  Synthetic oligonucleotide; AGG chr2 60476548 60476567 60476564 +
accacaccccatcagcatgg

SEQ ID NO: 159972 - DNA, 20 bp, Artificial Sequence
  Synthetic oligonucleotide; GGG chr2 60476549 60476568 60476565 +
ccacaccccatcagcatgga

SEQ ID NO: 159973 - DNA, 20 bp, Artificial Sequence
  Synthetic oligonucleotide; TGG chr2 60476556 60476575 60476572 +
ccatcagcatggagggttct

SEQ ID NO: 159974 - DNA, 20 bp, Artificial Sequence
  Synthetic oligonucleotide; AAG chr2 60476560 60476579 60476576 +
cagcatggagggttcttgga

SEQ ID NO: 159975 - DNA, 20 bp, Artificial Sequence
  Synthetic oligonucleotide; CAG chr2 60476619 60476638 60476635 +
tttgctaaccaacataattt

SEQ ID NO: 159976 - DNA, 20 bp, Artificial Sequence
  Synthetic oligonucleotide; GAG chr2 60476621 60476640 60476637 +
tgctaaccaacataatttca

SEQ ID NO: 159977 - DNA, 20 bp, Artificial Sequence
  Synthetic oligonucleotide; CAG chr2 60476641 60476660 60476657 +
gagatgtttcgtcacccttc

SEQ ID NO: 159978 - DNA, 20 bp, Artificial Sequence
  Synthetic oligonucleotide; AGG chr2 60476642 60476661 60476658 +
agatgtttcgtcacccttcc

SEQ ID NO: 159979 - DNA, 20 bp, Artificial Sequence
  Synthetic oligonucleotide; TGG chr2 60476657 60476676 60476673 +
cttccaggctcattgaaaat

SEQ ID NO: 159980 - DNA, 20 bp, Artificial Sequence
  Synthetic oligonucleotide; CAG chr2 60476660 60476679 60476676 +
ccaggctcattgaaaattgg

SEQ ID NO: 159981 - DNA, 20 bp, Artificial Sequence
  Synthetic oligonucleotide; AGG chr2 60476661 60476680 60476677 +
caggctcattgaaaattggc

SEQ ID NO: 159982 - DNA, 20 bp, Artificial Sequence
  Synthetic oligonucleotide; GGG chr2 60476662 60476681 60476678 +
aggctcattgaaaattggca

SEQ ID NO: 159983 - DNA, 20 bp, Artificial Sequence
  Synthetic oligonucleotide; AAG chr2 60476685 60476704 60476701 +
cttctaacattttacctttt

SEQ ID NO: 159984 - DNA, 20 bp, Artificial Sequence
  Synthetic oligonucleotide; AAG chr2 60476727 60476746 60476743 +
cccccaatatcctctctgtc

SEQ ID NO: 159985 - DNA, 20 bp, Artificial Sequence
  Synthetic oligonucleotide; TAG chr2 60476730 60476749 60476746 +
ccaatatcctctctgtcaag

SEQ ID NO: 159986 - DNA, 20 bp, Artificial Sequence
  Synthetic oligonucleotide; CAG chr2 60476763 60476782 60476779 +
gtaaacaaacactttaaatt

SEQ ID NO: 159987 - DNA, 20 bp, Artificial Sequence
  Synthetic oligonucleotide; TGG chr2 60476766 60476785 60476782 +
aacaaacactttaaattcag

SEQ ID NO: 159988 - DNA, 20 bp, Artificial Sequence
  Synthetic oligonucleotide; GGG chr2 60476767 60476786 60476783 +
acaaacactttaaattcagt

SEQ ID NO: 159989 - DNA, 20 bp, Artificial Sequence
  Synthetic oligonucleotide; GGG chr2 60476768 60476787 60476784 +
caaacactttaaattcagtg

SEQ ID NO: 159990 - DNA, 20 bp, Artificial Sequence
  Synthetic oligonucleotide; GGG chr2 60476769 60476788 60476785 +
aaacactttaaattcagtgg

SEQ ID NO: 159991 - DNA, 20 bp, Artificial Sequence
  Synthetic oligonucleotide; GAG chr2 60476771 60476790 60476787 +
acactttaaattcagtgggg

SEQ ID NO: 159992 - DNA, 20 bp, Artificial Sequence
  Synthetic oligonucleotide; AAG chr2 60476785 60476804 60476801 +
gtgggggagctcactattta

SEQ ID NO: 159993 - DNA, 20 bp, Artificial Sequence
  Synthetic oligonucleotide; TGG chr2 60476796 60476815 60476812 +
cactatttaaagaaaccctg

SEQ ID NO: 159994 - DNA, 20 bp, Artificial Sequence
  Synthetic oligonucleotide; AAG chr2 60476813 60476832 60476829 +
ctgtggtgaaaccttttgaa

SEQ ID NO: 159995 - DNA, 20 bp, Artificial Sequence
  Synthetic oligonucleotide; CAG chr2 60476859 60476878 60476875 +
aaaatcactctctaatttat

SEQ ID NO: 159996 - DNA, 20 bp, Artificial Sequence
  Synthetic oligonucleotide; GAG chr2 60476873 60476892 60476889 +
atttatcagtttccattaat

SEQ ID NO: 159997 - DNA, 20 bp, Artificial Sequence
  Synthetic oligonucleotide; TGG chr2 60476890 60476909 60476906 +
aatgagatttttgtgtgtat

SEQ ID NO: 159998 - DNA, 20 bp, Artificial Sequence
  Synthetic oligonucleotide; GGG chr2 60476891 60476910 60476907 +
atgagatttttgtgtgtatt

SEQ ID NO: 159999 - DNA, 20 bp, Artificial Sequence
  Synthetic oligonucleotide; AAG chr2 60476902 60476921 60476918 +
gtgtgtattgggccttctga

SEQ ID NO: 160000 - DNA, 20 bp, Artificial Sequence
  Synthetic oligonucleotide; TGG chr2 60476905 60476924 60476921 +
tgtattgggccttctgaaag

SEQ ID NO: 160001 - DNA, 20 bp, Artificial Sequence
  Synthetic oligonucleotide; GGG chr2 60476906 60476925 60476922 +
gtattgggccttctgaaagt

SEQ ID NO: 160002 - DNA, 20 bp, Artificial Sequence
  Synthetic oligonucleotide; GGG chr2 60476907 60476926 60476923 +
tattgggccttctgaaagtg

SEQ ID NO: 160003 - DNA, 20 bp, Artificial Sequence
  Synthetic oligonucleotide; TAG chr2 60476933 60476952 60476949 +
aactgcaatccatgcctttg

SEQ ID NO: 160004 - DNA, 20 bp, Artificial Sequence
  Synthetic oligonucleotide; TAG chr2 60476937 60476956 60476953 +
gcaatccatgcctttgtagt

SEQ ID NO: 160005 - DNA, 20 bp, Artificial Sequence
  Synthetic oligonucleotide; AAG chr2 60476940 60476959 60476956 +
atccatgcctttgtagttag

SEQ ID NO: 160006 - DNA, 20 bp, Artificial Sequence
  Synthetic oligonucleotide; AGG chr2 60476941 60476960 60476957 +
tccatgcctttgtagttaga

SEQ ID NO: 160007 - DNA, 20 bp, Artificial Sequence
  Synthetic oligonucleotide; GGG chr2 60476942 60476961 60476958 +
ccatgcctttgtagttagaa

SEQ ID NO: 160008 - DNA, 20 bp, Artificial Sequence
  Synthetic oligonucleotide; AAG chr2 60476952 60476971 60476968 +
gtagttagaagggacgataa

SEQ ID NO: 160009 - DNA, 20 bp, Artificial Sequence
  Synthetic oligonucleotide; CAG chr2 60476992 60477011 60477008 +
tttctgtcacccgaattgtc

SEQ ID NO: 160010 - DNA, 20 bp, Artificial Sequence
  Synthetic oligonucleotide; GAG chr2 60477043 60477062 60477059 +
gatgcctccctgccccactc

SEQ ID NO: 160011 - DNA, 20 bp, Artificial Sequence
  Synthetic oligonucleotide; AAG chr2 60477051 60477070 60477067 +
cctgccccactcgagaaatg

SEQ ID NO: 160012 - DNA, 20 bp, Artificial Sequence
  Synthetic oligonucleotide; AAG chr2 60477056 60477075 60477072 +
cccactcgagaaatgaagaa

SEQ ID NO: 160013 - DNA, 20 bp, Artificial Sequence
  Synthetic oligonucleotide; AGG chr2 60477057 60477076 60477073 +
ccactcgagaaatgaagaaa

SEQ ID NO: 160014 - DNA, 20 bp, Artificial Sequence
  Synthetic oligonucleotide; TGG chr2 60477061 60477080 60477077 +
tcgagaaatgaagaaaagga

SEQ ID NO: 160015 - DNA, 20 bp, Artificial Sequence
  Synthetic oligonucleotide; GGG chr2 60477062 60477081 60477078 +
cgagaaatgaagaaaaggat

SEQ ID NO: 160016 - DNA, 20 bp, Artificial Sequence
  Synthetic oligonucleotide; TGG chr2 60477076 60477095 60477092 +
aaggatgggaaatcatcatt

SEQ ID NO: 160017 - DNA, 20 bp, Artificial Sequence
  Synthetic oligonucleotide; TGG chr2 60477084 60477103 60477100 +
gaaatcatcatttggacacc

SEQ ID NO: 160018 - DNA, 20 bp, Artificial Sequence
  Synthetic oligonucleotide; AAG chr2 60477088 60477107 60477104 +
tcatcatttggacacctgga

SEQ ID NO: 160019 - DNA, 20 bp, Artificial Sequence
  Synthetic oligonucleotide; CAG chr2 60477118 60477137 60477134 +
aaccacacttgcgtttctcc

SEQ ID NO: 160020 - DNA, 20 bp, Artificial Sequence
  Synthetic oligonucleotide; AGG chr2 60477119 60477138 60477135 +
accacacttgcgtttctccc

SEQ ID NO: 160021 - DNA, 20 bp, Artificial Sequence
  Synthetic oligonucleotide; AAG chr2 60477124 60477143 60477140 +
acttgcgtttctcccaggtt

SEQ ID NO: 160022 - DNA, 20 bp, Artificial Sequence
  Synthetic oligonucleotide; TAG chr2 60477130 60477149 60477146 +
gtttctcccaggttaagtat

SEQ ID NO: 160023 - DNA, 20 bp, Artificial Sequence
  Synthetic oligonucleotide; GAG chr2 60477139 60477158 60477155 +
aggttaagtattagatacct

SEQ ID NO: 160024 - DNA, 20 bp, Artificial Sequence
  Synthetic oligonucleotide; AGG chr2 60477140 60477159 60477156 +
ggttaagtattagatacctg

SEQ ID NO: 160025 - DNA, 20 bp, Artificial Sequence
  Synthetic oligonucleotide; AAG chr2 60477143 60477162 60477159 +
taagtattagatacctgagg

SEQ ID NO: 160026 - DNA, 20 bp, Artificial Sequence
  Synthetic oligonucleotide; AGG chr2 60477144 60477163 60477160 +
aagtattagatacctgagga

SEQ ID NO: 160027 - DNA, 20 bp, Artificial Sequence
  Synthetic oligonucleotide; GAG chr2 60477167 60477186 60477183 +
tgaaatacgcattttcaact

SEQ ID NO: 160028 - DNA, 20 bp, Artificial Sequence
  Synthetic oligonucleotide; CAG chr2 60477174 60477193 60477190 +
cgcattttcaactgagcatt

SEQ ID NO: 160029 - DNA, 20 bp, Artificial Sequence
  Synthetic oligonucleotide; AGG chr2 60477175 60477194 60477191 +
gcattttcaactgagcattc

SEQ ID NO: 160030 - DNA, 20 bp, Artificial Sequence
  Synthetic oligonucleotide; AAG chr2 60477178 60477197 60477194 +
ttttcaactgagcattcagg

SEQ ID NO: 160031 - DNA, 20 bp, Artificial Sequence
  Synthetic oligonucleotide; GAG chr2 60477180 60477199 60477196 +
ttcaactgagcattcaggaa

SEQ ID NO: 160032 - DNA, 20 bp, Artificial Sequence
  Synthetic oligonucleotide; AGG chr2 60477181 60477200 60477197 +
tcaactgagcattcaggaag

SEQ ID NO: 160033 - DNA, 20 bp, Artificial Sequence
  Synthetic oligonucleotide; TGG chr2 60477186 60477205 60477202 +
tgagcattcaggaagaggca

SEQ ID NO: 160034 - DNA, 20 bp, Artificial Sequence
  Synthetic oligonucleotide; GGG chr2 60477187 60477206 60477203 +
gagcattcaggaagaggcat

SEQ ID NO: 160035 - DNA, 20 bp, Artificial Sequence
  Synthetic oligonucleotide; GGG chr2 60477188 60477207 60477204 +
agcattcaggaagaggcatg

SEQ ID NO: 160036 - DNA, 20 bp, Artificial Sequence
  Synthetic oligonucleotide; AAG chr2 60477196 60477215 60477212 +
ggaagaggcatggggctgtg

SEQ ID NO: 160037 - DNA, 20 bp, Artificial Sequence
  Synthetic oligonucleotide; TGG chr2 60477200 60477219 60477216 +
gaggcatggggctgtgaaga

SEQ ID NO: 160038 - DNA, 20 bp, Artificial Sequence
  Synthetic oligonucleotide; GAG chr2 60477210 60477229 60477226 +
gctgtgaagatggatgcgat

SEQ ID NO: 160039 - DNA, 20 bp, Artificial Sequence
  Synthetic oligonucleotide; CAG chr2 60477252 60477271 60477268 +
ttgattctgataacacctgc

SEQ ID NO: 160040 - DNA, 20 bp, Artificial Sequence
  Synthetic oligonucleotide; GAG chr2 60477254 60477273 60477270 +
gattctgataacacctgcca

SEQ ID NO: 160041 - DNA, 20 bp, Artificial Sequence
  Synthetic oligonucleotide; CAG chr2 60477257 60477276 60477273 +
tctgataacacctgccagag

SEQ ID NO: 160042 - DNA, 20 bp, Artificial Sequence
  Synthetic oligonucleotide; GAG chr2 60477259 60477278 60477275 +
tgataacacctgccagagca

SEQ ID NO: 160043 - DNA, 20 bp, Artificial Sequence
  Synthetic oligonucleotide; AAG chr2 60477262 60477281 60477278 +
taacacctgccagagcagag

SEQ ID NO: 160044 - DNA, 20 bp, Artificial Sequence
  Synthetic oligonucleotide; AGG chr2 60477263 60477282 60477279 +
aacacctgccagagcagaga

SEQ ID NO: 160045 - DNA, 20 bp, Artificial Sequence
  Synthetic oligonucleotide; GGG chr2 60477264 60477283 60477280 +
acacctgccagagcagagaa

SEQ ID NO: 160046 - DNA, 20 bp, Artificial Sequence
  Synthetic oligonucleotide; AAG chr2 60477278 60477297 60477294 +
agagaagggcttgtctatca

SEQ ID NO: 160047 - DNA, 20 bp, Artificial Sequence
  Synthetic oligonucleotide; CAG chr2 60477282 60477301 60477298 +
aagggcttgtctatcaaagc

SEQ ID NO: 160048 - DNA, 20 bp, Artificial Sequence
  Synthetic oligonucleotide; CAG chr2 60477285 60477304 60477301 +
ggcttgtctatcaaagccag

SEQ ID NO: 160049 - DNA, 20 bp, Artificial Sequence
  Synthetic oligonucleotide; AAG chr2 60477313 60477332 60477329 +
acaactcccaaattactctg

SEQ ID NO: 160050 - DNA, 20 bp, Artificial Sequence
  Synthetic oligonucleotide; AAG chr2 60477324 60477343 60477340 +
attactctgaagaccacccc

SEQ ID NO: 160051 - DNA, 20 bp, Artificial Sequence
  Synthetic oligonucleotide; CGG chr2 60477388 60477407 60477404 +
ctctatattatcatttcgat

SEQ ID NO: 160052 - DNA, 20 bp, Artificial Sequence
  Synthetic oligonucleotide; GAG chr2 60477395 60477414 60477411 +
ttatcatttcgatcggtctt

SEQ ID NO: 160053 - DNA, 20 bp, Artificial Sequence
  Synthetic oligonucleotide; TAG chr2 60477405 60477424 60477421 +
gatcggtcttgagaaaatac

SEQ ID NO: 160054 - DNA, 20 bp, Artificial Sequence
  Synthetic oligonucleotide; AAG chr2 60477411 60477430 60477427 +
tcttgagaaaatactagaat

SEQ ID NO: 160055 - DNA, 20 bp, Artificial Sequence
  Synthetic oligonucleotide; AAG chr2 60477417 60477436 60477433 +
gaaaatactagaataagcta

SEQ ID NO: 160056 - DNA, 20 bp, Artificial Sequence
  Synthetic oligonucleotide; TGG chr2 60477431 60477450 60477447 +
aagctaaagaaaaccaaaca

SEQ ID NO: 160057 - DNA, 20 bp, Artificial Sequence
  Synthetic oligonucleotide; GGG chr2 60477432 60477451 60477448 +
agctaaagaaaaccaaacat

SEQ ID NO: 160058 - DNA, 20 bp, Artificial Sequence
  Synthetic oligonucleotide; TGG chr2 60477435 60477454 60477451 +
taaagaaaaccaaacatggg

SEQ ID NO: 160059 - DNA, 20 bp, Artificial Sequence
  Synthetic oligonucleotide; GAG chr2 60477437 60477456 60477453 +
aagaaaaccaaacatgggtg

SEQ ID NO: 160060 - DNA, 20 bp, Artificial Sequence
  Synthetic oligonucleotide; AGG chr2 60477438 60477457 60477454 +
agaaaaccaaacatgggtgg

SEQ ID NO: 160061 - DNA, 20 bp, Artificial Sequence
  Synthetic oligonucleotide; GGG chr2 60477439 60477458 60477455 +
gaaaaccaaacatgggtgga

SEQ ID NO: 160062 - DNA, 20 bp, Artificial Sequence
  Synthetic oligonucleotide; GGG chr2 60477440 60477459 60477456 +
aaaaccaaacatgggtggag

SEQ ID NO: 160063 - DNA, 20 bp, Artificial Sequence
  Synthetic oligonucleotide; AAG chr2 60477444 60477463 60477460 +
ccaaacatgggtggaggggc

SEQ ID NO: 160064 - DNA, 20 bp, Artificial Sequence
  Synthetic oligonucleotide; AGG chr2 60477445 60477464 60477461 +
caaacatgggtggaggggca

SEQ ID NO: 160065 - DNA, 20 bp, Artificial Sequence
  Synthetic oligonucleotide; GGG chr2 60477446 60477465 60477462 +
aaacatgggtggaggggcaa

SEQ ID NO: 160066 - DNA, 20 bp, Artificial Sequence
  Synthetic oligonucleotide; GGG chr2 60477447 60477466 60477463 +
aacatgggtggaggggcaag

SEQ ID NO: 160067 - DNA, 20 bp, Artificial Sequence
  Synthetic oligonucleotide; GAG chr2 60477449 60477468 60477465 +
catgggtggaggggcaaggg

SEQ ID NO: 160068 - DNA, 20 bp, Artificial Sequence
  Synthetic oligonucleotide; AGG chr2 60477450 60477469 60477466 +
atgggtggaggggcaagggg

SEQ ID NO: 160069 - DNA, 20 bp, Artificial Sequence
  Synthetic oligonucleotide; GGG chr2 60477451 60477470 60477467 +
tgggtggaggggcaagggga

SEQ ID NO: 160070 - DNA, 20 bp, Artificial Sequence
  Synthetic oligonucleotide; TAG chr2 60477455 60477474 60477471 +
tggaggggcaaggggaggga

SEQ ID NO: 160071 - DNA, 20 bp, Artificial Sequence
  Synthetic oligonucleotide; TAG chr2 60477461 60477480 60477477 +
ggcaaggggagggatagcat

SEQ ID NO: 160072 - DNA, 20 bp, Artificial Sequence
  Synthetic oligonucleotide; AGG chr2 60477462 60477481 60477478 +
gcaaggggagggatagcatt

SEQ ID NO: 160073 - DNA, 20 bp, Artificial Sequence
  Synthetic oligonucleotide; GAG chr2 60477464 60477483 60477480 +
aaggggagggatagcattag

SEQ ID NO: 160074 - DNA, 20 bp, Artificial Sequence
  Synthetic oligonucleotide; TAG chr2 60477479 60477498 60477495 +
attaggagaaatgcctaatg

SEQ ID NO: 160075 - DNA, 20 bp, Artificial Sequence
  Synthetic oligonucleotide; TGG chr2 60477486 60477505 60477502 +
gaaatgcctaatgtagatga

SEQ ID NO: 160076 - DNA, 20 bp, Artificial Sequence
  Synthetic oligonucleotide; GGG chr2 60477487 60477506 60477503 +
aaatgcctaatgtagatgat

SEQ ID NO: 160077 - DNA, 20 bp, Artificial Sequence
  Synthetic oligonucleotide; TAG chr2 60477494 60477513 60477510 +
taatgtagatgatgggttga

SEQ ID NO: 160078 - DNA, 20 bp, Artificial Sequence
  Synthetic oligonucleotide; AGG chr2 60477495 60477514 60477511 +
aatgtagatgatgggttgat

SEQ ID NO: 160079 - DNA, 20 bp, Artificial Sequence
  Synthetic oligonucleotide; CAG chr2 60477500 60477519 60477516 +
agatgatgggttgataggtg

SEQ ID NO: 160080 - DNA, 20 bp, Artificial Sequence
  Synthetic oligonucleotide; TGG chr2 60477513 60477532 60477529 +
ataggtgcagcaaaccacca

SEQ ID NO: 160081 - DNA, 20 bp, Artificial Sequence
  Synthetic oligonucleotide; CAG chr2 60477563 60477582 60477579 +
cacattctgcacatgtatcc

SEQ ID NO: 160082 - DNA, 20 bp, Artificial Sequence
  Synthetic oligonucleotide; TAG chr2 60477570 60477589 60477586 +
tgcacatgtatcccagaact

SEQ ID NO: 160083 - DNA, 20 bp, Artificial Sequence
  Synthetic oligonucleotide; GAG chr2 60477572 60477591 60477588 +
cacatgtatcccagaactta

SEQ ID NO: 160084 - DNA, 20 bp, Artificial Sequence
  Synthetic oligonucleotide; AAG chr2 60477586 60477605 60477602 +
aacttagagtaaaataaata

SEQ ID NO: 160085 - DNA, 20 bp, Artificial Sequence
  Synthetic oligonucleotide; AAG chr2 60477590 60477609 60477606 +
tagagtaaaataaataaaga

SEQ ID NO: 160086 - DNA, 20 bp, Artificial Sequence
  Synthetic oligonucleotide; AAG chr2 60477594 60477613 60477610 +
gtaaaataaataaagaaaga

SEQ ID NO: 160087 - DNA, 20 bp, Artificial Sequence
  Synthetic oligonucleotide; AAG chr2 60477598 60477617 60477614 +
aataaataaagaaagaaaga

SEQ ID NO: 160088 - DNA, 20 bp, Artificial Sequence
  Synthetic oligonucleotide; AAG chr2 60477602 60477621 60477618 +
aataaagaaagaaagaaaga

SEQ ID NO: 160089 - DNA, 20 bp, Artificial Sequence
  Synthetic oligonucleotide; TGG chr2 60477618 60477637 60477634 +
aagaaagaaataatcaaaca

SEQ ID NO: 160090 - DNA, 20 bp, Artificial Sequence
  Synthetic oligonucleotide; AAG chr2 60477628 60477647 60477644 +
taatcaaacatggtgtttcc

SEQ ID NO: 160091 - DNA, 20 bp, Artificial Sequence
  Synthetic oligonucleotide; GAG chr2 60477630 60477649 60477646 +
atcaaacatggtgtttccaa

SEQ ID NO: 160092 - DNA, 20 bp, Artificial Sequence
  Synthetic oligonucleotide; TGG chr2 60477652 60477671 60477668 +
gactcctgatgttttgttcg

SEQ ID NO: 160093 - DNA, 20 bp, Artificial Sequence
  Synthetic oligonucleotide; GGG chr2 60477653 60477672 60477669 +
actcctgatgttttgttcgt

SEQ ID NO: 160094 - DNA, 20 bp, Artificial Sequence
  Synthetic oligonucleotide; TGG chr2 60477661 60477680 60477677 +
tgttttgttcgtgggcactg

SEQ ID NO: 160095 - DNA, 20 bp, Artificial Sequence
  Synthetic oligonucleotide; CAG chr2 60477667 60477686 60477683 +
gttcgtgggcactgtggaaa

SEQ ID NO: 160096 - DNA, 20 bp, Artificial Sequence
  Synthetic oligonucleotide; AGG chr2 60477668 60477687 60477684 +
ttcgtgggcactgtggaaac

SEQ ID NO: 160097 - DNA, 20 bp, Artificial Sequence
  Synthetic oligonucleotide; GGG chr2 60477669 60477688 60477685 +
tcgtgggcactgtggaaaca

SEQ ID NO: 160098 - DNA, 20 bp, Artificial Sequence
  Synthetic oligonucleotide; GGG chr2 60477670 60477689 60477686 +
cgtgggcactgtggaaacag

SEQ ID NO: 160099 - DNA, 20 bp, Artificial Sequence
  Synthetic oligonucleotide; CAG chr2 60477673 60477692 60477689 +
gggcactgtggaaacagggg

SEQ ID NO: 160100 - DNA, 20 bp, Artificial Sequence
  Synthetic oligonucleotide; TGG chr2 60477676 60477695 60477692 +
cactgtggaaacaggggcag

SEQ ID NO: 160101 - DNA, 20 bp, Artificial Sequence
  Synthetic oligonucleotide; GAG chr2 60477685 60477704 60477701 +
aacaggggcagtggtgctgt

SEQ ID NO: 160102 - DNA, 20 bp, Artificial Sequence
  Synthetic oligonucleotide; GAG chr2 60477687 60477706 60477703 +
caggggcagtggtgctgtga

SEQ ID NO: 160103 - DNA, 20 bp, Artificial Sequence
  Synthetic oligonucleotide; AAG chr2 60477692 60477711 60477708 +
gcagtggtgctgtgagagac

SEQ ID NO: 160104 - DNA, 20 bp, Artificial Sequence
  Synthetic oligonucleotide; AGG chr2 60477693 60477712 60477709 +
cagtggtgctgtgagagaca

SEQ ID NO: 160105 - DNA, 20 bp, Artificial Sequence
  Synthetic oligonucleotide; GGG chr2 60477694 60477713 60477710 +
agtggtgctgtgagagacaa

SEQ ID NO: 160106 - DNA, 20 bp, Artificial Sequence
  Synthetic oligonucleotide; GAG chr2 60477696 60477715 60477712 +
tggtgctgtgagagacaagg

SEQ ID NO: 160107 - DNA, 20 bp, Artificial Sequence
  Synthetic oligonucleotide; TGG chr2 60477699 60477718 60477715 +
tgctgtgagagacaagggag

SEQ ID NO: 160108 - DNA, 20 bp, Artificial Sequence
  Synthetic oligonucleotide; GGG chr2 60477700 60477719 60477716 +
gctgtgagagacaagggagt

SEQ ID NO: 160109 - DNA, 20 bp, Artificial Sequence
  Synthetic oligonucleotide; GGG chr2 60477701 60477720 60477717 +
ctgtgagagacaagggagtg

SEQ ID NO: 160110 - DNA, 20 bp, Artificial Sequence
  Synthetic oligonucleotide; GAG chr2 60477703 60477722 60477719 +
gtgagagacaagggagtggg

SEQ ID NO: 160111 - DNA, 20 bp, Artificial Sequence
  Synthetic oligonucleotide; TGG chr2 60477709 60477728 60477725 +
gacaagggagtggggagcca

SEQ ID NO: 160112 - DNA, 20 bp, Artificial Sequence
  Synthetic oligonucleotide; CAG chr2 60477713 60477732 60477729 +
agggagtggggagccatggt

SEQ ID NO: 160113 - DNA, 20 bp, Artificial Sequence
  Synthetic oligonucleotide; AAG chr2 60477717 60477736 60477733 +
agtggggagccatggtcagc

SEQ ID NO: 160114 - DNA, 20 bp, Artificial Sequence
  Synthetic oligonucleotide; TGG chr2 60477722 60477741 60477738 +
ggagccatggtcagcaagtg

SEQ ID NO: 160115 - DNA, 20 bp, Artificial Sequence
  Synthetic oligonucleotide; GGG chr2 60477723 60477742 60477739 +
gagccatggtcagcaagtgt

SEQ ID NO: 160116 - DNA, 20 bp, Artificial Sequence
  Synthetic oligonucleotide; CAG chr2 60477726 60477745 60477742 +
ccatggtcagcaagtgtggg

SEQ ID NO: 160117 - DNA, 20 bp, Artificial Sequence
  Synthetic oligonucleotide; CAG chr2 60477732 60477751 60477748 +
tcagcaagtgtgggcagccc

SEQ ID NO: 160118 - DNA, 20 bp, Artificial Sequence
  Synthetic oligonucleotide; CAG chr2 60477743 60477762 60477759 +
gggcagccccagcgacactg

SEQ ID NO: 160119 - DNA, 20 bp, Artificial Sequence
  Synthetic oligonucleotide; CGG chr2 60477748 60477767 60477764 +
gccccagcgacactgcagcc

SEQ ID NO: 160120 - DNA, 20 bp, Artificial Sequence
  Synthetic oligonucleotide; CAG chr2 60477752 60477771 60477768 +
cagcgacactgcagcccggc

SEQ ID NO: 160121 - DNA, 20 bp, Artificial Sequence
  Synthetic oligonucleotide; AGG chr2 60477753 60477772 60477769 +
agcgacactgcagcccggcc

SEQ ID NO: 160122 - DNA, 20 bp, Artificial Sequence
  Synthetic oligonucleotide; TGG chr2 60477756 60477775 60477772 +
gacactgcagcccggccagg

SEQ ID NO: 160123 - DNA, 20 bp, Artificial Sequence
  Synthetic oligonucleotide; GAG chr2 60477758 60477777 60477774 +
cactgcagcccggccaggtg

SEQ ID NO: 160124 - DNA, 20 bp, Artificial Sequence
  Synthetic oligonucleotide; AGG chr2 60477759 60477778 60477775 +
actgcagcccggccaggtgg

SEQ ID NO: 160125 - DNA, 20 bp, Artificial Sequence
  Synthetic oligonucleotide; GGG chr2 60477760 60477779 60477776 +
ctgcagcccggccaggtgga

SEQ ID NO: 160126 - DNA, 20 bp, Artificial Sequence
  Synthetic oligonucleotide; AAG chr2 60477782 60477801 60477798 +
gctttcctgacttatcatcc

SEQ ID NO: 160127 - DNA, 20 bp, Artificial Sequence
  Synthetic oligonucleotide; TGG chr2 60477787 60477806 60477803 +
cctgacttatcatccaagac

SEQ ID NO: 160128 - DNA, 20 bp, Artificial Sequence
  Synthetic oligonucleotide; CGG chr2 60477798 60477817 60477814 +
atccaagactggtctgtgca

SEQ ID NO: 160129 - DNA, 20 bp, Artificial Sequence
  Synthetic oligonucleotide; GAG chr2 60477800 60477819 60477816 +
ccaagactggtctgtgcacg

SEQ ID NO: 160130 - DNA, 20 bp, Artificial Sequence
  Synthetic oligonucleotide; AAG chr2 60477803 60477822 60477819 +
agactggtctgtgcacggag

SEQ ID NO: 160131 - DNA, 20 bp, Artificial Sequence
  Synthetic oligonucleotide; AGG chr2 60477804 60477823 60477820 +
gactggtctgtgcacggaga

SEQ ID NO: 160132 - DNA, 20 bp, Artificial Sequence
  Synthetic oligonucleotide; GGG chr2 60477805 60477824 60477821 +
actggtctgtgcacggagaa

SEQ ID NO: 160133 - DNA, 20 bp, Artificial Sequence
  Synthetic oligonucleotide; GGG chr2 60477806 60477825 60477822 +
ctggtctgtgcacggagaag

SEQ ID NO: 160134 - DNA, 20 bp, Artificial Sequence
  Synthetic oligonucleotide; CAG chr2 60477810 60477829 60477826 +
tctgtgcacggagaaggggc

SEQ ID NO: 160135 - DNA, 20 bp, Artificial Sequence
  Synthetic oligonucleotide; AAG chr2 60477813 60477832 60477829 +
gtgcacggagaaggggccag

SEQ ID NO: 160136 - DNA, 20 bp, Artificial Sequence
  Synthetic oligonucleotide; CAG chr2 60477818 60477837 60477834 +
cggagaaggggccagaagaa

SEQ ID NO: 160137 - DNA, 20 bp, Artificial Sequence
  Synthetic oligonucleotide; AGG chr2 60477819 60477838 60477835 +
ggagaaggggccagaagaac

SEQ ID NO: 160138 - DNA, 20 bp, Artificial Sequence
  Synthetic oligonucleotide; CAG chr2 60477822 60477841 60477838 +
gaaggggccagaagaacagg

SEQ ID NO: 160139 - DNA, 20 bp, Artificial Sequence
  Synthetic oligonucleotide; CAG chr2 60477828 60477847 60477844 +
gccagaagaacaggcagccc

SEQ ID NO: 160140 - DNA, 20 bp, Artificial Sequence
  Synthetic oligonucleotide; AGG chr2 60477829 60477848 60477845 +
ccagaagaacaggcagcccc

SEQ ID NO: 160141 - DNA, 20 bp, Artificial Sequence
  Synthetic oligonucleotide; AAG chr2 60477832 60477851 60477848 +
gaagaacaggcagccccagg

SEQ ID NO: 160142 - DNA, 20 bp, Artificial Sequence
  Synthetic oligonucleotide; AGG chr2 60477833 60477852 60477849 +
aagaacaggcagccccagga

SEQ ID NO: 160143 - DNA, 20 bp, Artificial Sequence
  Synthetic oligonucleotide; CAG chr2 60477842 60477861 60477858 +
cagccccaggaaggctctgt

SEQ ID NO: 160144 - DNA, 20 bp, Artificial Sequence
  Synthetic oligonucleotide; AGG chr2 60477843 60477862 60477859 +
agccccaggaaggctctgtc

SEQ ID NO: 160145 - DNA, 20 bp, Artificial Sequence
  Synthetic oligonucleotide; AAG chr2 60477854 60477873 60477870 +
ggctctgtcaggcctccccc

SEQ ID NO: 160146 - DNA, 20 bp, Artificial Sequence
  Synthetic oligonucleotide; AGG chr2 60477855 60477874 60477871 +
gctctgtcaggcctccccca

SEQ ID NO: 160147 - DNA, 20 bp, Artificial Sequence
  Synthetic oligonucleotide; AAG chr2 60477863 60477882 60477879 +
aggcctcccccaaggccaac

SEQ ID NO: 160148 - DNA, 20 bp, Artificial Sequence
  Synthetic oligonucleotide; CAG chr2 60477868 60477887 60477884 +
tcccccaaggccaacaagcc

SEQ ID NO: 160149 - DNA, 20 bp, Artificial Sequence
  Synthetic oligonucleotide; GAG chr2 60477870 60477889 60477886 +
ccccaaggccaacaagccca

SEQ ID NO: 160150 - DNA, 20 bp, Artificial Sequence
  Synthetic oligonucleotide; AGG chr2 60477871 60477890 60477887 +
cccaaggccaacaagcccag

SEQ ID NO: 160151 - DNA, 20 bp, Artificial Sequence
  Synthetic oligonucleotide; GAG chr2 60477873 60477892 60477889 +
caaggccaacaagcccagag

SEQ ID NO: 160152 - DNA, 20 bp, Artificial Sequence
  Synthetic oligonucleotide; AGG chr2 60477874 60477893 60477890 +
aaggccaacaagcccagagg

SEQ ID NO: 160153 - DNA, 20 bp, Artificial Sequence
  Synthetic oligonucleotide; GGG chr2 60477875 60477894 60477891 +
aggccaacaagcccagagga

SEQ ID NO: 160154 - DNA, 20 bp, Artificial Sequence
  Synthetic oligonucleotide; AAG chr2 60477879 60477898 60477895 +
caacaagcccagaggagggc

SEQ ID NO: 160155 - DNA, 20 bp, Artificial Sequence
  Synthetic oligonucleotide; AGG chr2 60477880 60477899 60477896 +
aacaagcccagaggagggca

SEQ ID NO: 160156 - DNA, 20 bp, Artificial Sequence
  Synthetic oligonucleotide; TAG chr2 60477893 60477912 60477909 +
gagggcaaggcctccaactc

SEQ ID NO: 160157 - DNA, 20 bp, Artificial Sequence
  Synthetic oligonucleotide; AAG chr2 60477904 60477923 60477920 +
ctccaactctagcccttctt

SEQ ID NO: 160158 - DNA, 20 bp, Artificial Sequence
  Synthetic oligonucleotide; AGG chr2 60477905 60477924 60477921 +
tccaactctagcccttctta

SEQ ID NO: 160159 - DNA, 20 bp, Artificial Sequence
  Synthetic oligonucleotide; AAG chr2 60477908 60477927 60477924 +
aactctagcccttcttaagg

SEQ ID NO: 160160 - DNA, 20 bp, Artificial Sequence
  Synthetic oligonucleotide; TGG chr2 60477922 60477941 60477938 +
ttaaggaagcacatctgtcc

SEQ ID NO: 160161 - DNA, 20 bp, Artificial Sequence
  Synthetic oligonucleotide; TGG chr2 60477931 60477950 60477947 +
cacatctgtcctggccttta

SEQ ID NO: 160162 - DNA, 20 bp, Artificial Sequence
  Synthetic oligonucleotide; AAG chr2 60477935 60477954 60477951 +
tctgtcctggcctttatgga

SEQ ID NO: 160163 - DNA, 20 bp, Artificial Sequence
  Synthetic oligonucleotide; GAG chr2 60477961 60477980 60477977 +
ttttttttttttttttaatt

SEQ ID NO: 160164 - DNA, 20 bp, Artificial Sequence
  Synthetic oligonucleotide; TGG chr2 60477967 60477986 60477983 +
ttttttttttaattgagaca

SEQ ID NO: 160165 - DNA, 20 bp, Artificial Sequence
  Synthetic oligonucleotide; CAG chr2 60477985 60478004 60478001 +
catggtctcactctgttgcc

SEQ ID NO: 160166 - DNA, 20 bp, Artificial Sequence
  Synthetic oligonucleotide; AGG chr2 60477986 60478005 60478002 +
atggtctcactctgttgccc

SEQ ID NO: 160167 - DNA, 20 bp, Artificial Sequence
  Synthetic oligonucleotide; TGG chr2 60477990 60478009 60478006 +
tctcactctgttgcccaggc

SEQ ID NO: 160168 - DNA, 20 bp, Artificial Sequence
  Synthetic oligonucleotide; GAG chr2 60477992 60478011 60478008 +
tcactctgttgcccaggctg

SEQ ID NO: 160169 - DNA, 20 bp, Artificial Sequence
  Synthetic oligonucleotide; CAG chr2 60477997 60478016 60478013 +
ctgttgcccaggctggagtg

SEQ ID NO: 160170 - DNA, 20 bp, Artificial Sequence
  Synthetic oligonucleotide; TGG chr2 60478000 60478019 60478016 +
ttgcccaggctggagtgcag

SEQ ID NO: 160171 - DNA, 20 bp, Artificial Sequence
  Synthetic oligonucleotide; TGG chr2 60478011 60478030 60478027 +
ggagtgcagtggtgcaatct

SEQ ID NO: 160172 - DNA, 20 bp, Artificial Sequence
  Synthetic oligonucleotide; GAG chr2 60478036 60478055 60478052 +
cactgcaacctccgcctccc

SEQ ID NO: 160173 - DNA, 20 bp, Artificial Sequence
  Synthetic oligonucleotide; AAG chr2 60478042 60478061 60478058 +
aacctccgcctcccgagttc

SEQ ID NO: 160174 - DNA, 20 bp, Artificial Sequence
  Synthetic oligonucleotide; CAG chr2 60478045 60478064 60478061 +
ctccgcctcccgagttcaag

SEQ ID NO: 160175 - DNA, 20 bp, Artificial Sequence
  Synthetic oligonucleotide; CAG chr2 60478059 60478078 60478075 +
ttcaagcagtcctcctgcct

SEQ ID NO: 160176 - DNA, 20 bp, Artificial Sequence
  Synthetic oligonucleotide; AAG chr2 60478067 60478086 60478083 +
gtcctcctgcctcagctctc

SEQ ID NO: 160177 - DNA, 20 bp, Artificial Sequence
  Synthetic oligonucleotide; TAG chr2 60478070 60478089 60478086 +
ctcctgcctcagctctcaag

SEQ ID NO: 160178 - DNA, 20 bp, Artificial Sequence
  Synthetic oligonucleotide; TAG chr2 60478074 60478093 60478090 +
tgcctcagctctcaagtagc

SEQ ID NO: 160179 - DNA, 20 bp, Artificial Sequence
  Synthetic oligonucleotide; AGG chr2 60478075 60478094 60478091 +
gcctcagctctcaagtagct

SEQ ID NO: 160180 - DNA, 20 bp, Artificial Sequence
  Synthetic oligonucleotide; CAG chr2 60478082 60478101 60478098 +
ctctcaagtagctaggacta

SEQ ID NO: 160181 - DNA, 20 bp, Artificial Sequence
  Synthetic oligonucleotide; AGG chr2 60478083 60478102 60478099 +
tctcaagtagctaggactac

SEQ ID NO: 160182 - DNA, 20 bp, Artificial Sequence
  Synthetic oligonucleotide; TGG chr2 60478105 60478124 60478121 +
gcatgcgccaccaccacacc

SEQ ID NO: 160183 - DNA, 20 bp, Artificial Sequence
  Synthetic oligonucleotide; TAG chr2 60478127 60478146 60478143 +
gctaatttttgtattttttg

SEQ ID NO: 160184 - DNA, 20 bp, Artificial Sequence
  Synthetic oligonucleotide; GAG chr2 60478129 60478148 60478145 +
taatttttgtattttttgta

SEQ ID NO: 160185 - DNA, 20 bp, Artificial Sequence
  Synthetic oligonucleotide; TGG chr2 60478133 60478152 60478149 +
ttttgtattttttgtagaga

SEQ ID NO: 160186 - DNA, 20 bp, Artificial Sequence
  Synthetic oligonucleotide; GGG chr2 60478134 60478153 60478150 +
tttgtattttttgtagagat

SEQ ID NO: 160187 - DNA, 20 bp, Artificial Sequence
  Synthetic oligonucleotide; CAG chr2 60478153 60478172 60478169 +
tgggatctcaccatgttgcc

SEQ ID NO: 160188 - DNA, 20 bp, Artificial Sequence
  Synthetic oligonucleotide; AGG chr2 60478154 60478173 60478170 +
gggatctcaccatgttgccc

SEQ ID NO: 160189 - DNA, 20 bp, Artificial Sequence
  Synthetic oligonucleotide; TGG chr2 60478158 60478177 60478174 +
tctcaccatgttgcccaggc

SEQ ID NO: 160190 - DNA, 20 bp, Artificial Sequence
  Synthetic oligonucleotide; GGG chr2 60478159 60478178 60478175 +
ctcaccatgttgcccaggct

SEQ ID NO: 160191 - DNA, 20 bp, Artificial Sequence
  Synthetic oligonucleotide; TGG chr2 60478162 60478181 60478178 +
accatgttgcccaggctggg

SEQ ID NO: 160192 - DNA, 20 bp, Artificial Sequence
  Synthetic oligonucleotide; AAG chr2 60478166 60478185 60478182 +
tgttgcccaggctgggtgga

SEQ ID NO: 160193 - DNA, 20 bp, Artificial Sequence
  Synthetic oligonucleotide; AAG chr2 60478185 60478204 60478201 +
aaagtgttatgttcttccca

SEQ ID NO: 160194 - DNA, 20 bp, Artificial Sequence
  Synthetic oligonucleotide; CAG chr2 60478212 60478231 60478228 +
ctcctcacatcctgccccaa

SEQ ID NO: 160195 - DNA, 20 bp, Artificial Sequence
  Synthetic oligonucleotide; TGG chr2 60478223 60478242 60478239 +
ctgccccaacagtcgccctg

SEQ ID NO: 160196 - DNA, 20 bp, Artificial Sequence
  Synthetic oligonucleotide; GAG chr2 60478229 60478248 60478245 +
caacagtcgccctgtggaat

SEQ ID NO: 160197 - DNA, 20 bp, Artificial Sequence
  Synthetic oligonucleotide; AGG chr2 60478230 60478249 60478246 +
aacagtcgccctgtggaatg

SEQ ID NO: 160198 - DNA, 20 bp, Artificial Sequence
  Synthetic oligonucleotide; GGG chr2 60478231 60478250 60478247 +
acagtcgccctgtggaatga

SEQ ID NO: 160199 - DNA, 20 bp, Artificial Sequence
  Synthetic oligonucleotide; AAG chr2 60478234 60478253 60478250 +
gtcgccctgtggaatgaggg

SEQ ID NO: 160200 - DNA, 20 bp, Artificial Sequence
  Synthetic oligonucleotide; AGG chr2 60478235 60478254 60478251 +
tcgccctgtggaatgaggga

SEQ ID NO: 160201 - DNA, 20 bp, Artificial Sequence
  Synthetic oligonucleotide; TAG chr2 60478241 60478260 60478257 +
tgtggaatgagggaaggtat

SEQ ID NO: 160202 - DNA, 20 bp, Artificial Sequence
  Synthetic oligonucleotide; CAG chr2 60478254 60478273 60478270 +
aaggtattagcctcacctcc

SEQ ID NO: 160203 - DNA, 20 bp, Artificial Sequence
  Synthetic oligonucleotide; GAG chr2 60478258 60478277 60478274 +
tattagcctcacctcccagt

SEQ ID NO: 160204 - DNA, 20 bp, Artificial Sequence
  Synthetic oligonucleotide; AGG chr2 60478259 60478278 60478275 +
attagcctcacctcccagtg

SEQ ID NO: 160205 - DNA, 20 bp, Artificial Sequence
  Synthetic oligonucleotide; AAG chr2 60478268 60478287 60478284 +
acctcccagtgaggaactcg

SEQ ID NO: 160206 - DNA, 20 bp, Artificial Sequence
  Synthetic oligonucleotide; CAG chr2 60478275 60478294 60478291 +
agtgaggaactcgaagatct

SEQ ID NO: 160207 - DNA, 20 bp, Artificial Sequence
  Synthetic oligonucleotide; AAG chr2 60478278 60478297 60478294 +
gaggaactcgaagatctcag

SEQ ID NO: 160208 - DNA, 20 bp, Artificial Sequence
  Synthetic oligonucleotide; TGG chr2 60478291 60478310 60478307 +
atctcagaagtgtcctgctg

SEQ ID NO: 160209 - DNA, 20 bp, Artificial Sequence
  Synthetic oligonucleotide; CAG chr2 60478295 60478314 60478311 +
cagaagtgtcctgctgtgga

SEQ ID NO: 160210 - DNA, 20 bp, Artificial Sequence
  Synthetic oligonucleotide; AGG chr2 60478296 60478315 60478312 +
agaagtgtcctgctgtggac

SEQ ID NO: 160211 - DNA, 20 bp, Artificial Sequence
  Synthetic oligonucleotide; GGG chr2 60478297 60478316 60478313 +
gaagtgtcctgctgtggaca

SEQ ID NO: 160212 - DNA, 20 bp, Artificial Sequence
  Synthetic oligonucleotide; GAG chr2 60478299 60478318 60478315 +
agtgtcctgctgtggacagg

SEQ ID NO: 160213 - DNA, 20 bp, Artificial Sequence
  Synthetic oligonucleotide; AGG chr2 60478300 60478319 60478316 +
gtgtcctgctgtggacaggg

SEQ ID NO: 160214 - DNA, 20 bp, Artificial Sequence
  Synthetic oligonucleotide; CAG chr2 60478304 60478323 60478320 +
cctgctgtggacagggagga

SEQ ID NO: 160215 - DNA, 20 bp, Artificial Sequence
  Synthetic oligonucleotide; AGG chr2 60478305 60478324 60478321 +
ctgctgtggacagggaggac

SEQ ID NO: 160216 - DNA, 20 bp, Artificial Sequence
  Synthetic oligonucleotide; GGG chr2 60478306 60478325 60478322 +
tgctgtggacagggaggaca

SEQ ID NO: 160217 - DNA, 20 bp, Artificial Sequence
  Synthetic oligonucleotide; TGG chr2 60478310 60478329 60478326 +
gtggacagggaggacagggc

SEQ ID NO: 160218 - DNA, 20 bp, Artificial Sequence
  Synthetic oligonucleotide; GGG chr2 60478311 60478330 60478327 +
tggacagggaggacagggct

SEQ ID NO: 160219 - DNA, 20 bp, Artificial Sequence
  Synthetic oligonucleotide; CAG chr2 60478317 60478336 60478333 +
gggaggacagggctgggctt

SEQ ID NO: 160220 - DNA, 20 bp, Artificial Sequence
  Synthetic oligonucleotide; AGG chr2 60478318 60478337 60478334 +
ggaggacagggctgggcttc

SEQ ID NO: 160221 - DNA, 20 bp, Artificial Sequence
  Synthetic oligonucleotide; CAG chr2 60478361 60478380 60478377 +
aacccctcccactgccacct

SEQ ID NO: 160222 - DNA, 20 bp, Artificial Sequence
  Synthetic oligonucleotide; AGG chr2 60478362 60478381 60478378 +
acccctcccactgccacctc

SEQ ID NO: 160223 - DNA, 20 bp, Artificial Sequence
  Synthetic oligonucleotide; GGG chr2 60478363 60478382 60478379 +
cccctcccactgccacctca

SEQ ID NO: 160224 - DNA, 20 bp, Artificial Sequence
  Synthetic oligonucleotide; CGG chr2 60478369 60478388 60478385 +
ccactgccacctcagggccg

SEQ ID NO: 160225 - DNA, 20 bp, Artificial Sequence
  Synthetic oligonucleotide; CAG chr2 60478372 60478391 60478388 +
ctgccacctcagggccgcgg

SEQ ID NO: 160226 - DNA, 20 bp, Artificial Sequence
  Synthetic oligonucleotide; TGG chr2 60478387 60478406 60478403 +
cgcggcagaaacctgtcgtc

SEQ ID NO: 160227 - DNA, 20 bp, Artificial Sequence
  Synthetic oligonucleotide; TGG chr2 60478394 60478413 60478410 +
gaaacctgtcgtctggacac

SEQ ID NO: 160228 - DNA, 20 bp, Artificial Sequence
  Synthetic oligonucleotide; CAG chr2 60478402 60478421 60478418 +
tcgtctggacactggtcata

SEQ ID NO: 160229 - DNA, 20 bp, Artificial Sequence
  Synthetic oligonucleotide; CAG chr2 60478412 60478431 60478428 +
actggtcatacagccccttt

SEQ ID NO: 160230 - DNA, 20 bp, Artificial Sequence
  Synthetic oligonucleotide; AGG chr2 60478413 60478432 60478429 +
ctggtcatacagcccctttc

SEQ ID NO: 160231 - DNA, 20 bp, Artificial Sequence
  Synthetic oligonucleotide; TGG chr2 60478437 60478456 60478453 +
aatctcctcacttgcctttc

SEQ ID NO: 160232 - DNA, 20 bp, Artificial Sequence
  Synthetic oligonucleotide; GAG chr2 60478447 60478466 60478463 +
cttgcctttctggcactatt

SEQ ID NO: 160233 - DNA, 20 bp, Artificial Sequence
  Synthetic oligonucleotide; TGG chr2 60478454 60478473 60478470 +
ttctggcactattgagtgac

SEQ ID NO: 160234 - DNA, 20 bp, Artificial Sequence
  Synthetic oligonucleotide; TGG chr2 60478461 60478480 60478477 +
actattgagtgactggtgtg

SEQ ID NO: 160235 - DNA, 20 bp, Artificial Sequence
  Synthetic oligonucleotide; CAG chr2 60478468 60478487 60478484 +
agtgactggtgtgtggactt

SEQ ID NO: 160236 - DNA, 20 bp, Artificial Sequence
  Synthetic oligonucleotide; AGG chr2 60478469 60478488 60478485 +
gtgactggtgtgtggacttc

SEQ ID NO: 160237 - DNA, 20 bp, Artificial Sequence
  Synthetic oligonucleotide; GGG chr2 60478470 60478489 60478486 +
tgactggtgtgtggacttca

SEQ ID NO: 160238 - DNA, 20 bp, Artificial Sequence
  Synthetic oligonucleotide; GGG chr2 60478471 60478490 60478487 +
gactggtgtgtggacttcag

SEQ ID NO: 160239 - DNA, 20 bp, Artificial Sequence
  Synthetic oligonucleotide; AAG chr2 60478474 60478493 60478490 +
tggtgtgtggacttcagggg

SEQ ID NO: 160240 - DNA, 20 bp, Artificial Sequence
  Synthetic oligonucleotide; TGG chr2 60478479 60478498 60478495 +
tgtggacttcaggggaagcg

SEQ ID NO: 160241 - DNA, 20 bp, Artificial Sequence
  Synthetic oligonucleotide; AAG chr2 60478482 60478501 60478498 +
ggacttcaggggaagcgtgg

SEQ ID NO: 160242 - DNA, 20 bp, Artificial Sequence
  Synthetic oligonucleotide; AGG chr2 60478483 60478502 60478499 +
gacttcaggggaagcgtgga

SEQ ID NO: 160243 - DNA, 20 bp, Artificial Sequence
  Synthetic oligonucleotide; CAG chr2 60478493 60478512 60478509 +
gaagcgtggaaggcacttca

SEQ ID NO: 160244 - DNA, 20 bp, Artificial Sequence
  Synthetic oligonucleotide; AGG chr2 60478494 60478513 60478510 +
aagcgtggaaggcacttcac

SEQ ID NO: 160245 - DNA, 20 bp, Artificial Sequence
  Synthetic oligonucleotide; CAG chr2 60478512 60478531 60478528 +
acaggcctaatactctgtga

SEQ ID NO: 160246 - DNA, 20 bp, Artificial Sequence
  Synthetic oligonucleotide; TGG chr2 60478518 60478537 60478534 +
ctaatactctgtgacagtct

SEQ ID NO: 160247 - DNA, 20 bp, Artificial Sequence
  Synthetic oligonucleotide; AAG chr2 60478523 60478542 60478539 +
actctgtgacagtcttggcc

SEQ ID NO: 160248 - DNA, 20 bp, Artificial Sequence
  Synthetic oligonucleotide; GAG chr2 60478525 60478544 60478541 +
tctgtgacagtcttggccaa

SEQ ID NO: 160249 - DNA, 20 bp, Artificial Sequence
  Synthetic oligonucleotide; GAG chr2 60478533 60478552 60478549 +
agtcttggccaagagattct

SEQ ID NO: 160250 - DNA, 20 bp, Artificial Sequence
  Synthetic oligonucleotide; CAG chr2 60478539 60478558 60478555 +
ggccaagagattctgagaac

SEQ ID NO: 160251 - DNA, 20 bp, Artificial Sequence
  Synthetic oligonucleotide; TGG chr2 60478545 60478564 60478561 +
gagattctgagaaccagaac

SEQ ID NO: 160252 - DNA, 20 bp, Artificial Sequence
  Synthetic oligonucleotide; CAG chr2 60478556 60478575 60478572 +
aaccagaactggccattctc

SEQ ID NO: 160253 - DNA, 20 bp, Artificial Sequence
  Synthetic oligonucleotide; TGG chr2 60478581 60478600 60478597 +
ttaaaacctattatgtccta

SEQ ID NO: 160254 - DNA, 20 bp, Artificial Sequence
  Synthetic oligonucleotide; CAG chr2 60478590 60478609 60478606 +
attatgtcctatggttaaca

SEQ ID NO: 160255 - DNA, 20 bp, Artificial Sequence
  Synthetic oligonucleotide; GAG chr2 60478592 60478611 60478608 +
tatgtcctatggttaacaca

SEQ ID NO: 160256 - DNA, 20 bp, Artificial Sequence
  Synthetic oligonucleotide; CAG chr2 60478600 60478619 60478616 +
atggttaacacagagctgct

SEQ ID NO: 160257 - DNA, 20 bp, Artificial Sequence
  Synthetic oligonucleotide; GAG chr2 60478610 60478629 60478626 +
cagagctgctcagaaattat

SEQ ID NO: 160258 - DNA, 20 bp, Artificial Sequence
  Synthetic oligonucleotide; AAG chr2 60478622 60478641 60478638 +
gaaattatgagaactaattt

SEQ ID NO: 160259 - DNA, 20 bp, Artificial Sequence
  Synthetic oligonucleotide; AGG chr2 60478623 60478642 60478639 +
aaattatgagaactaattta

SEQ ID NO: 160260 - DNA, 20 bp, Artificial Sequence
  Synthetic oligonucleotide; AAG chr2 60478631 60478650 60478647 +
agaactaatttaaggcttca

SEQ ID NO: 160261 - DNA, 20 bp, Artificial Sequence
  Synthetic oligonucleotide; TGG chr2 60478649 60478668 60478665 +
caaagctctaccaaaaaaaa

SEQ ID NO: 160262 - DNA, 20 bp, Artificial Sequence
  Synthetic oligonucleotide; TAG chr2 60478654 60478673 60478670 +
ctctaccaaaaaaaatggtc

SEQ ID NO: 160263 - DNA, 20 bp, Artificial Sequence
  Synthetic oligonucleotide; CAG chr2 60478657 60478676 60478673 +
taccaaaaaaaatggtctag

SEQ ID NO: 160264 - DNA, 20 bp, Artificial Sequence
  Synthetic oligonucleotide; AGG chr2 60478658 60478677 60478674 +
accaaaaaaaatggtctagc

SEQ ID NO: 160265 - DNA, 20 bp, Artificial Sequence
  Synthetic oligonucleotide; CAG chr2 60478662 60478681 60478678 +
aaaaaaatggtctagcaggt

SEQ ID NO: 160266 - DNA, 20 bp, Artificial Sequence
  Synthetic oligonucleotide; AGG chr2 60478663 60478682 60478679 +
aaaaaatggtctagcaggtc

SEQ ID NO: 160267 - DNA, 20 bp, Artificial Sequence
  Synthetic oligonucleotide; CAG chr2 60478680 60478699 60478696 +
gtcaggctctaacatttctt

SEQ ID NO: 160268 - DNA, 20 bp, Artificial Sequence
  Synthetic oligonucleotide; AGG chr2 60478681 60478700 60478697 +
tcaggctctaacatttcttc

SEQ ID NO: 160269 - DNA, 20 bp, Artificial Sequence
  Synthetic oligonucleotide; TAG chr2 60478692 60478711 60478708 +
catttcttcaggaataaaac

SEQ ID NO: 160270 - DNA, 20 bp, Artificial Sequence
  Synthetic oligonucleotide; AGG chr2 60478693 60478712 60478709 +
atttcttcaggaataaaact

SEQ ID NO: 160271 - DNA, 20 bp, Artificial Sequence
  Synthetic oligonucleotide; GAG chr2 60478710 60478729 60478726 +
actaggctgccctctcgcct

SEQ ID NO: 160272 - DNA, 20 bp, Artificial Sequence
  Synthetic oligonucleotide; AGG chr2 60478711 60478730 60478727 +
ctaggctgccctctcgcctg

SEQ ID NO: 160273 - DNA, 20 bp, Artificial Sequence
  Synthetic oligonucleotide; GAG chr2 60478715 60478734 60478731 +
gctgccctctcgcctgaggt

SEQ ID NO: 160274 - DNA, 20 bp, Artificial Sequence
  Synthetic oligonucleotide; AGG chr2 60478716 60478735 60478732 +
ctgccctctcgcctgaggtg

SEQ ID NO: 160275 - DNA, 20 bp, Artificial Sequence
  Synthetic oligonucleotide; AAG chr2 60478726 60478745 60478742 +
gcctgaggtgaggctgaatg

SEQ ID NO: 160276 - DNA, 20 bp, Artificial Sequence
  Synthetic oligonucleotide; AGG chr2 60478727 60478746 60478743 +
cctgaggtgaggctgaatga

SEQ ID NO: 160277 - DNA, 20 bp, Artificial Sequence
  Synthetic oligonucleotide; GAG chr2 60478729 60478748 60478745 +
tgaggtgaggctgaatgaag

SEQ ID NO: 160278 - DNA, 20 bp, Artificial Sequence
  Synthetic oligonucleotide; TGG chr2 60478737 60478756 60478753 +
ggctgaatgaaggagcgctc

SEQ ID NO: 160279 - DNA, 20 bp, Artificial Sequence
  Synthetic oligonucleotide; GAG chr2 60478746 60478765 60478762 +
aaggagcgctctggtgctgc

SEQ ID NO: 160280 - DNA, 20 bp, Artificial Sequence
  Synthetic oligonucleotide; AGG chr2 60478747 60478766 60478763 +
aggagcgctctggtgctgcg

SEQ ID NO: 160281 - DNA, 20 bp, Artificial Sequence
  Synthetic oligonucleotide; CAG chr2 60478751 60478770 60478767 +
gcgctctggtgctgcgaggc

SEQ ID NO: 160282 - DNA, 20 bp, Artificial Sequence
  Synthetic oligonucleotide; AGG chr2 60478752 60478771 60478768 +
cgctctggtgctgcgaggcc

SEQ ID NO: 160283 - DNA, 20 bp, Artificial Sequence
  Synthetic oligonucleotide; CGG chr2 60478768 60478787 60478784 +
ggccaggcctcctcccatga

SEQ ID NO: 160284 - DNA, 20 bp, Artificial Sequence
  Synthetic oligonucleotide; AAG chr2 60478772 60478791 60478788 +
aggcctcctcccatgacggc

SEQ ID NO: 160285 - DNA, 20 bp, Artificial Sequence
  Synthetic oligonucleotide; CAG chr2 60478784 60478803 60478800 +
atgacggcaagtccttcttt

SEQ ID NO: 160286 - DNA, 20 bp, Artificial Sequence
  Synthetic oligonucleotide; CAG chr2 60478791 60478810 60478807 +
caagtccttctttcagaaaa

SEQ ID NO: 160287 - DNA, 20 bp, Artificial Sequence
  Synthetic oligonucleotide; AGG chr2 60478792 60478811 60478808 +
aagtccttctttcagaaaac

SEQ ID NO: 160288 - DNA, 20 bp, Artificial Sequence
  Synthetic oligonucleotide; CGG chr2 60478803 60478822 60478819 +
tcagaaaacaggcctctgcc

SEQ ID NO: 160289 - DNA, 20 bp, Artificial Sequence
  Synthetic oligonucleotide; GGG chr2 60478804 60478823 60478820 +
cagaaaacaggcctctgccc

SEQ ID NO: 160290 - DNA, 20 bp, Artificial Sequence
  Synthetic oligonucleotide; GGG chr2 60478805 60478824 60478821 +
agaaaacaggcctctgcccg

SEQ ID NO: 160291 - DNA, 20 bp, Artificial Sequence
  Synthetic oligonucleotide; CAG chr2 60478815 60478834 60478831 +
cctctgcccggggcatgctg

SEQ ID NO: 160292 - DNA, 20 bp, Artificial Sequence
  Synthetic oligonucleotide; CAG chr2 60478829 60478848 60478845 +
atgctgcagctgcttctctg

SEQ ID NO: 160293 - DNA, 20 bp, Artificial Sequence
  Synthetic oligonucleotide; CAG chr2 60478837 60478856 60478853 +
gctgcttctctgcagtgcct

SEQ ID NO: 160294 - DNA, 20 bp, Artificial Sequence
  Synthetic oligonucleotide; CAG chr2 60478855 60478874 60478871 +
ctcagcaccttcccgcctcc

SEQ ID NO: 160295 - DNA, 20 bp, Artificial Sequence
  Synthetic oligonucleotide; AGG chr2 60478856 60478875 60478872 +
tcagcaccttcccgcctccc

SEQ ID NO: 160296 - DNA, 20 bp, Artificial Sequence
  Synthetic oligonucleotide; CAG chr2 60478863 60478882 60478879 +
cttcccgcctcccaggcaca

SEQ ID NO: 160297 - DNA, 20 bp, Artificial Sequence
  Synthetic oligonucleotide; CAG chr2 60478866 60478885 60478882 +
cccgcctcccaggcacacag

SEQ ID NO: 160298 - DNA, 20 bp, Artificial Sequence
  Synthetic oligonucleotide; CAG chr2 60478871 60478890 60478887 +
ctcccaggcacacagcagcc

SEQ ID NO: 160299 - DNA, 20 bp, Artificial Sequence
  Synthetic oligonucleotide; CAG chr2 60478877 60478896 60478893 +
ggcacacagcagcccagcct

SEQ ID NO: 160300 - DNA, 20 bp, Artificial Sequence
  Synthetic oligonucleotide; TGG chr2 60478892 60478911 60478908 +
agcctcagtcctcatctctc

SEQ ID NO: 160301 - DNA, 20 bp, Artificial Sequence
  Synthetic oligonucleotide; AAG chr2 60478897 60478916 60478913 +
cagtcctcatctctctggca

SEQ ID NO: 160302 - DNA, 20 bp, Artificial Sequence
  Synthetic oligonucleotide; CAG chr2 60478905 60478924 60478921 +
atctctctggcaaagtccca

SEQ ID NO: 160303 - DNA, 20 bp, Artificial Sequence
  Synthetic oligonucleotide; CAG chr2 60478917 60478936 60478933 +
aagtcccacagaacaaaaca

SEQ ID NO: 160304 - DNA, 20 bp, Artificial Sequence
  Synthetic oligonucleotide; AGG chr2 60478918 60478937 60478934 +
agtcccacagaacaaaacac

SEQ ID NO: 160305 - DNA, 20 bp, Artificial Sequence
  Synthetic oligonucleotide; TGG chr2 60478924 60478943 60478940 +
acagaacaaaacacaggcct

SEQ ID NO: 160306 - DNA, 20 bp, Artificial Sequence
  Synthetic oligonucleotide; TGG chr2 60478971 60478990 60478987 +
ttttttttttccctcctccc

SEQ ID NO: 160307 - DNA, 20 bp, Artificial Sequence
  Synthetic oligonucleotide; TGG chr2 60479020 60479039 60479036 +
atttataccactgaccaatc

SEQ ID NO: 160308 - DNA, 20 bp, Artificial Sequence
  Synthetic oligonucleotide; AAG chr2 60479024 60479043 60479040 +
ataccactgaccaatctgga

SEQ ID NO: 160309 - DNA, 20 bp, Artificial Sequence
  Synthetic oligonucleotide; GAG chr2 60479026 60479045 60479042 +
accactgaccaatctggaaa

SEQ ID NO: 160310 - DNA, 20 bp, Artificial Sequence
  Synthetic oligonucleotide; GAG chr2 60479035 60479054 60479051 +
caatctggaaagagttccct

SEQ ID NO: 160311 - DNA, 20 bp, Artificial Sequence
  Synthetic oligonucleotide; TGG chr2 60479043 60479062 60479059 +
aaagagttccctgagcaaat

SEQ ID NO: 160312 - DNA, 20 bp, Artificial Sequence
  Synthetic oligonucleotide; GAG chr2 60479045 60479064 60479061 +
agagttccctgagcaaattg

SEQ ID NO: 160313 - DNA, 20 bp, Artificial Sequence
  Synthetic oligonucleotide; CAG chr2 60479055 60479074 60479071 +
gagcaaattggagatgcccg

SEQ ID NO: 160314 - DNA, 20 bp, Artificial Sequence
  Synthetic oligonucleotide; TGG chr2 60479075 60479094 60479091 +
cagatacaacctgccatcat

SEQ ID NO: 160315 - DNA, 20 bp, Artificial Sequence
  Synthetic oligonucleotide; GAG chr2 60479077 60479096 60479093 +
gatacaacctgccatcattg

SEQ ID NO: 160316 - DNA, 20 bp, Artificial Sequence
  Synthetic oligonucleotide; CAG chr2 60479080 60479099 60479096 +
acaacctgccatcattggag

SEQ ID NO: 160317 - DNA, 20 bp, Artificial Sequence
  Synthetic oligonucleotide; CAG chr2 60479086 60479105 60479102 +
tgccatcattggagcagcct

SEQ ID NO: 160318 - DNA, 20 bp, Artificial Sequence
  Synthetic oligonucleotide; CAG chr2 60479091 60479110 60479107 +
tcattggagcagcctcagtc

SEQ ID NO: 160319 - DNA, 20 bp, Artificial Sequence
  Synthetic oligonucleotide; TGG chr2 60479097 60479116 60479113 +
gagcagcctcagtccagcca

SEQ ID NO: 160320 - DNA, 20 bp, Artificial Sequence
  Synthetic oligonucleotide; GGG chr2 60479098 60479117 60479114 +
agcagcctcagtccagccat

SEQ ID NO: 160321 - DNA, 20 bp, Artificial Sequence
  Synthetic oligonucleotide; GGG chr2 60479099 60479118 60479115 +
gcagcctcagtccagccatg

SEQ ID NO: 160322 - DNA, 20 bp, Artificial Sequence
  Synthetic oligonucleotide; TGG chr2 60479104 60479123 60479120 +
ctcagtccagccatggggtg

SEQ ID NO: 160323 - DNA, 20 bp, Artificial Sequence
  Synthetic oligonucleotide; TGG chr2 60479123 60479142 60479139 +
gtggcactgccgtctgttct

SEQ ID NO: 160324 - DNA, 20 bp, Artificial Sequence
  Synthetic oligonucleotide; GAG chr2 60479152 60479171 60479168 +
taattctgctgattccatat

SEQ ID NO: 160325 - DNA, 20 bp, Artificial Sequence
  Synthetic oligonucleotide; CAG chr2 60479171 60479190 60479187 +
tgagtaacatccaatgttcc

SEQ ID NO: 160326 - DNA, 20 bp, Artificial Sequence
  Synthetic oligonucleotide; AAG chr2 60479182 60479201 60479198 +
caatgttcccagacacctcc

SEQ ID NO: 160327 - DNA, 20 bp, Artificial Sequence
  Synthetic oligonucleotide; CAG chr2 60479198 60479217 60479214 +
ctccaagctcctccaaccaa

SEQ ID NO: 160328 - DNA, 20 bp, Artificial Sequence
  Synthetic oligonucleotide; TAG chr2 60479231 60479250 60479247 +
tcaactcctttctacccacc

SEQ ID NO: 160329 - DNA, 20 bp, Artificial Sequence
  Synthetic oligonucleotide; CAG chr2 60479234 60479253 60479250 +
actcctttctacccacctag

SEQ ID NO: 160330 - DNA, 20 bp, Artificial Sequence
  Synthetic oligonucleotide; AGG chr2 60479235 60479254 60479251 +
ctcctttctacccacctagc

SEQ ID NO: 160331 - DNA, 20 bp, Artificial Sequence
  Synthetic oligonucleotide; TGG chr2 60479244 60479263 60479260 +
acccacctagcaggtccacg

SEQ ID NO: 160332 - DNA, 20 bp, Artificial Sequence
  Synthetic oligonucleotide; GGG chr2 60479245 60479264 60479261 +
cccacctagcaggtccacgt

SEQ ID NO: 160333 - DNA, 20 bp, Artificial Sequence
  Synthetic oligonucleotide; GGG chr2 60479246 60479265 60479262 +
ccacctagcaggtccacgtg

SEQ ID NO: 160334 - DNA, 20 bp, Artificial Sequence
  Synthetic oligonucleotide; CAG chr2 60479252 60479271 60479268 +
agcaggtccacgtggggact

SEQ ID NO: 160335 - DNA, 20 bp, Artificial Sequence
  Synthetic oligonucleotide; TGG chr2 60479259 60479278 60479275 +
ccacgtggggactcagccta

SEQ ID NO: 160336 - DNA, 20 bp, Artificial Sequence
  Synthetic oligonucleotide; TGG chr2 60479267 60479286 60479283 +
ggactcagcctatggacacc

SEQ ID NO: 160337 - DNA, 20 bp, Artificial Sequence
  Synthetic oligonucleotide; CGG chr2 60479276 60479295 60479292 +
ctatggacacctggcctctg

SEQ ID NO: 160338 - DNA, 20 bp, Artificial Sequence
  Synthetic oligonucleotide; GGG chr2 60479277 60479296 60479293 +
tatggacacctggcctctgc

SEQ ID NO: 160339 - DNA, 20 bp, Artificial Sequence
  Synthetic oligonucleotide; CAG chr2 60479282 60479301 60479298 +
acacctggcctctgcgggca

SEQ ID NO: 160340 - DNA, 20 bp, Artificial Sequence
  Synthetic oligonucleotide; CGG chr2 60479285 60479304 60479301 +
cctggcctctgcgggcacag

SEQ ID NO: 160341 - DNA, 20 bp, Artificial Sequence
  Synthetic oligonucleotide; CGG chr2 60479298 60479317 60479314 +
ggcacagcggccacacacca

SEQ ID NO: 160342 - DNA, 20 bp, Artificial Sequence
  Synthetic oligonucleotide; TGG chr2 60479301 60479320 60479317 +
acagcggccacacaccacgg

SEQ ID NO: 160343 - DNA, 20 bp, Artificial Sequence
  Synthetic oligonucleotide; GGG chr2 60479302 60479321 60479318 +
cagcggccacacaccacggt

SEQ ID NO: 160344 - DNA, 20 bp, Artificial Sequence
  Synthetic oligonucleotide; CGG chr2 60479308 60479327 60479324 +
ccacacaccacggtgggacc

SEQ ID NO: 160345 - DNA, 20 bp, Artificial Sequence
  Synthetic oligonucleotide; GAG chr2 60479310 60479329 60479326 +
acacaccacggtgggacccg

SEQ ID NO: 160346 - DNA, 20 bp, Artificial Sequence
  Synthetic oligonucleotide; GAG chr2 60479328 60479347 60479344 +
cggagaccattttttgtttt

SEQ ID NO: 160347 - DNA, 20 bp, Artificial Sequence
  Synthetic oligonucleotide; AAG chr2 60479338 60479357 60479354 +
tttttgttttgagtctctct

SEQ ID NO: 160348 - DNA, 20 bp, Artificial Sequence
  Synthetic oligonucleotide; TGG chr2 60479347 60479366 60479363 +
tgagtctctctaagactgct

SEQ ID NO: 160349 - DNA, 20 bp, Artificial Sequence
  Synthetic oligonucleotide; GGG chr2 60479348 60479367 60479364 +
gagtctctctaagactgctt

SEQ ID NO: 160350 - DNA, 20 bp, Artificial Sequence
  Synthetic oligonucleotide; GAG chr2 60479355 60479374 60479371 +
tctaagactgcttgggaaat

SEQ ID NO: 160351 - DNA, 20 bp, Artificial Sequence
  Synthetic oligonucleotide; AGG chr2 60479356 60479375 60479372 +
ctaagactgcttgggaaatg

SEQ ID NO: 160352 - DNA, 20 bp, Artificial Sequence
  Synthetic oligonucleotide; CAG chr2 60479364 60479383 60479380 +
gcttgggaaatgaggtctct

SEQ ID NO: 160353 - DNA, 20 bp, Artificial Sequence
  Synthetic oligonucleotide; AGG chr2 60479365 60479384 60479381 +
cttgggaaatgaggtctctc

SEQ ID NO: 160354 - DNA, 20 bp, Artificial Sequence
  Synthetic oligonucleotide; TAG chr2 60479370 60479389 60479386 +
gaaatgaggtctctcaggtc

SEQ ID NO: 160355 - DNA, 20 bp, Artificial Sequence
  Synthetic oligonucleotide; CAG chr2 60479383 60479402 60479399 +
tcaggtctagcatttccacg

SEQ ID NO: 160356 - DNA, 20 bp, Artificial Sequence
  Synthetic oligonucleotide; GAG chr2 60479396 60479415 60479412 +
ttccacgcagtcccaaccat

SEQ ID NO: 160357 - DNA, 20 bp, Artificial Sequence
  Synthetic oligonucleotide; AGG chr2 60479397 60479416 60479413 +
tccacgcagtcccaaccatg

SEQ ID NO: 160358 - DNA, 20 bp, Artificial Sequence
  Synthetic oligonucleotide; CAG chr2 60479405 60479424 60479421 +
gtcccaaccatgaggctgac

SEQ ID NO: 160359 - DNA, 20 bp, Artificial Sequence
  Synthetic oligonucleotide; GAG chr2 60479407 60479426 60479423 +
cccaaccatgaggctgacca

SEQ ID NO: 160360 - DNA, 20 bp, Artificial Sequence
  Synthetic oligonucleotide; AGG chr2 60479408 60479427 60479424 +
ccaaccatgaggctgaccag

SEQ ID NO: 160361 - DNA, 20 bp, Artificial Sequence
  Synthetic oligonucleotide; AAG chr2 60479422 60479441 60479438 +
gaccagaggccaccaacgtc

SEQ ID NO: 160362 - DNA, 20 bp, Artificial Sequence
  Synthetic oligonucleotide; CAG chr2 60479431 60479450 60479447 +
ccaccaacgtcaagctctct

SEQ ID NO: 160363 - DNA, 20 bp, Artificial Sequence
  Synthetic oligonucleotide; AGG chr2 60479432 60479451 60479448 +
caccaacgtcaagctctctc

SEQ ID NO: 160364 - DNA, 20 bp, Artificial Sequence
  Synthetic oligonucleotide; TAG chr2 60479440 60479459 60479456 +
tcaagctctctcaggtctac

SEQ ID NO: 160365 - DNA, 20 bp, Artificial Sequence
  Synthetic oligonucleotide; AGG chr2 60479441 60479460 60479457 +
caagctctctcaggtctact

SEQ ID NO: 160366 - DNA, 20 bp, Artificial Sequence
  Synthetic oligonucleotide; CAG chr2 60479446 60479465 60479462 +
tctctcaggtctactaggaa

SEQ ID NO: 160367 - DNA, 20 bp, Artificial Sequence
  Synthetic oligonucleotide; AGG chr2 60479447 60479466 60479463 +
ctctcaggtctactaggaac

SEQ ID NO: 160368 - DNA, 20 bp, Artificial Sequence
  Synthetic oligonucleotide; AAG chr2 60479451 60479470 60479467 +
caggtctactaggaacagga

SEQ ID NO: 160369 - DNA, 20 bp, Artificial Sequence
  Synthetic oligonucleotide; AAG chr2 60479471 60479490 60479487 +
aagaataactctcccttaac

SEQ ID NO: 160370 - DNA, 20 bp, Artificial Sequence
  Synthetic oligonucleotide; CAG chr2 60479479 60479498 60479495 +
ctctcccttaacaagcccct

SEQ ID NO: 160371 - DNA, 20 bp, Artificial Sequence
  Synthetic oligonucleotide; AGG chr2 60479480 60479499 60479496 +
tctcccttaacaagcccctc

SEQ ID NO: 160372 - DNA, 20 bp, Artificial Sequence
  Synthetic oligonucleotide; CAG chr2 60479501 60479520 60479517 +
ggctgaaatccttttgcttc

SEQ ID NO: 160373 - DNA, 20 bp, Artificial Sequence
  Synthetic oligonucleotide; AGG chr2 60479502 60479521 60479518 +
gctgaaatccttttgcttcc

SEQ ID NO: 160374 - DNA, 20 bp, Artificial Sequence
  Synthetic oligonucleotide; GGG chr2 60479503 60479522 60479519 +
ctgaaatccttttgcttcca

SEQ ID NO: 160375 - DNA, 20 bp, Artificial Sequence
  Synthetic oligonucleotide; TGG chr2 60479523 60479542 60479539 +
gggcctcaaccttctactgc

SEQ ID NO: 160376 - DNA, 20 bp, Artificial Sequence
  Synthetic oligonucleotide; GGG chr2 60479524 60479543 60479540 +
ggcctcaaccttctactgct

SEQ ID NO: 160377 - DNA, 20 bp, Artificial Sequence
  Synthetic oligonucleotide; TAG chr2 60479527 60479546 60479543 +
ctcaaccttctactgctggg

SEQ ID NO: 160378 - DNA, 20 bp, Artificial Sequence
  Synthetic oligonucleotide; AAG chr2 60479531 60479550 60479547 +
accttctactgctgggtaga

SEQ ID NO: 160379 - DNA, 20 bp, Artificial Sequence
  Synthetic oligonucleotide; CGG chr2 60479547 60479566 60479563 +
tagaaagccccctctgtcac

SEQ ID NO: 160380 - DNA, 20 bp, Artificial Sequence
  Synthetic oligonucleotide; CAG chr2 60479554 60479573 60479570 +
ccccctctgtcaccggccca

SEQ ID NO: 160381 - DNA, 20 bp, Artificial Sequence
  Synthetic oligonucleotide; CAG chr2 60479561 60479580 60479577 +
tgtcaccggcccacagatct

SEQ ID NO: 160382 - DNA, 20 bp, Artificial Sequence
  Synthetic oligonucleotide; CAG chr2 60479587 60479606 60479603 +
ccatcgcactcaaaccctgt

SEQ ID NO: 160383 - DNA, 20 bp, Artificial Sequence
  Synthetic oligonucleotide; AGG chr2 60479588 60479607 60479604 +
catcgcactcaaaccctgtc

SEQ ID NO: 160384 - DNA, 20 bp, Artificial Sequence
  Synthetic oligonucleotide; CGG chr2 60479591 60479610 60479607 +
cgcactcaaaccctgtcagg

SEQ ID NO: 160385 - DNA, 20 bp, Artificial Sequence
  Synthetic oligonucleotide; TGG chr2 60479594 60479613 60479610 +
actcaaaccctgtcaggcgg

SEQ ID NO: 160386 - DNA, 20 bp, Artificial Sequence
  Synthetic oligonucleotide; GAG chr2 60479596 60479615 60479612 +
tcaaaccctgtcaggcggtg

SEQ ID NO: 160387 - DNA, 20 bp, Artificial Sequence
  Synthetic oligonucleotide; GAG chr2 60479598 60479617 60479614 +
aaaccctgtcaggcggtgga

SEQ ID NO: 160388 - DNA, 20 bp, Artificial Sequence
  Synthetic oligonucleotide; TGG chr2 60479603 60479622 60479619 +
ctgtcaggcggtggagagtg

SEQ ID NO: 160389 - DNA, 20 bp, Artificial Sequence
  Synthetic oligonucleotide; CGG chr2 60479607 60479626 60479623 +
caggcggtggagagtgtgga

SEQ ID NO: 160390 - DNA, 20 bp, Artificial Sequence
  Synthetic oligonucleotide; CAG chr2 60479610 60479629 60479626 +
gcggtggagagtgtggacgg

SEQ ID NO: 160391 - DNA, 20 bp, Artificial Sequence
  Synthetic oligonucleotide; AGG chr2 60479611 60479630 60479627 +
cggtggagagtgtggacggc

SEQ ID NO: 160392 - DNA, 20 bp, Artificial Sequence
  Synthetic oligonucleotide; CGG chr2 60479620 60479639 60479636 +
gtgtggacggcaggctgacg

SEQ ID NO: 160393 - DNA, 20 bp, Artificial Sequence
  Synthetic oligonucleotide; AAG chr2 60479628 60479647 60479644 +
ggcaggctgacgcggtttca

SEQ ID NO: 160394 - DNA, 20 bp, Artificial Sequence
  Synthetic oligonucleotide; GAG chr2 60479630 60479649 60479646 +
caggctgacgcggtttcaaa

SEQ ID NO: 160395 - DNA, 20 bp, Artificial Sequence
  Synthetic oligonucleotide; AGG chr2 60479631 60479650 60479647 +
aggctgacgcggtttcaaag

SEQ ID NO: 160396 - DNA, 20 bp, Artificial Sequence
  Synthetic oligonucleotide; CAG chr2 60479639 60479658 60479655 +
gcggtttcaaagaggccgac

SEQ ID NO: 160397 - DNA, 20 bp, Artificial Sequence
  Synthetic oligonucleotide; AGG chr2 60479640 60479659 60479656 +
cggtttcaaagaggccgacc

SEQ ID NO: 160398 - DNA, 20 bp, Artificial Sequence
  Synthetic oligonucleotide; AAG chr2 60479644 60479663 60479660 +
ttcaaagaggccgaccaggc

SEQ ID NO: 160399 - DNA, 20 bp, Artificial Sequence
  Synthetic oligonucleotide; CAG chr2 60479668 60479687 60479684 +
accgtcctgtactcctgccc

SEQ ID NO: 160400 - DNA, 20 bp, Artificial Sequence
  Synthetic oligonucleotide; AAG chr2 60479708 60479727 60479724 +
gtcttttatcaatgtaattc

SEQ ID NO: 160401 - DNA, 20 bp, Artificial Sequence
  Synthetic oligonucleotide; AGG chr2 60479709 60479728 60479725 +
tcttttatcaatgtaattca

SEQ ID NO: 160402 - DNA, 20 bp, Artificial Sequence
  Synthetic oligonucleotide; AAG chr2 60479714 60479733 60479730 +
tatcaatgtaattcaaggca

SEQ ID NO: 160403 - DNA, 20 bp, Artificial Sequence
  Synthetic oligonucleotide; GAG chr2 60479716 60479735 60479732 +
tcaatgtaattcaaggcaaa

SEQ ID NO: 160404 - DNA, 20 bp, Artificial Sequence
  Synthetic oligonucleotide; AAG chr2 60479721 60479740 60479737 +
gtaattcaaggcaaagagtc

SEQ ID NO: 160405 - DNA, 20 bp, Artificial Sequence
  Synthetic oligonucleotide; AGG chr2 60479722 60479741 60479738 +
taattcaaggcaaagagtca

SEQ ID NO: 160406 - DNA, 20 bp, Artificial Sequence
  Synthetic oligonucleotide; GGG chr2 60479723 60479742 60479739 +
aattcaaggcaaagagtcaa

SEQ ID NO: 160407 - DNA, 20 bp, Artificial Sequence
  Synthetic oligonucleotide; AAG chr2 60479741 60479760 60479757 +
aagggtctgtcaccatttta

SEQ ID NO: 160408 - DNA, 20 bp, Artificial Sequence
  Synthetic oligonucleotide; GAG chr2 60479743 60479762 60479759 +
gggtctgtcaccattttaaa

SEQ ID NO: 160409 - DNA, 20 bp, Artificial Sequence
  Synthetic oligonucleotide; AGG chr2 60479744 60479763 60479760 +
ggtctgtcaccattttaaag

SEQ ID NO: 160410 - DNA, 20 bp, Artificial Sequence
  Synthetic oligonucleotide; TGG chr2 60479756 60479775 60479772 +
ttttaaagaggcttattaca

SEQ ID NO: 160411 - DNA, 20 bp, Artificial Sequence
  Synthetic oligonucleotide; CAG chr2 60479775 60479794 60479791 +
atggccacaaaaatttgcct

SEQ ID NO: 160412 - DNA, 20 bp, Artificial Sequence
  Synthetic oligonucleotide; AGG chr2 60479776 60479795 60479792 +
tggccacaaaaatttgcctc

SEQ ID NO: 160413 - DNA, 20 bp, Artificial Sequence
  Synthetic oligonucleotide; TGG chr2 60479787 60479806 60479803 +
atttgcctcaggctcaaacc

SEQ ID NO: 160414 - DNA, 20 bp, Artificial Sequence
  Synthetic oligonucleotide; AAG chr2 60479795 60479814 60479811 +
caggctcaaacctggcatgt

SEQ ID NO: 160415 - DNA, 20 bp, Artificial Sequence
  Synthetic oligonucleotide; AGG chr2 60479796 60479815 60479812 +
aggctcaaacctggcatgta

SEQ ID NO: 160416 - DNA, 20 bp, Artificial Sequence
  Synthetic oligonucleotide; CAG chr2 60479802 60479821 60479818 +
aaacctggcatgtaaggtat

SEQ ID NO: 160417 - DNA, 20 bp, Artificial Sequence
  Synthetic oligonucleotide; TGG chr2 60479807 60479826 60479823 +
tggcatgtaaggtatcagcg

SEQ ID NO: 160418 - DNA, 20 bp, Artificial Sequence
  Synthetic oligonucleotide; GGG chr2 60479808 60479827 60479824 +
ggcatgtaaggtatcagcgt

SEQ ID NO: 160419 - DNA, 20 bp, Artificial Sequence
  Synthetic oligonucleotide; CAG chr2 60479812 60479831 60479828 +
tgtaaggtatcagcgtggga

SEQ ID NO: 160420 - DNA, 20 bp, Artificial Sequence
  Synthetic oligonucleotide; AGG chr2 60479813 60479832 60479829 +
gtaaggtatcagcgtgggac

SEQ ID NO: 160421 - DNA, 20 bp, Artificial Sequence
  Synthetic oligonucleotide; TGG chr2 60479901 60479920 60479917 +
accaaccgttttttgattta

SEQ ID NO: 160422 - DNA, 20 bp, Artificial Sequence
  Synthetic oligonucleotide; GGG chr2 60479902 60479921 60479918 +
ccaaccgttttttgatttat

SEQ ID NO: 160423 - DNA, 20 bp, Artificial Sequence
  Synthetic oligonucleotide; GGG chr2 60479903 60479922 60479919 +
caaccgttttttgatttatg

SEQ ID NO: 160424 - DNA, 20 bp, Artificial Sequence
  Synthetic oligonucleotide; GAG chr2 60479905 60479924 60479921 +
accgttttttgatttatggg

SEQ ID NO: 160425 - DNA, 20 bp, Artificial Sequence
  Synthetic oligonucleotide; AGG chr2 60479906 60479925 60479922 +
ccgttttttgatttatgggg

SEQ ID NO: 160426 - DNA, 20 bp, Artificial Sequence
  Synthetic oligonucleotide; GAG chr2 60479908 60479927 60479924 +
gttttttgatttatggggag

SEQ ID NO: 160427 - DNA, 20 bp, Artificial Sequence
  Synthetic oligonucleotide; AGG chr2 60479909 60479928 60479925 +
ttttttgatttatggggagg

SEQ ID NO: 160428 - DNA, 20 bp, Artificial Sequence
  Synthetic oligonucleotide; AAG chr2 60479913 60479932 60479929 +
ttgatttatggggaggagga

SEQ ID NO: 160429 - DNA, 20 bp, Artificial Sequence
  Synthetic oligonucleotide; AAG chr2 60479923 60479942 60479939 +
gggaggaggaaagaaatctg

SEQ ID NO: 160430 - DNA, 20 bp, Artificial Sequence
  Synthetic oligonucleotide; CAG chr2 60479930 60479949 60479946 +
ggaaagaaatctgaagttga

SEQ ID NO: 160431 - DNA, 20 bp, Artificial Sequence
  Synthetic oligonucleotide; AGG chr2 60479931 60479950 60479947 +
gaaagaaatctgaagttgac

SEQ ID NO: 160432 - DNA, 20 bp, Artificial Sequence
  Synthetic oligonucleotide; TGG chr2 60479935 60479954 60479951 +
gaaatctgaagttgacaggt

SEQ ID NO: 160433 - DNA, 20 bp, Artificial Sequence
  Synthetic oligonucleotide; GGG chr2 60479936 60479955 60479952 +
aaatctgaagttgacaggtt

SEQ ID NO: 160434 - DNA, 20 bp, Artificial Sequence
  Synthetic oligonucleotide; CAG chr2 60479950 60479969 60479966 +
caggttgggacaactccact

SEQ ID NO: 160435 - DNA, 20 bp, Artificial Sequence
  Synthetic oligonucleotide; AAG chr2 60479966 60479985 60479982 +
cactcagctttctcactcaa

SEQ ID NO: 160436 - DNA, 20 bp, Artificial Sequence
  Synthetic oligonucleotide; TGG chr2 60479999 60480018 60480015 +
taaatcatactttgcattta

SEQ ID NO: 160437 - DNA, 20 bp, Artificial Sequence
  Synthetic oligonucleotide; CGG chr2 60480006 60480025 60480022 +
tactttgcatttatggcctg

SEQ ID NO: 160438 - DNA, 20 bp, Artificial Sequence
  Synthetic oligonucleotide; TGG chr2 60480013 60480032 60480029 +
catttatggcctgcggctct

SEQ ID NO: 160439 - DNA, 20 bp, Artificial Sequence
  Synthetic oligonucleotide; TGG chr2 60480023 60480042 60480039 +
ctgcggctcttggctgactt

SEQ ID NO: 160440 - DNA, 20 bp, Artificial Sequence
  Synthetic oligonucleotide; CGG chr2 60480026 60480045 60480042 +
cggctcttggctgactttgg

SEQ ID NO: 160441 - DNA, 20 bp, Artificial Sequence
  Synthetic oligonucleotide; CGG chr2 60480035 60480054 60480051 +
gctgactttggcggctcctc

SEQ ID NO: 160442 - DNA, 20 bp, Artificial Sequence
  Synthetic oligonucleotide; TGG chr2 60480040 60480059 60480056 +
ctttggcggctcctccggtg

SEQ ID NO: 160443 - DNA, 20 bp, Artificial Sequence
  Synthetic oligonucleotide; GAG chr2 60480042 60480061 60480058 +
ttggcggctcctccggtgtg

SEQ ID NO: 160444 - DNA, 20 bp, Artificial Sequence
  Synthetic oligonucleotide; AAG chr2 60480046 60480065 60480062 +
cggctcctccggtgtggagc

SEQ ID NO: 160445 - DNA, 20 bp, Artificial Sequence
  Synthetic oligonucleotide; TGG chr2 60480052 60480071 60480068 +
ctccggtgtggagcaagctg

SEQ ID NO: 160446 - DNA, 20 bp, Artificial Sequence
  Synthetic oligonucleotide; CGG chr2 60480062 60480081 60480078 +
gagcaagctgtggacttccc

SEQ ID NO: 160447 - DNA, 20 bp, Artificial Sequence
  Synthetic oligonucleotide; GGG chr2 60480063 60480082 60480079 +
agcaagctgtggacttcccc

SEQ ID NO: 160448 - DNA, 20 bp, Artificial Sequence
  Synthetic oligonucleotide; GAG chr2 60480065 60480084 60480081 +
caagctgtggacttccccgg

SEQ ID NO: 160449 - DNA, 20 bp, Artificial Sequence
  Synthetic oligonucleotide; AGG chr2 60480066 60480085 60480082 +
aagctgtggacttccccggg

SEQ ID NO: 160450 - DNA, 20 bp, Artificial Sequence
  Synthetic oligonucleotide; GAG chr2 60480068 60480087 60480084 +
gctgtggacttccccgggag

SEQ ID NO: 160451 - DNA, 20 bp, Artificial Sequence
  Synthetic oligonucleotide; AGG chr2 60480069 60480088 60480085 +
ctgtggacttccccgggagg

SEQ ID NO: 160452 - DNA, 20 bp, Artificial Sequence
  Synthetic oligonucleotide; GAG chr2 60480079 60480098 60480095 +
ccccgggaggaggccccact

SEQ ID NO: 160453 - DNA, 20 bp, Artificial Sequence
  Synthetic oligonucleotide; AAG chr2 60480103 60480122 60480119 +
tgactgccccactctgcacc

SEQ ID NO: 160454 - DNA, 20 bp, Artificial Sequence
  Synthetic oligonucleotide; AGG chr2 60480104 60480123 60480120 +
gactgccccactctgcacca

SEQ ID NO: 160455 - DNA, 20 bp, Artificial Sequence
  Synthetic oligonucleotide; CAG chr2 60480108 60480127 60480124 +
gccccactctgcaccaagga

SEQ ID NO: 160456 - DNA, 20 bp, Artificial Sequence
  Synthetic oligonucleotide; GAG chr2 60480112 60480131 60480128 +
cactctgcaccaaggacagc

SEQ ID NO: 160457 - DNA, 20 bp, Artificial Sequence
  Synthetic oligonucleotide; AGG chr2 60480113 60480132 60480129 +
actctgcaccaaggacagcg

SEQ ID NO: 160458 - DNA, 20 bp, Artificial Sequence
  Synthetic oligonucleotide; GAG chr2 60480115 60480134 60480131 +
tctgcaccaaggacagcgag

SEQ ID NO: 160459 - DNA, 20 bp, Artificial Sequence
  Synthetic oligonucleotide; AGG chr2 60480116 60480135 60480132 +
ctgcaccaaggacagcgagg

SEQ ID NO: 160460 - DNA, 20 bp, Artificial Sequence
  Synthetic oligonucleotide; GGG chr2 60480117 60480136 60480133 +
tgcaccaaggacagcgagga

SEQ ID NO: 160461 - DNA, 20 bp, Artificial Sequence
  Synthetic oligonucleotide; GGG chr2 60480118 60480137 60480134 +
gcaccaaggacagcgaggag

SEQ ID NO: 160462 - DNA, 20 bp, Artificial Sequence
  Synthetic oligonucleotide; GGG chr2 60480119 60480138 60480135 +
caccaaggacagcgaggagg

SEQ ID NO: 160463 - DNA, 20 bp, Artificial Sequence
  Synthetic oligonucleotide; GGG chr2 60480120 60480139 60480136 +
accaaggacagcgaggaggg

SEQ ID NO: 160464 - DNA, 20 bp, Artificial Sequence
  Synthetic oligonucleotide; AAG chr2 60480123 60480142 60480139 +
aaggacagcgaggagggggg

SEQ ID NO: 160465 - DNA, 20 bp, Artificial Sequence
  Synthetic oligonucleotide; AGG chr2 60480124 60480143 60480140 +
aggacagcgaggagggggga

SEQ ID NO: 160466 - DNA, 20 bp, Artificial Sequence
  Synthetic oligonucleotide; TGG chr2 60480127 60480146 60480143 +
acagcgaggaggggggaagg

SEQ ID NO: 160467 - DNA, 20 bp, Artificial Sequence
  Synthetic oligonucleotide; GGG chr2 60480128 60480147 60480144 +
cagcgaggaggggggaaggt

SEQ ID NO: 160468 - DNA, 20 bp, Artificial Sequence
  Synthetic oligonucleotide; GGG chr2 60480129 60480148 60480145 +
agcgaggaggggggaaggtg

SEQ ID NO: 160469 - DNA, 20 bp, Artificial Sequence
  Synthetic oligonucleotide; GGG chr2 60480130 60480149 60480146 +
gcgaggaggggggaaggtgg

SEQ ID NO: 160470 - DNA, 20 bp, Artificial Sequence
  Synthetic oligonucleotide; TGG chr2 60480133 60480152 60480149 +
aggaggggggaaggtggggg

SEQ ID NO: 160471 - DNA, 20 bp, Artificial Sequence
  Synthetic oligonucleotide; GAG chr2 60480135 60480154 60480151 +
gaggggggaaggtgggggtg

SEQ ID NO: 160472 - DNA, 20 bp, Artificial Sequence
  Synthetic oligonucleotide; AGG chr2 60480136 60480155 60480152 +
aggggggaaggtgggggtgg

SEQ ID NO: 160473 - DNA, 20 bp, Artificial Sequence
  Synthetic oligonucleotide; GAG chr2 60480138 60480157 60480154 +
gggggaaggtgggggtggag

SEQ ID NO: 160474 - DNA, 20 bp, Artificial Sequence
  Synthetic oligonucleotide; TGG chr2 60480142 60480161 60480158 +
gaaggtgggggtggaggagc

SEQ ID NO: 160475 - DNA, 20 bp, Artificial Sequence
  Synthetic oligonucleotide; GAG chr2 60480144 60480163 60480160 +
aggtgggggtggaggagctg

SEQ ID NO: 160476 - DNA, 20 bp, Artificial Sequence
  Synthetic oligonucleotide; AGG chr2 60480145 60480164 60480161 +
ggtgggggtggaggagctgg

SEQ ID NO: 160477 - DNA, 20 bp, Artificial Sequence
  Synthetic oligonucleotide; CAG chr2 60480149 60480168 60480165 +
ggggtggaggagctggaggc

SEQ ID NO: 160478 - DNA, 20 bp, Artificial Sequence
  Synthetic oligonucleotide; AGG chr2 60480150 60480169 60480166 +
gggtggaggagctggaggcc

SEQ ID NO: 160479 - DNA, 20 bp, Artificial Sequence
  Synthetic oligonucleotide; GGG chr2 60480151 60480170 60480167 +
ggtggaggagctggaggcca

SEQ ID NO: 160480 - DNA, 20 bp, Artificial Sequence
  Synthetic oligonucleotide; GGG chr2 60480152 60480171 60480168 +
gtggaggagctggaggccag

SEQ ID NO: 160481 - DNA, 20 bp, Artificial Sequence
  Synthetic oligonucleotide; GGG chr2 60480153 60480172 60480169 +
tggaggagctggaggccagg

SEQ ID NO: 160482 - DNA, 20 bp, Artificial Sequence
  Synthetic oligonucleotide; TGG chr2 60480157 60480176 60480173 +
ggagctggaggccagggggc

SEQ ID NO: 160483 - DNA, 20 bp, Artificial Sequence
  Synthetic oligonucleotide; GGG chr2 60480158 60480177 60480174 +
gagctggaggccagggggct

SEQ ID NO: 160484 - DNA, 20 bp, Artificial Sequence
  Synthetic oligonucleotide; GGG chr2 60480159 60480178 60480175 +
agctggaggccagggggctg

SEQ ID NO: 160485 - DNA, 20 bp, Artificial Sequence
  Synthetic oligonucleotide; AAG chr2 60480167 60480186 60480183 +
gccagggggctggggacatg

SEQ ID NO: 160486 - DNA, 20 bp, Artificial Sequence
  Synthetic oligonucleotide; AGG chr2 60480168 60480187 60480184 +
ccagggggctggggacatga

SEQ ID NO: 160487 - DNA, 20 bp, Artificial Sequence
  Synthetic oligonucleotide; TGG chr2 60480174 60480193 60480190 +
ggctggggacatgaaggcac

SEQ ID NO: 160488 - DNA, 20 bp, Artificial Sequence
  Synthetic oligonucleotide; TAG chr2 60480178 60480197 60480194 +
ggggacatgaaggcactggc

SEQ ID NO: 160489 - DNA, 20 bp, Artificial Sequence
  Synthetic oligonucleotide; AGG chr2 60480179 60480198 60480195 +
gggacatgaaggcactggct

SEQ ID NO: 160490 - DNA, 20 bp, Artificial Sequence
  Synthetic oligonucleotide; AAG chr2 60480189 60480208 60480205 +
ggcactggctaggtaacaca

SEQ ID NO: 160491 - DNA, 20 bp, Artificial Sequence
  Synthetic oligonucleotide; AGG chr2 60480190 60480209 60480206 +
gcactggctaggtaacacaa

SEQ ID NO: 160492 - DNA, 20 bp, Artificial Sequence
  Synthetic oligonucleotide; AAG chr2 60480199 60480218 60480215 +
aggtaacacaaaggcctgta

SEQ ID NO: 160493 - DNA, 20 bp, Artificial Sequence
  Synthetic oligonucleotide; AGG chr2 60480200 60480219 60480216 +
ggtaacacaaaggcctgtaa

SEQ ID NO: 160494 - DNA, 20 bp, Artificial Sequence
  Synthetic oligonucleotide; TGG chr2 60480223 60480242 60480239 +
atatgtctctcttctgaacc

SEQ ID NO: 160495 - DNA, 20 bp, Artificial Sequence
  Synthetic oligonucleotide; TGG chr2 60480245 60480264 60480261 +
gctctccactccatttctcc

SEQ ID NO: 160496 - DNA, 20 bp, Artificial Sequence
  Synthetic oligonucleotide; AAG chr2 60480252 60480271 60480268 +
actccatttctcctggatcc

SEQ ID NO: 160497 - DNA, 20 bp, Artificial Sequence
  Synthetic oligonucleotide; CAG chr2 60480267 60480286 60480283 +
gatccaagtctccctgtaat

SEQ ID NO: 160498 - DNA, 20 bp, Artificial Sequence
  Synthetic oligonucleotide; TGG chr2 60480284 60480303 60480300 +
aatcagcatgtatctaccac

SEQ ID NO: 160499 - DNA, 20 bp, Artificial Sequence
  Synthetic oligonucleotide; AAG chr2 60480299 60480318 60480315 +
accactggttctccaactaa

SEQ ID NO: 160500 - DNA, 20 bp, Artificial Sequence
  Synthetic oligonucleotide; AAG chr2 60480305 60480324 60480321 +
ggttctccaactaaaagttc

SEQ ID NO: 160501 - DNA, 20 bp, Artificial Sequence
  Synthetic oligonucleotide; AGG chr2 60480306 60480325 60480322 +
gttctccaactaaaagttca

SEQ ID NO: 160502 - DNA, 20 bp, Artificial Sequence
  Synthetic oligonucleotide; AAG chr2 60480314 60480333 60480330 +
actaaaagttcaaggcttct

SEQ ID NO: 160503 - DNA, 20 bp, Artificial Sequence
  Synthetic oligonucleotide; AAG chr2 60480321 60480340 60480337 +
gttcaaggcttctaagaacc

SEQ ID NO: 160504 - DNA, 20 bp, Artificial Sequence
  Synthetic oligonucleotide; CAG chr2 60480327 60480346 60480343 +
ggcttctaagaaccaagact

SEQ ID NO: 160505 - DNA, 20 bp, Artificial Sequence
  Synthetic oligonucleotide; TGG chr2 60480330 60480349 60480346 +
ttctaagaaccaagactcag

SEQ ID NO: 160506 - DNA, 20 bp, Artificial Sequence
  Synthetic oligonucleotide; CAG chr2 60480349 60480368 60480365 +
gtggtctacctctgactgtc

SEQ ID NO: 160507 - DNA, 20 bp, Artificial Sequence
  Synthetic oligonucleotide; TGG chr2 60480360 60480379 60480376 +
ctgactgtccagcaccatgc

SEQ ID NO: 160508 - DNA, 20 bp, Artificial Sequence
  Synthetic oligonucleotide; GGG chr2 60480361 60480380 60480377 +
tgactgtccagcaccatgct

SEQ ID NO: 160509 - DNA, 20 bp, Artificial Sequence
  Synthetic oligonucleotide; AAG chr2 60480366 60480385 60480382 +
gtccagcaccatgctgggca

SEQ ID NO: 160510 - DNA, 20 bp, Artificial Sequence
  Synthetic oligonucleotide; AAG chr2 60480369 60480388 60480385 +
cagcaccatgctgggcaaag

SEQ ID NO: 160511 - DNA, 20 bp, Artificial Sequence
  Synthetic oligonucleotide; GAG chr2 60480371 60480390 60480387 +
gcaccatgctgggcaaagaa

SEQ ID NO: 160512 - DNA, 20 bp, Artificial Sequence
  Synthetic oligonucleotide; TAG chr2 60480390 60480409 60480406 +
agagcccctcaataaataat

SEQ ID NO: 160513 - DNA, 20 bp, Artificial Sequence
  Synthetic oligonucleotide; AGG chr2 60480391 60480410 60480407 +
gagcccctcaataaataatt

SEQ ID NO: 160514 - DNA, 20 bp, Artificial Sequence
  Synthetic oligonucleotide; AAG chr2 60480398 60480417 60480414 +
tcaataaataattaggattc

SEQ ID NO: 160515 - DNA, 20 bp, Artificial Sequence
  Synthetic oligonucleotide; CAG chr2 60480408 60480427 60480424 +
attaggattcaagcgctgtg

SEQ ID NO: 160516 - DNA, 20 bp, Artificial Sequence
  Synthetic oligonucleotide; TGG chr2 60480428 60480447 60480444 +
cagtgaacttttcttcctgt

SEQ ID NO: 160517 - DNA, 20 bp, Artificial Sequence
  Synthetic oligonucleotide; GAG chr2 60480430 60480449 60480446 +
gtgaacttttcttcctgttg

SEQ ID NO: 160518 - DNA, 20 bp, Artificial Sequence
  Synthetic oligonucleotide; GAG chr2 60480432 60480451 60480448 +
gaacttttcttcctgttgga

SEQ ID NO: 160519 - DNA, 20 bp, Artificial Sequence
  Synthetic oligonucleotide; TGG chr2 60480450 60480469 60480466 +
gagagccattctaaatgacc

SEQ ID NO: 160520 - DNA, 20 bp, Artificial Sequence
  Synthetic oligonucleotide; TGG chr2 60480454 60480473 60480470 +
gccattctaaatgacctggc

SEQ ID NO: 160521 - DNA, 20 bp, Artificial Sequence
  Synthetic oligonucleotide; AAG chr2 60480457 60480476 60480473 +
attctaaatgacctggctgg

SEQ ID NO: 160522 - DNA, 20 bp, Artificial Sequence
  Synthetic oligonucleotide; AGG chr2 60480458 60480477 60480474 +
ttctaaatgacctggctgga

SEQ ID NO: 160523 - DNA, 20 bp, Artificial Sequence
  Synthetic oligonucleotide; CAG chr2 60480463 60480482 60480479 +
aatgacctggctggaaggac

SEQ ID NO: 160524 - DNA, 20 bp, Artificial Sequence
  Synthetic oligonucleotide; AGG chr2 60480464 60480483 60480480 +
atgacctggctggaaggacc

SEQ ID NO: 160525 - DNA, 20 bp, Artificial Sequence
  Synthetic oligonucleotide; TGG chr2 60480470 60480489 60480486 +
tggctggaaggaccaggcca

SEQ ID NO: 160526 - DNA, 20 bp, Artificial Sequence
  Synthetic oligonucleotide; GAG chr2 60480472 60480491 60480488 +
gctggaaggaccaggccatg

SEQ ID NO: 160527 - DNA, 20 bp, Artificial Sequence
  Synthetic oligonucleotide; CAG chr2 60480476 60480495 60480492 +
gaaggaccaggccatggagc

SEQ ID NO: 160528 - DNA, 20 bp, Artificial Sequence
  Synthetic oligonucleotide; CAG chr2 60480479 60480498 60480495 +
ggaccaggccatggagccag

SEQ ID NO: 160529 - DNA, 20 bp, Artificial Sequence
  Synthetic oligonucleotide; CAG chr2 60480486 60480505 60480502 +
gccatggagccagcagtgac

SEQ ID NO: 160530 - DNA, 20 bp, Artificial Sequence
  Synthetic oligonucleotide; AGG chr2 60480487 60480506 60480503 +
ccatggagccagcagtgacc

SEQ ID NO: 160531 - DNA, 20 bp, Artificial Sequence
  Synthetic oligonucleotide; GGG chr2 60480488 60480507 60480504 +
catggagccagcagtgacca

SEQ ID NO: 160532 - DNA, 20 bp, Artificial Sequence
  Synthetic oligonucleotide; GGG chr2 60480489 60480508 60480505 +
atggagccagcagtgaccag

SEQ ID NO: 160533 - DNA, 20 bp, Artificial Sequence
  Synthetic oligonucleotide; TAG chr2 60480502 60480521 60480518 +
tgaccaggggaaaccttccc

SEQ ID NO: 160534 - DNA, 20 bp, Artificial Sequence
  Synthetic oligonucleotide; AAG chr2 60480522 60480541 60480538 +
tagtaaatgattcactaacc

SEQ ID NO: 160535 - DNA, 20 bp, Artificial Sequence
  Synthetic oligonucleotide; AGG chr2 60480523 60480542 60480539 +
agtaaatgattcactaacca

SEQ ID NO: 160536 - DNA, 20 bp, Artificial Sequence
  Synthetic oligonucleotide; GAG chr2 60480525 60480544 60480541 +
taaatgattcactaaccaag

SEQ ID NO: 160537 - DNA, 20 bp, Artificial Sequence
  Synthetic oligonucleotide; TGG chr2 60480532 60480551 60480548 +
ttcactaaccaaggagcctc

SEQ ID NO: 160538 - DNA, 20 bp, Artificial Sequence
  Synthetic oligonucleotide; GGG chr2 60480533 60480552 60480549 +
tcactaaccaaggagcctct

SEQ ID NO: 160539 - DNA, 20 bp, Artificial Sequence
  Synthetic oligonucleotide; CAG chr2 60480537 60480556 60480553 +
taaccaaggagcctctgggt

SEQ ID NO: 160540 - DNA, 20 bp, Artificial Sequence
  Synthetic oligonucleotide; CAG chr2 60480548 60480567 60480564 +
cctctgggtcagccttgacc

SEQ ID NO: 160541 - DNA, 20 bp, Artificial Sequence
  Synthetic oligonucleotide; AGG chr2 60480549 60480568 60480565 +
ctctgggtcagccttgaccc

SEQ ID NO: 160542 - DNA, 20 bp, Artificial Sequence
  Synthetic oligonucleotide; GAG chr2 60480551 60480570 60480567 +
ctgggtcagccttgacccag

SEQ ID NO: 160543 - DNA, 20 bp, Artificial Sequence
  Synthetic oligonucleotide; GAG chr2 60480553 60480572 60480569 +
gggtcagccttgacccagga

SEQ ID NO: 160544 - DNA, 20 bp, Artificial Sequence
  Synthetic oligonucleotide; AGG chr2 60480554 60480573 60480570 +
ggtcagccttgacccaggag

SEQ ID NO: 160545 - DNA, 20 bp, Artificial Sequence
  Synthetic oligonucleotide; CAG chr2 60480561 60480580 60480577 +
cttgacccaggagaggatta

SEQ ID NO: 160546 - DNA, 20 bp, Artificial Sequence
  Synthetic oligonucleotide; AAG chr2 60480572 60480591 60480588 +
agaggattacagccccttga

SEQ ID NO: 160547 - DNA, 20 bp, Artificial Sequence
  Synthetic oligonucleotide; TGG chr2 60480575 60480594 60480591 +
ggattacagccccttgaaag

SEQ ID NO: 160548 - DNA, 20 bp, Artificial Sequence
  Synthetic oligonucleotide; TGG chr2 60480582 60480601 60480598 +
agccccttgaaagtggctgc

SEQ ID NO: 160549 - DNA, 20 bp, Artificial Sequence
  Synthetic oligonucleotide; TGG chr2 60480608 60480627 60480624 +
atcgcttcactgtactattt

SEQ ID NO: 160550 - DNA, 20 bp, Artificial Sequence
  Synthetic oligonucleotide; TAG chr2 60480621 60480640 60480637 +
actattttggcaatctgtaa

SEQ ID NO: 160551 - DNA, 20 bp, Artificial Sequence
  Synthetic oligonucleotide; TGG chr2 60480637 60480656 60480653 +
gtaatagtgtatttactcaa

SEQ ID NO: 160552 - DNA, 20 bp, Artificial Sequence
  Synthetic oligonucleotide; TGG chr2 60480646 60480665 60480662 +
tatttactcaatggttgtta

SEQ ID NO: 160553 - DNA, 20 bp, Artificial Sequence
  Synthetic oligonucleotide; CAG chr2 60480654 60480673 60480670 +
caatggttgttatggacaat

SEQ ID NO: 160554 - DNA, 20 bp, Artificial Sequence
  Synthetic oligonucleotide; AGG chr2 60480655 60480674 60480671 +
aatggttgttatggacaatc

SEQ ID NO: 160555 - DNA, 20 bp, Artificial Sequence
  Synthetic oligonucleotide; CAG chr2 60480693 60480712 60480709 +
ccaaatgctgtgtaattaca

SEQ ID NO: 160556 - DNA, 20 bp, Artificial Sequence
  Synthetic oligonucleotide; AAG chr2 60480700 60480719 60480716 +
ctgtgtaattacacagttaa

SEQ ID NO: 160557 - DNA, 20 bp, Artificial Sequence
  Synthetic oligonucleotide; GAG chr2 60480702 60480721 60480718 +
gtgtaattacacagttaaaa

SEQ ID NO: 160558 - DNA, 20 bp, Artificial Sequence
  Synthetic oligonucleotide; CAG chr2 60480708 60480727 60480724 +
ttacacagttaaaagagcta

SEQ ID NO: 160559 - DNA, 20 bp, Artificial Sequence
  Synthetic oligonucleotide; CGG chr2 60480711 60480730 60480727 +
cacagttaaaagagctacag

SEQ ID NO: 160560 - DNA, 20 bp, Artificial Sequence
  Synthetic oligonucleotide; AAG chr2 60480729 60480748 60480745 +
agcggatgtcaaatttcctt

SEQ ID NO: 160561 - DNA, 20 bp, Artificial Sequence
  Synthetic oligonucleotide; TGG chr2 60480737 60480756 60480753 +
tcaaatttccttaagtcttc

SEQ ID NO: 160562 - DNA, 20 bp, Artificial Sequence
  Synthetic oligonucleotide; TGG chr2 60480745 60480764 60480761 +
ccttaagtcttctggtgaat

SEQ ID NO: 160563 - DNA, 20 bp, Artificial Sequence
  Synthetic oligonucleotide; TAG chr2 60480758 60480777 60480774 +
ggtgaattggtctcaattac

SEQ ID NO: 160564 - DNA, 20 bp, Artificial Sequence
  Synthetic oligonucleotide; TGG chr2 60480763 60480782 60480779 +
attggtctcaattactagtc

SEQ ID NO: 160565 - DNA, 20 bp, Artificial Sequence
  Synthetic oligonucleotide; GGG chr2 60480764 60480783 60480780 +
ttggtctcaattactagtct

SEQ ID NO: 160566 - DNA, 20 bp, Artificial Sequence
  Synthetic oligonucleotide; TAG chr2 60480798 60480817 60480814 +
cttcctctctcaatttgttt

SEQ ID NO: 160567 - DNA, 20 bp, Artificial Sequence
  Synthetic oligonucleotide; AAG chr2 60480858 60480877 60480874 +
tgcacccccatctctgtccc

SEQ ID NO: 160568 - DNA, 20 bp, Artificial Sequence
  Synthetic oligonucleotide; GAG chr2 60480860 60480879 60480876 +
cacccccatctctgtcccaa

SEQ ID NO: 160569 - DNA, 20 bp, Artificial Sequence
  Synthetic oligonucleotide; AAG chr2 60480864 60480883 60480880 +
cccatctctgtcccaagaga

SEQ ID NO: 160570 - DNA, 20 bp, Artificial Sequence
  Synthetic oligonucleotide; CAG chr2 60480869 60480888 60480885 +
ctctgtcccaagagaaagaa

SEQ ID NO: 160571 - DNA, 20 bp, Artificial Sequence
  Synthetic oligonucleotide; AAG chr2 60480876 60480895 60480892 +
ccaagagaaagaacagtgtg

SEQ ID NO: 160572 - DNA, 20 bp, Artificial Sequence
  Synthetic oligonucleotide; TAG chr2 60480913 60480932 60480929 +
taatcctatttttgaactca

SEQ ID NO: 160573 - DNA, 20 bp, Artificial Sequence
  Synthetic oligonucleotide; TAG chr2 60480923 60480942 60480939 +
tttgaactcatagttctaaa

SEQ ID NO: 160574 - DNA, 20 bp, Artificial Sequence
  Synthetic oligonucleotide; AAG chr2 60480941 60480960 60480957 +
aatagtttttgctccactaa

SEQ ID NO: 160575 - DNA, 20 bp, Artificial Sequence
  Synthetic oligonucleotide; AGG chr2 60480942 60480961 60480958 +
atagtttttgctccactaaa

SEQ ID NO: 160576 - DNA, 20 bp, Artificial Sequence
  Synthetic oligonucleotide; GGG chr2 60480943 60480962 60480959 +
tagtttttgctccactaaaa

SEQ ID NO: 160577 - DNA, 20 bp, Artificial Sequence
  Synthetic oligonucleotide; AAG chr2 60480955 60480974 60480971 +
cactaaaagggcttaaaaat

SEQ ID NO: 160578 - DNA, 20 bp, Artificial Sequence
  Synthetic oligonucleotide; AGG chr2 60480956 60480975 60480972 +
actaaaagggcttaaaaata

SEQ ID NO: 160579 - DNA, 20 bp, Artificial Sequence
  Synthetic oligonucleotide; TAG chr2 60480960 60480979 60480976 +
aaagggcttaaaaataaggc

SEQ ID NO: 160580 - DNA, 20 bp, Artificial Sequence
  Synthetic oligonucleotide; AGG chr2 60480961 60480980 60480977 +
aagggcttaaaaataaggct

SEQ ID NO: 160581 - DNA, 20 bp, Artificial Sequence
  Synthetic oligonucleotide; AAG chr2 60480964 60480983 60480980 +
ggcttaaaaataaggctagg

SEQ ID NO: 160582 - DNA, 20 bp, Artificial Sequence
  Synthetic oligonucleotide; TAG chr2 60480968 60480987 60480984 +
taaaaataaggctaggaagc

SEQ ID NO: 160583 - DNA, 20 bp, Artificial Sequence
  Synthetic oligonucleotide; TGG chr2 60480974 60480993 60480990 +
taaggctaggaagctagacc

SEQ ID NO: 160584 - DNA, 20 bp, Artificial Sequence
  Synthetic oligonucleotide; GGG chr2 60480975 60480994 60480991 +
aaggctaggaagctagacct

SEQ ID NO: 160585 - DNA, 20 bp, Artificial Sequence
  Synthetic oligonucleotide; GAG chr2 60480977 60480996 60480993 +
ggctaggaagctagacctgg

SEQ ID NO: 160586 - DNA, 20 bp, Artificial Sequence
  Synthetic oligonucleotide; AGG chr2 60480978 60480997 60480994 +
gctaggaagctagacctggg

SEQ ID NO: 160587 - DNA, 20 bp, Artificial Sequence
  Synthetic oligonucleotide; GGG chr2 60480979 60480998 60480995 +
ctaggaagctagacctggga

SEQ ID NO: 160588 - DNA, 20 bp, Artificial Sequence
  Synthetic oligonucleotide; GGG chr2 60480980 60480999 60480996 +
taggaagctagacctgggag

SEQ ID NO: 160589 - DNA, 20 bp, Artificial Sequence
  Synthetic oligonucleotide; CAG chr2 60480988 60481007 60481004 +
tagacctgggaggggcatta

SEQ ID NO: 160590 - DNA, 20 bp, Artificial Sequence
  Synthetic oligonucleotide; AGG chr2 60480989 60481008 60481005 +
agacctgggaggggcattac

SEQ ID NO: 160591 - DNA, 20 bp, Artificial Sequence
  Synthetic oligonucleotide; TGG chr2 60480993 60481012 60481009 +
ctgggaggggcattacaggc

SEQ ID NO: 160592 - DNA, 20 bp, Artificial Sequence
  Synthetic oligonucleotide; TGG chr2 60480997 60481016 60481013 +
gaggggcattacaggctggc

SEQ ID NO: 160593 - DNA, 20 bp, Artificial Sequence
  Synthetic oligonucleotide; AAG chr2 60481000 60481019 60481016 +
gggcattacaggctggctgg

SEQ ID NO: 160594 - DNA, 20 bp, Artificial Sequence
  Synthetic oligonucleotide; CAG chr2 60481007 60481026 60481023 +
acaggctggctggaagcccc

SEQ ID NO: 160595 - DNA, 20 bp, Artificial Sequence
  Synthetic oligonucleotide; CAG chr2 60481024 60481043 60481040 +
ccccagctgcctccctgcct

SEQ ID NO: 160596 - DNA, 20 bp, Artificial Sequence
  Synthetic oligonucleotide; CAG chr2 60481030 60481049 60481046 +
ctgcctccctgcctcagatg

SEQ ID NO: 160597 - DNA, 20 bp, Artificial Sequence
  Synthetic oligonucleotide; AGG chr2 60481031 60481050 60481047 +
tgcctccctgcctcagatgc

SEQ ID NO: 160598 - DNA, 20 bp, Artificial Sequence
  Synthetic oligonucleotide; GGG chr2 60481032 60481051 60481048 +
gcctccctgcctcagatgca

SEQ ID NO: 160599 - DNA, 20 bp, Artificial Sequence
  Synthetic oligonucleotide; GAG chr2 60481034 60481053 60481050 +
ctccctgcctcagatgcagg

SEQ ID NO: 160600 - DNA, 20 bp, Artificial Sequence
  Synthetic oligonucleotide; CAG chr2 60481045 60481064 60481061 +
agatgcagggagaacacctg

SEQ ID NO: 160601 - DNA, 20 bp, Artificial Sequence
  Synthetic oligonucleotide; AAG chr2 60481068 60481087 60481084 +
ccacccacaccttgtcaccc

SEQ ID NO: 160602 - DNA, 20 bp, Artificial Sequence
  Synthetic oligonucleotide; TAG chr2 60481077 60481096 60481093 +
ccttgtcacccaagttgcac

SEQ ID NO: 160603 - DNA, 20 bp, Artificial Sequence
  Synthetic oligonucleotide; TGG chr2 60481084 60481103 60481100 +
acccaagttgcactagatcc

SEQ ID NO: 160604 - DNA, 20 bp, Artificial Sequence
  Synthetic oligonucleotide; CAG chr2 60481089 60481108 60481105 +
agttgcactagatcctggta

SEQ ID NO: 160605 - DNA, 20 bp, Artificial Sequence
  Synthetic oligonucleotide; CAG chr2 60481094 60481113 60481110 +
cactagatcctggtacagcc

SEQ ID NO: 160606 - DNA, 20 bp, Artificial Sequence
  Synthetic oligonucleotide; TGG chr2 60481097 60481116 60481113 +
tagatcctggtacagcccag

SEQ ID NO: 160607 - DNA, 20 bp, Artificial Sequence
  Synthetic oligonucleotide; TGG chr2 60481100 60481119 60481116 +
atcctggtacagcccagtgg

SEQ ID NO: 160608 - DNA, 20 bp, Artificial Sequence
  Synthetic oligonucleotide; CAG chr2 60481106 60481125 60481122 +
gtacagcccagtggtggccg

SEQ ID NO: 160609 - DNA, 20 bp, Artificial Sequence
  Synthetic oligonucleotide; CAG chr2 60481111 60481130 60481127 +
gcccagtggtggccgcagct

SEQ ID NO: 160610 - DNA, 20 bp, Artificial Sequence
  Synthetic oligonucleotide; AGG chr2 60481112 60481131 60481128 +
cccagtggtggccgcagctc

SEQ ID NO: 160611 - DNA, 20 bp, Artificial Sequence
  Synthetic oligonucleotide; GGG chr2 60481113 60481132 60481129 +
ccagtggtggccgcagctca

SEQ ID NO: 160612 - DNA, 20 bp, Artificial Sequence
  Synthetic oligonucleotide; AAG chr2 60481116 60481135 60481132 +
gtggtggccgcagctcaggg

SEQ ID NO: 160613 - DNA, 20 bp, Artificial Sequence
  Synthetic oligonucleotide; AAG chr2 60481120 60481139 60481136 +
tggccgcagctcagggaaga

SEQ ID NO: 160614 - DNA, 20 bp, Artificial Sequence
  Synthetic oligonucleotide; AAG chr2 60481123 60481142 60481139 +
ccgcagctcagggaagaaag

SEQ ID NO: 160615 - DNA, 20 bp, Artificial Sequence
  Synthetic oligonucleotide; AGG chr2 60481124 60481143 60481140 +
cgcagctcagggaagaaaga

SEQ ID NO: 160616 - DNA, 20 bp, Artificial Sequence
  Synthetic oligonucleotide; AAG chr2 60481129 60481148 60481145 +
ctcagggaagaaagaaggca

SEQ ID NO: 160617 - DNA, 20 bp, Artificial Sequence
  Synthetic oligonucleotide; AAG chr2 60481145 60481164 60481161 +
ggcaaagccctgctgtgctc

SEQ ID NO: 160618 - DNA, 20 bp, Artificial Sequence
  Synthetic oligonucleotide; AGG chr2 60481146 60481165 60481162 +
gcaaagccctgctgtgctca

SEQ ID NO: 160619 - DNA, 20 bp, Artificial Sequence
  Synthetic oligonucleotide; GAG chr2 60481148 60481167 60481164 +
aaagccctgctgtgctcaag

SEQ ID NO: 160620 - DNA, 20 bp, Artificial Sequence
  Synthetic oligonucleotide; GAG chr2 60481154 60481173 60481170 +
ctgctgtgctcaaggagatt

SEQ ID NO: 160621 - DNA, 20 bp, Artificial Sequence
  Synthetic oligonucleotide; AGG chr2 60481155 60481174 60481171 +
tgctgtgctcaaggagattg

SEQ ID NO: 160622 - DNA, 20 bp, Artificial Sequence
  Synthetic oligonucleotide; CAG chr2 60481163 60481182 60481179 +
tcaaggagattgaggcttcc

SEQ ID NO: 160623 - DNA, 20 bp, Artificial Sequence
  Synthetic oligonucleotide; TGG chr2 60481175 60481194 60481191 +
aggcttcccagccccaaaac

SEQ ID NO: 160624 - DNA, 20 bp, Artificial Sequence
  Synthetic oligonucleotide; GGG chr2 60481176 60481195 60481192 +
ggcttcccagccccaaaact

SEQ ID NO: 160625 - DNA, 20 bp, Artificial Sequence
  Synthetic oligonucleotide; AAG chr2 60481179 60481198 60481195 +
ttcccagccccaaaactggg

SEQ ID NO: 160626 - DNA, 20 bp, Artificial Sequence
  Synthetic oligonucleotide; AGG chr2 60481180 60481199 60481196 +
tcccagccccaaaactggga

SEQ ID NO: 160627 - DNA, 20 bp, Artificial Sequence
  Synthetic oligonucleotide; GGG chr2 60481181 60481200 60481197 +
cccagccccaaaactgggaa

SEQ ID NO: 160628 - DNA, 20 bp, Artificial Sequence
  Synthetic oligonucleotide; TGG chr2 60481187 60481206 60481203 +
cccaaaactgggaagggccc

SEQ ID NO: 160629 - DNA, 20 bp, Artificial Sequence
  Synthetic oligonucleotide; TGG chr2 60481192 60481211 60481208 +
aactgggaagggccctggaa

SEQ ID NO: 160630 - DNA, 20 bp, Artificial Sequence
  Synthetic oligonucleotide; GGG chr2 60481193 60481212 60481209 +
actgggaagggccctggaat

SEQ ID NO: 160631 - DNA, 20 bp, Artificial Sequence
  Synthetic oligonucleotide; CAG chr2 60481212 60481231 60481228 +
tgggatatcccctcccctcc

SEQ ID NO: 160632 - DNA, 20 bp, Artificial Sequence
  Synthetic oligonucleotide; TAG chr2 60481232 60481251 60481248 +
cagcaccccattcccaaacc

SEQ ID NO: 160633 - DNA, 20 bp, Artificial Sequence
  Synthetic oligonucleotide; TGG chr2 60481250 60481269 60481266 +
cctagccacccatctctgct

SEQ ID NO: 160634 - DNA, 20 bp, Artificial Sequence
  Synthetic oligonucleotide; GGG chr2 60481251 60481270 60481267 +
ctagccacccatctctgctt

SEQ ID NO: 160635 - DNA, 20 bp, Artificial Sequence
  Synthetic oligonucleotide; TGG chr2 60481260 60481279 60481276 +
catctctgcttgggacatgc

SEQ ID NO: 160636 - DNA, 20 bp, Artificial Sequence
  Synthetic oligonucleotide; AAG chr2 60481263 60481282 60481279 +
ctctgcttgggacatgctgg

SEQ ID NO: 160637 - DNA, 20 bp, Artificial Sequence
  Synthetic oligonucleotide; AGG chr2 60481264 60481283 60481280 +
tctgcttgggacatgctgga

SEQ ID NO: 160638 - DNA, 20 bp, Artificial Sequence
  Synthetic oligonucleotide; AAG chr2 60481268 60481287 60481284 +
cttgggacatgctggaaggc

SEQ ID NO: 160639 - DNA, 20 bp, Artificial Sequence
  Synthetic oligonucleotide; AAG chr2 60481271 60481290 60481287 +
gggacatgctggaaggcaag

SEQ ID NO: 160640 - DNA, 20 bp, Artificial Sequence
  Synthetic oligonucleotide; GAG chr2 60481273 60481292 60481289 +
gacatgctggaaggcaagaa

SEQ ID NO: 160641 - DNA, 20 bp, Artificial Sequence
  Synthetic oligonucleotide; GAG chr2 60481275 60481294 60481291 +
catgctggaaggcaagaaga

SEQ ID NO: 160642 - DNA, 20 bp, Artificial Sequence
  Synthetic oligonucleotide; AAG chr2 60481282 60481301 60481298 +
gaaggcaagaagagagaaac

SEQ ID NO: 160643 - DNA, 20 bp, Artificial Sequence
  Synthetic oligonucleotide; AAG chr2 60481307 60481326 60481323 +
actccttgaaaacaaaaatg

SEQ ID NO: 160644 - DNA, 20 bp, Artificial Sequence
  Synthetic oligonucleotide; CAG chr2 60481310 60481329 60481326 +
ccttgaaaacaaaaatgaag

SEQ ID NO: 160645 - DNA, 20 bp, Artificial Sequence
  Synthetic oligonucleotide; AGG chr2 60481311 60481330 60481327 +
cttgaaaacaaaaatgaagc

SEQ ID NO: 160646 - DNA, 20 bp, Artificial Sequence
  Synthetic oligonucleotide; GGG chr2 60481312 60481331 60481328 +
ttgaaaacaaaaatgaagca

SEQ ID NO: 160647 - DNA, 20 bp, Artificial Sequence
  Synthetic oligonucleotide; TAG chr2 60481319 60481338 60481335 +
caaaaatgaagcagggatcc

SEQ ID NO: 160648 - DNA, 20 bp, Artificial Sequence
  Synthetic oligonucleotide; AGG chr2 60481320 60481339 60481336 +
aaaaatgaagcagggatcct

SEQ ID NO: 160649 - DNA, 20 bp, Artificial Sequence
  Synthetic oligonucleotide; AAG chr2 60481325 60481344 60481341 +
tgaagcagggatcctaggaa

SEQ ID NO: 160650 - DNA, 20 bp, Artificial Sequence
  Synthetic oligonucleotide; CAG chr2 60481338 60481357 60481354 +
ctaggaaaagtaaaaacatt

SEQ ID NO: 160651 - DNA, 20 bp, Artificial Sequence
  Synthetic oligonucleotide; CAG chr2 60481345 60481364 60481361 +
aagtaaaaacattcagaacc

SEQ ID NO: 160652 - DNA, 20 bp, Artificial Sequence
  Synthetic oligonucleotide; AGG chr2 60481346 60481365 60481362 +
agtaaaaacattcagaaccc

SEQ ID NO: 160653 - DNA, 20 bp, Artificial Sequence
  Synthetic oligonucleotide; GGG chr2 60481347 60481366 60481363 +
gtaaaaacattcagaaccca

SEQ ID NO: 160654 - DNA, 20 bp, Artificial Sequence
  Synthetic oligonucleotide; CAG chr2 60481378 60481397 60481394 +
ctgtctcccacgacctacac

SEQ ID NO: 160655 - DNA, 20 bp, Artificial Sequence
  Synthetic oligonucleotide; AGG chr2 60481379 60481398 60481395 +
tgtctcccacgacctacacc

SEQ ID NO: 160656 - DNA, 20 bp, Artificial Sequence
  Synthetic oligonucleotide; CGG chr2 60481402 60481421 60481418 +
cccttcgcacctctgctttg

SEQ ID NO: 160657 - DNA, 20 bp, Artificial Sequence
  Synthetic oligonucleotide; AAG chr2 60481433 60481452 60481449 +
cactacaccccacccaccac

SEQ ID NO: 160658 - DNA, 20 bp, Artificial Sequence
  Synthetic oligonucleotide; CAG chr2 60481452 60481471 60481468 +
caagcacatacacatgctct

SEQ ID NO: 160659 - DNA, 20 bp, Artificial Sequence
  Synthetic oligonucleotide; AGG chr2 60481453 60481472 60481469 +
aagcacatacacatgctctc

SEQ ID NO: 160660 - DNA, 20 bp, Artificial Sequence
  Synthetic oligonucleotide; GAG chr2 60481455 60481474 60481471 +
gcacatacacatgctctcag

SEQ ID NO: 160661 - DNA, 20 bp, Artificial Sequence
  Synthetic oligonucleotide; CAG chr2 60481459 60481478 60481475 +
atacacatgctctcaggagt

SEQ ID NO: 160662 - DNA, 20 bp, Artificial Sequence
  Synthetic oligonucleotide; GAG chr2 60481461 60481480 60481477 +
acacatgctctcaggagtca

SEQ ID NO: 160663 - DNA, 20 bp, Artificial Sequence
  Synthetic oligonucleotide; AGG chr2 60481462 60481481 60481478 +
cacatgctctcaggagtcag

SEQ ID NO: 160664 - DNA, 20 bp, Artificial Sequence
  Synthetic oligonucleotide; GGG chr2 60481463 60481482 60481479 +
acatgctctcaggagtcaga

SEQ ID NO: 160665 - DNA, 20 bp, Artificial Sequence
  Synthetic oligonucleotide; CAG chr2 60481471 60481490 60481487 +
tcaggagtcagagggtcacc

SEQ ID NO: 160666 - DNA, 20 bp, Artificial Sequence
  Synthetic oligonucleotide; AGG chr2 60481472 60481491 60481488 +
caggagtcagagggtcaccc

SEQ ID NO: 160667 - DNA, 20 bp, Artificial Sequence
  Synthetic oligonucleotide; GGG chr2 60481473 60481492 60481489 +
aggagtcagagggtcaccca

SEQ ID NO: 160668 - DNA, 20 bp, Artificial Sequence
  Synthetic oligonucleotide; TAG chr2 60481477 60481496 60481493 +
gtcagagggtcacccagggc

SEQ ID NO: 160669 - DNA, 20 bp, Artificial Sequence
  Synthetic oligonucleotide; AAG chr2 60481485 60481504 60481501 +
gtcacccagggctagaactt

SEQ ID NO: 160670 - DNA, 20 bp, Artificial Sequence
  Synthetic oligonucleotide; CAG chr2 60481493 60481512 60481509 +
gggctagaacttaagccacc

SEQ ID NO: 160671 - DNA, 20 bp, Artificial Sequence
  Synthetic oligonucleotide; AAG chr2 60481501 60481520 60481517 +
acttaagccacccagcccac

SEQ ID NO: 160672 - DNA, 20 bp, Artificial Sequence
  Synthetic oligonucleotide; TGG chr2 60481505 60481524 60481521 +
aagccacccagcccacaagc

SEQ ID NO: 160673 - DNA, 20 bp, Artificial Sequence
  Synthetic oligonucleotide; CAG chr2 60481508 60481527 60481524 +
ccacccagcccacaagctgg

SEQ ID NO: 160674 - DNA, 20 bp, Artificial Sequence
  Synthetic oligonucleotide; AGG chr2 60481509 60481528 60481525 +
cacccagcccacaagctggc

SEQ ID NO: 160675 - DNA, 20 bp, Artificial Sequence
  Synthetic oligonucleotide; AAG chr2 60481514 60481533 60481530 +
agcccacaagctggcaggtg

SEQ ID NO: 160676 - DNA, 20 bp, Artificial Sequence
  Synthetic oligonucleotide; AGG chr2 60481515 60481534 60481531 +
gcccacaagctggcaggtga

SEQ ID NO: 160677 - DNA, 20 bp, Artificial Sequence
  Synthetic oligonucleotide; GAG chr2 60481517 60481536 60481533 +
ccacaagctggcaggtgaag

SEQ ID NO: 160678 - DNA, 20 bp, Artificial Sequence
  Synthetic oligonucleotide; AGG chr2 60481518 60481537 60481534 +
cacaagctggcaggtgaagg

SEQ ID NO: 160679 - DNA, 20 bp, Artificial Sequence
  Synthetic oligonucleotide; CAG chr2 60481522 60481541 60481538 +
agctggcaggtgaaggagga

SEQ ID NO: 160680 - DNA, 20 bp, Artificial Sequence
  Synthetic oligonucleotide; AGG chr2 60481523 60481542 60481539 +
gctggcaggtgaaggaggac

SEQ ID NO: 160681 - DNA, 20 bp, Artificial Sequence
  Synthetic oligonucleotide; GGG chr2 60481524 60481543 60481540 +
ctggcaggtgaaggaggaca

SEQ ID NO: 160682 - DNA, 20 bp, Artificial Sequence
  Synthetic oligonucleotide; AAG chr2 60481530 60481549 60481546 +
ggtgaaggaggacagggatc

SEQ ID NO: 160683 - DNA, 20 bp, Artificial Sequence
  Synthetic oligonucleotide; AGG chr2 60481531 60481550 60481547 +
gtgaaggaggacagggatca

SEQ ID NO: 160684 - DNA, 20 bp, Artificial Sequence
  Synthetic oligonucleotide; CAG chr2 60481537 60481556 60481553 +
gaggacagggatcaaggtga

SEQ ID NO: 160685 - DNA, 20 bp, Artificial Sequence
  Synthetic oligonucleotide; TGG chr2 60481552 60481571 60481568 +
ggtgacagtgctgtccacgc

SEQ ID NO: 160686 - DNA, 20 bp, Artificial Sequence
  Synthetic oligonucleotide; TGG chr2 60481559 60481578 60481575 +
gtgctgtccacgctggcccc

SEQ ID NO: 160687 - DNA, 20 bp, Artificial Sequence
  Synthetic oligonucleotide; AAG chr2 60481564 60481583 60481580 +
gtccacgctggcccctggct

SEQ ID NO: 160688 - DNA, 20 bp, Artificial Sequence
  Synthetic oligonucleotide; GAG chr2 60481566 60481585 60481582 +
ccacgctggcccctggctaa

SEQ ID NO: 160689 - DNA, 20 bp, Artificial Sequence
  Synthetic oligonucleotide; CAG chr2 60481575 60481594 60481591 +
cccctggctaagagcaactg

SEQ ID NO: 160690 - DNA, 20 bp, Artificial Sequence
  Synthetic oligonucleotide; CAG chr2 60481578 60481597 60481594 +
ctggctaagagcaactgcag

SEQ ID NO: 160691 - DNA, 20 bp, Artificial Sequence
  Synthetic oligonucleotide; CAG chr2 60481584 60481603 60481600 +
aagagcaactgcagcagaaa

SEQ ID NO: 160692 - DNA, 20 bp, Artificial Sequence
  Synthetic oligonucleotide; TGG chr2 60481606 60481625 60481622 +
gtgtttcttctccatttcca

SEQ ID NO: 160693 - DNA, 20 bp, Artificial Sequence
  Synthetic oligonucleotide; CAG chr2 60481678 60481697 60481694 +
tttcttttccccacatgctc

SEQ ID NO: 160694 - DNA, 20 bp, Artificial Sequence
  Synthetic oligonucleotide; CAG chr2 60481692 60481711 60481708 +
atgctccagcacatacaact

SEQ ID NO: 160695 - DNA, 20 bp, Artificial Sequence
  Synthetic oligonucleotide; AGG chr2 60481693 60481712 60481709 +
tgctccagcacatacaactc

SEQ ID NO: 160696 - DNA, 20 bp, Artificial Sequence
  Synthetic oligonucleotide; GGG chr2 60481694 60481713 60481710 +
gctccagcacatacaactca

SEQ ID NO: 160697 - DNA, 20 bp, Artificial Sequence
  Synthetic oligonucleotide; CAG chr2 60481700 60481719 60481716 +
gcacatacaactcagggctc

SEQ ID NO: 160698 - DNA, 20 bp, Artificial Sequence
  Synthetic oligonucleotide; AAG chr2 60481709 60481728 60481725 +
actcagggctccagtgtttt

SEQ ID NO: 160699 - DNA, 20 bp, Artificial Sequence
  Synthetic oligonucleotide; AGG chr2 60481710 60481729 60481726 +
ctcagggctccagtgtttta

SEQ ID NO: 160700 - DNA, 20 bp, Artificial Sequence
  Synthetic oligonucleotide; GGG chr2 60481711 60481730 60481727 +
tcagggctccagtgttttaa

SEQ ID NO: 160701 - DNA, 20 bp, Artificial Sequence
  Synthetic oligonucleotide; AAG chr2 60481728 60481747 60481744 +
taagggcattttttttccac

SEQ ID NO: 160702 - DNA, 20 bp, Artificial Sequence
  Synthetic oligonucleotide; GAG chr2 60481732 60481751 60481748 +
ggcattttttttccacaagt

SEQ ID NO: 160703 - DNA, 20 bp, Artificial Sequence
  Synthetic oligonucleotide; CAG chr2 60481748 60481767 60481764 +
aagtgagattaattttctaa

SEQ ID NO: 160704 - DNA, 20 bp, Artificial Sequence
  Synthetic oligonucleotide; TAG chr2 60481756 60481775 60481772 +
ttaattttctaacagaaccc

SEQ ID NO: 160705 - DNA, 20 bp, Artificial Sequence
  Synthetic oligonucleotide; TGG chr2 60481773 60481792 60481789 +
ccctagtacattctgtgtga

SEQ ID NO: 160706 - DNA, 20 bp, Artificial Sequence
  Synthetic oligonucleotide; TGG chr2 60481776 60481795 60481792 +
tagtacattctgtgtgatgg

SEQ ID NO: 160707 - DNA, 20 bp, Artificial Sequence
  Synthetic oligonucleotide; GGG chr2 60481777 60481796 60481793 +
agtacattctgtgtgatggt

SEQ ID NO: 160708 - DNA, 20 bp, Artificial Sequence
  Synthetic oligonucleotide; GAG chr2 60481779 60481798 60481795 +
tacattctgtgtgatggtgg

SEQ ID NO: 160709 - DNA, 20 bp, Artificial Sequence
  Synthetic oligonucleotide; GAG chr2 60481781 60481800 60481797 +
cattctgtgtgatggtggga

SEQ ID NO: 160710 - DNA, 20 bp, Artificial Sequence
  Synthetic oligonucleotide; CAG chr2 60481798 60481817 60481814 +
ggagagccttttgaccatca

SEQ ID NO: 160711 - DNA, 20 bp, Artificial Sequence
  Synthetic oligonucleotide; TGG chr2 60481806 60481825 60481822 +
ttttgaccatcacagtgtcc

SEQ ID NO: 160712 - DNA, 20 bp, Artificial Sequence
  Synthetic oligonucleotide; GAG chr2 60481812 60481831 60481828 +
ccatcacagtgtcctggaat

SEQ ID NO: 160713 - DNA, 20 bp, Artificial Sequence
  Synthetic oligonucleotide; CAG chr2 60481817 60481836 60481833 +
acagtgtcctggaatgagct

SEQ ID NO: 160714 - DNA, 20 bp, Artificial Sequence
  Synthetic oligonucleotide; TGG chr2 60481829 60481848 60481845 +
aatgagctcagcatgctctc

SEQ ID NO: 160715 - DNA, 20 bp, Artificial Sequence
  Synthetic oligonucleotide; GGG chr2 60481830 60481849 60481846 +
atgagctcagcatgctctct

SEQ ID NO: 160716 - DNA, 20 bp, Artificial Sequence
  Synthetic oligonucleotide; AAG chr2 60481833 60481852 60481849 +
agctcagcatgctctctggg

SEQ ID NO: 160717 - DNA, 20 bp, Artificial Sequence
  Synthetic oligonucleotide; TGG chr2 60481841 60481860 60481857 +
atgctctctgggaagtgaat

SEQ ID NO: 160718 - DNA, 20 bp, Artificial Sequence
  Synthetic oligonucleotide; GGG chr2 60481842 60481861 60481858 +
tgctctctgggaagtgaatt

SEQ ID NO: 160719 - DNA, 20 bp, Artificial Sequence
  Synthetic oligonucleotide; AAG chr2 60481846 60481865 60481862 +
ctctgggaagtgaattggga

SEQ ID NO: 160720 - DNA, 20 bp, Artificial Sequence
  Synthetic oligonucleotide; TGG chr2 60481853 60481872 60481869 +
aagtgaattgggaaagtgaa

SEQ ID NO: 160721 - DNA, 20 bp, Artificial Sequence
  Synthetic oligonucleotide; GGG chr2 60481854 60481873 60481870 +
agtgaattgggaaagtgaat

SEQ ID NO: 160722 - DNA, 20 bp, Artificial Sequence
  Synthetic oligonucleotide; GGG chr2 60481855 60481874 60481871 +
gtgaattgggaaagtgaatg

SEQ ID NO: 160723 - DNA, 20 bp, Artificial Sequence
  Synthetic oligonucleotide; AAG chr2 60481860 60481879 60481876 +
ttgggaaagtgaatggggaa

SEQ ID NO: 160724 - DNA, 20 bp, Artificial Sequence
  Synthetic oligonucleotide; CAG chr2 60481873 60481892 60481889 +
tggggaaaagcctcaacaca

SEQ ID NO: 160725 - DNA, 20 bp, Artificial Sequence
  Synthetic oligonucleotide; CAG chr2 60481877 60481896 60481893 +
gaaaagcctcaacacacaga

SEQ ID NO: 160726 - DNA, 20 bp, Artificial Sequence
  Synthetic oligonucleotide; TGG chr2 60481885 60481904 60481901 +
tcaacacacagacagcccca

SEQ ID NO: 160727 - DNA, 20 bp, Artificial Sequence
  Synthetic oligonucleotide; CAG chr2 60481897 60481916 60481913 +
cagccccatggaaaattctc

SEQ ID NO: 160728 - DNA, 20 bp, Artificial Sequence
  Synthetic oligonucleotide; CAG chr2 60481902 60481921 60481918 +
ccatggaaaattctccagct

SEQ ID NO: 160729 - DNA, 20 bp, Artificial Sequence
  Synthetic oligonucleotide; AGG chr2 60481903 60481922 60481919 +
catggaaaattctccagctc

SEQ ID NO: 160730 - DNA, 20 bp, Artificial Sequence
  Synthetic oligonucleotide; TAG chr2 60481915 60481934 60481931 +
tccagctcaggaaacccacc

SEQ ID NO: 160731 - DNA, 20 bp, Artificial Sequence
  Synthetic oligonucleotide; AGG chr2 60481916 60481935 60481932 +
ccagctcaggaaacccacct

SEQ ID NO: 160732 - DNA, 20 bp, Artificial Sequence
  Synthetic oligonucleotide; TAG chr2 60481921 60481940 60481937 +
tcaggaaacccacctaggta

SEQ ID NO: 160733 - DNA, 20 bp, Artificial Sequence
  Synthetic oligonucleotide; GAG chr2 60481923 60481942 60481939 +
aggaaacccacctaggtata

SEQ ID NO: 160734 - DNA, 20 bp, Artificial Sequence
  Synthetic oligonucleotide; CGG chr2 60481934 60481953 60481950 +
ctaggtatagagaccttctc

SEQ ID NO: 160735 - DNA, 20 bp, Artificial Sequence
  Synthetic oligonucleotide; TGG chr2 60481943 60481962 60481959 +
gagaccttctccggaacctc

SEQ ID NO: 160736 - DNA, 20 bp, Artificial Sequence
  Synthetic oligonucleotide; TAG chr2 60481953 60481972 60481969 +
ccggaacctctggtctgttc

SEQ ID NO: 160737 - DNA, 20 bp, Artificial Sequence
  Synthetic oligonucleotide; AAG chr2 60481968 60481987 60481984 +
tgttctagtcctgctgtcaa

SEQ ID NO: 160738 - DNA, 20 bp, Artificial Sequence
  Synthetic oligonucleotide; AAG chr2 60481972 60481991 60481988 +
ctagtcctgctgtcaaaaga

SEQ ID NO: 160739 - DNA, 20 bp, Artificial Sequence
  Synthetic oligonucleotide; AGG chr2 60481973 60481992 60481989 +
tagtcctgctgtcaaaagaa

SEQ ID NO: 160740 - DNA, 20 bp, Artificial Sequence
  Synthetic oligonucleotide; GGG chr2 60481974 60481993 60481990 +
agtcctgctgtcaaaagaaa

SEQ ID NO: 160741 - DNA, 20 bp, Artificial Sequence
  Synthetic oligonucleotide; GGG chr2 60481975 60481994 60481991 +
gtcctgctgtcaaaagaaag

SEQ ID NO: 160742 - DNA, 20 bp, Artificial Sequence
  Synthetic oligonucleotide; TGG chr2 60481979 60481998 60481995 +
tgctgtcaaaagaaaggggt

SEQ ID NO: 160743 - DNA, 20 bp, Artificial Sequence
  Synthetic oligonucleotide; CAG chr2 60481994 60482013 60482010 +
ggggttggactgatgtttcc

SEQ ID NO: 160744 - DNA, 20 bp, Artificial Sequence
  Synthetic oligonucleotide; TGG chr2 60481997 60482016 60482013 +
gttggactgatgtttcccag

SEQ ID NO: 160745 - DNA, 20 bp, Artificial Sequence
  Synthetic oligonucleotide; GAG chr2 60481999 60482018 60482015 +
tggactgatgtttcccagtg

SEQ ID NO: 160746 - DNA, 20 bp, Artificial Sequence
  Synthetic oligonucleotide; AGG chr2 60482000 60482019 60482016 +
ggactgatgtttcccagtgg

SEQ ID NO: 160747 - DNA, 20 bp, Artificial Sequence
  Synthetic oligonucleotide; GGG chr2 60482001 60482020 60482017 +
gactgatgtttcccagtgga

SEQ ID NO: 160748 - DNA, 20 bp, Artificial Sequence
  Synthetic oligonucleotide; TGG chr2 60482019 60482038 60482035 +
gagggcttgtttgtcatttt

SEQ ID NO: 160749 - DNA, 20 bp, Artificial Sequence
  Synthetic oligonucleotide; CAG chr2 60482032 60482051 60482048 +
tcatttttggacctaacatc

SEQ ID NO: 160750 - DNA, 20 bp, Artificial Sequence
  Synthetic oligonucleotide; AAG chr2 60482041 60482060 60482057 +
gacctaacatccagttcatc

SEQ ID NO: 160751 - DNA, 20 bp, Artificial Sequence
  Synthetic oligonucleotide; AGG chr2 60482042 60482061 60482058 +
acctaacatccagttcatca

SEQ ID NO: 160752 - DNA, 20 bp, Artificial Sequence
  Synthetic oligonucleotide; CAG chr2 60482059 60482078 60482075 +
tcaaggtcacttctgactcc

SEQ ID NO: 160753 - DNA, 20 bp, Artificial Sequence
  Synthetic oligonucleotide; AGG chr2 60482060 60482079 60482076 +
caaggtcacttctgactccc

SEQ ID NO: 160754 - DNA, 20 bp, Artificial Sequence
  Synthetic oligonucleotide; AAG chr2 60482063 60482082 60482079 +
ggtcacttctgactcccagg

SEQ ID NO: 160755 - DNA, 20 bp, Artificial Sequence
  Synthetic oligonucleotide; GAG chr2 60482065 60482084 60482081 +
tcacttctgactcccaggaa

SEQ ID NO: 160756 - DNA, 20 bp, Artificial Sequence
  Synthetic oligonucleotide; GAG chr2 60482067 60482086 60482083 +
acttctgactcccaggaaga

SEQ ID NO: 160757 - DNA, 20 bp, Artificial Sequence
  Synthetic oligonucleotide; AGG chr2 60482068 60482087 60482084 +
cttctgactcccaggaagag

SEQ ID NO: 160758 - DNA, 20 bp, Artificial Sequence
  Synthetic oligonucleotide; CAG chr2 60482071 60482090 60482087 +
ctgactcccaggaagagagg

SEQ ID NO: 160759 - DNA, 20 bp, Artificial Sequence
  Synthetic oligonucleotide; AAG chr2 60482081 60482100 60482097 +
ggaagagaggcagacctgtt

SEQ ID NO: 160760 - DNA, 20 bp, Artificial Sequence
  Synthetic oligonucleotide; AGG chr2 60482082 60482101 60482098 +
gaagagaggcagacctgtta

SEQ ID NO: 160761 - DNA, 20 bp, Artificial Sequence
  Synthetic oligonucleotide; GGG chr2 60482083 60482102 60482099 +
aagagaggcagacctgttaa

SEQ ID NO: 160762 - DNA, 20 bp, Artificial Sequence
  Synthetic oligonucleotide; GGG chr2 60482084 60482103 60482100 +
agagaggcagacctgttaag

SEQ ID NO: 160763 - DNA, 20 bp, Artificial Sequence
  Synthetic oligonucleotide; CGG chr2 60482087 60482106 60482103 +
gaggcagacctgttaagggg

SEQ ID NO: 160764 - DNA, 20 bp, Artificial Sequence
  Synthetic oligonucleotide; GGG chr2 60482088 60482107 60482104 +
aggcagacctgttaaggggc

SEQ ID NO: 160765 - DNA, 20 bp, Artificial Sequence
  Synthetic oligonucleotide; TGG chr2 60482091 60482110 60482107 +
cagacctgttaaggggcggg

SEQ ID NO: 160766 - DNA, 20 bp, Artificial Sequence
  Synthetic oligonucleotide; GAG chr2 60482097 60482116 60482113 +
tgttaaggggcgggtggttt

SEQ ID NO: 160767 - DNA, 20 bp, Artificial Sequence
  Synthetic oligonucleotide; TAG chr2 60482105 60482124 60482121 +
ggcgggtggtttgagccact

SEQ ID NO: 160768 - DNA, 20 bp, Artificial Sequence
  Synthetic oligonucleotide; AGG chr2 60482106 60482125 60482122 +
gcgggtggtttgagccactt

SEQ ID NO: 160769 - DNA, 20 bp, Artificial Sequence
  Synthetic oligonucleotide; TGG chr2 60482115 60482134 60482131 +
ttgagccacttaggacattt

SEQ ID NO: 160770 - DNA, 20 bp, Artificial Sequence
  Synthetic oligonucleotide; GAG chr2 60482147 60482166 60482163 +
atctctcatgattctatctt

SEQ ID NO: 160771 - DNA, 20 bp, Artificial Sequence
  Synthetic oligonucleotide; GAG chr2 60482149 60482168 60482165 +
ctctcatgattctatcttga

SEQ ID NO: 160772 - DNA, 20 bp, Artificial Sequence
  Synthetic oligonucleotide; TAG chr2 60482154 60482173 60482170 +
atgattctatcttgagagtt

SEQ ID NO: 160773 - DNA, 20 bp, Artificial Sequence
  Synthetic oligonucleotide; TGG chr2 60482159 60482178 60482175 +
tctatcttgagagtttagtt

SEQ ID NO: 160774 - DNA, 20 bp, Artificial Sequence
  Synthetic oligonucleotide; TGG chr2 60482163 60482182 60482179 +
tcttgagagtttagtttggt

SEQ ID NO: 160775 - DNA, 20 bp, Artificial Sequence
  Synthetic oligonucleotide; GAG chr2 60482165 60482184 60482181 +
ttgagagtttagtttggttg

SEQ ID NO: 160776 - DNA, 20 bp, Artificial Sequence
  Synthetic oligonucleotide; TAG chr2 60482170 60482189 60482186 +
agtttagtttggttggagtt

SEQ ID NO: 160777 - DNA, 20 bp, Artificial Sequence
  Synthetic oligonucleotide; GAG chr2 60482178 60482197 60482194 +
ttggttggagtttagttttt

SEQ ID NO: 160778 - DNA, 20 bp, Artificial Sequence
  Synthetic oligonucleotide; CGG chr2 60482190 60482209 60482206 +
tagtttttgagttttttgtt

SEQ ID NO: 160779 - DNA, 20 bp, Artificial Sequence
  Synthetic oligonucleotide; GGG chr2 60482191 60482210 60482207 +
agtttttgagttttttgttc

SEQ ID NO: 160780 - DNA, 20 bp, Artificial Sequence
  Synthetic oligonucleotide; TGG chr2 60482197 60482216 60482213 +
tgagttttttgttcgggttg

SEQ ID NO: 160781 - DNA, 20 bp, Artificial Sequence
  Synthetic oligonucleotide; TGG chr2 60482228 60482247 60482244 +
cctccattaaaaaaaaaaat

SEQ ID NO: 160782 - DNA, 20 bp, Artificial Sequence
  Synthetic oligonucleotide; GAG chr2 60482230 60482249 60482246 +
tccattaaaaaaaaaaattg

SEQ ID NO: 160783 - DNA, 20 bp, Artificial Sequence
  Synthetic oligonucleotide; CGG chr2 60482255 60482274 60482271 +
gtatttctgtttcctgttca

SEQ ID NO: 160784 - DNA, 20 bp, Artificial Sequence
  Synthetic oligonucleotide; GAG chr2 60482257 60482276 60482273 +
atttctgtttcctgttcacg

SEQ ID NO: 160785 - DNA, 20 bp, Artificial Sequence
  Synthetic oligonucleotide; CGG chr2 60482260 60482279 60482276 +
tctgtttcctgttcacggag

SEQ ID NO: 160786 - DNA, 20 bp, Artificial Sequence
  Synthetic oligonucleotide; CAG chr2 60482264 60482283 60482280 +
tttcctgttcacggagcgga

SEQ ID NO: 160787 - DNA, 20 bp, Artificial Sequence
  Synthetic oligonucleotide; AAG chr2 60482267 60482286 60482283 +
cctgttcacggagcggacag

SEQ ID NO: 160788 - DNA, 20 bp, Artificial Sequence
  Synthetic oligonucleotide; AGG chr2 60482268 60482287 60482284 +
ctgttcacggagcggacaga

SEQ ID NO: 160789 - DNA, 20 bp, Artificial Sequence
  Synthetic oligonucleotide; GAG chr2 60482270 60482289 60482286 +
gttcacggagcggacagaag

SEQ ID NO: 160790 - DNA, 20 bp, Artificial Sequence
  Synthetic oligonucleotide; AGG chr2 60482271 60482290 60482287 +
ttcacggagcggacagaagg

SEQ ID NO: 160791 - DNA, 20 bp, Artificial Sequence
  Synthetic oligonucleotide; GGG chr2 60482272 60482291 60482288 +
tcacggagcggacagaagga

SEQ ID NO: 160792 - DNA, 20 bp, Artificial Sequence
  Synthetic oligonucleotide; CAG chr2 60482279 60482298 60482295 +
gcggacagaaggagggtgtg

SEQ ID NO: 160793 - DNA, 20 bp, Artificial Sequence
  Synthetic oligonucleotide; TGG chr2 60482282 60482301 60482298 +
gacagaaggagggtgtgcag

SEQ ID NO: 160794 - DNA, 20 bp, Artificial Sequence
  Synthetic oligonucleotide; GAG chr2 60482284 60482303 60482300 +
cagaaggagggtgtgcagtg

SEQ ID NO: 160795 - DNA, 20 bp, Artificial Sequence
  Synthetic oligonucleotide; AGG chr2 60482285 60482304 60482301 +
agaaggagggtgtgcagtgg

SEQ ID NO: 160796 - DNA, 20 bp, Artificial Sequence
  Synthetic oligonucleotide; GAG chr2 60482287 60482306 60482303 +
aaggagggtgtgcagtggag

SEQ ID NO: 160797 - DNA, 20 bp, Artificial Sequence
  Synthetic oligonucleotide; AGG chr2 60482288 60482307 60482304 +
aggagggtgtgcagtggagg

SEQ ID NO: 160798 - DNA, 20 bp, Artificial Sequence
  Synthetic oligonucleotide; TGG chr2 60482295 60482314 60482311 +
tgtgcagtggaggaggtgtg

SEQ ID NO: 160799 - DNA, 20 bp, Artificial Sequence
  Synthetic oligonucleotide; GGG chr2 60482296 60482315 60482312 +
gtgcagtggaggaggtgtgt

SEQ ID NO: 160800 - DNA, 20 bp, Artificial Sequence
  Synthetic oligonucleotide; GGG chr2 60482297 60482316 60482313 +
tgcagtggaggaggtgtgtg

SEQ ID NO: 160801 - DNA, 20 bp, Artificial Sequence
  Synthetic oligonucleotide; GAG chr2 60482299 60482318 60482315 +
cagtggaggaggtgtgtggg

SEQ ID NO: 160802 - DNA, 20 bp, Artificial Sequence
  Synthetic oligonucleotide; AGG chr2 60482300 60482319 60482316 +
agtggaggaggtgtgtgggg

SEQ ID NO: 160803 - DNA, 20 bp, Artificial Sequence
  Synthetic oligonucleotide; GAG chr2 60482302 60482321 60482318 +
tggaggaggtgtgtggggag

SEQ ID NO: 160804 - DNA, 20 bp, Artificial Sequence
  Synthetic oligonucleotide; AGG chr2 60482303 60482322 60482319 +
ggaggaggtgtgtggggagg

SEQ ID NO: 160805 - DNA, 20 bp, Artificial Sequence
  Synthetic oligonucleotide; TGG chr2 60482314 60482333 60482330 +
gtggggaggaggctgataca

SEQ ID NO: 160806 - DNA, 20 bp, Artificial Sequence
  Synthetic oligonucleotide; GAG chr2 60482316 60482335 60482332 +
ggggaggaggctgatacatg

SEQ ID NO: 160807 - DNA, 20 bp, Artificial Sequence
  Synthetic oligonucleotide; CAG chr2 60482319 60482338 60482335 +
gaggaggctgatacatggag

SEQ ID NO: 160808 - DNA, 20 bp, Artificial Sequence
  Synthetic oligonucleotide; GAG chr2 60482321 60482340 60482337 +
ggaggctgatacatggagca

SEQ ID NO: 160809 - DNA, 20 bp, Artificial Sequence
  Synthetic oligonucleotide; GAG chr2 60482326 60482345 60482342 +
ctgatacatggagcagagcc

SEQ ID NO: 160810 - DNA, 20 bp, Artificial Sequence
  Synthetic oligonucleotide; CGG chr2 60482335 60482354 60482351 +
ggagcagagccgagaatatc

SEQ ID NO: 160811 - DNA, 20 bp, Artificial Sequence
  Synthetic oligonucleotide; TGG chr2 60482341 60482360 60482357 +
gagccgagaatatccggaac

SEQ ID NO: 160812 - DNA, 20 bp, Artificial Sequence
  Synthetic oligonucleotide; GAG chr2 60482343 60482362 60482359 +
gccgagaatatccggaactg

SEQ ID NO: 160813 - DNA, 20 bp, Artificial Sequence
  Synthetic oligonucleotide; AAG chr2 60482348 60482367 60482364 +
gaatatccggaactggagaa

SEQ ID NO: 160814 - DNA, 20 bp, Artificial Sequence
  Synthetic oligonucleotide; GAG chr2 60482352 60482371 60482368 +
atccggaactggagaaaagt

SEQ ID NO: 160815 - DNA, 20 bp, Artificial Sequence
  Synthetic oligonucleotide; TGG chr2 60482358 60482377 60482374 +
aactggagaaaagtgagaaa

SEQ ID NO: 160816 - DNA, 20 bp, Artificial Sequence
  Synthetic oligonucleotide; GAG chr2 60482360 60482379 60482376 +
ctggagaaaagtgagaaatg

SEQ ID NO: 160817 - DNA, 20 bp, Artificial Sequence
  Synthetic oligonucleotide; TGG chr2 60482372 60482391 60482388 +
gagaaatggagcttttttct

SEQ ID NO: 160818 - DNA, 20 bp, Artificial Sequence
  Synthetic oligonucleotide; CAG chr2 60482383 60482402 60482399 +
cttttttcttggcttccaaa

SEQ ID NO: 160819 - DNA, 20 bp, Artificial Sequence
  Synthetic oligonucleotide; TAG chr2 60482409 60482428 60482425 +
taatttccactgccactgct

SEQ ID NO: 160820 - DNA, 20 bp, Artificial Sequence
  Synthetic oligonucleotide; TGG chr2 60482416 60482435 60482432 +
cactgccactgcttagttcc

SEQ ID NO: 160821 - DNA, 20 bp, Artificial Sequence
  Synthetic oligonucleotide; GGG chr2 60482417 60482436 60482433 +
actgccactgcttagttcct

SEQ ID NO: 160822 - DNA, 20 bp, Artificial Sequence
  Synthetic oligonucleotide; CAG chr2 60482423 60482442 60482439 +
actgcttagttcctgggcac

SEQ ID NO: 160823 - DNA, 20 bp, Artificial Sequence
  Synthetic oligonucleotide; AGG chr2 60482424 60482443 60482440 +
ctgcttagttcctgggcacc

SEQ ID NO: 160824 - DNA, 20 bp, Artificial Sequence
  Synthetic oligonucleotide; CAG chr2 60482431 60482450 60482447 +
gttcctgggcaccaggcata

SEQ ID NO: 160825 - DNA, 20 bp, Artificial Sequence
  Synthetic oligonucleotide; GAG chr2 60482433 60482452 60482449 +
tcctgggcaccaggcataca

SEQ ID NO: 160826 - DNA, 20 bp, Artificial Sequence
  Synthetic oligonucleotide; TGG chr2 60482436 60482455 60482452 +
tgggcaccaggcatacagag

SEQ ID NO: 160827 - DNA, 20 bp, Artificial Sequence
  Synthetic oligonucleotide; GGG chr2 60482437 60482456 60482453 +
gggcaccaggcatacagagt

SEQ ID NO: 160828 - DNA, 20 bp, Artificial Sequence
  Synthetic oligonucleotide; AAG chr2 60482441 60482460 60482457 +
accaggcatacagagtggga

SEQ ID NO: 160829 - DNA, 20 bp, Artificial Sequence
  Synthetic oligonucleotide; AGG chr2 60482442 60482461 60482458 +
ccaggcatacagagtgggaa

SEQ ID NO: 160830 - DNA, 20 bp, Artificial Sequence
  Synthetic oligonucleotide; GGG chr2 60482443 60482462 60482459 +
caggcatacagagtgggaaa

SEQ ID NO: 160831 - DNA, 20 bp, Artificial Sequence
  Synthetic oligonucleotide; GGG chr2 60482444 60482463 60482460 +
aggcatacagagtgggaaag

SEQ ID NO: 160832 - DNA, 20 bp, Artificial Sequence
  Synthetic oligonucleotide; CAG chr2 60482470 60482489 60482486 +
gtgacaactttgccacaaat

SEQ ID NO: 160833 - DNA, 20 bp, Artificial Sequence
  Synthetic oligonucleotide; AGG chr2 60482471 60482490 60482487 +
tgacaactttgccacaaatc

SEQ ID NO: 160834 - DNA, 20 bp, Artificial Sequence
  Synthetic oligonucleotide; TGG chr2 60482477 60482496 60482493 +
ctttgccacaaatcaggatt

SEQ ID NO: 160835 - DNA, 20 bp, Artificial Sequence
  Synthetic oligonucleotide; CAG chr2 60482492 60482511 60482508 +
ggatttggcatttaaatcca

SEQ ID NO: 160836 - DNA, 20 bp, Artificial Sequence
  Synthetic oligonucleotide; AGG chr2 60482493 60482512 60482509 +
gatttggcatttaaatccac

SEQ ID NO: 160837 - DNA, 20 bp, Artificial Sequence
  Synthetic oligonucleotide; AAG chr2 60482496 60482515 60482512 +
ttggcatttaaatccacagg

SEQ ID NO: 160838 - DNA, 20 bp, Artificial Sequence
  Synthetic oligonucleotide; AAG chr2 60482500 60482519 60482516 +
catttaaatccacaggaagc

SEQ ID NO: 160839 - DNA, 20 bp, Artificial Sequence
  Synthetic oligonucleotide; AAG chr2 60482503 60482522 60482519 +
ttaaatccacaggaagcaag

SEQ ID NO: 160840 - DNA, 20 bp, Artificial Sequence
  Synthetic oligonucleotide; TAG chr2 60482508 60482527 60482524 +
tccacaggaagcaagaagaa

SEQ ID NO: 160841 - DNA, 20 bp, Artificial Sequence
  Synthetic oligonucleotide; GAG chr2 60482510 60482529 60482526 +
cacaggaagcaagaagaata

SEQ ID NO: 160842 - DNA, 20 bp, Artificial Sequence
  Synthetic oligonucleotide; AGG chr2 60482511 60482530 60482527 +
acaggaagcaagaagaatag

SEQ ID NO: 160843 - DNA, 20 bp, Artificial Sequence
  Synthetic oligonucleotide; GGG chr2 60482512 60482531 60482528 +
caggaagcaagaagaataga

SEQ ID NO: 160844 - DNA, 20 bp, Artificial Sequence
  Synthetic oligonucleotide; TAG chr2 60482527 60482546 60482543 +
atagagggactgcttattta

SEQ ID NO: 160845 - DNA, 20 bp, Artificial Sequence
  Synthetic oligonucleotide; CAG chr2 60482535 60482554 60482551 +
actgcttatttatagatttg

SEQ ID NO: 160846 - DNA, 20 bp, Artificial Sequence
  Synthetic oligonucleotide; GAG chr2 60482544 60482563 60482560 +
ttatagatttgcagatgaat

SEQ ID NO: 160847 - DNA, 20 bp, Artificial Sequence
  Synthetic oligonucleotide; AAG chr2 60482576 60482595 60482592 +
atgcacttctcgcgtatgtg

SEQ ID NO: 160848 - DNA, 20 bp, Artificial Sequence
  Synthetic oligonucleotide; AGG chr2 60482577 60482596 60482593 +
tgcacttctcgcgtatgtga

SEQ ID NO: 160849 - DNA, 20 bp, Artificial Sequence
  Synthetic oligonucleotide; GAG chr2 60482579 60482598 60482595 +
cacttctcgcgtatgtgaag

SEQ ID NO: 160850 - DNA, 20 bp, Artificial Sequence
  Synthetic oligonucleotide; CAG chr2 60482594 60482613 60482610 +
tgaaggagcaattccatttt

SEQ ID NO: 160851 - DNA, 20 bp, Artificial Sequence
  Synthetic oligonucleotide; TGG chr2 60482600 60482619 60482616 +
agcaattccattttcagact

SEQ ID NO: 160852 - DNA, 20 bp, Artificial Sequence
  Synthetic oligonucleotide; AAG chr2 60482604 60482623 60482620 +
attccattttcagacttgga

SEQ ID NO: 160853 - DNA, 20 bp, Artificial Sequence
  Synthetic oligonucleotide; AAG chr2 60482619 60482638 60482635 +
ttggaaagttctccataatt

SEQ ID NO: 160854 - DNA, 20 bp, Artificial Sequence
  Synthetic oligonucleotide; AAG chr2 60482638 60482657 60482654 +
taagtatcacccaaccctga

SEQ ID NO: 160855 - DNA, 20 bp, Artificial Sequence
  Synthetic oligonucleotide; AAG chr2 60482654 60482673 60482670 +
ctgaaagcacactgcatccc

SEQ ID NO: 160856 - DNA, 20 bp, Artificial Sequence
  Synthetic oligonucleotide; AGG chr2 60482655 60482674 60482671 +
tgaaagcacactgcatccca

SEQ ID NO: 160857 - DNA, 20 bp, Artificial Sequence
  Synthetic oligonucleotide; AAG chr2 60482660 60482679 60482676 +
gcacactgcatcccaaggtt

SEQ ID NO: 160858 - DNA, 20 bp, Artificial Sequence
  Synthetic oligonucleotide; CAG chr2 60482665 60482684 60482681 +
ctgcatcccaaggttaagat

SEQ ID NO: 160859 - DNA, 20 bp, Artificial Sequence
  Synthetic oligonucleotide; CAG chr2 60482679 60482698 60482695 +
taagatcagcttcctgaaaa

SEQ ID NO: 160860 - DNA, 20 bp, Artificial Sequence
  Synthetic oligonucleotide; AGG chr2 60482680 60482699 60482696 +
aagatcagcttcctgaaaac

SEQ ID NO: 160861 - DNA, 20 bp, Artificial Sequence
  Synthetic oligonucleotide; GGG chr2 60482681 60482700 60482697 +
agatcagcttcctgaaaaca

SEQ ID NO: 160862 - DNA, 20 bp, Artificial Sequence
  Synthetic oligonucleotide; CAG chr2 60482684 60482703 60482700 +
tcagcttcctgaaaacaggg

SEQ ID NO: 160863 - DNA, 20 bp, Artificial Sequence
  Synthetic oligonucleotide; AAG chr2 60482687 60482706 60482703 +
gcttcctgaaaacagggcag

SEQ ID NO: 160864 - DNA, 20 bp, Artificial Sequence
  Synthetic oligonucleotide; CAG chr2 60482700 60482719 60482716 +
agggcagaagactgctgctt

SEQ ID NO: 160865 - DNA, 20 bp, Artificial Sequence
  Synthetic oligonucleotide; TGG chr2 60482703 60482722 60482719 +
gcagaagactgctgcttcag

SEQ ID NO: 160866 - DNA, 20 bp, Artificial Sequence
  Synthetic oligonucleotide; TAG chr2 60482706 60482725 60482722 +
gaagactgctgcttcagtgg

SEQ ID NO: 160867 - DNA, 20 bp, Artificial Sequence
  Synthetic oligonucleotide; AAG chr2 60482727 60482746 60482743 +
agctcaaaaattctattttg

SEQ ID NO: 160868 - DNA, 20 bp, Artificial Sequence
  Synthetic oligonucleotide; AGG chr2 60482728 60482747 60482744 +
gctcaaaaattctattttga

SEQ ID NO: 160869 - DNA, 20 bp, Artificial Sequence
  Synthetic oligonucleotide; CAG chr2 60482732 60482751 60482748 +
aaaaattctattttgaagga

SEQ ID NO: 160870 - DNA, 20 bp, Artificial Sequence
  Synthetic oligonucleotide; AGG chr2 60482733 60482752 60482749 +
aaaattctattttgaaggac

SEQ ID NO: 160871 - DNA, 20 bp, Artificial Sequence
  Synthetic oligonucleotide; TAG chr2 60482737 60482756 60482753 +
ttctattttgaaggacaggt

SEQ ID NO: 160872 - DNA, 20 bp, Artificial Sequence
  Synthetic oligonucleotide; TGG chr2 60482758 60482777 60482774 +
agtaccacactacatttaac

SEQ ID NO: 160873 - DNA, 20 bp, Artificial Sequence
  Synthetic oligonucleotide; CAG chr2 60482764 60482783 60482780 +
acactacatttaactggatt

SEQ ID NO: 160874 - DNA, 20 bp, Artificial Sequence
  Synthetic oligonucleotide; CAG chr2 60482781 60482800 60482797 +
attcagttcatgtgattata

SEQ ID NO: 160875 - DNA, 20 bp, Artificial Sequence
  Synthetic oligonucleotide; TAG chr2 60482796 60482815 60482812 +
ttatacagtgccttgctttc

SEQ ID NO: 160876 - DNA, 20 bp, Artificial Sequence
  Synthetic oligonucleotide; TAG chr2 60482842 60482861 60482858 +
tgacattttaaatatccaac

SEQ ID NO: 160877 - DNA, 20 bp, Artificial Sequence
  Synthetic oligonucleotide; CAG chr2 60482856 60482875 60482872 +
tccaactagacaaataattg

SEQ ID NO: 160878 - DNA, 20 bp, Artificial Sequence
  Synthetic oligonucleotide; TAG chr2 60482869 60482888 60482885 +
ataattgcagcaataattga

SEQ ID NO: 160879 - DNA, 20 bp, Artificial Sequence
  Synthetic oligonucleotide; CAG chr2 60482872 60482891 60482888 +
attgcagcaataattgatag

SEQ ID NO: 160880 - DNA, 20 bp, Artificial Sequence
  Synthetic oligonucleotide; GAG chr2 60482874 60482893 60482890 +
tgcagcaataattgatagca

SEQ ID NO: 160881 - DNA, 20 bp, Artificial Sequence
  Synthetic oligonucleotide; AAG chr2 60482879 60482898 60482895 +
caataattgatagcagagtc

SEQ ID NO: 160882 - DNA, 20 bp, Artificial Sequence
  Synthetic oligonucleotide; TGG chr2 60482883 60482902 60482899 +
aattgatagcagagtcaagc

SEQ ID NO: 160883 - DNA, 20 bp, Artificial Sequence
  Synthetic oligonucleotide; AAG chr2 60482886 60482905 60482902 +
tgatagcagagtcaagctgg

SEQ ID NO: 160884 - DNA, 20 bp, Artificial Sequence
  Synthetic oligonucleotide; TGG chr2 60482898 60482917 60482914 +
caagctggaagatcattgat

SEQ ID NO: 160885 - DNA, 20 bp, Artificial Sequence
  Synthetic oligonucleotide; CAG chr2 60482901 60482920 60482917 +
gctggaagatcattgattgg

SEQ ID NO: 160886 - DNA, 20 bp, Artificial Sequence
  Synthetic oligonucleotide; GAG chr2 60482903 60482922 60482919 +
tggaagatcattgattggca

SEQ ID NO: 160887 - DNA, 20 bp, Artificial Sequence
  Synthetic oligonucleotide; CAG chr2 60482940 60482959 60482956 +
aatctttctttcaaacatta

SEQ ID NO: 160888 - DNA, 20 bp, Artificial Sequence
  Synthetic oligonucleotide; AAG chr2 60482957 60482976 60482973 +
ttacagaaatgatgatgttt

SEQ ID NO: 160889 - DNA, 20 bp, Artificial Sequence
  Synthetic oligonucleotide; AAG chr2 60483003 60483022 60483019 +
caaaatctgatttactgata

SEQ ID NO: 160890 - DNA, 20 bp, Artificial Sequence
  Synthetic oligonucleotide; AGG chr2 60483004 60483023 60483020 +
aaaatctgatttactgataa

SEQ ID NO: 160891 - DNA, 20 bp, Artificial Sequence
  Synthetic oligonucleotide; AAG chr2 60483013 60483032 60483029 +
tttactgataaaggcactgc

SEQ ID NO: 160892 - DNA, 20 bp, Artificial Sequence
  Synthetic oligonucleotide; CAG chr2 60483029 60483048 60483045 +
ctgcaagaaaacctgcactt

SEQ ID NO: 160893 - DNA, 20 bp, Artificial Sequence
  Synthetic oligonucleotide; GAG chr2 60483048 60483067 60483064 +
tcagcccatgattactttgc

SEQ ID NO: 160894 - DNA, 20 bp, Artificial Sequence
  Synthetic oligonucleotide; GAG chr2 60483057 60483076 60483073 +
gattactttgcgagatgttt

SEQ ID NO: 160895 - DNA, 20 bp, Artificial Sequence
  Synthetic oligonucleotide; AAG chr2 60483060 60483079 60483076 +
tactttgcgagatgtttgag

SEQ ID NO: 160896 - DNA, 20 bp, Artificial Sequence
  Synthetic oligonucleotide; CAG chr2 60483066 60483085 60483082 +
gcgagatgtttgagaagaat

SEQ ID NO: 160897 - DNA, 20 bp, Artificial Sequence
  Synthetic oligonucleotide; AGG chr2 60483067 60483086 60483083 +
cgagatgtttgagaagaatc

SEQ ID NO: 160898 - DNA, 20 bp, Artificial Sequence
  Synthetic oligonucleotide; CAG chr2 60483070 60483089 60483086 +
gatgtttgagaagaatcagg

SEQ ID NO: 160899 - DNA, 20 bp, Artificial Sequence
  Synthetic oligonucleotide; AAG chr2 60483105 60483124 60483121 +
tatttcccatgaataactgc

SEQ ID NO: 160900 - DNA, 20 bp, Artificial Sequence
  Synthetic oligonucleotide; AGG chr2 60483106 60483125 60483122 +
atttcccatgaataactgca

SEQ ID NO: 160901 - DNA, 20 bp, Artificial Sequence
  Synthetic oligonucleotide; TAG chr2 60483110 60483129 60483126 +
cccatgaataactgcaagga

SEQ ID NO: 160902 - DNA, 20 bp, Artificial Sequence
  Synthetic oligonucleotide; TGG chr2 60483115 60483134 60483131 +
gaataactgcaaggatagtg

SEQ ID NO: 160903 - DNA, 20 bp, Artificial Sequence
  Synthetic oligonucleotide; GGG chr2 60483116 60483135 60483132 +
aataactgcaaggatagtgt

SEQ ID NO: 160904 - DNA, 20 bp, Artificial Sequence
  Synthetic oligonucleotide; TAG chr2 60483119 60483138 60483135 +
aactgcaaggatagtgtggg

SEQ ID NO: 160905 - DNA, 20 bp, Artificial Sequence
  Synthetic oligonucleotide; TGG chr2 60483123 60483142 60483139 +
gcaaggatagtgtgggtagt

SEQ ID NO: 160906 - DNA, 20 bp, Artificial Sequence
  Synthetic oligonucleotide; GAG chr2 60483125 60483144 60483141 +
aaggatagtgtgggtagttg

SEQ ID NO: 160907 - DNA, 20 bp, Artificial Sequence
  Synthetic oligonucleotide; AGG chr2 60483126 60483145 60483142 +
aggatagtgtgggtagttgg

SEQ ID NO: 160908 - DNA, 20 bp, Artificial Sequence
  Synthetic oligonucleotide; GAG chr2 60483128 60483147 60483144 +
gatagtgtgggtagttggag

SEQ ID NO: 160909 - DNA, 20 bp, Artificial Sequence
  Synthetic oligonucleotide; CAG chr2 60483139 60483158 60483155 +
tagttggaggagaatcaaca

SEQ ID NO: 160910 - DNA, 20 bp, Artificial Sequence
  Synthetic oligonucleotide; AGG chr2 60483140 60483159 60483156 +
agttggaggagaatcaacac

SEQ ID NO: 160911 - DNA, 20 bp, Artificial Sequence
  Synthetic oligonucleotide; GAG chr2 60483144 60483163 60483160 +
ggaggagaatcaacacaggc

SEQ ID NO: 160912 - DNA, 20 bp, Artificial Sequence
  Synthetic oligonucleotide; GAG chr2 60483146 60483165 60483162 +
aggagaatcaacacaggcga

SEQ ID NO: 160913 - DNA, 20 bp, Artificial Sequence
  Synthetic oligonucleotide; AAG chr2 60483149 60483168 60483165 +
agaatcaacacaggcgagag

SEQ ID NO: 160914 - DNA, 20 bp, Artificial Sequence
  Synthetic oligonucleotide; TAG chr2 60483187 60483206 60483203 +
ctacacttcctgaacaatgc

SEQ ID NO: 160915 - DNA, 20 bp, Artificial Sequence
  Synthetic oligonucleotide; CAG chr2 60483198 60483217 60483214 +
gaacaatgctagccaacaat

SEQ ID NO: 160916 - DNA, 20 bp, Artificial Sequence
  Synthetic oligonucleotide; AGG chr2 60483199 60483218 60483215 +
aacaatgctagccaacaatc

SEQ ID NO: 160917 - DNA, 20 bp, Artificial Sequence
  Synthetic oligonucleotide; GGG chr2 60483200 60483219 60483216 +
acaatgctagccaacaatca

SEQ ID NO: 160918 - DNA, 20 bp, Artificial Sequence
  Synthetic oligonucleotide; CAG chr2 60483207 60483226 60483223 +
tagccaacaatcagggttta

SEQ ID NO: 160919 - DNA, 20 bp, Artificial Sequence
  Synthetic oligonucleotide; TGG chr2 60483237 60483256 60483253 +
cccctctaatatatatcccg

SEQ ID NO: 160920 - DNA, 20 bp, Artificial Sequence
  Synthetic oligonucleotide; TAG chr2 60483240 60483259 60483256 +
ctctaatatatatcccgtgg

SEQ ID NO: 160921 - DNA, 20 bp, Artificial Sequence
  Synthetic oligonucleotide; GAG chr2 60483242 60483261 60483258 +
ctaatatatatcccgtggta

SEQ ID NO: 160922 - DNA, 20 bp, Artificial Sequence
  Synthetic oligonucleotide; TGG chr2 60483248 60483267 60483264 +
tatatcccgtggtagagaaa

SEQ ID NO: 160923 - DNA, 20 bp, Artificial Sequence
  Synthetic oligonucleotide; AAG chr2 60483258 60483277 60483274 +
ggtagagaaatggtcttgac

SEQ ID NO: 160924 - DNA, 20 bp, Artificial Sequence
  Synthetic oligonucleotide; AGG chr2 60483259 60483278 60483275 +
gtagagaaatggtcttgaca

SEQ ID NO: 160925 - DNA, 20 bp, Artificial Sequence
  Synthetic oligonucleotide; GGG chr2 60483260 60483279 60483276 +
tagagaaatggtcttgacaa

SEQ ID NO: 160926 - DNA, 20 bp, Artificial Sequence
  Synthetic oligonucleotide; GGG chr2 60483261 60483280 60483277 +
agagaaatggtcttgacaag

SEQ ID NO: 160927 - DNA, 20 bp, Artificial Sequence
  Synthetic oligonucleotide; AAG chr2 60483264 60483283 60483280 +
gaaatggtcttgacaagggg

SEQ ID NO: 160928 - DNA, 20 bp, Artificial Sequence
  Synthetic oligonucleotide; CAG chr2 60483269 60483288 60483285 +
ggtcttgacaaggggaagac

SEQ ID NO: 160929 - DNA, 20 bp, Artificial Sequence
  Synthetic oligonucleotide; AGG chr2 60483270 60483289 60483286 +
gtcttgacaaggggaagacc

SEQ ID NO: 160930 - DNA, 20 bp, Artificial Sequence
  Synthetic oligonucleotide; AAG chr2 60483275 60483294 60483291 +
gacaaggggaagaccaggaa

SEQ ID NO: 160931 - DNA, 20 bp, Artificial Sequence
  Synthetic oligonucleotide; AAG chr2 60483278 60483297 60483294 +
aaggggaagaccaggaaaag

SEQ ID NO: 160932 - DNA, 20 bp, Artificial Sequence
  Synthetic oligonucleotide; CAG chr2 60483294 60483313 60483310 +
aaagaagacacacaaataat

SEQ ID NO: 160933 - DNA, 20 bp, Artificial Sequence
  Synthetic oligonucleotide; CAG chr2 60483304 60483323 60483320 +
cacaaataatcagctccatt

SEQ ID NO: 160934 - DNA, 20 bp, Artificial Sequence
  Synthetic oligonucleotide; AGG chr2 60483305 60483324 60483321 +
acaaataatcagctccattc

SEQ ID NO: 160935 - DNA, 20 bp, Artificial Sequence
  Synthetic oligonucleotide; AAG chr2 60483316 60483335 60483332 +
gctccattcaggcctttgaa

SEQ ID NO: 160936 - DNA, 20 bp, Artificial Sequence
  Synthetic oligonucleotide; TGG chr2 60483319 60483338 60483335 +
ccattcaggcctttgaaaag

SEQ ID NO: 160937 - DNA, 20 bp, Artificial Sequence
  Synthetic oligonucleotide; TGG chr2 60483342 60483361 60483358 +
tttaaatcgatgcctcaaat

SEQ ID NO: 160938 - DNA, 20 bp, Artificial Sequence
  Synthetic oligonucleotide; GGG chr2 60483343 60483362 60483359 +
ttaaatcgatgcctcaaatt

SEQ ID NO: 160939 - DNA, 20 bp, Artificial Sequence
  Synthetic oligonucleotide; CAG chr2 60483363 60483382 60483379 +
gggactcaaattcccctgcc

SEQ ID NO: 160940 - DNA, 20 bp, Artificial Sequence
  Synthetic oligonucleotide; AAG chr2 60483370 60483389 60483386 +
aaattcccctgcccagtgca

SEQ ID NO: 160941 - DNA, 20 bp, Artificial Sequence
  Synthetic oligonucleotide; TGG chr2 60483378 60483397 60483394 +
ctgcccagtgcaaagatccc

SEQ ID NO: 160942 - DNA, 20 bp, Artificial Sequence
  Synthetic oligonucleotide; AAG chr2 60483383 60483402 60483399 +
cagtgcaaagatccctggcc

SEQ ID NO: 160943 - DNA, 20 bp, Artificial Sequence
  Synthetic oligonucleotide; AGG chr2 60483384 60483403 60483400 +
agtgcaaagatccctggcca

SEQ ID NO: 160944 - DNA, 20 bp, Artificial Sequence
  Synthetic oligonucleotide; CAG chr2 60483388 60483407 60483404 +
caaagatccctggccaaggt

SEQ ID NO: 160945 - DNA, 20 bp, Artificial Sequence
  Synthetic oligonucleotide; AAG chr2 60483391 60483410 60483407 +
agatccctggccaaggtcag

SEQ ID NO: 160946 - DNA, 20 bp, Artificial Sequence
  Synthetic oligonucleotide; GAG chr2 60483398 60483417 60483414 +
tggccaaggtcagaagactt

SEQ ID NO: 160947 - DNA, 20 bp, Artificial Sequence
  Synthetic oligonucleotide; CAG chr2 60483403 60483422 60483419 +
aaggtcagaagacttgagac

SEQ ID NO: 160948 - DNA, 20 bp, Artificial Sequence
  Synthetic oligonucleotide; AGG chr2 60483404 60483423 60483420 +
aggtcagaagacttgagacc

SEQ ID NO: 160949 - DNA, 20 bp, Artificial Sequence
  Synthetic oligonucleotide; AAG chr2 60483408 60483427 60483424 +
cagaagacttgagaccaggc

SEQ ID NO: 160950 - DNA, 20 bp, Artificial Sequence
  Synthetic oligonucleotide; CAG chr2 60483414 60483433 60483430 +
acttgagaccaggcaagtcc

SEQ ID NO: 160951 - DNA, 20 bp, Artificial Sequence
  Synthetic oligonucleotide; CAG chr2 60483424 60483443 60483440 +
aggcaagtcccagatgatct

SEQ ID NO: 160952 - DNA, 20 bp, Artificial Sequence
  Synthetic oligonucleotide; AGG chr2 60483425 60483444 60483441 +
ggcaagtcccagatgatctc

SEQ ID NO: 160953 - DNA, 20 bp, Artificial Sequence
  Synthetic oligonucleotide; AAG chr2 60483429 60483448 60483445 +
agtcccagatgatctcaggc

SEQ ID NO: 160954 - DNA, 20 bp, Artificial Sequence
  Synthetic oligonucleotide; CAG chr2 60483436 60483455 60483452 +
gatgatctcaggcaagtccc

SEQ ID NO: 160955 - DNA, 20 bp, Artificial Sequence
  Synthetic oligonucleotide; AGG chr2 60483437 60483456 60483453 +
atgatctcaggcaagtcccc

SEQ ID NO: 160956 - DNA, 20 bp, Artificial Sequence
  Synthetic oligonucleotide; TAG chr2 60483442 60483461 60483458 +
ctcaggcaagtccccaggta

SEQ ID NO: 160957 - DNA, 20 bp, Artificial Sequence
  Synthetic oligonucleotide; CAG chr2 60483448 60483467 60483464 +
caagtccccaggtatagctg

SEQ ID NO: 160958 - DNA, 20 bp, Artificial Sequence
  Synthetic oligonucleotide; TAG chr2 60483457 60483476 60483473 +
aggtatagctgcagtccctt

SEQ ID NO: 160959 - DNA, 20 bp, Artificial Sequence
  Synthetic oligonucleotide; CAG chr2 60483463 60483482 60483479 +
agctgcagtccctttagccc

SEQ ID NO: 160960 - DNA, 20 bp, Artificial Sequence
  Synthetic oligonucleotide; AAG chr2 60483481 60483500 60483497 +
cccagtctgtttctctgtcc

SEQ ID NO: 160961 - DNA, 20 bp, Artificial Sequence
  Synthetic oligonucleotide; AGG chr2 60483482 60483501 60483498 +
ccagtctgtttctctgtcca

SEQ ID NO: 160962 - DNA, 20 bp, Artificial Sequence
  Synthetic oligonucleotide; CAG chr2 60483485 60483504 60483501 +
gtctgtttctctgtccaagg

SEQ ID NO: 160963 - DNA, 20 bp, Artificial Sequence
  Synthetic oligonucleotide; AAG chr2 60483536 60483555 60483552 +
gtgttttgattgtaatattt

SEQ ID NO: 160964 - DNA, 20 bp, Artificial Sequence
  Synthetic oligonucleotide; TAG chr2 60483540 60483559 60483556 +
tttgattgtaatatttaagt

SEQ ID NO: 160965 - DNA, 20 bp, Artificial Sequence
  Synthetic oligonucleotide; AGG chr2 60483541 60483560 60483557 +
ttgattgtaatatttaagtt

SEQ ID NO: 160966 - DNA, 20 bp, Artificial Sequence
  Synthetic oligonucleotide; GGG chr2 60483542 60483561 60483558 +
tgattgtaatatttaagtta

SEQ ID NO: 160967 - DNA, 20 bp, Artificial Sequence
  Synthetic oligonucleotide; CAG chr2 60483562 60483581 60483578 +
gggcactgtgttcaacaact

SEQ ID NO: 160968 - DNA, 20 bp, Artificial Sequence
  Synthetic oligonucleotide; TGG chr2 60483571 60483590 60483587 +
gttcaacaactcagaccctg

SEQ ID NO: 160969 - DNA, 20 bp, Artificial Sequence
  Synthetic oligonucleotide; CAG chr2 60483581 60483600 60483597 +
tcagaccctgtggaatgctg

SEQ ID NO: 160970 - DNA, 20 bp, Artificial Sequence
  Synthetic oligonucleotide; CAG chr2 60483588 60483607 60483604 +
ctgtggaatgctgcagttgt

SEQ ID NO: 160971 - DNA, 20 bp, Artificial Sequence
  Synthetic oligonucleotide; AAG chr2 60483600 60483619 60483616 +
gcagttgtcagaaataactc

SEQ ID NO: 160972 - DNA, 20 bp, Artificial Sequence
  Synthetic oligonucleotide; GAG chr2 60483602 60483621 60483618 +
agttgtcagaaataactcaa

SEQ ID NO: 160973 - DNA, 20 bp, Artificial Sequence
  Synthetic oligonucleotide; GAG chr2 60483604 60483623 60483620 +
ttgtcagaaataactcaaga

SEQ ID NO: 160974 - DNA, 20 bp, Artificial Sequence
  Synthetic oligonucleotide; AGG chr2 60483605 60483624 60483621 +
tgtcagaaataactcaagag

SEQ ID NO: 160975 - DNA, 20 bp, Artificial Sequence
  Synthetic oligonucleotide; CAG chr2 60483619 60483638 60483635 +
caagagaggatgctcgtccc

SEQ ID NO: 160976 - DNA, 20 bp, Artificial Sequence
  Synthetic oligonucleotide; AGG chr2 60483620 60483639 60483636 +
aagagaggatgctcgtcccc

SEQ ID NO: 160977 - DNA, 20 bp, Artificial Sequence
  Synthetic oligonucleotide; GAG chr2 60483638 60483657 60483654 +
ccaggaaacatcaaatgaat

SEQ ID NO: 160978 - DNA, 20 bp, Artificial Sequence
  Synthetic oligonucleotide; TGG chr2 60483642 60483661 60483658 +
gaaacatcaaatgaatgagc

SEQ ID NO: 160979 - DNA, 20 bp, Artificial Sequence
  Synthetic oligonucleotide; TAG chr2 60483650 60483669 60483666 +
aaatgaatgagctggcatat

SEQ ID NO: 160980 - DNA, 20 bp, Artificial Sequence
  Synthetic oligonucleotide; CAG chr2 60483653 60483672 60483669 +
tgaatgagctggcatattag

SEQ ID NO: 160981 - DNA, 20 bp, Artificial Sequence
  Synthetic oligonucleotide; TGG chr2 60483659 60483678 60483675 +
agctggcatattagcagacg

SEQ ID NO: 160982 - DNA, 20 bp, Artificial Sequence
  Synthetic oligonucleotide; CAG chr2 60483666 60483685 60483682 +
atattagcagacgtggatta

SEQ ID NO: 160983 - DNA, 20 bp, Artificial Sequence
  Synthetic oligonucleotide; AAG chr2 60483670 60483689 60483686 +
tagcagacgtggattacagt

SEQ ID NO: 160984 - DNA, 20 bp, Artificial Sequence
  Synthetic oligonucleotide; AGG chr2 60483671 60483690 60483687 +
agcagacgtggattacagta

SEQ ID NO: 160985 - DNA, 20 bp, Artificial Sequence
  Synthetic oligonucleotide; CAG chr2 60483685 60483704 60483701 +
acagtaaggaaaatctaaaa

SEQ ID NO: 160986 - DNA, 20 bp, Artificial Sequence
  Synthetic oligonucleotide; AAG chr2 60483688 60483707 60483704 +
gtaaggaaaatctaaaacag

SEQ ID NO: 160987 - DNA, 20 bp, Artificial Sequence
  Synthetic oligonucleotide; TGG chr2 60483698 60483717 60483714 +
tctaaaacagaagatgtatc

SEQ ID NO: 160988 - DNA, 20 bp, Artificial Sequence
  Synthetic oligonucleotide; CAG chr2 60483707 60483726 60483723 +
gaagatgtatctggatgctt

SEQ ID NO: 160989 - DNA, 20 bp, Artificial Sequence
  Synthetic oligonucleotide; CAG chr2 60483710 60483729 60483726 +
gatgtatctggatgcttcag

SEQ ID NO: 160990 - DNA, 20 bp, Artificial Sequence
  Synthetic oligonucleotide; AAG chr2 60483719 60483738 60483735 +
ggatgcttcagcagacaaca

SEQ ID NO: 160991 - DNA, 20 bp, Artificial Sequence
  Synthetic oligonucleotide; AGG chr2 60483720 60483739 60483736 +
gatgcttcagcagacaacaa

SEQ ID NO: 160992 - DNA, 20 bp, Artificial Sequence
  Synthetic oligonucleotide; AAG chr2 60483723 60483742 60483739 +
gcttcagcagacaacaaagg

SEQ ID NO: 160993 - DNA, 20 bp, Artificial Sequence
  Synthetic oligonucleotide; TGG chr2 60483730 60483749 60483746 +
cagacaacaaaggaagaatt

SEQ ID NO: 160994 - DNA, 20 bp, Artificial Sequence
  Synthetic oligonucleotide; GGG chr2 60483731 60483750 60483747 +
agacaacaaaggaagaattt

SEQ ID NO: 160995 - DNA, 20 bp, Artificial Sequence
  Synthetic oligonucleotide; GGG chr2 60483732 60483751 60483748 +
gacaacaaaggaagaatttg

SEQ ID NO: 160996 - DNA, 20 bp, Artificial Sequence
  Synthetic oligonucleotide; TGG chr2 60483737 60483756 60483753 +
caaaggaagaatttggggac

SEQ ID NO: 160997 - DNA, 20 bp, Artificial Sequence
  Synthetic oligonucleotide; GGG chr2 60483738 60483757 60483754 +
aaaggaagaatttggggact

SEQ ID NO: 160998 - DNA, 20 bp, Artificial Sequence
  Synthetic oligonucleotide; AAG chr2 60483744 60483763 60483760 +
agaatttggggactgggtct

SEQ ID NO: 160999 - DNA, 20 bp, Artificial Sequence
  Synthetic oligonucleotide; AAG chr2 60483757 60483776 60483773 +
tgggtctaagcactcgccca

SEQ ID NO: 161000 - DNA, 20 bp, Artificial Sequence
  Synthetic oligonucleotide; TAG chr2 60483763 60483782 60483779 +
taagcactcgcccaaagcac

SEQ ID NO: 161001 - DNA, 20 bp, Artificial Sequence
  Synthetic oligonucleotide; AAG chr2 60483766 60483785 60483782 +
gcactcgcccaaagcactag

SEQ ID NO: 161002 - DNA, 20 bp, Artificial Sequence
  Synthetic oligonucleotide; AGG chr2 60483767 60483786 60483783 +
cactcgcccaaagcactaga

SEQ ID NO: 161003 - DNA, 20 bp, Artificial Sequence
  Synthetic oligonucleotide; GAG chr2 60483769 60483788 60483785 +
ctcgcccaaagcactagaag

SEQ ID NO: 161004 - DNA, 20 bp, Artificial Sequence
  Synthetic oligonucleotide; AGG chr2 60483770 60483789 60483786 +
tcgcccaaagcactagaagg

SEQ ID NO: 161005 - DNA, 20 bp, Artificial Sequence
  Synthetic oligonucleotide; TGG chr2 60483809 60483828 60483825 +
ctttcctatttttgttcttc

SEQ ID NO: 161006 - DNA, 20 bp, Artificial Sequence
  Synthetic oligonucleotide; TGG chr2 60483866 60483885 60483882 +
ctttccttctttttctttct

SEQ ID NO: 161007 - DNA, 20 bp, Artificial Sequence
  Synthetic oligonucleotide; GAG chr2 60483909 60483928 60483925 +
gaaactgaaccattataaat

SEQ ID NO: 161008 - DNA, 20 bp, Artificial Sequence
  Synthetic oligonucleotide; TGG chr2 60483913 60483932 60483929 +
ctgaaccattataaatgagt

SEQ ID NO: 161009 - DNA, 20 bp, Artificial Sequence
  Synthetic oligonucleotide; TAG chr2 60483921 60483940 60483937 +
ttataaatgagttggtctca

SEQ ID NO: 161010 - DNA, 20 bp, Artificial Sequence
  Synthetic oligonucleotide; CAG chr2 60483938 60483957 60483954 +
tcatagcttctgttaaaaat

SEQ ID NO: 161011 - DNA, 20 bp, Artificial Sequence
  Synthetic oligonucleotide; AAG chr2 60483941 60483960 60483957 +
tagcttctgttaaaaatcag

SEQ ID NO: 161012 - DNA, 20 bp, Artificial Sequence
  Synthetic oligonucleotide; TAG chr2 60483949 60483968 60483965 +
gttaaaaatcagaagcttgt

SEQ ID NO: 161013 - DNA, 20 bp, Artificial Sequence
  Synthetic oligonucleotide; GAG chr2 60483990 60484009 60484006 +
ttgtgacacttaccgcgtat

SEQ ID NO: 161014 - DNA, 20 bp, Artificial Sequence
  Synthetic oligonucleotide; AGG chr2 60483991 60484010 60484007 +
tgtgacacttaccgcgtatg

SEQ ID NO: 161015 - DNA, 20 bp, Artificial Sequence
  Synthetic oligonucleotide; GGG chr2 60483992 60484011 60484008 +
gtgacacttaccgcgtatga

SEQ ID NO: 161016 - DNA, 20 bp, Artificial Sequence
  Synthetic oligonucleotide; GGG chr2 60483993 60484012 60484009 +
tgacacttaccgcgtatgag

SEQ ID NO: 161017 - DNA, 20 bp, Artificial Sequence
  Synthetic oligonucleotide; CAG chr2 60484006 60484025 60484022 +
gtatgaggggtcttgtcgaa

SEQ ID NO: 161018 - DNA, 20 bp, Artificial Sequence
  Synthetic oligonucleotide; TAG chr2 60484022 60484041 60484038 +
cgaacagctttactctaatt

SEQ ID NO: 161019 - DNA, 20 bp, Artificial Sequence
  Synthetic oligonucleotide; GAG chr2 60484024 60484043 60484040 +
aacagctttactctaattta

SEQ ID NO: 161020 - DNA, 20 bp, Artificial Sequence
  Synthetic oligonucleotide; TAG chr2 60484040 60484059 60484056 +
tttagagctcctctgttaat

SEQ ID NO: 161021 - DNA, 20 bp, Artificial Sequence
  Synthetic oligonucleotide; AAG chr2 60484044 60484063 60484060 +
gagctcctctgttaattaga

SEQ ID NO: 161022 - DNA, 20 bp, Artificial Sequence
  Synthetic oligonucleotide; CAG chr2 60484051 60484070 60484067 +
tctgttaattagaaagccct

SEQ ID NO: 161023 - DNA, 20 bp, Artificial Sequence
  Synthetic oligonucleotide; CAG chr2 60484068 60484087 60484084 +
cctcagattttctgcaaatg

SEQ ID NO: 161024 - DNA, 20 bp, Artificial Sequence
  Synthetic oligonucleotide; AGG chr2 60484069 60484088 60484085 +
ctcagattttctgcaaatgc

SEQ ID NO: 161025 - DNA, 20 bp, Artificial Sequence
  Synthetic oligonucleotide; CAG chr2 60484082 60484101 60484098 +
caaatgcaggtcactatcga

SEQ ID NO: 161026 - DNA, 20 bp, Artificial Sequence
  Synthetic oligonucleotide; CAG chr2 60484112 60484131 60484128 +
ttttgatgcttcgtctgtga

SEQ ID NO: 161027 - DNA, 20 bp, Artificial Sequence
  Synthetic oligonucleotide; TGG chr2 60484119 60484138 60484135 +
gcttcgtctgtgacagttgt

SEQ ID NO: 161028 - DNA, 20 bp, Artificial Sequence
  Synthetic oligonucleotide; GGG chr2 60484120 60484139 60484136 +
cttcgtctgtgacagttgtt

SEQ ID NO: 161029 - DNA, 20 bp, Artificial Sequence
  Synthetic oligonucleotide; TAG chr2 60484132 60484151 60484148 +
cagttgttgggttgcccttc

SEQ ID NO: 161030 - DNA, 20 bp, Artificial Sequence
  Synthetic oligonucleotide; AGG chr2 60484133 60484152 60484149 +
agttgttgggttgcccttct

SEQ ID NO: 161031 - DNA, 20 bp, Artificial Sequence
  Synthetic oligonucleotide; GAG chr2 60484135 60484154 60484151 +
ttgttgggttgcccttctag

SEQ ID NO: 161032 - DNA, 20 bp, Artificial Sequence
  Synthetic oligonucleotide; TGG chr2 60484139 60484158 60484155 +
tgggttgcccttctaggagc

SEQ ID NO: 161033 - DNA, 20 bp, Artificial Sequence
  Synthetic oligonucleotide; CAG chr2 60484142 60484161 60484158 +
gttgcccttctaggagctgg

SEQ ID NO: 161034 - DNA, 20 bp, Artificial Sequence
  Synthetic oligonucleotide; AGG chr2 60484143 60484162 60484159 +
ttgcccttctaggagctggc

SEQ ID NO: 161035 - DNA, 20 bp, Artificial Sequence
  Synthetic oligonucleotide; GGG chr2 60484144 60484163 60484160 +
tgcccttctaggagctggca

SEQ ID NO: 161036 - DNA, 20 bp, Artificial Sequence
  Synthetic oligonucleotide; CAG chr2 60484152 60484171 60484168 +
taggagctggcagggttgtc

SEQ ID NO: 161037 - DNA, 20 bp, Artificial Sequence
  Synthetic oligonucleotide; CAG chr2 60484162 60484181 60484178 +
cagggttgtccagactctga

SEQ ID NO: 161038 - DNA, 20 bp, Artificial Sequence
  Synthetic oligonucleotide; CAG chr2 60484168 60484187 60484184 +
tgtccagactctgacagtgt

SEQ ID NO: 161039 - DNA, 20 bp, Artificial Sequence
  Synthetic oligonucleotide; CAG chr2 60484177 60484196 60484193 +
tctgacagtgtcagaaaatg

SEQ ID NO: 161040 - DNA, 20 bp, Artificial Sequence
  Synthetic oligonucleotide; CGG chr2 60484186 60484205 60484202 +
gtcagaaaatgcagtcacca

SEQ ID NO: 161041 - DNA, 20 bp, Artificial Sequence
  Synthetic oligonucleotide; CAG chr2 60484197 60484216 60484213 +
cagtcaccacggctgcttca

SEQ ID NO: 161042 - DNA, 20 bp, Artificial Sequence
  Synthetic oligonucleotide; AGG chr2 60484198 60484217 60484214 +
agtcaccacggctgcttcac

SEQ ID NO: 161043 - DNA, 20 bp, Artificial Sequence
  Synthetic oligonucleotide; AAG chr2 60484201 60484220 60484217 +
caccacggctgcttcacagg

SEQ ID NO: 161044 - DNA, 20 bp, Artificial Sequence
  Synthetic oligonucleotide; AAG chr2 60484212 60484231 60484228 +
cttcacaggaagttacacgc

SEQ ID NO: 161045 - DNA, 20 bp, Artificial Sequence
  Synthetic oligonucleotide; AGG chr2 60484213 60484232 60484229 +
ttcacaggaagttacacgca

SEQ ID NO: 161046 - DNA, 20 bp, Artificial Sequence
  Synthetic oligonucleotide; CAG chr2 60484224 60484243 60484240 +
ttacacgcaaggtccgcaca

SEQ ID NO: 161047 - DNA, 20 bp, Artificial Sequence
  Synthetic oligonucleotide; CAG chr2 60484228 60484247 60484244 +
acgcaaggtccgcacacagt

SEQ ID NO: 161048 - DNA, 20 bp, Artificial Sequence
  Synthetic oligonucleotide; TAG chr2 60484239 60484258 60484255 +
gcacacagtcagtttccctg

SEQ ID NO: 161049 - DNA, 20 bp, Artificial Sequence
  Synthetic oligonucleotide; CAG chr2 60484244 60484263 60484260 +
cagtcagtttccctgtagcc

SEQ ID NO: 161050 - DNA, 20 bp, Artificial Sequence
  Synthetic oligonucleotide; AAG chr2 60484247 60484266 60484263 +
tcagtttccctgtagcccag

SEQ ID NO: 161051 - DNA, 20 bp, Artificial Sequence
  Synthetic oligonucleotide; CAG chr2 60484274 60484293 60484290 +
atgaaatctgcactcacatt

SEQ ID NO: 161052 - DNA, 20 bp, Artificial Sequence
  Synthetic oligonucleotide; TAG chr2 60484284 60484303 60484300 +
cactcacattcagctgaaaa

SEQ ID NO: 161053 - DNA, 20 bp, Artificial Sequence
  Synthetic oligonucleotide; CAG chr2 60484377 60484396 60484393 +
ctttctccaacctctgtttc

SEQ ID NO: 161054 - DNA, 20 bp, Artificial Sequence
  Synthetic oligonucleotide; TAG chr2 60484407 60484426 60484423 +
tttctcatcttctctctctt

SEQ ID NO: 161055 - DNA, 20 bp, Artificial Sequence
  Synthetic oligonucleotide; TGG chr2 60484421 60484440 60484437 +
tctctttagtcctcaacaac

SEQ ID NO: 161056 - DNA, 20 bp, Artificial Sequence
  Synthetic oligonucleotide; GGG chr2 60484422 60484441 60484438 +
ctctttagtcctcaacaact

SEQ ID NO: 161057 - DNA, 20 bp, Artificial Sequence
  Synthetic oligonucleotide; GGG chr2 60484423 60484442 60484439 +
tctttagtcctcaacaactg

SEQ ID NO: 161058 - DNA, 20 bp, Artificial Sequence
  Synthetic oligonucleotide; CAG chr2 60484443 60484462 60484459 +
gggtcctctgctgtcaaaaa

SEQ ID NO: 161059 - DNA, 20 bp, Artificial Sequence
  Synthetic oligonucleotide; CAG chr2 60484456 60484475 60484472 +
tcaaaaacagccacattcac

SEQ ID NO: 161060 - DNA, 20 bp, Artificial Sequence
  Synthetic oligonucleotide; AAG chr2 60484460 60484479 60484476 +
aaacagccacattcaccaga

SEQ ID NO: 161061 - DNA, 20 bp, Artificial Sequence
  Synthetic oligonucleotide; AGG chr2 60484461 60484480 60484477 +
aacagccacattcaccagaa

SEQ ID NO: 161062 - DNA, 20 bp, Artificial Sequence
  Synthetic oligonucleotide; GGG chr2 60484462 60484481 60484478 +
acagccacattcaccagaaa

SEQ ID NO: 161063 - DNA, 20 bp, Artificial Sequence
  Synthetic oligonucleotide; AAG chr2 60484465 60484484 60484481 +
gccacattcaccagaaaggg

SEQ ID NO: 161064 - DNA, 20 bp, Artificial Sequence
  Synthetic oligonucleotide; TAG chr2 60484468 60484487 60484484 +
acattcaccagaaagggaag

SEQ ID NO: 161065 - DNA, 20 bp, Artificial Sequence
  Synthetic oligonucleotide; AGG chr2 60484469 60484488 60484485 +
cattcaccagaaagggaagt

SEQ ID NO: 161066 - DNA, 20 bp, Artificial Sequence
  Synthetic oligonucleotide; CAG chr2 60484477 60484496 60484493 +
agaaagggaagtaggtttta

SEQ ID NO: 161067 - DNA, 20 bp, Artificial Sequence
  Synthetic oligonucleotide; CGG chr2 60484486 60484505 60484502 +
agtaggttttacagataaac

SEQ ID NO: 161068 - DNA, 20 bp, Artificial Sequence
  Synthetic oligonucleotide; GGG chr2 60484487 60484506 60484503 +
gtaggttttacagataaacc

SEQ ID NO: 161069 - DNA, 20 bp, Artificial Sequence
  Synthetic oligonucleotide; CAG chr2 60484506 60484525 60484522 +
cgggttgcttttcactgaaa

SEQ ID NO: 161070 - DNA, 20 bp, Artificial Sequence
  Synthetic oligonucleotide; CAG chr2 60484509 60484528 60484525 +
gttgcttttcactgaaacag

SEQ ID NO: 161071 - DNA, 20 bp, Artificial Sequence
  Synthetic oligonucleotide; TGG chr2 60484518 60484537 60484534 +
cactgaaacagcagtgattg

SEQ ID NO: 161072 - DNA, 20 bp, Artificial Sequence
  Synthetic oligonucleotide; CAG chr2 60484523 60484542 60484539 +
aaacagcagtgattgtggaa

SEQ ID NO: 161073 - DNA, 20 bp, Artificial Sequence
  Synthetic oligonucleotide; CGG chr2 60484575 60484594 60484591 +
tatttcctatttttttgcac

SEQ ID NO: 161074 - DNA, 20 bp, Artificial Sequence
  Synthetic oligonucleotide; CAG chr2 60484579 60484598 60484595 +
tcctatttttttgcaccggt

SEQ ID NO: 161075 - DNA, 20 bp, Artificial Sequence
  Synthetic oligonucleotide; CAG chr2 60484582 60484601 60484598 +
tatttttttgcaccggtcag

SEQ ID NO: 161076 - DNA, 20 bp, Artificial Sequence
  Synthetic oligonucleotide; TGG chr2 60484592 60484611 60484608 +
caccggtcagcagccgcacc

SEQ ID NO: 161077 - DNA, 20 bp, Artificial Sequence
  Synthetic oligonucleotide; GAG chr2 60484596 60484615 60484612 +
ggtcagcagccgcacctggt

SEQ ID NO: 161078 - DNA, 20 bp, Artificial Sequence
  Synthetic oligonucleotide; AGG chr2 60484597 60484616 60484613 +
gtcagcagccgcacctggtg

SEQ ID NO: 161079 - DNA, 20 bp, Artificial Sequence
  Synthetic oligonucleotide; GAG chr2 60484602 60484621 60484618 +
cagccgcacctggtgaggct

SEQ ID NO: 161080 - DNA, 20 bp, Artificial Sequence
  Synthetic oligonucleotide; AGG chr2 60484603 60484622 60484619 +
agccgcacctggtgaggctg

SEQ ID NO: 161081 - DNA, 20 bp, Artificial Sequence
  Synthetic oligonucleotide; AAG chr2 60484608 60484627 60484624 +
cacctggtgaggctgaggtc

SEQ ID NO: 161082 - DNA, 20 bp, Artificial Sequence
  Synthetic oligonucleotide; AGG chr2 60484609 60484628 60484625 +
acctggtgaggctgaggtca

SEQ ID NO: 161083 - DNA, 20 bp, Artificial Sequence
  Synthetic oligonucleotide; TGG chr2 60484626 60484645 60484642 +
tcaaggctgtacttccaaca

SEQ ID NO: 161084 - DNA, 20 bp, Artificial Sequence
  Synthetic oligonucleotide; AAG chr2 60484646 60484665 60484662 +
tggctcacgtgttttttctt

SEQ ID NO: 161085 - DNA, 20 bp, Artificial Sequence
  Synthetic oligonucleotide; GAG chr2 60484648 60484667 60484664 +
gctcacgtgttttttcttaa

SEQ ID NO: 161086 - DNA, 20 bp, Artificial Sequence
  Synthetic oligonucleotide; AAG chr2 60484651 60484670 60484667 +
cacgtgttttttcttaagag

SEQ ID NO: 161087 - DNA, 20 bp, Artificial Sequence
  Synthetic oligonucleotide; AGG chr2 60484652 60484671 60484668 +
acgtgttttttcttaagaga

SEQ ID NO: 161088 - DNA, 20 bp, Artificial Sequence
  Synthetic oligonucleotide; GGG chr2 60484653 60484672 60484669 +
cgtgttttttcttaagagaa

SEQ ID NO: 161089 - DNA, 20 bp, Artificial Sequence
  Synthetic oligonucleotide; GGG chr2 60484654 60484673 60484670 +
gtgttttttcttaagagaag

SEQ ID NO: 161090 - DNA, 20 bp, Artificial Sequence
  Synthetic oligonucleotide; GGG chr2 60484655 60484674 60484671 +
tgttttttcttaagagaagg

SEQ ID NO: 161091 - DNA, 20 bp, Artificial Sequence
  Synthetic oligonucleotide; TGG chr2 60484662 60484681 60484678 +
tcttaagagaagggggaatt

SEQ ID NO: 161092 - DNA, 20 bp, Artificial Sequence
  Synthetic oligonucleotide; GAG chr2 60484664 60484683 60484680 +
ttaagagaagggggaatttg

SEQ ID NO: 161093 - DNA, 20 bp, Artificial Sequence
  Synthetic oligonucleotide; AGG chr2 60484665 60484684 60484681 +
taagagaagggggaatttgg

SEQ ID NO: 161094 - DNA, 20 bp, Artificial Sequence
  Synthetic oligonucleotide; GGG chr2 60484666 60484685 60484682 +
aagagaagggggaatttgga

SEQ ID NO: 161095 - DNA, 20 bp, Artificial Sequence
  Synthetic oligonucleotide; GGG chr2 60484667 60484686 60484683 +
agagaagggggaatttggag

SEQ ID NO: 161096 - DNA, 20 bp, Artificial Sequence
  Synthetic oligonucleotide; GGG chr2 60484668 60484687 60484684 +
gagaagggggaatttggagg

SEQ ID NO: 161097 - DNA, 20 bp, Artificial Sequence
  Synthetic oligonucleotide; GGG chr2 60484669 60484688 60484685 +
agaagggggaatttggaggg

SEQ ID NO: 161098 - DNA, 20 bp, Artificial Sequence
  Synthetic oligonucleotide; AAG chr2 60484678 60484697 60484694 +
aatttggaggggggcaaaaa

SEQ ID NO: 161099 - DNA, 20 bp, Artificial Sequence
  Synthetic oligonucleotide; AAG chr2 60484681 60484700 60484697 +
ttggaggggggcaaaaaaag

SEQ ID NO: 161100 - DNA, 20 bp, Artificial Sequence
  Synthetic oligonucleotide; AGG chr2 60484682 60484701 60484698 +
tggaggggggcaaaaaaaga

SEQ ID NO: 161101 - DNA, 20 bp, Artificial Sequence
  Synthetic oligonucleotide; GAG chr2 60484684 60484703 60484700 +
gaggggggcaaaaaaagaag

SEQ ID NO: 161102 - DNA, 20 bp, Artificial Sequence
  Synthetic oligonucleotide; AAG chr2 60484688 60484707 60484704 +
ggggcaaaaaaagaaggaga

SEQ ID NO: 161103 - DNA, 20 bp, Artificial Sequence
  Synthetic oligonucleotide; GAG chr2 60484690 60484709 60484706 +
ggcaaaaaaagaaggagaaa

SEQ ID NO: 161104 - DNA, 20 bp, Artificial Sequence
  Synthetic oligonucleotide; GAG chr2 60484692 60484711 60484708 +
caaaaaaagaaggagaaaga

SEQ ID NO: 161105 - DNA, 20 bp, Artificial Sequence
  Synthetic oligonucleotide; AGG chr2 60484693 60484712 60484709 +
aaaaaaagaaggagaaagag

SEQ ID NO: 161106 - DNA, 20 bp, Artificial Sequence
  Synthetic oligonucleotide; AAG chr2 60484697 60484716 60484713 +
aaagaaggagaaagagagga

SEQ ID NO: 161107 - DNA, 20 bp, Artificial Sequence
  Synthetic oligonucleotide; AGG chr2 60484698 60484717 60484714 +
aagaaggagaaagagaggaa

SEQ ID NO: 161108 - DNA, 20 bp, Artificial Sequence
  Synthetic oligonucleotide; GAG chr2 60484711 60484730 60484727 +
agaggaaaggttaaccactc

SEQ ID NO: 161109 - DNA, 20 bp, Artificial Sequence
  Synthetic oligonucleotide; TGG chr2 60484726 60484745 60484742 +
cactcgagaaaaaatgcaca

SEQ ID NO: 161110 - DNA, 20 bp, Artificial Sequence
  Synthetic oligonucleotide; GGG chr2 60484727 60484746 60484743 +
actcgagaaaaaatgcacat

SEQ ID NO: 161111 - DNA, 20 bp, Artificial Sequence
  Synthetic oligonucleotide; GAG chr2 60484732 60484751 60484748 +
agaaaaaatgcacatgggct

SEQ ID NO: 161112 - DNA, 20 bp, Artificial Sequence
  Synthetic oligonucleotide; AGG chr2 60484733 60484752 60484749 +
gaaaaaatgcacatgggctg

SEQ ID NO: 161113 - DNA, 20 bp, Artificial Sequence
  Synthetic oligonucleotide; CAG chr2 60484758 60484777 60484774 +
tcctgcccttatcaccattc

SEQ ID NO: 161114 - DNA, 20 bp, Artificial Sequence
  Synthetic oligonucleotide; TGG chr2 60484778 60484797 60484794 +
cagtataaaacctcaaatta

SEQ ID NO: 161115 - DNA, 20 bp, Artificial Sequence
  Synthetic oligonucleotide; GGG chr2 60484779 60484798 60484795 +
agtataaaacctcaaattat

SEQ ID NO: 161116 - DNA, 20 bp, Artificial Sequence
  Synthetic oligonucleotide; TAG chr2 60484792 60484811 60484808 +
aaattatgggaattctcact

SEQ ID NO: 161117 - DNA, 20 bp, Artificial Sequence
  Synthetic oligonucleotide; AGG chr2 60484793 60484812 60484809 +
aattatgggaattctcactt

SEQ ID NO: 161118 - DNA, 20 bp, Artificial Sequence
  Synthetic oligonucleotide; TGG chr2 60484808 60484827 60484824 +
cacttaggaacacctcatta

SEQ ID NO: 161119 - DNA, 20 bp, Artificial Sequence
  Synthetic oligonucleotide; TGG chr2 60484822 60484841 60484838 +
tcattatggaacatatgtgc

SEQ ID NO: 161120 - DNA, 20 bp, Artificial Sequence
  Synthetic oligonucleotide; GGG chr2 60484823 60484842 60484839 +
cattatggaacatatgtgct

SEQ ID NO: 161121 - DNA, 20 bp, Artificial Sequence
  Synthetic oligonucleotide; GGG chr2 60484824 60484843 60484840 +
attatggaacatatgtgctg

SEQ ID NO: 161122 - DNA, 20 bp, Artificial Sequence
  Synthetic oligonucleotide; GGG chr2 60484825 60484844 60484841 +
ttatggaacatatgtgctgg

SEQ ID NO: 161123 - DNA, 20 bp, Artificial Sequence
  Synthetic oligonucleotide; TGG chr2 60484830 60484849 60484846 +
gaacatatgtgctgggggtc

SEQ ID NO: 161124 - DNA, 20 bp, Artificial Sequence
  Synthetic oligonucleotide; GGG chr2 60484831 60484850 60484847 +
aacatatgtgctgggggtct

SEQ ID NO: 161125 - DNA, 20 bp, Artificial Sequence
  Synthetic oligonucleotide; GGG chr2 60484832 60484851 60484848 +
acatatgtgctgggggtctg

SEQ ID NO: 161126 - DNA, 20 bp, Artificial Sequence
  Synthetic oligonucleotide; GAG chr2 60484834 60484853 60484850 +
atatgtgctgggggtctggg

SEQ ID NO: 161127 - DNA, 20 bp, Artificial Sequence
  Synthetic oligonucleotide; TGG chr2 60484838 60484857 60484854 +
gtgctgggggtctggggaga

SEQ ID NO: 161128 - DNA, 20 bp, Artificial Sequence
  Synthetic oligonucleotide; GGG chr2 60484839 60484858 60484855 +
tgctgggggtctggggagat

SEQ ID NO: 161129 - DNA, 20 bp, Artificial Sequence
  Synthetic oligonucleotide; GAG chr2 60484841 60484860 60484857 +
ctgggggtctggggagatgg

SEQ ID NO: 161130 - DNA, 20 bp, Artificial Sequence
  Synthetic oligonucleotide; AAG chr2 60484844 60484863 60484860 +
ggggtctggggagatgggag

SEQ ID NO: 161131 - DNA, 20 bp, Artificial Sequence
  Synthetic oligonucleotide; AGG chr2 60484845 60484864 60484861 +
gggtctggggagatgggaga

SEQ ID NO: 161132 - DNA, 20 bp, Artificial Sequence
  Synthetic oligonucleotide; GGG chr2 60484846 60484865 60484862 +
ggtctggggagatgggagaa

SEQ ID NO: 161133 - DNA, 20 bp, Artificial Sequence
  Synthetic oligonucleotide; GGG chr2 60484847 60484866 60484863 +
gtctggggagatgggagaag

SEQ ID NO: 161134 - DNA, 20 bp, Artificial Sequence
  Synthetic oligonucleotide; AAG chr2 60484898 60484917 60484914 +
tgtgtgctccaaattttatc

SEQ ID NO: 161135 - DNA, 20 bp, Artificial Sequence
  Synthetic oligonucleotide; AAG chr2 60484904 60484923 60484920 +
ctccaaattttatcaagttc

SEQ ID NO: 161136 - DNA, 20 bp, Artificial Sequence
  Synthetic oligonucleotide; AAG chr2 60484912 60484931 60484928 +
tttatcaagttcaagccaaa

SEQ ID NO: 161137 - DNA, 20 bp, Artificial Sequence
  Synthetic oligonucleotide; TGG chr2 60484925 60484944 60484941 +
agccaaaaagaaatcctctg

SEQ ID NO: 161138 - DNA, 20 bp, Artificial Sequence
  Synthetic oligonucleotide; TAG chr2 60484936 60484955 60484952 +
aatcctctgtggcacttgtt

SEQ ID NO: 161139 - DNA, 20 bp, Artificial Sequence
  Synthetic oligonucleotide; AGG chr2 60484937 60484956 60484953 +
atcctctgtggcacttgttt

SEQ ID NO: 161140 - DNA, 20 bp, Artificial Sequence
  Synthetic oligonucleotide; CAG chr2 60484982 60485001 60484998 +
ccaaccaaccaaacaaaaaa

SEQ ID NO: 161141 - DNA, 20 bp, Artificial Sequence
  Synthetic oligonucleotide; TAG chr2 60484999 60485018 60485015 +
aaacagtatttaaatcaaaa

SEQ ID NO: 161142 - DNA, 20 bp, Artificial Sequence
  Synthetic oligonucleotide; AGG chr2 60485000 60485019 60485016 +
aacagtatttaaatcaaaat

SEQ ID NO: 161143 - DNA, 20 bp, Artificial Sequence
  Synthetic oligonucleotide; AAG chr2 60485043 60485062 60485059 +
acaccctcaccaccaccacc

SEQ ID NO: 161144 - DNA, 20 bp, Artificial Sequence
  Synthetic oligonucleotide; AGG chr2 60485044 60485063 60485060 +
caccctcaccaccaccacca

SEQ ID NO: 161145 - DNA, 20 bp, Artificial Sequence
  Synthetic oligonucleotide; TAG chr2 60485049 60485068 60485065 +
tcaccaccaccaccaaggca

SEQ ID NO: 161146 - DNA, 20 bp, Artificial Sequence
  Synthetic oligonucleotide; TGG chr2 60485055 60485074 60485071 +
ccaccaccaaggcatagcct

SEQ ID NO: 161147 - DNA, 20 bp, Artificial Sequence
  Synthetic oligonucleotide; AAG chr2 60485058 60485077 60485074 +
ccaccaaggcatagccttgg

SEQ ID NO: 161148 - DNA, 20 bp, Artificial Sequence
  Synthetic oligonucleotide; AAG chr2 60485064 60485083 60485080 +
aggcatagccttggaagaaa

SEQ ID NO: 161149 - DNA, 20 bp, Artificial Sequence
  Synthetic oligonucleotide; AGG chr2 60485065 60485084 60485081 +
ggcatagccttggaagaaaa

SEQ ID NO: 161150 - DNA, 20 bp, Artificial Sequence
  Synthetic oligonucleotide; CAG chr2 60485077 60485096 60485093 +
gaagaaaaaggcatcccttg

SEQ ID NO: 161151 - DNA, 20 bp, Artificial Sequence
  Synthetic oligonucleotide; AAG chr2 60485092 60485111 60485108 +
ccttgcagccacaatttcgc

SEQ ID NO: 161152 - DNA, 20 bp, Artificial Sequence
  Synthetic oligonucleotide; CAG chr2 60485108 60485127 60485124 +
tcgcaagttgaccttttcac

SEQ ID NO: 161153 - DNA, 20 bp, Artificial Sequence
  Synthetic oligonucleotide; AGG chr2 60485109 60485128 60485125 +
cgcaagttgaccttttcacc

SEQ ID NO: 161154 - DNA, 20 bp, Artificial Sequence
  Synthetic oligonucleotide; CAG chr2 60485113 60485132 60485129 +
agttgaccttttcaccaggc

SEQ ID NO: 161155 - DNA, 20 bp, Artificial Sequence
  Synthetic oligonucleotide; CAG chr2 60485132 60485151 60485148 +
ccagtgcctaatttcctaaa

SEQ ID NO: 161156 - DNA, 20 bp, Artificial Sequence
  Synthetic oligonucleotide; AGG chr2 60485133 60485152 60485149 +
cagtgcctaatttcctaaac

SEQ ID NO: 161157 - DNA, 20 bp, Artificial Sequence
  Synthetic oligonucleotide; AAG chr2 60485150 60485169 60485166 +
aacaggccccttcttccttg

SEQ ID NO: 161158 - DNA, 20 bp, Artificial Sequence
  Synthetic oligonucleotide; CAG chr2 60485169 60485188 60485185 +
gaagtcactgcaaataaatg

SEQ ID NO: 161159 - DNA, 20 bp, Artificial Sequence
  Synthetic oligonucleotide; CAG chr2 60485177 60485196 60485193 +
tgcaaataaatgcagtcatc

SEQ ID NO: 161160 - DNA, 20 bp, Artificial Sequence
  Synthetic oligonucleotide; GAG chr2 60485179 60485198 60485195 +
caaataaatgcagtcatcca

SEQ ID NO: 161161 - DNA, 20 bp, Artificial Sequence
  Synthetic oligonucleotide; TGG chr2 60485187 60485206 60485203 +
tgcagtcatccagagtgtaa

SEQ ID NO: 161162 - DNA, 20 bp, Artificial Sequence
  Synthetic oligonucleotide; AAG chr2 60485190 60485209 60485206 +
agtcatccagagtgtaatgg

SEQ ID NO: 161163 - DNA, 20 bp, Artificial Sequence
  Synthetic oligonucleotide; TGG chr2 60485195 60485214 60485211 +
tccagagtgtaatggaagtc

SEQ ID NO: 161164 - DNA, 20 bp, Artificial Sequence
  Synthetic oligonucleotide; TGG chr2 60485201 60485220 60485217 +
gtgtaatggaagtctggcct

SEQ ID NO: 161165 - DNA, 20 bp, Artificial Sequence
  Synthetic oligonucleotide; GAG chr2 60485203 60485222 60485219 +
gtaatggaagtctggccttg

SEQ ID NO: 161166 - DNA, 20 bp, Artificial Sequence
  Synthetic oligonucleotide; TGG chr2 60485210 60485229 60485226 +
aagtctggccttggagttac

SEQ ID NO: 161167 - DNA, 20 bp, Artificial Sequence
  Synthetic oligonucleotide; TGG chr2 60485227 60485246 60485243 +
tactggcttatgaaatgcaa

SEQ ID NO: 161168 - DNA, 20 bp, Artificial Sequence
  Synthetic oligonucleotide; GGG chr2 60485228 60485247 60485244 +
actggcttatgaaatgcaat

SEQ ID NO: 161169 - DNA, 20 bp, Artificial Sequence
  Synthetic oligonucleotide; GAG chr2 60485233 60485252 60485249 +
cttatgaaatgcaatgggat

SEQ ID NO: 161170 - DNA, 20 bp, Artificial Sequence
  Synthetic oligonucleotide; AGG chr2 60485234 60485253 60485250 +
ttatgaaatgcaatgggatg

SEQ ID NO: 161171 - DNA, 20 bp, Artificial Sequence
  Synthetic oligonucleotide; TGG chr2 60485237 60485256 60485253 +
tgaaatgcaatgggatgagg

SEQ ID NO: 161172 - DNA, 20 bp, Artificial Sequence
  Synthetic oligonucleotide; GGG chr2 60485238 60485257 60485254 +
gaaatgcaatgggatgaggt

SEQ ID NO: 161173 - DNA, 20 bp, Artificial Sequence
  Synthetic oligonucleotide; GGG chr2 60485239 60485258 60485255 +
aaatgcaatgggatgaggtg

SEQ ID NO: 161174 - DNA, 20 bp, Artificial Sequence
  Synthetic oligonucleotide; GAG chr2 60485243 60485262 60485259 +
gcaatgggatgaggtggggt

SEQ ID NO: 161175 - DNA, 20 bp, Artificial Sequence
  Synthetic oligonucleotide; GAG chr2 60485245 60485264 60485261 +
aatgggatgaggtggggtga

SEQ ID NO: 161176 - DNA, 20 bp, Artificial Sequence
  Synthetic oligonucleotide; AGG chr2 60485246 60485265 60485262 +
atgggatgaggtggggtgag

SEQ ID NO: 161177 - DNA, 20 bp, Artificial Sequence
  Synthetic oligonucleotide; TAG chr2 60485252 60485271 60485268 +
tgaggtggggtgagaggcca

SEQ ID NO: 161178 - DNA, 20 bp, Artificial Sequence
  Synthetic oligonucleotide; CAG chr2 60485257 60485276 60485273 +
tggggtgagaggccatagcc

SEQ ID NO: 161179 - DNA, 20 bp, Artificial Sequence
  Synthetic oligonucleotide; CGG chr2 60485266 60485285 60485282 +
aggccatagcccagactgaa

SEQ ID NO: 161180 - DNA, 20 bp, Artificial Sequence
  Synthetic oligonucleotide; CAG chr2 60485271 60485290 60485287 +
atagcccagactgaacggca

SEQ ID NO: 161181 - DNA, 20 bp, Artificial Sequence
  Synthetic oligonucleotide; CAG chr2 60485278 60485297 60485294 +
agactgaacggcacagtgac

SEQ ID NO: 161182 - DNA, 20 bp, Artificial Sequence
  Synthetic oligonucleotide; AGG chr2 60485279 60485298 60485295 +
gactgaacggcacagtgacc

SEQ ID NO: 161183 - DNA, 20 bp, Artificial Sequence
  Synthetic oligonucleotide; TAG chr2 60485282 60485301 60485298 +
tgaacggcacagtgaccagg

SEQ ID NO: 161184 - DNA, 20 bp, Artificial Sequence
  Synthetic oligonucleotide; AGG chr2 60485283 60485302 60485299 +
gaacggcacagtgaccaggt

SEQ ID NO: 161185 - DNA, 20 bp, Artificial Sequence
  Synthetic oligonucleotide; GGG chr2 60485284 60485303 60485300 +
aacggcacagtgaccaggta

SEQ ID NO: 161186 - DNA, 20 bp, Artificial Sequence
  Synthetic oligonucleotide; TGG chr2 60485287 60485306 60485303 +
ggcacagtgaccaggtaggg

SEQ ID NO: 161187 - DNA, 20 bp, Artificial Sequence
  Synthetic oligonucleotide; GAG chr2 60485289 60485308 60485305 +
cacagtgaccaggtagggtg

SEQ ID NO: 161188 - DNA, 20 bp, Artificial Sequence
  Synthetic oligonucleotide; AAG chr2 60485293 60485312 60485309 +
gtgaccaggtagggtggagc

SEQ ID NO: 161189 - DNA, 20 bp, Artificial Sequence
  Synthetic oligonucleotide; AGG chr2 60485294 60485313 60485310 +
tgaccaggtagggtggagca

SEQ ID NO: 161190 - DNA, 20 bp, Artificial Sequence
  Synthetic oligonucleotide; CAG chr2 60485303 60485322 60485319 +
agggtggagcaaggccactc

SEQ ID NO: 161191 - DNA, 20 bp, Artificial Sequence
  Synthetic oligonucleotide; AAG chr2 60485307 60485326 60485323 +
tggagcaaggccactccagc

SEQ ID NO: 161192 - DNA, 20 bp, Artificial Sequence
  Synthetic oligonucleotide; AAG chr2 60485316 60485335 60485332 +
gccactccagcaagaatgcc

SEQ ID NO: 161193 - DNA, 20 bp, Artificial Sequence
  Synthetic oligonucleotide; AGG chr2 60485317 60485336 60485333 +
ccactccagcaagaatgcca

SEQ ID NO: 161194 - DNA, 20 bp, Artificial Sequence
  Synthetic oligonucleotide; TAG chr2 60485321 60485340 60485337 +
tccagcaagaatgccaagga

SEQ ID NO: 161195 - DNA, 20 bp, Artificial Sequence
  Synthetic oligonucleotide; CAG chr2 60485328 60485347 60485344 +
agaatgccaaggatagcctg

SEQ ID NO: 161196 - DNA, 20 bp, Artificial Sequence
  Synthetic oligonucleotide; TGG chr2 60485331 60485350 60485347 +
atgccaaggatagcctgcag

SEQ ID NO: 161197 - DNA, 20 bp, Artificial Sequence
  Synthetic oligonucleotide; GGG chr2 60485332 60485351 60485348 +
tgccaaggatagcctgcagt

SEQ ID NO: 161198 - DNA, 20 bp, Artificial Sequence
  Synthetic oligonucleotide; TAG chr2 60485339 60485358 60485355 +
gatagcctgcagtgggttat

SEQ ID NO: 161199 - DNA, 20 bp, Artificial Sequence
  Synthetic oligonucleotide; CAG chr2 60485345 60485364 60485361 +
ctgcagtgggttattagccc

SEQ ID NO: 161200 - DNA, 20 bp, Artificial Sequence
  Synthetic oligonucleotide; CAG chr2 60485348 60485367 60485364 +
cagtgggttattagccccag

SEQ ID NO: 161201 - DNA, 20 bp, Artificial Sequence
  Synthetic oligonucleotide; AGG chr2 60485349 60485368 60485365 +
agtgggttattagccccagc

SEQ ID NO: 161202 - DNA, 20 bp, Artificial Sequence
  Synthetic oligonucleotide; GGG chr2 60485350 60485369 60485366 +
gtgggttattagccccagca

SEQ ID NO: 161203 - DNA, 20 bp, Artificial Sequence
  Synthetic oligonucleotide; CGG chr2 60485365 60485384 60485381 +
cagcagggcccatgcctcta

SEQ ID NO: 161204 - DNA, 20 bp, Artificial Sequence
  Synthetic oligonucleotide; TGG chr2 60485392 60485411 60485408 +
gttgctgtcatcttcgttct

SEQ ID NO: 161205 - DNA, 20 bp, Artificial Sequence
  Synthetic oligonucleotide; TAG chr2 60485396 60485415 60485412 +
ctgtcatcttcgttcttggc

SEQ ID NO: 161206 - DNA, 20 bp, Artificial Sequence
  Synthetic oligonucleotide; CAG chr2 60485399 60485418 60485415 +
tcatcttcgttcttggctag

SEQ ID NO: 161207 - DNA, 20 bp, Artificial Sequence
  Synthetic oligonucleotide; TAG chr2 60485406 60485425 60485422 +
cgttcttggctagcagatgc

SEQ ID NO: 161208 - DNA, 20 bp, Artificial Sequence
  Synthetic oligonucleotide; CAG chr2 60485412 60485431 60485428 +
tggctagcagatgctagtcc

SEQ ID NO: 161209 - DNA, 20 bp, Artificial Sequence
  Synthetic oligonucleotide; AGG chr2 60485413 60485432 60485429 +
ggctagcagatgctagtccc

SEQ ID NO: 161210 - DNA, 20 bp, Artificial Sequence
  Synthetic oligonucleotide; AAG chr2 60485434 60485453 60485450 +
ggaatgtcctccatgccttt

SEQ ID NO: 161211 - DNA, 20 bp, Artificial Sequence
  Synthetic oligonucleotide; CAG chr2 60485450 60485469 60485466 +
ctttaagctaactgcaaaaa

SEQ ID NO: 161212 - DNA, 20 bp, Artificial Sequence
  Synthetic oligonucleotide; CGG chr2 60485455 60485474 60485471 +
agctaactgcaaaaacagaa

SEQ ID NO: 161213 - DNA, 20 bp, Artificial Sequence
  Synthetic oligonucleotide; GAG chr2 60485461 60485480 60485477 +
ctgcaaaaacagaacggtgt

SEQ ID NO: 161214 - DNA, 20 bp, Artificial Sequence
  Synthetic oligonucleotide; CAG chr2 60485465 60485484 60485481 +
aaaaacagaacggtgtgagc

SEQ ID NO: 161215 - DNA, 20 bp, Artificial Sequence
  Synthetic oligonucleotide; AGG chr2 60485466 60485485 60485482 +
aaaacagaacggtgtgagcc

SEQ ID NO: 161216 - DNA, 20 bp, Artificial Sequence
  Synthetic oligonucleotide; GGG chr2 60485467 60485486 60485483 +
aaacagaacggtgtgagcca

SEQ ID NO: 161217 - DNA, 20 bp, Artificial Sequence
  Synthetic oligonucleotide; CAG chr2 60485470 60485489 60485486 +
cagaacggtgtgagccaggg

SEQ ID NO: 161218 - DNA, 20 bp, Artificial Sequence
  Synthetic oligonucleotide; AAG chr2 60485501 60485520 60485517 +
ctcttttatattctacctat

SEQ ID NO: 161219 - DNA, 20 bp, Artificial Sequence
  Synthetic oligonucleotide; AGG chr2 60485502 60485521 60485518 +
tcttttatattctacctata

SEQ ID NO: 161220 - DNA, 20 bp, Artificial Sequence
  Synthetic oligonucleotide; GGG chr2 60485503 60485522 60485519 +
cttttatattctacctataa

SEQ ID NO: 161221 - DNA, 20 bp, Artificial Sequence
  Synthetic oligonucleotide; TAG chr2 60485517 60485536 60485533 +
ctataagggaaaaataaacc

SEQ ID NO: 161222 - DNA, 20 bp, Artificial Sequence
  Synthetic oligonucleotide; TGG chr2 60485523 60485542 60485539 +
gggaaaaataaacctagacc

SEQ ID NO: 161223 - DNA, 20 bp, Artificial Sequence
  Synthetic oligonucleotide; AAG chr2 60485539 60485558 60485555 +
gacctggaaaacaatgtgta

SEQ ID NO: 161224 - DNA, 20 bp, Artificial Sequence
  Synthetic oligonucleotide; TGG chr2 60485542 60485561 60485558 +
ctggaaaacaatgtgtaaag

SEQ ID NO: 161225 - DNA, 20 bp, Artificial Sequence
  Synthetic oligonucleotide; AAG chr2 60485548 60485567 60485564 +
aacaatgtgtaaagtggcaa

SEQ ID NO: 161226 - DNA, 20 bp, Artificial Sequence
  Synthetic oligonucleotide; AAG chr2 60485569 60485588 60485585 +
agccaatcaactcatttaaa

SEQ ID NO: 161227 - DNA, 20 bp, Artificial Sequence
  Synthetic oligonucleotide; AAG chr2 60485596 60485615 60485612 +
accctccatccaacgtcacg

SEQ ID NO: 161228 - DNA, 20 bp, Artificial Sequence
  Synthetic oligonucleotide; TAG chr2 60485610 60485629 60485626 +
gtcacgaagctgctgaatat

SEQ ID NO: 161229 - DNA, 20 bp, Artificial Sequence
  Synthetic oligonucleotide; AGG chr2 60485611 60485630 60485627 +
tcacgaagctgctgaatatt

SEQ ID NO: 161230 - DNA, 20 bp, Artificial Sequence
  Synthetic oligonucleotide; TGG chr2 60485618 60485637 60485634 +
gctgctgaatattaggttcc

SEQ ID NO: 161231 - DNA, 20 bp, Artificial Sequence
  Synthetic oligonucleotide; GGG chr2 60485619 60485638 60485635 +
ctgctgaatattaggttcct

SEQ ID NO: 161232 - DNA, 20 bp, Artificial Sequence
  Synthetic oligonucleotide; AAG chr2 60485622 60485641 60485638 +
ctgaatattaggttcctggg

SEQ ID NO: 161233 - DNA, 20 bp, Artificial Sequence
  Synthetic oligonucleotide; CAG chr2 60485631 60485650 60485647 +
aggttcctgggaagctgtcc

SEQ ID NO: 161234 - DNA, 20 bp, Artificial Sequence
  Synthetic oligonucleotide; TAG chr2 60485639 60485658 60485655 +
gggaagctgtcccagcaacc

SEQ ID NO: 161235 - DNA, 20 bp, Artificial Sequence
  Synthetic oligonucleotide; GAG chr2 60485646 60485665 60485662 +
tgtcccagcaacctagatat

SEQ ID NO: 161236 - DNA, 20 bp, Artificial Sequence
  Synthetic oligonucleotide; TGG chr2 60485667 60485686 60485683 +
agaaacaacgcttgctattc

SEQ ID NO: 161237 - DNA, 20 bp, Artificial Sequence
  Synthetic oligonucleotide; GGG chr2 60485668 60485687 60485684 +
gaaacaacgcttgctattct

SEQ ID NO: 161238 - DNA, 20 bp, Artificial Sequence
  Synthetic oligonucleotide; GGG chr2 60485669 60485688 60485685 +
aaacaacgcttgctattctg

SEQ ID NO: 161239 - DNA, 20 bp, Artificial Sequence
  Synthetic oligonucleotide; GAG chr2 60485673 60485692 60485689 +
aacgcttgctattctggggt

SEQ ID NO: 161240 - DNA, 20 bp, Artificial Sequence
  Synthetic oligonucleotide; AAG chr2 60485676 60485695 60485692 +
gcttgctattctggggtgag

SEQ ID NO: 161241 - DNA, 20 bp, Artificial Sequence
  Synthetic oligonucleotide; AAG chr2 60485681 60485700 60485697 +
ctattctggggtgagaagtg

SEQ ID NO: 161242 - DNA, 20 bp, Artificial Sequence
  Synthetic oligonucleotide; CGG chr2 60485696 60485715 60485712 +
aagtgaagttgcctttcact

SEQ ID NO: 161243 - DNA, 20 bp, Artificial Sequence
  Synthetic oligonucleotide; GGG chr2 60485697 60485716 60485713 +
agtgaagttgcctttcactc

SEQ ID NO: 161244 - DNA, 20 bp, Artificial Sequence
  Synthetic oligonucleotide; CAG chr2 60485711 60485730 60485727 +
tcactcgggactgtcaaaca

SEQ ID NO: 161245 - DNA, 20 bp, Artificial Sequence
  Synthetic oligonucleotide; CAG chr2 60485725 60485744 60485741 +
caaacacagtctataaatac

SEQ ID NO: 161246 - DNA, 20 bp, Artificial Sequence
  Synthetic oligonucleotide; CGG chr2 60485747 60485766 60485763 +
gcaatgccccttgtgaacta

SEQ ID NO: 161247 - DNA, 20 bp, Artificial Sequence
  Synthetic oligonucleotide; GGG chr2 60485748 60485767 60485764 +
caatgccccttgtgaactac

SEQ ID NO: 161248 - DNA, 20 bp, Artificial Sequence
  Synthetic oligonucleotide; GAG chr2 60485753 60485772 60485769 +
ccccttgtgaactacgggct

SEQ ID NO: 161249 - DNA, 20 bp, Artificial Sequence
  Synthetic oligonucleotide; CAG chr2 60485763 60485782 60485779 +
actacgggctgagctcaacc

SEQ ID NO: 161250 - DNA, 20 bp, Artificial Sequence
  Synthetic oligonucleotide; GAG chr2 60485765 60485784 60485781 +
tacgggctgagctcaaccca

SEQ ID NO: 161251 - DNA, 20 bp, Artificial Sequence
  Synthetic oligonucleotide; AAG chr2 60485768 60485787 60485784 +
gggctgagctcaacccagag

SEQ ID NO: 161252 - DNA, 20 bp, Artificial Sequence
  Synthetic oligonucleotide; AGG chr2 60485769 60485788 60485785 +
ggctgagctcaacccagaga

SEQ ID NO: 161253 - DNA, 20 bp, Artificial Sequence
  Synthetic oligonucleotide; AAG chr2 60485773 60485792 60485789 +
gagctcaacccagagaaggc

SEQ ID NO: 161254 - DNA, 20 bp, Artificial Sequence
  Synthetic oligonucleotide; AAG chr2 60485785 60485804 60485801 +
gagaaggcaagtgtttccca

SEQ ID NO: 161255 - DNA, 20 bp, Artificial Sequence
  Synthetic oligonucleotide; AGG chr2 60485786 60485805 60485802 +
agaaggcaagtgtttcccaa

SEQ ID NO: 161256 - DNA, 20 bp, Artificial Sequence
  Synthetic oligonucleotide; CAG chr2 60485794 60485813 60485810 +
agtgtttcccaaaggtcaca

SEQ ID NO: 161257 - DNA, 20 bp, Artificial Sequence
  Synthetic oligonucleotide; CAG chr2 60485803 60485822 60485819 +
caaaggtcacacagcaattc

SEQ ID NO: 161258 - DNA, 20 bp, Artificial Sequence
  Synthetic oligonucleotide; AGG chr2 60485804 60485823 60485820 +
aaaggtcacacagcaattcc

SEQ ID NO: 161259 - DNA, 20 bp, Artificial Sequence
  Synthetic oligonucleotide; CAG chr2 60485812 60485831 60485828 +
cacagcaattccaggtcccc

SEQ ID NO: 161260 - DNA, 20 bp, Artificial Sequence
  Synthetic oligonucleotide; AAG chr2 60485815 60485834 60485831 +
agcaattccaggtcccccag

SEQ ID NO: 161261 - DNA, 20 bp, Artificial Sequence
  Synthetic oligonucleotide; TAG chr2 60485818 60485837 60485834 +
aattccaggtcccccagaag

SEQ ID NO: 161262 - DNA, 20 bp, Artificial Sequence
  Synthetic oligonucleotide; CAG chr2 60485829 60485848 60485845 +
ccccagaagtagcccttcac

SEQ ID NO: 161263 - DNA, 20 bp, Artificial Sequence
  Synthetic oligonucleotide; TGG chr2 60485833 60485852 60485849 +
agaagtagcccttcaccaga

SEQ ID NO: 161264 - DNA, 20 bp, Artificial Sequence
  Synthetic oligonucleotide; CAG chr2 60485846 60485865 60485862 +
caccagatggatcccatcac

SEQ ID NO: 161265 - DNA, 20 bp, Artificial Sequence
  Synthetic oligonucleotide; TAG chr2 60485850 60485869 60485866 +
agatggatcccatcaccaga

SEQ ID NO: 161266 - DNA, 20 bp, Artificial Sequence
  Synthetic oligonucleotide; TGG chr2 60485857 60485876 60485873 +
tcccatcaccagatagctct

SEQ ID NO: 161267 - DNA, 20 bp, Artificial Sequence
  Synthetic oligonucleotide; AAG chr2 60485897 60485916 60485913 +
atctgattctcattttcaac

SEQ ID NO: 161268 - DNA, 20 bp, Artificial Sequence
  Synthetic oligonucleotide; AAG chr2 60485900 60485919 60485916 +
tgattctcattttcaacaag

SEQ ID NO: 161269 - DNA, 20 bp, Artificial Sequence
  Synthetic oligonucleotide; AGG chr2 60485901 60485920 60485917 +
gattctcattttcaacaaga

SEQ ID NO: 161270 - DNA, 20 bp, Artificial Sequence
  Synthetic oligonucleotide; GAG chr2 60485906 60485925 60485922 +
tcattttcaacaagaaggct

SEQ ID NO: 161271 - DNA, 20 bp, Artificial Sequence
  Synthetic oligonucleotide; AGG chr2 60485907 60485926 60485923 +
cattttcaacaagaaggctg

SEQ ID NO: 161272 - DNA, 20 bp, Artificial Sequence
  Synthetic oligonucleotide; GAG chr2 60485913 60485932 60485929 +
caacaagaaggctgaggaat

SEQ ID NO: 161273 - DNA, 20 bp, Artificial Sequence
  Synthetic oligonucleotide; TAG chr2 60485927 60485946 60485943 +
aggaatgagattgcacattt

SEQ ID NO: 161274 - DNA, 20 bp, Artificial Sequence
  Synthetic oligonucleotide; TGG chr2 60485967 60485986 60485983 +
ctttctccaaccttctgctc

SEQ ID NO: 161275 - DNA, 20 bp, Artificial Sequence
  Synthetic oligonucleotide; TAG chr2 60486009 60486028 60486025 +
acgtacaaaaaaaatctttt

SEQ ID NO: 161276 - DNA, 20 bp, Artificial Sequence
  Synthetic oligonucleotide; TAG chr2 60486018 60486037 60486034 +
aaaaatctttttagtatgtt

SEQ ID NO: 161277 - DNA, 20 bp, Artificial Sequence
  Synthetic oligonucleotide; AGG chr2 60486019 60486038 60486035 +
aaaatctttttagtatgttt

SEQ ID NO: 161278 - DNA, 20 bp, Artificial Sequence
  Synthetic oligonucleotide; GGG chr2 60486020 60486039 60486036 +
aaatctttttagtatgttta

SEQ ID NO: 161279 - DNA, 20 bp, Artificial Sequence
  Synthetic oligonucleotide; AAG chr2 60486052 60486071 60486068 +
catatctacccaaaatctcc

SEQ ID NO: 161280 - DNA, 20 bp, Artificial Sequence
  Synthetic oligonucleotide; CAG chr2 60486068 60486087 60486084 +
ctccaagccccttgttctat

SEQ ID NO: 161281 - DNA, 20 bp, Artificial Sequence
  Synthetic oligonucleotide; CAG chr2 60486071 60486090 60486087 +
caagccccttgttctatcag

SEQ ID NO: 161282 - DNA, 20 bp, Artificial Sequence
  Synthetic oligonucleotide; AGG chr2 60486072 60486091 60486088 +
aagccccttgttctatcagc

SEQ ID NO: 161283 - DNA, 20 bp, Artificial Sequence
  Synthetic oligonucleotide; AAG chr2 60486077 60486096 60486093 +
ccttgttctatcagcaggtc

SEQ ID NO: 161284 - DNA, 20 bp, Artificial Sequence
  Synthetic oligonucleotide; GAG chr2 60486079 60486098 60486095 +
ttgttctatcagcaggtcaa

SEQ ID NO: 161285 - DNA, 20 bp, Artificial Sequence
  Synthetic oligonucleotide; TAG chr2 60486082 60486101 60486098 +
ttctatcagcaggtcaagag

SEQ ID NO: 161286 - DNA, 20 bp, Artificial Sequence
  Synthetic oligonucleotide; GAG chr2 60486084 60486103 60486100 +
ctatcagcaggtcaagagta

SEQ ID NO: 161287 - DNA, 20 bp, Artificial Sequence
  Synthetic oligonucleotide; AAG chr2 60486096 60486115 60486112 +
caagagtagagaactgtgac

SEQ ID NO: 161288 - DNA, 20 bp, Artificial Sequence
  Synthetic oligonucleotide; TGG chr2 60486117 60486136 60486133 +
agctgttctccattctgaaa

SEQ ID NO: 161289 - DNA, 20 bp, Artificial Sequence
  Synthetic oligonucleotide; CAG chr2 60486131 60486150 60486147 +
ctgaaatggatttgactgaa

SEQ ID NO: 161290 - DNA, 20 bp, Artificial Sequence
  Synthetic oligonucleotide; AAG chr2 60486141 60486160 60486157 +
tttgactgaacagctgctga

SEQ ID NO: 161291 - DNA, 20 bp, Artificial Sequence
  Synthetic oligonucleotide; AGG chr2 60486142 60486161 60486158 +
ttgactgaacagctgctgaa

SEQ ID NO: 161292 - DNA, 20 bp, Artificial Sequence
  Synthetic oligonucleotide; AAG chr2 60486146 60486165 60486162 +
ctgaacagctgctgaaaggc

SEQ ID NO: 161293 - DNA, 20 bp, Artificial Sequence
  Synthetic oligonucleotide; TAG chr2 60486155 60486174 60486171 +
tgctgaaaggcaagacatcc

SEQ ID NO: 161294 - DNA, 20 bp, Artificial Sequence
  Synthetic oligonucleotide; AGG chr2 60486156 60486175 60486172 +
gctgaaaggcaagacatcct

SEQ ID NO: 161295 - DNA, 20 bp, Artificial Sequence
  Synthetic oligonucleotide; GGG chr2 60486157 60486176 60486173 +
ctgaaaggcaagacatccta

SEQ ID NO: 161296 - DNA, 20 bp, Artificial Sequence
  Synthetic oligonucleotide; GAG chr2 60486159 60486178 60486175 +
gaaaggcaagacatcctagg

SEQ ID NO: 161297 - DNA, 20 bp, Artificial Sequence
  Synthetic oligonucleotide; TGG chr2 60486164 60486183 60486180 +
gcaagacatcctagggagac

SEQ ID NO: 161298 - DNA, 20 bp, Artificial Sequence
  Synthetic oligonucleotide; TGG chr2 60486170 60486189 60486186 +
catcctagggagactggtac

SEQ ID NO: 161299 - DNA, 20 bp, Artificial Sequence
  Synthetic oligonucleotide; GGG chr2 60486171 60486190 60486187 +
atcctagggagactggtact

SEQ ID NO: 161300 - DNA, 20 bp, Artificial Sequence
  Synthetic oligonucleotide; GGG chr2 60486172 60486191 60486188 +
tcctagggagactggtactg

SEQ ID NO: 161301 - DNA, 20 bp, Artificial Sequence
  Synthetic oligonucleotide; CAG chr2 60486179 60486198 60486195 +
gagactggtactggggattt

SEQ ID NO: 161302 - DNA, 20 bp, Artificial Sequence
  Synthetic oligonucleotide; AGG chr2 60486180 60486199 60486196 +
agactggtactggggatttc

SEQ ID NO: 161303 - DNA, 20 bp, Artificial Sequence
  Synthetic oligonucleotide; GGG chr2 60486181 60486200 60486197 +
gactggtactggggatttca

SEQ ID NO: 161304 - DNA, 20 bp, Artificial Sequence
  Synthetic oligonucleotide; TGG chr2 60486195 60486214 60486211 +
atttcagggtccttgttctg

SEQ ID NO: 161305 - DNA, 20 bp, Artificial Sequence
  Synthetic oligonucleotide; GGG chr2 60486196 60486215 60486212 +
tttcagggtccttgttctgt

SEQ ID NO: 161306 - DNA, 20 bp, Artificial Sequence
  Synthetic oligonucleotide; TGG chr2 60486199 60486218 60486215 +
cagggtccttgttctgtggg

SEQ ID NO: 161307 - DNA, 20 bp, Artificial Sequence
  Synthetic oligonucleotide; TGG chr2 60486206 60486225 60486222 +
cttgttctgtgggtggacca

SEQ ID NO: 161308 - DNA, 20 bp, Artificial Sequence
  Synthetic oligonucleotide; CAG chr2 60486217 60486236 60486233 +
ggtggaccatggctcctttc

SEQ ID NO: 161309 - DNA, 20 bp, Artificial Sequence
  Synthetic oligonucleotide; GAG chr2 60486219 60486238 60486235 +
tggaccatggctcctttcca

SEQ ID NO: 161310 - DNA, 20 bp, Artificial Sequence
  Synthetic oligonucleotide; AAG chr2 60486257 60486276 60486273 +
gttctctctcctacacatca

SEQ ID NO: 161311 - DNA, 20 bp, Artificial Sequence
  Synthetic oligonucleotide; GAG chr2 60486261 60486280 60486277 +
tctctcctacacatcaaagt

SEQ ID NO: 161312 - DNA, 20 bp, Artificial Sequence
  Synthetic oligonucleotide; CAG chr2 60486274 60486293 60486290 +
tcaaagtgagacaccaatca

SEQ ID NO: 161313 - DNA, 20 bp, Artificial Sequence
  Synthetic oligonucleotide; TGG chr2 60486283 60486302 60486299 +
gacaccaatcacagctctac

SEQ ID NO: 161314 - DNA, 20 bp, Artificial Sequence
  Synthetic oligonucleotide; TGG chr2 60486309 60486328 60486325 +
accttgccccacctccaatt

SEQ ID NO: 161315 - DNA, 20 bp, Artificial Sequence
  Synthetic oligonucleotide; GAG chr2 60486337 60486356 60486353 +
ttgcctccttctcacacaat

SEQ ID NO: 161316 - DNA, 20 bp, Artificial Sequence
  Synthetic oligonucleotide; AAG chr2 60486341 60486360 60486357 +
ctccttctcacacaatgaga

SEQ ID NO: 161317 - DNA, 20 bp, Artificial Sequence
  Synthetic oligonucleotide; CGG chr2 60486346 60486365 60486362 +
tctcacacaatgagaaagaa

SEQ ID NO: 161318 - DNA, 20 bp, Artificial Sequence
  Synthetic oligonucleotide; TAG chr2 60486350 60486369 60486366 +
acacaatgagaaagaacgga

SEQ ID NO: 161319 - DNA, 20 bp, Artificial Sequence
  Synthetic oligonucleotide; AAG chr2 60486362 60486381 60486378 +
agaacggatagccaaattct

SEQ ID NO: 161320 - DNA, 20 bp, Artificial Sequence
  Synthetic oligonucleotide; GAG chr2 60486364 60486383 60486380 +
aacggatagccaaattctaa

SEQ ID NO: 161321 - DNA, 20 bp, Artificial Sequence
  Synthetic oligonucleotide; TAG chr2 60486388 60486407 60486404 +
tcactttctgcacatatgtg

SEQ ID NO: 161322 - DNA, 20 bp, Artificial Sequence
  Synthetic oligonucleotide; AAG chr2 60486393 60486412 60486409 +
ttctgcacatatgtgtagtt

SEQ ID NO: 161323 - DNA, 20 bp, Artificial Sequence
  Synthetic oligonucleotide; AAG chr2 60486401 60486420 60486417 +
atatgtgtagttaagtactg

SEQ ID NO: 161324 - DNA, 20 bp, Artificial Sequence
  Synthetic oligonucleotide; GAG chr2 60486405 60486424 60486421 +
gtgtagttaagtactgaagt

SEQ ID NO: 161325 - DNA, 20 bp, Artificial Sequence
  Synthetic oligonucleotide; AAG chr2 60486414 60486433 60486430 +
agtactgaagtgagaaattc

SEQ ID NO: 161326 - DNA, 20 bp, Artificial Sequence
  Synthetic oligonucleotide; TAG chr2 60486428 60486447 60486444 +
aaattcaagaaaactatact

SEQ ID NO: 161327 - DNA, 20 bp, Artificial Sequence
  Synthetic oligonucleotide; AGG chr2 60486429 60486448 60486445 +
aattcaagaaaactatactt

SEQ ID NO: 161328 - DNA, 20 bp, Artificial Sequence
  Synthetic oligonucleotide; GAG chr2 60486450 60486469 60486466 +
ggcacacacacacacatttt

SEQ ID NO: 161329 - DNA, 20 bp, Artificial Sequence
  Synthetic oligonucleotide; GAG chr2 60486452 60486471 60486468 +
cacacacacacacattttga

SEQ ID NO: 161330 - DNA, 20 bp, Artificial Sequence
  Synthetic oligonucleotide; AAG chr2 60486465 60486484 60486481 +
attttgagagataatttcta

SEQ ID NO: 161331 - DNA, 20 bp, Artificial Sequence
  Synthetic oligonucleotide; AAG chr2 60486480 60486499 60486496 +
ttctaaagacctaccaatct

SEQ ID NO: 161332 - DNA, 20 bp, Artificial Sequence
  Synthetic oligonucleotide; AAG chr2 60486490 60486509 60486506 +
ctaccaatctaagatactga

SEQ ID NO: 161333 - DNA, 20 bp, Artificial Sequence
  Synthetic oligonucleotide; TGG chr2 60486497 60486516 60486513 +
tctaagatactgaaagaaaa

SEQ ID NO: 161334 - DNA, 20 bp, Artificial Sequence
  Synthetic oligonucleotide; CAG chr2 60486506 60486525 60486522 +
ctgaaagaaaatggctacat

SEQ ID NO: 161335 - DNA, 20 bp, Artificial Sequence
  Synthetic oligonucleotide; AGG chr2 60486507 60486526 60486523 +
tgaaagaaaatggctacatc

SEQ ID NO: 161336 - DNA, 20 bp, Artificial Sequence
  Synthetic oligonucleotide; CAG chr2 60486512 60486531 60486528 +
gaaaatggctacatcaggcc

SEQ ID NO: 161337 - DNA, 20 bp, Artificial Sequence
  Synthetic oligonucleotide; AAG chr2 60486517 60486536 60486533 +
tggctacatcaggcccagaa

SEQ ID NO: 161338 - DNA, 20 bp, Artificial Sequence
  Synthetic oligonucleotide; CAG chr2 60486541 60486560 60486557 +
cttgaaattttccctatcca

SEQ ID NO: 161339 - DNA, 20 bp, Artificial Sequence
  Synthetic oligonucleotide; CAG chr2 60486548 60486567 60486564 +
ttttccctatccacagacca

SEQ ID NO: 161340 - DNA, 20 bp, Artificial Sequence
  Synthetic oligonucleotide; TGG chr2 60486559 60486578 60486575 +
cacagaccacagccctgtga

SEQ ID NO: 161341 - DNA, 20 bp, Artificial Sequence
  Synthetic oligonucleotide; GAG chr2 60486566 60486585 60486582 +
cacagccctgtgatggacat

SEQ ID NO: 161342 - DNA, 20 bp, Artificial Sequence
  Synthetic oligonucleotide; TGG chr2 60486575 60486594 60486591 +
gtgatggacatgagatcctc

SEQ ID NO: 161343 - DNA, 20 bp, Artificial Sequence
  Synthetic oligonucleotide; GAG chr2 60486582 60486601 60486598 +
acatgagatcctctggcttt

SEQ ID NO: 161344 - DNA, 20 bp, Artificial Sequence
  Synthetic oligonucleotide; CAG chr2 60486597 60486616 60486613 +
gctttgagatgaataatgca

SEQ ID NO: 161345 - DNA, 20 bp, Artificial Sequence
  Synthetic oligonucleotide; GAG chr2 60486604 60486623 60486620 +
gatgaataatgcacagaaat

SEQ ID NO: 161346 - DNA, 20 bp, Artificial Sequence
  Synthetic oligonucleotide; CAG chr2 60486607 60486626 60486623 +
gaataatgcacagaaatgag

SEQ ID NO: 161347 - DNA, 20 bp, Artificial Sequence
  Synthetic oligonucleotide; TGG chr2 60486615 60486634 60486631 +
cacagaaatgagcagcatga

SEQ ID NO: 161348 - DNA, 20 bp, Artificial Sequence
  Synthetic oligonucleotide; TAG chr2 60486620 60486639 60486636 +
aaatgagcagcatgatggat

SEQ ID NO: 161349 - DNA, 20 bp, Artificial Sequence
  Synthetic oligonucleotide; TGG chr2 60486624 60486643 60486640 +
gagcagcatgatggattagc

SEQ ID NO: 161350 - DNA, 20 bp, Artificial Sequence
  Synthetic oligonucleotide; CAG chr2 60486627 60486646 60486643 +
cagcatgatggattagctgg

SEQ ID NO: 161351 - DNA, 20 bp, Artificial Sequence
  Synthetic oligonucleotide; CAG chr2 60486638 60486657 60486654 +
attagctggcagattattac

SEQ ID NO: 161352 - DNA, 20 bp, Artificial Sequence
  Synthetic oligonucleotide; CAG chr2 60486666 60486685 60486682 +
tgaacatgccaactcaacat

SEQ ID NO: 161353 - DNA, 20 bp, Artificial Sequence
  Synthetic oligonucleotide; AGG chr2 60486667 60486686 60486683 +
gaacatgccaactcaacatc

SEQ ID NO: 161354 - DNA, 20 bp, Artificial Sequence
  Synthetic oligonucleotide; TGG chr2 60486672 60486691 60486688 +
tgccaactcaacatcaggat

SEQ ID NO: 161355 - DNA, 20 bp, Artificial Sequence
  Synthetic oligonucleotide; GGG chr2 60486673 60486692 60486689 +
gccaactcaacatcaggatt

SEQ ID NO: 161356 - DNA, 20 bp, Artificial Sequence
  Synthetic oligonucleotide; CAG chr2 60486690 60486709 60486706 +
attgggcctgaaacttctct

SEQ ID NO: 161357 - DNA, 20 bp, Artificial Sequence
  Synthetic oligonucleotide; AGG chr2 60486691 60486710 60486707 +
ttgggcctgaaacttctctc

SEQ ID NO: 161358 - DNA, 20 bp, Artificial Sequence
  Synthetic oligonucleotide; AAG chr2 60486694 60486713 60486710 +
ggcctgaaacttctctcagg

SEQ ID NO: 161359 - DNA, 20 bp, Artificial Sequence
  Synthetic oligonucleotide; AGG chr2 60486695 60486714 60486711 +
gcctgaaacttctctcagga

SEQ ID NO: 161360 - DNA, 20 bp, Artificial Sequence
  Synthetic oligonucleotide; TAG chr2 60486704 60486723 60486720 +
ttctctcaggaaggccttga

SEQ ID NO: 161361 - DNA, 20 bp, Artificial Sequence
  Synthetic oligonucleotide; TAG chr2 60486710 60486729 60486726 +
caggaaggccttgatagcat

SEQ ID NO: 161362 - DNA, 20 bp, Artificial Sequence
  Synthetic oligonucleotide; TGG chr2 60486714 60486733 60486730 +
aaggccttgatagcattaga

SEQ ID NO: 161363 - DNA, 20 bp, Artificial Sequence
  Synthetic oligonucleotide; CAG chr2 60486721 60486740 60486737 +
tgatagcattagatggttga

SEQ ID NO: 161364 - DNA, 20 bp, Artificial Sequence
  Synthetic oligonucleotide; GAG chr2 60486723 60486742 60486739 +
atagcattagatggttgaca

SEQ ID NO: 161365 - DNA, 20 bp, Artificial Sequence
  Synthetic oligonucleotide; AGG chr2 60486724 60486743 60486740 +
tagcattagatggttgacag

SEQ ID NO: 161366 - DNA, 20 bp, Artificial Sequence
  Synthetic oligonucleotide; CAG chr2 60486732 60486751 60486748 +
gatggttgacagaggtatta

SEQ ID NO: 161367 - DNA, 20 bp, Artificial Sequence
  Synthetic oligonucleotide; CAG chr2 60486740 60486759 60486756 +
acagaggtattacagtgtga

SEQ ID NO: 161368 - DNA, 20 bp, Artificial Sequence
  Synthetic oligonucleotide; GAG chr2 60486742 60486761 60486758 +
agaggtattacagtgtgaca

SEQ ID NO: 161369 - DNA, 20 bp, Artificial Sequence
  Synthetic oligonucleotide; GAG chr2 60486748 60486767 60486764 +
attacagtgtgacagagtct

SEQ ID NO: 161370 - DNA, 20 bp, Artificial Sequence
  Synthetic oligonucleotide; CAG chr2 60486755 60486774 60486771 +
tgtgacagagtctgagccca

SEQ ID NO: 161371 - DNA, 20 bp, Artificial Sequence
  Synthetic oligonucleotide; GAG chr2 60486761 60486780 60486777 +
agagtctgagcccacagtct

SEQ ID NO: 161372 - DNA, 20 bp, Artificial Sequence
  Synthetic oligonucleotide; CAG chr2 60486782 60486801 60486798 +
agaatgaccacatcccttcc

SEQ ID NO: 161373 - DNA, 20 bp, Artificial Sequence
  Synthetic oligonucleotide; AGG chr2 60486783 60486802 60486799 +
gaatgaccacatcccttccc

SEQ ID NO: 161374 - DNA, 20 bp, Artificial Sequence
  Synthetic oligonucleotide; GGG chr2 60486784 60486803 60486800 +
aatgaccacatcccttccca

SEQ ID NO: 161375 - DNA, 20 bp, Artificial Sequence
  Synthetic oligonucleotide; GAG chr2 60486786 60486805 60486802 +
tgaccacatcccttcccagg

SEQ ID NO: 161376 - DNA, 20 bp, Artificial Sequence
  Synthetic oligonucleotide; TGG chr2 60486808 60486827 60486824 +
gacgttcccactcaacaccc

SEQ ID NO: 161377 - DNA, 20 bp, Artificial Sequence
  Synthetic oligonucleotide; GGG chr2 60486809 60486828 60486825 +
acgttcccactcaacaccct

SEQ ID NO: 161378 - DNA, 20 bp, Artificial Sequence
  Synthetic oligonucleotide; AAG chr2 60486812 60486831 60486828 +
ttcccactcaacaccctggg

SEQ ID NO: 161379 - DNA, 20 bp, Artificial Sequence
  Synthetic oligonucleotide; TGG chr2 60486845 60486864 60486861 +
atcactctgtctctcaaacc

SEQ ID NO: 161380 - DNA, 20 bp, Artificial Sequence
  Synthetic oligonucleotide; TGG chr2 60486851 60486870 60486867 +
ctgtctctcaaacctggcca

SEQ ID NO: 161381 - DNA, 20 bp, Artificial Sequence
  Synthetic oligonucleotide; CAG chr2 60486856 60486875 60486872 +
tctcaaacctggccatggct

SEQ ID NO: 161382 - DNA, 20 bp, Artificial Sequence
  Synthetic oligonucleotide; CAG chr2 60486897 60486916 60486913 +
tttgcccttttccctgctaa

SEQ ID NO: 161383 - DNA, 20 bp, Artificial Sequence
  Synthetic oligonucleotide; TGG chr2 60486903 60486922 60486919 +
cttttccctgctaacagaaa

SEQ ID NO: 161384 - DNA, 20 bp, Artificial Sequence
  Synthetic oligonucleotide; CAG chr2 60486909 60486928 60486925 +
cctgctaacagaaatggaat

SEQ ID NO: 161385 - DNA, 20 bp, Artificial Sequence
  Synthetic oligonucleotide; AAG chr2 60486933 60486952 60486949 +
acaaattaatatttaatttt

SEQ ID NO: 161386 - DNA, 20 bp, Artificial Sequence
  Synthetic oligonucleotide; CAG chr2 60486949 60486968 60486965 +
ttttaagattactattctat

SEQ ID NO: 161387 - DNA, 20 bp, Artificial Sequence
  Synthetic oligonucleotide; AAG chr2 60486959 60486978 60486975 +
actattctatcagaataaaa

SEQ ID NO: 161388 - DNA, 20 bp, Artificial Sequence
  Synthetic oligonucleotide; CGG chr2 60486965 60486984 60486981 +
ctatcagaataaaaaagact

SEQ ID NO: 161389 - DNA, 20 bp, Artificial Sequence
  Synthetic oligonucleotide; GGG chr2 60486966 60486985 60486982 +
tatcagaataaaaaagactc

SEQ ID NO: 161390 - DNA, 20 bp, Artificial Sequence
  Synthetic oligonucleotide; GAG chr2 60486968 60486987 60486984 +
tcagaataaaaaagactcgg

SEQ ID NO: 161391 - DNA, 20 bp, Artificial Sequence
  Synthetic oligonucleotide; AAG chr2 60486976 60486995 60486992 +
aaaaagactcgggagattca

SEQ ID NO: 161392 - DNA, 20 bp, Artificial Sequence
  Synthetic oligonucleotide; AAG chr2 60486981 60487000 60486997 +
gactcgggagattcaaagcg

SEQ ID NO: 161393 - DNA, 20 bp, Artificial Sequence
  Synthetic oligonucleotide; AGG chr2 60486982 60487001 60486998 +
actcgggagattcaaagcga

SEQ ID NO: 161394 - DNA, 20 bp, Artificial Sequence
  Synthetic oligonucleotide; AAG chr2 60487001 60487020 60487017 +
aaggcaaatgcccctccttt

SEQ ID NO: 161395 - DNA, 20 bp, Artificial Sequence
  Synthetic oligonucleotide; CAG chr2 60487019 60487038 60487035 +
ttaagtctaacgttgctatt

SEQ ID NO: 161396 - DNA, 20 bp, Artificial Sequence
  Synthetic oligonucleotide; AGG chr2 60487020 60487039 60487036 +
taagtctaacgttgctattc

SEQ ID NO: 161397 - DNA, 20 bp, Artificial Sequence
  Synthetic oligonucleotide; TAG chr2 60487027 60487046 60487043 +
aacgttgctattcaggcatt

SEQ ID NO: 161398 - DNA, 20 bp, Artificial Sequence
  Synthetic oligonucleotide; AGG chr2 60487028 60487047 60487044 +
acgttgctattcaggcattt

SEQ ID NO: 161399 - DNA, 20 bp, Artificial Sequence
  Synthetic oligonucleotide; GAG chr2 60487030 60487049 60487046 +
gttgctattcaggcatttag

SEQ ID NO: 161400 - DNA, 20 bp, Artificial Sequence
  Synthetic oligonucleotide; TAG chr2 60487036 60487055 60487052 +
attcaggcatttaggagcgc

SEQ ID NO: 161401 - DNA, 20 bp, Artificial Sequence
  Synthetic oligonucleotide; CAG chr2 60487042 60487061 60487058 +
gcatttaggagcgctagaca

SEQ ID NO: 161402 - DNA, 20 bp, Artificial Sequence
  Synthetic oligonucleotide; GAG chr2 60487046 60487065 60487062 +
ttaggagcgctagacacagt

SEQ ID NO: 161403 - DNA, 20 bp, Artificial Sequence
  Synthetic oligonucleotide; AAG chr2 60487079 60487098 60487095 +
tccaacctgtgatttgccac

SEQ ID NO: 161404 - DNA, 20 bp, Artificial Sequence
  Synthetic oligonucleotide; AGG chr2 60487080 60487099 60487096 +
ccaacctgtgatttgccaca

SEQ ID NO: 161405 - DNA, 20 bp, Artificial Sequence
  Synthetic oligonucleotide; CAG chr2 60487083 60487102 60487099 +
acctgtgatttgccacaagg

SEQ ID NO: 161406 - DNA, 20 bp, Artificial Sequence
  Synthetic oligonucleotide; AGG chr2 60487084 60487103 60487100 +
cctgtgatttgccacaaggc

SEQ ID NO: 161407 - DNA, 20 bp, Artificial Sequence
  Synthetic oligonucleotide; AAG chr2 60487087 60487106 60487103 +
gtgatttgccacaaggcagg

SEQ ID NO: 161408 - DNA, 20 bp, Artificial Sequence
  Synthetic oligonucleotide; AGG chr2 60487088 60487107 60487104 +
tgatttgccacaaggcagga

SEQ ID NO: 161409 - DNA, 20 bp, Artificial Sequence
  Synthetic oligonucleotide; GGG chr2 60487089 60487108 60487105 +
gatttgccacaaggcaggaa

SEQ ID NO: 161410 - DNA, 20 bp, Artificial Sequence
  Synthetic oligonucleotide; GGG chr2 60487090 60487109 60487106 +
atttgccacaaggcaggaag

SEQ ID NO: 161411 - DNA, 20 bp, Artificial Sequence
  Synthetic oligonucleotide; AAG chr2 60487093 60487112 60487109 +
tgccacaaggcaggaagggg

SEQ ID NO: 161412 - DNA, 20 bp, Artificial Sequence
  Synthetic oligonucleotide; AGG chr2 60487094 60487113 60487110 +
gccacaaggcaggaagggga

SEQ ID NO: 161413 - DNA, 20 bp, Artificial Sequence
  Synthetic oligonucleotide; TAG chr2 60487098 60487117 60487114 +
caaggcaggaaggggaagga

SEQ ID NO: 161414 - DNA, 20 bp, Artificial Sequence
  Synthetic oligonucleotide; AAG chr2 60487113 60487132 60487129 +
aaggatagtgcaacacccct

SEQ ID NO: 161415 - DNA, 20 bp, Artificial Sequence
  Synthetic oligonucleotide; AAG chr2 60487122 60487141 60487138 +
gcaacacccctaagtgtgtg

SEQ ID NO: 161416 - DNA, 20 bp, Artificial Sequence
  Synthetic oligonucleotide; TAG chr2 60487152 60487171 60487168 +
cttttacccatgtaatgatc

SEQ ID NO: 161417 - DNA, 20 bp, Artificial Sequence
  Synthetic oligonucleotide; AAG chr2 60487185 60487204 60487201 +
attttgcctttaatcaatga

SEQ ID NO: 161418 - DNA, 20 bp, Artificial Sequence
  Synthetic oligonucleotide; GAG chr2 60487187 60487206 60487203 +
tttgcctttaatcaatgaaa

SEQ ID NO: 161419 - DNA, 20 bp, Artificial Sequence
  Synthetic oligonucleotide; AAG chr2 60487191 60487210 60487207 +
cctttaatcaatgaaagagt

SEQ ID NO: 161420 - DNA, 20 bp, Artificial Sequence
  Synthetic oligonucleotide; AAG chr2 60487235 60487254 60487251 +
ctccctaacctatattttgc

SEQ ID NO: 161421 - DNA, 20 bp, Artificial Sequence
  Synthetic oligonucleotide; TAG chr2 60487243 60487262 60487259 +
cctatattttgcaagtcgat

SEQ ID NO: 161422 - DNA, 20 bp, Artificial Sequence
  Synthetic oligonucleotide; AAG chr2 60487248 60487267 60487264 +
attttgcaagtcgattagct

SEQ ID NO: 161423 - DNA, 20 bp, Artificial Sequence
  Synthetic oligonucleotide; CAG chr2 60487267 60487286 60487283 +
taagctcttcatgctaatgt

SEQ ID NO: 161424 - DNA, 20 bp, Artificial Sequence
  Synthetic oligonucleotide; CAG chr2 60487270 60487289 60487286 +
gctcttcatgctaatgtcag

SEQ ID NO: 161425 - DNA, 20 bp, Artificial Sequence
  Synthetic oligonucleotide; GAG chr2 60487272 60487291 60487288 +
tcttcatgctaatgtcagca

SEQ ID NO: 161426 - DNA, 20 bp, Artificial Sequence
  Synthetic oligonucleotide; CAG chr2 60487290 60487309 60487306 +
cagagcccatgttacatctc

SEQ ID NO: 161427 - DNA, 20 bp, Artificial Sequence
  Synthetic oligonucleotide; CAG chr2 60487294 60487313 60487310 +
gcccatgttacatctccagt

SEQ ID NO: 161428 - DNA, 20 bp, Artificial Sequence
  Synthetic oligonucleotide; AGG chr2 60487295 60487314 60487311 +
cccatgttacatctccagtc

SEQ ID NO: 161429 - DNA, 20 bp, Artificial Sequence
  Synthetic oligonucleotide; CAG chr2 60487302 60487321 60487318 +
tacatctccagtcaggcttt

SEQ ID NO: 161430 - DNA, 20 bp, Artificial Sequence
  Synthetic oligonucleotide; AGG chr2 60487303 60487322 60487319 +
acatctccagtcaggctttc

SEQ ID NO: 161431 - DNA, 20 bp, Artificial Sequence
  Synthetic oligonucleotide; GAG chr2 60487333 60487352 60487349 +
accccacaatgccacacacc

SEQ ID NO: 161432 - DNA, 20 bp, Artificial Sequence
  Synthetic oligonucleotide; GAG chr2 60487335 60487354 60487351 +
cccacaatgccacacaccga

SEQ ID NO: 161433 - DNA, 20 bp, Artificial Sequence
  Synthetic oligonucleotide; TGG chr2 60487338 60487357 60487354 +
acaatgccacacaccgagag

SEQ ID NO: 161434 - DNA, 20 bp, Artificial Sequence
  Synthetic oligonucleotide; AAG chr2 60487344 60487363 60487360 +
ccacacaccgagagtggaaa

SEQ ID NO: 161435 - DNA, 20 bp, Artificial Sequence
  Synthetic oligonucleotide; CAG chr2 60487353 60487372 60487369 +
gagagtggaaaaagaaaatt

SEQ ID NO: 161436 - DNA, 20 bp, Artificial Sequence
  Synthetic oligonucleotide; CAG chr2 60487356 60487375 60487372 +
agtggaaaaagaaaattcag

SEQ ID NO: 161437 - DNA, 20 bp, Artificial Sequence
  Synthetic oligonucleotide; AGG chr2 60487357 60487376 60487373 +
gtggaaaaagaaaattcagc

SEQ ID NO: 161438 - DNA, 20 bp, Artificial Sequence
  Synthetic oligonucleotide; GGG chr2 60487358 60487377 60487374 +
tggaaaaagaaaattcagca

SEQ ID NO: 161439 - DNA, 20 bp, Artificial Sequence
  Synthetic oligonucleotide; GGG chr2 60487359 60487378 60487375 +
ggaaaaagaaaattcagcag

SEQ ID NO: 161440 - DNA, 20 bp, Artificial Sequence
  Synthetic oligonucleotide; GGG chr2 60487360 60487379 60487376 +
gaaaaagaaaattcagcagg

SEQ ID NO: 161441 - DNA, 20 bp, Artificial Sequence
  Synthetic oligonucleotide; GAG chr2 60487362 60487381 60487378 +
aaaagaaaattcagcagggg

SEQ ID NO: 161442 - DNA, 20 bp, Artificial Sequence
  Synthetic oligonucleotide; CAG chr2 60487365 60487384 60487381 +
agaaaattcagcagggggag

SEQ ID NO: 161443 - DNA, 20 bp, Artificial Sequence
  Synthetic oligonucleotide; TAG chr2 60487370 60487389 60487386 +
attcagcagggggagcagtg

SEQ ID NO: 161444 - DNA, 20 bp, Artificial Sequence
  Synthetic oligonucleotide; TGG chr2 60487373 60487392 60487389 +
cagcagggggagcagtgtag

SEQ ID NO: 161445 - DNA, 20 bp, Artificial Sequence
  Synthetic oligonucleotide; GGG chr2 60487374 60487393 60487390 +
agcagggggagcagtgtagt

SEQ ID NO: 161446 - DNA, 20 bp, Artificial Sequence
  Synthetic oligonucleotide; CAG chr2 60487377 60487396 60487393 +
agggggagcagtgtagtggg

SEQ ID NO: 161447 - DNA, 20 bp, Artificial Sequence
  Synthetic oligonucleotide; TGG chr2 60487400 60487419 60487416 +
ttacgttttcgtcatctgta

SEQ ID NO: 161448 - DNA, 20 bp, Artificial Sequence
  Synthetic oligonucleotide; TGG chr2 60487407 60487426 60487423 +
ttcgtcatctgtatggaaat

SEQ ID NO: 161449 - DNA, 20 bp, Artificial Sequence
  Synthetic oligonucleotide; GGG chr2 60487408 60487427 60487424 +
tcgtcatctgtatggaaatt

SEQ ID NO: 161450 - DNA, 20 bp, Artificial Sequence
  Synthetic oligonucleotide; TAG chr2 60487429 60487448 60487445 +
ggaaatcgtcttctcaaatg

SEQ ID NO: 161451 - DNA, 20 bp, Artificial Sequence
  Synthetic oligonucleotide; TGG chr2 60487444 60487463 60487460 +
aaatgtagattatcttccct

SEQ ID NO: 161452 - DNA, 20 bp, Artificial Sequence
  Synthetic oligonucleotide; GGG chr2 60487445 60487464 60487461 +
aatgtagattatcttccctt

SEQ ID NO: 161453 - DNA, 20 bp, Artificial Sequence
  Synthetic oligonucleotide; TGG chr2 60487455 60487474 60487471 +
atcttcccttgggatccttc

SEQ ID NO: 161454 - DNA, 20 bp, Artificial Sequence
  Synthetic oligonucleotide; GAG chr2 60487457 60487476 60487473 +
cttcccttgggatccttctg

SEQ ID NO: 161455 - DNA, 20 bp, Artificial Sequence
  Synthetic oligonucleotide; AGG chr2 60487458 60487477 60487474 +
ttcccttgggatccttctgg

SEQ ID NO: 161456 - DNA, 20 bp, Artificial Sequence
  Synthetic oligonucleotide; GGG chr2 60487459 60487478 60487475 +
tcccttgggatccttctgga

SEQ ID NO: 161457 - DNA, 20 bp, Artificial Sequence
  Synthetic oligonucleotide; TAG chr2 60487472 60487491 60487488 +
ttctggagggctataaataa

SEQ ID NO: 161458 - DNA, 20 bp, Artificial Sequence
  Synthetic oligonucleotide; TAG chr2 60487492 60487511 60487508 +
tagaacatactaatcaacat

SEQ ID NO: 161459 - DNA, 20 bp, Artificial Sequence
  Synthetic oligonucleotide; CAG chr2 60487512 60487531 60487528 +
tagatatttaaaaatgaata

SEQ ID NO: 161460 - DNA, 20 bp, Artificial Sequence
  Synthetic oligonucleotide; CAG chr2 60487518 60487537 60487534 +
tttaaaaatgaatacagatt

SEQ ID NO: 161461 - DNA, 20 bp, Artificial Sequence
  Synthetic oligonucleotide; AAG chr2 60487524 60487543 60487540 +
aatgaatacagattcagatt

SEQ ID NO: 161462 - DNA, 20 bp, Artificial Sequence
  Synthetic oligonucleotide; AGG chr2 60487525 60487544 60487541 +
atgaatacagattcagatta

SEQ ID NO: 161463 - DNA, 20 bp, Artificial Sequence
  Synthetic oligonucleotide; GGG chr2 60487526 60487545 60487542 +
tgaatacagattcagattaa

SEQ ID NO: 161464 - DNA, 20 bp, Artificial Sequence
  Synthetic oligonucleotide; CAG chr2 60487556 60487575 60487572 +
aatgatgcctttataaaatc

SEQ ID NO: 161465 - DNA, 20 bp, Artificial Sequence
  Synthetic oligonucleotide; AAG chr2 60487577 60487596 60487593 +
agaacaaaacaaaacaaaaa

SEQ ID NO: 161466 - DNA, 20 bp, Artificial Sequence
  Synthetic oligonucleotide; AGG chr2 60487578 60487597 60487594 +
gaacaaaacaaaacaaaaaa

SEQ ID NO: 161467 - DNA, 20 bp, Artificial Sequence
  Synthetic oligonucleotide; AAG chr2 60487588 60487607 60487604 +
aaacaaaaaaaggcatgaaa

SEQ ID NO: 161468 - DNA, 20 bp, Artificial Sequence
  Synthetic oligonucleotide; AAG chr2 60487591 60487610 60487607 +
caaaaaaaggcatgaaaaag

SEQ ID NO: 161469 - DNA, 20 bp, Artificial Sequence
  Synthetic oligonucleotide; AGG chr2 60487592 60487611 60487608 +
aaaaaaaggcatgaaaaaga

SEQ ID NO: 161470 - DNA, 20 bp, Artificial Sequence
  Synthetic oligonucleotide; TAG chr2 60487597 60487616 60487613 +
aaggcatgaaaaagaaggct

SEQ ID NO: 161471 - DNA, 20 bp, Artificial Sequence
  Synthetic oligonucleotide; CGG chr2 60487600 60487619 60487616 +
gcatgaaaaagaaggcttag

SEQ ID NO: 161472 - DNA, 20 bp, Artificial Sequence
  Synthetic oligonucleotide; AAG chr2 60487612 60487631 60487628 +
aggcttagcggatccccctt

SEQ ID NO: 161473 - DNA, 20 bp, Artificial Sequence
  Synthetic oligonucleotide; TAG chr2 60487616 60487635 60487632 +
ttagcggatcccccttaagt

SEQ ID NO: 161474 - DNA, 20 bp, Artificial Sequence
  Synthetic oligonucleotide; TGG chr2 60487629 60487648 60487645 +
cttaagttagccctattctc

SEQ ID NO: 161475 - DNA, 20 bp, Artificial Sequence
  Synthetic oligonucleotide; CAG chr2 60487641 60487660 60487657 +
ctattctctggcaaccacac

SEQ ID NO: 161476 - DNA, 20 bp, Artificial Sequence
  Synthetic oligonucleotide; GAG chr2 60487652 60487671 60487668 +
caaccacaccagcctttaac

SEQ ID NO: 161477 - DNA, 20 bp, Artificial Sequence
  Synthetic oligonucleotide; AGG chr2 60487653 60487672 60487669 +
aaccacaccagcctttaacg

SEQ ID NO: 161478 - DNA, 20 bp, Artificial Sequence
  Synthetic oligonucleotide; GGG chr2 60487654 60487673 60487670 +
accacaccagcctttaacga

SEQ ID NO: 161479 - DNA, 20 bp, Artificial Sequence
  Synthetic oligonucleotide; AAG chr2 60487663 60487682 60487679 +
gcctttaacgagggtgttca

SEQ ID NO: 161480 - DNA, 20 bp, Artificial Sequence
  Synthetic oligonucleotide; GAG chr2 60487692 60487711 60487708 +
tttcccactcccttatttat

SEQ ID NO: 161481 - DNA, 20 bp, Artificial Sequence
  Synthetic oligonucleotide; CAG chr2 60487695 60487714 60487711 +
cccactcccttatttatgag

SEQ ID NO: 161482 - DNA, 20 bp, Artificial Sequence
  Synthetic oligonucleotide; CAG chr2 60487698 60487717 60487714 +
actcccttatttatgagcag

SEQ ID NO: 161483 - DNA, 20 bp, Artificial Sequence
  Synthetic oligonucleotide; AAG chr2 60487709 60487728 60487725 +
tatgagcagcagaatgtaaa

SEQ ID NO: 161484 - DNA, 20 bp, Artificial Sequence
  Synthetic oligonucleotide; AAG chr2 60487713 60487732 60487729 +
agcagcagaatgtaaaaagc

SEQ ID NO: 161485 - DNA, 20 bp, Artificial Sequence
  Synthetic oligonucleotide; GAG chr2 60487715 60487734 60487731 +
cagcagaatgtaaaaagcaa

SEQ ID NO: 161486 - DNA, 20 bp, Artificial Sequence
  Synthetic oligonucleotide; AGG chr2 60487716 60487735 60487732 +
agcagaatgtaaaaagcaag

SEQ ID NO: 161487 - DNA, 20 bp, Artificial Sequence
  Synthetic oligonucleotide; CGG chr2 60487732 60487751 60487748 +
caagaggcttaattttaatg

SEQ ID NO: 161488 - DNA, 20 bp, Artificial Sequence
  Synthetic oligonucleotide; AAG chr2 60487761 60487780 60487777 +
tctcatcaaccattctatct

SEQ ID NO: 161489 - DNA, 20 bp, Artificial Sequence
  Synthetic oligonucleotide; AGG chr2 60487762 60487781 60487778 +
ctcatcaaccattctatcta

SEQ ID NO: 161490 - DNA, 20 bp, Artificial Sequence
  Synthetic oligonucleotide; AAG chr2 60487765 60487784 60487781 +
atcaaccattctatctaagg

SEQ ID NO: 161491 - DNA, 20 bp, Artificial Sequence
  Synthetic oligonucleotide; CAG chr2 60487771 60487790 60487787 +
cattctatctaaggaagctg

SEQ ID NO: 161492 - DNA, 20 bp, Artificial Sequence
  Synthetic oligonucleotide; AAG chr2 60487775 60487794 60487791 +
ctatctaaggaagctgcaga

SEQ ID NO: 161493 - DNA, 20 bp, Artificial Sequence
  Synthetic oligonucleotide; AGG chr2 60487776 60487795 60487792 +
tatctaaggaagctgcagaa

SEQ ID NO: 161494 - DNA, 20 bp, Artificial Sequence
  Synthetic oligonucleotide; TGG chr2 60487786 60487805 60487802 +
agctgcagaaaggtgaaaac

SEQ ID NO: 161495 - DNA, 20 bp, Artificial Sequence
  Synthetic oligonucleotide; TGG chr2 60487807 60487826 60487823 +
ggaaatttatgaacctttaa

SEQ ID NO: 161496 - DNA, 20 bp, Artificial Sequence
  Synthetic oligonucleotide; GGG chr2 60487808 60487827 60487824 +
gaaatttatgaacctttaat

SEQ ID NO: 161497 - DNA, 20 bp, Artificial Sequence
  Synthetic oligonucleotide; TGG chr2 60487816 60487835 60487832 +
tgaacctttaatgggaaatc

SEQ ID NO: 161498 - DNA, 20 bp, Artificial Sequence
  Synthetic oligonucleotide; AAG chr2 60487821 60487840 60487837 +
ctttaatgggaaatctggat

SEQ ID NO: 161499 - DNA, 20 bp, Artificial Sequence
  Synthetic oligonucleotide; TGG chr2 60487828 60487847 60487844 +
gggaaatctggataagaatt

SEQ ID NO: 161500 - DNA, 20 bp, Artificial Sequence
  Synthetic oligonucleotide; AAG chr2 60487843 60487862 60487859 +
gaatttggtctaaatatatg

SEQ ID NO: 161501 - DNA, 20 bp, Artificial Sequence
  Synthetic oligonucleotide; GAG chr2 60487845 60487864 60487861 +
atttggtctaaatatatgaa

SEQ ID NO: 161502 - DNA, 20 bp, Artificial Sequence
  Synthetic oligonucleotide; AGG chr2 60487846 60487865 60487862 +
tttggtctaaatatatgaag

SEQ ID NO: 161503 - DNA, 20 bp, Artificial Sequence
  Synthetic oligonucleotide; TGG chr2 60487853 60487872 60487869 +
taaatatatgaagaggaaca

SEQ ID NO: 161504 - DNA, 20 bp, Artificial Sequence
  Synthetic oligonucleotide; CAG chr2 60487857 60487876 60487873 +
tatatgaagaggaacatgga

SEQ ID NO: 161505 - DNA, 20 bp, Artificial Sequence
  Synthetic oligonucleotide; TGG chr2 60487861 60487880 60487877 +
tgaagaggaacatggacagc

SEQ ID NO: 161506 - DNA, 20 bp, Artificial Sequence
  Synthetic oligonucleotide; AAG chr2 60487880 60487899 60487896 +
ctggcacaaacacaaaatgc

SEQ ID NO: 161507 - DNA, 20 bp, Artificial Sequence
  Synthetic oligonucleotide; CAG chr2 60487894 60487913 60487910 +
aaatgcaagtactccaactc

SEQ ID NO: 161508 - DNA, 20 bp, Artificial Sequence
  Synthetic oligonucleotide; AAG chr2 60487920 60487939 60487936 +
cctgataacatctgccacta

SEQ ID NO: 161509 - DNA, 20 bp, Artificial Sequence
  Synthetic oligonucleotide; AGG chr2 60487921 60487940 60487937 +
ctgataacatctgccactaa

SEQ ID NO: 161510 - DNA, 20 bp, Artificial Sequence
  Synthetic oligonucleotide; TGG chr2 60487934 60487953 60487950 +
ccactaaaggtttactgact

SEQ ID NO: 161511 - DNA, 20 bp, Artificial Sequence
  Synthetic oligonucleotide; TAG chr2 60487949 60487968 60487965 +
tgacttggttttcccaactc

SEQ ID NO: 161512 - DNA, 20 bp, Artificial Sequence
  Synthetic oligonucleotide; TGG chr2 60487954 60487973 60487970 +
tggttttcccaactctagaa

SEQ ID NO: 161513 - DNA, 20 bp, Artificial Sequence
  Synthetic oligonucleotide; GAG chr2 60487956 60487975 60487972 +
gttttcccaactctagaatg

SEQ ID NO: 161514 - DNA, 20 bp, Artificial Sequence
  Synthetic oligonucleotide; TGG chr2 60487973 60487992 60487989 +
atggagccctcatctaaacc

SEQ ID NO: 161515 - DNA, 20 bp, Artificial Sequence
  Synthetic oligonucleotide; GGG chr2 60487974 60487993 60487990 +
tggagccctcatctaaacct

SEQ ID NO: 161516 - DNA, 20 bp, Artificial Sequence
  Synthetic oligonucleotide; GGG chr2 60487975 60487994 60487991 +
ggagccctcatctaaacctg

SEQ ID NO: 161517 - DNA, 20 bp, Artificial Sequence
  Synthetic oligonucleotide; AAG chr2 60487978 60487997 60487994 +
gccctcatctaaacctgggg

SEQ ID NO: 161518 - DNA, 20 bp, Artificial Sequence
  Synthetic oligonucleotide; TAG chr2 60487996 60488015 60488012 +
ggaagcaatatatgaacaat

SEQ ID NO: 161519 - DNA, 20 bp, Artificial Sequence
  Synthetic oligonucleotide; TAG chr2 60488013 60488032 60488029 +
aattagatattaaatgctta

SEQ ID NO: 161520 - DNA, 20 bp, Artificial Sequence
  Synthetic oligonucleotide; TGG chr2 60488044 60488063 60488060 +
ctgtgctattacttttgacc

SEQ ID NO: 161521 - DNA, 20 bp, Artificial Sequence
  Synthetic oligonucleotide; GGG chr2 60488045 60488064 60488061 +
tgtgctattacttttgacct

SEQ ID NO: 161522 - DNA, 20 bp, Artificial Sequence
  Synthetic oligonucleotide; CAG chr2 60488059 60488078 60488075 +
tgacctgggttttaaaaaca

SEQ ID NO: 161523 - DNA, 20 bp, Artificial Sequence
  Synthetic oligonucleotide; TAG chr2 60488089 60488108 60488105 +
tacaatttattctcattatg

SEQ ID NO: 161524 - DNA, 20 bp, Artificial Sequence
  Synthetic oligonucleotide; TGG chr2 60488109 60488128 60488125 +
tagaaacatttaaattatcc

SEQ ID NO: 161525 - DNA, 20 bp, Artificial Sequence
  Synthetic oligonucleotide; AAG chr2 60488112 60488131 60488128 +
aaacatttaaattatcctgg

SEQ ID NO: 161526 - DNA, 20 bp, Artificial Sequence
  Synthetic oligonucleotide; GAG chr2 60488114 60488133 60488130 +
acatttaaattatcctggaa

SEQ ID NO: 161527 - DNA, 20 bp, Artificial Sequence
  Synthetic oligonucleotide; CGG chr2 60488126 60488145 60488142 +
tcctggaagagtttgtctca

SEQ ID NO: 161528 - DNA, 20 bp, Artificial Sequence
  Synthetic oligonucleotide; GGG chr2 60488127 60488146 60488143 +
cctggaagagtttgtctcac

SEQ ID NO: 161529 - DNA, 20 bp, Artificial Sequence
  Synthetic oligonucleotide; AAG chr2 60488137 60488156 60488153 +
tttgtctcacgggctgttca

SEQ ID NO: 161530 - DNA, 20 bp, Artificial Sequence
  Synthetic oligonucleotide; GAG chr2 60488139 60488158 60488155 +
tgtctcacgggctgttcaaa

SEQ ID NO: 161531 - DNA, 20 bp, Artificial Sequence
  Synthetic oligonucleotide; TAG chr2 60488160 60488179 60488176 +
agtgtttcttcctttccttc

SEQ ID NO: 161532 - DNA, 20 bp, Artificial Sequence
  Synthetic oligonucleotide; AGG chr2 60488161 60488180 60488177 +
gtgtttcttcctttccttct

SEQ ID NO: 161533 - DNA, 20 bp, Artificial Sequence
  Synthetic oligonucleotide; GAG chr2 60488169 60488188 60488185 +
tcctttccttctaggaacat

SEQ ID NO: 161534 - DNA, 20 bp, Artificial Sequence
  Synthetic oligonucleotide; AGG chr2 60488170 60488189 60488186 +
cctttccttctaggaacatg

SEQ ID NO: 161535 - DNA, 20 bp, Artificial Sequence
  Synthetic oligonucleotide; GAG chr2 60488172 60488191 60488188 +
tttccttctaggaacatgag

SEQ ID NO: 161536 - DNA, 20 bp, Artificial Sequence
  Synthetic oligonucleotide; AAG chr2 60488195 60488214 60488211 +
tgaatctgactatttcatca

SEQ ID NO: 161537 - DNA, 20 bp, Artificial Sequence
  Synthetic oligonucleotide; AAG chr2 60488205 60488224 60488221 +
tatttcatcaaagcctgtaa

SEQ ID NO: 161538 - DNA, 20 bp, Artificial Sequence
  Synthetic oligonucleotide; GAG chr2 60488214 60488233 60488230 +
aaagcctgtaaaagatacct

SEQ ID NO: 161539 - DNA, 20 bp, Artificial Sequence
  Synthetic oligonucleotide; AAG chr2 60488244 60488263 60488260 +
tttaactgaacaatgtctcc

SEQ ID NO: 161540 - DNA, 20 bp, Artificial Sequence
  Synthetic oligonucleotide; CAG chr2 60488251 60488270 60488267 +
gaacaatgtctccaagaatt

SEQ ID NO: 161541 - DNA, 20 bp, Artificial Sequence
  Synthetic oligonucleotide; GAG chr2 60488259 60488278 60488275 +
tctccaagaattcagactgt

SEQ ID NO: 161542 - DNA, 20 bp, Artificial Sequence
  Synthetic oligonucleotide; GAG chr2 60488261 60488280 60488277 +
tccaagaattcagactgtga

SEQ ID NO: 161543 - DNA, 20 bp, Artificial Sequence
  Synthetic oligonucleotide; AGG chr2 60488262 60488281 60488278 +
ccaagaattcagactgtgag

SEQ ID NO: 161544 - DNA, 20 bp, Artificial Sequence
  Synthetic oligonucleotide; GGG chr2 60488263 60488282 60488279 +
caagaattcagactgtgaga

SEQ ID NO: 161545 - DNA, 20 bp, Artificial Sequence
  Synthetic oligonucleotide; GGG chr2 60488264 60488283 60488280 +
aagaattcagactgtgagag

SEQ ID NO: 161546 - DNA, 20 bp, Artificial Sequence
  Synthetic oligonucleotide; GGG chr2 60488265 60488284 60488281 +
agaattcagactgtgagagg

SEQ ID NO: 161547 - DNA, 20 bp, Artificial Sequence
  Synthetic oligonucleotide; AAG chr2 60488268 60488287 60488284 +
attcagactgtgagaggggg

SEQ ID NO: 161548 - DNA, 20 bp, Artificial Sequence
  Synthetic oligonucleotide; AAG chr2 60488271 60488290 60488287 +
cagactgtgagagggggaag

SEQ ID NO: 161549 - DNA, 20 bp, Artificial Sequence
  Synthetic oligonucleotide; TGG chr2 60488284 60488303 60488300 +
ggggaagaagaccgtctctt

SEQ ID NO: 161550 - DNA, 20 bp, Artificial Sequence
  Synthetic oligonucleotide; CAG chr2 60488289 60488308 60488305 +
agaagaccgtctctttggtg

SEQ ID NO: 161551 - DNA, 20 bp, Artificial Sequence
  Synthetic oligonucleotide; TGG chr2 60488292 60488311 60488308 +
agaccgtctctttggtgcag

SEQ ID NO: 161552 - DNA, 20 bp, Artificial Sequence
  Synthetic oligonucleotide; GGG chr2 60488293 60488312 60488309 +
gaccgtctctttggtgcagt

SEQ ID NO: 161553 - DNA, 20 bp, Artificial Sequence
  Synthetic oligonucleotide; TGG chr2 60488316 60488335 60488332 +
aattgccattgtgtcctccc

SEQ ID NO: 161554 - DNA, 20 bp, Artificial Sequence
  Synthetic oligonucleotide; TGG chr2 60488336 60488355 60488352 +
tggttcctctcctctgtcct

SEQ ID NO: 161555 - DNA, 20 bp, Artificial Sequence
  Synthetic oligonucleotide; CAG chr2 60488344 60488363 60488360 +
ctcctctgtccttggcaatc

SEQ ID NO: 161556 - DNA, 20 bp, Artificial Sequence
  Synthetic oligonucleotide; CAG chr2 60488358 60488377 60488374 +
gcaatccagttacaatttga

SEQ ID NO: 161557 - DNA, 20 bp, Artificial Sequence
  Synthetic oligonucleotide; AAG chr2 60488367 60488386 60488383 +
ttacaatttgacagcattta

SEQ ID NO: 161558 - DNA, 20 bp, Artificial Sequence
  Synthetic oligonucleotide; CAG chr2 60488374 60488393 60488390 +
ttgacagcatttaaagatga

SEQ ID NO: 161559 - DNA, 20 bp, Artificial Sequence
  Synthetic oligonucleotide; GAG chr2 60488382 60488401 60488398 +
atttaaagatgacagtactt

SEQ ID NO: 161560 - DNA, 20 bp, Artificial Sequence
  Synthetic oligonucleotide; TAG chr2 60488389 60488408 60488405 +
gatgacagtacttgagataa

SEQ ID NO: 161561 - DNA, 20 bp, Artificial Sequence
  Synthetic oligonucleotide; AGG chr2 60488390 60488409 60488406 +
atgacagtacttgagataat

SEQ ID NO: 161562 - DNA, 20 bp, Artificial Sequence
  Synthetic oligonucleotide; CAG chr2 60488405 60488424 60488421 +
ataataggacaatgccataa

SEQ ID NO: 161563 - DNA, 20 bp, Artificial Sequence
  Synthetic oligonucleotide; AGG chr2 60488406 60488425 60488422 +
taataggacaatgccataac

SEQ ID NO: 161564 - DNA, 20 bp, Artificial Sequence
  Synthetic oligonucleotide; CAG chr2 60488413 60488432 60488429 +
acaatgccataacaggatta

SEQ ID NO: 161565 - DNA, 20 bp, Artificial Sequence
  Synthetic oligonucleotide; AAG chr2 60488425 60488444 60488441 +
caggattacagcaaatgtga

SEQ ID NO: 161566 - DNA, 20 bp, Artificial Sequence
  Synthetic oligonucleotide; AAG chr2 60488429 60488448 60488445 +
attacagcaaatgtgaaaga

SEQ ID NO: 161567 - DNA, 20 bp, Artificial Sequence
  Synthetic oligonucleotide; AGG chr2 60488430 60488449 60488446 +
ttacagcaaatgtgaaagaa

SEQ ID NO: 161568 - DNA, 20 bp, Artificial Sequence
  Synthetic oligonucleotide; TAG chr2 60488440 60488459 60488456 +
tgtgaaagaaaggacacacg

SEQ ID NO: 161569 - DNA, 20 bp, Artificial Sequence
  Synthetic oligonucleotide; AGG chr2 60488441 60488460 60488457 +
gtgaaagaaaggacacacgt

SEQ ID NO: 161570 - DNA, 20 bp, Artificial Sequence
  Synthetic oligonucleotide; TAG chr2 60488454 60488473 60488470 +
cacacgtaggtactgtcatt

SEQ ID NO: 161571 - DNA, 20 bp, Artificial Sequence
  Synthetic oligonucleotide; AGG chr2 60488455 60488474 60488471 +
acacgtaggtactgtcattt

SEQ ID NO: 161572 - DNA, 20 bp, Artificial Sequence
  Synthetic oligonucleotide; CAG chr2 60488474 60488493 60488490 +
taggtaatgtcatctatgat

SEQ ID NO: 161573 - DNA, 20 bp, Artificial Sequence
  Synthetic oligonucleotide; CAG chr2 60488501 60488520 60488517 +
tgtttcattttttgctgaca

SEQ ID NO: 161574 - DNA, 20 bp, Artificial Sequence
  Synthetic oligonucleotide; CAG chr2 60488508 60488527 60488524 +
ttttttgctgacacagaact

SEQ ID NO: 161575 - DNA, 20 bp, Artificial Sequence
  Synthetic oligonucleotide; TGG chr2 60488530 60488549 60488546 +
gtgctacttatacaattcac

SEQ ID NO: 161576 - DNA, 20 bp, Artificial Sequence
  Synthetic oligonucleotide; TGG chr2 60488544 60488563 60488560 +
attcactggaaaccctgtta

SEQ ID NO: 161577 - DNA, 20 bp, Artificial Sequence
  Synthetic oligonucleotide; TAG chr2 60488554 60488573 60488570 +
aaccctgttatggctgtaaa

SEQ ID NO: 161578 - DNA, 20 bp, Artificial Sequence
  Synthetic oligonucleotide; AAG chr2 60488574 60488593 60488590 +
tagtttgcttcccccaatga

SEQ ID NO: 161579 - DNA, 20 bp, Artificial Sequence
  Synthetic oligonucleotide; CAG chr2 60488595 60488614 60488611 +
agaaaatacttactgtactg

SEQ ID NO: 161580 - DNA, 20 bp, Artificial Sequence
  Synthetic oligonucleotide; AGG chr2 60488596 60488615 60488612 +
gaaaatacttactgtactgc

SEQ ID NO: 161581 - DNA, 20 bp, Artificial Sequence
  Synthetic oligonucleotide; GGG chr2 60488597 60488616 60488613 +
aaaatacttactgtactgca

SEQ ID NO: 161582 - DNA, 20 bp, Artificial Sequence
  Synthetic oligonucleotide; GGG chr2 60488598 60488617 60488614 +
aaatacttactgtactgcag

SEQ ID NO: 161583 - DNA, 20 bp, Artificial Sequence
  Synthetic oligonucleotide; CGG chr2 60488605 60488624 60488621 +
tactgtactgcaggggaatt

SEQ ID NO: 161584 - DNA, 20 bp, Artificial Sequence
  Synthetic oligonucleotide; TAG chr2 60488618 60488637 60488634 +
gggaattcggtaaaactttc

SEQ ID NO: 161585 - DNA, 20 bp, Artificial Sequence
  Synthetic oligonucleotide; CAG chr2 60488660 60488679 60488676 +
aataacaaaaaatttcaaat

SEQ ID NO: 161586 - DNA, 20 bp, Artificial Sequence
  Synthetic oligonucleotide; TAG chr2 60488669 60488688 60488685 +
aaatttcaaatcagtatcaa

SEQ ID NO: 161587 - DNA, 20 bp, Artificial Sequence
  Synthetic oligonucleotide; AAG chr2 60488675 60488694 60488691 +
caaatcagtatcaatagcca

SEQ ID NO: 161588 - DNA, 20 bp, Artificial Sequence
  Synthetic oligonucleotide; CAG chr2 60488687 60488706 60488703 +
aatagccaaagatccaaaaa

SEQ ID NO: 161589 - DNA, 20 bp, Artificial Sequence
  Synthetic oligonucleotide; AAG chr2 60488694 60488713 60488710 +
aaagatccaaaaacagccta

SEQ ID NO: 161590 - DNA, 20 bp, Artificial Sequence
  Synthetic oligonucleotide; GAG chr2 60488757 60488776 60488773 +
tttgtttgttttttgtttct

SEQ ID NO: 161591 - DNA, 20 bp, Artificial Sequence
  Synthetic oligonucleotide; AGG chr2 60488758 60488777 60488774 +
ttgtttgttttttgtttctg

SEQ ID NO: 161592 - DNA, 20 bp, Artificial Sequence
  Synthetic oligonucleotide; TGG chr2 60488761 60488780 60488777 +
tttgttttttgtttctgagg

SEQ ID NO: 161593 - DNA, 20 bp, Artificial Sequence
  Synthetic oligonucleotide; GAG chr2 60488763 60488782 60488779 +
tgttttttgtttctgaggtg

SEQ ID NO: 161594 - DNA, 20 bp, Artificial Sequence
  Synthetic oligonucleotide; CGG chr2 60488782 60488801 60488798 +
ggagtttcgctcttgttgcc

SEQ ID NO: 161595 - DNA, 20 bp, Artificial Sequence
  Synthetic oligonucleotide; GGG chr2 60488783 60488802 60488799 +
gagtttcgctcttgttgccc

SEQ ID NO: 161596 - DNA, 20 bp, Artificial Sequence
  Synthetic oligonucleotide; TGG chr2 60488787 60488806 60488803 +
ttcgctcttgttgcccgggc

SEQ ID NO: 161597 - DNA, 20 bp, Artificial Sequence
  Synthetic oligonucleotide; GAG chr2 60488789 60488808 60488805 +
cgctcttgttgcccgggctg

SEQ ID NO: 161598 - DNA, 20 bp, Artificial Sequence
  Synthetic oligonucleotide; TGG chr2 60488797 60488816 60488813 +
ttgcccgggctggagtgcaa

SEQ ID NO: 161599 - DNA, 20 bp, Artificial Sequence
  Synthetic oligonucleotide; CGG chr2 60488808 60488827 60488824 +
ggagtgcaatggcgcaatct

SEQ ID NO: 161600 - DNA, 20 bp, Artificial Sequence
  Synthetic oligonucleotide; CGG chr2 60488832 60488851 60488848 +
tcaccgcaatctccgcctcc

SEQ ID NO: 161601 - DNA, 20 bp, Artificial Sequence
  Synthetic oligonucleotide; GGG chr2 60488833 60488852 60488849 +
caccgcaatctccgcctccc

SEQ ID NO: 161602 - DNA, 20 bp, Artificial Sequence
  Synthetic oligonucleotide; AAG chr2 60488839 60488858 60488855 +
aatctccgcctcccgggttc

SEQ ID NO: 161603 - DNA, 20 bp, Artificial Sequence
  Synthetic oligonucleotide; CAG chr2 60488856 60488875 60488872 +
ttcaagcgattctcctgcct

SEQ ID NO: 161604 - DNA, 20 bp, Artificial Sequence
  Synthetic oligonucleotide; AAG chr2 60488865 60488884 60488881 +
ttctcctgcctcagcctccc

SEQ ID NO: 161605 - DNA, 20 bp, Artificial Sequence
  Synthetic oligonucleotide; TAG chr2 60488868 60488887 60488884 +
tcctgcctcagcctcccaag

SEQ ID NO: 161606 - DNA, 20 bp, Artificial Sequence
  Synthetic oligonucleotide; TGG chr2 60488872 60488891 60488888 +
gcctcagcctcccaagtagc

SEQ ID NO: 161607 - DNA, 20 bp, Artificial Sequence
  Synthetic oligonucleotide; GGG chr2 60488873 60488892 60488889 +
cctcagcctcccaagtagct

SEQ ID NO: 161608 - DNA, 20 bp, Artificial Sequence
  Synthetic oligonucleotide; TAG chr2 60488880 60488899 60488896 +
ctcccaagtagctgggatta

SEQ ID NO: 161609 - DNA, 20 bp, Artificial Sequence
  Synthetic oligonucleotide; AGG chr2 60488881 60488900 60488897 +
tcccaagtagctgggattat

SEQ ID NO: 161610 - DNA, 20 bp, Artificial Sequence
  Synthetic oligonucleotide; CGG chr2 60488900 60488919 60488916 +
taggcatgcgccaccacacg

SEQ ID NO: 161611 - DNA, 20 bp, Artificial Sequence
  Synthetic oligonucleotide; TGG chr2 60488919 60488938 60488935 +
gcggctaatttctgtatttt

SEQ ID NO: 161612 - DNA, 20 bp, Artificial Sequence
  Synthetic oligonucleotide; TAG chr2 60488922 60488941 60488938 +
gctaatttctgtatttttgg

SEQ ID NO: 161613 - DNA, 20 bp, Artificial Sequence
  Synthetic oligonucleotide; GAG chr2 60488924 60488943 60488940 +
taatttctgtatttttggta

SEQ ID NO: 161614 - DNA, 20 bp, Artificial Sequence
  Synthetic oligonucleotide; CGG chr2 60488928 60488947 60488944 +
ttctgtatttttggtagaga

SEQ ID NO: 161615 - DNA, 20 bp, Artificial Sequence
  Synthetic oligonucleotide; GGG chr2 60488929 60488948 60488945 +
tctgtatttttggtagagac

SEQ ID NO: 161616 - DNA, 20 bp, Artificial Sequence
  Synthetic oligonucleotide; GGG chr2 60488930 60488949 60488946 +
ctgtatttttggtagagacg

SEQ ID NO: 161617 - DNA, 20 bp, Artificial Sequence
  Synthetic oligonucleotide; TGG chr2 60488944 60488963 60488960 +
gagacggggtttctccatgt

SEQ ID NO: 161618 - DNA, 20 bp, Artificial Sequence
  Synthetic oligonucleotide; CAG chr2 60488948 60488967 60488964 +
cggggtttctccatgttggt

SEQ ID NO: 161619 - DNA, 20 bp, Artificial Sequence
  Synthetic oligonucleotide; AGG chr2 60488949 60488968 60488965 +
ggggtttctccatgttggtc

SEQ ID NO: 161620 - DNA, 20 bp, Artificial Sequence
  Synthetic oligonucleotide; TGG chr2 60488953 60488972 60488969 +
tttctccatgttggtcaggc

SEQ ID NO: 161621 - DNA, 20 bp, Artificial Sequence
  Synthetic oligonucleotide; TAG chr2 60488973 60488992 60488989 +
tggtctcaaactcccgacct

SEQ ID NO: 161622 - DNA, 20 bp, Artificial Sequence
  Synthetic oligonucleotide; AGG chr2 60488974 60488993 60488990 +
ggtctcaaactcccgacctt

SEQ ID NO: 161623 - DNA, 20 bp, Artificial Sequence
  Synthetic oligonucleotide; CAG chr2 60488991 60489010 60489007 +
cttaggtgatccacccacct

SEQ ID NO: 161624 - DNA, 20 bp, Artificial Sequence
  Synthetic oligonucleotide; AAG chr2 60489001 60489020 60489017 +
ccacccacctcagcctccca

SEQ ID NO: 161625 - DNA, 20 bp, Artificial Sequence
  Synthetic oligonucleotide; TGG chr2 60489007 60489026 60489023 +
acctcagcctcccaaagtgc

SEQ ID NO: 161626 - DNA, 20 bp, Artificial Sequence
  Synthetic oligonucleotide; GGG chr2 60489008 60489027 60489024 +
cctcagcctcccaaagtgct

SEQ ID NO: 161627 - DNA, 20 bp, Artificial Sequence
  Synthetic oligonucleotide; TAG chr2 60489015 60489034 60489031 +
ctcccaaagtgctgggatta

SEQ ID NO: 161628 - DNA, 20 bp, Artificial Sequence
  Synthetic oligonucleotide; AGG chr2 60489016 60489035 60489032 +
tcccaaagtgctgggattat

SEQ ID NO: 161629 - DNA, 20 bp, Artificial Sequence
  Synthetic oligonucleotide; AAG chr2 60489022 60489041 60489038 +
agtgctgggattataggcat

SEQ ID NO: 161630 - DNA, 20 bp, Artificial Sequence
  Synthetic oligonucleotide; CAG chr2 60489035 60489054 60489051 +
taggcataagctaccacacc

SEQ ID NO: 161631 - DNA, 20 bp, Artificial Sequence
  Synthetic oligonucleotide; AAG chr2 60489064 60489083 60489080 +
ccaaaacaaatttatcttca

SEQ ID NO: 161632 - DNA, 20 bp, Artificial Sequence
  Synthetic oligonucleotide; TAG chr2 60489094 60489113 60489110 +
atgctgtgtgtcctaaataa

SEQ ID NO: 161633 - DNA, 20 bp, Artificial Sequence
  Synthetic oligonucleotide; AGG chr2 60489095 60489114 60489111 +
tgctgtgtgtcctaaataat

SEQ ID NO: 161634 - DNA, 20 bp, Artificial Sequence
  Synthetic oligonucleotide; TGG chr2 60489098 60489117 60489114 +
tgtgtgtcctaaataatagg

SEQ ID NO: 161635 - DNA, 20 bp, Artificial Sequence
  Synthetic oligonucleotide; AAG chr2 60489115 60489134 60489131 +
aggtggtcaaaatgtttcta

SEQ ID NO: 161636 - DNA, 20 bp, Artificial Sequence
  Synthetic oligonucleotide; AGG chr2 60489116 60489135 60489132 +
ggtggtcaaaatgtttctaa

SEQ ID NO: 161637 - DNA, 20 bp, Artificial Sequence
  Synthetic oligonucleotide; GGG chr2 60489117 60489136 60489133 +
gtggtcaaaatgtttctaaa

SEQ ID NO: 161638 - DNA, 20 bp, Artificial Sequence
  Synthetic oligonucleotide; TAG chr2 60489125 60489144 60489141 +
aatgtttctaaagggtacct

SEQ ID NO: 161639 - DNA, 20 bp, Artificial Sequence
  Synthetic oligonucleotide; TAG chr2 60489149 60489168 60489165 +
ccccaattaaactgttgctt

SEQ ID NO: 161640 - DNA, 20 bp, Artificial Sequence
  Synthetic oligonucleotide; GAG chr2 60489151 60489170 60489167 +
ccaattaaactgttgcttta

SEQ ID NO: 161641 - DNA, 20 bp, Artificial Sequence
  Synthetic oligonucleotide; TGG chr2 60489156 60489175 60489172 +
taaactgttgctttagagtt

SEQ ID NO: 161642 - DNA, 20 bp, Artificial Sequence
  Synthetic oligonucleotide; GGG chr2 60489157 60489176 60489173 +
aaactgttgctttagagttt

SEQ ID NO: 161643 - DNA, 20 bp, Artificial Sequence
  Synthetic oligonucleotide; GGG chr2 60489158 60489177 60489174 +
aactgttgctttagagtttg

SEQ ID NO: 161644 - DNA, 20 bp, Artificial Sequence
  Synthetic oligonucleotide; AAG chr2 60489167 60489186 60489183 +
tttagagtttggggaaaata

SEQ ID NO: 161645 - DNA, 20 bp, Artificial Sequence
  Synthetic oligonucleotide; TGG chr2 60489170 60489189 60489186 +
agagtttggggaaaataaag

SEQ ID NO: 161646 - DNA, 20 bp, Artificial Sequence
  Synthetic oligonucleotide; GAG chr2 60489198 60489217 60489214 +
cctaactaaattcacactgt

SEQ ID NO: 161647 - DNA, 20 bp, Artificial Sequence
  Synthetic oligonucleotide; GAG chr2 60489200 60489219 60489216 +
taactaaattcacactgtga

SEQ ID NO: 161648 - DNA, 20 bp, Artificial Sequence
  Synthetic oligonucleotide; CAG chr2 60489204 60489223 60489220 +
taaattcacactgtgagagc

SEQ ID NO: 161649 - DNA, 20 bp, Artificial Sequence
  Synthetic oligonucleotide; TAG chr2 60489214 60489233 60489230 +
ctgtgagagccagtcaacac

SEQ ID NO: 161650 - DNA, 20 bp, Artificial Sequence
  Synthetic oligonucleotide; TGG chr2 60489229 60489248 60489245 +
aacactagcccacatgccaa

SEQ ID NO: 161651 - DNA, 20 bp, Artificial Sequence
  Synthetic oligonucleotide; GGG chr2 60489230 60489249 60489246 +
acactagcccacatgccaat

SEQ ID NO: 161652 - DNA, 20 bp, Artificial Sequence
  Synthetic oligonucleotide; GGG chr2 60489231 60489250 60489247 +
cactagcccacatgccaatg

SEQ ID NO: 161653 - DNA, 20 bp, Artificial Sequence
  Synthetic oligonucleotide; CAG chr2 60489241 60489260 60489257 +
catgccaatggggtccttgt

SEQ ID NO: 161654 - DNA, 20 bp, Artificial Sequence
  Synthetic oligonucleotide; TAG chr2 60489313 60489332 60489329 +
acatatccaaattcatacaa

SEQ ID NO: 161655 - DNA, 20 bp, Artificial Sequence
  Synthetic oligonucleotide; GAG chr2 60489315 60489334 60489331 +
atatccaaattcatacaata

SEQ ID NO: 161656 - DNA, 20 bp, Artificial Sequence
  Synthetic oligonucleotide; AGG chr2 60489316 60489335 60489332 +
tatccaaattcatacaatag

SEQ ID NO: 161657 - DNA, 20 bp, Artificial Sequence
  Synthetic oligonucleotide; TGG chr2 60489323 60489342 60489339 +
attcatacaatagaggcatt

SEQ ID NO: 161658 - DNA, 20 bp, Artificial Sequence
  Synthetic oligonucleotide; CAG chr2 60489330 60489349 60489346 +
caatagaggcatttggaacc

SEQ ID NO: 161659 - DNA, 20 bp, Artificial Sequence
  Synthetic oligonucleotide; TGG chr2 60489365 60489384 60489381 +
tcctaactaatttctgccgc

SEQ ID NO: 161660 - DNA, 20 bp, Artificial Sequence
  Synthetic oligonucleotide; AAG chr2 60489368 60489387 60489384 +
taactaatttctgccgctgg

SEQ ID NO: 161661 - DNA, 20 bp, Artificial Sequence
  Synthetic oligonucleotide; AAG chr2 60489381 60489400 60489397 +
ccgctggaagtttgttccta

SEQ ID NO: 161662 - DNA, 20 bp, Artificial Sequence
  Synthetic oligonucleotide; AAG chr2 60489389 60489408 60489405 +
agtttgttcctaaagccacc

SEQ ID NO: 161663 - DNA, 20 bp, Artificial Sequence
  Synthetic oligonucleotide; TAG chr2 60489397 60489416 60489413 +
cctaaagccaccaagtctcc

SEQ ID NO: 161664 - DNA, 20 bp, Artificial Sequence
  Synthetic oligonucleotide; AAG chr2 60489400 60489419 60489416 +
aaagccaccaagtctcctag

SEQ ID NO: 161665 - DNA, 20 bp, Artificial Sequence
  Synthetic oligonucleotide; TGG chr2 60489414 60489433 60489430 +
tcctagaagcccttatttct

SEQ ID NO: 161666 - DNA, 20 bp, Artificial Sequence
  Synthetic oligonucleotide; CAG chr2 60489417 60489436 60489433 +
tagaagcccttatttcttgg

SEQ ID NO: 161667 - DNA, 20 bp, Artificial Sequence
  Synthetic oligonucleotide; CGG chr2 60489428 60489447 60489444 +
atttcttggcagtaaacaca

SEQ ID NO: 161668 - DNA, 20 bp, Artificial Sequence
  Synthetic oligonucleotide; CGG chr2 60489431 60489450 60489447 +
tcttggcagtaaacacacgg

SEQ ID NO: 161669 - DNA, 20 bp, Artificial Sequence
  Synthetic oligonucleotide; TAG chr2 60489452 60489471 60489468 +
ggccctgcgtgccattaaaa

SEQ ID NO: 161670 - DNA, 20 bp, Artificial Sequence
  Synthetic oligonucleotide; CAG chr2 60489468 60489487 60489484 +
aaaatagctgcctcatcatc

SEQ ID NO: 161671 - DNA, 20 bp, Artificial Sequence
  Synthetic oligonucleotide; AGG chr2 60489469 60489488 60489485 +
aaatagctgcctcatcatcc

SEQ ID NO: 161672 - DNA, 20 bp, Artificial Sequence
  Synthetic oligonucleotide; CAG chr2 60489480 60489499 60489496 +
tcatcatccaggatgacaaa

SEQ ID NO: 161673 - DNA, 20 bp, Artificial Sequence
  Synthetic oligonucleotide; AAG chr2 60489497 60489516 60489513 +
aaacagccacactgtgtgcc

SEQ ID NO: 161674 - DNA, 20 bp, Artificial Sequence
  Synthetic oligonucleotide; CAG chr2 60489504 60489523 60489520 +
cacactgtgtgccaagtgac

SEQ ID NO: 161675 - DNA, 20 bp, Artificial Sequence
  Synthetic oligonucleotide; AAG chr2 60489517 60489536 60489533 +
aagtgaccagccacaaacaa

SEQ ID NO: 161676 - DNA, 20 bp, Artificial Sequence
  Synthetic oligonucleotide; CAG chr2 60489530 60489549 60489546 +
caaacaaaagcttgtttgac

SEQ ID NO: 161677 - DNA, 20 bp, Artificial Sequence
  Synthetic oligonucleotide; AAG chr2 60489545 60489564 60489561 +
ttgaccagcacctatctcaa

SEQ ID NO: 161678 - DNA, 20 bp, Artificial Sequence
  Synthetic oligonucleotide; GAG chr2 60489556 60489575 60489572 +
ctatctcaaaagaaaattct

SEQ ID NO: 161679 - DNA, 20 bp, Artificial Sequence
  Synthetic oligonucleotide; TAG chr2 60489559 60489578 60489575 +
tctcaaaagaaaattctgag

SEQ ID NO: 161680 - DNA, 20 bp, Artificial Sequence
  Synthetic oligonucleotide; AAG chr2 60489562 60489581 60489578 +
caaaagaaaattctgagtag

SEQ ID NO: 161681 - DNA, 20 bp, Artificial Sequence
  Synthetic oligonucleotide; GAG chr2 60489564 60489583 60489580 +
aaagaaaattctgagtagaa

SEQ ID NO: 161682 - DNA, 20 bp, Artificial Sequence
  Synthetic oligonucleotide; AGG chr2 60489565 60489584 60489581 +
aagaaaattctgagtagaag

SEQ ID NO: 161683 - DNA, 20 bp, Artificial Sequence
  Synthetic oligonucleotide; AAG chr2 60489568 60489587 60489584 +
aaaattctgagtagaagagg

SEQ ID NO: 161684 - DNA, 20 bp, Artificial Sequence
  Synthetic oligonucleotide; AAG chr2 60489577 60489596 60489593 +
agtagaagaggaagcacctg

SEQ ID NO: 161685 - DNA, 20 bp, Artificial Sequence
  Synthetic oligonucleotide; AGG chr2 60489578 60489597 60489594 +
gtagaagaggaagcacctga

SEQ ID NO: 161686 - DNA, 20 bp, Artificial Sequence
  Synthetic oligonucleotide; AAG chr2 60489581 60489600 60489597 +
gaagaggaagcacctgaagg

SEQ ID NO: 161687 - DNA, 20 bp, Artificial Sequence
  Synthetic oligonucleotide; AAG chr2 60489589 60489608 60489605 +
agcacctgaaggaagctgaa

SEQ ID NO: 161688 - DNA, 20 bp, Artificial Sequence
  Synthetic oligonucleotide; AAG chr2 60489593 60489612 60489609 +
cctgaaggaagctgaaaaga

SEQ ID NO: 161689 - DNA, 20 bp, Artificial Sequence
  Synthetic oligonucleotide; CAG chr2 60489616 60489635 60489632 +
tctgacatttgaaattctaa

SEQ ID NO: 161690 - DNA, 20 bp, Artificial Sequence
  Synthetic oligonucleotide; GAG chr2 60489618 60489637 60489634 +
tgacatttgaaattctaaca

SEQ ID NO: 161691 - DNA, 20 bp, Artificial Sequence
  Synthetic oligonucleotide; AGG chr2 60489619 60489638 60489635 +
gacatttgaaattctaacag

SEQ ID NO: 161692 - DNA, 20 bp, Artificial Sequence
  Synthetic oligonucleotide; TAG chr2 60489634 60489653 60489650 +
aacagaggttctttcccctc

SEQ ID NO: 161693 - DNA, 20 bp, Artificial Sequence
  Synthetic oligonucleotide; AGG chr2 60489635 60489654 60489651 +
acagaggttctttcccctct

SEQ ID NO: 161694 - DNA, 20 bp, Artificial Sequence
  Synthetic oligonucleotide; TGG chr2 60489644 60489663 60489660 +
ctttcccctctaggacactc

SEQ ID NO: 161695 - DNA, 20 bp, Artificial Sequence
  Synthetic oligonucleotide; GGG chr2 60489645 60489664 60489661 +
tttcccctctaggacactct

SEQ ID NO: 161696 - DNA, 20 bp, Artificial Sequence
  Synthetic oligonucleotide; TAG chr2 60489652 60489671 60489668 +
tctaggacactctgggtcac

SEQ ID NO: 161697 - DNA, 20 bp, Artificial Sequence
  Synthetic oligonucleotide; TGG chr2 60489677 60489696 60489693 +
tctctgctttccttgttccc

SEQ ID NO: 161698 - DNA, 20 bp, Artificial Sequence
  Synthetic oligonucleotide; GAG chr2 60489690 60489709 60489706 +
tgttccctggctcatctcct

SEQ ID NO: 161699 - DNA, 20 bp, Artificial Sequence
  Synthetic oligonucleotide; CGG chr2 60489697 60489716 60489713 +
tggctcatctcctgagcccc

SEQ ID NO: 161700 - DNA, 20 bp, Artificial Sequence
  Synthetic oligonucleotide; GGG chr2 60489698 60489717 60489714 +
ggctcatctcctgagccccc

SEQ ID NO: 161701 - DNA, 20 bp, Artificial Sequence
  Synthetic oligonucleotide; CAG chr2 60489742 60489761 60489758 +
tatttactaaccacttttat

SEQ ID NO: 161702 - DNA, 20 bp, Artificial Sequence
  Synthetic oligonucleotide; AAG chr2 60489778 60489797 60489794 +
ccatccaaaaatgtttactc

SEQ ID NO: 161703 - DNA, 20 bp, Artificial Sequence
  Synthetic oligonucleotide; CAG chr2 60489783 60489802 60489799 +
caaaaatgtttactcaagtt

SEQ ID NO: 161704 - DNA, 20 bp, Artificial Sequence
  Synthetic oligonucleotide; AGG chr2 60489784 60489803 60489800 +
aaaaatgtttactcaagttc

SEQ ID NO: 161705 - DNA, 20 bp, Artificial Sequence
  Synthetic oligonucleotide; TAG chr2 60489788 60489807 60489804 +
atgtttactcaagttcaggc

SEQ ID NO: 161706 - DNA, 20 bp, Artificial Sequence
  Synthetic oligonucleotide; AAG chr2 60489805 60489824 60489821 +
ggctagcttaataaccccca

SEQ ID NO: 161707 - DNA, 20 bp, Artificial Sequence
  Synthetic oligonucleotide; CAG chr2 60489808 60489827 60489824 +
tagcttaataacccccaaag

SEQ ID NO: 161708 - DNA, 20 bp, Artificial Sequence
  Synthetic oligonucleotide; AGG chr2 60489809 60489828 60489825 +
agcttaataacccccaaagc

SEQ ID NO: 161709 - DNA, 20 bp, Artificial Sequence
  Synthetic oligonucleotide; GAG chr2 60489811 60489830 60489827 +
cttaataacccccaaagcag

SEQ ID NO: 161710 - DNA, 20 bp, Artificial Sequence
  Synthetic oligonucleotide; AGG chr2 60489812 60489831 60489828 +
ttaataacccccaaagcagg

SEQ ID NO: 161711 - DNA, 20 bp, Artificial Sequence
  Synthetic oligonucleotide; AAG chr2 60489824 60489843 60489840 +
aaagcaggaggacactatta

SEQ ID NO: 161712 - DNA, 20 bp, Artificial Sequence
  Synthetic oligonucleotide; GAG chr2 60489826 60489845 60489842 +
agcaggaggacactattaaa

SEQ ID NO: 161713 - DNA, 20 bp, Artificial Sequence
  Synthetic oligonucleotide; GAG chr2 60489828 60489847 60489844 +
caggaggacactattaaaga

SEQ ID NO: 161714 - DNA, 20 bp, Artificial Sequence
  Synthetic oligonucleotide; CAG chr2 60489835 60489854 60489851 +
acactattaaagagagatca

SEQ ID NO: 161715 - DNA, 20 bp, Artificial Sequence
  Synthetic oligonucleotide; AGG chr2 60489836 60489855 60489852 +
cactattaaagagagatcac

SEQ ID NO: 161716 - DNA, 20 bp, Artificial Sequence
  Synthetic oligonucleotide; GGG chr2 60489837 60489856 60489853 +
actattaaagagagatcaca

SEQ ID NO: 161717 - DNA, 20 bp, Artificial Sequence
  Synthetic oligonucleotide; GAG chr2 60489920 60489939 60489936 +
tgaaacaccatccatgccct

SEQ ID NO: 161718 - DNA, 20 bp, Artificial Sequence
  Synthetic oligonucleotide; TGG chr2 60489933 60489952 60489949 +
atgccctgagtatcccaaca

SEQ ID NO: 161719 - DNA, 20 bp, Artificial Sequence
  Synthetic oligonucleotide; TGG chr2 60489937 60489956 60489953 +
cctgagtatcccaacatgga

SEQ ID NO: 161720 - DNA, 20 bp, Artificial Sequence
  Synthetic oligonucleotide; TGG chr2 60489942 60489961 60489958 +
gtatcccaacatggatggac

SEQ ID NO: 161721 - DNA, 20 bp, Artificial Sequence
  Synthetic oligonucleotide; GAG chr2 60489944 60489963 60489960 +
atcccaacatggatggactg

SEQ ID NO: 161722 - DNA, 20 bp, Artificial Sequence
  Synthetic oligonucleotide; AGG chr2 60489945 60489964 60489961 +
tcccaacatggatggactgg

SEQ ID NO: 161723 - DNA, 20 bp, Artificial Sequence
  Synthetic oligonucleotide; GAG chr2 60489947 60489966 60489963 +
ccaacatggatggactggag

SEQ ID NO: 161724 - DNA, 20 bp, Artificial Sequence
  Synthetic oligonucleotide; GAG chr2 60489949 60489968 60489965 +
aacatggatggactggagga

SEQ ID NO: 161725 - DNA, 20 bp, Artificial Sequence
  Synthetic oligonucleotide; AGG chr2 60489950 60489969 60489966 +
acatggatggactggaggag

SEQ ID NO: 161726 - DNA, 20 bp, Artificial Sequence
  Synthetic oligonucleotide; GGG chr2 60489951 60489970 60489967 +
catggatggactggaggaga

SEQ ID NO: 161727 - DNA, 20 bp, Artificial Sequence
  Synthetic oligonucleotide; AAG chr2 60489956 60489975 60489972 +
atggactggaggagagggac

SEQ ID NO: 161728 - DNA, 20 bp, Artificial Sequence
  Synthetic oligonucleotide; AGG chr2 60489957 60489976 60489973 +
tggactggaggagagggaca

SEQ ID NO: 161729 - DNA, 20 bp, Artificial Sequence
  Synthetic oligonucleotide; GGG chr2 60489958 60489977 60489974 +
ggactggaggagagggacaa

SEQ ID NO: 161730 - DNA, 20 bp, Artificial Sequence
  Synthetic oligonucleotide; CAG chr2 60489968 60489987 60489984 +
agagggacaagggaccaata

SEQ ID NO: 161731 - DNA, 20 bp, Artificial Sequence
  Synthetic oligonucleotide; TGG chr2 60489978 60489997 60489994 +
gggaccaatacagaccctga

SEQ ID NO: 161732 - DNA, 20 bp, Artificial Sequence
  Synthetic oligonucleotide; GGG chr2 60489979 60489998 60489995 +
ggaccaatacagaccctgat

SEQ ID NO: 161733 - DNA, 20 bp, Artificial Sequence
  Synthetic oligonucleotide; TGG chr2 60490025 60490044 60490041 +
tgcccactccccatctgcaa

SEQ ID NO: 161734 - DNA, 20 bp, Artificial Sequence
  Synthetic oligonucleotide; GGG chr2 60490026 60490045 60490042 +
gcccactccccatctgcaat

SEQ ID NO: 161735 - DNA, 20 bp, Artificial Sequence
  Synthetic oligonucleotide; GGG chr2 60490027 60490046 60490043 +
cccactccccatctgcaatg

SEQ ID NO: 161736 - DNA, 20 bp, Artificial Sequence
  Synthetic oligonucleotide; GGG chr2 60490028 60490047 60490044 +
ccactccccatctgcaatgg

SEQ ID NO: 161737 - DNA, 20 bp, Artificial Sequence
  Synthetic oligonucleotide; AAG chr2 60490033 60490052 60490049 +
ccccatctgcaatgggggca

SEQ ID NO: 161738 - DNA, 20 bp, Artificial Sequence
  Synthetic oligonucleotide; AGG chr2 60490034 60490053 60490050 +
cccatctgcaatgggggcaa

SEQ ID NO: 161739 - DNA, 20 bp, Artificial Sequence
  Synthetic oligonucleotide; AAG chr2 60490040 60490059 60490056 +
tgcaatgggggcaaaggcaa

SEQ ID NO: 161740 - DNA, 20 bp, Artificial Sequence
  Synthetic oligonucleotide; AGG chr2 60490041 60490060 60490057 +
gcaatgggggcaaaggcaaa

SEQ ID NO: 161741 - DNA, 20 bp, Artificial Sequence
  Synthetic oligonucleotide; AAG chr2 60490045 60490064 60490061 +
tgggggcaaaggcaaaagga

SEQ ID NO: 161742 - DNA, 20 bp, Artificial Sequence
  Synthetic oligonucleotide; AAG chr2 60490054 60490073 60490070 +
aggcaaaaggaaagctttcc

SEQ ID NO: 161743 - DNA, 20 bp, Artificial Sequence
  Synthetic oligonucleotide; CAG chr2 60490064 60490083 60490080 +
aaagctttccaagatttaaa

SEQ ID NO: 161744 - DNA, 20 bp, Artificial Sequence
  Synthetic oligonucleotide; TAG chr2 60490077 60490096 60490093 +
atttaaacagtcctctatat

SEQ ID NO: 161745 - DNA, 20 bp, Artificial Sequence
  Synthetic oligonucleotide; CAG chr2 60490083 60490102 60490099 +
acagtcctctatattagtaa

SEQ ID NO: 161746 - DNA, 20 bp, Artificial Sequence
  Synthetic oligonucleotide; TAG chr2 60490096 60490115 60490112 +
ttagtaacagacccatgtgc

SEQ ID NO: 161747 - DNA, 20 bp, Artificial Sequence
  Synthetic oligonucleotide; AGG chr2 60490097 60490116 60490113 +
tagtaacagacccatgtgct

SEQ ID NO: 161748 - DNA, 20 bp, Artificial Sequence
  Synthetic oligonucleotide; TGG chr2 60490113 60490132 60490129 +
tgctaggctcctacaatatc

SEQ ID NO: 161749 - DNA, 20 bp, Artificial Sequence
  Synthetic oligonucleotide; TAG chr2 60490127 60490146 60490143 +
aatatctggttccattctgc

SEQ ID NO: 161750 - DNA, 20 bp, Artificial Sequence
  Synthetic oligonucleotide; AAG chr2 60490133 60490152 60490149 +
tggttccattctgctagtga

SEQ ID NO: 161751 - DNA, 20 bp, Artificial Sequence
  Synthetic oligonucleotide; AGG chr2 60490134 60490153 60490150 +
ggttccattctgctagtgaa

SEQ ID NO: 161752 - DNA, 20 bp, Artificial Sequence
  Synthetic oligonucleotide; CGG chr2 60490145 60490164 60490161 +
gctagtgaaaggaaacccta

SEQ ID NO: 161753 - DNA, 20 bp, Artificial Sequence
  Synthetic oligonucleotide; TAG chr2 60490166 60490185 60490182 +
ggtcaaccaactccatcctc

SEQ ID NO: 161754 - DNA, 20 bp, Artificial Sequence
  Synthetic oligonucleotide; AAG chr2 60490176 60490195 60490192 +
ctccatcctctagaacatat

SEQ ID NO: 161755 - DNA, 20 bp, Artificial Sequence
  Synthetic oligonucleotide; CAG chr2 60490183 60490202 60490199 +
ctctagaacatataagtcaa

SEQ ID NO: 161756 - DNA, 20 bp, Artificial Sequence
  Synthetic oligonucleotide; AGG chr2 60490184 60490203 60490200 +
tctagaacatataagtcaac

SEQ ID NO: 161757 - DNA, 20 bp, Artificial Sequence
  Synthetic oligonucleotide; GGG chr2 60490185 60490204 60490201 +
ctagaacatataagtcaaca

SEQ ID NO: 161758 - DNA, 20 bp, Artificial Sequence
  Synthetic oligonucleotide; GGG chr2 60490186 60490205 60490202 +
tagaacatataagtcaacag

SEQ ID NO: 161759 - DNA, 20 bp, Artificial Sequence
  Synthetic oligonucleotide; GAG chr2 60490188 60490207 60490204 +
gaacatataagtcaacaggg

SEQ ID NO: 161760 - DNA, 20 bp, Artificial Sequence
  Synthetic oligonucleotide; CGG chr2 60490195 60490214 60490211 +
taagtcaacaggggagaact

SEQ ID NO: 161761 - DNA, 20 bp, Artificial Sequence
  Synthetic oligonucleotide; AAG chr2 60490202 60490221 60490218 +
acaggggagaactcggcatg

SEQ ID NO: 161762 - DNA, 20 bp, Artificial Sequence
  Synthetic oligonucleotide; AGG chr2 60490203 60490222 60490219 +
caggggagaactcggcatga

SEQ ID NO: 161763 - DNA, 20 bp, Artificial Sequence
  Synthetic oligonucleotide; GGG chr2 60490204 60490223 60490220 +
aggggagaactcggcatgaa

SEQ ID NO: 161764 - DNA, 20 bp, Artificial Sequence
  Synthetic oligonucleotide; CAG chr2 60490212 60490231 60490228 +
actcggcatgaagggtataa

SEQ ID NO: 161765 - DNA, 20 bp, Artificial Sequence
  Synthetic oligonucleotide; GAG chr2 60490214 60490233 60490230 +
tcggcatgaagggtataaca

SEQ ID NO: 161766 - DNA, 20 bp, Artificial Sequence
  Synthetic oligonucleotide; CAG chr2 60490245 60490264 60490261 +
caactcatccaccccctttg

SEQ ID NO: 161767 - DNA, 20 bp, Artificial Sequence
  Synthetic oligonucleotide; GAG chr2 60490247 60490266 60490263 +
actcatccaccccctttgca

SEQ ID NO: 161768 - DNA, 20 bp, Artificial Sequence
  Synthetic oligonucleotide; TAG chr2 60490268 60490287 60490284 +
agtcctcacttaacatcccc

SEQ ID NO: 161769 - DNA, 20 bp, Artificial Sequence
  Synthetic oligonucleotide; CAG chr2 60490293 60490312 60490309 +
tgctgcctttgtcttctgat

SEQ ID NO: 161770 - DNA, 20 bp, Artificial Sequence
  Synthetic oligonucleotide; GAG chr2 60490295 60490314 60490311 +
ctgcctttgtcttctgatca

SEQ ID NO: 161771 - DNA, 20 bp, Artificial Sequence
  Synthetic oligonucleotide; CAG chr2 60490303 60490322 60490319 +
gtcttctgatcagagtattt

SEQ ID NO: 161772 - DNA, 20 bp, Artificial Sequence
  Synthetic oligonucleotide; CAG chr2 60490306 60490325 60490322 +
ttctgatcagagtatttcag

SEQ ID NO: 161773 - DNA, 20 bp, Artificial Sequence
  Synthetic oligonucleotide; TAG chr2 60490323 60490342 60490339 +
cagcagccctctgtgatcta

SEQ ID NO: 161774 - DNA, 20 bp, Artificial Sequence
  Synthetic oligonucleotide; AGG chr2 60490324 60490343 60490340 +
agcagccctctgtgatctat

SEQ ID NO: 161775 - DNA, 20 bp, Artificial Sequence
  Synthetic oligonucleotide; TGG chr2 60490330 60490349 60490346 +
cctctgtgatctataggata

SEQ ID NO: 161776 - DNA, 20 bp, Artificial Sequence
  Synthetic oligonucleotide; AAG chr2 60490344 60490363 60490360 +
aggatatggtccaactcctt

SEQ ID NO: 161777 - DNA, 20 bp, Artificial Sequence
  Synthetic oligonucleotide; CAG chr2 60490356 60490375 60490372 +
aactccttaagccatcattc

SEQ ID NO: 161778 - DNA, 20 bp, Artificial Sequence
  Synthetic oligonucleotide; GAG chr2 60490358 60490377 60490374 +
ctccttaagccatcattcca

SEQ ID NO: 161779 - DNA, 20 bp, Artificial Sequence
  Synthetic oligonucleotide; CAG chr2 60490390 60490409 60490406 +
ccaactccaattttctattc

SEQ ID NO: 161780 - DNA, 20 bp, Artificial Sequence
  Synthetic oligonucleotide; TAG chr2 60490396 60490415 60490412 +
ccaattttctattccagtct

SEQ ID NO: 161781 - DNA, 20 bp, Artificial Sequence
  Synthetic oligonucleotide; AAG chr2 60490414 60490433 60490430 +
cttagttccccgtacccatc

SEQ ID NO: 161782 - DNA, 20 bp, Artificial Sequence
  Synthetic oligonucleotide; AGG chr2 60490415 60490434 60490431 +
ttagttccccgtacccatca

SEQ ID NO: 161783 - DNA, 20 bp, Artificial Sequence
  Synthetic oligonucleotide; AAG chr2 60490432 60490451 60490448 +
tcaaggaaaatattctgccc

SEQ ID NO: 161784 - DNA, 20 bp, Artificial Sequence
  Synthetic oligonucleotide; TGG chr2 60490465 60490484 60490481 +
ttccgttctcatttccttcc

SEQ ID NO: 161785 - DNA, 20 bp, Artificial Sequence
  Synthetic oligonucleotide; TGG chr2 60490493 60490512 60490509 +
cttcttcttctcttacctcc

SEQ ID NO: 161786 - DNA, 20 bp, Artificial Sequence
  Synthetic oligonucleotide; AAG chr2 60490513 60490532 60490529 +
tggaatcctgctcatacttc

SEQ ID NO: 161787 - DNA, 20 bp, Artificial Sequence
  Synthetic oligonucleotide; AGG chr2 60490514 60490533 60490530 +
ggaatcctgctcatacttca

SEQ ID NO: 161788 - DNA, 20 bp, Artificial Sequence
  Synthetic oligonucleotide; AAG chr2 60490525 60490544 60490541 +
catacttcaaggcctcaatg

SEQ ID NO: 161789 - DNA, 20 bp, Artificial Sequence
  Synthetic oligonucleotide; AGG chr2 60490526 60490545 60490542 +
atacttcaaggcctcaatga

SEQ ID NO: 161790 - DNA, 20 bp, Artificial Sequence
  Synthetic oligonucleotide; TAG chr2 60490535 60490554 60490551 +
ggcctcaatgaaggtctacc

SEQ ID NO: 161791 - DNA, 20 bp, Artificial Sequence
  Synthetic oligonucleotide; TAG chr2 60490544 60490563 60490560 +
gaaggtctacctagtcacct

SEQ ID NO: 161792 - DNA, 20 bp, Artificial Sequence
  Synthetic oligonucleotide; AAG chr2 60490548 60490567 60490564 +
gtctacctagtcaccttagc

SEQ ID NO: 161793 - DNA, 20 bp, Artificial Sequence
  Synthetic oligonucleotide; AAG chr2 60490551 60490570 60490567 +
tacctagtcaccttagcaag

SEQ ID NO: 161794 - DNA, 20 bp, Artificial Sequence
  Synthetic oligonucleotide; TAG chr2 60490581 60490600 60490597 +
ctcatccttctccaacctca

SEQ ID NO: 161795 - DNA, 20 bp, Artificial Sequence
  Synthetic oligonucleotide; TAG chr2 60490620 60490639 60490636 +
accactccctgactcatatc

SEQ ID NO: 161796 - DNA, 20 bp, Artificial Sequence
  Synthetic oligonucleotide; AGG chr2 60490621 60490640 60490637 +
ccactccctgactcatatct

SEQ ID NO: 161797 - DNA, 20 bp, Artificial Sequence
  Synthetic oligonucleotide; TGG chr2 60490635 60490654 60490651 +
atatctaggccttacattgc

SEQ ID NO: 161798 - DNA, 20 bp, Artificial Sequence
  Synthetic oligonucleotide; GAG chr2 60490679 60490698 60490695 +
taatttcatgtgttcccaat

SEQ ID NO: 161799 - DNA, 20 bp, Artificial Sequence
  Synthetic oligonucleotide; CAG chr2 60490693 60490712 60490709 +
cccaatgagtttcttcaata

SEQ ID NO: 161800 - DNA, 20 bp, Artificial Sequence
  Synthetic oligonucleotide; AGG chr2 60490694 60490713 60490710 +
ccaatgagtttcttcaatac

SEQ ID NO: 161801 - DNA, 20 bp, Artificial Sequence
  Synthetic oligonucleotide; GGG chr2 60490695 60490714 60490711 +
caatgagtttcttcaataca

SEQ ID NO: 161802 - DNA, 20 bp, Artificial Sequence
  Synthetic oligonucleotide; AAG chr2 60490731 60490750 60490747 +
cttgcttctattatatttga

SEQ ID NO: 161803 - DNA, 20 bp, Artificial Sequence
  Synthetic oligonucleotide; CAG chr2 60490737 60490756 60490753 +
tctattatatttgaaagtac

SEQ ID NO: 161804 - DNA, 20 bp, Artificial Sequence
  Synthetic oligonucleotide; CAG chr2 60490742 60490761 60490758 +
tatatttgaaagtaccagca

SEQ ID NO: 161805 - DNA, 20 bp, Artificial Sequence
  Synthetic oligonucleotide; TAG chr2 60490770 60490789 60490786 +
gacatgatattcatatattc

SEQ ID NO: 161806 - DNA, 20 bp, Artificial Sequence
  Synthetic oligonucleotide; AGG chr2 60490771 60490790 60490787 +
acatgatattcatatattct

SEQ ID NO: 161807 - DNA, 20 bp, Artificial Sequence
  Synthetic oligonucleotide; TAG chr2 60490785 60490804 60490801 +
tattctaggaattcaacaaa

SEQ ID NO: 161808 - DNA, 20 bp, Artificial Sequence
  Synthetic oligonucleotide; AAG chr2 60490816 60490835 60490832 +
tgactgatttaccttcctaa

SEQ ID NO: 161809 - DNA, 20 bp, Artificial Sequence
  Synthetic oligonucleotide; AGG chr2 60490817 60490836 60490833 +
gactgatttaccttcctaaa

SEQ ID NO: 161810 - DNA, 20 bp, Artificial Sequence
  Synthetic oligonucleotide; GGG chr2 60490818 60490837 60490834 +
actgatttaccttcctaaaa

SEQ ID NO: 161811 - DNA, 20 bp, Artificial Sequence
  Synthetic oligonucleotide; AAG chr2 60490821 60490840 60490837 +
gatttaccttcctaaaaggg

SEQ ID NO: 161812 - DNA, 20 bp, Artificial Sequence
  Synthetic oligonucleotide; TGG chr2 60490855 60490874 60490871 +
aatatcatttctgttcaaaa

SEQ ID NO: 161813 - DNA, 20 bp, Artificial Sequence
  Synthetic oligonucleotide; TAG chr2 60490873 60490892 60490889 +
aatggtaattttaaccttct

SEQ ID NO: 161814 - DNA, 20 bp, Artificial Sequence
  Synthetic oligonucleotide; CAG chr2 60490916 60490935 60490932 +
ctgatatctacttgaacttt

SEQ ID NO: 161815 - DNA, 20 bp, Artificial Sequence
  Synthetic oligonucleotide; AAG chr2 60490931 60490950 60490947 +
actttcagataaaaaaaaaa

SEQ ID NO: 161816 - DNA, 20 bp, Artificial Sequence
  Synthetic oligonucleotide; AAG chr2 60490935 60490954 60490951 +
tcagataaaaaaaaaaaagc

SEQ ID NO: 161817 - DNA, 20 bp, Artificial Sequence
  Synthetic oligonucleotide; CAG chr2 60490941 60490960 60490957 +
aaaaaaaaaaaagcaagttg

SEQ ID NO: 161818 - DNA, 20 bp, Artificial Sequence
  Synthetic oligonucleotide; AAG chr2 60490963 60490982 60490979 +
gtaacatgttatgctacaca

SEQ ID NO: 161819 - DNA, 20 bp, Artificial Sequence
  Synthetic oligonucleotide; TAG chr2 60490968 60490987 60490984 +
atgttatgctacacaaagat

SEQ ID NO: 161820 - DNA, 20 bp, Artificial Sequence
  Synthetic oligonucleotide; CAG chr2 60490994 60491013 60491010 +
gaatatccaccctctttaaa

SEQ ID NO: 161821 - DNA, 20 bp, Artificial Sequence
  Synthetic oligonucleotide; TGG chr2 60491010 60491029 60491026 +
taaacagccaccccacaccc

SEQ ID NO: 161822 - DNA, 20 bp, Artificial Sequence
  Synthetic oligonucleotide; GAG chr2 60491012 60491031 60491028 +
aacagccaccccacaccctg

SEQ ID NO: 161823 - DNA, 20 bp, Artificial Sequence
  Synthetic oligonucleotide; AAG chr2 60491015 60491034 60491031 +
agccaccccacaccctggag

SEQ ID NO: 161824 - DNA, 20 bp, Artificial Sequence
  Synthetic oligonucleotide; GAG chr2 60491017 60491036 60491033 +
ccaccccacaccctggagaa

SEQ ID NO: 161825 - DNA, 20 bp, Artificial Sequence
  Synthetic oligonucleotide; AAG chr2 60491028 60491047 60491044 +
cctggagaagagcaaatgtg

SEQ ID NO: 161826 - DNA, 20 bp, Artificial Sequence
  Synthetic oligonucleotide; CAG chr2 60491044 60491063 60491060 +
tgtgaagtttatgtgccaac

SEQ ID NO: 161827 - DNA, 20 bp, Artificial Sequence
  Synthetic oligonucleotide; CAG chr2 60491056 60491075 60491072 +
gtgccaaccagactgtgcgc

SEQ ID NO: 161828 - DNA, 20 bp, Artificial Sequence
  Synthetic oligonucleotide; AGG chr2 60491057 60491076 60491073 +
tgccaaccagactgtgcgcc

SEQ ID NO: 161829 - DNA, 20 bp, Artificial Sequence
  Synthetic oligonucleotide; TGG chr2 60491061 60491080 60491077 +
aaccagactgtgcgccaggt

SEQ ID NO: 161830 - DNA, 20 bp, Artificial Sequence
  Synthetic oligonucleotide; AAG chr2 60491066 60491085 60491082 +
gactgtgcgccaggttggta

SEQ ID NO: 161831 - DNA, 20 bp, Artificial Sequence
  Synthetic oligonucleotide; CAG chr2 60491074 60491093 60491090 +
gccaggttggtaaagtctga

SEQ ID NO: 161832 - DNA, 20 bp, Artificial Sequence
  Synthetic oligonucleotide; GAG chr2 60491076 60491095 60491092 +
caggttggtaaagtctgaca

SEQ ID NO: 161833 - DNA, 20 bp, Artificial Sequence
  Synthetic oligonucleotide; AAG chr2 60491111 60491130 60491127 +
gacaacatcttctatatgtg

SEQ ID NO: 161834 - DNA, 20 bp, Artificial Sequence
  Synthetic oligonucleotide; TGG chr2 60491124 60491143 60491140 +
atatgtgaagcccaactacg

SEQ ID NO: 161835 - DNA, 20 bp, Artificial Sequence
  Synthetic oligonucleotide; TAG chr2 60491140 60491159 60491156 +
tacgtggttgtgcaactcta

SEQ ID NO: 161836 - DNA, 20 bp, Artificial Sequence
  Synthetic oligonucleotide; TGG chr2 60491157 60491176 60491173 +
ctatagctgactttcaacca

SEQ ID NO: 161837 - DNA, 20 bp, Artificial Sequence
  Synthetic oligonucleotide; AAG chr2 60491169 60491188 60491185 +
ttcaaccatggtcatctgca

SEQ ID NO: 161838 - DNA, 20 bp, Artificial Sequence
  Synthetic oligonucleotide; AAG chr2 60491172 60491191 60491188 +
aaccatggtcatctgcaaag

SEQ ID NO: 161839 - DNA, 20 bp, Artificial Sequence
  Synthetic oligonucleotide; TAG chr2 60491176 60491195 60491192 +
atggtcatctgcaaagaagt

SEQ ID NO: 161840 - DNA, 20 bp, Artificial Sequence
  Synthetic oligonucleotide; CAG chr2 60491182 60491201 60491198 +
atctgcaaagaagttagtct

SEQ ID NO: 161841 - DNA, 20 bp, Artificial Sequence
  Synthetic oligonucleotide; AAG chr2 60491209 60491228 60491225 +
ctgcgcatcctcaatgcaaa

SEQ ID NO: 161842 - DNA, 20 bp, Artificial Sequence
  Synthetic oligonucleotide; AAG chr2 60491214 60491233 60491230 +
catcctcaatgcaaaaagct

SEQ ID NO: 161843 - DNA, 20 bp, Artificial Sequence
  Synthetic oligonucleotide; CAG chr2 60491251 60491270 60491267 +
tcttaatgctgttttaaatg

SEQ ID NO: 161844 - DNA, 20 bp, Artificial Sequence
  Synthetic oligonucleotide; AAG chr2 60491264 60491283 60491280 +
ttaaatgcagcactactaaa

SEQ ID NO: 161845 - DNA, 20 bp, Artificial Sequence
  Synthetic oligonucleotide; AGG chr2 60491265 60491284 60491281 +
taaatgcagcactactaaaa

SEQ ID NO: 161846 - DNA, 20 bp, Artificial Sequence
  Synthetic oligonucleotide; CAG chr2 60491283 60491302 60491299 +
aaaggacctcattttgatgc

SEQ ID NO: 161847 - DNA, 20 bp, Artificial Sequence
  Synthetic oligonucleotide; GAG chr2 60491285 60491304 60491301 +
aggacctcattttgatgcca

SEQ ID NO: 161848 - DNA, 20 bp, Artificial Sequence
  Synthetic oligonucleotide; AGG chr2 60491286 60491305 60491302 +
ggacctcattttgatgccag

SEQ ID NO: 161849 - DNA, 20 bp, Artificial Sequence
  Synthetic oligonucleotide; GGG chr2 60491287 60491306 60491303 +
gacctcattttgatgccaga

SEQ ID NO: 161850 - DNA, 20 bp, Artificial Sequence
  Synthetic oligonucleotide; CAG chr2 60491290 60491309 60491306 +
ctcattttgatgccagaggg

SEQ ID NO: 161851 - DNA, 20 bp, Artificial Sequence
  Synthetic oligonucleotide; TGG chr2 60491299 60491318 60491315 +
atgccagagggcagcaaaca

SEQ ID NO: 161852 - DNA, 20 bp, Artificial Sequence
  Synthetic oligonucleotide; TGG chr2 60491309 60491328 60491325 +
gcagcaaacatggacacttt

SEQ ID NO: 161853 - DNA, 20 bp, Artificial Sequence
  Synthetic oligonucleotide; CAG chr2 60491319 60491338 60491335 +
tggacacttttggccccctt

SEQ ID NO: 161854 - DNA, 20 bp, Artificial Sequence
  Synthetic oligonucleotide; AAG chr2 60491327 60491346 60491343 +
tttggcccccttcagctatt

SEQ ID NO: 161855 - DNA, 20 bp, Artificial Sequence
  Synthetic oligonucleotide; CAG chr2 60491332 60491351 60491348 +
cccccttcagctattaagta

SEQ ID NO: 161856 - DNA, 20 bp, Artificial Sequence
  Synthetic oligonucleotide; AAG chr2 60491338 60491357 60491354 +
tcagctattaagtacagtaa

SEQ ID NO: 161857 - DNA, 20 bp, Artificial Sequence
  Synthetic oligonucleotide; AGG chr2 60491339 60491358 60491355 +
cagctattaagtacagtaaa

SEQ ID NO: 161858 - DNA, 20 bp, Artificial Sequence
  Synthetic oligonucleotide; AAG chr2 60491342 60491361 60491358 +
ctattaagtacagtaaaagg

SEQ ID NO: 161859 - DNA, 20 bp, Artificial Sequence
  Synthetic oligonucleotide; CGG chr2 60491370 60491389 60491386 +
actatcatttgaaatgctcc

SEQ ID NO: 161860 - DNA, 20 bp, Artificial Sequence
  Synthetic oligonucleotide; CAG chr2 60491374 60491393 60491390 +
tcatttgaaatgctcccggc

SEQ ID NO: 161861 - DNA, 20 bp, Artificial Sequence
  Synthetic oligonucleotide; AGG chr2 60491375 60491394 60491391 +
catttgaaatgctcccggcc

SEQ ID NO: 161862 - DNA, 20 bp, Artificial Sequence
  Synthetic oligonucleotide; TGG chr2 60491383 60491402 60491399 +
atgctcccggccaggcgctg

SEQ ID NO: 161863 - DNA, 20 bp, Artificial Sequence
  Synthetic oligonucleotide; CAG chr2 60491402 60491421 60491418 +
gtggctcacacctgtaatcc

SEQ ID NO: 161864 - DNA, 20 bp, Artificial Sequence
  Synthetic oligonucleotide; TGG chr2 60491410 60491429 60491426 +
cacctgtaatcccagcactt

SEQ ID NO: 161865 - DNA, 20 bp, Artificial Sequence
  Synthetic oligonucleotide; GGG chr2 60491411 60491430 60491427 +
acctgtaatcccagcacttt

SEQ ID NO: 161866 - DNA, 20 bp, Artificial Sequence
  Synthetic oligonucleotide; GAG chr2 60491413 60491432 60491429 +
ctgtaatcccagcactttgg

SEQ ID NO: 161867 - DNA, 20 bp, Artificial Sequence
  Synthetic oligonucleotide; AGG chr2 60491414 60491433 60491430 +
tgtaatcccagcactttggg

SEQ ID NO: 161868 - DNA, 20 bp, Artificial Sequence
  Synthetic oligonucleotide; CGG chr2 60491418 60491437 60491434 +
atcccagcactttgggaggc

SEQ ID NO: 161869 - DNA, 20 bp, Artificial Sequence
  Synthetic oligonucleotide; GGG chr2 60491419 60491438 60491435 +
tcccagcactttgggaggcc

SEQ ID NO: 161870 - DNA, 20 bp, Artificial Sequence
  Synthetic oligonucleotide; GGG chr2 60491420 60491439 60491436 +
cccagcactttgggaggccg

SEQ ID NO: 161871 - DNA, 20 bp, Artificial Sequence
  Synthetic oligonucleotide; CAG chr2 60491423 60491442 60491439 +
agcactttgggaggccgggg

SEQ ID NO: 161872 - DNA, 20 bp, Artificial Sequence
  Synthetic oligonucleotide; AGG chr2 60491424 60491443 60491440 +
gcactttgggaggccggggc

SEQ ID NO: 161873 - DNA, 20 bp, Artificial Sequence
  Synthetic oligonucleotide; GAG chr2 60491426 60491445 60491442 +
actttgggaggccggggcag

SEQ ID NO: 161874 - DNA, 20 bp, Artificial Sequence
  Synthetic oligonucleotide; AGG chr2 60491427 60491446 60491443 +
ctttgggaggccggggcagg

SEQ ID NO: 161875 - DNA, 20 bp, Artificial Sequence
  Synthetic oligonucleotide; GAG chr2 60491437 60491456 60491453 +
ccggggcaggaggatcacct

SEQ ID NO: 161876 - DNA, 20 bp, Artificial Sequence
  Synthetic oligonucleotide; AGG chr2 60491438 60491457 60491454 +
cggggcaggaggatcacctg

SEQ ID NO: 161877 - DNA, 20 bp, Artificial Sequence
  Synthetic oligonucleotide; CAG chr2 60491442 60491461 60491458 +
gcaggaggatcacctgaggt

SEQ ID NO: 161878 - DNA, 20 bp, Artificial Sequence
  Synthetic oligonucleotide; AGG chr2 60491443 60491462 60491459 +
caggaggatcacctgaggtc

SEQ ID NO: 161879 - DNA, 20 bp, Artificial Sequence
  Synthetic oligonucleotide; GAG chr2 60491445 60491464 60491461 +
ggaggatcacctgaggtcag

SEQ ID NO: 161880 - DNA, 20 bp, Artificial Sequence
  Synthetic oligonucleotide; AAG chr2 60491451 60491470 60491467 +
tcacctgaggtcaggagttc

SEQ ID NO: 161881 - DNA, 20 bp, Artificial Sequence
  Synthetic oligonucleotide; CAG chr2 60491456 60491475 60491472 +
tgaggtcaggagttcaagat

SEQ ID NO: 161882 - DNA, 20 bp, Artificial Sequence
  Synthetic oligonucleotide; TGG chr2 60491461 60491480 60491477 +
tcaggagttcaagatcagtt

SEQ ID NO: 161883 - DNA, 20 bp, Artificial Sequence
  Synthetic oligonucleotide; CAG chr2 60491470 60491489 60491486 +
caagatcagtttggacaaca

SEQ ID NO: 161884 - DNA, 20 bp, Artificial Sequence
  Synthetic oligonucleotide; TAG chr2 60491504 60491523 60491520 +
ctctactaaaaatacaaaat

SEQ ID NO: 161885 - DNA, 20 bp, Artificial Sequence
  Synthetic oligonucleotide; CGG chr2 60491508 60491527 60491524 +
actaaaaatacaaaattagc

SEQ ID NO: 161886 - DNA, 20 bp, Artificial Sequence
  Synthetic oligonucleotide; GGG chr2 60491509 60491528 60491525 +
ctaaaaatacaaaattagcc

SEQ ID NO: 161887 - DNA, 20 bp, Artificial Sequence
  Synthetic oligonucleotide; TGG chr2 60491514 60491533 60491530 +
aatacaaaattagccgggca

SEQ ID NO: 161888 - DNA, 20 bp, Artificial Sequence
  Synthetic oligonucleotide; CAG chr2 60491536 60491555 60491552 +
gtaatacatgcctgtaatct

SEQ ID NO: 161889 - DNA, 20 bp, Artificial Sequence
  Synthetic oligonucleotide; CGG chr2 60491544 60491563 60491560 +
tgcctgtaatctcagctact

SEQ ID NO: 161890 - DNA, 20 bp, Artificial Sequence
  Synthetic oligonucleotide; GGG chr2 60491545 60491564 60491561 +
gcctgtaatctcagctactc

SEQ ID NO: 161891 - DNA, 20 bp, Artificial Sequence
  Synthetic oligonucleotide; GAG chr2 60491547 60491566 60491563 +
ctgtaatctcagctactcgg

SEQ ID NO: 161892 - DNA, 20 bp, Artificial Sequence
  Synthetic oligonucleotide; AGG chr2 60491548 60491567 60491564 +
tgtaatctcagctactcggg

SEQ ID NO: 161893 - DNA, 20 bp, Artificial Sequence
  Synthetic oligonucleotide; GAG chr2 60491553 60491572 60491569 +
tctcagctactcgggaggct

SEQ ID NO: 161894 - DNA, 20 bp, Artificial Sequence
  Synthetic oligonucleotide; AGG chr2 60491554 60491573 60491570 +
ctcagctactcgggaggctg

SEQ ID NO: 161895 - DNA, 20 bp, Artificial Sequence
  Synthetic oligonucleotide; CAG chr2 60491557 60491576 60491573 +
agctactcgggaggctgagg

SEQ ID NO: 161896 - DNA, 20 bp, Artificial Sequence
  Synthetic oligonucleotide; AGG chr2 60491558 60491577 60491574 +
gctactcgggaggctgaggc

SEQ ID NO: 161897 - DNA, 20 bp, Artificial Sequence
  Synthetic oligonucleotide; GAG chr2 60491560 60491579 60491576 +
tactcgggaggctgaggcag

SEQ ID NO: 161898 - DNA, 20 bp, Artificial Sequence
  Synthetic oligonucleotide; TGG chr2 60491575 60491594 60491591 +
ggcaggagatcgcttgaacc

SEQ ID NO: 161899 - DNA, 20 bp, Artificial Sequence
  Synthetic oligonucleotide; GGG chr2 60491576 60491595 60491592 +
gcaggagatcgcttgaacct

SEQ ID NO: 161900 - DNA, 20 bp, Artificial Sequence
  Synthetic oligonucleotide; GAG chr2 60491578 60491597 60491594 +
aggagatcgcttgaacctgg

SEQ ID NO: 161901 - DNA, 20 bp, Artificial Sequence
  Synthetic oligonucleotide; AGG chr2 60491579 60491598 60491595 +
ggagatcgcttgaacctggg

SEQ ID NO: 161902 - DNA, 20 bp, Artificial Sequence
  Synthetic oligonucleotide; CAG chr2 60491582 60491601 60491598 +
gatcgcttgaacctgggagg

SEQ ID NO: 161903 - DNA, 20 bp, Artificial Sequence
  Synthetic oligonucleotide; AAG chr2 60491585 60491604 60491601 +
cgcttgaacctgggaggcag

SEQ ID NO: 161904 - DNA, 20 bp, Artificial Sequence
  Synthetic oligonucleotide; CAG chr2 60491591 60491610 60491607 +
aacctgggaggcagaagatg

SEQ ID NO: 161905 - DNA, 20 bp, Artificial Sequence
  Synthetic oligonucleotide; GAG chr2 60491595 60491614 60491611 +
tgggaggcagaagatgcagt

SEQ ID NO: 161906 - DNA, 20 bp, Artificial Sequence
  Synthetic oligonucleotide; GAG chr2 60491600 60491619 60491616 +
ggcagaagatgcagtgagcc

SEQ ID NO: 161907 - DNA, 20 bp, Artificial Sequence
  Synthetic oligonucleotide; CAG chr2 60491620 60491639 60491636 +
gagatcgcgccattgcattc

SEQ ID NO: 161908 - DNA, 20 bp, Artificial Sequence
  Synthetic oligonucleotide; CGG chr2 60491625 60491644 60491641 +
cgcgccattgcattccagcc

SEQ ID NO: 161909 - DNA, 20 bp, Artificial Sequence
  Synthetic oligonucleotide; GGG chr2 60491626 60491645 60491642 +
gcgccattgcattccagccc

SEQ ID NO: 161910 - DNA, 20 bp, Artificial Sequence
  Synthetic oligonucleotide; AAG chr2 60491633 60491652 60491649 +
tgcattccagcccgggcaac

SEQ ID NO: 161911 - DNA, 20 bp, Artificial Sequence
  Synthetic oligonucleotide; GAG chr2 60491635 60491654 60491651 +
cattccagcccgggcaacaa

SEQ ID NO: 161912 - DNA, 20 bp, Artificial Sequence
  Synthetic oligonucleotide; AAG chr2 60491660 60491679 60491676 +
aatctccgtctcaccaaaaa

SEQ ID NO: 161913 - DNA, 20 bp, Artificial Sequence
  Synthetic oligonucleotide; AAG chr2 60491667 60491686 60491683 +
gtctcaccaaaaaaagaaaa

SEQ ID NO: 161914 - DNA, 20 bp, Artificial Sequence
  Synthetic oligonucleotide; AAG chr2 60491682 60491701 60491698 +
gaaaaaagaaaaaaaaaaaa

SEQ ID NO: 161915 - DNA, 20 bp, Artificial Sequence
  Synthetic oligonucleotide; AAG chr2 60491686 60491705 60491702 +
aaagaaaaaaaaaaaaaaga

SEQ ID NO: 161916 - DNA, 20 bp, Artificial Sequence
  Synthetic oligonucleotide; CAG chr2 60491701 60491720 60491717 +
aaagaaagaaatgctcccct

SEQ ID NO: 161917 - DNA, 20 bp, Artificial Sequence
  Synthetic oligonucleotide; CAG chr2 60491709 60491728 60491725 +
aaatgctcccctcagttctc

SEQ ID NO: 161918 - DNA, 20 bp, Artificial Sequence
  Synthetic oligonucleotide; AGG chr2 60491710 60491729 60491726 +
aatgctcccctcagttctcc

SEQ ID NO: 161919 - DNA, 20 bp, Artificial Sequence
  Synthetic oligonucleotide; TGG chr2 60491714 60491733 60491730 +
ctcccctcagttctccaggc

SEQ ID NO: 161920 - DNA, 20 bp, Artificial Sequence
  Synthetic oligonucleotide; GGG chr2 60491715 60491734 60491731 +
tcccctcagttctccaggct

SEQ ID NO: 161921 - DNA, 20 bp, Artificial Sequence
  Synthetic oligonucleotide; TAG chr2 60491742 60491761 60491758 +
ctgcccacgtcaaaacaccc

SEQ ID NO: 161922 - DNA, 20 bp, Artificial Sequence
  Synthetic oligonucleotide; AGG chr2 60491743 60491762 60491759 +
tgcccacgtcaaaacaccct

SEQ ID NO: 161923 - DNA, 20 bp, Artificial Sequence
  Synthetic oligonucleotide; GAG chr2 60491763 60491782 60491779 +
aggcatcatcactccgtgtt

SEQ ID NO: 161924 - DNA, 20 bp, Artificial Sequence
  Synthetic oligonucleotide; GAG chr2 60491765 60491784 60491781 +
gcatcatcactccgtgttga

SEQ ID NO: 161925 - DNA, 20 bp, Artificial Sequence
  Synthetic oligonucleotide; AAG chr2 60491770 60491789 60491786 +
atcactccgtgttgagagcc

SEQ ID NO: 161926 - DNA, 20 bp, Artificial Sequence
  Synthetic oligonucleotide; TGG chr2 60491773 60491792 60491789 +
actccgtgttgagagccaag

SEQ ID NO: 161927 - DNA, 20 bp, Artificial Sequence
  Synthetic oligonucleotide; CAG chr2 60491777 60491796 60491793 +
cgtgttgagagccaagtggc

SEQ ID NO: 161928 - DNA, 20 bp, Artificial Sequence
  Synthetic oligonucleotide; AGG chr2 60491778 60491797 60491794 +
gtgttgagagccaagtggcc

SEQ ID NO: 161929 - DNA, 20 bp, Artificial Sequence
  Synthetic oligonucleotide; TAG chr2 60491781 60491800 60491797 +
ttgagagccaagtggccagg

SEQ ID NO: 161930 - DNA, 20 bp, Artificial Sequence
  Synthetic oligonucleotide; AGG chr2 60491782 60491801 60491798 +
tgagagccaagtggccaggt

SEQ ID NO: 161931 - DNA, 20 bp, Artificial Sequence
  Synthetic oligonucleotide; CAG chr2 60491798 60491817 60491814 +
aggtaggacccaacactacg

SEQ ID NO: 161932 - DNA, 20 bp, Artificial Sequence
  Synthetic oligonucleotide; AGG chr2 60491799 60491818 60491815 +
ggtaggacccaacactacgc

SEQ ID NO: 161933 - DNA, 20 bp, Artificial Sequence
  Synthetic oligonucleotide; CAG chr2 60491804 60491823 60491820 +
gacccaacactacgcaggca

SEQ ID NO: 161934 - DNA, 20 bp, Artificial Sequence
  Synthetic oligonucleotide; AAG chr2 60491821 60491840 60491837 +
gcacagacgttttccatgtt

SEQ ID NO: 161935 - DNA, 20 bp, Artificial Sequence
  Synthetic oligonucleotide; CAG chr2 60491838 60491857 60491854 +
gttaagaacccaaatccata

SEQ ID NO: 161936 - DNA, 20 bp, Artificial Sequence
  Synthetic oligonucleotide; TAG chr2 60491845 60491864 60491861 +
acccaaatccatacagtcct

SEQ ID NO: 161937 - DNA, 20 bp, Artificial Sequence
  Synthetic oligonucleotide; TAG chr2 60491856 60491875 60491872 +
tacagtccttagcacccaaa

SEQ ID NO: 161938 - DNA, 20 bp, Artificial Sequence
  Synthetic oligonucleotide; AGG chr2 60491857 60491876 60491873 +
acagtccttagcacccaaat

SEQ ID NO: 161939 - DNA, 20 bp, Artificial Sequence
  Synthetic oligonucleotide; CAG chr2 60491862 60491881 60491878 +
ccttagcacccaaataggtt

SEQ ID NO: 161940 - DNA, 20 bp, Artificial Sequence
  Synthetic oligonucleotide; AAG chr2 60491867 60491886 60491883 +
gcacccaaataggttcagaa

SEQ ID NO: 161941 - DNA, 20 bp, Artificial Sequence
  Synthetic oligonucleotide; AGG chr2 60491868 60491887 60491884 +
cacccaaataggttcagaaa

SEQ ID NO: 161942 - DNA, 20 bp, Artificial Sequence
  Synthetic oligonucleotide; CAG chr2 60491871 60491890 60491887 +
ccaaataggttcagaaaagg

SEQ ID NO: 161943 - DNA, 20 bp, Artificial Sequence
  Synthetic oligonucleotide; AAG chr2 60491899 60491918 60491915 +
acaaatctgccaaataaatg

SEQ ID NO: 161944 - DNA, 20 bp, Artificial Sequence
  Synthetic oligonucleotide; CAG chr2 60491904 60491923 60491920 +
tctgccaaataaatgaagtt

SEQ ID NO: 161945 - DNA, 20 bp, Artificial Sequence
  Synthetic oligonucleotide; TGG chr2 60491931 60491950 60491947 +
tgcatttacgctaaatacct

SEQ ID NO: 161946 - DNA, 20 bp, Artificial Sequence
  Synthetic oligonucleotide; GAG chr2 60491939 60491958 60491955 +
cgctaaataccttggaaatt

SEQ ID NO: 161947 - DNA, 20 bp, Artificial Sequence
  Synthetic oligonucleotide; GAG chr2 60491941 60491960 60491957 +
ctaaataccttggaaattga

SEQ ID NO: 161948 - DNA, 20 bp, Artificial Sequence
  Synthetic oligonucleotide; AGG chr2 60491942 60491961 60491958 +
taaataccttggaaattgag

SEQ ID NO: 161949 - DNA, 20 bp, Artificial Sequence
  Synthetic oligonucleotide; GGG chr2 60491943 60491962 60491959 +
aaataccttggaaattgaga

SEQ ID NO: 161950 - DNA, 20 bp, Artificial Sequence
  Synthetic oligonucleotide; TGG chr2 60491950 60491969 60491966 +
ttggaaattgagagggaatc

SEQ ID NO: 161951 - DNA, 20 bp, Artificial Sequence
  Synthetic oligonucleotide; GAG chr2 60491952 60491971 60491968 +
ggaaattgagagggaatctg

SEQ ID NO: 161952 - DNA, 20 bp, Artificial Sequence
  Synthetic oligonucleotide; GAG chr2 60491954 60491973 60491970 +
aaattgagagggaatctgga

SEQ ID NO: 161953 - DNA, 20 bp, Artificial Sequence
  Synthetic oligonucleotide; AGG chr2 60491955 60491974 60491971 +
aattgagagggaatctggag

SEQ ID NO: 161954 - DNA, 20 bp, Artificial Sequence
  Synthetic oligonucleotide; AAG chr2 60491958 60491977 60491974 +
tgagagggaatctggagagg

SEQ ID NO: 161955 - DNA, 20 bp, Artificial Sequence
  Synthetic oligonucleotide; TGG chr2 60491962 60491981 60491978 +
agggaatctggagaggaaga

SEQ ID NO: 161956 - DNA, 20 bp, Artificial Sequence
  Synthetic oligonucleotide; TAG chr2 60491968 60491987 60491984 +
tctggagaggaagatggatg

SEQ ID NO: 161957 - DNA, 20 bp, Artificial Sequence
  Synthetic oligonucleotide; AGG chr2 60491969 60491988 60491985 +
ctggagaggaagatggatgt

SEQ ID NO: 161958 - DNA, 20 bp, Artificial Sequence
  Synthetic oligonucleotide; CAG chr2 60491994 60492013 60492010 +
aaacaaaaaccctcacttta

SEQ ID NO: 161959 - DNA, 20 bp, Artificial Sequence
  Synthetic oligonucleotide; AGG chr2 60491995 60492014 60492011 +
aacaaaaaccctcactttac

SEQ ID NO: 161960 - DNA, 20 bp, Artificial Sequence
  Synthetic oligonucleotide; CAG chr2 60492002 60492021 60492018 +
accctcactttacaggaatt

SEQ ID NO: 161961 - DNA, 20 bp, Artificial Sequence
  Synthetic oligonucleotide; CAG chr2 60492007 60492026 60492023 +
cactttacaggaattcagca

SEQ ID NO: 161962 - DNA, 20 bp, Artificial Sequence
  Synthetic oligonucleotide; AGG chr2 60492008 60492027 60492024 +
actttacaggaattcagcac

SEQ ID NO: 161963 - DNA, 20 bp, Artificial Sequence
  Synthetic oligonucleotide; GAG chr2 60492010 60492029 60492026 +
tttacaggaattcagcacag

SEQ ID NO: 161964 - DNA, 20 bp, Artificial Sequence
  Synthetic oligonucleotide; TAG chr2 60492025 60492044 60492041 +
cacaggagatgctacattgt

SEQ ID NO: 161965 - DNA, 20 bp, Artificial Sequence
  Synthetic oligonucleotide; AAG chr2 60492039 60492058 60492055 +
cattgttagcatctccgctt

SEQ ID NO: 161966 - DNA, 20 bp, Artificial Sequence
  Synthetic oligonucleotide; AGG chr2 60492040 60492059 60492056 +
attgttagcatctccgctta

SEQ ID NO: 161967 - DNA, 20 bp, Artificial Sequence
  Synthetic oligonucleotide; GAG chr2 60492042 60492061 60492058 +
tgttagcatctccgcttaag

SEQ ID NO: 161968 - DNA, 20 bp, Artificial Sequence
  Synthetic oligonucleotide; AAG chr2 60492045 60492064 60492061 +
tagcatctccgcttaaggag

SEQ ID NO: 161969 - DNA, 20 bp, Artificial Sequence
  Synthetic oligonucleotide; AAG chr2 60492062 60492081 60492078 +
gagaagacatactgatgaat

SEQ ID NO: 161970 - DNA, 20 bp, Artificial Sequence
  Synthetic oligonucleotide; GAG chr2 60492068 60492087 60492084 +
acatactgatgaataagact

SEQ ID NO: 161971 - DNA, 20 bp, Artificial Sequence
  Synthetic oligonucleotide; TGG chr2 60492072 60492091 60492088 +
actgatgaataagactgagt

SEQ ID NO: 161972 - DNA, 20 bp, Artificial Sequence
  Synthetic oligonucleotide; CAG chr2 60492078 60492097 60492094 +
gaataagactgagttggtga

SEQ ID NO: 161973 - DNA, 20 bp, Artificial Sequence
  Synthetic oligonucleotide; AGG chr2 60492079 60492098 60492095 +
aataagactgagttggtgac

SEQ ID NO: 161974 - DNA, 20 bp, Artificial Sequence
  Synthetic oligonucleotide; CAG chr2 60492084 60492103 60492100 +
gactgagttggtgacaggca

SEQ ID NO: 161975 - DNA, 20 bp, Artificial Sequence
  Synthetic oligonucleotide; TGG chr2 60492087 60492106 60492103 +
tgagttggtgacaggcacag

SEQ ID NO: 161976 - DNA, 20 bp, Artificial Sequence
  Synthetic oligonucleotide; CAG chr2 60492106 60492125 60492122 +
gtggctctcgcctgtaatcc

SEQ ID NO: 161977 - DNA, 20 bp, Artificial Sequence
  Synthetic oligonucleotide; TGG chr2 60492114 60492133 60492130 +
cgcctgtaatcccagcactt

SEQ ID NO: 161978 - DNA, 20 bp, Artificial Sequence
  Synthetic oligonucleotide; GGG chr2 60492115 60492134 60492131 +
gcctgtaatcccagcacttt

SEQ ID NO: 161979 - DNA, 20 bp, Artificial Sequence
  Synthetic oligonucleotide; GAG chr2 60492117 60492136 60492133 +
ctgtaatcccagcactttgg

SEQ ID NO: 161980 - DNA, 20 bp, Artificial Sequence
  Synthetic oligonucleotide; AGG chr2 60492118 60492137 60492134 +
tgtaatcccagcactttggg

SEQ ID NO: 161981 - DNA, 20 bp, Artificial Sequence
  Synthetic oligonucleotide; AAG chr2 60492123 60492142 60492139 +
tcccagcactttgggaggtc

SEQ ID NO: 161982 - DNA, 20 bp, Artificial Sequence
  Synthetic oligonucleotide; AGG chr2 60492124 60492143 60492140 +
cccagcactttgggaggtca

SEQ ID NO: 161983 - DNA, 20 bp, Artificial Sequence
  Synthetic oligonucleotide; CAG chr2 60492127 60492146 60492143 +
agcactttgggaggtcaagg

SEQ ID NO: 161984 - DNA, 20 bp, Artificial Sequence
  Synthetic oligonucleotide; AGG chr2 60492128 60492147 60492144 +
gcactttgggaggtcaaggc

SEQ ID NO: 161985 - DNA, 20 bp, Artificial Sequence
  Synthetic oligonucleotide; GAG chr2 60492130 60492149 60492146 +
actttgggaggtcaaggcag

SEQ ID NO: 161986 - DNA, 20 bp, Artificial Sequence
  Synthetic oligonucleotide; AGG chr2 60492131 60492150 60492147 +
ctttgggaggtcaaggcagg

SEQ ID NO: 161987 - DNA, 20 bp, Artificial Sequence
  Synthetic oligonucleotide; TGG chr2 60492139 60492158 60492155 +
ggtcaaggcaggaggatcac

SEQ ID NO: 161988 - DNA, 20 bp, Artificial Sequence
  Synthetic oligonucleotide; GAG chr2 60492141 60492160 60492157 +
tcaaggcaggaggatcactg

SEQ ID NO: 161989 - DNA, 20 bp, Artificial Sequence
  Synthetic oligonucleotide; CAG chr2 60492146 60492165 60492162 +
gcaggaggatcactggagcc

SEQ ID NO: 161990 - DNA, 20 bp, Artificial Sequence
  Synthetic oligonucleotide; AGG chr2 60492147 60492166 60492163 +
caggaggatcactggagccc

SEQ ID NO: 161991 - DNA, 20 bp, Artificial Sequence
  Synthetic oligonucleotide; GAG chr2 60492149 60492168 60492165 +
ggaggatcactggagcccag

SEQ ID NO: 161992 - DNA, 20 bp, Artificial Sequence
  Synthetic oligonucleotide; AAG chr2 60492155 60492174 60492171 +
tcactggagcccaggagttc

SEQ ID NO: 161993 - DNA, 20 bp, Artificial Sequence
  Synthetic oligonucleotide; CAG chr2 60492160 60492179 60492176 +
ggagcccaggagttcaagac

SEQ ID NO: 161994 - DNA, 20 bp, Artificial Sequence
  Synthetic oligonucleotide; TGG chr2 60492165 60492184 60492181 +
ccaggagttcaagaccagcc

SEQ ID NO: 161995 - DNA, 20 bp, Artificial Sequence
  Synthetic oligonucleotide; GGG chr2 60492166 60492185 60492182 +
caggagttcaagaccagcct

SEQ ID NO: 161996 - DNA, 20 bp, Artificial Sequence
  Synthetic oligonucleotide; CAG chr2 60492172 60492191 60492188 +
ttcaagaccagcctgggcaa

SEQ ID NO: 161997 - DNA, 20 bp, Artificial Sequence
  Synthetic oligonucleotide; AGG chr2 60492173 60492192 60492189 +
tcaagaccagcctgggcaac

SEQ ID NO: 161998 - DNA, 20 bp, Artificial Sequence
  Synthetic oligonucleotide; GGG chr2 60492174 60492193 60492190 +
caagaccagcctgggcaaca

SEQ ID NO: 161999 - DNA, 20 bp, Artificial Sequence
  Synthetic oligonucleotide; GAG chr2 60492176 60492195 60492192 +
agaccagcctgggcaacagg

SEQ ID NO: 162000 - DNA, 20 bp, Artificial Sequence
  Synthetic oligonucleotide; TAG chr2 60492199 60492218 60492215 +
aaactccatctctacaaaat

SEQ ID NO: 162001 - DNA, 20 bp, Artificial Sequence
  Synthetic oligonucleotide; CAG chr2 60492203 60492222 60492219 +
tccatctctacaaaattagc

SEQ ID NO: 162002 - DNA, 20 bp, Artificial Sequence
  Synthetic oligonucleotide; AGG chr2 60492204 60492223 60492220 +
ccatctctacaaaattagcc

SEQ ID NO: 162003 - DNA, 20 bp, Artificial Sequence
  Synthetic oligonucleotide; TGG chr2 60492209 60492228 60492225 +
tctacaaaattagccaggca

SEQ ID NO: 162004 - DNA, 20 bp, Artificial Sequence
  Synthetic oligonucleotide; TGG chr2 60492212 60492231 60492228 +
acaaaattagccaggcatgg

SEQ ID NO: 162005 - DNA, 20 bp, Artificial Sequence
  Synthetic oligonucleotide; CAG chr2 60492231 60492250 60492247 +
gtggcatgcacctgtcgtcc

SEQ ID NO: 162006 - DNA, 20 bp, Artificial Sequence
  Synthetic oligonucleotide; CAG chr2 60492239 60492258 60492255 +
cacctgtcgtcccagctact

SEQ ID NO: 162007 - DNA, 20 bp, Artificial Sequence
  Synthetic oligonucleotide; AGG chr2 60492240 60492259 60492256 +
acctgtcgtcccagctactc

SEQ ID NO: 162008 - DNA, 20 bp, Artificial Sequence
  Synthetic oligonucleotide; GAG chr2 60492242 60492261 60492258 +
ctgtcgtcccagctactcag

SEQ ID NO: 162009 - DNA, 20 bp, Artificial Sequence
  Synthetic oligonucleotide; AGG chr2 60492243 60492262 60492259 +
tgtcgtcccagctactcagg

SEQ ID NO: 162010 - DNA, 20 bp, Artificial Sequence
  Synthetic oligonucleotide; GAG chr2 60492248 60492267 60492264 +
tcccagctactcaggaggct

SEQ ID NO: 162011 - DNA, 20 bp, Artificial Sequence
  Synthetic oligonucleotide; AGG chr2 60492249 60492268 60492265 +
cccagctactcaggaggctg

SEQ ID NO: 162012 - DNA, 20 bp, Artificial Sequence
  Synthetic oligonucleotide; CAG chr2 60492255 60492274 60492271 +
tactcaggaggctgaggtga

SEQ ID NO: 162013 - DNA, 20 bp, Artificial Sequence
  Synthetic oligonucleotide; AGG chr2 60492256 60492275 60492272 +
actcaggaggctgaggtgac

SEQ ID NO: 162014 - DNA, 20 bp, Artificial Sequence
  Synthetic oligonucleotide; TGG chr2 60492260 60492279 60492276 +
aggaggctgaggtgacagga

SEQ ID NO: 162015 - DNA, 20 bp, Artificial Sequence
  Synthetic oligonucleotide; GAG chr2 60492266 60492285 60492282 +
ctgaggtgacaggatggctt

SEQ ID NO: 162016 - DNA, 20 bp, Artificial Sequence
  Synthetic oligonucleotide; TAG chr2 60492271 60492290 60492287 +
gtgacaggatggcttgagcc

SEQ ID NO: 162017 - DNA, 20 bp, Artificial Sequence
  Synthetic oligonucleotide; AGG chr2 60492272 60492291 60492288 +
tgacaggatggcttgagcct

SEQ ID NO: 162018 - DNA, 20 bp, Artificial Sequence
  Synthetic oligonucleotide; GAG chr2 60492274 60492293 60492290 +
acaggatggcttgagcctag

SEQ ID NO: 162019 - DNA, 20 bp, Artificial Sequence
  Synthetic oligonucleotide; AAG chr2 60492280 60492299 60492296 +
tggcttgagcctaggagatc

SEQ ID NO: 162020 - DNA, 20 bp, Artificial Sequence
  Synthetic oligonucleotide; AGG chr2 60492281 60492300 60492297 +
ggcttgagcctaggagatca

SEQ ID NO: 162021 - DNA, 20 bp, Artificial Sequence
  Synthetic oligonucleotide; CAG chr2 60492287 60492306 60492303 +
agcctaggagatcaaggctg

SEQ ID NO: 162022 - DNA, 20 bp, Artificial Sequence
  Synthetic oligonucleotide; GAG chr2 60492291 60492310 60492307 +
taggagatcaaggctgcagt

SEQ ID NO: 162023 - DNA, 20 bp, Artificial Sequence
  Synthetic oligonucleotide; TAG chr2 60492316 60492335 60492332 +
atgaacatgccactacactc

SEQ ID NO: 162024 - DNA, 20 bp, Artificial Sequence
  Synthetic oligonucleotide; TAG chr2 60492321 60492340 60492337 +
catgccactacactctagcc

SEQ ID NO: 162025 - DNA, 20 bp, Artificial Sequence
  Synthetic oligonucleotide; AGG chr2 60492322 60492341 60492338 +
atgccactacactctagcct

SEQ ID NO: 162026 - DNA, 20 bp, Artificial Sequence
  Synthetic oligonucleotide; CAG chr2 60492330 60492349 60492346 +
acactctagcctaggcaaca

SEQ ID NO: 162027 - DNA, 20 bp, Artificial Sequence
  Synthetic oligonucleotide; GAG chr2 60492334 60492353 60492350 +
tctagcctaggcaacacagc

SEQ ID NO: 162028 - DNA, 20 bp, Artificial Sequence
  Synthetic oligonucleotide; AAG chr2 60492371 60492390 60492387 +
acaaacaaacaaacaaacaa

SEQ ID NO: 162029 - DNA, 20 bp, Artificial Sequence
  Synthetic oligonucleotide; TGG chr2 60492383 60492402 60492399 +
acaaacaaaagacaactaat

SEQ ID NO: 162030 - DNA, 20 bp, Artificial Sequence
  Synthetic oligonucleotide; GGG chr2 60492384 60492403 60492400 +
caaacaaaagacaactaatt

SEQ ID NO: 162031 - DNA, 20 bp, Artificial Sequence
  Synthetic oligonucleotide; TAG chr2 60492395 60492414 60492411 +
caactaattgggctaatgtt

SEQ ID NO: 162032 - DNA, 20 bp, Artificial Sequence
  Synthetic oligonucleotide; TAG chr2 60492412 60492431 60492428 +
gtttagaataaatgtatttc

SEQ ID NO: 162033 - DNA, 20 bp, Artificial Sequence
  Synthetic oligonucleotide; AGG chr2 60492413 60492432 60492429 +
tttagaataaatgtatttct

SEQ ID NO: 162034 - DNA, 20 bp, Artificial Sequence
  Synthetic oligonucleotide; GGG chr2 60492414 60492433 60492430 +
ttagaataaatgtatttcta

SEQ ID NO: 162035 - DNA, 20 bp, Artificial Sequence
  Synthetic oligonucleotide; AAG chr2 60492417 60492436 60492433 +
gaataaatgtatttctaggg

SEQ ID NO: 162036 - DNA, 20 bp, Artificial Sequence
  Synthetic oligonucleotide; TAG chr2 60492429 60492448 60492445 +
ttctagggaagaaaaaaact

SEQ ID NO: 162037 - DNA, 20 bp, Artificial Sequence
  Synthetic oligonucleotide; TGG chr2 60492433 60492452 60492449 +
agggaagaaaaaaacttagt

SEQ ID NO: 162038 - DNA, 20 bp, Artificial Sequence
  Synthetic oligonucleotide; GGG chr2 60492434 60492453 60492450 +
gggaagaaaaaaacttagtt

SEQ ID NO: 162039 - DNA, 20 bp, Artificial Sequence
  Synthetic oligonucleotide; AAG chr2 60492462 60492481 60492478 +
cctcccctttttactttttg

SEQ ID NO: 162040 - DNA, 20 bp, Artificial Sequence
  Synthetic oligonucleotide; TGG chr2 60492470 60492489 60492486 +
ttttactttttgaagcctgc

SEQ ID NO: 162041 - DNA, 20 bp, Artificial Sequence
  Synthetic oligonucleotide; TAG chr2 60492478 60492497 60492494 +
tttgaagcctgctggaattc

SEQ ID NO: 162042 - DNA, 20 bp, Artificial Sequence
  Synthetic oligonucleotide; AGG chr2 60492479 60492498 60492495 +
ttgaagcctgctggaattct

SEQ ID NO: 162043 - DNA, 20 bp, Artificial Sequence
  Synthetic oligonucleotide; CAG chr2 60492486 60492505 60492502 +
ctgctggaattctaggaaaa

SEQ ID NO: 162044 - DNA, 20 bp, Artificial Sequence
  Synthetic oligonucleotide; CAG chr2 60492527 60492546 60492543 +
ctccttcctcacatactcac

SEQ ID NO: 162045 - DNA, 20 bp, Artificial Sequence
  Synthetic oligonucleotide; CAG chr2 60492545 60492564 60492561 +
accagtactcatgcgcttct

SEQ ID NO: 162046 - DNA, 20 bp, Artificial Sequence
  Synthetic oligonucleotide; TGG chr2 60492566 60492585 60492582 +
agacccaaatgctctgctta

SEQ ID NO: 162047 - DNA, 20 bp, Artificial Sequence
  Synthetic oligonucleotide; TGG chr2 60492569 60492588 60492585 +
cccaaatgctctgcttatgg

SEQ ID NO: 162048 - DNA, 20 bp, Artificial Sequence
  Synthetic oligonucleotide; CAG chr2 60492584 60492603 60492600 +
tatggtggataaccccatct

SEQ ID NO: 162049 - DNA, 20 bp, Artificial Sequence
  Synthetic oligonucleotide; TGG chr2 60492587 60492606 60492603 +
ggtggataaccccatctcag

SEQ ID NO: 162050 - DNA, 20 bp, Artificial Sequence
  Synthetic oligonucleotide; GGG chr2 60492588 60492607 60492604 +
gtggataaccccatctcagt

SEQ ID NO: 162051 - DNA, 20 bp, Artificial Sequence
  Synthetic oligonucleotide; CAG chr2 60492649 60492668 60492665 +
taccaacttctataaaatct

SEQ ID NO: 162052 - DNA, 20 bp, Artificial Sequence
  Synthetic oligonucleotide; AAG chr2 60492658 60492677 60492674 +
ctataaaatctcagaataca

SEQ ID NO: 162053 - DNA, 20 bp, Artificial Sequence
  Synthetic oligonucleotide; AGG chr2 60492659 60492678 60492675 +
tataaaatctcagaatacaa

SEQ ID NO: 162054 - DNA, 20 bp, Artificial Sequence
  Synthetic oligonucleotide; GGG chr2 60492660 60492679 60492676 +
ataaaatctcagaatacaaa

SEQ ID NO: 162055 - DNA, 20 bp, Artificial Sequence
  Synthetic oligonucleotide; TGG chr2 60492689 60492708 60492705 +
catttccctgaaatgtactt

SEQ ID NO: 162056 - DNA, 20 bp, Artificial Sequence
  Synthetic oligonucleotide; AAG chr2 60492703 60492722 60492719 +
gtactttggtgctaccctga

SEQ ID NO: 162057 - DNA, 20 bp, Artificial Sequence
  Synthetic oligonucleotide; CGG chr2 60492707 60492726 60492723 +
tttggtgctaccctgaaaga

SEQ ID NO: 162058 - DNA, 20 bp, Artificial Sequence
  Synthetic oligonucleotide; TAG chr2 60492711 60492730 60492727 +
gtgctaccctgaaagacggc

SEQ ID NO: 162059 - DNA, 20 bp, Artificial Sequence
  Synthetic oligonucleotide; GAG chr2 60492713 60492732 60492729 +
gctaccctgaaagacggcta

SEQ ID NO: 162060 - DNA, 20 bp, Artificial Sequence
  Synthetic oligonucleotide; GAG chr2 60492720 60492739 60492736 +
tgaaagacggctagagtctt

SEQ ID NO: 162061 - DNA, 20 bp, Artificial Sequence
  Synthetic oligonucleotide; AGG chr2 60492721 60492740 60492737 +
gaaagacggctagagtcttg

SEQ ID NO: 162062 - DNA, 20 bp, Artificial Sequence
  Synthetic oligonucleotide; GAG chr2 60492723 60492742 60492739 +
aagacggctagagtcttgag

SEQ ID NO: 162063 - DNA, 20 bp, Artificial Sequence
  Synthetic oligonucleotide; CAG chr2 60492733 60492752 60492749 +
gagtcttgaggagacccaaa

SEQ ID NO: 162064 - DNA, 20 bp, Artificial Sequence
  Synthetic oligonucleotide; AAG chr2 60492739 60492758 60492755 +
tgaggagacccaaacagtta

SEQ ID NO: 162065 - DNA, 20 bp, Artificial Sequence
  Synthetic oligonucleotide; AGG chr2 60492740 60492759 60492756 +
gaggagacccaaacagttaa

SEQ ID NO: 162066 - DNA, 20 bp, Artificial Sequence
  Synthetic oligonucleotide; CAG chr2 60492746 60492765 60492762 +
acccaaacagttaaaggtta

SEQ ID NO: 162067 - DNA, 20 bp, Artificial Sequence
  Synthetic oligonucleotide; CAG chr2 60492750 60492769 60492766 +
aaacagttaaaggttacaga

SEQ ID NO: 162068 - DNA, 20 bp, Artificial Sequence
  Synthetic oligonucleotide; TGG chr2 60492756 60492775 60492772 +
ttaaaggttacagacagact

SEQ ID NO: 162069 - DNA, 20 bp, Artificial Sequence
  Synthetic oligonucleotide; CAG chr2 60492767 60492786 60492783 +
agacagacttggttccactc

SEQ ID NO: 162070 - DNA, 20 bp, Artificial Sequence
  Synthetic oligonucleotide; TGG chr2 60492770 60492789 60492786 +
cagacttggttccactccag

SEQ ID NO: 162071 - DNA, 20 bp, Artificial Sequence
  Synthetic oligonucleotide; TGG chr2 60492773 60492792 60492789 +
acttggttccactccagtgg

SEQ ID NO: 162072 - DNA, 20 bp, Artificial Sequence
  Synthetic oligonucleotide; GGG chr2 60492774 60492793 60492790 +
cttggttccactccagtggt

SEQ ID NO: 162073 - DNA, 20 bp, Artificial Sequence
  Synthetic oligonucleotide; TAG chr2 60492797 60492816 60492813 +
tgttttgttttgtttcgctt

SEQ ID NO: 162074 - DNA, 20 bp, Artificial Sequence
  Synthetic oligonucleotide; AAG chr2 60492807 60492826 60492823 +
tgtttcgctttagctttatt

SEQ ID NO: 162075 - DNA, 20 bp, Artificial Sequence
  Synthetic oligonucleotide; AGG chr2 60492808 60492827 60492824 +
gtttcgctttagctttatta

SEQ ID NO: 162076 - DNA, 20 bp, Artificial Sequence
  Synthetic oligonucleotide; AAG chr2 60492830 60492849 60492846 +
gtatactttacatacaacaa

SEQ ID NO: 162077 - DNA, 20 bp, Artificial Sequence
  Synthetic oligonucleotide; AAG chr2 60492844 60492863 60492860 +
caacaaaagtcattcatttt

SEQ ID NO: 162078 - DNA, 20 bp, Artificial Sequence
  Synthetic oligonucleotide; CAG chr2 60492851 60492870 60492867 +
agtcattcattttaagtgta

SEQ ID NO: 162079 - DNA, 20 bp, Artificial Sequence
  Synthetic oligonucleotide; TGG chr2 60492855 60492874 60492871 +
attcattttaagtgtacagt

SEQ ID NO: 162080 - DNA, 20 bp, Artificial Sequence
  Synthetic oligonucleotide; CAG chr2 60492869 60492888 60492885 +
tacagttggattcaatttgc

SEQ ID NO: 162081 - DNA, 20 bp, Artificial Sequence
  Synthetic oligonucleotide; CAG chr2 60492879 60492898 60492895 +
ttcaatttgccagttgtata

SEQ ID NO: 162082 - DNA, 20 bp, Artificial Sequence
  Synthetic oligonucleotide; TGG chr2 60492887 60492906 60492903 +
gccagttgtatacagctgtg

SEQ ID NO: 162083 - DNA, 20 bp, Artificial Sequence
  Synthetic oligonucleotide; AAG chr2 60492904 60492923 60492920 +
gtgtggcctccaccaaaatc

SEQ ID NO: 162084 - DNA, 20 bp, Artificial Sequence
  Synthetic oligonucleotide; CAG chr2 60492910 60492929 60492926 +
cctccaccaaaatcaagata

SEQ ID NO: 162085 - DNA, 20 bp, Artificial Sequence
  Synthetic oligonucleotide; CAG chr2 60492924 60492943 60492940 +
aagatacagaacacgtccac

SEQ ID NO: 162086 - DNA, 20 bp, Artificial Sequence
  Synthetic oligonucleotide; TAG chr2 60492929 60492948 60492945 +
acagaacacgtccaccagtc

SEQ ID NO: 162087 - DNA, 20 bp, Artificial Sequence
  Synthetic oligonucleotide; AAG chr2 60492933 60492952 60492949 +
aacacgtccaccagtctaga

SEQ ID NO: 162088 - DNA, 20 bp, Artificial Sequence
  Synthetic oligonucleotide; CAG chr2 60493020 60493039 60493036 +
tgaacccccacctaccacca

SEQ ID NO: 162089 - DNA, 20 bp, Artificial Sequence
  Synthetic oligonucleotide; GAG chr2 60493027 60493046 60493043 +
ccacctaccaccacagtgtt

SEQ ID NO: 162090 - DNA, 20 bp, Artificial Sequence
  Synthetic oligonucleotide; TAG chr2 60493035 60493054 60493051 +
caccacagtgttgagaattc

SEQ ID NO: 162091 - DNA, 20 bp, Artificial Sequence
  Synthetic oligonucleotide; TGG chr2 60493051 60493070 60493067 +
attctagaatttgttacaaa

SEQ ID NO: 162092 - DNA, 20 bp, Artificial Sequence
  Synthetic oligonucleotide; CAG chr2 60493061 60493080 60493077 +
ttgttacaaatggactcata

SEQ ID NO: 162093 - DNA, 20 bp, Artificial Sequence
  Synthetic oligonucleotide; AGG chr2 60493062 60493081 60493078 +
tgttacaaatggactcatac

SEQ ID NO: 162094 - DNA, 20 bp, Artificial Sequence
  Synthetic oligonucleotide; CAG chr2 60493094 60493113 60493110 +
tttgtgtttaatttcttcca

SEQ ID NO: 162095 - DNA, 20 bp, Artificial Sequence
  Synthetic oligonucleotide; GAG chr2 60493096 60493115 60493112 +
tgtgtttaatttcttccaca

SEQ ID NO: 162096 - DNA, 20 bp, Artificial Sequence
  Synthetic oligonucleotide; CAG chr2 60493099 60493118 60493115 +
gtttaatttcttccacagag

SEQ ID NO: 162097 - DNA, 20 bp, Artificial Sequence
  Synthetic oligonucleotide; TGG chr2 60493110 60493129 60493126 +
tccacagagcagaatgattc

SEQ ID NO: 162098 - DNA, 20 bp, Artificial Sequence
  Synthetic oligonucleotide; GGG chr2 60493111 60493130 60493127 +
ccacagagcagaatgattct

SEQ ID NO: 162099 - DNA, 20 bp, Artificial Sequence
  Synthetic oligonucleotide; TGG chr2 60493123 60493142 60493139 +
atgattctgggattcatcca

SEQ ID NO: 162100 - DNA, 20 bp, Artificial Sequence
  Synthetic oligonucleotide; TGG chr2 60493128 60493147 60493144 +
tctgggattcatccatggtg

SEQ ID NO: 162101 - DNA, 20 bp, Artificial Sequence
  Synthetic oligonucleotide; GAG chr2 60493130 60493149 60493146 +
tgggattcatccatggtgtg

SEQ ID NO: 162102 - DNA, 20 bp, Artificial Sequence
  Synthetic oligonucleotide; GAG chr2 60493161 60493180 60493177 +
tctttcattcttctactgtt

SEQ ID NO: 162103 - DNA, 20 bp, Artificial Sequence
  Synthetic oligonucleotide; TAG chr2 60493177 60493196 60493193 +
tgttgagttgtattccacca

SEQ ID NO: 162104 - DNA, 20 bp, Artificial Sequence
  Synthetic oligonucleotide; AGG chr2 60493178 60493197 60493194 +
gttgagttgtattccaccat

SEQ ID NO: 162105 - DNA, 20 bp, Artificial Sequence
  Synthetic oligonucleotide; GGG chr2 60493179 60493198 60493195 +
ttgagttgtattccaccata

SEQ ID NO: 162106 - DNA, 20 bp, Artificial Sequence
  Synthetic oligonucleotide; TGG chr2 60493202 60493221 60493218 +
cgtttatccattcaacctat

SEQ ID NO: 162107 - DNA, 20 bp, Artificial Sequence
  Synthetic oligonucleotide; TGG chr2 60493213 60493232 60493229 +
tcaacctattggttgccatg

SEQ ID NO: 162108 - DNA, 20 bp, Artificial Sequence
  Synthetic oligonucleotide; GGG chr2 60493214 60493233 60493230 +
caacctattggttgccatgt

SEQ ID NO: 162109 - DNA, 20 bp, Artificial Sequence
  Synthetic oligonucleotide; CAG chr2 60493244 60493263 60493260 +
cactttttgaccactatgaa

SEQ ID NO: 162110 - DNA, 20 bp, Artificial Sequence
  Synthetic oligonucleotide; TGG chr2 60493255 60493274 60493271 +
cactatgaacagtgctacaa

SEQ ID NO: 162111 - DNA, 20 bp, Artificial Sequence
  Synthetic oligonucleotide; TAG chr2 60493266 60493285 60493282 +
gtgctacaatggacactgtg

SEQ ID NO: 162112 - DNA, 20 bp, Artificial Sequence
  Synthetic oligonucleotide; TAG chr2 60493278 60493297 60493294 +
acactgtgtagatgtgttta

SEQ ID NO: 162113 - DNA, 20 bp, Artificial Sequence
  Synthetic oligonucleotide; AGG chr2 60493279 60493298 60493295 +
cactgtgtagatgtgtttat

SEQ ID NO: 162114 - DNA, 20 bp, Artificial Sequence
  Synthetic oligonucleotide; TAG chr2 60493303 60493322 60493319 +
atgtatgtctacatttctct

SEQ ID NO: 162115 - DNA, 20 bp, Artificial Sequence
  Synthetic oligonucleotide; AGG chr2 60493304 60493323 60493320 +
tgtatgtctacatttctctt

SEQ ID NO: 162116 - DNA, 20 bp, Artificial Sequence
  Synthetic oligonucleotide; AAG chr2 60493316 60493335 60493332 +
tttctcttaggtaaacatct

SEQ ID NO: 162117 - DNA, 20 bp, Artificial Sequence
  Synthetic oligonucleotide; AGG chr2 60493317 60493336 60493333 +
ttctcttaggtaaacatcta

SEQ ID NO: 162118 - DNA, 20 bp, Artificial Sequence
  Synthetic oligonucleotide; GAG chr2 60493326 60493345 60493342 +
gtaaacatctaaggcatttc

SEQ ID NO: 162119 - DNA, 20 bp, Artificial Sequence
  Synthetic oligonucleotide; CAG chr2 60493333 60493352 60493349 +
tctaaggcatttcgagaaca

SEQ ID NO: 162120 - DNA, 20 bp, Artificial Sequence
  Synthetic oligonucleotide; AAG chr2 60493338 60493357 60493354 +
ggcatttcgagaacacagaa

SEQ ID NO: 162121 - DNA, 20 bp, Artificial Sequence
  Synthetic oligonucleotide; AGG chr2 60493339 60493358 60493355 +
gcatttcgagaacacagaaa

SEQ ID NO: 162122 - DNA, 20 bp, Artificial Sequence
  Synthetic oligonucleotide; GAG chr2 60493346 60493365 60493362 +
gagaacacagaaaaggtttt

SEQ ID NO: 162123 - DNA, 20 bp, Artificial Sequence
  Synthetic oligonucleotide; GAG chr2 60493352 60493371 60493368 +
acagaaaaggttttgagttt

SEQ ID NO: 162124 - DNA, 20 bp, Artificial Sequence
  Synthetic oligonucleotide; CAG chr2 60493357 60493376 60493373 +
aaaggttttgagtttgagtc

SEQ ID NO: 162125 - DNA, 20 bp, Artificial Sequence
  Synthetic oligonucleotide; AGG chr2 60493358 60493377 60493374 +
aaggttttgagtttgagtcc

SEQ ID NO: 162126 - DNA, 20 bp, Artificial Sequence
  Synthetic oligonucleotide; GGG chr2 60493359 60493378 60493375 +
aggttttgagtttgagtcca

SEQ ID NO: 162127 - DNA, 20 bp, Artificial Sequence
  Synthetic oligonucleotide; GAG chr2 60493361 60493380 60493377 +
gttttgagtttgagtccagg

SEQ ID NO: 162128 - DNA, 20 bp, Artificial Sequence
  Synthetic oligonucleotide; CAG chr2 60493383 60493402 60493399 +
gccctcattttgtcatcctc

SEQ ID NO: 162129 - DNA, 20 bp, Artificial Sequence
  Synthetic oligonucleotide; AGG chr2 60493384 60493403 60493400 +
ccctcattttgtcatcctcc

SEQ ID NO: 162130 - DNA, 20 bp, Artificial Sequence
  Synthetic oligonucleotide; TGG chr2 60493411 60493430 60493427 +
ccccctcccaccccattccc

SEQ ID NO: 162131 - DNA, 20 bp, Artificial Sequence
  Synthetic oligonucleotide; GAG chr2 60493413 60493432 60493429 +
ccctcccaccccattccctg

SEQ ID NO: 162132 - DNA, 20 bp, Artificial Sequence
  Synthetic oligonucleotide; GAG chr2 60493415 60493434 60493431 +
ctcccaccccattccctgga

SEQ ID NO: 162133 - DNA, 20 bp, Artificial Sequence
  Synthetic oligonucleotide; CAG chr2 60493440 60493459 60493456 +
caactccaaaccctatatcc

SEQ ID NO: 162134 - DNA, 20 bp, Artificial Sequence
  Synthetic oligonucleotide; TGG chr2 60493452 60493471 60493468 +
ctatatcccagctatctgtt

SEQ ID NO: 162135 - DNA, 20 bp, Artificial Sequence
  Synthetic oligonucleotide; CAG chr2 60493457 60493476 60493473 +
tcccagctatctgtttggct

SEQ ID NO: 162136 - DNA, 20 bp, Artificial Sequence
  Synthetic oligonucleotide; TAG chr2 60493485 60493504 60493501 +
aaatgtcatcctattccgaa

SEQ ID NO: 162137 - DNA, 20 bp, Artificial Sequence
  Synthetic oligonucleotide; AAG chr2 60493506 60493525 60493522 +
agaaacctctccactacact

SEQ ID NO: 162138 - DNA, 20 bp, Artificial Sequence
  Synthetic oligonucleotide; AGG chr2 60493507 60493526 60493523 +
gaaacctctccactacacta

SEQ ID NO: 162139 - DNA, 20 bp, Artificial Sequence
  Synthetic oligonucleotide; TGG chr2 60493516 60493535 60493532 +
ccactacactaaggaaatga

SEQ ID NO: 162140 - DNA, 20 bp, Artificial Sequence
  Synthetic oligonucleotide; GGG chr2 60493517 60493536 60493533 +
cactacactaaggaaatgat

SEQ ID NO: 162141 - DNA, 20 bp, Artificial Sequence
  Synthetic oligonucleotide; AAG chr2 60493520 60493539 60493536 +
tacactaaggaaatgatggg

SEQ ID NO: 162142 - DNA, 20 bp, Artificial Sequence
  Synthetic oligonucleotide; GAG chr2 60493522 60493541 60493538 +
cactaaggaaatgatgggaa

SEQ ID NO: 162143 - DNA, 20 bp, Artificial Sequence
  Synthetic oligonucleotide; TGG chr2 60493545 60493564 60493561 +
accccaaaacattcttaaaa

SEQ ID NO: 162144 - DNA, 20 bp, Artificial Sequence
  Synthetic oligonucleotide; GGG chr2 60493546 60493565 60493562 +
ccccaaaacattcttaaaat

SEQ ID NO: 162145 - DNA, 20 bp, Artificial Sequence
  Synthetic oligonucleotide; CAG chr2 60493562 60493581 60493578 +
aaatgggcattcatttgaat

SEQ ID NO: 162146 - DNA, 20 bp, Artificial Sequence
  Synthetic oligonucleotide; AGG chr2 60493563 60493582 60493579 +
aatgggcattcatttgaatc

SEQ ID NO: 162147 - DNA, 20 bp, Artificial Sequence
  Synthetic oligonucleotide; TGG chr2 60493576 60493595 60493592 +
ttgaatcaggccaaataaat

SEQ ID NO: 162148 - DNA, 20 bp, Artificial Sequence
  Synthetic oligonucleotide; TGG chr2 60493583 60493602 60493599 +
aggccaaataaattggactc

SEQ ID NO: 162149 - DNA, 20 bp, Artificial Sequence
  Synthetic oligonucleotide; GGG chr2 60493584 60493603 60493600 +
ggccaaataaattggactct

SEQ ID NO: 162150 - DNA, 20 bp, Artificial Sequence
  Synthetic oligonucleotide; CAG chr2 60493588 60493607 60493604 +
aaataaattggactctgggt

SEQ ID NO: 162151 - DNA, 20 bp, Artificial Sequence
  Synthetic oligonucleotide; GAG chr2 60493590 60493609 60493606 +
ataaattggactctgggtca

SEQ ID NO: 162152 - DNA, 20 bp, Artificial Sequence
  Synthetic oligonucleotide; AAG chr2 60493600 60493619 60493616 +
ctctgggtcagagataactt

SEQ ID NO: 162153 - DNA, 20 bp, Artificial Sequence
  Synthetic oligonucleotide; TGG chr2 60493605 60493624 60493621 +
ggtcagagataacttaagtg

SEQ ID NO: 162154 - DNA, 20 bp, Artificial Sequence
  Synthetic oligonucleotide; CGG chr2 60493612 60493631 60493628 +
gataacttaagtgtggtgtt

SEQ ID NO: 162155 - DNA, 20 bp, Artificial Sequence
  Synthetic oligonucleotide; GAG chr2 60493614 60493633 60493630 +
taacttaagtgtggtgttcg

SEQ ID NO: 162156 - DNA, 20 bp, Artificial Sequence
  Synthetic oligonucleotide; AAG chr2 60493621 60493640 60493637 +
agtgtggtgttcggagtcct

SEQ ID NO: 162157 - DNA, 20 bp, Artificial Sequence
  Synthetic oligonucleotide; GAG chr2 60493623 60493642 60493639 +
tgtggtgttcggagtcctaa

SEQ ID NO: 162158 - DNA, 20 bp, Artificial Sequence
  Synthetic oligonucleotide; TAG chr2 60493633 60493652 60493649 +
ggagtcctaagagcccccac

SEQ ID NO: 162159 - DNA, 20 bp, Artificial Sequence
  Synthetic oligonucleotide; CAG chr2 60493638 60493657 60493654 +
cctaagagcccccactagct

SEQ ID NO: 162160 - DNA, 20 bp, Artificial Sequence
  Synthetic oligonucleotide; TGG chr2 60493644 60493663 60493660 +
agcccccactagctcagaaa

SEQ ID NO: 162161 - DNA, 20 bp, Artificial Sequence
  Synthetic oligonucleotide; TAG chr2 60493650 60493669 60493666 +
cactagctcagaaatggact

SEQ ID NO: 162162 - DNA, 20 bp, Artificial Sequence
  Synthetic oligonucleotide; TAG chr2 60493667 60493686 60493683 +
acttagttgacctcccccat

SEQ ID NO: 162163 - DNA, 20 bp, Artificial Sequence
  Synthetic oligonucleotide; CAG chr2 60493670 60493689 60493686 +
tagttgacctcccccattag

SEQ ID NO: 162164 - DNA, 20 bp, Artificial Sequence
  Synthetic oligonucleotide; TGG chr2 60493675 60493694 60493691 +
gacctcccccattagcagca

SEQ ID NO: 162165 - DNA, 20 bp, Artificial Sequence
  Synthetic oligonucleotide; GAG chr2 60493677 60493696 60493693 +
cctcccccattagcagcatg

SEQ ID NO: 162166 - DNA, 20 bp, Artificial Sequence
  Synthetic oligonucleotide; GAG chr2 60493679 60493698 60493695 +
tcccccattagcagcatgga

SEQ ID NO: 162167 - DNA, 20 bp, Artificial Sequence
  Synthetic oligonucleotide; AAG chr2 60493684 60493703 60493700 +
cattagcagcatggagagtc

SEQ ID NO: 162168 - DNA, 20 bp, Artificial Sequence
  Synthetic oligonucleotide; AGG chr2 60493685 60493704 60493701 +
attagcagcatggagagtca

SEQ ID NO: 162169 - DNA, 20 bp, Artificial Sequence
  Synthetic oligonucleotide; GAG chr2 60493687 60493706 60493703 +
tagcagcatggagagtcaag

SEQ ID NO: 162170 - DNA, 20 bp, Artificial Sequence
  Synthetic oligonucleotide; AAG chr2 60493708 60493727 60493724 +
agatgacttctaccttgcca

SEQ ID NO: 162171 - DNA, 20 bp, Artificial Sequence
  Synthetic oligonucleotide; AGG chr2 60493709 60493728 60493725 +
gatgacttctaccttgccaa

SEQ ID NO: 162172 - DNA, 20 bp, Artificial Sequence
  Synthetic oligonucleotide; TGG chr2 60493715 60493734 60493731 +
ttctaccttgccaaaggcct

SEQ ID NO: 162173 - DNA, 20 bp, Artificial Sequence
  Synthetic oligonucleotide; GGG chr2 60493716 60493735 60493732 +
tctaccttgccaaaggcctt

SEQ ID NO: 162174 - DNA, 20 bp, Artificial Sequence
  Synthetic oligonucleotide; AAG chr2 60493719 60493738 60493735 +
accttgccaaaggccttggg

SEQ ID NO: 162175 - DNA, 20 bp, Artificial Sequence
  Synthetic oligonucleotide; AAG chr2 60493723 60493742 60493739 +
tgccaaaggccttgggaaga

SEQ ID NO: 162176 - DNA, 20 bp, Artificial Sequence
  Synthetic oligonucleotide; CAG chr2 60493727 60493746 60493743 +
aaaggccttgggaagaaaga

SEQ ID NO: 162177 - DNA, 20 bp, Artificial Sequence
  Synthetic oligonucleotide; AAG chr2 60493734 60493753 60493750 +
ttgggaagaaagacagcatc

SEQ ID NO: 162178 - DNA, 20 bp, Artificial Sequence
  Synthetic oligonucleotide; AGG chr2 60493735 60493754 60493751 +
tgggaagaaagacagcatca

SEQ ID NO: 162179 - DNA, 20 bp, Artificial Sequence
  Synthetic oligonucleotide; CAG chr2 60493753 60493772 60493769 +
caaggtctcacacaacactc

SEQ ID NO: 162180 - DNA, 20 bp, Artificial Sequence
  Synthetic oligonucleotide; AGG chr2 60493754 60493773 60493770 +
aaggtctcacacaacactcc

SEQ ID NO: 162181 - DNA, 20 bp, Artificial Sequence
  Synthetic oligonucleotide; GGG chr2 60493755 60493774 60493771 +
aggtctcacacaacactcca

SEQ ID NO: 162182 - DNA, 20 bp, Artificial Sequence
  Synthetic oligonucleotide; GAG chr2 60493757 60493776 60493773 +
gtctcacacaacactccagg

SEQ ID NO: 162183 - DNA, 20 bp, Artificial Sequence
  Synthetic oligonucleotide; AGG chr2 60493758 60493777 60493774 +
tctcacacaacactccaggg

SEQ ID NO: 162184 - DNA, 20 bp, Artificial Sequence
  Synthetic oligonucleotide; CAG chr2 60493761 60493780 60493777 +
cacacaacactccagggagg

SEQ ID NO: 162185 - DNA, 20 bp, Artificial Sequence
  Synthetic oligonucleotide; CAG chr2 60493772 60493791 60493788 +
ccagggaggcagctgctgcc

SEQ ID NO: 162186 - DNA, 20 bp, Artificial Sequence
  Synthetic oligonucleotide; TGG chr2 60493780 60493799 60493796 +
gcagctgctgcccagtgctg

SEQ ID NO: 162187 - DNA, 20 bp, Artificial Sequence
  Synthetic oligonucleotide; CAG chr2 60493784 60493803 60493800 +
ctgctgcccagtgctgtgga

SEQ ID NO: 162188 - DNA, 20 bp, Artificial Sequence
  Synthetic oligonucleotide; AAG chr2 60493789 60493808 60493805 +
gcccagtgctgtggacagca

SEQ ID NO: 162189 - DNA, 20 bp, Artificial Sequence
  Synthetic oligonucleotide; CAG chr2 60493795 60493814 60493811 +
tgctgtggacagcaaagctt

SEQ ID NO: 162190 - DNA, 20 bp, Artificial Sequence
  Synthetic oligonucleotide; CAG chr2 60493800 60493819 60493816 +
tggacagcaaagcttcagtg

SEQ ID NO: 162191 - DNA, 20 bp, Artificial Sequence
  Synthetic oligonucleotide; AGG chr2 60493801 60493820 60493817 +
ggacagcaaagcttcagtgc

SEQ ID NO: 162192 - DNA, 20 bp, Artificial Sequence
  Synthetic oligonucleotide; AAG chr2 60493809 60493828 60493825 +
aagcttcagtgcaggaaatt

SEQ ID NO: 162193 - DNA, 20 bp, Artificial Sequence
  Synthetic oligonucleotide; CAG chr2 60493844 60493863 60493860 +
tccccctcccccatcctcat

SEQ ID NO: 162194 - DNA, 20 bp, Artificial Sequence
  Synthetic oligonucleotide; TGG chr2 60493849 60493868 60493865 +
ctcccccatcctcatcagct

SEQ ID NO: 162195 - DNA, 20 bp, Artificial Sequence
  Synthetic oligonucleotide; TGG chr2 60493855 60493874 60493871 +
catcctcatcagcttggcca

SEQ ID NO: 162196 - DNA, 20 bp, Artificial Sequence
  Synthetic oligonucleotide; CAG chr2 60493858 60493877 60493874 +
cctcatcagcttggccatgg

SEQ ID NO: 162197 - DNA, 20 bp, Artificial Sequence
  Synthetic oligonucleotide; AGG chr2 60493859 60493878 60493875 +
ctcatcagcttggccatggc

SEQ ID NO: 162198 - DNA, 20 bp, Artificial Sequence
  Synthetic oligonucleotide; GGG chr2 60493860 60493879 60493876 +
tcatcagcttggccatggca

SEQ ID NO: 162199 - DNA, 20 bp, Artificial Sequence
  Synthetic oligonucleotide; TGG chr2 60493864 60493883 60493880 +
cagcttggccatggcagggc

SEQ ID NO: 162200 - DNA, 20 bp, Artificial Sequence
  Synthetic oligonucleotide; GGG chr2 60493865 60493884 60493881 +
agcttggccatggcagggct

SEQ ID NO: 162201 - DNA, 20 bp, Artificial Sequence
  Synthetic oligonucleotide; GGG chr2 60493866 60493885 60493882 +
gcttggccatggcagggctg

SEQ ID NO: 162202 - DNA, 20 bp, Artificial Sequence
  Synthetic oligonucleotide; GGG chr2 60493867 60493886 60493883 +
cttggccatggcagggctgg

SEQ ID NO: 162203 - DNA, 20 bp, Artificial Sequence
  Synthetic oligonucleotide; CAG chr2 60493872 60493891 60493888 +
ccatggcagggctgggggat

SEQ ID NO: 162204 - DNA, 20 bp, Artificial Sequence
  Synthetic oligonucleotide; GAG chr2 60493874 60493893 60493890 +
atggcagggctgggggatca

SEQ ID NO: 162205 - DNA, 20 bp, Artificial Sequence
  Synthetic oligonucleotide; AGG chr2 60493875 60493894 60493891 +
tggcagggctgggggatcag

SEQ ID NO: 162206 - DNA, 20 bp, Artificial Sequence
  Synthetic oligonucleotide; CAG chr2 60493882 60493901 60493898 +
gctgggggatcagaggtgaa

SEQ ID NO: 162207 - DNA, 20 bp, Artificial Sequence
  Synthetic oligonucleotide; AGG chr2 60493883 60493902 60493899 +
ctgggggatcagaggtgaac

SEQ ID NO: 162208 - DNA, 20 bp, Artificial Sequence
  Synthetic oligonucleotide; AAG chr2 60493886 60493905 60493902 +
ggggatcagaggtgaacagg

SEQ ID NO: 162209 - DNA, 20 bp, Artificial Sequence
  Synthetic oligonucleotide; CAG chr2 60493889 60493908 60493905 +
gatcagaggtgaacaggaag

SEQ ID NO: 162210 - DNA, 20 bp, Artificial Sequence
  Synthetic oligonucleotide; AAG chr2 60493892 60493911 60493908 +
cagaggtgaacaggaagcag

SEQ ID NO: 162211 - DNA, 20 bp, Artificial Sequence
  Synthetic oligonucleotide; AGG chr2 60493893 60493912 60493909 +
agaggtgaacaggaagcaga

SEQ ID NO: 162212 - DNA, 20 bp, Artificial Sequence
  Synthetic oligonucleotide; TGG chr2 60493901 60493920 60493917 +
acaggaagcagaaggacccc

SEQ ID NO: 162213 - DNA, 20 bp, Artificial Sequence
  Synthetic oligonucleotide; GGG chr2 60493902 60493921 60493918 +
caggaagcagaaggacccct

SEQ ID NO: 162214 - DNA, 20 bp, Artificial Sequence
  Synthetic oligonucleotide; GGG chr2 60493903 60493922 60493919 +
aggaagcagaaggacccctg

SEQ ID NO: 162215 - DNA, 20 bp, Artificial Sequence
  Synthetic oligonucleotide; GGG chr2 60493904 60493923 60493920 +
ggaagcagaaggacccctgg

SEQ ID NO: 162216 - DNA, 20 bp, Artificial Sequence
  Synthetic oligonucleotide; GAG chr2 60493906 60493925 60493922 +
aagcagaaggacccctgggg

SEQ ID NO: 162217 - DNA, 20 bp, Artificial Sequence
  Synthetic oligonucleotide; CAG chr2 60493910 60493929 60493926 +
agaaggacccctgggggaga

SEQ ID NO: 162218 - DNA, 20 bp, Artificial Sequence
  Synthetic oligonucleotide; AGG chr2 60493911 60493930 60493927 +
gaaggacccctgggggagac

SEQ ID NO: 162219 - DNA, 20 bp, Artificial Sequence
  Synthetic oligonucleotide; GGG chr2 60493912 60493931 60493928 +
aaggacccctgggggagaca

SEQ ID NO: 162220 - DNA, 20 bp, Artificial Sequence
  Synthetic oligonucleotide; CAG chr2 60493919 60493938 60493935 +
cctgggggagacagggcctc

SEQ ID NO: 162221 - DNA, 20 bp, Artificial Sequence
  Synthetic oligonucleotide; TGG chr2 60493922 60493941 60493938 +
gggggagacagggcctccag

SEQ ID NO: 162222 - DNA, 20 bp, Artificial Sequence
  Synthetic oligonucleotide; GGG chr2 60493923 60493942 60493939 +
ggggagacagggcctccagt

SEQ ID NO: 162223 - DNA, 20 bp, Artificial Sequence
  Synthetic oligonucleotide; CAG chr2 60493928 60493947 60493944 +
gacagggcctccagtgggac

SEQ ID NO: 162224 - DNA, 20 bp, Artificial Sequence
  Synthetic oligonucleotide; GAG chr2 60493930 60493949 60493946 +
cagggcctccagtgggacca

SEQ ID NO: 162225 - DNA, 20 bp, Artificial Sequence
  Synthetic oligonucleotide; GAG chr2 60493935 60493954 60493951 +
cctccagtgggaccagagct

SEQ ID NO: 162226 - DNA, 20 bp, Artificial Sequence
  Synthetic oligonucleotide; TGG chr2 60493938 60493957 60493954 +
ccagtgggaccagagctgag

SEQ ID NO: 162227 - DNA, 20 bp, Artificial Sequence
  Synthetic oligonucleotide; CAG chr2 60493944 60493963 60493960 +
ggaccagagctgagtggcct

SEQ ID NO: 162228 - DNA, 20 bp, Artificial Sequence
  Synthetic oligonucleotide; AGG chr2 60493945 60493964 60493961 +
gaccagagctgagtggcctc

SEQ ID NO: 162229 - DNA, 20 bp, Artificial Sequence
  Synthetic oligonucleotide; CAG chr2 60493948 60493967 60493964 +
cagagctgagtggcctcagg

SEQ ID NO: 162230 - DNA, 20 bp, Artificial Sequence
  Synthetic oligonucleotide; TGG chr2 60493951 60493970 60493967 +
agctgagtggcctcaggcag

SEQ ID NO: 162231 - DNA, 20 bp, Artificial Sequence
  Synthetic oligonucleotide; CGG chr2 60493954 60493973 60493970 +
tgagtggcctcaggcagtgg

SEQ ID NO: 162232 - DNA, 20 bp, Artificial Sequence
  Synthetic oligonucleotide; AAG chr2 60493957 60493976 60493973 +
gtggcctcaggcagtggcgg

SEQ ID NO: 162233 - DNA, 20 bp, Artificial Sequence
  Synthetic oligonucleotide; AAG chr2 60493967 60493986 60493983 +
gcagtggcggaagctgatta

SEQ ID NO: 162234 - DNA, 20 bp, Artificial Sequence
  Synthetic oligonucleotide; AGG chr2 60493968 60493987 60493984 +
cagtggcggaagctgattaa

SEQ ID NO: 162235 - DNA, 20 bp, Artificial Sequence
  Synthetic oligonucleotide; AAG chr2 60493971 60493990 60493987 +
tggcggaagctgattaaagg

SEQ ID NO: 162236 - DNA, 20 bp, Artificial Sequence
  Synthetic oligonucleotide; AGG chr2 60493972 60493991 60493988 +
ggcggaagctgattaaagga

SEQ ID NO: 162237 - DNA, 20 bp, Artificial Sequence
  Synthetic oligonucleotide; CGG chr2 60493977 60493996 60493993 +
aagctgattaaaggaaggta

SEQ ID NO: 162238 - DNA, 20 bp, Artificial Sequence
  Synthetic oligonucleotide; GGG chr2 60493978 60493997 60493994 +
agctgattaaaggaaggtac

SEQ ID NO: 162239 - DNA, 20 bp, Artificial Sequence
  Synthetic oligonucleotide; GGG chr2 60493979 60493998 60493995 +
gctgattaaaggaaggtacg

SEQ ID NO: 162240 - DNA, 20 bp, Artificial Sequence
  Synthetic oligonucleotide; GAG chr2 60493981 60494000 60493997 +
tgattaaaggaaggtacggg

SEQ ID NO: 162241 - DNA, 20 bp, Artificial Sequence
  Synthetic oligonucleotide; TGG chr2 60493984 60494003 60494000 +
ttaaaggaaggtacggggag

SEQ ID NO: 162242 - DNA, 20 bp, Artificial Sequence
  Synthetic oligonucleotide; GAG chr2 60493986 60494005 60494002 +
aaaggaaggtacggggagtg

SEQ ID NO: 162243 - DNA, 20 bp, Artificial Sequence
  Synthetic oligonucleotide; AGG chr2 60493987 60494006 60494003 +
aaggaaggtacggggagtgg

SEQ ID NO: 162244 - DNA, 20 bp, Artificial Sequence
  Synthetic oligonucleotide; GGG chr2 60493988 60494007 60494004 +
aggaaggtacggggagtgga

SEQ ID NO: 162245 - DNA, 20 bp, Artificial Sequence
  Synthetic oligonucleotide; GGG chr2 60493989 60494008 60494005 +
ggaaggtacggggagtggag

SEQ ID NO: 162246 - DNA, 20 bp, Artificial Sequence
  Synthetic oligonucleotide; AAG chr2 60493992 60494011 60494008 +
aggtacggggagtggagggg

SEQ ID NO: 162247 - DNA, 20 bp, Artificial Sequence
  Synthetic oligonucleotide; TGG chr2 60493995 60494014 60494011 +
tacggggagtggaggggaag

SEQ ID NO: 162248 - DNA, 20 bp, Artificial Sequence
  Synthetic oligonucleotide; AAG chr2 60494002 60494021 60494018 +
agtggaggggaagtggacaa

SEQ ID NO: 162249 - DNA, 20 bp, Artificial Sequence
  Synthetic oligonucleotide; CAG chr2 60494006 60494025 60494022 +
gaggggaagtggacaaaaga

SEQ ID NO: 162250 - DNA, 20 bp, Artificial Sequence
  Synthetic oligonucleotide; AGG chr2 60494007 60494026 60494023 +
aggggaagtggacaaaagac

SEQ ID NO: 162251 - DNA, 20 bp, Artificial Sequence
  Synthetic oligonucleotide; CAG chr2 60494011 60494030 60494027 +
gaagtggacaaaagacagga

SEQ ID NO: 162252 - DNA, 20 bp, Artificial Sequence
  Synthetic oligonucleotide; TAG chr2 60494020 60494039 60494036 +
aaaagacaggacagccatct

SEQ ID NO: 162253 - DNA, 20 bp, Artificial Sequence
  Synthetic oligonucleotide; AAG chr2 60494033 60494052 60494049 +
gccatcttagacaacaatgc

SEQ ID NO: 162254 - DNA, 20 bp, Artificial Sequence
  Synthetic oligonucleotide; AGG chr2 60494034 60494053 60494050 +
ccatcttagacaacaatgca

SEQ ID NO: 162255 - DNA, 20 bp, Artificial Sequence
  Synthetic oligonucleotide; GGG chr2 60494035 60494054 60494051 +
catcttagacaacaatgcaa

SEQ ID NO: 162256 - DNA, 20 bp, Artificial Sequence
  Synthetic oligonucleotide; GGG chr2 60494036 60494055 60494052 +
atcttagacaacaatgcaag

SEQ ID NO: 162257 - DNA, 20 bp, Artificial Sequence
  Synthetic oligonucleotide; GGG chr2 60494037 60494056 60494053 +
tcttagacaacaatgcaagg

SEQ ID NO: 162258 - DNA, 20 bp, Artificial Sequence
  Synthetic oligonucleotide; GAG chr2 60494039 60494058 60494055 +
ttagacaacaatgcaagggg

SEQ ID NO: 162259 - DNA, 20 bp, Artificial Sequence
  Synthetic oligonucleotide; AAG chr2 60494048 60494067 60494064 +
aatgcaagggggagaaactg

SEQ ID NO: 162260 - DNA, 20 bp, Artificial Sequence
  Synthetic oligonucleotide; CAG chr2 60494055 60494074 60494071 +
gggggagaaactgaagaaaa

SEQ ID NO: 162261 - DNA, 20 bp, Artificial Sequence
  Synthetic oligonucleotide; CAG chr2 60494060 60494079 60494076 +
agaaactgaagaaaacagaa

SEQ ID NO: 162262 - DNA, 20 bp, Artificial Sequence
  Synthetic oligonucleotide; GAG chr2 60494062 60494081 60494078 +
aaactgaagaaaacagaaca

SEQ ID NO: 162263 - DNA, 20 bp, Artificial Sequence
  Synthetic oligonucleotide; TGG chr2 60494073 60494092 60494089 +
aacagaacagagaccactac

SEQ ID NO: 162264 - DNA, 20 bp, Artificial Sequence
  Synthetic oligonucleotide; CAG chr2 60494083 60494102 60494099 +
agaccactactggcaataaa

SEQ ID NO: 162265 - DNA, 20 bp, Artificial Sequence
  Synthetic oligonucleotide; GAG chr2 60494085 60494104 60494101 +
accactactggcaataaaca

SEQ ID NO: 162266 - DNA, 20 bp, Artificial Sequence
  Synthetic oligonucleotide; GAG chr2 60494087 60494106 60494103 +
cactactggcaataaacaga

SEQ ID NO: 162267 - DNA, 20 bp, Artificial Sequence
  Synthetic oligonucleotide; AAG chr2 60494091 60494110 60494107 +
actggcaataaacagagaga

SEQ ID NO: 162268 - DNA, 20 bp, Artificial Sequence
  Synthetic oligonucleotide; AAG chr2 60494096 60494115 60494112 +
caataaacagagagaaagtg

SEQ ID NO: 162269 - DNA, 20 bp, Artificial Sequence
  Synthetic oligonucleotide; TGG chr2 60494104 60494123 60494120 +
agagagaaagtgaagcccca

SEQ ID NO: 162270 - DNA, 20 bp, Artificial Sequence
  Synthetic oligonucleotide; GGG chr2 60494105 60494124 60494121 +
gagagaaagtgaagccccat

SEQ ID NO: 162271 - DNA, 20 bp, Artificial Sequence
  Synthetic oligonucleotide; GAG chr2 60494109 60494128 60494125 +
gaaagtgaagccccatgggt

SEQ ID NO: 162272 - DNA, 20 bp, Artificial Sequence
  Synthetic oligonucleotide; AGG chr2 60494110 60494129 60494126 +
aaagtgaagccccatgggtg

SEQ ID NO: 162273 - DNA, 20 bp, Artificial Sequence
  Synthetic oligonucleotide; AAG chr2 60494129 60494148 60494145 +
gaggcacacctacattactt

SEQ ID NO: 162274 - DNA, 20 bp, Artificial Sequence
  Synthetic oligonucleotide; GAG chr2 60494138 60494157 60494154 +
ctacattacttaagaaacct

SEQ ID NO: 162275 - DNA, 20 bp, Artificial Sequence
  Synthetic oligonucleotide; TAG chr2 60494155 60494174 60494171 +
cctgagcacattcttacgcc

SEQ ID NO: 162276 - DNA, 20 bp, Artificial Sequence
  Synthetic oligonucleotide; AGG chr2 60494156 60494175 60494172 +
ctgagcacattcttacgcct

SEQ ID NO: 162277 - DNA, 20 bp, Artificial Sequence
  Synthetic oligonucleotide; GGG chr2 60494157 60494176 60494173 +
tgagcacattcttacgccta

SEQ ID NO: 162278 - DNA, 20 bp, Artificial Sequence
  Synthetic oligonucleotide; GAG chr2 60494176 60494195 60494192 +
agggcaataaatacatcctt

SEQ ID NO: 162279 - DNA, 20 bp, Artificial Sequence
  Synthetic oligonucleotide; CAG chr2 60494184 60494203 60494200 +
aaatacatccttgagctaca

SEQ ID NO: 162280 - DNA, 20 bp, Artificial Sequence
  Synthetic oligonucleotide; AGG chr2 60494185 60494204 60494201 +
aatacatccttgagctacac

SEQ ID NO: 162281 - DNA, 20 bp, Artificial Sequence
  Synthetic oligonucleotide; AAG chr2 60494190 60494209 60494206 +
atccttgagctacacaggct

SEQ ID NO: 162282 - DNA, 20 bp, Artificial Sequence
  Synthetic oligonucleotide; AAG chr2 60494194 60494213 60494210 +
ttgagctacacaggctaagc

SEQ ID NO: 162283 - DNA, 20 bp, Artificial Sequence
  Synthetic oligonucleotide; GAG chr2 60494196 60494215 60494212 +
gagctacacaggctaagcaa

SEQ ID NO: 162284 - DNA, 20 bp, Artificial Sequence
  Synthetic oligonucleotide; GAG chr2 60494200 60494219 60494216 +
tacacaggctaagcaagagt

SEQ ID NO: 162285 - DNA, 20 bp, Artificial Sequence
  Synthetic oligonucleotide; GAG chr2 60494202 60494221 60494218 +
cacaggctaagcaagagtga

SEQ ID NO: 162286 - DNA, 20 bp, Artificial Sequence
  Synthetic oligonucleotide; GAG chr2 60494204 60494223 60494220 +
caggctaagcaagagtgaga

SEQ ID NO: 162287 - DNA, 20 bp, Artificial Sequence
  Synthetic oligonucleotide; AGG chr2 60494205 60494224 60494221 +
aggctaagcaagagtgagag

SEQ ID NO: 162288 - DNA, 20 bp, Artificial Sequence
  Synthetic oligonucleotide; GGG chr2 60494206 60494225 60494222 +
ggctaagcaagagtgagaga

SEQ ID NO: 162289 - DNA, 20 bp, Artificial Sequence
  Synthetic oligonucleotide; CAG chr2 60494218 60494237 60494234 +
gtgagagagggtgatgctga

SEQ ID NO: 162290 - DNA, 20 bp, Artificial Sequence
  Synthetic oligonucleotide; AGG chr2 60494219 60494238 60494235 +
tgagagagggtgatgctgac

SEQ ID NO: 162291 - DNA, 20 bp, Artificial Sequence
  Synthetic oligonucleotide; TGG chr2 60494227 60494246 60494243 +
ggtgatgctgacaggccaca

SEQ ID NO: 162292 - DNA, 20 bp, Artificial Sequence
  Synthetic oligonucleotide; GGG chr2 60494228 60494247 60494244 +
gtgatgctgacaggccacat

SEQ ID NO: 162293 - DNA, 20 bp, Artificial Sequence
  Synthetic oligonucleotide; GAG chr2 60494230 60494249 60494246 +
gatgctgacaggccacatgg

SEQ ID NO: 162294 - DNA, 20 bp, Artificial Sequence
  Synthetic oligonucleotide; GAG chr2 60494232 60494251 60494248 +
tgctgacaggccacatggga

SEQ ID NO: 162295 - DNA, 20 bp, Artificial Sequence
  Synthetic oligonucleotide; TGG chr2 60494235 60494254 60494251 +
tgacaggccacatgggagag

SEQ ID NO: 162296 - DNA, 20 bp, Artificial Sequence
  Synthetic oligonucleotide; GGG chr2 60494236 60494255 60494252 +
gacaggccacatgggagagt

SEQ ID NO: 162297 - DNA, 20 bp, Artificial Sequence
  Synthetic oligonucleotide; AAG chr2 60494239 60494258 60494255 +
aggccacatgggagagtggg

SEQ ID NO: 162298 - DNA, 20 bp, Artificial Sequence
  Synthetic oligonucleotide; TGG chr2 60494245 60494264 60494261 +
catgggagagtgggaagacg

SEQ ID NO: 162299 - DNA, 20 bp, Artificial Sequence
  Synthetic oligonucleotide; GGG chr2 60494246 60494265 60494262 +
atgggagagtgggaagacgt

SEQ ID NO: 162300 - DNA, 20 bp, Artificial Sequence
  Synthetic oligonucleotide; TGG chr2 60494250 60494269 60494266 +
gagagtgggaagacgtgggc

SEQ ID NO: 162301 - DNA, 20 bp, Artificial Sequence
  Synthetic oligonucleotide; GGG chr2 60494251 60494270 60494267 +
agagtgggaagacgtgggct

SEQ ID NO: 162302 - DNA, 20 bp, Artificial Sequence
  Synthetic oligonucleotide; GAG chr2 60494253 60494272 60494269 +
agtgggaagacgtgggctgg

SEQ ID NO: 162303 - DNA, 20 bp, Artificial Sequence
  Synthetic oligonucleotide; TGG chr2 60494257 60494276 60494273 +
ggaagacgtgggctgggagc

SEQ ID NO: 162304 - DNA, 20 bp, Artificial Sequence
  Synthetic oligonucleotide; GGG chr2 60494258 60494277 60494274 +
gaagacgtgggctgggagct

SEQ ID NO: 162305 - DNA, 20 bp, Artificial Sequence
  Synthetic oligonucleotide; GAG chr2 60494260 60494279 60494276 +
agacgtgggctgggagctgg

SEQ ID NO: 162306 - DNA, 20 bp, Artificial Sequence
  Synthetic oligonucleotide; TGG chr2 60494265 60494284 60494281 +
tgggctgggagctgggagtt

SEQ ID NO: 162307 - DNA, 20 bp, Artificial Sequence
  Synthetic oligonucleotide; TGG chr2 60494283 60494302 60494299 +
tttggcttctcatctgtgca

SEQ ID NO: 162308 - DNA, 20 bp, Artificial Sequence
  Synthetic oligonucleotide; TGG chr2 60494295 60494314 60494311 +
tctgtgcatggcctctaaac

SEQ ID NO: 162309 - DNA, 20 bp, Artificial Sequence
  Synthetic oligonucleotide; GGG chr2 60494296 60494315 60494312 +
ctgtgcatggcctctaaact

SEQ ID NO: 162310 - DNA, 20 bp, Artificial Sequence
  Synthetic oligonucleotide; CAG chr2 60494299 60494318 60494315 +
tgcatggcctctaaactggg

SEQ ID NO: 162311 - DNA, 20 bp, Artificial Sequence
  Synthetic oligonucleotide; TGG chr2 60494308 60494327 60494324 +
tctaaactgggcagtgacca

SEQ ID NO: 162312 - DNA, 20 bp, Artificial Sequence
  Synthetic oligonucleotide; TGG chr2 60494313 60494332 60494329 +
actgggcagtgaccatggcc

SEQ ID NO: 162313 - DNA, 20 bp, Artificial Sequence
  Synthetic oligonucleotide; TGG chr2 60494330 60494349 60494346 +
gcctggtcacctccccactc

SEQ ID NO: 162314 - DNA, 20 bp, Artificial Sequence
  Synthetic oligonucleotide; TGG chr2 60494336 60494355 60494352 +
tcacctccccactctggacc

SEQ ID NO: 162315 - DNA, 20 bp, Artificial Sequence
  Synthetic oligonucleotide; GGG chr2 60494337 60494356 60494353 +
cacctccccactctggacct

SEQ ID NO: 162316 - DNA, 20 bp, Artificial Sequence
  Synthetic oligonucleotide; AAG chr2 60494356 60494375 60494372 +
tgggttgcccctctgtaaac

SEQ ID NO: 162317 - DNA, 20 bp, Artificial Sequence
  Synthetic oligonucleotide; AGG chr2 60494357 60494376 60494373 +
gggttgcccctctgtaaaca

SEQ ID NO: 162318 - DNA, 20 bp, Artificial Sequence
  Synthetic oligonucleotide; GAG chr2 60494359 60494378 60494375 +
gttgcccctctgtaaacaag

SEQ ID NO: 162319 - DNA, 20 bp, Artificial Sequence
  Synthetic oligonucleotide; AGG chr2 60494360 60494379 60494376 +
ttgcccctctgtaaacaagg

SEQ ID NO: 162320 - DNA, 20 bp, Artificial Sequence
  Synthetic oligonucleotide; AAG chr2 60494420 60494439 60494436 +
aatcttatgcaatttttgcc

SEQ ID NO: 162321 - DNA, 20 bp, Artificial Sequence
  Synthetic oligonucleotide; TGG chr2 60494424 60494443 60494440 +
ttatgcaatttttgccaaga

SEQ ID NO: 162322 - DNA, 20 bp, Artificial Sequence
  Synthetic oligonucleotide; GGG chr2 60494425 60494444 60494441 +
tatgcaatttttgccaagat

SEQ ID NO: 162323 - DNA, 20 bp, Artificial Sequence
  Synthetic oligonucleotide; GAG chr2 60494427 60494446 60494443 +
tgcaatttttgccaagatgg

SEQ ID NO: 162324 - DNA, 20 bp, Artificial Sequence
  Synthetic oligonucleotide; TGG chr2 60494432 60494451 60494448 +
tttttgccaagatgggagta

SEQ ID NO: 162325 - DNA, 20 bp, Artificial Sequence
  Synthetic oligonucleotide; GGG chr2 60494433 60494452 60494449 +
ttttgccaagatgggagtat

SEQ ID NO: 162326 - DNA, 20 bp, Artificial Sequence
  Synthetic oligonucleotide; GGG chr2 60494434 60494453 60494450 +
tttgccaagatgggagtatg

SEQ ID NO: 162327 - DNA, 20 bp, Artificial Sequence
  Synthetic oligonucleotide; GAG chr2 60494436 60494455 60494452 +
tgccaagatgggagtatggg

SEQ ID NO: 162328 - DNA, 20 bp, Artificial Sequence
  Synthetic oligonucleotide; GAG chr2 60494438 60494457 60494454 +
ccaagatgggagtatgggga

SEQ ID NO: 162329 - DNA, 20 bp, Artificial Sequence
  Synthetic oligonucleotide; AAG chr2 60494441 60494460 60494457 +
agatgggagtatggggagag

SEQ ID NO: 162330 - DNA, 20 bp, Artificial Sequence
  Synthetic oligonucleotide; GAG chr2 60494443 60494462 60494459 +
atgggagtatggggagagaa

SEQ ID NO: 162331 - DNA, 20 bp, Artificial Sequence
  Synthetic oligonucleotide; TGG chr2 60494446 60494465 60494462 +
ggagtatggggagagaagag

SEQ ID NO: 162332 - DNA, 20 bp, Artificial Sequence
  Synthetic oligonucleotide; CGG chr2 60494452 60494471 60494468 +
tggggagagaagagtggaaa

SEQ ID NO: 162333 - DNA, 20 bp, Artificial Sequence
  Synthetic oligonucleotide; CAG chr2 60494457 60494476 60494473 +
agagaagagtggaaacggcc

SEQ ID NO: 162334 - DNA, 20 bp, Artificial Sequence
  Synthetic oligonucleotide; GAG chr2 60494459 60494478 60494475 +
agaagagtggaaacggccca

SEQ ID NO: 162335 - DNA, 20 bp, Artificial Sequence
  Synthetic oligonucleotide; CAG chr2 60494464 60494483 60494480 +
agtggaaacggcccagagct

SEQ ID NO: 162336 - DNA, 20 bp, Artificial Sequence
  Synthetic oligonucleotide; GAG chr2 60494468 60494487 60494484 +
gaaacggcccagagctcagt

SEQ ID NO: 162337 - DNA, 20 bp, Artificial Sequence
  Synthetic oligonucleotide; GAG chr2 60494473 60494492 60494489 +
ggcccagagctcagtgagat

SEQ ID NO: 162338 - DNA, 20 bp, Artificial Sequence
  Synthetic oligonucleotide; AAG chr2 60494482 60494501 60494498 +
ctcagtgagatgagatatca

SEQ ID NO: 162339 - DNA, 20 bp, Artificial Sequence
  Synthetic oligonucleotide; AGG chr2 60494483 60494502 60494499 +
tcagtgagatgagatatcaa

SEQ ID NO: 162340 - DNA, 20 bp, Artificial Sequence
  Synthetic oligonucleotide; GGG chr2 60494484 60494503 60494500 +
cagtgagatgagatatcaaa

SEQ ID NO: 162341 - DNA, 20 bp, Artificial Sequence
  Synthetic oligonucleotide; GGG chr2 60494485 60494504 60494501 +
agtgagatgagatatcaaag

SEQ ID NO: 162342 - DNA, 20 bp, Artificial Sequence
  Synthetic oligonucleotide; AAG chr2 60494493 60494512 60494509 +
gagatatcaaaggggacgaa

SEQ ID NO: 162343 - DNA, 20 bp, Artificial Sequence
  Synthetic oligonucleotide; TGG chr2 60494524 60494543 60494540 +
ccatctccctaatctccaat

SEQ ID NO: 162344 - DNA, 20 bp, Artificial Sequence
  Synthetic oligonucleotide; AAG chr2 60494529 60494548 60494545 +
tccctaatctccaattggca

SEQ ID NO: 162345 - DNA, 20 bp, Artificial Sequence
  Synthetic oligonucleotide; CAG chr2 60494533 60494552 60494549 +
taatctccaattggcaaagc

SEQ ID NO: 162346 - DNA, 20 bp, Artificial Sequence
  Synthetic oligonucleotide; TGG chr2 60494539 60494558 60494555 +
ccaattggcaaagccagact

SEQ ID NO: 162347 - DNA, 20 bp, Artificial Sequence
  Synthetic oligonucleotide; GGG chr2 60494540 60494559 60494556 +
caattggcaaagccagactt

SEQ ID NO: 162348 - DNA, 20 bp, Artificial Sequence
  Synthetic oligonucleotide; GGG chr2 60494541 60494560 60494557 +
aattggcaaagccagacttg

SEQ ID NO: 162349 - DNA, 20 bp, Artificial Sequence
  Synthetic oligonucleotide; CAG chr2 60494549 60494568 60494565 +
aagccagacttggggcaata

SEQ ID NO: 162350 - DNA, 20 bp, Artificial Sequence
  Synthetic oligonucleotide; TGG chr2 60494554 60494573 60494570 +
agacttggggcaatacagac

SEQ ID NO: 162351 - DNA, 20 bp, Artificial Sequence
  Synthetic oligonucleotide; TAG chr2 60494579 60494598 60494595 +
ctgtgatgacaaataactcc

SEQ ID NO: 162352 - DNA, 20 bp, Artificial Sequence
  Synthetic oligonucleotide; CAG chr2 60494619 60494638 60494635 +
atcaccaaatgttctttctt

SEQ ID NO: 162353 - DNA, 20 bp, Artificial Sequence
  Synthetic oligonucleotide; TGG chr2 60494623 60494642 60494639 +
ccaaatgttctttcttcagc

SEQ ID NO: 162354 - DNA, 20 bp, Artificial Sequence
  Synthetic oligonucleotide; TGG chr2 60494637 60494656 60494653 +
ttcagctggaatttaaaata

SEQ ID NO: 162355 - DNA, 20 bp, Artificial Sequence
  Synthetic oligonucleotide; TAG chr2 60494654 60494673 60494670 +
atatggactcatccgtaaaa

SEQ ID NO: 162356 - DNA, 20 bp, Artificial Sequence
  Synthetic oligonucleotide; AGG chr2 60494655 60494674 60494671 +
tatggactcatccgtaaaat

SEQ ID NO: 162357 - DNA, 20 bp, Artificial Sequence
  Synthetic oligonucleotide; TAG chr2 60494666 60494685 60494682 +
ccgtaaaataggaataataa

SEQ ID NO: 162358 - DNA, 20 bp, Artificial Sequence
  Synthetic oligonucleotide; TAG chr2 60494680 60494699 60494696 +
taataatagtatatgcttca

SEQ ID NO: 162359 - DNA, 20 bp, Artificial Sequence
  Synthetic oligonucleotide; AGG chr2 60494681 60494700 60494697 +
aataatagtatatgcttcat

SEQ ID NO: 162360 - DNA, 20 bp, Artificial Sequence
  Synthetic oligonucleotide; GGG chr2 60494682 60494701 60494698 +
ataatagtatatgcttcata

SEQ ID NO: 162361 - DNA, 20 bp, Artificial Sequence
  Synthetic oligonucleotide; GAG chr2 60494703 60494722 60494719 +
ggtttgtatgaaaataaaat

SEQ ID NO: 162362 - DNA, 20 bp, Artificial Sequence
  Synthetic oligonucleotide; AAG chr2 60494718 60494737 60494734 +
aaaatgagtgcgtatttgta

SEQ ID NO: 162363 - DNA, 20 bp, Artificial Sequence
  Synthetic oligonucleotide; TAG chr2 60494725 60494744 60494741 +
gtgcgtatttgtaaagttcc

SEQ ID NO: 162364 - DNA, 20 bp, Artificial Sequence
  Synthetic oligonucleotide; GAG chr2 60494727 60494746 60494743 +
gcgtatttgtaaagttccta

SEQ ID NO: 162365 - DNA, 20 bp, Artificial Sequence
  Synthetic oligonucleotide; CAG chr2 60494730 60494749 60494746 +
tatttgtaaagttcctagag

SEQ ID NO: 162366 - DNA, 20 bp, Artificial Sequence
  Synthetic oligonucleotide; GAG chr2 60494732 60494751 60494748 +
tttgtaaagttcctagagca

SEQ ID NO: 162367 - DNA, 20 bp, Artificial Sequence
  Synthetic oligonucleotide; AAG chr2 60494736 60494755 60494752 +
taaagttcctagagcagagt

SEQ ID NO: 162368 - DNA, 20 bp, Artificial Sequence
  Synthetic oligonucleotide; GAG chr2 60494745 60494764 60494761 +
tagagcagagtaagtgctcc

SEQ ID NO: 162369 - DNA, 20 bp, Artificial Sequence
  Synthetic oligonucleotide; TGG chr2 60494772 60494791 60494788 +
tgaactaaaatgctgcctcc

SEQ ID NO: 162370 - DNA, 20 bp, Artificial Sequence
  Synthetic oligonucleotide; TAG chr2 60494782 60494801 60494798 +
tgctgcctcctggtatttat

SEQ ID NO: 162371 - DNA, 20 bp, Artificial Sequence
  Synthetic oligonucleotide; CAG chr2 60494793 60494812 60494809 +
ggtatttattagttacacct

SEQ ID NO: 162372 - DNA, 20 bp, Artificial Sequence
  Synthetic oligonucleotide; CAG chr2 60494796 60494815 60494812 +
atttattagttacacctcag

SEQ ID NO: 162373 - DNA, 20 bp, Artificial Sequence
  Synthetic oligonucleotide; AAG chr2 60494804 60494823 60494820 +
gttacacctcagcagaaaca

SEQ ID NO: 162374 - DNA, 20 bp, Artificial Sequence
  Synthetic oligonucleotide; CAG chr2 60494811 60494830 60494827 +
ctcagcagaaacaaagttat

SEQ ID NO: 162375 - DNA, 20 bp, Artificial Sequence
  Synthetic oligonucleotide; AGG chr2 60494812 60494831 60494828 +
tcagcagaaacaaagttatc

SEQ ID NO: 162376 - DNA, 20 bp, Artificial Sequence
  Synthetic oligonucleotide; TAG chr2 60494831 60494850 60494847 +
caggccctttccccaattcc

SEQ ID NO: 162377 - DNA, 20 bp, Artificial Sequence
  Synthetic oligonucleotide; TGG chr2 60494836 60494855 60494852 +
cctttccccaattcctagtt

SEQ ID NO: 162378 - DNA, 20 bp, Artificial Sequence
  Synthetic oligonucleotide; GGG chr2 60494837 60494856 60494853 +
ctttccccaattcctagttt

SEQ ID NO: 162379 - DNA, 20 bp, Artificial Sequence
  Synthetic oligonucleotide; CAG chr2 60494841 60494860 60494857 +
ccccaattcctagtttgggt

SEQ ID NO: 162380 - DNA, 20 bp, Artificial Sequence
  Synthetic oligonucleotide; AAG chr2 60494844 60494863 60494860 +
caattcctagtttgggtcag

SEQ ID NO: 162381 - DNA, 20 bp, Artificial Sequence
  Synthetic oligonucleotide; AAG chr2 60494849 60494868 60494865 +
cctagtttgggtcagaagaa

SEQ ID NO: 162382 - DNA, 20 bp, Artificial Sequence
  Synthetic oligonucleotide; AGG chr2 60494850 60494869 60494866 +
ctagtttgggtcagaagaaa

SEQ ID NO: 162383 - DNA, 20 bp, Artificial Sequence
  Synthetic oligonucleotide; GGG chr2 60494851 60494870 60494867 +
tagtttgggtcagaagaaaa

SEQ ID NO: 162384 - DNA, 20 bp, Artificial Sequence
  Synthetic oligonucleotide; AAG chr2 60494856 60494875 60494872 +
tgggtcagaagaaaagggaa

SEQ ID NO: 162385 - DNA, 20 bp, Artificial Sequence
  Synthetic oligonucleotide; AGG chr2 60494857 60494876 60494873 +
gggtcagaagaaaagggaaa

SEQ ID NO: 162386 - DNA, 20 bp, Artificial Sequence
  Synthetic oligonucleotide; GGG chr2 60494858 60494877 60494874 +
ggtcagaagaaaagggaaaa

SEQ ID NO: 162387 - DNA, 20 bp, Artificial Sequence
  Synthetic oligonucleotide; GAG chr2 60494860 60494879 60494876 +
tcagaagaaaagggaaaagg

SEQ ID NO: 162388 - DNA, 20 bp, Artificial Sequence
  Synthetic oligonucleotide; GAG chr2 60494862 60494881 60494878 +
agaagaaaagggaaaaggga

SEQ ID NO: 162389 - DNA, 20 bp, Artificial Sequence
  Synthetic oligonucleotide; AGG chr2 60494863 60494882 60494879 +
gaagaaaagggaaaagggag

SEQ ID NO: 162390 - DNA, 20 bp, Artificial Sequence
  Synthetic oligonucleotide; AAG chr2 60494869 60494888 60494885 +
aagggaaaagggagaggaaa

SEQ ID NO: 162391 - DNA, 20 bp, Artificial Sequence
  Synthetic oligonucleotide; AGG chr2 60494870 60494889 60494886 +
agggaaaagggagaggaaaa

SEQ ID NO: 162392 - DNA, 20 bp, Artificial Sequence
  Synthetic oligonucleotide; AAG chr2 60494875 60494894 60494891 +
aaagggagaggaaaaaggaa

SEQ ID NO: 162393 - DNA, 20 bp, Artificial Sequence
  Synthetic oligonucleotide; CAG chr2 60494888 60494907 60494904 +
aaaggaaaagaatatgacgt

SEQ ID NO: 162394 - DNA, 20 bp, Artificial Sequence
  Synthetic oligonucleotide; AGG chr2 60494889 60494908 60494905 +
aaggaaaagaatatgacgtc

SEQ ID NO: 162395 - DNA, 20 bp, Artificial Sequence
  Synthetic oligonucleotide; GGG chr2 60494890 60494909 60494906 +
aggaaaagaatatgacgtca

SEQ ID NO: 162396 - DNA, 20 bp, Artificial Sequence
  Synthetic oligonucleotide; GGG chr2 60494891 60494910 60494907 +
ggaaaagaatatgacgtcag

SEQ ID NO: 162397 - DNA, 20 bp, Artificial Sequence
  Synthetic oligonucleotide; GGG chr2 60494892 60494911 60494908 +
gaaaagaatatgacgtcagg

SEQ ID NO: 162398 - DNA, 20 bp, Artificial Sequence
  Synthetic oligonucleotide; GAG chr2 60494894 60494913 60494910 +
aaagaatatgacgtcagggg

SEQ ID NO: 162399 - DNA, 20 bp, Artificial Sequence
  Synthetic oligonucleotide; AGG chr2 60494895 60494914 60494911 +
aagaatatgacgtcaggggg

SEQ ID NO: 162400 - DNA, 20 bp, Artificial Sequence
  Synthetic oligonucleotide; AAG chr2 60494899 60494918 60494915 +
atatgacgtcagggggaggc

SEQ ID NO: 162401 - DNA, 20 bp, Artificial Sequence
  Synthetic oligonucleotide; CAG chr2 60494903 60494922 60494919 +
gacgtcagggggaggcaagt

SEQ ID NO: 162402 - DNA, 20 bp, Artificial Sequence
  Synthetic oligonucleotide; TGG chr2 60494907 60494926 60494923 +
tcagggggaggcaagtcagt

SEQ ID NO: 162403 - DNA, 20 bp, Artificial Sequence
  Synthetic oligonucleotide; GGG chr2 60494908 60494927 60494924 +
cagggggaggcaagtcagtt

SEQ ID NO: 162404 - DNA, 20 bp, Artificial Sequence
  Synthetic oligonucleotide; CAG chr2 60494915 60494934 60494931 +
aggcaagtcagttgggaaca

SEQ ID NO: 162405 - DNA, 20 bp, Artificial Sequence
  Synthetic oligonucleotide; CAG chr2 60494927 60494946 60494943 +
tgggaacacagatcctaaca

SEQ ID NO: 162406 - DNA, 20 bp, Artificial Sequence
  Synthetic oligonucleotide; TAG chr2 60494930 60494949 60494946 +
gaacacagatcctaacacag

SEQ ID NO: 162407 - DNA, 20 bp, Artificial Sequence
  Synthetic oligonucleotide; TGG chr2 60494934 60494953 60494950 +
acagatcctaacacagtagc

SEQ ID NO: 162408 - DNA, 20 bp, Artificial Sequence
  Synthetic oligonucleotide; TAG chr2 60494944 60494963 60494960 +
acacagtagctggtacctga

SEQ ID NO: 162409 - DNA, 20 bp, Artificial Sequence
  Synthetic oligonucleotide; AGG chr2 60494945 60494964 60494961 +
cacagtagctggtacctgat

SEQ ID NO: 162410 - DNA, 20 bp, Artificial Sequence
  Synthetic oligonucleotide; TGG chr2 60494961 60494980 60494977 +
tgataggtgcctatatgtga

SEQ ID NO: 162411 - DNA, 20 bp, Artificial Sequence
  Synthetic oligonucleotide; TGG chr2 60494965 60494984 60494981 +
aggtgcctatatgtgatgga

SEQ ID NO: 162412 - DNA, 20 bp, Artificial Sequence
  Synthetic oligonucleotide; GGG chr2 60494966 60494985 60494982 +
ggtgcctatatgtgatggat

SEQ ID NO: 162413 - DNA, 20 bp, Artificial Sequence
  Synthetic oligonucleotide; TGG chr2 60494969 60494988 60494985 +
gcctatatgtgatggatggg

SEQ ID NO: 162414 - DNA, 20 bp, Artificial Sequence
  Synthetic oligonucleotide; CAG chr2 60494973 60494992 60494989 +
atatgtgatggatgggtgga

SEQ ID NO: 162415 - DNA, 20 bp, Artificial Sequence
  Synthetic oligonucleotide; CAG chr2 60494981 60495000 60494997 +
tggatgggtggacagcccga

SEQ ID NO: 162416 - DNA, 20 bp, Artificial Sequence
  Synthetic oligonucleotide; TGG chr2 60494992 60495011 60495008 +
acagcccgacagatgaaaaa

SEQ ID NO: 162417 - DNA, 20 bp, Artificial Sequence
  Synthetic oligonucleotide; GAG chr2 60495003 60495022 60495019 +
gatgaaaaatggacaattat

SEQ ID NO: 162418 - DNA, 20 bp, Artificial Sequence
  Synthetic oligonucleotide; AGG chr2 60495004 60495023 60495020 +
atgaaaaatggacaattatg

SEQ ID NO: 162419 - DNA, 20 bp, Artificial Sequence
  Synthetic oligonucleotide; GAG chr2 60495006 60495025 60495022 +
gaaaaatggacaattatgag

SEQ ID NO: 162420 - DNA, 20 bp, Artificial Sequence
  Synthetic oligonucleotide; AGG chr2 60495007 60495026 60495023 +
aaaaatggacaattatgagg

SEQ ID NO: 162421 - DNA, 20 bp, Artificial Sequence
  Synthetic oligonucleotide; GGG chr2 60495008 60495027 60495024 +
aaaatggacaattatgagga

SEQ ID NO: 162422 - DNA, 20 bp, Artificial Sequence
  Synthetic oligonucleotide; GGG chr2 60495009 60495028 60495025 +
aaatggacaattatgaggag

SEQ ID NO: 162423 - DNA, 20 bp, Artificial Sequence
  Synthetic oligonucleotide; GAG chr2 60495011 60495030 60495027 +
atggacaattatgaggaggg

SEQ ID NO: 162424 - DNA, 20 bp, Artificial Sequence
  Synthetic oligonucleotide; GAG chr2 60495013 60495032 60495029 +
ggacaattatgaggagggga

SEQ ID NO: 162425 - DNA, 20 bp, Artificial Sequence
  Synthetic oligonucleotide; CAG chr2 60495018 60495037 60495034 +
attatgaggaggggagagtg

SEQ ID NO: 162426 - DNA, 20 bp, Artificial Sequence
  Synthetic oligonucleotide; CAG chr2 60495022 60495041 60495038 +
tgaggaggggagagtgcaga

SEQ ID NO: 162427 - DNA, 20 bp, Artificial Sequence
  Synthetic oligonucleotide; AGG chr2 60495023 60495042 60495039 +
gaggaggggagagtgcagac

SEQ ID NO: 162428 - DNA, 20 bp, Artificial Sequence
  Synthetic oligonucleotide; GGG chr2 60495024 60495043 60495040 +
aggaggggagagtgcagaca

SEQ ID NO: 162429 - DNA, 20 bp, Artificial Sequence
  Synthetic oligonucleotide; GGG chr2 60495025 60495044 60495041 +
ggaggggagagtgcagacag

SEQ ID NO: 162430 - DNA, 20 bp, Artificial Sequence
  Synthetic oligonucleotide; AAG chr2 60495028 60495047 60495044 +
ggggagagtgcagacagggg

SEQ ID NO: 162431 - DNA, 20 bp, Artificial Sequence
  Synthetic oligonucleotide; TGG chr2 60495051 60495070 60495067 +
cttcacctcctttacaattt

SEQ ID NO: 162432 - DNA, 20 bp, Artificial Sequence
  Synthetic oligonucleotide; GGG chr2 60495052 60495071 60495068 +
ttcacctcctttacaatttt

SEQ ID NO: 162433 - DNA, 20 bp, Artificial Sequence
  Synthetic oligonucleotide; GAG chr2 60495054 60495073 60495070 +
cacctcctttacaattttgg

SEQ ID NO: 162434 - DNA, 20 bp, Artificial Sequence
  Synthetic oligonucleotide; CGG chr2 60495063 60495082 60495079 +
tacaattttgggagtccaca

SEQ ID NO: 162435 - DNA, 20 bp, Artificial Sequence
  Synthetic oligonucleotide; TGG chr2 60495068 60495087 60495084 +
ttttgggagtccacacggca

SEQ ID NO: 162436 - DNA, 20 bp, Artificial Sequence
  Synthetic oligonucleotide; GAG chr2 60495095 60495114 60495111 +
caaattatttcattcccatt

SEQ ID NO: 162437 - DNA, 20 bp, Artificial Sequence
  Synthetic oligonucleotide; AAG chr2 60495123 60495142 60495139 +
aaatccaattctccatcacc

SEQ ID NO: 162438 - DNA, 20 bp, Artificial Sequence
  Synthetic oligonucleotide; GAG chr2 60495125 60495144 60495141 +
atccaattctccatcaccaa

SEQ ID NO: 162439 - DNA, 20 bp, Artificial Sequence
  Synthetic oligonucleotide; GAG chr2 60495127 60495146 60495143 +
ccaattctccatcaccaaga

SEQ ID NO: 162440 - DNA, 20 bp, Artificial Sequence
  Synthetic oligonucleotide; AAG chr2 60495138 60495157 60495154 +
tcaccaagagagccttccga

SEQ ID NO: 162441 - DNA, 20 bp, Artificial Sequence
  Synthetic oligonucleotide; GAG chr2 60495140 60495159 60495156 +
accaagagagccttccgaaa

SEQ ID NO: 162442 - DNA, 20 bp, Artificial Sequence
  Synthetic oligonucleotide; AGG chr2 60495141 60495160 60495157 +
ccaagagagccttccgaaag

SEQ ID NO: 162443 - DNA, 20 bp, Artificial Sequence
  Synthetic oligonucleotide; TGG chr2 60495150 60495169 60495166 +
ccttccgaaagaggcccccc

SEQ ID NO: 162444 - DNA, 20 bp, Artificial Sequence
  Synthetic oligonucleotide; GGG chr2 60495151 60495170 60495167 +
cttccgaaagaggcccccct

SEQ ID NO: 162445 - DNA, 20 bp, Artificial Sequence
  Synthetic oligonucleotide; CGG chr2 60495158 60495177 60495174 +
aagaggcccccctgggcaaa

SEQ ID NO: 162446 - DNA, 20 bp, Artificial Sequence
  Synthetic oligonucleotide; TGG chr2 60495168 60495187 60495184 +
cctgggcaaacggccaccga

SEQ ID NO: 162447 - DNA, 20 bp, Artificial Sequence
  Synthetic oligonucleotide; GAG chr2 60495170 60495189 60495186 +
tgggcaaacggccaccgatg

SEQ ID NO: 162448 - DNA, 20 bp, Artificial Sequence
  Synthetic oligonucleotide; GAG chr2 60495172 60495191 60495188 +
ggcaaacggccaccgatgga

SEQ ID NO: 162449 - DNA, 20 bp, Artificial Sequence
  Synthetic oligonucleotide; AGG chr2 60495173 60495192 60495189 +
gcaaacggccaccgatggag

SEQ ID NO: 162450 - DNA, 20 bp, Artificial Sequence
  Synthetic oligonucleotide; CAG chr2 60495181 60495200 60495197 +
ccaccgatggagaggtctgc

SEQ ID NO: 162451 - DNA, 20 bp, Artificial Sequence
  Synthetic oligonucleotide; CAG chr2 60495218 60495237 60495234 +
acccacgcccccaccctaat

SEQ ID NO: 162452 - DNA, 20 bp, Artificial Sequence
  Synthetic oligonucleotide; GAG chr2 60495220 60495239 60495236 +
ccacgcccccaccctaatca

SEQ ID NO: 162453 - DNA, 20 bp, Artificial Sequence
  Synthetic oligonucleotide; AGG chr2 60495221 60495240 60495237 +
cacgcccccaccctaatcag

SEQ ID NO: 162454 - DNA, 20 bp, Artificial Sequence
  Synthetic oligonucleotide; TGG chr2 60495236 60495255 60495252 +
atcagaggccaaacccttcc

SEQ ID NO: 162455 - DNA, 20 bp, Artificial Sequence
  Synthetic oligonucleotide; GAG chr2 60495238 60495257 60495254 +
cagaggccaaacccttcctg

SEQ ID NO: 162456 - DNA, 20 bp, Artificial Sequence
  Synthetic oligonucleotide; AAG chr2 60495251 60495270 60495267 +
cttcctggagcctgtgataa

SEQ ID NO: 162457 - DNA, 20 bp, Artificial Sequence
  Synthetic oligonucleotide; TAG chr2 60495261 60495280 60495277 +
cctgtgataaaagcaactgt

SEQ ID NO: 162458 - DNA, 20 bp, Artificial Sequence
  Synthetic oligonucleotide; TAG chr2 60495271 60495290 60495287 +
aagcaactgttagcttgcac

SEQ ID NO: 162459 - DNA, 20 bp, Artificial Sequence
  Synthetic oligonucleotide; TAG chr2 60495276 60495295 60495292 +
actgttagcttgcactagac

SEQ ID NO: 162460 - DNA, 20 bp, Artificial Sequence
  Synthetic oligonucleotide; AAG chr2 60495284 60495303 60495300 +
cttgcactagactagcttca

SEQ ID NO: 162461 - DNA, 20 bp, Artificial Sequence
  Synthetic oligonucleotide; TGG chr2 60495299 60495318 60495315 +
cttcaaagttgtattgaccc

SEQ ID NO: 162462 - DNA, 20 bp, Artificial Sequence
  Synthetic oligonucleotide; AAG chr2 60495314 60495333 60495330 +
gaccctggtgtgttatgtct

SEQ ID NO: 162463 - DNA, 20 bp, Artificial Sequence
  Synthetic oligonucleotide; GAG chr2 60495316 60495335 60495332 +
ccctggtgtgttatgtctaa

SEQ ID NO: 162464 - DNA, 20 bp, Artificial Sequence
  Synthetic oligonucleotide; TAG chr2 60495319 60495338 60495335 +
tggtgtgttatgtctaagag

SEQ ID NO: 162465 - DNA, 20 bp, Artificial Sequence
  Synthetic oligonucleotide; TGG chr2 60495339 60495358 60495355 +
tagatgccatatctcttttc

SEQ ID NO: 162466 - DNA, 20 bp, Artificial Sequence
  Synthetic oligonucleotide; TGG chr2 60495360 60495379 60495376 +
ggcctatgttattacctgta

SEQ ID NO: 162467 - DNA, 20 bp, Artificial Sequence
  Synthetic oligonucleotide; TGG chr2 60495372 60495391 60495388 +
tacctgtatggactttgcac

SEQ ID NO: 162468 - DNA, 20 bp, Artificial Sequence
  Synthetic oligonucleotide; CAG chr2 60495378 60495397 60495394 +
tatggactttgcactggaat

SEQ ID NO: 162469 - DNA, 20 bp, Artificial Sequence
  Synthetic oligonucleotide; TGG chr2 60495406 60495425 60495422 +
tgctcttacttatgcacacc

SEQ ID NO: 162470 - DNA, 20 bp, Artificial Sequence
  Synthetic oligonucleotide; GGG chr2 60495407 60495426 60495423 +
gctcttacttatgcacacct

SEQ ID NO: 162471 - DNA, 20 bp, Artificial Sequence
  Synthetic oligonucleotide; GGG chr2 60495408 60495427 60495424 +
ctcttacttatgcacacctg

SEQ ID NO: 162472 - DNA, 20 bp, Artificial Sequence
  Synthetic oligonucleotide; TAG chr2 60495413 60495432 60495429 +
acttatgcacacctggggca

SEQ ID NO: 162473 - DNA, 20 bp, Artificial Sequence
  Synthetic oligonucleotide; GAG chr2 60495415 60495434 60495431 +
ttatgcacacctggggcata

SEQ ID NO: 162474 - DNA, 20 bp, Artificial Sequence
  Synthetic oligonucleotide; CAG chr2 60495419 60495438 60495435 +
gcacacctggggcatagagc

SEQ ID NO: 162475 - DNA, 20 bp, Artificial Sequence
  Synthetic oligonucleotide; CAG chr2 60495437 60495456 60495453 +
gccagccctgtatcgctttt

SEQ ID NO: 162476 - DNA, 20 bp, Artificial Sequence
  Synthetic oligonucleotide; CAG chr2 60495451 60495470 60495467 +
gcttttcagccatctcacta

SEQ ID NO: 162477 - DNA, 20 bp, Artificial Sequence
  Synthetic oligonucleotide; AAG chr2 60495463 60495482 60495479 +
tctcactacagataactccc

SEQ ID NO: 162478 - DNA, 20 bp, Artificial Sequence
  Synthetic oligonucleotide; TAG chr2 60495473 60495492 60495489 +
gataactcccaagtcctgtc

SEQ ID NO: 162479 - DNA, 20 bp, Artificial Sequence
  Synthetic oligonucleotide; CAG chr2 60495491 60495510 60495507 +
tctagctgccttccttatca

SEQ ID NO: 162480 - DNA, 20 bp, Artificial Sequence
  Synthetic oligonucleotide; AGG chr2 60495492 60495511 60495508 +
ctagctgccttccttatcac

SEQ ID NO: 162481 - DNA, 20 bp, Artificial Sequence
  Synthetic oligonucleotide; TAG chr2 60495497 60495516 60495513 +
tgccttccttatcacaggaa

SEQ ID NO: 162482 - DNA, 20 bp, Artificial Sequence
  Synthetic oligonucleotide; AAG chr2 60495505 60495524 60495521 +
ttatcacaggaatagcaccc

SEQ ID NO: 162483 - DNA, 20 bp, Artificial Sequence
  Synthetic oligonucleotide; AGG chr2 60495506 60495525 60495522 +
tatcacaggaatagcaccca

SEQ ID NO: 162484 - DNA, 20 bp, Artificial Sequence
  Synthetic oligonucleotide; CAG chr2 60495514 60495533 60495530 +
gaatagcacccaaggtccat

SEQ ID NO: 162485 - DNA, 20 bp, Artificial Sequence
  Synthetic oligonucleotide; CAG chr2 60495522 60495541 60495538 +
cccaaggtccatcagtacct

SEQ ID NO: 162486 - DNA, 20 bp, Artificial Sequence
  Synthetic oligonucleotide; GAG chr2 60495524 60495543 60495540 +
caaggtccatcagtacctca

SEQ ID NO: 162487 - DNA, 20 bp, Artificial Sequence
  Synthetic oligonucleotide; TAG chr2 60495527 60495546 60495543 +
ggtccatcagtacctcagag

SEQ ID NO: 162488 - DNA, 20 bp, Artificial Sequence
  Synthetic oligonucleotide; TAG chr2 60495544 60495563 60495560 +
gagtagaaccccctataaac

SEQ ID NO: 162489 - DNA, 20 bp, Artificial Sequence
  Synthetic oligonucleotide; TGG chr2 60495549 60495568 60495565 +
gaaccccctataaactagtc

SEQ ID NO: 162490 - DNA, 20 bp, Artificial Sequence
  Synthetic oligonucleotide; TGG chr2 60495560 60495579 60495576 +
aaactagtctggtttgccca

SEQ ID NO: 162491 - DNA, 20 bp, Artificial Sequence
  Synthetic oligonucleotide; GGG chr2 60495561 60495580 60495577 +
aactagtctggtttgcccat

SEQ ID NO: 162492 - DNA, 20 bp, Artificial Sequence
  Synthetic oligonucleotide; GGG chr2 60495562 60495581 60495578 +
actagtctggtttgcccatg

SEQ ID NO: 162493 - DNA, 20 bp, Artificial Sequence
  Synthetic oligonucleotide; CAG chr2 60495567 60495586 60495583 +
tctggtttgcccatggggca

SEQ ID NO: 162494 - DNA, 20 bp, Artificial Sequence
  Synthetic oligonucleotide; CAG chr2 60495571 60495590 60495587 +
gtttgcccatggggcacagt

SEQ ID NO: 162495 - DNA, 20 bp, Artificial Sequence
  Synthetic oligonucleotide; AGG chr2 60495572 60495591 60495588 +
tttgcccatggggcacagtc

SEQ ID NO: 162496 - DNA, 20 bp, Artificial Sequence
  Synthetic oligonucleotide; CAG chr2 60495583 60495602 60495599 +
ggcacagtcaggctgttttc

SEQ ID NO: 162497 - DNA, 20 bp, Artificial Sequence
  Synthetic oligonucleotide; AGG chr2 60495584 60495603 60495600 +
gcacagtcaggctgttttcc

SEQ ID NO: 162498 - DNA, 20 bp, Artificial Sequence
  Synthetic oligonucleotide; GGG chr2 60495585 60495604 60495601 +
cacagtcaggctgttttcca

SEQ ID NO: 162499 - DNA, 20 bp, Artificial Sequence
  Synthetic oligonucleotide; TGG chr2 60495588 60495607 60495604 +
agtcaggctgttttccaggg

SEQ ID NO: 162500 - DNA, 20 bp, Artificial Sequence
  Synthetic oligonucleotide; GGG chr2 60495589 60495608 60495605 +
gtcaggctgttttccagggt

SEQ ID NO: 162501 - DNA, 20 bp, Artificial Sequence
  Synthetic oligonucleotide; GGG chr2 60495590 60495609 60495606 +
tcaggctgttttccagggtg

SEQ ID NO: 162502 - DNA, 20 bp, Artificial Sequence
  Synthetic oligonucleotide; CAG chr2 60495595 60495614 60495611 +
ctgttttccagggtggggtg

SEQ ID NO: 162503 - DNA, 20 bp, Artificial Sequence
  Synthetic oligonucleotide; CAG chr2 60495639 60495658 60495655 +
gcttacatataacgtcataa

SEQ ID NO: 162504 - DNA, 20 bp, Artificial Sequence
  Synthetic oligonucleotide; TGG chr2 60495667 60495686 60495683 +
cgtatgtgttgtgatccctg

SEQ ID NO: 162505 - DNA, 20 bp, Artificial Sequence
  Synthetic oligonucleotide; GAG chr2 60495673 60495692 60495689 +
tgttgtgatccctgtggttt

SEQ ID NO: 162506 - DNA, 20 bp, Artificial Sequence
  Synthetic oligonucleotide; GAG chr2 60495675 60495694 60495691 +
ttgtgatccctgtggtttga

SEQ ID NO: 162507 - DNA, 20 bp, Artificial Sequence
  Synthetic oligonucleotide; TGG chr2 60495680 60495699 60495696 +
atccctgtggtttgagagtt

SEQ ID NO: 162508 - DNA, 20 bp, Artificial Sequence
  Synthetic oligonucleotide; GAG chr2 60495682 60495701 60495698 +
ccctgtggtttgagagtttg

SEQ ID NO: 162509 - DNA, 20 bp, Artificial Sequence
  Synthetic oligonucleotide; AAG chr2 60495694 60495713 60495710 +
agagtttggagcttccctaa

SEQ ID NO: 162510 - DNA, 20 bp, Artificial Sequence
  Synthetic oligonucleotide; TGG chr2 60495712 60495731 60495728 +
aaaagtcaaaatattctcaa

SEQ ID NO: 162511 - DNA, 20 bp, Artificial Sequence
  Synthetic oligonucleotide; GGG chr2 60495713 60495732 60495729 +
aaagtcaaaatattctcaat

SEQ ID NO: 162512 - DNA, 20 bp, Artificial Sequence
  Synthetic oligonucleotide; CAG chr2 60495724 60495743 60495740 +
attctcaatgggccctcaat

SEQ ID NO: 162513 - DNA, 20 bp, Artificial Sequence
  Synthetic oligonucleotide; AAG chr2 60495740 60495759 60495756 +
caatcagcacatacacacaa

SEQ ID NO: 162514 - DNA, 20 bp, Artificial Sequence
  Synthetic oligonucleotide; AGG chr2 60495741 60495760 60495757 +
aatcagcacatacacacaaa

SEQ ID NO: 162515 - DNA, 20 bp, Artificial Sequence
  Synthetic oligonucleotide; TGG chr2 60495748 60495767 60495764 +
acatacacacaaaaggtacc

SEQ ID NO: 162516 - DNA, 20 bp, Artificial Sequence
  Synthetic oligonucleotide; AAG chr2 60495776 60495795 60495792 +
tgtaattcttttcctgctca

SEQ ID NO: 162517 - DNA, 20 bp, Artificial Sequence
  Synthetic oligonucleotide; CAG chr2 60495780 60495799 60495796 +
attcttttcctgctcaaaga

SEQ ID NO: 162518 - DNA, 20 bp, Artificial Sequence
  Synthetic oligonucleotide; AGG chr2 60495781 60495800 60495797 +
ttcttttcctgctcaaagac

SEQ ID NO: 162519 - DNA, 20 bp, Artificial Sequence
  Synthetic oligonucleotide; TGG chr2 60495826 60495845 60495842 +
accaaaaacccttgccacca

SEQ ID NO: 162520 - DNA, 20 bp, Artificial Sequence
  Synthetic oligonucleotide; GGG chr2 60495827 60495846 60495843 +
ccaaaaacccttgccaccat

SEQ ID NO: 162521 - DNA, 20 bp, Artificial Sequence
  Synthetic oligonucleotide; GAG chr2 60495829 60495848 60495845 +
aaaaacccttgccaccatgg

SEQ ID NO: 162522 - DNA, 20 bp, Artificial Sequence
  Synthetic oligonucleotide; TGG chr2 60495834 60495853 60495850 +
cccttgccaccatgggagcc

SEQ ID NO: 162523 - DNA, 20 bp, Artificial Sequence
  Synthetic oligonucleotide; GGG chr2 60495835 60495854 60495851 +
ccttgccaccatgggagcct

SEQ ID NO: 162524 - DNA, 20 bp, Artificial Sequence
  Synthetic oligonucleotide; GGG chr2 60495836 60495855 60495852 +
cttgccaccatgggagcctg

SEQ ID NO: 162525 - DNA, 20 bp, Artificial Sequence
  Synthetic oligonucleotide; CAG chr2 60495839 60495858 60495855 +
gccaccatgggagcctgggg

SEQ ID NO: 162526 - DNA, 20 bp, Artificial Sequence
  Synthetic oligonucleotide; GAG chr2 60495841 60495860 60495857 +
caccatgggagcctggggca

SEQ ID NO: 162527 - DNA, 20 bp, Artificial Sequence
  Synthetic oligonucleotide; AAG chr2 60495844 60495863 60495860 +
catgggagcctggggcagag

SEQ ID NO: 162528 - DNA, 20 bp, Artificial Sequence
  Synthetic oligonucleotide; AGG chr2 60495845 60495864 60495861 +
atgggagcctggggcagaga

SEQ ID NO: 162529 - DNA, 20 bp, Artificial Sequence
  Synthetic oligonucleotide; CAG chr2 60495850 60495869 60495866 +
agcctggggcagagaaggca

SEQ ID NO: 162530 - DNA, 20 bp, Artificial Sequence
  Synthetic oligonucleotide; AAG chr2 60495855 60495874 60495871 +
ggggcagagaaggcacagtg

SEQ ID NO: 162531 - DNA, 20 bp, Artificial Sequence
  Synthetic oligonucleotide; CAG chr2 60495872 60495891 60495888 +
gtgaagtcaaactgtaattc

SEQ ID NO: 162532 - DNA, 20 bp, Artificial Sequence
  Synthetic oligonucleotide; AGG chr2 60495873 60495892 60495889 +
tgaagtcaaactgtaattcc

SEQ ID NO: 162533 - DNA, 20 bp, Artificial Sequence
  Synthetic oligonucleotide; TGG chr2 60495883 60495902 60495899 +
ctgtaattccaggctctaaa

SEQ ID NO: 162534 - DNA, 20 bp, Artificial Sequence
  Synthetic oligonucleotide; GAG chr2 60495901 60495920 60495917 +
aatggtgctgtcatttttct

SEQ ID NO: 162535 - DNA, 20 bp, Artificial Sequence
  Synthetic oligonucleotide; GAG chr2 60495903 60495922 60495919 +
tggtgctgtcatttttctga

SEQ ID NO: 162536 - DNA, 20 bp, Artificial Sequence
  Synthetic oligonucleotide; AAG chr2 60495918 60495937 60495934 +
tctgagagtctctaaattac

SEQ ID NO: 162537 - DNA, 20 bp, Artificial Sequence
  Synthetic oligonucleotide; AGG chr2 60495919 60495938 60495935 +
ctgagagtctctaaattaca

SEQ ID NO: 162538 - DNA, 20 bp, Artificial Sequence
  Synthetic oligonucleotide; GGG chr2 60495920 60495939 60495936 +
tgagagtctctaaattacaa

SEQ ID NO: 162539 - DNA, 20 bp, Artificial Sequence
  Synthetic oligonucleotide; TAG chr2 60495938 60495957 60495954 +
aagggtgttttcactattct

SEQ ID NO: 162540 - DNA, 20 bp, Artificial Sequence
  Synthetic oligonucleotide; AAG chr2 60495959 60495978 60495975 +
agctattttttaaaacacct

SEQ ID NO: 162541 - DNA, 20 bp, Artificial Sequence
  Synthetic oligonucleotide; CAG chr2 60495972 60495991 60495988 +
aacacctaagaaacatactg

SEQ ID NO: 162542 - DNA, 20 bp, Artificial Sequence
  Synthetic oligonucleotide; TGG chr2 60495978 60495997 60495994 +
taagaaacatactgcagctc

SEQ ID NO: 162543 - DNA, 20 bp, Artificial Sequence
  Synthetic oligonucleotide; AAG chr2 60495983 60496002 60495999 +
aacatactgcagctctggaa

SEQ ID NO: 162544 - DNA, 20 bp, Artificial Sequence
  Synthetic oligonucleotide; GAG chr2 60495985 60496004 60496001 +
catactgcagctctggaaaa

SEQ ID NO: 162545 - DNA, 20 bp, Artificial Sequence
  Synthetic oligonucleotide; AAG chr2 60496001 60496020 60496017 +
aaaagagaacaaacaaacca

SEQ ID NO: 162546 - DNA, 20 bp, Artificial Sequence
  Synthetic oligonucleotide; GAG chr2 60496003 60496022 60496019 +
aagagaacaaacaaaccaaa

SEQ ID NO: 162547 - DNA, 20 bp, Artificial Sequence
  Synthetic oligonucleotide; AAG chr2 60496006 60496025 60496022 +
agaacaaacaaaccaaagag

SEQ ID NO: 162548 - DNA, 20 bp, Artificial Sequence
  Synthetic oligonucleotide; AGG chr2 60496007 60496026 60496023 +
gaacaaacaaaccaaagaga

SEQ ID NO: 162549 - DNA, 20 bp, Artificial Sequence
  Synthetic oligonucleotide; GGG chr2 60496008 60496027 60496024 +
aacaaacaaaccaaagagaa

SEQ ID NO: 162550 - DNA, 20 bp, Artificial Sequence
  Synthetic oligonucleotide; CAG chr2 60496014 60496033 60496030 +
caaaccaaagagaagggatc

SEQ ID NO: 162551 - DNA, 20 bp, Artificial Sequence
  Synthetic oligonucleotide; GAG chr2 60496016 60496035 60496032 +
aaccaaagagaagggatcca

SEQ ID NO: 162552 - DNA, 20 bp, Artificial Sequence
  Synthetic oligonucleotide; AGG chr2 60496017 60496036 60496033 +
accaaagagaagggatccag

SEQ ID NO: 162553 - DNA, 20 bp, Artificial Sequence
  Synthetic oligonucleotide; AAG chr2 60496037 60496056 60496053 +
aggtcaccctcatatgtgaa

SEQ ID NO: 162554 - DNA, 20 bp, Artificial Sequence
  Synthetic oligonucleotide; AAG chr2 60496053 60496072 60496069 +
tgaaaagtcaattgataatg

SEQ ID NO: 162555 - DNA, 20 bp, Artificial Sequence
  Synthetic oligonucleotide; AGG chr2 60496054 60496073 60496070 +
gaaaagtcaattgataatga

SEQ ID NO: 162556 - DNA, 20 bp, Artificial Sequence
  Synthetic oligonucleotide; TAG chr2 60496060 60496079 60496076 +
tcaattgataatgaaggctt

SEQ ID NO: 162557 - DNA, 20 bp, Artificial Sequence
  Synthetic oligonucleotide; AGG chr2 60496061 60496080 60496077 +
caattgataatgaaggcttt

SEQ ID NO: 162558 - DNA, 20 bp, Artificial Sequence
  Synthetic oligonucleotide; CGG chr2 60496069 60496088 60496085 +
aatgaaggctttaggataac

SEQ ID NO: 162559 - DNA, 20 bp, Artificial Sequence
  Synthetic oligonucleotide; GAG chr2 60496071 60496090 60496087 +
tgaaggctttaggataaccg

SEQ ID NO: 162560 - DNA, 20 bp, Artificial Sequence
  Synthetic oligonucleotide; AGG chr2 60496072 60496091 60496088 +
gaaggctttaggataaccgg

SEQ ID NO: 162561 - DNA, 20 bp, Artificial Sequence
  Synthetic oligonucleotide; GGG chr2 60496073 60496092 60496089 +
aaggctttaggataaccgga

SEQ ID NO: 162562 - DNA, 20 bp, Artificial Sequence
  Synthetic oligonucleotide; GGG chr2 60496074 60496093 60496090 +
aggctttaggataaccggag

SEQ ID NO: 162563 - DNA, 20 bp, Artificial Sequence
  Synthetic oligonucleotide; GAG chr2 60496076 60496095 60496092 +
gctttaggataaccggaggg

SEQ ID NO: 162564 - DNA, 20 bp, Artificial Sequence
  Synthetic oligonucleotide; AAG chr2 60496087 60496106 60496103 +
accggaggggagatgattga

SEQ ID NO: 162565 - DNA, 20 bp, Artificial Sequence
  Synthetic oligonucleotide; CAG chr2 60496103 60496122 60496119 +
ttgaaagcaatgcacctgtg

SEQ ID NO: 162566 - DNA, 20 bp, Artificial Sequence
  Synthetic oligonucleotide; AGG chr2 60496104 60496123 60496120 +
tgaaagcaatgcacctgtgc

SEQ ID NO: 162567 - DNA, 20 bp, Artificial Sequence
  Synthetic oligonucleotide; TGG chr2 60496110 60496129 60496126 +
caatgcacctgtgcaggaaa

SEQ ID NO: 162568 - DNA, 20 bp, Artificial Sequence
  Synthetic oligonucleotide; CGG chr2 60496117 60496136 60496133 +
cctgtgcaggaaatggatta

SEQ ID NO: 162569 - DNA, 20 bp, Artificial Sequence
  Synthetic oligonucleotide; CAG chr2 60496123 60496142 60496139 +
caggaaatggattacggaaa

SEQ ID NO: 162570 - DNA, 20 bp, Artificial Sequence
  Synthetic oligonucleotide; AGG chr2 60496124 60496143 60496140 +
aggaaatggattacggaaac

SEQ ID NO: 162571 - DNA, 20 bp, Artificial Sequence
  Synthetic oligonucleotide; GGG chr2 60496125 60496144 60496141 +
ggaaatggattacggaaaca

SEQ ID NO: 162572 - DNA, 20 bp, Artificial Sequence
  Synthetic oligonucleotide; CAG chr2 60496145 60496164 60496161 +
gggaattgttcatgaaatcc

SEQ ID NO: 162573 - DNA, 20 bp, Artificial Sequence
  Synthetic oligonucleotide; CAG chr2 60496153 60496172 60496169 +
ttcatgaaatcccagaaaac

SEQ ID NO: 162574 - DNA, 20 bp, Artificial Sequence
  Synthetic oligonucleotide; CGG chr2 60496159 60496178 60496175 +
aaatcccagaaaaccagaac

SEQ ID NO: 162575 - DNA, 20 bp, Artificial Sequence
  Synthetic oligonucleotide; GGG chr2 60496160 60496179 60496176 +
aatcccagaaaaccagaacc

SEQ ID NO: 162576 - DNA, 20 bp, Artificial Sequence
  Synthetic oligonucleotide; AAG chr2 60496164 60496183 60496180 +
ccagaaaaccagaaccggga

SEQ ID NO: 162577 - DNA, 20 bp, Artificial Sequence
  Synthetic oligonucleotide; TGG chr2 60496170 60496189 60496186 +
aaccagaaccgggaaagttc

SEQ ID NO: 162578 - DNA, 20 bp, Artificial Sequence
  Synthetic oligonucleotide; AAG chr2 60496173 60496192 60496189 +
cagaaccgggaaagttctgg

SEQ ID NO: 162579 - DNA, 20 bp, Artificial Sequence
  Synthetic oligonucleotide; CGG chr2 60496177 60496196 60496193 +
accgggaaagttctggaagt

SEQ ID NO: 162580 - DNA, 20 bp, Artificial Sequence
  Synthetic oligonucleotide; AAG chr2 60496198 60496217 60496214 +
ggaaaaacaaatcatgactt

SEQ ID NO: 162581 - DNA, 20 bp, Artificial Sequence
  Synthetic oligonucleotide; TGG chr2 60496204 60496223 60496220 +
acaaatcatgacttaagcaa

SEQ ID NO: 162582 - DNA, 20 bp, Artificial Sequence
  Synthetic oligonucleotide; AAG chr2 60496207 60496226 60496223 +
aatcatgacttaagcaatgg

SEQ ID NO: 162583 - DNA, 20 bp, Artificial Sequence
  Synthetic oligonucleotide; CAG chr2 60496225 60496244 60496241 +
ggaagtccaatacacgttta

SEQ ID NO: 162584 - DNA, 20 bp, Artificial Sequence
  Synthetic oligonucleotide; GAG chr2 60496243 60496262 60496259 +
tacagaatgccttgtcccac

SEQ ID NO: 162585 - DNA, 20 bp, Artificial Sequence
  Synthetic oligonucleotide; AGG chr2 60496244 60496263 60496260 +
acagaatgccttgtcccacg

SEQ ID NO: 162586 - DNA, 20 bp, Artificial Sequence
  Synthetic oligonucleotide; CAG chr2 60496252 60496271 60496268 +
ccttgtcccacgaggcaaca

SEQ ID NO: 162587 - DNA, 20 bp, Artificial Sequence
  Synthetic oligonucleotide; AGG chr2 60496253 60496272 60496269 +
cttgtcccacgaggcaacac

SEQ ID NO: 162588 - DNA, 20 bp, Artificial Sequence
  Synthetic oligonucleotide; CAG chr2 60496262 60496281 60496278 +
cgaggcaacacaggctacca

SEQ ID NO: 162589 - DNA, 20 bp, Artificial Sequence
  Synthetic oligonucleotide; TGG chr2 60496266 60496285 60496282 +
gcaacacaggctaccacaga

SEQ ID NO: 162590 - DNA, 20 bp, Artificial Sequence
  Synthetic oligonucleotide; GGG chr2 60496267 60496286 60496283 +
caacacaggctaccacagat

SEQ ID NO: 162591 - DNA, 20 bp, Artificial Sequence
  Synthetic oligonucleotide; GGG chr2 60496268 60496287 60496284 +
aacacaggctaccacagatg

SEQ ID NO: 162592 - DNA, 20 bp, Artificial Sequence
  Synthetic oligonucleotide; GGG chr2 60496269 60496288 60496285 +
acacaggctaccacagatgg

SEQ ID NO: 162593 - DNA, 20 bp, Artificial Sequence
  Synthetic oligonucleotide; CAG chr2 60496273 60496292 60496289 +
aggctaccacagatggggga

SEQ ID NO: 162594 - DNA, 20 bp, Artificial Sequence
  Synthetic oligonucleotide; AGG chr2 60496274 60496293 60496290 +
ggctaccacagatgggggac

SEQ ID NO: 162595 - DNA, 20 bp, Artificial Sequence
  Synthetic oligonucleotide; GGG chr2 60496275 60496294 60496291 +
gctaccacagatgggggaca

SEQ ID NO: 162596 - DNA, 20 bp, Artificial Sequence
  Synthetic oligonucleotide; TGG chr2 60496278 60496297 60496294 +
accacagatgggggacaggg

SEQ ID NO: 162597 - DNA, 20 bp, Artificial Sequence
  Synthetic oligonucleotide; GGG chr2 60496279 60496298 60496295 +
ccacagatgggggacagggt

SEQ ID NO: 162598 - DNA, 20 bp, Artificial Sequence
  Synthetic oligonucleotide; GAG chr2 60496281 60496300 60496297 +
acagatgggggacagggtgg

SEQ ID NO: 162599 - DNA, 20 bp, Artificial Sequence
  Synthetic oligonucleotide; TGG chr2 60496284 60496303 60496300 +
gatgggggacagggtgggag

SEQ ID NO: 162600 - DNA, 20 bp, Artificial Sequence
  Synthetic oligonucleotide; CAG chr2 60496294 60496313 60496310 +
agggtgggagtggaccatcc

SEQ ID NO: 162601 - DNA, 20 bp, Artificial Sequence
  Synthetic oligonucleotide; TGG chr2 60496297 60496316 60496313 +
gtgggagtggaccatcccag

SEQ ID NO: 162602 - DNA, 20 bp, Artificial Sequence
  Synthetic oligonucleotide; GAG chr2 60496307 60496326 60496323 +
accatcccagtggtgttact

SEQ ID NO: 162603 - DNA, 20 bp, Artificial Sequence
  Synthetic oligonucleotide; AGG chr2 60496308 60496327 60496324 +
ccatcccagtggtgttactg

SEQ ID NO: 162604 - DNA, 20 bp, Artificial Sequence
  Synthetic oligonucleotide; GGG chr2 60496309 60496328 60496325 +
catcccagtggtgttactga

SEQ ID NO: 162605 - DNA, 20 bp, Artificial Sequence
  Synthetic oligonucleotide; GGG chr2 60496310 60496329 60496326 +
atcccagtggtgttactgag

SEQ ID NO: 162606 - DNA, 20 bp, Artificial Sequence
  Synthetic oligonucleotide; AAG chr2 60496315 60496334 60496331 +
agtggtgttactgaggggca

SEQ ID NO: 162607 - DNA, 20 bp, Artificial Sequence
  Synthetic oligonucleotide; AGG chr2 60496316 60496335 60496332 +
gtggtgttactgaggggcaa

SEQ ID NO: 162608 - DNA, 20 bp, Artificial Sequence
  Synthetic oligonucleotide; GGG chr2 60496317 60496336 60496333 +
tggtgttactgaggggcaaa

SEQ ID NO: 162609 - DNA, 20 bp, Artificial Sequence
  Synthetic oligonucleotide; TAG chr2 60496321 60496340 60496337 +
gttactgaggggcaaaggga

SEQ ID NO: 162610 - DNA, 20 bp, Artificial Sequence
  Synthetic oligonucleotide; GAG chr2 60496330 60496349 60496346 +
gggcaaagggatagccctat

SEQ ID NO: 162611 - DNA, 20 bp, Artificial Sequence
  Synthetic oligonucleotide; AGG chr2 60496331 60496350 60496347 +
ggcaaagggatagccctatg

SEQ ID NO: 162612 - DNA, 20 bp, Artificial Sequence
  Synthetic oligonucleotide; AAG chr2 60496335 60496354 60496351 +
aagggatagccctatgaggc

SEQ ID NO: 162613 - DNA, 20 bp, Artificial Sequence
  Synthetic oligonucleotide; CAG chr2 60496342 60496361 60496358 +
agccctatgaggcaagtgtc

SEQ ID NO: 162614 - DNA, 20 bp, Artificial Sequence
  Synthetic oligonucleotide; AGG chr2 60496343 60496362 60496359 +
gccctatgaggcaagtgtcc

SEQ ID NO: 162615 - DNA, 20 bp, Artificial Sequence
  Synthetic oligonucleotide; GGG chr2 60496344 60496363 60496360 +
ccctatgaggcaagtgtcca

SEQ ID NO: 162616 - DNA, 20 bp, Artificial Sequence
  Synthetic oligonucleotide; CAG chr2 60496347 60496366 60496363 +
tatgaggcaagtgtccaggg

SEQ ID NO: 162617 - DNA, 20 bp, Artificial Sequence
  Synthetic oligonucleotide; TGG chr2 60496353 60496372 60496369 +
gcaagtgtccagggcagaac

SEQ ID NO: 162618 - DNA, 20 bp, Artificial Sequence
  Synthetic oligonucleotide; GAG chr2 60496355 60496374 60496371 +
aagtgtccagggcagaactg

SEQ ID NO: 162619 - DNA, 20 bp, Artificial Sequence
  Synthetic oligonucleotide; CAG chr2 60496376 60496395 60496392 +
agctttgtgaaaccatttcc

SEQ ID NO: 162620 - DNA, 20 bp, Artificial Sequence
  Synthetic oligonucleotide; AGG chr2 60496377 60496396 60496393 +
gctttgtgaaaccatttccc

SEQ ID NO: 162621 - DNA, 20 bp, Artificial Sequence
  Synthetic oligonucleotide; CAG chr2 60496380 60496399 60496396 +
ttgtgaaaccatttcccagg

SEQ ID NO: 162622 - DNA, 20 bp, Artificial Sequence
  Synthetic oligonucleotide; GAG chr2 60496382 60496401 60496398 +
gtgaaaccatttcccaggca

SEQ ID NO: 162623 - DNA, 20 bp, Artificial Sequence
  Synthetic oligonucleotide; CAG chr2 60496386 60496405 60496402 +
aaccatttcccaggcagaga

SEQ ID NO: 162624 - DNA, 20 bp, Artificial Sequence
  Synthetic oligonucleotide; GAG chr2 60496388 60496407 60496404 +
ccatttcccaggcagagaca

SEQ ID NO: 162625 - DNA, 20 bp, Artificial Sequence
  Synthetic oligonucleotide; TAG chr2 60496394 60496413 60496410 +
cccaggcagagacagagcac

SEQ ID NO: 162626 - DNA, 20 bp, Artificial Sequence
  Synthetic oligonucleotide; AGG chr2 60496395 60496414 60496411 +
ccaggcagagacagagcact

SEQ ID NO: 162627 - DNA, 20 bp, Artificial Sequence
  Synthetic oligonucleotide; TGG chr2 60496399 60496418 60496415 +
gcagagacagagcactaggc

SEQ ID NO: 162628 - DNA, 20 bp, Artificial Sequence
  Synthetic oligonucleotide; CAG chr2 60496408 60496427 60496424 +
gagcactaggctggtgctgc

SEQ ID NO: 162629 - DNA, 20 bp, Artificial Sequence
  Synthetic oligonucleotide; AAG chr2 60496420 60496439 60496436 +
ggtgctgccagtctgacaat

SEQ ID NO: 162630 - DNA, 20 bp, Artificial Sequence
  Synthetic oligonucleotide; TGG chr2 60496438 60496457 60496454 +
ataagtctgccattgtcctc

SEQ ID NO: 162631 - DNA, 20 bp, Artificial Sequence
  Synthetic oligonucleotide; CAG chr2 60496442 60496461 60496458 +
gtctgccattgtcctctggt

SEQ ID NO: 162632 - DNA, 20 bp, Artificial Sequence
  Synthetic oligonucleotide; TGG chr2 60496448 60496467 60496464 +
cattgtcctctggtcagctc

SEQ ID NO: 162633 - DNA, 20 bp, Artificial Sequence
  Synthetic oligonucleotide; CAG chr2 60496456 60496475 60496472 +
tctggtcagctctggacaca

SEQ ID NO: 162634 - DNA, 20 bp, Artificial Sequence
  Synthetic oligonucleotide; AAG chr2 60496462 60496481 60496478 +
cagctctggacacacagcaa

SEQ ID NO: 162635 - DNA, 20 bp, Artificial Sequence
  Synthetic oligonucleotide; GAG chr2 60496466 60496485 60496482 +
tctggacacacagcaaaagt

SEQ ID NO: 162636 - DNA, 20 bp, Artificial Sequence
  Synthetic oligonucleotide; CAG chr2 60496471 60496490 60496487 +
acacacagcaaaagtgagtt

SEQ ID NO: 162637 - DNA, 20 bp, Artificial Sequence
  Synthetic oligonucleotide; GAG chr2 60496473 60496492 60496489 +
acacagcaaaagtgagttca

SEQ ID NO: 162638 - DNA, 20 bp, Artificial Sequence
  Synthetic oligonucleotide; TAG chr2 60496476 60496495 60496492 +
cagcaaaagtgagttcagag

SEQ ID NO: 162639 - DNA, 20 bp, Artificial Sequence
  Synthetic oligonucleotide; AAG chr2 60496483 60496502 60496499 +
agtgagttcagagtagcctg

SEQ ID NO: 162640 - DNA, 20 bp, Artificial Sequence
  Synthetic oligonucleotide; CAG chr2 60496486 60496505 60496502 +
gagttcagagtagcctgaag

SEQ ID NO: 162641 - DNA, 20 bp, Artificial Sequence
  Synthetic oligonucleotide; AGG chr2 60496487 60496506 60496503 +
agttcagagtagcctgaagc

SEQ ID NO: 162642 - DNA, 20 bp, Artificial Sequence
  Synthetic oligonucleotide; AAG chr2 60496491 60496510 60496507 +
cagagtagcctgaagcagga

SEQ ID NO: 162643 - DNA, 20 bp, Artificial Sequence
  Synthetic oligonucleotide; GAG chr2 60496493 60496512 60496509 +
gagtagcctgaagcaggaaa

SEQ ID NO: 162644 - DNA, 20 bp, Artificial Sequence
  Synthetic oligonucleotide; AGG chr2 60496494 60496513 60496510 +
agtagcctgaagcaggaaag

SEQ ID NO: 162645 - DNA, 20 bp, Artificial Sequence
  Synthetic oligonucleotide; GGG chr2 60496495 60496514 60496511 +
gtagcctgaagcaggaaaga

SEQ ID NO: 162646 - DNA, 20 bp, Artificial Sequence
  Synthetic oligonucleotide; AAG chr2 60496498 60496517 60496514 +
gcctgaagcaggaaagaggg

SEQ ID NO: 162647 - DNA, 20 bp, Artificial Sequence
  Synthetic oligonucleotide; GAG chr2 60496500 60496519 60496516 +
ctgaagcaggaaagagggaa

SEQ ID NO: 162648 - DNA, 20 bp, Artificial Sequence
  Synthetic oligonucleotide; GAG chr2 60496502 60496521 60496518 +
gaagcaggaaagagggaaga

SEQ ID NO: 162649 - DNA, 20 bp, Artificial Sequence
  Synthetic oligonucleotide; AGG chr2 60496503 60496522 60496519 +
aagcaggaaagagggaagag

SEQ ID NO: 162650 - DNA, 20 bp, Artificial Sequence
  Synthetic oligonucleotide; GAG chr2 60496505 60496524 60496521 +
gcaggaaagagggaagagag

SEQ ID NO: 162651 - DNA, 20 bp, Artificial Sequence
  Synthetic oligonucleotide; AGG chr2 60496506 60496525 60496522 +
caggaaagagggaagagagg

SEQ ID NO: 162652 - DNA, 20 bp, Artificial Sequence
  Synthetic oligonucleotide; CAG chr2 60496534 60496553 60496550 +
acctatcttccactttgctg

SEQ ID NO: 162653 - DNA, 20 bp, Artificial Sequence
  Synthetic oligonucleotide; AGG chr2 60496535 60496554 60496551 +
cctatcttccactttgctgc

SEQ ID NO: 162654 - DNA, 20 bp, Artificial Sequence
  Synthetic oligonucleotide; AAG chr2 60496541 60496560 60496557 +
ttccactttgctgcaggttc

SEQ ID NO: 162655 - DNA, 20 bp, Artificial Sequence
  Synthetic oligonucleotide; AGG chr2 60496542 60496561 60496558 +
tccactttgctgcaggttca

SEQ ID NO: 162656 - DNA, 20 bp, Artificial Sequence
  Synthetic oligonucleotide; AAG chr2 60496546 60496565 60496562 +
ctttgctgcaggttcaaggc

SEQ ID NO: 162657 - DNA, 20 bp, Artificial Sequence
  Synthetic oligonucleotide; AGG chr2 60496547 60496566 60496563 +
tttgctgcaggttcaaggca

SEQ ID NO: 162658 - DNA, 20 bp, Artificial Sequence
  Synthetic oligonucleotide; GAG chr2 60496554 60496573 60496570 +
caggttcaaggcaaggattt

SEQ ID NO: 162659 - DNA, 20 bp, Artificial Sequence
  Synthetic oligonucleotide; CAG chr2 60496558 60496577 60496574 +
ttcaaggcaaggatttgaga

SEQ ID NO: 162660 - DNA, 20 bp, Artificial Sequence
  Synthetic oligonucleotide; TGG chr2 60496571 60496590 60496587 +
tttgagacagttaccccttc

SEQ ID NO: 162661 - DNA, 20 bp, Artificial Sequence
  Synthetic oligonucleotide; AAG chr2 60496574 60496593 60496590 +
gagacagttaccccttctgg

SEQ ID NO: 162662 - DNA, 20 bp, Artificial Sequence
  Synthetic oligonucleotide; GAG chr2 60496576 60496595 60496592 +
gacagttaccccttctggaa

SEQ ID NO: 162663 - DNA, 20 bp, Artificial Sequence
  Synthetic oligonucleotide; TGG chr2 60496581 60496600 60496597 +
ttaccccttctggaagagcc

SEQ ID NO: 162664 - DNA, 20 bp, Artificial Sequence
  Synthetic oligonucleotide; GAG chr2 60496585 60496604 60496601 +
cccttctggaagagcctggt

SEQ ID NO: 162665 - DNA, 20 bp, Artificial Sequence
  Synthetic oligonucleotide; CAG chr2 60496638 60496657 60496654 +
tcctcaccgactttctctcc

SEQ ID NO: 162666 - DNA, 20 bp, Artificial Sequence
  Synthetic oligonucleotide; CAG chr2 60496641 60496660 60496657 +
tcaccgactttctctcccag

SEQ ID NO: 162667 - DNA, 20 bp, Artificial Sequence
  Synthetic oligonucleotide; CAG chr2 60496645 60496664 60496661 +
cgactttctctcccagcagc

SEQ ID NO: 162668 - DNA, 20 bp, Artificial Sequence
  Synthetic oligonucleotide; CAG chr2 60496648 60496667 60496664 +
ctttctctcccagcagccag

SEQ ID NO: 162669 - DNA, 20 bp, Artificial Sequence
  Synthetic oligonucleotide; AGG chr2 60496649 60496668 60496665 +
tttctctcccagcagccagc

SEQ ID NO: 162670 - DNA, 20 bp, Artificial Sequence
  Synthetic oligonucleotide; GGG chr2 60496650 60496669 60496666 +
ttctctcccagcagccagca

SEQ ID NO: 162671 - DNA, 20 bp, Artificial Sequence
  Synthetic oligonucleotide; GGG chr2 60496651 60496670 60496667 +
tctctcccagcagccagcag

SEQ ID NO: 162672 - DNA, 20 bp, Artificial Sequence
  Synthetic oligonucleotide; TGG chr2 60496656 60496675 60496672 +
cccagcagccagcaggggcc

SEQ ID NO: 162673 - DNA, 20 bp, Artificial Sequence
  Synthetic oligonucleotide; GGG chr2 60496657 60496676 60496673 +
ccagcagccagcaggggcct

SEQ ID NO: 162674 - DNA, 20 bp, Artificial Sequence
  Synthetic oligonucleotide; TGG chr2 60496667 60496686 60496683 +
gcaggggcctgggccattta

SEQ ID NO: 162675 - DNA, 20 bp, Artificial Sequence
  Synthetic oligonucleotide; AAG chr2 60496675 60496694 60496691 +
ctgggccatttatggaatgc

SEQ ID NO: 162676 - DNA, 20 bp, Artificial Sequence
  Synthetic oligonucleotide; CAG chr2 60496689 60496708 60496705 +
gaatgcaagccctgaccaca

SEQ ID NO: 162677 - DNA, 20 bp, Artificial Sequence
  Synthetic oligonucleotide; CAG chr2 60496706 60496725 60496722 +
acacagacttacttacatgc

SEQ ID NO: 162678 - DNA, 20 bp, Artificial Sequence
  Synthetic oligonucleotide; AGG chr2 60496707 60496726 60496723 +
cacagacttacttacatgcc

SEQ ID NO: 162679 - DNA, 20 bp, Artificial Sequence
  Synthetic oligonucleotide; CAG chr2 60496711 60496730 60496727 +
gacttacttacatgccagga

SEQ ID NO: 162680 - DNA, 20 bp, Artificial Sequence
  Synthetic oligonucleotide; CAG chr2 60496718 60496737 60496734 +
ttacatgccaggacagccac

SEQ ID NO: 162681 - DNA, 20 bp, Artificial Sequence
  Synthetic oligonucleotide; AGG chr2 60496719 60496738 60496735 +
tacatgccaggacagccacc

SEQ ID NO: 162682 - DNA, 20 bp, Artificial Sequence
  Synthetic oligonucleotide; TAG chr2 60496722 60496741 60496738 +
atgccaggacagccaccagg

SEQ ID NO: 162683 - DNA, 20 bp, Artificial Sequence
  Synthetic oligonucleotide; TAG chr2 60496737 60496756 60496753 +
ccaggtagcctttcccactc

SEQ ID NO: 162684 - DNA, 20 bp, Artificial Sequence
  Synthetic oligonucleotide; AGG chr2 60496738 60496757 60496754 +
caggtagcctttcccactct

SEQ ID NO: 162685 - DNA, 20 bp, Artificial Sequence
  Synthetic oligonucleotide; GAG chr2 60496750 60496769 60496766 +
cccactctaggttccactgt

SEQ ID NO: 162686 - DNA, 20 bp, Artificial Sequence
  Synthetic oligonucleotide; AAG chr2 60496787 60496806 60496803 +
ctctctctcactatgctccc

SEQ ID NO: 162687 - DNA, 20 bp, Artificial Sequence
  Synthetic oligonucleotide; GAG chr2 60496789 60496808 60496805 +
ctctctcactatgctcccaa

SEQ ID NO: 162688 - DNA, 20 bp, Artificial Sequence
  Synthetic oligonucleotide; AGG chr2 60496790 60496809 60496806 +
tctctcactatgctcccaag

SEQ ID NO: 162689 - DNA, 20 bp, Artificial Sequence
  Synthetic oligonucleotide; GAG chr2 60496792 60496811 60496808 +
tctcactatgctcccaagag

SEQ ID NO: 162690 - DNA, 20 bp, Artificial Sequence
  Synthetic oligonucleotide; TGG chr2 60496829 60496848 60496845 +
cttcctcaaatctccctcac

SEQ ID NO: 162691 - DNA, 20 bp, Artificial Sequence
  Synthetic oligonucleotide; CAG chr2 60496838 60496857 60496854 +
atctccctcactggatgtca

SEQ ID NO: 162692 - DNA, 20 bp, Artificial Sequence
  Synthetic oligonucleotide; TAG chr2 60496844 60496863 60496860 +
ctcactggatgtcacagtca

SEQ ID NO: 162693 - DNA, 20 bp, Artificial Sequence
  Synthetic oligonucleotide; AGG chr2 60496845 60496864 60496861 +
tcactggatgtcacagtcat

SEQ ID NO: 162694 - DNA, 20 bp, Artificial Sequence
  Synthetic oligonucleotide; AAG chr2 60496854 60496873 60496870 +
gtcacagtcataggcctgaa

SEQ ID NO: 162695 - DNA, 20 bp, Artificial Sequence
  Synthetic oligonucleotide; CAG chr2 60496857 60496876 60496873 +
acagtcataggcctgaaaag

SEQ ID NO: 162696 - DNA, 20 bp, Artificial Sequence
  Synthetic oligonucleotide; AAG chr2 60496881 60496900 60496897 +
atgcaaactgaatttttgta

SEQ ID NO: 162697 - DNA, 20 bp, Artificial Sequence
  Synthetic oligonucleotide; CAG chr2 60496884 60496903 60496900 +
caaactgaatttttgtaaag

SEQ ID NO: 162698 - DNA, 20 bp, Artificial Sequence
  Synthetic oligonucleotide; AGG chr2 60496885 60496904 60496901 +
aaactgaatttttgtaaagc

SEQ ID NO: 162699 - DNA, 20 bp, Artificial Sequence
  Synthetic oligonucleotide; TGG chr2 60496901 60496920 60496917 +
aagcaggacccatttcccca

SEQ ID NO: 162700 - DNA, 20 bp, Artificial Sequence
  Synthetic oligonucleotide; CAG chr2 60496905 60496924 60496921 +
aggacccatttccccatgga

SEQ ID NO: 162701 - DNA, 20 bp, Artificial Sequence
  Synthetic oligonucleotide; AAG chr2 60496912 60496931 60496928 +
atttccccatggacagtcat

SEQ ID NO: 162702 - DNA, 20 bp, Artificial Sequence
  Synthetic oligonucleotide; GAG chr2 60496914 60496933 60496930 +
ttccccatggacagtcataa

SEQ ID NO: 162703 - DNA, 20 bp, Artificial Sequence
  Synthetic oligonucleotide; GAG chr2 60496919 60496938 60496935 +
catggacagtcataagagat

SEQ ID NO: 162704 - DNA, 20 bp, Artificial Sequence
  Synthetic oligonucleotide; TAG chr2 60496933 60496952 60496949 +
agagatgagtgaacacaatg

SEQ ID NO: 162705 - DNA, 20 bp, Artificial Sequence
  Synthetic oligonucleotide; TGG chr2 60496975 60496994 60496991 +
cgattacttcacgataaatc

SEQ ID NO: 162706 - DNA, 20 bp, Artificial Sequence
  Synthetic oligonucleotide; AAG chr2 60496984 60497003 60497000 +
cacgataaatctggattcca

SEQ ID NO: 162707 - DNA, 20 bp, Artificial Sequence
  Synthetic oligonucleotide; AGG chr2 60496985 60497004 60497001 +
acgataaatctggattccaa

SEQ ID NO: 162708 - DNA, 20 bp, Artificial Sequence
  Synthetic oligonucleotide; GGG chr2 60496986 60497005 60497002 +
cgataaatctggattccaaa

SEQ ID NO: 162709 - DNA, 20 bp, Artificial Sequence
  Synthetic oligonucleotide; AAG chr2 60496994 60497013 60497010 +
ctggattccaaagggactat

SEQ ID NO: 162710 - DNA, 20 bp, Artificial Sequence
  Synthetic oligonucleotide; TGG chr2 60497005 60497024 60497021 +
agggactataagctctcaca

SEQ ID NO: 162711 - DNA, 20 bp, Artificial Sequence
  Synthetic oligonucleotide; AAG chr2 60497008 60497027 60497024 +
gactataagctctcacatgg

SEQ ID NO: 162712 - DNA, 20 bp, Artificial Sequence
  Synthetic oligonucleotide; AGG chr2 60497009 60497028 60497025 +
actataagctctcacatgga

SEQ ID NO: 162713 - DNA, 20 bp, Artificial Sequence
  Synthetic oligonucleotide; AAG chr2 60497012 60497031 60497028 +
ataagctctcacatggaagg

SEQ ID NO: 162714 - DNA, 20 bp, Artificial Sequence
  Synthetic oligonucleotide; AAG chr2 60497016 60497035 60497032 +
gctctcacatggaaggaagc

SEQ ID NO: 162715 - DNA, 20 bp, Artificial Sequence
  Synthetic oligonucleotide; CAG chr2 60497035 60497054 60497051 +
caagatctctactcctcccc

SEQ ID NO: 162716 - DNA, 20 bp, Artificial Sequence
  Synthetic oligonucleotide; GAG chr2 60497042 60497061 60497058 +
tctactcctcccccagtgtt

SEQ ID NO: 162717 - DNA, 20 bp, Artificial Sequence
  Synthetic oligonucleotide; TGG chr2 60497045 60497064 60497061 +
actcctcccccagtgttgag

SEQ ID NO: 162718 - DNA, 20 bp, Artificial Sequence
  Synthetic oligonucleotide; CAG chr2 60497049 60497068 60497065 +
ctcccccagtgttgagtgga

SEQ ID NO: 162719 - DNA, 20 bp, Artificial Sequence
  Synthetic oligonucleotide; AGG chr2 60497050 60497069 60497066 +
tcccccagtgttgagtggac

SEQ ID NO: 162720 - DNA, 20 bp, Artificial Sequence
  Synthetic oligonucleotide; GGG chr2 60497051 60497070 60497067 +
cccccagtgttgagtggaca

SEQ ID NO: 162721 - DNA, 20 bp, Artificial Sequence
  Synthetic oligonucleotide; GAG chr2 60497053 60497072 60497069 +
cccagtgttgagtggacagg

SEQ ID NO: 162722 - DNA, 20 bp, Artificial Sequence
  Synthetic oligonucleotide; CAG chr2 60497063 60497082 60497079 +
agtggacagggagtacaccg

SEQ ID NO: 162723 - DNA, 20 bp, Artificial Sequence
  Synthetic oligonucleotide; TGG chr2 60497074 60497093 60497090 +
agtacaccgcagacacctgt

SEQ ID NO: 162724 - DNA, 20 bp, Artificial Sequence
  Synthetic oligonucleotide; TAG chr2 60497098 60497117 60497114 +
caaccaattctaattccctt

SEQ ID NO: 162725 - DNA, 20 bp, Artificial Sequence
  Synthetic oligonucleotide; TAG chr2 60497102 60497121 60497118 +
caattctaattccctttagc

SEQ ID NO: 162726 - DNA, 20 bp, Artificial Sequence
  Synthetic oligonucleotide; AAG chr2 60497113 60497132 60497129 +
ccctttagctagcatcccct

SEQ ID NO: 162727 - DNA, 20 bp, Artificial Sequence
  Synthetic oligonucleotide; TAG chr2 60497117 60497136 60497133 +
ttagctagcatcccctaagc

SEQ ID NO: 162728 - DNA, 20 bp, Artificial Sequence
  Synthetic oligonucleotide; GAG chr2 60497119 60497138 60497135 +
agctagcatcccctaagcta

SEQ ID NO: 162729 - DNA, 20 bp, Artificial Sequence
  Synthetic oligonucleotide; TAG chr2 60497123 60497142 60497139 +
agcatcccctaagctagagc

SEQ ID NO: 162730 - DNA, 20 bp, Artificial Sequence
  Synthetic oligonucleotide; GAG chr2 60497125 60497144 60497141 +
catcccctaagctagagcta

SEQ ID NO: 162731 - DNA, 20 bp, Artificial Sequence
  Synthetic oligonucleotide; TAG chr2 60497129 60497148 60497145 +
ccctaagctagagctagagc

SEQ ID NO: 162732 - DNA, 20 bp, Artificial Sequence
  Synthetic oligonucleotide; GAG chr2 60497131 60497150 60497147 +
ctaagctagagctagagcta

SEQ ID NO: 162733 - DNA, 20 bp, Artificial Sequence
  Synthetic oligonucleotide; CAG chr2 60497145 60497164 60497161 +
gagctagagctatttccttg

SEQ ID NO: 162734 - DNA, 20 bp, Artificial Sequence
  Synthetic oligonucleotide; TAG chr2 60497161 60497180 60497177 +
cttgcagccttccttttctc

SEQ ID NO: 162735 - DNA, 20 bp, Artificial Sequence
  Synthetic oligonucleotide; AAG chr2 60497166 60497185 60497182 +
agccttccttttctctagca

SEQ ID NO: 162736 - DNA, 20 bp, Artificial Sequence
  Synthetic oligonucleotide; CAG chr2 60497179 60497198 60497195 +
tctagcaaagtccttccatg

SEQ ID NO: 162737 - DNA, 20 bp, Artificial Sequence
  Synthetic oligonucleotide; TAG chr2 60497182 60497201 60497198 +
agcaaagtccttccatgcag

SEQ ID NO: 162738 - DNA, 20 bp, Artificial Sequence
  Synthetic oligonucleotide; GAG chr2 60497208 60497227 60497224 +
atgacctgtaaacacttaat

SEQ ID NO: 162739 - DNA, 20 bp, Artificial Sequence
  Synthetic oligonucleotide; TAG chr2 60497212 60497231 60497228 +
cctgtaaacacttaatgagc

SEQ ID NO: 162740 - DNA, 20 bp, Artificial Sequence
  Synthetic oligonucleotide; GAG chr2 60497214 60497233 60497230 +
tgtaaacacttaatgagcta

SEQ ID NO: 162741 - DNA, 20 bp, Artificial Sequence
  Synthetic oligonucleotide; AAG chr2 60497231 60497250 60497247 +
ctagagaaacattccattga

SEQ ID NO: 162742 - DNA, 20 bp, Artificial Sequence
  Synthetic oligonucleotide; AGG chr2 60497232 60497251 60497248 +
tagagaaacattccattgaa

SEQ ID NO: 162743 - DNA, 20 bp, Artificial Sequence
  Synthetic oligonucleotide; AAG chr2 60497259 60497278 60497275 +
ccactgtgcatccttttgta

SEQ ID NO: 162744 - DNA, 20 bp, Artificial Sequence
  Synthetic oligonucleotide; GAG chr2 60497261 60497280 60497277 +
actgtgcatccttttgtaaa

SEQ ID NO: 162745 - DNA, 20 bp, Artificial Sequence
  Synthetic oligonucleotide; AGG chr2 60497262 60497281 60497278 +
ctgtgcatccttttgtaaag

SEQ ID NO: 162746 - DNA, 20 bp, Artificial Sequence
  Synthetic oligonucleotide; GGG chr2 60497263 60497282 60497279 +
tgtgcatccttttgtaaaga

SEQ ID NO: 162747 - DNA, 20 bp, Artificial Sequence
  Synthetic oligonucleotide; GGG chr2 60497264 60497283 60497280 +
gtgcatccttttgtaaagag

SEQ ID NO: 162748 - DNA, 20 bp, Artificial Sequence
  Synthetic oligonucleotide; GGG chr2 60497265 60497284 60497281 +
tgcatccttttgtaaagagg

SEQ ID NO: 162749 - DNA, 20 bp, Artificial Sequence
  Synthetic oligonucleotide; GGG chr2 60497266 60497285 60497282 +
gcatccttttgtaaagaggg

SEQ ID NO: 162750 - DNA, 20 bp, Artificial Sequence
  Synthetic oligonucleotide; AAG chr2 60497287 60497306 60497303 +
ggaaaatcttttgtaaaacg

SEQ ID NO: 162751 - DNA, 20 bp, Artificial Sequence
  Synthetic oligonucleotide; AAG chr2 60497317 60497336 60497333 +
tttaactgctctgtttgatc

SEQ ID NO: 162752 - DNA, 20 bp, Artificial Sequence
  Synthetic oligonucleotide; CAG chr2 60497321 60497340 60497337 +
actgctctgtttgatcaagt

SEQ ID NO: 162753 - DNA, 20 bp, Artificial Sequence
  Synthetic oligonucleotide; CAG chr2 60497330 60497349 60497346 +
tttgatcaagtcagattttt

SEQ ID NO: 162754 - DNA, 20 bp, Artificial Sequence
  Synthetic oligonucleotide; TAG chr2 60497341 60497360 60497357 +
cagatttttcagaatatgaa

SEQ ID NO: 162755 - DNA, 20 bp, Artificial Sequence
  Synthetic oligonucleotide; TAG chr2 60497345 60497364 60497361 +
tttttcagaatatgaatagc

SEQ ID NO: 162756 - DNA, 20 bp, Artificial Sequence
  Synthetic oligonucleotide; AAG chr2 60497353 60497372 60497369 +
aatatgaatagctagtattc

SEQ ID NO: 162757 - DNA, 20 bp, Artificial Sequence
  Synthetic oligonucleotide; AAG chr2 60497374 60497393 60497390 +
agcatatatgaactgtcttt

SEQ ID NO: 162758 - DNA, 20 bp, Artificial Sequence
  Synthetic oligonucleotide; TAG chr2 60497389 60497408 60497405 +
tctttaagttaatcaatccc

SEQ ID NO: 162759 - DNA, 20 bp, Artificial Sequence
  Synthetic oligonucleotide; TAG chr2 60497396 60497415 60497412 +
gttaatcaatccctagaaac

SEQ ID NO: 162760 - DNA, 20 bp, Artificial Sequence
  Synthetic oligonucleotide; CAG chr2 60497403 60497422 60497419 +
aatccctagaaactagccct

SEQ ID NO: 162761 - DNA, 20 bp, Artificial Sequence
  Synthetic oligonucleotide; AGG chr2 60497404 60497423 60497420 +
atccctagaaactagccctc

SEQ ID NO: 162762 - DNA, 20 bp, Artificial Sequence
  Synthetic oligonucleotide; TAG chr2 60497408 60497427 60497424 +
ctagaaactagccctcaggt

SEQ ID NO: 162763 - DNA, 20 bp, Artificial Sequence
  Synthetic oligonucleotide; CAG chr2 60497411 60497430 60497427 +
gaaactagccctcaggttag

SEQ ID NO: 162764 - DNA, 20 bp, Artificial Sequence
  Synthetic oligonucleotide; AGG chr2 60497412 60497431 60497428 +
aaactagccctcaggttagc

SEQ ID NO: 162765 - DNA, 20 bp, Artificial Sequence
  Synthetic oligonucleotide; AAG chr2 60497417 60497436 60497433 +
agccctcaggttagcaggcc

SEQ ID NO: 162766 - DNA, 20 bp, Artificial Sequence
  Synthetic oligonucleotide; AGG chr2 60497418 60497437 60497434 +
gccctcaggttagcaggcca

SEQ ID NO: 162767 - DNA, 20 bp, Artificial Sequence
  Synthetic oligonucleotide; GAG chr2 60497427 60497446 60497443 +
ttagcaggccaaggatatat

SEQ ID NO: 162768 - DNA, 20 bp, Artificial Sequence
  Synthetic oligonucleotide; GAG chr2 60497429 60497448 60497445 +
agcaggccaaggatatatga

SEQ ID NO: 162769 - DNA, 20 bp, Artificial Sequence
  Synthetic oligonucleotide; AAG chr2 60497439 60497458 60497455 +
ggatatatgagagtgctttg

SEQ ID NO: 162770 - DNA, 20 bp, Artificial Sequence
  Synthetic oligonucleotide; TAG chr2 60497444 60497463 60497460 +
tatgagagtgctttgaagtc

SEQ ID NO: 162771 - DNA, 20 bp, Artificial Sequence
  Synthetic oligonucleotide; TAG chr2 60497474 60497493 60497490 +
ctgccgctcctgaattgaat

SEQ ID NO: 162772 - DNA, 20 bp, Artificial Sequence
  Synthetic oligonucleotide; CAG chr2 60497484 60497503 60497500 +
tgaattgaattagaacattc

SEQ ID NO: 162773 - DNA, 20 bp, Artificial Sequence
  Synthetic oligonucleotide; AGG chr2 60497485 60497504 60497501 +
gaattgaattagaacattcc

SEQ ID NO: 162774 - DNA, 20 bp, Artificial Sequence
  Synthetic oligonucleotide; TAG chr2 60497488 60497507 60497504 +
ttgaattagaacattccagg

SEQ ID NO: 162775 - DNA, 20 bp, Artificial Sequence
  Synthetic oligonucleotide; CAG chr2 60497492 60497511 60497508 +
attagaacattccaggtaga

SEQ ID NO: 162776 - DNA, 20 bp, Artificial Sequence
  Synthetic oligonucleotide; TGG chr2 60497500 60497519 60497516 +
attccaggtagacagattca

SEQ ID NO: 162777 - DNA, 20 bp, Artificial Sequence
  Synthetic oligonucleotide; CAG chr2 60497513 60497532 60497529 +
agattcatggcccctaacat

SEQ ID NO: 162778 - DNA, 20 bp, Artificial Sequence
  Synthetic oligonucleotide; AGG chr2 60497514 60497533 60497530 +
gattcatggcccctaacatc

SEQ ID NO: 162779 - DNA, 20 bp, Artificial Sequence
  Synthetic oligonucleotide; CAG chr2 60497520 60497539 60497536 +
tggcccctaacatcaggaat

SEQ ID NO: 162780 - DNA, 20 bp, Artificial Sequence
  Synthetic oligonucleotide; TAG chr2 60497524 60497543 60497540 +
ccctaacatcaggaatcagc

SEQ ID NO: 162781 - DNA, 20 bp, Artificial Sequence
  Synthetic oligonucleotide; CGG chr2 60497536 60497555 60497552 +
gaatcagctagaaactcaat

SEQ ID NO: 162782 - DNA, 20 bp, Artificial Sequence
  Synthetic oligonucleotide; CAG chr2 60497546 60497565 60497562 +
gaaactcaatcggctcttac

SEQ ID NO: 162783 - DNA, 20 bp, Artificial Sequence
  Synthetic oligonucleotide; CAG chr2 60497562 60497581 60497578 +
ttaccagtcactacctacgt

SEQ ID NO: 162784 - DNA, 20 bp, Artificial Sequence
  Synthetic oligonucleotide; TGG chr2 60497580 60497599 60497596 +
gtcagtgccatatcctataa

SEQ ID NO: 162785 - DNA, 20 bp, Artificial Sequence
  Synthetic oligonucleotide; TAG chr2 60497622 60497641 60497638 +
gatgatgataataataataa

SEQ ID NO: 162786 - DNA, 20 bp, Artificial Sequence
  Synthetic oligonucleotide; TGG chr2 60497632 60497651 60497648 +
ataataataatagcttccac

SEQ ID NO: 162787 - DNA, 20 bp, Artificial Sequence
  Synthetic oligonucleotide; TGG chr2 60497636 60497655 60497652 +
taataatagcttccactgga

SEQ ID NO: 162788 - DNA, 20 bp, Artificial Sequence
  Synthetic oligonucleotide; CAG chr2 60497653 60497672 60497669 +
ggatggcactttgcaccttc

SEQ ID NO: 162789 - DNA, 20 bp, Artificial Sequence
  Synthetic oligonucleotide; GAG chr2 60497655 60497674 60497671 +
atggcactttgcaccttcca

SEQ ID NO: 162790 - DNA, 20 bp, Artificial Sequence
  Synthetic oligonucleotide; TGG chr2 60497682 60497701 60497698 +
ttaacatcctttactttttt

SEQ ID NO: 162791 - DNA, 20 bp, Artificial Sequence
  Synthetic oligonucleotide; AAG chr2 60497685 60497704 60497701 +
acatcctttactttttttgg

SEQ ID NO: 162792 - DNA, 20 bp, Artificial Sequence
  Synthetic oligonucleotide; AGG chr2 60497686 60497705 60497702 +
catcctttactttttttgga

SEQ ID NO: 162793 - DNA, 20 bp, Artificial Sequence
  Synthetic oligonucleotide; CAG chr2 60497693 60497712 60497709 +
tactttttttggaaggcctt

SEQ ID NO: 162794 - DNA, 20 bp, Artificial Sequence
  Synthetic oligonucleotide; AGG chr2 60497694 60497713 60497710 +
actttttttggaaggccttc

SEQ ID NO: 162795 - DNA, 20 bp, Artificial Sequence
  Synthetic oligonucleotide; CAG chr2 60497699 60497718 60497715 +
ttttggaaggccttcaggtc

SEQ ID NO: 162796 - DNA, 20 bp, Artificial Sequence
  Synthetic oligonucleotide; TAG chr2 60497741 60497760 60497757 +
tctgaactatcaccttacta

SEQ ID NO: 162797 - DNA, 20 bp, Artificial Sequence
  Synthetic oligonucleotide; AGG chr2 60497742 60497761 60497758 +
ctgaactatcaccttactat

SEQ ID NO: 162798 - DNA, 20 bp, Artificial Sequence
  Synthetic oligonucleotide; AAG chr2 60497760 60497779 60497776 +
ataggcacatatttccccca

SEQ ID NO: 162799 - DNA, 20 bp, Artificial Sequence
  Synthetic oligonucleotide; AGG chr2 60497761 60497780 60497777 +
taggcacatatttcccccaa

SEQ ID NO: 162800 - DNA, 20 bp, Artificial Sequence
  Synthetic oligonucleotide; CAG chr2 60497767 60497786 60497783 +
catatttcccccaaaggact

SEQ ID NO: 162801 - DNA, 20 bp, Artificial Sequence
  Synthetic oligonucleotide; TGG chr2 60497770 60497789 60497786 +
atttcccccaaaggactcag

SEQ ID NO: 162802 - DNA, 20 bp, Artificial Sequence
  Synthetic oligonucleotide; CAG chr2 60497808 60497827 60497824 +
ttctccctttgctgatgatc

SEQ ID NO: 162803 - DNA, 20 bp, Artificial Sequence
  Synthetic oligonucleotide; TAG chr2 60497811 60497830 60497827 +
tccctttgctgatgatccag

SEQ ID NO: 162804 - DNA, 20 bp, Artificial Sequence
  Synthetic oligonucleotide; GAG chr2 60497813 60497832 60497829 +
cctttgctgatgatccagta

SEQ ID NO: 162805 - DNA, 20 bp, Artificial Sequence
  Synthetic oligonucleotide; AAG chr2 60497826 60497845 60497842 +
tccagtagagaaatgatcaa

SEQ ID NO: 162806 - DNA, 20 bp, Artificial Sequence
  Synthetic oligonucleotide; AGG chr2 60497827 60497846 60497843 +
ccagtagagaaatgatcaaa

SEQ ID NO: 162807 - DNA, 20 bp, Artificial Sequence
  Synthetic oligonucleotide; AAG chr2 60497857 60497876 60497873 +
acattgtcctaaatgaaacc

SEQ ID NO: 162808 - DNA, 20 bp, Artificial Sequence
  Synthetic oligonucleotide; CAG chr2 60497869 60497888 60497885 +
atgaaaccaagcttcctctg

SEQ ID NO: 162809 - DNA, 20 bp, Artificial Sequence
  Synthetic oligonucleotide; AGG chr2 60497870 60497889 60497886 +
tgaaaccaagcttcctctgc

SEQ ID NO: 162810 - DNA, 20 bp, Artificial Sequence
  Synthetic oligonucleotide; TGG chr2 60497874 60497893 60497890 +
accaagcttcctctgcagga

SEQ ID NO: 162811 - DNA, 20 bp, Artificial Sequence
  Synthetic oligonucleotide; AAG chr2 60497877 60497896 60497893 +
aagcttcctctgcaggatgg

SEQ ID NO: 162812 - DNA, 20 bp, Artificial Sequence
  Synthetic oligonucleotide; GAG chr2 60497881 60497900 60497897 +
ttcctctgcaggatggaagt

SEQ ID NO: 162813 - DNA, 20 bp, Artificial Sequence
  Synthetic oligonucleotide; CAG chr2 60497885 60497904 60497901 +
tctgcaggatggaagtgagc

SEQ ID NO: 162814 - DNA, 20 bp, Artificial Sequence
  Synthetic oligonucleotide; AGG chr2 60497886 60497905 60497902 +
ctgcaggatggaagtgagcc

SEQ ID NO: 162815 - DNA, 20 bp, Artificial Sequence
  Synthetic oligonucleotide; TAG chr2 60497892 60497911 60497908 +
gatggaagtgagccaggtga

SEQ ID NO: 162816 - DNA, 20 bp, Artificial Sequence
  Synthetic oligonucleotide; AAG chr2 60497895 60497914 60497911 +
ggaagtgagccaggtgatag

SEQ ID NO: 162817 - DNA, 20 bp, Artificial Sequence
  Synthetic oligonucleotide; AGG chr2 60497896 60497915 60497912 +
gaagtgagccaggtgataga

SEQ ID NO: 162818 - DNA, 20 bp, Artificial Sequence
  Synthetic oligonucleotide; GGG chr2 60497897 60497916 60497913 +
aagtgagccaggtgatagaa

SEQ ID NO: 162819 - DNA, 20 bp, Artificial Sequence
  Synthetic oligonucleotide; GGG chr2 60497898 60497917 60497914 +
agtgagccaggtgatagaag

SEQ ID NO: 162820 - DNA, 20 bp, Artificial Sequence
  Synthetic oligonucleotide; GGG chr2 60497899 60497918 60497915 +
gtgagccaggtgatagaagg

SEQ ID NO: 162821 - DNA, 20 bp, Artificial Sequence
  Synthetic oligonucleotide; GAG chr2 60497901 60497920 60497917 +
gagccaggtgatagaagggg

SEQ ID NO: 162822 - DNA, 20 bp, Artificial Sequence
  Synthetic oligonucleotide; TGG chr2 60497906 60497925 60497922 +
aggtgatagaagggggagcc

SEQ ID NO: 162823 - DNA, 20 bp, Artificial Sequence
  Synthetic oligonucleotide; TGG chr2 60497923 60497942 60497939 +
gcctggacccaccgcttcat

SEQ ID NO: 162824 - DNA, 20 bp, Artificial Sequence
  Synthetic oligonucleotide; GAG chr2 60497928 60497947 60497944 +
gacccaccgcttcattggcc

SEQ ID NO: 162825 - DNA, 20 bp, Artificial Sequence
  Synthetic oligonucleotide; AGG chr2 60497929 60497948 60497945 +
acccaccgcttcattggccg

SEQ ID NO: 162826 - DNA, 20 bp, Artificial Sequence
  Synthetic oligonucleotide; AAG chr2 60497943 60497962 60497959 +
tggccgaggatgaccccata

SEQ ID NO: 162827 - DNA, 20 bp, Artificial Sequence
  Synthetic oligonucleotide; AGG chr2 60497944 60497963 60497960 +
ggccgaggatgaccccataa

SEQ ID NO: 162828 - DNA, 20 bp, Artificial Sequence
  Synthetic oligonucleotide; CAG chr2 60497948 60497967 60497964 +
gaggatgaccccataaaggt

SEQ ID NO: 162829 - DNA, 20 bp, Artificial Sequence
  Synthetic oligonucleotide; AGG chr2 60497949 60497968 60497965 +
aggatgaccccataaaggtc

SEQ ID NO: 162830 - DNA, 20 bp, Artificial Sequence
  Synthetic oligonucleotide; GGG chr2 60497950 60497969 60497966 +
ggatgaccccataaaggtca

SEQ ID NO: 162831 - DNA, 20 bp, Artificial Sequence
  Synthetic oligonucleotide; CAG chr2 60497958 60497977 60497974 +
ccataaaggtcagggtgttg

SEQ ID NO: 162832 - DNA, 20 bp, Artificial Sequence
  Synthetic oligonucleotide; GAG chr2 60497960 60497979 60497976 +
ataaaggtcagggtgttgca

SEQ ID NO: 162833 - DNA, 20 bp, Artificial Sequence
  Synthetic oligonucleotide; AAG chr2 60497982 60498001 60497998 +
gattgctatgcacaaaatcc

SEQ ID NO: 162834 - DNA, 20 bp, Artificial Sequence
  Synthetic oligonucleotide; GAG chr2 60497984 60498003 60498000 +
ttgctatgcacaaaatccaa

SEQ ID NO: 162835 - DNA, 20 bp, Artificial Sequence
  Synthetic oligonucleotide; AGG chr2 60497985 60498004 60498001 +
tgctatgcacaaaatccaag

SEQ ID NO: 162836 - DNA, 20 bp, Artificial Sequence
  Synthetic oligonucleotide; TGG chr2 60497992 60498011 60498008 +
cacaaaatccaagaggccca

SEQ ID NO: 162837 - DNA, 20 bp, Artificial Sequence
  Synthetic oligonucleotide; GAG chr2 60497994 60498013 60498010 +
caaaatccaagaggcccatg

SEQ ID NO: 162838 - DNA, 20 bp, Artificial Sequence
  Synthetic oligonucleotide; AGG chr2 60497995 60498014 60498011 +
aaaatccaagaggcccatgg

SEQ ID NO: 162839 - DNA, 20 bp, Artificial Sequence
  Synthetic oligonucleotide; TGG chr2 60497998 60498017 60498014 +
atccaagaggcccatggagg

SEQ ID NO: 162840 - DNA, 20 bp, Artificial Sequence
  Synthetic oligonucleotide; GGG chr2 60497999 60498018 60498015 +
tccaagaggcccatggaggt

SEQ ID NO: 162841 - DNA, 20 bp, Artificial Sequence
  Synthetic oligonucleotide; GGG chr2 60498000 60498019 60498016 +
ccaagaggcccatggaggtg

SEQ ID NO: 162842 - DNA, 20 bp, Artificial Sequence
  Synthetic oligonucleotide; GAG chr2 60498002 60498021 60498018 +
aagaggcccatggaggtggg

SEQ ID NO: 162843 - DNA, 20 bp, Artificial Sequence
  Synthetic oligonucleotide; GAG chr2 60498007 60498026 60498023 +
gcccatggaggtggggagat

SEQ ID NO: 162844 - DNA, 20 bp, Artificial Sequence
  Synthetic oligonucleotide; AGG chr2 60498008 60498027 60498024 +
cccatggaggtggggagatg

SEQ ID NO: 162845 - DNA, 20 bp, Artificial Sequence
  Synthetic oligonucleotide; GGG chr2 60498009 60498028 60498025 +
ccatggaggtggggagatga

SEQ ID NO: 162846 - DNA, 20 bp, Artificial Sequence
  Synthetic oligonucleotide; TGG chr2 60498019 60498038 60498035 +
ggggagatgagggacccacc

SEQ ID NO: 162847 - DNA, 20 bp, Artificial Sequence
  Synthetic oligonucleotide; CAG chr2 60498022 60498041 60498038 +
gagatgagggacccacctgg

SEQ ID NO: 162848 - DNA, 20 bp, Artificial Sequence
  Synthetic oligonucleotide; AAG chr2 60498031 60498050 60498047 +
gacccacctggcagaccctc

SEQ ID NO: 162849 - DNA, 20 bp, Artificial Sequence
  Synthetic oligonucleotide; GAG chr2 60498033 60498052 60498049 +
cccacctggcagaccctcaa

SEQ ID NO: 162850 - DNA, 20 bp, Artificial Sequence
  Synthetic oligonucleotide; CAG chr2 60498036 60498055 60498052 +
acctggcagaccctcaagag

SEQ ID NO: 162851 - DNA, 20 bp, Artificial Sequence
  Synthetic oligonucleotide; AGG chr2 60498037 60498056 60498053 +
cctggcagaccctcaagagc

SEQ ID NO: 162852 - DNA, 20 bp, Artificial Sequence
  Synthetic oligonucleotide; GGG chr2 60498038 60498057 60498054 +
ctggcagaccctcaagagca

SEQ ID NO: 162853 - DNA, 20 bp, Artificial Sequence
  Synthetic oligonucleotide; GGG chr2 60498039 60498058 60498055 +
tggcagaccctcaagagcag

SEQ ID NO: 162854 - DNA, 20 bp, Artificial Sequence
  Synthetic oligonucleotide; TGG chr2 60498051 60498070 60498067 +
aagagcaggggtcttctctt

SEQ ID NO: 162855 - DNA, 20 bp, Artificial Sequence
  Synthetic oligonucleotide; GGG chr2 60498052 60498071 60498068 +
agagcaggggtcttctcttt

SEQ ID NO: 162856 - DNA, 20 bp, Artificial Sequence
  Synthetic oligonucleotide; GGG chr2 60498053 60498072 60498069 +
gagcaggggtcttctctttg

SEQ ID NO: 162857 - DNA, 20 bp, Artificial Sequence
  Synthetic oligonucleotide; GGG chr2 60498054 60498073 60498070 +
agcaggggtcttctctttgg

SEQ ID NO: 162858 - DNA, 20 bp, Artificial Sequence
  Synthetic oligonucleotide; GAG chr2 60498056 60498075 60498072 +
caggggtcttctctttgggg

SEQ ID NO: 162859 - DNA, 20 bp, Artificial Sequence
  Synthetic oligonucleotide; AGG chr2 60498057 60498076 60498073 +
aggggtcttctctttggggg

SEQ ID NO: 162860 - DNA, 20 bp, Artificial Sequence
  Synthetic oligonucleotide; TAG chr2 60498070 60498089 60498086 +
ttgggggaggacatcactct

SEQ ID NO: 162861 - DNA, 20 bp, Artificial Sequence
  Synthetic oligonucleotide; CAG chr2 60498073 60498092 60498089 +
ggggaggacatcactcttag

SEQ ID NO: 162862 - DNA, 20 bp, Artificial Sequence
  Synthetic oligonucleotide; AGG chr2 60498074 60498093 60498090 +
gggaggacatcactcttagc

SEQ ID NO: 162863 - DNA, 20 bp, Artificial Sequence
  Synthetic oligonucleotide; GGG chr2 60498075 60498094 60498091 +
ggaggacatcactcttagca

SEQ ID NO: 162864 - DNA, 20 bp, Artificial Sequence
  Synthetic oligonucleotide; TGG chr2 60498079 60498098 60498095 +
gacatcactcttagcagggc

SEQ ID NO: 162865 - DNA, 20 bp, Artificial Sequence
  Synthetic oligonucleotide; GGG chr2 60498080 60498099 60498096 +
acatcactcttagcagggct

SEQ ID NO: 162866 - DNA, 20 bp, Artificial Sequence
  Synthetic oligonucleotide; GGG chr2 60498081 60498100 60498097 +
catcactcttagcagggctg

SEQ ID NO: 162867 - DNA, 20 bp, Artificial Sequence
  Synthetic oligonucleotide; GAG chr2 60498085 60498104 60498101 +
actcttagcagggctggggt

SEQ ID NO: 162868 - DNA, 20 bp, Artificial Sequence
  Synthetic oligonucleotide; AAG chr2 60498092 60498111 60498108 +
gcagggctggggtgagtcaa

SEQ ID NO: 162869 - DNA, 20 bp, Artificial Sequence
  Synthetic oligonucleotide; TGG chr2 60498097 60498116 60498113 +
gctggggtgagtcaaaagtc

SEQ ID NO: 162870 - DNA, 20 bp, Artificial Sequence
  Synthetic oligonucleotide; GGG chr2 60498098 60498117 60498114 +
ctggggtgagtcaaaagtct

SEQ ID NO: 162871 - DNA, 20 bp, Artificial Sequence
  Synthetic oligonucleotide; GAG chr2 60498100 60498119 60498116 +
ggggtgagtcaaaagtctgg

SEQ ID NO: 162872 - DNA, 20 bp, Artificial Sequence
  Synthetic oligonucleotide; TGG chr2 60498105 60498124 60498121 +
gagtcaaaagtctgggagaa

SEQ ID NO: 162873 - DNA, 20 bp, Artificial Sequence
  Synthetic oligonucleotide; GAG chr2 60498107 60498126 60498123 +
gtcaaaagtctgggagaatg

SEQ ID NO: 162874 - DNA, 20 bp, Artificial Sequence
  Synthetic oligonucleotide; AGG chr2 60498108 60498127 60498124 +
tcaaaagtctgggagaatgg

SEQ ID NO: 162875 - DNA, 20 bp, Artificial Sequence
  Synthetic oligonucleotide; TGG chr2 60498113 60498132 60498129 +
agtctgggagaatggaggtg

SEQ ID NO: 162876 - DNA, 20 bp, Artificial Sequence
  Synthetic oligonucleotide; GAG chr2 60498115 60498134 60498131 +
tctgggagaatggaggtgtg

SEQ ID NO: 162877 - DNA, 20 bp, Artificial Sequence
  Synthetic oligonucleotide; AGG chr2 60498116 60498135 60498132 +
ctgggagaatggaggtgtgg

SEQ ID NO: 162878 - DNA, 20 bp, Artificial Sequence
  Synthetic oligonucleotide; GGG chr2 60498117 60498136 60498133 +
tgggagaatggaggtgtgga

SEQ ID NO: 162879 - DNA, 20 bp, Artificial Sequence
  Synthetic oligonucleotide; GGG chr2 60498118 60498137 60498134 +
gggagaatggaggtgtggag

SEQ ID NO: 162880 - DNA, 20 bp, Artificial Sequence
  Synthetic oligonucleotide; TGG chr2 60498126 60498145 60498142 +
ggaggtgtggaggggataac

SEQ ID NO: 162881 - DNA, 20 bp, Artificial Sequence
  Synthetic oligonucleotide; GGG chr2 60498127 60498146 60498143 +
gaggtgtggaggggataact

SEQ ID NO: 162882 - DNA, 20 bp, Artificial Sequence
  Synthetic oligonucleotide; CAG chr2 60498131 60498150 60498147 +
tgtggaggggataactgggt

SEQ ID NO: 162883 - DNA, 20 bp, Artificial Sequence
  Synthetic oligonucleotide; AAG chr2 60498139 60498158 60498155 +
ggataactgggtcagacccc

SEQ ID NO: 162884 - DNA, 20 bp, Artificial Sequence
  Synthetic oligonucleotide; CAG chr2 60498142 60498161 60498158 +
taactgggtcagaccccaag

SEQ ID NO: 162885 - DNA, 20 bp, Artificial Sequence
  Synthetic oligonucleotide; AGG chr2 60498143 60498162 60498159 +
aactgggtcagaccccaagc

SEQ ID NO: 162886 - DNA, 20 bp, Artificial Sequence
  Synthetic oligonucleotide; AAG chr2 60498146 60498165 60498162 +
tgggtcagaccccaagcagg

SEQ ID NO: 162887 - DNA, 20 bp, Artificial Sequence
  Synthetic oligonucleotide; AGG chr2 60498147 60498166 60498163 +
gggtcagaccccaagcagga

SEQ ID NO: 162888 - DNA, 20 bp, Artificial Sequence
  Synthetic oligonucleotide; GGG chr2 60498148 60498167 60498164 +
ggtcagaccccaagcaggaa

SEQ ID NO: 162889 - DNA, 20 bp, Artificial Sequence
  Synthetic oligonucleotide; TAG chr2 60498159 60498178 60498175 +
aagcaggaagggcctctatg

SEQ ID NO: 162890 - DNA, 20 bp, Artificial Sequence
  Synthetic oligonucleotide; CGG chr2 60498163 60498182 60498179 +
aggaagggcctctatgtaga

SEQ ID NO: 162891 - DNA, 20 bp, Artificial Sequence
  Synthetic oligonucleotide; GGG chr2 60498164 60498183 60498180 +
ggaagggcctctatgtagac

SEQ ID NO: 162892 - DNA, 20 bp, Artificial Sequence
  Synthetic oligonucleotide; TGG chr2 60498171 60498190 60498187 +
cctctatgtagacgggtgtg

SEQ ID NO: 162893 - DNA, 20 bp, Artificial Sequence
  Synthetic oligonucleotide; AAG chr2 60498180 60498199 60498196 +
agacgggtgtgtggctcctt

SEQ ID NO: 162894 - DNA, 20 bp, Artificial Sequence
  Synthetic oligonucleotide; AGG chr2 60498181 60498200 60498197 +
gacgggtgtgtggctcctta

SEQ ID NO: 162895 - DNA, 20 bp, Artificial Sequence
  Synthetic oligonucleotide; CAG chr2 60498189 60498208 60498205 +
tgtggctccttaaggtgacc

SEQ ID NO: 162896 - DNA, 20 bp, Artificial Sequence
  Synthetic oligonucleotide; CAG chr2 60498192 60498211 60498208 +
ggctccttaaggtgacccag

SEQ ID NO: 162897 - DNA, 20 bp, Artificial Sequence
  Synthetic oligonucleotide; TGG chr2 60498198 60498217 60498214 +
ttaaggtgacccagcagccc

SEQ ID NO: 162898 - DNA, 20 bp, Artificial Sequence
  Synthetic oligonucleotide; GGG chr2 60498199 60498218 60498215 +
taaggtgacccagcagccct

SEQ ID NO: 162899 - DNA, 20 bp, Artificial Sequence
  Synthetic oligonucleotide; CAG chr2 60498204 60498223 60498220 +
tgacccagcagccctgggca

SEQ ID NO: 162900 - DNA, 20 bp, Artificial Sequence
  Synthetic oligonucleotide; AAG chr2 60498207 60498226 60498223 +
cccagcagccctgggcacag

SEQ ID NO: 162901 - DNA, 20 bp, Artificial Sequence
  Synthetic oligonucleotide; TGG chr2 60498210 60498229 60498226 +
agcagccctgggcacagaag

SEQ ID NO: 162902 - DNA, 20 bp, Artificial Sequence
  Synthetic oligonucleotide; TGG chr2 60498217 60498236 60498233 +
ctgggcacagaagtggtgcg

SEQ ID NO: 162903 - DNA, 20 bp, Artificial Sequence
  Synthetic oligonucleotide; GAG chr2 60498219 60498238 60498235 +
gggcacagaagtggtgcgtg

SEQ ID NO: 162904 - DNA, 20 bp, Artificial Sequence
  Synthetic oligonucleotide; CAG chr2 60498232 60498251 60498248 +
gtgcgtggagataatgccaa

SEQ ID NO: 162905 - DNA, 20 bp, Artificial Sequence
  Synthetic oligonucleotide; CAG chr2 60498242 60498261 60498258 +
ataatgccaacagtgataac

SEQ ID NO: 162906 - DNA, 20 bp, Artificial Sequence
  Synthetic oligonucleotide; CAG chr2 60498245 60498264 60498261 +
atgccaacagtgataaccag

SEQ ID NO: 162907 - DNA, 20 bp, Artificial Sequence
  Synthetic oligonucleotide; AGG chr2 60498246 60498265 60498262 +
tgccaacagtgataaccagc

SEQ ID NO: 162908 - DNA, 20 bp, Artificial Sequence
  Synthetic oligonucleotide; GGG chr2 60498247 60498266 60498263 +
gccaacagtgataaccagca

SEQ ID NO: 162909 - DNA, 20 bp, Artificial Sequence
  Synthetic oligonucleotide; CAG chr2 60498255 60498274 60498271 +
tgataaccagcagggcctgt

SEQ ID NO: 162910 - DNA, 20 bp, Artificial Sequence
  Synthetic oligonucleotide; AAG chr2 60498258 60498277 60498274 +
taaccagcagggcctgtcag

SEQ ID NO: 162911 - DNA, 20 bp, Artificial Sequence
  Synthetic oligonucleotide; GAG chr2 60498260 60498279 60498276 +
accagcagggcctgtcagaa

SEQ ID NO: 162912 - DNA, 20 bp, Artificial Sequence
  Synthetic oligonucleotide; AGG chr2 60498261 60498280 60498277 +
ccagcagggcctgtcagaag

SEQ ID NO: 162913 - DNA, 20 bp, Artificial Sequence
  Synthetic oligonucleotide; TGG chr2 60498267 60498286 60498283 +
gggcctgtcagaagaggccc

SEQ ID NO: 162914 - DNA, 20 bp, Artificial Sequence
  Synthetic oligonucleotide; AAG chr2 60498276 60498295 60498292 +
agaagaggccctggacactg

SEQ ID NO: 162915 - DNA, 20 bp, Artificial Sequence
  Synthetic oligonucleotide; AGG chr2 60498277 60498296 60498293 +
gaagaggccctggacactga

SEQ ID NO: 162916 - DNA, 20 bp, Artificial Sequence
  Synthetic oligonucleotide; TGG chr2 60498281 60498300 60498297 +
aggccctggacactgaaggc

SEQ ID NO: 162917 - DNA, 20 bp, Artificial Sequence
  Synthetic oligonucleotide; GGG chr2 60498282 60498301 60498298 +
ggccctggacactgaaggct

SEQ ID NO: 162918 - DNA, 20 bp, Artificial Sequence
  Synthetic oligonucleotide; CAG chr2 60498287 60498306 60498303 +
tggacactgaaggctgggca

SEQ ID NO: 162919 - DNA, 20 bp, Artificial Sequence
  Synthetic oligonucleotide; TGG chr2 60498293 60498312 60498309 +
ctgaaggctgggcacagcct

SEQ ID NO: 162920 - DNA, 20 bp, Artificial Sequence
  Synthetic oligonucleotide; GGG chr2 60498294 60498313 60498310 +
tgaaggctgggcacagcctt

SEQ ID NO: 162921 - DNA, 20 bp, Artificial Sequence
  Synthetic oligonucleotide; GGG chr2 60498295 60498314 60498311 +
gaaggctgggcacagccttg

SEQ ID NO: 162922 - DNA, 20 bp, Artificial Sequence
  Synthetic oligonucleotide; CAG chr2 60498306 60498325 60498322 +
acagccttggggaccgctca

SEQ ID NO: 162923 - DNA, 20 bp, Artificial Sequence
  Synthetic oligonucleotide; AGG chr2 60498307 60498326 60498323 +
cagccttggggaccgctcac

SEQ ID NO: 162924 - DNA, 20 bp, Artificial Sequence
  Synthetic oligonucleotide; CAG chr2 60498315 60498334 60498331 +
gggaccgctcacaggacatg

SEQ ID NO: 162925 - DNA, 20 bp, Artificial Sequence
  Synthetic oligonucleotide; CAG chr2 60498318 60498337 60498334 +
accgctcacaggacatgcag

SEQ ID NO: 162926 - DNA, 20 bp, Artificial Sequence
  Synthetic oligonucleotide; CAG chr2 60498354 60498373 60498370 +
ctccctaccgcgacccctat

SEQ ID NO: 162927 - DNA, 20 bp, Artificial Sequence
  Synthetic oligonucleotide; AAG chr2 60498365 60498384 60498381 +
gacccctatcagtgccgacc

SEQ ID NO: 162928 - DNA, 20 bp, Artificial Sequence
  Synthetic oligonucleotide; AAG chr2 60498373 60498392 60498389 +
tcagtgccgaccaagcacac

SEQ ID NO: 162929 - DNA, 20 bp, Artificial Sequence
  Synthetic oligonucleotide; CAG chr2 60498385 60498404 60498401 +
aagcacacaagatgcacacc

SEQ ID NO: 162930 - DNA, 20 bp, Artificial Sequence
  Synthetic oligonucleotide; AGG chr2 60498386 60498405 60498402 +
agcacacaagatgcacaccc

SEQ ID NO: 162931 - DNA, 20 bp, Artificial Sequence
  Synthetic oligonucleotide; TGG chr2 60498390 60498409 60498406 +
cacaagatgcacacccaggc

SEQ ID NO: 162932 - DNA, 20 bp, Artificial Sequence
  Synthetic oligonucleotide; GGG chr2 60498391 60498410 60498407 +
acaagatgcacacccaggct

SEQ ID NO: 162933 - DNA, 20 bp, Artificial Sequence
  Synthetic oligonucleotide; TGG chr2 60498395 60498414 60498411 +
gatgcacacccaggctgggc

SEQ ID NO: 162934 - DNA, 20 bp, Artificial Sequence
  Synthetic oligonucleotide; CAG chr2 60498399 60498418 60498415 +
cacacccaggctgggctgga

SEQ ID NO: 162935 - DNA, 20 bp, Artificial Sequence
  Synthetic oligonucleotide; GAG chr2 60498401 60498420 60498417 +
cacccaggctgggctggaca

SEQ ID NO: 162936 - DNA, 20 bp, Artificial Sequence
  Synthetic oligonucleotide; AGG chr2 60498402 60498421 60498418 +
acccaggctgggctggacag

SEQ ID NO: 162937 - DNA, 20 bp, Artificial Sequence
  Synthetic oligonucleotide; GGG chr2 60498403 60498422 60498419 +
cccaggctgggctggacaga

SEQ ID NO: 162938 - DNA, 20 bp, Artificial Sequence
  Synthetic oligonucleotide; GGG chr2 60498404 60498423 60498420 +
ccaggctgggctggacagag

SEQ ID NO: 162939 - DNA, 20 bp, Artificial Sequence
  Synthetic oligonucleotide; AAG chr2 60498413 60498432 60498429 +
gctggacagaggggtcccac

SEQ ID NO: 162940 - DNA, 20 bp, Artificial Sequence
  Synthetic oligonucleotide; CAG chr2 60498420 60498439 60498436 +
agaggggtcccacaagatca

SEQ ID NO: 162941 - DNA, 20 bp, Artificial Sequence
  Synthetic oligonucleotide; AGG chr2 60498421 60498440 60498437 +
gaggggtcccacaagatcac

SEQ ID NO: 162942 - DNA, 20 bp, Artificial Sequence
  Synthetic oligonucleotide; GGG chr2 60498422 60498441 60498438 +
aggggtcccacaagatcaca

SEQ ID NO: 162943 - DNA, 20 bp, Artificial Sequence
  Synthetic oligonucleotide; GAG chr2 60498433 60498452 60498449 +
aagatcacagggtgtgccct

SEQ ID NO: 162944 - DNA, 20 bp, Artificial Sequence
  Synthetic oligonucleotide; AAG chr2 60498436 60498455 60498452 +
atcacagggtgtgccctgag

SEQ ID NO: 162945 - DNA, 20 bp, Artificial Sequence
  Synthetic oligonucleotide; AGG chr2 60498437 60498456 60498453 +
tcacagggtgtgccctgaga

SEQ ID NO: 162946 - DNA, 20 bp, Artificial Sequence
  Synthetic oligonucleotide; TGG chr2 60498440 60498459 60498456 +
cagggtgtgccctgagaagg

SEQ ID NO: 162947 - DNA, 20 bp, Artificial Sequence
  Synthetic oligonucleotide; GGG chr2 60498441 60498460 60498457 +
agggtgtgccctgagaaggt

SEQ ID NO: 162948 - DNA, 20 bp, Artificial Sequence
  Synthetic oligonucleotide; GGG chr2 60498442 60498461 60498458 +
gggtgtgccctgagaaggtg

SEQ ID NO: 162949 - DNA, 20 bp, Artificial Sequence
  Synthetic oligonucleotide; GAG chr2 60498444 60498463 60498460 +
gtgtgccctgagaaggtggg

SEQ ID NO: 162950 - DNA, 20 bp, Artificial Sequence
  Synthetic oligonucleotide; CAG chr2 60498451 60498470 60498467 +
ctgagaaggtggggagctca

SEQ ID NO: 162951 - DNA, 20 bp, Artificial Sequence
  Synthetic oligonucleotide; AAG chr2 60498459 60498478 60498475 +
gtggggagctcacagcctcc

SEQ ID NO: 162952 - DNA, 20 bp, Artificial Sequence
  Synthetic oligonucleotide; TGG chr2 60498475 60498494 60498491 +
ctccaagcattgcatcatcc

SEQ ID NO: 162953 - DNA, 20 bp, Artificial Sequence
  Synthetic oligonucleotide; CAG chr2 60498481 60498500 60498497 +
gcattgcatcatcctggtac

SEQ ID NO: 162954 - DNA, 20 bp, Artificial Sequence
  Synthetic oligonucleotide; AGG chr2 60498482 60498501 60498498 +
cattgcatcatcctggtacc

SEQ ID NO: 162955 - DNA, 20 bp, Artificial Sequence
  Synthetic oligonucleotide; AAG chr2 60498485 60498504 60498501 +
tgcatcatcctggtaccagg

SEQ ID NO: 162956 - DNA, 20 bp, Artificial Sequence
  Synthetic oligonucleotide; AGG chr2 60498486 60498505 60498502 +
gcatcatcctggtaccagga

SEQ ID NO: 162957 - DNA, 20 bp, Artificial Sequence
  Synthetic oligonucleotide; TGG chr2 60498492 60498511 60498508 +
tcctggtaccaggaaggcaa

SEQ ID NO: 162958 - DNA, 20 bp, Artificial Sequence
  Synthetic oligonucleotide; GGG chr2 60498493 60498512 60498509 +
cctggtaccaggaaggcaat

SEQ ID NO: 162959 - DNA, 20 bp, Artificial Sequence
  Synthetic oligonucleotide; TAG chr2 60498520 60498539 60498536 +
cccatacccacttcccttcc

SEQ ID NO: 162960 - DNA, 20 bp, Artificial Sequence
  Synthetic oligonucleotide; TGG chr2 60498526 60498545 60498542 +
cccacttcccttcctagaat

SEQ ID NO: 162961 - DNA, 20 bp, Artificial Sequence
  Synthetic oligonucleotide; TGG chr2 60498531 60498550 60498547 +
ttcccttcctagaattggcc

SEQ ID NO: 162962 - DNA, 20 bp, Artificial Sequence
  Synthetic oligonucleotide; GGG chr2 60498532 60498551 60498548 +
tcccttcctagaattggcct

SEQ ID NO: 162963 - DNA, 20 bp, Artificial Sequence
  Synthetic oligonucleotide; TAG chr2 60498547 60498566 60498563 +
ggcctgggacattcattatt

SEQ ID NO: 162964 - DNA, 20 bp, Artificial Sequence
  Synthetic oligonucleotide; TGG chr2 60498557 60498576 60498573 +
attcattatttagccacctc

SEQ ID NO: 162965 - DNA, 20 bp, Artificial Sequence
  Synthetic oligonucleotide; TAG chr2 60498587 60498606 60498603 +
atttgtttttcaaattttaa

SEQ ID NO: 162966 - DNA, 20 bp, Artificial Sequence
  Synthetic oligonucleotide; TAG chr2 60498594 60498613 60498610 +
tttcaaattttaatagcaaa

SEQ ID NO: 162967 - DNA, 20 bp, Artificial Sequence
  Synthetic oligonucleotide; AGG chr2 60498595 60498614 60498611 +
ttcaaattttaatagcaaat

SEQ ID NO: 162968 - DNA, 20 bp, Artificial Sequence
  Synthetic oligonucleotide; TAG chr2 60498600 60498619 60498616 +
attttaatagcaaataggct

SEQ ID NO: 162969 - DNA, 20 bp, Artificial Sequence
  Synthetic oligonucleotide; TGG chr2 60498608 60498627 60498624 +
agcaaataggcttagtgtgc

SEQ ID NO: 162970 - DNA, 20 bp, Artificial Sequence
  Synthetic oligonucleotide; GGG chr2 60498609 60498628 60498625 +
gcaaataggcttagtgtgct

SEQ ID NO: 162971 - DNA, 20 bp, Artificial Sequence
  Synthetic oligonucleotide; CAG chr2 60498612 60498631 60498628 +
aataggcttagtgtgctggg

SEQ ID NO: 162972 - DNA, 20 bp, Artificial Sequence
  Synthetic oligonucleotide; GAG chr2 60498614 60498633 60498630 +
taggcttagtgtgctgggca

SEQ ID NO: 162973 - DNA, 20 bp, Artificial Sequence
  Synthetic oligonucleotide; GAG chr2 60498619 60498638 60498635 +
ttagtgtgctgggcagagct

SEQ ID NO: 162974 - DNA, 20 bp, Artificial Sequence
  Synthetic oligonucleotide; CAG chr2 60498622 60498641 60498638 +
gtgtgctgggcagagctgag

SEQ ID NO: 162975 - DNA, 20 bp, Artificial Sequence
  Synthetic oligonucleotide; GAG chr2 60498624 60498643 60498640 +
gtgctgggcagagctgagca

SEQ ID NO: 162976 - DNA, 20 bp, Artificial Sequence
  Synthetic oligonucleotide; AGG chr2 60498625 60498644 60498641 +
tgctgggcagagctgagcag

SEQ ID NO: 162977 - DNA, 20 bp, Artificial Sequence
  Synthetic oligonucleotide; AAG chr2 60498655 60498674 60498671 +
acccctctacctactcacat

SEQ ID NO: 162978 - DNA, 20 bp, Artificial Sequence
  Synthetic oligonucleotide; CAG chr2 60498660 60498679 60498676 +
tctacctactcacataagat

SEQ ID NO: 162979 - DNA, 20 bp, Artificial Sequence
  Synthetic oligonucleotide; AAG chr2 60498665 60498684 60498681 +
ctactcacataagatcagta

SEQ ID NO: 162980 - DNA, 20 bp, Artificial Sequence
  Synthetic oligonucleotide; GAG chr2 60498667 60498686 60498683 +
actcacataagatcagtaaa

SEQ ID NO: 162981 - DNA, 20 bp, Artificial Sequence
  Synthetic oligonucleotide; AAG chr2 60498670 60498689 60498686 +
cacataagatcagtaaagag

SEQ ID NO: 162982 - DNA, 20 bp, Artificial Sequence
  Synthetic oligonucleotide; AGG chr2 60498671 60498690 60498687 +
acataagatcagtaaagaga

SEQ ID NO: 162983 - DNA, 20 bp, Artificial Sequence
  Synthetic oligonucleotide; AAG chr2 60498674 60498693 60498690 +
taagatcagtaaagagaagg

SEQ ID NO: 162984 - DNA, 20 bp, Artificial Sequence
  Synthetic oligonucleotide; CAG chr2 60498677 60498696 60498693 +
gatcagtaaagagaaggaag

SEQ ID NO: 162985 - DNA, 20 bp, Artificial Sequence
  Synthetic oligonucleotide; AGG chr2 60498678 60498697 60498694 +
atcagtaaagagaaggaagc

SEQ ID NO: 162986 - DNA, 20 bp, Artificial Sequence
  Synthetic oligonucleotide; CAG chr2 60498681 60498700 60498697 +
agtaaagagaaggaagcagg

SEQ ID NO: 162987 - DNA, 20 bp, Artificial Sequence
  Synthetic oligonucleotide; GAG chr2 60498686 60498705 60498702 +
agagaaggaagcaggcagat

SEQ ID NO: 162988 - DNA, 20 bp, Artificial Sequence
  Synthetic oligonucleotide; AGG chr2 60498687 60498706 60498703 +
gagaaggaagcaggcagatg

SEQ ID NO: 162989 - DNA, 20 bp, Artificial Sequence
  Synthetic oligonucleotide; AAG chr2 60498694 60498713 60498710 +
aagcaggcagatgaggtgac

SEQ ID NO: 162990 - DNA, 20 bp, Artificial Sequence
  Synthetic oligonucleotide; AGG chr2 60498695 60498714 60498711 +
agcaggcagatgaggtgaca

SEQ ID NO: 162991 - DNA, 20 bp, Artificial Sequence
  Synthetic oligonucleotide; GGG chr2 60498696 60498715 60498712 +
gcaggcagatgaggtgacaa

SEQ ID NO: 162992 - DNA, 20 bp, Artificial Sequence
  Synthetic oligonucleotide; GGG chr2 60498697 60498716 60498713 +
caggcagatgaggtgacaag

SEQ ID NO: 162993 - DNA, 20 bp, Artificial Sequence
  Synthetic oligonucleotide; GAG chr2 60498699 60498718 60498715 +
ggcagatgaggtgacaaggg

SEQ ID NO: 162994 - DNA, 20 bp, Artificial Sequence
  Synthetic oligonucleotide; CAG chr2 60498706 60498725 60498722 +
gaggtgacaaggggagaaac

SEQ ID NO: 162995 - DNA, 20 bp, Artificial Sequence
  Synthetic oligonucleotide; GAG chr2 60498710 60498729 60498726 +
tgacaaggggagaaaccagt

SEQ ID NO: 162996 - DNA, 20 bp, Artificial Sequence
  Synthetic oligonucleotide; AGG chr2 60498711 60498730 60498727 +
gacaaggggagaaaccagtg

SEQ ID NO: 162997 - DNA, 20 bp, Artificial Sequence
  Synthetic oligonucleotide; TAG chr2 60498721 60498740 60498737 +
gaaaccagtgaggtcatcta

SEQ ID NO: 162998 - DNA, 20 bp, Artificial Sequence
  Synthetic oligonucleotide; AGG chr2 60498722 60498741 60498738 +
aaaccagtgaggtcatctat

SEQ ID NO: 162999 - DNA, 20 bp, Artificial Sequence
  Synthetic oligonucleotide; AAG chr2 60498728 60498747 60498744 +
gtgaggtcatctataggtcc

SEQ ID NO: 163000 - DNA, 20 bp, Artificial Sequence
  Synthetic oligonucleotide; CAG chr2 60498737 60498756 60498753 +
tctataggtccaagttcgta

SEQ ID NO: 163001 - DNA, 20 bp, Artificial Sequence
  Synthetic oligonucleotide; CAG chr2 60498743 60498762 60498759 +
ggtccaagttcgtacagacc

SEQ ID NO: 163002 - DNA, 20 bp, Artificial Sequence
  Synthetic oligonucleotide; CAG chr2 60498747 60498766 60498763 +
caagttcgtacagacccagc

SEQ ID NO: 163003 - DNA, 20 bp, Artificial Sequence
  Synthetic oligonucleotide; CAG chr2 60498755 60498774 60498771 +
tacagacccagccagactgc

SEQ ID NO: 163004 - DNA, 20 bp, Artificial Sequence
  Synthetic oligonucleotide; GAG chr2 60498764 60498783 60498780 +
agccagactgccagttctct

SEQ ID NO: 163005 - DNA, 20 bp, Artificial Sequence
  Synthetic oligonucleotide; AGG chr2 60498765 60498784 60498781 +
gccagactgccagttctctg

SEQ ID NO: 163006 - DNA, 20 bp, Artificial Sequence
  Synthetic oligonucleotide; GAG chr2 60498767 60498786 60498783 +
cagactgccagttctctgag

SEQ ID NO: 163007 - DNA, 20 bp, Artificial Sequence
  Synthetic oligonucleotide; TAG chr2 60498771 60498790 60498787 +
ctgccagttctctgaggagc

SEQ ID NO: 163008 - DNA, 20 bp, Artificial Sequence
  Synthetic oligonucleotide; GAG chr2 60498773 60498792 60498789 +
gccagttctctgaggagcta

SEQ ID NO: 163009 - DNA, 20 bp, Artificial Sequence
  Synthetic oligonucleotide; TGG chr2 60498781 60498800 60498797 +
tctgaggagctagagacttg

SEQ ID NO: 163010 - DNA, 20 bp, Artificial Sequence
  Synthetic oligonucleotide; AAG chr2 60498787 60498806 60498803 +
gagctagagacttgtggctt

SEQ ID NO: 163011 - DNA, 20 bp, Artificial Sequence
  Synthetic oligonucleotide; AGG chr2 60498788 60498807 60498804 +
agctagagacttgtggctta

SEQ ID NO: 163012 - DNA, 20 bp, Artificial Sequence
  Synthetic oligonucleotide; AAG chr2 60498791 60498810 60498807 +
tagagacttgtggcttaagg

SEQ ID NO: 163013 - DNA, 20 bp, Artificial Sequence
  Synthetic oligonucleotide; TGG chr2 60498803 60498822 60498819 +
gcttaaggaagcctctctga

SEQ ID NO: 163014 - DNA, 20 bp, Artificial Sequence
  Synthetic oligonucleotide; CAG chr2 60498868 60498887 60498884 +
ctgtaaatcttgatcaaact

SEQ ID NO: 163015 - DNA, 20 bp, Artificial Sequence
  Synthetic oligonucleotide; CAG chr2 60498889 60498908 60498905 +
agatgactgtccaactcatc

SEQ ID NO: 163016 - DNA, 20 bp, Artificial Sequence
  Synthetic oligonucleotide; TAG chr2 60498909 60498928 60498925 +
cagaaactacgtttgtctaa

SEQ ID NO: 163017 - DNA, 20 bp, Artificial Sequence
  Synthetic oligonucleotide; CAG chr2 60498914 60498933 60498930 +
actacgtttgtctaatagaa

SEQ ID NO: 163018 - DNA, 20 bp, Artificial Sequence
  Synthetic oligonucleotide; AGG chr2 60498915 60498934 60498931 +
ctacgtttgtctaatagaac

SEQ ID NO: 163019 - DNA, 20 bp, Artificial Sequence
  Synthetic oligonucleotide; AAG chr2 60498918 60498937 60498934 +
cgtttgtctaatagaacagg

SEQ ID NO: 163020 - DNA, 20 bp, Artificial Sequence
  Synthetic oligonucleotide; CAG chr2 60498921 60498940 60498937 +
ttgtctaatagaacaggaag

SEQ ID NO: 163021 - DNA, 20 bp, Artificial Sequence
  Synthetic oligonucleotide; AGG chr2 60498922 60498941 60498938 +
tgtctaatagaacaggaagc

SEQ ID NO: 163022 - DNA, 20 bp, Artificial Sequence
  Synthetic oligonucleotide; TGG chr2 60498925 60498944 60498941 +
ctaatagaacaggaagcagg

SEQ ID NO: 163023 - DNA, 20 bp, Artificial Sequence
  Synthetic oligonucleotide; TGG chr2 60498928 60498947 60498944 +
atagaacaggaagcaggtgg

SEQ ID NO: 163024 - DNA, 20 bp, Artificial Sequence
  Synthetic oligonucleotide; TGG chr2 60498931 60498950 60498947 +
gaacaggaagcaggtggtgg

SEQ ID NO: 163025 - DNA, 20 bp, Artificial Sequence
  Synthetic oligonucleotide; TGG chr2 60498934 60498953 60498950 +
caggaagcaggtggtggtgg

SEQ ID NO: 163026 - DNA, 20 bp, Artificial Sequence
  Synthetic oligonucleotide; GGG chr2 60498935 60498954 60498951 +
aggaagcaggtggtggtggt

SEQ ID NO: 163027 - DNA, 20 bp, Artificial Sequence
  Synthetic oligonucleotide; TGG chr2 60498938 60498957 60498954 +
aagcaggtggtggtggtggg

SEQ ID NO: 163028 - DNA, 20 bp, Artificial Sequence
  Synthetic oligonucleotide; TGG chr2 60498941 60498960 60498957 +
caggtggtggtggtgggtgg

SEQ ID NO: 163029 - DNA, 20 bp, Artificial Sequence
  Synthetic oligonucleotide; GGG chr2 60498942 60498961 60498958 +
aggtggtggtggtgggtggt

SEQ ID NO: 163030 - DNA, 20 bp, Artificial Sequence
  Synthetic oligonucleotide; GGG chr2 60498943 60498962 60498959 +
ggtggtggtggtgggtggtg

SEQ ID NO: 163031 - DNA, 20 bp, Artificial Sequence
  Synthetic oligonucleotide; GGG chr2 60498944 60498963 60498960 +
gtggtggtggtgggtggtgg

SEQ ID NO: 163032 - DNA, 20 bp, Artificial Sequence
  Synthetic oligonucleotide; GGG chr2 60498945 60498964 60498961 +
tggtggtggtgggtggtggg

SEQ ID NO: 163033 - DNA, 20 bp, Artificial Sequence
  Synthetic oligonucleotide; GGG chr2 60498946 60498965 60498962 +
ggtggtggtgggtggtgggg

SEQ ID NO: 163034 - DNA, 20 bp, Artificial Sequence
  Synthetic oligonucleotide; GAG chr2 60498956 60498975 60498972 +
ggtggtgggggggcattgat

SEQ ID NO: 163035 - DNA, 20 bp, Artificial Sequence
  Synthetic oligonucleotide; GAG chr2 60498958 60498977 60498974 +
tggtgggggggcattgatga

SEQ ID NO: 163036 - DNA, 20 bp, Artificial Sequence
  Synthetic oligonucleotide; AGG chr2 60498959 60498978 60498975 +
ggtgggggggcattgatgag

SEQ ID NO: 163037 - DNA, 20 bp, Artificial Sequence
  Synthetic oligonucleotide; CAG chr2 60498962 60498981 60498978 +
gggggggcattgatgagagg

SEQ ID NO: 163038 - DNA, 20 bp, Artificial Sequence
  Synthetic oligonucleotide; AGG chr2 60498963 60498982 60498979 +
ggggggcattgatgagaggc

SEQ ID NO: 163039 - DNA, 20 bp, Artificial Sequence
  Synthetic oligonucleotide; GGG chr2 60498964 60498983 60498980 +
gggggcattgatgagaggca

SEQ ID NO: 163040 - DNA, 20 bp, Artificial Sequence
  Synthetic oligonucleotide; CAG chr2 60498968 60498987 60498984 +
gcattgatgagaggcagggc

SEQ ID NO: 163041 - DNA, 20 bp, Artificial Sequence
  Synthetic oligonucleotide; CAG chr2 60499013 60499032 60499029 +
ccactgattctgtccccaca

SEQ ID NO: 163042 - DNA, 20 bp, Artificial Sequence
  Synthetic oligonucleotide; AGG chr2 60499014 60499033 60499030 +
cactgattctgtccccacac

SEQ ID NO: 163043 - DNA, 20 bp, Artificial Sequence
  Synthetic oligonucleotide; AAG chr2 60499023 60499042 60499039 +
tgtccccacacaggcatcca

SEQ ID NO: 163044 - DNA, 20 bp, Artificial Sequence
  Synthetic oligonucleotide; AGG chr2 60499024 60499043 60499040 +
gtccccacacaggcatccaa

SEQ ID NO: 163045 - DNA, 20 bp, Artificial Sequence
  Synthetic oligonucleotide; GGG chr2 60499025 60499044 60499041 +
tccccacacaggcatccaaa

SEQ ID NO: 163046 - DNA, 20 bp, Artificial Sequence
  Synthetic oligonucleotide; AAG chr2 60499028 60499047 60499044 +
ccacacaggcatccaaaggg

SEQ ID NO: 163047 - DNA, 20 bp, Artificial Sequence
  Synthetic oligonucleotide; CAG chr2 60499038 60499057 60499054 +
atccaaagggaagaatgcta

SEQ ID NO: 163048 - DNA, 20 bp, Artificial Sequence
  Synthetic oligonucleotide; CAG chr2 60499044 60499063 60499060 +
agggaagaatgctacagcta

SEQ ID NO: 163049 - DNA, 20 bp, Artificial Sequence
  Synthetic oligonucleotide; TGG chr2 60499059 60499078 60499075 +
agctacagtccatttctcgc

SEQ ID NO: 163050 - DNA, 20 bp, Artificial Sequence
  Synthetic oligonucleotide; TGG chr2 60499068 60499087 60499084 +
ccatttctcgctggcttttc

SEQ ID NO: 163051 - DNA, 20 bp, Artificial Sequence
  Synthetic oligonucleotide; GGG chr2 60499069 60499088 60499085 +
catttctcgctggcttttct

SEQ ID NO: 163052 - DNA, 20 bp, Artificial Sequence
  Synthetic oligonucleotide; GAG chr2 60499071 60499090 60499087 +
tttctcgctggcttttctgg

SEQ ID NO: 163053 - DNA, 20 bp, Artificial Sequence
  Synthetic oligonucleotide; CAG chr2 60499095 60499114 60499111 +
tcaccctacaatgtgttccc

SEQ ID NO: 163054 - DNA, 20 bp, Artificial Sequence
  Synthetic oligonucleotide; CAG chr2 60499102 60499121 60499118 +
acaatgtgttccccagtatt

SEQ ID NO: 163055 - DNA, 20 bp, Artificial Sequence
  Synthetic oligonucleotide; AGG chr2 60499103 60499122 60499119 +
caatgtgttccccagtattc

SEQ ID NO: 163056 - DNA, 20 bp, Artificial Sequence
  Synthetic oligonucleotide; TGG chr2 60499110 60499129 60499126 +
ttccccagtattcaggtttc

SEQ ID NO: 163057 - DNA, 20 bp, Artificial Sequence
  Synthetic oligonucleotide; GGG chr2 60499111 60499130 60499127 +
tccccagtattcaggtttct

SEQ ID NO: 163058 - DNA, 20 bp, Artificial Sequence
  Synthetic oligonucleotide; TGG chr2 60499130 60499149 60499146 +
tgggctgccattatcttctc

SEQ ID NO: 163059 - DNA, 20 bp, Artificial Sequence
  Synthetic oligonucleotide; CGG chr2 60499136 60499155 60499152 +
gccattatcttctctggtct

SEQ ID NO: 163060 - DNA, 20 bp, Artificial Sequence
  Synthetic oligonucleotide; GGG chr2 60499137 60499156 60499153 +
ccattatcttctctggtctc

SEQ ID NO: 163061 - DNA, 20 bp, Artificial Sequence
  Synthetic oligonucleotide; GGG chr2 60499138 60499157 60499154 +
cattatcttctctggtctcg

SEQ ID NO: 163062 - DNA, 20 bp, Artificial Sequence
  Synthetic oligonucleotide; AAG chr2 60499144 60499163 60499160 +
cttctctggtctcggggccc

SEQ ID NO: 163063 - DNA, 20 bp, Artificial Sequence
  Synthetic oligonucleotide; AAG chr2 60499150 60499169 60499166 +
tggtctcggggcccaagcca

SEQ ID NO: 163064 - DNA, 20 bp, Artificial Sequence
  Synthetic oligonucleotide; GAG chr2 60499152 60499171 60499168 +
gtctcggggcccaagccaaa

SEQ ID NO: 163065 - DNA, 20 bp, Artificial Sequence
  Synthetic oligonucleotide; TGG chr2 60499156 60499175 60499172 +
cggggcccaagccaaagagc

SEQ ID NO: 163066 - DNA, 20 bp, Artificial Sequence
  Synthetic oligonucleotide; GAG chr2 60499158 60499177 60499174 +
gggcccaagccaaagagctg

SEQ ID NO: 163067 - DNA, 20 bp, Artificial Sequence
  Synthetic oligonucleotide; CAG chr2 60499163 60499182 60499179 +
caagccaaagagctggagaa

SEQ ID NO: 163068 - DNA, 20 bp, Artificial Sequence
  Synthetic oligonucleotide; TGG chr2 60499170 60499189 60499186 +
aagagctggagaacagtatc

SEQ ID NO: 163069 - DNA, 20 bp, Artificial Sequence
  Synthetic oligonucleotide; CAG chr2 60499176 60499195 60499192 +
tggagaacagtatctggcca

SEQ ID NO: 163070 - DNA, 20 bp, Artificial Sequence
  Synthetic oligonucleotide; AAG chr2 60499184 60499203 60499200 +
agtatctggccacagaacct

SEQ ID NO: 163071 - DNA, 20 bp, Artificial Sequence
  Synthetic oligonucleotide; AGG chr2 60499185 60499204 60499201 +
gtatctggccacagaaccta

SEQ ID NO: 163072 - DNA, 20 bp, Artificial Sequence
  Synthetic oligonucleotide; TGG chr2 60499190 60499209 60499206 +
tggccacagaacctaaggcc

SEQ ID NO: 163073 - DNA, 20 bp, Artificial Sequence
  Synthetic oligonucleotide; TAG chr2 60499193 60499212 60499209 +
ccacagaacctaaggcctgg

SEQ ID NO: 163074 - DNA, 20 bp, Artificial Sequence
  Synthetic oligonucleotide; GAG chr2 60499195 60499214 60499211 +
acagaacctaaggcctggta

SEQ ID NO: 163075 - DNA, 20 bp, Artificial Sequence
  Synthetic oligonucleotide; AAG chr2 60499199 60499218 60499215 +
aacctaaggcctggtagagc

SEQ ID NO: 163076 - DNA, 20 bp, Artificial Sequence
  Synthetic oligonucleotide; CAG chr2 60499203 60499222 60499219 +
taaggcctggtagagcaaga

SEQ ID NO: 163077 - DNA, 20 bp, Artificial Sequence
  Synthetic oligonucleotide; AAG chr2 60499214 60499233 60499230 +
agagcaagacagccatgtgc

SEQ ID NO: 163078 - DNA, 20 bp, Artificial Sequence
  Synthetic oligonucleotide; AGG chr2 60499215 60499234 60499231 +
gagcaagacagccatgtgca

SEQ ID NO: 163079 - DNA, 20 bp, Artificial Sequence
  Synthetic oligonucleotide; GAG chr2 60499219 60499238 60499235 +
aagacagccatgtgcaaggc

SEQ ID NO: 163080 - DNA, 20 bp, Artificial Sequence
  Synthetic oligonucleotide; TGG chr2 60499222 60499241 60499238 +
acagccatgtgcaaggcgag

SEQ ID NO: 163081 - DNA, 20 bp, Artificial Sequence
  Synthetic oligonucleotide; TAG chr2 60499226 60499245 60499242 +
ccatgtgcaaggcgagtgga

SEQ ID NO: 163082 - DNA, 20 bp, Artificial Sequence
  Synthetic oligonucleotide; CAG chr2 60499248 60499267 60499264 +
gcgcccttccgtcactccca

SEQ ID NO: 163083 - DNA, 20 bp, Artificial Sequence
  Synthetic oligonucleotide; GAG chr2 60499250 60499269 60499266 +
gcccttccgtcactcccaca

SEQ ID NO: 163084 - DNA, 20 bp, Artificial Sequence
  Synthetic oligonucleotide; CAG chr2 60499256 60499275 60499272 +
ccgtcactcccacagagctg

SEQ ID NO: 163085 - DNA, 20 bp, Artificial Sequence
  Synthetic oligonucleotide; AGG chr2 60499257 60499276 60499273 +
cgtcactcccacagagctgc

SEQ ID NO: 163086 - DNA, 20 bp, Artificial Sequence
  Synthetic oligonucleotide; GGG chr2 60499258 60499277 60499274 +
gtcactcccacagagctgca

SEQ ID NO: 163087 - DNA, 20 bp, Artificial Sequence
  Synthetic oligonucleotide; GGG chr2 60499259 60499278 60499275 +
tcactcccacagagctgcag

SEQ ID NO: 163088 - DNA, 20 bp, Artificial Sequence
  Synthetic oligonucleotide; CAG chr2 60499277 60499296 60499293 +
aggggtgtgacgcccctgcc

SEQ ID NO: 163089 - DNA, 20 bp, Artificial Sequence
  Synthetic oligonucleotide; TGG chr2 60499291 60499310 60499307 +
cctgcccagccatacccttc

SEQ ID NO: 163090 - DNA, 20 bp, Artificial Sequence
  Synthetic oligonucleotide; GGG chr2 60499292 60499311 60499308 +
ctgcccagccatacccttct

SEQ ID NO: 163091 - DNA, 20 bp, Artificial Sequence
  Synthetic oligonucleotide; CAG chr2 60499298 60499317 60499314 +
agccatacccttctgggcca

SEQ ID NO: 163092 - DNA, 20 bp, Artificial Sequence
  Synthetic oligonucleotide; TGG chr2 60499304 60499323 60499320 +
acccttctgggccacagtgc

SEQ ID NO: 163093 - DNA, 20 bp, Artificial Sequence
  Synthetic oligonucleotide; GAG chr2 60499306 60499325 60499322 +
ccttctgggccacagtgctg

SEQ ID NO: 163094 - DNA, 20 bp, Artificial Sequence
  Synthetic oligonucleotide; AGG chr2 60499307 60499326 60499323 +
cttctgggccacagtgctgg

SEQ ID NO: 163095 - DNA, 20 bp, Artificial Sequence
  Synthetic oligonucleotide; AAG chr2 60499313 60499332 60499329 +
ggccacagtgctggaggctg

SEQ ID NO: 163096 - DNA, 20 bp, Artificial Sequence
  Synthetic oligonucleotide; AAG chr2 60499319 60499338 60499335 +
agtgctggaggctgaagtca

SEQ ID NO: 163097 - DNA, 20 bp, Artificial Sequence
  Synthetic oligonucleotide; CAG chr2 60499342 60499361 60499358 +
cccatcgtgccttattcctt

SEQ ID NO: 163098 - DNA, 20 bp, Artificial Sequence
  Synthetic oligonucleotide; AGG chr2 60499343 60499362 60499359 +
ccatcgtgccttattccttc

SEQ ID NO: 163099 - DNA, 20 bp, Artificial Sequence
  Synthetic oligonucleotide; GAG chr2 60499345 60499364 60499361 +
atcgtgccttattccttcag

SEQ ID NO: 163100 - DNA, 20 bp, Artificial Sequence
  Synthetic oligonucleotide; TGG chr2 60499357 60499376 60499373 +
tccttcaggagcaatactcc

SEQ ID NO: 163101 - DNA, 20 bp, Artificial Sequence
  Synthetic oligonucleotide; GGG chr2 60499358 60499377 60499374 +
ccttcaggagcaatactcct

SEQ ID NO: 163102 - DNA, 20 bp, Artificial Sequence
  Synthetic oligonucleotide; AAG chr2 60499362 60499381 60499378 +
caggagcaatactcctggga

SEQ ID NO: 163103 - DNA, 20 bp, Artificial Sequence
  Synthetic oligonucleotide; AGG chr2 60499363 60499382 60499379 +
aggagcaatactcctgggaa

SEQ ID NO: 163104 - DNA, 20 bp, Artificial Sequence
  Synthetic oligonucleotide; AAG chr2 60499388 60499407 60499404 +
gcacattctgtaactcctct

SEQ ID NO: 163105 - DNA, 20 bp, Artificial Sequence
  Synthetic oligonucleotide; CAG chr2 60499404 60499423 60499420 +
ctctaagtgatatttcttcc

SEQ ID NO: 163106 - DNA, 20 bp, Artificial Sequence
  Synthetic oligonucleotide; AGG chr2 60499405 60499424 60499421 +
tctaagtgatatttcttccc

SEQ ID NO: 163107 - DNA, 20 bp, Artificial Sequence
  Synthetic oligonucleotide; GGG chr2 60499406 60499425 60499422 +
ctaagtgatatttcttccca

SEQ ID NO: 163108 - DNA, 20 bp, Artificial Sequence
  Synthetic oligonucleotide; GGG chr2 60499407 60499426 60499423 +
taagtgatatttcttcccag

SEQ ID NO: 163109 - DNA, 20 bp, Artificial Sequence
  Synthetic oligonucleotide; AAG chr2 60499415 60499434 60499431 +
atttcttcccaggggcaaaa

SEQ ID NO: 163110 - DNA, 20 bp, Artificial Sequence
  Synthetic oligonucleotide; AGG chr2 60499416 60499435 60499432 +
tttcttcccaggggcaaaaa

SEQ ID NO: 163111 - DNA, 20 bp, Artificial Sequence
  Synthetic oligonucleotide; TAG chr2 60499423 60499442 60499439 +
ccaggggcaaaaaaggaaat

SEQ ID NO: 163112 - DNA, 20 bp, Artificial Sequence
  Synthetic oligonucleotide; TAG chr2 60499436 60499455 60499452 +
aggaaattagccccatttta

SEQ ID NO: 163113 - DNA, 20 bp, Artificial Sequence
  Synthetic oligonucleotide; AAG chr2 60499442 60499461 60499458 +
ttagccccattttatagata

SEQ ID NO: 163114 - DNA, 20 bp, Artificial Sequence
  Synthetic oligonucleotide; GAG chr2 60499444 60499463 60499460 +
agccccattttatagataaa

SEQ ID NO: 163115 - DNA, 20 bp, Artificial Sequence
  Synthetic oligonucleotide; GAG chr2 60499450 60499469 60499466 +
attttatagataaagagcct

SEQ ID NO: 163116 - DNA, 20 bp, Artificial Sequence
  Synthetic oligonucleotide; AGG chr2 60499451 60499470 60499467 +
ttttatagataaagagcctg

SEQ ID NO: 163117 - DNA, 20 bp, Artificial Sequence
  Synthetic oligonucleotide; TAG chr2 60499459 60499478 60499475 +
ataaagagcctgaggcccaa

SEQ ID NO: 163118 - DNA, 20 bp, Artificial Sequence
  Synthetic oligonucleotide; AGG chr2 60499460 60499479 60499476 +
taaagagcctgaggcccaat

SEQ ID NO: 163119 - DNA, 20 bp, Artificial Sequence
  Synthetic oligonucleotide; CGG chr2 60499477 60499496 60499493 +
aataggctgattgacttgtc

SEQ ID NO: 163120 - DNA, 20 bp, Artificial Sequence
  Synthetic oligonucleotide; GGG chr2 60499478 60499497 60499494 +
ataggctgattgacttgtcc

SEQ ID NO: 163121 - DNA, 20 bp, Artificial Sequence
  Synthetic oligonucleotide; GGG chr2 60499479 60499498 60499495 +
taggctgattgacttgtccg

SEQ ID NO: 163122 - DNA, 20 bp, Artificial Sequence
  Synthetic oligonucleotide; TAG chr2 60499487 60499506 60499503 +
ttgacttgtccggggccacc

SEQ ID NO: 163123 - DNA, 20 bp, Artificial Sequence
  Synthetic oligonucleotide; CAG chr2 60499491 60499510 60499507 +
cttgtccggggccacctagc

SEQ ID NO: 163124 - DNA, 20 bp, Artificial Sequence
  Synthetic oligonucleotide; CAG chr2 60499494 60499513 60499510 +
gtccggggccacctagccag

SEQ ID NO: 163125 - DNA, 20 bp, Artificial Sequence
  Synthetic oligonucleotide; AGG chr2 60499495 60499514 60499511 +
tccggggccacctagccagc

SEQ ID NO: 163126 - DNA, 20 bp, Artificial Sequence
  Synthetic oligonucleotide; AAG chr2 60499502 60499521 60499518 +
ccacctagccagcaggtgaa

SEQ ID NO: 163127 - DNA, 20 bp, Artificial Sequence
  Synthetic oligonucleotide; TAG chr2 60499514 60499533 60499530 +
caggtgaaaagactcatgtg

SEQ ID NO: 163128 - DNA, 20 bp, Artificial Sequence
  Synthetic oligonucleotide; TAG chr2 60499524 60499543 60499540 +
gactcatgtgtagctgactt

SEQ ID NO: 163129 - DNA, 20 bp, Artificial Sequence
  Synthetic oligonucleotide; GAG chr2 60499526 60499545 60499542 +
ctcatgtgtagctgacttta

SEQ ID NO: 163130 - DNA, 20 bp, Artificial Sequence
  Synthetic oligonucleotide; AAG chr2 60499532 60499551 60499548 +
tgtagctgactttagagtcc

SEQ ID NO: 163131 - DNA, 20 bp, Artificial Sequence
  Synthetic oligonucleotide; AAG chr2 60499558 60499577 60499574 +
cttcaacgtcccactttctc

SEQ ID NO: 163132 - DNA, 20 bp, Artificial Sequence
  Synthetic oligonucleotide; CAG chr2 60499562 60499581 60499578 +
aacgtcccactttctcaaga

SEQ ID NO: 163133 - DNA, 20 bp, Artificial Sequence
  Synthetic oligonucleotide; CGG chr2 60499574 60499593 60499590 +
tctcaagacagtgtttgcca

SEQ ID NO: 163134 - DNA, 20 bp, Artificial Sequence
  Synthetic oligonucleotide; GGG chr2 60499575 60499594 60499591 +
ctcaagacagtgtttgccac

SEQ ID NO: 163135 - DNA, 20 bp, Artificial Sequence
  Synthetic oligonucleotide; CAG chr2 60499579 60499598 60499595 +
agacagtgtttgccacgggc

SEQ ID NO: 163136 - DNA, 20 bp, Artificial Sequence
  Synthetic oligonucleotide; AGG chr2 60499580 60499599 60499596 +
gacagtgtttgccacgggcc

SEQ ID NO: 163137 - DNA, 20 bp, Artificial Sequence
  Synthetic oligonucleotide; GGG chr2 60499581 60499600 60499597 +
acagtgtttgccacgggcca

SEQ ID NO: 163138 - DNA, 20 bp, Artificial Sequence
  Synthetic oligonucleotide; TAG chr2 60499585 60499604 60499601 +
tgtttgccacgggccagggc

SEQ ID NO: 163139 - DNA, 20 bp, Artificial Sequence
  Synthetic oligonucleotide; AAG chr2 60499592 60499611 60499608 +
cacgggccagggctagcaaa

SEQ ID NO: 163140 - DNA, 20 bp, Artificial Sequence
  Synthetic oligonucleotide; CAG chr2 60499633 60499652 60499649 +
acctccccaccaaccccatg

SEQ ID NO: 163141 - DNA, 20 bp, Artificial Sequence
  Synthetic oligonucleotide; AGG chr2 60499634 60499653 60499650 +
cctccccaccaaccccatgc

SEQ ID NO: 163142 - DNA, 20 bp, Artificial Sequence
  Synthetic oligonucleotide; CAG chr2 60499640 60499659 60499656 +
caccaaccccatgcaggtgt

SEQ ID NO: 163143 - DNA, 20 bp, Artificial Sequence
  Synthetic oligonucleotide; GAG chr2 60499644 60499663 60499660 +
aaccccatgcaggtgtcagt

SEQ ID NO: 163144 - DNA, 20 bp, Artificial Sequence
  Synthetic oligonucleotide; AGG chr2 60499645 60499664 60499661 +
accccatgcaggtgtcagtg

SEQ ID NO: 163145 - DNA, 20 bp, Artificial Sequence
  Synthetic oligonucleotide; CAG chr2 60499650 60499669 60499666 +
atgcaggtgtcagtgaggcc

SEQ ID NO: 163146 - DNA, 20 bp, Artificial Sequence
  Synthetic oligonucleotide; AGG chr2 60499651 60499670 60499667 +
tgcaggtgtcagtgaggccc

SEQ ID NO: 163147 - DNA, 20 bp, Artificial Sequence
  Synthetic oligonucleotide; AAG chr2 60499660 60499679 60499676 +
cagtgaggcccaggaacatg

SEQ ID NO: 163148 - DNA, 20 bp, Artificial Sequence
  Synthetic oligonucleotide; CGG chr2 60499668 60499687 60499684 +
cccaggaacatgaagctccc

SEQ ID NO: 163149 - DNA, 20 bp, Artificial Sequence
  Synthetic oligonucleotide; AAG chr2 60499675 60499694 60499691 +
acatgaagctccccggacca

SEQ ID NO: 163150 - DNA, 20 bp, Artificial Sequence
  Synthetic oligonucleotide; AGG chr2 60499676 60499695 60499692 +
catgaagctccccggaccaa

SEQ ID NO: 163151 - DNA, 20 bp, Artificial Sequence
  Synthetic oligonucleotide; GGG chr2 60499677 60499696 60499693 +
atgaagctccccggaccaaa

SEQ ID NO: 163152 - DNA, 20 bp, Artificial Sequence
  Synthetic oligonucleotide; GGG chr2 60499678 60499697 60499694 +
tgaagctccccggaccaaag

SEQ ID NO: 163153 - DNA, 20 bp, Artificial Sequence
  Synthetic oligonucleotide; TGG chr2 60499681 60499700 60499697 +
agctccccggaccaaagggg

SEQ ID NO: 163154 - DNA, 20 bp, Artificial Sequence
  Synthetic oligonucleotide; CAG chr2 60499685 60499704 60499701 +
ccccggaccaaaggggtgga

SEQ ID NO: 163155 - DNA, 20 bp, Artificial Sequence
  Synthetic oligonucleotide; AAG chr2 60499693 60499712 60499709 +
caaaggggtggacagcactg

SEQ ID NO: 163156 - DNA, 20 bp, Artificial Sequence
  Synthetic oligonucleotide; AGG chr2 60499694 60499713 60499710 +
aaaggggtggacagcactga

SEQ ID NO: 163157 - DNA, 20 bp, Artificial Sequence
  Synthetic oligonucleotide; GAG chr2 60499712 60499731 60499728 +
gaaggaaaccgctcaacctt

SEQ ID NO: 163158 - DNA, 20 bp, Artificial Sequence
  Synthetic oligonucleotide; TGG chr2 60499715 60499734 60499731 +
ggaaaccgctcaaccttgag

SEQ ID NO: 163159 - DNA, 20 bp, Artificial Sequence
  Synthetic oligonucleotide; GAG chr2 60499717 60499736 60499733 +
aaaccgctcaaccttgagtg

SEQ ID NO: 163160 - DNA, 20 bp, Artificial Sequence
  Synthetic oligonucleotide; GAG chr2 60499719 60499738 60499735 +
accgctcaaccttgagtgga

SEQ ID NO: 163161 - DNA, 20 bp, Artificial Sequence
  Synthetic oligonucleotide; AGG chr2 60499720 60499739 60499736 +
ccgctcaaccttgagtggag

SEQ ID NO: 163162 - DNA, 20 bp, Artificial Sequence
  Synthetic oligonucleotide; CAG chr2 60499734 60499753 60499750 +
gtggagaggctgctgtgaaa

SEQ ID NO: 163163 - DNA, 20 bp, Artificial Sequence
  Synthetic oligonucleotide; TGG chr2 60499740 60499759 60499756 +
aggctgctgtgaaacagctc

SEQ ID NO: 163164 - DNA, 20 bp, Artificial Sequence
  Synthetic oligonucleotide; GGG chr2 60499741 60499760 60499757 +
ggctgctgtgaaacagctct

SEQ ID NO: 163165 - DNA, 20 bp, Artificial Sequence
  Synthetic oligonucleotide; CAG chr2 60499744 60499763 60499760 +
tgctgtgaaacagctctggg

SEQ ID NO: 163166 - DNA, 20 bp, Artificial Sequence
  Synthetic oligonucleotide; TGG chr2 60499751 60499770 60499767 +
aaacagctctgggcagcacc

SEQ ID NO: 163167 - DNA, 20 bp, Artificial Sequence
  Synthetic oligonucleotide; GGG chr2 60499752 60499771 60499768 +
aacagctctgggcagcacct

SEQ ID NO: 163168 - DNA, 20 bp, Artificial Sequence
  Synthetic oligonucleotide; CAG chr2 60499758 60499777 60499774 +
tctgggcagcacctgggcca

SEQ ID NO: 163169 - DNA, 20 bp, Artificial Sequence
  Synthetic oligonucleotide; TGG chr2 60499765 60499784 60499781 +
agcacctgggccacagcatg

SEQ ID NO: 163170 - DNA, 20 bp, Artificial Sequence
  Synthetic oligonucleotide; AAG chr2 60499768 60499787 60499784 +
acctgggccacagcatgtgg

SEQ ID NO: 163171 - DNA, 20 bp, Artificial Sequence
  Synthetic oligonucleotide; AGG chr2 60499769 60499788 60499785 +
cctgggccacagcatgtgga

SEQ ID NO: 163172 - DNA, 20 bp, Artificial Sequence
  Synthetic oligonucleotide; GAG chr2 60499771 60499790 60499787 +
tgggccacagcatgtggaag

SEQ ID NO: 163173 - DNA, 20 bp, Artificial Sequence
  Synthetic oligonucleotide; AAG chr2 60499784 60499803 60499800 +
gtggaaggagacatgttcct

SEQ ID NO: 163174 - DNA, 20 bp, Artificial Sequence
  Synthetic oligonucleotide; TGG chr2 60499792 60499811 60499808 +
agacatgttcctaagctgcc

SEQ ID NO: 163175 - DNA, 20 bp, Artificial Sequence
  Synthetic oligonucleotide; AAG chr2 60499831 60499850 60499847 +
ttctcttcctcctaatccat

SEQ ID NO: 163176 - DNA, 20 bp, Artificial Sequence
  Synthetic oligonucleotide; CAG chr2 60499837 60499856 60499853 +
tcctcctaatccataagcac

SEQ ID NO: 163177 - DNA, 20 bp, Artificial Sequence
  Synthetic oligonucleotide; AAG chr2 60499845 60499864 60499861 +
atccataagcaccagacctc

SEQ ID NO: 163178 - DNA, 20 bp, Artificial Sequence
  Synthetic oligonucleotide; CAG chr2 60499857 60499876 60499873 +
cagacctcaagccccatgtg

SEQ ID NO: 163179 - DNA, 20 bp, Artificial Sequence
  Synthetic oligonucleotide; CGG chr2 60499863 60499882 60499879 +
tcaagccccatgtgcagctc

SEQ ID NO: 163180 - DNA, 20 bp, Artificial Sequence
  Synthetic oligonucleotide; AAG chr2 60499866 60499885 60499882 +
agccccatgtgcagctccgg

SEQ ID NO: 163181 - DNA, 20 bp, Artificial Sequence
  Synthetic oligonucleotide; TAG chr2 60499873 60499892 60499889 +
tgtgcagctccggaagctgc

SEQ ID NO: 163182 - DNA, 20 bp, Artificial Sequence
  Synthetic oligonucleotide; AAG chr2 60499881 60499900 60499897 +
tccggaagctgctagacctc

SEQ ID NO: 163183 - DNA, 20 bp, Artificial Sequence
  Synthetic oligonucleotide; CAG chr2 60499884 60499903 60499900 +
ggaagctgctagacctcaag

SEQ ID NO: 163184 - DNA, 20 bp, Artificial Sequence
  Synthetic oligonucleotide; AGG chr2 60499885 60499904 60499901 +
gaagctgctagacctcaagc

SEQ ID NO: 163185 - DNA, 20 bp, Artificial Sequence
  Synthetic oligonucleotide; AAG chr2 60499891 60499910 60499907 +
gctagacctcaagcaggact

SEQ ID NO: 163186 - DNA, 20 bp, Artificial Sequence
  Synthetic oligonucleotide; CGG chr2 60499897 60499916 60499913 +
cctcaagcaggactaagatt

SEQ ID NO: 163187 - DNA, 20 bp, Artificial Sequence
  Synthetic oligonucleotide; GAG chr2 60499899 60499918 60499915 +
tcaagcaggactaagattcg

SEQ ID NO: 163188 - DNA, 20 bp, Artificial Sequence
  Synthetic oligonucleotide; GAG chr2 60499901 60499920 60499917 +
aagcaggactaagattcgga

SEQ ID NO: 163189 - DNA, 20 bp, Artificial Sequence
  Synthetic oligonucleotide; GAG chr2 60499903 60499922 60499919 +
gcaggactaagattcggaga

SEQ ID NO: 163190 - DNA, 20 bp, Artificial Sequence
  Synthetic oligonucleotide; CAG chr2 60499906 60499925 60499922 +
ggactaagattcggagagag

SEQ ID NO: 163191 - DNA, 20 bp, Artificial Sequence
  Synthetic oligonucleotide; TGG chr2 60499918 60499937 60499934 +
ggagagagcagccaccgacc

SEQ ID NO: 163192 - DNA, 20 bp, Artificial Sequence
  Synthetic oligonucleotide; CAG chr2 60499928 60499947 60499944 +
gccaccgacctggctcctcc

SEQ ID NO: 163193 - DNA, 20 bp, Artificial Sequence
  Synthetic oligonucleotide; AGG chr2 60499929 60499948 60499945 +
ccaccgacctggctcctccc

SEQ ID NO: 163194 - DNA, 20 bp, Artificial Sequence
  Synthetic oligonucleotide; CAG chr2 60499932 60499951 60499948 +
ccgacctggctcctcccagg

SEQ ID NO: 163195 - DNA, 20 bp, Artificial Sequence
  Synthetic oligonucleotide; AGG chr2 60499933 60499952 60499949 +
cgacctggctcctcccaggc

SEQ ID NO: 163196 - DNA, 20 bp, Artificial Sequence
  Synthetic oligonucleotide; CAG chr2 60499937 60499956 60499953 +
ctggctcctcccaggcaggc

SEQ ID NO: 163197 - DNA, 20 bp, Artificial Sequence
  Synthetic oligonucleotide; CAG chr2 60499942 60499961 60499958 +
tcctcccaggcaggccagcc

SEQ ID NO: 163198 - DNA, 20 bp, Artificial Sequence
  Synthetic oligonucleotide; AGG chr2 60499943 60499962 60499959 +
cctcccaggcaggccagccc

SEQ ID NO: 163199 - DNA, 20 bp, Artificial Sequence
  Synthetic oligonucleotide; GAG chr2 60499947 60499966 60499963 +
ccaggcaggccagcccaggt

SEQ ID NO: 163200 - DNA, 20 bp, Artificial Sequence
  Synthetic oligonucleotide; CAG chr2 60499956 60499975 60499972 +
ccagcccaggtgagcccctc

SEQ ID NO: 163201 - DNA, 20 bp, Artificial Sequence
  Synthetic oligonucleotide; CAG chr2 60499960 60499979 60499976 +
cccaggtgagcccctccagc

SEQ ID NO: 163202 - DNA, 20 bp, Artificial Sequence
  Synthetic oligonucleotide; AGG chr2 60499961 60499980 60499977 +
ccaggtgagcccctccagcc

SEQ ID NO: 163203 - DNA, 20 bp, Artificial Sequence
  Synthetic oligonucleotide; CAG chr2 60499979 60499998 60499995 +
ccaggcactcaccccactgc

SEQ ID NO: 163204 - DNA, 20 bp, Artificial Sequence
  Synthetic oligonucleotide; AGG chr2 60499980 60499999 60499996 +
caggcactcaccccactgcc

SEQ ID NO: 163205 - DNA, 20 bp, Artificial Sequence
  Synthetic oligonucleotide; TAG chr2 60499994 60500013 60500010 +
actgccaggctgtttactct

SEQ ID NO: 163206 - DNA, 20 bp, Artificial Sequence
  Synthetic oligonucleotide; TGG chr2 60499998 60500017 60500014 +
ccaggctgtttactcttagc

SEQ ID NO: 163207 - DNA, 20 bp, Artificial Sequence
  Synthetic oligonucleotide; TAG chr2 60500026 60500045 60500042 +
gtctcctgtctgctctactg

SEQ ID NO: 163208 - DNA, 20 bp, Artificial Sequence
  Synthetic oligonucleotide; CGG chr2 60500052 60500071 60500068 +
cctccctcctctcctccttt

SEQ ID NO: 163209 - DNA, 20 bp, Artificial Sequence
  Synthetic oligonucleotide; CAG chr2 60500064 60500083 60500080 +
cctcctttcggtcctctgcc

SEQ ID NO: 163210 - DNA, 20 bp, Artificial Sequence
  Synthetic oligonucleotide; AGG chr2 60500065 60500084 60500081 +
ctcctttcggtcctctgccc

SEQ ID NO: 163211 - DNA, 20 bp, Artificial Sequence
  Synthetic oligonucleotide; GAG chr2 60500075 60500094 60500091 +
tcctctgcccaggcctgcct

SEQ ID NO: 163212 - DNA, 20 bp, Artificial Sequence
  Synthetic oligonucleotide; AGG chr2 60500076 60500095 60500092 +
cctctgcccaggcctgcctg

SEQ ID NO: 163213 - DNA, 20 bp, Artificial Sequence
  Synthetic oligonucleotide; CAG chr2 60500087 60500106 60500103 +
gcctgcctgaggctgcctgc

SEQ ID NO: 163214 - DNA, 20 bp, Artificial Sequence
  Synthetic oligonucleotide; GAG chr2 60500091 60500110 60500107 +
gcctgaggctgcctgccagt

SEQ ID NO: 163215 - DNA, 20 bp, Artificial Sequence
  Synthetic oligonucleotide; CAG chr2 60500103 60500122 60500119 +
ctgccagtgagattgcatgt

SEQ ID NO: 163216 - DNA, 20 bp, Artificial Sequence
  Synthetic oligonucleotide; AGG chr2 60500104 60500123 60500120 +
tgccagtgagattgcatgtc

SEQ ID NO: 163217 - DNA, 20 bp, Artificial Sequence
  Synthetic oligonucleotide; GGG chr2 60500105 60500124 60500121 +
gccagtgagattgcatgtca

SEQ ID NO: 163218 - DNA, 20 bp, Artificial Sequence
  Synthetic oligonucleotide; TGG chr2 60500116 60500135 60500132 +
tgcatgtcagggctttgccc

SEQ ID NO: 163219 - DNA, 20 bp, Artificial Sequence
  Synthetic oligonucleotide; GGG chr2 60500117 60500136 60500133 +
gcatgtcagggctttgccct

SEQ ID NO: 163220 - DNA, 20 bp, Artificial Sequence
  Synthetic oligonucleotide; GAG chr2 60500124 60500143 60500140 +
agggctttgccctgggcact

SEQ ID NO: 163221 - DNA, 20 bp, Artificial Sequence
  Synthetic oligonucleotide; AGG chr2 60500125 60500144 60500141 +
gggctttgccctgggcactg

SEQ ID NO: 163222 - DNA, 20 bp, Artificial Sequence
  Synthetic oligonucleotide; GGG chr2 60500126 60500145 60500142 +
ggctttgccctgggcactga

SEQ ID NO: 163223 - DNA, 20 bp, Artificial Sequence
  Synthetic oligonucleotide; TAG chr2 60500130 60500149 60500146 +
ttgccctgggcactgagggc

SEQ ID NO: 163224 - DNA, 20 bp, Artificial Sequence
  Synthetic oligonucleotide; AGG chr2 60500131 60500150 60500147 +
tgccctgggcactgagggct

SEQ ID NO: 163225 - DNA, 20 bp, Artificial Sequence
  Synthetic oligonucleotide; GGG chr2 60500132 60500151 60500148 +
gccctgggcactgagggcta

SEQ ID NO: 163226 - DNA, 20 bp, Artificial Sequence
  Synthetic oligonucleotide; CAG chr2 60500139 60500158 60500155 +
gcactgagggctagggtgcc

SEQ ID NO: 163227 - DNA, 20 bp, Artificial Sequence
  Synthetic oligonucleotide; GAG chr2 60500141 60500160 60500157 +
actgagggctagggtgccca

SEQ ID NO: 163228 - DNA, 20 bp, Artificial Sequence
  Synthetic oligonucleotide; AGG chr2 60500142 60500161 60500158 +
ctgagggctagggtgcccag

SEQ ID NO: 163229 - DNA, 20 bp, Artificial Sequence
  Synthetic oligonucleotide; CGG chr2 60500149 60500168 60500165 +
ctagggtgcccagaggcctg

SEQ ID NO: 163230 - DNA, 20 bp, Artificial Sequence
  Synthetic oligonucleotide; TGG chr2 60500160 60500179 60500176 +
agaggcctgcggctgtgccc

SEQ ID NO: 163231 - DNA, 20 bp, Artificial Sequence
  Synthetic oligonucleotide; TGG chr2 60500164 60500183 60500180 +
gcctgcggctgtgccctgga

SEQ ID NO: 163232 - DNA, 20 bp, Artificial Sequence
  Synthetic oligonucleotide; CAG chr2 60500172 60500191 60500188 +
ctgtgccctggatggaaaac

SEQ ID NO: 163233 - DNA, 20 bp, Artificial Sequence
  Synthetic oligonucleotide; CAG chr2 60500175 60500194 60500191 +
tgccctggatggaaaaccag

SEQ ID NO: 163234 - DNA, 20 bp, Artificial Sequence
  Synthetic oligonucleotide; AAG chr2 60500184 60500203 60500200 +
tggaaaaccagcagcctgca

SEQ ID NO: 163235 - DNA, 20 bp, Artificial Sequence
  Synthetic oligonucleotide; TGG chr2 60500190 60500209 60500206 +
accagcagcctgcaaagctg

SEQ ID NO: 163236 - DNA, 20 bp, Artificial Sequence
  Synthetic oligonucleotide; GGG chr2 60500191 60500210 60500207 +
ccagcagcctgcaaagctgt

SEQ ID NO: 163237 - DNA, 20 bp, Artificial Sequence
  Synthetic oligonucleotide; GGG chr2 60500192 60500211 60500208 +
cagcagcctgcaaagctgtg

SEQ ID NO: 163238 - DNA, 20 bp, Artificial Sequence
  Synthetic oligonucleotide; GGG chr2 60500193 60500212 60500209 +
agcagcctgcaaagctgtgg

SEQ ID NO: 163239 - DNA, 20 bp, Artificial Sequence
  Synthetic oligonucleotide; CAG chr2 60500196 60500215 60500212 +
agcctgcaaagctgtggggg

SEQ ID NO: 163240 - DNA, 20 bp, Artificial Sequence
  Synthetic oligonucleotide; CAG chr2 60500201 60500220 60500217 +
gcaaagctgtgggggcagca

SEQ ID NO: 163241 - DNA, 20 bp, Artificial Sequence
  Synthetic oligonucleotide; AGG chr2 60500202 60500221 60500218 +
caaagctgtgggggcagcac

SEQ ID NO: 163242 - DNA, 20 bp, Artificial Sequence
  Synthetic oligonucleotide; GAG chr2 60500215 60500234 60500231 +
gcagcacaggacctgtgtgt

SEQ ID NO: 163243 - DNA, 20 bp, Artificial Sequence
  Synthetic oligonucleotide; GAG chr2 60500217 60500236 60500233 +
agcacaggacctgtgtgtga

SEQ ID NO: 163244 - DNA, 20 bp, Artificial Sequence
  Synthetic oligonucleotide; CGG chr2 60500220 60500239 60500236 +
acaggacctgtgtgtgagag

SEQ ID NO: 163245 - DNA, 20 bp, Artificial Sequence
  Synthetic oligonucleotide; TGG chr2 60500223 60500242 60500239 +
ggacctgtgtgtgagagcgg

SEQ ID NO: 163246 - DNA, 20 bp, Artificial Sequence
  Synthetic oligonucleotide; GAG chr2 60500230 60500249 60500246 +
tgtgtgagagcggtggtctt

SEQ ID NO: 163247 - DNA, 20 bp, Artificial Sequence
  Synthetic oligonucleotide; GAG chr2 60500232 60500251 60500248 +
tgtgagagcggtggtcttga

SEQ ID NO: 163248 - DNA, 20 bp, Artificial Sequence
  Synthetic oligonucleotide; AAG chr2 60500238 60500257 60500254 +
agcggtggtcttgagagtga

SEQ ID NO: 163249 - DNA, 20 bp, Artificial Sequence
  Synthetic oligonucleotide; TGG chr2 60500241 60500260 60500257 +
ggtggtcttgagagtgaaag

SEQ ID NO: 163250 - DNA, 20 bp, Artificial Sequence
  Synthetic oligonucleotide; AAG chr2 60500246 60500265 60500262 +
tcttgagagtgaaagtggac

SEQ ID NO: 163251 - DNA, 20 bp, Artificial Sequence
  Synthetic oligonucleotide; AAG chr2 60500251 60500270 60500267 +
agagtgaaagtggacaagtc

SEQ ID NO: 163252 - DNA, 20 bp, Artificial Sequence
  Synthetic oligonucleotide; CAG chr2 60500256 60500275 60500272 +
gaaagtggacaagtcaagcc

SEQ ID NO: 163253 - DNA, 20 bp, Artificial Sequence
  Synthetic oligonucleotide; AGG chr2 60500257 60500276 60500273 +
aaagtggacaagtcaagccc

SEQ ID NO: 163254 - DNA, 20 bp, Artificial Sequence
  Synthetic oligonucleotide; CGG chr2 60500260 60500279 60500276 +
gtggacaagtcaagcccagg

SEQ ID NO: 163255 - DNA, 20 bp, Artificial Sequence
  Synthetic oligonucleotide; GGG chr2 60500261 60500280 60500277 +
tggacaagtcaagcccaggc

SEQ ID NO: 163256 - DNA, 20 bp, Artificial Sequence
  Synthetic oligonucleotide; GGG chr2 60500262 60500281 60500278 +
ggacaagtcaagcccaggcg

SEQ ID NO: 163257 - DNA, 20 bp, Artificial Sequence
  Synthetic oligonucleotide; GAG chr2 60500264 60500283 60500280 +
acaagtcaagcccaggcggg

SEQ ID NO: 163258 - DNA, 20 bp, Artificial Sequence
  Synthetic oligonucleotide; AGG chr2 60500265 60500284 60500281 +
caagtcaagcccaggcgggg

SEQ ID NO: 163259 - DNA, 20 bp, Artificial Sequence
  Synthetic oligonucleotide; GGG chr2 60500266 60500285 60500282 +
aagtcaagcccaggcgggga

SEQ ID NO: 163260 - DNA, 20 bp, Artificial Sequence
  Synthetic oligonucleotide; GGG chr2 60500267 60500286 60500283 +
agtcaagcccaggcggggag

SEQ ID NO: 163261 - DNA, 20 bp, Artificial Sequence
  Synthetic oligonucleotide; CAG chr2 60500271 60500290 60500287 +
aagcccaggcggggagggga

SEQ ID NO: 163262 - DNA, 20 bp, Artificial Sequence
  Synthetic oligonucleotide; AGG chr2 60500272 60500291 60500288 +
agcccaggcggggaggggac

SEQ ID NO: 163263 - DNA, 20 bp, Artificial Sequence
  Synthetic oligonucleotide; GGG chr2 60500273 60500292 60500289 +
gcccaggcggggaggggaca

SEQ ID NO: 163264 - DNA, 20 bp, Artificial Sequence
  Synthetic oligonucleotide; GGG chr2 60500274 60500293 60500290 +
cccaggcggggaggggacag

SEQ ID NO: 163265 - DNA, 20 bp, Artificial Sequence
  Synthetic oligonucleotide; GGG chr2 60500275 60500294 60500291 +
ccaggcggggaggggacagg

SEQ ID NO: 163266 - DNA, 20 bp, Artificial Sequence
  Synthetic oligonucleotide; CAG chr2 60500278 60500297 60500294 +
ggcggggaggggacaggggg

SEQ ID NO: 163267 - DNA, 20 bp, Artificial Sequence
  Synthetic oligonucleotide; AGG chr2 60500279 60500298 60500295 +
gcggggaggggacagggggc

SEQ ID NO: 163268 - DNA, 20 bp, Artificial Sequence
  Synthetic oligonucleotide; TAG chr2 60500282 60500301 60500298 +
gggaggggacagggggcagg

SEQ ID NO: 163269 - DNA, 20 bp, Artificial Sequence
  Synthetic oligonucleotide; AGG chr2 60500283 60500302 60500299 +
ggaggggacagggggcaggt

SEQ ID NO: 163270 - DNA, 20 bp, Artificial Sequence
  Synthetic oligonucleotide; GGG chr2 60500284 60500303 60500300 +
gaggggacagggggcaggta

SEQ ID NO: 163271 - DNA, 20 bp, Artificial Sequence
  Synthetic oligonucleotide; TAG chr2 60500288 60500307 60500304 +
ggacagggggcaggtaggga

SEQ ID NO: 163272 - DNA, 20 bp, Artificial Sequence
  Synthetic oligonucleotide; AGG chr2 60500289 60500308 60500305 +
gacagggggcaggtagggat

SEQ ID NO: 163273 - DNA, 20 bp, Artificial Sequence
  Synthetic oligonucleotide; GGG chr2 60500290 60500309 60500306 +
acagggggcaggtagggata

SEQ ID NO: 163274 - DNA, 20 bp, Artificial Sequence
  Synthetic oligonucleotide; CAG chr2 60500293 60500312 60500309 +
gggggcaggtagggataggg

SEQ ID NO: 163275 - DNA, 20 bp, Artificial Sequence
  Synthetic oligonucleotide; AGG chr2 60500294 60500313 60500310 +
ggggcaggtagggatagggc

SEQ ID NO: 163276 - DNA, 20 bp, Artificial Sequence
  Synthetic oligonucleotide; GAG chr2 60500298 60500317 60500314 +
caggtagggatagggcaggt

SEQ ID NO: 163277 - DNA, 20 bp, Artificial Sequence
  Synthetic oligonucleotide; AGG chr2 60500299 60500318 60500315 +
aggtagggatagggcaggtg

SEQ ID NO: 163278 - DNA, 20 bp, Artificial Sequence
  Synthetic oligonucleotide; CGG chr2 60500306 60500325 60500322 +
gatagggcaggtgaggttcc

SEQ ID NO: 163279 - DNA, 20 bp, Artificial Sequence
  Synthetic oligonucleotide; GGG chr2 60500307 60500326 60500323 +
atagggcaggtgaggttccc

SEQ ID NO: 163280 - DNA, 20 bp, Artificial Sequence
  Synthetic oligonucleotide; GGG chr2 60500308 60500327 60500324 +
tagggcaggtgaggttcccg

SEQ ID NO: 163281 - DNA, 20 bp, Artificial Sequence
  Synthetic oligonucleotide; CAG chr2 60500312 60500331 60500328 +
gcaggtgaggttcccggggc

SEQ ID NO: 163282 - DNA, 20 bp, Artificial Sequence
  Synthetic oligonucleotide; TGG chr2 60500368 60500387 60500384 +
caccattaaccgtgcctctg

SEQ ID NO: 163283 - DNA, 20 bp, Artificial Sequence
  Synthetic oligonucleotide; GGG chr2 60500369 60500388 60500385 +
accattaaccgtgcctctgt

SEQ ID NO: 163284 - DNA, 20 bp, Artificial Sequence
  Synthetic oligonucleotide; CAG chr2 60500376 60500395 60500392 +
accgtgcctctgtgggctga

SEQ ID NO: 163285 - DNA, 20 bp, Artificial Sequence
  Synthetic oligonucleotide; CAG chr2 60500388 60500407 60500404 +
tgggctgacagatgtgcctt

SEQ ID NO: 163286 - DNA, 20 bp, Artificial Sequence
  Synthetic oligonucleotide; GAG chr2 60500390 60500409 60500406 +
ggctgacagatgtgccttca

SEQ ID NO: 163287 - DNA, 20 bp, Artificial Sequence
  Synthetic oligonucleotide; AAG chr2 60500393 60500412 60500409 +
tgacagatgtgccttcagag

SEQ ID NO: 163288 - DNA, 20 bp, Artificial Sequence
  Synthetic oligonucleotide; AGG chr2 60500394 60500413 60500410 +
gacagatgtgccttcagaga

SEQ ID NO: 163289 - DNA, 20 bp, Artificial Sequence
  Synthetic oligonucleotide; GGG chr2 60500395 60500414 60500411 +
acagatgtgccttcagagaa

SEQ ID NO: 163290 - DNA, 20 bp, Artificial Sequence
  Synthetic oligonucleotide; CAG chr2 60500398 60500417 60500414 +
gatgtgccttcagagaaggg

SEQ ID NO: 163291 - DNA, 20 bp, Artificial Sequence
  Synthetic oligonucleotide; AGG chr2 60500399 60500418 60500415 +
atgtgccttcagagaagggc

SEQ ID NO: 163292 - DNA, 20 bp, Artificial Sequence
  Synthetic oligonucleotide; GGG chr2 60500400 60500419 60500416 +
tgtgccttcagagaagggca

SEQ ID NO: 163293 - DNA, 20 bp, Artificial Sequence
  Synthetic oligonucleotide; GAG chr2 60500402 60500421 60500418 +
tgccttcagagaagggcagg

SEQ ID NO: 163294 - DNA, 20 bp, Artificial Sequence
  Synthetic oligonucleotide; CAG chr2 60500405 60500424 60500421 +
cttcagagaagggcagggag

SEQ ID NO: 163295 - DNA, 20 bp, Artificial Sequence
  Synthetic oligonucleotide; TGG chr2 60500409 60500428 60500425 +
agagaagggcagggagcagc

SEQ ID NO: 163296 - DNA, 20 bp, Artificial Sequence
  Synthetic oligonucleotide; GGG chr2 60500410 60500429 60500426 +
gagaagggcagggagcagct

SEQ ID NO: 163297 - DNA, 20 bp, Artificial Sequence
  Synthetic oligonucleotide; GGG chr2 60500411 60500430 60500427 +
agaagggcagggagcagctg

SEQ ID NO: 163298 - DNA, 20 bp, Artificial Sequence
  Synthetic oligonucleotide; GGG chr2 60500412 60500431 60500428 +
gaagggcagggagcagctgg

SEQ ID NO: 163299 - DNA, 20 bp, Artificial Sequence
  Synthetic oligonucleotide; TGG chr2 60500417 60500436 60500433 +
gcagggagcagctgggggcc

SEQ ID NO: 163300 - DNA, 20 bp, Artificial Sequence
  Synthetic oligonucleotide; CAG chr2 60500421 60500440 60500437 +
ggagcagctgggggcctggc

SEQ ID NO: 163301 - DNA, 20 bp, Artificial Sequence
  Synthetic oligonucleotide; GAG chr2 60500423 60500442 60500439 +
agcagctgggggcctggcca

SEQ ID NO: 163302 - DNA, 20 bp, Artificial Sequence
  Synthetic oligonucleotide; CAG chr2 60500435 60500454 60500451 +
cctggccagagcaatcatcc

SEQ ID NO: 163303 - DNA, 20 bp, Artificial Sequence
  Synthetic oligonucleotide; CAG chr2 60500438 60500457 60500454 +
ggccagagcaatcatcccag

SEQ ID NO: 163304 - DNA, 20 bp, Artificial Sequence
  Synthetic oligonucleotide; AGG chr2 60500439 60500458 60500455 +
gccagagcaatcatcccagc

SEQ ID NO: 163305 - DNA, 20 bp, Artificial Sequence
  Synthetic oligonucleotide; CAG chr2 60500451 60500470 60500467 +
atcccagcaggaacttacat

SEQ ID NO: 163306 - DNA, 20 bp, Artificial Sequence
  Synthetic oligonucleotide; GAG chr2 60500453 60500472 60500469 +
cccagcaggaacttacatca

SEQ ID NO: 163307 - DNA, 20 bp, Artificial Sequence
  Synthetic oligonucleotide; CAG chr2 60500456 60500475 60500472 +
agcaggaacttacatcagag

SEQ ID NO: 163308 - DNA, 20 bp, Artificial Sequence
  Synthetic oligonucleotide; AGG chr2 60500457 60500476 60500473 +
gcaggaacttacatcagagc

SEQ ID NO: 163309 - DNA, 20 bp, Artificial Sequence
  Synthetic oligonucleotide; CAG chr2 60500460 60500479 60500476 +
ggaacttacatcagagcagg

SEQ ID NO: 163310 - DNA, 20 bp, Artificial Sequence
  Synthetic oligonucleotide; AAG chr2 60500470 60500489 60500486 +
tcagagcaggcagcctaccc

SEQ ID NO: 163311 - DNA, 20 bp, Artificial Sequence
  Synthetic oligonucleotide; GAG chr2 60500472 60500491 60500488 +
agagcaggcagcctacccaa

SEQ ID NO: 163312 - DNA, 20 bp, Artificial Sequence
  Synthetic oligonucleotide; CAG chr2 60500476 60500495 60500492 +
caggcagcctacccaagagc

SEQ ID NO: 163313 - DNA, 20 bp, Artificial Sequence
  Synthetic oligonucleotide; AGG chr2 60500477 60500496 60500493 +
aggcagcctacccaagagcc

SEQ ID NO: 163314 - DNA, 20 bp, Artificial Sequence
  Synthetic oligonucleotide; GGG chr2 60500478 60500497 60500494 +
ggcagcctacccaagagcca

SEQ ID NO: 163315 - DNA, 20 bp, Artificial Sequence
  Synthetic oligonucleotide; AAG chr2 60500481 60500500 60500497 +
agcctacccaagagccaggg

SEQ ID NO: 163316 - DNA, 20 bp, Artificial Sequence
  Synthetic oligonucleotide; AGG chr2 60500482 60500501 60500498 +
gcctacccaagagccaggga

SEQ ID NO: 163317 - DNA, 20 bp, Artificial Sequence
  Synthetic oligonucleotide; AAG chr2 60500485 60500504 60500501 +
tacccaagagccagggaagg

SEQ ID NO: 163318 - DNA, 20 bp, Artificial Sequence
  Synthetic oligonucleotide; AGG chr2 60500486 60500505 60500502 +
acccaagagccagggaagga

SEQ ID NO: 163319 - DNA, 20 bp, Artificial Sequence
  Synthetic oligonucleotide; GAG chr2 60500488 60500507 60500504 +
ccaagagccagggaaggaag

SEQ ID NO: 163320 - DNA, 20 bp, Artificial Sequence
  Synthetic oligonucleotide; GAG chr2 60500490 60500509 60500506 +
aagagccagggaaggaagga

SEQ ID NO: 163321 - DNA, 20 bp, Artificial Sequence
  Synthetic oligonucleotide; GAG chr2 60500498 60500517 60500514 +
gggaaggaaggagagcccct

SEQ ID NO: 163322 - DNA, 20 bp, Artificial Sequence
  Synthetic oligonucleotide; TGG chr2 60500507 60500526 60500523 +
ggagagcccctgagaaaaaa

SEQ ID NO: 163323 - DNA, 20 bp, Artificial Sequence
  Synthetic oligonucleotide; CAG chr2 60500510 60500529 60500526 +
gagcccctgagaaaaaatgg

SEQ ID NO: 163324 - DNA, 20 bp, Artificial Sequence
  Synthetic oligonucleotide; AAG chr2 60500513 60500532 60500529 +
cccctgagaaaaaatggcag

SEQ ID NO: 163325 - DNA, 20 bp, Artificial Sequence
  Synthetic oligonucleotide; TGG chr2 60500518 60500537 60500534 +
gagaaaaaatggcagaagaa

SEQ ID NO: 163326 - DNA, 20 bp, Artificial Sequence
  Synthetic oligonucleotide; AAG chr2 60500521 60500540 60500537 +
aaaaaatggcagaagaatgg

SEQ ID NO: 163327 - DNA, 20 bp, Artificial Sequence
  Synthetic oligonucleotide; AGG chr2 60500522 60500541 60500538 +
aaaaatggcagaagaatgga

SEQ ID NO: 163328 - DNA, 20 bp, Artificial Sequence
  Synthetic oligonucleotide; GGG chr2 60500523 60500542 60500539 +
aaaatggcagaagaatggaa

SEQ ID NO: 163329 - DNA, 20 bp, Artificial Sequence
  Synthetic oligonucleotide; TGG chr2 60500540 60500559 60500556 +
gaagggactacgtgtattga

SEQ ID NO: 163330 - DNA, 20 bp, Artificial Sequence
  Synthetic oligonucleotide; CAG chr2 60500550 60500569 60500566 +
cgtgtattgatggaataaac

SEQ ID NO: 163331 - DNA, 20 bp, Artificial Sequence
  Synthetic oligonucleotide; CAG chr2 60500576 60500595 60500592 +
ccccacacttcccaactcct

SEQ ID NO: 163332 - DNA, 20 bp, Artificial Sequence
  Synthetic oligonucleotide; AGG chr2 60500577 60500596 60500593 +
cccacacttcccaactcctc

SEQ ID NO: 163333 - DNA, 20 bp, Artificial Sequence
  Synthetic oligonucleotide; CAG chr2 60500581 60500600 60500597 +
cacttcccaactcctcagga

SEQ ID NO: 163334 - DNA, 20 bp, Artificial Sequence
  Synthetic oligonucleotide; AGG chr2 60500582 60500601 60500598 +
acttcccaactcctcaggac

SEQ ID NO: 163335 - DNA, 20 bp, Artificial Sequence
  Synthetic oligonucleotide; GGG chr2 60500583 60500602 60500599 +
cttcccaactcctcaggaca

SEQ ID NO: 163336 - DNA, 20 bp, Artificial Sequence
  Synthetic oligonucleotide; CAG chr2 60500588 60500607 60500604 +
caactcctcaggacagggtt

SEQ ID NO: 163337 - DNA, 20 bp, Artificial Sequence
  Synthetic oligonucleotide; GAG chr2 60500590 60500609 60500606 +
actcctcaggacagggttca

SEQ ID NO: 163338 - DNA, 20 bp, Artificial Sequence
  Synthetic oligonucleotide; TAG chr2 60500594 60500613 60500610 +
ctcaggacagggttcagagc

SEQ ID NO: 163339 - DNA, 20 bp, Artificial Sequence
  Synthetic oligonucleotide; AGG chr2 60500595 60500614 60500611 +
tcaggacagggttcagagct

SEQ ID NO: 163340 - DNA, 20 bp, Artificial Sequence
  Synthetic oligonucleotide; TGG chr2 60500599 60500618 60500615 +
gacagggttcagagctaggc

SEQ ID NO: 163341 - DNA, 20 bp, Artificial Sequence
  Synthetic oligonucleotide; TGG chr2 60500602 60500621 60500618 +
agggttcagagctaggctgg

SEQ ID NO: 163342 - DNA, 20 bp, Artificial Sequence
  Synthetic oligonucleotide; CAG chr2 60500613 60500632 60500629 +
ctaggctggtggctgctaca

SEQ ID NO: 163343 - DNA, 20 bp, Artificial Sequence
  Synthetic oligonucleotide; GAG chr2 60500615 60500634 60500631 +
aggctggtggctgctacaca

SEQ ID NO: 163344 - DNA, 20 bp, Artificial Sequence
  Synthetic oligonucleotide; CAG chr2 60500619 60500638 60500635 +
tggtggctgctacacagaga

SEQ ID NO: 163345 - DNA, 20 bp, Artificial Sequence
  Synthetic oligonucleotide; CAG chr2 60500632 60500651 60500648 +
acagagacagcaccctccac

SEQ ID NO: 163346 - DNA, 20 bp, Artificial Sequence
  Synthetic oligonucleotide; AAG chr2 60500637 60500656 60500653 +
gacagcaccctccaccagtt

SEQ ID NO: 163347 - DNA, 20 bp, Artificial Sequence
  Synthetic oligonucleotide; AGG chr2 60500638 60500657 60500654 +
acagcaccctccaccagtta

SEQ ID NO: 163348 - DNA, 20 bp, Artificial Sequence
  Synthetic oligonucleotide; AAG chr2 60500644 60500663 60500660 +
ccctccaccagttaaggtat

SEQ ID NO: 163349 - DNA, 20 bp, Artificial Sequence
  Synthetic oligonucleotide; AAG chr2 60500649 60500668 60500665 +
caccagttaaggtataagac

SEQ ID NO: 163350 - DNA, 20 bp, Artificial Sequence
  Synthetic oligonucleotide; AGG chr2 60500650 60500669 60500666 +
accagttaaggtataagaca

SEQ ID NO: 163351 - DNA, 20 bp, Artificial Sequence
  Synthetic oligonucleotide; AAG chr2 60500656 60500675 60500672 +
taaggtataagacaaggtat

SEQ ID NO: 163352 - DNA, 20 bp, Artificial Sequence
  Synthetic oligonucleotide; AGG chr2 60500657 60500676 60500673 +
aaggtataagacaaggtata

SEQ ID NO: 163353 - DNA, 20 bp, Artificial Sequence
  Synthetic oligonucleotide; TGG chr2 60500664 60500683 60500680 +
aagacaaggtataaggctga

SEQ ID NO: 163354 - DNA, 20 bp, Artificial Sequence
  Synthetic oligonucleotide; GGG chr2 60500665 60500684 60500681 +
agacaaggtataaggctgat

SEQ ID NO: 163355 - DNA, 20 bp, Artificial Sequence
  Synthetic oligonucleotide; TAG chr2 60500671 60500690 60500687 +
ggtataaggctgatgggctg

SEQ ID NO: 163356 - DNA, 20 bp, Artificial Sequence
  Synthetic oligonucleotide; AGG chr2 60500672 60500691 60500688 +
gtataaggctgatgggctgt

SEQ ID NO: 163357 - DNA, 20 bp, Artificial Sequence
  Synthetic oligonucleotide; TGG chr2 60500684 60500703 60500700 +
tgggctgtaggcatcaaacc

SEQ ID NO: 163358 - DNA, 20 bp, Artificial Sequence
  Synthetic oligonucleotide; CAG chr2 60500693 60500712 60500709 +
ggcatcaaacctggaactca

SEQ ID NO: 163359 - DNA, 20 bp, Artificial Sequence
  Synthetic oligonucleotide; CGG chr2 60500697 60500716 60500713 +
tcaaacctggaactcacagt

SEQ ID NO: 163360 - DNA, 20 bp, Artificial Sequence
  Synthetic oligonucleotide; GGG chr2 60500698 60500717 60500714 +
caaacctggaactcacagtc

SEQ ID NO: 163361 - DNA, 20 bp, Artificial Sequence
  Synthetic oligonucleotide; GGG chr2 60500699 60500718 60500715 +
aaacctggaactcacagtcg

SEQ ID NO: 163362 - DNA, 20 bp, Artificial Sequence
  Synthetic oligonucleotide; AAG chr2 60500713 60500732 60500729 +
cagtcggggcacctcacttc

SEQ ID NO: 163363 - DNA, 20 bp, Artificial Sequence
  Synthetic oligonucleotide; TGG chr2 60500719 60500738 60500735 +
gggcacctcacttcaagcct

SEQ ID NO: 163364 - DNA, 20 bp, Artificial Sequence
  Synthetic oligonucleotide; TGG chr2 60500722 60500741 60500738 +
cacctcacttcaagccttgg

SEQ ID NO: 163365 - DNA, 20 bp, Artificial Sequence
  Synthetic oligonucleotide; TAG chr2 60500726 60500745 60500742 +
tcacttcaagccttggtgga

SEQ ID NO: 163366 - DNA, 20 bp, Artificial Sequence
  Synthetic oligonucleotide; AGG chr2 60500727 60500746 60500743 +
cacttcaagccttggtggat

SEQ ID NO: 163367 - DNA, 20 bp, Artificial Sequence
  Synthetic oligonucleotide; AAG chr2 60500731 60500750 60500747 +
tcaagccttggtggataggt

SEQ ID NO: 163368 - DNA, 20 bp, Artificial Sequence
  Synthetic oligonucleotide; CAG chr2 60500743 60500762 60500759 +
ggataggtaagatgaacact

SEQ ID NO: 163369 - DNA, 20 bp, Artificial Sequence
  Synthetic oligonucleotide; AGG chr2 60500744 60500763 60500760 +
gataggtaagatgaacactc

SEQ ID NO: 163370 - DNA, 20 bp, Artificial Sequence
  Synthetic oligonucleotide; AAG chr2 60500752 60500771 60500768 +
agatgaacactcaggctccc

SEQ ID NO: 163371 - DNA, 20 bp, Artificial Sequence
  Synthetic oligonucleotide; TAG chr2 60500756 60500775 60500772 +
gaacactcaggctcccaagt

SEQ ID NO: 163372 - DNA, 20 bp, Artificial Sequence
  Synthetic oligonucleotide; CAG chr2 60500760 60500779 60500776 +
actcaggctcccaagttaga

SEQ ID NO: 163373 - DNA, 20 bp, Artificial Sequence
  Synthetic oligonucleotide; GAG chr2 60500765 60500784 60500781 +
ggctcccaagttagacagat

SEQ ID NO: 163374 - DNA, 20 bp, Artificial Sequence
  Synthetic oligonucleotide; TGG chr2 60500769 60500788 60500785 +
cccaagttagacagatgagc

SEQ ID NO: 163375 - DNA, 20 bp, Artificial Sequence
  Synthetic oligonucleotide; TGG chr2 60500796 60500815 60500812 +
ttcatctaccaccaatttcc

SEQ ID NO: 163376 - DNA, 20 bp, Artificial Sequence
  Synthetic oligonucleotide; TGG chr2 60500808 60500827 60500824 +
caatttcctggctgtgtgtc

SEQ ID NO: 163377 - DNA, 20 bp, Artificial Sequence
  Synthetic oligonucleotide; GGG chr2 60500809 60500828 60500825 +
aatttcctggctgtgtgtct

SEQ ID NO: 163378 - DNA, 20 bp, Artificial Sequence
  Synthetic oligonucleotide; GAG chr2 60500811 60500830 60500827 +
tttcctggctgtgtgtctgg

SEQ ID NO: 163379 - DNA, 20 bp, Artificial Sequence
  Synthetic oligonucleotide; CAG chr2 60500814 60500833 60500830 +
cctggctgtgtgtctgggag

SEQ ID NO: 163380 - DNA, 20 bp, Artificial Sequence
  Synthetic oligonucleotide; AAG chr2 60500832 60500851 60500848 +
agcagctctttaacctctcc

SEQ ID NO: 163381 - DNA, 20 bp, Artificial Sequence
  Synthetic oligonucleotide; CAG chr2 60500838 60500857 60500854 +
tctttaacctctccaagcct

SEQ ID NO: 163382 - DNA, 20 bp, Artificial Sequence
  Synthetic oligonucleotide; TGG chr2 60500850 60500869 60500866 +
ccaagcctcagtttcttcac

SEQ ID NO: 163383 - DNA, 20 bp, Artificial Sequence
  Synthetic oligonucleotide; TGG chr2 60500877 60500896 60500893 +
atgtgtatgatgacattgta

SEQ ID NO: 163384 - DNA, 20 bp, Artificial Sequence
  Synthetic oligonucleotide; TGG chr2 60500886 60500905 60500902 +
atgacattgtatggccaacc

SEQ ID NO: 163385 - DNA, 20 bp, Artificial Sequence
  Synthetic oligonucleotide; GGG chr2 60500887 60500906 60500903 +
tgacattgtatggccaacct

SEQ ID NO: 163386 - DNA, 20 bp, Artificial Sequence
  Synthetic oligonucleotide; GGG chr2 60500888 60500907 60500904 +
gacattgtatggccaacctg

SEQ ID NO: 163387 - DNA, 20 bp, Artificial Sequence
  Synthetic oligonucleotide; TGG chr2 60500898 60500917 60500914 +
ggccaacctggggttgctga

SEQ ID NO: 163388 - DNA, 20 bp, Artificial Sequence
  Synthetic oligonucleotide; TAG chr2 60500904 60500923 60500920 +
cctggggttgctgatggaac

SEQ ID NO: 163389 - DNA, 20 bp, Artificial Sequence
  Synthetic oligonucleotide; AAG chr2 60500911 60500930 60500927 +
ttgctgatggaactagttaa

SEQ ID NO: 163390 - DNA, 20 bp, Artificial Sequence
  Synthetic oligonucleotide; GAG chr2 60500913 60500932 60500929 +
gctgatggaactagttaaaa

SEQ ID NO: 163391 - DNA, 20 bp, Artificial Sequence
  Synthetic oligonucleotide; AAG chr2 60500924 60500943 60500940 +
tagttaaaagagtgtctgtg

SEQ ID NO: 163392 - DNA, 20 bp, Artificial Sequence
  Synthetic oligonucleotide; AAG chr2 60500928 60500947 60500944 +
taaaagagtgtctgtgaagc

SEQ ID NO: 163393 - DNA, 20 bp, Artificial Sequence
  Synthetic oligonucleotide; TAG chr2 60500933 60500952 60500949 +
gagtgtctgtgaagcaagcc

SEQ ID NO: 163394 - DNA, 20 bp, Artificial Sequence
  Synthetic oligonucleotide; TGG chr2 60500937 60500956 60500953 +
gtctgtgaagcaagcctagc

SEQ ID NO: 163395 - DNA, 20 bp, Artificial Sequence
  Synthetic oligonucleotide; GGG chr2 60500938 60500957 60500954 +
tctgtgaagcaagcctagct

SEQ ID NO: 163396 - DNA, 20 bp, Artificial Sequence
  Synthetic oligonucleotide; TGG chr2 60500941 60500960 60500957 +
gtgaagcaagcctagctggg

SEQ ID NO: 163397 - DNA, 20 bp, Artificial Sequence
  Synthetic oligonucleotide; GGG chr2 60500942 60500961 60500958 +
tgaagcaagcctagctgggt

SEQ ID NO: 163398 - DNA, 20 bp, Artificial Sequence
  Synthetic oligonucleotide; AAG chr2 60500950 60500969 60500966 +
gcctagctgggtgggcttgc

SEQ ID NO: 163399 - DNA, 20 bp, Artificial Sequence
  Synthetic oligonucleotide; TGG chr2 60500959 60500978 60500975 +
ggtgggcttgcaagcatttc

SEQ ID NO: 163400 - DNA, 20 bp, Artificial Sequence
  Synthetic oligonucleotide; GGG chr2 60500960 60500979 60500976 +
gtgggcttgcaagcatttct

SEQ ID NO: 163401 - DNA, 20 bp, Artificial Sequence
  Synthetic oligonucleotide; TGG chr2 60500986 60501005 60501002 +
ctgcatcctcctctgtaaaa

SEQ ID NO: 163402 - DNA, 20 bp, Artificial Sequence
  Synthetic oligonucleotide; GGG chr2 60500987 60501006 60501003 +
tgcatcctcctctgtaaaat

SEQ ID NO: 163403 - DNA, 20 bp, Artificial Sequence
  Synthetic oligonucleotide; GAG chr2 60500989 60501008 60501005 +
catcctcctctgtaaaatgg

SEQ ID NO: 163404 - DNA, 20 bp, Artificial Sequence
  Synthetic oligonucleotide; CAG chr2 60501006 60501025 60501022 +
tgggagaaccctgaactgct

SEQ ID NO: 163405 - DNA, 20 bp, Artificial Sequence
  Synthetic oligonucleotide; TGG chr2 60501018 60501037 60501034 +
gaactgctcagccgacctca

SEQ ID NO: 163406 - DNA, 20 bp, Artificial Sequence
  Synthetic oligonucleotide; CAG chr2 60501031 60501050 60501047 +
gacctcatggttgactcact

SEQ ID NO: 163407 - DNA, 20 bp, Artificial Sequence
  Synthetic oligonucleotide; CAG chr2 60501037 60501056 60501053 +
atggttgactcactcagcaa

SEQ ID NO: 163408 - DNA, 20 bp, Artificial Sequence
  Synthetic oligonucleotide; GAG chr2 60501039 60501058 60501055 +
ggttgactcactcagcaaca

SEQ ID NO: 163409 - DNA, 20 bp, Artificial Sequence
  Synthetic oligonucleotide; AGG chr2 60501040 60501059 60501056 +
gttgactcactcagcaacag

SEQ ID NO: 163410 - DNA, 20 bp, Artificial Sequence
  Synthetic oligonucleotide; CAG chr2 60501049 60501068 60501065 +
ctcagcaacagaggtctcca

SEQ ID NO: 163411 - DNA, 20 bp, Artificial Sequence
  Synthetic oligonucleotide; AGG chr2 60501050 60501069 60501066 +
tcagcaacagaggtctccac

SEQ ID NO: 163412 - DNA, 20 bp, Artificial Sequence
  Synthetic oligonucleotide; GAG chr2 60501052 60501071 60501068 +
agcaacagaggtctccacag

SEQ ID NO: 163413 - DNA, 20 bp, Artificial Sequence
  Synthetic oligonucleotide; GAG chr2 60501067 60501086 60501083 +
cacaggagccctgcccacat

SEQ ID NO: 163414 - DNA, 20 bp, Artificial Sequence
  Synthetic oligonucleotide; TGG chr2 60501077 60501096 60501093 +
ctgcccacatgagacatctt

SEQ ID NO: 163415 - DNA, 20 bp, Artificial Sequence
  Synthetic oligonucleotide; AAG chr2 60501095 60501114 60501111 +
tttggcacatcttctgaaac

SEQ ID NO: 163416 - DNA, 20 bp, Artificial Sequence
  Synthetic oligonucleotide; TGG chr2 60501107 60501126 60501123 +
tctgaaacaagacctgtttc

SEQ ID NO: 163417 - DNA, 20 bp, Artificial Sequence
  Synthetic oligonucleotide; AAG chr2 60501111 60501130 60501127 +
aaacaagacctgtttctgga

SEQ ID NO: 163418 - DNA, 20 bp, Artificial Sequence
  Synthetic oligonucleotide; TGG chr2 60501118 60501137 60501134 +
acctgtttctggaaagttgt

SEQ ID NO: 163419 - DNA, 20 bp, Artificial Sequence
  Synthetic oligonucleotide; CAG chr2 60501158 60501177 60501174 +
acttatttatattattgttt

SEQ ID NO: 163420 - DNA, 20 bp, Artificial Sequence
  Synthetic oligonucleotide; TGG chr2 60501191 60501210 60501207 +
ttcattctgctttgattcaa

SEQ ID NO: 163421 - DNA, 20 bp, Artificial Sequence
  Synthetic oligonucleotide; CAG chr2 60501194 60501213 60501210 +
attctgctttgattcaatgg

SEQ ID NO: 163422 - DNA, 20 bp, Artificial Sequence
  Synthetic oligonucleotide; TGG chr2 60501212 60501231 60501228 +
ggcagccaatttaattcatt

SEQ ID NO: 163423 - DNA, 20 bp, Artificial Sequence
  Synthetic oligonucleotide; TAG chr2 60501225 60501244 60501241 +
attcatttggtccaaacctg

SEQ ID NO: 163424 - DNA, 20 bp, Artificial Sequence
  Synthetic oligonucleotide; CAG chr2 60501238 60501257 60501254 +
aaacctgtagtgctacttgc

SEQ ID NO: 163425 - DNA, 20 bp, Artificial Sequence
  Synthetic oligonucleotide; TGG chr2 60501248 60501267 60501264 +
tgctacttgccagaacaaaa

SEQ ID NO: 163426 - DNA, 20 bp, Artificial Sequence
  Synthetic oligonucleotide; GAG chr2 60501254 60501273 60501270 +
ttgccagaacaaaatggaat

SEQ ID NO: 163427 - DNA, 20 bp, Artificial Sequence
  Synthetic oligonucleotide; AAG chr2 60501274 60501293 60501290 +
gagcctcattccctgccctc

SEQ ID NO: 163428 - DNA, 20 bp, Artificial Sequence
  Synthetic oligonucleotide; AGG chr2 60501275 60501294 60501291 +
agcctcattccctgccctca

SEQ ID NO: 163429 - DNA, 20 bp, Artificial Sequence
  Synthetic oligonucleotide; GAG chr2 60501277 60501296 60501293 +
cctcattccctgccctcaag

SEQ ID NO: 163430 - DNA, 20 bp, Artificial Sequence
  Synthetic oligonucleotide; CAG chr2 60501284 60501303 60501300 +
ccctgccctcaaggagctca

SEQ ID NO: 163431 - DNA, 20 bp, Artificial Sequence
  Synthetic oligonucleotide; CAG chr2 60501289 60501308 60501305 +
ccctcaaggagctcacagtc

SEQ ID NO: 163432 - DNA, 20 bp, Artificial Sequence
  Synthetic oligonucleotide; TGG chr2 60501292 60501311 60501308 +
tcaaggagctcacagtccag

SEQ ID NO: 163433 - DNA, 20 bp, Artificial Sequence
  Synthetic oligonucleotide; AAG chr2 60501314 60501333 60501330 +
gctctgtctttaatatctat

SEQ ID NO: 163434 - DNA, 20 bp, Artificial Sequence
  Synthetic oligonucleotide; GAG chr2 60501316 60501335 60501332 +
tctgtctttaatatctataa

SEQ ID NO: 163435 - DNA, 20 bp, Artificial Sequence
  Synthetic oligonucleotide; CAG chr2 60501321 60501340 60501337 +
ctttaatatctataagagca

SEQ ID NO: 163436 - DNA, 20 bp, Artificial Sequence
  Synthetic oligonucleotide; AGG chr2 60501322 60501341 60501338 +
tttaatatctataagagcac

SEQ ID NO: 163437 - DNA, 20 bp, Artificial Sequence
  Synthetic oligonucleotide; AAG chr2 60501326 60501345 60501342 +
atatctataagagcacaggt

SEQ ID NO: 163438 - DNA, 20 bp, Artificial Sequence
  Synthetic oligonucleotide; CAG chr2 60501334 60501353 60501350 +
aagagcacaggtaagtgtca

SEQ ID NO: 163439 - DNA, 20 bp, Artificial Sequence
  Synthetic oligonucleotide; AGG chr2 60501335 60501354 60501351 +
agagcacaggtaagtgtcac

SEQ ID NO: 163440 - DNA, 20 bp, Artificial Sequence
  Synthetic oligonucleotide; AAG chr2 60501338 60501357 60501354 +
gcacaggtaagtgtcacagg

SEQ ID NO: 163441 - DNA, 20 bp, Artificial Sequence
  Synthetic oligonucleotide; TGG chr2 60501344 60501363 60501360 +
gtaagtgtcacaggaagcca

SEQ ID NO: 163442 - DNA, 20 bp, Artificial Sequence
  Synthetic oligonucleotide; TGG chr2 60501352 60501371 60501368 +
cacaggaagccatggtcctt

SEQ ID NO: 163443 - DNA, 20 bp, Artificial Sequence
  Synthetic oligonucleotide; GGG chr2 60501353 60501372 60501369 +
acaggaagccatggtccttt

SEQ ID NO: 163444 - DNA, 20 bp, Artificial Sequence
  Synthetic oligonucleotide; GGG chr2 60501354 60501373 60501370 +
caggaagccatggtcctttg

SEQ ID NO: 163445 - DNA, 20 bp, Artificial Sequence
  Synthetic oligonucleotide; GGG chr2 60501355 60501374 60501371 +
aggaagccatggtcctttgg

SEQ ID NO: 163446 - DNA, 20 bp, Artificial Sequence
  Synthetic oligonucleotide; AAG chr2 60501363 60501382 60501379 +
atggtcctttgggggaaatg

SEQ ID NO: 163447 - DNA, 20 bp, Artificial Sequence
  Synthetic oligonucleotide; TGG chr2 60501408 60501427 60501424 +
tcacttccaaatactttacc

SEQ ID NO: 163448 - DNA, 20 bp, Artificial Sequence
  Synthetic oligonucleotide; AAG chr2 60501416 60501435 60501432 +
aaatactttacctggtttgt

SEQ ID NO: 163449 - DNA, 20 bp, Artificial Sequence
  Synthetic oligonucleotide; CGG chr2 60501427 60501446 60501443 +
ctggtttgtaagttctcttt

SEQ ID NO: 163450 - DNA, 20 bp, Artificial Sequence
  Synthetic oligonucleotide; GGG chr2 60501428 60501447 60501444 +
tggtttgtaagttctctttc

SEQ ID NO: 163451 - DNA, 20 bp, Artificial Sequence
  Synthetic oligonucleotide; GAG chr2 60501440 60501459 60501456 +
tctctttcgggtgcttccct

SEQ ID NO: 163452 - DNA, 20 bp, Artificial Sequence
  Synthetic oligonucleotide; TGG chr2 60501443 60501462 60501459 +
ctttcgggtgcttccctgag

SEQ ID NO: 163453 - DNA, 20 bp, Artificial Sequence
  Synthetic oligonucleotide; AAG chr2 60501447 60501466 60501463 +
cgggtgcttccctgagtggc

SEQ ID NO: 163454 - DNA, 20 bp, Artificial Sequence
  Synthetic oligonucleotide; GAG chr2 60501449 60501468 60501465 +
ggtgcttccctgagtggcaa

SEQ ID NO: 163455 - DNA, 20 bp, Artificial Sequence
  Synthetic oligonucleotide; AGG chr2 60501450 60501469 60501466 +
gtgcttccctgagtggcaag

SEQ ID NO: 163456 - DNA, 20 bp, Artificial Sequence
  Synthetic oligonucleotide; GGG chr2 60501451 60501470 60501467 +
tgcttccctgagtggcaaga

SEQ ID NO: 163457 - DNA, 20 bp, Artificial Sequence
  Synthetic oligonucleotide; AAG chr2 60501455 60501474 60501471 +
tccctgagtggcaagaggga

SEQ ID NO: 163458 - DNA, 20 bp, Artificial Sequence
  Synthetic oligonucleotide; AGG chr2 60501456 60501475 60501472 +
ccctgagtggcaagagggaa

SEQ ID NO: 163459 - DNA, 20 bp, Artificial Sequence
  Synthetic oligonucleotide; AAG chr2 60501467 60501486 60501483 +
aagagggaaaggccttttgc

SEQ ID NO: 163460 - DNA, 20 bp, Artificial Sequence
  Synthetic oligonucleotide; GAG chr2 60501507 60501526 60501523 +
tttttttttttttttttttt

SEQ ID NO: 163461 - DNA, 20 bp, Artificial Sequence
  Synthetic oligonucleotide; CAG chr2 60501511 60501530 60501527 +
ttttttttttttttttgaga

SEQ ID NO: 163462 - DNA, 20 bp, Artificial Sequence
  Synthetic oligonucleotide; GAG chr2 60501513 60501532 60501529 +
ttttttttttttttgagaca

SEQ ID NO: 163463 - DNA, 20 bp, Artificial Sequence
  Synthetic oligonucleotide; CAG chr2 60501532 60501551 60501548 +
agagtttcgctcttgttgcc

SEQ ID NO: 163464 - DNA, 20 bp, Artificial Sequence
  Synthetic oligonucleotide; AGG chr2 60501533 60501552 60501549 +
gagtttcgctcttgttgccc

SEQ ID NO: 163465 - DNA, 20 bp, Artificial Sequence
  Synthetic oligonucleotide; TGG chr2 60501537 60501556 60501553 +
ttcgctcttgttgcccaggc

SEQ ID NO: 163466 - DNA, 20 bp, Artificial Sequence
  Synthetic oligonucleotide; GGG chr2 60501538 60501557 60501554 +
tcgctcttgttgcccaggct

SEQ ID NO: 163467 - DNA, 20 bp, Artificial Sequence
  Synthetic oligonucleotide; GGG chr2 60501539 60501558 60501555 +
cgctcttgttgcccaggctg

SEQ ID NO: 163468 - DNA, 20 bp, Artificial Sequence
  Synthetic oligonucleotide; TGG chr2 60501547 60501566 60501563 +
ttgcccaggctggggtgcaa

SEQ ID NO: 163469 - DNA, 20 bp, Artificial Sequence
  Synthetic oligonucleotide; CGG chr2 60501558 60501577 60501574 +
ggggtgcaatggtgtgatct

SEQ ID NO: 163470 - DNA, 20 bp, Artificial Sequence
  Synthetic oligonucleotide; TGG chr2 60501579 60501598 60501595 +
ggctcaccacctctgcctcc

SEQ ID NO: 163471 - DNA, 20 bp, Artificial Sequence
  Synthetic oligonucleotide; GGG chr2 60501580 60501599 60501596 +
gctcaccacctctgcctcct

SEQ ID NO: 163472 - DNA, 20 bp, Artificial Sequence
  Synthetic oligonucleotide; AAG chr2 60501586 60501605 60501602 +
cacctctgcctcctgggttc

SEQ ID NO: 163473 - DNA, 20 bp, Artificial Sequence
  Synthetic oligonucleotide; CAG chr2 60501603 60501622 60501619 +
ttcaagcaattctcctccct

SEQ ID NO: 163474 - DNA, 20 bp, Artificial Sequence
  Synthetic oligonucleotide; GAG chr2 60501612 60501631 60501628 +
ttctcctccctcagcctcct

SEQ ID NO: 163475 - DNA, 20 bp, Artificial Sequence
  Synthetic oligonucleotide; TAG chr2 60501615 60501634 60501631 +
tcctccctcagcctcctgag

SEQ ID NO: 163476 - DNA, 20 bp, Artificial Sequence
  Synthetic oligonucleotide; TGG chr2 60501619 60501638 60501635 +
ccctcagcctcctgagtagc

SEQ ID NO: 163477 - DNA, 20 bp, Artificial Sequence
  Synthetic oligonucleotide; GGG chr2 60501620 60501639 60501636 +
cctcagcctcctgagtagct

SEQ ID NO: 163478 - DNA, 20 bp, Artificial Sequence
  Synthetic oligonucleotide; CAG chr2 60501627 60501646 60501643 +
ctcctgagtagctgggatta

SEQ ID NO: 163479 - DNA, 20 bp, Artificial Sequence
  Synthetic oligonucleotide; AGG chr2 60501628 60501647 60501644 +
tcctgagtagctgggattac

SEQ ID NO: 163480 - DNA, 20 bp, Artificial Sequence
  Synthetic oligonucleotide; TGG chr2 60501647 60501666 60501663 +
caggcatgtgcgaccatgcc

SEQ ID NO: 163481 - DNA, 20 bp, Artificial Sequence
  Synthetic oligonucleotide; AAG chr2 60501652 60501671 60501668 +
atgtgcgaccatgcctggct

SEQ ID NO: 163482 - DNA, 20 bp, Artificial Sequence
  Synthetic oligonucleotide; TAG chr2 60501668 60501687 60501684 +
ggctaagtttatatttttaa

SEQ ID NO: 163483 - DNA, 20 bp, Artificial Sequence
  Synthetic oligonucleotide; GAG chr2 60501670 60501689 60501686 +
ctaagtttatatttttaata

SEQ ID NO: 163484 - DNA, 20 bp, Artificial Sequence
  Synthetic oligonucleotide; GAG chr2 60501675 60501694 60501691 +
tttatatttttaatagagat

SEQ ID NO: 163485 - DNA, 20 bp, Artificial Sequence
  Synthetic oligonucleotide; AGG chr2 60501676 60501695 60501692 +
ttatatttttaatagagatg

SEQ ID NO: 163486 - DNA, 20 bp, Artificial Sequence
  Synthetic oligonucleotide; TGG chr2 60501690 60501709 60501706 +
gagatgaggtttctccatgt

SEQ ID NO: 163487 - DNA, 20 bp, Artificial Sequence
  Synthetic oligonucleotide; CAG chr2 60501694 60501713 60501710 +
tgaggtttctccatgttggt

SEQ ID NO: 163488 - DNA, 20 bp, Artificial Sequence
  Synthetic oligonucleotide; AGG chr2 60501695 60501714 60501711 +
gaggtttctccatgttggtc

SEQ ID NO: 163489 - DNA, 20 bp, Artificial Sequence
  Synthetic oligonucleotide; TGG chr2 60501699 60501718 60501715 +
tttctccatgttggtcaggc

SEQ ID NO: 163490 - DNA, 20 bp, Artificial Sequence
  Synthetic oligonucleotide; CAG chr2 60501719 60501738 60501735 +
tggtctcaaactcttgacct

SEQ ID NO: 163491 - DNA, 20 bp, Artificial Sequence
  Synthetic oligonucleotide; AGG chr2 60501720 60501739 60501736 +
ggtctcaaactcttgacctc

SEQ ID NO: 163492 - DNA, 20 bp, Artificial Sequence
  Synthetic oligonucleotide; CGG chr2 60501737 60501756 60501753 +
ctcaggtgatctacccacct

SEQ ID NO: 163493 - DNA, 20 bp, Artificial Sequence
  Synthetic oligonucleotide; AAG chr2 60501747 60501766 60501763 +
ctacccacctcggcctccca

SEQ ID NO: 163494 - DNA, 20 bp, Artificial Sequence
  Synthetic oligonucleotide; TGG chr2 60501753 60501772 60501769 +
acctcggcctcccaaagtgc

SEQ ID NO: 163495 - DNA, 20 bp, Artificial Sequence
  Synthetic oligonucleotide; CAG chr2 60501761 60501780 60501777 +
ctcccaaagtgctggaatta

SEQ ID NO: 163496 - DNA, 20 bp, Artificial Sequence
  Synthetic oligonucleotide; GAG chr2 60501768 60501787 60501784 +
agtgctggaattacagacgt

SEQ ID NO: 163497 - DNA, 20 bp, Artificial Sequence
  Synthetic oligonucleotide; CAG chr2 60501781 60501800 60501797 +
cagacgtgagccactgcgcc

SEQ ID NO: 163498 - DNA, 20 bp, Artificial Sequence
  Synthetic oligonucleotide; CAG chr2 60501806 60501825 60501822 +
ttacactgctttcttaatta

SEQ ID NO: 163499 - DNA, 20 bp, Artificial Sequence
  Synthetic oligonucleotide; CAG chr2 60501809 60501828 60501825 +
cactgctttcttaattacag

SEQ ID NO: 163500 - DNA, 20 bp, Artificial Sequence
  Synthetic oligonucleotide; AAG chr2 60501836 60501855 60501852 +
ctcatctcacataaaaattt

SEQ ID NO: 163501 - DNA, 20 bp, Artificial Sequence
  Synthetic oligonucleotide; CGG chr2 60501840 60501859 60501856 +
tctcacataaaaatttaaga

SEQ ID NO: 163502 - DNA, 20 bp, Artificial Sequence
  Synthetic oligonucleotide; GGG chr2 60501841 60501860 60501857 +
ctcacataaaaatttaagac

SEQ ID NO: 163503 - DNA, 20 bp, Artificial Sequence
  Synthetic oligonucleotide; CAG chr2 60501848 60501867 60501864 +
aaaaatttaagacgggaaaa

SEQ ID NO: 163504 - DNA, 20 bp, Artificial Sequence
  Synthetic oligonucleotide; AGG chr2 60501849 60501868 60501865 +
aaaatttaagacgggaaaac

SEQ ID NO: 163505 - DNA, 20 bp, Artificial Sequence
  Synthetic oligonucleotide; AAG chr2 60501852 60501871 60501868 +
atttaagacgggaaaacagg

SEQ ID NO: 163506 - DNA, 20 bp, Artificial Sequence
  Synthetic oligonucleotide; GAG chr2 60501864 60501883 60501880 +
aaaacaggaagatgcattct

SEQ ID NO: 163507 - DNA, 20 bp, Artificial Sequence
  Synthetic oligonucleotide; AAG chr2 60501867 60501886 60501883 +
acaggaagatgcattctgag

SEQ ID NO: 163508 - DNA, 20 bp, Artificial Sequence
  Synthetic oligonucleotide; CAG chr2 60501876 60501895 60501892 +
tgcattctgagaagttatat

SEQ ID NO: 163509 - DNA, 20 bp, Artificial Sequence
  Synthetic oligonucleotide; CAG chr2 60501905 60501924 60501921 +
tgcctctctacattccaaaa

SEQ ID NO: 163510 - DNA, 20 bp, Artificial Sequence
  Synthetic oligonucleotide; TAG chr2 60501930 60501949 60501946 +
ttttattctaattattttac

SEQ ID NO: 163511 - DNA, 20 bp, Artificial Sequence
  Synthetic oligonucleotide; TGG chr2 60501940 60501959 60501956 +
attattttactagtgaatta

SEQ ID NO: 163512 - DNA, 20 bp, Artificial Sequence
  Synthetic oligonucleotide; AAG chr2 60501947 60501966 60501963 +
tactagtgaattatggaata

SEQ ID NO: 163513 - DNA, 20 bp, Artificial Sequence
  Synthetic oligonucleotide; TAG chr2 60501950 60501969 60501966 +
tagtgaattatggaataaag

SEQ ID NO: 163514 - DNA, 20 bp, Artificial Sequence
  Synthetic oligonucleotide; TAG chr2 60501987 60502006 60502003 +
ctacacaacttgtgttgcac

SEQ ID NO: 163515 - DNA, 20 bp, Artificial Sequence
  Synthetic oligonucleotide; AGG chr2 60501988 60502007 60502004 +
tacacaacttgtgttgcact

SEQ ID NO: 163516 - DNA, 20 bp, Artificial Sequence
  Synthetic oligonucleotide; CAG chr2 60501999 60502018 60502015 +
tgttgcactaggtgaaatct

SEQ ID NO: 163517 - DNA, 20 bp, Artificial Sequence
  Synthetic oligonucleotide; AGG chr2 60502000 60502019 60502016 +
gttgcactaggtgaaatctc

SEQ ID NO: 163518 - DNA, 20 bp, Artificial Sequence
  Synthetic oligonucleotide; CAG chr2 60502007 60502026 60502023 +
taggtgaaatctcaggctaa

SEQ ID NO: 163519 - DNA, 20 bp, Artificial Sequence
  Synthetic oligonucleotide; GAG chr2 60502009 60502028 60502025 +
ggtgaaatctcaggctaaca

SEQ ID NO: 163520 - DNA, 20 bp, Artificial Sequence
  Synthetic oligonucleotide; CAG chr2 60502015 60502034 60502031 +
atctcaggctaacagagctt

SEQ ID NO: 163521 - DNA, 20 bp, Artificial Sequence
  Synthetic oligonucleotide; AGG chr2 60502016 60502035 60502032 +
tctcaggctaacagagcttc

SEQ ID NO: 163522 - DNA, 20 bp, Artificial Sequence
  Synthetic oligonucleotide; GGG chr2 60502017 60502036 60502033 +
ctcaggctaacagagcttca

SEQ ID NO: 163523 - DNA, 20 bp, Artificial Sequence
  Synthetic oligonucleotide; GAG chr2 60502019 60502038 60502035 +
caggctaacagagcttcagg

SEQ ID NO: 163524 - DNA, 20 bp, Artificial Sequence
  Synthetic oligonucleotide; AGG chr2 60502020 60502039 60502036 +
aggctaacagagcttcaggg

SEQ ID NO: 163525 - DNA, 20 bp, Artificial Sequence
  Synthetic oligonucleotide; AAG chr2 60502024 60502043 60502040 +
taacagagcttcagggagga

SEQ ID NO: 163526 - DNA, 20 bp, Artificial Sequence
  Synthetic oligonucleotide; AGG chr2 60502025 60502044 60502041 +
aacagagcttcagggaggaa

SEQ ID NO: 163527 - DNA, 20 bp, Artificial Sequence
  Synthetic oligonucleotide; CAG chr2 60502029 60502048 60502045 +
gagcttcagggaggaaaggc

SEQ ID NO: 163528 - DNA, 20 bp, Artificial Sequence
  Synthetic oligonucleotide; CAG chr2 60502054 60502073 60502070 +
caaaaatatgcctcactcca

SEQ ID NO: 163529 - DNA, 20 bp, Artificial Sequence
  Synthetic oligonucleotide; GAG chr2 60502056 60502075 60502072 +
aaaatatgcctcactccaca

SEQ ID NO: 163530 - DNA, 20 bp, Artificial Sequence
  Synthetic oligonucleotide; AAG chr2 60502059 60502078 60502075 +
atatgcctcactccacagag

SEQ ID NO: 163531 - DNA, 20 bp, Artificial Sequence
  Synthetic oligonucleotide; CAG chr2 60502071 60502090 60502087 +
ccacagagaagctgtaccac

SEQ ID NO: 163532 - DNA, 20 bp, Artificial Sequence
  Synthetic oligonucleotide; AAG chr2 60502074 60502093 60502090 +
cagagaagctgtaccaccag

SEQ ID NO: 163533 - DNA, 20 bp, Artificial Sequence
  Synthetic oligonucleotide; TGG chr2 60502080 60502099 60502096 +
agctgtaccaccagaagtcc

SEQ ID NO: 163534 - DNA, 20 bp, Artificial Sequence
  Synthetic oligonucleotide; GAG chr2 60502089 60502108 60502105 +
accagaagtcctggaaaact

SEQ ID NO: 163535 - DNA, 20 bp, Artificial Sequence
  Synthetic oligonucleotide; GAG chr2 60502091 60502110 60502107 +
cagaagtcctggaaaactga

SEQ ID NO: 163536 - DNA, 20 bp, Artificial Sequence
  Synthetic oligonucleotide; AGG chr2 60502092 60502111 60502108 +
agaagtcctggaaaactgag

SEQ ID NO: 163537 - DNA, 20 bp, Artificial Sequence
  Synthetic oligonucleotide; AAG chr2 60502120 60502139 60502136 +
atgttgtaacaatgcaactc

SEQ ID NO: 163538 - DNA, 20 bp, Artificial Sequence
  Synthetic oligonucleotide; CAG chr2 60502128 60502147 60502144 +
acaatgcaactcaagactat

SEQ ID NO: 163539 - DNA, 20 bp, Artificial Sequence
  Synthetic oligonucleotide; TAG chr2 60502150 60502169 60502166 +
gaatgatatgaatatttgta

SEQ ID NO: 163540 - DNA, 20 bp, Artificial Sequence
  Synthetic oligonucleotide; AAG chr2 60502163 60502182 60502179 +
atttgtatagatacttatca

SEQ ID NO: 163541 - DNA, 20 bp, Artificial Sequence
  Synthetic oligonucleotide; CAG chr2 60502173 60502192 60502189 +
atacttatcaaagcaacaat

SEQ ID NO: 163542 - DNA, 20 bp, Artificial Sequence
  Synthetic oligonucleotide; GAG chr2 60502175 60502194 60502191 +
acttatcaaagcaacaatca

SEQ ID NO: 163543 - DNA, 20 bp, Artificial Sequence
  Synthetic oligonucleotide; CAG chr2 60502180 60502199 60502196 +
tcaaagcaacaatcagagat

SEQ ID NO: 163544 - DNA, 20 bp, Artificial Sequence
  Synthetic oligonucleotide; AGG chr2 60502181 60502200 60502197 +
caaagcaacaatcagagatc

SEQ ID NO: 163545 - DNA, 20 bp, Artificial Sequence
  Synthetic oligonucleotide; GAG chr2 60502195 60502214 60502211 +
gagatcaggtccctccaaat

SEQ ID NO: 163546 - DNA, 20 bp, Artificial Sequence
  Synthetic oligonucleotide; CAG chr2 60502202 60502221 60502218 +
ggtccctccaaatgagctta

SEQ ID NO: 163547 - DNA, 20 bp, Artificial Sequence
  Synthetic oligonucleotide; AAG chr2 60502225 60502244 60502241 +
tttatgatcctgctttgtaa

SEQ ID NO: 163548 - DNA, 20 bp, Artificial Sequence
  Synthetic oligonucleotide; TGG chr2 60502229 60502248 60502245 +
tgatcctgctttgtaaaagc

SEQ ID NO: 163549 - DNA, 20 bp, Artificial Sequence
  Synthetic oligonucleotide; TGG chr2 60502245 60502264 60502261 +
aagctggtgaaacaaaatga

SEQ ID NO: 163550 - DNA, 20 bp, Artificial Sequence
  Synthetic oligonucleotide; TAG chr2 60502249 60502268 60502265 +
tggtgaaacaaaatgatgga

SEQ ID NO: 163551 - DNA, 20 bp, Artificial Sequence
  Synthetic oligonucleotide; CAG chr2 60502252 60502271 60502268 +
tgaaacaaaatgatggatag

SEQ ID NO: 163552 - DNA, 20 bp, Artificial Sequence
  Synthetic oligonucleotide; GAG chr2 60502262 60502281 60502278 +
tgatggatagcagatttgct

SEQ ID NO: 163553 - DNA, 20 bp, Artificial Sequence
  Synthetic oligonucleotide; AAG chr2 60502270 60502289 60502286 +
agcagatttgctgagctcca

SEQ ID NO: 163554 - DNA, 20 bp, Artificial Sequence
  Synthetic oligonucleotide; CAG chr2 60502274 60502293 60502290 +
gatttgctgagctccaaagt

SEQ ID NO: 163555 - DNA, 20 bp, Artificial Sequence
  Synthetic oligonucleotide; AGG chr2 60502275 60502294 60502291 +
atttgctgagctccaaagtc

SEQ ID NO: 163556 - DNA, 20 bp, Artificial Sequence
  Synthetic oligonucleotide; GGG chr2 60502276 60502295 60502292 +
tttgctgagctccaaagtca

SEQ ID NO: 163557 - DNA, 20 bp, Artificial Sequence
  Synthetic oligonucleotide; GAG chr2 60502278 60502297 60502294 +
tgctgagctccaaagtcagg

SEQ ID NO: 163558 - DNA, 20 bp, Artificial Sequence
  Synthetic oligonucleotide; TAG chr2 60502281 60502300 60502297 +
tgagctccaaagtcagggag

SEQ ID NO: 163559 - DNA, 20 bp, Artificial Sequence
  Synthetic oligonucleotide; AGG chr2 60502282 60502301 60502298 +
gagctccaaagtcagggagt

SEQ ID NO: 163560 - DNA, 20 bp, Artificial Sequence
  Synthetic oligonucleotide; CAG chr2 60502289 60502308 60502305 +
aaagtcagggagtaggtaaa

SEQ ID NO: 163561 - DNA, 20 bp, Artificial Sequence
  Synthetic oligonucleotide; CAG chr2 60502303 60502322 60502319 +
ggtaaacagtgtgaacgtgt

SEQ ID NO: 163562 - DNA, 20 bp, Artificial Sequence
  Synthetic oligonucleotide; TGG chr2 60502314 60502333 60502330 +
tgaacgtgtcagctccctcc

SEQ ID NO: 163563 - DNA, 20 bp, Artificial Sequence
  Synthetic oligonucleotide; GAG chr2 60502335 60502354 60502351 +
ggctctcctctacattctgt

SEQ ID NO: 163564 - DNA, 20 bp, Artificial Sequence
  Synthetic oligonucleotide; CGG chr2 60502342 60502361 60502358 +
ctctacattctgtgagcaaa

SEQ ID NO: 163565 - DNA, 20 bp, Artificial Sequence
  Synthetic oligonucleotide; CGG chr2 60502358 60502377 60502374 +
caaacggaaaaataaaccat

SEQ ID NO: 163566 - DNA, 20 bp, Artificial Sequence
  Synthetic oligonucleotide; AAG chr2 60502364 60502383 60502380 +
gaaaaataaaccatcggaaa

SEQ ID NO: 163567 - DNA, 20 bp, Artificial Sequence
  Synthetic oligonucleotide; CAG chr2 60502370 60502389 60502386 +
taaaccatcggaaaaagtct

SEQ ID NO: 163568 - DNA, 20 bp, Artificial Sequence
  Synthetic oligonucleotide; CAG chr2 60502388 60502407 60502404 +
ctcagcctaataaaactgca

SEQ ID NO: 163569 - DNA, 20 bp, Artificial Sequence
  Synthetic oligonucleotide; CAG chr2 60502392 60502411 60502408 +
gcctaataaaactgcacaga

SEQ ID NO: 163570 - DNA, 20 bp, Artificial Sequence
  Synthetic oligonucleotide; CAG chr2 60502409 60502428 60502425 +
agacagaataacttcttcat

SEQ ID NO: 163571 - DNA, 20 bp, Artificial Sequence
  Synthetic oligonucleotide; CAG chr2 60502415 60502434 60502431 +
aataacttcttcatcagatt

SEQ ID NO: 163572 - DNA, 20 bp, Artificial Sequence
  Synthetic oligonucleotide; AAG chr2 60502418 60502437 60502434 +
aacttcttcatcagattcag

SEQ ID NO: 163573 - DNA, 20 bp, Artificial Sequence
  Synthetic oligonucleotide; GAG chr2 60502420 60502439 60502436 +
cttcttcatcagattcagaa

SEQ ID NO: 163574 - DNA, 20 bp, Artificial Sequence
  Synthetic oligonucleotide; TAG chr2 60502423 60502442 60502439 +
cttcatcagattcagaagag

SEQ ID NO: 163575 - DNA, 20 bp, Artificial Sequence
  Synthetic oligonucleotide; CAG chr2 60502426 60502445 60502442 +
catcagattcagaagagtag

SEQ ID NO: 163576 - DNA, 20 bp, Artificial Sequence
  Synthetic oligonucleotide; AGG chr2 60502427 60502446 60502443 +
atcagattcagaagagtagc

SEQ ID NO: 163577 - DNA, 20 bp, Artificial Sequence
  Synthetic oligonucleotide; GGG chr2 60502428 60502447 60502444 +
tcagattcagaagagtagca

SEQ ID NO: 163578 - DNA, 20 bp, Artificial Sequence
  Synthetic oligonucleotide; GGG chr2 60502429 60502448 60502445 +
cagattcagaagagtagcag

SEQ ID NO: 163579 - DNA, 20 bp, Artificial Sequence
  Synthetic oligonucleotide; GGG chr2 60502430 60502449 60502446 +
agattcagaagagtagcagg

SEQ ID NO: 163580 - DNA, 20 bp, Artificial Sequence
  Synthetic oligonucleotide; TAG chr2 60502441 60502460 60502457 +
agtagcagggggtttctcgc

SEQ ID NO: 163581 - DNA, 20 bp, Artificial Sequence
  Synthetic oligonucleotide; CAG chr2 60502446 60502465 60502462 +
cagggggtttctcgctagca

SEQ ID NO: 163582 - DNA, 20 bp, Artificial Sequence
  Synthetic oligonucleotide; GAG chr2 60502453 60502472 60502469 +
tttctcgctagcacagattt

SEQ ID NO: 163583 - DNA, 20 bp, Artificial Sequence
  Synthetic oligonucleotide; TGG chr2 60502488 60502507 60502504 +
acactttgtacatacaattc

SEQ ID NO: 163584 - DNA, 20 bp, Artificial Sequence
  Synthetic oligonucleotide; GGG chr2 60502489 60502508 60502505 +
cactttgtacatacaattct

SEQ ID NO: 163585 - DNA, 20 bp, Artificial Sequence
  Synthetic oligonucleotide; CAG chr2 60502496 60502515 60502512 +
tacatacaattctgggatct

SEQ ID NO: 163586 - DNA, 20 bp, Artificial Sequence
  Synthetic oligonucleotide; AGG chr2 60502497 60502516 60502513 +
acatacaattctgggatctc

SEQ ID NO: 163587 - DNA, 20 bp, Artificial Sequence
  Synthetic oligonucleotide; AAG chr2 60502511 60502530 60502527 +
gatctcaggtattgctccta

SEQ ID NO: 163588 - DNA, 20 bp, Artificial Sequence
  Synthetic oligonucleotide; AAG chr2 60502515 60502534 60502531 +
tcaggtattgctcctaaaga

SEQ ID NO: 163589 - DNA, 20 bp, Artificial Sequence
  Synthetic oligonucleotide; GAG chr2 60502517 60502536 60502533 +
aggtattgctcctaaagaaa

SEQ ID NO: 163590 - DNA, 20 bp, Artificial Sequence
  Synthetic oligonucleotide; CAG chr2 60502521 60502540 60502537 +
attgctcctaaagaaagagc

SEQ ID NO: 163591 - DNA, 20 bp, Artificial Sequence
  Synthetic oligonucleotide; AAG chr2 60502555 60502574 60502571 +
tatcttcctccaacatccaa

SEQ ID NO: 163592 - DNA, 20 bp, Artificial Sequence
  Synthetic oligonucleotide; CAG chr2 60502558 60502577 60502574 +
cttcctccaacatccaaaag

SEQ ID NO: 163593 - DNA, 20 bp, Artificial Sequence
  Synthetic oligonucleotide; AAG chr2 60502606 60502625 60502622 +
taatattaaaatatgaattt

SEQ ID NO: 163594 - DNA, 20 bp, Artificial Sequence
  Synthetic oligonucleotide; CAG chr2 60502615 60502634 60502631 +
aatatgaatttaagaaatac

SEQ ID NO: 163595 - DNA, 20 bp, Artificial Sequence
  Synthetic oligonucleotide; AAG chr2 60502622 60502641 60502638 +
atttaagaaataccagtgaa

SEQ ID NO: 163596 - DNA, 20 bp, Artificial Sequence
  Synthetic oligonucleotide; GAG chr2 60502624 60502643 60502640 +
ttaagaaataccagtgaaaa

SEQ ID NO: 163597 - DNA, 20 bp, Artificial Sequence
  Synthetic oligonucleotide; CAG chr2 60502638 60502657 60502654 +
tgaaaagagattttttaaac

SEQ ID NO: 163598 - DNA, 20 bp, Artificial Sequence
  Synthetic oligonucleotide; CAG chr2 60502698 60502717 60502714 +
aaactgttttcaatcatcat

SEQ ID NO: 163599 - DNA, 20 bp, Artificial Sequence
  Synthetic oligonucleotide; GAG chr2 60502700 60502719 60502716 +
actgttttcaatcatcatca

SEQ ID NO: 163600 - DNA, 20 bp, Artificial Sequence
  Synthetic oligonucleotide; TGG chr2 60502726 60502745 60502742 +
aacaaatttacctctgatca

SEQ ID NO: 163601 - DNA, 20 bp, Artificial Sequence
  Synthetic oligonucleotide; TAG chr2 60502729 60502748 60502745 +
aaatttacctctgatcatgg

SEQ ID NO: 163602 - DNA, 20 bp, Artificial Sequence
  Synthetic oligonucleotide; CAG chr2 60502734 60502753 60502750 +
tacctctgatcatggtagca

SEQ ID NO: 163603 - DNA, 20 bp, Artificial Sequence
  Synthetic oligonucleotide; TAG chr2 60502737 60502756 60502753 +
ctctgatcatggtagcacag

SEQ ID NO: 163604 - DNA, 20 bp, Artificial Sequence
  Synthetic oligonucleotide; GAG chr2 60502739 60502758 60502755 +
ctgatcatggtagcacagta

SEQ ID NO: 163605 - DNA, 20 bp, Artificial Sequence
  Synthetic oligonucleotide; CAG chr2 60502742 60502761 60502758 +
atcatggtagcacagtagag

SEQ ID NO: 163606 - DNA, 20 bp, Artificial Sequence
  Synthetic oligonucleotide; AAG chr2 60502746 60502765 60502762 +
tggtagcacagtagagcaga

SEQ ID NO: 163607 - DNA, 20 bp, Artificial Sequence
  Synthetic oligonucleotide; GAG chr2 60502748 60502767 60502764 +
gtagcacagtagagcagaaa

SEQ ID NO: 163608 - DNA, 20 bp, Artificial Sequence
  Synthetic oligonucleotide; TGG chr2 60502759 60502778 60502775 +
gagcagaaagagcactcaat

SEQ ID NO: 163609 - DNA, 20 bp, Artificial Sequence
  Synthetic oligonucleotide; AAG chr2 60502769 60502788 60502785 +
agcactcaattggtgatcaa

SEQ ID NO: 163610 - DNA, 20 bp, Artificial Sequence
  Synthetic oligonucleotide; TAG chr2 60502782 60502801 60502798 +
tgatcaaaagaaataaattc

SEQ ID NO: 163611 - DNA, 20 bp, Artificial Sequence
  Synthetic oligonucleotide; CAG chr2 60502795 60502814 60502811 +
taaattctagtcctgtcacc

SEQ ID NO: 163612 - DNA, 20 bp, Artificial Sequence
  Synthetic oligonucleotide; CAG chr2 60502810 60502829 60502826 +
tcacccagaaactatgtgac

SEQ ID NO: 163613 - DNA, 20 bp, Artificial Sequence
  Synthetic oligonucleotide; AGG chr2 60502811 60502830 60502827 +
cacccagaaactatgtgacc

SEQ ID NO: 163614 - DNA, 20 bp, Artificial Sequence
  Synthetic oligonucleotide; GGG chr2 60502812 60502831 60502828 +
acccagaaactatgtgacca

SEQ ID NO: 163615 - DNA, 20 bp, Artificial Sequence
  Synthetic oligonucleotide; GGG chr2 60502813 60502832 60502829 +
cccagaaactatgtgaccag

SEQ ID NO: 163616 - DNA, 20 bp, Artificial Sequence
  Synthetic oligonucleotide; GAG chr2 60502815 60502834 60502831 +
cagaaactatgtgaccaggg

SEQ ID NO: 163617 - DNA, 20 bp, Artificial Sequence
  Synthetic oligonucleotide; AGG chr2 60502816 60502835 60502832 +
agaaactatgtgaccagggg

SEQ ID NO: 163618 - DNA, 20 bp, Artificial Sequence
  Synthetic oligonucleotide; AAG chr2 60502831 60502850 60502847 +
aggggaggtacttaatctct

SEQ ID NO: 163619 - DNA, 20 bp, Artificial Sequence
  Synthetic oligonucleotide; GAG chr2 60502833 60502852 60502849 +
gggaggtacttaatctctaa

SEQ ID NO: 163620 - DNA, 20 bp, Artificial Sequence
  Synthetic oligonucleotide; AAG chr2 60502840 60502859 60502856 +
acttaatctctaagagaatc

SEQ ID NO: 163621 - DNA, 20 bp, Artificial Sequence
  Synthetic oligonucleotide; GAG chr2 60502847 60502866 60502863 +
ctctaagagaatcaagtctc

SEQ ID NO: 163622 - DNA, 20 bp, Artificial Sequence
  Synthetic oligonucleotide; TGG chr2 60502850 60502869 60502866 +
taagagaatcaagtctcgag

SEQ ID NO: 163623 - DNA, 20 bp, Artificial Sequence
  Synthetic oligonucleotide; GGG chr2 60502851 60502870 60502867 +
aagagaatcaagtctcgagt

SEQ ID NO: 163624 - DNA, 20 bp, Artificial Sequence
  Synthetic oligonucleotide; GAG chr2 60502860 60502879 60502876 +
aagtctcgagtgggtaaaat

SEQ ID NO: 163625 - DNA, 20 bp, Artificial Sequence
  Synthetic oligonucleotide; TGG chr2 60502864 60502883 60502880 +
ctcgagtgggtaaaatgagc

SEQ ID NO: 163626 - DNA, 20 bp, Artificial Sequence
  Synthetic oligonucleotide; GGG chr2 60502865 60502884 60502881 +
tcgagtgggtaaaatgagct

SEQ ID NO: 163627 - DNA, 20 bp, Artificial Sequence
  Synthetic oligonucleotide; GGG chr2 60502866 60502885 60502882 +
cgagtgggtaaaatgagctg

SEQ ID NO: 163628 - DNA, 20 bp, Artificial Sequence
  Synthetic oligonucleotide; AAG chr2 60502869 60502888 60502885 +
gtgggtaaaatgagctgggg

SEQ ID NO: 163629 - DNA, 20 bp, Artificial Sequence
  Synthetic oligonucleotide; AGG chr2 60502870 60502889 60502886 +
tgggtaaaatgagctgggga

SEQ ID NO: 163630 - DNA, 20 bp, Artificial Sequence
  Synthetic oligonucleotide; GAG chr2 60502872 60502891 60502888 +
ggtaaaatgagctggggaag

SEQ ID NO: 163631 - DNA, 20 bp, Artificial Sequence
  Synthetic oligonucleotide; CAG chr2 60502880 60502899 60502896 +
gagctggggaaggagtgaac

SEQ ID NO: 163632 - DNA, 20 bp, Artificial Sequence
  Synthetic oligonucleotide; GAG chr2 60502884 60502903 60502900 +
tggggaaggagtgaaccagt

SEQ ID NO: 163633 - DNA, 20 bp, Artificial Sequence
  Synthetic oligonucleotide; AAG chr2 60502888 60502907 60502904 +
gaaggagtgaaccagtgaga

SEQ ID NO: 163634 - DNA, 20 bp, Artificial Sequence
  Synthetic oligonucleotide; TGG chr2 60502896 60502915 60502912 +
gaaccagtgagaaagaacac

SEQ ID NO: 163635 - DNA, 20 bp, Artificial Sequence
  Synthetic oligonucleotide; TGG chr2 60502905 60502924 60502921 +
agaaagaacactggtctgtc

SEQ ID NO: 163636 - DNA, 20 bp, Artificial Sequence
  Synthetic oligonucleotide; GGG chr2 60502906 60502925 60502922 +
gaaagaacactggtctgtct

SEQ ID NO: 163637 - DNA, 20 bp, Artificial Sequence
  Synthetic oligonucleotide; GGG chr2 60502907 60502926 60502923 +
aaagaacactggtctgtctg

SEQ ID NO: 163638 - DNA, 20 bp, Artificial Sequence
  Synthetic oligonucleotide; CAG chr2 60502914 60502933 60502930 +
actggtctgtctggggctcc

SEQ ID NO: 163639 - DNA, 20 bp, Artificial Sequence
  Synthetic oligonucleotide; AAG chr2 60502917 60502936 60502933 +
ggtctgtctggggctcccag

SEQ ID NO: 163640 - DNA, 20 bp, Artificial Sequence
  Synthetic oligonucleotide; CAG chr2 60502923 60502942 60502939 +
tctggggctcccagaagaca

SEQ ID NO: 163641 - DNA, 20 bp, Artificial Sequence
  Synthetic oligonucleotide; CAG chr2 60502927 60502946 60502943 +
gggctcccagaagacacagc

SEQ ID NO: 163642 - DNA, 20 bp, Artificial Sequence
  Synthetic oligonucleotide; AAG chr2 60502970 60502989 60502986 +
caaacacctccttgtctttt

SEQ ID NO: 163643 - DNA, 20 bp, Artificial Sequence
  Synthetic oligonucleotide; AGG chr2 60502971 60502990 60502987 +
aaacacctccttgtctttta

SEQ ID NO: 163644 - DNA, 20 bp, Artificial Sequence
  Synthetic oligonucleotide; TGG chr2 60502976 60502995 60502992 +
cctccttgtcttttaaggcc

SEQ ID NO: 163645 - DNA, 20 bp, Artificial Sequence
  Synthetic oligonucleotide; GGG chr2 60502977 60502996 60502993 +
ctccttgtcttttaaggcct

SEQ ID NO: 163646 - DNA, 20 bp, Artificial Sequence
  Synthetic oligonucleotide; TAG chr2 60502985 60503004 60503001 +
cttttaaggcctgggctgtc

SEQ ID NO: 163647 - DNA, 20 bp, Artificial Sequence
  Synthetic oligonucleotide; AGG chr2 60502986 60503005 60503002 +
ttttaaggcctgggctgtct

SEQ ID NO: 163648 - DNA, 20 bp, Artificial Sequence
  Synthetic oligonucleotide; GGG chr2 60502987 60503006 60503003 +
tttaaggcctgggctgtcta

SEQ ID NO: 163649 - DNA, 20 bp, Artificial Sequence
  Synthetic oligonucleotide; GGG chr2 60502988 60503007 60503004 +
ttaaggcctgggctgtctag

SEQ ID NO: 163650 - DNA, 20 bp, Artificial Sequence
  Synthetic oligonucleotide; GGG chr2 60502989 60503008 60503005 +
taaggcctgggctgtctagg

SEQ ID NO: 163651 - DNA, 20 bp, Artificial Sequence
  Synthetic oligonucleotide; TGG chr2 60502993 60503012 60503009 +
gcctgggctgtctaggggga

SEQ ID NO: 163652 - DNA, 20 bp, Artificial Sequence
  Synthetic oligonucleotide; TGG chr2 60503000 60503019 60503016 +
ctgtctagggggatggctac

SEQ ID NO: 163653 - DNA, 20 bp, Artificial Sequence
  Synthetic oligonucleotide; TGG chr2 60503005 60503024 60503021 +
tagggggatggctactggct

SEQ ID NO: 163654 - DNA, 20 bp, Artificial Sequence
  Synthetic oligonucleotide; GAG chr2 60503007 60503026 60503023 +
gggggatggctactggcttg

SEQ ID NO: 163655 - DNA, 20 bp, Artificial Sequence
  Synthetic oligonucleotide; CGG chr2 60503042 60503061 60503058 +
gtctgtcatcttaatacaca

SEQ ID NO: 163656 - DNA, 20 bp, Artificial Sequence
  Synthetic oligonucleotide; AAG chr2 60503059 60503078 60503075 +
acacggaatgtgttgaaatg

SEQ ID NO: 163657 - DNA, 20 bp, Artificial Sequence
  Synthetic oligonucleotide; AGG chr2 60503060 60503079 60503076 +
cacggaatgtgttgaaatga

SEQ ID NO: 163658 - DNA, 20 bp, Artificial Sequence
  Synthetic oligonucleotide; TGG chr2 60503071 60503090 60503087 +
ttgaaatgaaggtgtctgtg

SEQ ID NO: 163659 - DNA, 20 bp, Artificial Sequence
  Synthetic oligonucleotide; AAG chr2 60503074 60503093 60503090 +
aaatgaaggtgtctgtgtgg

SEQ ID NO: 163660 - DNA, 20 bp, Artificial Sequence
  Synthetic oligonucleotide; AGG chr2 60503075 60503094 60503091 +
aatgaaggtgtctgtgtgga

SEQ ID NO: 163661 - DNA, 20 bp, Artificial Sequence
  Synthetic oligonucleotide; GGG chr2 60503076 60503095 60503092 +
atgaaggtgtctgtgtggaa

SEQ ID NO: 163662 - DNA, 20 bp, Artificial Sequence
  Synthetic oligonucleotide; CAG chr2 60503080 60503099 60503096 +
aggtgtctgtgtggaaggga

SEQ ID NO: 163663 - DNA, 20 bp, Artificial Sequence
  Synthetic oligonucleotide; CAG chr2 60503086 60503105 60503102 +
ctgtgtggaagggacagacc

SEQ ID NO: 163664 - DNA, 20 bp, Artificial Sequence
  Synthetic oligonucleotide; TGG chr2 60503108 60503127 60503124 +
gatccactctgcatttgtcc

SEQ ID NO: 163665 - DNA, 20 bp, Artificial Sequence
  Synthetic oligonucleotide; TGG chr2 60503114 60503133 60503130 +
ctctgcatttgtcctggcaa

SEQ ID NO: 163666 - DNA, 20 bp, Artificial Sequence
  Synthetic oligonucleotide; GGG chr2 60503115 60503134 60503131 +
tctgcatttgtcctggcaat

SEQ ID NO: 163667 - DNA, 20 bp, Artificial Sequence
  Synthetic oligonucleotide; GAG chr2 60503117 60503136 60503133 +
tgcatttgtcctggcaatgg

SEQ ID NO: 163668 - DNA, 20 bp, Artificial Sequence
  Synthetic oligonucleotide; CAG chr2 60503120 60503139 60503136 +
atttgtcctggcaatgggag

SEQ ID NO: 163669 - DNA, 20 bp, Artificial Sequence
  Synthetic oligonucleotide; AGG chr2 60503121 60503140 60503137 +
tttgtcctggcaatgggagc

SEQ ID NO: 163670 - DNA, 20 bp, Artificial Sequence
  Synthetic oligonucleotide; GAG chr2 60503127 60503146 60503143 +
ctggcaatgggagcaggaat

SEQ ID NO: 163671 - DNA, 20 bp, Artificial Sequence
  Synthetic oligonucleotide; TGG chr2 60503147 60503166 60503163 +
gagtccaccttctctaaacc

SEQ ID NO: 163672 - DNA, 20 bp, Artificial Sequence
  Synthetic oligonucleotide; TAG chr2 60503157 60503176 60503173 +
tctctaaacctggtcactcc

SEQ ID NO: 163673 - DNA, 20 bp, Artificial Sequence
  Synthetic oligonucleotide; AAG chr2 60503164 60503183 60503180 +
acctggtcactcctagtccc

SEQ ID NO: 163674 - DNA, 20 bp, Artificial Sequence
  Synthetic oligonucleotide; TGG chr2 60503168 60503187 60503184 +
ggtcactcctagtcccaaga

SEQ ID NO: 163675 - DNA, 20 bp, Artificial Sequence
  Synthetic oligonucleotide; GAG chr2 60503170 60503189 60503186 +
tcactcctagtcccaagatg

SEQ ID NO: 163676 - DNA, 20 bp, Artificial Sequence
  Synthetic oligonucleotide; AAG chr2 60503173 60503192 60503189 +
ctcctagtcccaagatggag

SEQ ID NO: 163677 - DNA, 20 bp, Artificial Sequence
  Synthetic oligonucleotide; TAG chr2 60503197 60503216 60503213 +
cacatcacccttgatcatgt

SEQ ID NO: 163678 - DNA, 20 bp, Artificial Sequence
  Synthetic oligonucleotide; CAG chr2 60503210 60503229 60503226 +
atcatgttagccccattctg

SEQ ID NO: 163679 - DNA, 20 bp, Artificial Sequence
  Synthetic oligonucleotide; CAG chr2 60503216 60503235 60503232 +
ttagccccattctgcagcct

SEQ ID NO: 163680 - DNA, 20 bp, Artificial Sequence
  Synthetic oligonucleotide; AGG chr2 60503217 60503236 60503233 +
tagccccattctgcagcctc

SEQ ID NO: 163681 - DNA, 20 bp, Artificial Sequence
  Synthetic oligonucleotide; GAG chr2 60503219 60503238 60503235 +
gccccattctgcagcctcag

SEQ ID NO: 163682 - DNA, 20 bp, Artificial Sequence
  Synthetic oligonucleotide; AGG chr2 60503220 60503239 60503236 +
ccccattctgcagcctcagg

SEQ ID NO: 163683 - DNA, 20 bp, Artificial Sequence
  Synthetic oligonucleotide; CAG chr2 60503230 60503249 60503246 +
cagcctcaggaggctctgac

SEQ ID NO: 163684 - DNA, 20 bp, Artificial Sequence
  Synthetic oligonucleotide; AGG chr2 60503231 60503250 60503247 +
agcctcaggaggctctgacc

SEQ ID NO: 163685 - DNA, 20 bp, Artificial Sequence
  Synthetic oligonucleotide; TGG chr2 60503234 60503253 60503250 +
ctcaggaggctctgaccagg

SEQ ID NO: 163686 - DNA, 20 bp, Artificial Sequence
  Synthetic oligonucleotide; AAG chr2 60503238 60503257 60503254 +
ggaggctctgaccaggtgga

SEQ ID NO: 163687 - DNA, 20 bp, Artificial Sequence
  Synthetic oligonucleotide; CAG chr2 60503242 60503261 60503258 +
gctctgaccaggtggaaagc

SEQ ID NO: 163688 - DNA, 20 bp, Artificial Sequence
  Synthetic oligonucleotide; TGG chr2 60503247 60503266 60503263 +
gaccaggtggaaagccagaa

SEQ ID NO: 163689 - DNA, 20 bp, Artificial Sequence
  Synthetic oligonucleotide; GGG chr2 60503248 60503267 60503264 +
accaggtggaaagccagaat

SEQ ID NO: 163690 - DNA, 20 bp, Artificial Sequence
  Synthetic oligonucleotide; GGG chr2 60503249 60503268 60503265 +
ccaggtggaaagccagaatg

SEQ ID NO: 163691 - DNA, 20 bp, Artificial Sequence
  Synthetic oligonucleotide; CAG chr2 60503258 60503277 60503274 +
aagccagaatggggtccaac

SEQ ID NO: 163692 - DNA, 20 bp, Artificial Sequence
  Synthetic oligonucleotide; AGG chr2 60503259 60503278 60503275 +
agccagaatggggtccaacc

SEQ ID NO: 163693 - DNA, 20 bp, Artificial Sequence
  Synthetic oligonucleotide; GAG chr2 60503261 60503280 60503277 +
ccagaatggggtccaaccag

SEQ ID NO: 163694 - DNA, 20 bp, Artificial Sequence
  Synthetic oligonucleotide; AAG chr2 60503268 60503287 60503284 +
ggggtccaaccaggagaccc

SEQ ID NO: 163695 - DNA, 20 bp, Artificial Sequence
  Synthetic oligonucleotide; CAG chr2 60503272 60503291 60503288 +
tccaaccaggagacccaaga

SEQ ID NO: 163696 - DNA, 20 bp, Artificial Sequence
  Synthetic oligonucleotide; AAG chr2 60503277 60503296 60503293 +
ccaggagacccaagacagaa

SEQ ID NO: 163697 - DNA, 20 bp, Artificial Sequence
  Synthetic oligonucleotide; AGG chr2 60503278 60503297 60503294 +
caggagacccaagacagaaa

SEQ ID NO: 163698 - DNA, 20 bp, Artificial Sequence
  Synthetic oligonucleotide; CAG chr2 60503281 60503300 60503297 +
gagacccaagacagaaaagg

SEQ ID NO: 163699 - DNA, 20 bp, Artificial Sequence
  Synthetic oligonucleotide; AGG chr2 60503282 60503301 60503298 +
agacccaagacagaaaaggc

SEQ ID NO: 163700 - DNA, 20 bp, Artificial Sequence
  Synthetic oligonucleotide; TGG chr2 60503285 60503304 60503301 +
cccaagacagaaaaggcagg

SEQ ID NO: 163701 - DNA, 20 bp, Artificial Sequence
  Synthetic oligonucleotide; AAG chr2 60503292 60503311 60503308 +
cagaaaaggcaggtggctgc

SEQ ID NO: 163702 - DNA, 20 bp, Artificial Sequence
  Synthetic oligonucleotide; AGG chr2 60503293 60503312 60503309 +
agaaaaggcaggtggctgca

SEQ ID NO: 163703 - DNA, 20 bp, Artificial Sequence
  Synthetic oligonucleotide; GAG chr2 60503295 60503314 60503311 +
aaaaggcaggtggctgcaag

SEQ ID NO: 163704 - DNA, 20 bp, Artificial Sequence
  Synthetic oligonucleotide; CAG chr2 60503309 60503328 60503325 +
tgcaaggagcctcacttctc

SEQ ID NO: 163705 - DNA, 20 bp, Artificial Sequence
  Synthetic oligonucleotide; AGG chr2 60503310 60503329 60503326 +
gcaaggagcctcacttctcc

SEQ ID NO: 163706 - DNA, 20 bp, Artificial Sequence
  Synthetic oligonucleotide; CAG chr2 60503357 60503376 60503373 +
cttacccatgccacccaccg

SEQ ID NO: 163707 - DNA, 20 bp, Artificial Sequence
  Synthetic oligonucleotide; TGG chr2 60503362 60503381 60503378 +
ccatgccacccaccgcagcc

SEQ ID NO: 163708 - DNA, 20 bp, Artificial Sequence
  Synthetic oligonucleotide; CAG chr2 60503366 60503385 60503382 +
gccacccaccgcagcctgga

SEQ ID NO: 163709 - DNA, 20 bp, Artificial Sequence
  Synthetic oligonucleotide; AGG chr2 60503367 60503386 60503383 +
ccacccaccgcagcctggac

SEQ ID NO: 163710 - DNA, 20 bp, Artificial Sequence
  Synthetic oligonucleotide; CAG chr2 60503375 60503394 60503391 +
cgcagcctggacaggcattc

SEQ ID NO: 163711 - DNA, 20 bp, Artificial Sequence
  Synthetic oligonucleotide; AGG chr2 60503376 60503395 60503392 +
gcagcctggacaggcattcc

SEQ ID NO: 163712 - DNA, 20 bp, Artificial Sequence
  Synthetic oligonucleotide; GAG chr2 60503378 60503397 60503394 +
agcctggacaggcattccag

SEQ ID NO: 163713 - DNA, 20 bp, Artificial Sequence
  Synthetic oligonucleotide; CAG chr2 60503382 60503401 60503398 +
tggacaggcattccaggagc

SEQ ID NO: 163714 - DNA, 20 bp, Artificial Sequence
  Synthetic oligonucleotide; TGG chr2 60503394 60503413 60503410 +
ccaggagccagacatgtccc

SEQ ID NO: 163715 - DNA, 20 bp, Artificial Sequence
  Synthetic oligonucleotide; AAG chr2 60503397 60503416 60503413 +
ggagccagacatgtccctgg

SEQ ID NO: 163716 - DNA, 20 bp, Artificial Sequence
  Synthetic oligonucleotide; CAG chr2 60503401 60503420 60503417 +
ccagacatgtccctggaaga

SEQ ID NO: 163717 - DNA, 20 bp, Artificial Sequence
  Synthetic oligonucleotide; TAG chr2 60503404 60503423 60503420 +
gacatgtccctggaagacag

SEQ ID NO: 163718 - DNA, 20 bp, Artificial Sequence
  Synthetic oligonucleotide; AGG chr2 60503405 60503424 60503421 +
acatgtccctggaagacagt

SEQ ID NO: 163719 - DNA, 20 bp, Artificial Sequence
  Synthetic oligonucleotide; GAG chr2 60503422 60503441 60503438 +
agtaggctattgcttcctct

SEQ ID NO: 163720 - DNA, 20 bp, Artificial Sequence
  Synthetic oligonucleotide; TGG chr2 60503443 60503462 60503459 +
agcactgcaacaattttctc

SEQ ID NO: 163721 - DNA, 20 bp, Artificial Sequence
  Synthetic oligonucleotide; CAG chr2 60503467 60503486 60503483 +
ccctctcctccacctattca

SEQ ID NO: 163722 - DNA, 20 bp, Artificial Sequence
  Synthetic oligonucleotide; TGG chr2 60503471 60503490 60503487 +
ctcctccacctattcacaga

SEQ ID NO: 163723 - DNA, 20 bp, Artificial Sequence
  Synthetic oligonucleotide; GGG chr2 60503472 60503491 60503488 +
tcctccacctattcacagat

SEQ ID NO: 163724 - DNA, 20 bp, Artificial Sequence
  Synthetic oligonucleotide; GGG chr2 60503473 60503492 60503489 +
cctccacctattcacagatg

SEQ ID NO: 163725 - DNA, 20 bp, Artificial Sequence
  Synthetic oligonucleotide; TAG chr2 60503498 60503517 60503514 +
taaccctccctcctatccat

SEQ ID NO: 163726 - DNA, 20 bp, Artificial Sequence
  Synthetic oligonucleotide; TGG chr2 60503513 60503532 60503529 +
tccattagattgcccaaatc

SEQ ID NO: 163727 - DNA, 20 bp, Artificial Sequence
  Synthetic oligonucleotide; GGG chr2 60503514 60503533 60503530 +
ccattagattgcccaaatct

SEQ ID NO: 163728 - DNA, 20 bp, Artificial Sequence
  Synthetic oligonucleotide; TGG chr2 60503528 60503547 60503544 +
aaatctgggaaaataatgtg

SEQ ID NO: 163729 - DNA, 20 bp, Artificial Sequence
  Synthetic oligonucleotide; CAG chr2 60503535 60503554 60503551 +
ggaaaataatgtgtggcgct

SEQ ID NO: 163730 - DNA, 20 bp, Artificial Sequence
  Synthetic oligonucleotide; AGG chr2 60503536 60503555 60503552 +
gaaaataatgtgtggcgctc

SEQ ID NO: 163731 - DNA, 20 bp, Artificial Sequence
  Synthetic oligonucleotide; GAG chr2 60503542 60503561 60503558 +
aatgtgtggcgctcaggtct

SEQ ID NO: 163732 - DNA, 20 bp, Artificial Sequence
  Synthetic oligonucleotide; CAG chr2 60503547 60503566 60503563 +
gtggcgctcaggtctgagtg

SEQ ID NO: 163733 - DNA, 20 bp, Artificial Sequence
  Synthetic oligonucleotide; AAG chr2 60503553 60503572 60503569 +
ctcaggtctgagtgcagacc

SEQ ID NO: 163734 - DNA, 20 bp, Artificial Sequence
  Synthetic oligonucleotide; CAG chr2 60503566 60503585 60503582 +
gcagaccaagctcccaatac

SEQ ID NO: 163735 - DNA, 20 bp, Artificial Sequence
  Synthetic oligonucleotide; TGG chr2 60503569 60503588 60503585 +
gaccaagctcccaataccag

SEQ ID NO: 163736 - DNA, 20 bp, Artificial Sequence
  Synthetic oligonucleotide; CAG chr2 60503578 60503597 60503594 +
cccaataccagtggctcttt

SEQ ID NO: 163737 - DNA, 20 bp, Artificial Sequence
  Synthetic oligonucleotide; AGG chr2 60503579 60503598 60503595 +
ccaataccagtggctctttc

SEQ ID NO: 163738 - DNA, 20 bp, Artificial Sequence
  Synthetic oligonucleotide; AAG chr2 60503588 60503607 60503604 +
gtggctctttcaggcttaca

SEQ ID NO: 163739 - DNA, 20 bp, Artificial Sequence
  Synthetic oligonucleotide; TGG chr2 60503594 60503613 60503610 +
ctttcaggcttacaaagcct

SEQ ID NO: 163740 - DNA, 20 bp, Artificial Sequence
  Synthetic oligonucleotide; TGG chr2 60503597 60503616 60503613 +
tcaggcttacaaagccttgg

SEQ ID NO: 163741 - DNA, 20 bp, Artificial Sequence
  Synthetic oligonucleotide; CAG chr2 60503610 60503629 60503626 +
gccttggtggtttccacacc

SEQ ID NO: 163742 - DNA, 20 bp, Artificial Sequence
  Synthetic oligonucleotide; CAG chr2 60503613 60503632 60503629 +
ttggtggtttccacacccag

SEQ ID NO: 163743 - DNA, 20 bp, Artificial Sequence
  Synthetic oligonucleotide; CAG chr2 60503624 60503643 60503640 +
cacacccagcagttcctacc

SEQ ID NO: 163744 - DNA, 20 bp, Artificial Sequence
  Synthetic oligonucleotide; AGG chr2 60503625 60503644 60503641 +
acacccagcagttcctaccc

SEQ ID NO: 163745 - DNA, 20 bp, Artificial Sequence
  Synthetic oligonucleotide; GAG chr2 60503631 60503650 60503647 +
agcagttcctacccaggact

SEQ ID NO: 163746 - DNA, 20 bp, Artificial Sequence
  Synthetic oligonucleotide; AAG chr2 60503634 60503653 60503650 +
agttcctacccaggactgag

SEQ ID NO: 163747 - DNA, 20 bp, Artificial Sequence
  Synthetic oligonucleotide; CAG chr2 60503641 60503660 60503657 +
acccaggactgagaagccct

SEQ ID NO: 163748 - DNA, 20 bp, Artificial Sequence
  Synthetic oligonucleotide; CAG chr2 60503652 60503671 60503668 +
agaagccctcagcaaacacc

SEQ ID NO: 163749 - DNA, 20 bp, Artificial Sequence
  Synthetic oligonucleotide; TGG chr2 60503656 60503675 60503672 +
gccctcagcaaacacccaga

SEQ ID NO: 163750 - DNA, 20 bp, Artificial Sequence
  Synthetic oligonucleotide; TGG chr2 60503675 60503694 60503691 +
atggcccttgttcaccctcc

SEQ ID NO: 163751 - DNA, 20 bp, Artificial Sequence
  Synthetic oligonucleotide; TAG chr2 60503685 60503704 60503701 +
ttcaccctcctggaaaccta

SEQ ID NO: 163752 - DNA, 20 bp, Artificial Sequence
  Synthetic oligonucleotide; CAG chr2 60503692 60503711 60503708 +
tcctggaaacctatagctgc

SEQ ID NO: 163753 - DNA, 20 bp, Artificial Sequence
  Synthetic oligonucleotide; AGG chr2 60503693 60503712 60503709 +
cctggaaacctatagctgcc

SEQ ID NO: 163754 - DNA, 20 bp, Artificial Sequence
  Synthetic oligonucleotide; GGG chr2 60503694 60503713 60503710 +
ctggaaacctatagctgcca

SEQ ID NO: 163755 - DNA, 20 bp, Artificial Sequence
  Synthetic oligonucleotide; GAG chr2 60503713 60503732 60503729 +
agggaaatgtgacattttgt

SEQ ID NO: 163756 - DNA, 20 bp, Artificial Sequence
  Synthetic oligonucleotide; AGG chr2 60503714 60503733 60503730 +
gggaaatgtgacattttgtg

SEQ ID NO: 163757 - DNA, 20 bp, Artificial Sequence
  Synthetic oligonucleotide; TAG chr2 60503733 60503752 60503749 +
gaggactaatttaacccgcc

SEQ ID NO: 163758 - DNA, 20 bp, Artificial Sequence
  Synthetic oligonucleotide; AAG chr2 60503736 60503755 60503752 +
gactaatttaacccgcctag

SEQ ID NO: 163759 - DNA, 20 bp, Artificial Sequence
  Synthetic oligonucleotide; TAG chr2 60503742 60503761 60503758 +
tttaacccgcctagaagatt

SEQ ID NO: 163760 - DNA, 20 bp, Artificial Sequence
  Synthetic oligonucleotide; AGG chr2 60503743 60503762 60503759 +
ttaacccgcctagaagattt

SEQ ID NO: 163761 - DNA, 20 bp, Artificial Sequence
  Synthetic oligonucleotide; GAG chr2 60503745 60503764 60503761 +
aacccgcctagaagatttag

SEQ ID NO: 163762 - DNA, 20 bp, Artificial Sequence
  Synthetic oligonucleotide; AAG chr2 60503750 60503769 60503766 +
gcctagaagatttaggagcc

SEQ ID NO: 163763 - DNA, 20 bp, Artificial Sequence
  Synthetic oligonucleotide; AAG chr2 60503764 60503783 60503780 +
ggagccaagatgcaacccta

SEQ ID NO: 163764 - DNA, 20 bp, Artificial Sequence
  Synthetic oligonucleotide; AAG chr2 60503775 60503794 60503791 +
gcaaccctaaagcccactgc

SEQ ID NO: 163765 - DNA, 20 bp, Artificial Sequence
  Synthetic oligonucleotide; AGG chr2 60503776 60503795 60503792 +
caaccctaaagcccactgca

SEQ ID NO: 163766 - DNA, 20 bp, Artificial Sequence
  Synthetic oligonucleotide; GGG chr2 60503777 60503796 60503793 +
aaccctaaagcccactgcaa

SEQ ID NO: 163767 - DNA, 20 bp, Artificial Sequence
  Synthetic oligonucleotide; TGG chr2 60503789 60503808 60503805 +
cactgcaagggacaatattc

SEQ ID NO: 163768 - DNA, 20 bp, Artificial Sequence
  Synthetic oligonucleotide; CAG chr2 60503801 60503820 60503817 +
caatattctggatcttttgt

SEQ ID NO: 163769 - DNA, 20 bp, Artificial Sequence
  Synthetic oligonucleotide; GAG chr2 60503803 60503822 60503819 +
atattctggatcttttgtca

SEQ ID NO: 163770 - DNA, 20 bp, Artificial Sequence
  Synthetic oligonucleotide; CAG chr2 60503838 60503857 60503854 +
aataaaatttttatattaaa

SEQ ID NO: 163771 - DNA, 20 bp, Artificial Sequence
  Synthetic oligonucleotide; TGG chr2 60503872 60503891 60503888 +
catctaaacctcctgaaaat

SEQ ID NO: 163772 - DNA, 20 bp, Artificial Sequence
  Synthetic oligonucleotide; TGG chr2 60503879 60503898 60503895 +
acctcctgaaaattggttat

SEQ ID NO: 163773 - DNA, 20 bp, Artificial Sequence
  Synthetic oligonucleotide; TAG chr2 60503897 60503916 60503913 +
attggctgcttcgttgattc

SEQ ID NO: 163774 - DNA, 20 bp, Artificial Sequence
  Synthetic oligonucleotide; AAG chr2 60503906 60503925 60503922 +
ttcgttgattctagaaaaaa

SEQ ID NO: 163775 - DNA, 20 bp, Artificial Sequence
  Synthetic oligonucleotide; AAG chr2 60503910 60503929 60503926 +
ttgattctagaaaaaaaaga

SEQ ID NO: 163776 - DNA, 20 bp, Artificial Sequence
  Synthetic oligonucleotide; AAG chr2 60503914 60503933 60503930 +
ttctagaaaaaaaagaaagc

SEQ ID NO: 163777 - DNA, 20 bp, Artificial Sequence
  Synthetic oligonucleotide; CAG chr2 60503922 60503941 60503938 +
aaaaaagaaagcaagaaatg

SEQ ID NO: 163778 - DNA, 20 bp, Artificial Sequence
  Synthetic oligonucleotide; AGG chr2 60503923 60503942 60503939 +
aaaaagaaagcaagaaatgc

SEQ ID NO: 163779 - DNA, 20 bp, Artificial Sequence
  Synthetic oligonucleotide; AAG chr2 60503927 60503946 60503943 +
agaaagcaagaaatgcagga

SEQ ID NO: 163780 - DNA, 20 bp, Artificial Sequence
  Synthetic oligonucleotide; AGG chr2 60503928 60503947 60503944 +
gaaagcaagaaatgcaggaa

SEQ ID NO: 163781 - DNA, 20 bp, Artificial Sequence
  Synthetic oligonucleotide; GAG chr2 60503934 60503953 60503950 +
aagaaatgcaggaaaggaac

SEQ ID NO: 163782 - DNA, 20 bp, Artificial Sequence
  Synthetic oligonucleotide; AGG chr2 60503935 60503954 60503951 +
agaaatgcaggaaaggaacg

SEQ ID NO: 163783 - DNA, 20 bp, Artificial Sequence
  Synthetic oligonucleotide; GGG chr2 60503936 60503955 60503952 +
gaaatgcaggaaaggaacga

SEQ ID NO: 163784 - DNA, 20 bp, Artificial Sequence
  Synthetic oligonucleotide; GGG chr2 60503937 60503956 60503953 +
aaatgcaggaaaggaacgag

SEQ ID NO: 163785 - DNA, 20 bp, Artificial Sequence
  Synthetic oligonucleotide; GGG chr2 60503938 60503957 60503954 +
aatgcaggaaaggaacgagg

SEQ ID NO: 163786 - DNA, 20 bp, Artificial Sequence
  Synthetic oligonucleotide; CAG chr2 60503941 60503960 60503957 +
gcaggaaaggaacgaggggg

SEQ ID NO: 163787 - DNA, 20 bp, Artificial Sequence
  Synthetic oligonucleotide; GAG chr2 60503943 60503962 60503959 +
aggaaaggaacgagggggca

SEQ ID NO: 163788 - DNA, 20 bp, Artificial Sequence
  Synthetic oligonucleotide; GAG chr2 60503945 60503964 60503961 +
gaaaggaacgagggggcaga

SEQ ID NO: 163789 - DNA, 20 bp, Artificial Sequence
  Synthetic oligonucleotide; AGG chr2 60503946 60503965 60503962 +
aaaggaacgagggggcagag

SEQ ID NO: 163790 - DNA, 20 bp, Artificial Sequence
  Synthetic oligonucleotide; GGG chr2 60503947 60503966 60503963 +
aaggaacgagggggcagaga

SEQ ID NO: 163791 - DNA, 20 bp, Artificial Sequence
  Synthetic oligonucleotide; AAG chr2 60503955 60503974 60503971 +
agggggcagagagggaatga

SEQ ID NO: 163792 - DNA, 20 bp, Artificial Sequence
  Synthetic oligonucleotide; GAG chr2 60503963 60503982 60503979 +
gagagggaatgaaagacact

SEQ ID NO: 163793 - DNA, 20 bp, Artificial Sequence
  Synthetic oligonucleotide; AAG chr2 60503970 60503989 60503986 +
aatgaaagacactgagtatt

SEQ ID NO: 163794 - DNA, 20 bp, Artificial Sequence
  Synthetic oligonucleotide; AGG chr2 60503971 60503990 60503987 +
atgaaagacactgagtatta

SEQ ID NO: 163795 - DNA, 20 bp, Artificial Sequence
  Synthetic oligonucleotide; CAG chr2 60503981 60504000 60503997 +
ctgagtattaaggcccaacc

SEQ ID NO: 163796 - DNA, 20 bp, Artificial Sequence
  Synthetic oligonucleotide; TAG chr2 60504000 60504019 60504016 +
ccagccaaaaccccatctgc

SEQ ID NO: 163797 - DNA, 20 bp, Artificial Sequence
  Synthetic oligonucleotide; AAG chr2 60504003 60504022 60504019 +
gccaaaaccccatctgctag

SEQ ID NO: 163798 - DNA, 20 bp, Artificial Sequence
  Synthetic oligonucleotide; TGG chr2 60504011 60504030 60504027 +
cccatctgctagaagcctgc

SEQ ID NO: 163799 - DNA, 20 bp, Artificial Sequence
  Synthetic oligonucleotide; AAG chr2 60504014 60504033 60504030 +
atctgctagaagcctgctgg

SEQ ID NO: 163800 - DNA, 20 bp, Artificial Sequence
  Synthetic oligonucleotide; TGG chr2 60504023 60504042 60504039 +
aagcctgctggaagcctaca

SEQ ID NO: 163801 - DNA, 20 bp, Artificial Sequence
  Synthetic oligonucleotide; GAG chr2 60504030 60504049 60504046 +
ctggaagcctacatggcttc

SEQ ID NO: 163802 - DNA, 20 bp, Artificial Sequence
  Synthetic oligonucleotide; CGG chr2 60504033 60504052 60504049 +
gaagcctacatggcttcgag

SEQ ID NO: 163803 - DNA, 20 bp, Artificial Sequence
  Synthetic oligonucleotide; GAG chr2 60504044 60504063 60504060 +
ggcttcgagcggcacattct

SEQ ID NO: 163804 - DNA, 20 bp, Artificial Sequence
  Synthetic oligonucleotide; AAG chr2 60504054 60504073 60504070 +
ggcacattctgagaactctg

SEQ ID NO: 163805 - DNA, 20 bp, Artificial Sequence
  Synthetic oligonucleotide; GAG chr2 60504056 60504075 60504072 +
cacattctgagaactctgaa

SEQ ID NO: 163806 - DNA, 20 bp, Artificial Sequence
  Synthetic oligonucleotide; CAG chr2 60504066 60504085 60504082 +
gaactctgaagagtaccact

SEQ ID NO: 163807 - DNA, 20 bp, Artificial Sequence
  Synthetic oligonucleotide; TAG chr2 60504089 60504108 60504105 +
ccgacactgcccccatgaca

SEQ ID NO: 163808 - DNA, 20 bp, Artificial Sequence
  Synthetic oligonucleotide; AGG chr2 60504090 60504109 60504106 +
cgacactgcccccatgacat

SEQ ID NO: 163809 - DNA, 20 bp, Artificial Sequence
  Synthetic oligonucleotide; GGG chr2 60504091 60504110 60504107 +
gacactgcccccatgacata

SEQ ID NO: 163810 - DNA, 20 bp, Artificial Sequence
  Synthetic oligonucleotide; TGG chr2 60504097 60504116 60504113 +
gcccccatgacatagggccc

SEQ ID NO: 163811 - DNA, 20 bp, Artificial Sequence
  Synthetic oligonucleotide; TGG chr2 60504124 60504143 60504140 +
ctctttgactcacacttgcc

SEQ ID NO: 163812 - DNA, 20 bp, Artificial Sequence
  Synthetic oligonucleotide; CAG chr2 60504127 60504146 60504143 +
tttgactcacacttgcctgg

SEQ ID NO: 163813 - DNA, 20 bp, Artificial Sequence
  Synthetic oligonucleotide; AGG chr2 60504128 60504147 60504144 +
ttgactcacacttgcctggc

SEQ ID NO: 163814 - DNA, 20 bp, Artificial Sequence
  Synthetic oligonucleotide; CAG chr2 60504141 60504160 60504157 +
gcctggcaggactccccaaa

SEQ ID NO: 163815 - DNA, 20 bp, Artificial Sequence
  Synthetic oligonucleotide; CAG chr2 60504146 60504165 60504162 +
gcaggactccccaaacagaa

SEQ ID NO: 163816 - DNA, 20 bp, Artificial Sequence
  Synthetic oligonucleotide; GAG chr2 60504148 60504167 60504164 +
aggactccccaaacagaaca

SEQ ID NO: 163817 - DNA, 20 bp, Artificial Sequence
  Synthetic oligonucleotide; CAG chr2 60504156 60504175 60504172 +
ccaaacagaacagagatgct

SEQ ID NO: 163818 - DNA, 20 bp, Artificial Sequence
  Synthetic oligonucleotide; CGG chr2 60504160 60504179 60504176 +
acagaacagagatgctcagc

SEQ ID NO: 163819 - DNA, 20 bp, Artificial Sequence
  Synthetic oligonucleotide; GGG chr2 60504161 60504180 60504177 +
cagaacagagatgctcagcc

SEQ ID NO: 163820 - DNA, 20 bp, Artificial Sequence
  Synthetic oligonucleotide; AAG chr2 60504167 60504186 60504183 +
agagatgctcagccgggcac

SEQ ID NO: 163821 - DNA, 20 bp, Artificial Sequence
  Synthetic oligonucleotide; GAG chr2 60504169 60504188 60504185 +
agatgctcagccgggcacaa

SEQ ID NO: 163822 - DNA, 20 bp, Artificial Sequence
  Synthetic oligonucleotide; GAG chr2 60504171 60504190 60504187 +
atgctcagccgggcacaaga

SEQ ID NO: 163823 - DNA, 20 bp, Artificial Sequence
  Synthetic oligonucleotide; CAG chr2 60504174 60504193 60504190 +
ctcagccgggcacaagagag

SEQ ID NO: 163824 - DNA, 20 bp, Artificial Sequence
  Synthetic oligonucleotide; AGG chr2 60504175 60504194 60504191 +
tcagccgggcacaagagagc

SEQ ID NO: 163825 - DNA, 20 bp, Artificial Sequence
  Synthetic oligonucleotide; CAG chr2 60504181 60504200 60504197 +
gggcacaagagagcaggccc

SEQ ID NO: 163826 - DNA, 20 bp, Artificial Sequence
  Synthetic oligonucleotide; AGG chr2 60504182 60504201 60504198 +
ggcacaagagagcaggcccc

SEQ ID NO: 163827 - DNA, 20 bp, Artificial Sequence
  Synthetic oligonucleotide; GGG chr2 60504183 60504202 60504199 +
gcacaagagagcaggcccca

SEQ ID NO: 163828 - DNA, 20 bp, Artificial Sequence
  Synthetic oligonucleotide; TGG chr2 60504200 60504219 60504216 +
ccagggctcatgctgcactg

SEQ ID NO: 163829 - DNA, 20 bp, Artificial Sequence
  Synthetic oligonucleotide; CAG chr2 60504209 60504228 60504225 +
atgctgcactgtggtttccc

SEQ ID NO: 163830 - DNA, 20 bp, Artificial Sequence
  Synthetic oligonucleotide; CAG chr2 60504218 60504237 60504234 +
tgtggtttccccagcaattc

SEQ ID NO: 163831 - DNA, 20 bp, Artificial Sequence
  Synthetic oligonucleotide; CGG chr2 60504234 60504253 60504250 +
attccagaactgctgcctac

SEQ ID NO: 163832 - DNA, 20 bp, Artificial Sequence
  Synthetic oligonucleotide; CAG chr2 60504245 60504264 60504261 +
gctgcctaccggcacgcatg

SEQ ID NO: 163833 - DNA, 20 bp, Artificial Sequence
  Synthetic oligonucleotide; AGG chr2 60504246 60504265 60504262 +
ctgcctaccggcacgcatgc

SEQ ID NO: 163834 - DNA, 20 bp, Artificial Sequence
  Synthetic oligonucleotide; AAG chr2 60504259 60504278 60504275 +
cgcatgcaggatcaatgatg

SEQ ID NO: 163835 - DNA, 20 bp, Artificial Sequence
  Synthetic oligonucleotide; CAG chr2 60504265 60504284 60504281 +
caggatcaatgatgaagatg

SEQ ID NO: 163836 - DNA, 20 bp, Artificial Sequence
  Synthetic oligonucleotide; TGG chr2 60504275 60504294 60504291 +
gatgaagatgcagtaccttc

SEQ ID NO: 163837 - DNA, 20 bp, Artificial Sequence
  Synthetic oligonucleotide; GGG chr2 60504276 60504295 60504292 +
atgaagatgcagtaccttct

SEQ ID NO: 163838 - DNA, 20 bp, Artificial Sequence
  Synthetic oligonucleotide; TGG chr2 60504285 60504304 60504301 +
cagtaccttctgggtctgcc

SEQ ID NO: 163839 - DNA, 20 bp, Artificial Sequence
  Synthetic oligonucleotide; GGG chr2 60504286 60504305 60504302 +
agtaccttctgggtctgcct

SEQ ID NO: 163840 - DNA, 20 bp, Artificial Sequence
  Synthetic oligonucleotide; TAG chr2 60504305 60504324 60504321 +
tgggtccacccttcctttct

SEQ ID NO: 163841 - DNA, 20 bp, Artificial Sequence
  Synthetic oligonucleotide; AAG chr2 60504315 60504334 60504331 +
cttcctttcttagtcactgc

SEQ ID NO: 163842 - DNA, 20 bp, Artificial Sequence
  Synthetic oligonucleotide; CAG chr2 60504326 60504345 60504342 +
agtcactgcaagatttcacc

SEQ ID NO: 163843 - DNA, 20 bp, Artificial Sequence
  Synthetic oligonucleotide; CAG chr2 60504331 60504350 60504347 +
ctgcaagatttcacccagcc

SEQ ID NO: 163844 - DNA, 20 bp, Artificial Sequence
  Synthetic oligonucleotide; AAG chr2 60504346 60504365 60504362 +
cagcccagccacccactgaa

SEQ ID NO: 163845 - DNA, 20 bp, Artificial Sequence
  Synthetic oligonucleotide; AGG chr2 60504347 60504366 60504363 +
agcccagccacccactgaaa

SEQ ID NO: 163846 - DNA, 20 bp, Artificial Sequence
  Synthetic oligonucleotide; CAG chr2 60504350 60504369 60504366 +
ccagccacccactgaaaagg

SEQ ID NO: 163847 - DNA, 20 bp, Artificial Sequence
  Synthetic oligonucleotide; GAG chr2 60504352 60504371 60504368 +
agccacccactgaaaaggca

SEQ ID NO: 163848 - DNA, 20 bp, Artificial Sequence
  Synthetic oligonucleotide; AGG chr2 60504353 60504372 60504369 +
gccacccactgaaaaggcag

SEQ ID NO: 163849 - DNA, 20 bp, Artificial Sequence
  Synthetic oligonucleotide; GAG chr2 60504355 60504374 60504371 +
cacccactgaaaaggcagag

SEQ ID NO: 163850 - DNA, 20 bp, Artificial Sequence
  Synthetic oligonucleotide; AGG chr2 60504356 60504375 60504372 +
acccactgaaaaggcagagg

SEQ ID NO: 163851 - DNA, 20 bp, Artificial Sequence
  Synthetic oligonucleotide; TAG chr2 60504375 60504394 60504391 +
gaggccacctatctgaatgc

SEQ ID NO: 163852 - DNA, 20 bp, Artificial Sequence
  Synthetic oligonucleotide; AGG chr2 60504376 60504395 60504392 +
aggccacctatctgaatgct

SEQ ID NO: 163853 - DNA, 20 bp, Artificial Sequence
  Synthetic oligonucleotide; TGG chr2 60504404 60504423 60504420 +
acacacttgaaccttcctcc

SEQ ID NO: 163854 - DNA, 20 bp, Artificial Sequence
  Synthetic oligonucleotide; CAG chr2 60504408 60504427 60504424 +
acttgaaccttcctcctggc

SEQ ID NO: 163855 - DNA, 20 bp, Artificial Sequence
  Synthetic oligonucleotide; AAG chr2 60504423 60504442 60504439 +
ctggccagcctgctctccca

SEQ ID NO: 163856 - DNA, 20 bp, Artificial Sequence
  Synthetic oligonucleotide; AAG chr2 60504426 60504445 60504442 +
gccagcctgctctcccaaag

SEQ ID NO: 163857 - DNA, 20 bp, Artificial Sequence
  Synthetic oligonucleotide; AGG chr2 60504427 60504446 60504443 +
ccagcctgctctcccaaaga

SEQ ID NO: 163858 - DNA, 20 bp, Artificial Sequence
  Synthetic oligonucleotide; CAG chr2 60504435 60504454 60504451 +
ctctcccaaagaaggaataa

SEQ ID NO: 163859 - DNA, 20 bp, Artificial Sequence
  Synthetic oligonucleotide; AAG chr2 60504445 60504464 60504461 +
gaaggaataacagaacaaaa

SEQ ID NO: 163860 - DNA, 20 bp, Artificial Sequence
  Synthetic oligonucleotide; TGG chr2 60504466 60504485 60504482 +
agtcaacctctgactacttc

SEQ ID NO: 163861 - DNA, 20 bp, Artificial Sequence
  Synthetic oligonucleotide; AAG chr2 60504498 60504517 60504514 +
ttataccaatgttcttcttg

SEQ ID NO: 163862 - DNA, 20 bp, Artificial Sequence
  Synthetic oligonucleotide; TGG chr2 60504501 60504520 60504517 +
taccaatgttcttcttgaag

SEQ ID NO: 163863 - DNA, 20 bp, Artificial Sequence
  Synthetic oligonucleotide; GGG chr2 60504502 60504521 60504518 +
accaatgttcttcttgaagt

SEQ ID NO: 163864 - DNA, 20 bp, Artificial Sequence
  Synthetic oligonucleotide; GAG chr2 60504504 60504523 60504520 +
caatgttcttcttgaagtgg

SEQ ID NO: 163865 - DNA, 20 bp, Artificial Sequence
  Synthetic oligonucleotide; CAG chr2 60504509 60504528 60504525 +
ttcttcttgaagtgggagct

SEQ ID NO: 163866 - DNA, 20 bp, Artificial Sequence
  Synthetic oligonucleotide; CGG chr2 60504515 60504534 60504531 +
ttgaagtgggagctcagcat

SEQ ID NO: 163867 - DNA, 20 bp, Artificial Sequence
  Synthetic oligonucleotide; GGG chr2 60504516 60504535 60504532 +
tgaagtgggagctcagcatc

SEQ ID NO: 163868 - DNA, 20 bp, Artificial Sequence
  Synthetic oligonucleotide; CAG chr2 60504524 60504543 60504540 +
gagctcagcatcgggacacc

SEQ ID NO: 163869 - DNA, 20 bp, Artificial Sequence
  Synthetic oligonucleotide; AAG chr2 60504541 60504560 60504557 +
acccagaaaaaataatctcc

SEQ ID NO: 163870 - DNA, 20 bp, Artificial Sequence
  Synthetic oligonucleotide; AGG chr2 60504542 60504561 60504558 +
cccagaaaaaataatctcca

SEQ ID NO: 163871 - DNA, 20 bp, Artificial Sequence
  Synthetic oligonucleotide; AAG chr2 60504549 60504568 60504565 +
aaaataatctccaaggcaaa

SEQ ID NO: 163872 - DNA, 20 bp, Artificial Sequence
  Synthetic oligonucleotide; TAG chr2 60504556 60504575 60504572 +
tctccaaggcaaaaagcaaa

SEQ ID NO: 163873 - DNA, 20 bp, Artificial Sequence
  Synthetic oligonucleotide; CAG chr2 60504559 60504578 60504575 +
ccaaggcaaaaagcaaatag

SEQ ID NO: 163874 - DNA, 20 bp, Artificial Sequence
  Synthetic oligonucleotide; GAG chr2 60504565 60504584 60504581 +
caaaaagcaaatagcagaat

SEQ ID NO: 163875 - DNA, 20 bp, Artificial Sequence
  Synthetic oligonucleotide; CAG chr2 60504578 60504597 60504594 +
gcagaatgagtctgctgaaa

SEQ ID NO: 163876 - DNA, 20 bp, Artificial Sequence
  Synthetic oligonucleotide; AAG chr2 60504604 60504623 60504620 +
actctgtctctgtctccccc

SEQ ID NO: 163877 - DNA, 20 bp, Artificial Sequence
  Synthetic oligonucleotide; TAG chr2 60504613 60504632 60504629 +
ctgtctcccccaagccctcc

SEQ ID NO: 163878 - DNA, 20 bp, Artificial Sequence
  Synthetic oligonucleotide; CAG chr2 60504617 60504636 60504633 +
ctcccccaagccctcctagt

SEQ ID NO: 163879 - DNA, 20 bp, Artificial Sequence
  Synthetic oligonucleotide; CAG chr2 60504630 60504649 60504646 +
tcctagtcagaacgttctct

SEQ ID NO: 163880 - DNA, 20 bp, Artificial Sequence
  Synthetic oligonucleotide; CAG chr2 60504638 60504657 60504654 +
agaacgttctctcagcattt

SEQ ID NO: 163881 - DNA, 20 bp, Artificial Sequence
  Synthetic oligonucleotide; CAG chr2 60504641 60504660 60504657 +
acgttctctcagcatttcag

SEQ ID NO: 163882 - DNA, 20 bp, Artificial Sequence
  Synthetic oligonucleotide; AGG chr2 60504642 60504661 60504658 +
cgttctctcagcatttcagc

SEQ ID NO: 163883 - DNA, 20 bp, Artificial Sequence
  Synthetic oligonucleotide; TGG chr2 60504656 60504675 60504672 +
ttcagcaggtactgctcacc

SEQ ID NO: 163884 - DNA, 20 bp, Artificial Sequence
  Synthetic oligonucleotide; CAG chr2 60504664 60504683 60504680 +
gtactgctcacctggaaata

SEQ ID NO: 163885 - DNA, 20 bp, Artificial Sequence
  Synthetic oligonucleotide; GAG chr2 60504681 60504700 60504697 +
atacagctgatgtatttact

SEQ ID NO: 163886 - DNA, 20 bp, Artificial Sequence
  Synthetic oligonucleotide; AAG chr2 60504684 60504703 60504700 +
cagctgatgtatttactgag

SEQ ID NO: 163887 - DNA, 20 bp, Artificial Sequence
  Synthetic oligonucleotide; AAG chr2 60504694 60504713 60504710 +
atttactgagaagcttcttc

SEQ ID NO: 163888 - DNA, 20 bp, Artificial Sequence
  Synthetic oligonucleotide; TGG chr2 60504705 60504724 60504721 +
agcttcttcaagctttctac

SEQ ID NO: 163889 - DNA, 20 bp, Artificial Sequence
  Synthetic oligonucleotide; TAG chr2 60504712 60504731 60504728 +
tcaagctttctactggtgct

SEQ ID NO: 163890 - DNA, 20 bp, Artificial Sequence
  Synthetic oligonucleotide; AGG chr2 60504713 60504732 60504729 +
caagctttctactggtgctt

SEQ ID NO: 163891 - DNA, 20 bp, Artificial Sequence
  Synthetic oligonucleotide; GGG chr2 60504714 60504733 60504730 +
aagctttctactggtgctta

SEQ ID NO: 163892 - DNA, 20 bp, Artificial Sequence
  Synthetic oligonucleotide; AAG chr2 60504729 60504748 60504745 +
gcttagggacaatgccaatc

SEQ ID NO: 163893 - DNA, 20 bp, Artificial Sequence
  Synthetic oligonucleotide; TAG chr2 60504745 60504764 60504761 +
aatcaagtcttgaaattata

SEQ ID NO: 163894 - DNA, 20 bp, Artificial Sequence
  Synthetic oligonucleotide; GAG chr2 60504747 60504766 60504763 +
tcaagtcttgaaattatata

SEQ ID NO: 163895 - DNA, 20 bp, Artificial Sequence
  Synthetic oligonucleotide; GAG chr2 60504749 60504768 60504765 +
aagtcttgaaattatataga

SEQ ID NO: 163896 - DNA, 20 bp, Artificial Sequence
  Synthetic oligonucleotide; AGG chr2 60504750 60504769 60504766 +
agtcttgaaattatatagag

SEQ ID NO: 163897 - DNA, 20 bp, Artificial Sequence
  Synthetic oligonucleotide; TGG chr2 60504753 60504772 60504769 +
cttgaaattatatagagagg

SEQ ID NO: 163898 - DNA, 20 bp, Artificial Sequence
  Synthetic oligonucleotide; CAG chr2 60504761 60504780 60504777 +
tatatagagaggtggaatat

SEQ ID NO: 163899 - DNA, 20 bp, Artificial Sequence
  Synthetic oligonucleotide; AGG chr2 60504762 60504781 60504778 +
atatagagaggtggaatatc

SEQ ID NO: 163900 - DNA, 20 bp, Artificial Sequence
  Synthetic oligonucleotide; AAG chr2 60504792 60504811 60504808 +
ctgtccctgaaaatgcttaa

SEQ ID NO: 163901 - DNA, 20 bp, Artificial Sequence
  Synthetic oligonucleotide; CAG chr2 60504828 60504847 60504844 +
ctatcacatgcctcccctac

SEQ ID NO: 163902 - DNA, 20 bp, Artificial Sequence
  Synthetic oligonucleotide; GAG chr2 60504832 60504851 60504848 +
cacatgcctcccctaccagt

SEQ ID NO: 163903 - DNA, 20 bp, Artificial Sequence
  Synthetic oligonucleotide; TAG chr2 60504845 60504864 60504861 +
taccagtgagcgcccaccac

SEQ ID NO: 163904 - DNA, 20 bp, Artificial Sequence
  Synthetic oligonucleotide; CAG chr2 60504872 60504891 60504888 +
cttgctccaaactattaaaa

SEQ ID NO: 163905 - DNA, 20 bp, Artificial Sequence
  Synthetic oligonucleotide; GAG chr2 60504874 60504893 60504890 +
tgctccaaactattaaaaca

SEQ ID NO: 163906 - DNA, 20 bp, Artificial Sequence
  Synthetic oligonucleotide; CAG chr2 60504893 60504912 60504909 +
agagcgtccccccaaaaaaa

SEQ ID NO: 163907 - DNA, 20 bp, Artificial Sequence
  Synthetic oligonucleotide; AAG chr2 60504904 60504923 60504920 +
ccaaaaaaacagccttctgc

SEQ ID NO: 163908 - DNA, 20 bp, Artificial Sequence
  Synthetic oligonucleotide; CAG chr2 60504930 60504949 60504946 +
caacttccctaccctgtgtg

SEQ ID NO: 163909 - DNA, 20 bp, Artificial Sequence
  Synthetic oligonucleotide; AGG chr2 60504931 60504950 60504947 +
aacttccctaccctgtgtgc

SEQ ID NO: 163910 - DNA, 20 bp, Artificial Sequence
  Synthetic oligonucleotide; TGG chr2 60504937 60504956 60504953 +
cctaccctgtgtgcaggctg

SEQ ID NO: 163911 - DNA, 20 bp, Artificial Sequence
  Synthetic oligonucleotide; AAG chr2 60504940 60504959 60504956 +
accctgtgtgcaggctgtgg

SEQ ID NO: 163912 - DNA, 20 bp, Artificial Sequence
  Synthetic oligonucleotide; TGG chr2 60504945 60504964 60504961 +
gtgtgcaggctgtggaagcg

SEQ ID NO: 163913 - DNA, 20 bp, Artificial Sequence
  Synthetic oligonucleotide; GGG chr2 60504946 60504965 60504962 +
tgtgcaggctgtggaagcgt

SEQ ID NO: 163914 - DNA, 20 bp, Artificial Sequence
  Synthetic oligonucleotide; GGG chr2 60504947 60504966 60504963 +
gtgcaggctgtggaagcgtg

SEQ ID NO: 163915 - DNA, 20 bp, Artificial Sequence
  Synthetic oligonucleotide; TGG chr2 60504950 60504969 60504966 +
caggctgtggaagcgtgggg

SEQ ID NO: 163916 - DNA, 20 bp, Artificial Sequence
  Synthetic oligonucleotide; CAG chr2 60504956 60504975 60504972 +
gtggaagcgtggggtggacc

SEQ ID NO: 163917 - DNA, 20 bp, Artificial Sequence
  Synthetic oligonucleotide; AAG chr2 60504959 60504978 60504975 +
gaagcgtggggtggacccag

SEQ ID NO: 163918 - DNA, 20 bp, Artificial Sequence
  Synthetic oligonucleotide; AAG chr2 60504965 60504984 60504981 +
tggggtggacccagaagtat

SEQ ID NO: 163919 - DNA, 20 bp, Artificial Sequence
  Synthetic oligonucleotide; AGG chr2 60504966 60504985 60504982 +
ggggtggacccagaagtata

SEQ ID NO: 163920 - DNA, 20 bp, Artificial Sequence
  Synthetic oligonucleotide; GAG chr2 60504968 60504987 60504984 +
ggtggacccagaagtataag

SEQ ID NO: 163921 - DNA, 20 bp, Artificial Sequence
  Synthetic oligonucleotide; TGG chr2 60504974 60504993 60504990 +
cccagaagtataaggagttc

SEQ ID NO: 163922 - DNA, 20 bp, Artificial Sequence
  Synthetic oligonucleotide; CAG chr2 60504979 60504998 60504995 +
aagtataaggagttctggat

SEQ ID NO: 163923 - DNA, 20 bp, Artificial Sequence
  Synthetic oligonucleotide; TAG chr2 60504988 60505007 60505004 +
gagttctggatcagaatccc

SEQ ID NO: 163924 - DNA, 20 bp, Artificial Sequence
  Synthetic oligonucleotide; CGG chr2 60505001 60505020 60505017 +
gaatccctagtctacccctg

SEQ ID NO: 163925 - DNA, 20 bp, Artificial Sequence
  Synthetic oligonucleotide; GAG chr2 60505010 60505029 60505026 +
gtctacccctgcggctgcat

SEQ ID NO: 163926 - DNA, 20 bp, Artificial Sequence
  Synthetic oligonucleotide; CAG chr2 60505015 60505034 60505031 +
cccctgcggctgcatgagac

SEQ ID NO: 163927 - DNA, 20 bp, Artificial Sequence
  Synthetic oligonucleotide; AAG chr2 60505038 60505057 60505054 +
acctgccatttaacctctct

SEQ ID NO: 163928 - DNA, 20 bp, Artificial Sequence
  Synthetic oligonucleotide; CAG chr2 60505070 60505089 60505086 +
ccctttctcctgcctcttca

SEQ ID NO: 163929 - DNA, 20 bp, Artificial Sequence
  Synthetic oligonucleotide; AGG chr2 60505071 60505090 60505087 +
cctttctcctgcctcttcac

SEQ ID NO: 163930 - DNA, 20 bp, Artificial Sequence
  Synthetic oligonucleotide; GGG chr2 60505072 60505091 60505088 +
ctttctcctgcctcttcaca

SEQ ID NO: 163931 - DNA, 20 bp, Artificial Sequence
  Synthetic oligonucleotide; GAG chr2 60505083 60505102 60505099 +
ctcttcacagggttactcat

SEQ ID NO: 163932 - DNA, 20 bp, Artificial Sequence
  Synthetic oligonucleotide; AGG chr2 60505084 60505103 60505100 +
tcttcacagggttactcatg

SEQ ID NO: 163933 - DNA, 20 bp, Artificial Sequence
  Synthetic oligonucleotide; GAG chr2 60505088 60505107 60505104 +
cacagggttactcatgaggt

SEQ ID NO: 163934 - DNA, 20 bp, Artificial Sequence
  Synthetic oligonucleotide; AAG chr2 60505114 60505133 60505130 +
caatttgacaatactcctca

SEQ ID NO: 163935 - DNA, 20 bp, Artificial Sequence
  Synthetic oligonucleotide; AGG chr2 60505115 60505134 60505131 +
aatttgacaatactcctcaa

SEQ ID NO: 163936 - DNA, 20 bp, Artificial Sequence
  Synthetic oligonucleotide; GGG chr2 60505116 60505135 60505132 +
atttgacaatactcctcaaa

SEQ ID NO: 163937 - DNA, 20 bp, Artificial Sequence
  Synthetic oligonucleotide; CAG chr2 60505165 60505184 60505181 +
atccgtatcctcattactaa

SEQ ID NO: 163938 - DNA, 20 bp, Artificial Sequence
  Synthetic oligonucleotide; TGG chr2 60505173 60505192 60505189 +
cctcattactaacagcacaa

SEQ ID NO: 163939 - DNA, 20 bp, Artificial Sequence
  Synthetic oligonucleotide; AAG chr2 60505184 60505203 60505200 +
acagcacaatggacattcga

SEQ ID NO: 163940 - DNA, 20 bp, Artificial Sequence
  Synthetic oligonucleotide; AGG chr2 60505185 60505204 60505201 +
cagcacaatggacattcgaa

SEQ ID NO: 163941 - DNA, 20 bp, Artificial Sequence
  Synthetic oligonucleotide; GGG chr2 60505186 60505205 60505202 +
agcacaatggacattcgaaa

SEQ ID NO: 163942 - DNA, 20 bp, Artificial Sequence
  Synthetic oligonucleotide; TGG chr2 60505190 60505209 60505206 +
caatggacattcgaaaggga

SEQ ID NO: 163943 - DNA, 20 bp, Artificial Sequence
  Synthetic oligonucleotide; GGG chr2 60505191 60505210 60505207 +
aatggacattcgaaagggat

SEQ ID NO: 163944 - DNA, 20 bp, Artificial Sequence
  Synthetic oligonucleotide; AAG chr2 60505207 60505226 60505223 +
ggatgggcccaatttttcat

SEQ ID NO: 163945 - DNA, 20 bp, Artificial Sequence
  Synthetic oligonucleotide; AAG chr2 60505216 60505235 60505232 +
caatttttcataagccaaaa

SEQ ID NO: 163946 - DNA, 20 bp, Artificial Sequence
  Synthetic oligonucleotide; TAG chr2 60505220 60505239 60505236 +
ttttcataagccaaaaaagc

SEQ ID NO: 163947 - DNA, 20 bp, Artificial Sequence
  Synthetic oligonucleotide; GAG chr2 60505222 60505241 60505238 +
ttcataagccaaaaaagcta

SEQ ID NO: 163948 - DNA, 20 bp, Artificial Sequence
  Synthetic oligonucleotide; AGG chr2 60505223 60505242 60505239 +
tcataagccaaaaaagctag

SEQ ID NO: 163949 - DNA, 20 bp, Artificial Sequence
  Synthetic oligonucleotide; CGG chr2 60505228 60505247 60505244 +
agccaaaaaagctagaggat

SEQ ID NO: 163950 - DNA, 20 bp, Artificial Sequence
  Synthetic oligonucleotide; GAG chr2 60505230 60505249 60505246 +
ccaaaaaagctagaggatcg

SEQ ID NO: 163951 - DNA, 20 bp, Artificial Sequence
  Synthetic oligonucleotide; GAG chr2 60505232 60505251 60505248 +
aaaaaagctagaggatcgga

SEQ ID NO: 163952 - DNA, 20 bp, Artificial Sequence
  Synthetic oligonucleotide; AAG chr2 60505237 60505256 60505253 +
agctagaggatcggagagaa

SEQ ID NO: 163953 - DNA, 20 bp, Artificial Sequence
  Synthetic oligonucleotide; AAG chr2 60505240 60505259 60505256 +
tagaggatcggagagaaaag

SEQ ID NO: 163954 - DNA, 20 bp, Artificial Sequence
  Synthetic oligonucleotide; AGG chr2 60505241 60505260 60505257 +
agaggatcggagagaaaaga

SEQ ID NO: 163955 - DNA, 20 bp, Artificial Sequence
  Synthetic oligonucleotide; GGG chr2 60505242 60505261 60505258 +
gaggatcggagagaaaagaa

SEQ ID NO: 163956 - DNA, 20 bp, Artificial Sequence
  Synthetic oligonucleotide; CGG chr2 60505246 60505265 60505262 +
atcggagagaaaagaaggga

SEQ ID NO: 163957 - DNA, 20 bp, Artificial Sequence
  Synthetic oligonucleotide; CAG chr2 60505254 60505273 60505270 +
gaaaagaagggacggatact

SEQ ID NO: 163958 - DNA, 20 bp, Artificial Sequence
  Synthetic oligonucleotide; CGG chr2 60505260 60505279 60505276 +
aagggacggatactcagaaa

SEQ ID NO: 163959 - DNA, 20 bp, Artificial Sequence
  Synthetic oligonucleotide; AAG chr2 60505267 60505286 60505283 +
ggatactcagaaacggcttc

SEQ ID NO: 163960 - DNA, 20 bp, Artificial Sequence
  Synthetic oligonucleotide; AGG chr2 60505268 60505287 60505284 +
gatactcagaaacggcttca

SEQ ID NO: 163961 - DNA, 20 bp, Artificial Sequence
  Synthetic oligonucleotide; GGG chr2 60505269 60505288 60505285 +
atactcagaaacggcttcaa

SEQ ID NO: 163962 - DNA, 20 bp, Artificial Sequence
  Synthetic oligonucleotide; TGG chr2 60505279 60505298 60505295 +
acggcttcaagggtgtcctt

SEQ ID NO: 163963 - DNA, 20 bp, Artificial Sequence
  Synthetic oligonucleotide; CAG chr2 60505295 60505314 60505311 +
cctttggcaccccattcttc

SEQ ID NO: 163964 - DNA, 20 bp, Artificial Sequence
  Synthetic oligonucleotide; CAG chr2 60505318 60505337 60505334 +
attgttccaaatgcctgctg

SEQ ID NO: 163965 - DNA, 20 bp, Artificial Sequence
  Synthetic oligonucleotide; CAG chr2 60505327 60505346 60505343 +
aatgcctgctgcagtaataa

SEQ ID NO: 163966 - DNA, 20 bp, Artificial Sequence
  Synthetic oligonucleotide; AAG chr2 60505336 60505355 60505352 +
tgcagtaataacagccccaa

SEQ ID NO: 163967 - DNA, 20 bp, Artificial Sequence
  Synthetic oligonucleotide; CAG chr2 60505354 60505373 60505370 +
aaaagaacacaccactttgt

SEQ ID NO: 163968 - DNA, 20 bp, Artificial Sequence
  Synthetic oligonucleotide; AGG chr2 60505355 60505374 60505371 +
aaagaacacaccactttgtc

SEQ ID NO: 163969 - DNA, 20 bp, Artificial Sequence
  Synthetic oligonucleotide; TAG chr2 60505363 60505382 60505379 +
caccactttgtcaggacttg

SEQ ID NO: 163970 - DNA, 20 bp, Artificial Sequence
  Synthetic oligonucleotide; AGG chr2 60505364 60505383 60505380 +
accactttgtcaggacttgt

SEQ ID NO: 163971 - DNA, 20 bp, Artificial Sequence
  Synthetic oligonucleotide; TGG chr2 60505377 60505396 60505393 +
gacttgtaggtgaaatgtgt

SEQ ID NO: 163972 - DNA, 20 bp, Artificial Sequence
  Synthetic oligonucleotide; GAG chr2 60505379 60505398 60505395 +
cttgtaggtgaaatgtgttg

SEQ ID NO: 163973 - DNA, 20 bp, Artificial Sequence
  Synthetic oligonucleotide; CAG chr2 60505382 60505401 60505398 +
gtaggtgaaatgtgttggag

SEQ ID NO: 163974 - DNA, 20 bp, Artificial Sequence
  Synthetic oligonucleotide; CAG chr2 60505389 60505408 60505405 +
aaatgtgttggagcagctgt

SEQ ID NO: 163975 - DNA, 20 bp, Artificial Sequence
  Synthetic oligonucleotide; TGG chr2 60505394 60505413 60505410 +
tgttggagcagctgtcagct

SEQ ID NO: 163976 - DNA, 20 bp, Artificial Sequence
  Synthetic oligonucleotide; GGG chr2 60505395 60505414 60505411 +
gttggagcagctgtcagctt

SEQ ID NO: 163977 - DNA, 20 bp, Artificial Sequence
  Synthetic oligonucleotide; GGG chr2 60505396 60505415 60505412 +
ttggagcagctgtcagcttg

SEQ ID NO: 163978 - DNA, 20 bp, Artificial Sequence
  Synthetic oligonucleotide; CAG chr2 60505411 60505430 60505427 +
gcttggggaaaatcactcat

SEQ ID NO: 163979 - DNA, 20 bp, Artificial Sequence
  Synthetic oligonucleotide; AGG chr2 60505412 60505431 60505428 +
cttggggaaaatcactcatc

SEQ ID NO: 163980 - DNA, 20 bp, Artificial Sequence
  Synthetic oligonucleotide; TAG chr2 60505415 60505434 60505431 +
ggggaaaatcactcatcagg

SEQ ID NO: 163981 - DNA, 20 bp, Artificial Sequence
  Synthetic oligonucleotide; CAG chr2 60505419 60505438 60505435 +
aaaatcactcatcaggtagt

SEQ ID NO: 163982 - DNA, 20 bp, Artificial Sequence
  Synthetic oligonucleotide; GAG chr2 60505424 60505443 60505440 +
cactcatcaggtagtcagcc

SEQ ID NO: 163983 - DNA, 20 bp, Artificial Sequence
  Synthetic oligonucleotide; GAG chr2 60505428 60505447 60505444 +
catcaggtagtcagccgagt

SEQ ID NO: 163984 - DNA, 20 bp, Artificial Sequence
  Synthetic oligonucleotide; AGG chr2 60505429 60505448 60505445 +
atcaggtagtcagccgagtg

SEQ ID NO: 163985 - DNA, 20 bp, Artificial Sequence
  Synthetic oligonucleotide; CAG chr2 60505439 60505458 60505455 +
cagccgagtgaggctgcctt

SEQ ID NO: 163986 - DNA, 20 bp, Artificial Sequence
  Synthetic oligonucleotide; TGG chr2 60505443 60505462 60505459 +
cgagtgaggctgccttcagc

SEQ ID NO: 163987 - DNA, 20 bp, Artificial Sequence
  Synthetic oligonucleotide; CAG chr2 60505464 60505483 60505480 +
ggacaaacactgcatccaca

SEQ ID NO: 163988 - DNA, 20 bp, Artificial Sequence
  Synthetic oligonucleotide; AGG chr2 60505465 60505484 60505481 +
gacaaacactgcatccacac

SEQ ID NO: 163989 - DNA, 20 bp, Artificial Sequence
  Synthetic oligonucleotide; GGG chr2 60505466 60505485 60505482 +
acaaacactgcatccacaca

SEQ ID NO: 163990 - DNA, 20 bp, Artificial Sequence
  Synthetic oligonucleotide; AAG chr2 60505472 60505491 60505488 +
actgcatccacacagggaac

SEQ ID NO: 163991 - DNA, 20 bp, Artificial Sequence
  Synthetic oligonucleotide; CGG chr2 60505475 60505494 60505491 +
gcatccacacagggaacaag

SEQ ID NO: 163992 - DNA, 20 bp, Artificial Sequence
  Synthetic oligonucleotide; GGG chr2 60505476 60505495 60505492 +
catccacacagggaacaagc

SEQ ID NO: 163993 - DNA, 20 bp, Artificial Sequence
  Synthetic oligonucleotide; TAG chr2 60505498 60505517 60505514 +
gtgctttcctgtccttccct

SEQ ID NO: 163994 - DNA, 20 bp, Artificial Sequence
  Synthetic oligonucleotide; AGG chr2 60505499 60505518 60505515 +
tgctttcctgtccttccctt

SEQ ID NO: 163995 - DNA, 20 bp, Artificial Sequence
  Synthetic oligonucleotide; GGG chr2 60505500 60505519 60505516 +
gctttcctgtccttccctta

SEQ ID NO: 163996 - DNA, 20 bp, Artificial Sequence
  Synthetic oligonucleotide; GGG chr2 60505501 60505520 60505517 +
ctttcctgtccttcccttag

SEQ ID NO: 163997 - DNA, 20 bp, Artificial Sequence
  Synthetic oligonucleotide; CAG chr2 60505510 60505529 60505526 +
ccttcccttaggggccaaac

SEQ ID NO: 163998 - DNA, 20 bp, Artificial Sequence
  Synthetic oligonucleotide; CAG chr2 60505538 60505557 60505554 +
ttttaccttcttgtccaacc

SEQ ID NO: 163999 - DNA, 20 bp, Artificial Sequence
  Synthetic oligonucleotide; TGG chr2 60505541 60505560 60505557 +
taccttcttgtccaacccag

SEQ ID NO: 164000 - DNA, 20 bp, Artificial Sequence
  Synthetic oligonucleotide; GGG chr2 60505542 60505561 60505558 +
accttcttgtccaacccagt

SEQ ID NO: 164001 - DNA, 20 bp, Artificial Sequence
  Synthetic oligonucleotide; CAG chr2 60505583 60505602 60505599 +
atacctccttctctttcctc

SEQ ID NO: 164002 - DNA, 20 bp, Artificial Sequence
  Synthetic oligonucleotide; AAG chr2 60505592 60505611 60505608 +
tctctttcctccagctccct

SEQ ID NO: 164003 - DNA, 20 bp, Artificial Sequence
  Synthetic oligonucleotide; CAG chr2 60505603 60505622 60505619 +
cagctccctaagctgttgtt

SEQ ID NO: 164004 - DNA, 20 bp, Artificial Sequence
  Synthetic oligonucleotide; AGG chr2 60505604 60505623 60505620 +
agctccctaagctgttgttc

SEQ ID NO: 164005 - DNA, 20 bp, Artificial Sequence
  Synthetic oligonucleotide; GGG chr2 60505605 60505624 60505621 +
gctccctaagctgttgttca

SEQ ID NO: 164006 - DNA, 20 bp, Artificial Sequence
  Synthetic oligonucleotide; CAG chr2 60505610 60505629 60505626 +
ctaagctgttgttcagggca

SEQ ID NO: 164007 - DNA, 20 bp, Artificial Sequence
  Synthetic oligonucleotide; CAG chr2 60505614 60505633 60505630 +
gctgttgttcagggcacaga

SEQ ID NO: 164008 - DNA, 20 bp, Artificial Sequence
  Synthetic oligonucleotide; CAG chr2 60505622 60505641 60505638 +
tcagggcacagacagctctt

SEQ ID NO: 164009 - DNA, 20 bp, Artificial Sequence
  Synthetic oligonucleotide; AGG chr2 60505623 60505642 60505639 +
cagggcacagacagctcttc

SEQ ID NO: 164010 - DNA, 20 bp, Artificial Sequence
  Synthetic oligonucleotide; CAG chr2 60505630 60505649 60505646 +
cagacagctcttcaggctgc

SEQ ID NO: 164011 - DNA, 20 bp, Artificial Sequence
  Synthetic oligonucleotide; GAG chr2 60505632 60505651 60505648 +
gacagctcttcaggctgcca

SEQ ID NO: 164012 - DNA, 20 bp, Artificial Sequence
  Synthetic oligonucleotide; AAG chr2 60505636 60505655 60505652 +
gctcttcaggctgccagagc

SEQ ID NO: 164013 - DNA, 20 bp, Artificial Sequence
  Synthetic oligonucleotide; GAG chr2 60505638 60505657 60505654 +
tcttcaggctgccagagcaa

SEQ ID NO: 164014 - DNA, 20 bp, Artificial Sequence
  Synthetic oligonucleotide; GAG chr2 60505640 60505659 60505656 +
ttcaggctgccagagcaaga

SEQ ID NO: 164015 - DNA, 20 bp, Artificial Sequence
  Synthetic oligonucleotide; TAG chr2 60505644 60505663 60505660 +
ggctgccagagcaagagagt

SEQ ID NO: 164016 - DNA, 20 bp, Artificial Sequence
  Synthetic oligonucleotide; AGG chr2 60505645 60505664 60505661 +
gctgccagagcaagagagtt

SEQ ID NO: 164017 - DNA, 20 bp, Artificial Sequence
  Synthetic oligonucleotide; CGG chr2 60505682 60505701 60505698 +
ccacatgcattcccacctcc

SEQ ID NO: 164018 - DNA, 20 bp, Artificial Sequence
  Synthetic oligonucleotide; AAG chr2 60505685 60505704 60505701 +
catgcattcccacctcccgg

SEQ ID NO: 164019 - DNA, 20 bp, Artificial Sequence
  Synthetic oligonucleotide; CAG chr2 60505688 60505707 60505704 +
gcattcccacctcccggaag

SEQ ID NO: 164020 - DNA, 20 bp, Artificial Sequence
  Synthetic oligonucleotide; AGG chr2 60505689 60505708 60505705 +
cattcccacctcccggaagc

SEQ ID NO: 164021 - DNA, 20 bp, Artificial Sequence
  Synthetic oligonucleotide; GGG chr2 60505690 60505709 60505706 +
attcccacctcccggaagca

SEQ ID NO: 164022 - DNA, 20 bp, Artificial Sequence
  Synthetic oligonucleotide; GGG chr2 60505691 60505710 60505707 +
ttcccacctcccggaagcag

SEQ ID NO: 164023 - DNA, 20 bp, Artificial Sequence
  Synthetic oligonucleotide; CAG chr2 60505697 60505716 60505713 +
cctcccggaagcaggggaca

SEQ ID NO: 164024 - DNA, 20 bp, Artificial Sequence
  Synthetic oligonucleotide; TGG chr2 60505701 60505720 60505717 +
ccggaagcaggggacacagc

SEQ ID NO: 164025 - DNA, 20 bp, Artificial Sequence
  Synthetic oligonucleotide; CGG chr2 60505715 60505734 60505731 +
cacagctggccactctgtga

SEQ ID NO: 164026 - DNA, 20 bp, Artificial Sequence
  Synthetic oligonucleotide; GAG chr2 60505717 60505736 60505733 +
cagctggccactctgtgacg

SEQ ID NO: 164027 - DNA, 20 bp, Artificial Sequence
  Synthetic oligonucleotide; AGG chr2 60505718 60505737 60505734 +
agctggccactctgtgacgg

SEQ ID NO: 164028 - DNA, 20 bp, Artificial Sequence
  Synthetic oligonucleotide; GGG chr2 60505719 60505738 60505735 +
gctggccactctgtgacgga

SEQ ID NO: 164029 - DNA, 20 bp, Artificial Sequence
  Synthetic oligonucleotide; TGG chr2 60505722 60505741 60505738 +
ggccactctgtgacggaggg

SEQ ID NO: 164030 - DNA, 20 bp, Artificial Sequence
  Synthetic oligonucleotide; GGG chr2 60505723 60505742 60505739 +
gccactctgtgacggagggt

SEQ ID NO: 164031 - DNA, 20 bp, Artificial Sequence
  Synthetic oligonucleotide; TGG chr2 60505739 60505758 60505755 +
gggtgggtaacctctctacc

SEQ ID NO: 164032 - DNA, 20 bp, Artificial Sequence
  Synthetic oligonucleotide; GGG chr2 60505740 60505759 60505756 +
ggtgggtaacctctctacct

SEQ ID NO: 164033 - DNA, 20 bp, Artificial Sequence
  Synthetic oligonucleotide; TAG chr2 60505753 60505772 60505769 +
tctacctgggtctatcattt

SEQ ID NO: 164034 - DNA, 20 bp, Artificial Sequence
  Synthetic oligonucleotide; TGG chr2 60505769 60505788 60505785 +
attttagaataaatcattcg

SEQ ID NO: 164035 - DNA, 20 bp, Artificial Sequence
  Synthetic oligonucleotide; TGG chr2 60505784 60505803 60505800 +
attcgtggctgactcttaaa

SEQ ID NO: 164036 - DNA, 20 bp, Artificial Sequence
  Synthetic oligonucleotide; GGG chr2 60505785 60505804 60505801 +
ttcgtggctgactcttaaat

SEQ ID NO: 164037 - DNA, 20 bp, Artificial Sequence
  Synthetic oligonucleotide; AAG chr2 60505788 60505807 60505804 +
gtggctgactcttaaatggg

SEQ ID NO: 164038 - DNA, 20 bp, Artificial Sequence
  Synthetic oligonucleotide; AGG chr2 60505789 60505808 60505805 +
tggctgactcttaaatggga

SEQ ID NO: 164039 - DNA, 20 bp, Artificial Sequence
  Synthetic oligonucleotide; GGG chr2 60505790 60505809 60505806 +
ggctgactcttaaatgggaa

SEQ ID NO: 164040 - DNA, 20 bp, Artificial Sequence
  Synthetic oligonucleotide; CAG chr2 60505800 60505819 60505816 +
taaatgggaagggccaatta

SEQ ID NO: 164041 - DNA, 20 bp, Artificial Sequence
  Synthetic oligonucleotide; GAG chr2 60505811 60505830 60505827 +
ggccaattacagatatctct

SEQ ID NO: 164042 - DNA, 20 bp, Artificial Sequence
  Synthetic oligonucleotide; GAG chr2 60505827 60505846 60505843 +
ctctgagaacaactctacct

SEQ ID NO: 164043 - DNA, 20 bp, Artificial Sequence
  Synthetic oligonucleotide; AGG chr2 60505828 60505847 60505844 +
tctgagaacaactctacctg

SEQ ID NO: 164044 - DNA, 20 bp, Artificial Sequence
  Synthetic oligonucleotide; GGG chr2 60505829 60505848 60505845 +
ctgagaacaactctacctga

SEQ ID NO: 164045 - DNA, 20 bp, Artificial Sequence
  Synthetic oligonucleotide; GAG chr2 60505831 60505850 60505847 +
gagaacaactctacctgagg

SEQ ID NO: 164046 - DNA, 20 bp, Artificial Sequence
  Synthetic oligonucleotide; AGG chr2 60505832 60505851 60505848 +
agaacaactctacctgaggg

SEQ ID NO: 164047 - DNA, 20 bp, Artificial Sequence
  Synthetic oligonucleotide; GGG chr2 60505833 60505852 60505849 +
gaacaactctacctgaggga

SEQ ID NO: 164048 - DNA, 20 bp, Artificial Sequence
  Synthetic oligonucleotide; GGG chr2 60505834 60505853 60505850 +
aacaactctacctgagggag

SEQ ID NO: 164049 - DNA, 20 bp, Artificial Sequence
  Synthetic oligonucleotide; GGG chr2 60505835 60505854 60505851 +
acaactctacctgagggagg

SEQ ID NO: 164050 - DNA, 20 bp, Artificial Sequence
  Synthetic oligonucleotide; CGG chr2 60505856 60505875 60505872 +
ggaaatccctcccaaaacaa

SEQ ID NO: 164051 - DNA, 20 bp, Artificial Sequence
  Synthetic oligonucleotide; TGG chr2 60505859 60505878 60505875 +
aatccctcccaaaacaacgg

SEQ ID NO: 164052 - DNA, 20 bp, Artificial Sequence
  Synthetic oligonucleotide; GGG chr2 60505860 60505879 60505876 +
atccctcccaaaacaacggt

SEQ ID NO: 164053 - DNA, 20 bp, Artificial Sequence
  Synthetic oligonucleotide; CAG chr2 60505863 60505882 60505879 +
cctcccaaaacaacggtggg

SEQ ID NO: 164054 - DNA, 20 bp, Artificial Sequence
  Synthetic oligonucleotide; CAG chr2 60505890 60505909 60505906 +
atctgcatcccgtaaatacc

SEQ ID NO: 164055 - DNA, 20 bp, Artificial Sequence
  Synthetic oligonucleotide; AAG chr2 60505893 60505912 60505909 +
tgcatcccgtaaatacccag

SEQ ID NO: 164056 - DNA, 20 bp, Artificial Sequence
  Synthetic oligonucleotide; TAG chr2 60505899 60505918 60505915 +
ccgtaaatacccagaagcaa

SEQ ID NO: 164057 - DNA, 20 bp, Artificial Sequence
  Synthetic oligonucleotide; CAG chr2 60505902 60505921 60505918 +
taaatacccagaagcaatag

SEQ ID NO: 164058 - DNA, 20 bp, Artificial Sequence
  Synthetic oligonucleotide; TGG chr2 60505912 60505931 60505928 +
gaagcaatagcagccccacc

SEQ ID NO: 164059 - DNA, 20 bp, Artificial Sequence
  Synthetic oligonucleotide; CAG chr2 60505924 60505943 60505940 +
gccccacctggttcgtctgc

SEQ ID NO: 164060 - DNA, 20 bp, Artificial Sequence
  Synthetic oligonucleotide; TGG chr2 60505933 60505952 60505949 +
ggttcgtctgccagatgctg

SEQ ID NO: 164061 - DNA, 20 bp, Artificial Sequence
  Synthetic oligonucleotide; GAG chr2 60505935 60505954 60505951 +
ttcgtctgccagatgctgtg

SEQ ID NO: 164062 - DNA, 20 bp, Artificial Sequence
  Synthetic oligonucleotide; TGG chr2 60505939 60505958 60505955 +
tctgccagatgctgtggaga

SEQ ID NO: 164063 - DNA, 20 bp, Artificial Sequence
  Synthetic oligonucleotide; TGG chr2 60505944 60505963 60505960 +
cagatgctgtggagatggca

SEQ ID NO: 164064 - DNA, 20 bp, Artificial Sequence
  Synthetic oligonucleotide; TGG chr2 60505947 60505966 60505963 +
atgctgtggagatggcatgg

SEQ ID NO: 164065 - DNA, 20 bp, Artificial Sequence
  Synthetic oligonucleotide; TGG chr2 60505954 60505973 60505970 +
ggagatggcatggtggcatt

SEQ ID NO: 164066 - DNA, 20 bp, Artificial Sequence
  Synthetic oligonucleotide; TAG chr2 60505970 60505989 60505986 +
catttggtaaataacccaaa

SEQ ID NO: 164067 - DNA, 20 bp, Artificial Sequence
  Synthetic oligonucleotide; AGG chr2 60505971 60505990 60505987 +
atttggtaaataacccaaat

SEQ ID NO: 164068 - DNA, 20 bp, Artificial Sequence
  Synthetic oligonucleotide; GGG chr2 60505972 60505991 60505988 +
tttggtaaataacccaaata

SEQ ID NO: 164069 - DNA, 20 bp, Artificial Sequence
  Synthetic oligonucleotide; CAG chr2 60505980 60505999 60505996 +
ataacccaaatagggctttg

SEQ ID NO: 164070 - DNA, 20 bp, Artificial Sequence
  Synthetic oligonucleotide; AGG chr2 60505981 60506000 60505997 +
taacccaaatagggctttgc

SEQ ID NO: 164071 - DNA, 20 bp, Artificial Sequence
  Synthetic oligonucleotide; GGG chr2 60505982 60506001 60505998 +
aacccaaatagggctttgca

SEQ ID NO: 164072 - DNA, 20 bp, Artificial Sequence
  Synthetic oligonucleotide; TGG chr2 60505987 60506006 60506003 +
aaatagggctttgcagggta

SEQ ID NO: 164073 - DNA, 20 bp, Artificial Sequence
  Synthetic oligonucleotide; GGG chr2 60505988 60506007 60506004 +
aatagggctttgcagggtat

SEQ ID NO: 164074 - DNA, 20 bp, Artificial Sequence
  Synthetic oligonucleotide; TAG chr2 60506000 60506019 60506016 +
cagggtatgggacaccacac

SEQ ID NO: 164075 - DNA, 20 bp, Artificial Sequence
  Synthetic oligonucleotide; AGG chr2 60506001 60506020 60506017 +
agggtatgggacaccacact

SEQ ID NO: 164076 - DNA, 20 bp, Artificial Sequence
  Synthetic oligonucleotide; CAG chr2 60506009 60506028 60506025 +
ggacaccacactaggctttg

SEQ ID NO: 164077 - DNA, 20 bp, Artificial Sequence
  Synthetic oligonucleotide; CGG chr2 60506014 60506033 60506030 +
ccacactaggctttgcagcc

SEQ ID NO: 164078 - DNA, 20 bp, Artificial Sequence
  Synthetic oligonucleotide; GGG chr2 60506015 60506034 60506031 +
cacactaggctttgcagccc

SEQ ID NO: 164079 - DNA, 20 bp, Artificial Sequence
  Synthetic oligonucleotide; CAG chr2 60506024 60506043 60506040 +
ctttgcagcccgggtgaaac

SEQ ID NO: 164080 - DNA, 20 bp, Artificial Sequence
  Synthetic oligonucleotide; TGG chr2 60506028 60506047 60506044 +
gcagcccgggtgaaaccaga

SEQ ID NO: 164081 - DNA, 20 bp, Artificial Sequence
  Synthetic oligonucleotide; GAG chr2 60506034 60506053 60506050 +
cgggtgaaaccagatggtgc

SEQ ID NO: 164082 - DNA, 20 bp, Artificial Sequence
  Synthetic oligonucleotide; AAG chr2 60506037 60506056 60506053 +
gtgaaaccagatggtgcgag

SEQ ID NO: 164083 - DNA, 20 bp, Artificial Sequence
  Synthetic oligonucleotide; TAG chr2 60506041 60506060 60506057 +
aaccagatggtgcgagaaga

SEQ ID NO: 164084 - DNA, 20 bp, Artificial Sequence
  Synthetic oligonucleotide; TAG chr2 60506055 60506074 60506071 +
agaagatagtgaatcactca

SEQ ID NO: 164085 - DNA, 20 bp, Artificial Sequence
  Synthetic oligonucleotide; AGG chr2 60506056 60506075 60506072 +
gaagatagtgaatcactcat

SEQ ID NO: 164086 - DNA, 20 bp, Artificial Sequence
  Synthetic oligonucleotide; AAG chr2 60506060 60506079 60506076 +
atagtgaatcactcataggc

SEQ ID NO: 164087 - DNA, 20 bp, Artificial Sequence
  Synthetic oligonucleotide; AGG chr2 60506061 60506080 60506077 +
tagtgaatcactcataggca

SEQ ID NO: 164088 - DNA, 20 bp, Artificial Sequence
  Synthetic oligonucleotide; GGG chr2 60506062 60506081 60506078 +
agtgaatcactcataggcaa

SEQ ID NO: 164089 - DNA, 20 bp, Artificial Sequence
  Synthetic oligonucleotide; TAG chr2 60506069 60506088 60506085 +
cactcataggcaagggatgt

SEQ ID NO: 164090 - DNA, 20 bp, Artificial Sequence
  Synthetic oligonucleotide; CAG chr2 60506094 60506113 60506110 +
cacctaaaaatcccctttcc

SEQ ID NO: 164091 - DNA, 20 bp, Artificial Sequence
  Synthetic oligonucleotide; TAG chr2 60506117 60506136 60506133 +
ccatcctttgacacccacca

SEQ ID NO: 164092 - DNA, 20 bp, Artificial Sequence
  Synthetic oligonucleotide; CAG chr2 60506126 60506145 60506142 +
gacacccaccatagaaatca

SEQ ID NO: 164093 - DNA, 20 bp, Artificial Sequence
  Synthetic oligonucleotide; GAG chr2 60506128 60506147 60506144 +
cacccaccatagaaatcaca

SEQ ID NO: 164094 - DNA, 20 bp, Artificial Sequence
  Synthetic oligonucleotide; GAG chr2 60506130 60506149 60506146 +
cccaccatagaaatcacaga

SEQ ID NO: 164095 - DNA, 20 bp, Artificial Sequence
  Synthetic oligonucleotide; AGG chr2 60506131 60506150 60506147 +
ccaccatagaaatcacagag

SEQ ID NO: 164096 - DNA, 20 bp, Artificial Sequence
  Synthetic oligonucleotide; CAG chr2 60506135 60506154 60506151 +
catagaaatcacagagaggt

SEQ ID NO: 164097 - DNA, 20 bp, Artificial Sequence
  Synthetic oligonucleotide; AAG chr2 60506139 60506158 60506155 +
gaaatcacagagaggtcaga

SEQ ID NO: 164098 - DNA, 20 bp, Artificial Sequence
  Synthetic oligonucleotide; TGG chr2 60506148 60506167 60506164 +
gagaggtcagaaagaacacc

SEQ ID NO: 164099 - DNA, 20 bp, Artificial Sequence
  Synthetic oligonucleotide; GGG chr2 60506149 60506168 60506165 +
agaggtcagaaagaacacct

SEQ ID NO: 164100 - DNA, 20 bp, Artificial Sequence
  Synthetic oligonucleotide; TAG chr2 60506159 60506178 60506175 +
aagaacacctgggcccaaaa

SEQ ID NO: 164101 - DNA, 20 bp, Artificial Sequence
  Synthetic oligonucleotide; TAG chr2 60506172 60506191 60506188 +
cccaaaatagcctgtcctgt

SEQ ID NO: 164102 - DNA, 20 bp, Artificial Sequence
  Synthetic oligonucleotide; CAG chr2 60506183 60506202 60506199 +
ctgtcctgttagccaaatgc

SEQ ID NO: 164103 - DNA, 20 bp, Artificial Sequence
  Synthetic oligonucleotide; GAG chr2 60506202 60506221 60506218 +
ccagcactcccactttctct

SEQ ID NO: 164104 - DNA, 20 bp, Artificial Sequence
  Synthetic oligonucleotide; AGG chr2 60506203 60506222 60506219 +
cagcactcccactttctctg

SEQ ID NO: 164105 - DNA, 20 bp, Artificial Sequence
  Synthetic oligonucleotide; GGG chr2 60506204 60506223 60506220 +
agcactcccactttctctga

SEQ ID NO: 164106 - DNA, 20 bp, Artificial Sequence
  Synthetic oligonucleotide; TGG chr2 60506209 60506228 60506225 +
tcccactttctctgagggca

SEQ ID NO: 164107 - DNA, 20 bp, Artificial Sequence
  Synthetic oligonucleotide; GAG chr2 60506211 60506230 60506227 +
ccactttctctgagggcatg

SEQ ID NO: 164108 - DNA, 20 bp, Artificial Sequence
  Synthetic oligonucleotide; AGG chr2 60506212 60506231 60506228 +
cactttctctgagggcatgg

SEQ ID NO: 164109 - DNA, 20 bp, Artificial Sequence
  Synthetic oligonucleotide; GGG chr2 60506213 60506232 60506229 +
actttctctgagggcatgga

SEQ ID NO: 164110 - DNA, 20 bp, Artificial Sequence
  Synthetic oligonucleotide; GGG chr2 60506214 60506233 60506230 +
ctttctctgagggcatggag

SEQ ID NO: 164111 - DNA, 20 bp, Artificial Sequence
  Synthetic oligonucleotide; GAG chr2 60506216 60506235 60506232 +
ttctctgagggcatggaggg

SEQ ID NO: 164112 - DNA, 20 bp, Artificial Sequence
  Synthetic oligonucleotide; AGG chr2 60506217 60506236 60506233 +
tctctgagggcatggagggg

SEQ ID NO: 164113 - DNA, 20 bp, Artificial Sequence
  Synthetic oligonucleotide; CAG chr2 60506220 60506239 60506236 +
ctgagggcatggaggggagg

SEQ ID NO: 164114 - DNA, 20 bp, Artificial Sequence
  Synthetic oligonucleotide; CAG chr2 60506223 60506242 60506239 +
agggcatggaggggaggcag

SEQ ID NO: 164115 - DNA, 20 bp, Artificial Sequence
  Synthetic oligonucleotide; TAG chr2 60506227 60506246 60506243 +
catggaggggaggcagcagc

SEQ ID NO: 164116 - DNA, 20 bp, Artificial Sequence
  Synthetic oligonucleotide; AGG chr2 60506228 60506247 60506244 +
atggaggggaggcagcagct

SEQ ID NO: 164117 - DNA, 20 bp, Artificial Sequence
  Synthetic oligonucleotide; GGG chr2 60506229 60506248 60506245 +
tggaggggaggcagcagcta

SEQ ID NO: 164118 - DNA, 20 bp, Artificial Sequence
  Synthetic oligonucleotide; TGG chr2 60506235 60506254 60506251 +
ggaggcagcagctagggctc

SEQ ID NO: 164119 - DNA, 20 bp, Artificial Sequence
  Synthetic oligonucleotide; CAG chr2 60506263 60506282 60506279 +
tcatttaattctctctgcat

SEQ ID NO: 164120 - DNA, 20 bp, Artificial Sequence
  Synthetic oligonucleotide; GAG chr2 60506265 60506284 60506281 +
atttaattctctctgcatca

SEQ ID NO: 164121 - DNA, 20 bp, Artificial Sequence
  Synthetic oligonucleotide; AGG chr2 60506266 60506285 60506282 +
tttaattctctctgcatcag

SEQ ID NO: 164122 - DNA, 20 bp, Artificial Sequence
  Synthetic oligonucleotide; AAG chr2 60506269 60506288 60506285 +
aattctctctgcatcagagg

SEQ ID NO: 164123 - DNA, 20 bp, Artificial Sequence
  Synthetic oligonucleotide; GAG chr2 60506271 60506290 60506287 +
ttctctctgcatcagaggaa

SEQ ID NO: 164124 - DNA, 20 bp, Artificial Sequence
  Synthetic oligonucleotide; CAG chr2 60506283 60506302 60506299 +
cagaggaagagtcaccttca

SEQ ID NO: 164125 - DNA, 20 bp, Artificial Sequence
  Synthetic oligonucleotide; AGG chr2 60506284 60506303 60506300 +
agaggaagagtcaccttcac

SEQ ID NO: 164126 - DNA, 20 bp, Artificial Sequence
  Synthetic oligonucleotide; CAG chr2 60506288 60506307 60506304 +
gaagagtcaccttcacaggc

SEQ ID NO: 164127 - DNA, 20 bp, Artificial Sequence
  Synthetic oligonucleotide; TGG chr2 60506294 60506313 60506310 +
tcaccttcacaggccagctg

SEQ ID NO: 164128 - DNA, 20 bp, Artificial Sequence
  Synthetic oligonucleotide; CAG chr2 60506322 60506341 60506338 +
cttgccacatctaatgccac

SEQ ID NO: 164129 - DNA, 20 bp, Artificial Sequence
  Synthetic oligonucleotide; AGG chr2 60506323 60506342 60506339 +
ttgccacatctaatgccacc

SEQ ID NO: 164130 - DNA, 20 bp, Artificial Sequence
  Synthetic oligonucleotide; CAG chr2 60506332 60506351 60506348 +
ctaatgccaccaggccctgc

SEQ ID NO: 164131 - DNA, 20 bp, Artificial Sequence
  Synthetic oligonucleotide; CGG chr2 60506335 60506354 60506351 +
atgccaccaggccctgccag

SEQ ID NO: 164132 - DNA, 20 bp, Artificial Sequence
  Synthetic oligonucleotide; TGG chr2 60506347 60506366 60506363 +
cctgccagcggcccccattc

SEQ ID NO: 164133 - DNA, 20 bp, Artificial Sequence
  Synthetic oligonucleotide; TGG chr2 60506363 60506382 60506379 +
attctggtctgtcaaacccc

SEQ ID NO: 164134 - DNA, 20 bp, Artificial Sequence
  Synthetic oligonucleotide; CAG chr2 60506373 60506392 60506389 +
gtcaaacccctggaaaactt

SEQ ID NO: 164135 - DNA, 20 bp, Artificial Sequence
  Synthetic oligonucleotide; CAG chr2 60506377 60506396 60506393 +
aacccctggaaaacttcaga

SEQ ID NO: 164136 - DNA, 20 bp, Artificial Sequence
  Synthetic oligonucleotide; CAG chr2 60506387 60506406 60506403 +
aaacttcagacagtgttcct

SEQ ID NO: 164137 - DNA, 20 bp, Artificial Sequence
  Synthetic oligonucleotide; CAG chr2 60506393 60506412 60506409 +
cagacagtgttcctcagatc

SEQ ID NO: 164138 - DNA, 20 bp, Artificial Sequence
  Synthetic oligonucleotide; AGG chr2 60506394 60506413 60506410 +
agacagtgttcctcagatcc

SEQ ID NO: 164139 - DNA, 20 bp, Artificial Sequence
  Synthetic oligonucleotide; CAG chr2 60506398 60506417 60506414 +
agtgttcctcagatccagga

SEQ ID NO: 164140 - DNA, 20 bp, Artificial Sequence
  Synthetic oligonucleotide; GAG chr2 60506400 60506419 60506416 +
tgttcctcagatccaggaca

SEQ ID NO: 164141 - DNA, 20 bp, Artificial Sequence
  Synthetic oligonucleotide; TGG chr2 60506404 60506423 60506420 +
cctcagatccaggacagagc

SEQ ID NO: 164142 - DNA, 20 bp, Artificial Sequence
  Synthetic oligonucleotide; CAG chr2 60506409 60506428 60506425 +
gatccaggacagagctggct

SEQ ID NO: 164143 - DNA, 20 bp, Artificial Sequence
  Synthetic oligonucleotide; AGG chr2 60506410 60506429 60506426 +
atccaggacagagctggctc

SEQ ID NO: 164144 - DNA, 20 bp, Artificial Sequence
  Synthetic oligonucleotide; TGG chr2 60506421 60506440 60506437 +
agctggctcaggacgccaca

SEQ ID NO: 164145 - DNA, 20 bp, Artificial Sequence
  Synthetic oligonucleotide; GGG chr2 60506422 60506441 60506438 +
gctggctcaggacgccacat

SEQ ID NO: 164146 - DNA, 20 bp, Artificial Sequence
  Synthetic oligonucleotide; GAG chr2 60506432 60506451 60506448 +
gacgccacatgggtcaaccc

SEQ ID NO: 164147 - DNA, 20 bp, Artificial Sequence
  Synthetic oligonucleotide; CAG chr2 60506440 60506459 60506456 +
atgggtcaacccgagcgcac

SEQ ID NO: 164148 - DNA, 20 bp, Artificial Sequence
  Synthetic oligonucleotide; CAG chr2 60506447 60506466 60506463 +
aacccgagcgcaccagtcct

SEQ ID NO: 164149 - DNA, 20 bp, Artificial Sequence
  Synthetic oligonucleotide; AAG chr2 60506457 60506476 60506473 +
caccagtcctcagaccctcc

SEQ ID NO: 164150 - DNA, 20 bp, Artificial Sequence
  Synthetic oligonucleotide; AGG chr2 60506458 60506477 60506474 +
accagtcctcagaccctcca

SEQ ID NO: 164151 - DNA, 20 bp, Artificial Sequence
  Synthetic oligonucleotide; AAG chr2 60506466 60506485 60506482 +
tcagaccctccaaggtgaca

SEQ ID NO: 164152 - DNA, 20 bp, Artificial Sequence
  Synthetic oligonucleotide; TAG chr2 60506476 60506495 60506492 +
caaggtgacaaagacctcac

SEQ ID NO: 164153 - DNA, 20 bp, Artificial Sequence
  Synthetic oligonucleotide; CAG chr2 60506496 60506515 60506512 +
tagactgtatctcatttttc

SEQ ID NO: 164154 - DNA, 20 bp, Artificial Sequence
  Synthetic oligonucleotide; CAG chr2 60506502 60506521 60506518 +
gtatctcatttttccagcct

SEQ ID NO: 164155 - DNA, 20 bp, Artificial Sequence
  Synthetic oligonucleotide; GAG chr2 60506506 60506525 60506522 +
ctcatttttccagcctcagt

SEQ ID NO: 164156 - DNA, 20 bp, Artificial Sequence
  Synthetic oligonucleotide; CGG chr2 60506510 60506529 60506526 +
tttttccagcctcagtgagc

SEQ ID NO: 164157 - DNA, 20 bp, Artificial Sequence
  Synthetic oligonucleotide; CAG chr2 60506516 60506535 60506532 +
cagcctcagtgagccggccc

SEQ ID NO: 164158 - DNA, 20 bp, Artificial Sequence
  Synthetic oligonucleotide; TGG chr2 60506520 60506539 60506536 +
ctcagtgagccggccccagc

SEQ ID NO: 164159 - DNA, 20 bp, Artificial Sequence
  Synthetic oligonucleotide; GAG chr2 60506529 60506548 60506545 +
ccggccccagctggcatgct

SEQ ID NO: 164160 - DNA, 20 bp, Artificial Sequence
  Synthetic oligonucleotide; CAG chr2 60506534 60506553 60506550 +
cccagctggcatgctgagtc

SEQ ID NO: 164161 - DNA, 20 bp, Artificial Sequence
  Synthetic oligonucleotide; AGG chr2 60506535 60506554 60506551 +
ccagctggcatgctgagtcc

SEQ ID NO: 164162 - DNA, 20 bp, Artificial Sequence
  Synthetic oligonucleotide; AAG chr2 60506539 60506558 60506555 +
ctggcatgctgagtccagga

SEQ ID NO: 164163 - DNA, 20 bp, Artificial Sequence
  Synthetic oligonucleotide; TGG chr2 60506545 60506564 60506561 +
tgctgagtccaggaaagccc

SEQ ID NO: 164164 - DNA, 20 bp, Artificial Sequence
  Synthetic oligonucleotide; CAG chr2 60506560 60506579 60506576 +
agccctggctatacaaaaca

SEQ ID NO: 164165 - DNA, 20 bp, Artificial Sequence
  Synthetic oligonucleotide; TGG chr2 60506583 60506602 60506599 +
cacccacgtgcctttgtgca

SEQ ID NO: 164166 - DNA, 20 bp, Artificial Sequence
  Synthetic oligonucleotide; TAG chr2 60506591 60506610 60506607 +
tgcctttgtgcatggctgct

SEQ ID NO: 164167 - DNA, 20 bp, Artificial Sequence
  Synthetic oligonucleotide; GAG chr2 60506593 60506612 60506609 +
cctttgtgcatggctgctta

SEQ ID NO: 164168 - DNA, 20 bp, Artificial Sequence
  Synthetic oligonucleotide; AGG chr2 60506594 60506613 60506610 +
ctttgtgcatggctgcttag

SEQ ID NO: 164169 - DNA, 20 bp, Artificial Sequence
  Synthetic oligonucleotide; GGG chr2 60506595 60506614 60506611 +
tttgtgcatggctgcttaga

SEQ ID NO: 164170 - DNA, 20 bp, Artificial Sequence
  Synthetic oligonucleotide; AAG chr2 60506607 60506626 60506623 +
tgcttagagggctaatgata

SEQ ID NO: 164171 - DNA, 20 bp, Artificial Sequence
  Synthetic oligonucleotide; AGG chr2 60506608 60506627 60506624 +
gcttagagggctaatgataa

SEQ ID NO: 164172 - DNA, 20 bp, Artificial Sequence
  Synthetic oligonucleotide; CAG chr2 60506611 60506630 60506627 +
tagagggctaatgataaagg

SEQ ID NO: 164173 - DNA, 20 bp, Artificial Sequence
  Synthetic oligonucleotide; AAG chr2 60506620 60506639 60506636 +
aatgataaaggcagctcact

SEQ ID NO: 164174 - DNA, 20 bp, Artificial Sequence
  Synthetic oligonucleotide; CAG chr2 60506637 60506656 60506653 +
actaagaaaacgaccgtgcc

SEQ ID NO: 164175 - DNA, 20 bp, Artificial Sequence
  Synthetic oligonucleotide; CAG chr2 60506640 60506659 60506656 +
aagaaaacgaccgtgcccag

SEQ ID NO: 164176 - DNA, 20 bp, Artificial Sequence
  Synthetic oligonucleotide; TGG chr2 60506652 60506671 60506668 +
gtgcccagcagtctcctaaa

SEQ ID NO: 164177 - DNA, 20 bp, Artificial Sequence
  Synthetic oligonucleotide; AAG chr2 60506657 60506676 60506673 +
cagcagtctcctaaatggcg

SEQ ID NO: 164178 - DNA, 20 bp, Artificial Sequence
  Synthetic oligonucleotide; AGG chr2 60506658 60506677 60506674 +
agcagtctcctaaatggcga

SEQ ID NO: 164179 - DNA, 20 bp, Artificial Sequence
  Synthetic oligonucleotide; CAG chr2 60506661 60506680 60506677 +
agtctcctaaatggcgaagg

SEQ ID NO: 164180 - DNA, 20 bp, Artificial Sequence
  Synthetic oligonucleotide; CAG chr2 60506680 60506699 60506696 +
gcagcatttaccactgatga

SEQ ID NO: 164181 - DNA, 20 bp, Artificial Sequence
  Synthetic oligonucleotide; CAG chr2 60506732 60506751 60506748 +
atatatatccatttttctgt

SEQ ID NO: 164182 - DNA, 20 bp, Artificial Sequence
  Synthetic oligonucleotide; GAG chr2 60506761 60506780 60506777 +
caaataatgtctataatgct

SEQ ID NO: 164183 - DNA, 20 bp, Artificial Sequence
  Synthetic oligonucleotide; TGG chr2 60506773 60506792 60506789 +
ataatgctgagatttataca

SEQ ID NO: 164184 - DNA, 20 bp, Artificial Sequence
  Synthetic oligonucleotide; GGG chr2 60506774 60506793 60506790 +
taatgctgagatttatacat

SEQ ID NO: 164185 - DNA, 20 bp, Artificial Sequence
  Synthetic oligonucleotide; TAG chr2 60506800 60506819 60506816 +
ttataaatgtgatttcatta

SEQ ID NO: 164186 - DNA, 20 bp, Artificial Sequence
  Synthetic oligonucleotide; TGG chr2 60506863 60506882 60506879 +
gtaattaaattgctacctga

SEQ ID NO: 164187 - DNA, 20 bp, Artificial Sequence
  Synthetic oligonucleotide; TGG chr2 60506883 60506902 60506899 +
tggcattatctaatttaact

SEQ ID NO: 164188 - DNA, 20 bp, Artificial Sequence
  Synthetic oligonucleotide; GGG chr2 60506884 60506903 60506900 +
ggcattatctaatttaactt

SEQ ID NO: 164189 - DNA, 20 bp, Artificial Sequence
  Synthetic oligonucleotide; AAG chr2 60506902 60506921 60506918 +
ttgggatccaaactattgaa

SEQ ID NO: 164190 - DNA, 20 bp, Artificial Sequence
  Synthetic oligonucleotide; TGG chr2 60506928 60506947 60506944 +
gtgccttttaacaccctgac

SEQ ID NO: 164191 - DNA, 20 bp, Artificial Sequence
  Synthetic oligonucleotide; AAG chr2 60506932 60506951 60506948 +
cttttaacaccctgactggt

SEQ ID NO: 164192 - DNA, 20 bp, Artificial Sequence
  Synthetic oligonucleotide; AGG chr2 60506933 60506952 60506949 +
ttttaacaccctgactggta

SEQ ID NO: 164193 - DNA, 20 bp, Artificial Sequence
  Synthetic oligonucleotide; CAG chr2 60506947 60506966 60506963 +
ctggtaaggcatgtgatgaa

SEQ ID NO: 164194 - DNA, 20 bp, Artificial Sequence
  Synthetic oligonucleotide; GAG chr2 60506949 60506968 60506965 +
ggtaaggcatgtgatgaaca

SEQ ID NO: 164195 - DNA, 20 bp, Artificial Sequence
  Synthetic oligonucleotide; TGG chr2 60506964 60506983 60506980 +
gaacagagctataaacatgt

SEQ ID NO: 164196 - DNA, 20 bp, Artificial Sequence
  Synthetic oligonucleotide; GAG chr2 60506974 60506993 60506990 +
ataaacatgttggcgtaact

SEQ ID NO: 164197 - DNA, 20 bp, Artificial Sequence
  Synthetic oligonucleotide; TAG chr2 60506993 60507012 60507009 +
tgagctgtttaaaaataaat

SEQ ID NO: 164198 - DNA, 20 bp, Artificial Sequence
  Synthetic oligonucleotide; CAG chr2 60507013 60507032 60507029 +
tagcaaactataaaaataaa

SEQ ID NO: 164199 - DNA, 20 bp, Artificial Sequence
  Synthetic oligonucleotide; TAG chr2 60507082 60507101 60507098 +
tgaaatactgtctttgacct

SEQ ID NO: 164200 - DNA, 20 bp, Artificial Sequence
  Synthetic oligonucleotide; AAG chr2 60507093 60507112 60507109 +
ctttgaccttagtcataaac

SEQ ID NO: 164201 - DNA, 20 bp, Artificial Sequence
  Synthetic oligonucleotide; CAG chr2 60507123 60507142 60507139 +
aaaaaaacataatatcccaa

SEQ ID NO: 164202 - DNA, 20 bp, Artificial Sequence
  Synthetic oligonucleotide; CAG chr2 60507127 60507146 60507143 +
aaacataatatcccaacaga

SEQ ID NO: 164203 - DNA, 20 bp, Artificial Sequence
  Synthetic oligonucleotide; GAG chr2 60507129 60507148 60507145 +
acataatatcccaacagaca

SEQ ID NO: 164204 - DNA, 20 bp, Artificial Sequence
  Synthetic oligonucleotide; AGG chr2 60507130 60507149 60507146 +
cataatatcccaacagacag

SEQ ID NO: 164205 - DNA, 20 bp, Artificial Sequence
  Synthetic oligonucleotide; GGG chr2 60507131 60507150 60507147 +
ataatatcccaacagacaga

SEQ ID NO: 164206 - DNA, 20 bp, Artificial Sequence
  Synthetic oligonucleotide; AAG chr2 60507136 60507155 60507152 +
atcccaacagacagagggcc

SEQ ID NO: 164207 - DNA, 20 bp, Artificial Sequence
  Synthetic oligonucleotide; AGG chr2 60507137 60507156 60507153 +
tcccaacagacagagggcca

SEQ ID NO: 164208 - DNA, 20 bp, Artificial Sequence
  Synthetic oligonucleotide; TAG chr2 60507154 60507173 60507170 +
ccaaggattaaatgctcttc

SEQ ID NO: 164209 - DNA, 20 bp, Artificial Sequence
  Synthetic oligonucleotide; CAG chr2 60507162 60507181 60507178 +
taaatgctcttctagctctg

SEQ ID NO: 164210 - DNA, 20 bp, Artificial Sequence
  Synthetic oligonucleotide; AAG chr2 60507171 60507190 60507187 +
ttctagctctgcagaatgca

SEQ ID NO: 164211 - DNA, 20 bp, Artificial Sequence
  Synthetic oligonucleotide; AAG chr2 60507175 60507194 60507191 +
agctctgcagaatgcaaagc

SEQ ID NO: 164212 - DNA, 20 bp, Artificial Sequence
  Synthetic oligonucleotide; AAG chr2 60507180 60507199 60507196 +
tgcagaatgcaaagcaagac

SEQ ID NO: 164213 - DNA, 20 bp, Artificial Sequence
  Synthetic oligonucleotide; AGG chr2 60507181 60507200 60507197 +
gcagaatgcaaagcaagaca

SEQ ID NO: 164214 - DNA, 20 bp, Artificial Sequence
  Synthetic oligonucleotide; AAG chr2 60507184 60507203 60507200 +
gaatgcaaagcaagacaagg

SEQ ID NO: 164215 - DNA, 20 bp, Artificial Sequence
  Synthetic oligonucleotide; AAG chr2 60507188 60507207 60507204 +
gcaaagcaagacaaggaaga

SEQ ID NO: 164216 - DNA, 20 bp, Artificial Sequence
  Synthetic oligonucleotide; AGG chr2 60507189 60507208 60507205 +
caaagcaagacaaggaagaa

SEQ ID NO: 164217 - DNA, 20 bp, Artificial Sequence
  Synthetic oligonucleotide; AAG chr2 60507192 60507211 60507208 +
agcaagacaaggaagaaagg

SEQ ID NO: 164218 - DNA, 20 bp, Artificial Sequence
  Synthetic oligonucleotide; AGG chr2 60507193 60507212 60507209 +
gcaagacaaggaagaaagga

SEQ ID NO: 164219 - DNA, 20 bp, Artificial Sequence
  Synthetic oligonucleotide; AAG chr2 60507196 60507215 60507212 +
agacaaggaagaaaggaagg

SEQ ID NO: 164220 - DNA, 20 bp, Artificial Sequence
  Synthetic oligonucleotide; AGG chr2 60507197 60507216 60507213 +
gacaaggaagaaaggaagga

SEQ ID NO: 164221 - DNA, 20 bp, Artificial Sequence
  Synthetic oligonucleotide; AAG chr2 60507200 60507219 60507216 +
aaggaagaaaggaaggaagg

SEQ ID NO: 164222 - DNA, 20 bp, Artificial Sequence
  Synthetic oligonucleotide; AGG chr2 60507201 60507220 60507217 +
aggaagaaaggaaggaagga

SEQ ID NO: 164223 - DNA, 20 bp, Artificial Sequence
  Synthetic oligonucleotide; AAG chr2 60507204 60507223 60507220 +
aagaaaggaaggaaggaagg

SEQ ID NO: 164224 - DNA, 20 bp, Artificial Sequence
  Synthetic oligonucleotide; AGG chr2 60507205 60507224 60507221 +
agaaaggaaggaaggaagga

SEQ ID NO: 164225 - DNA, 20 bp, Artificial Sequence
  Synthetic oligonucleotide; AAG chr2 60507208 60507227 60507224 +
aaggaaggaaggaaggaagg

SEQ ID NO: 164226 - DNA, 20 bp, Artificial Sequence
  Synthetic oligonucleotide; AGG chr2 60507209 60507228 60507225 +
aggaaggaaggaaggaagga

SEQ ID NO: 164227 - DNA, 20 bp, Artificial Sequence
  Synthetic oligonucleotide; AAG chr2 60507212 60507231 60507228 +
aaggaaggaaggaaggaagg

SEQ ID NO: 164228 - DNA, 20 bp, Artificial Sequence
  Synthetic oligonucleotide; AGG chr2 60507213 60507232 60507229 +
aggaaggaaggaaggaagga

SEQ ID NO: 164229 - DNA, 20 bp, Artificial Sequence
  Synthetic oligonucleotide; GGG chr2 60507214 60507233 60507230 +
ggaaggaaggaaggaaggaa

SEQ ID NO: 164230 - DNA, 20 bp, Artificial Sequence
  Synthetic oligonucleotide; GAG chr2 60507216 60507235 60507232 +
aaggaaggaaggaaggaagg

SEQ ID NO: 164231 - DNA, 20 bp, Artificial Sequence
  Synthetic oligonucleotide; AGG chr2 60507217 60507236 60507233 +
aggaaggaaggaaggaaggg

SEQ ID NO: 164232 - DNA, 20 bp, Artificial Sequence
  Synthetic oligonucleotide; GGG chr2 60507218 60507237 60507234 +
ggaaggaaggaaggaaggga

SEQ ID NO: 164233 - DNA, 20 bp, Artificial Sequence
  Synthetic oligonucleotide; GAG chr2 60507220 60507239 60507236 +
aaggaaggaaggaagggagg

SEQ ID NO: 164234 - DNA, 20 bp, Artificial Sequence
  Synthetic oligonucleotide; AGG chr2 60507221 60507240 60507237 +
aggaaggaaggaagggaggg

SEQ ID NO: 164235 - DNA, 20 bp, Artificial Sequence
  Synthetic oligonucleotide; GGG chr2 60507222 60507241 60507238 +
ggaaggaaggaagggaggga

SEQ ID NO: 164236 - DNA, 20 bp, Artificial Sequence
  Synthetic oligonucleotide; GAG chr2 60507224 60507243 60507240 +
aaggaaggaagggagggagg

SEQ ID NO: 164237 - DNA, 20 bp, Artificial Sequence
  Synthetic oligonucleotide; AGG chr2 60507225 60507244 60507241 +
aggaaggaagggagggaggg

SEQ ID NO: 164238 - DNA, 20 bp, Artificial Sequence
  Synthetic oligonucleotide; GGG chr2 60507226 60507245 60507242 +
ggaaggaagggagggaggga

SEQ ID NO: 164239 - DNA, 20 bp, Artificial Sequence
  Synthetic oligonucleotide; GGG chr2 60507227 60507246 60507243 +
gaaggaagggagggagggag

SEQ ID NO: 164240 - DNA, 20 bp, Artificial Sequence
  Synthetic oligonucleotide; GAG chr2 60507229 60507248 60507245 +
aggaagggagggagggaggg

SEQ ID NO: 164241 - DNA, 20 bp, Artificial Sequence
  Synthetic oligonucleotide; AGG chr2 60507230 60507249 60507246 +
ggaagggagggagggagggg

SEQ ID NO: 164242 - DNA, 20 bp, Artificial Sequence
  Synthetic oligonucleotide; GGG chr2 60507231 60507250 60507247 +
gaagggagggagggagggga

SEQ ID NO: 164243 - DNA, 20 bp, Artificial Sequence
  Synthetic oligonucleotide; GGG chr2 60507232 60507251 60507248 +
aagggagggagggaggggag

SEQ ID NO: 164244 - DNA, 20 bp, Artificial Sequence
  Synthetic oligonucleotide; GAG chr2 60507234 60507253 60507250 +
gggagggagggaggggaggg

SEQ ID NO: 164245 - DNA, 20 bp, Artificial Sequence
  Synthetic oligonucleotide; AGG chr2 60507235 60507254 60507251 +
ggagggagggaggggagggg

SEQ ID NO: 164246 - DNA, 20 bp, Artificial Sequence
  Synthetic oligonucleotide; GGG chr2 60507236 60507255 60507252 +
gagggagggaggggagggga

SEQ ID NO: 164247 - DNA, 20 bp, Artificial Sequence
  Synthetic oligonucleotide; GGG chr2 60507237 60507256 60507253 +
agggagggaggggaggggag

SEQ ID NO: 164248 - DNA, 20 bp, Artificial Sequence
  Synthetic oligonucleotide; GAG chr2 60507239 60507258 60507255 +
ggagggaggggaggggaggg

SEQ ID NO: 164249 - DNA, 20 bp, Artificial Sequence
  Synthetic oligonucleotide; AGG chr2 60507240 60507259 60507256 +
gagggaggggaggggagggg

SEQ ID NO: 164250 - DNA, 20 bp, Artificial Sequence
  Synthetic oligonucleotide; GGG chr2 60507241 60507260 60507257 +
agggaggggaggggagggga

SEQ ID NO: 164251 - DNA, 20 bp, Artificial Sequence
  Synthetic oligonucleotide; GGG chr2 60507242 60507261 60507258 +
gggaggggaggggaggggag

SEQ ID NO: 164252 - DNA, 20 bp, Artificial Sequence
  Synthetic oligonucleotide; GAG chr2 60507244 60507263 60507260 +
gaggggaggggaggggaggg

SEQ ID NO: 164253 - DNA, 20 bp, Artificial Sequence
  Synthetic oligonucleotide; AGG chr2 60507245 60507264 60507261 +
aggggaggggaggggagggg

SEQ ID NO: 164254 - DNA, 20 bp, Artificial Sequence
  Synthetic oligonucleotide; GGG chr2 60507246 60507265 60507262 +
ggggaggggaggggagggga

SEQ ID NO: 164255 - DNA, 20 bp, Artificial Sequence
  Synthetic oligonucleotide; GGG chr2 60507247 60507266 60507263 +
gggaggggaggggaggggag

SEQ ID NO: 164256 - DNA, 20 bp, Artificial Sequence
  Synthetic oligonucleotide; GAG chr2 60507249 60507268 60507265 +
gaggggaggggaggggaggg

SEQ ID NO: 164257 - DNA, 20 bp, Artificial Sequence
  Synthetic oligonucleotide; AGG chr2 60507250 60507269 60507266 +
aggggaggggaggggagggg

SEQ ID NO: 164258 - DNA, 20 bp, Artificial Sequence
  Synthetic oligonucleotide; GGG chr2 60507251 60507270 60507267 +
ggggaggggaggggagggga

SEQ ID NO: 164259 - DNA, 20 bp, Artificial Sequence
  Synthetic oligonucleotide; GGG chr2 60507252 60507271 60507268 +
gggaggggaggggaggggag

SEQ ID NO: 164260 - DNA, 20 bp, Artificial Sequence
  Synthetic oligonucleotide; GAG chr2 60507254 60507273 60507270 +
gaggggaggggaggggaggg

SEQ ID NO: 164261 - DNA, 20 bp, Artificial Sequence
  Synthetic oligonucleotide; AGG chr2 60507255 60507274 60507271 +
aggggaggggaggggagggg

SEQ ID NO: 164262 - DNA, 20 bp, Artificial Sequence
  Synthetic oligonucleotide; GGG chr2 60507256 60507275 60507272 +
ggggaggggaggggagggga

SEQ ID NO: 164263 - DNA, 20 bp, Artificial Sequence
  Synthetic oligonucleotide; GGG chr2 60507257 60507276 60507273 +
gggaggggaggggaggggag

SEQ ID NO: 164264 - DNA, 20 bp, Artificial Sequence
  Synthetic oligonucleotide; GAG chr2 60507259 60507278 60507275 +
gaggggaggggaggggaggg

SEQ ID NO: 164265 - DNA, 20 bp, Artificial Sequence
  Synthetic oligonucleotide; AGG chr2 60507260 60507279 60507276 +
aggggaggggaggggagggg

SEQ ID NO: 164266 - DNA, 20 bp, Artificial Sequence
  Synthetic oligonucleotide; GGG chr2 60507261 60507280 60507277 +
ggggaggggaggggagggga

SEQ ID NO: 164267 - DNA, 20 bp, Artificial Sequence
  Synthetic oligonucleotide; GGG chr2 60507262 60507281 60507278 +
gggaggggaggggaggggag

SEQ ID NO: 164268 - DNA, 20 bp, Artificial Sequence
  Synthetic oligonucleotide; GAG chr2 60507264 60507283 60507280 +
gaggggaggggaggggaggg

SEQ ID NO: 164269 - DNA, 20 bp, Artificial Sequence
  Synthetic oligonucleotide; AGG chr2 60507265 60507284 60507281 +
aggggaggggaggggagggg

SEQ ID NO: 164270 - DNA, 20 bp, Artificial Sequence
  Synthetic oligonucleotide; GGG chr2 60507266 60507285 60507282 +
ggggaggggaggggagggga

SEQ ID NO: 164271 - DNA, 20 bp, Artificial Sequence
  Synthetic oligonucleotide; GGG chr2 60507267 60507286 60507283 +
gggaggggaggggaggggag

SEQ ID NO: 164272 - DNA, 20 bp, Artificial Sequence
  Synthetic oligonucleotide; GAG chr2 60507269 60507288 60507285 +
gaggggaggggaggggaggg

SEQ ID NO: 164273 - DNA, 20 bp, Artificial Sequence
  Synthetic oligonucleotide; AGG chr2 60507270 60507289 60507286 +
aggggaggggaggggagggg

SEQ ID NO: 164274 - DNA, 20 bp, Artificial Sequence
  Synthetic oligonucleotide; GGG chr2 60507271 60507290 60507287 +
ggggaggggaggggagggga

SEQ ID NO: 164275 - DNA, 20 bp, Artificial Sequence
  Synthetic oligonucleotide; GGG chr2 60507272 60507291 60507288 +
gggaggggaggggaggggag

SEQ ID NO: 164276 - DNA, 20 bp, Artificial Sequence
  Synthetic oligonucleotide; GAG chr2 60507274 60507293 60507290 +
gaggggaggggaggggaggg

SEQ ID NO: 164277 - DNA, 20 bp, Artificial Sequence
  Synthetic oligonucleotide; AGG chr2 60507275 60507294 60507291 +
aggggaggggaggggagggg

SEQ ID NO: 164278 - DNA, 20 bp, Artificial Sequence
  Synthetic oligonucleotide; GGG chr2 60507276 60507295 60507292 +
ggggaggggaggggagggga

SEQ ID NO: 164279 - DNA, 20 bp, Artificial Sequence
  Synthetic oligonucleotide; GGG chr2 60507277 60507296 60507293 +
gggaggggaggggaggggag

SEQ ID NO: 164280 - DNA, 20 bp, Artificial Sequence
  Synthetic oligonucleotide; GAG chr2 60507279 60507298 60507295 +
gaggggaggggaggggaggg

SEQ ID NO: 164281 - DNA, 20 bp, Artificial Sequence
  Synthetic oligonucleotide; AGG chr2 60507280 60507299 60507296 +
aggggaggggaggggagggg

SEQ ID NO: 164282 - DNA, 20 bp, Artificial Sequence
  Synthetic oligonucleotide; GGG chr2 60507281 60507300 60507297 +
ggggaggggaggggagggga

SEQ ID NO: 164283 - DNA, 20 bp, Artificial Sequence
  Synthetic oligonucleotide; GGG chr2 60507282 60507301 60507298 +
gggaggggaggggaggggag

SEQ ID NO: 164284 - DNA, 20 bp, Artificial Sequence
  Synthetic oligonucleotide; GAG chr2 60507284 60507303 60507300 +
gaggggaggggaggggaggg

SEQ ID NO: 164285 - DNA, 20 bp, Artificial Sequence
  Synthetic oligonucleotide; AGG chr2 60507285 60507304 60507301 +
aggggaggggaggggagggg

SEQ ID NO: 164286 - DNA, 20 bp, Artificial Sequence
  Synthetic oligonucleotide; GGG chr2 60507286 60507305 60507302 +
ggggaggggaggggagggga

SEQ ID NO: 164287 - DNA, 20 bp, Artificial Sequence
  Synthetic oligonucleotide; GGG chr2 60507287 60507306 60507303 +
gggaggggaggggaggggag

SEQ ID NO: 164288 - DNA, 20 bp, Artificial Sequence
  Synthetic oligonucleotide; GAG chr2 60507289 60507308 60507305 +
gaggggaggggaggggaggg

SEQ ID NO: 164289 - DNA, 20 bp, Artificial Sequence
  Synthetic oligonucleotide; AGG chr2 60507290 60507309 60507306 +
aggggaggggaggggagggg

SEQ ID NO: 164290 - DNA, 20 bp, Artificial Sequence
  Synthetic oligonucleotide; GGG chr2 60507291 60507310 60507307 +
ggggaggggaggggagggga

SEQ ID NO: 164291 - DNA, 20 bp, Artificial Sequence
  Synthetic oligonucleotide; GGG chr2 60507292 60507311 60507308 +
gggaggggaggggaggggag

SEQ ID NO: 164292 - DNA, 20 bp, Artificial Sequence
  Synthetic oligonucleotide; GAG chr2 60507294 60507313 60507310 +
gaggggaggggaggggaggg

SEQ ID NO: 164293 - DNA, 20 bp, Artificial Sequence
  Synthetic oligonucleotide; AGG chr2 60507295 60507314 60507311 +
aggggaggggaggggagggg

SEQ ID NO: 164294 - DNA, 20 bp, Artificial Sequence
  Synthetic oligonucleotide; GGG chr2 60507296 60507315 60507312 +
ggggaggggaggggagggga

SEQ ID NO: 164295 - DNA, 20 bp, Artificial Sequence
  Synthetic oligonucleotide; GGG chr2 60507297 60507316 60507313 +
gggaggggaggggaggggag

SEQ ID NO: 164296 - DNA, 20 bp, Artificial Sequence
  Synthetic oligonucleotide; AAG chr2 60507300 60507319 60507316 +
aggggaggggaggggagggg

SEQ ID NO: 164297 - DNA, 20 bp, Artificial Sequence
  Synthetic oligonucleotide; AGG chr2 60507301 60507320 60507317 +
ggggaggggaggggagggga

SEQ ID NO: 164298 - DNA, 20 bp, Artificial Sequence
  Synthetic oligonucleotide; GGG chr2 60507302 60507321 60507318 +
gggaggggaggggaggggaa

SEQ ID NO: 164299 - DNA, 20 bp, Artificial Sequence
  Synthetic oligonucleotide; AAG chr2 60507305 60507324 60507321 +
aggggaggggaggggaaggg

SEQ ID NO: 164300 - DNA, 20 bp, Artificial Sequence
  Synthetic oligonucleotide; AGG chr2 60507306 60507325 60507322 +
ggggaggggaggggaaggga

SEQ ID NO: 164301 - DNA, 20 bp, Artificial Sequence
  Synthetic oligonucleotide; GGG chr2 60507307 60507326 60507323 +
gggaggggaggggaagggaa

SEQ ID NO: 164302 - DNA, 20 bp, Artificial Sequence
  Synthetic oligonucleotide; AAG chr2 60507310 60507329 60507326 +
aggggaggggaagggaaggg

SEQ ID NO: 164303 - DNA, 20 bp, Artificial Sequence
  Synthetic oligonucleotide; AGG chr2 60507311 60507330 60507327 +
ggggaggggaagggaaggga

SEQ ID NO: 164304 - DNA, 20 bp, Artificial Sequence
  Synthetic oligonucleotide; GGG chr2 60507312 60507331 60507328 +
gggaggggaagggaagggaa

SEQ ID NO: 164305 - DNA, 20 bp, Artificial Sequence
  Synthetic oligonucleotide; AAG chr2 60507315 60507334 60507331 +
aggggaagggaagggaaggg

SEQ ID NO: 164306 - DNA, 20 bp, Artificial Sequence
  Synthetic oligonucleotide; AGG chr2 60507316 60507335 60507332 +
ggggaagggaagggaaggga

SEQ ID NO: 164307 - DNA, 20 bp, Artificial Sequence
  Synthetic oligonucleotide; GGG chr2 60507317 60507336 60507333 +
gggaagggaagggaagggaa

SEQ ID NO: 164308 - DNA, 20 bp, Artificial Sequence
  Synthetic oligonucleotide; AAG chr2 60507320 60507339 60507336 +
aagggaagggaagggaaggg

SEQ ID NO: 164309 - DNA, 20 bp, Artificial Sequence
  Synthetic oligonucleotide; AGG chr2 60507321 60507340 60507337 +
agggaagggaagggaaggga

SEQ ID NO: 164310 - DNA, 20 bp, Artificial Sequence
  Synthetic oligonucleotide; GGG chr2 60507322 60507341 60507338 +
gggaagggaagggaagggaa

SEQ ID NO: 164311 - DNA, 20 bp, Artificial Sequence
  Synthetic oligonucleotide; AAG chr2 60507325 60507344 60507341 +
aagggaagggaagggaaggg

SEQ ID NO: 164312 - DNA, 20 bp, Artificial Sequence
  Synthetic oligonucleotide; AGG chr2 60507326 60507345 60507342 +
agggaagggaagggaaggga

SEQ ID NO: 164313 - DNA, 20 bp, Artificial Sequence
  Synthetic oligonucleotide; GGG chr2 60507327 60507346 60507343 +
gggaagggaagggaagggaa

SEQ ID NO: 164314 - DNA, 20 bp, Artificial Sequence
  Synthetic oligonucleotide; AAG chr2 60507330 60507349 60507346 +
aagggaagggaagggaaggg

SEQ ID NO: 164315 - DNA, 20 bp, Artificial Sequence
  Synthetic oligonucleotide; AGG chr2 60507331 60507350 60507347 +
agggaagggaagggaaggga

SEQ ID NO: 164316 - DNA, 20 bp, Artificial Sequence
  Synthetic oligonucleotide; GGG chr2 60507332 60507351 60507348 +
gggaagggaagggaagggaa

SEQ ID NO: 164317 - DNA, 20 bp, Artificial Sequence
  Synthetic oligonucleotide; AAG chr2 60507335 60507354 60507351 +
aagggaagggaagggaaggg

SEQ ID NO: 164318 - DNA, 20 bp, Artificial Sequence
  Synthetic oligonucleotide; AGG chr2 60507336 60507355 60507352 +
agggaagggaagggaaggga

SEQ ID NO: 164319 - DNA, 20 bp, Artificial Sequence
  Synthetic oligonucleotide; GGG chr2 60507337 60507356 60507353 +
gggaagggaagggaagggaa

SEQ ID NO: 164320 - DNA, 20 bp, Artificial Sequence
  Synthetic oligonucleotide; AAG chr2 60507340 60507359 60507356 +
aagggaagggaagggaaggg

SEQ ID NO: 164321 - DNA, 20 bp, Artificial Sequence
  Synthetic oligonucleotide; AGG chr2 60507341 60507360 60507357 +
agggaagggaagggaaggga

SEQ ID NO: 164322 - DNA, 20 bp, Artificial Sequence
  Synthetic oligonucleotide; GGG chr2 60507342 60507361 60507358 +
gggaagggaagggaagggaa

SEQ ID NO: 164323 - DNA, 20 bp, Artificial Sequence
  Synthetic oligonucleotide; AAG chr2 60507345 60507364 60507361 +
aagggaagggaagggaaggg

SEQ ID NO: 164324 - DNA, 20 bp, Artificial Sequence
  Synthetic oligonucleotide; AGG chr2 60507346 60507365 60507362 +
agggaagggaagggaaggga

SEQ ID NO: 164325 - DNA, 20 bp, Artificial Sequence
  Synthetic oligonucleotide; GGG chr2 60507347 60507366 60507363 +
gggaagggaagggaagggaa

SEQ ID NO: 164326 - DNA, 20 bp, Artificial Sequence
  Synthetic oligonucleotide; AAG chr2 60507350 60507369 60507366 +
aagggaagggaagggaaggg

SEQ ID NO: 164327 - DNA, 20 bp, Artificial Sequence
  Synthetic oligonucleotide; AGG chr2 60507351 60507370 60507367 +
agggaagggaagggaaggga

SEQ ID NO: 164328 - DNA, 20 bp, Artificial Sequence
  Synthetic oligonucleotide; GGG chr2 60507352 60507371 60507368 +
gggaagggaagggaagggaa

SEQ ID NO: 164329 - DNA, 20 bp, Artificial Sequence
  Synthetic oligonucleotide; AAG chr2 60507355 60507374 60507371 +
aagggaagggaagggaaggg

SEQ ID NO: 164330 - DNA, 20 bp, Artificial Sequence
  Synthetic oligonucleotide; AGG chr2 60507356 60507375 60507372 +
agggaagggaagggaaggga

SEQ ID NO: 164331 - DNA, 20 bp, Artificial Sequence
  Synthetic oligonucleotide; GGG chr2 60507357 60507376 60507373 +
gggaagggaagggaagggaa

SEQ ID NO: 164332 - DNA, 20 bp, Artificial Sequence
  Synthetic oligonucleotide; GAG chr2 60507359 60507378 60507375 +
gaagggaagggaagggaagg

SEQ ID NO: 164333 - DNA, 20 bp, Artificial Sequence
  Synthetic oligonucleotide; AGG chr2 60507360 60507379 60507376 +
aagggaagggaagggaaggg

SEQ ID NO: 164334 - DNA, 20 bp, Artificial Sequence
  Synthetic oligonucleotide; GGG chr2 60507361 60507380 60507377 +
agggaagggaagggaaggga

SEQ ID NO: 164335 - DNA, 20 bp, Artificial Sequence
  Synthetic oligonucleotide; GAG chr2 60507363 60507382 60507379 +
ggaagggaagggaagggagg

SEQ ID NO: 164336 - DNA, 20 bp, Artificial Sequence
  Synthetic oligonucleotide; AGG chr2 60507364 60507383 60507380 +
gaagggaagggaagggaggg

SEQ ID NO: 164337 - DNA, 20 bp, Artificial Sequence
  Synthetic oligonucleotide; GGG chr2 60507365 60507384 60507381 +
aagggaagggaagggaggga

SEQ ID NO: 164338 - DNA, 20 bp, Artificial Sequence
  Synthetic oligonucleotide; AAG chr2 60507368 60507387 60507384 +
ggaagggaagggagggaggg

SEQ ID NO: 164339 - DNA, 20 bp, Artificial Sequence
  Synthetic oligonucleotide; AGG chr2 60507369 60507388 60507385 +
gaagggaagggagggaggga

SEQ ID NO: 164340 - DNA, 20 bp, Artificial Sequence
  Synthetic oligonucleotide; GAG chr2 60507371 60507390 60507387 +
agggaagggagggagggaag

SEQ ID NO: 164341 - DNA, 20 bp, Artificial Sequence
  Synthetic oligonucleotide; AGG chr2 60507372 60507391 60507388 +
gggaagggagggagggaagg

SEQ ID NO: 164342 - DNA, 20 bp, Artificial Sequence
  Synthetic oligonucleotide; GGG chr2 60507373 60507392 60507389 +
ggaagggagggagggaagga

SEQ ID NO: 164343 - DNA, 20 bp, Artificial Sequence
  Synthetic oligonucleotide; AAG chr2 60507393 60507412 60507409 +
gggcccttgcctttcttgaa

SEQ ID NO: 164344 - DNA, 20 bp, Artificial Sequence
  Synthetic oligonucleotide; TAG chr2 60507397 60507416 60507413 +
ccttgcctttcttgaaaagc

SEQ ID NO: 164345 - DNA, 20 bp, Artificial Sequence
  Synthetic oligonucleotide; AAG chr2 60507422 60507441 60507438 +
aactgtgtccaaaacctaca

SEQ ID NO: 164346 - DNA, 20 bp, Artificial Sequence
  Synthetic oligonucleotide; AAG chr2 60507448 60507467 60507464 +
attgtgctcttgttgacttg

SEQ ID NO: 164347 - DNA, 20 bp, Artificial Sequence
  Synthetic oligonucleotide; AAG chr2 60507463 60507482 60507479 +
acttgaagctgcttccgttc

SEQ ID NO: 164348 - DNA, 20 bp, Artificial Sequence
  Synthetic oligonucleotide; CAG chr2 60507467 60507486 60507483 +
gaagctgcttccgttcaagc

SEQ ID NO: 164349 - DNA, 20 bp, Artificial Sequence
  Synthetic oligonucleotide; AAG chr2 60507472 60507491 60507488 +
tgcttccgttcaagccagaa

SEQ ID NO: 164350 - DNA, 20 bp, Artificial Sequence
  Synthetic oligonucleotide; AAG chr2 60507488 60507507 60507504 +
agaaaagttaaaaccttgtg

SEQ ID NO: 164351 - DNA, 20 bp, Artificial Sequence
  Synthetic oligonucleotide; CAG chr2 60507505 60507524 60507521 +
gtgaagtgcttttacatttt

SEQ ID NO: 164352 - DNA, 20 bp, Artificial Sequence
  Synthetic oligonucleotide; TGG chr2 60507514 60507533 60507530 +
ttttacattttcagatgttt

SEQ ID NO: 164353 - DNA, 20 bp, Artificial Sequence
  Synthetic oligonucleotide; GAG chr2 60507516 60507535 60507532 +
ttacattttcagatgttttg

SEQ ID NO: 164354 - DNA, 20 bp, Artificial Sequence
  Synthetic oligonucleotide; AAG chr2 60507525 60507544 60507541 +
cagatgttttggagtctctc

SEQ ID NO: 164355 - DNA, 20 bp, Artificial Sequence
  Synthetic oligonucleotide; GAG chr2 60507532 60507551 60507548 +
tttggagtctctcaagaaat

SEQ ID NO: 164356 - DNA, 20 bp, Artificial Sequence
  Synthetic oligonucleotide; AGG chr2 60507533 60507552 60507549 +
ttggagtctctcaagaaatg

SEQ ID NO: 164357 - DNA, 20 bp, Artificial Sequence
  Synthetic oligonucleotide; CAG chr2 60507537 60507556 60507553 +
agtctctcaagaaatgagga

SEQ ID NO: 164358 - DNA, 20 bp, Artificial Sequence
  Synthetic oligonucleotide; AGG chr2 60507538 60507557 60507554 +
gtctctcaagaaatgaggac

SEQ ID NO: 164359 - DNA, 20 bp, Artificial Sequence
  Synthetic oligonucleotide; AAG chr2 60507542 60507561 60507558 +
ctcaagaaatgaggacaggc

SEQ ID NO: 164360 - DNA, 20 bp, Artificial Sequence
  Synthetic oligonucleotide; AGG chr2 60507543 60507562 60507559 +
tcaagaaatgaggacaggca

SEQ ID NO: 164361 - DNA, 20 bp, Artificial Sequence
  Synthetic oligonucleotide; GGG chr2 60507544 60507563 60507560 +
caagaaatgaggacaggcaa

SEQ ID NO: 164362 - DNA, 20 bp, Artificial Sequence
  Synthetic oligonucleotide; GGG chr2 60507545 60507564 60507561 +
aagaaatgaggacaggcaag

SEQ ID NO: 164363 - DNA, 20 bp, Artificial Sequence
  Synthetic oligonucleotide; AAG chr2 60507548 60507567 60507564 +
aaatgaggacaggcaagggg

SEQ ID NO: 164364 - DNA, 20 bp, Artificial Sequence
  Synthetic oligonucleotide; CAG chr2 60507566 60507585 60507582 +
ggaagaactgtttccacatg

SEQ ID NO: 164365 - DNA, 20 bp, Artificial Sequence
  Synthetic oligonucleotide; CAG chr2 60507578 60507597 60507594 +
tccacatgcagctgtttcaa

SEQ ID NO: 164366 - DNA, 20 bp, Artificial Sequence
  Synthetic oligonucleotide; CAG chr2 60507593 60507612 60507609 +
ttcaacagctcactgcataa

SEQ ID NO: 164367 - DNA, 20 bp, Artificial Sequence
  Synthetic oligonucleotide; GAG chr2 60507595 60507614 60507611 +
caacagctcactgcataaca

SEQ ID NO: 164368 - DNA, 20 bp, Artificial Sequence
  Synthetic oligonucleotide; CAG chr2 60507607 60507626 60507623 +
gcataacagagtctcttaca

SEQ ID NO: 164369 - DNA, 20 bp, Artificial Sequence
  Synthetic oligonucleotide; AGG chr2 60507608 60507627 60507624 +
cataacagagtctcttacac

SEQ ID NO: 164370 - DNA, 20 bp, Artificial Sequence
  Synthetic oligonucleotide; GGG chr2 60507609 60507628 60507625 +
ataacagagtctcttacaca

SEQ ID NO: 164371 - DNA, 20 bp, Artificial Sequence
  Synthetic oligonucleotide; GAG chr2 60507626 60507645 60507642 +
acagggctgcctccgcacct

SEQ ID NO: 164372 - DNA, 20 bp, Artificial Sequence
  Synthetic oligonucleotide; GAG chr2 60507631 60507650 60507647 +
gctgcctccgcacctgagct

SEQ ID NO: 164373 - DNA, 20 bp, Artificial Sequence
  Synthetic oligonucleotide; AAG chr2 60507645 60507664 60507661 +
tgagctgagcttgctgtcct

SEQ ID NO: 164374 - DNA, 20 bp, Artificial Sequence
  Synthetic oligonucleotide; CGG chr2 60507649 60507668 60507665 +
ctgagcttgctgtcctaagt

SEQ ID NO: 164375 - DNA, 20 bp, Artificial Sequence
  Synthetic oligonucleotide; AAG chr2 60507663 60507682 60507679 +
ctaagtcggctactgcttct

SEQ ID NO: 164376 - DNA, 20 bp, Artificial Sequence
  Synthetic oligonucleotide; CAG chr2 60507670 60507689 60507686 +
ggctactgcttctaagtccc

SEQ ID NO: 164377 - DNA, 20 bp, Artificial Sequence
  Synthetic oligonucleotide; AAG chr2 60507680 60507699 60507696 +
tctaagtccccagcttttct

SEQ ID NO: 164378 - DNA, 20 bp, Artificial Sequence
  Synthetic oligonucleotide; TGG chr2 60507688 60507707 60507704 +
cccagcttttctaagacata

SEQ ID NO: 164379 - DNA, 20 bp, Artificial Sequence
  Synthetic oligonucleotide; CAG chr2 60507691 60507710 60507707 +
agcttttctaagacatatgg

SEQ ID NO: 164380 - DNA, 20 bp, Artificial Sequence
  Synthetic oligonucleotide; TGG chr2 60507699 60507718 60507715 +
taagacatatggcagaaatg

SEQ ID NO: 164381 - DNA, 20 bp, Artificial Sequence
  Synthetic oligonucleotide; CAG chr2 60507717 60507736 60507733 +
tgtggaaattgtcttccaaa

SEQ ID NO: 164382 - DNA, 20 bp, Artificial Sequence
  Synthetic oligonucleotide; AAG chr2 60507723 60507742 60507739 +
aattgtcttccaaacagcac

SEQ ID NO: 164383 - DNA, 20 bp, Artificial Sequence
  Synthetic oligonucleotide; CAG chr2 60507727 60507746 60507743 +
gtcttccaaacagcacaaga

SEQ ID NO: 164384 - DNA, 20 bp, Artificial Sequence
  Synthetic oligonucleotide; AAG chr2 60507731 60507750 60507747 +
tccaaacagcacaagacaga

SEQ ID NO: 164385 - DNA, 20 bp, Artificial Sequence
  Synthetic oligonucleotide; CGG chr2 60507734 60507753 60507750 +
aaacagcacaagacagaaag

SEQ ID NO: 164386 - DNA, 20 bp, Artificial Sequence
  Synthetic oligonucleotide; GGG chr2 60507735 60507754 60507751 +
aacagcacaagacagaaagc

SEQ ID NO: 164387 - DNA, 20 bp, Artificial Sequence
  Synthetic oligonucleotide; TGG chr2 60507738 60507757 60507754 +
agcacaagacagaaagcggg

SEQ ID NO: 164388 - DNA, 20 bp, Artificial Sequence
  Synthetic oligonucleotide; GGG chr2 60507739 60507758 60507755 +
gcacaagacagaaagcgggt

SEQ ID NO: 164389 - DNA, 20 bp, Artificial Sequence
  Synthetic oligonucleotide; GGG chr2 60507740 60507759 60507756 +
cacaagacagaaagcgggtg

SEQ ID NO: 164390 - DNA, 20 bp, Artificial Sequence
  Synthetic oligonucleotide; TGG chr2 60507743 60507762 60507759 +
aagacagaaagcgggtgggg

SEQ ID NO: 164391 - DNA, 20 bp, Artificial Sequence
  Synthetic oligonucleotide; GGG chr2 60507744 60507763 60507760 +
agacagaaagcgggtggggt

SEQ ID NO: 164392 - DNA, 20 bp, Artificial Sequence
  Synthetic oligonucleotide; GGG chr2 60507745 60507764 60507761 +
gacagaaagcgggtggggtg

SEQ ID NO: 164393 - DNA, 20 bp, Artificial Sequence
  Synthetic oligonucleotide; GGG chr2 60507746 60507765 60507762 +
acagaaagcgggtggggtgg

SEQ ID NO: 164394 - DNA, 20 bp, Artificial Sequence
  Synthetic oligonucleotide; GGG chr2 60507747 60507766 60507763 +
cagaaagcgggtggggtggg

SEQ ID NO: 164395 - DNA, 20 bp, Artificial Sequence
  Synthetic oligonucleotide; CGG chr2 60507753 60507772 60507769 +
gcgggtggggtggggggcga

SEQ ID NO: 164396 - DNA, 20 bp, Artificial Sequence
  Synthetic oligonucleotide; GGG chr2 60507754 60507773 60507770 +
cgggtggggtggggggcgac

SEQ ID NO: 164397 - DNA, 20 bp, Artificial Sequence
  Synthetic oligonucleotide; CGG chr2 60507759 60507778 60507775 +
ggggtggggggcgacgggtg

SEQ ID NO: 164398 - DNA, 20 bp, Artificial Sequence
  Synthetic oligonucleotide; GGG chr2 60507760 60507779 60507776 +
gggtggggggcgacgggtgc

SEQ ID NO: 164399 - DNA, 20 bp, Artificial Sequence
  Synthetic oligonucleotide; GGG chr2 60507761 60507780 60507777 +
ggtggggggcgacgggtgcg

SEQ ID NO: 164400 - DNA, 20 bp, Artificial Sequence
  Synthetic oligonucleotide; GAG chr2 60507763 60507782 60507779 +
tggggggcgacgggtgcggg

SEQ ID NO: 164401 - DNA, 20 bp, Artificial Sequence
  Synthetic oligonucleotide; AAG chr2 60507766 60507785 60507782 +
ggggcgacgggtgcggggag

SEQ ID NO: 164402 - DNA, 20 bp, Artificial Sequence
  Synthetic oligonucleotide; AGG chr2 60507767 60507786 60507783 +
gggcgacgggtgcggggaga

SEQ ID NO: 164403 - DNA, 20 bp, Artificial Sequence
  Synthetic oligonucleotide; GGG chr2 60507768 60507787 60507784 +
ggcgacgggtgcggggagaa

SEQ ID NO: 164404 - DNA, 20 bp, Artificial Sequence
  Synthetic oligonucleotide; AAG chr2 60507771 60507790 60507787 +
gacgggtgcggggagaaggg

SEQ ID NO: 164405 - DNA, 20 bp, Artificial Sequence
  Synthetic oligonucleotide; AAG chr2 60507774 60507793 60507790 +
gggtgcggggagaagggaag

SEQ ID NO: 164406 - DNA, 20 bp, Artificial Sequence
  Synthetic oligonucleotide; AAG chr2 60507784 60507803 60507800 +
agaagggaagaagtaaaaac

SEQ ID NO: 164407 - DNA, 20 bp, Artificial Sequence
  Synthetic oligonucleotide; CAG chr2 60507803 60507822 60507819 +
caagctgttgaaactgtata

SEQ ID NO: 164408 - DNA, 20 bp, Artificial Sequence
  Synthetic oligonucleotide; AGG chr2 60507804 60507823 60507820 +
aagctgttgaaactgtatac

SEQ ID NO: 164409 - DNA, 20 bp, Artificial Sequence
  Synthetic oligonucleotide; CAG chr2 60507818 60507837 60507834 +
gtatacaggacacgtcttca

SEQ ID NO: 164410 - DNA, 20 bp, Artificial Sequence
  Synthetic oligonucleotide; AAG chr2 60507842 60507861 60507858 +
aatccaatgctcctgtaaca

SEQ ID NO: 164411 - DNA, 20 bp, Artificial Sequence
  Synthetic oligonucleotide; AGG chr2 60507843 60507862 60507859 +
atccaatgctcctgtaacaa

SEQ ID NO: 164412 - DNA, 20 bp, Artificial Sequence
  Synthetic oligonucleotide; CAG chr2 60507847 60507866 60507863 +
aatgctcctgtaacaaagga

SEQ ID NO: 164413 - DNA, 20 bp, Artificial Sequence
  Synthetic oligonucleotide; TGG chr2 60507857 60507876 60507873 +
taacaaaggacagcatacta

SEQ ID NO: 164414 - DNA, 20 bp, Artificial Sequence
  Synthetic oligonucleotide; GGG chr2 60507858 60507877 60507874 +
aacaaaggacagcatactat

SEQ ID NO: 164415 - DNA, 20 bp, Artificial Sequence
  Synthetic oligonucleotide; TGG chr2 60507871 60507890 60507887 +
atactatgggataattacta

SEQ ID NO: 164416 - DNA, 20 bp, Artificial Sequence
  Synthetic oligonucleotide; CAG chr2 60507884 60507903 60507900 +
attactatggattattatta

SEQ ID NO: 164417 - DNA, 20 bp, Artificial Sequence
  Synthetic oligonucleotide; AAG chr2 60507893 60507912 60507909 +
gattattattacagtttcta

SEQ ID NO: 164418 - DNA, 20 bp, Artificial Sequence
  Synthetic oligonucleotide; AAG chr2 60507899 60507918 60507915 +
tattacagtttctaaagcaa

SEQ ID NO: 164419 - DNA, 20 bp, Artificial Sequence
  Synthetic oligonucleotide; AAG chr2 60507921 60507940 60507937 +
gaacaaaaaaaaattcacaa

SEQ ID NO: 164420 - DNA, 20 bp, Artificial Sequence
  Synthetic oligonucleotide; CAG chr2 60507938 60507957 60507954 +
caaaagacatattacacacg

SEQ ID NO: 164421 - DNA, 20 bp, Artificial Sequence
  Synthetic oligonucleotide; AAG chr2 60507948 60507967 60507964 +
attacacacgcagatttcta

SEQ ID NO: 164422 - DNA, 20 bp, Artificial Sequence
  Synthetic oligonucleotide; TGG chr2 60507964 60507983 60507980 +
tctaaagctttaaaatcata

SEQ ID NO: 164423 - DNA, 20 bp, Artificial Sequence
  Synthetic oligonucleotide; CGG chr2 60507971 60507990 60507987 +
ctttaaaatcatatggtctt

SEQ ID NO: 164424 - DNA, 20 bp, Artificial Sequence
  Synthetic oligonucleotide; TGG chr2 60507977 60507996 60507993 +
aatcatatggtcttcggtgt

SEQ ID NO: 164425 - DNA, 20 bp, Artificial Sequence
  Synthetic oligonucleotide; TGG chr2 60507986 60508005 60508002 +
gtcttcggtgttggttccta

SEQ ID NO: 164426 - DNA, 20 bp, Artificial Sequence
  Synthetic oligonucleotide; GGG chr2 60507987 60508006 60508003 +
tcttcggtgttggttcctat

SEQ ID NO: 164427 - DNA, 20 bp, Artificial Sequence
  Synthetic oligonucleotide; GGG chr2 60507988 60508007 60508004 +
cttcggtgttggttcctatg

SEQ ID NO: 164428 - DNA, 20 bp, Artificial Sequence
  Synthetic oligonucleotide; CGG chr2 60507994 60508013 60508010 +
tgttggttcctatggggtta

SEQ ID NO: 164429 - DNA, 20 bp, Artificial Sequence
  Synthetic oligonucleotide; GAG chr2 60508011 60508030 60508027 +
ttacggataatgccctaact

SEQ ID NO: 164430 - DNA, 20 bp, Artificial Sequence
  Synthetic oligonucleotide; CAG chr2 60508019 60508038 60508035 +
aatgccctaactgagcacga

SEQ ID NO: 164431 - DNA, 20 bp, Artificial Sequence
  Synthetic oligonucleotide; AAG chr2 60508036 60508055 60508052 +
cgacagatgcaaacacaaaa

SEQ ID NO: 164432 - DNA, 20 bp, Artificial Sequence
  Synthetic oligonucleotide; TGG chr2 60508072 60508091 60508088 +
cctgaaattctctcatgtca

SEQ ID NO: 164433 - DNA, 20 bp, Artificial Sequence
  Synthetic oligonucleotide; AAG chr2 60508103 60508122 60508119 +
gccctttctttcacaaacaa

SEQ ID NO: 164434 - DNA, 20 bp, Artificial Sequence
  Synthetic oligonucleotide; TAG chr2 60508106 60508125 60508122 +
ctttctttcacaaacaaaag

SEQ ID NO: 164435 - DNA, 20 bp, Artificial Sequence
  Synthetic oligonucleotide; GAG chr2 60508111 60508130 60508127 +
tttcacaaacaaaagtagtt

SEQ ID NO: 164436 - DNA, 20 bp, Artificial Sequence
  Synthetic oligonucleotide; CAG chr2 60508117 60508136 60508133 +
aaacaaaagtagttgagcaa

SEQ ID NO: 164437 - DNA, 20 bp, Artificial Sequence
  Synthetic oligonucleotide; AAG chr2 60508122 60508141 60508138 +
aaagtagttgagcaacagct

SEQ ID NO: 164438 - DNA, 20 bp, Artificial Sequence
  Synthetic oligonucleotide; TAG chr2 60508125 60508144 60508141 +
gtagttgagcaacagctaag

SEQ ID NO: 164439 - DNA, 20 bp, Artificial Sequence
  Synthetic oligonucleotide; AAG chr2 60508140 60508159 60508156 +
ctaagtagttattcatctca

SEQ ID NO: 164440 - DNA, 20 bp, Artificial Sequence
  Synthetic oligonucleotide; CAG chr2 60508162 60508181 60508178 +
gaaccaacctaaaattctga

SEQ ID NO: 164441 - DNA, 20 bp, Artificial Sequence
  Synthetic oligonucleotide; AGG chr2 60508163 60508182 60508179 +
aaccaacctaaaattctgac

SEQ ID NO: 164442 - DNA, 20 bp, Artificial Sequence
  Synthetic oligonucleotide; CAG chr2 60508168 60508187 60508184 +
acctaaaattctgacaggcc

SEQ ID NO: 164443 - DNA, 20 bp, Artificial Sequence
  Synthetic oligonucleotide; TAG chr2 60508229 60508248 60508245 +
caaattacacaaataaaaac

SEQ ID NO: 164444 - DNA, 20 bp, Artificial Sequence
  Synthetic oligonucleotide; AGG chr2 60508230 60508249 60508246 +
aaattacacaaataaaaact

SEQ ID NO: 164445 - DNA, 20 bp, Artificial Sequence
  Synthetic oligonucleotide; GAG chr2 60508232 60508251 60508248 +
attacacaaataaaaactag

SEQ ID NO: 164446 - DNA, 20 bp, Artificial Sequence
  Synthetic oligonucleotide; AGG chr2 60508233 60508252 60508249 +
ttacacaaataaaaactagg

SEQ ID NO: 164447 - DNA, 20 bp, Artificial Sequence
  Synthetic oligonucleotide; AAG chr2 60508236 60508255 60508252 +
cacaaataaaaactaggagg

SEQ ID NO: 164448 - DNA, 20 bp, Artificial Sequence
  Synthetic oligonucleotide; TGG chr2 60508257 60508276 60508273 +
agctcaaactcatccacact

SEQ ID NO: 164449 - DNA, 20 bp, Artificial Sequence
  Synthetic oligonucleotide; CAG chr2 60508262 60508281 60508278 +
aaactcatccacacttggtt

SEQ ID NO: 164450 - DNA, 20 bp, Artificial Sequence
  Synthetic oligonucleotide; AGG chr2 60508263 60508282 60508279 +
aactcatccacacttggttc

SEQ ID NO: 164451 - DNA, 20 bp, Artificial Sequence
  Synthetic oligonucleotide; CAG chr2 60508269 60508288 60508285 +
tccacacttggttcaggaca

SEQ ID NO: 164452 - DNA, 20 bp, Artificial Sequence
  Synthetic oligonucleotide; AGG chr2 60508270 60508289 60508286 +
ccacacttggttcaggacac

SEQ ID NO: 164453 - DNA, 20 bp, Artificial Sequence
  Synthetic oligonucleotide; GGG chr2 60508271 60508290 60508287 +
cacacttggttcaggacaca

SEQ ID NO: 164454 - DNA, 20 bp, Artificial Sequence
  Synthetic oligonucleotide; AAG chr2 60508274 60508293 60508290 +
acttggttcaggacacaggg

SEQ ID NO: 164455 - DNA, 20 bp, Artificial Sequence
  Synthetic oligonucleotide; AGG chr2 60508275 60508294 60508291 +
cttggttcaggacacaggga

SEQ ID NO: 164456 - DNA, 20 bp, Artificial Sequence
  Synthetic oligonucleotide; AAG chr2 60508288 60508307 60508304 +
acagggaaggcctgatgtga

SEQ ID NO: 164457 - DNA, 20 bp, Artificial Sequence
  Synthetic oligonucleotide; GAG chr2 60508290 60508309 60508306 +
agggaaggcctgatgtgaaa

SEQ ID NO: 164458 - DNA, 20 bp, Artificial Sequence
  Synthetic oligonucleotide; AGG chr2 60508291 60508310 60508307 +
gggaaggcctgatgtgaaag

SEQ ID NO: 164459 - DNA, 20 bp, Artificial Sequence
  Synthetic oligonucleotide; GAG chr2 60508293 60508312 60508309 +
gaaggcctgatgtgaaagag

SEQ ID NO: 164460 - DNA, 20 bp, Artificial Sequence
  Synthetic oligonucleotide; CAG chr2 60508297 60508316 60508313 +
gcctgatgtgaaagaggaga

SEQ ID NO: 164461 - DNA, 20 bp, Artificial Sequence
  Synthetic oligonucleotide; GAG chr2 60508299 60508318 60508315 +
ctgatgtgaaagaggagaca

SEQ ID NO: 164462 - DNA, 20 bp, Artificial Sequence
  Synthetic oligonucleotide; AAG chr2 60508302 60508321 60508318 +
atgtgaaagaggagacagag

SEQ ID NO: 164463 - DNA, 20 bp, Artificial Sequence
  Synthetic oligonucleotide; TGG chr2 60508310 60508329 60508326 +
gaggagacagagaagcttcc

SEQ ID NO: 164464 - DNA, 20 bp, Artificial Sequence
  Synthetic oligonucleotide; GGG chr2 60508311 60508330 60508327 +
aggagacagagaagcttcct

SEQ ID NO: 164465 - DNA, 20 bp, Artificial Sequence
  Synthetic oligonucleotide; CAG chr2 60508318 60508337 60508334 +
agagaagcttcctgggtgtg

SEQ ID NO: 164466 - DNA, 20 bp, Artificial Sequence
  Synthetic oligonucleotide; CAG chr2 60508331 60508350 60508347 +
gggtgtgcagaattacaccc

SEQ ID NO: 164467 - DNA, 20 bp, Artificial Sequence
  Synthetic oligonucleotide; AGG chr2 60508332 60508351 60508348 +
ggtgtgcagaattacacccc

SEQ ID NO: 164468 - DNA, 20 bp, Artificial Sequence
  Synthetic oligonucleotide; CAG chr2 60508347 60508366 60508363 +
accccaggccacactccctg

SEQ ID NO: 164469 - DNA, 20 bp, Artificial Sequence
  Synthetic oligonucleotide; AGG chr2 60508348 60508367 60508364 +
ccccaggccacactccctgc

SEQ ID NO: 164470 - DNA, 20 bp, Artificial Sequence
  Synthetic oligonucleotide; GGG chr2 60508349 60508368 60508365 +
cccaggccacactccctgca

SEQ ID NO: 164471 - DNA, 20 bp, Artificial Sequence
  Synthetic oligonucleotide; GGG chr2 60508350 60508369 60508366 +
ccaggccacactccctgcag

SEQ ID NO: 164472 - DNA, 20 bp, Artificial Sequence
  Synthetic oligonucleotide; CAG chr2 60508356 60508375 60508372 +
cacactccctgcaggggcca

SEQ ID NO: 164473 - DNA, 20 bp, Artificial Sequence
  Synthetic oligonucleotide; AGG chr2 60508357 60508376 60508373 +
acactccctgcaggggccac

SEQ ID NO: 164474 - DNA, 20 bp, Artificial Sequence
  Synthetic oligonucleotide; GAG chr2 60508359 60508378 60508375 +
actccctgcaggggccacag

SEQ ID NO: 164475 - DNA, 20 bp, Artificial Sequence
  Synthetic oligonucleotide; AAG chr2 60508363 60508382 60508379 +
cctgcaggggccacaggagc

SEQ ID NO: 164476 - DNA, 20 bp, Artificial Sequence
  Synthetic oligonucleotide; CAG chr2 60508371 60508390 60508387 +
ggccacaggagcaagcactg

SEQ ID NO: 164477 - DNA, 20 bp, Artificial Sequence
  Synthetic oligonucleotide; CGG chr2 60508375 60508394 60508391 +
acaggagcaagcactgcagc

SEQ ID NO: 164478 - DNA, 20 bp, Artificial Sequence
  Synthetic oligonucleotide; GGG chr2 60508376 60508395 60508392 +
caggagcaagcactgcagcc

SEQ ID NO: 164479 - DNA, 20 bp, Artificial Sequence
  Synthetic oligonucleotide; GAG chr2 60508384 60508403 60508400 +
agcactgcagccgggtccct

SEQ ID NO: 164480 - DNA, 20 bp, Artificial Sequence
  Synthetic oligonucleotide; CAG chr2 60508404 60508423 60508420 +
gagtctgacttttacccaaa

SEQ ID NO: 164481 - DNA, 20 bp, Artificial Sequence
  Synthetic oligonucleotide; AGG chr2 60508405 60508424 60508421 +
agtctgacttttacccaaac

SEQ ID NO: 164482 - DNA, 20 bp, Artificial Sequence
  Synthetic oligonucleotide; GGG chr2 60508406 60508425 60508422 +
gtctgacttttacccaaaca

SEQ ID NO: 164483 - DNA, 20 bp, Artificial Sequence
  Synthetic oligonucleotide; GGG chr2 60508407 60508426 60508423 +
tctgacttttacccaaacag

SEQ ID NO: 164484 - DNA, 20 bp, Artificial Sequence
  Synthetic oligonucleotide; GGG chr2 60508408 60508427 60508424 +
ctgacttttacccaaacagg

SEQ ID NO: 164485 - DNA, 20 bp, Artificial Sequence
  Synthetic oligonucleotide; CAG chr2 60508415 60508434 60508431 +
ttacccaaacagggggttgc

SEQ ID NO: 164486 - DNA, 20 bp, Artificial Sequence
  Synthetic oligonucleotide; GAG chr2 60508425 60508444 60508441 +
agggggttgccagttgctgc

SEQ ID NO: 164487 - DNA, 20 bp, Artificial Sequence
  Synthetic oligonucleotide; TAG chr2 60508439 60508458 60508455 +
tgctgcgagacaaatatccc

SEQ ID NO: 164488 - DNA, 20 bp, Artificial Sequence
  Synthetic oligonucleotide; TAG chr2 60508451 60508470 60508467 +
aatatccctagcacattacc

SEQ ID NO: 164489 - DNA, 20 bp, Artificial Sequence
  Synthetic oligonucleotide; TGG chr2 60508455 60508474 60508471 +
tccctagcacattacctagt

SEQ ID NO: 164490 - DNA, 20 bp, Artificial Sequence
  Synthetic oligonucleotide; AAG chr2 60508460 60508479 60508476 +
agcacattacctagttggca

SEQ ID NO: 164491 - DNA, 20 bp, Artificial Sequence
  Synthetic oligonucleotide; AGG chr2 60508461 60508480 60508477 +
gcacattacctagttggcaa

SEQ ID NO: 164492 - DNA, 20 bp, Artificial Sequence
  Synthetic oligonucleotide; TGG chr2 60508472 60508491 60508488 +
agttggcaaaggaatgcaac

SEQ ID NO: 164493 - DNA, 20 bp, Artificial Sequence
  Synthetic oligonucleotide; GGG chr2 60508473 60508492 60508489 +
gttggcaaaggaatgcaact

SEQ ID NO: 164494 - DNA, 20 bp, Artificial Sequence
  Synthetic oligonucleotide; GAG chr2 60508475 60508494 60508491 +
tggcaaaggaatgcaactgg

SEQ ID NO: 164495 - DNA, 20 bp, Artificial Sequence
  Synthetic oligonucleotide; AGG chr2 60508476 60508495 60508492 +
ggcaaaggaatgcaactggg

SEQ ID NO: 164496 - DNA, 20 bp, Artificial Sequence
  Synthetic oligonucleotide; TGG chr2 60508482 60508501 60508498 +
ggaatgcaactgggaggttc

SEQ ID NO: 164497 - DNA, 20 bp, Artificial Sequence
  Synthetic oligonucleotide; TAG chr2 60508487 60508506 60508503 +
gcaactgggaggttctggaa

SEQ ID NO: 164498 - DNA, 20 bp, Artificial Sequence
  Synthetic oligonucleotide; CAG chr2 60508492 60508511 60508508 +
tgggaggttctggaatagca

SEQ ID NO: 164499 - DNA, 20 bp, Artificial Sequence
  Synthetic oligonucleotide; TGG chr2 60508497 60508516 60508513 +
ggttctggaatagcacagtg

SEQ ID NO: 164500 - DNA, 20 bp, Artificial Sequence
  Synthetic oligonucleotide; TGG chr2 60508508 60508527 60508524 +
agcacagtgtggaactgcac

SEQ ID NO: 164501 - DNA, 20 bp, Artificial Sequence
  Synthetic oligonucleotide; AAG chr2 60508526 60508545 60508542 +
actggacttttcctgttctg

SEQ ID NO: 164502 - DNA, 20 bp, Artificial Sequence
  Synthetic oligonucleotide; GAG chr2 60508528 60508547 60508544 +
tggacttttcctgttctgaa

SEQ ID NO: 164503 - DNA, 20 bp, Artificial Sequence
  Synthetic oligonucleotide; AGG chr2 60508529 60508548 60508545 +
ggacttttcctgttctgaag

SEQ ID NO: 164504 - DNA, 20 bp, Artificial Sequence
  Synthetic oligonucleotide; CGG chr2 60508546 60508565 60508562 +
aagaggactttgctttcctc

SEQ ID NO: 164505 - DNA, 20 bp, Artificial Sequence
  Synthetic oligonucleotide; GGG chr2 60508547 60508566 60508563 +
agaggactttgctttcctcc

SEQ ID NO: 164506 - DNA, 20 bp, Artificial Sequence
  Synthetic oligonucleotide; AAG chr2 60508555 60508574 60508571 +
ttgctttcctccgggatgta

SEQ ID NO: 164507 - DNA, 20 bp, Artificial Sequence
  Synthetic oligonucleotide; TGG chr2 60508562 60508581 60508578 +
cctccgggatgtaaagcatt

SEQ ID NO: 164508 - DNA, 20 bp, Artificial Sequence
  Synthetic oligonucleotide; CAG chr2 60508565 60508584 60508581 +
ccgggatgtaaagcatttgg

SEQ ID NO: 164509 - DNA, 20 bp, Artificial Sequence
  Synthetic oligonucleotide; AGG chr2 60508566 60508585 60508582 +
cgggatgtaaagcatttggc

SEQ ID NO: 164510 - DNA, 20 bp, Artificial Sequence
  Synthetic oligonucleotide; AAG chr2 60508571 60508590 60508587 +
tgtaaagcatttggcaggca

SEQ ID NO: 164511 - DNA, 20 bp, Artificial Sequence
  Synthetic oligonucleotide; AGG chr2 60508572 60508591 60508588 +
gtaaagcatttggcaggcaa

SEQ ID NO: 164512 - DNA, 20 bp, Artificial Sequence
  Synthetic oligonucleotide; CAG chr2 60508588 60508607 60508604 +
gcaaaggacaaaacttacct

SEQ ID NO: 164513 - DNA, 20 bp, Artificial Sequence
  Synthetic oligonucleotide; AGG chr2 60508589 60508608 60508605 +
caaaggacaaaacttacctc

SEQ ID NO: 164514 - DNA, 20 bp, Artificial Sequence
  Synthetic oligonucleotide; TGG chr2 60508597 60508616 60508613 +
aaaacttacctcaggtacta

SEQ ID NO: 164515 - DNA, 20 bp, Artificial Sequence
  Synthetic oligonucleotide; TGG chr2 60508605 60508624 60508621 +
cctcaggtactatggcaaac

SEQ ID NO: 164516 - DNA, 20 bp, Artificial Sequence
  Synthetic oligonucleotide; AAG chr2 60508611 60508630 60508627 +
gtactatggcaaactggcca

SEQ ID NO: 164517 - DNA, 20 bp, Artificial Sequence
  Synthetic oligonucleotide; GAG chr2 60508613 60508632 60508629 +
actatggcaaactggccaaa

SEQ ID NO: 164518 - DNA, 20 bp, Artificial Sequence
  Synthetic oligonucleotide; AAG chr2 60508616 60508635 60508632 +
atggcaaactggccaaagag

SEQ ID NO: 164519 - DNA, 20 bp, Artificial Sequence
  Synthetic oligonucleotide; TAG chr2 60508625 60508644 60508641 +
tggccaaagagaagcgttgc

SEQ ID NO: 164520 - DNA, 20 bp, Artificial Sequence
  Synthetic oligonucleotide; AGG chr2 60508626 60508645 60508642 +
ggccaaagagaagcgttgct

SEQ ID NO: 164521 - DNA, 20 bp, Artificial Sequence
  Synthetic oligonucleotide; GAG chr2 60508628 60508647 60508644 +
ccaaagagaagcgttgctag

SEQ ID NO: 164522 - DNA, 20 bp, Artificial Sequence
  Synthetic oligonucleotide; TGG chr2 60508633 60508652 60508649 +
gagaagcgttgctaggagaa

SEQ ID NO: 164523 - DNA, 20 bp, Artificial Sequence
  Synthetic oligonucleotide; CGG chr2 60508639 60508658 60508655 +
cgttgctaggagaatggaca

SEQ ID NO: 164524 - DNA, 20 bp, Artificial Sequence
  Synthetic oligonucleotide; CAG chr2 60508642 60508661 60508658 +
tgctaggagaatggacacgg

SEQ ID NO: 164525 - DNA, 20 bp, Artificial Sequence
  Synthetic oligonucleotide; AGG chr2 60508643 60508662 60508659 +
gctaggagaatggacacggc

SEQ ID NO: 164526 - DNA, 20 bp, Artificial Sequence
  Synthetic oligonucleotide; CAG chr2 60508649 60508668 60508665 +
agaatggacacggcaggaaa

SEQ ID NO: 164527 - DNA, 20 bp, Artificial Sequence
  Synthetic oligonucleotide; CAG chr2 60508655 60508674 60508671 +
gacacggcaggaaacagcct

SEQ ID NO: 164528 - DNA, 20 bp, Artificial Sequence
  Synthetic oligonucleotide; TGG chr2 60508660 60508679 60508676 +
ggcaggaaacagcctcagct

SEQ ID NO: 164529 - DNA, 20 bp, Artificial Sequence
  Synthetic oligonucleotide; CAG chr2 60508665 60508684 60508681 +
gaaacagcctcagcttggcc

SEQ ID NO: 164530 - DNA, 20 bp, Artificial Sequence
  Synthetic oligonucleotide; AGG chr2 60508666 60508685 60508682 +
aaacagcctcagcttggccc

SEQ ID NO: 164531 - DNA, 20 bp, Artificial Sequence
  Synthetic oligonucleotide; AAG chr2 60508669 60508688 60508685 +
cagcctcagcttggcccagg

SEQ ID NO: 164532 - DNA, 20 bp, Artificial Sequence
  Synthetic oligonucleotide; AAG chr2 60508672 60508691 60508688 +
cctcagcttggcccaggaag

SEQ ID NO: 164533 - DNA, 20 bp, Artificial Sequence
  Synthetic oligonucleotide; TGG chr2 60508676 60508695 60508692 +
agcttggcccaggaagaagc

SEQ ID NO: 164534 - DNA, 20 bp, Artificial Sequence
  Synthetic oligonucleotide; CAG chr2 60508683 60508702 60508699 +
cccaggaagaagctggcgct

SEQ ID NO: 164535 - DNA, 20 bp, Artificial Sequence
  Synthetic oligonucleotide; CAG chr2 60508689 60508708 60508705 +
aagaagctggcgctcagcta

SEQ ID NO: 164536 - DNA, 20 bp, Artificial Sequence
  Synthetic oligonucleotide; AGG chr2 60508690 60508709 60508706 +
agaagctggcgctcagctac

SEQ ID NO: 164537 - DNA, 20 bp, Artificial Sequence
  Synthetic oligonucleotide; GGG chr2 60508691 60508710 60508707 +
gaagctggcgctcagctaca

SEQ ID NO: 164538 - DNA, 20 bp, Artificial Sequence
  Synthetic oligonucleotide; GGG chr2 60508692 60508711 60508708 +
aagctggcgctcagctacag

SEQ ID NO: 164539 - DNA, 20 bp, Artificial Sequence
  Synthetic oligonucleotide; TGG chr2 60508698 60508717 60508714 +
gcgctcagctacaggggccg

SEQ ID NO: 164540 - DNA, 20 bp, Artificial Sequence
  Synthetic oligonucleotide; GGG chr2 60508699 60508718 60508715 +
cgctcagctacaggggccgt

SEQ ID NO: 164541 - DNA, 20 bp, Artificial Sequence
  Synthetic oligonucleotide; TAG chr2 60508704 60508723 60508720 +
agctacaggggccgtgggaa

SEQ ID NO: 164542 - DNA, 20 bp, Artificial Sequence
  Synthetic oligonucleotide; TGG chr2 60508708 60508727 60508724 +
acaggggccgtgggaatagc

SEQ ID NO: 164543 - DNA, 20 bp, Artificial Sequence
  Synthetic oligonucleotide; GAG chr2 60508710 60508729 60508726 +
aggggccgtgggaatagctg

SEQ ID NO: 164544 - DNA, 20 bp, Artificial Sequence
  Synthetic oligonucleotide; AGG chr2 60508711 60508730 60508727 +
ggggccgtgggaatagctgg

SEQ ID NO: 164545 - DNA, 20 bp, Artificial Sequence
  Synthetic oligonucleotide; GAG chr2 60508729 60508748 60508745 +
ggaggcctgtgcatttccct

SEQ ID NO: 164546 - DNA, 20 bp, Artificial Sequence
  Synthetic oligonucleotide; AGG chr2 60508730 60508749 60508746 +
gaggcctgtgcatttccctg

SEQ ID NO: 164547 - DNA, 20 bp, Artificial Sequence
  Synthetic oligonucleotide; GGG chr2 60508731 60508750 60508747 +
aggcctgtgcatttccctga

SEQ ID NO: 164548 - DNA, 20 bp, Artificial Sequence
  Synthetic oligonucleotide; TGG chr2 60508740 60508759 60508756 +
catttccctgagggtctcct

SEQ ID NO: 164549 - DNA, 20 bp, Artificial Sequence
  Synthetic oligonucleotide; CAG chr2 60508746 60508765 60508762 +
cctgagggtctccttggcga

SEQ ID NO: 164550 - DNA, 20 bp, Artificial Sequence
  Synthetic oligonucleotide; AGG chr2 60508747 60508766 60508763 +
ctgagggtctccttggcgac

SEQ ID NO: 164551 - DNA, 20 bp, Artificial Sequence
  Synthetic oligonucleotide; GGG chr2 60508748 60508767 60508764 +
tgagggtctccttggcgaca

SEQ ID NO: 164552 - DNA, 20 bp, Artificial Sequence
  Synthetic oligonucleotide; TGG chr2 60508752 60508771 60508768 +
ggtctccttggcgacagggc

SEQ ID NO: 164553 - DNA, 20 bp, Artificial Sequence
  Synthetic oligonucleotide; TGG chr2 60508765 60508784 60508781 +
acagggctggacctttgcac

SEQ ID NO: 164554 - DNA, 20 bp, Artificial Sequence
  Synthetic oligonucleotide; CAG chr2 60508768 60508787 60508784 +
gggctggacctttgcactgg

SEQ ID NO: 164555 - DNA, 20 bp, Artificial Sequence
  Synthetic oligonucleotide; TGG chr2 60508773 60508792 60508789 +
ggacctttgcactggcagcc

SEQ ID NO: 164556 - DNA, 20 bp, Artificial Sequence
  Synthetic oligonucleotide; GAG chr2 60508786 60508805 60508802 +
ggcagcctggactcttctct

SEQ ID NO: 164557 - DNA, 20 bp, Artificial Sequence
  Synthetic oligonucleotide; TGG chr2 60508797 60508816 60508813 +
ctcttctctgagctccccct

SEQ ID NO: 164558 - DNA, 20 bp, Artificial Sequence
  Synthetic oligonucleotide; GGG chr2 60508798 60508817 60508814 +
tcttctctgagctccccctt

SEQ ID NO: 164559 - DNA, 20 bp, Artificial Sequence
  Synthetic oligonucleotide; CAG chr2 60508814 60508833 60508830 +
ccttgggttacctatgattc

SEQ ID NO: 164560 - DNA, 20 bp, Artificial Sequence
  Synthetic oligonucleotide; AAG chr2 60508817 60508836 60508833 +
tgggttacctatgattccag

SEQ ID NO: 164561 - DNA, 20 bp, Artificial Sequence
  Synthetic oligonucleotide; GAG chr2 60508819 60508838 60508835 +
ggttacctatgattccagaa

SEQ ID NO: 164562 - DNA, 20 bp, Artificial Sequence
  Synthetic oligonucleotide; TGG chr2 60508835 60508854 60508851 +
agaagagtttgttctacatg

SEQ ID NO: 164563 - DNA, 20 bp, Artificial Sequence
  Synthetic oligonucleotide; AAG chr2 60508840 60508859 60508856 +
agtttgttctacatgtggca

SEQ ID NO: 164564 - DNA, 20 bp, Artificial Sequence
  Synthetic oligonucleotide; CAG chr2 60508844 60508863 60508860 +
tgttctacatgtggcaaagc

SEQ ID NO: 164565 - DNA, 20 bp, Artificial Sequence
  Synthetic oligonucleotide; TAG chr2 60508852 60508871 60508868 +
atgtggcaaagccagcacca

SEQ ID NO: 164566 - DNA, 20 bp, Artificial Sequence
  Synthetic oligonucleotide; GAG chr2 60508854 60508873 60508870 +
gtggcaaagccagcaccata

SEQ ID NO: 164567 - DNA, 20 bp, Artificial Sequence
  Synthetic oligonucleotide; AGG chr2 60508855 60508874 60508871 +
tggcaaagccagcaccatag

SEQ ID NO: 164568 - DNA, 20 bp, Artificial Sequence
  Synthetic oligonucleotide; GGG chr2 60508856 60508875 60508872 +
ggcaaagccagcaccataga

SEQ ID NO: 164569 - DNA, 20 bp, Artificial Sequence
  Synthetic oligonucleotide; GGG chr2 60508857 60508876 60508873 +
gcaaagccagcaccatagag

SEQ ID NO: 164570 - DNA, 20 bp, Artificial Sequence
  Synthetic oligonucleotide; CAG chr2 60508861 60508880 60508877 +
agccagcaccatagagggga

SEQ ID NO: 164571 - DNA, 20 bp, Artificial Sequence
  Synthetic oligonucleotide; GAG chr2 60508863 60508882 60508879 +
ccagcaccatagaggggaca

SEQ ID NO: 164572 - DNA, 20 bp, Artificial Sequence
  Synthetic oligonucleotide; AGG chr2 60508864 60508883 60508880 +
cagcaccatagaggggacag

SEQ ID NO: 164573 - DNA, 20 bp, Artificial Sequence
  Synthetic oligonucleotide; GGG chr2 60508865 60508884 60508881 +
agcaccatagaggggacaga

SEQ ID NO: 164574 - DNA, 20 bp, Artificial Sequence
  Synthetic oligonucleotide; AAG chr2 60508874 60508893 60508890 +
gaggggacagagggaaacct

SEQ ID NO: 164575 - DNA, 20 bp, Artificial Sequence
  Synthetic oligonucleotide; AGG chr2 60508875 60508894 60508891 +
aggggacagagggaaaccta

SEQ ID NO: 164576 - DNA, 20 bp, Artificial Sequence
  Synthetic oligonucleotide; GAG chr2 60508886 60508905 60508902 +
ggaaacctaaggcctacctt

SEQ ID NO: 164577 - DNA, 20 bp, Artificial Sequence
  Synthetic oligonucleotide; AGG chr2 60508887 60508906 60508903 +
gaaacctaaggcctaccttg

SEQ ID NO: 164578 - DNA, 20 bp, Artificial Sequence
  Synthetic oligonucleotide; GGG chr2 60508888 60508907 60508904 +
aaacctaaggcctaccttga

SEQ ID NO: 164579 - DNA, 20 bp, Artificial Sequence
  Synthetic oligonucleotide; AAG chr2 60508923 60508942 60508939 +
cgccctacccactgctactt

SEQ ID NO: 164580 - DNA, 20 bp, Artificial Sequence
  Synthetic oligonucleotide; AGG chr2 60508924 60508943 60508940 +
gccctacccactgctactta

SEQ ID NO: 164581 - DNA, 20 bp, Artificial Sequence
  Synthetic oligonucleotide; GAG chr2 60508942 60508961 60508958 +
taaggtgtcttttgaatcct

SEQ ID NO: 164582 - DNA, 20 bp, Artificial Sequence
  Synthetic oligonucleotide; AGG chr2 60508943 60508962 60508959 +
aaggtgtcttttgaatcctg

SEQ ID NO: 164583 - DNA, 20 bp, Artificial Sequence
  Synthetic oligonucleotide; AAG chr2 60508949 60508968 60508965 +
tcttttgaatcctgaggacc

SEQ ID NO: 164584 - DNA, 20 bp, Artificial Sequence
  Synthetic oligonucleotide; AGG chr2 60508950 60508969 60508966 +
cttttgaatcctgaggacca

SEQ ID NO: 164585 - DNA, 20 bp, Artificial Sequence
  Synthetic oligonucleotide; GAG chr2 60508952 60508971 60508968 +
tttgaatcctgaggaccaag

SEQ ID NO: 164586 - DNA, 20 bp, Artificial Sequence
  Synthetic oligonucleotide; AAG chr2 60508967 60508986 60508983 +
ccaaggagctctcctatgac

SEQ ID NO: 164587 - DNA, 20 bp, Artificial Sequence
  Synthetic oligonucleotide; AGG chr2 60508968 60508987 60508984 +
caaggagctctcctatgaca

SEQ ID NO: 164588 - DNA, 20 bp, Artificial Sequence
  Synthetic oligonucleotide; TGG chr2 60508981 60509000 60508997 +
tatgacaaggaacctgtcac

SEQ ID NO: 164589 - DNA, 20 bp, Artificial Sequence
  Synthetic oligonucleotide; AAG chr2 60509001 60509020 60509017 +
tggttcttctgtgattgcta

SEQ ID NO: 164590 - DNA, 20 bp, Artificial Sequence
  Synthetic oligonucleotide; TAG chr2 60509006 60509025 60509022 +
cttctgtgattgctaaagcc

SEQ ID NO: 164591 - DNA, 20 bp, Artificial Sequence
  Synthetic oligonucleotide; GAG chr2 60509008 60509027 60509024 +
tctgtgattgctaaagccta

SEQ ID NO: 164592 - DNA, 20 bp, Artificial Sequence
  Synthetic oligonucleotide; AGG chr2 60509009 60509028 60509025 +
ctgtgattgctaaagcctag

SEQ ID NO: 164593 - DNA, 20 bp, Artificial Sequence
  Synthetic oligonucleotide; AAG chr2 60509022 60509041 60509038 +
agcctagaggacctcctcca

SEQ ID NO: 164594 - DNA, 20 bp, Artificial Sequence
  Synthetic oligonucleotide; AAG chr2 60509027 60509046 60509043 +
agaggacctcctccaaagaa

SEQ ID NO: 164595 - DNA, 20 bp, Artificial Sequence
  Synthetic oligonucleotide; TGG chr2 60509030 60509049 60509046 +
ggacctcctccaaagaaaag

SEQ ID NO: 164596 - DNA, 20 bp, Artificial Sequence
  Synthetic oligonucleotide; CAG chr2 60509035 60509054 60509051 +
tcctccaaagaaaagtggct

SEQ ID NO: 164597 - DNA, 20 bp, Artificial Sequence
  Synthetic oligonucleotide; CAG chr2 60509039 60509058 60509055 +
ccaaagaaaagtggctcaga

SEQ ID NO: 164598 - DNA, 20 bp, Artificial Sequence
  Synthetic oligonucleotide; CAG chr2 60509065 60509084 60509081 +
cactgactcttatttctcat

SEQ ID NO: 164599 - DNA, 20 bp, Artificial Sequence
  Synthetic oligonucleotide; CAG chr2 60509080 60509099 60509096 +
ctcatcagactccgaaatca

SEQ ID NO: 164600 - DNA, 20 bp, Artificial Sequence
  Synthetic oligonucleotide; AGG chr2 60509081 60509100 60509097 +
tcatcagactccgaaatcac

SEQ ID NO: 164601 - DNA, 20 bp, Artificial Sequence
  Synthetic oligonucleotide; TGG chr2 60509088 60509107 60509104 +
actccgaaatcacaggcttc

SEQ ID NO: 164602 - DNA, 20 bp, Artificial Sequence
  Synthetic oligonucleotide; AAG chr2 60509095 60509114 60509111 +
aatcacaggcttctggtcta

SEQ ID NO: 164603 - DNA, 20 bp, Artificial Sequence
  Synthetic oligonucleotide; AAG chr2 60509102 60509121 60509118 +
ggcttctggtctaaagattc

SEQ ID NO: 164604 - DNA, 20 bp, Artificial Sequence
  Synthetic oligonucleotide; GAG chr2 60509107 60509126 60509123 +
ctggtctaaagattcaagct

SEQ ID NO: 164605 - DNA, 20 bp, Artificial Sequence
  Synthetic oligonucleotide; AAG chr2 60509114 60509133 60509130 +
aaagattcaagctgagaaac

SEQ ID NO: 164606 - DNA, 20 bp, Artificial Sequence
  Synthetic oligonucleotide; AAG chr2 60509118 60509137 60509134 +
attcaagctgagaaacaaga

SEQ ID NO: 164607 - DNA, 20 bp, Artificial Sequence
  Synthetic oligonucleotide; CAG chr2 60509135 60509154 60509151 +
agaaagcaatttgtttgatt

SEQ ID NO: 164608 - DNA, 20 bp, Artificial Sequence
  Synthetic oligonucleotide; AGG chr2 60509136 60509155 60509152 +
gaaagcaatttgtttgattc

SEQ ID NO: 164609 - DNA, 20 bp, Artificial Sequence
  Synthetic oligonucleotide; TGG chr2 60509169 60509188 60509185 +
ttaccccccaataatttact

SEQ ID NO: 164610 - DNA, 20 bp, Artificial Sequence
  Synthetic oligonucleotide; CAG chr2 60509175 60509194 60509191 +
cccaataatttacttggtct

SEQ ID NO: 164611 - DNA, 20 bp, Artificial Sequence
  Synthetic oligonucleotide; TGG chr2 60509181 60509200 60509197 +
aatttacttggtctcagctt

SEQ ID NO: 164612 - DNA, 20 bp, Artificial Sequence
  Synthetic oligonucleotide; TGG chr2 60509185 60509204 60509201 +
tacttggtctcagctttggc

SEQ ID NO: 164613 - DNA, 20 bp, Artificial Sequence
  Synthetic oligonucleotide; TGG chr2 60509190 60509209 60509206 +
ggtctcagctttggctggct

SEQ ID NO: 164614 - DNA, 20 bp, Artificial Sequence
  Synthetic oligonucleotide; GAG chr2 60509200 60509219 60509216 +
ttggctggcttggatgttat

SEQ ID NO: 164615 - DNA, 20 bp, Artificial Sequence
  Synthetic oligonucleotide; AGG chr2 60509201 60509220 60509217 +
tggctggcttggatgttatg

SEQ ID NO: 164616 - DNA, 20 bp, Artificial Sequence
  Synthetic oligonucleotide; AAG chr2 60509209 60509228 60509225 +
ttggatgttatgaggattcc

SEQ ID NO: 164617 - DNA, 20 bp, Artificial Sequence
  Synthetic oligonucleotide; TAG chr2 60509231 60509250 60509247 +
gaatttttttacttttccat

SEQ ID NO: 164618 - DNA, 20 bp, Artificial Sequence
  Synthetic oligonucleotide; GAG chr2 60509233 60509252 60509249 +
atttttttacttttccatta

SEQ ID NO: 164619 - DNA, 20 bp, Artificial Sequence
  Synthetic oligonucleotide; AGG chr2 60509234 60509253 60509250 +
tttttttacttttccattag

SEQ ID NO: 164620 - DNA, 20 bp, Artificial Sequence
  Synthetic oligonucleotide; GGG chr2 60509235 60509254 60509251 +
ttttttacttttccattaga

SEQ ID NO: 164621 - DNA, 20 bp, Artificial Sequence
  Synthetic oligonucleotide; AAG chr2 60509255 60509274 60509271 +
gggctctgcactctcctttc

SEQ ID NO: 164622 - DNA, 20 bp, Artificial Sequence
  Synthetic oligonucleotide; AGG chr2 60509256 60509275 60509272 +
ggctctgcactctcctttca

SEQ ID NO: 164623 - DNA, 20 bp, Artificial Sequence
  Synthetic oligonucleotide; AAG chr2 60509262 60509281 60509278 +
gcactctcctttcaaggaaa

SEQ ID NO: 164624 - DNA, 20 bp, Artificial Sequence
  Synthetic oligonucleotide; AGG chr2 60509263 60509282 60509279 +
cactctcctttcaaggaaaa

SEQ ID NO: 164625 - DNA, 20 bp, Artificial Sequence
  Synthetic oligonucleotide; CAG chr2 60509276 60509295 60509292 +
aggaaaaaggctctatgtgc

SEQ ID NO: 164626 - DNA, 20 bp, Artificial Sequence
  Synthetic oligonucleotide; CAG chr2 60509291 60509310 60509307 +
tgtgccagcccacttctttc

SEQ ID NO: 164627 - DNA, 20 bp, Artificial Sequence
  Synthetic oligonucleotide; TGG chr2 60509297 60509316 60509313 +
agcccacttctttccagaaa

SEQ ID NO: 164628 - DNA, 20 bp, Artificial Sequence
  Synthetic oligonucleotide; GGG chr2 60509298 60509317 60509314 +
gcccacttctttccagaaat

SEQ ID NO: 164629 - DNA, 20 bp, Artificial Sequence
  Synthetic oligonucleotide; GGG chr2 60509299 60509318 60509315 +
cccacttctttccagaaatg

SEQ ID NO: 164630 - DNA, 20 bp, Artificial Sequence
  Synthetic oligonucleotide; AAG chr2 60509303 60509322 60509319 +
cttctttccagaaatgggga

SEQ ID NO: 164631 - DNA, 20 bp, Artificial Sequence
  Synthetic oligonucleotide; AGG chr2 60509304 60509323 60509320 +
ttctttccagaaatggggaa

SEQ ID NO: 164632 - DNA, 20 bp, Artificial Sequence
  Synthetic oligonucleotide; GGG chr2 60509305 60509324 60509321 +
tctttccagaaatggggaaa

SEQ ID NO: 164633 - DNA, 20 bp, Artificial Sequence
  Synthetic oligonucleotide; GAG chr2 60509307 60509326 60509323 +
tttccagaaatggggaaagg

SEQ ID NO: 164634 - DNA, 20 bp, Artificial Sequence
  Synthetic oligonucleotide; AGG chr2 60509308 60509327 60509324 +
ttccagaaatggggaaaggg

SEQ ID NO: 164635 - DNA, 20 bp, Artificial Sequence
  Synthetic oligonucleotide; GAG chr2 60509310 60509329 60509326 +
ccagaaatggggaaagggag

SEQ ID NO: 164636 - DNA, 20 bp, Artificial Sequence
  Synthetic oligonucleotide; AGG chr2 60509311 60509330 60509327 +
cagaaatggggaaagggagg

SEQ ID NO: 164637 - DNA, 20 bp, Artificial Sequence
  Synthetic oligonucleotide; GAG chr2 60509313 60509332 60509329 +
gaaatggggaaagggaggag

SEQ ID NO: 164638 - DNA, 20 bp, Artificial Sequence
  Synthetic oligonucleotide; TGG chr2 60509322 60509341 60509338 +
aaagggaggaggagaacctg

SEQ ID NO: 164639 - DNA, 20 bp, Artificial Sequence
  Synthetic oligonucleotide; AAG chr2 60509327 60509346 60509343 +
gaggaggagaacctgtggaa

SEQ ID NO: 164640 - DNA, 20 bp, Artificial Sequence
  Synthetic oligonucleotide; GAG chr2 60509329 60509348 60509345 +
ggaggagaacctgtggaaaa

SEQ ID NO: 164641 - DNA, 20 bp, Artificial Sequence
  Synthetic oligonucleotide; AGG chr2 60509330 60509349 60509346 +
gaggagaacctgtggaaaag

SEQ ID NO: 164642 - DNA, 20 bp, Artificial Sequence
  Synthetic oligonucleotide; CGG chr2 60509337 60509356 60509353 +
acctgtggaaaagaggacaa

SEQ ID NO: 164643 - DNA, 20 bp, Artificial Sequence
  Synthetic oligonucleotide; CGG chr2 60509345 60509364 60509361 +
aaaagaggacaacggatttc

SEQ ID NO: 164644 - DNA, 20 bp, Artificial Sequence
  Synthetic oligonucleotide; AAG chr2 60509348 60509367 60509364 +
agaggacaacggatttccgg

SEQ ID NO: 164645 - DNA, 20 bp, Artificial Sequence
  Synthetic oligonucleotide; AAG chr2 60509358 60509377 60509374 +
ggatttccggaagaaattcc

SEQ ID NO: 164646 - DNA, 20 bp, Artificial Sequence
  Synthetic oligonucleotide; CAG chr2 60509362 60509381 60509378 +
ttccggaagaaattccaagc

SEQ ID NO: 164647 - DNA, 20 bp, Artificial Sequence
  Synthetic oligonucleotide; AGG chr2 60509363 60509382 60509379 +
tccggaagaaattccaagcc

SEQ ID NO: 164648 - DNA, 20 bp, Artificial Sequence
  Synthetic oligonucleotide; GGG chr2 60509364 60509383 60509380 +
ccggaagaaattccaagcca

SEQ ID NO: 164649 - DNA, 20 bp, Artificial Sequence
  Synthetic oligonucleotide; GGG chr2 60509365 60509384 60509381 +
cggaagaaattccaagccag

SEQ ID NO: 164650 - DNA, 20 bp, Artificial Sequence
  Synthetic oligonucleotide; TGG chr2 60509375 60509394 60509391 +
tccaagccaggggctaaccg

SEQ ID NO: 164651 - DNA, 20 bp, Artificial Sequence
  Synthetic oligonucleotide; GAG chr2 60509382 60509401 60509398 +
caggggctaaccgtggacct

SEQ ID NO: 164652 - DNA, 20 bp, Artificial Sequence
  Synthetic oligonucleotide; CAG chr2 60509387 60509406 60509403 +
gctaaccgtggacctgagca

SEQ ID NO: 164653 - DNA, 20 bp, Artificial Sequence
  Synthetic oligonucleotide; CAG chr2 60509390 60509409 60509406 +
aaccgtggacctgagcacag

SEQ ID NO: 164654 - DNA, 20 bp, Artificial Sequence
  Synthetic oligonucleotide; GAG chr2 60509392 60509411 60509408 +
ccgtggacctgagcacagca

SEQ ID NO: 164655 - DNA, 20 bp, Artificial Sequence
  Synthetic oligonucleotide; CGG chr2 60509400 60509419 60509416 +
ctgagcacagcagagccaca

SEQ ID NO: 164656 - DNA, 20 bp, Artificial Sequence
  Synthetic oligonucleotide; CAG chr2 60509409 60509428 60509425 +
gcagagccacacggacgtct

SEQ ID NO: 164657 - DNA, 20 bp, Artificial Sequence
  Synthetic oligonucleotide; CGG chr2 60509416 60509435 60509432 +
cacacggacgtctcagaaaa

SEQ ID NO: 164658 - DNA, 20 bp, Artificial Sequence
  Synthetic oligonucleotide; TGG chr2 60509424 60509443 60509440 +
cgtctcagaaaacggttctg

SEQ ID NO: 164659 - DNA, 20 bp, Artificial Sequence
  Synthetic oligonucleotide; AAG chr2 60509427 60509446 60509443 +
ctcagaaaacggttctgtgg

SEQ ID NO: 164660 - DNA, 20 bp, Artificial Sequence
  Synthetic oligonucleotide; AAG chr2 60509433 60509452 60509449 +
aaacggttctgtggaagcac

SEQ ID NO: 164661 - DNA, 20 bp, Artificial Sequence
  Synthetic oligonucleotide; TGG chr2 60509441 60509460 60509457 +
ctgtggaagcacaagacacg

SEQ ID NO: 164662 - DNA, 20 bp, Artificial Sequence
  Synthetic oligonucleotide; CAG chr2 60509444 60509463 60509460 +
tggaagcacaagacacgtgg

SEQ ID NO: 164663 - DNA, 20 bp, Artificial Sequence
  Synthetic oligonucleotide; GAG chr2 60509448 60509467 60509464 +
agcacaagacacgtggcagt

SEQ ID NO: 164664 - DNA, 20 bp, Artificial Sequence
  Synthetic oligonucleotide; GAG chr2 60509450 60509469 60509466 +
cacaagacacgtggcagtga

SEQ ID NO: 164665 - DNA, 20 bp, Artificial Sequence
  Synthetic oligonucleotide; GAG chr2 60509457 60509476 60509473 +
cacgtggcagtgagagtcct

SEQ ID NO: 164666 - DNA, 20 bp, Artificial Sequence
  Synthetic oligonucleotide; AAG chr2 60509460 60509479 60509476 +
gtggcagtgagagtcctgag

SEQ ID NO: 164667 - DNA, 20 bp, Artificial Sequence
  Synthetic oligonucleotide; CAG chr2 60509465 60509484 60509481 +
agtgagagtcctgagaagtc

SEQ ID NO: 164668 - DNA, 20 bp, Artificial Sequence
  Synthetic oligonucleotide; AGG chr2 60509466 60509485 60509482 +
gtgagagtcctgagaagtcc

SEQ ID NO: 164669 - DNA, 20 bp, Artificial Sequence
  Synthetic oligonucleotide; AAG chr2 60509471 60509490 60509487 +
agtcctgagaagtccaggaa

SEQ ID NO: 164670 - DNA, 20 bp, Artificial Sequence
  Synthetic oligonucleotide; CAG chr2 60509477 60509496 60509493 +
gagaagtccaggaaaagatg

SEQ ID NO: 164671 - DNA, 20 bp, Artificial Sequence
  Synthetic oligonucleotide; CAG chr2 60509512 60509531 60509528 +
tcctaaatatcaccaattaa

SEQ ID NO: 164672 - DNA, 20 bp, Artificial Sequence
  Synthetic oligonucleotide; CAG chr2 60509515 60509534 60509531 +
taaatatcaccaattaacag

SEQ ID NO: 164673 - DNA, 20 bp, Artificial Sequence
  Synthetic oligonucleotide; TGG chr2 60509523 60509542 60509539 +
accaattaacagcagctcga

SEQ ID NO: 164674 - DNA, 20 bp, Artificial Sequence
  Synthetic oligonucleotide; GAG chr2 60509533 60509552 60509549 +
agcagctcgatggtctacct

SEQ ID NO: 164675 - DNA, 20 bp, Artificial Sequence
  Synthetic oligonucleotide; GAG chr2 60509540 60509559 60509556 +
cgatggtctacctgagacct

SEQ ID NO: 164676 - DNA, 20 bp, Artificial Sequence
  Synthetic oligonucleotide; AAG chr2 60509553 60509572 60509569 +
gagacctgagaaaacaaacg

SEQ ID NO: 164677 - DNA, 20 bp, Artificial Sequence
  Synthetic oligonucleotide; AGG chr2 60509554 60509573 60509570 +
agacctgagaaaacaaacga

SEQ ID NO: 164678 - DNA, 20 bp, Artificial Sequence
  Synthetic oligonucleotide; GGG chr2 60509555 60509574 60509571 +
gacctgagaaaacaaacgaa

SEQ ID NO: 164679 - DNA, 20 bp, Artificial Sequence
  Synthetic oligonucleotide; AAG chr2 60509559 60509578 60509575 +
tgagaaaacaaacgaaggga

SEQ ID NO: 164680 - DNA, 20 bp, Artificial Sequence
  Synthetic oligonucleotide; AAG chr2 60509568 60509587 60509584 +
aaacgaagggaaagaaatgc

SEQ ID NO: 164681 - DNA, 20 bp, Artificial Sequence
  Synthetic oligonucleotide; AAG chr2 60509576 60509595 60509592 +
ggaaagaaatgcaagaaaca

SEQ ID NO: 164682 - DNA, 20 bp, Artificial Sequence
  Synthetic oligonucleotide; TGG chr2 60509589 60509608 60509605 +
agaaacaaagcgcatctttc

SEQ ID NO: 164683 - DNA, 20 bp, Artificial Sequence
  Synthetic oligonucleotide; AAG chr2 60509597 60509616 60509613 +
agcgcatctttctggatcaa

SEQ ID NO: 164684 - DNA, 20 bp, Artificial Sequence
  Synthetic oligonucleotide; AAG chr2 60509603 60509622 60509619 +
tctttctggatcaaaagatc

SEQ ID NO: 164685 - DNA, 20 bp, Artificial Sequence
  Synthetic oligonucleotide; TGG chr2 60509613 60509632 60509629 +
tcaaaagatcaagttgtctt

SEQ ID NO: 164686 - DNA, 20 bp, Artificial Sequence
  Synthetic oligonucleotide; TAG chr2 60509616 60509635 60509632 +
aaagatcaagttgtctttgg

SEQ ID NO: 164687 - DNA, 20 bp, Artificial Sequence
  Synthetic oligonucleotide; AAG chr2 60509622 60509641 60509638 +
caagttgtctttggtagcta

SEQ ID NO: 164688 - DNA, 20 bp, Artificial Sequence
  Synthetic oligonucleotide; CAG chr2 60509630 60509649 60509646 +
ctttggtagctaaagaacaa

SEQ ID NO: 164689 - DNA, 20 bp, Artificial Sequence
  Synthetic oligonucleotide; GAG chr2 60509632 60509651 60509648 +
ttggtagctaaagaacaaca

SEQ ID NO: 164690 - DNA, 20 bp, Artificial Sequence
  Synthetic oligonucleotide; AAG chr2 60509635 60509654 60509651 +
gtagctaaagaacaacagag

SEQ ID NO: 164691 - DNA, 20 bp, Artificial Sequence
  Synthetic oligonucleotide; AGG chr2 60509636 60509655 60509652 +
tagctaaagaacaacagaga

SEQ ID NO: 164692 - DNA, 20 bp, Artificial Sequence
  Synthetic oligonucleotide; AAG chr2 60509642 60509661 60509658 +
aagaacaacagagaaggaaa

SEQ ID NO: 164693 - DNA, 20 bp, Artificial Sequence
  Synthetic oligonucleotide; AAG chr2 60509651 60509670 60509667 +
agagaaggaaaaagaacaaa

SEQ ID NO: 164694 - DNA, 20 bp, Artificial Sequence
  Synthetic oligonucleotide; TAG chr2 60509656 60509675 60509672 +
aggaaaaagaacaaaaagat

SEQ ID NO: 164695 - DNA, 20 bp, Artificial Sequence
  Synthetic oligonucleotide; AGG chr2 60509657 60509676 60509673 +
ggaaaaagaacaaaaagatt

SEQ ID NO: 164696 - DNA, 20 bp, Artificial Sequence
  Synthetic oligonucleotide; GAG chr2 60509659 60509678 60509675 +
aaaaagaacaaaaagattag

SEQ ID NO: 164697 - DNA, 20 bp, Artificial Sequence
  Synthetic oligonucleotide; AGG chr2 60509660 60509679 60509676 +
aaaagaacaaaaagattagg

SEQ ID NO: 164698 - DNA, 20 bp, Artificial Sequence
  Synthetic oligonucleotide; GAG chr2 60509662 60509681 60509678 +
aagaacaaaaagattaggag

SEQ ID NO: 164699 - DNA, 20 bp, Artificial Sequence
  Synthetic oligonucleotide; AGG chr2 60509663 60509682 60509679 +
agaacaaaaagattaggagg

SEQ ID NO: 164700 - DNA, 20 bp, Artificial Sequence
  Synthetic oligonucleotide; GAG chr2 60509665 60509684 60509681 +
aacaaaaagattaggaggag

SEQ ID NO: 164701 - DNA, 20 bp, Artificial Sequence
  Synthetic oligonucleotide; TGG chr2 60509677 60509696 60509693 +
aggaggaggagaaaaacacc

SEQ ID NO: 164702 - DNA, 20 bp, Artificial Sequence
  Synthetic oligonucleotide; AAG chr2 60509689 60509708 60509705 +
aaaacacctggccctcccca

SEQ ID NO: 164703 - DNA, 20 bp, Artificial Sequence
  Synthetic oligonucleotide; CAG chr2 60509711 60509730 60509727 +
gaactcgacttaaatcatct

SEQ ID NO: 164704 - DNA, 20 bp, Artificial Sequence
  Synthetic oligonucleotide; TAG chr2 60509717 60509736 60509733 +
gacttaaatcatctcagcta

SEQ ID NO: 164705 - DNA, 20 bp, Artificial Sequence
  Synthetic oligonucleotide; AGG chr2 60509718 60509737 60509734 +
acttaaatcatctcagctat

SEQ ID NO: 164706 - DNA, 20 bp, Artificial Sequence
  Synthetic oligonucleotide; CAG chr2 60509721 60509740 60509737 +
taaatcatctcagctatagg

SEQ ID NO: 164707 - DNA, 20 bp, Artificial Sequence
  Synthetic oligonucleotide; TGG chr2 60509729 60509748 60509745 +
ctcagctataggcagtcaac

SEQ ID NO: 164708 - DNA, 20 bp, Artificial Sequence
  Synthetic oligonucleotide; GGG chr2 60509730 60509749 60509746 +
tcagctataggcagtcaact

SEQ ID NO: 164709 - DNA, 20 bp, Artificial Sequence
  Synthetic oligonucleotide; GGG chr2 60509731 60509750 60509747 +
cagctataggcagtcaactg

SEQ ID NO: 164710 - DNA, 20 bp, Artificial Sequence
  Synthetic oligonucleotide; CAG chr2 60509743 60509762 60509759 +
gtcaactggggctctccgaa

SEQ ID NO: 164711 - DNA, 20 bp, Artificial Sequence
  Synthetic oligonucleotide; CGG chr2 60509753 60509772 60509769 +
gctctccgaacagccacaat

SEQ ID NO: 164712 - DNA, 20 bp, Artificial Sequence
  Synthetic oligonucleotide; GGG chr2 60509754 60509773 60509770 +
ctctccgaacagccacaatc

SEQ ID NO: 164713 - DNA, 20 bp, Artificial Sequence
  Synthetic oligonucleotide; GGG chr2 60509755 60509774 60509771 +
tctccgaacagccacaatcg

SEQ ID NO: 164714 - DNA, 20 bp, Artificial Sequence
  Synthetic oligonucleotide; GGG chr2 60509756 60509775 60509772 +
ctccgaacagccacaatcgg

SEQ ID NO: 164715 - DNA, 20 bp, Artificial Sequence
  Synthetic oligonucleotide; GGG chr2 60509757 60509776 60509773 +
tccgaacagccacaatcggg

SEQ ID NO: 164716 - DNA, 20 bp, Artificial Sequence
  Synthetic oligonucleotide; CAG chr2 60509791 60509810 60509807 +
cccctcacgatcttcctgaa

SEQ ID NO: 164717 - DNA, 20 bp, Artificial Sequence
  Synthetic oligonucleotide; AGG chr2 60509792 60509811 60509808 +
ccctcacgatcttcctgaac

SEQ ID NO: 164718 - DNA, 20 bp, Artificial Sequence
  Synthetic oligonucleotide; GGG chr2 60509793 60509812 60509809 +
cctcacgatcttcctgaaca

SEQ ID NO: 164719 - DNA, 20 bp, Artificial Sequence
  Synthetic oligonucleotide; CAG chr2 60509796 60509815 60509812 +
cacgatcttcctgaacaggg

SEQ ID NO: 164720 - DNA, 20 bp, Artificial Sequence
  Synthetic oligonucleotide; TAG chr2 60509799 60509818 60509815 +
gatcttcctgaacagggcag

SEQ ID NO: 164721 - DNA, 20 bp, Artificial Sequence
  Synthetic oligonucleotide; TAG chr2 60509804 60509823 60509820 +
tcctgaacagggcagtagtc

SEQ ID NO: 164722 - DNA, 20 bp, Artificial Sequence
  Synthetic oligonucleotide; AAG chr2 60509816 60509835 60509832 +
cagtagtctagcatccactg

SEQ ID NO: 164723 - DNA, 20 bp, Artificial Sequence
  Synthetic oligonucleotide; AAG chr2 60509824 60509843 60509840 +
tagcatccactgaagtcctg

SEQ ID NO: 164724 - DNA, 20 bp, Artificial Sequence
  Synthetic oligonucleotide; TGG chr2 60509827 60509846 60509843 +
catccactgaagtcctgaag

SEQ ID NO: 164725 - DNA, 20 bp, Artificial Sequence
  Synthetic oligonucleotide; AAG chr2 60509832 60509851 60509848 +
actgaagtcctgaagtggtg

SEQ ID NO: 164726 - DNA, 20 bp, Artificial Sequence
  Synthetic oligonucleotide; AGG chr2 60509833 60509852 60509849 +
ctgaagtcctgaagtggtga

SEQ ID NO: 164727 - DNA, 20 bp, Artificial Sequence
  Synthetic oligonucleotide; GAG chr2 60509835 60509854 60509851 +
gaagtcctgaagtggtgaag

SEQ ID NO: 164728 - DNA, 20 bp, Artificial Sequence
  Synthetic oligonucleotide; CAG chr2 60509841 60509860 60509857 +
ctgaagtggtgaaggagccc

SEQ ID NO: 164729 - DNA, 20 bp, Artificial Sequence
  Synthetic oligonucleotide; GAG chr2 60509859 60509878 60509875 +
cccagacacacccatcctct

SEQ ID NO: 164730 - DNA, 20 bp, Artificial Sequence
  Synthetic oligonucleotide; CAG chr2 60509870 60509889 60509886 +
ccatcctctgagcacctcca

SEQ ID NO: 164731 - DNA, 20 bp, Artificial Sequence
  Synthetic oligonucleotide; TGG chr2 60509879 60509898 60509895 +
gagcacctccacagcctttc

SEQ ID NO: 164732 - DNA, 20 bp, Artificial Sequence
  Synthetic oligonucleotide; CAG chr2 60509896 60509915 60509912 +
ttctggcccatcccaataaa

SEQ ID NO: 164733 - DNA, 20 bp, Artificial Sequence
  Synthetic oligonucleotide; CAG chr2 60509913 60509932 60509929 +
aaacagcaattctattctcc

SEQ ID NO: 164734 - DNA, 20 bp, Artificial Sequence
  Synthetic oligonucleotide; GAG chr2 60509921 60509940 60509937 +
attctattctcccagtcacc

SEQ ID NO: 164735 - DNA, 20 bp, Artificial Sequence
  Synthetic oligonucleotide; TGG chr2 60509934 60509953 60509950 +
agtcaccgagccacacattt

SEQ ID NO: 164736 - DNA, 20 bp, Artificial Sequence
  Synthetic oligonucleotide; GGG chr2 60509935 60509954 60509951 +
gtcaccgagccacacatttt

SEQ ID NO: 164737 - DNA, 20 bp, Artificial Sequence
  Synthetic oligonucleotide; GGG chr2 60509936 60509955 60509952 +
tcaccgagccacacattttg

SEQ ID NO: 164738 - DNA, 20 bp, Artificial Sequence
  Synthetic oligonucleotide; CAG chr2 60509981 60510000 60509997 +
tttcatacaacccatcccac

SEQ ID NO: 164739 - DNA, 20 bp, Artificial Sequence
  Synthetic oligonucleotide; CAG chr2 60509985 60510004 60510001 +
atacaacccatcccaccagt

SEQ ID NO: 164740 - DNA, 20 bp, Artificial Sequence
  Synthetic oligonucleotide; CGG chr2 60509998 60510017 60510014 +
caccagtcagcaaatcctgc

SEQ ID NO: 164741 - DNA, 20 bp, Artificial Sequence
  Synthetic oligonucleotide; AAG chr2 60510012 60510031 60510028 +
tcctgccggttttcccttcg

SEQ ID NO: 164742 - DNA, 20 bp, Artificial Sequence
  Synthetic oligonucleotide; CAG chr2 60510021 60510040 60510037 +
ttttcccttcgaagtatgtc

SEQ ID NO: 164743 - DNA, 20 bp, Artificial Sequence
  Synthetic oligonucleotide; CAG chr2 60510028 60510047 60510044 +
ttcgaagtatgtccagaatc

SEQ ID NO: 164744 - DNA, 20 bp, Artificial Sequence
  Synthetic oligonucleotide; TGG chr2 60510055 60510074 60510071 +
ttctcacgtccccaccaccc

SEQ ID NO: 164745 - DNA, 20 bp, Artificial Sequence
  Synthetic oligonucleotide; GAG chr2 60510123 60510142 60510139 +
tgcctcactttcccatgctt

SEQ ID NO: 164746 - DNA, 20 bp, Artificial Sequence
  Synthetic oligonucleotide; CGG chr2 60510136 60510155 60510152 +
catgcttgagtctcaaaatg

SEQ ID NO: 164747 - DNA, 20 bp, Artificial Sequence
  Synthetic oligonucleotide; AAG chr2 60510142 60510161 60510158 +
tgagtctcaaaatgcggccc

SEQ ID NO: 164748 - DNA, 20 bp, Artificial Sequence
  Synthetic oligonucleotide; GAG chr2 60510144 60510163 60510160 +
agtctcaaaatgcggcccaa

SEQ ID NO: 164749 - DNA, 20 bp, Artificial Sequence
  Synthetic oligonucleotide; TGG chr2 60510153 60510172 60510169 +
atgcggcccaagagactctc

SEQ ID NO: 164750 - DNA, 20 bp, Artificial Sequence
  Synthetic oligonucleotide; AAG chr2 60510156 60510175 60510172 +
cggcccaagagactctctgg

SEQ ID NO: 164751 - DNA, 20 bp, Artificial Sequence
  Synthetic oligonucleotide; AAG chr2 60510162 60510181 60510178 +
aagagactctctggaagcgc

SEQ ID NO: 164752 - DNA, 20 bp, Artificial Sequence
  Synthetic oligonucleotide; CAG chr2 60510184 60510203 60510200 +
gtcatatgacatcactcctc

SEQ ID NO: 164753 - DNA, 20 bp, Artificial Sequence
  Synthetic oligonucleotide; TGG chr2 60510187 60510206 60510203 +
atatgacatcactcctccag

SEQ ID NO: 164754 - DNA, 20 bp, Artificial Sequence
  Synthetic oligonucleotide; TGG chr2 60510203 60510222 60510219 +
ccagtggcttccatctccct

SEQ ID NO: 164755 - DNA, 20 bp, Artificial Sequence
  Synthetic oligonucleotide; GAG chr2 60510205 60510224 60510221 +
agtggcttccatctcccttg

SEQ ID NO: 164756 - DNA, 20 bp, Artificial Sequence
  Synthetic oligonucleotide; CAG chr2 60510209 60510228 60510225 +
gcttccatctcccttggagt

SEQ ID NO: 164757 - DNA, 20 bp, Artificial Sequence
  Synthetic oligonucleotide; GAG chr2 60510211 60510230 60510227 +
ttccatctcccttggagtca

SEQ ID NO: 164758 - DNA, 20 bp, Artificial Sequence
  Synthetic oligonucleotide; AAG chr2 60510240 60510259 60510256 +
atccctgctctacgtccttc

SEQ ID NO: 164759 - DNA, 20 bp, Artificial Sequence
  Synthetic oligonucleotide; AGG chr2 60510241 60510260 60510257 +
tccctgctctacgtccttca

SEQ ID NO: 164760 - DNA, 20 bp, Artificial Sequence
  Synthetic oligonucleotide; GAG chr2 60510243 60510262 60510259 +
cctgctctacgtccttcaag

SEQ ID NO: 164761 - DNA, 20 bp, Artificial Sequence
  Synthetic oligonucleotide; CAG chr2 60510247 60510266 60510263 +
ctctacgtccttcaaggagc

SEQ ID NO: 164762 - DNA, 20 bp, Artificial Sequence
  Synthetic oligonucleotide; TGG chr2 60510251 60510270 60510267 +
acgtccttcaaggagccagc

SEQ ID NO: 164763 - DNA, 20 bp, Artificial Sequence
  Synthetic oligonucleotide; CAG chr2 60510295 60510314 60510311 +
cactctttccactctgacct

SEQ ID NO: 164764 - DNA, 20 bp, Artificial Sequence
  Synthetic oligonucleotide; AGG chr2 60510296 60510315 60510312 +
actctttccactctgacctc

SEQ ID NO: 164765 - DNA, 20 bp, Artificial Sequence
  Synthetic oligonucleotide; GGG chr2 60510297 60510316 60510313 +
ctctttccactctgacctca

SEQ ID NO: 164766 - DNA, 20 bp, Artificial Sequence
  Synthetic oligonucleotide; CAG chr2 60510316 60510335 60510332 +
agggccccttgctcctcctc

SEQ ID NO: 164767 - DNA, 20 bp, Artificial Sequence
  Synthetic oligonucleotide; TAG chr2 60510319 60510338 60510335 +
gccccttgctcctcctccag

SEQ ID NO: 164768 - DNA, 20 bp, Artificial Sequence
  Synthetic oligonucleotide; CAG chr2 60510323 60510342 60510339 +
cttgctcctcctccagtagc

SEQ ID NO: 164769 - DNA, 20 bp, Artificial Sequence
  Synthetic oligonucleotide; AGG chr2 60510324 60510343 60510340 +
ttgctcctcctccagtagcc

SEQ ID NO: 164770 - DNA, 20 bp, Artificial Sequence
  Synthetic oligonucleotide; AAG chr2 60510339 60510358 60510355 +
tagccaggcgtattacacac

SEQ ID NO: 164771 - DNA, 20 bp, Artificial Sequence
  Synthetic oligonucleotide; AGG chr2 60510340 60510359 60510356 +
agccaggcgtattacacaca

SEQ ID NO: 164772 - DNA, 20 bp, Artificial Sequence
  Synthetic oligonucleotide; TGG chr2 60510367 60510386 60510383 +
tgctctctacacactcttcc

SEQ ID NO: 164773 - DNA, 20 bp, Artificial Sequence
  Synthetic oligonucleotide; TGG chr2 60510392 60510411 60510408 +
ccatcttctcaaaattctca

SEQ ID NO: 164774 - DNA, 20 bp, Artificial Sequence
  Synthetic oligonucleotide; TGG chr2 60510413 60510432 60510429 +
ggccaacttcctcacctctt

SEQ ID NO: 164775 - DNA, 20 bp, Artificial Sequence
  Synthetic oligonucleotide; GAG chr2 60510415 60510434 60510431 +
ccaacttcctcacctctttg

SEQ ID NO: 164776 - DNA, 20 bp, Artificial Sequence
  Synthetic oligonucleotide; TGG chr2 60510432 60510451 60510448 +
ttggagcctttgcttctcat

SEQ ID NO: 164777 - DNA, 20 bp, Artificial Sequence
  Synthetic oligonucleotide; GGG chr2 60510433 60510452 60510449 +
tggagcctttgcttctcatt

SEQ ID NO: 164778 - DNA, 20 bp, Artificial Sequence
  Synthetic oligonucleotide; AAG chr2 60510459 60510478 60510475 +
tccctaattatcctatttaa

SEQ ID NO: 164779 - DNA, 20 bp, Artificial Sequence
  Synthetic oligonucleotide; TGG chr2 60510464 60510483 60510480 +
aattatcctatttaaaagcc

SEQ ID NO: 164780 - DNA, 20 bp, Artificial Sequence
  Synthetic oligonucleotide; CAG chr2 60510510 60510529 60510526 +
ttccccaccttattttcgtg

SEQ ID NO: 164781 - DNA, 20 bp, Artificial Sequence
  Synthetic oligonucleotide; AGG chr2 60510511 60510530 60510527 +
tccccaccttattttcgtgc

SEQ ID NO: 164782 - DNA, 20 bp, Artificial Sequence
  Synthetic oligonucleotide; CAG chr2 60510514 60510533 60510530 +
ccaccttattttcgtgcagg

SEQ ID NO: 164783 - DNA, 20 bp, Artificial Sequence
  Synthetic oligonucleotide; TGG chr2 60510558 60510577 60510574 +
tatataattcacatatttat

SEQ ID NO: 164784 - DNA, 20 bp, Artificial Sequence
  Synthetic oligonucleotide; CAG chr2 60510580 60510599 60510596 +
gtgcatcttctgtctctccc

SEQ ID NO: 164785 - DNA, 20 bp, Artificial Sequence
  Synthetic oligonucleotide; TAG chr2 60510584 60510603 60510600 +
atcttctgtctctccccagc

SEQ ID NO: 164786 - DNA, 20 bp, Artificial Sequence
  Synthetic oligonucleotide; AAG chr2 60510588 60510607 60510604 +
tctgtctctccccagctaga

SEQ ID NO: 164787 - DNA, 20 bp, Artificial Sequence
  Synthetic oligonucleotide; AGG chr2 60510589 60510608 60510605 +
ctgtctctccccagctagaa

SEQ ID NO: 164788 - DNA, 20 bp, Artificial Sequence
  Synthetic oligonucleotide; GGG chr2 60510590 60510609 60510606 +
tgtctctccccagctagaaa

SEQ ID NO: 164789 - DNA, 20 bp, Artificial Sequence
  Synthetic oligonucleotide; GGG chr2 60510591 60510610 60510607 +
gtctctccccagctagaaag

SEQ ID NO: 164790 - DNA, 20 bp, Artificial Sequence
  Synthetic oligonucleotide; GGG chr2 60510592 60510611 60510608 +
tctctccccagctagaaagg

SEQ ID NO: 164791 - DNA, 20 bp, Artificial Sequence
  Synthetic oligonucleotide; AAG chr2 60510601 60510620 60510617 +
agctagaaagggggtgccac

SEQ ID NO: 164792 - DNA, 20 bp, Artificial Sequence
  Synthetic oligonucleotide; GAG chr2 60510603 60510622 60510619 +
ctagaaagggggtgccacaa

SEQ ID NO: 164793 - DNA, 20 bp, Artificial Sequence
  Synthetic oligonucleotide; CAG chr2 60510606 60510625 60510622 +
gaaagggggtgccacaagag

SEQ ID NO: 164794 - DNA, 20 bp, Artificial Sequence
  Synthetic oligonucleotide; AGG chr2 60510607 60510626 60510623 +
aaagggggtgccacaagagc

SEQ ID NO: 164795 - DNA, 20 bp, Artificial Sequence
  Synthetic oligonucleotide; GGG chr2 60510608 60510627 60510624 +
aagggggtgccacaagagca

SEQ ID NO: 164796 - DNA, 20 bp, Artificial Sequence
  Synthetic oligonucleotide; GAG chr2 60510610 60510629 60510626 +
gggggtgccacaagagcagg

SEQ ID NO: 164797 - DNA, 20 bp, Artificial Sequence
  Synthetic oligonucleotide; AAG chr2 60510618 60510637 60510634 +
cacaagagcagggagttttt

SEQ ID NO: 164798 - DNA, 20 bp, Artificial Sequence
  Synthetic oligonucleotide; AGG chr2 60510619 60510638 60510635 +
acaagagcagggagttttta

SEQ ID NO: 164799 - DNA, 20 bp, Artificial Sequence
  Synthetic oligonucleotide; AAG chr2 60510640 60510659 60510656 +
ggctttctatgcccaacacc

SEQ ID NO: 164800 - DNA, 20 bp, Artificial Sequence
  Synthetic oligonucleotide; CAG chr2 60510652 60510671 60510668 +
ccaacaccaagaaccgttcc

SEQ ID NO: 164801 - DNA, 20 bp, Artificial Sequence
  Synthetic oligonucleotide; TGG chr2 60510659 60510678 60510675 +
caagaaccgttcccagcatg

SEQ ID NO: 164802 - DNA, 20 bp, Artificial Sequence
  Synthetic oligonucleotide; CAG chr2 60510662 60510681 60510678 +
gaaccgttcccagcatgtgg

SEQ ID NO: 164803 - DNA, 20 bp, Artificial Sequence
  Synthetic oligonucleotide; AGG chr2 60510663 60510682 60510679 +
aaccgttcccagcatgtggc

SEQ ID NO: 164804 - DNA, 20 bp, Artificial Sequence
  Synthetic oligonucleotide; GAG chr2 60510694 60510713 60510710 +
atatttgttgaaaaatgaat

SEQ ID NO: 164805 - DNA, 20 bp, Artificial Sequence
  Synthetic oligonucleotide; CAG chr2 60510721 60510740 60510737 +
ccttcacaattccaaactgc

SEQ ID NO: 164806 - DNA, 20 bp, Artificial Sequence
  Synthetic oligonucleotide; AGG chr2 60510722 60510741 60510738 +
cttcacaattccaaactgcc

SEQ ID NO: 164807 - DNA, 20 bp, Artificial Sequence
  Synthetic oligonucleotide; GAG chr2 60510724 60510743 60510740 +
tcacaattccaaactgccag

SEQ ID NO: 164808 - DNA, 20 bp, Artificial Sequence
  Synthetic oligonucleotide; AGG chr2 60510725 60510744 60510741 +
cacaattccaaactgccagg

SEQ ID NO: 164809 - DNA, 20 bp, Artificial Sequence
  Synthetic oligonucleotide; CAG chr2 60510756 60510775 60510772 +
tgccatatctataaaactgt

SEQ ID NO: 164810 - DNA, 20 bp, Artificial Sequence
  Synthetic oligonucleotide; AGG chr2 60510757 60510776 60510773 +
gccatatctataaaactgtc

SEQ ID NO: 164811 - DNA, 20 bp, Artificial Sequence
  Synthetic oligonucleotide; CAG chr2 60510760 60510779 60510776 +
atatctataaaactgtcagg

SEQ ID NO: 164812 - DNA, 20 bp, Artificial Sequence
  Synthetic oligonucleotide; TGG chr2 60510770 60510789 60510786 +
aactgtcaggcagcccaacc

SEQ ID NO: 164813 - DNA, 20 bp, Artificial Sequence
  Synthetic oligonucleotide; GGG chr2 60510771 60510790 60510787 +
actgtcaggcagcccaacct

SEQ ID NO: 164814 - DNA, 20 bp, Artificial Sequence
  Synthetic oligonucleotide; GGG chr2 60510772 60510791 60510788 +
ctgtcaggcagcccaacctg

SEQ ID NO: 164815 - DNA, 20 bp, Artificial Sequence
  Synthetic oligonucleotide; GGG chr2 60510773 60510792 60510789 +
tgtcaggcagcccaacctgg

SEQ ID NO: 164816 - DNA, 20 bp, Artificial Sequence
  Synthetic oligonucleotide; TAG chr2 60510781 60510800 60510797 +
agcccaacctgggggcactt

SEQ ID NO: 164817 - DNA, 20 bp, Artificial Sequence
  Synthetic oligonucleotide; TGG chr2 60510787 60510806 60510803 +
acctgggggcactttagctt

SEQ ID NO: 164818 - DNA, 20 bp, Artificial Sequence
  Synthetic oligonucleotide; TGG chr2 60510794 60510813 60510810 +
ggcactttagctttggatct

SEQ ID NO: 164819 - DNA, 20 bp, Artificial Sequence
  Synthetic oligonucleotide; GGG chr2 60510795 60510814 60510811 +
gcactttagctttggatctt

SEQ ID NO: 164820 - DNA, 20 bp, Artificial Sequence
  Synthetic oligonucleotide; GAG chr2 60510801 60510820 60510817 +
tagctttggatcttgggttt

SEQ ID NO: 164821 - DNA, 20 bp, Artificial Sequence
  Synthetic oligonucleotide; CAG chr2 60510805 60510824 60510821 +
tttggatcttgggtttgagc

SEQ ID NO: 164822 - DNA, 20 bp, Artificial Sequence
  Synthetic oligonucleotide; CAG chr2 60510823 60510842 60510839 +
gccagattccattttcccca

SEQ ID NO: 164823 - DNA, 20 bp, Artificial Sequence
  Synthetic oligonucleotide; AGG chr2 60510824 60510843 60510840 +
ccagattccattttccccac

SEQ ID NO: 164824 - DNA, 20 bp, Artificial Sequence
  Synthetic oligonucleotide; GAG chr2 60510831 60510850 60510847 +
ccattttccccacaggccct

SEQ ID NO: 164825 - DNA, 20 bp, Artificial Sequence
  Synthetic oligonucleotide; CAG chr2 60510839 60510858 60510855 +
cccacaggccctgagaccca

SEQ ID NO: 164826 - DNA, 20 bp, Artificial Sequence
  Synthetic oligonucleotide; AGG chr2 60510840 60510859 60510856 +
ccacaggccctgagacccac

SEQ ID NO: 164827 - DNA, 20 bp, Artificial Sequence
  Synthetic oligonucleotide; GGG chr2 60510841 60510860 60510857 +
cacaggccctgagacccaca

SEQ ID NO: 164828 - DNA, 20 bp, Artificial Sequence
  Synthetic oligonucleotide; AAG chr2 60510844 60510863 60510860 +
aggccctgagacccacaggg

SEQ ID NO: 164829 - DNA, 20 bp, Artificial Sequence
  Synthetic oligonucleotide; GAG chr2 60510846 60510865 60510862 +
gccctgagacccacagggaa

SEQ ID NO: 164830 - DNA, 20 bp, Artificial Sequence
  Synthetic oligonucleotide; TGG chr2 60510869 60510888 60510885 +
cttttgcattataatgtaaa

SEQ ID NO: 164831 - DNA, 20 bp, Artificial Sequence
  Synthetic oligonucleotide; GAG chr2 60510871 60510890 60510887 +
tttgcattataatgtaaatg

SEQ ID NO: 164832 - DNA, 20 bp, Artificial Sequence
  Synthetic oligonucleotide; AGG chr2 60510872 60510891 60510888 +
ttgcattataatgtaaatgg

SEQ ID NO: 164833 - DNA, 20 bp, Artificial Sequence
  Synthetic oligonucleotide; GGG chr2 60510873 60510892 60510889 +
tgcattataatgtaaatgga

SEQ ID NO: 164834 - DNA, 20 bp, Artificial Sequence
  Synthetic oligonucleotide; GGG chr2 60510874 60510893 60510890 +
gcattataatgtaaatggag

SEQ ID NO: 164835 - DNA, 20 bp, Artificial Sequence
  Synthetic oligonucleotide; GAG chr2 60510879 60510898 60510895 +
ataatgtaaatggaggggtt

SEQ ID NO: 164836 - DNA, 20 bp, Artificial Sequence
  Synthetic oligonucleotide; TGG chr2 60510883 60510902 60510899 +
tgtaaatggaggggttgagc

SEQ ID NO: 164837 - DNA, 20 bp, Artificial Sequence
  Synthetic oligonucleotide; TGG chr2 60510888 60510907 60510904 +
atggaggggttgagctggtt

SEQ ID NO: 164838 - DNA, 20 bp, Artificial Sequence
  Synthetic oligonucleotide; GGG chr2 60510889 60510908 60510905 +
tggaggggttgagctggttt

SEQ ID NO: 164839 - DNA, 20 bp, Artificial Sequence
  Synthetic oligonucleotide; GGG chr2 60510890 60510909 60510906 +
ggaggggttgagctggtttg

SEQ ID NO: 164840 - DNA, 20 bp, Artificial Sequence
  Synthetic oligonucleotide; GGG chr2 60510891 60510910 60510907 +
gaggggttgagctggtttgg

SEQ ID NO: 164841 - DNA, 20 bp, Artificial Sequence
  Synthetic oligonucleotide; CAG chr2 60510903 60510922 60510919 +
tggtttgggggaacccttga

SEQ ID NO: 164842 - DNA, 20 bp, Artificial Sequence
  Synthetic oligonucleotide; AGG chr2 60510904 60510923 60510920 +
ggtttgggggaacccttgac

SEQ ID NO: 164843 - DNA, 20 bp, Artificial Sequence
  Synthetic oligonucleotide; GAG chr2 60510906 60510925 60510922 +
tttgggggaacccttgacag

SEQ ID NO: 164844 - DNA, 20 bp, Artificial Sequence
  Synthetic oligonucleotide; CAG chr2 60510910 60510929 60510926 +
ggggaacccttgacaggagc

SEQ ID NO: 164845 - DNA, 20 bp, Artificial Sequence
  Synthetic oligonucleotide; AAG chr2 60510927 60510946 60510943 +
agccagttaaaaccaaacga

SEQ ID NO: 164846 - DNA, 20 bp, Artificial Sequence
  Synthetic oligonucleotide; AAG chr2 60510938 60510957 60510954 +
accaaacgaaagtctttcct

SEQ ID NO: 164847 - DNA, 20 bp, Artificial Sequence
  Synthetic oligonucleotide; AGG chr2 60510939 60510958 60510955 +
ccaaacgaaagtctttccta

SEQ ID NO: 164848 - DNA, 20 bp, Artificial Sequence
  Synthetic oligonucleotide; TAG chr2 60510944 60510963 60510960 +
cgaaagtctttcctaaggct

SEQ ID NO: 164849 - DNA, 20 bp, Artificial Sequence
  Synthetic oligonucleotide; AGG chr2 60510945 60510964 60510961 +
gaaagtctttcctaaggctt

SEQ ID NO: 164850 - DNA, 20 bp, Artificial Sequence
  Synthetic oligonucleotide; TGG chr2 60510948 60510967 60510964 +
agtctttcctaaggcttagg

SEQ ID NO: 164851 - DNA, 20 bp, Artificial Sequence
  Synthetic oligonucleotide; GAG chr2 60510950 60510969 60510966 +
tctttcctaaggcttaggtg

SEQ ID NO: 164852 - DNA, 20 bp, Artificial Sequence
  Synthetic oligonucleotide; TAG chr2 60510957 60510976 60510973 +
taaggcttaggtggagcctc

SEQ ID NO: 164853 - DNA, 20 bp, Artificial Sequence
  Synthetic oligonucleotide; AAG chr2 60510961 60510980 60510977 +
gcttaggtggagcctctaga

SEQ ID NO: 164854 - DNA, 20 bp, Artificial Sequence
  Synthetic oligonucleotide; GAG chr2 60510963 60510982 60510979 +
ttaggtggagcctctagaaa

SEQ ID NO: 164855 - DNA, 20 bp, Artificial Sequence
  Synthetic oligonucleotide; AGG chr2 60510964 60510983 60510980 +
taggtggagcctctagaaag

SEQ ID NO: 164856 - DNA, 20 bp, Artificial Sequence
  Synthetic oligonucleotide; GGG chr2 60510965 60510984 60510981 +
aggtggagcctctagaaaga

SEQ ID NO: 164857 - DNA, 20 bp, Artificial Sequence
  Synthetic oligonucleotide; GGG chr2 60510966 60510985 60510982 +
ggtggagcctctagaaagag

SEQ ID NO: 164858 - DNA, 20 bp, Artificial Sequence
  Synthetic oligonucleotide; GAG chr2 60510971 60510990 60510987 +
agcctctagaaagaggggct

SEQ ID NO: 164859 - DNA, 20 bp, Artificial Sequence
  Synthetic oligonucleotide; GAG chr2 60510973 60510992 60510989 +
cctctagaaagaggggctga

SEQ ID NO: 164860 - DNA, 20 bp, Artificial Sequence
  Synthetic oligonucleotide; TGG chr2 60510978 60510997 60510994 +
agaaagaggggctgagagcc

SEQ ID NO: 164861 - DNA, 20 bp, Artificial Sequence
  Synthetic oligonucleotide; GGG chr2 60510979 60510998 60510995 +
gaaagaggggctgagagcct

SEQ ID NO: 164862 - DNA, 20 bp, Artificial Sequence
  Synthetic oligonucleotide; GGG chr2 60510980 60510999 60510996 +
aaagaggggctgagagcctg

SEQ ID NO: 164863 - DNA, 20 bp, Artificial Sequence
  Synthetic oligonucleotide; AAG chr2 60510983 60511002 60510999 +
gaggggctgagagcctgggg

SEQ ID NO: 164864 - DNA, 20 bp, Artificial Sequence
  Synthetic oligonucleotide; GAG chr2 60510985 60511004 60511001 +
ggggctgagagcctggggaa

SEQ ID NO: 164865 - DNA, 20 bp, Artificial Sequence
  Synthetic oligonucleotide; CAG chr2 60510996 60511015 60511012 +
cctggggaagagccaaccac

SEQ ID NO: 164866 - DNA, 20 bp, Artificial Sequence
  Synthetic oligonucleotide; CAG chr2 60510999 60511018 60511015 +
ggggaagagccaaccaccag

SEQ ID NO: 164867 - DNA, 20 bp, Artificial Sequence
  Synthetic oligonucleotide; CAG chr2 60511007 60511026 60511023 +
gccaaccaccagcagttcct

SEQ ID NO: 164868 - DNA, 20 bp, Artificial Sequence
  Synthetic oligonucleotide; GAG chr2 60511009 60511028 60511025 +
caaccaccagcagttcctca

SEQ ID NO: 164869 - DNA, 20 bp, Artificial Sequence
  Synthetic oligonucleotide; TGG chr2 60511022 60511041 60511038 +
ttcctcagagttcttcccac

SEQ ID NO: 164870 - DNA, 20 bp, Artificial Sequence
  Synthetic oligonucleotide; GGG chr2 60511023 60511042 60511039 +
tcctcagagttcttcccact

SEQ ID NO: 164871 - DNA, 20 bp, Artificial Sequence
  Synthetic oligonucleotide; GGG chr2 60511024 60511043 60511040 +
cctcagagttcttcccactg

SEQ ID NO: 164872 - DNA, 20 bp, Artificial Sequence
  Synthetic oligonucleotide; CAG chr2 60511032 60511051 60511048 +
ttcttcccactggggctgtg

SEQ ID NO: 164873 - DNA, 20 bp, Artificial Sequence
  Synthetic oligonucleotide; CAG chr2 60511048 60511067 60511064 +
tgtgcagccaactgcgtttc

SEQ ID NO: 164874 - DNA, 20 bp, Artificial Sequence
  Synthetic oligonucleotide; AGG chr2 60511049 60511068 60511065 +
gtgcagccaactgcgtttcc

SEQ ID NO: 164875 - DNA, 20 bp, Artificial Sequence
  Synthetic oligonucleotide; GAG chr2 60511058 60511077 60511074 +
actgcgtttccaggcacact

SEQ ID NO: 164876 - DNA, 20 bp, Artificial Sequence
  Synthetic oligonucleotide; CAG chr2 60511088 60511107 60511104 +
tactcatatccaatactgtg

SEQ ID NO: 164877 - DNA, 20 bp, Artificial Sequence
  Synthetic oligonucleotide; AGG chr2 60511089 60511108 60511105 +
actcatatccaatactgtgc

SEQ ID NO: 164878 - DNA, 20 bp, Artificial Sequence
  Synthetic oligonucleotide; GGG chr2 60511090 60511109 60511106 +
ctcatatccaatactgtgca

SEQ ID NO: 164879 - DNA, 20 bp, Artificial Sequence
  Synthetic oligonucleotide; GGG chr2 60511091 60511110 60511107 +
tcatatccaatactgtgcag

SEQ ID NO: 164880 - DNA, 20 bp, Artificial Sequence
  Synthetic oligonucleotide; TGG chr2 60511097 60511116 60511113 +
ccaatactgtgcaggggcac

SEQ ID NO: 164881 - DNA, 20 bp, Artificial Sequence
  Synthetic oligonucleotide; CAG chr2 60511101 60511120 60511117 +
tactgtgcaggggcactggc

SEQ ID NO: 164882 - DNA, 20 bp, Artificial Sequence
  Synthetic oligonucleotide; AGG chr2 60511102 60511121 60511118 +
actgtgcaggggcactggcc

SEQ ID NO: 164883 - DNA, 20 bp, Artificial Sequence
  Synthetic oligonucleotide; CAG chr2 60511114 60511133 60511130 +
cactggccaggcacaaatcc

SEQ ID NO: 164884 - DNA, 20 bp, Artificial Sequence
  Synthetic oligonucleotide; CGG chr2 60511126 60511145 60511142 +
acaaatcccagctgcctcca

SEQ ID NO: 164885 - DNA, 20 bp, Artificial Sequence
  Synthetic oligonucleotide; CAG chr2 60511155 60511174 60511171 +
tctccctccattcttgcttt

SEQ ID NO: 164886 - DNA, 20 bp, Artificial Sequence
  Synthetic oligonucleotide; TGG chr2 60511172 60511191 60511188 +
tttcagattctccctcctcc

SEQ ID NO: 164887 - DNA, 20 bp, Artificial Sequence
  Synthetic oligonucleotide; CAG chr2 60511175 60511194 60511191 +
cagattctccctcctcctgg

SEQ ID NO: 164888 - DNA, 20 bp, Artificial Sequence
  Synthetic oligonucleotide; AGG chr2 60511176 60511195 60511192 +
agattctccctcctcctggc

SEQ ID NO: 164889 - DNA, 20 bp, Artificial Sequence
  Synthetic oligonucleotide; GGG chr2 60511177 60511196 60511193 +
gattctccctcctcctggca

SEQ ID NO: 164890 - DNA, 20 bp, Artificial Sequence
  Synthetic oligonucleotide; GGG chr2 60511178 60511197 60511194 +
attctccctcctcctggcag

SEQ ID NO: 164891 - DNA, 20 bp, Artificial Sequence
  Synthetic oligonucleotide; TGG chr2 60511184 60511203 60511200 +
cctcctcctggcaggggcac

SEQ ID NO: 164892 - DNA, 20 bp, Artificial Sequence
  Synthetic oligonucleotide; GGG chr2 60511185 60511204 60511201 +
ctcctcctggcaggggcact

SEQ ID NO: 164893 - DNA, 20 bp, Artificial Sequence
  Synthetic oligonucleotide; GGG chr2 60511186 60511205 60511202 +
tcctcctggcaggggcactg

SEQ ID NO: 164894 - DNA, 20 bp, Artificial Sequence
  Synthetic oligonucleotide; GAG chr2 60511188 60511207 60511204 +
ctcctggcaggggcactggg

SEQ ID NO: 164895 - DNA, 20 bp, Artificial Sequence
  Synthetic oligonucleotide; AGG chr2 60511189 60511208 60511205 +
tcctggcaggggcactgggg

SEQ ID NO: 164896 - DNA, 20 bp, Artificial Sequence
  Synthetic oligonucleotide; GGG chr2 60511190 60511209 60511206 +
cctggcaggggcactgggga

SEQ ID NO: 164897 - DNA, 20 bp, Artificial Sequence
  Synthetic oligonucleotide; CAG chr2 60511193 60511212 60511209 +
ggcaggggcactggggaggg

SEQ ID NO: 164898 - DNA, 20 bp, Artificial Sequence
  Synthetic oligonucleotide; AGG chr2 60511194 60511213 60511210 +
gcaggggcactggggagggc

SEQ ID NO: 164899 - DNA, 20 bp, Artificial Sequence
  Synthetic oligonucleotide; GAG chr2 60511196 60511215 60511212 +
aggggcactggggagggcag

SEQ ID NO: 164900 - DNA, 20 bp, Artificial Sequence
  Synthetic oligonucleotide; GAG chr2 60511198 60511217 60511214 +
gggcactggggagggcagga

SEQ ID NO: 164901 - DNA, 20 bp, Artificial Sequence
  Synthetic oligonucleotide; AAG chr2 60511201 60511220 60511217 +
cactggggagggcaggagag

SEQ ID NO: 164902 - DNA, 20 bp, Artificial Sequence
  Synthetic oligonucleotide; AGG chr2 60511202 60511221 60511218 +
actggggagggcaggagaga

SEQ ID NO: 164903 - DNA, 20 bp, Artificial Sequence
  Synthetic oligonucleotide; GAG chr2 60511204 60511223 60511220 +
tggggagggcaggagagaag

SEQ ID NO: 164904 - DNA, 20 bp, Artificial Sequence
  Synthetic oligonucleotide; AGG chr2 60511205 60511224 60511221 +
ggggagggcaggagagaagg

SEQ ID NO: 164905 - DNA, 20 bp, Artificial Sequence
  Synthetic oligonucleotide; TGG chr2 60511211 60511230 60511227 +
ggcaggagagaaggaggcca

SEQ ID NO: 164906 - DNA, 20 bp, Artificial Sequence
  Synthetic oligonucleotide; AAG chr2 60511216 60511235 60511232 +
gagagaaggaggccatggca

SEQ ID NO: 164907 - DNA, 20 bp, Artificial Sequence
  Synthetic oligonucleotide; AGG chr2 60511217 60511236 60511233 +
agagaaggaggccatggcaa

SEQ ID NO: 164908 - DNA, 20 bp, Artificial Sequence
  Synthetic oligonucleotide; GGG chr2 60511218 60511237 60511234 +
gagaaggaggccatggcaaa

SEQ ID NO: 164909 - DNA, 20 bp, Artificial Sequence
  Synthetic oligonucleotide; GAG chr2 60511238 60511257 60511254 +
gggacaaatcccttctacct

SEQ ID NO: 164910 - DNA, 20 bp, Artificial Sequence
  Synthetic oligonucleotide; GAG chr2 60511240 60511259 60511256 +
gacaaatcccttctacctga

SEQ ID NO: 164911 - DNA, 20 bp, Artificial Sequence
  Synthetic oligonucleotide; CGG chr2 60511245 60511264 60511261 +
atcccttctacctgagagcc

SEQ ID NO: 164912 - DNA, 20 bp, Artificial Sequence
  Synthetic oligonucleotide; GGG chr2 60511246 60511265 60511262 +
tcccttctacctgagagccc

SEQ ID NO: 164913 - DNA, 20 bp, Artificial Sequence
  Synthetic oligonucleotide; CAG chr2 60511252 60511271 60511268 +
ctacctgagagcccgggatg

SEQ ID NO: 164914 - DNA, 20 bp, Artificial Sequence
  Synthetic oligonucleotide; CAG chr2 60511256 60511275 60511272 +
ctgagagcccgggatgcagc

SEQ ID NO: 164915 - DNA, 20 bp, Artificial Sequence
  Synthetic oligonucleotide; AAG chr2 60511261 60511280 60511277 +
agcccgggatgcagccagaa

SEQ ID NO: 164916 - DNA, 20 bp, Artificial Sequence
  Synthetic oligonucleotide; TAG chr2 60511285 60511304 60511301 +
taaaataccctttcccaccc

SEQ ID NO: 164917 - DNA, 20 bp, Artificial Sequence
  Synthetic oligonucleotide; CAG chr2 60511300 60511319 60511316 +
caccctagcatacaatttga

SEQ ID NO: 164918 - DNA, 20 bp, Artificial Sequence
  Synthetic oligonucleotide; AGG chr2 60511301 60511320 60511317 +
accctagcatacaatttgac

SEQ ID NO: 164919 - DNA, 20 bp, Artificial Sequence
  Synthetic oligonucleotide; AAG chr2 60511309 60511328 60511325 +
atacaatttgacaggtgaat

SEQ ID NO: 164920 - DNA, 20 bp, Artificial Sequence
  Synthetic oligonucleotide; CAG chr2 60511319 60511338 60511335 +
acaggtgaataagtgctccc

SEQ ID NO: 164921 - DNA, 20 bp, Artificial Sequence
  Synthetic oligonucleotide; TAG chr2 60511322 60511341 60511338 +
ggtgaataagtgctccccag

SEQ ID NO: 164922 - DNA, 20 bp, Artificial Sequence
  Synthetic oligonucleotide; AGG chr2 60511323 60511342 60511339 +
gtgaataagtgctccccagt

SEQ ID NO: 164923 - DNA, 20 bp, Artificial Sequence
  Synthetic oligonucleotide; AAG chr2 60511333 60511352 60511349 +
gctccccagtaggcaataac

SEQ ID NO: 164924 - DNA, 20 bp, Artificial Sequence
  Synthetic oligonucleotide; AGG chr2 60511334 60511353 60511350 +
ctccccagtaggcaataaca

SEQ ID NO: 164925 - DNA, 20 bp, Artificial Sequence
  Synthetic oligonucleotide; GAG chr2 60511336 60511355 60511352 +
ccccagtaggcaataacaag

SEQ ID NO: 164926 - DNA, 20 bp, Artificial Sequence
  Synthetic oligonucleotide; AAG chr2 60511339 60511358 60511355 +
cagtaggcaataacaaggag

SEQ ID NO: 164927 - DNA, 20 bp, Artificial Sequence
  Synthetic oligonucleotide; AAG chr2 60511352 60511371 60511368 +
caaggagaagtctgaattaa

SEQ ID NO: 164928 - DNA, 20 bp, Artificial Sequence
  Synthetic oligonucleotide; TGG chr2 60511367 60511386 60511383 +
attaaaagaactcgccaatt

SEQ ID NO: 164929 - DNA, 20 bp, Artificial Sequence
  Synthetic oligonucleotide; GGG chr2 60511368 60511387 60511384 +
ttaaaagaactcgccaattt

SEQ ID NO: 164930 - DNA, 20 bp, Artificial Sequence
  Synthetic oligonucleotide; AAG chr2 60511371 60511390 60511387 +
aaagaactcgccaatttggg

SEQ ID NO: 164931 - DNA, 20 bp, Artificial Sequence
  Synthetic oligonucleotide; AAG chr2 60511425 60511444 60511441 +
cgttaccaataaaacactta

SEQ ID NO: 164932 - DNA, 20 bp, Artificial Sequence
  Synthetic oligonucleotide; CAG chr2 60511440 60511459 60511456 +
acttaaagatgctattcatg

SEQ ID NO: 164933 - DNA, 20 bp, Artificial Sequence
  Synthetic oligonucleotide; AAG chr2 60511448 60511467 60511464 +
atgctattcatgcagacata

SEQ ID NO: 164934 - DNA, 20 bp, Artificial Sequence
  Synthetic oligonucleotide; TGG chr2 60511457 60511476 60511473 +
atgcagacataaagtgctaa

SEQ ID NO: 164935 - DNA, 20 bp, Artificial Sequence
  Synthetic oligonucleotide; CAG chr2 60511509 60511528 60511525 +
tatttccctctgatttctga

SEQ ID NO: 164936 - DNA, 20 bp, Artificial Sequence
  Synthetic oligonucleotide; TGG chr2 60511537 60511556 60511553 +
tttttttccttcttcttttt

SEQ ID NO: 164937 - DNA, 20 bp, Artificial Sequence
  Synthetic oligonucleotide; GGG chr2 60511538 60511557 60511554 +
ttttttccttcttctttttt

SEQ ID NO: 164938 - DNA, 20 bp, Artificial Sequence
  Synthetic oligonucleotide; GGG chr2 60511539 60511558 60511555 +
tttttccttcttcttttttg

SEQ ID NO: 164939 - DNA, 20 bp, Artificial Sequence
  Synthetic oligonucleotide; AAG chr2 60511549 60511568 60511565 +
ttcttttttggggctatttt

SEQ ID NO: 164940 - DNA, 20 bp, Artificial Sequence
  Synthetic oligonucleotide; CAG chr2 60511556 60511575 60511572 +
ttggggctattttaagttaa

SEQ ID NO: 164941 - DNA, 20 bp, Artificial Sequence
  Synthetic oligonucleotide; GAG chr2 60511558 60511577 60511574 +
ggggctattttaagttaaca

SEQ ID NO: 164942 - DNA, 20 bp, Artificial Sequence
  Synthetic oligonucleotide; AAG chr2 60511582 60511601 60511598 +
gctaatctgattcaaaactg

SEQ ID NO: 164943 - DNA, 20 bp, Artificial Sequence
  Synthetic oligonucleotide; AAG chr2 60511590 60511609 60511606 +
gattcaaaactgaagactca

SEQ ID NO: 164944 - DNA, 20 bp, Artificial Sequence
  Synthetic oligonucleotide; GAG chr2 60511592 60511611 60511608 +
ttcaaaactgaagactcaaa

SEQ ID NO: 164945 - DNA, 20 bp, Artificial Sequence
  Synthetic oligonucleotide; CAG chr2 60511673 60511692 60511689 +
tcatgaaaacaatcatcact

SEQ ID NO: 164946 - DNA, 20 bp, Artificial Sequence
  Synthetic oligonucleotide; AAG chr2 60511690 60511709 60511706 +
actcagtcaacgtattttcc

SEQ ID NO: 164947 - DNA, 20 bp, Artificial Sequence
  Synthetic oligonucleotide; CAG chr2 60511696 60511715 60511712 +
tcaacgtattttccaagcca

SEQ ID NO: 164948 - DNA, 20 bp, Artificial Sequence
  Synthetic oligonucleotide; AAG chr2 60511704 60511723 60511720 +
ttttccaagccacagaaaat

SEQ ID NO: 164949 - DNA, 20 bp, Artificial Sequence
  Synthetic oligonucleotide; AAG chr2 60511714 60511733 60511730 +
cacagaaaataagttgaaat

SEQ ID NO: 164950 - DNA, 20 bp, Artificial Sequence
  Synthetic oligonucleotide; CAG chr2 60511726 60511745 60511742 +
gttgaaataagttgaaaatg

SEQ ID NO: 164951 - DNA, 20 bp, Artificial Sequence
  Synthetic oligonucleotide; TAG chr2 60511729 60511748 60511745 +
gaaataagttgaaaatgcag

SEQ ID NO: 164952 - DNA, 20 bp, Artificial Sequence
  Synthetic oligonucleotide; AGG chr2 60511730 60511749 60511746 +
aaataagttgaaaatgcagt

SEQ ID NO: 164953 - DNA, 20 bp, Artificial Sequence
  Synthetic oligonucleotide; AAG chr2 60511735 60511754 60511751 +
agttgaaaatgcagtaggca

SEQ ID NO: 164954 - DNA, 20 bp, Artificial Sequence
  Synthetic oligonucleotide; AAG chr2 60511738 60511757 60511754 +
tgaaaatgcagtaggcaaag

SEQ ID NO: 164955 - DNA, 20 bp, Artificial Sequence
  Synthetic oligonucleotide; CAG chr2 60511741 60511760 60511757 +
aaatgcagtaggcaaagaag

SEQ ID NO: 164956 - DNA, 20 bp, Artificial Sequence
  Synthetic oligonucleotide; TAG chr2 60511745 60511764 60511761 +
gcagtaggcaaagaagcagc

SEQ ID NO: 164957 - DNA, 20 bp, Artificial Sequence
  Synthetic oligonucleotide; AAG chr2 60511754 60511773 60511770 +
aaagaagcagctagtcatgt

SEQ ID NO: 164958 - DNA, 20 bp, Artificial Sequence
  Synthetic oligonucleotide; AAG chr2 60511762 60511781 60511778 +
agctagtcatgtaagacact

SEQ ID NO: 164959 - DNA, 20 bp, Artificial Sequence
  Synthetic oligonucleotide; AGG chr2 60511763 60511782 60511779 +
gctagtcatgtaagacacta

SEQ ID NO: 164960 - DNA, 20 bp, Artificial Sequence
  Synthetic oligonucleotide; GGG chr2 60511764 60511783 60511780 +
ctagtcatgtaagacactaa

SEQ ID NO: 164961 - DNA, 20 bp, Artificial Sequence
  Synthetic oligonucleotide; GGG chr2 60511765 60511784 60511781 +
tagtcatgtaagacactaag

SEQ ID NO: 164962 - DNA, 20 bp, Artificial Sequence
  Synthetic oligonucleotide; CAG chr2 60511768 60511787 60511784 +
tcatgtaagacactaagggg

SEQ ID NO: 164963 - DNA, 20 bp, Artificial Sequence
  Synthetic oligonucleotide; AGG chr2 60511769 60511788 60511785 +
catgtaagacactaaggggc

SEQ ID NO: 164964 - DNA, 20 bp, Artificial Sequence
  Synthetic oligonucleotide; GGG chr2 60511770 60511789 60511786 +
atgtaagacactaaggggca

SEQ ID NO: 164965 - DNA, 20 bp, Artificial Sequence
  Synthetic oligonucleotide; GGG chr2 60511771 60511790 60511787 +
tgtaagacactaaggggcag

SEQ ID NO: 164966 - DNA, 20 bp, Artificial Sequence
  Synthetic oligonucleotide; GAG chr2 60511773 60511792 60511789 +
taagacactaaggggcaggg

SEQ ID NO: 164967 - DNA, 20 bp, Artificial Sequence
  Synthetic oligonucleotide; AAG chr2 60511792 60511811 60511808 +
ggagtcattaattcttctcc

SEQ ID NO: 164968 - DNA, 20 bp, Artificial Sequence
  Synthetic oligonucleotide; AAG chr2 60511817 60511836 60511833 +
ttcaacactctgtttctatg

SEQ ID NO: 164969 - DNA, 20 bp, Artificial Sequence
  Synthetic oligonucleotide; AGG chr2 60511818 60511837 60511834 +
tcaacactctgtttctatga

SEQ ID NO: 164970 - DNA, 20 bp, Artificial Sequence
  Synthetic oligonucleotide; AAG chr2 60511822 60511841 60511838 +
cactctgtttctatgaaggc

SEQ ID NO: 164971 - DNA, 20 bp, Artificial Sequence
  Synthetic oligonucleotide; AGG chr2 60511823 60511842 60511839 +
actctgtttctatgaaggca

SEQ ID NO: 164972 - DNA, 20 bp, Artificial Sequence
  Synthetic oligonucleotide; GGG chr2 60511824 60511843 60511840 +
ctctgtttctatgaaggcaa

SEQ ID NO: 164973 - DNA, 20 bp, Artificial Sequence
  Synthetic oligonucleotide; TGG chr2 60511828 60511847 60511844 +
gtttctatgaaggcaagggt

SEQ ID NO: 164974 - DNA, 20 bp, Artificial Sequence
  Synthetic oligonucleotide; GAG chr2 60511830 60511849 60511846 +
ttctatgaaggcaagggttg

SEQ ID NO: 164975 - DNA, 20 bp, Artificial Sequence
  Synthetic oligonucleotide; AGG chr2 60511831 60511850 60511847 +
tctatgaaggcaagggttgg

SEQ ID NO: 164976 - DNA, 20 bp, Artificial Sequence
  Synthetic oligonucleotide; GGG chr2 60511832 60511851 60511848 +
ctatgaaggcaagggttgga

SEQ ID NO: 164977 - DNA, 20 bp, Artificial Sequence
  Synthetic oligonucleotide; GAG chr2 60511834 60511853 60511850 +
atgaaggcaagggttggagg

SEQ ID NO: 164978 - DNA, 20 bp, Artificial Sequence
  Synthetic oligonucleotide; CAG chr2 60511857 60511876 60511873 +
cttttttctttcaaataaat

SEQ ID NO: 164979 - DNA, 20 bp, Artificial Sequence
  Synthetic oligonucleotide; GAG chr2 60511869 60511888 60511885 +
aaataaatcagtaaaatgat

SEQ ID NO: 164980 - DNA, 20 bp, Artificial Sequence
  Synthetic oligonucleotide; AGG chr2 60511870 60511889 60511886 +
aataaatcagtaaaatgatg

SEQ ID NO: 164981 - DNA, 20 bp, Artificial Sequence
  Synthetic oligonucleotide; CAG chr2 60511891 60511910 60511907 +
ggtgcttcctctgctacgcc

SEQ ID NO: 164982 - DNA, 20 bp, Artificial Sequence
  Synthetic oligonucleotide; TGG chr2 60511894 60511913 60511910 +
gcttcctctgctacgcccag

SEQ ID NO: 164983 - DNA, 20 bp, Artificial Sequence
  Synthetic oligonucleotide; CAG chr2 60511899 60511918 60511915 +
ctctgctacgcccagtggcc

SEQ ID NO: 164984 - DNA, 20 bp, Artificial Sequence
  Synthetic oligonucleotide; AGG chr2 60511900 60511919 60511916 +
tctgctacgcccagtggccc

SEQ ID NO: 164985 - DNA, 20 bp, Artificial Sequence
  Synthetic oligonucleotide; AAG chr2 60511913 60511932 60511929 +
gtggcccaggcactctcact

SEQ ID NO: 164986 - DNA, 20 bp, Artificial Sequence
  Synthetic oligonucleotide; AGG chr2 60511914 60511933 60511930 +
tggcccaggcactctcacta

SEQ ID NO: 164987 - DNA, 20 bp, Artificial Sequence
  Synthetic oligonucleotide; CAG chr2 60511925 60511944 60511941 +
ctctcactaaggtatcctcc

SEQ ID NO: 164988 - DNA, 20 bp, Artificial Sequence
  Synthetic oligonucleotide; TAG chr2 60511933 60511952 60511949 +
aaggtatcctcccagcaatg

SEQ ID NO: 164989 - DNA, 20 bp, Artificial Sequence
  Synthetic oligonucleotide; AGG chr2 60511934 60511953 60511950 +
aggtatcctcccagcaatgt

SEQ ID NO: 164990 - DNA, 20 bp, Artificial Sequence
  Synthetic oligonucleotide; AAG chr2 60511943 60511962 60511959 +
cccagcaatgtaggtgttca

SEQ ID NO: 164991 - DNA, 20 bp, Artificial Sequence
  Synthetic oligonucleotide; AGG chr2 60511944 60511963 60511960 +
ccagcaatgtaggtgttcaa

SEQ ID NO: 164992 - DNA, 20 bp, Artificial Sequence
  Synthetic oligonucleotide; AAG chr2 60511950 60511969 60511966 +
atgtaggtgttcaaaggcaa

SEQ ID NO: 164993 - DNA, 20 bp, Artificial Sequence
  Synthetic oligonucleotide; AAG chr2 60511954 60511973 60511970 +
aggtgttcaaaggcaaaaga

SEQ ID NO: 164994 - DNA, 20 bp, Artificial Sequence
  Synthetic oligonucleotide; AGG chr2 60511955 60511974 60511971 +
ggtgttcaaaggcaaaagaa

SEQ ID NO: 164995 - DNA, 20 bp, Artificial Sequence
  Synthetic oligonucleotide; GGG chr2 60511956 60511975 60511972 +
gtgttcaaaggcaaaagaaa

SEQ ID NO: 164996 - DNA, 20 bp, Artificial Sequence
  Synthetic oligonucleotide; CAG chr2 60511962 60511981 60511978 +
aaaggcaaaagaaagggaac

SEQ ID NO: 164997 - DNA, 20 bp, Artificial Sequence
  Synthetic oligonucleotide; TGG chr2 60511969 60511988 60511985 +
aaagaaagggaaccagctca

SEQ ID NO: 164998 - DNA, 20 bp, Artificial Sequence
  Synthetic oligonucleotide; CGG chr2 60511985 60512004 60512001 +
ctcatggcgtaatacttgct

SEQ ID NO: 164999 - DNA, 20 bp, Artificial Sequence
  Synthetic oligonucleotide; AAG chr2 60511991 60512010 60512007 +
gcgtaatacttgctcggcca

SEQ ID NO: 165000 - DNA, 20 bp, Artificial Sequence
  Synthetic oligonucleotide; TAG chr2 60511997 60512016 60512013 +
tacttgctcggccaaagaca

SEQ ID NO: 165001 - DNA, 20 bp, Artificial Sequence
  Synthetic oligonucleotide; CAG chr2 60512010 60512029 60512026 +
aaagacatagtaacgcttcc

SEQ ID NO: 165002 - DNA, 20 bp, Artificial Sequence
  Synthetic oligonucleotide; AGG chr2 60512011 60512030 60512027 +
aagacatagtaacgcttccc

SEQ ID NO: 165003 - DNA, 20 bp, Artificial Sequence
  Synthetic oligonucleotide; AAG chr2 60512020 60512039 60512036 +
taacgcttcccaggaaatac

SEQ ID NO: 165004 - DNA, 20 bp, Artificial Sequence
  Synthetic oligonucleotide; CAG chr2 60512028 60512047 60512044 +
cccaggaaatacaagtgtca

SEQ ID NO: 165005 - DNA, 20 bp, Artificial Sequence
  Synthetic oligonucleotide; CAG chr2 60512054 60512073 60512070 +
ctccaaaatgaatatgtgtg

SEQ ID NO: 165006 - DNA, 20 bp, Artificial Sequence
  Synthetic oligonucleotide; TGG chr2 60512062 60512081 60512078 +
tgaatatgtgtgcagccacc

SEQ ID NO: 165007 - DNA, 20 bp, Artificial Sequence
  Synthetic oligonucleotide; GGG chr2 60512063 60512082 60512079 +
gaatatgtgtgcagccacct

SEQ ID NO: 165008 - DNA, 20 bp, Artificial Sequence
  Synthetic oligonucleotide; TGG chr2 60512089 60512108 60512105 +
gcaacttaattcaaacaact

SEQ ID NO: 165009 - DNA, 20 bp, Artificial Sequence
  Synthetic oligonucleotide; AAG chr2 60512092 60512111 60512108 +
acttaattcaaacaacttgg

SEQ ID NO: 165010 - DNA, 20 bp, Artificial Sequence
  Synthetic oligonucleotide; AGG chr2 60512093 60512112 60512109 +
cttaattcaaacaacttgga

SEQ ID NO: 165011 - DNA, 20 bp, Artificial Sequence
  Synthetic oligonucleotide; AAG chr2 60512098 60512117 60512114 +
ttcaaacaacttggaaggct

SEQ ID NO: 165012 - DNA, 20 bp, Artificial Sequence
  Synthetic oligonucleotide; AGG chr2 60512099 60512118 60512115 +
tcaaacaacttggaaggcta

SEQ ID NO: 165013 - DNA, 20 bp, Artificial Sequence
  Synthetic oligonucleotide; GAG chr2 60512101 60512120 60512117 +
aaacaacttggaaggctaag

SEQ ID NO: 165014 - DNA, 20 bp, Artificial Sequence
  Synthetic oligonucleotide; TGG chr2 60512107 60512126 60512123 +
cttggaaggctaaggagcac

SEQ ID NO: 165015 - DNA, 20 bp, Artificial Sequence
  Synthetic oligonucleotide; GAG chr2 60512109 60512128 60512125 +
tggaaggctaaggagcactg

SEQ ID NO: 165016 - DNA, 20 bp, Artificial Sequence
  Synthetic oligonucleotide; TGG chr2 60512113 60512132 60512129 +
aggctaaggagcactggagc

SEQ ID NO: 165017 - DNA, 20 bp, Artificial Sequence
  Synthetic oligonucleotide; GGG chr2 60512114 60512133 60512130 +
ggctaaggagcactggagct

SEQ ID NO: 165018 - DNA, 20 bp, Artificial Sequence
  Synthetic oligonucleotide; GGG chr2 60512115 60512134 60512131 +
gctaaggagcactggagctg

SEQ ID NO: 165019 - DNA, 20 bp, Artificial Sequence
  Synthetic oligonucleotide; GAG chr2 60512117 60512136 60512133 +
taaggagcactggagctggg

SEQ ID NO: 165020 - DNA, 20 bp, Artificial Sequence
  Synthetic oligonucleotide; CAG chr2 60512123 60512142 60512139 +
gcactggagctggggagctg

SEQ ID NO: 165021 - DNA, 20 bp, Artificial Sequence
  Synthetic oligonucleotide; TGG chr2 60512150 60512169 60512166 +
acccctgtgctcaccacccc

SEQ ID NO: 165022 - DNA, 20 bp, Artificial Sequence
  Synthetic oligonucleotide; GAG chr2 60512152 60512171 60512168 +
ccctgtgctcaccacccctg

SEQ ID NO: 165023 - DNA, 20 bp, Artificial Sequence
  Synthetic oligonucleotide; GAG chr2 60512154 60512173 60512170 +
ctgtgctcaccacccctgga

SEQ ID NO: 165024 - DNA, 20 bp, Artificial Sequence
  Synthetic oligonucleotide; CAG chr2 60512157 60512176 60512173 +
tgctcaccacccctggagag

SEQ ID NO: 165025 - DNA, 20 bp, Artificial Sequence
  Synthetic oligonucleotide; CAG chr2 60512161 60512180 60512177 +
caccacccctggagagcagt

SEQ ID NO: 165026 - DNA, 20 bp, Artificial Sequence
  Synthetic oligonucleotide; GAG chr2 60512163 60512182 60512179 +
ccacccctggagagcagtca

SEQ ID NO: 165027 - DNA, 20 bp, Artificial Sequence
  Synthetic oligonucleotide; GAG chr2 60512165 60512184 60512181 +
acccctggagagcagtcaga

SEQ ID NO: 165028 - DNA, 20 bp, Artificial Sequence
  Synthetic oligonucleotide; AGG chr2 60512166 60512185 60512182 +
cccctggagagcagtcagag

SEQ ID NO: 165029 - DNA, 20 bp, Artificial Sequence
  Synthetic oligonucleotide; AAG chr2 60512169 60512188 60512185 +
ctggagagcagtcagagagg

SEQ ID NO: 165030 - DNA, 20 bp, Artificial Sequence
  Synthetic oligonucleotide; CAG chr2 60512183 60512202 60512199 +
gagaggaagcctgctttcct

SEQ ID NO: 165031 - DNA, 20 bp, Artificial Sequence
  Synthetic oligonucleotide; AAG chr2 60512194 60512213 60512210 +
tgctttcctcagatgtttta

SEQ ID NO: 165032 - DNA, 20 bp, Artificial Sequence
  Synthetic oligonucleotide; AGG chr2 60512195 60512214 60512211 +
gctttcctcagatgttttaa

SEQ ID NO: 165033 - DNA, 20 bp, Artificial Sequence
  Synthetic oligonucleotide; AAG chr2 60512198 60512217 60512214 +
ttcctcagatgttttaaagg

SEQ ID NO: 165034 - DNA, 20 bp, Artificial Sequence
  Synthetic oligonucleotide; TAG chr2 60512206 60512225 60512222 +
atgttttaaaggaagccacc

SEQ ID NO: 165035 - DNA, 20 bp, Artificial Sequence
  Synthetic oligonucleotide; GAG chr2 60512208 60512227 60512224 +
gttttaaaggaagccaccta

SEQ ID NO: 165036 - DNA, 20 bp, Artificial Sequence
  Synthetic oligonucleotide; TGG chr2 60512226 60512245 60512242 +
tagagccccacctgtcactg

SEQ ID NO: 165037 - DNA, 20 bp, Artificial Sequence
  Synthetic oligonucleotide; TGG chr2 60512238 60512257 60512254 +
tgtcactgtggaactgctca

SEQ ID NO: 165038 - DNA, 20 bp, Artificial Sequence
  Synthetic oligonucleotide; TGG chr2 60512241 60512260 60512257 +
cactgtggaactgctcatgg

SEQ ID NO: 165039 - DNA, 20 bp, Artificial Sequence
  Synthetic oligonucleotide; TGG chr2 60512262 60512281 60512278 +
ggctgcccgatgcgctgatg

SEQ ID NO: 165040 - DNA, 20 bp, Artificial Sequence
  Synthetic oligonucleotide; CAG chr2 60512269 60512288 60512285 +
cgatgcgctgatgtggaact

SEQ ID NO: 165041 - DNA, 20 bp, Artificial Sequence
  Synthetic oligonucleotide; TGG chr2 60512283 60512302 60512299 +
ggaactcagaatcattcatt

SEQ ID NO: 165042 - DNA, 20 bp, Artificial Sequence
  Synthetic oligonucleotide; GGG chr2 60512284 60512303 60512300 +
gaactcagaatcattcattt

SEQ ID NO: 165043 - DNA, 20 bp, Artificial Sequence
  Synthetic oligonucleotide; TGG chr2 60512291 60512310 60512307 +
gaatcattcatttgggcttg

SEQ ID NO: 165044 - DNA, 20 bp, Artificial Sequence
  Synthetic oligonucleotide; GAG chr2 60512296 60512315 60512312 +
attcatttgggcttgtggct

SEQ ID NO: 165045 - DNA, 20 bp, Artificial Sequence
  Synthetic oligonucleotide; TAG chr2 60512305 60512324 60512321 +
ggcttgtggctgagctgtgc

SEQ ID NO: 165046 - DNA, 20 bp, Artificial Sequence
  Synthetic oligonucleotide; AGG chr2 60512306 60512325 60512322 +
gcttgtggctgagctgtgct

SEQ ID NO: 165047 - DNA, 20 bp, Artificial Sequence
  Synthetic oligonucleotide; TGG chr2 60512313 60512332 60512329 +
gctgagctgtgctaggtaac

SEQ ID NO: 165048 - DNA, 20 bp, Artificial Sequence
  Synthetic oligonucleotide; GGG chr2 60512314 60512333 60512330 +
ctgagctgtgctaggtaact

SEQ ID NO: 165049 - DNA, 20 bp, Artificial Sequence
  Synthetic oligonucleotide; TGG chr2 60512317 60512336 60512333 +
agctgtgctaggtaactggg

SEQ ID NO: 165050 - DNA, 20 bp, Artificial Sequence
  Synthetic oligonucleotide; TGG chr2 60512322 60512341 60512338 +
tgctaggtaactgggtggcc

SEQ ID NO: 165051 - DNA, 20 bp, Artificial Sequence
  Synthetic oligonucleotide; GGG chr2 60512323 60512342 60512339 +
gctaggtaactgggtggcct

SEQ ID NO: 165052 - DNA, 20 bp, Artificial Sequence
  Synthetic oligonucleotide; AAG chr2 60512327 60512346 60512343 +
ggtaactgggtggcctgggc

SEQ ID NO: 165053 - DNA, 20 bp, Artificial Sequence
  Synthetic oligonucleotide; TGG chr2 60512345 60512364 60512361 +
gcaagtcacttcacctccct

SEQ ID NO: 165054 - DNA, 20 bp, Artificial Sequence
  Synthetic oligonucleotide; GAG chr2 60512359 60512378 60512375 +
ctcccttggcctgtgtcctt

SEQ ID NO: 165055 - DNA, 20 bp, Artificial Sequence
  Synthetic oligonucleotide; TGG chr2 60512368 60512387 60512384 +
cctgtgtccttgagctttcc

SEQ ID NO: 165056 - DNA, 20 bp, Artificial Sequence
  Synthetic oligonucleotide; CAG chr2 60512387 60512406 60512403 +
ctggctgcacatcttgctct

SEQ ID NO: 165057 - DNA, 20 bp, Artificial Sequence
  Synthetic oligonucleotide; AGG chr2 60512388 60512407 60512404 +
tggctgcacatcttgctctc

SEQ ID NO: 165058 - DNA, 20 bp, Artificial Sequence
  Synthetic oligonucleotide; AAG chr2 60512395 60512414 60512411 +
acatcttgctctcaggtata

SEQ ID NO: 165059 - DNA, 20 bp, Artificial Sequence
  Synthetic oligonucleotide; AGG chr2 60512396 60512415 60512412 +
catcttgctctcaggtataa

SEQ ID NO: 165060 - DNA, 20 bp, Artificial Sequence
  Synthetic oligonucleotide; GAG chr2 60512449 60512468 60512465 +
cacacactcgcctctcaaat

SEQ ID NO: 165061 - DNA, 20 bp, Artificial Sequence
  Synthetic oligonucleotide; AAG chr2 60512453 60512472 60512469 +
cactcgcctctcaaatgaga

SEQ ID NO: 165062 - DNA, 20 bp, Artificial Sequence
  Synthetic oligonucleotide; AGG chr2 60512454 60512473 60512470 +
actcgcctctcaaatgagaa

SEQ ID NO: 165063 - DNA, 20 bp, Artificial Sequence
  Synthetic oligonucleotide; CAG chr2 60512457 60512476 60512473 +
cgcctctcaaatgagaaagg

SEQ ID NO: 165064 - DNA, 20 bp, Artificial Sequence
  Synthetic oligonucleotide; GAG chr2 60512464 60512483 60512480 +
caaatgagaaaggcagcttt

SEQ ID NO: 165065 - DNA, 20 bp, Artificial Sequence
  Synthetic oligonucleotide; GAG chr2 60512466 60512485 60512482 +
aatgagaaaggcagctttga

SEQ ID NO: 165066 - DNA, 20 bp, Artificial Sequence
  Synthetic oligonucleotide; GAG chr2 60512468 60512487 60512484 +
tgagaaaggcagctttgaga

SEQ ID NO: 165067 - DNA, 20 bp, Artificial Sequence
  Synthetic oligonucleotide; AGG chr2 60512469 60512488 60512485 +
gagaaaggcagctttgagag

SEQ ID NO: 165068 - DNA, 20 bp, Artificial Sequence
  Synthetic oligonucleotide; CGG chr2 60512485 60512504 60512501 +
agagaggatgcttgccttcc

SEQ ID NO: 165069 - DNA, 20 bp, Artificial Sequence
  Synthetic oligonucleotide; CAG chr2 60512502 60512521 60512518 +
tcccggctcccctcccaacc

SEQ ID NO: 165070 - DNA, 20 bp, Artificial Sequence
  Synthetic oligonucleotide; CAG chr2 60512524 60512543 60512540 +
gaacctatcacaatgctctg

SEQ ID NO: 165071 - DNA, 20 bp, Artificial Sequence
  Synthetic oligonucleotide; GAG chr2 60512526 60512545 60512542 +
acctatcacaatgctctgca

SEQ ID NO: 165072 - DNA, 20 bp, Artificial Sequence
  Synthetic oligonucleotide; GAG chr2 60512528 60512547 60512544 +
ctatcacaatgctctgcaga

SEQ ID NO: 165073 - DNA, 20 bp, Artificial Sequence
  Synthetic oligonucleotide; AAG chr2 60512565 60512584 60512581 +
atccaatgctaaattgtaaa

SEQ ID NO: 165074 - DNA, 20 bp, Artificial Sequence
  Synthetic oligonucleotide; GAG chr2 60512569 60512588 60512585 +
aatgctaaattgtaaaaagt

SEQ ID NO: 165075 - DNA, 20 bp, Artificial Sequence
  Synthetic oligonucleotide; TAG chr2 60512574 60512593 60512590 +
taaattgtaaaaagtgagac

SEQ ID NO: 165076 - DNA, 20 bp, Artificial Sequence
  Synthetic oligonucleotide; TGG chr2 60512578 60512597 60512594 +
ttgtaaaaagtgagactaga

SEQ ID NO: 165077 - DNA, 20 bp, Artificial Sequence
  Synthetic oligonucleotide; CAG chr2 60512597 60512616 60512613 +
atggtatctgcctctcctct

SEQ ID NO: 165078 - DNA, 20 bp, Artificial Sequence
  Synthetic oligonucleotide; TGG chr2 60512612 60512631 60512628 +
cctctcagctctaaattatt

SEQ ID NO: 165079 - DNA, 20 bp, Artificial Sequence
  Synthetic oligonucleotide; AAG chr2 60512619 60512638 60512635 +
gctctaaattatttggtcta

SEQ ID NO: 165080 - DNA, 20 bp, Artificial Sequence
  Synthetic oligonucleotide; AAG chr2 60512629 60512648 60512645 +
atttggtctaaagaaaactg

SEQ ID NO: 165081 - DNA, 20 bp, Artificial Sequence
  Synthetic oligonucleotide; CAG chr2 60512636 60512655 60512652 +
ctaaagaaaactgaagcccc

SEQ ID NO: 165082 - DNA, 20 bp, Artificial Sequence
  Synthetic oligonucleotide; TGG chr2 60512662 60512681 60512678 +
ctccattttgcatatctaat

SEQ ID NO: 165083 - DNA, 20 bp, Artificial Sequence
  Synthetic oligonucleotide; GAG chr2 60512664 60512683 60512680 +
ccattttgcatatctaattg

SEQ ID NO: 165084 - DNA, 20 bp, Artificial Sequence
  Synthetic oligonucleotide; TGG chr2 60512668 60512687 60512684 +
tttgcatatctaattggaga

SEQ ID NO: 165085 - DNA, 20 bp, Artificial Sequence
  Synthetic oligonucleotide; AAG chr2 60512690 60512709 60512706 +
gtttcaataatataattatc

SEQ ID NO: 165086 - DNA, 20 bp, Artificial Sequence
  Synthetic oligonucleotide; AGG chr2 60512691 60512710 60512707 +
tttcaataatataattatca

SEQ ID NO: 165087 - DNA, 20 bp, Artificial Sequence
  Synthetic oligonucleotide; AAG chr2 60512711 60512730 60512727 +
aggcatccctacgttacttg

SEQ ID NO: 165088 - DNA, 20 bp, Artificial Sequence
  Synthetic oligonucleotide; TGG chr2 60512715 60512734 60512731 +
atccctacgttacttgaagt

SEQ ID NO: 165089 - DNA, 20 bp, Artificial Sequence
  Synthetic oligonucleotide; TGG chr2 60512727 60512746 60512743 +
cttgaagttggttcataatc

SEQ ID NO: 165090 - DNA, 20 bp, Artificial Sequence
  Synthetic oligonucleotide; CAG chr2 60512739 60512758 60512755 +
tcataatctggcgacgttca

SEQ ID NO: 165091 - DNA, 20 bp, Artificial Sequence
  Synthetic oligonucleotide; AAG chr2 60512749 60512768 60512765 +
gcgacgttcacagccttatg

SEQ ID NO: 165092 - DNA, 20 bp, Artificial Sequence
  Synthetic oligonucleotide; CAG chr2 60512753 60512772 60512769 +
cgttcacagccttatgaaga

SEQ ID NO: 165093 - DNA, 20 bp, Artificial Sequence
  Synthetic oligonucleotide; TAG chr2 60512768 60512787 60512784 +
gaagacagtttattctcttt

SEQ ID NO: 165094 - DNA, 20 bp, Artificial Sequence
  Synthetic oligonucleotide; AAG chr2 60512777 60512796 60512793 +
ttattctcttttagtgtctc

SEQ ID NO: 165095 - DNA, 20 bp, Artificial Sequence
  Synthetic oligonucleotide; GAG chr2 60512783 60512802 60512799 +
tcttttagtgtctcaagtat

SEQ ID NO: 165096 - DNA, 20 bp, Artificial Sequence
  Synthetic oligonucleotide; CGG chr2 60512799 60512818 60512815 +
gtatgagtcacctctgatga

SEQ ID NO: 165097 - DNA, 20 bp, Artificial Sequence
  Synthetic oligonucleotide; TAG chr2 60512803 60512822 60512819 +
gagtcacctctgatgacgga

SEQ ID NO: 165098 - DNA, 20 bp, Artificial Sequence
  Synthetic oligonucleotide; AGG chr2 60512804 60512823 60512820 +
agtcacctctgatgacggat

SEQ ID NO: 165099 - DNA, 20 bp, Artificial Sequence
  Synthetic oligonucleotide; GAG chr2 60512806 60512825 60512822 +
tcacctctgatgacggatag

SEQ ID NO: 165100 - DNA, 20 bp, Artificial Sequence
  Synthetic oligonucleotide; AAG chr2 60512812 60512831 60512828 +
ctgatgacggataggagaac

SEQ ID NO: 165101 - DNA, 20 bp, Artificial Sequence
  Synthetic oligonucleotide; CAG chr2 60512815 60512834 60512831 +
atgacggataggagaacaag

SEQ ID NO: 165102 - DNA, 20 bp, Artificial Sequence
  Synthetic oligonucleotide; AGG chr2 60512816 60512835 60512832 +
tgacggataggagaacaagc

SEQ ID NO: 165103 - DNA, 20 bp, Artificial Sequence
  Synthetic oligonucleotide; AAG chr2 60512840 60512859 60512856 +
tttactacaatacacaccta

SEQ ID NO: 165104 - DNA, 20 bp, Artificial Sequence
  Synthetic oligonucleotide; TGG chr2 60512878 60512897 60512894 +
aaccactttgcccacccaca

SEQ ID NO: 165105 - DNA, 20 bp, Artificial Sequence
  Synthetic oligonucleotide; TGG chr2 60512889 60512908 60512905 +
ccacccacatggcatccatt

SEQ ID NO: 165106 - DNA, 20 bp, Artificial Sequence
  Synthetic oligonucleotide; GAG chr2 60512891 60512910 60512907 +
acccacatggcatccatttg

SEQ ID NO: 165107 - DNA, 20 bp, Artificial Sequence
  Synthetic oligonucleotide; AGG chr2 60512892 60512911 60512908 +
cccacatggcatccatttgg

SEQ ID NO: 165108 - DNA, 20 bp, Artificial Sequence
  Synthetic oligonucleotide; GAG chr2 60512894 60512913 60512910 +
cacatggcatccatttggag

SEQ ID NO: 165109 - DNA, 20 bp, Artificial Sequence
  Synthetic oligonucleotide; CAG chr2 60512900 60512919 60512916 +
gcatccatttggaggagaca

SEQ ID NO: 165110 - DNA, 20 bp, Artificial Sequence
  Synthetic oligonucleotide; GAG chr2 60512902 60512921 60512918 +
atccatttggaggagacaca

SEQ ID NO: 165111 - DNA, 20 bp, Artificial Sequence
  Synthetic oligonucleotide; AAG chr2 60512906 60512925 60512922 +
atttggaggagacacagaga

SEQ ID NO: 165112 - DNA, 20 bp, Artificial Sequence
  Synthetic oligonucleotide; AGG chr2 60512907 60512926 60512923 +
tttggaggagacacagagaa

SEQ ID NO: 165113 - DNA, 20 bp, Artificial Sequence
  Synthetic oligonucleotide; GAG chr2 60512909 60512928 60512925 +
tggaggagacacagagaaag

SEQ ID NO: 165114 - DNA, 20 bp, Artificial Sequence
  Synthetic oligonucleotide; TAG chr2 60512922 60512941 60512938 +
gagaaaggagtttcacctct

SEQ ID NO: 165115 - DNA, 20 bp, Artificial Sequence
  Synthetic oligonucleotide; CAG chr2 60512931 60512950 60512947 +
gtttcacctcttagacgtct

SEQ ID NO: 165116 - DNA, 20 bp, Artificial Sequence
  Synthetic oligonucleotide; GAG chr2 60512933 60512952 60512949 +
ttcacctcttagacgtctca

SEQ ID NO: 165117 - DNA, 20 bp, Artificial Sequence
  Synthetic oligonucleotide; CAG chr2 60512963 60512982 60512979 +
ttttctcaaaaatgaacaca

SEQ ID NO: 165118 - DNA, 20 bp, Artificial Sequence
  Synthetic oligonucleotide; GAG chr2 60512965 60512984 60512981 +
ttctcaaaaatgaacacaca

SEQ ID NO: 165119 - DNA, 20 bp, Artificial Sequence
  Synthetic oligonucleotide; CAG chr2 60512971 60512990 60512987 +
aaaatgaacacacagagcaa

SEQ ID NO: 165120 - DNA, 20 bp, Artificial Sequence
  Synthetic oligonucleotide; GAG chr2 60512979 60512998 60512995 +
cacacagagcaacagctgac

SEQ ID NO: 165121 - DNA, 20 bp, Artificial Sequence
  Synthetic oligonucleotide; CAG chr2 60512985 60513004 60513001 +
gagcaacagctgacgagtca

SEQ ID NO: 165122 - DNA, 20 bp, Artificial Sequence
  Synthetic oligonucleotide; TGG chr2 60512988 60513007 60513004 +
caacagctgacgagtcacag

SEQ ID NO: 165123 - DNA, 20 bp, Artificial Sequence
  Synthetic oligonucleotide; TGG chr2 60513007 60513026 60513023 +
gtggaccacaccaccacctc

SEQ ID NO: 165124 - DNA, 20 bp, Artificial Sequence
  Synthetic oligonucleotide; GAG chr2 60513019 60513038 60513035 +
accacctctggttaccccct

SEQ ID NO: 165125 - DNA, 20 bp, Artificial Sequence
  Synthetic oligonucleotide; AAG chr2 60513023 60513042 60513039 +
cctctggttaccccctgaga

SEQ ID NO: 165126 - DNA, 20 bp, Artificial Sequence
  Synthetic oligonucleotide; AGG chr2 60513024 60513043 60513040 +
ctctggttaccccctgagaa

SEQ ID NO: 165127 - DNA, 20 bp, Artificial Sequence
  Synthetic oligonucleotide; CAG chr2 60513027 60513046 60513043 +
tggttaccccctgagaaagg

SEQ ID NO: 165128 - DNA, 20 bp, Artificial Sequence
  Synthetic oligonucleotide; GAG chr2 60513029 60513048 60513045 +
gttaccccctgagaaaggca

SEQ ID NO: 165129 - DNA, 20 bp, Artificial Sequence
  Synthetic oligonucleotide; AAG chr2 60513033 60513052 60513049 +
ccccctgagaaaggcagaga

SEQ ID NO: 165130 - DNA, 20 bp, Artificial Sequence
  Synthetic oligonucleotide; AGG chr2 60513034 60513053 60513050 +
cccctgagaaaggcagagaa

SEQ ID NO: 165131 - DNA, 20 bp, Artificial Sequence
  Synthetic oligonucleotide; CAG chr2 60513042 60513061 60513058 +
aaaggcagagaaaggacccc

SEQ ID NO: 165132 - DNA, 20 bp, Artificial Sequence
  Synthetic oligonucleotide; CAG chr2 60513047 60513066 60513063 +
cagagaaaggacccccagaa

SEQ ID NO: 165133 - DNA, 20 bp, Artificial Sequence
  Synthetic oligonucleotide; GAG chr2 60513059 60513078 60513075 +
ccccagaacagtcaccattt

SEQ ID NO: 165134 - DNA, 20 bp, Artificial Sequence
  Synthetic oligonucleotide; AGG chr2 60513060 60513079 60513076 +
cccagaacagtcaccatttg

SEQ ID NO: 165135 - DNA, 20 bp, Artificial Sequence
  Synthetic oligonucleotide; GAG chr2 60513062 60513081 60513078 +
cagaacagtcaccatttgag

SEQ ID NO: 165136 - DNA, 20 bp, Artificial Sequence
  Synthetic oligonucleotide; GAG chr2 60513064 60513083 60513080 +
gaacagtcaccatttgagga

SEQ ID NO: 165137 - DNA, 20 bp, Artificial Sequence
  Synthetic oligonucleotide; AGG chr2 60513065 60513084 60513081 +
aacagtcaccatttgaggag

SEQ ID NO: 165138 - DNA, 20 bp, Artificial Sequence
  Synthetic oligonucleotide; CAG chr2 60513070 60513089 60513086 +
tcaccatttgaggagaggtt

SEQ ID NO: 165139 - DNA, 20 bp, Artificial Sequence
  Synthetic oligonucleotide; AGG chr2 60513071 60513090 60513087 +
caccatttgaggagaggttc

SEQ ID NO: 165140 - DNA, 20 bp, Artificial Sequence
  Synthetic oligonucleotide; GGG chr2 60513072 60513091 60513088 +
accatttgaggagaggttca

SEQ ID NO: 165141 - DNA, 20 bp, Artificial Sequence
  Synthetic oligonucleotide; GAG chr2 60513080 60513099 60513096 +
aggagaggttcagggatcat

SEQ ID NO: 165142 - DNA, 20 bp, Artificial Sequence
  Synthetic oligonucleotide; AGG chr2 60513081 60513100 60513097 +
ggagaggttcagggatcatg

SEQ ID NO: 165143 - DNA, 20 bp, Artificial Sequence
  Synthetic oligonucleotide; TGG chr2 60513107 60513126 60513123 +
caccaccccactgaaatcca

SEQ ID NO: 165144 - DNA, 20 bp, Artificial Sequence
  Synthetic oligonucleotide; TAG chr2 60513111 60513130 60513127 +
accccactgaaatccatgga

SEQ ID NO: 165145 - DNA, 20 bp, Artificial Sequence
  Synthetic oligonucleotide; TAG chr2 60513116 60513135 60513132 +
actgaaatccatggatagtc

SEQ ID NO: 165146 - DNA, 20 bp, Artificial Sequence
  Synthetic oligonucleotide; GAG chr2 60513124 60513143 60513140 +
ccatggatagtctagcctgt

SEQ ID NO: 165147 - DNA, 20 bp, Artificial Sequence
  Synthetic oligonucleotide; AGG chr2 60513125 60513144 60513141 +
catggatagtctagcctgtg

SEQ ID NO: 165148 - DNA, 20 bp, Artificial Sequence
  Synthetic oligonucleotide; GGG chr2 60513126 60513145 60513142 +
atggatagtctagcctgtga

SEQ ID NO: 165149 - DNA, 20 bp, Artificial Sequence
  Synthetic oligonucleotide; GGG chr2 60513127 60513146 60513143 +
tggatagtctagcctgtgag

SEQ ID NO: 165150 - DNA, 20 bp, Artificial Sequence
  Synthetic oligonucleotide; TGG chr2 60513131 60513150 60513147 +
tagtctagcctgtgaggggt

SEQ ID NO: 165151 - DNA, 20 bp, Artificial Sequence
  Synthetic oligonucleotide; GGG chr2 60513132 60513151 60513148 +
agtctagcctgtgaggggtt

SEQ ID NO: 165152 - DNA, 20 bp, Artificial Sequence
  Synthetic oligonucleotide; GGG chr2 60513133 60513152 60513149 +
gtctagcctgtgaggggttg

SEQ ID NO: 165153 - DNA, 20 bp, Artificial Sequence
  Synthetic oligonucleotide; GGG chr2 60513134 60513153 60513150 +
tctagcctgtgaggggttgg

SEQ ID NO: 165154 - DNA, 20 bp, Artificial Sequence
  Synthetic oligonucleotide; TGG chr2 60513137 60513156 60513153 +
agcctgtgaggggttggggg

SEQ ID NO: 165155 - DNA, 20 bp, Artificial Sequence
  Synthetic oligonucleotide; GAG chr2 60513166 60513185 60513182 +
actttatctttctcatcttt

SEQ ID NO: 165156 - DNA, 20 bp, Artificial Sequence
  Synthetic oligonucleotide; CGG chr2 60513169 60513188 60513185 +
ttatctttctcatctttgag

SEQ ID NO: 165157 - DNA, 20 bp, Artificial Sequence
  Synthetic oligonucleotide; CAG chr2 60513180 60513199 60513196 +
atctttgagcggctcttccc

SEQ ID NO: 165158 - DNA, 20 bp, Artificial Sequence
  Synthetic oligonucleotide; GAG chr2 60513182 60513201 60513198 +
ctttgagcggctcttcccca

SEQ ID NO: 165159 - DNA, 20 bp, Artificial Sequence
  Synthetic oligonucleotide; CAG chr2 60513186 60513205 60513202 +
gagcggctcttccccagagt

SEQ ID NO: 165160 - DNA, 20 bp, Artificial Sequence
  Synthetic oligonucleotide; AGG chr2 60513187 60513206 60513203 +
agcggctcttccccagagtc

SEQ ID NO: 165161 - DNA, 20 bp, Artificial Sequence
  Synthetic oligonucleotide; TAG chr2 60513201 60513220 60513217 +
agagtcaggatgactctcac

SEQ ID NO: 165162 - DNA, 20 bp, Artificial Sequence
  Synthetic oligonucleotide; AGG chr2 60513202 60513221 60513218 +
gagtcaggatgactctcact

SEQ ID NO: 165163 - DNA, 20 bp, Artificial Sequence
  Synthetic oligonucleotide; CAG chr2 60513208 60513227 60513224 +
ggatgactctcactaggttt

SEQ ID NO: 165164 - DNA, 20 bp, Artificial Sequence
  Synthetic oligonucleotide; AGG chr2 60513209 60513228 60513225 +
gatgactctcactaggtttc

SEQ ID NO: 165165 - DNA, 20 bp, Artificial Sequence
  Synthetic oligonucleotide; CGG chr2 60513230 60513249 60513246 +
ggtacatccccatcatgccc

SEQ ID NO: 165166 - DNA, 20 bp, Artificial Sequence
  Synthetic oligonucleotide; CAG chr2 60513237 60513256 60513253 +
ccccatcatgccccggactc

SEQ ID NO: 165167 - DNA, 20 bp, Artificial Sequence
  Synthetic oligonucleotide; CAG chr2 60513246 60513265 60513262 +
gccccggactccagtctctg

SEQ ID NO: 165168 - DNA, 20 bp, Artificial Sequence
  Synthetic oligonucleotide; CGG chr2 60513255 60513274 60513271 +
tccagtctctgcagctgaca

SEQ ID NO: 165169 - DNA, 20 bp, Artificial Sequence
  Synthetic oligonucleotide; AAG chr2 60513262 60513281 60513278 +
tctgcagctgacacggctcc

SEQ ID NO: 165170 - DNA, 20 bp, Artificial Sequence
  Synthetic oligonucleotide; GAG chr2 60513276 60513295 60513292 +
ggctccaagatgctaaatat

SEQ ID NO: 165171 - DNA, 20 bp, Artificial Sequence
  Synthetic oligonucleotide; AAG chr2 60513281 60513300 60513297 +
caagatgctaaatatgagac

SEQ ID NO: 165172 - DNA, 20 bp, Artificial Sequence
  Synthetic oligonucleotide; AGG chr2 60513282 60513301 60513298 +
aagatgctaaatatgagaca

SEQ ID NO: 165173 - DNA, 20 bp, Artificial Sequence
  Synthetic oligonucleotide; GAG chr2 60513284 60513303 60513300 +
gatgctaaatatgagacaag

SEQ ID NO: 165174 - DNA, 20 bp, Artificial Sequence
  Synthetic oligonucleotide; AGG chr2 60513285 60513304 60513301 +
atgctaaatatgagacaagg

SEQ ID NO: 165175 - DNA, 20 bp, Artificial Sequence
  Synthetic oligonucleotide; GGG chr2 60513286 60513305 60513302 +
tgctaaatatgagacaagga

SEQ ID NO: 165176 - DNA, 20 bp, Artificial Sequence
  Synthetic oligonucleotide; GGG chr2 60513287 60513306 60513303 +
gctaaatatgagacaaggag

SEQ ID NO: 165177 - DNA, 20 bp, Artificial Sequence
  Synthetic oligonucleotide; AAG chr2 60513292 60513311 60513308 +
atatgagacaaggaggggac

SEQ ID NO: 165178 - DNA, 20 bp, Artificial Sequence
  Synthetic oligonucleotide; AGG chr2 60513293 60513312 60513309 +
tatgagacaaggaggggaca

SEQ ID NO: 165179 - DNA, 20 bp, Artificial Sequence
  Synthetic oligonucleotide; TAG chr2 60513300 60513319 60513316 +
caaggaggggacaaggaatt

SEQ ID NO: 165180 - DNA, 20 bp, Artificial Sequence
  Synthetic oligonucleotide; CAG chr2 60513306 60513325 60513322 +
ggggacaaggaatttagtcc

SEQ ID NO: 165181 - DNA, 20 bp, Artificial Sequence
  Synthetic oligonucleotide; AGG chr2 60513307 60513326 60513323 +
gggacaaggaatttagtccc

SEQ ID NO: 165182 - DNA, 20 bp, Artificial Sequence
  Synthetic oligonucleotide; GAG chr2 60513309 60513328 60513325 +
gacaaggaatttagtcccag

SEQ ID NO: 165183 - DNA, 20 bp, Artificial Sequence
  Synthetic oligonucleotide; TGG chr2 60513312 60513331 60513328 +
aaggaatttagtcccaggag

SEQ ID NO: 165184 - DNA, 20 bp, Artificial Sequence
  Synthetic oligonucleotide; TAG chr2 60513318 60513337 60513334 +
tttagtcccaggagtggcac

SEQ ID NO: 165185 - DNA, 20 bp, Artificial Sequence
  Synthetic oligonucleotide; AAG chr2 60513321 60513340 60513337 +
agtcccaggagtggcactag

SEQ ID NO: 165186 - DNA, 20 bp, Artificial Sequence
  Synthetic oligonucleotide; AGG chr2 60513322 60513341 60513338 +
gtcccaggagtggcactaga

SEQ ID NO: 165187 - DNA, 20 bp, Artificial Sequence
  Synthetic oligonucleotide; GAG chr2 60513324 60513343 60513340 +
cccaggagtggcactagaag

SEQ ID NO: 165188 - DNA, 20 bp, Artificial Sequence
  Synthetic oligonucleotide; CAG chr2 60513339 60513358 60513355 +
agaaggagtccctgctccct

SEQ ID NO: 165189 - DNA, 20 bp, Artificial Sequence
  Synthetic oligonucleotide; AGG chr2 60513340 60513359 60513356 +
gaaggagtccctgctccctc

SEQ ID NO: 165190 - DNA, 20 bp, Artificial Sequence
  Synthetic oligonucleotide; GAG chr2 60513342 60513361 60513358 +
aggagtccctgctccctcag

SEQ ID NO: 165191 - DNA, 20 bp, Artificial Sequence
  Synthetic oligonucleotide; CGG chr2 60513353 60513372 60513369 +
ctccctcaggagccatctgc

SEQ ID NO: 165192 - DNA, 20 bp, Artificial Sequence
  Synthetic oligonucleotide; GGG chr2 60513354 60513373 60513370 +
tccctcaggagccatctgcc

SEQ ID NO: 165193 - DNA, 20 bp, Artificial Sequence
  Synthetic oligonucleotide; TGG chr2 60513363 60513382 60513379 +
agccatctgccgggtgcttc

SEQ ID NO: 165194 - DNA, 20 bp, Artificial Sequence
  Synthetic oligonucleotide; GAG chr2 60513365 60513384 60513381 +
ccatctgccgggtgcttctg

SEQ ID NO: 165195 - DNA, 20 bp, Artificial Sequence
  Synthetic oligonucleotide; GAG chr2 60513390 60513409 60513406 +
gctgcctccacgccccactt

SEQ ID NO: 165196 - DNA, 20 bp, Artificial Sequence
  Synthetic oligonucleotide; AGG chr2 60513391 60513410 60513407 +
ctgcctccacgccccacttg

SEQ ID NO: 165197 - DNA, 20 bp, Artificial Sequence
  Synthetic oligonucleotide; CAG chr2 60513401 60513420 60513417 +
gccccacttgaggctgtcca

SEQ ID NO: 165198 - DNA, 20 bp, Artificial Sequence
  Synthetic oligonucleotide; CAG chr2 60513404 60513423 60513420 +
ccacttgaggctgtccacag

SEQ ID NO: 165199 - DNA, 20 bp, Artificial Sequence
  Synthetic oligonucleotide; CAG chr2 60513411 60513430 60513427 +
aggctgtccacagcagaaac

SEQ ID NO: 165200 - DNA, 20 bp, Artificial Sequence
  Synthetic oligonucleotide; CAG chr2 60513418 60513437 60513434 +
ccacagcagaaaccagcgcc

SEQ ID NO: 165201 - DNA, 20 bp, Artificial Sequence
  Synthetic oligonucleotide; AAG chr2 60513429 60513448 60513445 +
accagcgcccagatcccctc

SEQ ID NO: 165202 - DNA, 20 bp, Artificial Sequence
  Synthetic oligonucleotide; CAG chr2 60513433 60513452 60513449 +
gcgcccagatcccctcaagc

SEQ ID NO: 165203 - DNA, 20 bp, Artificial Sequence
  Synthetic oligonucleotide; TGG chr2 60513444 60513463 60513460 +
ccctcaagccagccacccca

SEQ ID NO: 165204 - DNA, 20 bp, Artificial Sequence
  Synthetic oligonucleotide; GGG chr2 60513445 60513464 60513461 +
cctcaagccagccaccccat

SEQ ID NO: 165205 - DNA, 20 bp, Artificial Sequence
  Synthetic oligonucleotide; TGG chr2 60513456 60513475 60513472 +
ccaccccatgggaacccctt

SEQ ID NO: 165206 - DNA, 20 bp, Artificial Sequence
  Synthetic oligonucleotide; CAG chr2 60513459 60513478 60513475 +
ccccatgggaacccctttgg

SEQ ID NO: 165207 - DNA, 20 bp, Artificial Sequence
  Synthetic oligonucleotide; AGG chr2 60513460 60513479 60513476 +
cccatgggaacccctttggc

SEQ ID NO: 165208 - DNA, 20 bp, Artificial Sequence
  Synthetic oligonucleotide; TGG chr2 60513465 60513484 60513481 +
gggaacccctttggcaggtg

SEQ ID NO: 165209 - DNA, 20 bp, Artificial Sequence
  Synthetic oligonucleotide; GGG chr2 60513466 60513485 60513482 +
ggaacccctttggcaggtgt

SEQ ID NO: 165210 - DNA, 20 bp, Artificial Sequence
  Synthetic oligonucleotide; TGG chr2 60513472 60513491 60513488 +
cctttggcaggtgtgggtgt

SEQ ID NO: 165211 - DNA, 20 bp, Artificial Sequence
  Synthetic oligonucleotide; GGG chr2 60513473 60513492 60513489 +
ctttggcaggtgtgggtgtt

SEQ ID NO: 165212 - DNA, 20 bp, Artificial Sequence
  Synthetic oligonucleotide; TAG chr2 60513477 60513496 60513493 +
ggcaggtgtgggtgttgggt

SEQ ID NO: 165213 - DNA, 20 bp, Artificial Sequence
  Synthetic oligonucleotide; TAG chr2 60513484 60513503 60513500 +
gtgggtgttgggttagcctc

SEQ ID NO: 165214 - DNA, 20 bp, Artificial Sequence
  Synthetic oligonucleotide; CAG chr2 60513488 60513507 60513504 +
gtgttgggttagcctctagc

SEQ ID NO: 165215 - DNA, 20 bp, Artificial Sequence
  Synthetic oligonucleotide; TGG chr2 60513514 60513533 60513530 +
tcctgctgcttctctctttg

SEQ ID NO: 165216 - DNA, 20 bp, Artificial Sequence
  Synthetic oligonucleotide; GAG chr2 60513516 60513535 60513532 +
ctgctgcttctctctttgtg

SEQ ID NO: 165217 - DNA, 20 bp, Artificial Sequence
  Synthetic oligonucleotide; TGG chr2 60513538 60513557 60513554 +
gcaaatcttcatgtcctgtc

SEQ ID NO: 165218 - DNA, 20 bp, Artificial Sequence
  Synthetic oligonucleotide; CAG chr2 60513548 60513567 60513564 +
atgtcctgtctggatcttcc

SEQ ID NO: 165219 - DNA, 20 bp, Artificial Sequence
  Synthetic oligonucleotide; AAG chr2 60513587 60513606 60513603 +
ctgaatcttcccacccttcc

SEQ ID NO: 165220 - DNA, 20 bp, Artificial Sequence
  Synthetic oligonucleotide; AGG chr2 60513588 60513607 60513604 +
tgaatcttcccacccttcca

SEQ ID NO: 165221 - DNA, 20 bp, Artificial Sequence
  Synthetic oligonucleotide; GGG chr2 60513589 60513608 60513605 +
gaatcttcccacccttccaa

SEQ ID NO: 165222 - DNA, 20 bp, Artificial Sequence
  Synthetic oligonucleotide; AAG chr2 60513627 60513646 60513643 +
atctccccactcacacgcta

SEQ ID NO: 165223 - DNA, 20 bp, Artificial Sequence
  Synthetic oligonucleotide; CAG chr2 60513647 60513666 60513663 +
aagtaaatgaataaacccaa

SEQ ID NO: 165224 - DNA, 20 bp, Artificial Sequence
  Synthetic oligonucleotide; CGG chr2 60513652 60513671 60513668 +
aatgaataaacccaacagca

SEQ ID NO: 165225 - DNA, 20 bp, Artificial Sequence
  Synthetic oligonucleotide; CAG chr2 60513668 60513687 60513684 +
agcacggactcatccctgat

SEQ ID NO: 165226 - DNA, 20 bp, Artificial Sequence
  Synthetic oligonucleotide; AGG chr2 60513669 60513688 60513685 +
gcacggactcatccctgatc

SEQ ID NO: 165227 - DNA, 20 bp, Artificial Sequence
  Synthetic oligonucleotide; AAG chr2 60513680 60513699 60513696 +
tccctgatcaggactgaaaa

SEQ ID NO: 165228 - DNA, 20 bp, Artificial Sequence
  Synthetic oligonucleotide; AAG chr2 60513686 60513705 60513702 +
atcaggactgaaaaaagaaa

SEQ ID NO: 165229 - DNA, 20 bp, Artificial Sequence
  Synthetic oligonucleotide; TAG chr2 60513692 60513711 60513708 +
actgaaaaaagaaaaagaaa

SEQ ID NO: 165230 - DNA, 20 bp, Artificial Sequence
  Synthetic oligonucleotide; TGG chr2 60513715 60513734 60513731 +
cctcccatcacaccactctc

SEQ ID NO: 165231 - DNA, 20 bp, Artificial Sequence
  Synthetic oligonucleotide; GGG chr2 60513716 60513735 60513732 +
ctcccatcacaccactctct

SEQ ID NO: 165232 - DNA, 20 bp, Artificial Sequence
  Synthetic oligonucleotide; TAG chr2 60513723 60513742 60513739 +
cacaccactctctgggaaaa

SEQ ID NO: 165233 - DNA, 20 bp, Artificial Sequence
  Synthetic oligonucleotide; GAG chr2 60513730 60513749 60513746 +
ctctctgggaaaatagaact

SEQ ID NO: 165234 - DNA, 20 bp, Artificial Sequence
  Synthetic oligonucleotide; TAG chr2 60513736 60513755 60513752 +
gggaaaatagaactgagtcc

SEQ ID NO: 165235 - DNA, 20 bp, Artificial Sequence
  Synthetic oligonucleotide; TAG chr2 60513742 60513761 60513758 +
atagaactgagtcctagctc

SEQ ID NO: 165236 - DNA, 20 bp, Artificial Sequence
  Synthetic oligonucleotide; TGG chr2 60513748 60513767 60513764 +
ctgagtcctagctctagcac

SEQ ID NO: 165237 - DNA, 20 bp, Artificial Sequence
  Synthetic oligonucleotide; GGG chr2 60513749 60513768 60513765 +
tgagtcctagctctagcact

SEQ ID NO: 165238 - DNA, 20 bp, Artificial Sequence
  Synthetic oligonucleotide; CAG chr2 60513754 60513773 60513770 +
cctagctctagcactgggca

SEQ ID NO: 165239 - DNA, 20 bp, Artificial Sequence
  Synthetic oligonucleotide; TGG chr2 60513758 60513777 60513774 +
gctctagcactgggcacagc

SEQ ID NO: 165240 - DNA, 20 bp, Artificial Sequence
  Synthetic oligonucleotide; GGG chr2 60513759 60513778 60513775 +
ctctagcactgggcacagct

SEQ ID NO: 165241 - DNA, 20 bp, Artificial Sequence
  Synthetic oligonucleotide; CAG chr2 60513763 60513782 60513779 +
agcactgggcacagctgggt

SEQ ID NO: 165242 - DNA, 20 bp, Artificial Sequence
  Synthetic oligonucleotide; AAG chr2 60513774 60513793 60513790 +
cagctgggtcagcacctacg

SEQ ID NO: 165243 - DNA, 20 bp, Artificial Sequence
  Synthetic oligonucleotide; AGG chr2 60513775 60513794 60513791 +
agctgggtcagcacctacga

SEQ ID NO: 165244 - DNA, 20 bp, Artificial Sequence
  Synthetic oligonucleotide; GGG chr2 60513776 60513795 60513792 +
gctgggtcagcacctacgaa

SEQ ID NO: 165245 - DNA, 20 bp, Artificial Sequence
  Synthetic oligonucleotide; CAG chr2 60513786 60513805 60513802 +
cacctacgaagggtcctatg

SEQ ID NO: 165246 - DNA, 20 bp, Artificial Sequence
  Synthetic oligonucleotide; CAG chr2 60513800 60513819 60513816 +
cctatgcagtgaacaccttg

SEQ ID NO: 165247 - DNA, 20 bp, Artificial Sequence
  Synthetic oligonucleotide; AAG chr2 60513807 60513826 60513823 +
agtgaacaccttgcagtctg

SEQ ID NO: 165248 - DNA, 20 bp, Artificial Sequence
  Synthetic oligonucleotide; AGG chr2 60513808 60513827 60513824 +
gtgaacaccttgcagtctga

SEQ ID NO: 165249 - DNA, 20 bp, Artificial Sequence
  Synthetic oligonucleotide; GGG chr2 60513809 60513828 60513825 +
tgaacaccttgcagtctgaa

SEQ ID NO: 165250 - DNA, 20 bp, Artificial Sequence
  Synthetic oligonucleotide; CAG chr2 60513812 60513831 60513828 +
acaccttgcagtctgaaggg

SEQ ID NO: 165251 - DNA, 20 bp, Artificial Sequence
  Synthetic oligonucleotide; AAG chr2 60513831 60513850 60513847 +
gcagactctctcttctcaac

SEQ ID NO: 165252 - DNA, 20 bp, Artificial Sequence
  Synthetic oligonucleotide; CAG chr2 60513835 60513854 60513851 +
actctctcttctcaacaagc

SEQ ID NO: 165253 - DNA, 20 bp, Artificial Sequence
  Synthetic oligonucleotide; GAG chr2 60513837 60513856 60513853 +
tctctcttctcaacaagcca

SEQ ID NO: 165254 - DNA, 20 bp, Artificial Sequence
  Synthetic oligonucleotide; CAG chr2 60513853 60513872 60513869 +
gccagagattctctgccttc

SEQ ID NO: 165255 - DNA, 20 bp, Artificial Sequence
  Synthetic oligonucleotide; CAG chr2 60513857 60513876 60513873 +
gagattctctgccttccaga

SEQ ID NO: 165256 - DNA, 20 bp, Artificial Sequence
  Synthetic oligonucleotide; AGG chr2 60513858 60513877 60513874 +
agattctctgccttccagac

SEQ ID NO: 165257 - DNA, 20 bp, Artificial Sequence
  Synthetic oligonucleotide; AAG chr2 60513871 60513890 60513887 +
tccagacaggcacctccatg

SEQ ID NO: 165258 - DNA, 20 bp, Artificial Sequence
  Synthetic oligonucleotide; GAG chr2 60513873 60513892 60513889 +
cagacaggcacctccatgaa

SEQ ID NO: 165259 - DNA, 20 bp, Artificial Sequence
  Synthetic oligonucleotide; AAG chr2 60513876 60513895 60513892 +
acaggcacctccatgaagag

SEQ ID NO: 165260 - DNA, 20 bp, Artificial Sequence
  Synthetic oligonucleotide; TGG chr2 60513886 60513905 60513902 +
ccatgaagagaagctgttcc

SEQ ID NO: 165261 - DNA, 20 bp, Artificial Sequence
  Synthetic oligonucleotide; TGG chr2 60513893 60513912 60513909 +
gagaagctgttcctggcttg

SEQ ID NO: 165262 - DNA, 20 bp, Artificial Sequence
  Synthetic oligonucleotide; GAG chr2 60513897 60513916 60513913 +
agctgttcctggcttgtggt

SEQ ID NO: 165263 - DNA, 20 bp, Artificial Sequence
  Synthetic oligonucleotide; TGG chr2 60513910 60513929 60513926 +
ttgtggtgagcaaaactccc

SEQ ID NO: 165264 - DNA, 20 bp, Artificial Sequence
  Synthetic oligonucleotide; GAG chr2 60513916 60513935 60513932 +
tgagcaaaactccctggatt

SEQ ID NO: 165265 - DNA, 20 bp, Artificial Sequence
  Synthetic oligonucleotide; GAG chr2 60513921 60513940 60513937 +
aaaactccctggattgagtc

SEQ ID NO: 165266 - DNA, 20 bp, Artificial Sequence
  Synthetic oligonucleotide; TGG chr2 60513927 60513946 60513943 +
ccctggattgagtcgagacc

SEQ ID NO: 165267 - DNA, 20 bp, Artificial Sequence
  Synthetic oligonucleotide; TAG chr2 60513934 60513953 60513950 +
ttgagtcgagacctggattc

SEQ ID NO: 165268 - DNA, 20 bp, Artificial Sequence
  Synthetic oligonucleotide; TAG chr2 60513957 60513976 60513973 +
ttccactactttgaattctc

SEQ ID NO: 165269 - DNA, 20 bp, Artificial Sequence
  Synthetic oligonucleotide; AGG chr2 60513958 60513977 60513974 +
tccactactttgaattctct

SEQ ID NO: 165270 - DNA, 20 bp, Artificial Sequence
  Synthetic oligonucleotide; CAG chr2 60513965 60513984 60513981 +
ctttgaattctctaggttca

SEQ ID NO: 165271 - DNA, 20 bp, Artificial Sequence
  Synthetic oligonucleotide; CAG chr2 60513979 60513998 60513995 +
ggttcacagtcctaaatcct

SEQ ID NO: 165272 - DNA, 20 bp, Artificial Sequence
  Synthetic oligonucleotide; GAG chr2 60513981 60514000 60513997 +
ttcacagtcctaaatcctca

SEQ ID NO: 165273 - DNA, 20 bp, Artificial Sequence
  Synthetic oligonucleotide; AAG chr2 60513984 60514003 60514000 +
acagtcctaaatcctcagag

SEQ ID NO: 165274 - DNA, 20 bp, Artificial Sequence
  Synthetic oligonucleotide; AGG chr2 60513985 60514004 60514001 +
cagtcctaaatcctcagaga

SEQ ID NO: 165275 - DNA, 20 bp, Artificial Sequence
  Synthetic oligonucleotide; CAG chr2 60513989 60514008 60514005 +
cctaaatcctcagagaagga

SEQ ID NO: 165276 - DNA, 20 bp, Artificial Sequence
  Synthetic oligonucleotide; GAG chr2 60513996 60514015 60514012 +
cctcagagaaggacagactt

SEQ ID NO: 165277 - DNA, 20 bp, Artificial Sequence
  Synthetic oligonucleotide; AGG chr2 60513997 60514016 60514013 +
ctcagagaaggacagacttg

SEQ ID NO: 165278 - DNA, 20 bp, Artificial Sequence
  Synthetic oligonucleotide; GGG chr2 60513998 60514017 60514014 +
tcagagaaggacagacttga

SEQ ID NO: 165279 - DNA, 20 bp, Artificial Sequence
  Synthetic oligonucleotide; CAG chr2 60514001 60514020 60514017 +
gagaaggacagacttgaggg

SEQ ID NO: 165280 - DNA, 20 bp, Artificial Sequence
  Synthetic oligonucleotide; CAG chr2 60514005 60514024 60514021 +
aggacagacttgagggcaga

SEQ ID NO: 165281 - DNA, 20 bp, Artificial Sequence
  Synthetic oligonucleotide; CAG chr2 60514011 60514030 60514027 +
gacttgagggcagacagcca

SEQ ID NO: 165282 - DNA, 20 bp, Artificial Sequence
  Synthetic oligonucleotide; AGG chr2 60514012 60514031 60514028 +
acttgagggcagacagccac

SEQ ID NO: 165283 - DNA, 20 bp, Artificial Sequence
  Synthetic oligonucleotide; TGG chr2 60514015 60514034 60514031 +
tgagggcagacagccacagg

SEQ ID NO: 165284 - DNA, 20 bp, Artificial Sequence
  Synthetic oligonucleotide; TGG chr2 60514020 60514039 60514036 +
gcagacagccacaggtggcc

SEQ ID NO: 165285 - DNA, 20 bp, Artificial Sequence
  Synthetic oligonucleotide; TGG chr2 60514025 60514044 60514041 +
cagccacaggtggcctggca

SEQ ID NO: 165286 - DNA, 20 bp, Artificial Sequence
  Synthetic oligonucleotide; GGG chr2 60514026 60514045 60514042 +
agccacaggtggcctggcat

SEQ ID NO: 165287 - DNA, 20 bp, Artificial Sequence
  Synthetic oligonucleotide; GAG chr2 60514031 60514050 60514047 +
caggtggcctggcatgggct

SEQ ID NO: 165288 - DNA, 20 bp, Artificial Sequence
  Synthetic oligonucleotide; AGG chr2 60514032 60514051 60514048 +
aggtggcctggcatgggctg

SEQ ID NO: 165289 - DNA, 20 bp, Artificial Sequence
  Synthetic oligonucleotide; CAG chr2 60514035 60514054 60514051 +
tggcctggcatgggctgagg

SEQ ID NO: 165290 - DNA, 20 bp, Artificial Sequence
  Synthetic oligonucleotide; AAG chr2 60514043 60514062 60514059 +
catgggctgaggcagcacac

SEQ ID NO: 165291 - DNA, 20 bp, Artificial Sequence
  Synthetic oligonucleotide; AGG chr2 60514044 60514063 60514060 +
atgggctgaggcagcacaca

SEQ ID NO: 165292 - DNA, 20 bp, Artificial Sequence
  Synthetic oligonucleotide; GAG chr2 60514052 60514071 60514068 +
aggcagcacacaaggactct

SEQ ID NO: 165293 - DNA, 20 bp, Artificial Sequence
  Synthetic oligonucleotide; CAG chr2 60514061 60514080 60514077 +
acaaggactctgagccacac

SEQ ID NO: 165294 - DNA, 20 bp, Artificial Sequence
  Synthetic oligonucleotide; TGG chr2 60514075 60514094 60514091 +
ccacaccagccatctccttg

SEQ ID NO: 165295 - DNA, 20 bp, Artificial Sequence
  Synthetic oligonucleotide; GAG chr2 60514086 60514105 60514102 +
atctccttgtggactttcct

SEQ ID NO: 165296 - DNA, 20 bp, Artificial Sequence
  Synthetic oligonucleotide; GAG chr2 60514088 60514107 60514104 +
ctccttgtggactttcctga

SEQ ID NO: 165297 - DNA, 20 bp, Artificial Sequence
  Synthetic oligonucleotide; CAG chr2 60514097 60514116 60514113 +
gactttcctgagagcacgtg

SEQ ID NO: 165298 - DNA, 20 bp, Artificial Sequence
  Synthetic oligonucleotide; TAG chr2 60514101 60514120 60514117 +
ttcctgagagcacgtgcagc

SEQ ID NO: 165299 - DNA, 20 bp, Artificial Sequence
  Synthetic oligonucleotide; CAG chr2 60514104 60514123 60514120 +
ctgagagcacgtgcagctag

SEQ ID NO: 165300 - DNA, 20 bp, Artificial Sequence
  Synthetic oligonucleotide; AAG chr2 60514113 60514132 60514129 +
cgtgcagctagcagtgctcc

SEQ ID NO: 165301 - DNA, 20 bp, Artificial Sequence
  Synthetic oligonucleotide; GAG chr2 60514124 60514143 60514140 +
cagtgctccaagcactctct

SEQ ID NO: 165302 - DNA, 20 bp, Artificial Sequence
  Synthetic oligonucleotide; GAG chr2 60514126 60514145 60514142 +
gtgctccaagcactctctga

SEQ ID NO: 165303 - DNA, 20 bp, Artificial Sequence
  Synthetic oligonucleotide; AGG chr2 60514127 60514146 60514143 +
tgctccaagcactctctgag

SEQ ID NO: 165304 - DNA, 20 bp, Artificial Sequence
  Synthetic oligonucleotide; CAG chr2 60514134 60514153 60514150 +
agcactctctgagaggcttc

SEQ ID NO: 165305 - DNA, 20 bp, Artificial Sequence
  Synthetic oligonucleotide; AGG chr2 60514135 60514154 60514151 +
gcactctctgagaggcttcc

SEQ ID NO: 165306 - DNA, 20 bp, Artificial Sequence
  Synthetic oligonucleotide; TGG chr2 60514139 60514158 60514155 +
tctctgagaggcttccaggc

SEQ ID NO: 165307 - DNA, 20 bp, Artificial Sequence
  Synthetic oligonucleotide; GAG chr2 60514141 60514160 60514157 +
tctgagaggcttccaggctg

SEQ ID NO: 165308 - DNA, 20 bp, Artificial Sequence
  Synthetic oligonucleotide; GAG chr2 60514148 60514167 60514164 +
ggcttccaggctggagctct

SEQ ID NO: 165309 - DNA, 20 bp, Artificial Sequence
  Synthetic oligonucleotide; GAG chr2 60514150 60514169 60514166 +
cttccaggctggagctctga

SEQ ID NO: 165310 - DNA, 20 bp, Artificial Sequence
  Synthetic oligonucleotide; AGG chr2 60514151 60514170 60514167 +
ttccaggctggagctctgag

SEQ ID NO: 165311 - DNA, 20 bp, Artificial Sequence
  Synthetic oligonucleotide; CAG chr2 60514158 60514177 60514174 +
ctggagctctgagaggcttc

SEQ ID NO: 165312 - DNA, 20 bp, Artificial Sequence
  Synthetic oligonucleotide; AGG chr2 60514159 60514178 60514175 +
tggagctctgagaggcttcc

SEQ ID NO: 165313 - DNA, 20 bp, Artificial Sequence
  Synthetic oligonucleotide; TGG chr2 60514163 60514182 60514179 +
gctctgagaggcttccaggc

SEQ ID NO: 165314 - DNA, 20 bp, Artificial Sequence
  Synthetic oligonucleotide; GGG chr2 60514164 60514183 60514180 +
ctctgagaggcttccaggct

SEQ ID NO: 165315 - DNA, 20 bp, Artificial Sequence
  Synthetic oligonucleotide; CAG chr2 60514174 60514193 60514190 +
cttccaggctgggctacctc

SEQ ID NO: 165316 - DNA, 20 bp, Artificial Sequence
  Synthetic oligonucleotide; TGG chr2 60514182 60514201 60514198 +
ctgggctacctccagccatg

SEQ ID NO: 165317 - DNA, 20 bp, Artificial Sequence
  Synthetic oligonucleotide; TGG chr2 60514185 60514204 60514201 +
ggctacctccagccatgtgg

SEQ ID NO: 165318 - DNA, 20 bp, Artificial Sequence
  Synthetic oligonucleotide; TGG chr2 60514192 60514211 60514208 +
tccagccatgtggtggaaac

SEQ ID NO: 165319 - DNA, 20 bp, Artificial Sequence
  Synthetic oligonucleotide; TAG chr2 60514195 60514214 60514211 +
agccatgtggtggaaactgg

SEQ ID NO: 165320 - DNA, 20 bp, Artificial Sequence
  Synthetic oligonucleotide; AAG chr2 60514200 60514219 60514216 +
tgtggtggaaactggtagca

SEQ ID NO: 165321 - DNA, 20 bp, Artificial Sequence
  Synthetic oligonucleotide; AGG chr2 60514201 60514220 60514217 +
gtggtggaaactggtagcaa

SEQ ID NO: 165322 - DNA, 20 bp, Artificial Sequence
  Synthetic oligonucleotide; AAG chr2 60514204 60514223 60514220 +
gtggaaactggtagcaaagg

SEQ ID NO: 165323 - DNA, 20 bp, Artificial Sequence
  Synthetic oligonucleotide; CAG chr2 60514209 60514228 60514225 +
aactggtagcaaaggaagcc

SEQ ID NO: 165324 - DNA, 20 bp, Artificial Sequence
  Synthetic oligonucleotide; AAG chr2 60514212 60514231 60514228 +
tggtagcaaaggaagcccag

SEQ ID NO: 165325 - DNA, 20 bp, Artificial Sequence
  Synthetic oligonucleotide; AGG chr2 60514213 60514232 60514229 +
ggtagcaaaggaagcccaga

SEQ ID NO: 165326 - DNA, 20 bp, Artificial Sequence
  Synthetic oligonucleotide; GGG chr2 60514214 60514233 60514230 +
gtagcaaaggaagcccagaa

SEQ ID NO: 165327 - DNA, 20 bp, Artificial Sequence
  Synthetic oligonucleotide; TAG chr2 60514229 60514248 60514245 +
cagaagggccacaactgaac

SEQ ID NO: 165328 - DNA, 20 bp, Artificial Sequence
  Synthetic oligonucleotide; AAG chr2 60514232 60514251 60514248 +
aagggccacaactgaactag

SEQ ID NO: 165329 - DNA, 20 bp, Artificial Sequence
  Synthetic oligonucleotide; AGG chr2 60514233 60514252 60514249 +
agggccacaactgaactaga

SEQ ID NO: 165330 - DNA, 20 bp, Artificial Sequence
  Synthetic oligonucleotide; AAG chr2 60514238 60514257 60514254 +
cacaactgaactagaaggct

SEQ ID NO: 165331 - DNA, 20 bp, Artificial Sequence
  Synthetic oligonucleotide; AGG chr2 60514239 60514258 60514255 +
acaactgaactagaaggcta

SEQ ID NO: 165332 - DNA, 20 bp, Artificial Sequence
  Synthetic oligonucleotide; CGG chr2 60514249 60514268 60514265 +
tagaaggctaaggaacaccc

SEQ ID NO: 165333 - DNA, 20 bp, Artificial Sequence
  Synthetic oligonucleotide; TGG chr2 60514256 60514275 60514272 +
ctaaggaacaccccggccac

SEQ ID NO: 165334 - DNA, 20 bp, Artificial Sequence
  Synthetic oligonucleotide; TGG chr2 60514259 60514278 60514275 +
aggaacaccccggccactgg

SEQ ID NO: 165335 - DNA, 20 bp, Artificial Sequence
  Synthetic oligonucleotide; GGG chr2 60514260 60514279 60514276 +
ggaacaccccggccactggt

SEQ ID NO: 165336 - DNA, 20 bp, Artificial Sequence
  Synthetic oligonucleotide; CAG chr2 60514267 60514286 60514283 +
cccggccactggtgggatcg

SEQ ID NO: 165337 - DNA, 20 bp, Artificial Sequence
  Synthetic oligonucleotide; GAG chr2 60514274 60514293 60514290 +
actggtgggatcgcagtgct

SEQ ID NO: 165338 - DNA, 20 bp, Artificial Sequence
  Synthetic oligonucleotide; GAG chr2 60514281 60514300 60514297 +
ggatcgcagtgctgagccat

SEQ ID NO: 165339 - DNA, 20 bp, Artificial Sequence
  Synthetic oligonucleotide; CAG chr2 60514290 60514309 60514306 +
tgctgagccatgagccctac

SEQ ID NO: 165340 - DNA, 20 bp, Artificial Sequence
  Synthetic oligonucleotide; AGG chr2 60514291 60514310 60514307 +
gctgagccatgagccctacc

SEQ ID NO: 165341 - DNA, 20 bp, Artificial Sequence
  Synthetic oligonucleotide; TGG chr2 60514305 60514324 60514321 +
cctaccaggcaacccatttc

SEQ ID NO: 165342 - DNA, 20 bp, Artificial Sequence
  Synthetic oligonucleotide; GGG chr2 60514306 60514325 60514322 +
ctaccaggcaacccatttct

SEQ ID NO: 165343 - DNA, 20 bp, Artificial Sequence
  Synthetic oligonucleotide; CAG chr2 60514309 60514328 60514325 +
ccaggcaacccatttctggg

SEQ ID NO: 165344 - DNA, 20 bp, Artificial Sequence
  Synthetic oligonucleotide; AAG chr2 60514316 60514335 60514332 +
acccatttctgggcagtccc

SEQ ID NO: 165345 - DNA, 20 bp, Artificial Sequence
  Synthetic oligonucleotide; TGG chr2 60514322 60514341 60514338 +
ttctgggcagtcccaagact

SEQ ID NO: 165346 - DNA, 20 bp, Artificial Sequence
  Synthetic oligonucleotide; GAG chr2 60514324 60514343 60514340 +
ctgggcagtcccaagacttg

SEQ ID NO: 165347 - DNA, 20 bp, Artificial Sequence
  Synthetic oligonucleotide; AAG chr2 60514330 60514349 60514346 +
agtcccaagacttggagaac

SEQ ID NO: 165348 - DNA, 20 bp, Artificial Sequence
  Synthetic oligonucleotide; TAG chr2 60514344 60514363 60514360 +
gagaacaagccatctgaaaa

SEQ ID NO: 165349 - DNA, 20 bp, Artificial Sequence
  Synthetic oligonucleotide; TAG chr2 60514354 60514373 60514370 +
catctgaaaatagaattaaa

SEQ ID NO: 165350 - DNA, 20 bp, Artificial Sequence
  Synthetic oligonucleotide; CAG chr2 60514358 60514377 60514374 +
tgaaaatagaattaaatagc

SEQ ID NO: 165351 - DNA, 20 bp, Artificial Sequence
  Synthetic oligonucleotide; AGG chr2 60514359 60514378 60514375 +
gaaaatagaattaaatagcc

SEQ ID NO: 165352 - DNA, 20 bp, Artificial Sequence
  Synthetic oligonucleotide; CGG chr2 60514364 60514383 60514380 +
tagaattaaatagccaggtg

SEQ ID NO: 165353 - DNA, 20 bp, Artificial Sequence
  Synthetic oligonucleotide; TGG chr2 60514367 60514386 60514383 +
aattaaatagccaggtgcgg

SEQ ID NO: 165354 - DNA, 20 bp, Artificial Sequence
  Synthetic oligonucleotide; CAG chr2 60514386 60514405 60514402 +
gtggctcacacctgtaatct

SEQ ID NO: 165355 - DNA, 20 bp, Artificial Sequence
  Synthetic oligonucleotide; TGG chr2 60514394 60514413 60514410 +
cacctgtaatctcagcattt

SEQ ID NO: 165356 - DNA, 20 bp, Artificial Sequence
  Synthetic oligonucleotide; GGG chr2 60514395 60514414 60514411 +
acctgtaatctcagcatttt

SEQ ID NO: 165357 - DNA, 20 bp, Artificial Sequence
  Synthetic oligonucleotide; GAG chr2 60514397 60514416 60514413 +
ctgtaatctcagcattttgg

SEQ ID NO: 165358 - DNA, 20 bp, Artificial Sequence
  Synthetic oligonucleotide; AGG chr2 60514398 60514417 60514414 +
tgtaatctcagcattttggg

SEQ ID NO: 165359 - DNA, 20 bp, Artificial Sequence
  Synthetic oligonucleotide; GAG chr2 60514403 60514422 60514419 +
tctcagcattttgggaggcc

SEQ ID NO: 165360 - DNA, 20 bp, Artificial Sequence
  Synthetic oligonucleotide; AGG chr2 60514404 60514423 60514420 +
ctcagcattttgggaggccg

SEQ ID NO: 165361 - DNA, 20 bp, Artificial Sequence
  Synthetic oligonucleotide; TGG chr2 60514411 60514430 60514427 +
ttttgggaggccgaggcgtg

SEQ ID NO: 165362 - DNA, 20 bp, Artificial Sequence
  Synthetic oligonucleotide; GGG chr2 60514412 60514431 60514428 +
tttgggaggccgaggcgtgt

SEQ ID NO: 165363 - DNA, 20 bp, Artificial Sequence
  Synthetic oligonucleotide; GAG chr2 60514421 60514440 60514437 +
ccgaggcgtgtgggtcacct

SEQ ID NO: 165364 - DNA, 20 bp, Artificial Sequence
  Synthetic oligonucleotide; AGG chr2 60514422 60514441 60514438 +
cgaggcgtgtgggtcacctg

SEQ ID NO: 165365 - DNA, 20 bp, Artificial Sequence
  Synthetic oligonucleotide; CAG chr2 60514426 60514445 60514442 +
gcgtgtgggtcacctgaggt

SEQ ID NO: 165366 - DNA, 20 bp, Artificial Sequence
  Synthetic oligonucleotide; AGG chr2 60514427 60514446 60514443 +
cgtgtgggtcacctgaggtc

SEQ ID NO: 165367 - DNA, 20 bp, Artificial Sequence
  Synthetic oligonucleotide; GAG chr2 60514429 60514448 60514445 +
tgtgggtcacctgaggtcag

SEQ ID NO: 165368 - DNA, 20 bp, Artificial Sequence
  Synthetic oligonucleotide; AAG chr2 60514435 60514454 60514451 +
tcacctgaggtcaggagttc

SEQ ID NO: 165369 - DNA, 20 bp, Artificial Sequence
  Synthetic oligonucleotide; CAG chr2 60514440 60514459 60514456 +
tgaggtcaggagttcaagac

SEQ ID NO: 165370 - DNA, 20 bp, Artificial Sequence
  Synthetic oligonucleotide; TAG chr2 60514445 60514464 60514461 +
tcaggagttcaagaccagcc

SEQ ID NO: 165371 - DNA, 20 bp, Artificial Sequence
  Synthetic oligonucleotide; TGG chr2 60514454 60514473 60514470 +
caagaccagcctagccaaca

SEQ ID NO: 165372 - DNA, 20 bp, Artificial Sequence
  Synthetic oligonucleotide; CAG chr2 60514500 60514519 60514516 +
aaaaaaaaaaaaaaaaaaat

SEQ ID NO: 165373 - DNA, 20 bp, Artificial Sequence
  Synthetic oligonucleotide; CAG chr2 60514504 60514523 60514520 +
aaaaaaaaaaaaaaatcagc

SEQ ID NO: 165374 - DNA, 20 bp, Artificial Sequence
  Synthetic oligonucleotide; AGG chr2 60514505 60514524 60514521 +
aaaaaaaaaaaaaatcagcc

SEQ ID NO: 165375 - DNA, 20 bp, Artificial Sequence
  Synthetic oligonucleotide; TGG chr2 60514513 60514532 60514529 +
aaaaaatcagccaggtgtga

SEQ ID NO: 165376 - DNA, 20 bp, Artificial Sequence
  Synthetic oligonucleotide; CAG chr2 60514532 60514551 60514548 +
atggcatgcacctataatcc

SEQ ID NO: 165377 - DNA, 20 bp, Artificial Sequence
  Synthetic oligonucleotide; TGG chr2 60514540 60514559 60514556 +
cacctataatcccagctact

SEQ ID NO: 165378 - DNA, 20 bp, Artificial Sequence
  Synthetic oligonucleotide; GGG chr2 60514541 60514560 60514557 +
acctataatcccagctactt

SEQ ID NO: 165379 - DNA, 20 bp, Artificial Sequence
  Synthetic oligonucleotide; GAG chr2 60514543 60514562 60514559 +
ctataatcccagctacttgg

SEQ ID NO: 165380 - DNA, 20 bp, Artificial Sequence
  Synthetic oligonucleotide; AGG chr2 60514544 60514563 60514560 +
tataatcccagctacttggg

SEQ ID NO: 165381 - DNA, 20 bp, Artificial Sequence
  Synthetic oligonucleotide; GAG chr2 60514549 60514568 60514565 +
tcccagctacttgggaggct

SEQ ID NO: 165382 - DNA, 20 bp, Artificial Sequence
  Synthetic oligonucleotide; AGG chr2 60514550 60514569 60514566 +
cccagctacttgggaggctg

SEQ ID NO: 165383 - DNA, 20 bp, Artificial Sequence
  Synthetic oligonucleotide; CAG chr2 60514553 60514572 60514569 +
agctacttgggaggctgagg

SEQ ID NO: 165384 - DNA, 20 bp, Artificial Sequence
  Synthetic oligonucleotide; AGG chr2 60514554 60514573 60514570 +
gctacttgggaggctgaggc

SEQ ID NO: 165385 - DNA, 20 bp, Artificial Sequence
  Synthetic oligonucleotide; GAG chr2 60514556 60514575 60514572 +
tacttgggaggctgaggcag

SEQ ID NO: 165386 - DNA, 20 bp, Artificial Sequence
  Synthetic oligonucleotide; TGG chr2 60514572 60514591 60514588 +
gcaggagaatcacttgaacc

SEQ ID NO: 165387 - DNA, 20 bp, Artificial Sequence
  Synthetic oligonucleotide; GGG chr2 60514573 60514592 60514589 +
caggagaatcacttgaacct

SEQ ID NO: 165388 - DNA, 20 bp, Artificial Sequence
  Synthetic oligonucleotide; GAG chr2 60514575 60514594 60514591 +
ggagaatcacttgaacctgg

SEQ ID NO: 165389 - DNA, 20 bp, Artificial Sequence
  Synthetic oligonucleotide; AGG chr2 60514576 60514595 60514592 +
gagaatcacttgaacctggg

SEQ ID NO: 165390 - DNA, 20 bp, Artificial Sequence
  Synthetic oligonucleotide; CGG chr2 60514579 60514598 60514595 +
aatcacttgaacctgggagg

SEQ ID NO: 165391 - DNA, 20 bp, Artificial Sequence
  Synthetic oligonucleotide; GAG chr2 60514581 60514600 60514597 +
tcacttgaacctgggaggcg

SEQ ID NO: 165392 - DNA, 20 bp, Artificial Sequence
  Synthetic oligonucleotide; AGG chr2 60514582 60514601 60514598 +
cacttgaacctgggaggcgg

SEQ ID NO: 165393 - DNA, 20 bp, Artificial Sequence
  Synthetic oligonucleotide; GAG chr2 60514592 60514611 60514608 +
tgggaggcggaggctgcaat

SEQ ID NO: 165394 - DNA, 20 bp, Artificial Sequence
  Synthetic oligonucleotide; GAG chr2 60514597 60514616 60514613 +
ggcggaggctgcaatgagcc

SEQ ID NO: 165395 - DNA, 20 bp, Artificial Sequence
  Synthetic oligonucleotide; TAG chr2 60514604 60514623 60514620 +
gctgcaatgagccgagatcg

SEQ ID NO: 165396 - DNA, 20 bp, Artificial Sequence
  Synthetic oligonucleotide; CAG chr2 60514617 60514636 60514633 +
gagatcgtagcactgcactc

SEQ ID NO: 165397 - DNA, 20 bp, Artificial Sequence
  Synthetic oligonucleotide; TGG chr2 60514622 60514641 60514638 +
cgtagcactgcactccagcc

SEQ ID NO: 165398 - DNA, 20 bp, Artificial Sequence
  Synthetic oligonucleotide; GGG chr2 60514623 60514642 60514639 +
gtagcactgcactccagcct

SEQ ID NO: 165399 - DNA, 20 bp, Artificial Sequence
  Synthetic oligonucleotide; CAG chr2 60514629 60514648 60514645 +
ctgcactccagcctgggcga

SEQ ID NO: 165400 - DNA, 20 bp, Artificial Sequence
  Synthetic oligonucleotide; GAG chr2 60514631 60514650 60514647 +
gcactccagcctgggcgaca

SEQ ID NO: 165401 - DNA, 20 bp, Artificial Sequence
  Synthetic oligonucleotide; GAG chr2 60514635 60514654 60514651 +
tccagcctgggcgacagagc

SEQ ID NO: 165402 - DNA, 20 bp, Artificial Sequence
  Synthetic oligonucleotide; TGG chr2 60514669 60514688 60514685 +
aaaaaaaaaaaaaattaaat

SEQ ID NO: 165403 - DNA, 20 bp, Artificial Sequence
  Synthetic oligonucleotide; GGG chr2 60514670 60514689 60514686 +
aaaaaaaaaaaaattaaatt

SEQ ID NO: 165404 - DNA, 20 bp, Artificial Sequence
  Synthetic oligonucleotide; TGG chr2 60514673 60514692 60514689 +
aaaaaaaaaattaaattggg

SEQ ID NO: 165405 - DNA, 20 bp, Artificial Sequence
  Synthetic oligonucleotide; GGG chr2 60514674 60514693 60514690 +
aaaaaaaaattaaattgggt

SEQ ID NO: 165406 - DNA, 20 bp, Artificial Sequence
  Synthetic oligonucleotide; GGG chr2 60514675 60514694 60514691 +
aaaaaaaattaaattgggtg

SEQ ID NO: 165407 - DNA, 20 bp, Artificial Sequence
  Synthetic oligonucleotide; GGG chr2 60514676 60514695 60514692 +
aaaaaaattaaattgggtgg

SEQ ID NO: 165408 - DNA, 20 bp, Artificial Sequence
  Synthetic oligonucleotide; GAG chr2 60514678 60514697 60514694 +
aaaaattaaattgggtgggg

SEQ ID NO: 165409 - DNA, 20 bp, Artificial Sequence
  Synthetic oligonucleotide; TAG chr2 60514686 60514705 60514702 +
aattgggtgggggagtttct

SEQ ID NO: 165410 - DNA, 20 bp, Artificial Sequence
  Synthetic oligonucleotide; AGG chr2 60514687 60514706 60514703 +
attgggtgggggagtttctt

SEQ ID NO: 165411 - DNA, 20 bp, Artificial Sequence
  Synthetic oligonucleotide; CAG chr2 60514698 60514717 60514714 +
gagtttcttaggaaaaaaat

SEQ ID NO: 165412 - DNA, 20 bp, Artificial Sequence
  Synthetic oligonucleotide; GAG chr2 60514700 60514719 60514716 +
gtttcttaggaaaaaaatca

SEQ ID NO: 165413 - DNA, 20 bp, Artificial Sequence
  Synthetic oligonucleotide; TAG chr2 60514718 60514737 60514734 +
cagagttgtgcaaataaatc

SEQ ID NO: 165414 - DNA, 20 bp, Artificial Sequence
  Synthetic oligonucleotide; TGG chr2 60514722 60514741 60514738 +
gttgtgcaaataaatctagt

SEQ ID NO: 165415 - DNA, 20 bp, Artificial Sequence
  Synthetic oligonucleotide; AAG chr2 60514750 60514769 60514766 +
ctgtctttacaacacaatga

SEQ ID NO: 165416 - DNA, 20 bp, Artificial Sequence
  Synthetic oligonucleotide; AGG chr2 60514751 60514770 60514767 +
tgtctttacaacacaatgaa

SEQ ID NO: 165417 - DNA, 20 bp, Artificial Sequence
  Synthetic oligonucleotide; GGG chr2 60514752 60514771 60514768 +
gtctttacaacacaatgaaa

SEQ ID NO: 165418 - DNA, 20 bp, Artificial Sequence
  Synthetic oligonucleotide; AAG chr2 60514756 60514775 60514772 +
ttacaacacaatgaaagggt

SEQ ID NO: 165419 - DNA, 20 bp, Artificial Sequence
  Synthetic oligonucleotide; AGG chr2 60514757 60514776 60514773 +
tacaacacaatgaaagggta

SEQ ID NO: 165420 - DNA, 20 bp, Artificial Sequence
  Synthetic oligonucleotide; AAG chr2 60514766 60514785 60514782 +
atgaaagggtaaggcaccat

SEQ ID NO: 165421 - DNA, 20 bp, Artificial Sequence
  Synthetic oligonucleotide; GAG chr2 60514768 60514787 60514784 +
gaaagggtaaggcaccataa

SEQ ID NO: 165422 - DNA, 20 bp, Artificial Sequence
  Synthetic oligonucleotide; AGG chr2 60514769 60514788 60514785 +
aaagggtaaggcaccataag

SEQ ID NO: 165423 - DNA, 20 bp, Artificial Sequence
  Synthetic oligonucleotide; AAG chr2 60514789 60514808 60514805 +
aggctgtgaattccattgat

SEQ ID NO: 165424 - DNA, 20 bp, Artificial Sequence
  Synthetic oligonucleotide; GAG chr2 60514791 60514810 60514807 +
gctgtgaattccattgataa

SEQ ID NO: 165425 - DNA, 20 bp, Artificial Sequence
  Synthetic oligonucleotide; GAG chr2 60514793 60514812 60514809 +
tgtgaattccattgataaga

SEQ ID NO: 165426 - DNA, 20 bp, Artificial Sequence
  Synthetic oligonucleotide; AGG chr2 60514794 60514813 60514810 +
gtgaattccattgataagag

SEQ ID NO: 165427 - DNA, 20 bp, Artificial Sequence
  Synthetic oligonucleotide; AAG chr2 60514817 60514836 60514833 +
atttccctactcaaatatca

SEQ ID NO: 165428 - DNA, 20 bp, Artificial Sequence
  Synthetic oligonucleotide; AGG chr2 60514818 60514837 60514834 +
tttccctactcaaatatcaa

SEQ ID NO: 165429 - DNA, 20 bp, Artificial Sequence
  Synthetic oligonucleotide; CAG chr2 60514844 60514863 60514860 +
tgcatacacatacactaaaa

SEQ ID NO: 165430 - DNA, 20 bp, Artificial Sequence
  Synthetic oligonucleotide; AAG chr2 60514851 60514870 60514867 +
acatacactaaaacagaaaa

SEQ ID NO: 165431 - DNA, 20 bp, Artificial Sequence
  Synthetic oligonucleotide; AAG chr2 60514865 60514884 60514881 +
agaaaaaagaaaaaaaaaaa

SEQ ID NO: 165432 - DNA, 20 bp, Artificial Sequence
  Synthetic oligonucleotide; AAG chr2 60514870 60514889 60514886 +
aaagaaaaaaaaaaaaagaa

SEQ ID NO: 165433 - DNA, 20 bp, Artificial Sequence
  Synthetic oligonucleotide; GAG chr2 60514872 60514891 60514888 +
agaaaaaaaaaaaaagaaaa

SEQ ID NO: 165434 - DNA, 20 bp, Artificial Sequence
  Synthetic oligonucleotide; GAG chr2 60514874 60514893 60514890 +
aaaaaaaaaaaaagaaaaga

SEQ ID NO: 165435 - DNA, 20 bp, Artificial Sequence
  Synthetic oligonucleotide; CAG chr2 60514878 60514897 60514894 +
aaaaaaaaagaaaagagaga

SEQ ID NO: 165436 - DNA, 20 bp, Artificial Sequence
  Synthetic oligonucleotide; GAG chr2 60514880 60514899 60514896 +
aaaaaaagaaaagagagaca

SEQ ID NO: 165437 - DNA, 20 bp, Artificial Sequence
  Synthetic oligonucleotide; GAG chr2 60514882 60514901 60514898 +
aaaaagaaaagagagacaga

SEQ ID NO: 165438 - DNA, 20 bp, Artificial Sequence
  Synthetic oligonucleotide; GAG chr2 60514884 60514903 60514900 +
aaagaaaagagagacagaga

SEQ ID NO: 165439 - DNA, 20 bp, Artificial Sequence
  Synthetic oligonucleotide; GAG chr2 60514886 60514905 60514902 +
agaaaagagagacagagaga

SEQ ID NO: 165440 - DNA, 20 bp, Artificial Sequence
  Synthetic oligonucleotide; GAG chr2 60514888 60514907 60514904 +
aaaagagagacagagagaga

SEQ ID NO: 165441 - DNA, 20 bp, Artificial Sequence
  Synthetic oligonucleotide; GAG chr2 60514890 60514909 60514906 +
aagagagacagagagagaga

SEQ ID NO: 165442 - DNA, 20 bp, Artificial Sequence
  Synthetic oligonucleotide; AAG chr2 60514914 60514933 60514930 +
atcaccttttaaactcatcc

SEQ ID NO: 165443 - DNA, 20 bp, Artificial Sequence
  Synthetic oligonucleotide; GAG chr2 60514916 60514935 60514932 +
caccttttaaactcatccaa

SEQ ID NO: 165444 - DNA, 20 bp, Artificial Sequence
  Synthetic oligonucleotide; CAG chr2 60514920 60514939 60514936 +
ttttaaactcatccaagagc

SEQ ID NO: 165445 - DNA, 20 bp, Artificial Sequence
  Synthetic oligonucleotide; AAG chr2 60514926 60514945 60514942 +
actcatccaagagccagtca

SEQ ID NO: 165446 - DNA, 20 bp, Artificial Sequence
  Synthetic oligonucleotide; AAG chr2 60514936 60514955 60514952 +
gagccagtcaaagccaccca

SEQ ID NO: 165447 - DNA, 20 bp, Artificial Sequence
  Synthetic oligonucleotide; AGG chr2 60514937 60514956 60514953 +
agccagtcaaagccacccaa

SEQ ID NO: 165448 - DNA, 20 bp, Artificial Sequence
  Synthetic oligonucleotide; AAG chr2 60514941 60514960 60514957 +
agtcaaagccacccaaagga

SEQ ID NO: 165449 - DNA, 20 bp, Artificial Sequence
  Synthetic oligonucleotide; CAG chr2 60514944 60514963 60514960 +
caaagccacccaaaggaaag

SEQ ID NO: 165450 - DNA, 20 bp, Artificial Sequence
  Synthetic oligonucleotide; AGG chr2 60514945 60514964 60514961 +
aaagccacccaaaggaaagc

SEQ ID NO: 165451 - DNA, 20 bp, Artificial Sequence
  Synthetic oligonucleotide; CAG chr2 60514951 60514970 60514967 +
acccaaaggaaagcaggccc

SEQ ID NO: 165452 - DNA, 20 bp, Artificial Sequence
  Synthetic oligonucleotide; CAG chr2 60514967 60514986 60514983 +
gccccagtcccttccgaact

SEQ ID NO: 165453 - DNA, 20 bp, Artificial Sequence
  Synthetic oligonucleotide; TGG chr2 60514982 60515001 60514998 +
gaactcagccgttctccctc

SEQ ID NO: 165454 - DNA, 20 bp, Artificial Sequence
  Synthetic oligonucleotide; GAG chr2 60514986 60515005 60515002 +
tcagccgttctccctctggt

SEQ ID NO: 165455 - DNA, 20 bp, Artificial Sequence
  Synthetic oligonucleotide; CAG chr2 60514990 60515009 60515006 +
ccgttctccctctggtgaga

SEQ ID NO: 165456 - DNA, 20 bp, Artificial Sequence
  Synthetic oligonucleotide; AGG chr2 60514991 60515010 60515007 +
cgttctccctctggtgagac

SEQ ID NO: 165457 - DNA, 20 bp, Artificial Sequence
  Synthetic oligonucleotide; TAG chr2 60514997 60515016 60515013 +
ccctctggtgagacaggctc

SEQ ID NO: 165458 - DNA, 20 bp, Artificial Sequence
  Synthetic oligonucleotide; CAG chr2 60515008 60515027 60515024 +
gacaggctctagcttgtttc

SEQ ID NO: 165459 - DNA, 20 bp, Artificial Sequence
  Synthetic oligonucleotide; CAG chr2 60515022 60515041 60515038 +
tgtttccagaatgccactac

SEQ ID NO: 165460 - DNA, 20 bp, Artificial Sequence
  Synthetic oligonucleotide; CAG chr2 60515038 60515057 60515054 +
ctaccagcttcccacacctc

SEQ ID NO: 165461 - DNA, 20 bp, Artificial Sequence
  Synthetic oligonucleotide; AGG chr2 60515039 60515058 60515055 +
taccagcttcccacacctcc

SEQ ID NO: 165462 - DNA, 20 bp, Artificial Sequence
  Synthetic oligonucleotide; GGG chr2 60515040 60515059 60515056 +
accagcttcccacacctcca

SEQ ID NO: 165463 - DNA, 20 bp, Artificial Sequence
  Synthetic oligonucleotide; GGG chr2 60515041 60515060 60515057 +
ccagcttcccacacctccag

SEQ ID NO: 165464 - DNA, 20 bp, Artificial Sequence
  Synthetic oligonucleotide; AAG chr2 60515058 60515077 60515074 +
caggggaccccctaactcca

SEQ ID NO: 165465 - DNA, 20 bp, Artificial Sequence
  Synthetic oligonucleotide; CAG chr2 60515068 60515087 60515084 +
cctaactccaaagtgttgcc

SEQ ID NO: 165466 - DNA, 20 bp, Artificial Sequence
  Synthetic oligonucleotide; AAG chr2 60515075 60515094 60515091 +
ccaaagtgttgcccagacct

SEQ ID NO: 165467 - DNA, 20 bp, Artificial Sequence
  Synthetic oligonucleotide; AGG chr2 60515076 60515095 60515092 +
caaagtgttgcccagaccta

SEQ ID NO: 165468 - DNA, 20 bp, Artificial Sequence
  Synthetic oligonucleotide; TGG chr2 60515109 60515128 60515125 +
acgtgctccttccccaacac

SEQ ID NO: 165469 - DNA, 20 bp, Artificial Sequence
  Synthetic oligonucleotide; CAG chr2 60515116 60515135 60515132 +
ccttccccaacactggcttc

SEQ ID NO: 165470 - DNA, 20 bp, Artificial Sequence
  Synthetic oligonucleotide; AGG chr2 60515117 60515136 60515133 +
cttccccaacactggcttcc

SEQ ID NO: 165471 - DNA, 20 bp, Artificial Sequence
  Synthetic oligonucleotide; GAG chr2 60515121 60515140 60515137 +
cccaacactggcttccaggt

SEQ ID NO: 165472 - DNA, 20 bp, Artificial Sequence
  Synthetic oligonucleotide; GAG chr2 60515125 60515144 60515141 +
acactggcttccaggtgagc

SEQ ID NO: 165473 - DNA, 20 bp, Artificial Sequence
  Synthetic oligonucleotide; CAG chr2 60515129 60515148 60515145 +
tggcttccaggtgagcgaga

SEQ ID NO: 165474 - DNA, 20 bp, Artificial Sequence
  Synthetic oligonucleotide; AAG chr2 60515139 60515158 60515155 +
gtgagcgagacagaatctgc

SEQ ID NO: 165475 - DNA, 20 bp, Artificial Sequence
  Synthetic oligonucleotide; CAG chr2 60515142 60515161 60515158 +
agcgagacagaatctgcaag

SEQ ID NO: 165476 - DNA, 20 bp, Artificial Sequence
  Synthetic oligonucleotide; GAG chr2 60515144 60515163 60515160 +
cgagacagaatctgcaagca

SEQ ID NO: 165477 - DNA, 20 bp, Artificial Sequence
  Synthetic oligonucleotide; TGG chr2 60515162 60515181 60515178 +
cagagttcactgcttgacca

SEQ ID NO: 165478 - DNA, 20 bp, Artificial Sequence
  Synthetic oligonucleotide; GGG chr2 60515163 60515182 60515179 +
agagttcactgcttgaccat

SEQ ID NO: 165479 - DNA, 20 bp, Artificial Sequence
  Synthetic oligonucleotide; GGG chr2 60515164 60515183 60515180 +
gagttcactgcttgaccatg

SEQ ID NO: 165480 - DNA, 20 bp, Artificial Sequence
  Synthetic oligonucleotide; AAG chr2 60515170 60515189 60515186 +
actgcttgaccatggggtga

SEQ ID NO: 165481 - DNA, 20 bp, Artificial Sequence
  Synthetic oligonucleotide; AAG chr2 60515178 60515197 60515194 +
accatggggtgaaagccaca

SEQ ID NO: 165482 - DNA, 20 bp, Artificial Sequence
  Synthetic oligonucleotide; CAG chr2 60515188 60515207 60515204 +
gaaagccacaaagacaccac

SEQ ID NO: 165483 - DNA, 20 bp, Artificial Sequence
  Synthetic oligonucleotide; CAG chr2 60515203 60515222 60515219 +
accaccagctatcccaaccc

SEQ ID NO: 165484 - DNA, 20 bp, Artificial Sequence
  Synthetic oligonucleotide; CAG chr2 60515231 60515250 60515247 +
tcactttttcactttctccc

SEQ ID NO: 165485 - DNA, 20 bp, Artificial Sequence
  Synthetic oligonucleotide; AGG chr2 60515232 60515251 60515248 +
cactttttcactttctcccc

SEQ ID NO: 165486 - DNA, 20 bp, Artificial Sequence
  Synthetic oligonucleotide; GGG chr2 60515233 60515252 60515249 +
actttttcactttctcccca

SEQ ID NO: 165487 - DNA, 20 bp, Artificial Sequence
  Synthetic oligonucleotide; GAG chr2 60515235 60515254 60515251 +
tttttcactttctccccagg

SEQ ID NO: 165488 - DNA, 20 bp, Artificial Sequence
  Synthetic oligonucleotide; AGG chr2 60515236 60515255 60515252 +
ttttcactttctccccaggg

SEQ ID NO: 165489 - DNA, 20 bp, Artificial Sequence
  Synthetic oligonucleotide; AAG chr2 60515239 60515258 60515255 +
tcactttctccccagggagg

SEQ ID NO: 165490 - DNA, 20 bp, Artificial Sequence
  Synthetic oligonucleotide; AGG chr2 60515240 60515259 60515256 +
cactttctccccagggagga

SEQ ID NO: 165491 - DNA, 20 bp, Artificial Sequence
  Synthetic oligonucleotide; GGG chr2 60515241 60515260 60515257 +
actttctccccagggaggaa

SEQ ID NO: 165492 - DNA, 20 bp, Artificial Sequence
  Synthetic oligonucleotide; GGG chr2 60515242 60515261 60515258 +
ctttctccccagggaggaag

SEQ ID NO: 165493 - DNA, 20 bp, Artificial Sequence
  Synthetic oligonucleotide; GGG chr2 60515243 60515262 60515259 +
tttctccccagggaggaagg

SEQ ID NO: 165494 - DNA, 20 bp, Artificial Sequence
  Synthetic oligonucleotide; CAG chr2 60515259 60515278 60515275 +
aagggggaaataaacttgcc

SEQ ID NO: 165495 - DNA, 20 bp, Artificial Sequence
  Synthetic oligonucleotide; TGG chr2 60515276 60515295 60515292 +
gcccagcctcacaccttccc

SEQ ID NO: 165496 - DNA, 20 bp, Artificial Sequence
  Synthetic oligonucleotide; CAG chr2 60515280 60515299 60515296 +
agcctcacaccttccctgga

SEQ ID NO: 165497 - DNA, 20 bp, Artificial Sequence
  Synthetic oligonucleotide; AGG chr2 60515281 60515300 60515297 +
gcctcacaccttccctggac

SEQ ID NO: 165498 - DNA, 20 bp, Artificial Sequence
  Synthetic oligonucleotide; GGG chr2 60515282 60515301 60515298 +
cctcacaccttccctggaca

SEQ ID NO: 165499 - DNA, 20 bp, Artificial Sequence
  Synthetic oligonucleotide; GAG chr2 60515284 60515303 60515300 +
tcacaccttccctggacagg

SEQ ID NO: 165500 - DNA, 20 bp, Artificial Sequence
  Synthetic oligonucleotide; TGG chr2 60515288 60515307 60515304 +
accttccctggacagggagc

SEQ ID NO: 165501 - DNA, 20 bp, Artificial Sequence
  Synthetic oligonucleotide; GGG chr2 60515289 60515308 60515305 +
ccttccctggacagggagct

SEQ ID NO: 165502 - DNA, 20 bp, Artificial Sequence
  Synthetic oligonucleotide; GGG chr2 60515290 60515309 60515306 +
cttccctggacagggagctg

SEQ ID NO: 165503 - DNA, 20 bp, Artificial Sequence
  Synthetic oligonucleotide; AAG chr2 60515302 60515321 60515318 +
gggagctggggatccattca

SEQ ID NO: 165504 - DNA, 20 bp, Artificial Sequence
  Synthetic oligonucleotide; CGG chr2 60515307 60515326 60515323 +
ctggggatccattcaaagcc

SEQ ID NO: 165505 - DNA, 20 bp, Artificial Sequence
  Synthetic oligonucleotide; AAG chr2 60515327 60515346 60515343 +
cggtctttctctgttcaatc

SEQ ID NO: 165506 - DNA, 20 bp, Artificial Sequence
  Synthetic oligonucleotide; CAG chr2 60515330 60515349 60515346 +
tctttctctgttcaatcaag

SEQ ID NO: 165507 - DNA, 20 bp, Artificial Sequence
  Synthetic oligonucleotide; GAG chr2 60515336 60515355 60515352 +
tctgttcaatcaagcagcgt

SEQ ID NO: 165508 - DNA, 20 bp, Artificial Sequence
  Synthetic oligonucleotide; AAG chr2 60515341 60515360 60515357 +
tcaatcaagcagcgtgagca

SEQ ID NO: 165509 - DNA, 20 bp, Artificial Sequence
  Synthetic oligonucleotide; CAG chr2 60515346 60515365 60515362 +
caagcagcgtgagcaaagta

SEQ ID NO: 165510 - DNA, 20 bp, Artificial Sequence
  Synthetic oligonucleotide; CAG chr2 60515369 60515388 60515385 +
attaaatactacatatgaac

SEQ ID NO: 165511 - DNA, 20 bp, Artificial Sequence
  Synthetic oligonucleotide; TAG chr2 60515380 60515399 60515396 +
catatgaaccagcattatgt

SEQ ID NO: 165512 - DNA, 20 bp, Artificial Sequence
  Synthetic oligonucleotide; AGG chr2 60515381 60515400 60515397 +
atatgaaccagcattatgtt

SEQ ID NO: 165513 - DNA, 20 bp, Artificial Sequence
  Synthetic oligonucleotide; AAG chr2 60515388 60515407 60515404 +
ccagcattatgttaggcacc

SEQ ID NO: 165514 - DNA, 20 bp, Artificial Sequence
  Synthetic oligonucleotide; AAG chr2 60515391 60515410 60515407 +
gcattatgttaggcaccaag

SEQ ID NO: 165515 - DNA, 20 bp, Artificial Sequence
  Synthetic oligonucleotide; AGG chr2 60515392 60515411 60515408 +
cattatgttaggcaccaaga

SEQ ID NO: 165516 - DNA, 20 bp, Artificial Sequence
  Synthetic oligonucleotide; AAG chr2 60515428 60515447 60515444 +
acatgactcctgccctccaa

SEQ ID NO: 165517 - DNA, 20 bp, Artificial Sequence
  Synthetic oligonucleotide; AGG chr2 60515429 60515448 60515445 +
catgactcctgccctccaaa

SEQ ID NO: 165518 - DNA, 20 bp, Artificial Sequence
  Synthetic oligonucleotide; GAG chr2 60515441 60515460 60515457 +
cctccaaaaggttataattt

SEQ ID NO: 165519 - DNA, 20 bp, Artificial Sequence
  Synthetic oligonucleotide; AGG chr2 60515442 60515461 60515458 +
ctccaaaaggttataatttg

SEQ ID NO: 165520 - DNA, 20 bp, Artificial Sequence
  Synthetic oligonucleotide; GAG chr2 60515444 60515463 60515460 +
ccaaaaggttataatttgag

SEQ ID NO: 165521 - DNA, 20 bp, Artificial Sequence
  Synthetic oligonucleotide; AGG chr2 60515445 60515464 60515461 +
caaaaggttataatttgagg

SEQ ID NO: 165522 - DNA, 20 bp, Artificial Sequence
  Synthetic oligonucleotide; GAG chr2 60515447 60515466 60515463 +
aaaggttataatttgaggag

SEQ ID NO: 165523 - DNA, 20 bp, Artificial Sequence
  Synthetic oligonucleotide; GAG chr2 60515463 60515482 60515479 +
ggaggagaaaatacacccac

SEQ ID NO: 165524 - DNA, 20 bp, Artificial Sequence
  Synthetic oligonucleotide; CAG chr2 60515503 60515522 60515519 +
gatccccttttaactaatcc

SEQ ID NO: 165525 - DNA, 20 bp, Artificial Sequence
  Synthetic oligonucleotide; GAG chr2 60515505 60515524 60515521 +
tccccttttaactaatccca

SEQ ID NO: 165526 - DNA, 20 bp, Artificial Sequence
  Synthetic oligonucleotide; AAG chr2 60515522 60515541 60515538 +
ccagagtgacacctcctcca

SEQ ID NO: 165527 - DNA, 20 bp, Artificial Sequence
  Synthetic oligonucleotide; AAG chr2 60515526 60515545 60515542 +
agtgacacctcctccaaaga

SEQ ID NO: 165528 - DNA, 20 bp, Artificial Sequence
  Synthetic oligonucleotide; AAG chr2 60515531 60515550 60515547 +
cacctcctccaaagaaagcc

SEQ ID NO: 165529 - DNA, 20 bp, Artificial Sequence
  Synthetic oligonucleotide; CAG chr2 60515541 60515560 60515557 +
aaagaaagccaagttgctga

SEQ ID NO: 165530 - DNA, 20 bp, Artificial Sequence
  Synthetic oligonucleotide; GAG chr2 60515543 60515562 60515559 +
agaaagccaagttgctgaca

SEQ ID NO: 165531 - DNA, 20 bp, Artificial Sequence
  Synthetic oligonucleotide; CAG chr2 60515547 60515566 60515563 +
agccaagttgctgacagagt

SEQ ID NO: 165532 - DNA, 20 bp, Artificial Sequence
  Synthetic oligonucleotide; AGG chr2 60515548 60515567 60515564 +
gccaagttgctgacagagtc

SEQ ID NO: 165533 - DNA, 20 bp, Artificial Sequence
  Synthetic oligonucleotide; TAG chr2 60515557 60515576 60515573 +
ctgacagagtcaggccttcc

SEQ ID NO: 165534 - DNA, 20 bp, Artificial Sequence
  Synthetic oligonucleotide; TAG chr2 60515565 60515584 60515581 +
gtcaggccttcctagttacc

SEQ ID NO: 165535 - DNA, 20 bp, Artificial Sequence
  Synthetic oligonucleotide; TGG chr2 60515573 60515592 60515589 +
ttcctagttacctagaaaaa

SEQ ID NO: 165536 - DNA, 20 bp, Artificial Sequence
  Synthetic oligonucleotide; TGG chr2 60515578 60515597 60515594 +
agttacctagaaaaatggcc

SEQ ID NO: 165537 - DNA, 20 bp, Artificial Sequence
  Synthetic oligonucleotide; GGG chr2 60515579 60515598 60515595 +
gttacctagaaaaatggcct

SEQ ID NO: 165538 - DNA, 20 bp, Artificial Sequence
  Synthetic oligonucleotide; GGG chr2 60515580 60515599 60515596 +
ttacctagaaaaatggcctg

SEQ ID NO: 165539 - DNA, 20 bp, Artificial Sequence
  Synthetic oligonucleotide; GAG chr2 60515582 60515601 60515598 +
acctagaaaaatggcctggg

SEQ ID NO: 165540 - DNA, 20 bp, Artificial Sequence
  Synthetic oligonucleotide; AGG chr2 60515583 60515602 60515599 +
cctagaaaaatggcctgggg

SEQ ID NO: 165541 - DNA, 20 bp, Artificial Sequence
  Synthetic oligonucleotide; CAG chr2 60515588 60515607 60515604 +
aaaaatggcctggggaggtc

SEQ ID NO: 165542 - DNA, 20 bp, Artificial Sequence
  Synthetic oligonucleotide; TAG chr2 60515596 60515615 60515612 +
cctggggaggtccagcccac

SEQ ID NO: 165543 - DNA, 20 bp, Artificial Sequence
  Synthetic oligonucleotide; AAG chr2 60515599 60515618 60515615 +
ggggaggtccagcccactag

SEQ ID NO: 165544 - DNA, 20 bp, Artificial Sequence
  Synthetic oligonucleotide; AGG chr2 60515600 60515619 60515616 +
gggaggtccagcccactaga

SEQ ID NO: 165545 - DNA, 20 bp, Artificial Sequence
  Synthetic oligonucleotide; GAG chr2 60515602 60515621 60515618 +
gaggtccagcccactagaag

SEQ ID NO: 165546 - DNA, 20 bp, Artificial Sequence
  Synthetic oligonucleotide; CAG chr2 60515608 60515627 60515624 +
cagcccactagaaggagata

SEQ ID NO: 165547 - DNA, 20 bp, Artificial Sequence
  Synthetic oligonucleotide; AAG chr2 60515615 60515634 60515631 +
ctagaaggagatacagaaac

SEQ ID NO: 165548 - DNA, 20 bp, Artificial Sequence
  Synthetic oligonucleotide; TGG chr2 60515635 60515654 60515651 +
aagccctccataaatatctg

SEQ ID NO: 165549 - DNA, 20 bp, Artificial Sequence
  Synthetic oligonucleotide; GGG chr2 60515636 60515655 60515652 +
agccctccataaatatctgt

SEQ ID NO: 165550 - DNA, 20 bp, Artificial Sequence
  Synthetic oligonucleotide; CAG chr2 60515642 60515661 60515658 +
ccataaatatctgtgggacc

SEQ ID NO: 165551 - DNA, 20 bp, Artificial Sequence
  Synthetic oligonucleotide; CAG chr2 60515661 60515680 60515677 +
ccagctacctctctgaaaca

SEQ ID NO: 165552 - DNA, 20 bp, Artificial Sequence
  Synthetic oligonucleotide; CAG chr2 60515666 60515685 60515682 +
tacctctctgaaacacagcc

SEQ ID NO: 165553 - DNA, 20 bp, Artificial Sequence
  Synthetic oligonucleotide; CAG chr2 60515675 60515694 60515691 +
gaaacacagcccagtgcttt

SEQ ID NO: 165554 - DNA, 20 bp, Artificial Sequence
  Synthetic oligonucleotide; AGG chr2 60515676 60515695 60515692 +
aaacacagcccagtgctttc

SEQ ID NO: 165555 - DNA, 20 bp, Artificial Sequence
  Synthetic oligonucleotide; CAG chr2 60515679 60515698 60515695 +
cacagcccagtgctttcagg

SEQ ID NO: 165556 - DNA, 20 bp, Artificial Sequence
  Synthetic oligonucleotide; AGG chr2 60515680 60515699 60515696 +
acagcccagtgctttcaggc

SEQ ID NO: 165557 - DNA, 20 bp, Artificial Sequence
  Synthetic oligonucleotide; GGG chr2 60515681 60515700 60515697 +
cagcccagtgctttcaggca

SEQ ID NO: 165558 - DNA, 20 bp, Artificial Sequence
  Synthetic oligonucleotide; GAG chr2 60515683 60515702 60515699 +
gcccagtgctttcaggcagg

SEQ ID NO: 165559 - DNA, 20 bp, Artificial Sequence
  Synthetic oligonucleotide; AAG chr2 60515687 60515706 60515703 +
agtgctttcaggcagggaga

SEQ ID NO: 165560 - DNA, 20 bp, Artificial Sequence
  Synthetic oligonucleotide; TGG chr2 60515690 60515709 60515706 +
gctttcaggcagggagaaag

SEQ ID NO: 165561 - DNA, 20 bp, Artificial Sequence
  Synthetic oligonucleotide; TGG chr2 60515693 60515712 60515709 +
ttcaggcagggagaaagtgg

SEQ ID NO: 165562 - DNA, 20 bp, Artificial Sequence
  Synthetic oligonucleotide; TGG chr2 60515696 60515715 60515712 +
aggcagggagaaagtggtgg

SEQ ID NO: 165563 - DNA, 20 bp, Artificial Sequence
  Synthetic oligonucleotide; GGG chr2 60515697 60515716 60515713 +
ggcagggagaaagtggtggt

SEQ ID NO: 165564 - DNA, 20 bp, Artificial Sequence
  Synthetic oligonucleotide; TGG chr2 60515700 60515719 60515716 +
agggagaaagtggtggtggg

SEQ ID NO: 165565 - DNA, 20 bp, Artificial Sequence
  Synthetic oligonucleotide; CGG chr2 60515703 60515722 60515719 +
gagaaagtggtggtgggtgg

SEQ ID NO: 165566 - DNA, 20 bp, Artificial Sequence
  Synthetic oligonucleotide; CAG chr2 60515707 60515726 60515723 +
aagtggtggtgggtggcgga

SEQ ID NO: 165567 - DNA, 20 bp, Artificial Sequence
  Synthetic oligonucleotide; GAG chr2 60515709 60515728 60515725 +
gtggtggtgggtggcggaca

SEQ ID NO: 165568 - DNA, 20 bp, Artificial Sequence
  Synthetic oligonucleotide; GAG chr2 60515716 60515735 60515732 +
tgggtggcggacagagatgt

SEQ ID NO: 165569 - DNA, 20 bp, Artificial Sequence
  Synthetic oligonucleotide; TGG chr2 60515719 60515738 60515735 +
gtggcggacagagatgtgag

SEQ ID NO: 165570 - DNA, 20 bp, Artificial Sequence
  Synthetic oligonucleotide; CAG chr2 60515729 60515748 60515745 +
gagatgtgagtggactgaca

SEQ ID NO: 165571 - DNA, 20 bp, Artificial Sequence
  Synthetic oligonucleotide; TGG chr2 60515735 60515754 60515751 +
tgagtggactgacacagaca

SEQ ID NO: 165572 - DNA, 20 bp, Artificial Sequence
  Synthetic oligonucleotide; GGG chr2 60515736 60515755 60515752 +
gagtggactgacacagacat

SEQ ID NO: 165573 - DNA, 20 bp, Artificial Sequence
  Synthetic oligonucleotide; GGG chr2 60515737 60515756 60515753 +
agtggactgacacagacatg

SEQ ID NO: 165574 - DNA, 20 bp, Artificial Sequence
  Synthetic oligonucleotide; GGG chr2 60515738 60515757 60515754 +
gtggactgacacagacatgg

SEQ ID NO: 165575 - DNA, 20 bp, Artificial Sequence
  Synthetic oligonucleotide; CAG chr2 60515772 60515791 60515788 +
ctcttgatcacccaactttc

SEQ ID NO: 165576 - DNA, 20 bp, Artificial Sequence
  Synthetic oligonucleotide; GAG chr2 60515799 60515818 60515815 +
cccatttctgcccctgactt

SEQ ID NO: 165577 - DNA, 20 bp, Artificial Sequence
  Synthetic oligonucleotide; CAG chr2 60515806 60515825 60515822 +
ctgcccctgacttgagctcc

SEQ ID NO: 165578 - DNA, 20 bp, Artificial Sequence
  Synthetic oligonucleotide; AGG chr2 60515807 60515826 60515823 +
tgcccctgacttgagctccc

SEQ ID NO: 165579 - DNA, 20 bp, Artificial Sequence
  Synthetic oligonucleotide; GAG chr2 60515826 60515845 60515842 +
caggccactcaacccactgt

SEQ ID NO: 165580 - DNA, 20 bp, Artificial Sequence
  Synthetic oligonucleotide; AGG chr2 60515827 60515846 60515843 +
aggccactcaacccactgtg

SEQ ID NO: 165581 - DNA, 20 bp, Artificial Sequence
  Synthetic oligonucleotide; TGG chr2 60515838 60515857 60515854 +
cccactgtgaggtcttactg

SEQ ID NO: 165582 - DNA, 20 bp, Artificial Sequence
  Synthetic oligonucleotide; GGG chr2 60515839 60515858 60515855 +
ccactgtgaggtcttactgt

SEQ ID NO: 165583 - DNA, 20 bp, Artificial Sequence
  Synthetic oligonucleotide; GGG chr2 60515840 60515859 60515856 +
cactgtgaggtcttactgtg

SEQ ID NO: 165584 - DNA, 20 bp, Artificial Sequence
  Synthetic oligonucleotide; GAG chr2 60515849 60515868 60515865 +
gtcttactgtggggattacc

SEQ ID NO: 165585 - DNA, 20 bp, Artificial Sequence
  Synthetic oligonucleotide; CAG chr2 60515859 60515878 60515875 +
ggggattaccgagtcaccac

SEQ ID NO: 165586 - DNA, 20 bp, Artificial Sequence
  Synthetic oligonucleotide; AGG chr2 60515860 60515879 60515876 +
gggattaccgagtcaccacc

SEQ ID NO: 165587 - DNA, 20 bp, Artificial Sequence
  Synthetic oligonucleotide; CAG chr2 60515873 60515892 60515889 +
caccaccaggctgcgctgaa

SEQ ID NO: 165588 - DNA, 20 bp, Artificial Sequence
  Synthetic oligonucleotide; AGG chr2 60515874 60515893 60515890 +
accaccaggctgcgctgaac

SEQ ID NO: 165589 - DNA, 20 bp, Artificial Sequence
  Synthetic oligonucleotide; AAG chr2 60515877 60515896 60515893 +
accaggctgcgctgaacagg

SEQ ID NO: 165590 - DNA, 20 bp, Artificial Sequence
  Synthetic oligonucleotide; AAG chr2 60515885 60515904 60515901 +
gcgctgaacaggaagtgaac

SEQ ID NO: 165591 - DNA, 20 bp, Artificial Sequence
  Synthetic oligonucleotide; GAG chr2 60515895 60515914 60515911 +
ggaagtgaacaagtcaattc

SEQ ID NO: 165592 - DNA, 20 bp, Artificial Sequence
  Synthetic oligonucleotide; AAG chr2 60515899 60515918 60515915 +
gtgaacaagtcaattcgaga

SEQ ID NO: 165593 - DNA, 20 bp, Artificial Sequence
  Synthetic oligonucleotide; AAG chr2 60515909 60515928 60515925 +
caattcgagaaagatccaat

SEQ ID NO: 165594 - DNA, 20 bp, Artificial Sequence
  Synthetic oligonucleotide; AGG chr2 60515910 60515929 60515926 +
aattcgagaaagatccaata

SEQ ID NO: 165595 - DNA, 20 bp, Artificial Sequence
  Synthetic oligonucleotide; GGG chr2 60515911 60515930 60515927 +
attcgagaaagatccaataa

SEQ ID NO: 165596 - DNA, 20 bp, Artificial Sequence
  Synthetic oligonucleotide; TGG chr2 60515923 60515942 60515939 +
tccaataagggaatattctc

SEQ ID NO: 165597 - DNA, 20 bp, Artificial Sequence
  Synthetic oligonucleotide; GGG chr2 60515924 60515943 60515940 +
ccaataagggaatattctct

SEQ ID NO: 165598 - DNA, 20 bp, Artificial Sequence
  Synthetic oligonucleotide; TGG chr2 60515933 60515952 60515949 +
gaatattctctgggcaccgc

SEQ ID NO: 165599 - DNA, 20 bp, Artificial Sequence
  Synthetic oligonucleotide; GGG chr2 60515934 60515953 60515950 +
aatattctctgggcaccgct

SEQ ID NO: 165600 - DNA, 20 bp, Artificial Sequence
  Synthetic oligonucleotide; CGG chr2 60515947 60515966 60515963 +
caccgctgggccaacaccca

SEQ ID NO: 165601 - DNA, 20 bp, Artificial Sequence
  Synthetic oligonucleotide; GAG chr2 60515949 60515968 60515965 +
ccgctgggccaacacccacg

SEQ ID NO: 165602 - DNA, 20 bp, Artificial Sequence
  Synthetic oligonucleotide; AGG chr2 60515950 60515969 60515966 +
cgctgggccaacacccacgg

SEQ ID NO: 165603 - DNA, 20 bp, Artificial Sequence
  Synthetic oligonucleotide; GGG chr2 60515951 60515970 60515967 +
gctgggccaacacccacgga

SEQ ID NO: 165604 - DNA, 20 bp, Artificial Sequence
  Synthetic oligonucleotide; GGG chr2 60515952 60515971 60515968 +
ctgggccaacacccacggag

SEQ ID NO: 165605 - DNA, 20 bp, Artificial Sequence
  Synthetic oligonucleotide; TGG chr2 60515958 60515977 60515974 +
caacacccacggaggggtcc

SEQ ID NO: 165606 - DNA, 20 bp, Artificial Sequence
  Synthetic oligonucleotide; TGG chr2 60515974 60515993 60515990 +
gtcctggaatacaaataccc

SEQ ID NO: 165607 - DNA, 20 bp, Artificial Sequence
  Synthetic oligonucleotide; GAG chr2 60515976 60515995 60515992 +
cctggaatacaaataccctg

SEQ ID NO: 165608 - DNA, 20 bp, Artificial Sequence
  Synthetic oligonucleotide; AAG chr2 60515983 60516002 60515999 +
tacaaataccctggagtctg

SEQ ID NO: 165609 - DNA, 20 bp, Artificial Sequence
  Synthetic oligonucleotide; AGG chr2 60515984 60516003 60516000 +
acaaataccctggagtctga

SEQ ID NO: 165610 - DNA, 20 bp, Artificial Sequence
  Synthetic oligonucleotide; GGG chr2 60515985 60516004 60516001 +
caaataccctggagtctgaa

SEQ ID NO: 165611 - DNA, 20 bp, Artificial Sequence
  Synthetic oligonucleotide; CGG chr2 60515988 60516007 60516004 +
ataccctggagtctgaaggg

SEQ ID NO: 165612 - DNA, 20 bp, Artificial Sequence
  Synthetic oligonucleotide; TGG chr2 60515991 60516010 60516007 +
ccctggagtctgaagggcgg

SEQ ID NO: 165613 - DNA, 20 bp, Artificial Sequence
  Synthetic oligonucleotide; TGG chr2 60516032 60516051 60516048 +
caattatgtcttcattgaac

SEQ ID NO: 165614 - DNA, 20 bp, Artificial Sequence
  Synthetic oligonucleotide; GGG chr2 60516033 60516052 60516049 +
aattatgtcttcattgaact

SEQ ID NO: 165615 - DNA, 20 bp, Artificial Sequence
  Synthetic oligonucleotide; AAG chr2 60516044 60516063 60516060 +
cattgaactgggttatgaaa

SEQ ID NO: 165616 - DNA, 20 bp, Artificial Sequence
  Synthetic oligonucleotide; AGG chr2 60516045 60516064 60516061 +
attgaactgggttatgaaaa

SEQ ID NO: 165617 - DNA, 20 bp, Artificial Sequence
  Synthetic oligonucleotide; GGG chr2 60516046 60516065 60516062 +
ttgaactgggttatgaaaaa

SEQ ID NO: 165618 - DNA, 20 bp, Artificial Sequence
  Synthetic oligonucleotide; AAG chr2 60516049 60516068 60516065 +
aactgggttatgaaaaaggg

SEQ ID NO: 165619 - DNA, 20 bp, Artificial Sequence
  Synthetic oligonucleotide; CAG chr2 60516052 60516071 60516068 +
tgggttatgaaaaagggaag

SEQ ID NO: 165620 - DNA, 20 bp, Artificial Sequence
  Synthetic oligonucleotide; AGG chr2 60516053 60516072 60516069 +
gggttatgaaaaagggaagc

SEQ ID NO: 165621 - DNA, 20 bp, Artificial Sequence
  Synthetic oligonucleotide; GGG chr2 60516054 60516073 60516070 +
ggttatgaaaaagggaagca

SEQ ID NO: 165622 - DNA, 20 bp, Artificial Sequence
  Synthetic oligonucleotide; TAG chr2 60516067 60516086 60516083 +
ggaagcagggattgaaaatc

SEQ ID NO: 165623 - DNA, 20 bp, Artificial Sequence
  Synthetic oligonucleotide; TGG chr2 60516075 60516094 60516091 +
ggattgaaaatctagccttg

SEQ ID NO: 165624 - DNA, 20 bp, Artificial Sequence
  Synthetic oligonucleotide; AAG chr2 60516082 60516101 60516098 +
aaatctagccttgtggccat

SEQ ID NO: 165625 - DNA, 20 bp, Artificial Sequence
  Synthetic oligonucleotide; CAG chr2 60516102 60516121 60516118 +
aagcctgtgatgactcatgc

SEQ ID NO: 165626 - DNA, 20 bp, Artificial Sequence
  Synthetic oligonucleotide; TGG chr2 60516108 60516127 60516124 +
gtgatgactcatgccagctt

SEQ ID NO: 165627 - DNA, 20 bp, Artificial Sequence
  Synthetic oligonucleotide; GGG chr2 60516109 60516128 60516125 +
tgatgactcatgccagcttt

SEQ ID NO: 165628 - DNA, 20 bp, Artificial Sequence
  Synthetic oligonucleotide; AAG chr2 60516118 60516137 60516134 +
atgccagctttgggtgctct

SEQ ID NO: 165629 - DNA, 20 bp, Artificial Sequence
  Synthetic oligonucleotide; CAG chr2 60516187 60516206 60516203 +
actgtcacctctcctcaccc

SEQ ID NO: 165630 - DNA, 20 bp, Artificial Sequence
  Synthetic oligonucleotide; CAG chr2 60516194 60516213 60516210 +
cctctcctcaccccagcaca

SEQ ID NO: 165631 - DNA, 20 bp, Artificial Sequence
  Synthetic oligonucleotide; AAG chr2 60516199 60516218 60516215 +
cctcaccccagcacacagaa

SEQ ID NO: 165632 - DNA, 20 bp, Artificial Sequence
  Synthetic oligonucleotide; TAG chr2 60516222 60516241 60516238 +
atgtgcttattatgtgcact

SEQ ID NO: 165633 - DNA, 20 bp, Artificial Sequence
  Synthetic oligonucleotide; AGG chr2 60516223 60516242 60516239 +
tgtgcttattatgtgcactt

SEQ ID NO: 165634 - DNA, 20 bp, Artificial Sequence
  Synthetic oligonucleotide; CAG chr2 60516273 60516292 60516289 +
ccactcctattattaaaaca

SEQ ID NO: 165635 - DNA, 20 bp, Artificial Sequence
  Synthetic oligonucleotide; AGG chr2 60516274 60516293 60516290 +
cactcctattattaaaacac

SEQ ID NO: 165636 - DNA, 20 bp, Artificial Sequence
  Synthetic oligonucleotide; TGG chr2 60516283 60516302 60516299 +
tattaaaacacaggttttgc

SEQ ID NO: 165637 - DNA, 20 bp, Artificial Sequence
  Synthetic oligonucleotide; AAG chr2 60516296 60516315 60516312 +
gttttgctggaaactcaaaa

SEQ ID NO: 165638 - DNA, 20 bp, Artificial Sequence
  Synthetic oligonucleotide; TGG chr2 60516302 60516321 60516318 +
ctggaaactcaaaaaagact

SEQ ID NO: 165639 - DNA, 20 bp, Artificial Sequence
  Synthetic oligonucleotide; TGG chr2 60516311 60516330 60516327 +
caaaaaagacttggctctgc

SEQ ID NO: 165640 - DNA, 20 bp, Artificial Sequence
  Synthetic oligonucleotide; CAG chr2 60516318 60516337 60516334 +
gacttggctctgctggctca

SEQ ID NO: 165641 - DNA, 20 bp, Artificial Sequence
  Synthetic oligonucleotide; AGG chr2 60516319 60516338 60516335 +
acttggctctgctggctcac

SEQ ID NO: 165642 - DNA, 20 bp, Artificial Sequence
  Synthetic oligonucleotide; GGG chr2 60516320 60516339 60516336 +
cttggctctgctggctcaca

SEQ ID NO: 165643 - DNA, 20 bp, Artificial Sequence
  Synthetic oligonucleotide; TGG chr2 60516327 60516346 60516343 +
ctgctggctcacagggaatc

SEQ ID NO: 165644 - DNA, 20 bp, Artificial Sequence
  Synthetic oligonucleotide; GGG chr2 60516328 60516347 60516344 +
tgctggctcacagggaatct

SEQ ID NO: 165645 - DNA, 20 bp, Artificial Sequence
  Synthetic oligonucleotide; CAG chr2 60516358 60516377 60516374 +
cttccaaaacctttgttctc

SEQ ID NO: 165646 - DNA, 20 bp, Artificial Sequence
  Synthetic oligonucleotide; CAG chr2 60516365 60516384 60516381 +
aacctttgttctccagatgt

SEQ ID NO: 165647 - DNA, 20 bp, Artificial Sequence
  Synthetic oligonucleotide; AAG chr2 60516372 60516391 60516388 +
gttctccagatgtcagtgca

SEQ ID NO: 165648 - DNA, 20 bp, Artificial Sequence
  Synthetic oligonucleotide; CAG chr2 60516382 60516401 60516398 +
tgtcagtgcaaagttatgaa

SEQ ID NO: 165649 - DNA, 20 bp, Artificial Sequence
  Synthetic oligonucleotide; GAG chr2 60516395 60516414 60516411 +
ttatgaacagctctccccct

SEQ ID NO: 165650 - DNA, 20 bp, Artificial Sequence
  Synthetic oligonucleotide; GAG chr2 60516408 60516427 60516424 +
tccccctgagctaacttacc

SEQ ID NO: 165651 - DNA, 20 bp, Artificial Sequence
  Synthetic oligonucleotide; CAG chr2 60516411 60516430 60516427 +
ccctgagctaacttaccgag

SEQ ID NO: 165652 - DNA, 20 bp, Artificial Sequence
  Synthetic oligonucleotide; AAG chr2 60516415 60516434 60516431 +
gagctaacttaccgagcagt

SEQ ID NO: 165653 - DNA, 20 bp, Artificial Sequence
  Synthetic oligonucleotide; GAG chr2 60516419 60516438 60516435 +
taacttaccgagcagtaagt

SEQ ID NO: 165654 - DNA, 20 bp, Artificial Sequence
  Synthetic oligonucleotide; AGG chr2 60516420 60516439 60516436 +
aacttaccgagcagtaagtg

SEQ ID NO: 165655 - DNA, 20 bp, Artificial Sequence
  Synthetic oligonucleotide; AAG chr2 60516424 60516443 60516440 +
taccgagcagtaagtgaggc

SEQ ID NO: 165656 - DNA, 20 bp, Artificial Sequence
  Synthetic oligonucleotide; AAG chr2 60516428 60516447 60516444 +
gagcagtaagtgaggcaaga

SEQ ID NO: 165657 - DNA, 20 bp, Artificial Sequence
  Synthetic oligonucleotide; AGG chr2 60516429 60516448 60516445 +
agcagtaagtgaggcaagaa

SEQ ID NO: 165658 - DNA, 20 bp, Artificial Sequence
  Synthetic oligonucleotide; CAG chr2 60516449 60516468 60516465 +
aggccactcactatatttct

SEQ ID NO: 165659 - DNA, 20 bp, Artificial Sequence
  Synthetic oligonucleotide; AAG chr2 60516460 60516479 60516476 +
tatatttctcagcctccatg

SEQ ID NO: 165660 - DNA, 20 bp, Artificial Sequence
  Synthetic oligonucleotide; TGG chr2 60516470 60516489 60516486 +
agcctccatgaagtcgtcac

SEQ ID NO: 165661 - DNA, 20 bp, Artificial Sequence
  Synthetic oligonucleotide; GGG chr2 60516471 60516490 60516487 +
gcctccatgaagtcgtcact

SEQ ID NO: 165662 - DNA, 20 bp, Artificial Sequence
  Synthetic oligonucleotide; GAG chr2 60516473 60516492 60516489 +
ctccatgaagtcgtcactgg

SEQ ID NO: 165663 - DNA, 20 bp, Artificial Sequence
  Synthetic oligonucleotide; GAG chr2 60516475 60516494 60516491 +
ccatgaagtcgtcactggga

SEQ ID NO: 165664 - DNA, 20 bp, Artificial Sequence
  Synthetic oligonucleotide; AGG chr2 60516476 60516495 60516492 +
catgaagtcgtcactgggag

SEQ ID NO: 165665 - DNA, 20 bp, Artificial Sequence
  Synthetic oligonucleotide; GAG chr2 60516478 60516497 60516494 +
tgaagtcgtcactgggagag

SEQ ID NO: 165666 - DNA, 20 bp, Artificial Sequence
  Synthetic oligonucleotide; AAG chr2 60516483 60516502 60516499 +
tcgtcactgggagaggagcc

SEQ ID NO: 165667 - DNA, 20 bp, Artificial Sequence
  Synthetic oligonucleotide; GAG chr2 60516485 60516504 60516501 +
gtcactgggagaggagccaa

SEQ ID NO: 165668 - DNA, 20 bp, Artificial Sequence
  Synthetic oligonucleotide; AGG chr2 60516486 60516505 60516502 +
tcactgggagaggagccaag

SEQ ID NO: 165669 - DNA, 20 bp, Artificial Sequence
  Synthetic oligonucleotide; GGG chr2 60516487 60516506 60516503 +
cactgggagaggagccaaga

SEQ ID NO: 165670 - DNA, 20 bp, Artificial Sequence
  Synthetic oligonucleotide; GAG chr2 60516489 60516508 60516505 +
ctgggagaggagccaagagg

SEQ ID NO: 165671 - DNA, 20 bp, Artificial Sequence
  Synthetic oligonucleotide; AGG chr2 60516490 60516509 60516506 +
tgggagaggagccaagaggg

SEQ ID NO: 165672 - DNA, 20 bp, Artificial Sequence
  Synthetic oligonucleotide; GGG chr2 60516491 60516510 60516507 +
gggagaggagccaagaggga

SEQ ID NO: 165673 - DNA, 20 bp, Artificial Sequence
  Synthetic oligonucleotide; GGG chr2 60516492 60516511 60516508 +
ggagaggagccaagagggag

SEQ ID NO: 165674 - DNA, 20 bp, Artificial Sequence
  Synthetic oligonucleotide; GGG chr2 60516493 60516512 60516509 +
gagaggagccaagagggagg

SEQ ID NO: 165675 - DNA, 20 bp, Artificial Sequence
  Synthetic oligonucleotide; TAG chr2 60516501 60516520 60516517 +
ccaagagggagggggcacct

SEQ ID NO: 165676 - DNA, 20 bp, Artificial Sequence
  Synthetic oligonucleotide; AGG chr2 60516502 60516521 60516518 +
caagagggagggggcacctt

SEQ ID NO: 165677 - DNA, 20 bp, Artificial Sequence
  Synthetic oligonucleotide; GAG chr2 60516504 60516523 60516520 +
agagggagggggcaccttag

SEQ ID NO: 165678 - DNA, 20 bp, Artificial Sequence
  Synthetic oligonucleotide; AAG chr2 60516509 60516528 60516525 +
gagggggcaccttaggagac

SEQ ID NO: 165679 - DNA, 20 bp, Artificial Sequence
  Synthetic oligonucleotide; CGG chr2 60516531 60516550 60516547 +
gatcgtaactcaccgtcatc

SEQ ID NO: 165680 - DNA, 20 bp, Artificial Sequence
  Synthetic oligonucleotide; GGG chr2 60516532 60516551 60516548 +
atcgtaactcaccgtcatcc

SEQ ID NO: 165681 - DNA, 20 bp, Artificial Sequence
  Synthetic oligonucleotide; GGG chr2 60516533 60516552 60516549 +
tcgtaactcaccgtcatccg

SEQ ID NO: 165682 - DNA, 20 bp, Artificial Sequence
  Synthetic oligonucleotide; AAG chr2 60516536 60516555 60516552 +
taactcaccgtcatccgggg

SEQ ID NO: 165683 - DNA, 20 bp, Artificial Sequence
  Synthetic oligonucleotide; TGG chr2 60516539 60516558 60516555 +
ctcaccgtcatccggggaag

SEQ ID NO: 165684 - DNA, 20 bp, Artificial Sequence
  Synthetic oligonucleotide; GAG chr2 60516541 60516560 60516557 +
caccgtcatccggggaagtg

SEQ ID NO: 165685 - DNA, 20 bp, Artificial Sequence
  Synthetic oligonucleotide; GAG chr2 60516543 60516562 60516559 +
ccgtcatccggggaagtgga

SEQ ID NO: 165686 - DNA, 20 bp, Artificial Sequence
  Synthetic oligonucleotide; AGG chr2 60516544 60516563 60516560 +
cgtcatccggggaagtggag

SEQ ID NO: 165687 - DNA, 20 bp, Artificial Sequence
  Synthetic oligonucleotide; AAG chr2 60516547 60516566 60516563 +
catccggggaagtggagagg

SEQ ID NO: 165688 - DNA, 20 bp, Artificial Sequence
  Synthetic oligonucleotide; CAG chr2 60516551 60516570 60516567 +
cggggaagtggagaggaagt

SEQ ID NO: 165689 - DNA, 20 bp, Artificial Sequence
  Synthetic oligonucleotide; AGG chr2 60516552 60516571 60516568 +
ggggaagtggagaggaagtc

SEQ ID NO: 165690 - DNA, 20 bp, Artificial Sequence
  Synthetic oligonucleotide; GGG chr2 60516553 60516572 60516569 +
gggaagtggagaggaagtca

SEQ ID NO: 165691 - DNA, 20 bp, Artificial Sequence
  Synthetic oligonucleotide; CAG chr2 60516565 60516584 60516581 +
ggaagtcagggaactcgtgt

SEQ ID NO: 165692 - DNA, 20 bp, Artificial Sequence
  Synthetic oligonucleotide; AGG chr2 60516566 60516585 60516582 +
gaagtcagggaactcgtgtc

SEQ ID NO: 165693 - DNA, 20 bp, Artificial Sequence
  Synthetic oligonucleotide; GAG chr2 60516568 60516587 60516584 +
agtcagggaactcgtgtcag

SEQ ID NO: 165694 - DNA, 20 bp, Artificial Sequence
  Synthetic oligonucleotide; TGG chr2 60516571 60516590 60516587 +
cagggaactcgtgtcaggag

SEQ ID NO: 165695 - DNA, 20 bp, Artificial Sequence
  Synthetic oligonucleotide; GAG chr2 60516573 60516592 60516589 +
gggaactcgtgtcaggagtg

SEQ ID NO: 165696 - DNA, 20 bp, Artificial Sequence
  Synthetic oligonucleotide; GAG chr2 60516575 60516594 60516591 +
gaactcgtgtcaggagtgga

SEQ ID NO: 165697 - DNA, 20 bp, Artificial Sequence
  Synthetic oligonucleotide; AAG chr2 60516580 60516599 60516596 +
cgtgtcaggagtggagagct

SEQ ID NO: 165698 - DNA, 20 bp, Artificial Sequence
  Synthetic oligonucleotide; TGG chr2 60516590 60516609 60516606 +
gtggagagctaagctcaata

SEQ ID NO: 165699 - DNA, 20 bp, Artificial Sequence
  Synthetic oligonucleotide; AAG chr2 60516595 60516614 60516611 +
gagctaagctcaatatggac

SEQ ID NO: 165700 - DNA, 20 bp, Artificial Sequence
  Synthetic oligonucleotide; AGG chr2 60516596 60516615 60516612 +
agctaagctcaatatggaca

SEQ ID NO: 165701 - DNA, 20 bp, Artificial Sequence
  Synthetic oligonucleotide; CAG chr2 60516600 60516619 60516616 +
aagctcaatatggacaagga

SEQ ID NO: 165702 - DNA, 20 bp, Artificial Sequence
  Synthetic oligonucleotide; GAG chr2 60516602 60516621 60516618 +
gctcaatatggacaaggaca

SEQ ID NO: 165703 - DNA, 20 bp, Artificial Sequence
  Synthetic oligonucleotide; GAG chr2 60516604 60516623 60516620 +
tcaatatggacaaggacaga

SEQ ID NO: 165704 - DNA, 20 bp, Artificial Sequence
  Synthetic oligonucleotide; AGG chr2 60516605 60516624 60516621 +
caatatggacaaggacagag

SEQ ID NO: 165705 - DNA, 20 bp, Artificial Sequence
  Synthetic oligonucleotide; GGG chr2 60516606 60516625 60516622 +
aatatggacaaggacagaga

SEQ ID NO: 165706 - DNA, 20 bp, Artificial Sequence
  Synthetic oligonucleotide; GGG chr2 60516607 60516626 60516623 +
atatggacaaggacagagag

SEQ ID NO: 165707 - DNA, 20 bp, Artificial Sequence
  Synthetic oligonucleotide; TGG chr2 60516614 60516633 60516630 +
caaggacagagaggggcacc

SEQ ID NO: 165708 - DNA, 20 bp, Artificial Sequence
  Synthetic oligonucleotide; GGG chr2 60516615 60516634 60516631 +
aaggacagagaggggcacct

SEQ ID NO: 165709 - DNA, 20 bp, Artificial Sequence
  Synthetic oligonucleotide; TGG chr2 60516619 60516638 60516635 +
acagagaggggcacctggga

SEQ ID NO: 165710 - DNA, 20 bp, Artificial Sequence
  Synthetic oligonucleotide; GGG chr2 60516620 60516639 60516636 +
cagagaggggcacctgggat

SEQ ID NO: 165711 - DNA, 20 bp, Artificial Sequence
  Synthetic oligonucleotide; GAG chr2 60516622 60516641 60516638 +
gagaggggcacctgggatgg

SEQ ID NO: 165712 - DNA, 20 bp, Artificial Sequence
  Synthetic oligonucleotide; TGG chr2 60516630 60516649 60516646 +
cacctgggatgggagaaatg

SEQ ID NO: 165713 - DNA, 20 bp, Artificial Sequence
  Synthetic oligonucleotide; CAG chr2 60516636 60516655 60516652 +
ggatgggagaaatgtggcat

SEQ ID NO: 165714 - DNA, 20 bp, Artificial Sequence
  Synthetic oligonucleotide; AGG chr2 60516637 60516656 60516653 +
gatgggagaaatgtggcatc

SEQ ID NO: 165715 - DNA, 20 bp, Artificial Sequence
  Synthetic oligonucleotide; TGG chr2 60516645 60516664 60516661 +
aaatgtggcatcaggacaac

SEQ ID NO: 165716 - DNA, 20 bp, Artificial Sequence
  Synthetic oligonucleotide; GGG chr2 60516646 60516665 60516662 +
aatgtggcatcaggacaact

SEQ ID NO: 165717 - DNA, 20 bp, Artificial Sequence
  Synthetic oligonucleotide; GAG chr2 60516648 60516667 60516664 +
tgtggcatcaggacaactgg

SEQ ID NO: 165718 - DNA, 20 bp, Artificial Sequence
  Synthetic oligonucleotide; AAG chr2 60516654 60516673 60516670 +
atcaggacaactgggagtga

SEQ ID NO: 165719 - DNA, 20 bp, Artificial Sequence
  Synthetic oligonucleotide; AAG chr2 60516671 60516690 60516687 +
tgaaagtttaactgccctca

SEQ ID NO: 165720 - DNA, 20 bp, Artificial Sequence
  Synthetic oligonucleotide; TGG chr2 60516675 60516694 60516691 +
agtttaactgccctcaaaga

SEQ ID NO: 165721 - DNA, 20 bp, Artificial Sequence
  Synthetic oligonucleotide; AAG chr2 60516684 60516703 60516700 +
gccctcaaagatggctgaca

SEQ ID NO: 165722 - DNA, 20 bp, Artificial Sequence
  Synthetic oligonucleotide; TAG chr2 60516690 60516709 60516706 +
aaagatggctgacaaagatc

SEQ ID NO: 165723 - DNA, 20 bp, Artificial Sequence
  Synthetic oligonucleotide; TAG chr2 60516699 60516718 60516715 +
tgacaaagatctagcattcc

SEQ ID NO: 165724 - DNA, 20 bp, Artificial Sequence
  Synthetic oligonucleotide; TGG chr2 60516702 60516721 60516718 +
caaagatctagcattcctag

SEQ ID NO: 165725 - DNA, 20 bp, Artificial Sequence
  Synthetic oligonucleotide; AAG chr2 60516710 60516729 60516726 +
tagcattcctagtggacacc

SEQ ID NO: 165726 - DNA, 20 bp, Artificial Sequence
  Synthetic oligonucleotide; GAG chr2 60516715 60516734 60516731 +
ttcctagtggacaccaagct

SEQ ID NO: 165727 - DNA, 20 bp, Artificial Sequence
  Synthetic oligonucleotide; GAG chr2 60516721 60516740 60516737 +
gtggacaccaagctgagcat

SEQ ID NO: 165728 - DNA, 20 bp, Artificial Sequence
  Synthetic oligonucleotide; AAG chr2 60516733 60516752 60516749 +
ctgagcatgagtcatcaatg

SEQ ID NO: 165729 - DNA, 20 bp, Artificial Sequence
  Synthetic oligonucleotide; TGG chr2 60516739 60516758 60516755 +
atgagtcatcaatgaagcac

SEQ ID NO: 165730 - DNA, 20 bp, Artificial Sequence
  Synthetic oligonucleotide; AAG chr2 60516751 60516770 60516767 +
tgaagcactggtttttaaaa

SEQ ID NO: 165731 - DNA, 20 bp, Artificial Sequence
  Synthetic oligonucleotide; AAG chr2 60516755 60516774 60516771 +
gcactggtttttaaaaaagc

SEQ ID NO: 165732 - DNA, 20 bp, Artificial Sequence
  Synthetic oligonucleotide; CAG chr2 60516758 60516777 60516774 +
ctggtttttaaaaaagcaag

SEQ ID NO: 165733 - DNA, 20 bp, Artificial Sequence
  Synthetic oligonucleotide; AGG chr2 60516759 60516778 60516775 +
tggtttttaaaaaagcaagc

SEQ ID NO: 165734 - DNA, 20 bp, Artificial Sequence
  Synthetic oligonucleotide; AAG chr2 60516766 60516785 60516782 +
taaaaaagcaagcaggacat

SEQ ID NO: 165735 - DNA, 20 bp, Artificial Sequence
  Synthetic oligonucleotide; GAG chr2 60516768 60516787 60516784 +
aaaaagcaagcaggacataa

SEQ ID NO: 165736 - DNA, 20 bp, Artificial Sequence
  Synthetic oligonucleotide; CAG chr2 60516773 60516792 60516789 +
gcaagcaggacataagagtg

SEQ ID NO: 165737 - DNA, 20 bp, Artificial Sequence
  Synthetic oligonucleotide; AAG chr2 60516780 60516799 60516796 +
ggacataagagtgcagacat

SEQ ID NO: 165738 - DNA, 20 bp, Artificial Sequence
  Synthetic oligonucleotide; AAG chr2 60516787 60516806 60516803 +
agagtgcagacataagacta

SEQ ID NO: 165739 - DNA, 20 bp, Artificial Sequence
  Synthetic oligonucleotide; TGG chr2 60516794 60516813 60516810 +
agacataagactaaagaatg

SEQ ID NO: 165740 - DNA, 20 bp, Artificial Sequence
  Synthetic oligonucleotide; AAG chr2 60516805 60516824 60516821 +
taaagaatgtggaaaacact

SEQ ID NO: 165741 - DNA, 20 bp, Artificial Sequence
  Synthetic oligonucleotide; TGG chr2 60516820 60516839 60516836 +
acactaagatatcttgccat

SEQ ID NO: 165742 - DNA, 20 bp, Artificial Sequence
  Synthetic oligonucleotide; TAG chr2 60516829 60516848 60516845 +
tatcttgccattggactctg

SEQ ID NO: 165743 - DNA, 20 bp, Artificial Sequence
  Synthetic oligonucleotide; CAG chr2 60516836 60516855 60516852 +
ccattggactctgtagttat

SEQ ID NO: 165744 - DNA, 20 bp, Artificial Sequence
  Synthetic oligonucleotide; GAG chr2 60516849 60516868 60516865 +
tagttatcagactaatgttt

SEQ ID NO: 165745 - DNA, 20 bp, Artificial Sequence
  Synthetic oligonucleotide; AAG chr2 60516855 60516874 60516871 +
tcagactaatgtttgagtaa

SEQ ID NO: 165746 - DNA, 20 bp, Artificial Sequence
  Synthetic oligonucleotide; GAG chr2 60516857 60516876 60516873 +
agactaatgtttgagtaaaa

SEQ ID NO: 165747 - DNA, 20 bp, Artificial Sequence
  Synthetic oligonucleotide; TGG chr2 60516861 60516880 60516877 +
taatgtttgagtaaaagagc

SEQ ID NO: 165748 - DNA, 20 bp, Artificial Sequence
  Synthetic oligonucleotide; CAG chr2 60516869 60516888 60516885 +
gagtaaaagagctggaaaac

SEQ ID NO: 165749 - DNA, 20 bp, Artificial Sequence
  Synthetic oligonucleotide; CAG chr2 60516872 60516891 60516888 +
taaaagagctggaaaaccag

SEQ ID NO: 165750 - DNA, 20 bp, Artificial Sequence
  Synthetic oligonucleotide; AAG chr2 60516881 60516900 60516897 +
tggaaaaccagcagattcta

SEQ ID NO: 165751 - DNA, 20 bp, Artificial Sequence
  Synthetic oligonucleotide; GAG chr2 60516883 60516902 60516899 +
gaaaaccagcagattctaaa

SEQ ID NO: 165752 - DNA, 20 bp, Artificial Sequence
  Synthetic oligonucleotide; GAG chr2 60516885 60516904 60516901 +
aaaccagcagattctaaaga

SEQ ID NO: 165753 - DNA, 20 bp, Artificial Sequence
  Synthetic oligonucleotide; AGG chr2 60516886 60516905 60516902 +
aaccagcagattctaaagag

SEQ ID NO: 165754 - DNA, 20 bp, Artificial Sequence
  Synthetic oligonucleotide; TAG chr2 60516891 60516910 60516907 +
gcagattctaaagagaggca

SEQ ID NO: 165755 - DNA, 20 bp, Artificial Sequence
  Synthetic oligonucleotide; TGG chr2 60516904 60516923 60516920 +
agaggcatagaaacaataaa

SEQ ID NO: 165756 - DNA, 20 bp, Artificial Sequence
  Synthetic oligonucleotide; GGG chr2 60516905 60516924 60516921 +
gaggcatagaaacaataaat

SEQ ID NO: 165757 - DNA, 20 bp, Artificial Sequence
  Synthetic oligonucleotide; AAG chr2 60516912 60516931 60516928 +
agaaacaataaatgggttac

SEQ ID NO: 165758 - DNA, 20 bp, Artificial Sequence
  Synthetic oligonucleotide; TAG chr2 60516919 60516938 60516935 +
ataaatgggttacaagataa

SEQ ID NO: 165759 - DNA, 20 bp, Artificial Sequence
  Synthetic oligonucleotide; GAG chr2 60516928 60516947 60516944 +
ttacaagataatagatccat

SEQ ID NO: 165760 - DNA, 20 bp, Artificial Sequence
  Synthetic oligonucleotide; CAG chr2 60516933 60516952 60516949 +
agataatagatccatgagtt

SEQ ID NO: 165761 - DNA, 20 bp, Artificial Sequence
  Synthetic oligonucleotide; AGG chr2 60516934 60516953 60516950 +
gataatagatccatgagttc

SEQ ID NO: 165762 - DNA, 20 bp, Artificial Sequence
  Synthetic oligonucleotide; CAG chr2 60516939 60516958 60516955 +
tagatccatgagttcaggtt

SEQ ID NO: 165763 - DNA, 20 bp, Artificial Sequence
  Synthetic oligonucleotide; AGG chr2 60516940 60516959 60516956 +
agatccatgagttcaggttc

SEQ ID NO: 165764 - DNA, 20 bp, Artificial Sequence
  Synthetic oligonucleotide; AAG chr2 60516944 60516963 60516960 +
ccatgagttcaggttcagga

SEQ ID NO: 165765 - DNA, 20 bp, Artificial Sequence
  Synthetic oligonucleotide; GAG chr2 60516946 60516965 60516962 +
atgagttcaggttcaggaaa

SEQ ID NO: 165766 - DNA, 20 bp, Artificial Sequence
  Synthetic oligonucleotide; TAG chr2 60516955 60516974 60516971 +
ggttcaggaaagagattatt

SEQ ID NO: 165767 - DNA, 20 bp, Artificial Sequence
  Synthetic oligonucleotide; AGG chr2 60516956 60516975 60516972 +
gttcaggaaagagattattt

SEQ ID NO: 165768 - DNA, 20 bp, Artificial Sequence
  Synthetic oligonucleotide; AAG chr2 60516959 60516978 60516975 +
caggaaagagattatttagg

SEQ ID NO: 165769 - DNA, 20 bp, Artificial Sequence
  Synthetic oligonucleotide; AAG chr2 60516962 60516981 60516978 +
gaaagagattatttaggaag

SEQ ID NO: 165770 - DNA, 20 bp, Artificial Sequence
  Synthetic oligonucleotide; AAG chr2 60516965 60516984 60516981 +
agagattatttaggaagaag

SEQ ID NO: 165771 - DNA, 20 bp, Artificial Sequence
  Synthetic oligonucleotide; TGG chr2 60516968 60516987 60516984 +
gattatttaggaagaagaag

SEQ ID NO: 165772 - DNA, 20 bp, Artificial Sequence
  Synthetic oligonucleotide; CGG chr2 60516971 60516990 60516987 +
tatttaggaagaagaagtgg

SEQ ID NO: 165773 - DNA, 20 bp, Artificial Sequence
  Synthetic oligonucleotide; GAG chr2 60516973 60516992 60516989 +
tttaggaagaagaagtggcg

SEQ ID NO: 165774 - DNA, 20 bp, Artificial Sequence
  Synthetic oligonucleotide; TGG chr2 60516978 60516997 60516994 +
gaagaagaagtggcggagaa

SEQ ID NO: 165775 - DNA, 20 bp, Artificial Sequence
  Synthetic oligonucleotide; AAG chr2 60516985 60517004 60517001 +
aagtggcggagaatggaatg

SEQ ID NO: 165776 - DNA, 20 bp, Artificial Sequence
  Synthetic oligonucleotide; AAG chr2 60517001 60517020 60517017 +
aatgaagaatgtaaaatatg

SEQ ID NO: 165777 - DNA, 20 bp, Artificial Sequence
  Synthetic oligonucleotide; CAG chr2 60517009 60517028 60517025 +
atgtaaaatatgaagcattt

SEQ ID NO: 165778 - DNA, 20 bp, Artificial Sequence
  Synthetic oligonucleotide; AAG chr2 60517016 60517035 60517032 +
atatgaagcatttcagccca

SEQ ID NO: 165779 - DNA, 20 bp, Artificial Sequence
  Synthetic oligonucleotide; TGG chr2 60517020 60517039 60517036 +
gaagcatttcagcccaaagc

SEQ ID NO: 165780 - DNA, 20 bp, Artificial Sequence
  Synthetic oligonucleotide; GAG chr2 60517027 60517046 60517043 +
ttcagcccaaagctggtgat

SEQ ID NO: 165781 - DNA, 20 bp, Artificial Sequence
  Synthetic oligonucleotide; TGG chr2 60517045 60517064 60517061 +
atgagatactttgtcgtctc

SEQ ID NO: 165782 - DNA, 20 bp, Artificial Sequence
  Synthetic oligonucleotide; AAG chr2 60517052 60517071 60517068 +
actttgtcgtctctggaatg

SEQ ID NO: 165783 - DNA, 20 bp, Artificial Sequence
  Synthetic oligonucleotide; GAG chr2 60517054 60517073 60517070 +
tttgtcgtctctggaatgaa

SEQ ID NO: 165784 - DNA, 20 bp, Artificial Sequence
  Synthetic oligonucleotide; AGG chr2 60517055 60517074 60517071 +
ttgtcgtctctggaatgaag

SEQ ID NO: 165785 - DNA, 20 bp, Artificial Sequence
  Synthetic oligonucleotide; TGG chr2 60517061 60517080 60517077 +
tctctggaatgaagaggaaa

SEQ ID NO: 165786 - DNA, 20 bp, Artificial Sequence
  Synthetic oligonucleotide; GGG chr2 60517062 60517081 60517078 +
ctctggaatgaagaggaaat

SEQ ID NO: 165787 - DNA, 20 bp, Artificial Sequence
  Synthetic oligonucleotide; AAG chr2 60517074 60517093 60517090 +
gaggaaatgggtttaaaatg

SEQ ID NO: 165788 - DNA, 20 bp, Artificial Sequence
  Synthetic oligonucleotide; AAG chr2 60517080 60517099 60517096 +
atgggtttaaaatgaagcat

SEQ ID NO: 165789 - DNA, 20 bp, Artificial Sequence
  Synthetic oligonucleotide; AGG chr2 60517081 60517100 60517097 +
tgggtttaaaatgaagcata

SEQ ID NO: 165790 - DNA, 20 bp, Artificial Sequence
  Synthetic oligonucleotide; GGG chr2 60517082 60517101 60517098 +
gggtttaaaatgaagcataa

SEQ ID NO: 165791 - DNA, 20 bp, Artificial Sequence
  Synthetic oligonucleotide; AAG chr2 60517089 60517108 60517105 +
aaatgaagcataagggatcg

SEQ ID NO: 165792 - DNA, 20 bp, Artificial Sequence
  Synthetic oligonucleotide; AGG chr2 60517090 60517109 60517106 +
aatgaagcataagggatcga

SEQ ID NO: 165793 - DNA, 20 bp, Artificial Sequence
  Synthetic oligonucleotide; TAG chr2 60517093 60517112 60517109 +
gaagcataagggatcgaagg

SEQ ID NO: 165794 - DNA, 20 bp, Artificial Sequence
  Synthetic oligonucleotide; AAG chr2 60517100 60517119 60517116 +
aagggatcgaaggtagacaa

SEQ ID NO: 165795 - DNA, 20 bp, Artificial Sequence
  Synthetic oligonucleotide; AGG chr2 60517101 60517120 60517117 +
agggatcgaaggtagacaaa

SEQ ID NO: 165796 - DNA, 20 bp, Artificial Sequence
  Synthetic oligonucleotide; AAG chr2 60517104 60517123 60517120 +
gatcgaaggtagacaaaagg

SEQ ID NO: 165797 - DNA, 20 bp, Artificial Sequence
  Synthetic oligonucleotide; AGG chr2 60517105 60517124 60517121 +
atcgaaggtagacaaaagga

SEQ ID NO: 165798 - DNA, 20 bp, Artificial Sequence
  Synthetic oligonucleotide; GAG chr2 60517121 60517140 60517137 +
aggaaggatttcctgcgatt

SEQ ID NO: 165799 - DNA, 20 bp, Artificial Sequence
  Synthetic oligonucleotide; GAG chr2 60517123 60517142 60517139 +
gaaggatttcctgcgattga

SEQ ID NO: 165800 - DNA, 20 bp, Artificial Sequence
  Synthetic oligonucleotide; AGG chr2 60517124 60517143 60517140 +
aaggatttcctgcgattgag

SEQ ID NO: 165801 - DNA, 20 bp, Artificial Sequence
  Synthetic oligonucleotide; TAG chr2 60517139 60517158 60517155 +
ttgagaggtgtctttaaaaa

SEQ ID NO: 165802 - DNA, 20 bp, Artificial Sequence
  Synthetic oligonucleotide; TAG chr2 60517145 60517164 60517161 +
ggtgtctttaaaaatagaac

SEQ ID NO: 165803 - DNA, 20 bp, Artificial Sequence
  Synthetic oligonucleotide; AGG chr2 60517146 60517165 60517162 +
gtgtctttaaaaatagaact

SEQ ID NO: 165804 - DNA, 20 bp, Artificial Sequence
  Synthetic oligonucleotide; GGG chr2 60517147 60517166 60517163 +
tgtctttaaaaatagaacta

SEQ ID NO: 165805 - DNA, 20 bp, Artificial Sequence
  Synthetic oligonucleotide; TGG chr2 60517150 60517169 60517166 +
ctttaaaaatagaactaggg

SEQ ID NO: 165806 - DNA, 20 bp, Artificial Sequence
  Synthetic oligonucleotide; GAG chr2 60517154 60517173 60517170 +
aaaaatagaactagggtggt

SEQ ID NO: 165807 - DNA, 20 bp, Artificial Sequence
  Synthetic oligonucleotide; AGG chr2 60517155 60517174 60517171 +
aaaatagaactagggtggtg

SEQ ID NO: 165808 - DNA, 20 bp, Artificial Sequence
  Synthetic oligonucleotide; AAG chr2 60517158 60517177 60517174 +
atagaactagggtggtgagg

SEQ ID NO: 165809 - DNA, 20 bp, Artificial Sequence
  Synthetic oligonucleotide; GAG chr2 60517160 60517179 60517176 +
agaactagggtggtgaggaa

SEQ ID NO: 165810 - DNA, 20 bp, Artificial Sequence
  Synthetic oligonucleotide; AGG chr2 60517161 60517180 60517177 +
gaactagggtggtgaggaag

SEQ ID NO: 165811 - DNA, 20 bp, Artificial Sequence
  Synthetic oligonucleotide; TGG chr2 60517165 60517184 60517181 +
tagggtggtgaggaagaggt

SEQ ID NO: 165812 - DNA, 20 bp, Artificial Sequence
  Synthetic oligonucleotide; GGG chr2 60517166 60517185 60517182 +
agggtggtgaggaagaggtt

SEQ ID NO: 165813 - DNA, 20 bp, Artificial Sequence
  Synthetic oligonucleotide; TGG chr2 60517170 60517189 60517186 +
tggtgaggaagaggttgggc

SEQ ID NO: 165814 - DNA, 20 bp, Artificial Sequence
  Synthetic oligonucleotide; TGG chr2 60517180 60517199 60517196 +
gaggttgggctggccaattc

SEQ ID NO: 165815 - DNA, 20 bp, Artificial Sequence
  Synthetic oligonucleotide; GAG chr2 60517182 60517201 60517198 +
ggttgggctggccaattctg

SEQ ID NO: 165816 - DNA, 20 bp, Artificial Sequence
  Synthetic oligonucleotide; AGG chr2 60517183 60517202 60517199 +
gttgggctggccaattctgg

SEQ ID NO: 165817 - DNA, 20 bp, Artificial Sequence
  Synthetic oligonucleotide; GGG chr2 60517184 60517203 60517200 +
ttgggctggccaattctgga

SEQ ID NO: 165818 - DNA, 20 bp, Artificial Sequence
  Synthetic oligonucleotide; GAG chr2 60517199 60517218 60517215 +
ctggagggccatctgcccct

SEQ ID NO: 165819 - DNA, 20 bp, Artificial Sequence
  Synthetic oligonucleotide; GAG chr2 60517201 60517220 60517217 +
ggagggccatctgcccctga

SEQ ID NO: 165820 - DNA, 20 bp, Artificial Sequence
  Synthetic oligonucleotide; AGG chr2 60517202 60517221 60517218 +
gagggccatctgcccctgag

SEQ ID NO: 165821 - DNA, 20 bp, Artificial Sequence
  Synthetic oligonucleotide; GGG chr2 60517203 60517222 60517219 +
agggccatctgcccctgaga

SEQ ID NO: 165822 - DNA, 20 bp, Artificial Sequence
  Synthetic oligonucleotide; CAG chr2 60517250 60517269 60517266 +
tccatctactccattatctc

SEQ ID NO: 165823 - DNA, 20 bp, Artificial Sequence
  Synthetic oligonucleotide; AAG chr2 60517267 60517286 60517283 +
ctccagttatctgaataaaa

SEQ ID NO: 165824 - DNA, 20 bp, Artificial Sequence
  Synthetic oligonucleotide; AAG chr2 60517272 60517291 60517288 +
gttatctgaataaaaaagcc

SEQ ID NO: 165825 - DNA, 20 bp, Artificial Sequence
  Synthetic oligonucleotide; TGG chr2 60517283 60517302 60517299 +
aaaaaagccaagctattccc

SEQ ID NO: 165826 - DNA, 20 bp, Artificial Sequence
  Synthetic oligonucleotide; GGG chr2 60517284 60517303 60517300 +
aaaaagccaagctattccct

SEQ ID NO: 165827 - DNA, 20 bp, Artificial Sequence
  Synthetic oligonucleotide; CAG chr2 60517303 60517322 60517319 +
tgggcacaccatgtaaaccc

SEQ ID NO: 165828 - DNA, 20 bp, Artificial Sequence
  Synthetic oligonucleotide; AAG chr2 60517306 60517325 60517322 +
gcacaccatgtaaaccccag

SEQ ID NO: 165829 - DNA, 20 bp, Artificial Sequence
  Synthetic oligonucleotide; AGG chr2 60517307 60517326 60517323 +
cacaccatgtaaaccccaga

SEQ ID NO: 165830 - DNA, 20 bp, Artificial Sequence
  Synthetic oligonucleotide; GGG chr2 60517308 60517327 60517324 +
acaccatgtaaaccccagaa

SEQ ID NO: 165831 - DNA, 20 bp, Artificial Sequence
  Synthetic oligonucleotide; TGG chr2 60517319 60517338 60517335 +
accccagaagggccacactt

SEQ ID NO: 165832 - DNA, 20 bp, Artificial Sequence
  Synthetic oligonucleotide; GGG chr2 60517320 60517339 60517336 +
ccccagaagggccacacttt

SEQ ID NO: 165833 - DNA, 20 bp, Artificial Sequence
  Synthetic oligonucleotide; GAG chr2 60517322 60517341 60517338 +
ccagaagggccacactttgg

SEQ ID NO: 165834 - DNA, 20 bp, Artificial Sequence
  Synthetic oligonucleotide; TAG chr2 60517328 60517347 60517344 +
gggccacactttgggagccc

SEQ ID NO: 165835 - DNA, 20 bp, Artificial Sequence
  Synthetic oligonucleotide; CAG chr2 60517331 60517350 60517347 +
ccacactttgggagccctag

SEQ ID NO: 165836 - DNA, 20 bp, Artificial Sequence
  Synthetic oligonucleotide; AGG chr2 60517332 60517351 60517348 +
cacactttgggagccctagc

SEQ ID NO: 165837 - DNA, 20 bp, Artificial Sequence
  Synthetic oligonucleotide; AAG chr2 60517336 60517355 60517352 +
ctttgggagccctagcagga

SEQ ID NO: 165838 - DNA, 20 bp, Artificial Sequence
  Synthetic oligonucleotide; AGG chr2 60517337 60517356 60517353 +
tttgggagccctagcaggaa

SEQ ID NO: 165839 - DNA, 20 bp, Artificial Sequence
  Synthetic oligonucleotide; TGG chr2 60517340 60517359 60517356 +
gggagccctagcaggaaagg

SEQ ID NO: 165840 - DNA, 20 bp, Artificial Sequence
  Synthetic oligonucleotide; TAG chr2 60517343 60517362 60517359 +
agccctagcaggaaaggtgg

SEQ ID NO: 165841 - DNA, 20 bp, Artificial Sequence
  Synthetic oligonucleotide; AGG chr2 60517344 60517363 60517360 +
gccctagcaggaaaggtggt

SEQ ID NO: 165842 - DNA, 20 bp, Artificial Sequence
  Synthetic oligonucleotide; AAG chr2 60517347 60517366 60517363 +
ctagcaggaaaggtggtagg

SEQ ID NO: 165843 - DNA, 20 bp, Artificial Sequence
  Synthetic oligonucleotide; CAG chr2 60517352 60517371 60517368 +
aggaaaggtggtaggaagac

SEQ ID NO: 165844 - DNA, 20 bp, Artificial Sequence
  Synthetic oligonucleotide; AAG chr2 60517363 60517382 60517379 +
taggaagaccagccccgaaa

SEQ ID NO: 165845 - DNA, 20 bp, Artificial Sequence
  Synthetic oligonucleotide; AGG chr2 60517364 60517383 60517380 +
aggaagaccagccccgaaaa

SEQ ID NO: 165846 - DNA, 20 bp, Artificial Sequence
  Synthetic oligonucleotide; GGG chr2 60517365 60517384 60517381 +
ggaagaccagccccgaaaaa

SEQ ID NO: 165847 - DNA, 20 bp, Artificial Sequence
  Synthetic oligonucleotide; CAG chr2 60517368 60517387 60517384 +
agaccagccccgaaaaaggg

SEQ ID NO: 165848 - DNA, 20 bp, Artificial Sequence
  Synthetic oligonucleotide; GAG chr2 60517370 60517389 60517386 +
accagccccgaaaaagggca

SEQ ID NO: 165849 - DNA, 20 bp, Artificial Sequence
  Synthetic oligonucleotide; CAG chr2 60517377 60517396 60517393 +
ccgaaaaagggcagagaaaa

SEQ ID NO: 165850 - DNA, 20 bp, Artificial Sequence
  Synthetic oligonucleotide; AGG chr2 60517378 60517397 60517394 +
cgaaaaagggcagagaaaac

SEQ ID NO: 165851 - DNA, 20 bp, Artificial Sequence
  Synthetic oligonucleotide; GGG chr2 60517379 60517398 60517395 +
gaaaaagggcagagaaaaca

SEQ ID NO: 165852 - DNA, 20 bp, Artificial Sequence
  Synthetic oligonucleotide; AAG chr2 60517383 60517402 60517399 +
aagggcagagaaaacaggga

SEQ ID NO: 165853 - DNA, 20 bp, Artificial Sequence
  Synthetic oligonucleotide; AGG chr2 60517384 60517403 60517400 +
agggcagagaaaacagggaa

SEQ ID NO: 165854 - DNA, 20 bp, Artificial Sequence
  Synthetic oligonucleotide; AAG chr2 60517390 60517409 60517406 +
gagaaaacagggaaaggaac

SEQ ID NO: 165855 - DNA, 20 bp, Artificial Sequence
  Synthetic oligonucleotide; AGG chr2 60517391 60517410 60517407 +
agaaaacagggaaaggaaca

SEQ ID NO: 165856 - DNA, 20 bp, Artificial Sequence
  Synthetic oligonucleotide; AAG chr2 60517395 60517414 60517411 +
aacagggaaaggaacaaggc

SEQ ID NO: 165857 - DNA, 20 bp, Artificial Sequence
  Synthetic oligonucleotide; AAG chr2 60517398 60517417 60517414 +
agggaaaggaacaaggcaag

SEQ ID NO: 165858 - DNA, 20 bp, Artificial Sequence
  Synthetic oligonucleotide; AAG chr2 60517402 60517421 60517418 +
aaaggaacaaggcaagaaga

SEQ ID NO: 165859 - DNA, 20 bp, Artificial Sequence
  Synthetic oligonucleotide; AGG chr2 60517403 60517422 60517419 +
aaggaacaaggcaagaagaa

SEQ ID NO: 165860 - DNA, 20 bp, Artificial Sequence
  Synthetic oligonucleotide; GGG chr2 60517404 60517423 60517420 +
aggaacaaggcaagaagaaa

SEQ ID NO: 165861 - DNA, 20 bp, Artificial Sequence
  Synthetic oligonucleotide; AAG chr2 60517409 60517428 60517425 +
caaggcaagaagaaagggca

SEQ ID NO: 165862 - DNA, 20 bp, Artificial Sequence
  Synthetic oligonucleotide; AGG chr2 60517410 60517429 60517426 +
aaggcaagaagaaagggcaa

SEQ ID NO: 165863 - DNA, 20 bp, Artificial Sequence
  Synthetic oligonucleotide; CAG chr2 60517427 60517446 60517443 +
caaaggaccattctctgcaa

SEQ ID NO: 165864 - DNA, 20 bp, Artificial Sequence
  Synthetic oligonucleotide; CAG chr2 60517432 60517451 60517448 +
gaccattctctgcaacagca

SEQ ID NO: 165865 - DNA, 20 bp, Artificial Sequence
  Synthetic oligonucleotide; AGG chr2 60517433 60517452 60517449 +
accattctctgcaacagcac

SEQ ID NO: 165866 - DNA, 20 bp, Artificial Sequence
  Synthetic oligonucleotide; TGG chr2 60517440 60517459 60517456 +
tctgcaacagcacaggtgat

SEQ ID NO: 165867 - DNA, 20 bp, Artificial Sequence
  Synthetic oligonucleotide; GGG chr2 60517441 60517460 60517457 +
ctgcaacagcacaggtgatt

SEQ ID NO: 165868 - DNA, 20 bp, Artificial Sequence
  Synthetic oligonucleotide; TGG chr2 60517444 60517463 60517460 +
caacagcacaggtgattggg

SEQ ID NO: 165869 - DNA, 20 bp, Artificial Sequence
  Synthetic oligonucleotide; TGG chr2 60517447 60517466 60517463 +
cagcacaggtgattgggtgg

SEQ ID NO: 165870 - DNA, 20 bp, Artificial Sequence
  Synthetic oligonucleotide; TGG chr2 60517460 60517479 60517476 +
tgggtggtggttttgttgct

SEQ ID NO: 165871 - DNA, 20 bp, Artificial Sequence
  Synthetic oligonucleotide; GGG chr2 60517461 60517480 60517477 +
gggtggtggttttgttgctt

SEQ ID NO: 165872 - DNA, 20 bp, Artificial Sequence
  Synthetic oligonucleotide; TGG chr2 60517472 60517491 60517488 +
ttgttgcttgggttttacca

SEQ ID NO: 165873 - DNA, 20 bp, Artificial Sequence
  Synthetic oligonucleotide; GGG chr2 60517473 60517492 60517489 +
tgttgcttgggttttaccat

SEQ ID NO: 165874 - DNA, 20 bp, Artificial Sequence
  Synthetic oligonucleotide; CAG chr2 60517481 60517500 60517497 +
gggttttaccatgggctccc

SEQ ID NO: 165875 - DNA, 20 bp, Artificial Sequence
  Synthetic oligonucleotide; AGG chr2 60517482 60517501 60517498 +
ggttttaccatgggctcccc

SEQ ID NO: 165876 - DNA, 20 bp, Artificial Sequence
  Synthetic oligonucleotide; TAG chr2 60517486 60517505 60517502 +
ttaccatgggctccccaggt

SEQ ID NO: 165877 - DNA, 20 bp, Artificial Sequence
  Synthetic oligonucleotide; AAG chr2 60517500 60517519 60517516 +
ccaggttagcactgccacaa

SEQ ID NO: 165878 - DNA, 20 bp, Artificial Sequence
  Synthetic oligonucleotide; CAG chr2 60517506 60517525 60517522 +
tagcactgccacaaaagcac

SEQ ID NO: 165879 - DNA, 20 bp, Artificial Sequence
  Synthetic oligonucleotide; AGG chr2 60517507 60517526 60517523 +
agcactgccacaaaagcacc

SEQ ID NO: 165880 - DNA, 20 bp, Artificial Sequence
  Synthetic oligonucleotide; AAG chr2 60517520 60517539 60517536 +
aagcaccaggctcttcaaca

SEQ ID NO: 165881 - DNA, 20 bp, Artificial Sequence
  Synthetic oligonucleotide; CAG chr2 60517526 60517545 60517542 +
caggctcttcaacaaagctc

SEQ ID NO: 165882 - DNA, 20 bp, Artificial Sequence
  Synthetic oligonucleotide; AAG chr2 60517531 60517550 60517547 +
tcttcaacaaagctccagtt

SEQ ID NO: 165883 - DNA, 20 bp, Artificial Sequence
  Synthetic oligonucleotide; AAG chr2 60517536 60517555 60517552 +
aacaaagctccagttaagaa

SEQ ID NO: 165884 - DNA, 20 bp, Artificial Sequence
  Synthetic oligonucleotide; CAG chr2 60517544 60517563 60517560 +
tccagttaagaaaagcattc

SEQ ID NO: 165885 - DNA, 20 bp, Artificial Sequence
  Synthetic oligonucleotide; AAG chr2 60517560 60517579 60517576 +
attccagccatcaccgataa

SEQ ID NO: 165886 - DNA, 20 bp, Artificial Sequence
  Synthetic oligonucleotide; TGG chr2 60517565 60517584 60517581 +
agccatcaccgataaaagcg

SEQ ID NO: 165887 - DNA, 20 bp, Artificial Sequence
  Synthetic oligonucleotide; GGG chr2 60517566 60517585 60517582 +
gccatcaccgataaaagcgt

SEQ ID NO: 165888 - DNA, 20 bp, Artificial Sequence
  Synthetic oligonucleotide; AAG chr2 60517572 60517591 60517588 +
accgataaaagcgtgggtgc

SEQ ID NO: 165889 - DNA, 20 bp, Artificial Sequence
  Synthetic oligonucleotide; AAG chr2 60517585 60517604 60517601 +
tgggtgcaagttcctctgca

SEQ ID NO: 165890 - DNA, 20 bp, Artificial Sequence
  Synthetic oligonucleotide; CGG chr2 60517594 60517613 60517610 +
gttcctctgcaaagcacatg

SEQ ID NO: 165891 - DNA, 20 bp, Artificial Sequence
  Synthetic oligonucleotide; GGG chr2 60517595 60517614 60517611 +
ttcctctgcaaagcacatgc

SEQ ID NO: 165892 - DNA, 20 bp, Artificial Sequence
  Synthetic oligonucleotide; TGG chr2 60517605 60517624 60517621 +
aagcacatgcgggccacctc

SEQ ID NO: 165893 - DNA, 20 bp, Artificial Sequence
  Synthetic oligonucleotide; TGG chr2 60517615 60517634 60517631 +
gggccacctctggctcctgc

SEQ ID NO: 165894 - DNA, 20 bp, Artificial Sequence
  Synthetic oligonucleotide; TGG chr2 60517621 60517640 60517637 +
cctctggctcctgctggcca

SEQ ID NO: 165895 - DNA, 20 bp, Artificial Sequence
  Synthetic oligonucleotide; GAG chr2 60517623 60517642 60517639 +
tctggctcctgctggccatg

SEQ ID NO: 165896 - DNA, 20 bp, Artificial Sequence
  Synthetic oligonucleotide; GAG chr2 60517625 60517644 60517641 +
tggctcctgctggccatgga

SEQ ID NO: 165897 - DNA, 20 bp, Artificial Sequence
  Synthetic oligonucleotide; AGG chr2 60517626 60517645 60517642 +
ggctcctgctggccatggag

SEQ ID NO: 165898 - DNA, 20 bp, Artificial Sequence
  Synthetic oligonucleotide; TGG chr2 60517640 60517659 60517656 +
atggagaggccatgtgcgat

SEQ ID NO: 165899 - DNA, 20 bp, Artificial Sequence
  Synthetic oligonucleotide; CAG chr2 60517645 60517664 60517661 +
gaggccatgtgcgattggta

SEQ ID NO: 165900 - DNA, 20 bp, Artificial Sequence
  Synthetic oligonucleotide; CAG chr2 60517649 60517668 60517665 +
ccatgtgcgattggtacagt

SEQ ID NO: 165901 - DNA, 20 bp, Artificial Sequence
  Synthetic oligonucleotide; CAG chr2 60517653 60517672 60517669 +
gtgcgattggtacagtcagc

SEQ ID NO: 165902 - DNA, 20 bp, Artificial Sequence
  Synthetic oligonucleotide; AGG chr2 60517654 60517673 60517670 +
tgcgattggtacagtcagcc

SEQ ID NO: 165903 - DNA, 20 bp, Artificial Sequence
  Synthetic oligonucleotide; AAG chr2 60517662 60517681 60517678 +
gtacagtcagccaggaatga

SEQ ID NO: 165904 - DNA, 20 bp, Artificial Sequence
  Synthetic oligonucleotide; TGG chr2 60517665 60517684 60517681 +
cagtcagccaggaatgaaag

SEQ ID NO: 165905 - DNA, 20 bp, Artificial Sequence
  Synthetic oligonucleotide; GGG chr2 60517666 60517685 60517682 +
agtcagccaggaatgaaagt

SEQ ID NO: 165906 - DNA, 20 bp, Artificial Sequence
  Synthetic oligonucleotide; AAG chr2 60517669 60517688 60517685 +
cagccaggaatgaaagtggg

SEQ ID NO: 165907 - DNA, 20 bp, Artificial Sequence
  Synthetic oligonucleotide; CAG chr2 60517675 60517694 60517691 +
ggaatgaaagtgggaagccc

SEQ ID NO: 165908 - DNA, 20 bp, Artificial Sequence
  Synthetic oligonucleotide; AGG chr2 60517676 60517695 60517692 +
gaatgaaagtgggaagcccc

SEQ ID NO: 165909 - DNA, 20 bp, Artificial Sequence
  Synthetic oligonucleotide; TGG chr2 60517682 60517701 60517698 +
aagtgggaagccccaggctc

SEQ ID NO: 165910 - DNA, 20 bp, Artificial Sequence
  Synthetic oligonucleotide; GGG chr2 60517683 60517702 60517699 +
agtgggaagccccaggctct

SEQ ID NO: 165911 - DNA, 20 bp, Artificial Sequence
  Synthetic oligonucleotide; AAG chr2 60517688 60517707 60517704 +
gaagccccaggctctgggcc

SEQ ID NO: 165912 - DNA, 20 bp, Artificial Sequence
  Synthetic oligonucleotide; TAG chr2 60517703 60517722 60517719 +
gggccaagtctaccactgcc

SEQ ID NO: 165913 - DNA, 20 bp, Artificial Sequence
  Synthetic oligonucleotide; AAG chr2 60517707 60517726 60517723 +
caagtctaccactgcctagc

SEQ ID NO: 165914 - DNA, 20 bp, Artificial Sequence
  Synthetic oligonucleotide; TAG chr2 60517710 60517729 60517726 +
gtctaccactgcctagcaag

SEQ ID NO: 165915 - DNA, 20 bp, Artificial Sequence
  Synthetic oligonucleotide; TGG chr2 60517717 60517736 60517733 +
actgcctagcaagtagactc

SEQ ID NO: 165916 - DNA, 20 bp, Artificial Sequence
  Synthetic oligonucleotide; TAG chr2 60517735 60517754 60517751 +
tctggcactcactcccctct

SEQ ID NO: 165917 - DNA, 20 bp, Artificial Sequence
  Synthetic oligonucleotide; CAG chr2 60517765 60517784 60517781 +
ctttctcatctgtaaaatga

SEQ ID NO: 165918 - DNA, 20 bp, Artificial Sequence
  Synthetic oligonucleotide; AGG chr2 60517766 60517785 60517782 +
tttctcatctgtaaaatgac

SEQ ID NO: 165919 - DNA, 20 bp, Artificial Sequence
  Synthetic oligonucleotide; GGG chr2 60517767 60517786 60517783 +
ttctcatctgtaaaatgaca

SEQ ID NO: 165920 - DNA, 20 bp, Artificial Sequence
  Synthetic oligonucleotide; AAG chr2 60517788 60517807 60517804 +
ggttaatgatatgacttcac

SEQ ID NO: 165921 - DNA, 20 bp, Artificial Sequence
  Synthetic oligonucleotide; TAG chr2 60517803 60517822 60517819 +
ttcacaagtctatgtctaca

SEQ ID NO: 165922 - DNA, 20 bp, Artificial Sequence
  Synthetic oligonucleotide; AAG chr2 60517806 60517825 60517822 +
acaagtctatgtctacatag

SEQ ID NO: 165923 - DNA, 20 bp, Artificial Sequence
  Synthetic oligonucleotide; AAG chr2 60517818 60517837 60517834 +
ctacatagaagatgctcaat

SEQ ID NO: 165924 - DNA, 20 bp, Artificial Sequence
  Synthetic oligonucleotide; TGG chr2 60517830 60517849 60517846 +
tgctcaataagtattcactt

SEQ ID NO: 165925 - DNA, 20 bp, Artificial Sequence
  Synthetic oligonucleotide; AAG chr2 60517842 60517861 60517858 +
attcactttggctttccacg

SEQ ID NO: 165926 - DNA, 20 bp, Artificial Sequence
  Synthetic oligonucleotide; AGG chr2 60517843 60517862 60517859 +
ttcactttggctttccacga

SEQ ID NO: 165927 - DNA, 20 bp, Artificial Sequence
  Synthetic oligonucleotide; AAG chr2 60517862 60517881 60517878 +
aaggaaactatctatgctca

SEQ ID NO: 165928 - DNA, 20 bp, Artificial Sequence
  Synthetic oligonucleotide; GAG chr2 60517864 60517883 60517880 +
ggaaactatctatgctcaaa

SEQ ID NO: 165929 - DNA, 20 bp, Artificial Sequence
  Synthetic oligonucleotide; CAG chr2 60517890 60517909 60517906 +
tgctttcttctatgattcct

SEQ ID NO: 165930 - DNA, 20 bp, Artificial Sequence
  Synthetic oligonucleotide; TAG chr2 60517907 60517926 60517923 +
cctcagaaactcttgtcgac

SEQ ID NO: 165931 - DNA, 20 bp, Artificial Sequence
  Synthetic oligonucleotide; GAG chr2 60517909 60517928 60517925 +
tcagaaactcttgtcgacta

SEQ ID NO: 165932 - DNA, 20 bp, Artificial Sequence
  Synthetic oligonucleotide; AGG chr2 60517910 60517929 60517926 +
cagaaactcttgtcgactag

SEQ ID NO: 165933 - DNA, 20 bp, Artificial Sequence
  Synthetic oligonucleotide; AAG chr2 60517916 60517935 60517932 +
ctcttgtcgactagaggaac

SEQ ID NO: 165934 - DNA, 20 bp, Artificial Sequence
  Synthetic oligonucleotide; TAG chr2 60517942 60517961 60517958 +
cttactctaaaacccaattt

SEQ ID NO: 165935 - DNA, 20 bp, Artificial Sequence
  Synthetic oligonucleotide; AGG chr2 60517943 60517962 60517959 +
ttactctaaaacccaatttt

SEQ ID NO: 165936 - DNA, 20 bp, Artificial Sequence
  Synthetic oligonucleotide; GGG chr2 60517944 60517963 60517960 +
tactctaaaacccaatttta

SEQ ID NO: 165937 - DNA, 20 bp, Artificial Sequence
  Synthetic oligonucleotide; GGG chr2 60517945 60517964 60517961 +
actctaaaacccaattttag

SEQ ID NO: 165938 - DNA, 20 bp, Artificial Sequence
  Synthetic oligonucleotide; GAG chr2 60517947 60517966 60517963 +
tctaaaacccaattttaggg

SEQ ID NO: 165939 - DNA, 20 bp, Artificial Sequence
  Synthetic oligonucleotide; AGG chr2 60517948 60517967 60517964 +
ctaaaacccaattttagggg

SEQ ID NO: 165940 - DNA, 20 bp, Artificial Sequence
  Synthetic oligonucleotide; GAG chr2 60517950 60517969 60517966 +
aaaacccaattttaggggag

SEQ ID NO: 165941 - DNA, 20 bp, Artificial Sequence
  Synthetic oligonucleotide; GAG chr2 60517952 60517971 60517968 +
aacccaattttaggggagga

SEQ ID NO: 165942 - DNA, 20 bp, Artificial Sequence
  Synthetic oligonucleotide; AAG chr2 60517966 60517985 60517982 +
ggaggagagaaaatttttaa

SEQ ID NO: 165943 - DNA, 20 bp, Artificial Sequence
  Synthetic oligonucleotide; AAG chr2 60517988 60518007 60518004 +
gactttaaattaattacttg

SEQ ID NO: 165944 - DNA, 20 bp, Artificial Sequence
  Synthetic oligonucleotide; AGG chr2 60517989 60518008 60518005 +
actttaaattaattacttga

SEQ ID NO: 165945 - DNA, 20 bp, Artificial Sequence
  Synthetic oligonucleotide; CAG chr2 60517993 60518012 60518009 +
taaattaattacttgaaggc

SEQ ID NO: 165946 - DNA, 20 bp, Artificial Sequence
  Synthetic oligonucleotide; GAG chr2 60517995 60518014 60518011 +
aattaattacttgaaggcca

SEQ ID NO: 165947 - DNA, 20 bp, Artificial Sequence
  Synthetic oligonucleotide; AGG chr2 60517996 60518015 60518012 +
attaattacttgaaggccag

SEQ ID NO: 165948 - DNA, 20 bp, Artificial Sequence
  Synthetic oligonucleotide; CAG chr2 60518021 60518040 60518037 +
tttgcttatgcctataatct

SEQ ID NO: 165949 - DNA, 20 bp, Artificial Sequence
  Synthetic oligonucleotide; TGG chr2 60518029 60518048 60518045 +
tgcctataatctcagaaatt

SEQ ID NO: 165950 - DNA, 20 bp, Artificial Sequence
  Synthetic oligonucleotide; AAG chr2 60518032 60518051 60518048 +
ctataatctcagaaatttgg

SEQ ID NO: 165951 - DNA, 20 bp, Artificial Sequence
  Synthetic oligonucleotide; AGG chr2 60518033 60518052 60518049 +
tataatctcagaaatttgga

SEQ ID NO: 165952 - DNA, 20 bp, Artificial Sequence
  Synthetic oligonucleotide; CAG chr2 60518039 60518058 60518055 +
ctcagaaatttggaaggcca

SEQ ID NO: 165953 - DNA, 20 bp, Artificial Sequence
  Synthetic oligonucleotide; GAG chr2 60518041 60518060 60518057 +
cagaaatttggaaggccaca

SEQ ID NO: 165954 - DNA, 20 bp, Artificial Sequence
  Synthetic oligonucleotide; AGG chr2 60518042 60518061 60518058 +
agaaatttggaaggccacag

SEQ ID NO: 165955 - DNA, 20 bp, Artificial Sequence
  Synthetic oligonucleotide; GGG chr2 60518043 60518062 60518059 +
gaaatttggaaggccacaga

SEQ ID NO: 165956 - DNA, 20 bp, Artificial Sequence
  Synthetic oligonucleotide; AAG chr2 60518046 60518065 60518062 +
atttggaaggccacagaggg

SEQ ID NO: 165957 - DNA, 20 bp, Artificial Sequence
  Synthetic oligonucleotide; AAG chr2 60518057 60518076 60518073 +
cacagagggaagattgcttg

SEQ ID NO: 165958 - DNA, 20 bp, Artificial Sequence
  Synthetic oligonucleotide; TAG chr2 60518061 60518080 60518077 +
gagggaagattgcttgaagc

SEQ ID NO: 165959 - DNA, 20 bp, Artificial Sequence
  Synthetic oligonucleotide; AGG chr2 60518062 60518081 60518078 +
agggaagattgcttgaagct

SEQ ID NO: 165960 - DNA, 20 bp, Artificial Sequence
  Synthetic oligonucleotide; GAG chr2 60518064 60518083 60518080 +
ggaagattgcttgaagctag

SEQ ID NO: 165961 - DNA, 20 bp, Artificial Sequence
  Synthetic oligonucleotide; AAG chr2 60518070 60518089 60518086 +
ttgcttgaagctaggagttc

SEQ ID NO: 165962 - DNA, 20 bp, Artificial Sequence
  Synthetic oligonucleotide; CAG chr2 60518075 60518094 60518091 +
tgaagctaggagttcaagac

SEQ ID NO: 165963 - DNA, 20 bp, Artificial Sequence
  Synthetic oligonucleotide; TGG chr2 60518080 60518099 60518096 +
ctaggagttcaagaccagcc

SEQ ID NO: 165964 - DNA, 20 bp, Artificial Sequence
  Synthetic oligonucleotide; GGG chr2 60518081 60518100 60518097 +
taggagttcaagaccagcct

SEQ ID NO: 165965 - DNA, 20 bp, Artificial Sequence
  Synthetic oligonucleotide; TAG chr2 60518089 60518108 60518105 +
caagaccagcctgggcaaca

SEQ ID NO: 165966 - DNA, 20 bp, Artificial Sequence
  Synthetic oligonucleotide; AAG chr2 60518112 60518131 60518128 +
caaaaccctgtctctacaaa

SEQ ID NO: 165967 - DNA, 20 bp, Artificial Sequence
  Synthetic oligonucleotide; GAG chr2 60518142 60518161 60518158 +
aataaaataaaataattgct

SEQ ID NO: 165968 - DNA, 20 bp, Artificial Sequence
  Synthetic oligonucleotide; TAG chr2 60518148 60518167 60518164 +
ataaaataattgctgagatt

SEQ ID NO: 165969 - DNA, 20 bp, Artificial Sequence
  Synthetic oligonucleotide; AAG chr2 60518162 60518181 60518178 +
gagatttagctatcttttca

SEQ ID NO: 165970 - DNA, 20 bp, Artificial Sequence
  Synthetic oligonucleotide; TGG chr2 60518178 60518197 60518194 +
ttcaaagaaaatataaaatt

SEQ ID NO: 165971 - DNA, 20 bp, Artificial Sequence
  Synthetic oligonucleotide; CAG chr2 60518183 60518202 60518199 +
agaaaatataaaatttggcc

SEQ ID NO: 165972 - DNA, 20 bp, Artificial Sequence
  Synthetic oligonucleotide; TAG chr2 60518204 60518223 60518220 +
agttttttatctatcaaacc

SEQ ID NO: 165973 - DNA, 20 bp, Artificial Sequence
  Synthetic oligonucleotide; GAG chr2 60518249 60518268 60518265 +
tccctctgtcaacatctgct

SEQ ID NO: 165974 - DNA, 20 bp, Artificial Sequence
  Synthetic oligonucleotide; TAG chr2 60518275 60518294 60518291 +
tcataatacataaaacatca

SEQ ID NO: 165975 - DNA, 20 bp, Artificial Sequence
  Synthetic oligonucleotide; AAG chr2 60518281 60518300 60518297 +
tacataaaacatcatagata

SEQ ID NO: 165976 - DNA, 20 bp, Artificial Sequence
  Synthetic oligonucleotide; AGG chr2 60518282 60518301 60518298 +
acataaaacatcatagataa

SEQ ID NO: 165977 - DNA, 20 bp, Artificial Sequence
  Synthetic oligonucleotide; GAG chr2 60518284 60518303 60518300 +
ataaaacatcatagataaag

SEQ ID NO: 165978 - DNA, 20 bp, Artificial Sequence
  Synthetic oligonucleotide; CAG chr2 60518290 60518309 60518306 +
catcatagataaaggagtca

SEQ ID NO: 165979 - DNA, 20 bp, Artificial Sequence
  Synthetic oligonucleotide; AGG chr2 60518291 60518310 60518307 +
atcatagataaaggagtcac

SEQ ID NO: 165980 - DNA, 20 bp, Artificial Sequence
  Synthetic oligonucleotide; TAG chr2 60518296 60518315 60518312 +
agataaaggagtcacaggat

SEQ ID NO: 165981 - DNA, 20 bp, Artificial Sequence
  Synthetic oligonucleotide; CAG chr2 60518315 60518334 60518331 +
ttagacctaccgttccatac

SEQ ID NO: 165982 - DNA, 20 bp, Artificial Sequence
  Synthetic oligonucleotide; CAG chr2 60518325 60518344 60518341 +
cgttccataccagtgtgtta

SEQ ID NO: 165983 - DNA, 20 bp, Artificial Sequence
  Synthetic oligonucleotide; AAG chr2 60518337 60518356 60518353 +
gtgtgttacagcctgtcatg

SEQ ID NO: 165984 - DNA, 20 bp, Artificial Sequence
  Synthetic oligonucleotide; CAG chr2 60518340 60518359 60518356 +
tgttacagcctgtcatgaag

SEQ ID NO: 165985 - DNA, 20 bp, Artificial Sequence
  Synthetic oligonucleotide; CAG chr2 60518346 60518365 60518362 +
agcctgtcatgaagcagact

SEQ ID NO: 165986 - DNA, 20 bp, Artificial Sequence
  Synthetic oligonucleotide; GAG chr2 60518348 60518367 60518364 +
cctgtcatgaagcagactca

SEQ ID NO: 165987 - DNA, 20 bp, Artificial Sequence
  Synthetic oligonucleotide; TGG chr2 60518355 60518374 60518371 +
tgaagcagactcagagaatt

SEQ ID NO: 165988 - DNA, 20 bp, Artificial Sequence
  Synthetic oligonucleotide; TAG chr2 60518366 60518385 60518382 +
cagagaatttggctactact

SEQ ID NO: 165989 - DNA, 20 bp, Artificial Sequence
  Synthetic oligonucleotide; TAG chr2 60518384 60518403 60518400 +
cttagtactaacatttaatt

SEQ ID NO: 165990 - DNA, 20 bp, Artificial Sequence
  Synthetic oligonucleotide; TAG chr2 60518404 60518423 60518420 +
tagttttaaaatgtctgcga

SEQ ID NO: 165991 - DNA, 20 bp, Artificial Sequence
  Synthetic oligonucleotide; GAG chr2 60518406 60518425 60518422 +
gttttaaaatgtctgcgata

SEQ ID NO: 165992 - DNA, 20 bp, Artificial Sequence
  Synthetic oligonucleotide; CAG chr2 60518409 60518428 60518425 +
ttaaaatgtctgcgatagag

SEQ ID NO: 165993 - DNA, 20 bp, Artificial Sequence
  Synthetic oligonucleotide; CAG chr2 60518415 60518434 60518431 +
tgtctgcgatagagcagatt

SEQ ID NO: 165994 - DNA, 20 bp, Artificial Sequence
  Synthetic oligonucleotide; AGG chr2 60518416 60518435 60518432 +
gtctgcgatagagcagattc

SEQ ID NO: 165995 - DNA, 20 bp, Artificial Sequence
  Synthetic oligonucleotide; AAG chr2 60518430 60518449 60518446 +
agattcaggattatgcctgt

SEQ ID NO: 165996 - DNA, 20 bp, Artificial Sequence
  Synthetic oligonucleotide; AAG chr2 60518469 60518488 60518485 +
cctgcatttaaatatgaata

SEQ ID NO: 165997 - DNA, 20 bp, Artificial Sequence
  Synthetic oligonucleotide; GAG chr2 60518471 60518490 60518487 +
tgcatttaaatatgaataaa

SEQ ID NO: 165998 - DNA, 20 bp, Artificial Sequence
  Synthetic oligonucleotide; GAG chr2 60518475 60518494 60518491 +
tttaaatatgaataaagagt

SEQ ID NO: 165999 - DNA, 20 bp, Artificial Sequence
  Synthetic oligonucleotide; CAG chr2 60518478 60518497 60518494 +
aaatatgaataaagagtgag

SEQ ID NO: 166000 - DNA, 20 bp, Artificial Sequence
  Synthetic oligonucleotide; AAG chr2 60518481 60518500 60518497 +
tatgaataaagagtgagcag

SEQ ID NO: 166001 - DNA, 20 bp, Artificial Sequence
  Synthetic oligonucleotide; AGG chr2 60518482 60518501 60518498 +
atgaataaagagtgagcaga

SEQ ID NO: 166002 - DNA, 20 bp, Artificial Sequence
  Synthetic oligonucleotide; GGG chr2 60518483 60518502 60518499 +
tgaataaagagtgagcagaa

SEQ ID NO: 166003 - DNA, 20 bp, Artificial Sequence
  Synthetic oligonucleotide; CAG chr2 60518488 60518507 60518504 +
aaagagtgagcagaagggac

SEQ ID NO: 166004 - DNA, 20 bp, Artificial Sequence
  Synthetic oligonucleotide; AGG chr2 60518489 60518508 60518505 +
aagagtgagcagaagggacc

SEQ ID NO: 166005 - DNA, 20 bp, Artificial Sequence
  Synthetic oligonucleotide; TGG chr2 60518498 60518517 60518514 +
cagaagggaccaggtaaaaa

SEQ ID NO: 166006 - DNA, 20 bp, Artificial Sequence
  Synthetic oligonucleotide; TGG chr2 60518505 60518524 60518521 +
gaccaggtaaaaatggcaca

SEQ ID NO: 166007 - DNA, 20 bp, Artificial Sequence
  Synthetic oligonucleotide; GGG chr2 60518506 60518525 60518522 +
accaggtaaaaatggcacat

SEQ ID NO: 166008 - DNA, 20 bp, Artificial Sequence
  Synthetic oligonucleotide; GAG chr2 60518508 60518527 60518524 +
caggtaaaaatggcacatgg

SEQ ID NO: 166009 - DNA, 20 bp, Artificial Sequence
  Synthetic oligonucleotide; AGG chr2 60518509 60518528 60518525 +
aggtaaaaatggcacatggg

SEQ ID NO: 166010 - DNA, 20 bp, Artificial Sequence
  Synthetic oligonucleotide; GGG chr2 60518510 60518529 60518526 +
ggtaaaaatggcacatggga

SEQ ID NO: 166011 - DNA, 20 bp, Artificial Sequence
  Synthetic oligonucleotide; TAG chr2 60518531 60518550 60518547 +
ggcatcgcacatgtgaattt

SEQ ID NO: 166012 - DNA, 20 bp, Artificial Sequence
  Synthetic oligonucleotide; AAG chr2 60518547 60518566 60518563 +
attttagcttcccacacgca

SEQ ID NO: 166013 - DNA, 20 bp, Artificial Sequence
  Synthetic oligonucleotide; AGG chr2 60518548 60518567 60518564 +
ttttagcttcccacacgcaa

SEQ ID NO: 166014 - DNA, 20 bp, Artificial Sequence
  Synthetic oligonucleotide; TGG chr2 60518553 60518572 60518569 +
gcttcccacacgcaaaggca

SEQ ID NO: 166015 - DNA, 20 bp, Artificial Sequence
  Synthetic oligonucleotide; GGG chr2 60518554 60518573 60518570 +
cttcccacacgcaaaggcat

SEQ ID NO: 166016 - DNA, 20 bp, Artificial Sequence
  Synthetic oligonucleotide; GGG chr2 60518555 60518574 60518571 +
ttcccacacgcaaaggcatg

SEQ ID NO: 166017 - DNA, 20 bp, Artificial Sequence
  Synthetic oligonucleotide; GGG chr2 60518556 60518575 60518572 +
tcccacacgcaaaggcatgg

SEQ ID NO: 166018 - DNA, 20 bp, Artificial Sequence
  Synthetic oligonucleotide; GGG chr2 60518557 60518576 60518573 +
cccacacgcaaaggcatggg

SEQ ID NO: 166019 - DNA, 20 bp, Artificial Sequence
  Synthetic oligonucleotide; AAG chr2 60518562 60518581 60518578 +
acgcaaaggcatggggggac

SEQ ID NO: 166020 - DNA, 20 bp, Artificial Sequence
  Synthetic oligonucleotide; AGG chr2 60518563 60518582 60518579 +
cgcaaaggcatggggggaca

SEQ ID NO: 166021 - DNA, 20 bp, Artificial Sequence
  Synthetic oligonucleotide; CAG chr2 60518566 60518585 60518582 +
aaaggcatggggggacaagg

SEQ ID NO: 166022 - DNA, 20 bp, Artificial Sequence
  Synthetic oligonucleotide; AGG chr2 60518567 60518586 60518583 +
aaggcatggggggacaaggc

SEQ ID NO: 166023 - DNA, 20 bp, Artificial Sequence
  Synthetic oligonucleotide; AAG chr2 60518570 60518589 60518586 +
gcatggggggacaaggcagg

SEQ ID NO: 166024 - DNA, 20 bp, Artificial Sequence
  Synthetic oligonucleotide; TAG chr2 60518581 60518600 60518597 +
caaggcaggaagcattgctc

SEQ ID NO: 166025 - DNA, 20 bp, Artificial Sequence
  Synthetic oligonucleotide; GAG chr2 60518588 60518607 60518604 +
ggaagcattgctctagatct

SEQ ID NO: 166026 - DNA, 20 bp, Artificial Sequence
  Synthetic oligonucleotide; CAG chr2 60518604 60518623 60518620 +
atctgagaatcaccacacac

SEQ ID NO: 166027 - DNA, 20 bp, Artificial Sequence
  Synthetic oligonucleotide; GAG chr2 60518606 60518625 60518622 +
ctgagaatcaccacacacca

SEQ ID NO: 166028 - DNA, 20 bp, Artificial Sequence
  Synthetic oligonucleotide; GAG chr2 60518608 60518627 60518624 +
gagaatcaccacacaccaga

SEQ ID NO: 166029 - DNA, 20 bp, Artificial Sequence
  Synthetic oligonucleotide; AGG chr2 60518609 60518628 60518625 +
agaatcaccacacaccagag

SEQ ID NO: 166030 - DNA, 20 bp, Artificial Sequence
  Synthetic oligonucleotide; GGG chr2 60518610 60518629 60518626 +
gaatcaccacacaccagaga

SEQ ID NO: 166031 - DNA, 20 bp, Artificial Sequence
  Synthetic oligonucleotide; TGG chr2 60518615 60518634 60518631 +
accacacaccagagagggca

SEQ ID NO: 166032 - DNA, 20 bp, Artificial Sequence
  Synthetic oligonucleotide; GGG chr2 60518616 60518635 60518632 +
ccacacaccagagagggcat

SEQ ID NO: 166033 - DNA, 20 bp, Artificial Sequence
  Synthetic oligonucleotide; GAG chr2 60518618 60518637 60518634 +
acacaccagagagggcatgg

SEQ ID NO: 166034 - DNA, 20 bp, Artificial Sequence
  Synthetic oligonucleotide; AGG chr2 60518619 60518638 60518635 +
cacaccagagagggcatggg

SEQ ID NO: 166035 - DNA, 20 bp, Artificial Sequence
  Synthetic oligonucleotide; CAG chr2 60518635 60518654 60518651 +
tgggaggtgacacacaaacc

SEQ ID NO: 166036 - DNA, 20 bp, Artificial Sequence
  Synthetic oligonucleotide; CAG chr2 60518638 60518657 60518654 +
gaggtgacacacaaacccag

SEQ ID NO: 166037 - DNA, 20 bp, Artificial Sequence
  Synthetic oligonucleotide; GAG chr2 60518640 60518659 60518656 +
ggtgacacacaaacccagca

SEQ ID NO: 166038 - DNA, 20 bp, Artificial Sequence
  Synthetic oligonucleotide; GAG chr2 60518649 60518668 60518665 +
caaacccagcagagaacgtt

SEQ ID NO: 166039 - DNA, 20 bp, Artificial Sequence
  Synthetic oligonucleotide; AAG chr2 60518653 60518672 60518669 +
cccagcagagaacgttgaga

SEQ ID NO: 166040 - DNA, 20 bp, Artificial Sequence
  Synthetic oligonucleotide; GAG chr2 60518655 60518674 60518671 +
cagcagagaacgttgagaaa

SEQ ID NO: 166041 - DNA, 20 bp, Artificial Sequence
  Synthetic oligonucleotide; AAG chr2 60518662 60518681 60518678 +
gaacgttgagaaagagtttt

SEQ ID NO: 166042 - DNA, 20 bp, Artificial Sequence
  Synthetic oligonucleotide; GAG chr2 60518664 60518683 60518680 +
acgttgagaaagagttttaa

SEQ ID NO: 166043 - DNA, 20 bp, Artificial Sequence
  Synthetic oligonucleotide; CAG chr2 60518679 60518698 60518695 +
tttaagagcctactcatcat

SEQ ID NO: 166044 - DNA, 20 bp, Artificial Sequence
  Synthetic oligonucleotide; GAG chr2 60518681 60518700 60518697 +
taagagcctactcatcatca

SEQ ID NO: 166045 - DNA, 20 bp, Artificial Sequence
  Synthetic oligonucleotide; AAG chr2 60518693 60518712 60518709 +
catcatcagagttcacttaa

SEQ ID NO: 166046 - DNA, 20 bp, Artificial Sequence
  Synthetic oligonucleotide; CAG chr2 60518702 60518721 60518718 +
agttcacttaaaagtccatc

SEQ ID NO: 166047 - DNA, 20 bp, Artificial Sequence
  Synthetic oligonucleotide; CAG chr2 60518708 60518727 60518724 +
cttaaaagtccatccagaat

SEQ ID NO: 166048 - DNA, 20 bp, Artificial Sequence
  Synthetic oligonucleotide; TGG chr2 60518715 60518734 60518731 +
gtccatccagaatcagaacg

SEQ ID NO: 166049 - DNA, 20 bp, Artificial Sequence
  Synthetic oligonucleotide; GGG chr2 60518716 60518735 60518732 +
tccatccagaatcagaacgt

SEQ ID NO: 166050 - DNA, 20 bp, Artificial Sequence
  Synthetic oligonucleotide; TGG chr2 60518720 60518739 60518736 +
tccagaatcagaacgtggga

SEQ ID NO: 166051 - DNA, 20 bp, Artificial Sequence
  Synthetic oligonucleotide; GGG chr2 60518721 60518740 60518737 +
ccagaatcagaacgtgggat

SEQ ID NO: 166052 - DNA, 20 bp, Artificial Sequence
  Synthetic oligonucleotide; GGG chr2 60518722 60518741 60518738 +
cagaatcagaacgtgggatg

SEQ ID NO: 166053 - DNA, 20 bp, Artificial Sequence
  Synthetic oligonucleotide; AAG chr2 60518731 60518750 60518747 +
aacgtgggatggggtgcccc

SEQ ID NO: 166054 - DNA, 20 bp, Artificial Sequence
  Synthetic oligonucleotide; AGG chr2 60518732 60518751 60518748 +
acgtgggatggggtgcccca

SEQ ID NO: 166055 - DNA, 20 bp, Artificial Sequence
  Synthetic oligonucleotide; TGG chr2 60518741 60518760 60518757 +
ggggtgccccaaggcattcc

SEQ ID NO: 166056 - DNA, 20 bp, Artificial Sequence
  Synthetic oligonucleotide; GGG chr2 60518742 60518761 60518758 +
gggtgccccaaggcattcct

SEQ ID NO: 166057 - DNA, 20 bp, Artificial Sequence
  Synthetic oligonucleotide; GGG chr2 60518743 60518762 60518759 +
ggtgccccaaggcattcctg

SEQ ID NO: 166058 - DNA, 20 bp, Artificial Sequence
  Synthetic oligonucleotide; GGG chr2 60518744 60518763 60518760 +
gtgccccaaggcattcctgg

SEQ ID NO: 166059 - DNA, 20 bp, Artificial Sequence
  Synthetic oligonucleotide; CGG chr2 60518748 60518767 60518764 +
cccaaggcattcctgggggc

SEQ ID NO: 166060 - DNA, 20 bp, Artificial Sequence
  Synthetic oligonucleotide; GGG chr2 60518749 60518768 60518765 +
ccaaggcattcctgggggcc

SEQ ID NO: 166061 - DNA, 20 bp, Artificial Sequence
  Synthetic oligonucleotide; TGG chr2 60518754 60518773 60518770 +
gcattcctgggggccgggcg

SEQ ID NO: 166062 - DNA, 20 bp, Artificial Sequence
  Synthetic oligonucleotide; AAG chr2 60518762 60518781 60518778 +
gggggccgggcgtggatttt

SEQ ID NO: 166063 - DNA, 20 bp, Artificial Sequence
  Synthetic oligonucleotide; AGG chr2 60518763 60518782 60518779 +
ggggccgggcgtggatttta

SEQ ID NO: 166064 - DNA, 20 bp, Artificial Sequence
  Synthetic oligonucleotide; AAG chr2 60518784 60518803 60518800 +
ggactcatcaattactgttc

SEQ ID NO: 166065 - DNA, 20 bp, Artificial Sequence
  Synthetic oligonucleotide; CAG chr2 60518789 60518808 60518805 +
catcaattactgttcaagtt

SEQ ID NO: 166066 - DNA, 20 bp, Artificial Sequence
  Synthetic oligonucleotide; AGG chr2 60518790 60518809 60518806 +
atcaattactgttcaagttc

SEQ ID NO: 166067 - DNA, 20 bp, Artificial Sequence
  Synthetic oligonucleotide; AAG chr2 60518795 60518814 60518811 +
ttactgttcaagttcaggtc

SEQ ID NO: 166068 - DNA, 20 bp, Artificial Sequence
  Synthetic oligonucleotide; TGG chr2 60518799 60518818 60518815 +
tgttcaagttcaggtcaagc

SEQ ID NO: 166069 - DNA, 20 bp, Artificial Sequence
  Synthetic oligonucleotide; TGG chr2 60518803 60518822 60518819 +
caagttcaggtcaagctgga

SEQ ID NO: 166070 - DNA, 20 bp, Artificial Sequence
  Synthetic oligonucleotide; TGG chr2 60518818 60518837 60518834 +
ctggatggacaccatccaca

SEQ ID NO: 166071 - DNA, 20 bp, Artificial Sequence
  Synthetic oligonucleotide; TGG chr2 60518831 60518850 60518847 +
atccacatggtgttgctcga

SEQ ID NO: 166072 - DNA, 20 bp, Artificial Sequence
  Synthetic oligonucleotide; GGG chr2 60518832 60518851 60518848 +
tccacatggtgttgctcgat

SEQ ID NO: 166073 - DNA, 20 bp, Artificial Sequence
  Synthetic oligonucleotide; AAG chr2 60518837 60518856 60518853 +
atggtgttgctcgatgggca

SEQ ID NO: 166074 - DNA, 20 bp, Artificial Sequence
  Synthetic oligonucleotide; AAG chr2 60518843 60518862 60518859 +
ttgctcgatgggcaaagatc

SEQ ID NO: 166075 - DNA, 20 bp, Artificial Sequence
  Synthetic oligonucleotide; GAG chr2 60518845 60518864 60518861 +
gctcgatgggcaaagatcaa

SEQ ID NO: 166076 - DNA, 20 bp, Artificial Sequence
  Synthetic oligonucleotide; AGG chr2 60518846 60518865 60518862 +
ctcgatgggcaaagatcaag

SEQ ID NO: 166077 - DNA, 20 bp, Artificial Sequence
  Synthetic oligonucleotide; CAG chr2 60518849 60518868 60518865 +
gatgggcaaagatcaagagg

SEQ ID NO: 166078 - DNA, 20 bp, Artificial Sequence
  Synthetic oligonucleotide; CAG chr2 60518863 60518882 60518879 +
aagaggcagtcgttcaccac

SEQ ID NO: 166079 - DNA, 20 bp, Artificial Sequence
  Synthetic oligonucleotide; TGG chr2 60518876 60518895 60518892 +
tcaccaccagccgtatttcc

SEQ ID NO: 166080 - DNA, 20 bp, Artificial Sequence
  Synthetic oligonucleotide; GGG chr2 60518877 60518896 60518893 +
caccaccagccgtatttcct

SEQ ID NO: 166081 - DNA, 20 bp, Artificial Sequence
  Synthetic oligonucleotide; GGG chr2 60518878 60518897 60518894 +
accaccagccgtatttcctg

SEQ ID NO: 166082 - DNA, 20 bp, Artificial Sequence
  Synthetic oligonucleotide; AAG chr2 60518908 60518927 60518924 +
ttactgacattctgtcattc

SEQ ID NO: 166083 - DNA, 20 bp, Artificial Sequence
  Synthetic oligonucleotide; AGG chr2 60518909 60518928 60518925 +
tactgacattctgtcattca

SEQ ID NO: 166084 - DNA, 20 bp, Artificial Sequence
  Synthetic oligonucleotide; TGG chr2 60518912 60518931 60518928 +
tgacattctgtcattcaagg

SEQ ID NO: 166085 - DNA, 20 bp, Artificial Sequence
  Synthetic oligonucleotide; GGG chr2 60518913 60518932 60518929 +
gacattctgtcattcaaggt

SEQ ID NO: 166086 - DNA, 20 bp, Artificial Sequence
  Synthetic oligonucleotide; AAG chr2 60518921 60518940 60518937 +
gtcattcaaggtgggtcctg

SEQ ID NO: 166087 - DNA, 20 bp, Artificial Sequence
  Synthetic oligonucleotide; CAG chr2 60518927 60518946 60518943 +
caaggtgggtcctgaagcca

SEQ ID NO: 166088 - DNA, 20 bp, Artificial Sequence
  Synthetic oligonucleotide; AAG chr2 60518931 60518950 60518947 +
gtgggtcctgaagccacagt

SEQ ID NO: 166089 - DNA, 20 bp, Artificial Sequence
  Synthetic oligonucleotide; CAG chr2 60518959 60518978 60518975 +
aatctgctccctacaatcca

SEQ ID NO: 166090 - DNA, 20 bp, Artificial Sequence
  Synthetic oligonucleotide; AAG chr2 60518965 60518984 60518981 +
ctccctacaatccacagcaa

SEQ ID NO: 166091 - DNA, 20 bp, Artificial Sequence
  Synthetic oligonucleotide; AGG chr2 60518966 60518985 60518982 +
tccctacaatccacagcaaa

SEQ ID NO: 166092 - DNA, 20 bp, Artificial Sequence
  Synthetic oligonucleotide; GAG chr2 60518968 60518987 60518984 +
cctacaatccacagcaaaag

SEQ ID NO: 166093 - DNA, 20 bp, Artificial Sequence
  Synthetic oligonucleotide; GAG chr2 60518970 60518989 60518986 +
tacaatccacagcaaaagga

SEQ ID NO: 166094 - DNA, 20 bp, Artificial Sequence
  Synthetic oligonucleotide; AAG chr2 60518985 60519004 60519001 +
aaggagagttccttctttta

SEQ ID NO: 166095 - DNA, 20 bp, Artificial Sequence
  Synthetic oligonucleotide; GAG chr2 60518987 60519006 60519003 +
ggagagttccttcttttaaa

SEQ ID NO: 166096 - DNA, 20 bp, Artificial Sequence
  Synthetic oligonucleotide; TGG chr2 60518993 60519012 60519009 +
ttccttcttttaaagagcga

SEQ ID NO: 166097 - DNA, 20 bp, Artificial Sequence
  Synthetic oligonucleotide; GAG chr2 60519015 60519034 60519031 +
gcacacatctctcaactctt

SEQ ID NO: 166098 - DNA, 20 bp, Artificial Sequence
  Synthetic oligonucleotide; GAG chr2 60519017 60519036 60519033 +
acacatctctcaactcttga

SEQ ID NO: 166099 - DNA, 20 bp, Artificial Sequence
  Synthetic oligonucleotide; TGG chr2 60519024 60519043 60519040 +
tctcaactcttgagagaaaa

SEQ ID NO: 166100 - DNA, 20 bp, Artificial Sequence
  Synthetic oligonucleotide; CAG chr2 60519028 60519047 60519044 +
aactcttgagagaaaatgga

SEQ ID NO: 166101 - DNA, 20 bp, Artificial Sequence
  Synthetic oligonucleotide; AAG chr2 60519031 60519050 60519047 +
tcttgagagaaaatggacag

SEQ ID NO: 166102 - DNA, 20 bp, Artificial Sequence
  Synthetic oligonucleotide; TGG chr2 60519034 60519053 60519050 +
tgagagaaaatggacagaag

SEQ ID NO: 166103 - DNA, 20 bp, Artificial Sequence
  Synthetic oligonucleotide; GGG chr2 60519035 60519054 60519051 +
gagagaaaatggacagaagt

SEQ ID NO: 166104 - DNA, 20 bp, Artificial Sequence
  Synthetic oligonucleotide; CAG chr2 60519056 60519075 60519072 +
ggatttttcaatcctgatac

SEQ ID NO: 166105 - DNA, 20 bp, Artificial Sequence
  Synthetic oligonucleotide; CAG chr2 60519059 60519078 60519075 +
tttttcaatcctgataccag

SEQ ID NO: 166106 - DNA, 20 bp, Artificial Sequence
  Synthetic oligonucleotide; AGG chr2 60519060 60519079 60519076 +
ttttcaatcctgataccagc

SEQ ID NO: 166107 - DNA, 20 bp, Artificial Sequence
  Synthetic oligonucleotide; CAG chr2 60519066 60519085 60519082 +
atcctgataccagcaggaaa

SEQ ID NO: 166108 - DNA, 20 bp, Artificial Sequence
  Synthetic oligonucleotide; AGG chr2 60519067 60519086 60519083 +
tcctgataccagcaggaaac

SEQ ID NO: 166109 - DNA, 20 bp, Artificial Sequence
  Synthetic oligonucleotide; GGG chr2 60519068 60519087 60519084 +
cctgataccagcaggaaaca

SEQ ID NO: 166110 - DNA, 20 bp, Artificial Sequence
  Synthetic oligonucleotide; GAG chr2 60519070 60519089 60519086 +
tgataccagcaggaaacagg

SEQ ID NO: 166111 - DNA, 20 bp, Artificial Sequence
  Synthetic oligonucleotide; TGG chr2 60519077 60519096 60519093 +
agcaggaaacagggagtctc

SEQ ID NO: 166112 - DNA, 20 bp, Artificial Sequence
  Synthetic oligonucleotide; TAG chr2 60519080 60519099 60519096 +
aggaaacagggagtctctgg

SEQ ID NO: 166113 - DNA, 20 bp, Artificial Sequence
  Synthetic oligonucleotide; AGG chr2 60519081 60519100 60519097 +
ggaaacagggagtctctggt

SEQ ID NO: 166114 - DNA, 20 bp, Artificial Sequence
  Synthetic oligonucleotide; AAG chr2 60519096 60519115 60519112 +
ctggtaggtactaccaaacc

SEQ ID NO: 166115 - DNA, 20 bp, Artificial Sequence
  Synthetic oligonucleotide; AAG chr2 60519099 60519118 60519115 +
gtaggtactaccaaaccaag

SEQ ID NO: 166116 - DNA, 20 bp, Artificial Sequence
  Synthetic oligonucleotide; AAG chr2 60519115 60519134 60519131 +
caagaagcttcttttctccc

SEQ ID NO: 166117 - DNA, 20 bp, Artificial Sequence
  Synthetic oligonucleotide; CAG chr2 60519123 60519142 60519139 +
ttcttttctcccaagtacac

SEQ ID NO: 166118 - DNA, 20 bp, Artificial Sequence
  Synthetic oligonucleotide; AGG chr2 60519124 60519143 60519140 +
tcttttctcccaagtacacc

SEQ ID NO: 166119 - DNA, 20 bp, Artificial Sequence
  Synthetic oligonucleotide; CAG chr2 60519142 60519161 60519158 +
ccaggaacccctttcaaata

SEQ ID NO: 166120 - DNA, 20 bp, Artificial Sequence
  Synthetic oligonucleotide; AGG chr2 60519143 60519162 60519159 +
caggaacccctttcaaatac

SEQ ID NO: 166121 - DNA, 20 bp, Artificial Sequence
  Synthetic oligonucleotide; AAG chr2 60519157 60519176 60519173 +
aaatacaggcgctacaaaaa

SEQ ID NO: 166122 - DNA, 20 bp, Artificial Sequence
  Synthetic oligonucleotide; TAG chr2 60519163 60519182 60519179 +
aggcgctacaaaaaaagaaa

SEQ ID NO: 166123 - DNA, 20 bp, Artificial Sequence
  Synthetic oligonucleotide; AGG chr2 60519164 60519183 60519180 +
ggcgctacaaaaaaagaaat

SEQ ID NO: 166124 - DNA, 20 bp, Artificial Sequence
  Synthetic oligonucleotide; AAG chr2 60519172 60519191 60519188 +
aaaaaaagaaataggtgtga

SEQ ID NO: 166125 - DNA, 20 bp, Artificial Sequence
  Synthetic oligonucleotide; CGG chr2 60519175 60519194 60519191 +
aaaagaaataggtgtgaaag

SEQ ID NO: 166126 - DNA, 20 bp, Artificial Sequence
  Synthetic oligonucleotide; GGG chr2 60519176 60519195 60519192 +
aaagaaataggtgtgaaagc

SEQ ID NO: 166127 - DNA, 20 bp, Artificial Sequence
  Synthetic oligonucleotide; GGG chr2 60519177 60519196 60519193 +
aagaaataggtgtgaaagcg

SEQ ID NO: 166128 - DNA, 20 bp, Artificial Sequence
  Synthetic oligonucleotide; AAG chr2 60519181 60519200 60519197 +
aataggtgtgaaagcggggc

SEQ ID NO: 166129 - DNA, 20 bp, Artificial Sequence
  Synthetic oligonucleotide; AAG chr2 60519185 60519204 60519201 +
ggtgtgaaagcggggcaaga

SEQ ID NO: 166130 - DNA, 20 bp, Artificial Sequence
  Synthetic oligonucleotide; AGG chr2 60519186 60519205 60519202 +
gtgtgaaagcggggcaagaa

SEQ ID NO: 166131 - DNA, 20 bp, Artificial Sequence
  Synthetic oligonucleotide; GGG chr2 60519187 60519206 60519203 +
tgtgaaagcggggcaagaaa

SEQ ID NO: 166132 - DNA, 20 bp, Artificial Sequence
  Synthetic oligonucleotide; GAG chr2 60519195 60519214 60519211 +
cggggcaagaaagggaacct

SEQ ID NO: 166133 - DNA, 20 bp, Artificial Sequence
  Synthetic oligonucleotide; AGG chr2 60519196 60519215 60519212 +
ggggcaagaaagggaacctg

SEQ ID NO: 166134 - DNA, 20 bp, Artificial Sequence
  Synthetic oligonucleotide; TGG chr2 60519218 60519237 60519234 +
gactatgcatgctctgtcta

SEQ ID NO: 166135 - DNA, 20 bp, Artificial Sequence
  Synthetic oligonucleotide; GGG chr2 60519219 60519238 60519235 +
actatgcatgctctgtctat

SEQ ID NO: 166136 - DNA, 20 bp, Artificial Sequence
  Synthetic oligonucleotide; AAG chr2 60519235 60519254 60519251 +
ctatgggtatcaacaccttt

SEQ ID NO: 166137 - DNA, 20 bp, Artificial Sequence
  Synthetic oligonucleotide; AGG chr2 60519236 60519255 60519252 +
tatgggtatcaacaccttta

SEQ ID NO: 166138 - DNA, 20 bp, Artificial Sequence
  Synthetic oligonucleotide; CGG chr2 60519246 60519265 60519262 +
aacacctttaaggcattttg

SEQ ID NO: 166139 - DNA, 20 bp, Artificial Sequence
  Synthetic oligonucleotide; GAG chr2 60519276 60519295 60519292 +
gattctataacctccatatt

SEQ ID NO: 166140 - DNA, 20 bp, Artificial Sequence
  Synthetic oligonucleotide; GAG chr2 60519278 60519297 60519294 +
ttctataacctccatattga

SEQ ID NO: 166141 - DNA, 20 bp, Artificial Sequence
  Synthetic oligonucleotide; CAG chr2 60519291 60519310 60519307 +
atattgagagacataaaaca

SEQ ID NO: 166142 - DNA, 20 bp, Artificial Sequence
  Synthetic oligonucleotide; CAG chr2 60519308 60519327 60519324 +
acacagaacattacacctgt

SEQ ID NO: 166143 - DNA, 20 bp, Artificial Sequence
  Synthetic oligonucleotide; AGG chr2 60519309 60519328 60519325 +
cacagaacattacacctgtc

SEQ ID NO: 166144 - DNA, 20 bp, Artificial Sequence
  Synthetic oligonucleotide; TGG chr2 60519315 60519334 60519331 +
acattacacctgtcaggtgc

SEQ ID NO: 166145 - DNA, 20 bp, Artificial Sequence
  Synthetic oligonucleotide; GGG chr2 60519316 60519335 60519332 +
cattacacctgtcaggtgct

SEQ ID NO: 166146 - DNA, 20 bp, Artificial Sequence
  Synthetic oligonucleotide; CAG chr2 60519333 60519352 60519349 +
gctgggccctgaactatctc

SEQ ID NO: 166147 - DNA, 20 bp, Artificial Sequence
  Synthetic oligonucleotide; AGG chr2 60519334 60519353 60519350 +
ctgggccctgaactatctcc

SEQ ID NO: 166148 - DNA, 20 bp, Artificial Sequence
  Synthetic oligonucleotide; CAG chr2 60519337 60519356 60519353 +
ggccctgaactatctccagg

SEQ ID NO: 166149 - DNA, 20 bp, Artificial Sequence
  Synthetic oligonucleotide; AAG chr2 60519344 60519363 60519360 +
aactatctccaggcagctga

SEQ ID NO: 166150 - DNA, 20 bp, Artificial Sequence
  Synthetic oligonucleotide; CAG chr2 60519348 60519367 60519364 +
atctccaggcagctgaaagt

SEQ ID NO: 166151 - DNA, 20 bp, Artificial Sequence
  Synthetic oligonucleotide; CAG chr2 60519356 60519375 60519372 +
gcagctgaaagtcagtacat

SEQ ID NO: 166152 - DNA, 20 bp, Artificial Sequence
  Synthetic oligonucleotide; AAG chr2 60519375 60519394 60519391 +
tcagctttttaatgatgtga

SEQ ID NO: 166153 - DNA, 20 bp, Artificial Sequence
  Synthetic oligonucleotide; AAG chr2 60519381 60519400 60519397 +
ttttaatgatgtgaaagtta

SEQ ID NO: 166154 - DNA, 20 bp, Artificial Sequence
  Synthetic oligonucleotide; TGG chr2 60519397 60519416 60519413 +
gttaaagattaaaaacatgt

SEQ ID NO: 166155 - DNA, 20 bp, Artificial Sequence
  Synthetic oligonucleotide; CAG chr2 60519415 60519434 60519431 +
gttggaacgcttactttatg

SEQ ID NO: 166156 - DNA, 20 bp, Artificial Sequence
  Synthetic oligonucleotide; AAG chr2 60519443 60519462 60519459 +
aaaatgtgtctataacctgt

SEQ ID NO: 166157 - DNA, 20 bp, Artificial Sequence
  Synthetic oligonucleotide; AGG chr2 60519444 60519463 60519460 +
aaatgtgtctataacctgta

SEQ ID NO: 166158 - DNA, 20 bp, Artificial Sequence
  Synthetic oligonucleotide; GAG chr2 60519446 60519465 60519462 +
atgtgtctataacctgtaag

SEQ ID NO: 166159 - DNA, 20 bp, Artificial Sequence
  Synthetic oligonucleotide; GAG chr2 60519448 60519467 60519464 +
gtgtctataacctgtaagga

SEQ ID NO: 166160 - DNA, 20 bp, Artificial Sequence
  Synthetic oligonucleotide; TGG chr2 60519452 60519471 60519468 +
ctataacctgtaaggagaga

SEQ ID NO: 166161 - DNA, 20 bp, Artificial Sequence
  Synthetic oligonucleotide; GGG chr2 60519453 60519472 60519469 +
tataacctgtaaggagagat

SEQ ID NO: 166162 - DNA, 20 bp, Artificial Sequence
  Synthetic oligonucleotide; TGG chr2 60519458 60519477 60519474 +
cctgtaaggagagatgggtg

SEQ ID NO: 166163 - DNA, 20 bp, Artificial Sequence
  Synthetic oligonucleotide; TAG chr2 60519468 60519487 60519484 +
gagatgggtgtggaacatcg

SEQ ID NO: 166164 - DNA, 20 bp, Artificial Sequence
  Synthetic oligonucleotide; AGG chr2 60519469 60519488 60519485 +
agatgggtgtggaacatcgt

SEQ ID NO: 166165 - DNA, 20 bp, Artificial Sequence
  Synthetic oligonucleotide; AAG chr2 60519475 60519494 60519491 +
gtgtggaacatcgtaggaaa

SEQ ID NO: 166166 - DNA, 20 bp, Artificial Sequence
  Synthetic oligonucleotide; AGG chr2 60519476 60519495 60519492 +
tgtggaacatcgtaggaaaa

SEQ ID NO: 166167 - DNA, 20 bp, Artificial Sequence
  Synthetic oligonucleotide; CAG chr2 60519496 60519515 60519512 +
aggtgactgcactcatgctg

SEQ ID NO: 166168 - DNA, 20 bp, Artificial Sequence
  Synthetic oligonucleotide; GAG chr2 60519498 60519517 60519514 +
gtgactgcactcatgctgca

SEQ ID NO: 166169 - DNA, 20 bp, Artificial Sequence
  Synthetic oligonucleotide; AAG chr2 60519508 60519527 60519524 +
tcatgctgcagagaaaaaat

SEQ ID NO: 166170 - DNA, 20 bp, Artificial Sequence
  Synthetic oligonucleotide; AGG chr2 60519509 60519528 60519525 +
catgctgcagagaaaaaata

SEQ ID NO: 166171 - DNA, 20 bp, Artificial Sequence
  Synthetic oligonucleotide; AAG chr2 60519576 60519595 60519592 +
tgcctgccttctttccttac

SEQ ID NO: 166172 - DNA, 20 bp, Artificial Sequence
  Synthetic oligonucleotide; GAG chr2 60519578 60519597 60519594 +
cctgccttctttccttacaa

SEQ ID NO: 166173 - DNA, 20 bp, Artificial Sequence
  Synthetic oligonucleotide; CAG chr2 60519613 60519632 60519629 +
aaatctgacgtgctttgcaa

SEQ ID NO: 166174 - DNA, 20 bp, Artificial Sequence
  Synthetic oligonucleotide; CAG chr2 60519616 60519635 60519632 +
tctgacgtgctttgcaacag

SEQ ID NO: 166175 - DNA, 20 bp, Artificial Sequence
  Synthetic oligonucleotide; AAG chr2 60519620 60519639 60519636 +
acgtgctttgcaacagcagt

SEQ ID NO: 166176 - DNA, 20 bp, Artificial Sequence
  Synthetic oligonucleotide; TGG chr2 60519631 60519650 60519647 +
aacagcagtaagttgaccac

SEQ ID NO: 166177 - DNA, 20 bp, Artificial Sequence
  Synthetic oligonucleotide; GAG chr2 60519633 60519652 60519649 +
cagcagtaagttgaccactg

SEQ ID NO: 166178 - DNA, 20 bp, Artificial Sequence
  Synthetic oligonucleotide; AAG chr2 60519637 60519656 60519653 +
agtaagttgaccactggaga

SEQ ID NO: 166179 - DNA, 20 bp, Artificial Sequence
  Synthetic oligonucleotide; GAG chr2 60519641 60519660 60519657 +
agttgaccactggagaaagt

SEQ ID NO: 166180 - DNA, 20 bp, Artificial Sequence
  Synthetic oligonucleotide; AGG chr2 60519642 60519661 60519658 +
gttgaccactggagaaagtg

SEQ ID NO: 166181 - DNA, 20 bp, Artificial Sequence
  Synthetic oligonucleotide; TGG chr2 60519646 60519665 60519662 +
accactggagaaagtgaggc

SEQ ID NO: 166182 - DNA, 20 bp, Artificial Sequence
  Synthetic oligonucleotide; TGG chr2 60519655 60519674 60519671 +
gaaagtgaggctggaaccac

SEQ ID NO: 166183 - DNA, 20 bp, Artificial Sequence
  Synthetic oligonucleotide; TAG chr2 60519665 60519684 60519681 +
ctggaaccactggaatcttg

SEQ ID NO: 166184 - DNA, 20 bp, Artificial Sequence
  Synthetic oligonucleotide; GAG chr2 60519674 60519693 60519690 +
ctggaatcttgtagatttct

SEQ ID NO: 166185 - DNA, 20 bp, Artificial Sequence
  Synthetic oligonucleotide; AGG chr2 60519675 60519694 60519691 +
tggaatcttgtagatttctg

SEQ ID NO: 166186 - DNA, 20 bp, Artificial Sequence
  Synthetic oligonucleotide; CAG chr2 60519679 60519698 60519695 +
atcttgtagatttctgaggc

SEQ ID NO: 166187 - DNA, 20 bp, Artificial Sequence
  Synthetic oligonucleotide; CAG chr2 60519699 60519718 60519715 +
cagttctgttctgacacatg

SEQ ID NO: 166188 - DNA, 20 bp, Artificial Sequence
  Synthetic oligonucleotide; TGG chr2 60519703 60519722 60519719 +
tctgttctgacacatgcagc

SEQ ID NO: 166189 - DNA, 20 bp, Artificial Sequence
  Synthetic oligonucleotide; GGG chr2 60519704 60519723 60519720 +
ctgttctgacacatgcagct

SEQ ID NO: 166190 - DNA, 20 bp, Artificial Sequence
  Synthetic oligonucleotide; GAG chr2 60519706 60519725 60519722 +
gttctgacacatgcagctgg

SEQ ID NO: 166191 - DNA, 20 bp, Artificial Sequence
  Synthetic oligonucleotide; TGG chr2 60519713 60519732 60519729 +
cacatgcagctgggagccac

SEQ ID NO: 166192 - DNA, 20 bp, Artificial Sequence
  Synthetic oligonucleotide; TAG chr2 60519718 60519737 60519734 +
gcagctgggagccactggtt

SEQ ID NO: 166193 - DNA, 20 bp, Artificial Sequence
  Synthetic oligonucleotide; AGG chr2 60519719 60519738 60519735 +
cagctgggagccactggttt

SEQ ID NO: 166194 - DNA, 20 bp, Artificial Sequence
  Synthetic oligonucleotide; TGG chr2 60519730 60519749 60519746 +
cactggtttaggaattcacg

SEQ ID NO: 166195 - DNA, 20 bp, Artificial Sequence
  Synthetic oligonucleotide; GGG chr2 60519731 60519750 60519747 +
actggtttaggaattcacgt

SEQ ID NO: 166196 - DNA, 20 bp, Artificial Sequence
  Synthetic oligonucleotide; TGG chr2 60519736 60519755 60519752 +
tttaggaattcacgtgggca

SEQ ID NO: 166197 - DNA, 20 bp, Artificial Sequence
  Synthetic oligonucleotide; GGG chr2 60519737 60519756 60519753 +
ttaggaattcacgtgggcat

SEQ ID NO: 166198 - DNA, 20 bp, Artificial Sequence
  Synthetic oligonucleotide; CAG chr2 60519752 60519771 60519768 +
ggcatgggactgtgcttatt

SEQ ID NO: 166199 - DNA, 20 bp, Artificial Sequence
  Synthetic oligonucleotide; AAG chr2 60519756 60519775 60519772 +
tgggactgtgcttattcaga

SEQ ID NO: 166200 - DNA, 20 bp, Artificial Sequence
  Synthetic oligonucleotide; AGG chr2 60519757 60519776 60519773 +
gggactgtgcttattcagaa

SEQ ID NO: 166201 - DNA, 20 bp, Artificial Sequence
  Synthetic oligonucleotide; GGG chr2 60519758 60519777 60519774 +
ggactgtgcttattcagaaa

SEQ ID NO: 166202 - DNA, 20 bp, Artificial Sequence
  Synthetic oligonucleotide; CAG chr2 60519765 60519784 60519781 +
gcttattcagaaagggctcc

SEQ ID NO: 166203 - DNA, 20 bp, Artificial Sequence
  Synthetic oligonucleotide; AAG chr2 60519804 60519823 60519820 +
cctaaattactccaatgaca

SEQ ID NO: 166204 - DNA, 20 bp, Artificial Sequence
  Synthetic oligonucleotide; CAG chr2 60519813 60519832 60519829 +
ctccaatgacaaagaaaact

SEQ ID NO: 166205 - DNA, 20 bp, Artificial Sequence
  Synthetic oligonucleotide; AAG chr2 60519818 60519837 60519834 +
atgacaaagaaaactcagtg

SEQ ID NO: 166206 - DNA, 20 bp, Artificial Sequence
  Synthetic oligonucleotide; AAG chr2 60519824 60519843 60519840 +
aagaaaactcagtgaagaca

SEQ ID NO: 166207 - DNA, 20 bp, Artificial Sequence
  Synthetic oligonucleotide; GAG chr2 60519826 60519845 60519842 +
gaaaactcagtgaagacaaa

SEQ ID NO: 166208 - DNA, 20 bp, Artificial Sequence
  Synthetic oligonucleotide; TAG chr2 60519839 60519858 60519855 +
agacaaagagatcgttttca

SEQ ID NO: 166209 - DNA, 20 bp, Artificial Sequence
  Synthetic oligonucleotide; AGG chr2 60519840 60519859 60519856 +
gacaaagagatcgttttcat

SEQ ID NO: 166210 - DNA, 20 bp, Artificial Sequence
  Synthetic oligonucleotide; CAG chr2 60519868 60519887 60519884 +
tcatttgccaatccataact

SEQ ID NO: 166211 - DNA, 20 bp, Artificial Sequence
  Synthetic oligonucleotide; AGG chr2 60519869 60519888 60519885 +
catttgccaatccataactc

SEQ ID NO: 166212 - DNA, 20 bp, Artificial Sequence
  Synthetic oligonucleotide; TGG chr2 60519878 60519897 60519894 +
atccataactcaggaattca

SEQ ID NO: 166213 - DNA, 20 bp, Artificial Sequence
  Synthetic oligonucleotide; TGG chr2 60519888 60519907 60519904 +
caggaattcatggctatgct

SEQ ID NO: 166214 - DNA, 20 bp, Artificial Sequence
  Synthetic oligonucleotide; TAG chr2 60519902 60519921 60519918 +
tatgcttggataattctctc

SEQ ID NO: 166215 - DNA, 20 bp, Artificial Sequence
  Synthetic oligonucleotide; TGG chr2 60519908 60519927 60519924 +
tggataattctctctagact

SEQ ID NO: 166216 - DNA, 20 bp, Artificial Sequence
  Synthetic oligonucleotide; GAG chr2 60519910 60519929 60519926 +
gataattctctctagacttg

SEQ ID NO: 166217 - DNA, 20 bp, Artificial Sequence
  Synthetic oligonucleotide; AAG chr2 60519919 60519938 60519935 +
ctctagacttggagtgttaa

SEQ ID NO: 166218 - DNA, 20 bp, Artificial Sequence
  Synthetic oligonucleotide; TAG chr2 60519930 60519949 60519946 +
gagtgttaaaagtttgcacc

SEQ ID NO: 166219 - DNA, 20 bp, Artificial Sequence
  Synthetic oligonucleotide; TGG chr2 60519950 60519969 60519966 +
tagttattctcccctctctc

SEQ ID NO: 166220 - DNA, 20 bp, Artificial Sequence
  Synthetic oligonucleotide; CAG chr2 60519953 60519972 60519969 +
ttattctcccctctctctgg

SEQ ID NO: 166221 - DNA, 20 bp, Artificial Sequence
  Synthetic oligonucleotide; AGG chr2 60519954 60519973 60519970 +
tattctcccctctctctggc

SEQ ID NO: 166222 - DNA, 20 bp, Artificial Sequence
  Synthetic oligonucleotide; GAG chr2 60519956 60519975 60519972 +
ttctcccctctctctggcag

SEQ ID NO: 166223 - DNA, 20 bp, Artificial Sequence
  Synthetic oligonucleotide; TGG chr2 60519970 60519989 60519986 +
tggcaggagaatcatgtcac

SEQ ID NO: 166224 - DNA, 20 bp, Artificial Sequence
  Synthetic oligonucleotide; AAG chr2 60519974 60519993 60519990 +
aggagaatcatgtcactggc

SEQ ID NO: 166225 - DNA, 20 bp, Artificial Sequence
  Synthetic oligonucleotide; CGG chr2 60520004 60520023 60520020 +
tgtatcctcttcaaataatt

SEQ ID NO: 166226 - DNA, 20 bp, Artificial Sequence
  Synthetic oligonucleotide; TAG chr2 60520058 60520077 60520074 +
gcacaaatgtgtgtatgata

SEQ ID NO: 166227 - DNA, 20 bp, Artificial Sequence
  Synthetic oligonucleotide; TGG chr2 60520066 60520085 60520082 +
gtgtgtatgatatagtatta

SEQ ID NO: 166228 - DNA, 20 bp, Artificial Sequence
  Synthetic oligonucleotide; CAG chr2 60520095 60520114 60520111 +
tttctgaaaattgaaaaatt

SEQ ID NO: 166229 - DNA, 20 bp, Artificial Sequence
  Synthetic oligonucleotide; AAG chr2 60520099 60520118 60520115 +
tgaaaattgaaaaattcaga

SEQ ID NO: 166230 - DNA, 20 bp, Artificial Sequence
  Synthetic oligonucleotide; AAG chr2 60520105 60520124 60520121 +
ttgaaaaattcagaaagcca

SEQ ID NO: 166231 - DNA, 20 bp, Artificial Sequence
  Synthetic oligonucleotide; TAG chr2 60520112 60520131 60520128 +
attcagaaagccaaagataa

SEQ ID NO: 166232 - DNA, 20 bp, Artificial Sequence
  Synthetic oligonucleotide; TGG chr2 60520128 60520147 60520144 +
ataatagaatataccttgcg

SEQ ID NO: 166233 - DNA, 20 bp, Artificial Sequence
  Synthetic oligonucleotide; AAG chr2 60520132 60520151 60520148 +
tagaatataccttgcgtggc

SEQ ID NO: 166234 - DNA, 20 bp, Artificial Sequence
  Synthetic oligonucleotide; AGG chr2 60520133 60520152 60520149 +
agaatataccttgcgtggca

SEQ ID NO: 166235 - DNA, 20 bp, Artificial Sequence
  Synthetic oligonucleotide; TAG chr2 60520145 60520164 60520161 +
gcgtggcaaggtatattgat

SEQ ID NO: 166236 - DNA, 20 bp, Artificial Sequence
  Synthetic oligonucleotide; AGG chr2 60520146 60520165 60520162 +
cgtggcaaggtatattgatt

SEQ ID NO: 166237 - DNA, 20 bp, Artificial Sequence
  Synthetic oligonucleotide; TAG chr2 60520149 60520168 60520165 +
ggcaaggtatattgattagg

SEQ ID NO: 166238 - DNA, 20 bp, Artificial Sequence
  Synthetic oligonucleotide; AGG chr2 60520150 60520169 60520166 +
gcaaggtatattgattaggt

SEQ ID NO: 166239 - DNA, 20 bp, Artificial Sequence
  Synthetic oligonucleotide; CAG chr2 60520182 60520201 60520198 +
taattgcaaaattatttatg

SEQ ID NO: 166240 - DNA, 20 bp, Artificial Sequence
  Synthetic oligonucleotide; AGG chr2 60520183 60520202 60520199 +
aattgcaaaattatttatgc

SEQ ID NO: 166241 - DNA, 20 bp, Artificial Sequence
  Synthetic oligonucleotide; GAG chr2 60520185 60520204 60520201 +
ttgcaaaattatttatgcag

SEQ ID NO: 166242 - DNA, 20 bp, Artificial Sequence
  Synthetic oligonucleotide; AAG chr2 60520206 60520225 60520222 +
agtattaaaattttcctcaa

SEQ ID NO: 166243 - DNA, 20 bp, Artificial Sequence
  Synthetic oligonucleotide; CAG chr2 60520213 60520232 60520229 +
aaattttcctcaaaagttcc

SEQ ID NO: 166244 - DNA, 20 bp, Artificial Sequence
  Synthetic oligonucleotide; AGG chr2 60520214 60520233 60520230 +
aattttcctcaaaagttccc

SEQ ID NO: 166245 - DNA, 20 bp, Artificial Sequence
  Synthetic oligonucleotide; TGG chr2 60520221 60520240 60520237 +
ctcaaaagttcccaggcaaa

SEQ ID NO: 166246 - DNA, 20 bp, Artificial Sequence
  Synthetic oligonucleotide; GGG chr2 60520222 60520241 60520238 +
tcaaaagttcccaggcaaat

SEQ ID NO: 166247 - DNA, 20 bp, Artificial Sequence
  Synthetic oligonucleotide; CAG chr2 60520263 60520282 60520279 +
ccttacaataaactcttctg

SEQ ID NO: 166248 - DNA, 20 bp, Artificial Sequence
  Synthetic oligonucleotide; AGG chr2 60520264 60520283 60520280 +
cttacaataaactcttctgc

SEQ ID NO: 166249 - DNA, 20 bp, Artificial Sequence
  Synthetic oligonucleotide; GAG chr2 60520280 60520299 60520296 +
ctgcaggttttgtttatttt

SEQ ID NO: 166250 - DNA, 20 bp, Artificial Sequence
  Synthetic oligonucleotide; AGG chr2 60520281 60520300 60520297 +
tgcaggttttgtttattttg

SEQ ID NO: 166251 - DNA, 20 bp, Artificial Sequence
  Synthetic oligonucleotide; AAG chr2 60520305 60520324 60520321 +
aacatttcactttttttttc

SEQ ID NO: 166252 - DNA, 20 bp, Artificial Sequence
  Synthetic oligonucleotide; GAG chr2 60520312 60520331 60520328 +
cactttttttttcaagacat

SEQ ID NO: 166253 - DNA, 20 bp, Artificial Sequence
  Synthetic oligonucleotide; AGG chr2 60520313 60520332 60520329 +
actttttttttcaagacatg

SEQ ID NO: 166254 - DNA, 20 bp, Artificial Sequence
  Synthetic oligonucleotide; CAG chr2 60520332 60520351 60520348 +
gaggtgtgaatgatgcaaaa

SEQ ID NO: 166255 - DNA, 20 bp, Artificial Sequence
  Synthetic oligonucleotide; TGG chr2 60520339 60520358 60520355 +
gaatgatgcaaaacagtatt

SEQ ID NO: 166256 - DNA, 20 bp, Artificial Sequence
  Synthetic oligonucleotide; CAG chr2 60520380 60520399 60520396 +
ttgcataatgcattactaat

SEQ ID NO: 166257 - DNA, 20 bp, Artificial Sequence
  Synthetic oligonucleotide; GAG chr2 60520384 60520403 60520400 +
ataatgcattactaatcagt

SEQ ID NO: 166258 - DNA, 20 bp, Artificial Sequence
  Synthetic oligonucleotide; TGG chr2 60520396 60520415 60520412 +
taatcagtgagtataaattc

SEQ ID NO: 166259 - DNA, 20 bp, Artificial Sequence
  Synthetic oligonucleotide; GAG chr2 60520398 60520417 60520414 +
atcagtgagtataaattctg

SEQ ID NO: 166260 - DNA, 20 bp, Artificial Sequence
  Synthetic oligonucleotide; GAG chr2 60520404 60520423 60520420 +
gagtataaattctggagtct

SEQ ID NO: 166261 - DNA, 20 bp, Artificial Sequence
  Synthetic oligonucleotide; AGG chr2 60520405 60520424 60520421 +
agtataaattctggagtctg

SEQ ID NO: 166262 - DNA, 20 bp, Artificial Sequence
  Synthetic oligonucleotide; AAG chr2 60520418 60520437 60520434 +
gagtctgaggacctgaaatc

SEQ ID NO: 166263 - DNA, 20 bp, Artificial Sequence
  Synthetic oligonucleotide; TAG chr2 60520443 60520462 60520459 +
ccaccaaattttttaaaatc

SEQ ID NO: 166264 - DNA, 20 bp, Artificial Sequence
  Synthetic oligonucleotide; AAG chr2 60520453 60520472 60520469 +
ttttaaaatctagattataa

SEQ ID NO: 166265 - DNA, 20 bp, Artificial Sequence
  Synthetic oligonucleotide; AAG chr2 60520458 60520477 60520474 +
aaatctagattataaaagta

SEQ ID NO: 166266 - DNA, 20 bp, Artificial Sequence
  Synthetic oligonucleotide; GAG chr2 60520460 60520479 60520476 +
atctagattataaaagtaaa

SEQ ID NO: 166267 - DNA, 20 bp, Artificial Sequence
  Synthetic oligonucleotide; CGG chr2 60520473 60520492 60520489 +
aagtaaagagcatcaccctt

SEQ ID NO: 166268 - DNA, 20 bp, Artificial Sequence
  Synthetic oligonucleotide; TGG chr2 60520476 60520495 60520492 +
taaagagcatcacccttcgg

SEQ ID NO: 166269 - DNA, 20 bp, Artificial Sequence
  Synthetic oligonucleotide; GGG chr2 60520477 60520496 60520493 +
aaagagcatcacccttcggt

SEQ ID NO: 166270 - DNA, 20 bp, Artificial Sequence
  Synthetic oligonucleotide; AAG chr2 60520520 60520539 60520536 +
cacattcgcattccgtttat

SEQ ID NO: 166271 - DNA, 20 bp, Artificial Sequence
  Synthetic oligonucleotide; AAG chr2 60520523 60520542 60520539 +
attcgcattccgtttataag

SEQ ID NO: 166272 - DNA, 20 bp, Artificial Sequence
  Synthetic oligonucleotide; AGG chr2 60520524 60520543 60520540 +
ttcgcattccgtttataaga

SEQ ID NO: 166273 - DNA, 20 bp, Artificial Sequence
  Synthetic oligonucleotide; GAG chr2 60520526 60520545 60520542 +
cgcattccgtttataagaag

SEQ ID NO: 166274 - DNA, 20 bp, Artificial Sequence
  Synthetic oligonucleotide; CAG chr2 60520541 60520560 60520557 +
agaaggagaaattatcctca

SEQ ID NO: 166275 - DNA, 20 bp, Artificial Sequence
  Synthetic oligonucleotide; GAG chr2 60520543 60520562 60520559 +
aaggagaaattatcctcaca

SEQ ID NO: 166276 - DNA, 20 bp, Artificial Sequence
  Synthetic oligonucleotide; GAG chr2 60520552 60520571 60520568 +
ttatcctcacagagttttct

SEQ ID NO: 166277 - DNA, 20 bp, Artificial Sequence
  Synthetic oligonucleotide; AGG chr2 60520553 60520572 60520569 +
tatcctcacagagttttctg

SEQ ID NO: 166278 - DNA, 20 bp, Artificial Sequence
  Synthetic oligonucleotide; AAG chr2 60520566 60520585 60520582 +
ttttctgaggaaaattaaat

SEQ ID NO: 166279 - DNA, 20 bp, Artificial Sequence
  Synthetic oligonucleotide; TGG chr2 60520569 60520588 60520585 +
tctgaggaaaattaaataag

SEQ ID NO: 166280 - DNA, 20 bp, Artificial Sequence
  Synthetic oligonucleotide; GAG chr2 60520610 60520629 60520626 +
ttgctctgactcaacactat

SEQ ID NO: 166281 - DNA, 20 bp, Artificial Sequence
  Synthetic oligonucleotide; AGG chr2 60520611 60520630 60520627 +
tgctctgactcaacactatg

SEQ ID NO: 166282 - DNA, 20 bp, Artificial Sequence
  Synthetic oligonucleotide; AAG chr2 60520617 60520636 60520633 +
gactcaacactatgaggcat

SEQ ID NO: 166283 - DNA, 20 bp, Artificial Sequence
  Synthetic oligonucleotide; AGG chr2 60520618 60520637 60520634 +
actcaacactatgaggcata

SEQ ID NO: 166284 - DNA, 20 bp, Artificial Sequence
  Synthetic oligonucleotide; TAG chr2 60520632 60520651 60520648 +
ggcataaggtcctaaattca

SEQ ID NO: 166285 - DNA, 20 bp, Artificial Sequence
  Synthetic oligonucleotide; AGG chr2 60520633 60520652 60520649 +
gcataaggtcctaaattcat

SEQ ID NO: 166286 - DNA, 20 bp, Artificial Sequence
  Synthetic oligonucleotide; CAG chr2 60520644 60520663 60520660 +
taaattcataggcacaacca

SEQ ID NO: 166287 - DNA, 20 bp, Artificial Sequence
  Synthetic oligonucleotide; AAG chr2 60520647 60520666 60520663 +
attcataggcacaaccacag

SEQ ID NO: 166288 - DNA, 20 bp, Artificial Sequence
  Synthetic oligonucleotide; AAG chr2 60520654 60520673 60520670 +
ggcacaaccacagaagcacc

SEQ ID NO: 166289 - DNA, 20 bp, Artificial Sequence
  Synthetic oligonucleotide; AGG chr2 60520655 60520674 60520671 +
gcacaaccacagaagcacca

SEQ ID NO: 166290 - DNA, 20 bp, Artificial Sequence
  Synthetic oligonucleotide; GAG chr2 60520657 60520676 60520673 +
acaaccacagaagcaccaag

SEQ ID NO: 166291 - DNA, 20 bp, Artificial Sequence
  Synthetic oligonucleotide; GAG chr2 60520659 60520678 60520675 +
aaccacagaagcaccaagga

SEQ ID NO: 166292 - DNA, 20 bp, Artificial Sequence
  Synthetic oligonucleotide; AAG chr2 60520664 60520683 60520680 +
cagaagcaccaaggagagtg

SEQ ID NO: 166293 - DNA, 20 bp, Artificial Sequence
  Synthetic oligonucleotide; AAG chr2 60520681 60520700 60520697 +
gtgaagatatttgcatcaaa

SEQ ID NO: 166294 - DNA, 20 bp, Artificial Sequence
  Synthetic oligonucleotide; GAG chr2 60520683 60520702 60520699 +
gaagatatttgcatcaaaaa

SEQ ID NO: 166295 - DNA, 20 bp, Artificial Sequence
  Synthetic oligonucleotide; CAG chr2 60520686 60520705 60520702 +
gatatttgcatcaaaaagag

SEQ ID NO: 166296 - DNA, 20 bp, Artificial Sequence
  Synthetic oligonucleotide; CAG chr2 60520690 60520709 60520706 +
tttgcatcaaaaagagcaga

SEQ ID NO: 166297 - DNA, 20 bp, Artificial Sequence
  Synthetic oligonucleotide; TGG chr2 60520714 60520733 60520730 +
cccccacccccaccccatgt

SEQ ID NO: 166298 - DNA, 20 bp, Artificial Sequence
  Synthetic oligonucleotide; CGG chr2 60520724 60520743 60520740 +
caccccatgttggtcgccta

SEQ ID NO: 166299 - DNA, 20 bp, Artificial Sequence
  Synthetic oligonucleotide; CAG chr2 60520733 60520752 60520749 +
ttggtcgcctacggaatcta

SEQ ID NO: 166300 - DNA, 20 bp, Artificial Sequence
  Synthetic oligonucleotide; AGG chr2 60520734 60520753 60520750 +
tggtcgcctacggaatctac

SEQ ID NO: 166301 - DNA, 20 bp, Artificial Sequence
  Synthetic oligonucleotide; AAG chr2 60520743 60520762 60520759 +
acggaatctacaggaatctg

SEQ ID NO: 166302 - DNA, 20 bp, Artificial Sequence
  Synthetic oligonucleotide; AGG chr2 60520744 60520763 60520760 +
cggaatctacaggaatctga

SEQ ID NO: 166303 - DNA, 20 bp, Artificial Sequence
  Synthetic oligonucleotide; GGG chr2 60520745 60520764 60520761 +
ggaatctacaggaatctgaa

SEQ ID NO: 166304 - DNA, 20 bp, Artificial Sequence
  Synthetic oligonucleotide; GGG chr2 60520746 60520765 60520762 +
gaatctacaggaatctgaag

SEQ ID NO: 166305 - DNA, 20 bp, Artificial Sequence
  Synthetic oligonucleotide; CAG chr2 60520749 60520768 60520765 +
tctacaggaatctgaagggg

SEQ ID NO: 166306 - DNA, 20 bp, Artificial Sequence
  Synthetic oligonucleotide; CAG chr2 60520753 60520772 60520769 +
caggaatctgaaggggcagc

SEQ ID NO: 166307 - DNA, 20 bp, Artificial Sequence
  Synthetic oligonucleotide; CAG chr2 60520778 60520797 60520794 +
attctgcctataccacccat

SEQ ID NO: 166308 - DNA, 20 bp, Artificial Sequence
  Synthetic oligonucleotide; CAG chr2 60520783 60520802 60520799 +
gcctataccacccatcagat

SEQ ID NO: 166309 - DNA, 20 bp, Artificial Sequence
  Synthetic oligonucleotide; CAG chr2 60520822 60520841 60520838 +
aaaccacccatgcccttctc

SEQ ID NO: 166310 - DNA, 20 bp, Artificial Sequence
  Synthetic oligonucleotide; TGG chr2 60520825 60520844 60520841 +
ccacccatgcccttctccag

SEQ ID NO: 166311 - DNA, 20 bp, Artificial Sequence
  Synthetic oligonucleotide; GGG chr2 60520826 60520845 60520842 +
cacccatgcccttctccagt

SEQ ID NO: 166312 - DNA, 20 bp, Artificial Sequence
  Synthetic oligonucleotide; CGG chr2 60520836 60520855 60520852 +
cttctccagtgggttcccac

SEQ ID NO: 166313 - DNA, 20 bp, Artificial Sequence
  Synthetic oligonucleotide; AAG chr2 60520850 60520869 60520866 +
tcccaccggtgttttcgtgc

SEQ ID NO: 166314 - DNA, 20 bp, Artificial Sequence
  Synthetic oligonucleotide; TAG chr2 60520855 60520874 60520871 +
ccggtgttttcgtgcaagct

SEQ ID NO: 166315 - DNA, 20 bp, Artificial Sequence
  Synthetic oligonucleotide; CAG chr2 60520869 60520888 60520885 +
caagcttagccccttctttg

SEQ ID NO: 166316 - DNA, 20 bp, Artificial Sequence
  Synthetic oligonucleotide; AAG chr2 60520877 60520896 60520893 +
gccccttctttgcagaaaaa

SEQ ID NO: 166317 - DNA, 20 bp, Artificial Sequence
  Synthetic oligonucleotide; CAG chr2 60520895 60520914 60520911 +
aaaagatattgatgtgccaa

SEQ ID NO: 166318 - DNA, 20 bp, Artificial Sequence
  Synthetic oligonucleotide; TAG chr2 60520898 60520917 60520914 +
agatattgatgtgccaacag

SEQ ID NO: 166319 - DNA, 20 bp, Artificial Sequence
  Synthetic oligonucleotide; AAG chr2 60520902 60520921 60520918 +
attgatgtgccaacagtaga

SEQ ID NO: 166320 - DNA, 20 bp, Artificial Sequence
  Synthetic oligonucleotide; AAG chr2 60520905 60520924 60520921 +
gatgtgccaacagtagaaag

SEQ ID NO: 166321 - DNA, 20 bp, Artificial Sequence
  Synthetic oligonucleotide; CAG chr2 60520920 60520939 60520936 +
gaaagaagaaaaaattattc

SEQ ID NO: 166322 - DNA, 20 bp, Artificial Sequence
  Synthetic oligonucleotide; CAG chr2 60520947 60520966 60520963 +
gtacacaacctttgtcaacc

SEQ ID NO: 166323 - DNA, 20 bp, Artificial Sequence
  Synthetic oligonucleotide; AAG chr2 60520962 60520981 60520978 +
caacccagcatgataaaacc

SEQ ID NO: 166324 - DNA, 20 bp, Artificial Sequence
  Synthetic oligonucleotide; TGG chr2 60520967 60520986 60520983 +
cagcatgataaaaccaagtc

SEQ ID NO: 166325 - DNA, 20 bp, Artificial Sequence
  Synthetic oligonucleotide; GGG chr2 60520968 60520987 60520984 +
agcatgataaaaccaagtct

SEQ ID NO: 166326 - DNA, 20 bp, Artificial Sequence
  Synthetic oligonucleotide; TGG chr2 60520994 60521013 60521010 +
ctatttgtctaaacactttt

SEQ ID NO: 166327 - DNA, 20 bp, Artificial Sequence
  Synthetic oligonucleotide; AAG chr2 60520998 60521017 60521014 +
ttgtctaaacactttttgga

SEQ ID NO: 166328 - DNA, 20 bp, Artificial Sequence
  Synthetic oligonucleotide; AGG chr2 60520999 60521018 60521015 +
tgtctaaacactttttggaa

SEQ ID NO: 166329 - DNA, 20 bp, Artificial Sequence
  Synthetic oligonucleotide; GGG chr2 60521000 60521019 60521016 +
gtctaaacactttttggaaa

SEQ ID NO: 166330 - DNA, 20 bp, Artificial Sequence
  Synthetic oligonucleotide; TGG chr2 60521009 60521028 60521025 +
ctttttggaaagggatgaaa

SEQ ID NO: 166331 - DNA, 20 bp, Artificial Sequence
  Synthetic oligonucleotide; GAG chr2 60521011 60521030 60521027 +
ttttggaaagggatgaaatg

SEQ ID NO: 166332 - DNA, 20 bp, Artificial Sequence
  Synthetic oligonucleotide; GAG chr2 60521013 60521032 60521029 +
ttggaaagggatgaaatgga

SEQ ID NO: 166333 - DNA, 20 bp, Artificial Sequence
  Synthetic oligonucleotide; AGG chr2 60521014 60521033 60521030 +
tggaaagggatgaaatggag

SEQ ID NO: 166334 - DNA, 20 bp, Artificial Sequence
  Synthetic oligonucleotide; AAG chr2 60521018 60521037 60521034 +
aagggatgaaatggagagga

SEQ ID NO: 166335 - DNA, 20 bp, Artificial Sequence
  Synthetic oligonucleotide; AGG chr2 60521019 60521038 60521035 +
agggatgaaatggagaggaa

SEQ ID NO: 166336 - DNA, 20 bp, Artificial Sequence
  Synthetic oligonucleotide; AAG chr2 60521024 60521043 60521040 +
tgaaatggagaggaaaggaa

SEQ ID NO: 166337 - DNA, 20 bp, Artificial Sequence
  Synthetic oligonucleotide; AGG chr2 60521025 60521044 60521041 +
gaaatggagaggaaaggaaa

SEQ ID NO: 166338 - DNA, 20 bp, Artificial Sequence
  Synthetic oligonucleotide; AAG chr2 60521028 60521047 60521044 +
atggagaggaaaggaaaagg

SEQ ID NO: 166339 - DNA, 20 bp, Artificial Sequence
  Synthetic oligonucleotide; TAG chr2 60521033 60521052 60521049 +
gaggaaaggaaaaggaagtg

SEQ ID NO: 166340 - DNA, 20 bp, Artificial Sequence
  Synthetic oligonucleotide; TAG chr2 60521038 60521057 60521054 +
aaggaaaaggaagtgtagcc

SEQ ID NO: 166341 - DNA, 20 bp, Artificial Sequence
  Synthetic oligonucleotide; TGG chr2 60521041 60521060 60521057 +
gaaaaggaagtgtagcctag

SEQ ID NO: 166342 - DNA, 20 bp, Artificial Sequence
  Synthetic oligonucleotide; CAG chr2 60521045 60521064 60521061 +
aggaagtgtagcctagtggt

SEQ ID NO: 166343 - DNA, 20 bp, Artificial Sequence
  Synthetic oligonucleotide; GAG chr2 60521119 60521138 60521135 +
acacactcacacaaatcctt

SEQ ID NO: 166344 - DNA, 20 bp, Artificial Sequence
  Synthetic oligonucleotide; AGG chr2 60521120 60521139 60521136 +
cacactcacacaaatccttg

SEQ ID NO: 166345 - DNA, 20 bp, Artificial Sequence
  Synthetic oligonucleotide; GGG chr2 60521121 60521140 60521137 +
acactcacacaaatccttga

SEQ ID NO: 166346 - DNA, 20 bp, Artificial Sequence
  Synthetic oligonucleotide; CAG chr2 60521127 60521146 60521143 +
acacaaatccttgagggtgc

SEQ ID NO: 166347 - DNA, 20 bp, Artificial Sequence
  Synthetic oligonucleotide; AGG chr2 60521128 60521147 60521144 +
cacaaatccttgagggtgcc

SEQ ID NO: 166348 - DNA, 20 bp, Artificial Sequence
  Synthetic oligonucleotide; CAG chr2 60521145 60521164 60521161 +
gccaggttacatttctacaa

SEQ ID NO: 166349 - DNA, 20 bp, Artificial Sequence
  Synthetic oligonucleotide; CAG chr2 60521169 60521188 60521185 +
tgccttccattgtctactgc

SEQ ID NO: 166350 - DNA, 20 bp, Artificial Sequence
  Synthetic oligonucleotide; AAG chr2 60521174 60521193 60521190 +
tccattgtctactgccagtg

SEQ ID NO: 166351 - DNA, 20 bp, Artificial Sequence
  Synthetic oligonucleotide; CAG chr2 60521183 60521202 60521199 +
tactgccagtgaagccaaac

SEQ ID NO: 166352 - DNA, 20 bp, Artificial Sequence
  Synthetic oligonucleotide; AAG chr2 60521217 60521236 60521233 +
atttaatctgctgtaaaccc

SEQ ID NO: 166353 - DNA, 20 bp, Artificial Sequence
  Synthetic oligonucleotide; CAG chr2 60521223 60521242 60521239 +
tctgctgtaaacccaagtat

SEQ ID NO: 166354 - DNA, 20 bp, Artificial Sequence
  Synthetic oligonucleotide; AGG chr2 60521224 60521243 60521240 +
ctgctgtaaacccaagtatc

SEQ ID NO: 166355 - DNA, 20 bp, Artificial Sequence
  Synthetic oligonucleotide; TAG chr2 60521231 60521250 60521247 +
aaacccaagtatcaggcact

SEQ ID NO: 166356 - DNA, 20 bp, Artificial Sequence
  Synthetic oligonucleotide; TGG chr2 60521235 60521254 60521251 +
ccaagtatcaggcacttaga

SEQ ID NO: 166357 - DNA, 20 bp, Artificial Sequence
  Synthetic oligonucleotide; CAG chr2 60521238 60521257 60521254 +
agtatcaggcacttagatgg

SEQ ID NO: 166358 - DNA, 20 bp, Artificial Sequence
  Synthetic oligonucleotide; AAG chr2 60521245 60521264 60521261 +
ggcacttagatggcagctaa

SEQ ID NO: 166359 - DNA, 20 bp, Artificial Sequence
  Synthetic oligonucleotide; CAG chr2 60521257 60521276 60521273 +
gcagctaaaagcgccactct

SEQ ID NO: 166360 - DNA, 20 bp, Artificial Sequence
  Synthetic oligonucleotide; GAG chr2 60521266 60521285 60521282 +
agcgccactctcagataact

SEQ ID NO: 166361 - DNA, 20 bp, Artificial Sequence
  Synthetic oligonucleotide; TAG chr2 60521285 60521304 60521301 +
tgagtgacacttgctaataa

SEQ ID NO: 166362 - DNA, 20 bp, Artificial Sequence
  Synthetic oligonucleotide; AAG chr2 60521298 60521317 60521314 +
ctaataatagcctctgtgtg

SEQ ID NO: 166363 - DNA, 20 bp, Artificial Sequence
  Synthetic oligonucleotide; GAG chr2 60521302 60521321 60521318 +
taatagcctctgtgtgaagc

SEQ ID NO: 166364 - DNA, 20 bp, Artificial Sequence
  Synthetic oligonucleotide; GAG chr2 60521304 60521323 60521320 +
atagcctctgtgtgaagcga

SEQ ID NO: 166365 - DNA, 20 bp, Artificial Sequence
  Synthetic oligonucleotide; GAG chr2 60521306 60521325 60521322 +
agcctctgtgtgaagcgaga

SEQ ID NO: 166366 - DNA, 20 bp, Artificial Sequence
  Synthetic oligonucleotide; GAG chr2 60521308 60521327 60521324 +
cctctgtgtgaagcgagaga

SEQ ID NO: 166367 - DNA, 20 bp, Artificial Sequence
  Synthetic oligonucleotide; CGG chr2 60521311 60521330 60521327 +
ctgtgtgaagcgagagagag

SEQ ID NO: 166368 - DNA, 20 bp, Artificial Sequence
  Synthetic oligonucleotide; CAG chr2 60521328 60521347 60521344 +
gagcggacattttgtaaaac

SEQ ID NO: 166369 - DNA, 20 bp, Artificial Sequence
  Synthetic oligonucleotide; GAG chr2 60521330 60521349 60521346 +
gcggacattttgtaaaacca

SEQ ID NO: 166370 - DNA, 20 bp, Artificial Sequence
  Synthetic oligonucleotide; AGG chr2 60521331 60521350 60521347 +
cggacattttgtaaaaccag

SEQ ID NO: 166371 - DNA, 20 bp, Artificial Sequence
  Synthetic oligonucleotide; GGG chr2 60521332 60521351 60521348 +
ggacattttgtaaaaccaga

SEQ ID NO: 166372 - DNA, 20 bp, Artificial Sequence
  Synthetic oligonucleotide; CGG chr2 60521338 60521357 60521354 +
tttgtaaaaccagagggacc

SEQ ID NO: 166373 - DNA, 20 bp, Artificial Sequence
  Synthetic oligonucleotide; GGG chr2 60521339 60521358 60521355 +
ttgtaaaaccagagggaccc

SEQ ID NO: 166374 - DNA, 20 bp, Artificial Sequence
  Synthetic oligonucleotide; TGG chr2 60521344 60521363 60521360 +
aaaccagagggacccgggcc

SEQ ID NO: 166375 - DNA, 20 bp, Artificial Sequence
  Synthetic oligonucleotide; GGG chr2 60521345 60521364 60521361 +
aaccagagggacccgggcct

SEQ ID NO: 166376 - DNA, 20 bp, Artificial Sequence
  Synthetic oligonucleotide; TGG chr2 60521350 60521369 60521366 +
gagggacccgggcctgggcc

SEQ ID NO: 166377 - DNA, 20 bp, Artificial Sequence
  Synthetic oligonucleotide; GGG chr2 60521351 60521370 60521367 +
agggacccgggcctgggcct

SEQ ID NO: 166378 - DNA, 20 bp, Artificial Sequence
  Synthetic oligonucleotide; TGG chr2 60521356 60521375 60521372 +
cccgggcctgggcctgggcc

SEQ ID NO: 166379 - DNA, 20 bp, Artificial Sequence
  Synthetic oligonucleotide; GGG chr2 60521357 60521376 60521373 +
ccgggcctgggcctgggcct

SEQ ID NO: 166380 - DNA, 20 bp, Artificial Sequence
  Synthetic oligonucleotide; TGG chr2 60521362 60521381 60521378 +
cctgggcctgggcctgggtc

SEQ ID NO: 166381 - DNA, 20 bp, Artificial Sequence
  Synthetic oligonucleotide; GGG chr2 60521363 60521382 60521379 +
ctgggcctgggcctgggtct

SEQ ID NO: 166382 - DNA, 20 bp, Artificial Sequence
  Synthetic oligonucleotide; TGG chr2 60521368 60521387 60521384 +
cctgggcctgggtctgggaa

SEQ ID NO: 166383 - DNA, 20 bp, Artificial Sequence
  Synthetic oligonucleotide; TGG chr2 60521378 60521397 60521394 +
ggtctgggaatggtgtgatg

SEQ ID NO: 166384 - DNA, 20 bp, Artificial Sequence
  Synthetic oligonucleotide; TAG chr2 60521382 60521401 60521398 +
tgggaatggtgtgatgtggt

SEQ ID NO: 166385 - DNA, 20 bp, Artificial Sequence
  Synthetic oligonucleotide; AGG chr2 60521383 60521402 60521399 +
gggaatggtgtgatgtggtt

SEQ ID NO: 166386 - DNA, 20 bp, Artificial Sequence
  Synthetic oligonucleotide; CAG chr2 60521387 60521406 60521403 +
atggtgtgatgtggttaggc

SEQ ID NO: 166387 - DNA, 20 bp, Artificial Sequence
  Synthetic oligonucleotide; CAG chr2 60521393 60521412 60521409 +
tgatgtggttaggccagtct

SEQ ID NO: 166388 - DNA, 20 bp, Artificial Sequence
  Synthetic oligonucleotide; CAG chr2 60521400 60521419 60521416 +
gttaggccagtctcagcttc

SEQ ID NO: 166389 - DNA, 20 bp, Artificial Sequence
  Synthetic oligonucleotide; AGG chr2 60521401 60521420 60521417 +
ttaggccagtctcagcttcc

SEQ ID NO: 166390 - DNA, 20 bp, Artificial Sequence
  Synthetic oligonucleotide; CAG chr2 60521404 60521423 60521420 +
ggccagtctcagcttccagg

SEQ ID NO: 166391 - DNA, 20 bp, Artificial Sequence
  Synthetic oligonucleotide; CAG chr2 60521407 60521426 60521423 +
cagtctcagcttccaggcag

SEQ ID NO: 166392 - DNA, 20 bp, Artificial Sequence
  Synthetic oligonucleotide; CGG chr2 60521413 60521432 60521429 +
cagcttccaggcagcagata

SEQ ID NO: 166393 - DNA, 20 bp, Artificial Sequence
  Synthetic oligonucleotide; CAG chr2 60521416 60521435 60521432 +
cttccaggcagcagatacgg

SEQ ID NO: 166394 - DNA, 20 bp, Artificial Sequence
  Synthetic oligonucleotide; GAG chr2 60521418 60521437 60521434 +
tccaggcagcagatacggca

SEQ ID NO: 166395 - DNA, 20 bp, Artificial Sequence
  Synthetic oligonucleotide; GAG chr2 60521423 60521442 60521439 +
gcagcagatacggcagagac

SEQ ID NO: 166396 - DNA, 20 bp, Artificial Sequence
  Synthetic oligonucleotide; AGG chr2 60521424 60521443 60521440 +
cagcagatacggcagagacg

SEQ ID NO: 166397 - DNA, 20 bp, Artificial Sequence
  Synthetic oligonucleotide; TGG chr2 60521434 60521453 60521450 +
ggcagagacgaggcccacca

SEQ ID NO: 166398 - DNA, 20 bp, Artificial Sequence
  Synthetic oligonucleotide; CGG chr2 60521448 60521467 60521464 +
ccaccatggctcccctgtga

SEQ ID NO: 166399 - DNA, 20 bp, Artificial Sequence
  Synthetic oligonucleotide; GGG chr2 60521449 60521468 60521465 +
caccatggctcccctgtgac

SEQ ID NO: 166400 - DNA, 20 bp, Artificial Sequence
  Synthetic oligonucleotide; AAG chr2 60521459 60521478 60521475 +
cccctgtgacgggctgcacg

SEQ ID NO: 166401 - DNA, 20 bp, Artificial Sequence
  Synthetic oligonucleotide; CAG chr2 60521467 60521486 60521483 +
acgggctgcacgaagcccac

SEQ ID NO: 166402 - DNA, 20 bp, Artificial Sequence
  Synthetic oligonucleotide; TAG chr2 60521475 60521494 60521491 +
cacgaagcccaccagtgacc

SEQ ID NO: 166403 - DNA, 20 bp, Artificial Sequence
  Synthetic oligonucleotide; AAG chr2 60521483 60521502 60521499 +
ccaccagtgacctagctttc

SEQ ID NO: 166404 - DNA, 20 bp, Artificial Sequence
  Synthetic oligonucleotide; CAG chr2 60521491 60521510 60521507 +
gacctagctttcaagtcaca

SEQ ID NO: 166405 - DNA, 20 bp, Artificial Sequence
  Synthetic oligonucleotide; CAG chr2 60521497 60521516 60521513 +
gctttcaagtcacacagcga

SEQ ID NO: 166406 - DNA, 20 bp, Artificial Sequence
  Synthetic oligonucleotide; TGG chr2 60521503 60521522 60521519 +
aagtcacacagcgacagtcc

SEQ ID NO: 166407 - DNA, 20 bp, Artificial Sequence
  Synthetic oligonucleotide; TAG chr2 60521517 60521536 60521533 +
cagtcctggcttttgctatc

SEQ ID NO: 166408 - DNA, 20 bp, Artificial Sequence
  Synthetic oligonucleotide; AAG chr2 60521520 60521539 60521536 +
tcctggcttttgctatctag

SEQ ID NO: 166409 - DNA, 20 bp, Artificial Sequence
  Synthetic oligonucleotide; CAG chr2 60521540 60521559 60521556 +
aagaacaaaattcccctttc

SEQ ID NO: 166410 - DNA, 20 bp, Artificial Sequence
  Synthetic oligonucleotide; CAG chr2 60521589 60521608 60521605 +
tcatcttccatcttgtgccc

SEQ ID NO: 166411 - DNA, 20 bp, Artificial Sequence
  Synthetic oligonucleotide; AAG chr2 60521602 60521621 60521618 +
tgtgccccagtcctccctta

SEQ ID NO: 166412 - DNA, 20 bp, Artificial Sequence
  Synthetic oligonucleotide; AGG chr2 60521603 60521622 60521619 +
gtgccccagtcctcccttaa

SEQ ID NO: 166413 - DNA, 20 bp, Artificial Sequence
  Synthetic oligonucleotide; GGG chr2 60521604 60521623 60521620 +
tgccccagtcctcccttaaa

SEQ ID NO: 166414 - DNA, 20 bp, Artificial Sequence
  Synthetic oligonucleotide; AAG chr2 60521607 60521626 60521623 +
cccagtcctcccttaaaggg

SEQ ID NO: 166415 - DNA, 20 bp, Artificial Sequence
  Synthetic oligonucleotide; AGG chr2 60521608 60521627 60521624 +
ccagtcctcccttaaaggga

SEQ ID NO: 166416 - DNA, 20 bp, Artificial Sequence
  Synthetic oligonucleotide; GAG chr2 60521650 60521669 60521666 +
ttctttgtccccttctttct

SEQ ID NO: 166417 - DNA, 20 bp, Artificial Sequence
  Synthetic oligonucleotide; GAG chr2 60521652 60521671 60521668 +
ctttgtccccttctttctga

SEQ ID NO: 166418 - DNA, 20 bp, Artificial Sequence
  Synthetic oligonucleotide; TGG chr2 60521657 60521676 60521673 +
tccccttctttctgagagtg

SEQ ID NO: 166419 - DNA, 20 bp, Artificial Sequence
  Synthetic oligonucleotide; CAG chr2 60521672 60521691 60521688 +
gagtgtggtcaatctcctct

SEQ ID NO: 166420 - DNA, 20 bp, Artificial Sequence
  Synthetic oligonucleotide; AGG chr2 60521673 60521692 60521689 +
agtgtggtcaatctcctctc

SEQ ID NO: 166421 - DNA, 20 bp, Artificial Sequence
  Synthetic oligonucleotide; TAG chr2 60521694 60521713 60521710 +
ggcaaatcatctttctctaa

SEQ ID NO: 166422 - DNA, 20 bp, Artificial Sequence
  Synthetic oligonucleotide; CAG chr2 60521698 60521717 60521714 +
aatcatctttctctaatagc

SEQ ID NO: 166423 - DNA, 20 bp, Artificial Sequence
  Synthetic oligonucleotide; AGG chr2 60521699 60521718 60521715 +
atcatctttctctaatagcc

SEQ ID NO: 166424 - DNA, 20 bp, Artificial Sequence
  Synthetic oligonucleotide; GGG chr2 60521700 60521719 60521716 +
tcatctttctctaatagcca

SEQ ID NO: 166425 - DNA, 20 bp, Artificial Sequence
  Synthetic oligonucleotide; TGG chr2 60521709 60521728 60521725 +
tctaatagccagggctcaaa

SEQ ID NO: 166426 - DNA, 20 bp, Artificial Sequence
  Synthetic oligonucleotide; AAG chr2 60521715 60521734 60521731 +
agccagggctcaaatggcca

SEQ ID NO: 166427 - DNA, 20 bp, Artificial Sequence
  Synthetic oligonucleotide; AAG chr2 60521719 60521738 60521735 +
agggctcaaatggccaaaga

SEQ ID NO: 166428 - DNA, 20 bp, Artificial Sequence
  Synthetic oligonucleotide; AGG chr2 60521720 60521739 60521736 +
gggctcaaatggccaaagaa

SEQ ID NO: 166429 - DNA, 20 bp, Artificial Sequence
  Synthetic oligonucleotide; AAG chr2 60521728 60521747 60521744 +
atggccaaagaaaggtccca

SEQ ID NO: 166430 - DNA, 20 bp, Artificial Sequence
  Synthetic oligonucleotide; CAG chr2 60521751 60521770 60521767 +
ccttgtcttcataacactac

SEQ ID NO: 166431 - DNA, 20 bp, Artificial Sequence
  Synthetic oligonucleotide; GAG chr2 60521760 60521779 60521776 +
cataacactaccagccacgt

SEQ ID NO: 166432 - DNA, 20 bp, Artificial Sequence
  Synthetic oligonucleotide; CAG chr2 60521770 60521789 60521786 +
ccagccacgtgagcacgtcc

SEQ ID NO: 166433 - DNA, 20 bp, Artificial Sequence
  Synthetic oligonucleotide; GAG chr2 60521797 60521816 60521813 +
ttcttcctgaccctcaccac

SEQ ID NO: 166434 - DNA, 20 bp, Artificial Sequence
  Synthetic oligonucleotide; AGG chr2 60521798 60521817 60521814 +
tcttcctgaccctcaccacg

SEQ ID NO: 166435 - DNA, 20 bp, Artificial Sequence
  Synthetic oligonucleotide; CAG chr2 60521803 60521822 60521819 +
ctgaccctcaccacgaggca

SEQ ID NO: 166436 - DNA, 20 bp, Artificial Sequence
  Synthetic oligonucleotide; GAG chr2 60521805 60521824 60521821 +
gaccctcaccacgaggcaca

SEQ ID NO: 166437 - DNA, 20 bp, Artificial Sequence
  Synthetic oligonucleotide; AGG chr2 60521806 60521825 60521822 +
accctcaccacgaggcacag

SEQ ID NO: 166438 - DNA, 20 bp, Artificial Sequence
  Synthetic oligonucleotide; AAG chr2 60521826 60521845 60521842 +
aggcacctgtgctgaaactc

SEQ ID NO: 166439 - DNA, 20 bp, Artificial Sequence
  Synthetic oligonucleotide; AAG chr2 60521865 60521884 60521881 +
ctctgcctcatgcactgaaa

SEQ ID NO: 166440 - DNA, 20 bp, Artificial Sequence
  Synthetic oligonucleotide; AAG chr2 60521870 60521889 60521886 +
cctcatgcactgaaaaagac

SEQ ID NO: 166441 - DNA, 20 bp, Artificial Sequence
  Synthetic oligonucleotide; AGG chr2 60521871 60521890 60521887 +
ctcatgcactgaaaaagaca

SEQ ID NO: 166442 - DNA, 20 bp, Artificial Sequence
  Synthetic oligonucleotide; GGG chr2 60521872 60521891 60521888 +
tcatgcactgaaaaagacaa

SEQ ID NO: 166443 - DNA, 20 bp, Artificial Sequence
  Synthetic oligonucleotide; CAG chr2 60521888 60521907 60521904 +
acaagggatctctgttcttc

SEQ ID NO: 166444 - DNA, 20 bp, Artificial Sequence
  Synthetic oligonucleotide; AGG chr2 60521889 60521908 60521905 +
caagggatctctgttcttcc

SEQ ID NO: 166445 - DNA, 20 bp, Artificial Sequence
  Synthetic oligonucleotide; GAG chr2 60521891 60521910 60521907 +
agggatctctgttcttccag

SEQ ID NO: 166446 - DNA, 20 bp, Artificial Sequence
  Synthetic oligonucleotide; TGG chr2 60521896 60521915 60521912 +
tctctgttcttccaggagaa

SEQ ID NO: 166447 - DNA, 20 bp, Artificial Sequence
  Synthetic oligonucleotide; GGG chr2 60521897 60521916 60521913 +
ctctgttcttccaggagaat

SEQ ID NO: 166448 - DNA, 20 bp, Artificial Sequence
  Synthetic oligonucleotide; GGG chr2 60521898 60521917 60521914 +
tctgttcttccaggagaatg

SEQ ID NO: 166449 - DNA, 20 bp, Artificial Sequence
  Synthetic oligonucleotide; GGG chr2 60521899 60521918 60521915 +
ctgttcttccaggagaatgg

SEQ ID NO: 166450 - DNA, 20 bp, Artificial Sequence
  Synthetic oligonucleotide; CAG chr2 60521903 60521922 60521919 +
tcttccaggagaatggggga

SEQ ID NO: 166451 - DNA, 20 bp, Artificial Sequence
  Synthetic oligonucleotide; CAG chr2 60521910 60521929 60521926 +
ggagaatgggggacagtgca

SEQ ID NO: 166452 - DNA, 20 bp, Artificial Sequence
  Synthetic oligonucleotide; CAG chr2 60521915 60521934 60521931 +
atgggggacagtgcacagta

SEQ ID NO: 166453 - DNA, 20 bp, Artificial Sequence
  Synthetic oligonucleotide; CAG chr2 60521950 60521969 60521966 +
ccccttcacaatgaacttcc

SEQ ID NO: 166454 - DNA, 20 bp, Artificial Sequence
  Synthetic oligonucleotide; AAG chr2 60521957 60521976 60521973 +
acaatgaacttcccagatac

SEQ ID NO: 166455 - DNA, 20 bp, Artificial Sequence
  Synthetic oligonucleotide; GAG chr2 60521964 60521983 60521980 +
acttcccagatacaagactt

SEQ ID NO: 166456 - DNA, 20 bp, Artificial Sequence
  Synthetic oligonucleotide; CAG chr2 60521971 60521990 60521987 +
agatacaagacttgagctca

SEQ ID NO: 166457 - DNA, 20 bp, Artificial Sequence
  Synthetic oligonucleotide; AGG chr2 60521972 60521991 60521988 +
gatacaagacttgagctcac

SEQ ID NO: 166458 - DNA, 20 bp, Artificial Sequence
  Synthetic oligonucleotide; TAG chr2 60521989 60522008 60522005 +
cacaggtactttcttgccca

SEQ ID NO: 166459 - DNA, 20 bp, Artificial Sequence
  Synthetic oligonucleotide; AGG chr2 60521990 60522009 60522006 +
acaggtactttcttgcccat

SEQ ID NO: 166460 - DNA, 20 bp, Artificial Sequence
  Synthetic oligonucleotide; GAG chr2 60522016 60522035 60522032 +
cttgtccccttgctacctct

SEQ ID NO: 166461 - DNA, 20 bp, Artificial Sequence
  Synthetic oligonucleotide; TGG chr2 60522028 60522047 60522044 +
ctacctctgagccaaaccct

SEQ ID NO: 166462 - DNA, 20 bp, Artificial Sequence
  Synthetic oligonucleotide; AAG chr2 60522033 60522052 60522049 +
tctgagccaaacccttggtg

SEQ ID NO: 166463 - DNA, 20 bp, Artificial Sequence
  Synthetic oligonucleotide; AAG chr2 60522054 60522073 60522070 +
agaaacaacaccgactaaac

SEQ ID NO: 166464 - DNA, 20 bp, Artificial Sequence
  Synthetic oligonucleotide; AGG chr2 60522055 60522074 60522071 +
gaaacaacaccgactaaaca

SEQ ID NO: 166465 - DNA, 20 bp, Artificial Sequence
  Synthetic oligonucleotide; CAG chr2 60522074 60522093 60522090 +
aaggccatactgctctccac

SEQ ID NO: 166466 - DNA, 20 bp, Artificial Sequence
  Synthetic oligonucleotide; CAG chr2 60522078 60522097 60522094 +
ccatactgctctccaccagt

SEQ ID NO: 166467 - DNA, 20 bp, Artificial Sequence
  Synthetic oligonucleotide; AGG chr2 60522079 60522098 60522095 +
catactgctctccaccagtc

SEQ ID NO: 166468 - DNA, 20 bp, Artificial Sequence
  Synthetic oligonucleotide; TGG chr2 60522098 60522117 60522114 +
caggcaatacctttattttc

SEQ ID NO: 166469 - DNA, 20 bp, Artificial Sequence
  Synthetic oligonucleotide; AAG chr2 60522121 60522140 60522137 +
aaaaatctcaaatactacaa

SEQ ID NO: 166470 - DNA, 20 bp, Artificial Sequence
  Synthetic oligonucleotide; TAG chr2 60522124 60522143 60522140 +
aatctcaaatactacaaaag

SEQ ID NO: 166471 - DNA, 20 bp, Artificial Sequence
  Synthetic oligonucleotide; GAG chr2 60522126 60522145 60522142 +
tctcaaatactacaaaagta

SEQ ID NO: 166472 - DNA, 20 bp, Artificial Sequence
  Synthetic oligonucleotide; GAG chr2 60522128 60522147 60522144 +
tcaaatactacaaaagtaga

SEQ ID NO: 166473 - DNA, 20 bp, Artificial Sequence
  Synthetic oligonucleotide; CAG chr2 60522143 60522162 60522159 +
gtagagagaatgttataaat

SEQ ID NO: 166474 - DNA, 20 bp, Artificial Sequence
  Synthetic oligonucleotide; AAG chr2 60522151 60522170 60522167 +
aatgttataaatcagtcccc

SEQ ID NO: 166475 - DNA, 20 bp, Artificial Sequence
  Synthetic oligonucleotide; CAG chr2 60522165 60522184 60522181 +
gtccccaagtccacatcttc

SEQ ID NO: 166476 - DNA, 20 bp, Artificial Sequence
  Synthetic oligonucleotide; CAG chr2 60522180 60522199 60522196 +
tcttccagctccaaccacca

SEQ ID NO: 166477 - DNA, 20 bp, Artificial Sequence
  Synthetic oligonucleotide; CAG chr2 60522187 60522206 60522203 +
gctccaaccaccacagctca

SEQ ID NO: 166478 - DNA, 20 bp, Artificial Sequence
  Synthetic oligonucleotide; TAG chr2 60522223 60522242 60522239 +
ctgtaaccctatcgcctccc

SEQ ID NO: 166479 - DNA, 20 bp, Artificial Sequence
  Synthetic oligonucleotide; AAG chr2 60522241 60522260 60522257 +
cctagcccattttattattt

SEQ ID NO: 166480 - DNA, 20 bp, Artificial Sequence
  Synthetic oligonucleotide; CAG chr2 60522251 60522270 60522267 +
tttattatttaagttgatcc

SEQ ID NO: 166481 - DNA, 20 bp, Artificial Sequence
  Synthetic oligonucleotide; CAG chr2 60522271 60522290 60522287 +
cagacgtcatatcatttcat

SEQ ID NO: 166482 - DNA, 20 bp, Artificial Sequence
  Synthetic oligonucleotide; TAG chr2 60522303 60522322 60522319 +
ctgtatgtattttttaaaca

SEQ ID NO: 166483 - DNA, 20 bp, Artificial Sequence
  Synthetic oligonucleotide; AGG chr2 60522304 60522323 60522320 +
tgtatgtattttttaaacat

SEQ ID NO: 166484 - DNA, 20 bp, Artificial Sequence
  Synthetic oligonucleotide; AAG chr2 60522366 60522385 60522382 +
tatcacacctaaaaataata

SEQ ID NO: 166485 - DNA, 20 bp, Artificial Sequence
  Synthetic oligonucleotide; AAG chr2 60522378 60522397 60522394 +
aaataataaagtcacaaata

SEQ ID NO: 166486 - DNA, 20 bp, Artificial Sequence
  Synthetic oligonucleotide; TAG chr2 60522396 60522415 60522412 +
taaagtcccgtattaccaaa

SEQ ID NO: 166487 - DNA, 20 bp, Artificial Sequence
  Synthetic oligonucleotide; AGG chr2 60522397 60522416 60522413 +
aaagtcccgtattaccaaat

SEQ ID NO: 166488 - DNA, 20 bp, Artificial Sequence
  Synthetic oligonucleotide; GGG chr2 60522398 60522417 60522414 +
aagtcccgtattaccaaata

SEQ ID NO: 166489 - DNA, 20 bp, Artificial Sequence
  Synthetic oligonucleotide; GGG chr2 60522399 60522418 60522415 +
agtcccgtattaccaaatag

SEQ ID NO: 166490 - DNA, 20 bp, Artificial Sequence
  Synthetic oligonucleotide; GAG chr2 60522401 60522420 60522417 +
tcccgtattaccaaataggg

SEQ ID NO: 166491 - DNA, 20 bp, Artificial Sequence
  Synthetic oligonucleotide; CAG chr2 60522416 60522435 60522432 +
taggggagttattttaaact

SEQ ID NO: 166492 - DNA, 20 bp, Artificial Sequence
  Synthetic oligonucleotide; TGG chr2 60522436 60522455 60522452 +
cagaaatacttctttccatc

SEQ ID NO: 166493 - DNA, 20 bp, Artificial Sequence
  Synthetic oligonucleotide; GGG chr2 60522437 60522456 60522453 +
agaaatacttctttccatct

SEQ ID NO: 166494 - DNA, 20 bp, Artificial Sequence
  Synthetic oligonucleotide; TGG chr2 60522448 60522467 60522464 +
tttccatctgggtcatgttt

SEQ ID NO: 166495 - DNA, 20 bp, Artificial Sequence
  Synthetic oligonucleotide; GAG chr2 60522450 60522469 60522466 +
tccatctgggtcatgttttg

SEQ ID NO: 166496 - DNA, 20 bp, Artificial Sequence
  Synthetic oligonucleotide; AGG chr2 60522451 60522470 60522467 +
ccatctgggtcatgttttgg

SEQ ID NO: 166497 - DNA, 20 bp, Artificial Sequence
  Synthetic oligonucleotide; CAG chr2 60522462 60522481 60522478 +
atgttttggaggatcccttc

SEQ ID NO: 166498 - DNA, 20 bp, Artificial Sequence
  Synthetic oligonucleotide; GAG chr2 60522466 60522485 60522482 +
tttggaggatcccttccagt

SEQ ID NO: 166499 - DNA, 20 bp, Artificial Sequence
  Synthetic oligonucleotide; AGG chr2 60522467 60522486 60522483 +
ttggaggatcccttccagtg

SEQ ID NO: 166500 - DNA, 20 bp, Artificial Sequence
  Synthetic oligonucleotide; AAG chr2 60522473 60522492 60522489 +
gatcccttccagtgaggttc

SEQ ID NO: 166501 - DNA, 20 bp, Artificial Sequence
  Synthetic oligonucleotide; AAG chr2 60522480 60522499 60522496 +
tccagtgaggttcaagactg

SEQ ID NO: 166502 - DNA, 20 bp, Artificial Sequence
  Synthetic oligonucleotide; AAG chr2 60522488 60522507 60522504 +
ggttcaagactgaagctgcc

SEQ ID NO: 166503 - DNA, 20 bp, Artificial Sequence
  Synthetic oligonucleotide; AAG chr2 60522493 60522512 60522509 +
aagactgaagctgccaagaa

SEQ ID NO: 166504 - DNA, 20 bp, Artificial Sequence
  Synthetic oligonucleotide; CAG chr2 60522499 60522518 60522515 +
gaagctgccaagaaaagctt

SEQ ID NO: 166505 - DNA, 20 bp, Artificial Sequence
  Synthetic oligonucleotide; GAG chr2 60522501 60522520 60522517 +
agctgccaagaaaagcttca

SEQ ID NO: 166506 - DNA, 20 bp, Artificial Sequence
  Synthetic oligonucleotide; AAG chr2 60522520 60522539 60522536 +
agagaatcacactctctaaa

SEQ ID NO: 166507 - DNA, 20 bp, Artificial Sequence
  Synthetic oligonucleotide; AGG chr2 60522521 60522540 60522537 +
gagaatcacactctctaaaa

SEQ ID NO: 166508 - DNA, 20 bp, Artificial Sequence
  Synthetic oligonucleotide; GGG chr2 60522522 60522541 60522538 +
agaatcacactctctaaaaa

SEQ ID NO: 166509 - DNA, 20 bp, Artificial Sequence
  Synthetic oligonucleotide; AAG chr2 60522534 60522553 60522550 +
tctaaaaagggccttgtgta

SEQ ID NO: 166510 - DNA, 20 bp, Artificial Sequence
  Synthetic oligonucleotide; CAG chr2 60522550 60522569 60522566 +
tgtaaagccaccttgcatgt

SEQ ID NO: 166511 - DNA, 20 bp, Artificial Sequence
  Synthetic oligonucleotide; AAG chr2 60522556 60522575 60522572 +
gccaccttgcatgtcagccc

SEQ ID NO: 166512 - DNA, 20 bp, Artificial Sequence
  Synthetic oligonucleotide; CAG chr2 60522572 60522591 60522588 +
gcccaagctcctgccccttg

SEQ ID NO: 166513 - DNA, 20 bp, Artificial Sequence
  Synthetic oligonucleotide; CAG chr2 60522589 60522608 60522605 +
ttgcagtcctttgccctgtt

SEQ ID NO: 166514 - DNA, 20 bp, Artificial Sequence
  Synthetic oligonucleotide; AGG chr2 60522590 60522609 60522606 +
tgcagtcctttgccctgttc

SEQ ID NO: 166515 - DNA, 20 bp, Artificial Sequence
  Synthetic oligonucleotide; GGG chr2 60522591 60522610 60522607 +
gcagtcctttgccctgttca

SEQ ID NO: 166516 - DNA, 20 bp, Artificial Sequence
  Synthetic oligonucleotide; GAG chr2 60522609 60522628 60522625 +
cagggctgaatgcaccctct

SEQ ID NO: 166517 - DNA, 20 bp, Artificial Sequence
  Synthetic oligonucleotide; GAG chr2 60522611 60522630 60522627 +
gggctgaatgcaccctctga

SEQ ID NO: 166518 - DNA, 20 bp, Artificial Sequence
  Synthetic oligonucleotide; CAG chr2 60522623 60522642 60522639 +
ccctctgagagtctctgtga

SEQ ID NO: 166519 - DNA, 20 bp, Artificial Sequence
  Synthetic oligonucleotide; CAG chr2 60522648 60522667 60522664 +
ctcccacatcgactgcccca

SEQ ID NO: 166520 - DNA, 20 bp, Artificial Sequence
  Synthetic oligonucleotide; AGG chr2 60522649 60522668 60522665 +
tcccacatcgactgccccac

SEQ ID NO: 166521 - DNA, 20 bp, Artificial Sequence
  Synthetic oligonucleotide; GAG chr2 60522656 60522675 60522672 +
tcgactgccccacaggccct

SEQ ID NO: 166522 - DNA, 20 bp, Artificial Sequence
  Synthetic oligonucleotide; TGG chr2 60522680 60522699 60522696 +
ctccctcactccccaccatg

SEQ ID NO: 166523 - DNA, 20 bp, Artificial Sequence
  Synthetic oligonucleotide; AAG chr2 60522701 60522720 60522717 +
ggcccatcaccacatccgac

SEQ ID NO: 166524 - DNA, 20 bp, Artificial Sequence
  Synthetic oligonucleotide; CAG chr2 60522704 60522723 60522720 +
ccatcaccacatccgacaag

SEQ ID NO: 166525 - DNA, 20 bp, Artificial Sequence
  Synthetic oligonucleotide; AGG chr2 60522705 60522724 60522721 +
catcaccacatccgacaagc

SEQ ID NO: 166526 - DNA, 20 bp, Artificial Sequence
  Synthetic oligonucleotide; CAG chr2 60522716 60522735 60522732 +
ccgacaagcaggtgcactcc

SEQ ID NO: 166527 - DNA, 20 bp, Artificial Sequence
  Synthetic oligonucleotide; CAG chr2 60522723 60522742 60522739 +
gcaggtgcactcccagtgtt

SEQ ID NO: 166528 - DNA, 20 bp, Artificial Sequence
  Synthetic oligonucleotide; TGG chr2 60522729 60522748 60522745 +
gcactcccagtgttcagaac

SEQ ID NO: 166529 - DNA, 20 bp, Artificial Sequence
  Synthetic oligonucleotide; TGG chr2 60522745 60522764 60522761 +
gaactggaattcatttgtct

SEQ ID NO: 166530 - DNA, 20 bp, Artificial Sequence
  Synthetic oligonucleotide; AAG chr2 60522748 60522767 60522764 +
ctggaattcatttgtcttgg

SEQ ID NO: 166531 - DNA, 20 bp, Artificial Sequence
  Synthetic oligonucleotide; AAG chr2 60522752 60522771 60522768 +
aattcatttgtcttggaaga

SEQ ID NO: 166532 - DNA, 20 bp, Artificial Sequence
  Synthetic oligonucleotide; TGG chr2 60522763 60522782 60522779 +
cttggaagaaagtgttctcc

SEQ ID NO: 166533 - DNA, 20 bp, Artificial Sequence
  Synthetic oligonucleotide; CGG chr2 60522767 60522786 60522783 +
gaagaaagtgttctcctgga

SEQ ID NO: 166534 - DNA, 20 bp, Artificial Sequence
  Synthetic oligonucleotide; CAG chr2 60522777 60522796 60522793 +
ttctcctggacggttctgca

SEQ ID NO: 166535 - DNA, 20 bp, Artificial Sequence
  Synthetic oligonucleotide; CAG chr2 60522790 60522809 60522806 +
ttctgcacagaattcattca

SEQ ID NO: 166536 - DNA, 20 bp, Artificial Sequence
  Synthetic oligonucleotide; GAG chr2 60522792 60522811 60522808 +
ctgcacagaattcattcaca

SEQ ID NO: 166537 - DNA, 20 bp, Artificial Sequence
  Synthetic oligonucleotide; TGG chr2 60522802 60522821 60522818 +
ttcattcacagagcatgtct

SEQ ID NO: 166538 - DNA, 20 bp, Artificial Sequence
  Synthetic oligonucleotide; CAG chr2 60522810 60522829 60522826 +
cagagcatgtcttggatata

SEQ ID NO: 166539 - DNA, 20 bp, Artificial Sequence
  Synthetic oligonucleotide; TAG chr2 60522818 60522837 60522834 +
gtcttggatatacagctgac

SEQ ID NO: 166540 - DNA, 20 bp, Artificial Sequence
  Synthetic oligonucleotide; CAG chr2 60522827 60522846 60522843 +
atacagctgactagatatgt

SEQ ID NO: 166541 - DNA, 20 bp, Artificial Sequence
  Synthetic oligonucleotide; TGG chr2 60522842 60522861 60522858 +
tatgtcagttatgttccaaa

SEQ ID NO: 166542 - DNA, 20 bp, Artificial Sequence
  Synthetic oligonucleotide; GGG chr2 60522843 60522862 60522859 +
atgtcagttatgttccaaat

SEQ ID NO: 166543 - DNA, 20 bp, Artificial Sequence
  Synthetic oligonucleotide; CAG chr2 60522852 60522871 60522868 +
atgttccaaatgggttttca

SEQ ID NO: 166544 - DNA, 20 bp, Artificial Sequence
  Synthetic oligonucleotide; AGG chr2 60522853 60522872 60522869 +
tgttccaaatgggttttcac

SEQ ID NO: 166545 - DNA, 20 bp, Artificial Sequence
  Synthetic oligonucleotide; AAG chr2 60522858 60522877 60522874 +
caaatgggttttcacaggtc

SEQ ID NO: 166546 - DNA, 20 bp, Artificial Sequence
  Synthetic oligonucleotide; AGG chr2 60522859 60522878 60522875 +
aaatgggttttcacaggtca

SEQ ID NO: 166547 - DNA, 20 bp, Artificial Sequence
  Synthetic oligonucleotide; CAG chr2 60522867 60522886 60522883 +
tttcacaggtcaaggttctg

SEQ ID NO: 166548 - DNA, 20 bp, Artificial Sequence
  Synthetic oligonucleotide; AGG chr2 60522868 60522887 60522884 +
ttcacaggtcaaggttctgc

SEQ ID NO: 166549 - DNA, 20 bp, Artificial Sequence
  Synthetic oligonucleotide; AAG chr2 60522872 60522891 60522888 +
caggtcaaggttctgcaggc

SEQ ID NO: 166550 - DNA, 20 bp, Artificial Sequence
  Synthetic oligonucleotide; GAG chr2 60522874 60522893 60522890 +
ggtcaaggttctgcaggcaa

SEQ ID NO: 166551 - DNA, 20 bp, Artificial Sequence
  Synthetic oligonucleotide; TAG chr2 60522890 60522909 60522906 +
gcaagagcaaatactatttt

SEQ ID NO: 166552 - DNA, 20 bp, Artificial Sequence
  Synthetic oligonucleotide; CAG chr2 60522894 60522913 60522910 +
gagcaaatactatttttaga

SEQ ID NO: 166553 - DNA, 20 bp, Artificial Sequence
  Synthetic oligonucleotide; AGG chr2 60522895 60522914 60522911 +
agcaaatactatttttagac

SEQ ID NO: 166554 - DNA, 20 bp, Artificial Sequence
  Synthetic oligonucleotide; AAG chr2 60522900 60522919 60522916 +
atactatttttagacaggat

SEQ ID NO: 166555 - DNA, 20 bp, Artificial Sequence
  Synthetic oligonucleotide; AGG chr2 60522901 60522920 60522917 +
tactatttttagacaggata

SEQ ID NO: 166556 - DNA, 20 bp, Artificial Sequence
  Synthetic oligonucleotide; TAG chr2 60522916 60522935 60522932 +
ggataaggtcaaaatgcttt

SEQ ID NO: 166557 - DNA, 20 bp, Artificial Sequence
  Synthetic oligonucleotide; GAG chr2 60522918 60522937 60522934 +
ataaggtcaaaatgctttta

SEQ ID NO: 166558 - DNA, 20 bp, Artificial Sequence
  Synthetic oligonucleotide; CAG chr2 60522922 60522941 60522938 +
ggtcaaaatgcttttagaga

SEQ ID NO: 166559 - DNA, 20 bp, Artificial Sequence
  Synthetic oligonucleotide; GAG chr2 60522926 60522945 60522942 +
aaaatgcttttagagacagt

SEQ ID NO: 166560 - DNA, 20 bp, Artificial Sequence
  Synthetic oligonucleotide; AGG chr2 60522927 60522946 60522943 +
aaatgcttttagagacagtg

SEQ ID NO: 166561 - DNA, 20 bp, Artificial Sequence
  Synthetic oligonucleotide; CAG chr2 60522951 60522970 60522967 +
ctacaataaaacctattgat

SEQ ID NO: 166562 - DNA, 20 bp, Artificial Sequence
  Synthetic oligonucleotide; TGG chr2 60522958 60522977 60522974 +
aaaacctattgatcagcctc

SEQ ID NO: 166563 - DNA, 20 bp, Artificial Sequence
  Synthetic oligonucleotide; TAG chr2 60522964 60522983 60522980 +
tattgatcagcctctggaac

SEQ ID NO: 166564 - DNA, 20 bp, Artificial Sequence
  Synthetic oligonucleotide; CAG chr2 60522972 60522991 60522988 +
agcctctggaactagtgctc

SEQ ID NO: 166565 - DNA, 20 bp, Artificial Sequence
  Synthetic oligonucleotide; GAG chr2 60522974 60522993 60522990 +
cctctggaactagtgctcca

SEQ ID NO: 166566 - DNA, 20 bp, Artificial Sequence
  Synthetic oligonucleotide; GAG chr2 60522976 60522995 60522992 +
tctggaactagtgctccaga

SEQ ID NO: 166567 - DNA, 20 bp, Artificial Sequence
  Synthetic oligonucleotide; CAG chr2 60522982 60523001 60522998 +
actagtgctccagagagaca

SEQ ID NO: 166568 - DNA, 20 bp, Artificial Sequence
  Synthetic oligonucleotide; GAG chr2 60522984 60523003 60523000 +
tagtgctccagagagacaca

SEQ ID NO: 166569 - DNA, 20 bp, Artificial Sequence
  Synthetic oligonucleotide; TGG chr2 60523005 60523024 60523021 +
agattgaaacaaaaattgcc

SEQ ID NO: 166570 - DNA, 20 bp, Artificial Sequence
  Synthetic oligonucleotide; TAG chr2 60523020 60523039 60523036 +
ttgcctggccgttttctctg

SEQ ID NO: 166571 - DNA, 20 bp, Artificial Sequence
  Synthetic oligonucleotide; TGG chr2 60523029 60523048 60523045 +
cgttttctctgtagactctg

SEQ ID NO: 166572 - DNA, 20 bp, Artificial Sequence
  Synthetic oligonucleotide; GGG chr2 60523030 60523049 60523046 +
gttttctctgtagactctgt

SEQ ID NO: 166573 - DNA, 20 bp, Artificial Sequence
  Synthetic oligonucleotide; AAG chr2 60523036 60523055 60523052 +
tctgtagactctgtgggtaa

SEQ ID NO: 166574 - DNA, 20 bp, Artificial Sequence
  Synthetic oligonucleotide; TGG chr2 60523044 60523063 60523060 +
ctctgtgggtaaaagcttgt

SEQ ID NO: 166575 - DNA, 20 bp, Artificial Sequence
  Synthetic oligonucleotide; CAG chr2 60523060 60523079 60523076 +
ttgttggacttaatatcttt

SEQ ID NO: 166576 - DNA, 20 bp, Artificial Sequence
  Synthetic oligonucleotide; AGG chr2 60523061 60523080 60523077 +
tgttggacttaatatctttc

SEQ ID NO: 166577 - DNA, 20 bp, Artificial Sequence
  Synthetic oligonucleotide; AAG chr2 60523073 60523092 60523089 +
tatctttcaggatataaaat

SEQ ID NO: 166578 - DNA, 20 bp, Artificial Sequence
  Synthetic oligonucleotide; AAG chr2 60523077 60523096 60523093 +
tttcaggatataaaataagt

SEQ ID NO: 166579 - DNA, 20 bp, Artificial Sequence
  Synthetic oligonucleotide; AAG chr2 60523080 60523099 60523096 +
caggatataaaataagtaag

SEQ ID NO: 166580 - DNA, 20 bp, Artificial Sequence
  Synthetic oligonucleotide; CAG chr2 60523093 60523112 60523109 +
aagtaagaagtaactgtgta

SEQ ID NO: 166581 - DNA, 20 bp, Artificial Sequence
  Synthetic oligonucleotide; AAG chr2 60523103 60523122 60523119 +
taactgtgtacagattactg

SEQ ID NO: 166582 - DNA, 20 bp, Artificial Sequence
  Synthetic oligonucleotide; CAG chr2 60523116 60523135 60523132 +
attactgaagtccatttaac

SEQ ID NO: 166583 - DNA, 20 bp, Artificial Sequence
  Synthetic oligonucleotide; CAG chr2 60523122 60523141 60523138 +
gaagtccatttaaccagatg

SEQ ID NO: 166584 - DNA, 20 bp, Artificial Sequence
  Synthetic oligonucleotide; GAG chr2 60523124 60523143 60523140 +
agtccatttaaccagatgca

SEQ ID NO: 166585 - DNA, 20 bp, Artificial Sequence
  Synthetic oligonucleotide; AGG chr2 60523125 60523144 60523141 +
gtccatttaaccagatgcag

SEQ ID NO: 166586 - DNA, 20 bp, Artificial Sequence
  Synthetic oligonucleotide; CAG chr2 60523128 60523147 60523144 +
catttaaccagatgcagagg

SEQ ID NO: 166587 - DNA, 20 bp, Artificial Sequence
  Synthetic oligonucleotide; AGG chr2 60523129 60523148 60523145 +
atttaaccagatgcagaggc

SEQ ID NO: 166588 - DNA, 20 bp, Artificial Sequence
  Synthetic oligonucleotide; CAG chr2 60523135 60523154 60523151 +
ccagatgcagaggcaggtca

SEQ ID NO: 166589 - DNA, 20 bp, Artificial Sequence
  Synthetic oligonucleotide; TGG chr2 60523150 60523169 60523166 +
ggtcacagaaaatacactca

SEQ ID NO: 166590 - DNA, 20 bp, Artificial Sequence
  Synthetic oligonucleotide; CAG chr2 60523153 60523172 60523169 +
cacagaaaatacactcatgg

SEQ ID NO: 166591 - DNA, 20 bp, Artificial Sequence
  Synthetic oligonucleotide; AAG chr2 60523163 60523182 60523179 +
acactcatggcagaaccgta

SEQ ID NO: 166592 - DNA, 20 bp, Artificial Sequence
  Synthetic oligonucleotide; AAG chr2 60523166 60523185 60523182 +
ctcatggcagaaccgtaaag

SEQ ID NO: 166593 - DNA, 20 bp, Artificial Sequence
  Synthetic oligonucleotide; AGG chr2 60523167 60523186 60523183 +
tcatggcagaaccgtaaaga

SEQ ID NO: 166594 - DNA, 20 bp, Artificial Sequence
  Synthetic oligonucleotide; GGG chr2 60523168 60523187 60523184 +
catggcagaaccgtaaagaa

SEQ ID NO: 166595 - DNA, 20 bp, Artificial Sequence
  Synthetic oligonucleotide; GAG chr2 60523170 60523189 60523186 +
tggcagaaccgtaaagaagg

SEQ ID NO: 166596 - DNA, 20 bp, Artificial Sequence
  Synthetic oligonucleotide; AAG chr2 60523178 60523197 60523194 +
ccgtaaagaagggagatttc

SEQ ID NO: 166597 - DNA, 20 bp, Artificial Sequence
  Synthetic oligonucleotide; AGG chr2 60523179 60523198 60523195 +
cgtaaagaagggagatttca

SEQ ID NO: 166598 - DNA, 20 bp, Artificial Sequence
  Synthetic oligonucleotide; TAG chr2 60523199 60523218 60523215 +
aggcaacacgtgttgcaacc

SEQ ID NO: 166599 - DNA, 20 bp, Artificial Sequence
  Synthetic oligonucleotide; GAG chr2 60523201 60523220 60523217 +
gcaacacgtgttgcaaccta

SEQ ID NO: 166600 - DNA, 20 bp, Artificial Sequence
  Synthetic oligonucleotide; AAG chr2 60523205 60523224 60523221 +
cacgtgttgcaacctagaga

SEQ ID NO: 166601 - DNA, 20 bp, Artificial Sequence
  Synthetic oligonucleotide; CAG chr2 60523217 60523236 60523233 +
cctagagaaagaataaacac

SEQ ID NO: 166602 - DNA, 20 bp, Artificial Sequence
  Synthetic oligonucleotide; CAG chr2 60523231 60523250 60523247 +
aaacaccagtcttctcaact

SEQ ID NO: 166603 - DNA, 20 bp, Artificial Sequence
  Synthetic oligonucleotide; AGG chr2 60523232 60523251 60523248 +
aacaccagtcttctcaactc

SEQ ID NO: 166604 - DNA, 20 bp, Artificial Sequence
  Synthetic oligonucleotide; GGG chr2 60523233 60523252 60523249 +
acaccagtcttctcaactca

SEQ ID NO: 166605 - DNA, 20 bp, Artificial Sequence
  Synthetic oligonucleotide; GGG chr2 60523234 60523253 60523250 +
caccagtcttctcaactcag

SEQ ID NO: 166606 - DNA, 20 bp, Artificial Sequence
  Synthetic oligonucleotide; GAG chr2 60523236 60523255 60523252 +
ccagtcttctcaactcaggg

SEQ ID NO: 166607 - DNA, 20 bp, Artificial Sequence
  Synthetic oligonucleotide; AGG chr2 60523237 60523256 60523253 +
cagtcttctcaactcagggg

SEQ ID NO: 166608 - DNA, 20 bp, Artificial Sequence
  Synthetic oligonucleotide; AAG chr2 60523244 60523263 60523260 +
ctcaactcaggggaggcaca

SEQ ID NO: 166609 - DNA, 20 bp, Artificial Sequence
  Synthetic oligonucleotide; AGG chr2 60523245 60523264 60523261 +
tcaactcaggggaggcacaa

SEQ ID NO: 166610 - DNA, 20 bp, Artificial Sequence
  Synthetic oligonucleotide; CAG chr2 60523249 60523268 60523265 +
ctcaggggaggcacaaagga

SEQ ID NO: 166611 - DNA, 20 bp, Artificial Sequence
  Synthetic oligonucleotide; CAG chr2 60523261 60523280 60523277 +
acaaaggacagcctgccatc

SEQ ID NO: 166612 - DNA, 20 bp, Artificial Sequence
  Synthetic oligonucleotide; AGG chr2 60523262 60523281 60523278 +
caaaggacagcctgccatcc

SEQ ID NO: 166613 - DNA, 20 bp, Artificial Sequence
  Synthetic oligonucleotide; TGG chr2 60523274 60523293 60523290 +
tgccatccaggattcctgct

SEQ ID NO: 166614 - DNA, 20 bp, Artificial Sequence
  Synthetic oligonucleotide; GGG chr2 60523275 60523294 60523291 +
gccatccaggattcctgctt

SEQ ID NO: 166615 - DNA, 20 bp, Artificial Sequence
  Synthetic oligonucleotide; CAG chr2 60523315 60523334 60523331 +
tgccactatgatcctcaatc

SEQ ID NO: 166616 - DNA, 20 bp, Artificial Sequence
  Synthetic oligonucleotide; CAG chr2 60523332 60523351 60523348 +
atccagcgctatgtgaacaa

SEQ ID NO: 166617 - DNA, 20 bp, Artificial Sequence
  Synthetic oligonucleotide; CAG chr2 60523340 60523359 60523356 +
ctatgtgaacaacagacttt

SEQ ID NO: 166618 - DNA, 20 bp, Artificial Sequence
  Synthetic oligonucleotide; TAG chr2 60523348 60523367 60523364 +
acaacagactttcagataaa

SEQ ID NO: 166619 - DNA, 20 bp, Artificial Sequence
  Synthetic oligonucleotide; TGG chr2 60523353 60523372 60523369 +
agactttcagataaatagta

SEQ ID NO: 166620 - DNA, 20 bp, Artificial Sequence
  Synthetic oligonucleotide; GAG chr2 60523355 60523374 60523371 +
actttcagataaatagtatg

SEQ ID NO: 166621 - DNA, 20 bp, Artificial Sequence
  Synthetic oligonucleotide; AAG chr2 60523369 60523388 60523385 +
agtatggagataatttgctt

SEQ ID NO: 166622 - DNA, 20 bp, Artificial Sequence
  Synthetic oligonucleotide; CAG chr2 60523373 60523392 60523389 +
tggagataatttgcttaagt

SEQ ID NO: 166623 - DNA, 20 bp, Artificial Sequence
  Synthetic oligonucleotide; AAG chr2 60523387 60523406 60523403 +
ttaagtcagattttgatgaa

SEQ ID NO: 166624 - DNA, 20 bp, Artificial Sequence
  Synthetic oligonucleotide; TGG chr2 60523390 60523409 60523406 +
agtcagattttgatgaaaag

SEQ ID NO: 166625 - DNA, 20 bp, Artificial Sequence
  Synthetic oligonucleotide; TGG chr2 60523401 60523420 60523417 +
gatgaaaagtggtttctaca

SEQ ID NO: 166626 - DNA, 20 bp, Artificial Sequence
  Synthetic oligonucleotide; TAG chr2 60523405 60523424 60523421 +
aaaagtggtttctacatgga

SEQ ID NO: 166627 - DNA, 20 bp, Artificial Sequence
  Synthetic oligonucleotide; TGG chr2 60523435 60523454 60523451 +
aaacttctatattgatttga

SEQ ID NO: 166628 - DNA, 20 bp, Artificial Sequence
  Synthetic oligonucleotide; TGG chr2 60523443 60523462 60523459 +
atattgatttgatggaatca

SEQ ID NO: 166629 - DNA, 20 bp, Artificial Sequence
  Synthetic oligonucleotide; AAG chr2 60523455 60523474 60523471 +
tggaatcatggtgaattcta

SEQ ID NO: 166630 - DNA, 20 bp, Artificial Sequence
  Synthetic oligonucleotide; CAG chr2 60523496 60523515 60523512 +
tctccctttctacacacaca

SEQ ID NO: 166631 - DNA, 20 bp, Artificial Sequence
  Synthetic oligonucleotide; AGG chr2 60523497 60523516 60523513 +
ctccctttctacacacacac

SEQ ID NO: 166632 - DNA, 20 bp, Artificial Sequence
  Synthetic oligonucleotide; TAG chr2 60523548 60523567 60523564 +
catatacgtatgtatatatg

SEQ ID NO: 166633 - DNA, 20 bp, Artificial Sequence
  Synthetic oligonucleotide; TAG chr2 60523575 60523594 60523591 +
tacatatgtatgtgtgtata

SEQ ID NO: 166634 - DNA, 20 bp, Artificial Sequence
  Synthetic oligonucleotide; CAG chr2 60523611 60523630 60523627 +
tatgctttatcttatgatga

SEQ ID NO: 166635 - DNA, 20 bp, Artificial Sequence
  Synthetic oligonucleotide; TGG chr2 60523626 60523645 60523642 +
gatgacagtgttgatgtgtt

SEQ ID NO: 166636 - DNA, 20 bp, Artificial Sequence
  Synthetic oligonucleotide; GGG chr2 60523627 60523646 60523643 +
atgacagtgttgatgtgttt

SEQ ID NO: 166637 - DNA, 20 bp, Artificial Sequence
  Synthetic oligonucleotide; GGG chr2 60523628 60523647 60523644 +
tgacagtgttgatgtgtttg

SEQ ID NO: 166638 - DNA, 20 bp, Artificial Sequence
  Synthetic oligonucleotide; AAG chr2 60523649 60523668 60523665 +
ggatttttttttttttcaaa

SEQ ID NO: 166639 - DNA, 20 bp, Artificial Sequence
  Synthetic oligonucleotide; GAG chr2 60523651 60523670 60523667 +
atttttttttttttcaaaaa

SEQ ID NO: 166640 - DNA, 20 bp, Artificial Sequence
  Synthetic oligonucleotide; AAG chr2 60523659 60523678 60523675 +
ttttttcaaaaagagttaat

SEQ ID NO: 166641 - DNA, 20 bp, Artificial Sequence
  Synthetic oligonucleotide; TAG chr2 60523669 60523688 60523685 +
aagagttaataagcctttta

SEQ ID NO: 166642 - DNA, 20 bp, Artificial Sequence
  Synthetic oligonucleotide; AGG chr2 60523670 60523689 60523686 +
agagttaataagccttttat

SEQ ID NO: 166643 - DNA, 20 bp, Artificial Sequence
  Synthetic oligonucleotide; AAG chr2 60523683 60523702 60523699 +
cttttataggtgtaccacac

SEQ ID NO: 166644 - DNA, 20 bp, Artificial Sequence
  Synthetic oligonucleotide; CAG chr2 60523690 60523709 60523706 +
aggtgtaccacacaagactc

SEQ ID NO: 166645 - DNA, 20 bp, Artificial Sequence
  Synthetic oligonucleotide; AAG chr2 60523694 60523713 60523710 +
gtaccacacaagactccagt

SEQ ID NO: 166646 - DNA, 20 bp, Artificial Sequence
  Synthetic oligonucleotide; CAG chr2 60523713 60523732 60523729 +
taagcaaaatcattcattgc

SEQ ID NO: 166647 - DNA, 20 bp, Artificial Sequence
  Synthetic oligonucleotide; AGG chr2 60523714 60523733 60523730 +
aagcaaaatcattcattgcc

SEQ ID NO: 166648 - DNA, 20 bp, Artificial Sequence
  Synthetic oligonucleotide; GAG chr2 60523725 60523744 60523741 +
ttcattgccaggcaaaactt

SEQ ID NO: 166649 - DNA, 20 bp, Artificial Sequence
  Synthetic oligonucleotide; TAG chr2 60523737 60523756 60523753 +
caaaacttgagaaatacatt

SEQ ID NO: 166650 - DNA, 20 bp, Artificial Sequence
  Synthetic oligonucleotide; GAG chr2 60523749 60523768 60523765 +
aatacatttagaaatcatac

SEQ ID NO: 166651 - DNA, 20 bp, Artificial Sequence
  Synthetic oligonucleotide; CAG chr2 60523756 60523775 60523772 +
ttagaaatcatacgagcaca

SEQ ID NO: 166652 - DNA, 20 bp, Artificial Sequence
  Synthetic oligonucleotide; AGG chr2 60523757 60523776 60523773 +
tagaaatcatacgagcacac

SEQ ID NO: 166653 - DNA, 20 bp, Artificial Sequence
  Synthetic oligonucleotide; GAG chr2 60523759 60523778 60523775 +
gaaatcatacgagcacacag

SEQ ID NO: 166654 - DNA, 20 bp, Artificial Sequence
  Synthetic oligonucleotide; AAG chr2 60523769 60523788 60523785 +
gagcacacaggagctcaatc

SEQ ID NO: 166655 - DNA, 20 bp, Artificial Sequence
  Synthetic oligonucleotide; AAG chr2 60523785 60523804 60523801 +
aatcaagtaaatgaatcacc

SEQ ID NO: 166656 - DNA, 20 bp, Artificial Sequence
  Synthetic oligonucleotide; AGG chr2 60523786 60523805 60523802 +
atcaagtaaatgaatcacca

SEQ ID NO: 166657 - DNA, 20 bp, Artificial Sequence
  Synthetic oligonucleotide; CAG chr2 60523791 60523810 60523807 +
gtaaatgaatcaccaaggca

SEQ ID NO: 166658 - DNA, 20 bp, Artificial Sequence
  Synthetic oligonucleotide; AAG chr2 60523795 60523814 60523811 +
atgaatcaccaaggcacaga

SEQ ID NO: 166659 - DNA, 20 bp, Artificial Sequence
  Synthetic oligonucleotide; TGG chr2 60523802 60523821 60523818 +
accaaggcacagaaagtcac

SEQ ID NO: 166660 - DNA, 20 bp, Artificial Sequence
  Synthetic oligonucleotide; TAG chr2 60523818 60523837 60523834 +
tcactggaaaattacttaac

SEQ ID NO: 166661 - DNA, 20 bp, Artificial Sequence
  Synthetic oligonucleotide; AAG chr2 60523832 60523851 60523848 +
cttaactagcccaaacgttc

SEQ ID NO: 166662 - DNA, 20 bp, Artificial Sequence
  Synthetic oligonucleotide; AAG chr2 60523843 60523862 60523859 +
caaacgttcaagaattgacc

SEQ ID NO: 166663 - DNA, 20 bp, Artificial Sequence
  Synthetic oligonucleotide; AGG chr2 60523844 60523863 60523860 +
aaacgttcaagaattgacca

SEQ ID NO: 166664 - DNA, 20 bp, Artificial Sequence
  Synthetic oligonucleotide; AAG chr2 60523850 60523869 60523866 +
tcaagaattgaccaaggttt

SEQ ID NO: 166665 - DNA, 20 bp, Artificial Sequence
  Synthetic oligonucleotide; CAG chr2 60523853 60523872 60523869 +
agaattgaccaaggtttaag

SEQ ID NO: 166666 - DNA, 20 bp, Artificial Sequence
  Synthetic oligonucleotide; AAG chr2 60523877 60523896 60523893 +
aaaccctaaataatttattt

SEQ ID NO: 166667 - DNA, 20 bp, Artificial Sequence
  Synthetic oligonucleotide; TAG chr2 60523885 60523904 60523901 +
aataatttatttaagccaaa

SEQ ID NO: 166668 - DNA, 20 bp, Artificial Sequence
  Synthetic oligonucleotide; AGG chr2 60523886 60523905 60523902 +
ataatttatttaagccaaat

SEQ ID NO: 166669 - DNA, 20 bp, Artificial Sequence
  Synthetic oligonucleotide; GAG chr2 60523888 60523907 60523904 +
aatttatttaagccaaatag

SEQ ID NO: 166670 - DNA, 20 bp, Artificial Sequence
  Synthetic oligonucleotide; AAG chr2 60523895 60523914 60523911 +
ttaagccaaataggagcttt

SEQ ID NO: 166671 - DNA, 20 bp, Artificial Sequence
  Synthetic oligonucleotide; CAG chr2 60523900 60523919 60523916 +
ccaaataggagctttaagca

SEQ ID NO: 166672 - DNA, 20 bp, Artificial Sequence
  Synthetic oligonucleotide; TGG chr2 60523915 60523934 60523931 +
aagcacagacattaatgtaa

SEQ ID NO: 166673 - DNA, 20 bp, Artificial Sequence
  Synthetic oligonucleotide; CAG chr2 60523937 60523956 60523953 +
gactatcccatcttaaactt

SEQ ID NO: 166674 - DNA, 20 bp, Artificial Sequence
  Synthetic oligonucleotide; CAG chr2 60523941 60523960 60523957 +
atcccatcttaaacttcagc

SEQ ID NO: 166675 - DNA, 20 bp, Artificial Sequence
  Synthetic oligonucleotide; GAG chr2 60523943 60523962 60523959 +
cccatcttaaacttcagcca

SEQ ID NO: 166676 - DNA, 20 bp, Artificial Sequence
  Synthetic oligonucleotide; AAG chr2 60523959 60523978 60523975 +
gccagagatctaaaactttg

SEQ ID NO: 166677 - DNA, 20 bp, Artificial Sequence
  Synthetic oligonucleotide; CAG chr2 60523995 60524014 60524011 +
cataaatacctctccattat

SEQ ID NO: 166678 - DNA, 20 bp, Artificial Sequence
  Synthetic oligonucleotide; AGG chr2 60523996 60524015 60524012 +
ataaatacctctccattatc

SEQ ID NO: 166679 - DNA, 20 bp, Artificial Sequence
  Synthetic oligonucleotide; GGG chr2 60523997 60524016 60524013 +
taaatacctctccattatca

SEQ ID NO: 166680 - DNA, 20 bp, Artificial Sequence
  Synthetic oligonucleotide; GGG chr2 60523998 60524017 60524014 +
aaatacctctccattatcag

SEQ ID NO: 166681 - DNA, 20 bp, Artificial Sequence
  Synthetic oligonucleotide; GAG chr2 60524014 60524033 60524030 +
tcaggggtgctttattgttt

SEQ ID NO: 166682 - DNA, 20 bp, Artificial Sequence
  Synthetic oligonucleotide; GAG chr2 60524016 60524035 60524032 +
aggggtgctttattgtttga

SEQ ID NO: 166683 - DNA, 20 bp, Artificial Sequence
  Synthetic oligonucleotide; CGG chr2 60524023 60524042 60524039 +
ctttattgtttgagagactc

SEQ ID NO: 166684 - DNA, 20 bp, Artificial Sequence
  Synthetic oligonucleotide; CAG chr2 60524030 60524049 60524046 +
gtttgagagactccggacca

SEQ ID NO: 166685 - DNA, 20 bp, Artificial Sequence
  Synthetic oligonucleotide; AGG chr2 60524031 60524050 60524047 +
tttgagagactccggaccac

SEQ ID NO: 166686 - DNA, 20 bp, Artificial Sequence
  Synthetic oligonucleotide; TAG chr2 60524037 60524056 60524053 +
agactccggaccacaggaac

SEQ ID NO: 166687 - DNA, 20 bp, Artificial Sequence
  Synthetic oligonucleotide; TGG chr2 60524049 60524068 60524065 +
acaggaactagtgtgaaaac

SEQ ID NO: 166688 - DNA, 20 bp, Artificial Sequence
  Synthetic oligonucleotide; GAG chr2 60524051 60524070 60524067 +
aggaactagtgtgaaaactg

SEQ ID NO: 166689 - DNA, 20 bp, Artificial Sequence
  Synthetic oligonucleotide; AGG chr2 60524052 60524071 60524068 +
ggaactagtgtgaaaactgg

SEQ ID NO: 166690 - DNA, 20 bp, Artificial Sequence
  Synthetic oligonucleotide; GGG chr2 60524053 60524072 60524069 +
gaactagtgtgaaaactgga

SEQ ID NO: 166691 - DNA, 20 bp, Artificial Sequence
  Synthetic oligonucleotide; TGG chr2 60524102 60524121 60524118 +
ttcgcaaacaaaatatgcca

SEQ ID NO: 166692 - DNA, 20 bp, Artificial Sequence
  Synthetic oligonucleotide; CAG chr2 60524135 60524154 60524151 +
ctatatatcacattgtgaca

SEQ ID NO: 166693 - DNA, 20 bp, Artificial Sequence
  Synthetic oligonucleotide; TAG chr2 60524148 60524167 60524164 +
tgtgacacagctgaccgcat

SEQ ID NO: 166694 - DNA, 20 bp, Artificial Sequence
  Synthetic oligonucleotide; GAG chr2 60524152 60524171 60524168 +
acacagctgaccgcattagt

SEQ ID NO: 166695 - DNA, 20 bp, Artificial Sequence
  Synthetic oligonucleotide; AAG chr2 60524157 60524176 60524173 +
gctgaccgcattagtgagcc

SEQ ID NO: 166696 - DNA, 20 bp, Artificial Sequence
  Synthetic oligonucleotide; TAG chr2 60524167 60524186 60524183 +
ttagtgagccaagactgtcc

SEQ ID NO: 166697 - DNA, 20 bp, Artificial Sequence
  Synthetic oligonucleotide; CGG chr2 60524170 60524189 60524186 +
gtgagccaagactgtcctag

SEQ ID NO: 166698 - DNA, 20 bp, Artificial Sequence
  Synthetic oligonucleotide; CAG chr2 60524173 60524192 60524189 +
agccaagactgtcctagcgg

SEQ ID NO: 166699 - DNA, 20 bp, Artificial Sequence
  Synthetic oligonucleotide; CGG chr2 60524202 60524221 60524218 +
atcatgcattaacaatacaa

SEQ ID NO: 166700 - DNA, 20 bp, Artificial Sequence
  Synthetic oligonucleotide; AAG chr2 60524228 60524247 60524244 +
atacatttgcacaacacaat

SEQ ID NO: 166701 - DNA, 20 bp, Artificial Sequence
  Synthetic oligonucleotide; GAG chr2 60524230 60524249 60524246 +
acatttgcacaacacaataa

SEQ ID NO: 166702 - DNA, 20 bp, Artificial Sequence
  Synthetic oligonucleotide; AGG chr2 60524231 60524250 60524247 +
catttgcacaacacaataag

SEQ ID NO: 166703 - DNA, 20 bp, Artificial Sequence
  Synthetic oligonucleotide; TGG chr2 60524234 60524253 60524250 +
ttgcacaacacaataagagg

SEQ ID NO: 166704 - DNA, 20 bp, Artificial Sequence
  Synthetic oligonucleotide; GGG chr2 60524235 60524254 60524251 +
tgcacaacacaataagaggt

SEQ ID NO: 166705 - DNA, 20 bp, Artificial Sequence
  Synthetic oligonucleotide; GGG chr2 60524236 60524255 60524252 +
gcacaacacaataagaggtg

SEQ ID NO: 166706 - DNA, 20 bp, Artificial Sequence
  Synthetic oligonucleotide; GGG chr2 60524237 60524256 60524253 +
cacaacacaataagaggtgg

SEQ ID NO: 166707 - DNA, 20 bp, Artificial Sequence
  Synthetic oligonucleotide; GAG chr2 60524239 60524258 60524255 +
caacacaataagaggtgggg

SEQ ID NO: 166708 - DNA, 20 bp, Artificial Sequence
  Synthetic oligonucleotide; AAG chr2 60524242 60524261 60524258 +
cacaataagaggtgggggag

SEQ ID NO: 166709 - DNA, 20 bp, Artificial Sequence
  Synthetic oligonucleotide; GAG chr2 60524244 60524263 60524260 +
caataagaggtgggggagaa

SEQ ID NO: 166710 - DNA, 20 bp, Artificial Sequence
  Synthetic oligonucleotide; GAG chr2 60524246 60524265 60524262 +
ataagaggtgggggagaaga

SEQ ID NO: 166711 - DNA, 20 bp, Artificial Sequence
  Synthetic oligonucleotide; TGG chr2 60524254 60524273 60524270 +
tgggggagaagagagaacat

SEQ ID NO: 166712 - DNA, 20 bp, Artificial Sequence
  Synthetic oligonucleotide; GGG chr2 60524255 60524274 60524271 +
gggggagaagagagaacatt

SEQ ID NO: 166713 - DNA, 20 bp, Artificial Sequence
  Synthetic oligonucleotide; TGG chr2 60524309 60524328 60524325 +
ataattttgtcacctatctc

SEQ ID NO: 166714 - DNA, 20 bp, Artificial Sequence
  Synthetic oligonucleotide; CAG chr2 60524337 60524356 60524353 +
atgttatcatgcttttattt

SEQ ID NO: 166715 - DNA, 20 bp, Artificial Sequence
  Synthetic oligonucleotide; AGG chr2 60524338 60524357 60524354 +
tgttatcatgcttttatttc

SEQ ID NO: 166716 - DNA, 20 bp, Artificial Sequence
  Synthetic oligonucleotide; TGG chr2 60524347 60524366 60524363 +
gcttttatttcaggtaataa

SEQ ID NO: 166717 - DNA, 20 bp, Artificial Sequence
  Synthetic oligonucleotide; AAG chr2 60524350 60524369 60524366 +
tttatttcaggtaataatgg

SEQ ID NO: 166718 - DNA, 20 bp, Artificial Sequence
  Synthetic oligonucleotide; AGG chr2 60524351 60524370 60524367 +
ttatttcaggtaataatgga

SEQ ID NO: 166719 - DNA, 20 bp, Artificial Sequence
  Synthetic oligonucleotide; GGG chr2 60524352 60524371 60524368 +
tatttcaggtaataatggaa

SEQ ID NO: 166720 - DNA, 20 bp, Artificial Sequence
  Synthetic oligonucleotide; GGG chr2 60524353 60524372 60524369 +
atttcaggtaataatggaag

SEQ ID NO: 166721 - DNA, 20 bp, Artificial Sequence
  Synthetic oligonucleotide; AAG chr2 60524357 60524376 60524373 +
caggtaataatggaagggga

SEQ ID NO: 166722 - DNA, 20 bp, Artificial Sequence
  Synthetic oligonucleotide; TAG chr2 60524360 60524379 60524376 +
gtaataatggaaggggaaag

SEQ ID NO: 166723 - DNA, 20 bp, Artificial Sequence
  Synthetic oligonucleotide; GAG chr2 60524362 60524381 60524378 +
aataatggaaggggaaagta

SEQ ID NO: 166724 - DNA, 20 bp, Artificial Sequence
  Synthetic oligonucleotide; TGG chr2 60524369 60524388 60524385 +
gaaggggaaagtagagcctc

SEQ ID NO: 166725 - DNA, 20 bp, Artificial Sequence
  Synthetic oligonucleotide; GGG chr2 60524370 60524389 60524386 +
aaggggaaagtagagcctct

SEQ ID NO: 166726 - DNA, 20 bp, Artificial Sequence
  Synthetic oligonucleotide; GGG chr2 60524371 60524390 60524387 +
aggggaaagtagagcctctg

SEQ ID NO: 166727 - DNA, 20 bp, Artificial Sequence
  Synthetic oligonucleotide; GGG chr2 60524372 60524391 60524388 +
ggggaaagtagagcctctgg

SEQ ID NO: 166728 - DNA, 20 bp, Artificial Sequence
  Synthetic oligonucleotide; GGG chr2 60524373 60524392 60524389 +
gggaaagtagagcctctggg

SEQ ID NO: 166729 - DNA, 20 bp, Artificial Sequence
  Synthetic oligonucleotide; CGG chr2 60524388 60524407 60524404 +
ctggggggctgccattcatt

SEQ ID NO: 166730 - DNA, 20 bp, Artificial Sequence
  Synthetic oligonucleotide; TGG chr2 60524406 60524425 60524422 +
ttcggcctgttatttgcttt

SEQ ID NO: 166731 - DNA, 20 bp, Artificial Sequence
  Synthetic oligonucleotide; GGG chr2 60524407 60524426 60524423 +
tcggcctgttatttgctttt

SEQ ID NO: 166732 - DNA, 20 bp, Artificial Sequence
  Synthetic oligonucleotide; TGG chr2 60524411 60524430 60524427 +
cctgttatttgcttttgggt

SEQ ID NO: 166733 - DNA, 20 bp, Artificial Sequence
  Synthetic oligonucleotide; GGG chr2 60524412 60524431 60524428 +
ctgttatttgcttttgggtt

SEQ ID NO: 166734 - DNA, 20 bp, Artificial Sequence
  Synthetic oligonucleotide; TAG chr2 60524416 60524435 60524432 +
tatttgcttttgggttgggt

SEQ ID NO: 166735 - DNA, 20 bp, Artificial Sequence
  Synthetic oligonucleotide; AGG chr2 60524417 60524436 60524433 +
atttgcttttgggttgggtt

SEQ ID NO: 166736 - DNA, 20 bp, Artificial Sequence
  Synthetic oligonucleotide; GGG chr2 60524418 60524437 60524434 +
tttgcttttgggttgggtta

SEQ ID NO: 166737 - DNA, 20 bp, Artificial Sequence
  Synthetic oligonucleotide; AAG chr2 60524478 60524497 60524494 +
tttcttttttcttgtttttt

SEQ ID NO: 166738 - DNA, 20 bp, Artificial Sequence
  Synthetic oligonucleotide; CAG chr2 60524496 60524515 60524512 +
ttaagattttattttgttac

SEQ ID NO: 166739 - DNA, 20 bp, Artificial Sequence
  Synthetic oligonucleotide; GAG chr2 60524498 60524517 60524514 +
aagattttattttgttacca

SEQ ID NO: 166740 - DNA, 20 bp, Artificial Sequence
  Synthetic oligonucleotide; TAG chr2 60524502 60524521 60524518 +
ttttattttgttaccagaga

SEQ ID NO: 166741 - DNA, 20 bp, Artificial Sequence
  Synthetic oligonucleotide; AAG chr2 60524505 60524524 60524521 +
tattttgttaccagagatag

SEQ ID NO: 166742 - DNA, 20 bp, Artificial Sequence
  Synthetic oligonucleotide; GAG chr2 60524507 60524526 60524523 +
ttttgttaccagagatagaa

SEQ ID NO: 166743 - DNA, 20 bp, Artificial Sequence
  Synthetic oligonucleotide; CAG chr2 60524520 60524539 60524536 +
gatagaagagcatgcaaaat

SEQ ID NO: 166744 - DNA, 20 bp, Artificial Sequence
  Synthetic oligonucleotide; CAG chr2 60524526 60524545 60524542 +
agagcatgcaaaatcagaaa

SEQ ID NO: 166745 - DNA, 20 bp, Artificial Sequence
  Synthetic oligonucleotide; CAG chr2 60524537 60524556 60524553 +
aatcagaaacagctgattac

SEQ ID NO: 166746 - DNA, 20 bp, Artificial Sequence
  Synthetic oligonucleotide; CAG chr2 60524548 60524567 60524564 +
gctgattaccagtgccctta

SEQ ID NO: 166747 - DNA, 20 bp, Artificial Sequence
  Synthetic oligonucleotide; GAG chr2 60524550 60524569 60524566 +
tgattaccagtgcccttaca

SEQ ID NO: 166748 - DNA, 20 bp, Artificial Sequence
  Synthetic oligonucleotide; AAG chr2 60524589 60524608 60524605 +
ccccaaaacattataaatta

SEQ ID NO: 166749 - DNA, 20 bp, Artificial Sequence
  Synthetic oligonucleotide; GAG chr2 60524591 60524610 60524607 +
ccaaaacattataaattaaa

SEQ ID NO: 166750 - DNA, 20 bp, Artificial Sequence
  Synthetic oligonucleotide; AGG chr2 60524592 60524611 60524608 +
caaaacattataaattaaag

SEQ ID NO: 166751 - DNA, 20 bp, Artificial Sequence
  Synthetic oligonucleotide; CAG chr2 60524595 60524614 60524611 +
aacattataaattaaagagg

SEQ ID NO: 166752 - DNA, 20 bp, Artificial Sequence
  Synthetic oligonucleotide; AAG chr2 60524625 60524644 60524641 +
aataaattacctttttattg

SEQ ID NO: 166753 - DNA, 20 bp, Artificial Sequence
  Synthetic oligonucleotide; TAG chr2 60524631 60524650 60524647 +
ttacctttttattgaagcta

SEQ ID NO: 166754 - DNA, 20 bp, Artificial Sequence
  Synthetic oligonucleotide; AAG chr2 60524639 60524658 60524655 +
ttattgaagctatagatctc

SEQ ID NO: 166755 - DNA, 20 bp, Artificial Sequence
  Synthetic oligonucleotide; GAG chr2 60524641 60524660 60524657 +
attgaagctatagatctcaa

SEQ ID NO: 166756 - DNA, 20 bp, Artificial Sequence
  Synthetic oligonucleotide; AAG chr2 60524658 60524677 60524674 +
caagagtgcctgtgtcctac

SEQ ID NO: 166757 - DNA, 20 bp, Artificial Sequence
  Synthetic oligonucleotide; AGG chr2 60524659 60524678 60524675 +
aagagtgcctgtgtcctaca

SEQ ID NO: 166758 - DNA, 20 bp, Artificial Sequence
  Synthetic oligonucleotide; GAG chr2 60524701 60524720 60524717 +
attcatttgccccttactct

SEQ ID NO: 166759 - DNA, 20 bp, Artificial Sequence
  Synthetic oligonucleotide; TGG chr2 60524708 60524727 60524724 +
tgccccttactctgagcaca

SEQ ID NO: 166760 - DNA, 20 bp, Artificial Sequence
  Synthetic oligonucleotide; GGG chr2 60524709 60524728 60524725 +
gccccttactctgagcacat

SEQ ID NO: 166761 - DNA, 20 bp, Artificial Sequence
  Synthetic oligonucleotide; AAG chr2 60524719 60524738 60524735 +
ctgagcacatgggataataa

SEQ ID NO: 166762 - DNA, 20 bp, Artificial Sequence
  Synthetic oligonucleotide; AAG chr2 60524723 60524742 60524739 +
gcacatgggataataaaaga

SEQ ID NO: 166763 - DNA, 20 bp, Artificial Sequence
  Synthetic oligonucleotide; TAG chr2 60524729 60524748 60524745 +
gggataataaaagaaagttt

SEQ ID NO: 166764 - DNA, 20 bp, Artificial Sequence
  Synthetic oligonucleotide; AAG chr2 60524746 60524765 60524762 +
ttttagatcatcattatcca

SEQ ID NO: 166765 - DNA, 20 bp, Artificial Sequence
  Synthetic oligonucleotide; AGG chr2 60524747 60524766 60524763 +
tttagatcatcattatccaa

SEQ ID NO: 166766 - DNA, 20 bp, Artificial Sequence
  Synthetic oligonucleotide; CAG chr2 60524771 60524790 60524787 +
taactttgaatgcccttttt

SEQ ID NO: 166767 - DNA, 20 bp, Artificial Sequence
  Synthetic oligonucleotide; TGG chr2 60524820 60524839 60524836 +
cattcaatgccacatataaa

SEQ ID NO: 166768 - DNA, 20 bp, Artificial Sequence
  Synthetic oligonucleotide; TGG chr2 60524830 60524849 60524846 +
cacatataaatggtatttgc

SEQ ID NO: 166769 - DNA, 20 bp, Artificial Sequence
  Synthetic oligonucleotide; CAG chr2 60524834 60524853 60524850 +
tataaatggtatttgctgga

SEQ ID NO: 166770 - DNA, 20 bp, Artificial Sequence
  Synthetic oligonucleotide; TGG chr2 60524839 60524858 60524855 +
atggtatttgctggacagtg

SEQ ID NO: 166771 - DNA, 20 bp, Artificial Sequence
  Synthetic oligonucleotide; CAG chr2 60524846 60524865 60524862 +
ttgctggacagtgtggaaaa

SEQ ID NO: 166772 - DNA, 20 bp, Artificial Sequence
  Synthetic oligonucleotide; AAG chr2 60524864 60524883 60524880 +
aacagaaacatccgtgctaa

SEQ ID NO: 166773 - DNA, 20 bp, Artificial Sequence
  Synthetic oligonucleotide; TGG chr2 60524871 60524890 60524887 +
acatccgtgctaaaagccaa

SEQ ID NO: 166774 - DNA, 20 bp, Artificial Sequence
  Synthetic oligonucleotide; AAG chr2 60524882 60524901 60524898 +
aaaagccaatggtaaacacc

SEQ ID NO: 166775 - DNA, 20 bp, Artificial Sequence
  Synthetic oligonucleotide; TGG chr2 60524894 60524913 60524910 +
taaacaccaagtttaaaaaa

SEQ ID NO: 166776 - DNA, 20 bp, Artificial Sequence
  Synthetic oligonucleotide; AAG chr2 60524903 60524922 60524919 +
agtttaaaaaatggattgca

SEQ ID NO: 166777 - DNA, 20 bp, Artificial Sequence
  Synthetic oligonucleotide; CAG chr2 60524917 60524936 60524933 +
attgcaaagatcgcatgtcc

SEQ ID NO: 166778 - DNA, 20 bp, Artificial Sequence
  Synthetic oligonucleotide; CAG chr2 60524922 60524941 60524938 +
aaagatcgcatgtcccagaa

SEQ ID NO: 166779 - DNA, 20 bp, Artificial Sequence
  Synthetic oligonucleotide; AGG chr2 60524923 60524942 60524939 +
aagatcgcatgtcccagaac

SEQ ID NO: 166780 - DNA, 20 bp, Artificial Sequence
  Synthetic oligonucleotide; AAG chr2 60524958 60524977 60524974 +
acctacatgatgaataaaaa

SEQ ID NO: 166781 - DNA, 20 bp, Artificial Sequence
  Synthetic oligonucleotide; CAG chr2 60524998 60525017 60525014 +
tatgctgtcttcaacactaa

SEQ ID NO: 166782 - DNA, 20 bp, Artificial Sequence
  Synthetic oligonucleotide; GAG chr2 60525000 60525019 60525016 +
tgctgtcttcaacactaaca

SEQ ID NO: 166783 - DNA, 20 bp, Artificial Sequence
  Synthetic oligonucleotide; AGG chr2 60525001 60525020 60525017 +
gctgtcttcaacactaacag

SEQ ID NO: 166784 - DNA, 20 bp, Artificial Sequence
  Synthetic oligonucleotide; GGG chr2 60525002 60525021 60525018 +
ctgtcttcaacactaacaga

SEQ ID NO: 166785 - DNA, 20 bp, Artificial Sequence
  Synthetic oligonucleotide; GAG chr2 60525004 60525023 60525020 +
gtcttcaacactaacagagg

SEQ ID NO: 166786 - DNA, 20 bp, Artificial Sequence
  Synthetic oligonucleotide; GAG chr2 60525006 60525025 60525022 +
cttcaacactaacagaggga

SEQ ID NO: 166787 - DNA, 20 bp, Artificial Sequence
  Synthetic oligonucleotide; CGG chr2 60525029 60525048 60525045 +
ttcttctaaacatgttgcat

SEQ ID NO: 166788 - DNA, 20 bp, Artificial Sequence
  Synthetic oligonucleotide; AAG chr2 60525043 60525062 60525059 +
ttgcatcggatgcctttaac

SEQ ID NO: 166789 - DNA, 20 bp, Artificial Sequence
  Synthetic oligonucleotide; CAG chr2 60525062 60525081 60525078 +
caagcaaaaattcctaactc

SEQ ID NO: 166790 - DNA, 20 bp, Artificial Sequence
  Synthetic oligonucleotide; AGG chr2 60525063 60525082 60525079 +
aagcaaaaattcctaactcc

SEQ ID NO: 166791 - DNA, 20 bp, Artificial Sequence
  Synthetic oligonucleotide; GGG chr2 60525064 60525083 60525080 +
agcaaaaattcctaactcca

SEQ ID NO: 166792 - DNA, 20 bp, Artificial Sequence
  Synthetic oligonucleotide; CAG chr2 60525070 60525089 60525086 +
aattcctaactccagggact

SEQ ID NO: 166793 - DNA, 20 bp, Artificial Sequence
  Synthetic oligonucleotide; TAG chr2 60525079 60525098 60525095 +
ctccagggactcagcatatg

SEQ ID NO: 166794 - DNA, 20 bp, Artificial Sequence
  Synthetic oligonucleotide; AGG chr2 60525080 60525099 60525096 +
tccagggactcagcatatgt

SEQ ID NO: 166795 - DNA, 20 bp, Artificial Sequence
  Synthetic oligonucleotide; CAG chr2 60525094 60525113 60525110 +
atatgtaggctatgtccata

SEQ ID NO: 166796 - DNA, 20 bp, Artificial Sequence
  Synthetic oligonucleotide; GAG chr2 60525096 60525115 60525112 +
atgtaggctatgtccataca

SEQ ID NO: 166797 - DNA, 20 bp, Artificial Sequence
  Synthetic oligonucleotide; CAG chr2 60525103 60525122 60525119 +
ctatgtccatacagagaaac

SEQ ID NO: 166798 - DNA, 20 bp, Artificial Sequence
  Synthetic oligonucleotide; TGG chr2 60525110 60525129 60525126 +
catacagagaaaccagcttt

SEQ ID NO: 166799 - DNA, 20 bp, Artificial Sequence
  Synthetic oligonucleotide; GGG chr2 60525111 60525130 60525127 +
atacagagaaaccagctttt

SEQ ID NO: 166800 - DNA, 20 bp, Artificial Sequence
  Synthetic oligonucleotide; GAG chr2 60525113 60525132 60525129 +
acagagaaaccagcttttgg

SEQ ID NO: 166801 - DNA, 20 bp, Artificial Sequence
  Synthetic oligonucleotide; AGG chr2 60525114 60525133 60525130 +
cagagaaaccagcttttggg

SEQ ID NO: 166802 - DNA, 20 bp, Artificial Sequence
  Synthetic oligonucleotide; GAG chr2 60525116 60525135 60525132 +
gagaaaccagcttttgggag

SEQ ID NO: 166803 - DNA, 20 bp, Artificial Sequence
  Synthetic oligonucleotide; AGG chr2 60525117 60525136 60525133 +
agaaaccagcttttgggagg

SEQ ID NO: 166804 - DNA, 20 bp, Artificial Sequence
  Synthetic oligonucleotide; AAG chr2 60525120 60525139 60525136 +
aaccagcttttgggaggagg

SEQ ID NO: 166805 - DNA, 20 bp, Artificial Sequence
  Synthetic oligonucleotide; AGG chr2 60525121 60525140 60525137 +
accagcttttgggaggagga

SEQ ID NO: 166806 - DNA, 20 bp, Artificial Sequence
  Synthetic oligonucleotide; GAG chr2 60525123 60525142 60525139 +
cagcttttgggaggaggaag

SEQ ID NO: 166807 - DNA, 20 bp, Artificial Sequence
  Synthetic oligonucleotide; AGG chr2 60525124 60525143 60525140 +
agcttttgggaggaggaagg

SEQ ID NO: 166808 - DNA, 20 bp, Artificial Sequence
  Synthetic oligonucleotide; CAG chr2 60525143 60525162 60525159 +
gaggaaaatatcactgaatt

SEQ ID NO: 166809 - DNA, 20 bp, Artificial Sequence
  Synthetic oligonucleotide; CAG chr2 60525147 60525166 60525163 +
aaaatatcactgaattcagt

SEQ ID NO: 166810 - DNA, 20 bp, Artificial Sequence
  Synthetic oligonucleotide; TGG chr2 60525170 60525189 60525186 +
ttaattgaatttaaaatacc

SEQ ID NO: 166811 - DNA, 20 bp, Artificial Sequence
  Synthetic oligonucleotide; TAG chr2 60525223 60525242 60525239 +
aacgtacttctattttgatg

SEQ ID NO: 166812 - DNA, 20 bp, Artificial Sequence
  Synthetic oligonucleotide; AAG chr2 60525242 60525261 60525258 +
gtagttacatttgcccaaaa

SEQ ID NO: 166813 - DNA, 20 bp, Artificial Sequence
  Synthetic oligonucleotide; TGG chr2 60525251 60525270 60525267 +
tttgcccaaaaaagcaaact

SEQ ID NO: 166814 - DNA, 20 bp, Artificial Sequence
  Synthetic oligonucleotide; GAG chr2 60525253 60525272 60525269 +
tgcccaaaaaagcaaacttg

SEQ ID NO: 166815 - DNA, 20 bp, Artificial Sequence
  Synthetic oligonucleotide; TGG chr2 60525276 60525295 60525292 +
aaaatacacattacattctt

SEQ ID NO: 166816 - DNA, 20 bp, Artificial Sequence
  Synthetic oligonucleotide; GAG chr2 60525278 60525297 60525294 +
aatacacattacattctttg

SEQ ID NO: 166817 - DNA, 20 bp, Artificial Sequence
  Synthetic oligonucleotide; CAG chr2 60525295 60525314 60525311 +
ttggagtttttcaaaaaaaa

SEQ ID NO: 166818 - DNA, 20 bp, Artificial Sequence
  Synthetic oligonucleotide; AAG chr2 60525312 60525331 60525328 +
aaacagcttgcaacaattaa

SEQ ID NO: 166819 - DNA, 20 bp, Artificial Sequence
  Synthetic oligonucleotide; TGG chr2 60525316 60525335 60525332 +
agcttgcaacaattaaaaga

SEQ ID NO: 166820 - DNA, 20 bp, Artificial Sequence
  Synthetic oligonucleotide; GAG chr2 60525318 60525337 60525334 +
cttgcaacaattaaaagatg

SEQ ID NO: 166821 - DNA, 20 bp, Artificial Sequence
  Synthetic oligonucleotide; AAG chr2 60525330 60525349 60525346 +
aaaagatggagaaatcttat

SEQ ID NO: 166822 - DNA, 20 bp, Artificial Sequence
  Synthetic oligonucleotide; AGG chr2 60525331 60525350 60525347 +
aaagatggagaaatcttata

SEQ ID NO: 166823 - DNA, 20 bp, Artificial Sequence
  Synthetic oligonucleotide; TGG chr2 60525335 60525354 60525351 +
atggagaaatcttataaggc

SEQ ID NO: 166824 - DNA, 20 bp, Artificial Sequence
  Synthetic oligonucleotide; CAG chr2 60525390 60525409 60525406 +
ctgcacttcaattttgcttc

SEQ ID NO: 166825 - DNA, 20 bp, Artificial Sequence
  Synthetic oligonucleotide; AAG chr2 60525401 60525420 60525417 +
ttttgcttccagcaatttga

SEQ ID NO: 166826 - DNA, 20 bp, Artificial Sequence
  Synthetic oligonucleotide; AAG chr2 60525412 60525431 60525428 +
gcaatttgaaagatgccttt

SEQ ID NO: 166827 - DNA, 20 bp, Artificial Sequence
  Synthetic oligonucleotide; TGG chr2 60525423 60525442 60525439 +
gatgcctttaagctttctgt

SEQ ID NO: 166828 - DNA, 20 bp, Artificial Sequence
  Synthetic oligonucleotide; GGG chr2 60525424 60525443 60525440 +
atgcctttaagctttctgtt

SEQ ID NO: 166829 - DNA, 20 bp, Artificial Sequence
  Synthetic oligonucleotide; GGG chr2 60525425 60525444 60525441 +
tgcctttaagctttctgttg

SEQ ID NO: 166830 - DNA, 20 bp, Artificial Sequence
  Synthetic oligonucleotide; AAG chr2 60525440 60525459 60525456 +
tgttggggaatcacgaatcc

SEQ ID NO: 166831 - DNA, 20 bp, Artificial Sequence
  Synthetic oligonucleotide; TAG chr2 60525458 60525477 60525474 +
ccaagccttaatctccacca

SEQ ID NO: 166832 - DNA, 20 bp, Artificial Sequence
  Synthetic oligonucleotide; GAG chr2 60525472 60525491 60525488 +
ccaccatagcttccatcttt

SEQ ID NO: 166833 - DNA, 20 bp, Artificial Sequence
  Synthetic oligonucleotide; AGG chr2 60525473 60525492 60525489 +
caccatagcttccatctttg

SEQ ID NO: 166834 - DNA, 20 bp, Artificial Sequence
  Synthetic oligonucleotide; AAG chr2 60525482 60525501 60525498 +
ttccatctttgaggcaaatc

SEQ ID NO: 166835 - DNA, 20 bp, Artificial Sequence
  Synthetic oligonucleotide; CAG chr2 60525508 60525527 60525524 +
ataatattctgctgtctttg

SEQ ID NO: 166836 - DNA, 20 bp, Artificial Sequence
  Synthetic oligonucleotide; AGG chr2 60525509 60525528 60525525 +
taatattctgctgtctttgc

SEQ ID NO: 166837 - DNA, 20 bp, Artificial Sequence
  Synthetic oligonucleotide; GAG chr2 60525513 60525532 60525529 +
attctgctgtctttgcaggt

SEQ ID NO: 166838 - DNA, 20 bp, Artificial Sequence
  Synthetic oligonucleotide; CAG chr2 60525523 60525542 60525539 +
ctttgcaggtgagccccatt

SEQ ID NO: 166839 - DNA, 20 bp, Artificial Sequence
  Synthetic oligonucleotide; TAG chr2 60525530 60525549 60525546 +
ggtgagccccattcagcaac

SEQ ID NO: 166840 - DNA, 20 bp, Artificial Sequence
  Synthetic oligonucleotide; TAG chr2 60525544 60525563 60525560 +
agcaactagattccaaaaaa

SEQ ID NO: 166841 - DNA, 20 bp, Artificial Sequence
  Synthetic oligonucleotide; CAG chr2 60525547 60525566 60525563 +
aactagattccaaaaaatag

SEQ ID NO: 166842 - DNA, 20 bp, Artificial Sequence
  Synthetic oligonucleotide; AGG chr2 60525548 60525567 60525564 +
actagattccaaaaaatagc

SEQ ID NO: 166843 - DNA, 20 bp, Artificial Sequence
  Synthetic oligonucleotide; GGG chr2 60525549 60525568 60525565 +
ctagattccaaaaaatagca

SEQ ID NO: 166844 - DNA, 20 bp, Artificial Sequence
  Synthetic oligonucleotide; GAG chr2 60525551 60525570 60525567 +
agattccaaaaaatagcagg

SEQ ID NO: 166845 - DNA, 20 bp, Artificial Sequence
  Synthetic oligonucleotide; TGG chr2 60525559 60525578 60525575 +
aaaaatagcagggagaaaac

SEQ ID NO: 166846 - DNA, 20 bp, Artificial Sequence
  Synthetic oligonucleotide; CAG chr2 60525563 60525582 60525579 +
atagcagggagaaaactggt

SEQ ID NO: 166847 - DNA, 20 bp, Artificial Sequence
  Synthetic oligonucleotide; TGG chr2 60525566 60525585 60525582 +
gcagggagaaaactggtcag

SEQ ID NO: 166848 - DNA, 20 bp, Artificial Sequence
  Synthetic oligonucleotide; TAG chr2 60525583 60525602 60525599 +
cagtggtgttcatactatgc

SEQ ID NO: 166849 - DNA, 20 bp, Artificial Sequence
  Synthetic oligonucleotide; TGG chr2 60525593 60525612 60525609 +
catactatgctagaacatca

SEQ ID NO: 166850 - DNA, 20 bp, Artificial Sequence
  Synthetic oligonucleotide; GGG chr2 60525594 60525613 60525610 +
atactatgctagaacatcat

SEQ ID NO: 166851 - DNA, 20 bp, Artificial Sequence
  Synthetic oligonucleotide; GGG chr2 60525595 60525614 60525611 +
tactatgctagaacatcatg

SEQ ID NO: 166852 - DNA, 20 bp, Artificial Sequence
  Synthetic oligonucleotide; TAG chr2 60525601 60525620 60525617 +
gctagaacatcatggggact

SEQ ID NO: 166853 - DNA, 20 bp, Artificial Sequence
  Synthetic oligonucleotide; GAG chr2 60525603 60525622 60525619 +
tagaacatcatggggactta

SEQ ID NO: 166854 - DNA, 20 bp, Artificial Sequence
  Synthetic oligonucleotide; CAG chr2 60525613 60525632 60525629 +
tggggacttagagacccacc

SEQ ID NO: 166855 - DNA, 20 bp, Artificial Sequence
  Synthetic oligonucleotide; AAG chr2 60525644 60525663 60525660 +
atctattttacctactttac

SEQ ID NO: 166856 - DNA, 20 bp, Artificial Sequence
  Synthetic oligonucleotide; AAG chr2 60525649 60525668 60525665 +
ttttacctactttacaagac

SEQ ID NO: 166857 - DNA, 20 bp, Artificial Sequence
  Synthetic oligonucleotide; AGG chr2 60525650 60525669 60525666 +
tttacctactttacaagaca

SEQ ID NO: 166858 - DNA, 20 bp, Artificial Sequence
  Synthetic oligonucleotide; CAG chr2 60525666 60525685 60525682 +
gacaaggaaacaaatgctaa

SEQ ID NO: 166859 - DNA, 20 bp, Artificial Sequence
  Synthetic oligonucleotide; AGG chr2 60525667 60525686 60525683 +
acaaggaaacaaatgctaac

SEQ ID NO: 166860 - DNA, 20 bp, Artificial Sequence
  Synthetic oligonucleotide; AAG chr2 60525672 60525691 60525688 +
gaaacaaatgctaacaggtg

SEQ ID NO: 166861 - DNA, 20 bp, Artificial Sequence
  Synthetic oligonucleotide; AGG chr2 60525673 60525692 60525689 +
aaacaaatgctaacaggtga

SEQ ID NO: 166862 - DNA, 20 bp, Artificial Sequence
  Synthetic oligonucleotide; GGG chr2 60525674 60525693 60525690 +
aacaaatgctaacaggtgaa

SEQ ID NO: 166863 - DNA, 20 bp, Artificial Sequence
  Synthetic oligonucleotide; GAG chr2 60525676 60525695 60525692 +
caaatgctaacaggtgaagg

SEQ ID NO: 166864 - DNA, 20 bp, Artificial Sequence
  Synthetic oligonucleotide; CAG chr2 60525691 60525710 60525707 +
gaagggagcccaaaatctca

SEQ ID NO: 166865 - DNA, 20 bp, Artificial Sequence
  Synthetic oligonucleotide; AAG chr2 60525705 60525724 60525721 +
atctcacagcatgatacaat

SEQ ID NO: 166866 - DNA, 20 bp, Artificial Sequence
  Synthetic oligonucleotide; AGG chr2 60525706 60525725 60525722 +
tctcacagcatgatacaata

SEQ ID NO: 166867 - DNA, 20 bp, Artificial Sequence
  Synthetic oligonucleotide; GGG chr2 60525707 60525726 60525723 +
ctcacagcatgatacaataa

SEQ ID NO: 166868 - DNA, 20 bp, Artificial Sequence
  Synthetic oligonucleotide; CAG chr2 60525711 60525730 60525727 +
cagcatgatacaataagggt

SEQ ID NO: 166869 - DNA, 20 bp, Artificial Sequence
  Synthetic oligonucleotide; CAG chr2 60525718 60525737 60525734 +
atacaataagggtcagaacc

SEQ ID NO: 166870 - DNA, 20 bp, Artificial Sequence
  Synthetic oligonucleotide; AGG chr2 60525719 60525738 60525735 +
tacaataagggtcagaaccc

SEQ ID NO: 166871 - DNA, 20 bp, Artificial Sequence
  Synthetic oligonucleotide; TGG chr2 60525727 60525746 60525743 +
gggtcagaacccaggtgtcc

SEQ ID NO: 166872 - DNA, 20 bp, Artificial Sequence
  Synthetic oligonucleotide; CAG chr2 60525734 60525753 60525750 +
aacccaggtgtcctggtttt

SEQ ID NO: 166873 - DNA, 20 bp, Artificial Sequence
  Synthetic oligonucleotide; CAG chr2 60525739 60525758 60525755 +
aggtgtcctggttttcagat

SEQ ID NO: 166874 - DNA, 20 bp, Artificial Sequence
  Synthetic oligonucleotide; AAG chr2 60525762 60525781 60525778 +
tgtctctctgttaacactaa

SEQ ID NO: 166875 - DNA, 20 bp, Artificial Sequence
  Synthetic oligonucleotide; AAG chr2 60525768 60525787 60525784 +
tctgttaacactaaaagtca

SEQ ID NO: 166876 - DNA, 20 bp, Artificial Sequence
  Synthetic oligonucleotide; TGG chr2 60525773 60525792 60525789 +
taacactaaaagtcaaagtt

SEQ ID NO: 166877 - DNA, 20 bp, Artificial Sequence
  Synthetic oligonucleotide; TGG chr2 60525779 60525798 60525795 +
taaaagtcaaagtttggttc

SEQ ID NO: 166878 - DNA, 20 bp, Artificial Sequence
  Synthetic oligonucleotide; AAG chr2 60525800 60525819 60525816 +
ggaaaatctgtaatgcccaa

SEQ ID NO: 166879 - DNA, 20 bp, Artificial Sequence
  Synthetic oligonucleotide; CAG chr2 60525827 60525846 60525843 +
taaatgccctccccccaaac

SEQ ID NO: 166880 - DNA, 20 bp, Artificial Sequence
  Synthetic oligonucleotide; TGG chr2 60525833 60525852 60525849 +
ccctccccccaaaccagtct

SEQ ID NO: 166881 - DNA, 20 bp, Artificial Sequence
  Synthetic oligonucleotide; TGG chr2 60525847 60525866 60525863 +
cagtcttggtaatttctcca

SEQ ID NO: 166882 - DNA, 20 bp, Artificial Sequence
  Synthetic oligonucleotide; CAG chr2 60525856 60525875 60525872 +
taatttctccatggctttca

SEQ ID NO: 166883 - DNA, 20 bp, Artificial Sequence
  Synthetic oligonucleotide; AAG chr2 60525859 60525878 60525875 +
tttctccatggctttcacag

SEQ ID NO: 166884 - DNA, 20 bp, Artificial Sequence
  Synthetic oligonucleotide; AGG chr2 60525860 60525879 60525876 +
ttctccatggctttcacaga

SEQ ID NO: 166885 - DNA, 20 bp, Artificial Sequence
  Synthetic oligonucleotide; GGG chr2 60525861 60525880 60525877 +
tctccatggctttcacagaa

SEQ ID NO: 166886 - DNA, 20 bp, Artificial Sequence
  Synthetic oligonucleotide; TGG chr2 60525876 60525895 60525892 +
cagaagggtaaatgtctact

SEQ ID NO: 166887 - DNA, 20 bp, Artificial Sequence
  Synthetic oligonucleotide; AAG chr2 60525879 60525898 60525895 +
aagggtaaatgtctacttgg

SEQ ID NO: 166888 - DNA, 20 bp, Artificial Sequence
  Synthetic oligonucleotide; AGG chr2 60525880 60525899 60525896 +
agggtaaatgtctacttgga

SEQ ID NO: 166889 - DNA, 20 bp, Artificial Sequence
  Synthetic oligonucleotide; TGG chr2 60525925 60525944 60525941 +
cttcttccttcattcgtgtt

SEQ ID NO: 166890 - DNA, 20 bp, Artificial Sequence
  Synthetic oligonucleotide; TAG chr2 60525938 60525957 60525954 +
tcgtgtttggtaatcaaaaa

SEQ ID NO: 166891 - DNA, 20 bp, Artificial Sequence
  Synthetic oligonucleotide; TGG chr2 60525961 60525980 60525977 +
tttatcataatgctctcaat

SEQ ID NO: 166892 - DNA, 20 bp, Artificial Sequence
  Synthetic oligonucleotide; AAG chr2 60525964 60525983 60525980 +
atcataatgctctcaattgg

SEQ ID NO: 166893 - DNA, 20 bp, Artificial Sequence
  Synthetic oligonucleotide; AGG chr2 60525965 60525984 60525981 +
tcataatgctctcaattgga

SEQ ID NO: 166894 - DNA, 20 bp, Artificial Sequence
  Synthetic oligonucleotide; CAG chr2 60525979 60525998 60525995 +
attggaaggtcttcatacta

SEQ ID NO: 166895 - DNA, 20 bp, Artificial Sequence
  Synthetic oligonucleotide; AGG chr2 60525980 60525999 60525996 +
ttggaaggtcttcatactac

SEQ ID NO: 166896 - DNA, 20 bp, Artificial Sequence
  Synthetic oligonucleotide; CAG chr2 60525983 60526002 60525999 +
gaaggtcttcatactacagg

SEQ ID NO: 166897 - DNA, 20 bp, Artificial Sequence
  Synthetic oligonucleotide; TGG chr2 60526000 60526019 60526016 +
aggcagatactgttattttc

SEQ ID NO: 166898 - DNA, 20 bp, Artificial Sequence
  Synthetic oligonucleotide; TAG chr2 60526003 60526022 60526019 +
cagatactgttattttctgg

SEQ ID NO: 166899 - DNA, 20 bp, Artificial Sequence
  Synthetic oligonucleotide; GAG chr2 60526005 60526024 60526021 +
gatactgttattttctggta

SEQ ID NO: 166900 - DNA, 20 bp, Artificial Sequence
  Synthetic oligonucleotide; AGG chr2 60526006 60526025 60526022 +
atactgttattttctggtag

SEQ ID NO: 166901 - DNA, 20 bp, Artificial Sequence
  Synthetic oligonucleotide; TGG chr2 60526010 60526029 60526026 +
tgttattttctggtagagga

SEQ ID NO: 166902 - DNA, 20 bp, Artificial Sequence
  Synthetic oligonucleotide; CAG chr2 60526013 60526032 60526029 +
tattttctggtagaggatgg

SEQ ID NO: 166903 - DNA, 20 bp, Artificial Sequence
  Synthetic oligonucleotide; CAG chr2 60526016 60526035 60526032 +
tttctggtagaggatggcag

SEQ ID NO: 166904 - DNA, 20 bp, Artificial Sequence
  Synthetic oligonucleotide; AGG chr2 60526017 60526036 60526033 +
ttctggtagaggatggcagc

SEQ ID NO: 166905 - DNA, 20 bp, Artificial Sequence
  Synthetic oligonucleotide; GGG chr2 60526018 60526037 60526034 +
tctggtagaggatggcagca

SEQ ID NO: 166906 - DNA, 20 bp, Artificial Sequence
  Synthetic oligonucleotide; TGG chr2 60526022 60526041 60526038 +
gtagaggatggcagcagggc

SEQ ID NO: 166907 - DNA, 20 bp, Artificial Sequence
  Synthetic oligonucleotide; GGG chr2 60526023 60526042 60526039 +
tagaggatggcagcagggct

SEQ ID NO: 166908 - DNA, 20 bp, Artificial Sequence
  Synthetic oligonucleotide; AAG chr2 60526030 60526049 60526046 +
tggcagcagggctgggaaaa

SEQ ID NO: 166909 - DNA, 20 bp, Artificial Sequence
  Synthetic oligonucleotide; TGG chr2 60526037 60526056 60526053 +
agggctgggaaaaaagaatg

SEQ ID NO: 166910 - DNA, 20 bp, Artificial Sequence
  Synthetic oligonucleotide; CAG chr2 60526054 60526073 60526070 +
atgtggtttttttctaacca

SEQ ID NO: 166911 - DNA, 20 bp, Artificial Sequence
  Synthetic oligonucleotide; TAG chr2 60526057 60526076 60526073 +
tggtttttttctaaccacag

SEQ ID NO: 166912 - DNA, 20 bp, Artificial Sequence
  Synthetic oligonucleotide; AGG chr2 60526058 60526077 60526074 +
ggtttttttctaaccacagt

SEQ ID NO: 166913 - DNA, 20 bp, Artificial Sequence
  Synthetic oligonucleotide; TAG chr2 60526089 60526108 60526105 +
ataacaatgatttcactttc

SEQ ID NO: 166914 - DNA, 20 bp, Artificial Sequence
  Synthetic oligonucleotide; CAG chr2 60526100 60526119 60526116 +
ttcactttctagatataaaa

SEQ ID NO: 166915 - DNA, 20 bp, Artificial Sequence
  Synthetic oligonucleotide; AGG chr2 60526101 60526120 60526117 +
tcactttctagatataaaac

SEQ ID NO: 166916 - DNA, 20 bp, Artificial Sequence
  Synthetic oligonucleotide; TGG chr2 60526106 60526125 60526122 +
ttctagatataaaacaggca

SEQ ID NO: 166917 - DNA, 20 bp, Artificial Sequence
  Synthetic oligonucleotide; TAG chr2 60526138 60526157 60526154 +
ccctgaacttctgcaaaatc

SEQ ID NO: 166918 - DNA, 20 bp, Artificial Sequence
  Synthetic oligonucleotide; CAG chr2 60526154 60526173 60526170 +
aatctagatttgatcaaatt

SEQ ID NO: 166919 - DNA, 20 bp, Artificial Sequence
  Synthetic oligonucleotide; TGG chr2 60526161 60526180 60526177 +
atttgatcaaattcagaaac

SEQ ID NO: 166920 - DNA, 20 bp, Artificial Sequence
  Synthetic oligonucleotide; CAG chr2 60526179 60526198 60526195 +
actggtgatttgatcaaatt

SEQ ID NO: 166921 - DNA, 20 bp, Artificial Sequence
  Synthetic oligonucleotide; TGG chr2 60526194 60526213 60526210 +
aaattcagaatcccatattt

SEQ ID NO: 166922 - DNA, 20 bp, Artificial Sequence
  Synthetic oligonucleotide; GGG chr2 60526195 60526214 60526211 +
aattcagaatcccatatttt

SEQ ID NO: 166923 - DNA, 20 bp, Artificial Sequence
  Synthetic oligonucleotide; TAG chr2 60526209 60526228 60526225 +
tattttgggatgatgtgttc

SEQ ID NO: 166924 - DNA, 20 bp, Artificial Sequence
  Synthetic oligonucleotide; CAG chr2 60526212 60526231 60526228 +
tttgggatgatgtgttctag

SEQ ID NO: 166925 - DNA, 20 bp, Artificial Sequence
  Synthetic oligonucleotide; AAG chr2 60526216 60526235 60526232 +
ggatgatgtgttctagcaga

SEQ ID NO: 166926 - DNA, 20 bp, Artificial Sequence
  Synthetic oligonucleotide; TGG chr2 60526223 60526242 60526239 +
gtgttctagcagaaagctat

SEQ ID NO: 166927 - DNA, 20 bp, Artificial Sequence
  Synthetic oligonucleotide; TGG chr2 60526227 60526246 60526243 +
tctagcagaaagctattggt

SEQ ID NO: 166928 - DNA, 20 bp, Artificial Sequence
  Synthetic oligonucleotide; AAG chr2 60526255 60526274 60526271 +
ttttgctctttcttccccaa

SEQ ID NO: 166929 - DNA, 20 bp, Artificial Sequence
  Synthetic oligonucleotide; TAG chr2 60526267 60526286 60526283 +
ttccccaaaagatttttaaa

SEQ ID NO: 166930 - DNA, 20 bp, Artificial Sequence
  Synthetic oligonucleotide; AAG chr2 60526283 60526302 60526299 +
taaatagttttcatctttaa

SEQ ID NO: 166931 - DNA, 20 bp, Artificial Sequence
  Synthetic oligonucleotide; AGG chr2 60526284 60526303 60526300 +
aaatagttttcatctttaaa

SEQ ID NO: 166932 - DNA, 20 bp, Artificial Sequence
  Synthetic oligonucleotide; CAG chr2 60526297 60526316 60526313 +
ctttaaaaggatttcaactt

SEQ ID NO: 166933 - DNA, 20 bp, Artificial Sequence
  Synthetic oligonucleotide; AAG chr2 60526315 60526334 60526331 +
ttcagattgtgcccacgcca

SEQ ID NO: 166934 - DNA, 20 bp, Artificial Sequence
  Synthetic oligonucleotide; AAG chr2 60526346 60526365 60526362 +
catctaatcaataaataaat

SEQ ID NO: 166935 - DNA, 20 bp, Artificial Sequence
  Synthetic oligonucleotide; AAG chr2 60526356 60526375 60526372 +
ataaataaataagacaaaca

SEQ ID NO: 166936 - DNA, 20 bp, Artificial Sequence
  Synthetic oligonucleotide; CAG chr2 60526359 60526378 60526375 +
aataaataagacaaacaaag

SEQ ID NO: 166937 - DNA, 20 bp, Artificial Sequence
  Synthetic oligonucleotide; TGG chr2 60526384 60526403 60526400 +
tatgtttatcctttaccatt

SEQ ID NO: 166938 - DNA, 20 bp, Artificial Sequence
  Synthetic oligonucleotide; GGG chr2 60526385 60526404 60526401 +
atgtttatcctttaccattt

SEQ ID NO: 166939 - DNA, 20 bp, Artificial Sequence
  Synthetic oligonucleotide; AAG chr2 60526388 60526407 60526404 +
tttatcctttaccatttggg

SEQ ID NO: 166940 - DNA, 20 bp, Artificial Sequence
  Synthetic oligonucleotide; CAG chr2 60526407 60526426 60526423 +
gaagtgtacattaattactg

SEQ ID NO: 166941 - DNA, 20 bp, Artificial Sequence
  Synthetic oligonucleotide; CAG chr2 60526449 60526468 60526465 +
cccccaccccctctgcatcg

SEQ ID NO: 166942 - DNA, 20 bp, Artificial Sequence
  Synthetic oligonucleotide; CAG chr2 60526453 60526472 60526469 +
caccccctctgcatcgcaga

SEQ ID NO: 166943 - DNA, 20 bp, Artificial Sequence
  Synthetic oligonucleotide; CAG chr2 60526456 60526475 60526472 +
cccctctgcatcgcagacag

SEQ ID NO: 166944 - DNA, 20 bp, Artificial Sequence
  Synthetic oligonucleotide; AAG chr2 60526466 60526485 60526482 +
tcgcagacagcagtgctcaa

SEQ ID NO: 166945 - DNA, 20 bp, Artificial Sequence
  Synthetic oligonucleotide; AGG chr2 60526467 60526486 60526483 +
cgcagacagcagtgctcaaa

SEQ ID NO: 166946 - DNA, 20 bp, Artificial Sequence
  Synthetic oligonucleotide; GGG chr2 60526468 60526487 60526484 +
gcagacagcagtgctcaaaa

SEQ ID NO: 166947 - DNA, 20 bp, Artificial Sequence
  Synthetic oligonucleotide; CGG chr2 60526491 60526510 60526507 +
tccgcaaaataaaaatgtgt

SEQ ID NO: 166948 - DNA, 20 bp, Artificial Sequence
  Synthetic oligonucleotide; GGG chr2 60526492 60526511 60526508 +
ccgcaaaataaaaatgtgtc

SEQ ID NO: 166949 - DNA, 20 bp, Artificial Sequence
  Synthetic oligonucleotide; TGG chr2 60526503 60526522 60526519 +
aaatgtgtcgggtaattaaa

SEQ ID NO: 166950 - DNA, 20 bp, Artificial Sequence
  Synthetic oligonucleotide; GGG chr2 60526504 60526523 60526520 +
aatgtgtcgggtaattaaat

SEQ ID NO: 166951 - DNA, 20 bp, Artificial Sequence
  Synthetic oligonucleotide; TAG chr2 60526517 60526536 60526533 +
attaaatgggtatttataat

SEQ ID NO: 166952 - DNA, 20 bp, Artificial Sequence
  Synthetic oligonucleotide; CAG chr2 60526537 60526556 60526553 +
tagaacttaataatttgcat

SEQ ID NO: 166953 - DNA, 20 bp, Artificial Sequence
  Synthetic oligonucleotide; AGG chr2 60526538 60526557 60526554 +
agaacttaataatttgcatc

SEQ ID NO: 166954 - DNA, 20 bp, Artificial Sequence
  Synthetic oligonucleotide; GGG chr2 60526539 60526558 60526555 +
gaacttaataatttgcatca

SEQ ID NO: 166955 - DNA, 20 bp, Artificial Sequence
  Synthetic oligonucleotide; GAG chr2 60526548 60526567 60526564 +
aatttgcatcagggacaaat

SEQ ID NO: 166956 - DNA, 20 bp, Artificial Sequence
  Synthetic oligonucleotide; CAG chr2 60526567 60526586 60526583 +
tgagctctgattttaatctg

SEQ ID NO: 166957 - DNA, 20 bp, Artificial Sequence
  Synthetic oligonucleotide; TAG chr2 60526576 60526595 60526592 +
attttaatctgcagcgcatt

SEQ ID NO: 166958 - DNA, 20 bp, Artificial Sequence
  Synthetic oligonucleotide; TAG chr2 60526581 60526600 60526597 +
aatctgcagcgcatttagat

SEQ ID NO: 166959 - DNA, 20 bp, Artificial Sequence
  Synthetic oligonucleotide; AAG chr2 60526588 60526607 60526604 +
agcgcatttagattagccca

SEQ ID NO: 166960 - DNA, 20 bp, Artificial Sequence
  Synthetic oligonucleotide; TAG chr2 60526592 60526611 60526608 +
catttagattagcccaaaga

SEQ ID NO: 166961 - DNA, 20 bp, Artificial Sequence
  Synthetic oligonucleotide; TGG chr2 60526605 60526624 60526621 +
ccaaagatagtgtaatttga

SEQ ID NO: 166962 - DNA, 20 bp, Artificial Sequence
  Synthetic oligonucleotide; TAG chr2 60526612 60526631 60526628 +
tagtgtaatttgatggttta

SEQ ID NO: 166963 - DNA, 20 bp, Artificial Sequence
  Synthetic oligonucleotide; AGG chr2 60526613 60526632 60526629 +
agtgtaatttgatggtttat

SEQ ID NO: 166964 - DNA, 20 bp, Artificial Sequence
  Synthetic oligonucleotide; CGG chr2 60526624 60526643 60526640 +
atggtttataggcctcctct

SEQ ID NO: 166965 - DNA, 20 bp, Artificial Sequence
  Synthetic oligonucleotide; AAG chr2 60526643 60526662 60526659 +
tcggattatgaaacaatacc

SEQ ID NO: 166966 - DNA, 20 bp, Artificial Sequence
  Synthetic oligonucleotide; AAG chr2 60526651 60526670 60526667 +
tgaaacaataccaagccttc

SEQ ID NO: 166967 - DNA, 20 bp, Artificial Sequence
  Synthetic oligonucleotide; CAG chr2 60526656 60526675 60526672 +
caataccaagccttcaagtg

SEQ ID NO: 166968 - DNA, 20 bp, Artificial Sequence
  Synthetic oligonucleotide; CAG chr2 60526670 60526689 60526686 +
caagtgcagtgtgtctatgt

SEQ ID NO: 166969 - DNA, 20 bp, Artificial Sequence
  Synthetic oligonucleotide; AGG chr2 60526671 60526690 60526687 +
aagtgcagtgtgtctatgtc

SEQ ID NO: 166970 - DNA, 20 bp, Artificial Sequence
  Synthetic oligonucleotide; GAG chr2 60526673 60526692 60526689 +
gtgcagtgtgtctatgtcag

SEQ ID NO: 166971 - DNA, 20 bp, Artificial Sequence
  Synthetic oligonucleotide; AGG chr2 60526674 60526693 60526690 +
tgcagtgtgtctatgtcagg

SEQ ID NO: 166972 - DNA, 20 bp, Artificial Sequence
  Synthetic oligonucleotide; GGG chr2 60526675 60526694 60526691 +
gcagtgtgtctatgtcagga

SEQ ID NO: 166973 - DNA, 20 bp, Artificial Sequence
  Synthetic oligonucleotide; AAG chr2 60526683 60526702 60526699 +
tctatgtcaggagggtgtta

SEQ ID NO: 166974 - DNA, 20 bp, Artificial Sequence
  Synthetic oligonucleotide; AAG chr2 60526686 60526705 60526702 +
atgtcaggagggtgttaaag

SEQ ID NO: 166975 - DNA, 20 bp, Artificial Sequence
  Synthetic oligonucleotide; AAG chr2 60526689 60526708 60526705 +
tcaggagggtgttaaagaag

SEQ ID NO: 166976 - DNA, 20 bp, Artificial Sequence
  Synthetic oligonucleotide; AAG chr2 60526719 60526738 60526735 +
gaaaatgtttgacaacgtga

SEQ ID NO: 166977 - DNA, 20 bp, Artificial Sequence
  Synthetic oligonucleotide; CAG chr2 60526722 60526741 60526738 +
aatgtttgacaacgtgaaag

SEQ ID NO: 166978 - DNA, 20 bp, Artificial Sequence
  Synthetic oligonucleotide; AAG chr2 60526751 60526770 60526767 +
attacatgacaactgtgtaa

SEQ ID NO: 166979 - DNA, 20 bp, Artificial Sequence
  Synthetic oligonucleotide; AAG chr2 60526771 60526790 60526787 +
aagtcatgatgaaacaaata

SEQ ID NO: 166980 - DNA, 20 bp, Artificial Sequence
  Synthetic oligonucleotide; AGG chr2 60526772 60526791 60526788 +
agtcatgatgaaacaaataa

SEQ ID NO: 166981 - DNA, 20 bp, Artificial Sequence
  Synthetic oligonucleotide; GGG chr2 60526773 60526792 60526789 +
gtcatgatgaaacaaataaa

SEQ ID NO: 166982 - DNA, 20 bp, Artificial Sequence
  Synthetic oligonucleotide; CAG chr2 60526836 60526855 60526852 +
tccctgcgctaatctctgcc

SEQ ID NO: 166983 - DNA, 20 bp, Artificial Sequence
  Synthetic oligonucleotide; AAG chr2 60526852 60526871 60526868 +
tgcccagccaacgcattctt

SEQ ID NO: 166984 - DNA, 20 bp, Artificial Sequence
  Synthetic oligonucleotide; CGG chr2 60526855 60526874 60526871 +
ccagccaacgcattcttaag

SEQ ID NO: 166985 - DNA, 20 bp, Artificial Sequence
  Synthetic oligonucleotide; GGG chr2 60526856 60526875 60526872 +
cagccaacgcattcttaagc

SEQ ID NO: 166986 - DNA, 20 bp, Artificial Sequence
  Synthetic oligonucleotide; GGG chr2 60526857 60526876 60526873 +
agccaacgcattcttaagcg

SEQ ID NO: 166987 - DNA, 20 bp, Artificial Sequence
  Synthetic oligonucleotide; TAG chr2 60526867 60526886 60526883 +
ttcttaagcggggaactact

SEQ ID NO: 166988 - DNA, 20 bp, Artificial Sequence
  Synthetic oligonucleotide; CAG chr2 60526873 60526892 60526889 +
agcggggaactacttagcac

SEQ ID NO: 166989 - DNA, 20 bp, Artificial Sequence
  Synthetic oligonucleotide; AGG chr2 60526874 60526893 60526890 +
gcggggaactacttagcacc

SEQ ID NO: 166990 - DNA, 20 bp, Artificial Sequence
  Synthetic oligonucleotide; TAG chr2 60526895 60526914 60526911 +
ggaacgttgtaaattatcac

SEQ ID NO: 166991 - DNA, 20 bp, Artificial Sequence
  Synthetic oligonucleotide; CAG chr2 60526902 60526921 60526918 +
tgtaaattatcactagtcaa

SEQ ID NO: 166992 - DNA, 20 bp, Artificial Sequence
  Synthetic oligonucleotide; TAG chr2 60526915 60526934 60526931 +
tagtcaacagcattgatttt

SEQ ID NO: 166993 - DNA, 20 bp, Artificial Sequence
  Synthetic oligonucleotide; CAG chr2 60526931 60526950 60526947 +
tttttagtcgacatttcaat

SEQ ID NO: 166994 - DNA, 20 bp, Artificial Sequence
  Synthetic oligonucleotide; AGG chr2 60526932 60526951 60526948 +
ttttagtcgacatttcaatc

SEQ ID NO: 166995 - DNA, 20 bp, Artificial Sequence
  Synthetic oligonucleotide; AAG chr2 60526938 60526957 60526954 +
tcgacatttcaatcaggttg

SEQ ID NO: 166996 - DNA, 20 bp, Artificial Sequence
  Synthetic oligonucleotide; TAG chr2 60526941 60526960 60526957 +
acatttcaatcaggttgaag

SEQ ID NO: 166997 - DNA, 20 bp, Artificial Sequence
  Synthetic oligonucleotide; CGG chr2 60526954 60526973 60526970 +
gttgaagtagaaatactacc

SEQ ID NO: 166998 - DNA, 20 bp, Artificial Sequence
  Synthetic oligonucleotide; CAG chr2 60526966 60526985 60526982 +
atactacccggctcatccaa

SEQ ID NO: 166999 - DNA, 20 bp, Artificial Sequence
  Synthetic oligonucleotide; CAG chr2 60526978 60526997 60526994 +
tcatccaacagcctcttaac

SEQ ID NO: 167000 - DNA, 20 bp, Artificial Sequence
  Synthetic oligonucleotide; GAG chr2 60526995 60527014 60527011 +
aaccagtccactgcccctct

SEQ ID NO: 167001 - DNA, 20 bp, Artificial Sequence
  Synthetic oligonucleotide; AGG chr2 60526996 60527015 60527012 +
accagtccactgcccctctg

SEQ ID NO: 167002 - DNA, 20 bp, Artificial Sequence
  Synthetic oligonucleotide; CGG chr2 60527005 60527024 60527021 +
ctgcccctctgaggtctccc

SEQ ID NO: 167003 - DNA, 20 bp, Artificial Sequence
  Synthetic oligonucleotide; TGG chr2 60527011 60527030 60527027 +
ctctgaggtctccccggtta

SEQ ID NO: 167004 - DNA, 20 bp, Artificial Sequence
  Synthetic oligonucleotide; TAG chr2 60527056 60527075 60527072 +
tcaccattcgatatttattg

SEQ ID NO: 167005 - DNA, 20 bp, Artificial Sequence
  Synthetic oligonucleotide; CAG chr2 60527071 60527090 60527087 +
tattgtagctttgccacatc

SEQ ID NO: 167006 - DNA, 20 bp, Artificial Sequence
  Synthetic oligonucleotide; AGG chr2 60527072 60527091 60527088 +
attgtagctttgccacatcc

SEQ ID NO: 167007 - DNA, 20 bp, Artificial Sequence
  Synthetic oligonucleotide; TGG chr2 60527079 60527098 60527095 +
ctttgccacatccaggcact

SEQ ID NO: 167008 - DNA, 20 bp, Artificial Sequence
  Synthetic oligonucleotide; AAG chr2 60527086 60527105 60527102 +
acatccaggcacttggcctg

SEQ ID NO: 167009 - DNA, 20 bp, Artificial Sequence
  Synthetic oligonucleotide; AGG chr2 60527087 60527106 60527103 +
catccaggcacttggcctga

SEQ ID NO: 167010 - DNA, 20 bp, Artificial Sequence
  Synthetic oligonucleotide; GGG chr2 60527088 60527107 60527104 +
atccaggcacttggcctgaa

SEQ ID NO: 167011 - DNA, 20 bp, Artificial Sequence
  Synthetic oligonucleotide; CGG chr2 60527095 60527114 60527111 +
cacttggcctgaagggtcac

SEQ ID NO: 167012 - DNA, 20 bp, Artificial Sequence
  Synthetic oligonucleotide; TGG chr2 60527107 60527126 60527123 +
agggtcaccggcctgcctct

SEQ ID NO: 167013 - DNA, 20 bp, Artificial Sequence
  Synthetic oligonucleotide; GGG chr2 60527108 60527127 60527124 +
gggtcaccggcctgcctctt

SEQ ID NO: 167014 - DNA, 20 bp, Artificial Sequence
  Synthetic oligonucleotide; AAG chr2 60527136 60527155 60527152 +
aaatttgtgcttacctaacg

SEQ ID NO: 167015 - DNA, 20 bp, Artificial Sequence
  Synthetic oligonucleotide; AGG chr2 60527137 60527156 60527153 +
aatttgtgcttacctaacga

SEQ ID NO: 167016 - DNA, 20 bp, Artificial Sequence
  Synthetic oligonucleotide; CAG chr2 60527140 60527159 60527156 +
ttgtgcttacctaacgaagg

SEQ ID NO: 167017 - DNA, 20 bp, Artificial Sequence
  Synthetic oligonucleotide; CAG chr2 60527146 60527165 60527162 +
ttacctaacgaaggcagaaa

SEQ ID NO: 167018 - DNA, 20 bp, Artificial Sequence
  Synthetic oligonucleotide; AAG chr2 60527152 60527171 60527168 +
aacgaaggcagaaacagaaa

SEQ ID NO: 167019 - DNA, 20 bp, Artificial Sequence
  Synthetic oligonucleotide; AAG chr2 60527158 60527177 60527174 +
ggcagaaacagaaaaagaaa

SEQ ID NO: 167020 - DNA, 20 bp, Artificial Sequence
  Synthetic oligonucleotide; AAG chr2 60527167 60527186 60527183 +
agaaaaagaaaaagaaacaa

SEQ ID NO: 167021 - DNA, 20 bp, Artificial Sequence
  Synthetic oligonucleotide; AGG chr2 60527168 60527187 60527184 +
gaaaaagaaaaagaaacaaa

SEQ ID NO: 167022 - DNA, 20 bp, Artificial Sequence
  Synthetic oligonucleotide; CAG chr2 60527178 60527197 60527194 +
aagaaacaaaaggccatcat

SEQ ID NO: 167023 - DNA, 20 bp, Artificial Sequence
  Synthetic oligonucleotide; GAG chr2 60527180 60527199 60527196 +
gaaacaaaaggccatcatca

SEQ ID NO: 167024 - DNA, 20 bp, Artificial Sequence
  Synthetic oligonucleotide; TGG chr2 60527186 60527205 60527202 +
aaaggccatcatcagagatg

SEQ ID NO: 167025 - DNA, 20 bp, Artificial Sequence
  Synthetic oligonucleotide; AAG chr2 60527209 60527228 60527225 +
cctgattttcactgattttc

SEQ ID NO: 167026 - DNA, 20 bp, Artificial Sequence
  Synthetic oligonucleotide; AGG chr2 60527210 60527229 60527226 +
ctgattttcactgattttca

SEQ ID NO: 167027 - DNA, 20 bp, Artificial Sequence
  Synthetic oligonucleotide; GGG chr2 60527211 60527230 60527227 +
tgattttcactgattttcaa

SEQ ID NO: 167028 - DNA, 20 bp, Artificial Sequence
  Synthetic oligonucleotide; AAG chr2 60527214 60527233 60527230 +
ttttcactgattttcaaggg

SEQ ID NO: 167029 - DNA, 20 bp, Artificial Sequence
  Synthetic oligonucleotide; GAG chr2 60527216 60527235 60527232 +
ttcactgattttcaagggaa

SEQ ID NO: 167030 - DNA, 20 bp, Artificial Sequence
  Synthetic oligonucleotide; AAG chr2 60527219 60527238 60527235 +
actgattttcaagggaagag

SEQ ID NO: 167031 - DNA, 20 bp, Artificial Sequence
  Synthetic oligonucleotide; AGG chr2 60527220 60527239 60527236 +
ctgattttcaagggaagaga

SEQ ID NO: 167032 - DNA, 20 bp, Artificial Sequence
  Synthetic oligonucleotide; TAG chr2 60527228 60527247 60527244 +
caagggaagagaaggaaaac

SEQ ID NO: 167033 - DNA, 20 bp, Artificial Sequence
  Synthetic oligonucleotide; AGG chr2 60527229 60527248 60527245 +
aagggaagagaaggaaaact

SEQ ID NO: 167034 - DNA, 20 bp, Artificial Sequence
  Synthetic oligonucleotide; GGG chr2 60527230 60527249 60527246 +
agggaagagaaggaaaacta

SEQ ID NO: 167035 - DNA, 20 bp, Artificial Sequence
  Synthetic oligonucleotide; GGG chr2 60527231 60527250 60527247 +
gggaagagaaggaaaactag

SEQ ID NO: 167036 - DNA, 20 bp, Artificial Sequence
  Synthetic oligonucleotide; GGG chr2 60527232 60527251 60527248 +
ggaagagaaggaaaactagg

SEQ ID NO: 167037 - DNA, 20 bp, Artificial Sequence
  Synthetic oligonucleotide; GAG chr2 60527238 60527257 60527254 +
gaaggaaaactagggggtgc

SEQ ID NO: 167038 - DNA, 20 bp, Artificial Sequence
  Synthetic oligonucleotide; GAG chr2 60527242 60527261 60527258 +
gaaaactagggggtgcgagc

SEQ ID NO: 167039 - DNA, 20 bp, Artificial Sequence
  Synthetic oligonucleotide; AGG chr2 60527243 60527262 60527259 +
aaaactagggggtgcgagcg

SEQ ID NO: 167040 - DNA, 20 bp, Artificial Sequence
  Synthetic oligonucleotide; GGG chr2 60527244 60527263 60527260 +
aaactagggggtgcgagcga

SEQ ID NO: 167041 - DNA, 20 bp, Artificial Sequence
  Synthetic oligonucleotide; AAG chr2 60527251 60527270 60527267 +
ggggtgcgagcgagggaaat

SEQ ID NO: 167042 - DNA, 20 bp, Artificial Sequence
  Synthetic oligonucleotide; AAG chr2 60527254 60527273 60527270 +
gtgcgagcgagggaaataag

SEQ ID NO: 167043 - DNA, 20 bp, Artificial Sequence
  Synthetic oligonucleotide; AGG chr2 60527255 60527274 60527271 +
tgcgagcgagggaaataaga

SEQ ID NO: 167044 - DNA, 20 bp, Artificial Sequence
  Synthetic oligonucleotide; GGG chr2 60527256 60527275 60527272 +
gcgagcgagggaaataagaa

SEQ ID NO: 167045 - DNA, 20 bp, Artificial Sequence
  Synthetic oligonucleotide; AAG chr2 60527264 60527283 60527280 +
gggaaataagaagggttcta

SEQ ID NO: 167046 - DNA, 20 bp, Artificial Sequence
  Synthetic oligonucleotide; CAG chr2 60527290 60527309 60527306 +
tgatacgccttttatcattt

SEQ ID NO: 167047 - DNA, 20 bp, Artificial Sequence
  Synthetic oligonucleotide; CAG chr2 60527304 60527323 60527320 +
tcatttcagctttatcattt

SEQ ID NO: 167048 - DNA, 20 bp, Artificial Sequence
  Synthetic oligonucleotide; TAG chr2 60527309 60527328 60527325 +
tcagctttatcatttcagtc

SEQ ID NO: 167049 - DNA, 20 bp, Artificial Sequence
  Synthetic oligonucleotide; AGG chr2 60527310 60527329 60527326 +
cagctttatcatttcagtct

SEQ ID NO: 167050 - DNA, 20 bp, Artificial Sequence
  Synthetic oligonucleotide; GAG chr2 60527312 60527331 60527328 +
gctttatcatttcagtctag

SEQ ID NO: 167051 - DNA, 20 bp, Artificial Sequence
  Synthetic oligonucleotide; CAG chr2 60527318 60527337 60527334 +
tcatttcagtctaggagacc

SEQ ID NO: 167052 - DNA, 20 bp, Artificial Sequence
  Synthetic oligonucleotide; AAG chr2 60527332 60527351 60527348 +
gagacccagcaaataaaact

SEQ ID NO: 167053 - DNA, 20 bp, Artificial Sequence
  Synthetic oligonucleotide; GAG chr2 60527334 60527353 60527350 +
gacccagcaaataaaactaa

SEQ ID NO: 167054 - DNA, 20 bp, Artificial Sequence
  Synthetic oligonucleotide; CAG chr2 60527346 60527365 60527362 +
aaaactaagagcttctcttc

SEQ ID NO: 167055 - DNA, 20 bp, Artificial Sequence
  Synthetic oligonucleotide; AGG chr2 60527347 60527366 60527363 +
aaactaagagcttctcttcc

SEQ ID NO: 167056 - DNA, 20 bp, Artificial Sequence
  Synthetic oligonucleotide; GGG chr2 60527348 60527367 60527364 +
aactaagagcttctcttcca

SEQ ID NO: 167057 - DNA, 20 bp, Artificial Sequence
  Synthetic oligonucleotide; AAG chr2 60527355 60527374 60527371 +
agcttctcttccagggtgac

SEQ ID NO: 167058 - DNA, 20 bp, Artificial Sequence
  Synthetic oligonucleotide; AGG chr2 60527356 60527375 60527372 +
gcttctcttccagggtgaca

SEQ ID NO: 167059 - DNA, 20 bp, Artificial Sequence
  Synthetic oligonucleotide; GGG chr2 60527357 60527376 60527373 +
cttctcttccagggtgacaa

SEQ ID NO: 167060 - DNA, 20 bp, Artificial Sequence
  Synthetic oligonucleotide; GAG chr2 60527359 60527378 60527375 +
tctcttccagggtgacaagg

SEQ ID NO: 167061 - DNA, 20 bp, Artificial Sequence
  Synthetic oligonucleotide; AAG chr2 60527382 60527401 60527398 +
aaccactacactcttgaccc

SEQ ID NO: 167062 - DNA, 20 bp, Artificial Sequence
  Synthetic oligonucleotide; AGG chr2 60527383 60527402 60527399 +
accactacactcttgaccca

SEQ ID NO: 167063 - DNA, 20 bp, Artificial Sequence
  Synthetic oligonucleotide; GGG chr2 60527384 60527403 60527400 +
ccactacactcttgacccaa

SEQ ID NO: 167064 - DNA, 20 bp, Artificial Sequence
  Synthetic oligonucleotide; TAG chr2 60527391 60527410 60527407 +
actcttgacccaagggtatg

SEQ ID NO: 167065 - DNA, 20 bp, Artificial Sequence
  Synthetic oligonucleotide; GAG chr2 60527393 60527412 60527409 +
tcttgacccaagggtatgta

SEQ ID NO: 167066 - DNA, 20 bp, Artificial Sequence
  Synthetic oligonucleotide; AAG chr2 60527402 60527421 60527418 +
aagggtatgtagagacaatg

SEQ ID NO: 167067 - DNA, 20 bp, Artificial Sequence
  Synthetic oligonucleotide; GAG chr2 60527404 60527423 60527420 +
gggtatgtagagacaatgaa

SEQ ID NO: 167068 - DNA, 20 bp, Artificial Sequence
  Synthetic oligonucleotide; AGG chr2 60527405 60527424 60527421 +
ggtatgtagagacaatgaag

SEQ ID NO: 167069 - DNA, 20 bp, Artificial Sequence
  Synthetic oligonucleotide; GGG chr2 60527406 60527425 60527422 +
gtatgtagagacaatgaaga

SEQ ID NO: 167070 - DNA, 20 bp, Artificial Sequence
  Synthetic oligonucleotide; AAG chr2 60527411 60527430 60527427 +
tagagacaatgaagagggcc

SEQ ID NO: 167071 - DNA, 20 bp, Artificial Sequence
  Synthetic oligonucleotide; GAG chr2 60527413 60527432 60527429 +
gagacaatgaagagggccaa

SEQ ID NO: 167072 - DNA, 20 bp, Artificial Sequence
  Synthetic oligonucleotide; AAG chr2 60527416 60527435 60527432 +
acaatgaagagggccaagag

SEQ ID NO: 167073 - DNA, 20 bp, Artificial Sequence
  Synthetic oligonucleotide; AGG chr2 60527417 60527436 60527433 +
caatgaagagggccaagaga

SEQ ID NO: 167074 - DNA, 20 bp, Artificial Sequence
  Synthetic oligonucleotide; GGG chr2 60527418 60527437 60527434 +
aatgaagagggccaagagaa

SEQ ID NO: 167075 - DNA, 20 bp, Artificial Sequence
  Synthetic oligonucleotide; GGG chr2 60527419 60527438 60527435 +
atgaagagggccaagagaag

SEQ ID NO: 167076 - DNA, 20 bp, Artificial Sequence
  Synthetic oligonucleotide; GAG chr2 60527423 60527442 60527439 +
agagggccaagagaaggggt

SEQ ID NO: 167077 - DNA, 20 bp, Artificial Sequence
  Synthetic oligonucleotide; AGG chr2 60527424 60527443 60527440 +
gagggccaagagaaggggtg

SEQ ID NO: 167078 - DNA, 20 bp, Artificial Sequence
  Synthetic oligonucleotide; GGG chr2 60527425 60527444 60527441 +
agggccaagagaaggggtga

SEQ ID NO: 167079 - DNA, 20 bp, Artificial Sequence
  Synthetic oligonucleotide; GGG chr2 60527426 60527445 60527442 +
gggccaagagaaggggtgag

SEQ ID NO: 167080 - DNA, 20 bp, Artificial Sequence
  Synthetic oligonucleotide; GGG chr2 60527427 60527446 60527443 +
ggccaagagaaggggtgagg

SEQ ID NO: 167081 - DNA, 20 bp, Artificial Sequence
  Synthetic oligonucleotide; AAG chr2 60527430 60527449 60527446 +
caagagaaggggtgaggggg

SEQ ID NO: 167082 - DNA, 20 bp, Artificial Sequence
  Synthetic oligonucleotide; AGG chr2 60527431 60527450 60527447 +
aagagaaggggtgaggggga

SEQ ID NO: 167083 - DNA, 20 bp, Artificial Sequence
  Synthetic oligonucleotide; GGG chr2 60527432 60527451 60527448 +
agagaaggggtgagggggaa

SEQ ID NO: 167084 - DNA, 20 bp, Artificial Sequence
  Synthetic oligonucleotide; GAG chr2 60527452 60527471 60527468 +
gggcttgcatgacctccatt

SEQ ID NO: 167085 - DNA, 20 bp, Artificial Sequence
  Synthetic oligonucleotide; AGG chr2 60527453 60527472 60527469 +
ggcttgcatgacctccattg

SEQ ID NO: 167086 - DNA, 20 bp, Artificial Sequence
  Synthetic oligonucleotide; CGG chr2 60527468 60527487 60527484 +
cattgaggacgtccatgccc

SEQ ID NO: 167087 - DNA, 20 bp, Artificial Sequence
  Synthetic oligonucleotide; GGG chr2 60527469 60527488 60527485 +
attgaggacgtccatgcccc

SEQ ID NO: 167088 - DNA, 20 bp, Artificial Sequence
  Synthetic oligonucleotide; CAG chr2 60527473 60527492 60527489 +
aggacgtccatgccccggga

SEQ ID NO: 167089 - DNA, 20 bp, Artificial Sequence
  Synthetic oligonucleotide; GAG chr2 60527475 60527494 60527491 +
gacgtccatgccccgggaca

SEQ ID NO: 167090 - DNA, 20 bp, Artificial Sequence
  Synthetic oligonucleotide; AAG chr2 60527482 60527501 60527498 +
atgccccgggacagagtgcg

SEQ ID NO: 167091 - DNA, 20 bp, Artificial Sequence
  Synthetic oligonucleotide; AAG chr2 60527488 60527507 60527504 +
cgggacagagtgcgaagtaa

SEQ ID NO: 167092 - DNA, 20 bp, Artificial Sequence
  Synthetic oligonucleotide; AAG chr2 60527493 60527512 60527509 +
cagagtgcgaagtaaaagtg

SEQ ID NO: 167093 - DNA, 20 bp, Artificial Sequence
  Synthetic oligonucleotide; TGG chr2 60527499 60527518 60527515 +
gcgaagtaaaagtgaagctt

SEQ ID NO: 167094 - DNA, 20 bp, Artificial Sequence
  Synthetic oligonucleotide; GAG chr2 60527501 60527520 60527517 +
gaagtaaaagtgaagctttg

SEQ ID NO: 167095 - DNA, 20 bp, Artificial Sequence
  Synthetic oligonucleotide; TGG chr2 60527517 60527536 60527533 +
tttggagctcttgacccaca

SEQ ID NO: 167096 - DNA, 20 bp, Artificial Sequence
  Synthetic oligonucleotide; CAG chr2 60527525 60527544 60527541 +
tcttgacccacatggattct

SEQ ID NO: 167097 - DNA, 20 bp, Artificial Sequence
  Synthetic oligonucleotide; CAG chr2 60527528 60527547 60527544 +
tgacccacatggattctcag

SEQ ID NO: 167098 - DNA, 20 bp, Artificial Sequence
  Synthetic oligonucleotide; CAG chr2 60527554 60527573 60527570 +
cctccatcccacctcaaact

SEQ ID NO: 167099 - DNA, 20 bp, Artificial Sequence
  Synthetic oligonucleotide; AAG chr2 60527557 60527576 60527573 +
ccatcccacctcaaactcag

SEQ ID NO: 167100 - DNA, 20 bp, Artificial Sequence
  Synthetic oligonucleotide; TGG chr2 60527566 60527585 60527582 +
ctcaaactcagaagacaacc

SEQ ID NO: 167101 - DNA, 20 bp, Artificial Sequence
  Synthetic oligonucleotide; TGG chr2 60527593 60527612 60527609 +
gaccgacaacttctttgtga

SEQ ID NO: 167102 - DNA, 20 bp, Artificial Sequence
  Synthetic oligonucleotide; CAG chr2 60527603 60527622 60527619 +
ttctttgtgatggatctgaa

SEQ ID NO: 167103 - DNA, 20 bp, Artificial Sequence
  Synthetic oligonucleotide; TGG chr2 60527613 60527632 60527629 +
tggatctgaacagcctccct

SEQ ID NO: 167104 - DNA, 20 bp, Artificial Sequence
  Synthetic oligonucleotide; TAG chr2 60527619 60527638 60527635 +
tgaacagcctcccttggttc

SEQ ID NO: 167105 - DNA, 20 bp, Artificial Sequence
  Synthetic oligonucleotide; CAG chr2 60527622 60527641 60527638 +
acagcctcccttggttctag

SEQ ID NO: 167106 - DNA, 20 bp, Artificial Sequence
  Synthetic oligonucleotide; AAG chr2 60527625 60527644 60527641 +
gcctcccttggttctagcag

SEQ ID NO: 167107 - DNA, 20 bp, Artificial Sequence
  Synthetic oligonucleotide; AGG chr2 60527626 60527645 60527642 +
cctcccttggttctagcaga

SEQ ID NO: 167108 - DNA, 20 bp, Artificial Sequence
  Synthetic oligonucleotide; AAG chr2 60527636 60527655 60527652 +
ttctagcagaaggacttacc

SEQ ID NO: 167109 - DNA, 20 bp, Artificial Sequence
  Synthetic oligonucleotide; GAG chr2 60527640 60527659 60527656 +
agcagaaggacttaccaagt

SEQ ID NO: 167110 - DNA, 20 bp, Artificial Sequence
  Synthetic oligonucleotide; CAG chr2 60527643 60527662 60527659 +
agaaggacttaccaagtgag

SEQ ID NO: 167111 - DNA, 20 bp, Artificial Sequence
  Synthetic oligonucleotide; GAG chr2 60527645 60527664 60527661 +
aaggacttaccaagtgagca

SEQ ID NO: 167112 - DNA, 20 bp, Artificial Sequence
  Synthetic oligonucleotide; CAG chr2 60527666 60527685 60527682 +
agctcccatccgatactcgc

SEQ ID NO: 167113 - DNA, 20 bp, Artificial Sequence
  Synthetic oligonucleotide; GAG chr2 60527673 60527692 60527689 +
atccgatactcgccagtgct

SEQ ID NO: 167114 - DNA, 20 bp, Artificial Sequence
  Synthetic oligonucleotide; AGG chr2 60527674 60527693 60527690 +
tccgatactcgccagtgctg

SEQ ID NO: 167115 - DNA, 20 bp, Artificial Sequence
  Synthetic oligonucleotide; CGG chr2 60527698 60527717 60527714 +
caactcttccactcctccca

SEQ ID NO: 167116 - DNA, 20 bp, Artificial Sequence
  Synthetic oligonucleotide; GGG chr2 60527699 60527718 60527715 +
aactcttccactcctcccac

SEQ ID NO: 167117 - DNA, 20 bp, Artificial Sequence
  Synthetic oligonucleotide; GGG chr2 60527700 60527719 60527716 +
actcttccactcctcccacg

SEQ ID NO: 167118 - DNA, 20 bp, Artificial Sequence
  Synthetic oligonucleotide; AAG chr2 60527713 60527732 60527729 +
tcccacggggcctccgcatg

SEQ ID NO: 167119 - DNA, 20 bp, Artificial Sequence
  Synthetic oligonucleotide; TAG chr2 60527716 60527735 60527732 +
cacggggcctccgcatgaag

SEQ ID NO: 167120 - DNA, 20 bp, Artificial Sequence
  Synthetic oligonucleotide; AGG chr2 60527717 60527736 60527733 +
acggggcctccgcatgaagt

SEQ ID NO: 167121 - DNA, 20 bp, Artificial Sequence
  Synthetic oligonucleotide; CAG chr2 60527755 60527774 60527771 +
aaatgattctgaaattctct

SEQ ID NO: 167122 - DNA, 20 bp, Artificial Sequence
  Synthetic oligonucleotide; TGG chr2 60527758 60527777 60527774 +
tgattctgaaattctctcag

SEQ ID NO: 167123 - DNA, 20 bp, Artificial Sequence
  Synthetic oligonucleotide; GAG chr2 60527760 60527779 60527776 +
attctgaaattctctcagtg

SEQ ID NO: 167124 - DNA, 20 bp, Artificial Sequence
  Synthetic oligonucleotide; AGG chr2 60527761 60527780 60527777 +
ttctgaaattctctcagtgg

SEQ ID NO: 167125 - DNA, 20 bp, Artificial Sequence
  Synthetic oligonucleotide; TAG chr2 60527771 60527790 60527787 +
ctctcagtggaggtctatgt

SEQ ID NO: 167126 - DNA, 20 bp, Artificial Sequence
  Synthetic oligonucleotide; TGG chr2 60527776 60527795 60527792 +
agtggaggtctatgttagcc

SEQ ID NO: 167127 - DNA, 20 bp, Artificial Sequence
  Synthetic oligonucleotide; AAG chr2 60527788 60527807 60527804 +
tgttagcctggccaatttga

SEQ ID NO: 167128 - DNA, 20 bp, Artificial Sequence
  Synthetic oligonucleotide; AGG chr2 60527789 60527808 60527805 +
gttagcctggccaatttgaa

SEQ ID NO: 167129 - DNA, 20 bp, Artificial Sequence
  Synthetic oligonucleotide; TGG chr2 60527793 60527812 60527809 +
gcctggccaatttgaaagga

SEQ ID NO: 167130 - DNA, 20 bp, Artificial Sequence
  Synthetic oligonucleotide; GAG chr2 60527795 60527814 60527811 +
ctggccaatttgaaaggatg

SEQ ID NO: 167131 - DNA, 20 bp, Artificial Sequence
  Synthetic oligonucleotide; CAG chr2 60527802 60527821 60527818 +
atttgaaaggatggagaata

SEQ ID NO: 167132 - DNA, 20 bp, Artificial Sequence
  Synthetic oligonucleotide; AGG chr2 60527803 60527822 60527819 +
tttgaaaggatggagaatac

SEQ ID NO: 167133 - DNA, 20 bp, Artificial Sequence
  Synthetic oligonucleotide; CAG chr2 60527810 60527829 60527826 +
ggatggagaatacaggaaaa

SEQ ID NO: 167134 - DNA, 20 bp, Artificial Sequence
  Synthetic oligonucleotide; TGG chr2 60527820 60527839 60527836 +
tacaggaaaacagtaacatt

SEQ ID NO: 167135 - DNA, 20 bp, Artificial Sequence
  Synthetic oligonucleotide; TGG chr2 60527826 60527845 60527842 +
aaaacagtaacatttggttt

SEQ ID NO: 167136 - DNA, 20 bp, Artificial Sequence
  Synthetic oligonucleotide; CAG chr2 60527861 60527880 60527877 +
aatccatctgcaacgaacct

SEQ ID NO: 167137 - DNA, 20 bp, Artificial Sequence
  Synthetic oligonucleotide; AGG chr2 60527862 60527881 60527878 +
atccatctgcaacgaacctc

SEQ ID NO: 167138 - DNA, 20 bp, Artificial Sequence
  Synthetic oligonucleotide; CAG chr2 60527873 60527892 60527889 +
acgaacctcaggtcttgctt

SEQ ID NO: 167139 - DNA, 20 bp, Artificial Sequence
  Synthetic oligonucleotide; TAG chr2 60527886 60527905 60527902 +
cttgcttcagcaaatattaa

SEQ ID NO: 167140 - DNA, 20 bp, Artificial Sequence
  Synthetic oligonucleotide; CAG chr2 60527892 60527911 60527908 +
tcagcaaatattaatagcgt

SEQ ID NO: 167141 - DNA, 20 bp, Artificial Sequence
  Synthetic oligonucleotide; AGG chr2 60527893 60527912 60527909 +
cagcaaatattaatagcgtc

SEQ ID NO: 167142 - DNA, 20 bp, Artificial Sequence
  Synthetic oligonucleotide; GGG chr2 60527894 60527913 60527910 +
agcaaatattaatagcgtca

SEQ ID NO: 167143 - DNA, 20 bp, Artificial Sequence
  Synthetic oligonucleotide; CAG chr2 60527897 60527916 60527913 +
aaatattaatagcgtcaggg

SEQ ID NO: 167144 - DNA, 20 bp, Artificial Sequence
  Synthetic oligonucleotide; TGG chr2 60527904 60527923 60527920 +
aatagcgtcagggcagcctg

SEQ ID NO: 167145 - DNA, 20 bp, Artificial Sequence
  Synthetic oligonucleotide; GAG chr2 60527906 60527925 60527922 +
tagcgtcagggcagcctgtg

SEQ ID NO: 167146 - DNA, 20 bp, Artificial Sequence
  Synthetic oligonucleotide; TGG chr2 60527913 60527932 60527929 +
agggcagcctgtggagtgac

SEQ ID NO: 167147 - DNA, 20 bp, Artificial Sequence
  Synthetic oligonucleotide; GGG chr2 60527914 60527933 60527930 +
gggcagcctgtggagtgact

SEQ ID NO: 167148 - DNA, 20 bp, Artificial Sequence
  Synthetic oligonucleotide; GAG chr2 60527916 60527935 60527932 +
gcagcctgtggagtgactgg

SEQ ID NO: 167149 - DNA, 20 bp, Artificial Sequence
  Synthetic oligonucleotide; GAG chr2 60527918 60527937 60527934 +
agcctgtggagtgactggga

SEQ ID NO: 167150 - DNA, 20 bp, Artificial Sequence
  Synthetic oligonucleotide; AGG chr2 60527919 60527938 60527935 +
gcctgtggagtgactgggag

SEQ ID NO: 167151 - DNA, 20 bp, Artificial Sequence
  Synthetic oligonucleotide; CAG chr2 60527930 60527949 60527946 +
gactgggagaggccaccacg

SEQ ID NO: 167152 - DNA, 20 bp, Artificial Sequence
  Synthetic oligonucleotide; TGG chr2 60527948 60527967 60527964 +
cgcagctgaaaacttgcctc

SEQ ID NO: 167153 - DNA, 20 bp, Artificial Sequence
  Synthetic oligonucleotide; GGG chr2 60527949 60527968 60527965 +
gcagctgaaaacttgcctct

SEQ ID NO: 167154 - DNA, 20 bp, Artificial Sequence
  Synthetic oligonucleotide; GGG chr2 60527950 60527969 60527966 +
cagctgaaaacttgcctctg

SEQ ID NO: 167155 - DNA, 20 bp, Artificial Sequence
  Synthetic oligonucleotide; AAG chr2 60527953 60527972 60527969 +
ctgaaaacttgcctctgggg

SEQ ID NO: 167156 - DNA, 20 bp, Artificial Sequence
  Synthetic oligonucleotide; CGG chr2 60527963 60527982 60527979 +
gcctctggggaagccacatg

SEQ ID NO: 167157 - DNA, 20 bp, Artificial Sequence
  Synthetic oligonucleotide; TGG chr2 60527972 60527991 60527988 +
gaagccacatgcggatcata

SEQ ID NO: 167158 - DNA, 20 bp, Artificial Sequence
  Synthetic oligonucleotide; GAG chr2 60527974 60527993 60527990 +
agccacatgcggatcatatg

SEQ ID NO: 167159 - DNA, 20 bp, Artificial Sequence
  Synthetic oligonucleotide; CAG chr2 60527987 60528006 60528003 +
tcatatggagctgttgactg

SEQ ID NO: 167160 - DNA, 20 bp, Artificial Sequence
  Synthetic oligonucleotide; AAG chr2 60528011 60528030 60528027 +
ttccattcaaaacttccctc

SEQ ID NO: 167161 - DNA, 20 bp, Artificial Sequence
  Synthetic oligonucleotide; CAG chr2 60528018 60528037 60528034 +
caaaacttccctcaagtttc

SEQ ID NO: 167162 - DNA, 20 bp, Artificial Sequence
  Synthetic oligonucleotide; CGG chr2 60528030 60528049 60528046 +
caagtttccagcatgccttc

SEQ ID NO: 167163 - DNA, 20 bp, Artificial Sequence
  Synthetic oligonucleotide; CAG chr2 60528046 60528065 60528062 +
cttccggacttgccttacca

SEQ ID NO: 167164 - DNA, 20 bp, Artificial Sequence
  Synthetic oligonucleotide; CAG chr2 60528056 60528075 60528072 +
tgccttaccacagccttgtt

SEQ ID NO: 167165 - DNA, 20 bp, Artificial Sequence
  Synthetic oligonucleotide; CAG chr2 60528060 60528079 60528076 +
ttaccacagccttgttcagc

SEQ ID NO: 167166 - DNA, 20 bp, Artificial Sequence
  Synthetic oligonucleotide; AAG chr2 60528080 60528099 60528096 +
cagaaatgaaaacctcctcg

SEQ ID NO: 167167 - DNA, 20 bp, Artificial Sequence
  Synthetic oligonucleotide; CAG chr2 60528083 60528102 60528099 +
aaatgaaaacctcctcgaag

SEQ ID NO: 167168 - DNA, 20 bp, Artificial Sequence
  Synthetic oligonucleotide; CAG chr2 60528098 60528117 60528114 +
cgaagcagattatgaccccc

SEQ ID NO: 167169 - DNA, 20 bp, Artificial Sequence
  Synthetic oligonucleotide; AAG chr2 60528114 60528133 60528130 +
cccccagaacccatcgtcct

SEQ ID NO: 167170 - DNA, 20 bp, Artificial Sequence
  Synthetic oligonucleotide; CAG chr2 60528149 60528168 60528165 +
cacgcacactcactcacact

SEQ ID NO: 167171 - DNA, 20 bp, Artificial Sequence
  Synthetic oligonucleotide; CAG chr2 60528184 60528203 60528200 +
tgtataattctgattctccc

SEQ ID NO: 167172 - DNA, 20 bp, Artificial Sequence
  Synthetic oligonucleotide; AAG chr2 60528193 60528212 60528209 +
ctgattctccccagcctttg

SEQ ID NO: 167173 - DNA, 20 bp, Artificial Sequence
  Synthetic oligonucleotide; AGG chr2 60528194 60528213 60528210 +
tgattctccccagcctttga

SEQ ID NO: 167174 - DNA, 20 bp, Artificial Sequence
  Synthetic oligonucleotide; GAG chr2 60528205 60528224 60528221 +
agcctttgaaggtacgatcc

SEQ ID NO: 167175 - DNA, 20 bp, Artificial Sequence
  Synthetic oligonucleotide; AAG chr2 60528208 60528227 60528224 +
ctttgaaggtacgatccgag

SEQ ID NO: 167176 - DNA, 20 bp, Artificial Sequence
  Synthetic oligonucleotide; CAG chr2 60528220 60528239 60528236 +
gatccgagaagtaaatgcca

SEQ ID NO: 167177 - DNA, 20 bp, Artificial Sequence
  Synthetic oligonucleotide; GAG chr2 60528222 60528241 60528238 +
tccgagaagtaaatgccaca

SEQ ID NO: 167178 - DNA, 20 bp, Artificial Sequence
  Synthetic oligonucleotide; CAG chr2 60528233 60528252 60528249 +
aatgccacagagacaacaca

SEQ ID NO: 167179 - DNA, 20 bp, Artificial Sequence
  Synthetic oligonucleotide; CAG chr2 60528244 60528263 60528260 +
gacaacacacagaactgctg

SEQ ID NO: 167180 - DNA, 20 bp, Artificial Sequence
  Synthetic oligonucleotide; AGG chr2 60528245 60528264 60528261 +
acaacacacagaactgctgc

SEQ ID NO: 167181 - DNA, 20 bp, Artificial Sequence
  Synthetic oligonucleotide; AAG chr2 60528250 60528269 60528266 +
acacagaactgctgcaggcc

SEQ ID NO: 167182 - DNA, 20 bp, Artificial Sequence
  Synthetic oligonucleotide; AAG chr2 60528269 60528288 60528285 +
caagcctcaccacttcttaa

SEQ ID NO: 167183 - DNA, 20 bp, Artificial Sequence
  Synthetic oligonucleotide; GAG chr2 60528275 60528294 60528291 +
tcaccacttcttaaaagtcc

SEQ ID NO: 167184 - DNA, 20 bp, Artificial Sequence
  Synthetic oligonucleotide; TAG chr2 60528280 60528299 60528296 +
acttcttaaaagtccgagct

SEQ ID NO: 167185 - DNA, 20 bp, Artificial Sequence
  Synthetic oligonucleotide; CAG chr2 60528292 60528311 60528308 +
tccgagcttagtttctcatt

SEQ ID NO: 167186 - DNA, 20 bp, Artificial Sequence
  Synthetic oligonucleotide; CAG chr2 60528302 60528321 60528318 +
gtttctcattcagcccactg

SEQ ID NO: 167187 - DNA, 20 bp, Artificial Sequence
  Synthetic oligonucleotide; AAG chr2 60528315 60528334 60528331 +
cccactgcagtctcctgacc

SEQ ID NO: 167188 - DNA, 20 bp, Artificial Sequence
  Synthetic oligonucleotide; CAG chr2 60528329 60528348 60528345 +
ctgaccaagccacacacaaa

SEQ ID NO: 167189 - DNA, 20 bp, Artificial Sequence
  Synthetic oligonucleotide; CAG chr2 60528355 60528374 60528371 +
aacctcctccctctgtttct

SEQ ID NO: 167190 - DNA, 20 bp, Artificial Sequence
  Synthetic oligonucleotide; AGG chr2 60528356 60528375 60528372 +
acctcctccctctgtttctc

SEQ ID NO: 167191 - DNA, 20 bp, Artificial Sequence
  Synthetic oligonucleotide; CAG chr2 60528374 60528393 60528390 +
tcaggaccctcacttgattt

SEQ ID NO: 167192 - DNA, 20 bp, Artificial Sequence
  Synthetic oligonucleotide; AGG chr2 60528375 60528394 60528391 +
caggaccctcacttgatttc

SEQ ID NO: 167193 - DNA, 20 bp, Artificial Sequence
  Synthetic oligonucleotide; TGG chr2 60528385 60528404 60528401 +
acttgatttcaggctcattc

SEQ ID NO: 167194 - DNA, 20 bp, Artificial Sequence
  Synthetic oligonucleotide; CAG chr2 60528389 60528408 60528405 +
gatttcaggctcattctgga

SEQ ID NO: 167195 - DNA, 20 bp, Artificial Sequence
  Synthetic oligonucleotide; TGG chr2 60528393 60528412 60528409 +
tcaggctcattctggacaga

SEQ ID NO: 167196 - DNA, 20 bp, Artificial Sequence
  Synthetic oligonucleotide; GGG chr2 60528394 60528413 60528410 +
caggctcattctggacagat

SEQ ID NO: 167197 - DNA, 20 bp, Artificial Sequence
  Synthetic oligonucleotide; GGG chr2 60528395 60528414 60528411 +
aggctcattctggacagatg

SEQ ID NO: 167198 - DNA, 20 bp, Artificial Sequence
  Synthetic oligonucleotide; AAG chr2 60528413 60528432 60528429 +
tggggaaatgactacttgca

SEQ ID NO: 167199 - DNA, 20 bp, Artificial Sequence
  Synthetic oligonucleotide; CAG chr2 60528416 60528435 60528432 +
ggaaatgactacttgcaaag

SEQ ID NO: 167200 - DNA, 20 bp, Artificial Sequence
  Synthetic oligonucleotide; AGG chr2 60528417 60528436 60528433 +
gaaatgactacttgcaaagc

SEQ ID NO: 167201 - DNA, 20 bp, Artificial Sequence
  Synthetic oligonucleotide; CAG chr2 60528446 60528465 60528462 +
tacattgcaacttttcccaa

SEQ ID NO: 167202 - DNA, 20 bp, Artificial Sequence
  Synthetic oligonucleotide; CAG chr2 60528471 60528490 60528487 +
ccgtgctccttcaatatgcc

SEQ ID NO: 167203 - DNA, 20 bp, Artificial Sequence
  Synthetic oligonucleotide; TGG chr2 60528477 60528496 60528493 +
tccttcaatatgcccagaac

SEQ ID NO: 167204 - DNA, 20 bp, Artificial Sequence
  Synthetic oligonucleotide; GAG chr2 60528479 60528498 60528495 +
cttcaatatgcccagaactg

SEQ ID NO: 167205 - DNA, 20 bp, Artificial Sequence
  Synthetic oligonucleotide; AGG chr2 60528480 60528499 60528496 +
ttcaatatgcccagaactgg

SEQ ID NO: 167206 - DNA, 20 bp, Artificial Sequence
  Synthetic oligonucleotide; GGG chr2 60528481 60528500 60528497 +
tcaatatgcccagaactgga

SEQ ID NO: 167207 - DNA, 20 bp, Artificial Sequence
  Synthetic oligonucleotide; GGG chr2 60528482 60528501 60528498 +
caatatgcccagaactggag

SEQ ID NO: 167208 - DNA, 20 bp, Artificial Sequence
  Synthetic oligonucleotide; CAG chr2 60528502 60528521 60528518 +
gggaacattcttctctttcc

SEQ ID NO: 167209 - DNA, 20 bp, Artificial Sequence
  Synthetic oligonucleotide; AAG chr2 60528505 60528524 60528521 +
aacattcttctctttcccag

SEQ ID NO: 167210 - DNA, 20 bp, Artificial Sequence
  Synthetic oligonucleotide; CAG chr2 60528525 60528544 60528541 +
aagattgaaaaacttgacca

SEQ ID NO: 167211 - DNA, 20 bp, Artificial Sequence
  Synthetic oligonucleotide; TGG chr2 60528534 60528553 60528550 +
aaacttgaccacagaaccca

SEQ ID NO: 167212 - DNA, 20 bp, Artificial Sequence
  Synthetic oligonucleotide; GGG chr2 60528535 60528554 60528551 +
aacttgaccacagaacccat

SEQ ID NO: 167213 - DNA, 20 bp, Artificial Sequence
  Synthetic oligonucleotide; GAG chr2 60528537 60528556 60528553 +
cttgaccacagaacccatgg

SEQ ID NO: 167214 - DNA, 20 bp, Artificial Sequence
  Synthetic oligonucleotide; AGG chr2 60528538 60528557 60528554 +
ttgaccacagaacccatggg

SEQ ID NO: 167215 - DNA, 20 bp, Artificial Sequence
  Synthetic oligonucleotide; GGG chr2 60528539 60528558 60528555 +
tgaccacagaacccatggga

SEQ ID NO: 167216 - DNA, 20 bp, Artificial Sequence
  Synthetic oligonucleotide; CAG chr2 60528551 60528570 60528567 +
ccatgggagggacaactgtc

SEQ ID NO: 167217 - DNA, 20 bp, Artificial Sequence
  Synthetic oligonucleotide; CAG chr2 60528557 60528576 60528573 +
gagggacaactgtccagcac

SEQ ID NO: 167218 - DNA, 20 bp, Artificial Sequence
  Synthetic oligonucleotide; GAG chr2 60528559 60528578 60528575 +
gggacaactgtccagcacca

SEQ ID NO: 167219 - DNA, 20 bp, Artificial Sequence
  Synthetic oligonucleotide; CAG chr2 60528571 60528590 60528587 +
cagcaccagagcttcctgcc

SEQ ID NO: 167220 - DNA, 20 bp, Artificial Sequence
  Synthetic oligonucleotide; TGG chr2 60528582 60528601 60528598 +
cttcctgcccagttgttgcc

SEQ ID NO: 167221 - DNA, 20 bp, Artificial Sequence
  Synthetic oligonucleotide; AAG chr2 60528593 60528612 60528609 +
gttgttgcctggcaccgctg

SEQ ID NO: 167222 - DNA, 20 bp, Artificial Sequence
  Synthetic oligonucleotide; AAG chr2 60528597 60528616 60528613 +
ttgcctggcaccgctgaaga

SEQ ID NO: 167223 - DNA, 20 bp, Artificial Sequence
  Synthetic oligonucleotide; AAG chr2 60528614 60528633 60528630 +
agaaagctgcaaacgtactg

SEQ ID NO: 167224 - DNA, 20 bp, Artificial Sequence
  Synthetic oligonucleotide; GAG chr2 60528616 60528635 60528632 +
aaagctgcaaacgtactgaa

SEQ ID NO: 167225 - DNA, 20 bp, Artificial Sequence
  Synthetic oligonucleotide; AGG chr2 60528617 60528636 60528633 +
aagctgcaaacgtactgaag

SEQ ID NO: 167226 - DNA, 20 bp, Artificial Sequence
  Synthetic oligonucleotide; TAG chr2 60528620 60528639 60528636 +
ctgcaaacgtactgaagagg

SEQ ID NO: 167227 - DNA, 20 bp, Artificial Sequence
  Synthetic oligonucleotide; CAG chr2 60528623 60528642 60528639 +
caaacgtactgaagaggtag

SEQ ID NO: 167228 - DNA, 20 bp, Artificial Sequence
  Synthetic oligonucleotide; GAG chr2 60528625 60528644 60528641 +
aacgtactgaagaggtagca

SEQ ID NO: 167229 - DNA, 20 bp, Artificial Sequence
  Synthetic oligonucleotide; AGG chr2 60528626 60528645 60528642 +
acgtactgaagaggtagcag

SEQ ID NO: 167230 - DNA, 20 bp, Artificial Sequence
  Synthetic oligonucleotide; GGG chr2 60528627 60528646 60528643 +
cgtactgaagaggtagcaga

SEQ ID NO: 167231 - DNA, 20 bp, Artificial Sequence
  Synthetic oligonucleotide; TGG chr2 60528630 60528649 60528646 +
actgaagaggtagcagaggg

SEQ ID NO: 167232 - DNA, 20 bp, Artificial Sequence
  Synthetic oligonucleotide; CGG chr2 60528633 60528652 60528649 +
gaagaggtagcagagggtgg

SEQ ID NO: 167233 - DNA, 20 bp, Artificial Sequence
  Synthetic oligonucleotide; CAG chr2 60528639 60528658 60528655 +
gtagcagagggtggcggccg

SEQ ID NO: 167234 - DNA, 20 bp, Artificial Sequence
  Synthetic oligonucleotide; AGG chr2 60528640 60528659 60528656 +
tagcagagggtggcggccgc

SEQ ID NO: 167235 - DNA, 20 bp, Artificial Sequence
  Synthetic oligonucleotide; AAG chr2 60528646 60528665 60528662 +
agggtggcggccgcaggcca

SEQ ID NO: 167236 - DNA, 20 bp, Artificial Sequence
  Synthetic oligonucleotide; AGG chr2 60528647 60528666 60528663 +
gggtggcggccgcaggccaa

SEQ ID NO: 167237 - DNA, 20 bp, Artificial Sequence
  Synthetic oligonucleotide; TGG chr2 60528662 60528681 60528678 +
gccaaaggattgaacaactg

SEQ ID NO: 167238 - DNA, 20 bp, Artificial Sequence
  Synthetic oligonucleotide; CAG chr2 60528670 60528689 60528686 +
attgaacaactgtggaccct

SEQ ID NO: 167239 - DNA, 20 bp, Artificial Sequence
  Synthetic oligonucleotide; AGG chr2 60528671 60528690 60528687 +
ttgaacaactgtggaccctc

SEQ ID NO: 167240 - DNA, 20 bp, Artificial Sequence
  Synthetic oligonucleotide; GGG chr2 60528672 60528691 60528688 +
tgaacaactgtggaccctca

SEQ ID NO: 167241 - DNA, 20 bp, Artificial Sequence
  Synthetic oligonucleotide; AAG chr2 60528675 60528694 60528691 +
acaactgtggaccctcaggg

SEQ ID NO: 167242 - DNA, 20 bp, Artificial Sequence
  Synthetic oligonucleotide; GAG chr2 60528721 60528740 60528737 +
aatttcctcctctaccaaat

SEQ ID NO: 167243 - DNA, 20 bp, Artificial Sequence
  Synthetic oligonucleotide; AGG chr2 60528722 60528741 60528738 +
atttcctcctctaccaaatg

SEQ ID NO: 167244 - DNA, 20 bp, Artificial Sequence
  Synthetic oligonucleotide; TGG chr2 60528729 60528748 60528745 +
cctctaccaaatgaggctaa

SEQ ID NO: 167245 - DNA, 20 bp, Artificial Sequence
  Synthetic oligonucleotide; GGG chr2 60528730 60528749 60528746 +
ctctaccaaatgaggctaat

SEQ ID NO: 167246 - DNA, 20 bp, Artificial Sequence
  Synthetic oligonucleotide; GAG chr2 60528732 60528751 60528748 +
ctaccaaatgaggctaatgg

SEQ ID NO: 167247 - DNA, 20 bp, Artificial Sequence
  Synthetic oligonucleotide; GAG chr2 60528747 60528766 60528763 +
aatgggagtgtttcctttcc

SEQ ID NO: 167248 - DNA, 20 bp, Artificial Sequence
  Synthetic oligonucleotide; AGG chr2 60528748 60528767 60528764 +
atgggagtgtttcctttccg

SEQ ID NO: 167249 - DNA, 20 bp, Artificial Sequence
  Synthetic oligonucleotide; TGG chr2 60528757 60528776 60528773 +
tttcctttccgaggttgttg

SEQ ID NO: 167250 - DNA, 20 bp, Artificial Sequence
  Synthetic oligonucleotide; GGG chr2 60528758 60528777 60528774 +
ttcctttccgaggttgttgt

SEQ ID NO: 167251 - DNA, 20 bp, Artificial Sequence
  Synthetic oligonucleotide; TGG chr2 60528762 60528781 60528778 +
tttccgaggttgttgtggga

SEQ ID NO: 167252 - DNA, 20 bp, Artificial Sequence
  Synthetic oligonucleotide; CAG chr2 60528778 60528797 60528794 +
gggatggaatatcaatgtgt

SEQ ID NO: 167253 - DNA, 20 bp, Artificial Sequence
  Synthetic oligonucleotide; TGG chr2 60528786 60528805 60528802 +
atatcaatgtgtcagacaca

SEQ ID NO: 167254 - DNA, 20 bp, Artificial Sequence
  Synthetic oligonucleotide; CAG chr2 60528801 60528820 60528817 +
acacatggtaataatgacaa

SEQ ID NO: 167255 - DNA, 20 bp, Artificial Sequence
  Synthetic oligonucleotide; TGG chr2 60528810 60528829 60528826 +
aataatgacaacagcaattc

SEQ ID NO: 167256 - DNA, 20 bp, Artificial Sequence
  Synthetic oligonucleotide; GAG chr2 60528812 60528831 60528828 +
taatgacaacagcaattctg

SEQ ID NO: 167257 - DNA, 20 bp, Artificial Sequence
  Synthetic oligonucleotide; AGG chr2 60528813 60528832 60528829 +
aatgacaacagcaattctgg

SEQ ID NO: 167258 - DNA, 20 bp, Artificial Sequence
  Synthetic oligonucleotide; CAG chr2 60528818 60528837 60528834 +
caacagcaattctggaggtg

SEQ ID NO: 167259 - DNA, 20 bp, Artificial Sequence
  Synthetic oligonucleotide; CGG chr2 60528825 60528844 60528841 +
aattctggaggtgcagcccc

SEQ ID NO: 167260 - DNA, 20 bp, Artificial Sequence
  Synthetic oligonucleotide; GAG chr2 60528827 60528846 60528843 +
ttctggaggtgcagcccccg

SEQ ID NO: 167261 - DNA, 20 bp, Artificial Sequence
  Synthetic oligonucleotide; GAG chr2 60528831 60528850 60528847 +
ggaggtgcagcccccggagc

SEQ ID NO: 167262 - DNA, 20 bp, Artificial Sequence
  Synthetic oligonucleotide; TGG chr2 60528868 60528887 60528884 +
tccctcatttacttctcaca

SEQ ID NO: 167263 - DNA, 20 bp, Artificial Sequence
  Synthetic oligonucleotide; GAG chr2 60528878 60528897 60528894 +
acttctcacatggactctat

SEQ ID NO: 167264 - DNA, 20 bp, Artificial Sequence
  Synthetic oligonucleotide; AGG chr2 60528879 60528898 60528895 +
cttctcacatggactctatg

SEQ ID NO: 167265 - DNA, 20 bp, Artificial Sequence
  Synthetic oligonucleotide; AAG chr2 60528883 60528902 60528899 +
tcacatggactctatgaggt

SEQ ID NO: 167266 - DNA, 20 bp, Artificial Sequence
  Synthetic oligonucleotide; AGG chr2 60528884 60528903 60528900 +
cacatggactctatgaggta

SEQ ID NO: 167267 - DNA, 20 bp, Artificial Sequence
  Synthetic oligonucleotide; GGG chr2 60528885 60528904 60528901 +
acatggactctatgaggtaa

SEQ ID NO: 167268 - DNA, 20 bp, Artificial Sequence
  Synthetic oligonucleotide; GAG chr2 60528893 60528912 60528909 +
tctatgaggtaagggacctt

SEQ ID NO: 167269 - DNA, 20 bp, Artificial Sequence
  Synthetic oligonucleotide; CAG chr2 60528910 60528929 60528926 +
cttgagttatctccatttca

SEQ ID NO: 167270 - DNA, 20 bp, Artificial Sequence
  Synthetic oligonucleotide; GAG chr2 60528912 60528931 60528928 +
tgagttatctccatttcaca

SEQ ID NO: 167271 - DNA, 20 bp, Artificial Sequence
  Synthetic oligonucleotide; GAG chr2 60528914 60528933 60528930 +
agttatctccatttcacaga

SEQ ID NO: 167272 - DNA, 20 bp, Artificial Sequence
  Synthetic oligonucleotide; AGG chr2 60528915 60528934 60528931 +
gttatctccatttcacagag

SEQ ID NO: 167273 - DNA, 20 bp, Artificial Sequence
  Synthetic oligonucleotide; CAG chr2 60528932 60528951 60528948 +
gagaggtgaaatgattccct

SEQ ID NO: 167274 - DNA, 20 bp, Artificial Sequence
  Synthetic oligonucleotide; CAG chr2 60528946 60528965 60528962 +
ttccctcagactctcccaac

SEQ ID NO: 167275 - DNA, 20 bp, Artificial Sequence
  Synthetic oligonucleotide; TAG chr2 60528950 60528969 60528966 +
ctcagactctcccaaccagc

SEQ ID NO: 167276 - DNA, 20 bp, Artificial Sequence
  Synthetic oligonucleotide; CAG chr2 60528953 60528972 60528969 +
agactctcccaaccagctag

SEQ ID NO: 167277 - DNA, 20 bp, Artificial Sequence
  Synthetic oligonucleotide; TAG chr2 60528961 60528980 60528977 +
ccaaccagctagcagtaaca

SEQ ID NO: 167278 - DNA, 20 bp, Artificial Sequence
  Synthetic oligonucleotide; CAG chr2 60528975 60528994 60528991 +
gtaacatagaaatctgaacc

SEQ ID NO: 167279 - DNA, 20 bp, Artificial Sequence
  Synthetic oligonucleotide; GAG chr2 60528977 60528996 60528993 +
aacatagaaatctgaaccca

SEQ ID NO: 167280 - DNA, 20 bp, Artificial Sequence
  Synthetic oligonucleotide; CAG chr2 60528997 60529016 60529013 +
gagtaactgtgtcacacacc

SEQ ID NO: 167281 - DNA, 20 bp, Artificial Sequence
  Synthetic oligonucleotide; AGG chr2 60528998 60529017 60529014 +
agtaactgtgtcacacaccc

SEQ ID NO: 167282 - DNA, 20 bp, Artificial Sequence
  Synthetic oligonucleotide; CAG chr2 60529001 60529020 60529017 +
aactgtgtcacacacccagg

SEQ ID NO: 167283 - DNA, 20 bp, Artificial Sequence
  Synthetic oligonucleotide; AGG chr2 60529002 60529021 60529018 +
actgtgtcacacacccaggc

SEQ ID NO: 167284 - DNA, 20 bp, Artificial Sequence
  Synthetic oligonucleotide; AAG chr2 60529008 60529027 60529024 +
tcacacacccaggcaggcac

SEQ ID NO: 167285 - DNA, 20 bp, Artificial Sequence
  Synthetic oligonucleotide; AAG chr2 60529019 60529038 60529035 +
ggcaggcacaagcctctcgt

SEQ ID NO: 167286 - DNA, 20 bp, Artificial Sequence
  Synthetic oligonucleotide; AGG chr2 60529020 60529039 60529036 +
gcaggcacaagcctctcgta

SEQ ID NO: 167287 - DNA, 20 bp, Artificial Sequence
  Synthetic oligonucleotide; TGG chr2 60529036 60529055 60529052 +
cgtaaggcaacacacgtcta

SEQ ID NO: 167288 - DNA, 20 bp, Artificial Sequence
  Synthetic oligonucleotide; GGG chr2 60529037 60529056 60529053 +
gtaaggcaacacacgtctat

SEQ ID NO: 167289 - DNA, 20 bp, Artificial Sequence
  Synthetic oligonucleotide; GGG chr2 60529038 60529057 60529054 +
taaggcaacacacgtctatg

SEQ ID NO: 167290 - DNA, 20 bp, Artificial Sequence
  Synthetic oligonucleotide; GAG chr2 60529040 60529059 60529056 +
aggcaacacacgtctatggg

SEQ ID NO: 167291 - DNA, 20 bp, Artificial Sequence
  Synthetic oligonucleotide; GAG chr2 60529042 60529061 60529058 +
gcaacacacgtctatgggga

SEQ ID NO: 167292 - DNA, 20 bp, Artificial Sequence
  Synthetic oligonucleotide; AGG chr2 60529043 60529062 60529059 +
caacacacgtctatggggag

SEQ ID NO: 167293 - DNA, 20 bp, Artificial Sequence
  Synthetic oligonucleotide; GGG chr2 60529044 60529063 60529060 +
aacacacgtctatggggaga

SEQ ID NO: 167294 - DNA, 20 bp, Artificial Sequence
  Synthetic oligonucleotide; GGG chr2 60529045 60529064 60529061 +
acacacgtctatggggagag

SEQ ID NO: 167295 - DNA, 20 bp, Artificial Sequence
  Synthetic oligonucleotide; GAG chr2 60529060 60529079 60529076 +
gagaggggactcccacccac

SEQ ID NO: 167296 - DNA, 20 bp, Artificial Sequence
  Synthetic oligonucleotide; AGG chr2 60529061 60529080 60529077 +
agaggggactcccacccacg

SEQ ID NO: 167297 - DNA, 20 bp, Artificial Sequence
  Synthetic oligonucleotide; GGG chr2 60529062 60529081 60529078 +
gaggggactcccacccacga

SEQ ID NO: 167298 - DNA, 20 bp, Artificial Sequence
  Synthetic oligonucleotide; GAG chr2 60529064 60529083 60529080 +
ggggactcccacccacgagg

SEQ ID NO: 167299 - DNA, 20 bp, Artificial Sequence
  Synthetic oligonucleotide; CAG chr2 60529074 60529093 60529090 +
acccacgagggagctgccac

SEQ ID NO: 167300 - DNA, 20 bp, Artificial Sequence
  Synthetic oligonucleotide; GAG chr2 60529086 60529105 60529102 +
gctgccaccagaaacataat

SEQ ID NO: 167301 - DNA, 20 bp, Artificial Sequence
  Synthetic oligonucleotide; GAG chr2 60529094 60529113 60529110 +
cagaaacataatgagaccct

SEQ ID NO: 167302 - DNA, 20 bp, Artificial Sequence
  Synthetic oligonucleotide; TAG chr2 60529102 60529121 60529118 +
taatgagaccctgagctctt

SEQ ID NO: 167303 - DNA, 20 bp, Artificial Sequence
  Synthetic oligonucleotide; TGG chr2 60529154 60529173 60529170 +
ccaacctgctcaccccataa

SEQ ID NO: 167304 - DNA, 20 bp, Artificial Sequence
  Synthetic oligonucleotide; GGG chr2 60529155 60529174 60529171 +
caacctgctcaccccataat

SEQ ID NO: 167305 - DNA, 20 bp, Artificial Sequence
  Synthetic oligonucleotide; GGG chr2 60529156 60529175 60529172 +
aacctgctcaccccataatg

SEQ ID NO: 167306 - DNA, 20 bp, Artificial Sequence
  Synthetic oligonucleotide; GGG chr2 60529157 60529176 60529173 +
acctgctcaccccataatgg

SEQ ID NO: 167307 - DNA, 20 bp, Artificial Sequence
  Synthetic oligonucleotide; GAG chr2 60529169 60529188 60529185 +
cataatgggggaactacttt

SEQ ID NO: 167308 - DNA, 20 bp, Artificial Sequence
  Synthetic oligonucleotide; CAG chr2 60529176 60529195 60529192 +
ggggaactactttgagaccc

SEQ ID NO: 167309 - DNA, 20 bp, Artificial Sequence
  Synthetic oligonucleotide; AGG chr2 60529177 60529196 60529193 +
gggaactactttgagacccc

SEQ ID NO: 167310 - DNA, 20 bp, Artificial Sequence
  Synthetic oligonucleotide; GAG chr2 60529179 60529198 60529195 +
gaactactttgagaccccag

SEQ ID NO: 167311 - DNA, 20 bp, Artificial Sequence
  Synthetic oligonucleotide; CAG chr2 60529186 60529205 60529202 +
tttgagaccccaggagcaca

SEQ ID NO: 167312 - DNA, 20 bp, Artificial Sequence
  Synthetic oligonucleotide; AAG chr2 60529193 60529212 60529209 +
ccccaggagcacacagttcc

SEQ ID NO: 167313 - DNA, 20 bp, Artificial Sequence
  Synthetic oligonucleotide; GAG chr2 60529200 60529219 60529216 +
agcacacagttccaagccat

SEQ ID NO: 167314 - DNA, 20 bp, Artificial Sequence
  Synthetic oligonucleotide; TAG chr2 60529215 60529234 60529231 +
gccatgagtcataaccgtaa

SEQ ID NO: 167315 - DNA, 20 bp, Artificial Sequence
  Synthetic oligonucleotide; GAG chr2 60529222 60529241 60529238 +
gtcataaccgtaatagtaat

SEQ ID NO: 167316 - DNA, 20 bp, Artificial Sequence
  Synthetic oligonucleotide; CAG chr2 60529252 60529271 60529268 +
gacatgttttaccatgtgcc

SEQ ID NO: 167317 - DNA, 20 bp, Artificial Sequence
  Synthetic oligonucleotide; GAG chr2 60529259 60529278 60529275 +
tttaccatgtgcccagcact

SEQ ID NO: 167318 - DNA, 20 bp, Artificial Sequence
  Synthetic oligonucleotide; CAG chr2 60529264 60529283 60529280 +
catgtgcccagcactgagcc

SEQ ID NO: 167319 - DNA, 20 bp, Artificial Sequence
  Synthetic oligonucleotide; TAG chr2 60529285 60529304 60529301 +
agcgcccccacatgctctca

SEQ ID NO: 167320 - DNA, 20 bp, Artificial Sequence
  Synthetic oligonucleotide; AGG chr2 60529286 60529305 60529302 +
gcgcccccacatgctctcat

SEQ ID NO: 167321 - DNA, 20 bp, Artificial Sequence
  Synthetic oligonucleotide; AAG chr2 60529296 60529315 60529312 +
atgctctcataggatgctca

SEQ ID NO: 167322 - DNA, 20 bp, Artificial Sequence
  Synthetic oligonucleotide; AGG chr2 60529297 60529316 60529313 +
tgctctcataggatgctcaa

SEQ ID NO: 167323 - DNA, 20 bp, Artificial Sequence
  Synthetic oligonucleotide; GAG chr2 60529306 60529325 60529322 +
aggatgctcaaaggccctat

SEQ ID NO: 167324 - DNA, 20 bp, Artificial Sequence
  Synthetic oligonucleotide; AGG chr2 60529307 60529326 60529323 +
ggatgctcaaaggccctatg

SEQ ID NO: 167325 - DNA, 20 bp, Artificial Sequence
  Synthetic oligonucleotide; AAG chr2 60529311 60529330 60529327 +
gctcaaaggccctatgaggc

SEQ ID NO: 167326 - DNA, 20 bp, Artificial Sequence
  Synthetic oligonucleotide; CAG chr2 60529336 60529355 60529352 +
ccgtgattctccccacttta

SEQ ID NO: 167327 - DNA, 20 bp, Artificial Sequence
  Synthetic oligonucleotide; GAG chr2 60529342 60529361 60529358 +
ttctccccactttacagatt

SEQ ID NO: 167328 - DNA, 20 bp, Artificial Sequence
  Synthetic oligonucleotide; AGG chr2 60529343 60529362 60529359 +
tctccccactttacagattg

SEQ ID NO: 167329 - DNA, 20 bp, Artificial Sequence
  Synthetic oligonucleotide; AAG chr2 60529346 60529365 60529362 +
ccccactttacagattgagg

SEQ ID NO: 167330 - DNA, 20 bp, Artificial Sequence
  Synthetic oligonucleotide; CGG chr2 60529349 60529368 60529365 +
cactttacagattgaggaag

SEQ ID NO: 167331 - DNA, 20 bp, Artificial Sequence
  Synthetic oligonucleotide; GAG chr2 60529351 60529370 60529367 +
ctttacagattgaggaagcg

SEQ ID NO: 167332 - DNA, 20 bp, Artificial Sequence
  Synthetic oligonucleotide; AGG chr2 60529352 60529371 60529368 +
tttacagattgaggaagcgg

SEQ ID NO: 167333 - DNA, 20 bp, Artificial Sequence
  Synthetic oligonucleotide; TAG chr2 60529357 60529376 60529373 +
agattgaggaagcggaggct

SEQ ID NO: 167334 - DNA, 20 bp, Artificial Sequence
  Synthetic oligonucleotide; AGG chr2 60529358 60529377 60529374 +
gattgaggaagcggaggctt

SEQ ID NO: 167335 - DNA, 20 bp, Artificial Sequence
  Synthetic oligonucleotide; GGG chr2 60529359 60529378 60529375 +
attgaggaagcggaggctta

SEQ ID NO: 167336 - DNA, 20 bp, Artificial Sequence
  Synthetic oligonucleotide; AAG chr2 60529376 60529395 60529392 +
ttagggaatgaaatctgccc

SEQ ID NO: 167337 - DNA, 20 bp, Artificial Sequence
  Synthetic oligonucleotide; AGG chr2 60529377 60529396 60529393 +
tagggaatgaaatctgccca

SEQ ID NO: 167338 - DNA, 20 bp, Artificial Sequence
  Synthetic oligonucleotide; TAG chr2 60529389 60529408 60529405 +
tctgcccaaggttgcacaac

SEQ ID NO: 167339 - DNA, 20 bp, Artificial Sequence
  Synthetic oligonucleotide; TGG chr2 60529395 60529414 60529411 +
caaggttgcacaactagaaa

SEQ ID NO: 167340 - DNA, 20 bp, Artificial Sequence
  Synthetic oligonucleotide; CAG chr2 60529415 60529434 60529431 +
tggtattacttctttaccct

SEQ ID NO: 167341 - DNA, 20 bp, Artificial Sequence
  Synthetic oligonucleotide; AAG chr2 60529445 60529464 60529461 +
cattttatttcgtgtaatca

SEQ ID NO: 167342 - DNA, 20 bp, Artificial Sequence
  Synthetic oligonucleotide; GAG chr2 60529447 60529466 60529463 +
ttttatttcgtgtaatcaaa

SEQ ID NO: 167343 - DNA, 20 bp, Artificial Sequence
  Synthetic oligonucleotide; AAG chr2 60529450 60529469 60529466 +
tatttcgtgtaatcaaagag

SEQ ID NO: 167344 - DNA, 20 bp, Artificial Sequence
  Synthetic oligonucleotide; AAG chr2 60529453 60529472 60529469 +
ttcgtgtaatcaaagagaag

SEQ ID NO: 167345 - DNA, 20 bp, Artificial Sequence
  Synthetic oligonucleotide; AAG chr2 60529458 60529477 60529474 +
gtaatcaaagagaagaagaa

SEQ ID NO: 167346 - DNA, 20 bp, Artificial Sequence
  Synthetic oligonucleotide; AAG chr2 60529462 60529481 60529478 +
tcaaagagaagaagaaaaga

SEQ ID NO: 167347 - DNA, 20 bp, Artificial Sequence
  Synthetic oligonucleotide; AAG chr2 60529465 60529484 60529481 +
aagagaagaagaaaagaaag

SEQ ID NO: 167348 - DNA, 20 bp, Artificial Sequence
  Synthetic oligonucleotide; AAG chr2 60529482 60529501 60529498 +
aagaagatacatcatatgtc

SEQ ID NO: 167349 - DNA, 20 bp, Artificial Sequence
  Synthetic oligonucleotide; AGG chr2 60529483 60529502 60529499 +
agaagatacatcatatgtca

SEQ ID NO: 167350 - DNA, 20 bp, Artificial Sequence
  Synthetic oligonucleotide; GGG chr2 60529484 60529503 60529500 +
gaagatacatcatatgtcaa

SEQ ID NO: 167351 - DNA, 20 bp, Artificial Sequence
  Synthetic oligonucleotide; CAG chr2 60529525 60529544 60529541 +
gtccctcctccctttcttac

SEQ ID NO: 167352 - DNA, 20 bp, Artificial Sequence
  Synthetic oligonucleotide; CAG chr2 60529530 60529549 60529546 +
tcctccctttcttaccagct

SEQ ID NO: 167353 - DNA, 20 bp, Artificial Sequence
  Synthetic oligonucleotide; AGG chr2 60529531 60529550 60529547 +
cctccctttcttaccagctc

SEQ ID NO: 167354 - DNA, 20 bp, Artificial Sequence
  Synthetic oligonucleotide; AAG chr2 60529539 60529558 60529555 +
tcttaccagctcaggttaca

SEQ ID NO: 167355 - DNA, 20 bp, Artificial Sequence
  Synthetic oligonucleotide; TAG chr2 60529547 60529566 60529563 +
gctcaggttacaaagacatc

SEQ ID NO: 167356 - DNA, 20 bp, Artificial Sequence
  Synthetic oligonucleotide; AGG chr2 60529548 60529567 60529564 +
ctcaggttacaaagacatct

SEQ ID NO: 167357 - DNA, 20 bp, Artificial Sequence
  Synthetic oligonucleotide; TGG chr2 60529551 60529570 60529567 +
aggttacaaagacatctagg

SEQ ID NO: 167358 - DNA, 20 bp, Artificial Sequence
  Synthetic oligonucleotide; GGG chr2 60529552 60529571 60529568 +
ggttacaaagacatctaggt

SEQ ID NO: 167359 - DNA, 20 bp, Artificial Sequence
  Synthetic oligonucleotide; GAG chr2 60529554 60529573 60529570 +
ttacaaagacatctaggtgg

SEQ ID NO: 167360 - DNA, 20 bp, Artificial Sequence
  Synthetic oligonucleotide; GAG chr2 60529556 60529575 60529572 +
acaaagacatctaggtggga

SEQ ID NO: 167361 - DNA, 20 bp, Artificial Sequence
  Synthetic oligonucleotide; AAG chr2 60529559 60529578 60529575 +
aagacatctaggtgggagag

SEQ ID NO: 167362 - DNA, 20 bp, Artificial Sequence
  Synthetic oligonucleotide; AAG chr2 60529571 60529590 60529587 +
tgggagagaagactgcctct

SEQ ID NO: 167363 - DNA, 20 bp, Artificial Sequence
  Synthetic oligonucleotide; AGG chr2 60529572 60529591 60529588 +
gggagagaagactgcctcta

SEQ ID NO: 167364 - DNA, 20 bp, Artificial Sequence
  Synthetic oligonucleotide; GGG chr2 60529573 60529592 60529589 +
ggagagaagactgcctctaa

SEQ ID NO: 167365 - DNA, 20 bp, Artificial Sequence
  Synthetic oligonucleotide; TGG chr2 60529578 60529597 60529594 +
gaagactgcctctaagggct

SEQ ID NO: 167366 - DNA, 20 bp, Artificial Sequence
  Synthetic oligonucleotide; GAG chr2 60529583 60529602 60529599 +
ctgcctctaagggcttggct

SEQ ID NO: 167367 - DNA, 20 bp, Artificial Sequence
  Synthetic oligonucleotide; TGG chr2 60529587 60529606 60529603 +
ctctaagggcttggctgagt

SEQ ID NO: 167368 - DNA, 20 bp, Artificial Sequence
  Synthetic oligonucleotide; CGG chr2 60529590 60529609 60529606 +
taagggcttggctgagttgg

SEQ ID NO: 167369 - DNA, 20 bp, Artificial Sequence
  Synthetic oligonucleotide; GGG chr2 60529591 60529610 60529607 +
aagggcttggctgagttggc

SEQ ID NO: 167370 - DNA, 20 bp, Artificial Sequence
  Synthetic oligonucleotide; CGG chr2 60529594 60529613 60529610 +
ggcttggctgagttggcggg

SEQ ID NO: 167371 - DNA, 20 bp, Artificial Sequence
  Synthetic oligonucleotide; GGG chr2 60529595 60529614 60529611 +
gcttggctgagttggcgggc

SEQ ID NO: 167372 - DNA, 20 bp, Artificial Sequence
  Synthetic oligonucleotide; GAG chr2 60529597 60529616 60529613 +
ttggctgagttggcgggcgg

SEQ ID NO: 167373 - DNA, 20 bp, Artificial Sequence
  Synthetic oligonucleotide; CGG chr2 60529600 60529619 60529616 +
gctgagttggcgggcgggag

SEQ ID NO: 167374 - DNA, 20 bp, Artificial Sequence
  Synthetic oligonucleotide; GGG chr2 60529601 60529620 60529617 +
ctgagttggcgggcgggagc

SEQ ID NO: 167375 - DNA, 20 bp, Artificial Sequence
  Synthetic oligonucleotide; GGG chr2 60529602 60529621 60529618 +
tgagttggcgggcgggagcg

SEQ ID NO: 167376 - DNA, 20 bp, Artificial Sequence
  Synthetic oligonucleotide; GGG chr2 60529603 60529622 60529619 +
gagttggcgggcgggagcgg

SEQ ID NO: 167377 - DNA, 20 bp, Artificial Sequence
  Synthetic oligonucleotide; CAG chr2 60529606 60529625 60529622 +
ttggcgggcgggagcggggg

SEQ ID NO: 167378 - DNA, 20 bp, Artificial Sequence
  Synthetic oligonucleotide; AGG chr2 60529607 60529626 60529623 +
tggcgggcgggagcgggggc

SEQ ID NO: 167379 - DNA, 20 bp, Artificial Sequence
  Synthetic oligonucleotide; TGG chr2 60529616 60529635 60529632 +
ggagcgggggcaggtatcca

SEQ ID NO: 167380 - DNA, 20 bp, Artificial Sequence
  Synthetic oligonucleotide; GGG chr2 60529617 60529636 60529633 +
gagcgggggcaggtatccat

SEQ ID NO: 167381 - DNA, 20 bp, Artificial Sequence
  Synthetic oligonucleotide; CAG chr2 60529627 60529646 60529643 +
aggtatccatgggataaacc

SEQ ID NO: 167382 - DNA, 20 bp, Artificial Sequence
  Synthetic oligonucleotide; GAG chr2 60529629 60529648 60529645 +
gtatccatgggataaaccca

SEQ ID NO: 167383 - DNA, 20 bp, Artificial Sequence
  Synthetic oligonucleotide; AGG chr2 60529630 60529649 60529646 +
tatccatgggataaacccag

SEQ ID NO: 167384 - DNA, 20 bp, Artificial Sequence
  Synthetic oligonucleotide; CAG chr2 60529647 60529666 60529663 +
cagaggcccccaaattttcc

SEQ ID NO: 167385 - DNA, 20 bp, Artificial Sequence
  Synthetic oligonucleotide; TAG chr2 60529664 60529683 60529680 +
tcccagtttttatttgctac

SEQ ID NO: 167386 - DNA, 20 bp, Artificial Sequence
  Synthetic oligonucleotide; AAG chr2 60529669 60529688 60529685 +
gtttttatttgctactagaa

SEQ ID NO: 167387 - DNA, 20 bp, Artificial Sequence
  Synthetic oligonucleotide; AGG chr2 60529670 60529689 60529686 +
tttttatttgctactagaaa

SEQ ID NO: 167388 - DNA, 20 bp, Artificial Sequence
  Synthetic oligonucleotide; GAG chr2 60529672 60529691 60529688 +
tttatttgctactagaaaag

SEQ ID NO: 167389 - DNA, 20 bp, Artificial Sequence
  Synthetic oligonucleotide; AAG chr2 60529675 60529694 60529691 +
atttgctactagaaaaggag

SEQ ID NO: 167390 - DNA, 20 bp, Artificial Sequence
  Synthetic oligonucleotide; AGG chr2 60529676 60529695 60529692 +
tttgctactagaaaaggaga

SEQ ID NO: 167391 - DNA, 20 bp, Artificial Sequence
  Synthetic oligonucleotide; GAG chr2 60529697 60529716 60529713 +
ggaaatcctgcctcccttat

SEQ ID NO: 167392 - DNA, 20 bp, Artificial Sequence
  Synthetic oligonucleotide; AGG chr2 60529698 60529717 60529714 +
gaaatcctgcctcccttatg

SEQ ID NO: 167393 - DNA, 20 bp, Artificial Sequence
  Synthetic oligonucleotide; TAG chr2 60529703 60529722 60529719 +
cctgcctcccttatgaggcc

SEQ ID NO: 167394 - DNA, 20 bp, Artificial Sequence
  Synthetic oligonucleotide; CAG chr2 60529707 60529726 60529723 +
cctcccttatgaggcctagc

SEQ ID NO: 167395 - DNA, 20 bp, Artificial Sequence
  Synthetic oligonucleotide; AGG chr2 60529708 60529727 60529724 +
ctcccttatgaggcctagcc

SEQ ID NO: 167396 - DNA, 20 bp, Artificial Sequence
  Synthetic oligonucleotide; GGG chr2 60529709 60529728 60529725 +
tcccttatgaggcctagcca

SEQ ID NO: 167397 - DNA, 20 bp, Artificial Sequence
  Synthetic oligonucleotide; GGG chr2 60529710 60529729 60529726 +
cccttatgaggcctagccag

SEQ ID NO: 167398 - DNA, 20 bp, Artificial Sequence
  Synthetic oligonucleotide; AAG chr2 60529713 60529732 60529729 +
ttatgaggcctagccagggg

SEQ ID NO: 167399 - DNA, 20 bp, Artificial Sequence
  Synthetic oligonucleotide; TAG chr2 60529742 60529761 60529758 +
tgattttatcacattttata

SEQ ID NO: 167400 - DNA, 20 bp, Artificial Sequence
  Synthetic oligonucleotide; TGG chr2 60529755 60529774 60529771 +
ttttatatagatgtgcacaa

SEQ ID NO: 167401 - DNA, 20 bp, Artificial Sequence
  Synthetic oligonucleotide; AAG chr2 60529767 60529786 60529783 +
gtgcacaatggtgccttttc

SEQ ID NO: 167402 - DNA, 20 bp, Artificial Sequence
  Synthetic oligonucleotide; TGG chr2 60529777 60529796 60529793 +
gtgccttttcaagtctatga

SEQ ID NO: 167403 - DNA, 20 bp, Artificial Sequence
  Synthetic oligonucleotide; GGG chr2 60529778 60529797 60529794 +
tgccttttcaagtctatgat

SEQ ID NO: 167404 - DNA, 20 bp, Artificial Sequence
  Synthetic oligonucleotide; CAG chr2 60529812 60529831 60529828 +
ttattgtgtgaatatcattt

SEQ ID NO: 167405 - DNA, 20 bp, Artificial Sequence
  Synthetic oligonucleotide; CAG chr2 60529816 60529835 60529832 +
tgtgtgaatatcatttcaga

SEQ ID NO: 167406 - DNA, 20 bp, Artificial Sequence
  Synthetic oligonucleotide; AGG chr2 60529817 60529836 60529833 +
gtgtgaatatcatttcagac

SEQ ID NO: 167407 - DNA, 20 bp, Artificial Sequence
  Synthetic oligonucleotide; AAG chr2 60529836 60529855 60529852 +
caggtccccaaaccacttga

SEQ ID NO: 167408 - DNA, 20 bp, Artificial Sequence
  Synthetic oligonucleotide; TGG chr2 60529842 60529861 60529858 +
cccaaaccacttgaaagccc

SEQ ID NO: 167409 - DNA, 20 bp, Artificial Sequence
  Synthetic oligonucleotide; TAG chr2 60529852 60529871 60529868 +
ttgaaagccctggtgtcccc

SEQ ID NO: 167410 - DNA, 20 bp, Artificial Sequence
  Synthetic oligonucleotide; AGG chr2 60529853 60529872 60529869 +
tgaaagccctggtgtcccct

SEQ ID NO: 167411 - DNA, 20 bp, Artificial Sequence
  Synthetic oligonucleotide; TGG chr2 60529856 60529875 60529872 +
aagccctggtgtcccctagg

SEQ ID NO: 167412 - DNA, 20 bp, Artificial Sequence
  Synthetic oligonucleotide; GGG chr2 60529857 60529876 60529873 +
agccctggtgtcccctaggt

SEQ ID NO: 167413 - DNA, 20 bp, Artificial Sequence
  Synthetic oligonucleotide; CAG chr2 60529872 60529891 60529888 +
taggtgggattctatgaacc

SEQ ID NO: 167414 - DNA, 20 bp, Artificial Sequence
  Synthetic oligonucleotide; TAG chr2 60529878 60529897 60529894 +
ggattctatgaacccagctt

SEQ ID NO: 167415 - DNA, 20 bp, Artificial Sequence
  Synthetic oligonucleotide; CAG chr2 60529884 60529903 60529900 +
tatgaacccagctttagccc

SEQ ID NO: 167416 - DNA, 20 bp, Artificial Sequence
  Synthetic oligonucleotide; CAG chr2 60529887 60529906 60529903 +
gaacccagctttagccccag

SEQ ID NO: 167417 - DNA, 20 bp, Artificial Sequence
  Synthetic oligonucleotide; TGG chr2 60529896 60529915 60529912 +
tttagccccagcagctcctc

SEQ ID NO: 167418 - DNA, 20 bp, Artificial Sequence
  Synthetic oligonucleotide; TGG chr2 60529899 60529918 60529915 +
agccccagcagctcctctgg

SEQ ID NO: 167419 - DNA, 20 bp, Artificial Sequence
  Synthetic oligonucleotide; GGG chr2 60529900 60529919 60529916 +
gccccagcagctcctctggt

SEQ ID NO: 167420 - DNA, 20 bp, Artificial Sequence
  Synthetic oligonucleotide; TAG chr2 60529906 60529925 60529922 +
gcagctcctctggtgggaac

SEQ ID NO: 167421 - DNA, 20 bp, Artificial Sequence
  Synthetic oligonucleotide; CAG chr2 60529923 60529942 60529939 +
aactagaacatgcctcctgc

SEQ ID NO: 167422 - DNA, 20 bp, Artificial Sequence
  Synthetic oligonucleotide; TAG chr2 60529927 60529946 60529943 +
agaacatgcctcctgccagt

SEQ ID NO: 167423 - DNA, 20 bp, Artificial Sequence
  Synthetic oligonucleotide; CAG chr2 60529933 60529952 60529949 +
tgcctcctgccagttagtaa

SEQ ID NO: 167424 - DNA, 20 bp, Artificial Sequence
  Synthetic oligonucleotide; AGG chr2 60529934 60529953 60529950 +
gcctcctgccagttagtaac

SEQ ID NO: 167425 - DNA, 20 bp, Artificial Sequence
  Synthetic oligonucleotide; GGG chr2 60529935 60529954 60529951 +
cctcctgccagttagtaaca

SEQ ID NO: 167426 - DNA, 20 bp, Artificial Sequence
  Synthetic oligonucleotide; TGG chr2 60529961 60529980 60529977 +
ttcaattacttcgccacttg

SEQ ID NO: 167427 - DNA, 20 bp, Artificial Sequence
  Synthetic oligonucleotide; CAG chr2 60529964 60529983 60529980 +
aattacttcgccacttgtgg

SEQ ID NO: 167428 - DNA, 20 bp, Artificial Sequence
  Synthetic oligonucleotide; AGG chr2 60529965 60529984 60529981 +
attacttcgccacttgtggc

SEQ ID NO: 167429 - DNA, 20 bp, Artificial Sequence
  Synthetic oligonucleotide; GAG chr2 60529967 60529986 60529983 +
tacttcgccacttgtggcag

SEQ ID NO: 167430 - DNA, 20 bp, Artificial Sequence
  Synthetic oligonucleotide; AGG chr2 60529968 60529987 60529984 +
acttcgccacttgtggcagg

SEQ ID NO: 167431 - DNA, 20 bp, Artificial Sequence
  Synthetic oligonucleotide; GGG chr2 60529969 60529988 60529985 +
cttcgccacttgtggcagga

SEQ ID NO: 167432 - DNA, 20 bp, Artificial Sequence
  Synthetic oligonucleotide; AAG chr2 60529974 60529993 60529990 +
ccacttgtggcaggagggca

SEQ ID NO: 167433 - DNA, 20 bp, Artificial Sequence
  Synthetic oligonucleotide; AAG chr2 60529989 60530008 60530005 +
gggcaaagactgcacattaa

SEQ ID NO: 167434 - DNA, 20 bp, Artificial Sequence
  Synthetic oligonucleotide; GAG chr2 60529991 60530010 60530007 +
gcaaagactgcacattaaaa

SEQ ID NO: 167435 - DNA, 20 bp, Artificial Sequence
  Synthetic oligonucleotide; CAG chr2 60530004 60530023 60530020 +
attaaaagagctaaaaatgt

SEQ ID NO: 167436 - DNA, 20 bp, Artificial Sequence
  Synthetic oligonucleotide; AGG chr2 60530005 60530024 60530021 +
ttaaaagagctaaaaatgtc

SEQ ID NO: 167437 - DNA, 20 bp, Artificial Sequence
  Synthetic oligonucleotide; AAG chr2 60530008 60530027 60530024 +
aaagagctaaaaatgtcagg

SEQ ID NO: 167438 - DNA, 20 bp, Artificial Sequence
  Synthetic oligonucleotide; TGG chr2 60530015 60530034 60530031 +
taaaaatgtcaggaagttat

SEQ ID NO: 167439 - DNA, 20 bp, Artificial Sequence
  Synthetic oligonucleotide; GGG chr2 60530016 60530035 60530032 +
aaaaatgtcaggaagttatt

SEQ ID NO: 167440 - DNA, 20 bp, Artificial Sequence
  Synthetic oligonucleotide; CAG chr2 60530083 60530102 60530099 +
tcacaataaactaaaaaaca

SEQ ID NO: 167441 - DNA, 20 bp, Artificial Sequence
  Synthetic oligonucleotide; AGG chr2 60530084 60530103 60530100 +
cacaataaactaaaaaacac

SEQ ID NO: 167442 - DNA, 20 bp, Artificial Sequence
  Synthetic oligonucleotide; AAG chr2 60530087 60530106 60530103 +
aataaactaaaaaacacagg

SEQ ID NO: 167443 - DNA, 20 bp, Artificial Sequence
  Synthetic oligonucleotide; GAG chr2 60530089 60530108 60530105 +
taaactaaaaaacacaggaa

SEQ ID NO: 167444 - DNA, 20 bp, Artificial Sequence
  Synthetic oligonucleotide; AGG chr2 60530090 60530109 60530106 +
aaactaaaaaacacaggaag

SEQ ID NO: 167445 - DNA, 20 bp, Artificial Sequence
  Synthetic oligonucleotide; AAG chr2 60530095 60530114 60530111 +
aaaaaacacaggaagaggcc

SEQ ID NO: 167446 - DNA, 20 bp, Artificial Sequence
  Synthetic oligonucleotide; AAG chr2 60530098 60530117 60530114 +
aaacacaggaagaggccaag

SEQ ID NO: 167447 - DNA, 20 bp, Artificial Sequence
  Synthetic oligonucleotide; AAG chr2 60530103 60530122 60530119 +
caggaagaggccaagaagat

SEQ ID NO: 167448 - DNA, 20 bp, Artificial Sequence
  Synthetic oligonucleotide; GAG chr2 60530112 60530131 60530128 +
gccaagaagataagaaaatc

SEQ ID NO: 167449 - DNA, 20 bp, Artificial Sequence
  Synthetic oligonucleotide; AAG chr2 60530123 60530142 60530139 +
aagaaaatcgagaacaaaac

SEQ ID NO: 167450 - DNA, 20 bp, Artificial Sequence
  Synthetic oligonucleotide; TGG chr2 60530136 60530155 60530152 +
acaaaacaagcccaaacaca

SEQ ID NO: 167451 - DNA, 20 bp, Artificial Sequence
  Synthetic oligonucleotide; GGG chr2 60530137 60530156 60530153 +
caaaacaagcccaaacacat

SEQ ID NO: 167452 - DNA, 20 bp, Artificial Sequence
  Synthetic oligonucleotide; CGG chr2 60530148 60530167 60530164 +
caaacacatgggtttgccat

SEQ ID NO: 167453 - DNA, 20 bp, Artificial Sequence
  Synthetic oligonucleotide; TGG chr2 60530154 60530173 60530170 +
catgggtttgccatcggtcc

SEQ ID NO: 167454 - DNA, 20 bp, Artificial Sequence
  Synthetic oligonucleotide; GGG chr2 60530155 60530174 60530171 +
atgggtttgccatcggtcct

SEQ ID NO: 167455 - DNA, 20 bp, Artificial Sequence
  Synthetic oligonucleotide; CAG chr2 60530165 60530184 60530181 +
catcggtcctgggtcctgcc

SEQ ID NO: 167456 - DNA, 20 bp, Artificial Sequence
  Synthetic oligonucleotide; AGG chr2 60530166 60530185 60530182 +
atcggtcctgggtcctgccc

SEQ ID NO: 167457 - DNA, 20 bp, Artificial Sequence
  Synthetic oligonucleotide; AAG chr2 60530170 60530189 60530186 +
gtcctgggtcctgcccagga

SEQ ID NO: 167458 - DNA, 20 bp, Artificial Sequence
  Synthetic oligonucleotide; AGG chr2 60530171 60530190 60530187 +
tcctgggtcctgcccaggaa

SEQ ID NO: 167459 - DNA, 20 bp, Artificial Sequence
  Synthetic oligonucleotide; AAG chr2 60530187 60530206 60530203 +
ggaaaggctgcgcctctaac

SEQ ID NO: 167460 - DNA, 20 bp, Artificial Sequence
  Synthetic oligonucleotide; GAG chr2 60530189 60530208 60530205 +
aaaggctgcgcctctaacaa

SEQ ID NO: 167461 - DNA, 20 bp, Artificial Sequence
  Synthetic oligonucleotide; TGG chr2 60530209 60530228 60530225 +
gagcaccttttccccacccc

SEQ ID NO: 167462 - DNA, 20 bp, Artificial Sequence
  Synthetic oligonucleotide; GAG chr2 60530220 60530239 60530236 +
ccccacccctggcctttctt

SEQ ID NO: 167463 - DNA, 20 bp, Artificial Sequence
  Synthetic oligonucleotide; GAG chr2 60530231 60530250 60530247 +
gcctttcttgagccttcctt

SEQ ID NO: 167464 - DNA, 20 bp, Artificial Sequence
  Synthetic oligonucleotide; CAG chr2 60530257 60530276 60530273 +
tccttgcatattatcgttct

SEQ ID NO: 167465 - DNA, 20 bp, Artificial Sequence
  Synthetic oligonucleotide; CAG chr2 60530267 60530286 60530283 +
ttatcgttctcagccaccga

SEQ ID NO: 167466 - DNA, 20 bp, Artificial Sequence
  Synthetic oligonucleotide; CAG chr2 60530279 60530298 60530295 +
gccaccgacagcttaattca

SEQ ID NO: 167467 - DNA, 20 bp, Artificial Sequence
  Synthetic oligonucleotide; AGG chr2 60530280 60530299 60530296 +
ccaccgacagcttaattcac

SEQ ID NO: 167468 - DNA, 20 bp, Artificial Sequence
  Synthetic oligonucleotide; AAG chr2 60530293 60530312 60530309 +
aattcacaggcccttccaac

SEQ ID NO: 167469 - DNA, 20 bp, Artificial Sequence
  Synthetic oligonucleotide; CAG chr2 60530304 60530323 60530320 +
ccttccaacaagttaaactt

SEQ ID NO: 167470 - DNA, 20 bp, Artificial Sequence
  Synthetic oligonucleotide; AAG chr2 60530329 60530348 60530345 +
atttaaaaaaaaaaaaaaaa

SEQ ID NO: 167471 - DNA, 20 bp, Artificial Sequence
  Synthetic oligonucleotide; GAG chr2 60530331 60530350 60530347 +
ttaaaaaaaaaaaaaaaaaa

SEQ ID NO: 167472 - DNA, 20 bp, Artificial Sequence
  Synthetic oligonucleotide; CAG chr2 60530361 60530380 60530377 +
tgatttcttacctgcacacg

SEQ ID NO: 167473 - DNA, 20 bp, Artificial Sequence
  Synthetic oligonucleotide; AGG chr2 60530362 60530381 60530378 +
gatttcttacctgcacacgc

SEQ ID NO: 167474 - DNA, 20 bp, Artificial Sequence
  Synthetic oligonucleotide; CGG chr2 60530370 60530389 60530386 +
acctgcacacgcaggcacgc

SEQ ID NO: 167475 - DNA, 20 bp, Artificial Sequence
  Synthetic oligonucleotide; GAG chr2 60530397 60530416 60530413 +
gccccaccccactgcaccac

SEQ ID NO: 167476 - DNA, 20 bp, Artificial Sequence
  Synthetic oligonucleotide; TGG chr2 60530410 60530429 60530426 +
gcaccacgagctctcacacc

SEQ ID NO: 167477 - DNA, 20 bp, Artificial Sequence
  Synthetic oligonucleotide; TGG chr2 60530443 60530462 60530459 +
acaaccaaacccttcccatc

SEQ ID NO: 167478 - DNA, 20 bp, Artificial Sequence
  Synthetic oligonucleotide; CGG chr2 60530450 60530469 60530466 +
aacccttcccatctggccct

SEQ ID NO: 167479 - DNA, 20 bp, Artificial Sequence
  Synthetic oligonucleotide; GGG chr2 60530451 60530470 60530467 +
acccttcccatctggccctc

SEQ ID NO: 167480 - DNA, 20 bp, Artificial Sequence
  Synthetic oligonucleotide; TGG chr2 60530458 60530477 60530474 +
ccatctggccctcgggttac

SEQ ID NO: 167481 - DNA, 20 bp, Artificial Sequence
  Synthetic oligonucleotide; CGG chr2 60530485 60530504 60530501 +
atcacaactttttttcccaa

SEQ ID NO: 167482 - DNA, 20 bp, Artificial Sequence
  Synthetic oligonucleotide; AAG chr2 60530489 60530508 60530505 +
caactttttttcccaacggc

SEQ ID NO: 167483 - DNA, 20 bp, Artificial Sequence
  Synthetic oligonucleotide; CAG chr2 60530493 60530512 60530509 +
tttttttcccaacggcaagc

SEQ ID NO: 167484 - DNA, 20 bp, Artificial Sequence
  Synthetic oligonucleotide; AGG chr2 60530494 60530513 60530510 +
ttttttcccaacggcaagcc

SEQ ID NO: 167485 - DNA, 20 bp, Artificial Sequence
  Synthetic oligonucleotide; AAG chr2 60530498 60530517 60530514 +
ttcccaacggcaagccagga

SEQ ID NO: 167486 - DNA, 20 bp, Artificial Sequence
  Synthetic oligonucleotide; TAG chr2 60530505 60530524 60530521 +
cggcaagccaggaaagatga

SEQ ID NO: 167487 - DNA, 20 bp, Artificial Sequence
  Synthetic oligonucleotide; TAG chr2 60530520 60530539 60530536 +
gatgatagaacccgcatatg

SEQ ID NO: 167488 - DNA, 20 bp, Artificial Sequence
  Synthetic oligonucleotide; AAG chr2 60530527 60530546 60530543 +
gaacccgcatatgtagccaa

SEQ ID NO: 167489 - DNA, 20 bp, Artificial Sequence
  Synthetic oligonucleotide; TGG chr2 60530532 60530551 60530548 +
cgcatatgtagccaaaagac

SEQ ID NO: 167490 - DNA, 20 bp, Artificial Sequence
  Synthetic oligonucleotide; TGG chr2 60530542 60530561 60530558 +
gccaaaagactggcctcaac

SEQ ID NO: 167491 - DNA, 20 bp, Artificial Sequence
  Synthetic oligonucleotide; CAG chr2 60530547 60530566 60530563 +
aagactggcctcaactggtt

SEQ ID NO: 167492 - DNA, 20 bp, Artificial Sequence
  Synthetic oligonucleotide; GAG chr2 60530549 60530568 60530565 +
gactggcctcaactggttca

SEQ ID NO: 167493 - DNA, 20 bp, Artificial Sequence
  Synthetic oligonucleotide; AGG chr2 60530550 60530569 60530566 +
actggcctcaactggttcag

SEQ ID NO: 167494 - DNA, 20 bp, Artificial Sequence
  Synthetic oligonucleotide; GAG chr2 60530552 60530571 60530568 +
tggcctcaactggttcagag

SEQ ID NO: 167495 - DNA, 20 bp, Artificial Sequence
  Synthetic oligonucleotide; AGG chr2 60530553 60530572 60530569 +
ggcctcaactggttcagagg

SEQ ID NO: 167496 - DNA, 20 bp, Artificial Sequence
  Synthetic oligonucleotide; GGG chr2 60530554 60530573 60530570 +
gcctcaactggttcagagga

SEQ ID NO: 167497 - DNA, 20 bp, Artificial Sequence
  Synthetic oligonucleotide; GAG chr2 60530565 60530584 60530581 +
ttcagaggagggaaaaaatt

SEQ ID NO: 167498 - DNA, 20 bp, Artificial Sequence
  Synthetic oligonucleotide; TAG chr2 60530610 60530629 60530626 +
attttttatttttttgcctt

SEQ ID NO: 167499 - DNA, 20 bp, Artificial Sequence
  Synthetic oligonucleotide; AAG chr2 60530617 60530636 60530633 +
atttttttgcctttagccaa

SEQ ID NO: 167500 - DNA, 20 bp, Artificial Sequence
  Synthetic oligonucleotide; CAG chr2 60530622 60530641 60530638 +
tttgcctttagccaaaagac

SEQ ID NO: 167501 - DNA, 20 bp, Artificial Sequence
  Synthetic oligonucleotide; AGG chr2 60530623 60530642 60530639 +
ttgcctttagccaaaagacc

SEQ ID NO: 167502 - DNA, 20 bp, Artificial Sequence
  Synthetic oligonucleotide; GGG chr2 60530624 60530643 60530640 +
tgcctttagccaaaagacca

SEQ ID NO: 167503 - DNA, 20 bp, Artificial Sequence
  Synthetic oligonucleotide; GAG chr2 60530626 60530645 60530642 +
cctttagccaaaagaccagg

SEQ ID NO: 167504 - DNA, 20 bp, Artificial Sequence
  Synthetic oligonucleotide; CAG chr2 60530640 60530659 60530656 +
accagggagcatttgatgta

SEQ ID NO: 167505 - DNA, 20 bp, Artificial Sequence
  Synthetic oligonucleotide; CAG chr2 60530644 60530663 60530660 +
gggagcatttgatgtacagt

SEQ ID NO: 167506 - DNA, 20 bp, Artificial Sequence
  Synthetic oligonucleotide; CAG chr2 60530647 60530666 60530663 +
agcatttgatgtacagtcag

SEQ ID NO: 167507 - DNA, 20 bp, Artificial Sequence
  Synthetic oligonucleotide; AGG chr2 60530648 60530667 60530664 +
gcatttgatgtacagtcagc

SEQ ID NO: 167508 - DNA, 20 bp, Artificial Sequence
  Synthetic oligonucleotide; AAG chr2 60530660 60530679 60530676 +
cagtcagcaggtatttaaaa

SEQ ID NO: 167509 - DNA, 20 bp, Artificial Sequence
  Synthetic oligonucleotide; AAG chr2 60530664 60530683 60530680 +
cagcaggtatttaaaaaaga

SEQ ID NO: 167510 - DNA, 20 bp, Artificial Sequence
  Synthetic oligonucleotide; AAG chr2 60530668 60530687 60530684 +
aggtatttaaaaaagaaaga

SEQ ID NO: 167511 - DNA, 20 bp, Artificial Sequence
  Synthetic oligonucleotide; AAG chr2 60530674 60530693 60530690 +
ttaaaaaagaaagaaagaaa

SEQ ID NO: 167512 - DNA, 20 bp, Artificial Sequence
  Synthetic oligonucleotide; AGG chr2 60530675 60530694 60530691 +
taaaaaagaaagaaagaaaa

SEQ ID NO: 167513 - DNA, 20 bp, Artificial Sequence
  Synthetic oligonucleotide; AAG chr2 60530695 60530714 60530711 +
aggaaaaaaaaaacactgaa

SEQ ID NO: 167514 - DNA, 20 bp, Artificial Sequence
  Synthetic oligonucleotide; AGG chr2 60530696 60530715 60530712 +
ggaaaaaaaaaacactgaaa

SEQ ID NO: 167515 - DNA, 20 bp, Artificial Sequence
  Synthetic oligonucleotide; TGG chr2 60530701 60530720 60530717 +
aaaaaaacactgaaaaggct

SEQ ID NO: 167516 - DNA, 20 bp, Artificial Sequence
  Synthetic oligonucleotide; TGG chr2 60530710 60530729 60530726 +
ctgaaaaggcttggctgcac

SEQ ID NO: 167517 - DNA, 20 bp, Artificial Sequence
  Synthetic oligonucleotide; GGG chr2 60530711 60530730 60530727 +
tgaaaaggcttggctgcact

SEQ ID NO: 167518 - DNA, 20 bp, Artificial Sequence
  Synthetic oligonucleotide; GGG chr2 60530712 60530731 60530728 +
gaaaaggcttggctgcactg

SEQ ID NO: 167519 - DNA, 20 bp, Artificial Sequence
  Synthetic oligonucleotide; AAG chr2 60530735 60530754 60530751 +
ccctgacacgctctcatcta

SEQ ID NO: 167520 - DNA, 20 bp, Artificial Sequence
  Synthetic oligonucleotide; TGG chr2 60530740 60530759 60530756 +
acacgctctcatctaaagcc

SEQ ID NO: 167521 - DNA, 20 bp, Artificial Sequence
  Synthetic oligonucleotide; CGG chr2 60530747 60530766 60530763 +
ctcatctaaagcctggccct

SEQ ID NO: 167522 - DNA, 20 bp, Artificial Sequence
  Synthetic oligonucleotide; AAG chr2 60530752 60530771 60530768 +
ctaaagcctggccctcggcc

SEQ ID NO: 167523 - DNA, 20 bp, Artificial Sequence
  Synthetic oligonucleotide; TGG chr2 60530767 60530786 60530783 +
cggccaagttcatctgttaa

SEQ ID NO: 167524 - DNA, 20 bp, Artificial Sequence
  Synthetic oligonucleotide; CAG chr2 60530781 60530800 60530797 +
tgttaatggacaaccacaac

SEQ ID NO: 167525 - DNA, 20 bp, Artificial Sequence
  Synthetic oligonucleotide; AGG chr2 60530782 60530801 60530798 +
gttaatggacaaccacaacc

SEQ ID NO: 167526 - DNA, 20 bp, Artificial Sequence
  Synthetic oligonucleotide; GGG chr2 60530783 60530802 60530799 +
ttaatggacaaccacaacca

SEQ ID NO: 167527 - DNA, 20 bp, Artificial Sequence
  Synthetic oligonucleotide; GAG chr2 60530819 60530838 60530835 +
cacctcccactacccctcct

SEQ ID NO: 167528 - DNA, 20 bp, Artificial Sequence
  Synthetic oligonucleotide; GAG chr2 60530847 60530866 60530863 +
tctgttctcctacctctttc

SEQ ID NO: 167529 - DNA, 20 bp, Artificial Sequence
  Synthetic oligonucleotide; TAG chr2 60530861 60530880 60530877 +
tctttcgagctcctaaaaac

SEQ ID NO: 167530 - DNA, 20 bp, Artificial Sequence
  Synthetic oligonucleotide; AAG chr2 60530899 60530918 60530915 +
gcgcttttccctttctattc

SEQ ID NO: 167531 - DNA, 20 bp, Artificial Sequence
  Synthetic oligonucleotide; AAG chr2 60530909 60530928 60530925 +
ctttctattcaagataaaca

SEQ ID NO: 167532 - DNA, 20 bp, Artificial Sequence
  Synthetic oligonucleotide; AAG chr2 60530918 60530937 60530934 +
caagataaacaaagtgcttc

SEQ ID NO: 167533 - DNA, 20 bp, Artificial Sequence
  Synthetic oligonucleotide; CAG chr2 60530923 60530942 60530939 +
taaacaaagtgcttcaagtt

SEQ ID NO: 167534 - DNA, 20 bp, Artificial Sequence
  Synthetic oligonucleotide; AGG chr2 60530924 60530943 60530940 +
aaacaaagtgcttcaagttc

SEQ ID NO: 167535 - DNA, 20 bp, Artificial Sequence
  Synthetic oligonucleotide; GGG chr2 60530925 60530944 60530941 +
aacaaagtgcttcaagttca

SEQ ID NO: 167536 - DNA, 20 bp, Artificial Sequence
  Synthetic oligonucleotide; TGG chr2 60530935 60530954 60530951 +
ttcaagttcagggcgcaccc

SEQ ID NO: 167537 - DNA, 20 bp, Artificial Sequence
  Synthetic oligonucleotide; GGG chr2 60530936 60530955 60530952 +
tcaagttcagggcgcaccct

SEQ ID NO: 167538 - DNA, 20 bp, Artificial Sequence
  Synthetic oligonucleotide; CAG chr2 60530977 60530996 60530993 +
tatcattctgtctgctaaac

SEQ ID NO: 167539 - DNA, 20 bp, Artificial Sequence
  Synthetic oligonucleotide; TGG chr2 60530982 60531001 60530998 +
ttctgtctgctaaaccagtc

SEQ ID NO: 167540 - DNA, 20 bp, Artificial Sequence
  Synthetic oligonucleotide; TGG chr2 60530993 60531012 60531009 +
aaaccagtctggctacacca

SEQ ID NO: 167541 - DNA, 20 bp, Artificial Sequence
  Synthetic oligonucleotide; CAG chr2 60530997 60531016 60531013 +
cagtctggctacaccatggc

SEQ ID NO: 167542 - DNA, 20 bp, Artificial Sequence
  Synthetic oligonucleotide; AGG chr2 60530998 60531017 60531014 +
agtctggctacaccatggcc

SEQ ID NO: 167543 - DNA, 20 bp, Artificial Sequence
  Synthetic oligonucleotide; GGG chr2 60530999 60531018 60531015 +
gtctggctacaccatggcca

SEQ ID NO: 167544 - DNA, 20 bp, Artificial Sequence
  Synthetic oligonucleotide; GAG chr2 60531001 60531020 60531017 +
ctggctacaccatggccagg

SEQ ID NO: 167545 - DNA, 20 bp, Artificial Sequence
  Synthetic oligonucleotide; GAG chr2 60531003 60531022 60531019 +
ggctacaccatggccaggga

SEQ ID NO: 167546 - DNA, 20 bp, Artificial Sequence
  Synthetic oligonucleotide; CGG chr2 60531082 60531101 60531098 +
cttttctttaccaccttctc

SEQ ID NO: 167547 - DNA, 20 bp, Artificial Sequence
  Synthetic oligonucleotide; GAG chr2 60531084 60531103 60531100 +
tttctttaccaccttctccg

SEQ ID NO: 167548 - DNA, 20 bp, Artificial Sequence
  Synthetic oligonucleotide; CAG chr2 60531087 60531106 60531103 +
ctttaccaccttctccggag

SEQ ID NO: 167549 - DNA, 20 bp, Artificial Sequence
  Synthetic oligonucleotide; TGG chr2 60531091 60531110 60531107 +
accaccttctccggagcaga

SEQ ID NO: 167550 - DNA, 20 bp, Artificial Sequence
  Synthetic oligonucleotide; AAG chr2 60531111 60531130 60531127 +
tggacttgaccactttgctt

SEQ ID NO: 167551 - DNA, 20 bp, Artificial Sequence
  Synthetic oligonucleotide; TGG chr2 60531121 60531140 60531137 +
cactttgcttaagcccctcc

SEQ ID NO: 167552 - DNA, 20 bp, Artificial Sequence
  Synthetic oligonucleotide; CAG chr2 60531130 60531149 60531146 +
taagcccctcctggcaacct

SEQ ID NO: 167553 - DNA, 20 bp, Artificial Sequence
  Synthetic oligonucleotide; TAG chr2 60531137 60531156 60531153 +
ctcctggcaacctcagaaat

SEQ ID NO: 167554 - DNA, 20 bp, Artificial Sequence
  Synthetic oligonucleotide; GAG chr2 60531139 60531158 60531155 +
cctggcaacctcagaaatta

SEQ ID NO: 167555 - DNA, 20 bp, Artificial Sequence
  Synthetic oligonucleotide; AAG chr2 60531153 60531172 60531169 +
aaattagagaaaaaaaaaaa

SEQ ID NO: 167556 - DNA, 20 bp, Artificial Sequence
  Synthetic oligonucleotide; GAG chr2 60531155 60531174 60531171 +
attagagaaaaaaaaaaaaa

SEQ ID NO: 167557 - DNA, 20 bp, Artificial Sequence
  Synthetic oligonucleotide; TGG chr2 60531162 60531181 60531178 +
aaaaaaaaaaaaagagctcc

SEQ ID NO: 167558 - DNA, 20 bp, Artificial Sequence
  Synthetic oligonucleotide; CGG chr2 60531176 60531195 60531192 +
agctcctggctaccctactc

SEQ ID NO: 167559 - DNA, 20 bp, Artificial Sequence
  Synthetic oligonucleotide; CAG chr2 60531181 60531200 60531197 +
ctggctaccctactccggtc

SEQ ID NO: 167560 - DNA, 20 bp, Artificial Sequence
  Synthetic oligonucleotide; AGG chr2 60531182 60531201 60531198 +
tggctaccctactccggtcc

SEQ ID NO: 167561 - DNA, 20 bp, Artificial Sequence
  Synthetic oligonucleotide; CGG chr2 60531212 60531231 60531228 +
cctccctctgtgttgcccga

SEQ ID NO: 167562 - DNA, 20 bp, Artificial Sequence
  Synthetic oligonucleotide; CAG chr2 60531226 60531245 60531242 +
gcccgacggtcctgcacaca

SEQ ID NO: 167563 - DNA, 20 bp, Artificial Sequence
  Synthetic oligonucleotide; TGG chr2 60531242 60531261 60531258 +
cacacagacacaaatcccgt

SEQ ID NO: 167564 - DNA, 20 bp, Artificial Sequence
  Synthetic oligonucleotide; CAG chr2 60531250 60531269 60531266 +
cacaaatcccgttggaccca

SEQ ID NO: 167565 - DNA, 20 bp, Artificial Sequence
  Synthetic oligonucleotide; CAG chr2 60531286 60531305 60531302 +
ctctcacactaacactaaac

SEQ ID NO: 167566 - DNA, 20 bp, Artificial Sequence
  Synthetic oligonucleotide; TGG chr2 60531305 60531324 60531321 +
ccagaaaataaattaaatac

SEQ ID NO: 167567 - DNA, 20 bp, Artificial Sequence
  Synthetic oligonucleotide; GGG chr2 60531306 60531325 60531322 +
cagaaaataaattaaatact

SEQ ID NO: 167568 - DNA, 20 bp, Artificial Sequence
  Synthetic oligonucleotide; AAG chr2 60531333 60531352 60531349 +
ccccctcctttgcgttctgc

SEQ ID NO: 167569 - DNA, 20 bp, Artificial Sequence
  Synthetic oligonucleotide; AAG chr2 60531344 60531363 60531360 +
gcgttctgcaagaatatttt

SEQ ID NO: 167570 - DNA, 20 bp, Artificial Sequence
  Synthetic oligonucleotide; GAG chr2 60531348 60531367 60531364 +
tctgcaagaatattttaagt

SEQ ID NO: 167571 - DNA, 20 bp, Artificial Sequence
  Synthetic oligonucleotide; AAG chr2 60531401 60531420 60531417 +
cctgacttgcaattaaatgc

SEQ ID NO: 167572 - DNA, 20 bp, Artificial Sequence
  Synthetic oligonucleotide; CAG chr2 60531419 60531438 60531435 +
gcaagcacactttttacaac

SEQ ID NO: 167573 - DNA, 20 bp, Artificial Sequence
  Synthetic oligonucleotide; CGG chr2 60531424 60531443 60531440 +
cacactttttacaaccagta

SEQ ID NO: 167574 - DNA, 20 bp, Artificial Sequence
  Synthetic oligonucleotide; TGG chr2 60531450 60531469 60531466 +
gcattaattataactacaaa

SEQ ID NO: 167575 - DNA, 20 bp, Artificial Sequence
  Synthetic oligonucleotide; GAG chr2 60531459 60531478 60531475 +
ataactacaaatggtcaaat

SEQ ID NO: 167576 - DNA, 20 bp, Artificial Sequence
  Synthetic oligonucleotide; GAG chr2 60531461 60531480 60531477 +
aactacaaatggtcaaatga

SEQ ID NO: 167577 - DNA, 20 bp, Artificial Sequence
  Synthetic oligonucleotide; AAG chr2 60531465 60531484 60531481 +
acaaatggtcaaatgagagc

SEQ ID NO: 167578 - DNA, 20 bp, Artificial Sequence
  Synthetic oligonucleotide; AGG chr2 60531466 60531485 60531482 +
caaatggtcaaatgagagca

SEQ ID NO: 167579 - DNA, 20 bp, Artificial Sequence
  Synthetic oligonucleotide; TAG chr2 60531524 60531543 60531540 +
taatattaatgaaacaaaaa

SEQ ID NO: 167580 - DNA, 20 bp, Artificial Sequence
  Synthetic oligonucleotide; AAG chr2 60531533 60531552 60531549 +
tgaaacaaaaatagattcat

SEQ ID NO: 167581 - DNA, 20 bp, Artificial Sequence
  Synthetic oligonucleotide; TGG chr2 60531539 60531558 60531555 +
aaaaatagattcataagcct

SEQ ID NO: 167582 - DNA, 20 bp, Artificial Sequence
  Synthetic oligonucleotide; CAG chr2 60531543 60531562 60531559 +
atagattcataagccttggc

SEQ ID NO: 167583 - DNA, 20 bp, Artificial Sequence
  Synthetic oligonucleotide; AGG chr2 60531544 60531563 60531560 +
tagattcataagccttggcc

SEQ ID NO: 167584 - DNA, 20 bp, Artificial Sequence
  Synthetic oligonucleotide; GGG chr2 60531545 60531564 60531561 +
agattcataagccttggcca

SEQ ID NO: 167585 - DNA, 20 bp, Artificial Sequence
  Synthetic oligonucleotide; AAG chr2 60531565 60531584 60531581 +
gggcttttattatttcatgc

SEQ ID NO: 167586 - DNA, 20 bp, Artificial Sequence
  Synthetic oligonucleotide; AGG chr2 60531566 60531585 60531582 +
ggcttttattatttcatgca

SEQ ID NO: 167587 - DNA, 20 bp, Artificial Sequence
  Synthetic oligonucleotide; GGG chr2 60531567 60531586 60531583 +
gcttttattatttcatgcaa

SEQ ID NO: 167588 - DNA, 20 bp, Artificial Sequence
  Synthetic oligonucleotide; GGG chr2 60531568 60531587 60531584 +
cttttattatttcatgcaag

SEQ ID NO: 167589 - DNA, 20 bp, Artificial Sequence
  Synthetic oligonucleotide; AAG chr2 60531572 60531591 60531588 +
tattatttcatgcaagggga

SEQ ID NO: 167590 - DNA, 20 bp, Artificial Sequence
  Synthetic oligonucleotide; CAG chr2 60531577 60531596 60531593 +
tttcatgcaaggggaaagtc

SEQ ID NO: 167591 - DNA, 20 bp, Artificial Sequence
  Synthetic oligonucleotide; TGG chr2 60531605 60531624 60531621 +
gaaacttgctccatacactt

SEQ ID NO: 167592 - DNA, 20 bp, Artificial Sequence
  Synthetic oligonucleotide; CAG chr2 60531608 60531627 60531624 +
acttgctccatacactttgg

SEQ ID NO: 167593 - DNA, 20 bp, Artificial Sequence
  Synthetic oligonucleotide; AGG chr2 60531609 60531628 60531625 +
cttgctccatacactttggc

SEQ ID NO: 167594 - DNA, 20 bp, Artificial Sequence
  Synthetic oligonucleotide; CAG chr2 60531615 60531634 60531631 +
ccatacactttggcaggact

SEQ ID NO: 167595 - DNA, 20 bp, Artificial Sequence
  Synthetic oligonucleotide; AAG chr2 60531640 60531659 60531656 +
caaccactaccattaaactc

SEQ ID NO: 167596 - DNA, 20 bp, Artificial Sequence
  Synthetic oligonucleotide; GAG chr2 60531642 60531661 60531658 +
accactaccattaaactcaa

SEQ ID NO: 167597 - DNA, 20 bp, Artificial Sequence
  Synthetic oligonucleotide; TGG chr2 60531652 60531671 60531668 +
ttaaactcaagagcgtgttt

SEQ ID NO: 167598 - DNA, 20 bp, Artificial Sequence
  Synthetic oligonucleotide; CAG chr2 60531655 60531674 60531671 +
aactcaagagcgtgttttgg

SEQ ID NO: 167599 - DNA, 20 bp, Artificial Sequence
  Synthetic oligonucleotide; TGG chr2 60531663 60531682 60531679 +
agcgtgttttggcagtgccc

SEQ ID NO: 167600 - DNA, 20 bp, Artificial Sequence
  Synthetic oligonucleotide; TGG chr2 60531669 60531688 60531685 +
ttttggcagtgccctggcat

SEQ ID NO: 167601 - DNA, 20 bp, Artificial Sequence
  Synthetic oligonucleotide; GGG chr2 60531670 60531689 60531686 +
tttggcagtgccctggcatt

SEQ ID NO: 167602 - DNA, 20 bp, Artificial Sequence
  Synthetic oligonucleotide; GGG chr2 60531671 60531690 60531687 +
ttggcagtgccctggcattg

SEQ ID NO: 167603 - DNA, 20 bp, Artificial Sequence
  Synthetic oligonucleotide; GGG chr2 60531672 60531691 60531688 +
tggcagtgccctggcattgg

SEQ ID NO: 167604 - DNA, 20 bp, Artificial Sequence
  Synthetic oligonucleotide; GGG chr2 60531673 60531692 60531689 +
ggcagtgccctggcattggg

SEQ ID NO: 167605 - DNA, 20 bp, Artificial Sequence
  Synthetic oligonucleotide; CAG chr2 60531683 60531702 60531699 +
tggcattggggggccctgtg

SEQ ID NO: 167606 - DNA, 20 bp, Artificial Sequence
  Synthetic oligonucleotide; CAG chr2 60531693 60531712 60531709 +
gggccctgtgcagacaccac

SEQ ID NO: 167607 - DNA, 20 bp, Artificial Sequence
  Synthetic oligonucleotide; AGG chr2 60531694 60531713 60531710 +
ggccctgtgcagacaccacc

SEQ ID NO: 167608 - DNA, 20 bp, Artificial Sequence
  Synthetic oligonucleotide; GAG chr2 60531696 60531715 60531712 +
ccctgtgcagacaccaccag

SEQ ID NO: 167609 - DNA, 20 bp, Artificial Sequence
  Synthetic oligonucleotide; CAG chr2 60531709 60531728 60531725 +
ccaccaggagacgctgaccc

SEQ ID NO: 167610 - DNA, 20 bp, Artificial Sequence
  Synthetic oligonucleotide; AAG chr2 60531717 60531736 60531733 +
agacgctgaccccagtaccc

SEQ ID NO: 167611 - DNA, 20 bp, Artificial Sequence
  Synthetic oligonucleotide; AGG chr2 60531718 60531737 60531734 +
gacgctgaccccagtaccca

SEQ ID NO: 167612 - DNA, 20 bp, Artificial Sequence
  Synthetic oligonucleotide; CAG chr2 60531721 60531740 60531737 +
gctgaccccagtacccaagg

SEQ ID NO: 167613 - DNA, 20 bp, Artificial Sequence
  Synthetic oligonucleotide; AGG chr2 60531722 60531741 60531738 +
ctgaccccagtacccaaggc

SEQ ID NO: 167614 - DNA, 20 bp, Artificial Sequence
  Synthetic oligonucleotide; GGG chr2 60531723 60531742 60531739 +
tgaccccagtacccaaggca

SEQ ID NO: 167615 - DNA, 20 bp, Artificial Sequence
  Synthetic oligonucleotide; CAG chr2 60531742 60531761 60531758 +
agggtccataacgtcttatt

SEQ ID NO: 167616 - DNA, 20 bp, Artificial Sequence
  Synthetic oligonucleotide; TGG chr2 60531755 60531774 60531771 +
tcttattcagcctttccatg

SEQ ID NO: 167617 - DNA, 20 bp, Artificial Sequence
  Synthetic oligonucleotide; CGG chr2 60531759 60531778 60531775 +
attcagcctttccatgtggt

SEQ ID NO: 167618 - DNA, 20 bp, Artificial Sequence
  Synthetic oligonucleotide; GGG chr2 60531760 60531779 60531776 +
ttcagcctttccatgtggtc

SEQ ID NO: 167619 - DNA, 20 bp, Artificial Sequence
  Synthetic oligonucleotide; AAG chr2 60531763 60531782 60531779 +
agcctttccatgtggtcggg

SEQ ID NO: 167620 - DNA, 20 bp, Artificial Sequence
  Synthetic oligonucleotide; CAG chr2 60531773 60531792 60531789 +
tgtggtcgggaagttaccca

SEQ ID NO: 167621 - DNA, 20 bp, Artificial Sequence
  Synthetic oligonucleotide; AGG chr2 60531774 60531793 60531790 +
gtggtcgggaagttacccac

SEQ ID NO: 167622 - DNA, 20 bp, Artificial Sequence
  Synthetic oligonucleotide; CGG chr2 60531808 60531827 60531824 +
ttcctaaccaccctctctgc

SEQ ID NO: 167623 - DNA, 20 bp, Artificial Sequence
  Synthetic oligonucleotide; CAG chr2 60531814 60531833 60531830 +
accaccctctctgccggccg

SEQ ID NO: 167624 - DNA, 20 bp, Artificial Sequence
  Synthetic oligonucleotide; CAG chr2 60531826 60531845 60531842 +
gccggccgcagctgttctgt

SEQ ID NO: 167625 - DNA, 20 bp, Artificial Sequence
  Synthetic oligonucleotide; AAG chr2 60531847 60531866 60531863 +
agtgtccaccctgcccctca

SEQ ID NO: 167626 - DNA, 20 bp, Artificial Sequence
  Synthetic oligonucleotide; AGG chr2 60531848 60531867 60531864 +
gtgtccaccctgcccctcaa

SEQ ID NO: 167627 - DNA, 20 bp, Artificial Sequence
  Synthetic oligonucleotide; CAG chr2 60531866 60531885 60531882 +
aaaggacaaatgaaatcccc

SEQ ID NO: 167628 - DNA, 20 bp, Artificial Sequence
  Synthetic oligonucleotide; CAG chr2 60531872 60531891 60531888 +
caaatgaaatcccccagacc

SEQ ID NO: 167629 - DNA, 20 bp, Artificial Sequence
  Synthetic oligonucleotide; TGG chr2 60531875 60531894 60531891 +
atgaaatcccccagacccag

SEQ ID NO: 167630 - DNA, 20 bp, Artificial Sequence
  Synthetic oligonucleotide; GGG chr2 60531876 60531895 60531892 +
tgaaatcccccagacccagt

SEQ ID NO: 167631 - DNA, 20 bp, Artificial Sequence
  Synthetic oligonucleotide; AAG chr2 60531883 60531902 60531899 +
ccccagacccagtgggaaat

SEQ ID NO: 167632 - DNA, 20 bp, Artificial Sequence
  Synthetic oligonucleotide; AAG chr2 60531898 60531917 60531914 +
gaaataagcccacctaaatg

SEQ ID NO: 167633 - DNA, 20 bp, Artificial Sequence
  Synthetic oligonucleotide; AAG chr2 60531906 60531925 60531922 +
cccacctaaatgaagaactc

SEQ ID NO: 167634 - DNA, 20 bp, Artificial Sequence
  Synthetic oligonucleotide; TAG chr2 60531911 60531930 60531927 +
ctaaatgaagaactcaagac

SEQ ID NO: 167635 - DNA, 20 bp, Artificial Sequence
  Synthetic oligonucleotide; AGG chr2 60531912 60531931 60531928 +
taaatgaagaactcaagact

SEQ ID NO: 167636 - DNA, 20 bp, Artificial Sequence
  Synthetic oligonucleotide; GGG chr2 60531913 60531932 60531929 +
aaatgaagaactcaagacta

SEQ ID NO: 167637 - DNA, 20 bp, Artificial Sequence
  Synthetic oligonucleotide; GAG chr2 60531922 60531941 60531938 +
actcaagactagggcaccat

SEQ ID NO: 167638 - DNA, 20 bp, Artificial Sequence
  Synthetic oligonucleotide; TGG chr2 60531929 60531948 60531945 +
actagggcaccatgagcatc

SEQ ID NO: 167639 - DNA, 20 bp, Artificial Sequence
  Synthetic oligonucleotide; GGG chr2 60531930 60531949 60531946 +
ctagggcaccatgagcatct

SEQ ID NO: 167640 - DNA, 20 bp, Artificial Sequence
  Synthetic oligonucleotide; AAG chr2 60531935 60531954 60531951 +
gcaccatgagcatctgggtt

SEQ ID NO: 167641 - DNA, 20 bp, Artificial Sequence
  Synthetic oligonucleotide; AGG chr2 60531936 60531955 60531952 +
caccatgagcatctgggtta

SEQ ID NO: 167642 - DNA, 20 bp, Artificial Sequence
  Synthetic oligonucleotide; CGG chr2 60531941 60531960 60531957 +
tgagcatctgggttaaggct

SEQ ID NO: 167643 - DNA, 20 bp, Artificial Sequence
  Synthetic oligonucleotide; CAG chr2 60531954 60531973 60531970 +
taaggctcggaatcctgcac

SEQ ID NO: 167644 - DNA, 20 bp, Artificial Sequence
  Synthetic oligonucleotide; TGG chr2 60531960 60531979 60531976 +
tcggaatcctgcaccagcgt

SEQ ID NO: 167645 - DNA, 20 bp, Artificial Sequence
  Synthetic oligonucleotide; AAG chr2 60531963 60531982 60531979 +
gaatcctgcaccagcgttgg

SEQ ID NO: 167646 - DNA, 20 bp, Artificial Sequence
  Synthetic oligonucleotide; CGG chr2 60531990 60532009 60532006 +
ctttgttcctgccacaccgc

SEQ ID NO: 167647 - DNA, 20 bp, Artificial Sequence
  Synthetic oligonucleotide; GGG chr2 60531991 60532010 60532007 +
tttgttcctgccacaccgcc

SEQ ID NO: 167648 - DNA, 20 bp, Artificial Sequence
  Synthetic oligonucleotide; CAG chr2 60532021 60532040 60532037 +
taacctgtctccacaacact

SEQ ID NO: 167649 - DNA, 20 bp, Artificial Sequence
  Synthetic oligonucleotide; CAG chr2 60532039 60532058 60532055 +
ctcagcctcacgcctcaccc

SEQ ID NO: 167650 - DNA, 20 bp, Artificial Sequence
  Synthetic oligonucleotide; AAG chr2 60532104 60532123 60532120 +
ccgcacaatcgaatctaatt

SEQ ID NO: 167651 - DNA, 20 bp, Artificial Sequence
  Synthetic oligonucleotide; CAG chr2 60532109 60532128 60532125 +
caatcgaatctaattaagat

SEQ ID NO: 167652 - DNA, 20 bp, Artificial Sequence
  Synthetic oligonucleotide; AGG chr2 60532110 60532129 60532126 +
aatcgaatctaattaagatc

SEQ ID NO: 167653 - DNA, 20 bp, Artificial Sequence
  Synthetic oligonucleotide; AAG chr2 60532113 60532132 60532129 +
cgaatctaattaagatcagg

SEQ ID NO: 167654 - DNA, 20 bp, Artificial Sequence
  Synthetic oligonucleotide; CAG chr2 60532145 60532164 60532161 +
ttttcttttcactgtacccc

SEQ ID NO: 167655 - DNA, 20 bp, Artificial Sequence
  Synthetic oligonucleotide; CAG chr2 60532154 60532173 60532170 +
cactgtacccccagtaatca

SEQ ID NO: 167656 - DNA, 20 bp, Artificial Sequence
  Synthetic oligonucleotide; AAG chr2 60532157 60532176 60532173 +
tgtacccccagtaatcacag

SEQ ID NO: 167657 - DNA, 20 bp, Artificial Sequence
  Synthetic oligonucleotide; GAG chr2 60532173 60532192 60532189 +
acagaagttcttcaaatttt

SEQ ID NO: 167658 - DNA, 20 bp, Artificial Sequence
  Synthetic oligonucleotide; AAG chr2 60532218 60532237 60532234 +
tttccctcattttgcatttc

SEQ ID NO: 167659 - DNA, 20 bp, Artificial Sequence
  Synthetic oligonucleotide; AGG chr2 60532219 60532238 60532235 +
ttccctcattttgcatttca

SEQ ID NO: 167660 - DNA, 20 bp, Artificial Sequence
  Synthetic oligonucleotide; AAG chr2 60532226 60532245 60532242 +
attttgcatttcaaggcaca

SEQ ID NO: 167661 - DNA, 20 bp, Artificial Sequence
  Synthetic oligonucleotide; CAG chr2 60532230 60532249 60532246 +
tgcatttcaaggcacaaaga

SEQ ID NO: 167662 - DNA, 20 bp, Artificial Sequence
  Synthetic oligonucleotide; TGG chr2 60532243 60532262 60532259 +
acaaagacagtctatctcac

SEQ ID NO: 167663 - DNA, 20 bp, Artificial Sequence
  Synthetic oligonucleotide; TGG chr2 60532246 60532265 60532262 +
aagacagtctatctcactgg

SEQ ID NO: 167664 - DNA, 20 bp, Artificial Sequence
  Synthetic oligonucleotide; TAG chr2 60532257 60532276 60532273 +
tctcactggtggtctattaa

SEQ ID NO: 167665 - DNA, 20 bp, Artificial Sequence
  Synthetic oligonucleotide; AAG chr2 60532264 60532283 60532280 +
ggtggtctattaatagtttg

SEQ ID NO: 167666 - DNA, 20 bp, Artificial Sequence
  Synthetic oligonucleotide; GAG chr2 60532271 60532290 60532287 +
tattaatagtttgaagtttt

SEQ ID NO: 167667 - DNA, 20 bp, Artificial Sequence
  Synthetic oligonucleotide; CAG chr2 60532277 60532296 60532293 +
tagtttgaagttttgagcgt

SEQ ID NO: 167668 - DNA, 20 bp, Artificial Sequence
  Synthetic oligonucleotide; AAG chr2 60532280 60532299 60532296 +
tttgaagttttgagcgtcag

SEQ ID NO: 167669 - DNA, 20 bp, Artificial Sequence
  Synthetic oligonucleotide; AGG chr2 60532281 60532300 60532297 +
ttgaagttttgagcgtcaga

SEQ ID NO: 167670 - DNA, 20 bp, Artificial Sequence
  Synthetic oligonucleotide; TGG chr2 60532284 60532303 60532300 +
aagttttgagcgtcagaagg

SEQ ID NO: 167671 - DNA, 20 bp, Artificial Sequence
  Synthetic oligonucleotide; TGG chr2 60532298 60532317 60532314 +
agaaggtggttgttgctttt

SEQ ID NO: 167672 - DNA, 20 bp, Artificial Sequence
  Synthetic oligonucleotide; TGG chr2 60532305 60532324 60532321 +
ggttgttgctttttggtttt

SEQ ID NO: 167673 - DNA, 20 bp, Artificial Sequence
  Synthetic oligonucleotide; GGG chr2 60532306 60532325 60532322 +
gttgttgctttttggttttt

SEQ ID NO: 167674 - DNA, 20 bp, Artificial Sequence
  Synthetic oligonucleotide; CAG chr2 60532347 60532366 60532363 +
taaaactattctgtcatttc

SEQ ID NO: 167675 - DNA, 20 bp, Artificial Sequence
  Synthetic oligonucleotide; AAG chr2 60532359 60532378 60532375 +
gtcatttccagttttttaaa

SEQ ID NO: 167676 - DNA, 20 bp, Artificial Sequence
  Synthetic oligonucleotide; AGG chr2 60532360 60532379 60532376 +
tcatttccagttttttaaaa

SEQ ID NO: 167677 - DNA, 20 bp, Artificial Sequence
  Synthetic oligonucleotide; TGG chr2 60532410 60532429 60532426 +
tttttttgtttttctttttt

SEQ ID NO: 167678 - DNA, 20 bp, Artificial Sequence
  Synthetic oligonucleotide; TGG chr2 60532413 60532432 60532429 +
ttttgtttttctttttttgg

SEQ ID NO: 167679 - DNA, 20 bp, Artificial Sequence
  Synthetic oligonucleotide; TGG chr2 60532416 60532435 60532432 +
tgtttttctttttttggtgg

SEQ ID NO: 167680 - DNA, 20 bp, Artificial Sequence
  Synthetic oligonucleotide; TGG chr2 60532419 60532438 60532435 +
ttttctttttttggtggtgg

SEQ ID NO: 167681 - DNA, 20 bp, Artificial Sequence
  Synthetic oligonucleotide; CAG chr2 60532436 60532455 60532452 +
tggtggcgttaatgtttctt

SEQ ID NO: 167682 - DNA, 20 bp, Artificial Sequence
  Synthetic oligonucleotide; AAG chr2 60532440 60532459 60532456 +
ggcgttaatgtttcttcaga

SEQ ID NO: 167683 - DNA, 20 bp, Artificial Sequence
  Synthetic oligonucleotide; CAG chr2 60532444 60532463 60532460 +
ttaatgtttcttcagaaaga

SEQ ID NO: 167684 - DNA, 20 bp, Artificial Sequence
  Synthetic oligonucleotide; TGG chr2 60532451 60532470 60532467 +
ttcttcagaaagacagcttc

SEQ ID NO: 167685 - DNA, 20 bp, Artificial Sequence
  Synthetic oligonucleotide; GGG chr2 60532452 60532471 60532468 +
tcttcagaaagacagcttct

SEQ ID NO: 167686 - DNA, 20 bp, Artificial Sequence
  Synthetic oligonucleotide; TGG chr2 60532461 60532480 60532477 +
agacagcttctgggccactc

SEQ ID NO: 167687 - DNA, 20 bp, Artificial Sequence
  Synthetic oligonucleotide; GGG chr2 60532462 60532481 60532478 +
gacagcttctgggccactct

SEQ ID NO: 167688 - DNA, 20 bp, Artificial Sequence
  Synthetic oligonucleotide; TGG chr2 60532475 60532494 60532491 +
ccactctgggtattatgatt

SEQ ID NO: 167689 - DNA, 20 bp, Artificial Sequence
  Synthetic oligonucleotide; TAG chr2 60532492 60532511 60532508 +
atttggtttcccccttacaa

SEQ ID NO: 167690 - DNA, 20 bp, Artificial Sequence
  Synthetic oligonucleotide; TGG chr2 60532507 60532526 60532523 +
tacaatagttactctctgcc

SEQ ID NO: 167691 - DNA, 20 bp, Artificial Sequence
  Synthetic oligonucleotide; CAG chr2 60532522 60532541 60532538 +
ctgcctggtttactgattta

SEQ ID NO: 167692 - DNA, 20 bp, Artificial Sequence
  Synthetic oligonucleotide; TGG chr2 60532530 60532549 60532546 +
tttactgatttacagaacct

SEQ ID NO: 167693 - DNA, 20 bp, Artificial Sequence
  Synthetic oligonucleotide; TGG chr2 60532541 60532560 60532557 +
acagaaccttggtatgtgaa

SEQ ID NO: 167694 - DNA, 20 bp, Artificial Sequence
  Synthetic oligonucleotide; AAG chr2 60532549 60532568 60532565 +
ttggtatgtgaatggcgaaa

SEQ ID NO: 167695 - DNA, 20 bp, Artificial Sequence
  Synthetic oligonucleotide; AAG chr2 60532558 60532577 60532574 +
gaatggcgaaaaagaaaaaa

SEQ ID NO: 167696 - DNA, 20 bp, Artificial Sequence
  Synthetic oligonucleotide; AGG chr2 60532559 60532578 60532575 +
aatggcgaaaaagaaaaaaa

SEQ ID NO: 167697 - DNA, 20 bp, Artificial Sequence
  Synthetic oligonucleotide; AAG chr2 60532563 60532582 60532579 +
gcgaaaaagaaaaaaaagga

SEQ ID NO: 167698 - DNA, 20 bp, Artificial Sequence
  Synthetic oligonucleotide; AAG chr2 60532571 60532590 60532587 +
gaaaaaaaaggaaagaaaaa

SEQ ID NO: 167699 - DNA, 20 bp, Artificial Sequence
  Synthetic oligonucleotide; TGG chr2 60532583 60532602 60532599 +
aagaaaaaaagaaaattcct

SEQ ID NO: 167700 - DNA, 20 bp, Artificial Sequence
  Synthetic oligonucleotide; AAG chr2 60532589 60532608 60532605 +
aaaagaaaattccttggcat

SEQ ID NO: 167701 - DNA, 20 bp, Artificial Sequence
  Synthetic oligonucleotide; AGG chr2 60532590 60532609 60532606 +
aaagaaaattccttggcata

SEQ ID NO: 167702 - DNA, 20 bp, Artificial Sequence
  Synthetic oligonucleotide; CAG chr2 60532614 60532633 60532630 +
tatgtttgctgatcaaattt

SEQ ID NO: 167703 - DNA, 20 bp, Artificial Sequence
  Synthetic oligonucleotide; CAG chr2 60532655 60532674 60532671 +
ttatgactttacttgaaaaa

SEQ ID NO: 167704 - DNA, 20 bp, Artificial Sequence
  Synthetic oligonucleotide; CAG chr2 60532665 60532684 60532681 +
acttgaaaaacagtttgcca

SEQ ID NO: 167705 - DNA, 20 bp, Artificial Sequence
  Synthetic oligonucleotide; GAG chr2 60532669 60532688 60532685 +
gaaaaacagtttgccacagt

SEQ ID NO: 167706 - DNA, 20 bp, Artificial Sequence
  Synthetic oligonucleotide; TGG chr2 60532673 60532692 60532689 +
aacagtttgccacagtgaga

SEQ ID NO: 167707 - DNA, 20 bp, Artificial Sequence
  Synthetic oligonucleotide; AAG chr2 60532712 60532731 60532728 +
tctacccctccactcccttt

SEQ ID NO: 167708 - DNA, 20 bp, Artificial Sequence
  Synthetic oligonucleotide; CAG chr2 60532727 60532746 60532743 +
cctttaagtacttcgaaaaa

SEQ ID NO: 167709 - DNA, 20 bp, Artificial Sequence
  Synthetic oligonucleotide; AAG chr2 60532743 60532762 60532759 +
aaaacagtacaattttttta

SEQ ID NO: 167710 - DNA, 20 bp, Artificial Sequence
  Synthetic oligonucleotide; AGG chr2 60532744 60532763 60532760 +
aaacagtacaatttttttaa

SEQ ID NO: 167711 - DNA, 20 bp, Artificial Sequence
  Synthetic oligonucleotide; TAG chr2 60532747 60532766 60532763 +
cagtacaatttttttaaagg

SEQ ID NO: 167712 - DNA, 20 bp, Artificial Sequence
  Synthetic oligonucleotide; AAG chr2 60532755 60532774 60532771 +
tttttttaaaggtagattta

SEQ ID NO: 167713 - DNA, 20 bp, Artificial Sequence
  Synthetic oligonucleotide; TGG chr2 60532765 60532784 60532781 +
ggtagatttaaagcattaac

SEQ ID NO: 167714 - DNA, 20 bp, Artificial Sequence
  Synthetic oligonucleotide; TGG chr2 60532770 60532789 60532786 +
atttaaagcattaactggtt

SEQ ID NO: 167715 - DNA, 20 bp, Artificial Sequence
  Synthetic oligonucleotide; AAG chr2 60532823 60532842 60532839 +
ccctgaaaatacattttcaa

SEQ ID NO: 167716 - DNA, 20 bp, Artificial Sequence
  Synthetic oligonucleotide; AAG chr2 60532835 60532854 60532851 +
attttcaaaagacttatgca

SEQ ID NO: 167717 - DNA, 20 bp, Artificial Sequence
  Synthetic oligonucleotide; AAG chr2 60532851 60532870 60532867 +
tgcaaagccacatgattttg

SEQ ID NO: 167718 - DNA, 20 bp, Artificial Sequence
  Synthetic oligonucleotide; AGG chr2 60532852 60532871 60532868 +
gcaaagccacatgattttga

SEQ ID NO: 167719 - DNA, 20 bp, Artificial Sequence
  Synthetic oligonucleotide; GAG chr2 60532854 60532873 60532870 +
aaagccacatgattttgaag

SEQ ID NO: 167720 - DNA, 20 bp, Artificial Sequence
  Synthetic oligonucleotide; GAG chr2 60532862 60532881 60532878 +
atgattttgaaggagctaat

SEQ ID NO: 167721 - DNA, 20 bp, Artificial Sequence
  Synthetic oligonucleotide; TGG chr2 60532888 60532907 60532904 +
gtcccaccaccaaaatttaa

SEQ ID NO: 167722 - DNA, 20 bp, Artificial Sequence
  Synthetic oligonucleotide; AAG chr2 60532897 60532916 60532913 +
ccaaaatttaatggtgactt

SEQ ID NO: 167723 - DNA, 20 bp, Artificial Sequence
  Synthetic oligonucleotide; TAG chr2 60532929 60532948 60532945 +
tactttttatttacttcctg

SEQ ID NO: 167724 - DNA, 20 bp, Artificial Sequence
  Synthetic oligonucleotide; CAG chr2 60532958 60532977 60532974 +
ttgtgtacttgacatttata

SEQ ID NO: 167725 - DNA, 20 bp, Artificial Sequence
  Synthetic oligonucleotide; TGG chr2 60532987 60533006 60533003 +
cattatataacaatctaccc

SEQ ID NO: 167726 - DNA, 20 bp, Artificial Sequence
  Synthetic oligonucleotide; GGG chr2 60532988 60533007 60533004 +
attatataacaatctaccct

SEQ ID NO: 167727 - DNA, 20 bp, Artificial Sequence
  Synthetic oligonucleotide; TAG chr2 60532996 60533015 60533012 +
acaatctaccctgggtacac

SEQ ID NO: 167728 - DNA, 20 bp, Artificial Sequence
  Synthetic oligonucleotide; TAG chr2 60533014 60533033 60533030 +
actagattatgccaatctat

SEQ ID NO: 167729 - DNA, 20 bp, Artificial Sequence
  Synthetic oligonucleotide; AAG chr2 60533038 60533057 60533054 +
atgaaatttgtactccatat

SEQ ID NO: 167730 - DNA, 20 bp, Artificial Sequence
  Synthetic oligonucleotide; CAG chr2 60533041 60533060 60533057 +
aaatttgtactccatataag

SEQ ID NO: 167731 - DNA, 20 bp, Artificial Sequence
  Synthetic oligonucleotide; AAG chr2 60533044 60533063 60533060 +
tttgtactccatataagcag

SEQ ID NO: 167732 - DNA, 20 bp, Artificial Sequence
  Synthetic oligonucleotide; CAG chr2 60533051 60533070 60533067 +
tccatataagcagaagtttc

SEQ ID NO: 167733 - DNA, 20 bp, Artificial Sequence
  Synthetic oligonucleotide; AAG chr2 60533086 60533105 60533102 +
taccattatgtttcaatgta

SEQ ID NO: 167734 - DNA, 20 bp, Artificial Sequence
  Synthetic oligonucleotide; TAG chr2 60533097 60533116 60533113 +
ttcaatgtaaagtgttatta

SEQ ID NO: 167735 - DNA, 20 bp, Artificial Sequence
  Synthetic oligonucleotide; CAG chr2 60533100 60533119 60533116 +
aatgtaaagtgttattatag

SEQ ID NO: 167736 - DNA, 20 bp, Artificial Sequence
  Synthetic oligonucleotide; GAG chr2 60533102 60533121 60533118 +
tgtaaagtgttattatagca

SEQ ID NO: 167737 - DNA, 20 bp, Artificial Sequence
  Synthetic oligonucleotide; AAG chr2 60533109 60533128 60533125 +
tgttattatagcagagtata

SEQ ID NO: 167738 - DNA, 20 bp, Artificial Sequence
  Synthetic oligonucleotide; CAG chr2 60533114 60533133 60533130 +
ttatagcagagtataaagca

SEQ ID NO: 167739 - DNA, 20 bp, Artificial Sequence
  Synthetic oligonucleotide; TAG chr2 60533170 60533189 60533186 +
gtaatctttcttgctgcttc

SEQ ID NO: 167740 - DNA, 20 bp, Artificial Sequence
  Synthetic oligonucleotide; AGG chr2 60533171 60533190 60533187 +
taatctttcttgctgcttct

SEQ ID NO: 167741 - DNA, 20 bp, Artificial Sequence
  Synthetic oligonucleotide; GGG chr2 60533172 60533191 60533188 +
aatctttcttgctgcttcta

SEQ ID NO: 167742 - DNA, 20 bp, Artificial Sequence
  Synthetic oligonucleotide; CAG chr2 60533181 60533200 60533197 +
tgctgcttctagggctgtgt

SEQ ID NO: 167743 - DNA, 20 bp, Artificial Sequence
  Synthetic oligonucleotide; TGG chr2 60533196 60533215 60533212 +
tgtgtcagtgtttacattcc

SEQ ID NO: 167744 - DNA, 20 bp, Artificial Sequence
  Synthetic oligonucleotide; AAG chr2 60533199 60533218 60533215 +
gtcagtgtttacattcctgg

SEQ ID NO: 167745 - DNA, 20 bp, Artificial Sequence
  Synthetic oligonucleotide; TGG chr2 60533217 60533236 60533233 +
ggaagttaaataaaccgaca

SEQ ID NO: 167746 - DNA, 20 bp, Artificial Sequence
  Synthetic oligonucleotide; TGG chr2 60533229 60533248 60533245 +
aaccgacatggcaaaactcc

SEQ ID NO: 167747 - DNA, 20 bp, Artificial Sequence
  Synthetic oligonucleotide; TAG chr2 60533233 60533252 60533249 +
gacatggcaaaactcctgga

SEQ ID NO: 167748 - DNA, 20 bp, Artificial Sequence
  Synthetic oligonucleotide; AAG chr2 60533246 60533265 60533262 +
tcctggatagactgaataat

SEQ ID NO: 167749 - DNA, 20 bp, Artificial Sequence
  Synthetic oligonucleotide; AGG chr2 60533247 60533266 60533263 +
cctggatagactgaataata

SEQ ID NO: 167750 - DNA, 20 bp, Artificial Sequence
  Synthetic oligonucleotide; TAG chr2 60533285 60533304 60533301 +
ttgtttactttttaccttgt

SEQ ID NO: 167751 - DNA, 20 bp, Artificial Sequence
  Synthetic oligonucleotide; AGG chr2 60533286 60533305 60533302 +
tgtttactttttaccttgtt

SEQ ID NO: 167752 - DNA, 20 bp, Artificial Sequence
  Synthetic oligonucleotide; AAG chr2 60533303 60533322 60533319 +
gttaggatccctttcttgta

SEQ ID NO: 167753 - DNA, 20 bp, Artificial Sequence
  Synthetic oligonucleotide; TGG chr2 60533308 60533327 60533324 +
gatccctttcttgtaaagtt

SEQ ID NO: 167754 - DNA, 20 bp, Artificial Sequence
  Synthetic oligonucleotide; GGG chr2 60533309 60533328 60533325 +
atccctttcttgtaaagttt

SEQ ID NO: 167755 - DNA, 20 bp, Artificial Sequence
  Synthetic oligonucleotide; GGG chr2 60533310 60533329 60533326 +
tccctttcttgtaaagtttg

SEQ ID NO: 167756 - DNA, 20 bp, Artificial Sequence
  Synthetic oligonucleotide; GGG chr2 60533311 60533330 60533327 +
ccctttcttgtaaagtttgg

SEQ ID NO: 167757 - DNA, 20 bp, Artificial Sequence
  Synthetic oligonucleotide; GAG chr2 60533313 60533332 60533329 +
ctttcttgtaaagtttgggg

SEQ ID NO: 167758 - DNA, 20 bp, Artificial Sequence
  Synthetic oligonucleotide; GAG chr2 60533315 60533334 60533331 +
ttcttgtaaagtttggggga

SEQ ID NO: 167759 - DNA, 20 bp, Artificial Sequence
  Synthetic oligonucleotide; GAG chr2 60533317 60533336 60533333 +
cttgtaaagtttgggggaga

SEQ ID NO: 167760 - DNA, 20 bp, Artificial Sequence
  Synthetic oligonucleotide; GAG chr2 60533319 60533338 60533335 +
tgtaaagtttgggggagaga

SEQ ID NO: 167761 - DNA, 20 bp, Artificial Sequence
  Synthetic oligonucleotide; GAG chr2 60533321 60533340 60533337 +
taaagtttgggggagagaga

SEQ ID NO: 167762 - DNA, 20 bp, Artificial Sequence
  Synthetic oligonucleotide; AGG chr2 60533322 60533341 60533338 +
aaagtttgggggagagagag

SEQ ID NO: 167763 - DNA, 20 bp, Artificial Sequence
  Synthetic oligonucleotide; GAG chr2 60533324 60533343 60533340 +
agtttgggggagagagagag

SEQ ID NO: 167764 - DNA, 20 bp, Artificial Sequence
  Synthetic oligonucleotide; GAG chr2 60533326 60533345 60533342 +
tttgggggagagagagagga

SEQ ID NO: 167765 - DNA, 20 bp, Artificial Sequence
  Synthetic oligonucleotide; AAG chr2 60533330 60533349 60533346 +
ggggagagagagaggagaga

SEQ ID NO: 167766 - DNA, 20 bp, Artificial Sequence
  Synthetic oligonucleotide; GAG chr2 60533332 60533351 60533348 +
ggagagagagaggagagaaa

SEQ ID NO: 167767 - DNA, 20 bp, Artificial Sequence
  Synthetic oligonucleotide; GAG chr2 60533334 60533353 60533350 +
agagagagaggagagaaaga

SEQ ID NO: 167768 - DNA, 20 bp, Artificial Sequence
  Synthetic oligonucleotide; AAG chr2 60533337 60533356 60533353 +
gagagaggagagaaagagag

SEQ ID NO: 167769 - DNA, 20 bp, Artificial Sequence
  Synthetic oligonucleotide; AGG chr2 60533338 60533357 60533354 +
agagaggagagaaagagaga

SEQ ID NO: 167770 - DNA, 20 bp, Artificial Sequence
  Synthetic oligonucleotide; AAG chr2 60533345 60533364 60533361 +
agagaaagagagaaggaatg

SEQ ID NO: 167771 - DNA, 20 bp, Artificial Sequence
  Synthetic oligonucleotide; AGG chr2 60533346 60533365 60533362 +
gagaaagagagaaggaatga

SEQ ID NO: 167772 - DNA, 20 bp, Artificial Sequence
  Synthetic oligonucleotide; GGG chr2 60533347 60533366 60533363 +
agaaagagagaaggaatgaa

SEQ ID NO: 167773 - DNA, 20 bp, Artificial Sequence
  Synthetic oligonucleotide; GGG chr2 60533348 60533367 60533364 +
gaaagagagaaggaatgaag

SEQ ID NO: 167774 - DNA, 20 bp, Artificial Sequence
  Synthetic oligonucleotide; GGG chr2 60533349 60533368 60533365 +
aaagagagaaggaatgaagg

SEQ ID NO: 167775 - DNA, 20 bp, Artificial Sequence
  Synthetic oligonucleotide; AAG chr2 60533358 60533377 60533374 +
aggaatgaagggggtgatgc

SEQ ID NO: 167776 - DNA, 20 bp, Artificial Sequence
  Synthetic oligonucleotide; TAG chr2 60533362 60533381 60533378 +
atgaagggggtgatgcaaga

SEQ ID NO: 167777 - DNA, 20 bp, Artificial Sequence
  Synthetic oligonucleotide; AAG chr2 60533365 60533384 60533381 +
aagggggtgatgcaagatag

SEQ ID NO: 167778 - DNA, 20 bp, Artificial Sequence
  Synthetic oligonucleotide; AGG chr2 60533366 60533385 60533382 +
agggggtgatgcaagataga

SEQ ID NO: 167779 - DNA, 20 bp, Artificial Sequence
  Synthetic oligonucleotide; GAG chr2 60533368 60533387 60533384 +
ggggtgatgcaagatagaag

SEQ ID NO: 167780 - DNA, 20 bp, Artificial Sequence
  Synthetic oligonucleotide; GAG chr2 60533370 60533389 60533386 +
ggtgatgcaagatagaagga

SEQ ID NO: 167781 - DNA, 20 bp, Artificial Sequence
  Synthetic oligonucleotide; GAG chr2 60533372 60533391 60533388 +
tgatgcaagatagaaggaga

SEQ ID NO: 167782 - DNA, 20 bp, Artificial Sequence
  Synthetic oligonucleotide; TGG chr2 60533385 60533404 60533401 +
aaggagagagatttatacac

SEQ ID NO: 167783 - DNA, 20 bp, Artificial Sequence
  Synthetic oligonucleotide; AAG chr2 60533403 60533422 60533419 +
actggcttccatatgtcaca

SEQ ID NO: 167784 - DNA, 20 bp, Artificial Sequence
  Synthetic oligonucleotide; CAG chr2 60533419 60533438 60533435 +
cacaaagaccttcctatcca

SEQ ID NO: 167785 - DNA, 20 bp, Artificial Sequence
  Synthetic oligonucleotide; AAG chr2 60533434 60533453 60533450 +
atccacagccaacgcgactg

SEQ ID NO: 167786 - DNA, 20 bp, Artificial Sequence
  Synthetic oligonucleotide; CAG chr2 60533437 60533456 60533453 +
cacagccaacgcgactgaag

SEQ ID NO: 167787 - DNA, 20 bp, Artificial Sequence
  Synthetic oligonucleotide; AAG chr2 60533447 60533466 60533463 +
gcgactgaagcagcatgcat

SEQ ID NO: 167788 - DNA, 20 bp, Artificial Sequence
  Synthetic oligonucleotide; TAG chr2 60533451 60533470 60533467 +
ctgaagcagcatgcataagt

SEQ ID NO: 167789 - DNA, 20 bp, Artificial Sequence
  Synthetic oligonucleotide; CGG chr2 60533481 60533500 60533497 +
tgttttgttttcttaaatac

SEQ ID NO: 167790 - DNA, 20 bp, Artificial Sequence
  Synthetic oligonucleotide; GGG chr2 60533482 60533501 60533498 +
gttttgttttcttaaatacc

SEQ ID NO: 167791 - DNA, 20 bp, Artificial Sequence
  Synthetic oligonucleotide; CAG chr2 60533486 60533505 60533502 +
tgttttcttaaataccgggt

SEQ ID NO: 167792 - DNA, 20 bp, Artificial Sequence
  Synthetic oligonucleotide; CAG chr2 60533517 60533536 60533533 +
ccctttctccactgcccact

SEQ ID NO: 167793 - DNA, 20 bp, Artificial Sequence
  Synthetic oligonucleotide; AAG chr2 60533529 60533548 60533545 +
tgcccactcagccccacata

SEQ ID NO: 167794 - DNA, 20 bp, Artificial Sequence
  Synthetic oligonucleotide; AAG chr2 60533536 60533555 60533552 +
tcagccccacataaagtatg

SEQ ID NO: 167795 - DNA, 20 bp, Artificial Sequence
  Synthetic oligonucleotide; TAG chr2 60533561 60533580 60533577 +
tttttttgaccattttcaaa

SEQ ID NO: 167796 - DNA, 20 bp, Artificial Sequence
  Synthetic oligonucleotide; TAG chr2 60533576 60533595 60533592 +
tcaaatagcaaattatccat

SEQ ID NO: 167797 - DNA, 20 bp, Artificial Sequence
  Synthetic oligonucleotide; TAG chr2 60533593 60533612 60533609 +
cattagatttcatcatatct

SEQ ID NO: 167798 - DNA, 20 bp, Artificial Sequence
  Synthetic oligonucleotide; AAG chr2 60533598 60533617 60533614 +
gatttcatcatatcttagta

SEQ ID NO: 167799 - DNA, 20 bp, Artificial Sequence
  Synthetic oligonucleotide; AAG chr2 60533611 60533630 60533627 +
cttagtaaagcaattacatc

SEQ ID NO: 167800 - DNA, 20 bp, Artificial Sequence
  Synthetic oligonucleotide; TAG chr2 60533621 60533640 60533637 +
caattacatcaagaaaatga

SEQ ID NO: 167801 - DNA, 20 bp, Artificial Sequence
  Synthetic oligonucleotide; TGG chr2 60533630 60533649 60533646 +
caagaaaatgatagtgcgtg

SEQ ID NO: 167802 - DNA, 20 bp, Artificial Sequence
  Synthetic oligonucleotide; CAG chr2 60533648 60533667 60533664 +
tgtggaatcaattatgcatg

SEQ ID NO: 167803 - DNA, 20 bp, Artificial Sequence
  Synthetic oligonucleotide; TGG chr2 60533652 60533671 60533668 +
gaatcaattatgcatgcagt

SEQ ID NO: 167804 - DNA, 20 bp, Artificial Sequence
  Synthetic oligonucleotide; CGG chr2 60533656 60533675 60533672 +
caattatgcatgcagttggc

SEQ ID NO: 167805 - DNA, 20 bp, Artificial Sequence
  Synthetic oligonucleotide; GAG chr2 60533658 60533677 60533674 +
attatgcatgcagttggccg

SEQ ID NO: 167806 - DNA, 20 bp, Artificial Sequence
  Synthetic oligonucleotide; AAG chr2 60533665 60533684 60533681 +
atgcagttggccggagacca

SEQ ID NO: 167807 - DNA, 20 bp, Artificial Sequence
  Synthetic oligonucleotide; AGG chr2 60533666 60533685 60533682 +
tgcagttggccggagaccaa

SEQ ID NO: 167808 - DNA, 20 bp, Artificial Sequence
  Synthetic oligonucleotide; AAG chr2 60533674 60533693 60533690 +
gccggagaccaaaggctgtg

SEQ ID NO: 167809 - DNA, 20 bp, Artificial Sequence
  Synthetic oligonucleotide; CGG chr2 60533678 60533697 60533694 +
gagaccaaaggctgtgaagt

SEQ ID NO: 167810 - DNA, 20 bp, Artificial Sequence
  Synthetic oligonucleotide; GAG chr2 60533680 60533699 60533696 +
gaccaaaggctgtgaagtcg

SEQ ID NO: 167811 - DNA, 20 bp, Artificial Sequence
  Synthetic oligonucleotide; GAG chr2 60533682 60533701 60533698 +
ccaaaggctgtgaagtcgga

SEQ ID NO: 167812 - DNA, 20 bp, Artificial Sequence
  Synthetic oligonucleotide; AGG chr2 60533683 60533702 60533699 +
caaaggctgtgaagtcggag

SEQ ID NO: 167813 - DNA, 20 bp, Artificial Sequence
  Synthetic oligonucleotide; GGG chr2 60533684 60533703 60533700 +
aaaggctgtgaagtcggaga

SEQ ID NO: 167814 - DNA, 20 bp, Artificial Sequence
  Synthetic oligonucleotide; CAG chr2 60533687 60533706 60533703 +
ggctgtgaagtcggagaggg

SEQ ID NO: 167815 - DNA, 20 bp, Artificial Sequence
  Synthetic oligonucleotide; AAG chr2 60533714 60533733 60533730 +
gctcgacacacacaaataaa

SEQ ID NO: 167816 - DNA, 20 bp, Artificial Sequence
  Synthetic oligonucleotide; TGG chr2 60533721 60533740 60533737 +
acacacaaataaaaagcccc

SEQ ID NO: 167817 - DNA, 20 bp, Artificial Sequence
  Synthetic oligonucleotide; CAG chr2 60533730 60533749 60533746 +
taaaaagcccctggatctca

SEQ ID NO: 167818 - DNA, 20 bp, Artificial Sequence
  Synthetic oligonucleotide; TGG chr2 60533734 60533753 60533750 +
aagcccctggatctcacaga

SEQ ID NO: 167819 - DNA, 20 bp, Artificial Sequence
  Synthetic oligonucleotide; CAG chr2 60533744 60533763 60533760 +
atctcacagatggaccccat

SEQ ID NO: 167820 - DNA, 20 bp, Artificial Sequence
  Synthetic oligonucleotide; AAG chr2 60533765 60533784 60533781 +
agttcatcttactgcctaaa

SEQ ID NO: 167821 - DNA, 20 bp, Artificial Sequence
  Synthetic oligonucleotide; TGG chr2 60533797 60533816 60533813 +
ttaataatttatttgtgttc

SEQ ID NO: 167822 - DNA, 20 bp, Artificial Sequence
  Synthetic oligonucleotide; CAG chr2 60533811 60533830 60533827 +
gtgttctggatactgtttcc

SEQ ID NO: 167823 - DNA, 20 bp, Artificial Sequence
  Synthetic oligonucleotide; AAG chr2 60533838 60533857 60533854 +
atattaacaactttaaactg

SEQ ID NO: 167824 - DNA, 20 bp, Artificial Sequence
  Synthetic oligonucleotide; TAG chr2 60533849 60533868 60533865 +
tttaaactgaagcatgcttt

SEQ ID NO: 167825 - DNA, 20 bp, Artificial Sequence
  Synthetic oligonucleotide; TGG chr2 60533854 60533873 60533870 +
actgaagcatgcttttagca

SEQ ID NO: 167826 - DNA, 20 bp, Artificial Sequence
  Synthetic oligonucleotide; TGG chr2 60533859 60533878 60533875 +
agcatgcttttagcatggta

SEQ ID NO: 167827 - DNA, 20 bp, Artificial Sequence
  Synthetic oligonucleotide; TGG chr2 60533863 60533882 60533879 +
tgcttttagcatggtatgga

SEQ ID NO: 167828 - DNA, 20 bp, Artificial Sequence
  Synthetic oligonucleotide; AAG chr2 60533866 60533885 60533882 +
ttttagcatggtatggatgg

SEQ ID NO: 167829 - DNA, 20 bp, Artificial Sequence
  Synthetic oligonucleotide; CGG chr2 60533872 60533891 60533888 +
catggtatggatggaagtca

SEQ ID NO: 167830 - DNA, 20 bp, Artificial Sequence
  Synthetic oligonucleotide; TAG chr2 60533875 60533894 60533891 +
ggtatggatggaagtcacgg

SEQ ID NO: 167831 - DNA, 20 bp, Artificial Sequence
  Synthetic oligonucleotide; AGG chr2 60533876 60533895 60533892 +
gtatggatggaagtcacggt

SEQ ID NO: 167832 - DNA, 20 bp, Artificial Sequence
  Synthetic oligonucleotide; GGG chr2 60533877 60533896 60533893 +
tatggatggaagtcacggta

SEQ ID NO: 167833 - DNA, 20 bp, Artificial Sequence
  Synthetic oligonucleotide; CAG chr2 60533880 60533899 60533896 +
ggatggaagtcacggtaggg

SEQ ID NO: 167834 - DNA, 20 bp, Artificial Sequence
  Synthetic oligonucleotide; TAG chr2 60533886 60533905 60533902 +
aagtcacggtagggcagtgc

SEQ ID NO: 167835 - DNA, 20 bp, Artificial Sequence
  Synthetic oligonucleotide; AGG chr2 60533887 60533906 60533903 +
agtcacggtagggcagtgct

SEQ ID NO: 167836 - DNA, 20 bp, Artificial Sequence
  Synthetic oligonucleotide; CGG chr2 60533895 60533914 60533911 +
tagggcagtgctaggtccct

SEQ ID NO: 167837 - DNA, 20 bp, Artificial Sequence
  Synthetic oligonucleotide; GAG chr2 60533897 60533916 60533913 +
gggcagtgctaggtccctcg

SEQ ID NO: 167838 - DNA, 20 bp, Artificial Sequence
  Synthetic oligonucleotide; AGG chr2 60533898 60533917 60533914 +
ggcagtgctaggtccctcgg

SEQ ID NO: 167839 - DNA, 20 bp, Artificial Sequence
  Synthetic oligonucleotide; TAG chr2 60533910 60533929 60533926 +
tccctcggaggttaaaatta

SEQ ID NO: 167840 - DNA, 20 bp, Artificial Sequence
  Synthetic oligonucleotide; CAG chr2 60533981 60534000 60533997 +
cattaaacattcgttttaat

SEQ ID NO: 167841 - DNA, 20 bp, Artificial Sequence
  Synthetic oligonucleotide; CAG chr2 60533989 60534008 60534005 +
attcgttttaatcagaatat

SEQ ID NO: 167842 - DNA, 20 bp, Artificial Sequence
  Synthetic oligonucleotide; CAG chr2 60534020 60534039 60534036 +
ttctgattctgcttgttaac

SEQ ID NO: 167843 - DNA, 20 bp, Artificial Sequence
  Synthetic oligonucleotide; AAG chr2 60534041 60534060 60534057 +
agtgataaactcataaacca

SEQ ID NO: 167844 - DNA, 20 bp, Artificial Sequence
  Synthetic oligonucleotide; CAG chr2 60534060 60534079 60534076 +
aaagatgaacatcaataata

SEQ ID NO: 167845 - DNA, 20 bp, Artificial Sequence
  Synthetic oligonucleotide; CAG chr2 60534065 60534084 60534081 +
tgaacatcaataatacagca

SEQ ID NO: 167846 - DNA, 20 bp, Artificial Sequence
  Synthetic oligonucleotide; AGG chr2 60534066 60534085 60534082 +
gaacatcaataatacagcac

SEQ ID NO: 167847 - DNA, 20 bp, Artificial Sequence
  Synthetic oligonucleotide; CAG chr2 60534077 60534096 60534093 +
atacagcacaggttattcaa

SEQ ID NO: 167848 - DNA, 20 bp, Artificial Sequence
  Synthetic oligonucleotide; AAG chr2 60534082 60534101 60534098 +
gcacaggttattcaacagca

SEQ ID NO: 167849 - DNA, 20 bp, Artificial Sequence
  Synthetic oligonucleotide; AGG chr2 60534083 60534102 60534099 +
cacaggttattcaacagcaa

SEQ ID NO: 167850 - DNA, 20 bp, Artificial Sequence
  Synthetic oligonucleotide; CAG chr2 60534101 60534120 60534117 +
aaaggcaaacaccaaaatca

SEQ ID NO: 167851 - DNA, 20 bp, Artificial Sequence
  Synthetic oligonucleotide; AGG chr2 60534102 60534121 60534118 +
aaggcaaacaccaaaatcac

SEQ ID NO: 167852 - DNA, 20 bp, Artificial Sequence
  Synthetic oligonucleotide; CGG chr2 60534116 60534135 60534132 +
aatcacaggctctcaaaaat

SEQ ID NO: 167853 - DNA, 20 bp, Artificial Sequence
  Synthetic oligonucleotide; TAG chr2 60534126 60534145 60534142 +
tctcaaaaatcggaaaccgt

SEQ ID NO: 167854 - DNA, 20 bp, Artificial Sequence
  Synthetic oligonucleotide; TAG chr2 60534130 60534149 60534146 +
aaaaatcggaaaccgttagt

SEQ ID NO: 167855 - DNA, 20 bp, Artificial Sequence
  Synthetic oligonucleotide; CAG chr2 60534150 60534169 60534166 +
tagcaccttgttttcaccac

SEQ ID NO: 167856 - DNA, 20 bp, Artificial Sequence
  Synthetic oligonucleotide; AGG chr2 60534151 60534170 60534167 +
agcaccttgttttcaccacc

SEQ ID NO: 167857 - DNA, 20 bp, Artificial Sequence
  Synthetic oligonucleotide; GGG chr2 60534152 60534171 60534168 +
gcaccttgttttcaccacca

SEQ ID NO: 167858 - DNA, 20 bp, Artificial Sequence
  Synthetic oligonucleotide; GAG chr2 60534169 60534188 60534185 +
ccagggcactcgtgtacctt

SEQ ID NO: 167859 - DNA, 20 bp, Artificial Sequence
  Synthetic oligonucleotide; AGG chr2 60534170 60534189 60534186 +
cagggcactcgtgtaccttg

SEQ ID NO: 167860 - DNA, 20 bp, Artificial Sequence
  Synthetic oligonucleotide; GGG chr2 60534171 60534190 60534187 +
agggcactcgtgtaccttga

SEQ ID NO: 167861 - DNA, 20 bp, Artificial Sequence
  Synthetic oligonucleotide; GAG chr2 60534173 60534192 60534189 +
ggcactcgtgtaccttgagg

SEQ ID NO: 167862 - DNA, 20 bp, Artificial Sequence
  Synthetic oligonucleotide; TGG chr2 60534180 60534199 60534196 +
gtgtaccttgagggagacac

SEQ ID NO: 167863 - DNA, 20 bp, Artificial Sequence
  Synthetic oligonucleotide; GGG chr2 60534181 60534200 60534197 +
tgtaccttgagggagacact

SEQ ID NO: 167864 - DNA, 20 bp, Artificial Sequence
  Synthetic oligonucleotide; GAG chr2 60534183 60534202 60534199 +
taccttgagggagacactgg

SEQ ID NO: 167865 - DNA, 20 bp, Artificial Sequence
  Synthetic oligonucleotide; CAG chr2 60534188 60534207 60534204 +
tgagggagacactgggagcc

SEQ ID NO: 167866 - DNA, 20 bp, Artificial Sequence
  Synthetic oligonucleotide; AGG chr2 60534189 60534208 60534205 +
gagggagacactgggagccc

SEQ ID NO: 167867 - DNA, 20 bp, Artificial Sequence
  Synthetic oligonucleotide; GGG chr2 60534190 60534209 60534206 +
agggagacactgggagccca

SEQ ID NO: 167868 - DNA, 20 bp, Artificial Sequence
  Synthetic oligonucleotide; GAG chr2 60534192 60534211 60534208 +
ggagacactgggagcccagg

SEQ ID NO: 167869 - DNA, 20 bp, Artificial Sequence
  Synthetic oligonucleotide; TGG chr2 60534197 60534216 60534213 +
cactgggagcccagggagcc

SEQ ID NO: 167870 - DNA, 20 bp, Artificial Sequence
  Synthetic oligonucleotide; GAG chr2 60534199 60534218 60534215 +
ctgggagcccagggagcctg

SEQ ID NO: 167871 - DNA, 20 bp, Artificial Sequence
  Synthetic oligonucleotide; CAG chr2 60534204 60534223 60534220 +
agcccagggagcctggagac

SEQ ID NO: 167872 - DNA, 20 bp, Artificial Sequence
  Synthetic oligonucleotide; AGG chr2 60534205 60534224 60534221 +
gcccagggagcctggagacc

SEQ ID NO: 167873 - DNA, 20 bp, Artificial Sequence
  Synthetic oligonucleotide; TGG chr2 60534216 60534235 60534232 +
ctggagaccaggatatactt

SEQ ID NO: 167874 - DNA, 20 bp, Artificial Sequence
  Synthetic oligonucleotide; GAG chr2 60534223 60534242 60534239 +
ccaggatatactttggtgat

SEQ ID NO: 167875 - DNA, 20 bp, Artificial Sequence
  Synthetic oligonucleotide; AGG chr2 60534224 60534243 60534240 +
caggatatactttggtgatg

SEQ ID NO: 167876 - DNA, 20 bp, Artificial Sequence
  Synthetic oligonucleotide; GGG chr2 60534225 60534244 60534241 +
aggatatactttggtgatga

SEQ ID NO: 167877 - DNA, 20 bp, Artificial Sequence
  Synthetic oligonucleotide; GGG chr2 60534226 60534245 60534242 +
ggatatactttggtgatgag

SEQ ID NO: 167878 - DNA, 20 bp, Artificial Sequence
  Synthetic oligonucleotide; GAG chr2 60534228 60534247 60534244 +
atatactttggtgatgaggg

SEQ ID NO: 167879 - DNA, 20 bp, Artificial Sequence
  Synthetic oligonucleotide; AGG chr2 60534229 60534248 60534245 +
tatactttggtgatgagggg

SEQ ID NO: 167880 - DNA, 20 bp, Artificial Sequence
  Synthetic oligonucleotide; TAG chr2 60534240 60534259 60534256 +
gatgaggggaggacacattg

SEQ ID NO: 167881 - DNA, 20 bp, Artificial Sequence
  Synthetic oligonucleotide; CAG chr2 60534245 60534264 60534261 +
ggggaggacacattgtagct

SEQ ID NO: 167882 - DNA, 20 bp, Artificial Sequence
  Synthetic oligonucleotide; GAG chr2 60534247 60534266 60534263 +
ggaggacacattgtagctca

SEQ ID NO: 167883 - DNA, 20 bp, Artificial Sequence
  Synthetic oligonucleotide; CAG chr2 60534250 60534269 60534266 +
ggacacattgtagctcagag

SEQ ID NO: 167884 - DNA, 20 bp, Artificial Sequence
  Synthetic oligonucleotide; CAG chr2 60534253 60534272 60534269 +
cacattgtagctcagagcag

SEQ ID NO: 167885 - DNA, 20 bp, Artificial Sequence
  Synthetic oligonucleotide; GAG chr2 60534262 60534281 60534278 +
gctcagagcagcagctgaat

SEQ ID NO: 167886 - DNA, 20 bp, Artificial Sequence
  Synthetic oligonucleotide; AAG chr2 60534283 60534302 60534299 +
agaaaacttacttgatctaa

SEQ ID NO: 167887 - DNA, 20 bp, Artificial Sequence
  Synthetic oligonucleotide; AAG chr2 60534290 60534309 60534306 +
ttacttgatctaaaagataa

SEQ ID NO: 167888 - DNA, 20 bp, Artificial Sequence
  Synthetic oligonucleotide; GAG chr2 60534292 60534311 60534308 +
acttgatctaaaagataaaa

SEQ ID NO: 167889 - DNA, 20 bp, Artificial Sequence
  Synthetic oligonucleotide; CAG chr2 60534296 60534315 60534312 +
gatctaaaagataaaagagt

SEQ ID NO: 167890 - DNA, 20 bp, Artificial Sequence
  Synthetic oligonucleotide; CAG chr2 60534306 60534325 60534322 +
ataaaagagtcagccaaacc

SEQ ID NO: 167891 - DNA, 20 bp, Artificial Sequence
  Synthetic oligonucleotide; AGG chr2 60534307 60534326 60534323 +
taaaagagtcagccaaaccc

SEQ ID NO: 167892 - DNA, 20 bp, Artificial Sequence
  Synthetic oligonucleotide; AAG chr2 60534313 60534332 60534329 +
agtcagccaaacccaggccc

SEQ ID NO: 167893 - DNA, 20 bp, Artificial Sequence
  Synthetic oligonucleotide; TAG chr2 60534321 60534340 60534337 +
aaacccaggcccaagtcctt

SEQ ID NO: 167894 - DNA, 20 bp, Artificial Sequence
  Synthetic oligonucleotide; AGG chr2 60534322 60534341 60534338 +
aacccaggcccaagtccttt

SEQ ID NO: 167895 - DNA, 20 bp, Artificial Sequence
  Synthetic oligonucleotide; CAG chr2 60534328 60534347 60534344 +
ggcccaagtcctttaggtgc

SEQ ID NO: 167896 - DNA, 20 bp, Artificial Sequence
  Synthetic oligonucleotide; AAG chr2 60534342 60534361 60534358 +
aggtgccagccatctatcta

SEQ ID NO: 167897 - DNA, 20 bp, Artificial Sequence
  Synthetic oligonucleotide; AAG chr2 60534345 60534364 60534361 +
tgccagccatctatctaaag

SEQ ID NO: 167898 - DNA, 20 bp, Artificial Sequence
  Synthetic oligonucleotide; AAG chr2 60534355 60534374 60534371 +
ctatctaaagaagaaaccta

SEQ ID NO: 167899 - DNA, 20 bp, Artificial Sequence
  Synthetic oligonucleotide; TAG chr2 60534364 60534383 60534380 +
gaagaaacctaaagcattgt

SEQ ID NO: 167900 - DNA, 20 bp, Artificial Sequence
  Synthetic oligonucleotide; AAG chr2 60534368 60534387 60534384 +
aaacctaaagcattgttaga

SEQ ID NO: 167901 - DNA, 20 bp, Artificial Sequence
  Synthetic oligonucleotide; AGG chr2 60534369 60534388 60534385 +
aacctaaagcattgttagaa

SEQ ID NO: 167902 - DNA, 20 bp, Artificial Sequence
  Synthetic oligonucleotide; TAG chr2 60534376 60534395 60534392 +
agcattgttagaaaggtttg

SEQ ID NO: 167903 - DNA, 20 bp, Artificial Sequence
  Synthetic oligonucleotide; TAG chr2 60534384 60534403 60534400 +
tagaaaggtttgtagttctg

SEQ ID NO: 167904 - DNA, 20 bp, Artificial Sequence
  Synthetic oligonucleotide; AAG chr2 60534401 60534420 60534417 +
ctgtagccttccctcctcca

SEQ ID NO: 167905 - DNA, 20 bp, Artificial Sequence
  Synthetic oligonucleotide; AGG chr2 60534402 60534421 60534418 +
tgtagccttccctcctccaa

SEQ ID NO: 167906 - DNA, 20 bp, Artificial Sequence
  Synthetic oligonucleotide; GAG chr2 60534404 60534423 60534420 +
tagccttccctcctccaaag

SEQ ID NO: 167907 - DNA, 20 bp, Artificial Sequence
  Synthetic oligonucleotide; AGG chr2 60534405 60534424 60534421 +
agccttccctcctccaaagg

SEQ ID NO: 167908 - DNA, 20 bp, Artificial Sequence
  Synthetic oligonucleotide; TAG chr2 60534433 60534452 60534449 +
gatgtcttaatacactataa

SEQ ID NO: 167909 - DNA, 20 bp, Artificial Sequence
  Synthetic oligonucleotide; AAG chr2 60534438 60534457 60534454 +
cttaatacactataatagcc

SEQ ID NO: 167910 - DNA, 20 bp, Artificial Sequence
  Synthetic oligonucleotide; AGG chr2 60534439 60534458 60534455 +
ttaatacactataatagcca

SEQ ID NO: 167911 - DNA, 20 bp, Artificial Sequence
  Synthetic oligonucleotide; TGG chr2 60534489 60534508 60534505 +
aaactgccctgcaatgttcg

SEQ ID NO: 167912 - DNA, 20 bp, Artificial Sequence
  Synthetic oligonucleotide; GGG chr2 60534490 60534509 60534506 +
aactgccctgcaatgttcgt

SEQ ID NO: 167913 - DNA, 20 bp, Artificial Sequence
  Synthetic oligonucleotide; GGG chr2 60534491 60534510 60534507 +
actgccctgcaatgttcgtg

SEQ ID NO: 167914 - DNA, 20 bp, Artificial Sequence
  Synthetic oligonucleotide; CAG chr2 60534496 60534515 60534512 +
cctgcaatgttcgtggggaa

SEQ ID NO: 167915 - DNA, 20 bp, Artificial Sequence
  Synthetic oligonucleotide; CAG chr2 60534502 60534521 60534518 +
atgttcgtggggaacagaaa

SEQ ID NO: 167916 - DNA, 20 bp, Artificial Sequence
  Synthetic oligonucleotide; AGG chr2 60534503 60534522 60534519 +
tgttcgtggggaacagaaac

SEQ ID NO: 167917 - DNA, 20 bp, Artificial Sequence
  Synthetic oligonucleotide; TGG chr2 60534529 60534548 60534545 +
tacatatttctctatgtatc

SEQ ID NO: 167918 - DNA, 20 bp, Artificial Sequence
  Synthetic oligonucleotide; AAG chr2 60534532 60534551 60534548 +
atatttctctatgtatctgg

SEQ ID NO: 167919 - DNA, 20 bp, Artificial Sequence
  Synthetic oligonucleotide; CAG chr2 60534561 60534580 60534577 +
aatcatatacttaaatttta

SEQ ID NO: 167920 - DNA, 20 bp, Artificial Sequence
  Synthetic oligonucleotide; GAG chr2 60534578 60534597 60534594 +
ttacagtcttctccccaaat

SEQ ID NO: 167921 - DNA, 20 bp, Artificial Sequence
  Synthetic oligonucleotide; CAG chr2 60534590 60534609 60534606 +
ccccaaatgagaacgatttc

SEQ ID NO: 167922 - DNA, 20 bp, Artificial Sequence
  Synthetic oligonucleotide; AAG chr2 60534625 60534644 60534641 +
caaactgtacttaacgttaa

SEQ ID NO: 167923 - DNA, 20 bp, Artificial Sequence
  Synthetic oligonucleotide; CGG chr2 60534632 60534651 60534648 +
tacttaacgttaaaagaaaa

SEQ ID NO: 167924 - DNA, 20 bp, Artificial Sequence
  Synthetic oligonucleotide; AAG chr2 60534656 60534675 60534672 +
taaaacatatgtaattactc

SEQ ID NO: 167925 - DNA, 20 bp, Artificial Sequence
  Synthetic oligonucleotide; AGG chr2 60534657 60534676 60534673 +
aaaacatatgtaattactca

SEQ ID NO: 167926 - DNA, 20 bp, Artificial Sequence
  Synthetic oligonucleotide; TAG chr2 60534661 60534680 60534677 +
catatgtaattactcaaggt

SEQ ID NO: 167927 - DNA, 20 bp, Artificial Sequence
  Synthetic oligonucleotide; AAG chr2 60534687 60534706 60534703 +
tctaattcctcaattcacta

SEQ ID NO: 167928 - DNA, 20 bp, Artificial Sequence
  Synthetic oligonucleotide; AGG chr2 60534688 60534707 60534704 +
ctaattcctcaattcactaa

SEQ ID NO: 167929 - DNA, 20 bp, Artificial Sequence
  Synthetic oligonucleotide; TGG chr2 60534696 60534715 60534712 +
tcaattcactaaaggaaact

SEQ ID NO: 167930 - DNA, 20 bp, Artificial Sequence
  Synthetic oligonucleotide; AAG chr2 60534700 60534719 60534716 +
ttcactaaaggaaacttggc

SEQ ID NO: 167931 - DNA, 20 bp, Artificial Sequence
  Synthetic oligonucleotide; AAG chr2 60534703 60534722 60534719 +
actaaaggaaacttggcaag

SEQ ID NO: 167932 - DNA, 20 bp, Artificial Sequence
  Synthetic oligonucleotide; TGG chr2 60534730 60534749 60534746 +
atcattttgctcctttctac

SEQ ID NO: 167933 - DNA, 20 bp, Artificial Sequence
  Synthetic oligonucleotide; GGG chr2 60534731 60534750 60534747 +
tcattttgctcctttctact

SEQ ID NO: 167934 - DNA, 20 bp, Artificial Sequence
  Synthetic oligonucleotide; GGG chr2 60534732 60534751 60534748 +
cattttgctcctttctactg

SEQ ID NO: 167935 - DNA, 20 bp, Artificial Sequence
  Synthetic oligonucleotide; GAG chr2 60534740 60534759 60534756 +
tcctttctactggggcatct

SEQ ID NO: 167936 - DNA, 20 bp, Artificial Sequence
  Synthetic oligonucleotide; AGG chr2 60534741 60534760 60534757 +
cctttctactggggcatctg

SEQ ID NO: 167937 - DNA, 20 bp, Artificial Sequence
  Synthetic oligonucleotide; GAG chr2 60534743 60534762 60534759 +
tttctactggggcatctgag

SEQ ID NO: 167938 - DNA, 20 bp, Artificial Sequence
  Synthetic oligonucleotide; AGG chr2 60534744 60534763 60534760 +
ttctactggggcatctgagg

SEQ ID NO: 167939 - DNA, 20 bp, Artificial Sequence
  Synthetic oligonucleotide; GAG chr2 60534746 60534765 60534762 +
ctactggggcatctgaggag

SEQ ID NO: 167940 - DNA, 20 bp, Artificial Sequence
  Synthetic oligonucleotide; GAG chr2 60534748 60534767 60534764 +
actggggcatctgaggagga

SEQ ID NO: 167941 - DNA, 20 bp, Artificial Sequence
  Synthetic oligonucleotide; GAG chr2 60534756 60534775 60534772 +
atctgaggaggagagccact

SEQ ID NO: 167942 - DNA, 20 bp, Artificial Sequence
  Synthetic oligonucleotide; AGG chr2 60534757 60534776 60534773 +
tctgaggaggagagccactg

SEQ ID NO: 167943 - DNA, 20 bp, Artificial Sequence
  Synthetic oligonucleotide; CAG chr2 60534760 60534779 60534776 +
gaggaggagagccactgagg

SEQ ID NO: 167944 - DNA, 20 bp, Artificial Sequence
  Synthetic oligonucleotide; AAG chr2 60534785 60534804 60534801 +
aatacacaaaacatgatcaa

SEQ ID NO: 167945 - DNA, 20 bp, Artificial Sequence
  Synthetic oligonucleotide; CAG chr2 60534798 60534817 60534814 +
tgatcaaaagtgattaacaa

SEQ ID NO: 167946 - DNA, 20 bp, Artificial Sequence
  Synthetic oligonucleotide; AAG chr2 60534825 60534844 60534841 +
atatgcaaattacattaatg

SEQ ID NO: 167947 - DNA, 20 bp, Artificial Sequence
  Synthetic oligonucleotide; AGG chr2 60534826 60534845 60534842 +
tatgcaaattacattaatga

SEQ ID NO: 167948 - DNA, 20 bp, Artificial Sequence
  Synthetic oligonucleotide; GAG chr2 60534828 60534847 60534844 +
tgcaaattacattaatgaag

SEQ ID NO: 167949 - DNA, 20 bp, Artificial Sequence
  Synthetic oligonucleotide; AAG chr2 60534835 60534854 60534851 +
tacattaatgaaggagtgca

SEQ ID NO: 167950 - DNA, 20 bp, Artificial Sequence
  Synthetic oligonucleotide; TGG chr2 60534869 60534888 60534885 +
attaaatatgtcaaatctct

SEQ ID NO: 167951 - DNA, 20 bp, Artificial Sequence
  Synthetic oligonucleotide; GAG chr2 60534887 60534906 60534903 +
cttggtgaacttttaatctt

SEQ ID NO: 167952 - DNA, 20 bp, Artificial Sequence
  Synthetic oligonucleotide; AAG chr2 60534890 60534909 60534906 +
ggtgaacttttaatcttgag

SEQ ID NO: 167953 - DNA, 20 bp, Artificial Sequence
  Synthetic oligonucleotide; AAG chr2 60534933 60534952 60534949 +
ttttacatcatcaattttgc

SEQ ID NO: 167954 - DNA, 20 bp, Artificial Sequence
  Synthetic oligonucleotide; AAG chr2 60534947 60534966 60534963 +
ttttgcaagattgaaaatct

SEQ ID NO: 167955 - DNA, 20 bp, Artificial Sequence
  Synthetic oligonucleotide; TGG chr2 60534955 60534974 60534971 +
gattgaaaatctaagaatct

SEQ ID NO: 167956 - DNA, 20 bp, Artificial Sequence
  Synthetic oligonucleotide; CAG chr2 60534992 60535011 60535008 +
ttcaccttttttttctcctt

SEQ ID NO: 167957 - DNA, 20 bp, Artificial Sequence
  Synthetic oligonucleotide; CAG chr2 60534995 60535014 60535011 +
accttttttttctccttcag

SEQ ID NO: 167958 - DNA, 20 bp, Artificial Sequence
  Synthetic oligonucleotide; AGG chr2 60534996 60535015 60535012 +
ccttttttttctccttcagc

SEQ ID NO: 167959 - DNA, 20 bp, Artificial Sequence
  Synthetic oligonucleotide; CAG chr2 60535003 60535022 60535019 +
tttctccttcagcaggctga

SEQ ID NO: 167960 - DNA, 20 bp, Artificial Sequence
  Synthetic oligonucleotide; AGG chr2 60535004 60535023 60535020 +
ttctccttcagcaggctgac

SEQ ID NO: 167961 - DNA, 20 bp, Artificial Sequence
  Synthetic oligonucleotide; CAG chr2 60535008 60535027 60535024 +
ccttcagcaggctgacaggc

SEQ ID NO: 167962 - DNA, 20 bp, Artificial Sequence
  Synthetic oligonucleotide; TAG chr2 60535039 60535058 60535055 +
gcaccgaatgtacatgttaa

SEQ ID NO: 167963 - DNA, 20 bp, Artificial Sequence
  Synthetic oligonucleotide; AGG chr2 60535040 60535059 60535056 +
caccgaatgtacatgttaat

SEQ ID NO: 167964 - DNA, 20 bp, Artificial Sequence
  Synthetic oligonucleotide; TGG chr2 60535075 60535094 60535091 +
gcaaaacaattcgcaattac

SEQ ID NO: 167965 - DNA, 20 bp, Artificial Sequence
  Synthetic oligonucleotide; AAG chr2 60535078 60535097 60535094 +
aaacaattcgcaattactgg

SEQ ID NO: 167966 - DNA, 20 bp, Artificial Sequence
  Synthetic oligonucleotide; AGG chr2 60535079 60535098 60535095 +
aacaattcgcaattactgga

SEQ ID NO: 167967 - DNA, 20 bp, Artificial Sequence
  Synthetic oligonucleotide; TGG chr2 60535088 60535107 60535104 +
caattactggaaggacctaa

SEQ ID NO: 167968 - DNA, 20 bp, Artificial Sequence
  Synthetic oligonucleotide; TAG chr2 60535095 60535114 60535111 +
tggaaggacctaatggtcat

SEQ ID NO: 167969 - DNA, 20 bp, Artificial Sequence
  Synthetic oligonucleotide; TAG chr2 60535108 60535127 60535124 +
tggtcattagaatttacaac

SEQ ID NO: 167970 - DNA, 20 bp, Artificial Sequence
  Synthetic oligonucleotide; AGG chr2 60535109 60535128 60535125 +
ggtcattagaatttacaact

SEQ ID NO: 167971 - DNA, 20 bp, Artificial Sequence
  Synthetic oligonucleotide; AAG chr2 60535122 60535141 60535138 +
tacaactaggtaatgaactg

SEQ ID NO: 167972 - DNA, 20 bp, Artificial Sequence
  Synthetic oligonucleotide; AAG chr2 60535150 60535169 60535166 +
ccacaccatgcatattcata

SEQ ID NO: 167973 - DNA, 20 bp, Artificial Sequence
  Synthetic oligonucleotide; TAG chr2 60535158 60535177 60535174 +
tgcatattcataaagcaatt

SEQ ID NO: 167974 - DNA, 20 bp, Artificial Sequence
  Synthetic oligonucleotide; AAG chr2 60535167 60535186 60535183 +
ataaagcaatttagcctttg

SEQ ID NO: 167975 - DNA, 20 bp, Artificial Sequence
  Synthetic oligonucleotide; AAG chr2 60535174 60535193 60535190 +
aatttagcctttgaagatta

SEQ ID NO: 167976 - DNA, 20 bp, Artificial Sequence
  Synthetic oligonucleotide; AAG chr2 60535177 60535196 60535193 +
ttagcctttgaagattaaag

SEQ ID NO: 167977 - DNA, 20 bp, Artificial Sequence
  Synthetic oligonucleotide; GAG chr2 60535196 60535215 60535212 +
gaagtgcttaaaattcaaat

SEQ ID NO: 167978 - DNA, 20 bp, Artificial Sequence
  Synthetic oligonucleotide; TAG chr2 60535202 60535221 60535218 +
cttaaaattcaaatgagctt

SEQ ID NO: 167979 - DNA, 20 bp, Artificial Sequence
  Synthetic oligonucleotide; CAG chr2 60535213 60535232 60535229 +
aatgagctttagcaaattat

SEQ ID NO: 167980 - DNA, 20 bp, Artificial Sequence
  Synthetic oligonucleotide; AAG chr2 60535217 60535236 60535233 +
agctttagcaaattatcagt

SEQ ID NO: 167981 - DNA, 20 bp, Artificial Sequence
  Synthetic oligonucleotide; AAG chr2 60535231 60535250 60535247 +
atcagtaagattcatccaaa

SEQ ID NO: 167982 - DNA, 20 bp, Artificial Sequence
  Synthetic oligonucleotide; AAG chr2 60535236 60535255 60535252 +
taagattcatccaaaaagca

SEQ ID NO: 167983 - DNA, 20 bp, Artificial Sequence
  Synthetic oligonucleotide; AGG chr2 60535237 60535256 60535253 +
aagattcatccaaaaagcaa

SEQ ID NO: 167984 - DNA, 20 bp, Artificial Sequence
  Synthetic oligonucleotide; GGG chr2 60535238 60535257 60535254 +
agattcatccaaaaagcaaa

SEQ ID NO: 167985 - DNA, 20 bp, Artificial Sequence
  Synthetic oligonucleotide; CAG chr2 60535293 60535312 60535309 +
tgcaaaattgtaatatcttc

SEQ ID NO: 167986 - DNA, 20 bp, Artificial Sequence
  Synthetic oligonucleotide; GAG chr2 60535299 60535318 60535315 +
attgtaatatcttccagact

SEQ ID NO: 167987 - DNA, 20 bp, Artificial Sequence
  Synthetic oligonucleotide; TAG chr2 60535315 60535334 60535331 +
gactgagcttaaactaaaca

SEQ ID NO: 167988 - DNA, 20 bp, Artificial Sequence
  Synthetic oligonucleotide; GAG chr2 60535317 60535336 60535333 +
ctgagcttaaactaaacata

SEQ ID NO: 167989 - DNA, 20 bp, Artificial Sequence
  Synthetic oligonucleotide; TAG chr2 60535324 60535343 60535340 +
taaactaaacatagagcttc

SEQ ID NO: 167990 - DNA, 20 bp, Artificial Sequence
  Synthetic oligonucleotide; AAG chr2 60535329 60535348 60535345 +
taaacatagagcttctagtc

SEQ ID NO: 167991 - DNA, 20 bp, Artificial Sequence
  Synthetic oligonucleotide; AAG chr2 60535335 60535354 60535351 +
tagagcttctagtcaagcca

SEQ ID NO: 167992 - DNA, 20 bp, Artificial Sequence
  Synthetic oligonucleotide; AGG chr2 60535336 60535355 60535352 +
agagcttctagtcaagccaa

SEQ ID NO: 167993 - DNA, 20 bp, Artificial Sequence
  Synthetic oligonucleotide; GGG chr2 60535337 60535356 60535353 +
gagcttctagtcaagccaaa

SEQ ID NO: 167994 - DNA, 20 bp, Artificial Sequence
  Synthetic oligonucleotide; GGG chr2 60535338 60535357 60535354 +
agcttctagtcaagccaaag

SEQ ID NO: 167995 - DNA, 20 bp, Artificial Sequence
  Synthetic oligonucleotide; AAG chr2 60535343 60535362 60535359 +
ctagtcaagccaaaggggct

SEQ ID NO: 167996 - DNA, 20 bp, Artificial Sequence
  Synthetic oligonucleotide; CAG chr2 60535353 60535372 60535369 +
caaaggggctaagatacaaa

SEQ ID NO: 167997 - DNA, 20 bp, Artificial Sequence
  Synthetic oligonucleotide; GAG chr2 60535355 60535374 60535371 +
aaggggctaagatacaaaca

SEQ ID NO: 167998 - DNA, 20 bp, Artificial Sequence
  Synthetic oligonucleotide; AGG chr2 60535356 60535375 60535372 +
aggggctaagatacaaacag

SEQ ID NO: 167999 - DNA, 20 bp, Artificial Sequence
  Synthetic oligonucleotide; CGG chr2 60535374 60535393 60535390 +
agaggctgcaaacatcgtca

SEQ ID NO: 168000 - DNA, 20 bp, Artificial Sequence
  Synthetic oligonucleotide; AAG chr2 60535394 60535413 60535410 +
cggactttgttcataaaact

SEQ ID NO: 168001 - DNA, 20 bp, Artificial Sequence
  Synthetic oligonucleotide; AAG chr2 60535402 60535421 60535418 +
gttcataaaactaagccctt

SEQ ID NO: 168002 - DNA, 20 bp, Artificial Sequence
  Synthetic oligonucleotide; GAG chr2 60535404 60535423 60535420 +
tcataaaactaagcccttaa

SEQ ID NO: 168003 - DNA, 20 bp, Artificial Sequence
  Synthetic oligonucleotide; TGG chr2 60535426 60535445 60535442 +
gccaaacctatctctaaaca

SEQ ID NO: 168004 - DNA, 20 bp, Artificial Sequence
  Synthetic oligonucleotide; CAG chr2 60535443 60535462 60535459 +
acatggtaatttatcaaaaa

SEQ ID NO: 168005 - DNA, 20 bp, Artificial Sequence
  Synthetic oligonucleotide; CAG chr2 60535448 60535467 60535464 +
gtaatttatcaaaaacagcc

SEQ ID NO: 168006 - DNA, 20 bp, Artificial Sequence
  Synthetic oligonucleotide; GAG chr2 60535450 60535469 60535466 +
aatttatcaaaaacagccca

SEQ ID NO: 168007 - DNA, 20 bp, Artificial Sequence
  Synthetic oligonucleotide; TAG chr2 60535460 60535479 60535476 +
aaacagcccagagtcgctca

SEQ ID NO: 168008 - DNA, 20 bp, Artificial Sequence
  Synthetic oligonucleotide; AGG chr2 60535461 60535480 60535477 +
aacagcccagagtcgctcat

SEQ ID NO: 168009 - DNA, 20 bp, Artificial Sequence
  Synthetic oligonucleotide; TAG chr2 60535474 60535493 60535490 +
cgctcataggcaatactgca

SEQ ID NO: 168010 - DNA, 20 bp, Artificial Sequence
  Synthetic oligonucleotide; CAG chr2 60535485 60535504 60535501 +
aatactgcatagtcctccaa

SEQ ID NO: 168011 - DNA, 20 bp, Artificial Sequence
  Synthetic oligonucleotide; CAG chr2 60535490 60535509 60535506 +
tgcatagtcctccaacagaa

SEQ ID NO: 168012 - DNA, 20 bp, Artificial Sequence
  Synthetic oligonucleotide; GAG chr2 60535501 60535520 60535517 +
ccaacagaacagattaacac

SEQ ID NO: 168013 - DNA, 20 bp, Artificial Sequence
  Synthetic oligonucleotide; AAG chr2 60535522 60535541 60535538 +
agtccctccacccttccaaa

SEQ ID NO: 168014 - DNA, 20 bp, Artificial Sequence
  Synthetic oligonucleotide; AAG chr2 60535538 60535557 60535554 +
caaaaagccttttccccctc

SEQ ID NO: 168015 - DNA, 20 bp, Artificial Sequence
  Synthetic oligonucleotide; TGG chr2 60535568 60535587 60535584 +
tcctgtgtaaacatccactg

SEQ ID NO: 168016 - DNA, 20 bp, Artificial Sequence
  Synthetic oligonucleotide; CAG chr2 60535579 60535598 60535595 +
catccactgtggtataaaaa

SEQ ID NO: 168017 - DNA, 20 bp, Artificial Sequence
  Synthetic oligonucleotide; TGG chr2 60535591 60535610 60535607 +
tataaaaacagctttttcat

SEQ ID NO: 168018 - DNA, 20 bp, Artificial Sequence
  Synthetic oligonucleotide; TGG chr2 60535596 60535615 60535612 +
aaacagctttttcattggct

SEQ ID NO: 168019 - DNA, 20 bp, Artificial Sequence
  Synthetic oligonucleotide; GAG chr2 60535598 60535617 60535614 +
acagctttttcattggcttg

SEQ ID NO: 168020 - DNA, 20 bp, Artificial Sequence
  Synthetic oligonucleotide; TGG chr2 60535601 60535620 60535617 +
gctttttcattggcttggag

SEQ ID NO: 168021 - DNA, 20 bp, Artificial Sequence
  Synthetic oligonucleotide; TAG chr2 60535613 60535632 60535629 +
gcttggagtggcattaattt

SEQ ID NO: 168022 - DNA, 20 bp, Artificial Sequence
  Synthetic oligonucleotide; AAG chr2 60535616 60535635 60535632 +
tggagtggcattaattttag

SEQ ID NO: 168023 - DNA, 20 bp, Artificial Sequence
  Synthetic oligonucleotide; AAG chr2 60535631 60535650 60535647 +
tttagaagtttctgcttcca

SEQ ID NO: 168024 - DNA, 20 bp, Artificial Sequence
  Synthetic oligonucleotide; AGG chr2 60535632 60535651 60535648 +
ttagaagtttctgcttccaa

SEQ ID NO: 168025 - DNA, 20 bp, Artificial Sequence
  Synthetic oligonucleotide; GGG chr2 60535633 60535652 60535649 +
tagaagtttctgcttccaaa

SEQ ID NO: 168026 - DNA, 20 bp, Artificial Sequence
  Synthetic oligonucleotide; CAG chr2 60535640 60535659 60535656 +
ttctgcttccaaagggaaac

SEQ ID NO: 168027 - DNA, 20 bp, Artificial Sequence
  Synthetic oligonucleotide; AAG chr2 60535644 60535663 60535660 +
gcttccaaagggaaaccagc

SEQ ID NO: 168028 - DNA, 20 bp, Artificial Sequence
  Synthetic oligonucleotide; AAG chr2 60535648 60535667 60535664 +
ccaaagggaaaccagcaaga

SEQ ID NO: 168029 - DNA, 20 bp, Artificial Sequence
  Synthetic oligonucleotide; AGG chr2 60535649 60535668 60535665 +
caaagggaaaccagcaagaa

SEQ ID NO: 168030 - DNA, 20 bp, Artificial Sequence
  Synthetic oligonucleotide; GAG chr2 60535651 60535670 60535667 +
aagggaaaccagcaagaaag

SEQ ID NO: 168031 - DNA, 20 bp, Artificial Sequence
  Synthetic oligonucleotide; AAG chr2 60535654 60535673 60535670 +
ggaaaccagcaagaaaggag

SEQ ID NO: 168032 - DNA, 20 bp, Artificial Sequence
  Synthetic oligonucleotide; CAG chr2 60535659 60535678 60535675 +
ccagcaagaaaggagaagca

SEQ ID NO: 168033 - DNA, 20 bp, Artificial Sequence
  Synthetic oligonucleotide; AGG chr2 60535660 60535679 60535676 +
cagcaagaaaggagaagcac

SEQ ID NO: 168034 - DNA, 20 bp, Artificial Sequence
  Synthetic oligonucleotide; GAG chr2 60535662 60535681 60535678 +
gcaagaaaggagaagcacag

SEQ ID NO: 168035 - DNA, 20 bp, Artificial Sequence
  Synthetic oligonucleotide; AGG chr2 60535663 60535682 60535679 +
caagaaaggagaagcacagg

SEQ ID NO: 168036 - DNA, 20 bp, Artificial Sequence
  Synthetic oligonucleotide; GGG chr2 60535664 60535683 60535680 +
aagaaaggagaagcacagga

SEQ ID NO: 168037 - DNA, 20 bp, Artificial Sequence
  Synthetic oligonucleotide; GAG chr2 60535666 60535685 60535682 +
gaaaggagaagcacaggagg

SEQ ID NO: 168038 - DNA, 20 bp, Artificial Sequence
  Synthetic oligonucleotide; GAG chr2 60535668 60535687 60535684 +
aaggagaagcacaggaggga

SEQ ID NO: 168039 - DNA, 20 bp, Artificial Sequence
  Synthetic oligonucleotide; AGG chr2 60535669 60535688 60535685 +
aggagaagcacaggagggag

SEQ ID NO: 168040 - DNA, 20 bp, Artificial Sequence
  Synthetic oligonucleotide; GAG chr2 60535671 60535690 60535687 +
gagaagcacaggagggagag

SEQ ID NO: 168041 - DNA, 20 bp, Artificial Sequence
  Synthetic oligonucleotide; AAG chr2 60535675 60535694 60535691 +
agcacaggagggagaggagc

SEQ ID NO: 168042 - DNA, 20 bp, Artificial Sequence
  Synthetic oligonucleotide; AGG chr2 60535676 60535695 60535692 +
gcacaggagggagaggagca

SEQ ID NO: 168043 - DNA, 20 bp, Artificial Sequence
  Synthetic oligonucleotide; TGG chr2 60535681 60535700 60535697 +
ggagggagaggagcaaggtc

SEQ ID NO: 168044 - DNA, 20 bp, Artificial Sequence
  Synthetic oligonucleotide; GAG chr2 60535693 60535712 60535709 +
gcaaggtctggtttacttct

SEQ ID NO: 168045 - DNA, 20 bp, Artificial Sequence
  Synthetic oligonucleotide; AGG chr2 60535694 60535713 60535710 +
caaggtctggtttacttctg

SEQ ID NO: 168046 - DNA, 20 bp, Artificial Sequence
  Synthetic oligonucleotide; GAG chr2 60535696 60535715 60535712 +
aggtctggtttacttctgag

SEQ ID NO: 168047 - DNA, 20 bp, Artificial Sequence
  Synthetic oligonucleotide; GAG chr2 60535716 60535735 60535732 +
gagtgcaaatcctgttgctt

SEQ ID NO: 168048 - DNA, 20 bp, Artificial Sequence
  Synthetic oligonucleotide; CGG chr2 60535744 60535763 60535760 +
cctttctgatttcctccatt

SEQ ID NO: 168049 - DNA, 20 bp, Artificial Sequence
  Synthetic oligonucleotide; CAG chr2 60535750 60535769 60535766 +
tgatttcctccattcggcac

SEQ ID NO: 168050 - DNA, 20 bp, Artificial Sequence
  Synthetic oligonucleotide; TGG chr2 60535767 60535786 60535783 +
caccagccgcatttaatcca

SEQ ID NO: 168051 - DNA, 20 bp, Artificial Sequence
  Synthetic oligonucleotide; CGG chr2 60535774 60535793 60535790 +
cgcatttaatccatggtgaa

SEQ ID NO: 168052 - DNA, 20 bp, Artificial Sequence
  Synthetic oligonucleotide; GGG chr2 60535775 60535794 60535791 +
gcatttaatccatggtgaac

SEQ ID NO: 168053 - DNA, 20 bp, Artificial Sequence
  Synthetic oligonucleotide; CAG chr2 60535783 60535802 60535799 +
tccatggtgaacgggtcatg

SEQ ID NO: 168054 - DNA, 20 bp, Artificial Sequence
  Synthetic oligonucleotide; CAG chr2 60535790 60535809 60535806 +
tgaacgggtcatgcagacat

SEQ ID NO: 168055 - DNA, 20 bp, Artificial Sequence
  Synthetic oligonucleotide; CAG chr2 60535801 60535820 60535817 +
tgcagacatcagctgacatt

SEQ ID NO: 168056 - DNA, 20 bp, Artificial Sequence
  Synthetic oligonucleotide; AAG chr2 60535805 60535824 60535821 +
gacatcagctgacattcaga

SEQ ID NO: 168057 - DNA, 20 bp, Artificial Sequence
  Synthetic oligonucleotide; TGG chr2 60535811 60535830 60535827 +
agctgacattcagaaagttg

SEQ ID NO: 168058 - DNA, 20 bp, Artificial Sequence
  Synthetic oligonucleotide; CAG chr2 60535841 60535860 60535857 +
ccaccaccaccatcccaccc

SEQ ID NO: 168059 - DNA, 20 bp, Artificial Sequence
  Synthetic oligonucleotide; TAG chr2 60535848 60535867 60535864 +
caccatcccaccccagttat

SEQ ID NO: 168060 - DNA, 20 bp, Artificial Sequence
  Synthetic oligonucleotide; GAG chr2 60535850 60535869 60535866 +
ccatcccaccccagttatta

SEQ ID NO: 168061 - DNA, 20 bp, Artificial Sequence
  Synthetic oligonucleotide; GAG chr2 60535852 60535871 60535868 +
atcccaccccagttattaga

SEQ ID NO: 168062 - DNA, 20 bp, Artificial Sequence
  Synthetic oligonucleotide; TGG chr2 60535860 60535879 60535876 +
ccagttattagagagtatcg

SEQ ID NO: 168063 - DNA, 20 bp, Artificial Sequence
  Synthetic oligonucleotide; GGG chr2 60535861 60535880 60535877 +
cagttattagagagtatcgt

SEQ ID NO: 168064 - DNA, 20 bp, Artificial Sequence
  Synthetic oligonucleotide; TGG chr2 60535868 60535887 60535884 +
tagagagtatcgtgggaacc

SEQ ID NO: 168065 - DNA, 20 bp, Artificial Sequence
  Synthetic oligonucleotide; CAG chr2 60535876 60535895 60535892 +
atcgtgggaacctggatttg

SEQ ID NO: 168066 - DNA, 20 bp, Artificial Sequence
  Synthetic oligonucleotide; AGG chr2 60535877 60535896 60535893 +
tcgtgggaacctggatttgc

SEQ ID NO: 168067 - DNA, 20 bp, Artificial Sequence
  Synthetic oligonucleotide; TAG chr2 60535892 60535911 60535908 +
tttgcaggctttccaattac

SEQ ID NO: 168068 - DNA, 20 bp, Artificial Sequence
  Synthetic oligonucleotide; TGG chr2 60535897 60535916 60535913 +
aggctttccaattactagtc

SEQ ID NO: 168069 - DNA, 20 bp, Artificial Sequence
  Synthetic oligonucleotide; GAG chr2 60535899 60535918 60535915 +
gctttccaattactagtctg

SEQ ID NO: 168070 - DNA, 20 bp, Artificial Sequence
  Synthetic oligonucleotide; AAG chr2 60535902 60535921 60535918 +
ttccaattactagtctggag

SEQ ID NO: 168071 - DNA, 20 bp, Artificial Sequence
  Synthetic oligonucleotide; TAG chr2 60535963 60535982 60535979 +
tcctgacatttaaaaaattc

SEQ ID NO: 168072 - DNA, 20 bp, Artificial Sequence
  Synthetic oligonucleotide; CAG chr2 60535969 60535988 60535985 +
catttaaaaaattctagtga

SEQ ID NO: 168073 - DNA, 20 bp, Artificial Sequence
  Synthetic oligonucleotide; CAG chr2 60536021 60536040 60536037 +
caaccccaacctctccaacc

SEQ ID NO: 168074 - DNA, 20 bp, Artificial Sequence
  Synthetic oligonucleotide; AGG chr2 60536022 60536041 60536038 +
aaccccaacctctccaaccc

SEQ ID NO: 168075 - DNA, 20 bp, Artificial Sequence
  Synthetic oligonucleotide; AAG chr2 60536028 60536047 60536044 +
aacctctccaacccaggtga

SEQ ID NO: 168076 - DNA, 20 bp, Artificial Sequence
  Synthetic oligonucleotide; AAG chr2 60536032 60536051 60536048 +
tctccaacccaggtgaaagc

SEQ ID NO: 168077 - DNA, 20 bp, Artificial Sequence
  Synthetic oligonucleotide; AAG chr2 60536036 60536055 60536052 +
caacccaggtgaaagcaaga

SEQ ID NO: 168078 - DNA, 20 bp, Artificial Sequence
  Synthetic oligonucleotide; AAG chr2 60536047 60536066 60536063 +
aaagcaagaaagtatatgtt

SEQ ID NO: 168079 - DNA, 20 bp, Artificial Sequence
  Synthetic oligonucleotide; CAG chr2 60536058 60536077 60536074 +
gtatatgttaagtcctatct

SEQ ID NO: 168080 - DNA, 20 bp, Artificial Sequence
  Synthetic oligonucleotide; TGG chr2 60536062 60536081 60536078 +
atgttaagtcctatctcagc

SEQ ID NO: 168081 - DNA, 20 bp, Artificial Sequence
  Synthetic oligonucleotide; AAG chr2 60536070 60536089 60536086 +
tcctatctcagctggtgtgc

SEQ ID NO: 168082 - DNA, 20 bp, Artificial Sequence
  Synthetic oligonucleotide; CAG chr2 60536074 60536093 60536090 +
atctcagctggtgtgcaagt

SEQ ID NO: 168083 - DNA, 20 bp, Artificial Sequence
  Synthetic oligonucleotide; GAG chr2 60536080 60536099 60536096 +
gctggtgtgcaagtcagact

SEQ ID NO: 168084 - DNA, 20 bp, Artificial Sequence
  Synthetic oligonucleotide; CAG chr2 60536088 60536107 60536104 +
gcaagtcagactgagaataa

SEQ ID NO: 168085 - DNA, 20 bp, Artificial Sequence
  Synthetic oligonucleotide; AAG chr2 60536097 60536116 60536113 +
actgagaataacagcttcga

SEQ ID NO: 168086 - DNA, 20 bp, Artificial Sequence
  Synthetic oligonucleotide; AGG chr2 60536098 60536117 60536114 +
ctgagaataacagcttcgaa

SEQ ID NO: 168087 - DNA, 20 bp, Artificial Sequence
  Synthetic oligonucleotide; CAG chr2 60536111 60536130 60536127 +
cttcgaaaggccacgtgtcc

SEQ ID NO: 168088 - DNA, 20 bp, Artificial Sequence
  Synthetic oligonucleotide; TAG chr2 60536130 60536149 60536146 +
ccagcttaccgctccactgc

SEQ ID NO: 168089 - DNA, 20 bp, Artificial Sequence
  Synthetic oligonucleotide; AAG chr2 60536139 60536158 60536155 +
cgctccactgctagacccaa

SEQ ID NO: 168090 - DNA, 20 bp, Artificial Sequence
  Synthetic oligonucleotide; TGG chr2 60536152 60536171 60536168 +
gacccaaaagctctctgctg

SEQ ID NO: 168091 - DNA, 20 bp, Artificial Sequence
  Synthetic oligonucleotide; GGG chr2 60536153 60536172 60536169 +
acccaaaagctctctgctgt

SEQ ID NO: 168092 - DNA, 20 bp, Artificial Sequence
  Synthetic oligonucleotide; GGG chr2 60536154 60536173 60536170 +
cccaaaagctctctgctgtg

SEQ ID NO: 168093 - DNA, 20 bp, Artificial Sequence
  Synthetic oligonucleotide; AAG chr2 60536178 60536197 60536194 +
tttcatttgaactgctatcg

SEQ ID NO: 168094 - DNA, 20 bp, Artificial Sequence
  Synthetic oligonucleotide; AAG chr2 60536189 60536208 60536205 +
ctgctatcgaagaatattcc

SEQ ID NO: 168095 - DNA, 20 bp, Artificial Sequence
  Synthetic oligonucleotide; CAG chr2 60536227 60536246 60536243 +
ccttctccccctctctcccc

SEQ ID NO: 168096 - DNA, 20 bp, Artificial Sequence
  Synthetic oligonucleotide; CAG chr2 60536233 60536252 60536249 +
ccccctctctcccccagcct

SEQ ID NO: 168097 - DNA, 20 bp, Artificial Sequence
  Synthetic oligonucleotide; TAG chr2 60536245 60536264 60536261 +
cccagcctcagactttctcc

SEQ ID NO: 168098 - DNA, 20 bp, Artificial Sequence
  Synthetic oligonucleotide; GAG chr2 60536247 60536266 60536263 +
cagcctcagactttctccta

SEQ ID NO: 168099 - DNA, 20 bp, Artificial Sequence
  Synthetic oligonucleotide; CGG chr2 60536260 60536279 60536276 +
tctcctagagttgatcttac

SEQ ID NO: 168100 - DNA, 20 bp, Artificial Sequence
  Synthetic oligonucleotide; TGG chr2 60536268 60536287 60536284 +
agttgatcttaccggaaatg

SEQ ID NO: 168101 - DNA, 20 bp, Artificial Sequence
  Synthetic oligonucleotide; AAG chr2 60536279 60536298 60536295 +
ccggaaatgtggatgttatc

SEQ ID NO: 168102 - DNA, 20 bp, Artificial Sequence
  Synthetic oligonucleotide; AGG chr2 60536280 60536299 60536296 +
cggaaatgtggatgttatca

SEQ ID NO: 168103 - DNA, 20 bp, Artificial Sequence
  Synthetic oligonucleotide; CGG chr2 60536287 60536306 60536303 +
gtggatgttatcaaggaaat

SEQ ID NO: 168104 - DNA, 20 bp, Artificial Sequence
  Synthetic oligonucleotide; AAG chr2 60536291 60536310 60536307 +
atgttatcaaggaaatcgga

SEQ ID NO: 168105 - DNA, 20 bp, Artificial Sequence
  Synthetic oligonucleotide; GAG chr2 60536293 60536312 60536309 +
gttatcaaggaaatcggaaa

SEQ ID NO: 168106 - DNA, 20 bp, Artificial Sequence
  Synthetic oligonucleotide; AAG chr2 60536296 60536315 60536312 +
atcaaggaaatcggaaagag

SEQ ID NO: 168107 - DNA, 20 bp, Artificial Sequence
  Synthetic oligonucleotide; AGG chr2 60536297 60536316 60536313 +
tcaaggaaatcggaaagaga

SEQ ID NO: 168108 - DNA, 20 bp, Artificial Sequence
  Synthetic oligonucleotide; GGG chr2 60536298 60536317 60536314 +
caaggaaatcggaaagagaa

SEQ ID NO: 168109 - DNA, 20 bp, Artificial Sequence
  Synthetic oligonucleotide; GAG chr2 60536300 60536319 60536316 +
aggaaatcggaaagagaagg

SEQ ID NO: 168110 - DNA, 20 bp, Artificial Sequence
  Synthetic oligonucleotide; CAG chr2 60536311 60536330 60536327 +
aagagaagggagaaaaatct

SEQ ID NO: 168111 - DNA, 20 bp, Artificial Sequence
  Synthetic oligonucleotide; AGG chr2 60536312 60536331 60536328 +
agagaagggagaaaaatctc

SEQ ID NO: 168112 - DNA, 20 bp, Artificial Sequence
  Synthetic oligonucleotide; TGG chr2 60536348 60536367 60536364 +
tttcttaactctcttatcct

SEQ ID NO: 168113 - DNA, 20 bp, Artificial Sequence
  Synthetic oligonucleotide; GGG chr2 60536349 60536368 60536365 +
ttcttaactctcttatcctt

SEQ ID NO: 168114 - DNA, 20 bp, Artificial Sequence
  Synthetic oligonucleotide; CAG chr2 60536359 60536378 60536375 +
tcttatccttgggccctgct

SEQ ID NO: 168115 - DNA, 20 bp, Artificial Sequence
  Synthetic oligonucleotide; TAG chr2 60536387 60536406 60536403 +
tgccacattttaacatttat

SEQ ID NO: 168116 - DNA, 20 bp, Artificial Sequence
  Synthetic oligonucleotide; AAG chr2 60536391 60536410 60536407 +
acattttaacatttattaga

SEQ ID NO: 168117 - DNA, 20 bp, Artificial Sequence
  Synthetic oligonucleotide; AGG chr2 60536392 60536411 60536408 +
cattttaacatttattagaa

SEQ ID NO: 168118 - DNA, 20 bp, Artificial Sequence
  Synthetic oligonucleotide; TAG chr2 60536396 60536415 60536412 +
ttaacatttattagaaagga

SEQ ID NO: 168119 - DNA, 20 bp, Artificial Sequence
  Synthetic oligonucleotide; AGG chr2 60536397 60536416 60536413 +
taacatttattagaaaggat

SEQ ID NO: 168120 - DNA, 20 bp, Artificial Sequence
  Synthetic oligonucleotide; CAG chr2 60536403 60536422 60536419 +
ttattagaaaggataggatg

SEQ ID NO: 168121 - DNA, 20 bp, Artificial Sequence
  Synthetic oligonucleotide; GAG chr2 60536405 60536424 60536421 +
attagaaaggataggatgca

SEQ ID NO: 168122 - DNA, 20 bp, Artificial Sequence
  Synthetic oligonucleotide; TGG chr2 60536413 60536432 60536429 +
ggataggatgcagagctgca

SEQ ID NO: 168123 - DNA, 20 bp, Artificial Sequence
  Synthetic oligonucleotide; GAG chr2 60536441 60536460 60536457 +
acatccacaaccatctgtat

SEQ ID NO: 168124 - DNA, 20 bp, Artificial Sequence
  Synthetic oligonucleotide; CAG chr2 60536447 60536466 60536463 +
acaaccatctgtatgagcca

SEQ ID NO: 168125 - DNA, 20 bp, Artificial Sequence
  Synthetic oligonucleotide; AGG chr2 60536448 60536467 60536464 +
caaccatctgtatgagccac

SEQ ID NO: 168126 - DNA, 20 bp, Artificial Sequence
  Synthetic oligonucleotide; CAG chr2 60536455 60536474 60536471 +
ctgtatgagccacaggtcca

SEQ ID NO: 168127 - DNA, 20 bp, Artificial Sequence
  Synthetic oligonucleotide; GAG chr2 60536497 60536516 60536513 +
acactaatgttactctacat

SEQ ID NO: 168128 - DNA, 20 bp, Artificial Sequence
  Synthetic oligonucleotide; TAG chr2 60536500 60536519 60536516 +
ctaatgttactctacatgag

SEQ ID NO: 168129 - DNA, 20 bp, Artificial Sequence
  Synthetic oligonucleotide; GAG chr2 60536502 60536521 60536518 +
aatgttactctacatgagta

SEQ ID NO: 168130 - DNA, 20 bp, Artificial Sequence
  Synthetic oligonucleotide; GAG chr2 60536511 60536530 60536527 +
ctacatgagtagagttcaat

SEQ ID NO: 168131 - DNA, 20 bp, Artificial Sequence
  Synthetic oligonucleotide; AGG chr2 60536512 60536531 60536528 +
tacatgagtagagttcaatg

SEQ ID NO: 168132 - DNA, 20 bp, Artificial Sequence
  Synthetic oligonucleotide; GGG chr2 60536513 60536532 60536529 +
acatgagtagagttcaatga

SEQ ID NO: 168133 - DNA, 20 bp, Artificial Sequence
  Synthetic oligonucleotide; TGG chr2 60536522 60536541 60536538 +
gagttcaatgagggttgata

SEQ ID NO: 168134 - DNA, 20 bp, Artificial Sequence
  Synthetic oligonucleotide; GGG chr2 60536523 60536542 60536539 +
agttcaatgagggttgatat

SEQ ID NO: 168135 - DNA, 20 bp, Artificial Sequence
  Synthetic oligonucleotide; CAG chr2 60536532 60536551 60536548 +
agggttgatatgggatgtga

SEQ ID NO: 168136 - DNA, 20 bp, Artificial Sequence
  Synthetic oligonucleotide; AGG chr2 60536533 60536552 60536549 +
gggttgatatgggatgtgac

SEQ ID NO: 168137 - DNA, 20 bp, Artificial Sequence
  Synthetic oligonucleotide; GGG chr2 60536534 60536553 60536550 +
ggttgatatgggatgtgaca

SEQ ID NO: 168138 - DNA, 20 bp, Artificial Sequence
  Synthetic oligonucleotide; CAG chr2 60536542 60536561 60536558 +
tgggatgtgacagggcaaat

SEQ ID NO: 168139 - DNA, 20 bp, Artificial Sequence
  Synthetic oligonucleotide; TAG chr2 60536548 60536567 60536564 +
gtgacagggcaaatcagaat

SEQ ID NO: 168140 - DNA, 20 bp, Artificial Sequence
  Synthetic oligonucleotide; AAG chr2 60536562 60536581 60536578 +
cagaattagattaaaaacaa

SEQ ID NO: 168141 - DNA, 20 bp, Artificial Sequence
  Synthetic oligonucleotide; TAG chr2 60536567 60536586 60536583 +
ttagattaaaaacaaaagtt

SEQ ID NO: 168142 - DNA, 20 bp, Artificial Sequence
  Synthetic oligonucleotide; CAG chr2 60536587 60536606 60536603 +
tagaaaccaatgctacacta

SEQ ID NO: 168143 - DNA, 20 bp, Artificial Sequence
  Synthetic oligonucleotide; GAG chr2 60536589 60536608 60536605 +
gaaaccaatgctacactaca

SEQ ID NO: 168144 - DNA, 20 bp, Artificial Sequence
  Synthetic oligonucleotide; TGG chr2 60536596 60536615 60536612 +
atgctacactacagagcaaa

SEQ ID NO: 168145 - DNA, 20 bp, Artificial Sequence
  Synthetic oligonucleotide; GGG chr2 60536597 60536616 60536613 +
tgctacactacagagcaaat

SEQ ID NO: 168146 - DNA, 20 bp, Artificial Sequence
  Synthetic oligonucleotide; AAG chr2 60536605 60536624 60536621 +
tacagagcaaatgggacttg

SEQ ID NO: 168147 - DNA, 20 bp, Artificial Sequence
  Synthetic oligonucleotide; AGG chr2 60536606 60536625 60536622 +
acagagcaaatgggacttga

SEQ ID NO: 168148 - DNA, 20 bp, Artificial Sequence
  Synthetic oligonucleotide; AAG chr2 60536632 60536651 60536648 +
aatttcccctaactgccttc

SEQ ID NO: 168149 - DNA, 20 bp, Artificial Sequence
  Synthetic oligonucleotide; TAG chr2 60536648 60536667 60536664 +
cttcaagtgattttccctat

SEQ ID NO: 168150 - DNA, 20 bp, Artificial Sequence
  Synthetic oligonucleotide; GAG chr2 60536650 60536669 60536666 +
tcaagtgattttccctatta

SEQ ID NO: 168151 - DNA, 20 bp, Artificial Sequence
  Synthetic oligonucleotide; TGG chr2 60536675 60536694 60536691 +
tttgcctgccacccccctgc

SEQ ID NO: 168152 - DNA, 20 bp, Artificial Sequence
  Synthetic oligonucleotide; CAG chr2 60536695 60536714 60536711 +
tggcaacaccgcaatcacat

SEQ ID NO: 168153 - DNA, 20 bp, Artificial Sequence
  Synthetic oligonucleotide; AAG chr2 60536699 60536718 60536715 +
aacaccgcaatcacatcaga

SEQ ID NO: 168154 - DNA, 20 bp, Artificial Sequence
  Synthetic oligonucleotide; AAG chr2 60536704 60536723 60536720 +
cgcaatcacatcagaaagta

SEQ ID NO: 168155 - DNA, 20 bp, Artificial Sequence
  Synthetic oligonucleotide; TGG chr2 60536707 60536726 60536723 +
aatcacatcagaaagtaaag

SEQ ID NO: 168156 - DNA, 20 bp, Artificial Sequence
  Synthetic oligonucleotide; TAG chr2 60536718 60536737 60536734 +
aaagtaaagtggaatgcata

SEQ ID NO: 168157 - DNA, 20 bp, Artificial Sequence
  Synthetic oligonucleotide; AGG chr2 60536719 60536738 60536735 +
aagtaaagtggaatgcatat

SEQ ID NO: 168158 - DNA, 20 bp, Artificial Sequence
  Synthetic oligonucleotide; AAG chr2 60536722 60536741 60536738 +
taaagtggaatgcatatagg

SEQ ID NO: 168159 - DNA, 20 bp, Artificial Sequence
  Synthetic oligonucleotide; GAG chr2 60536729 60536748 60536745 +
gaatgcatataggaagcctt

SEQ ID NO: 168160 - DNA, 20 bp, Artificial Sequence
  Synthetic oligonucleotide; TAG chr2 60536771 60536790 60536787 +
atacctatatacttaatata

SEQ ID NO: 168161 - DNA, 20 bp, Artificial Sequence
  Synthetic oligonucleotide; TGG chr2 60536785 60536804 60536801 +
aatatatagcaattaacttc

SEQ ID NO: 168162 - DNA, 20 bp, Artificial Sequence
  Synthetic oligonucleotide; CAG chr2 60536789 60536808 60536805 +
tatagcaattaacttctggt

SEQ ID NO: 168163 - DNA, 20 bp, Artificial Sequence
  Synthetic oligonucleotide; CAG chr2 60536792 60536811 60536808 +
agcaattaacttctggtcag

SEQ ID NO: 168164 - DNA, 20 bp, Artificial Sequence
  Synthetic oligonucleotide; CAG chr2 60536799 60536818 60536815 +
aacttctggtcagcagtgtg

SEQ ID NO: 168165 - DNA, 20 bp, Artificial Sequence
  Synthetic oligonucleotide; AGG chr2 60536800 60536819 60536816 +
acttctggtcagcagtgtgc

SEQ ID NO: 168166 - DNA, 20 bp, Artificial Sequence
  Synthetic oligonucleotide; CAG chr2 60536803 60536822 60536819 +
tctggtcagcagtgtgcagg

SEQ ID NO: 168167 - DNA, 20 bp, Artificial Sequence
  Synthetic oligonucleotide; CAG chr2 60536806 60536825 60536822 +
ggtcagcagtgtgcaggcag

SEQ ID NO: 168168 - DNA, 20 bp, Artificial Sequence
  Synthetic oligonucleotide; AGG chr2 60536807 60536826 60536823 +
gtcagcagtgtgcaggcagc

SEQ ID NO: 168169 - DNA, 20 bp, Artificial Sequence
  Synthetic oligonucleotide; AAG chr2 60536817 60536836 60536833 +
tgcaggcagcaggctgcccc

SEQ ID NO: 168170 - DNA, 20 bp, Artificial Sequence
  Synthetic oligonucleotide; CAG chr2 60536820 60536839 60536836 +
aggcagcaggctgccccaag

SEQ ID NO: 168171 - DNA, 20 bp, Artificial Sequence
  Synthetic oligonucleotide; TAG chr2 60536824 60536843 60536840 +
agcaggctgccccaagcaga

SEQ ID NO: 168172 - DNA, 20 bp, Artificial Sequence
  Synthetic oligonucleotide; AGG chr2 60536825 60536844 60536841 +
gcaggctgccccaagcagat

SEQ ID NO: 168173 - DNA, 20 bp, Artificial Sequence
  Synthetic oligonucleotide; GAG chr2 60536827 60536846 60536843 +
aggctgccccaagcagatag

SEQ ID NO: 168174 - DNA, 20 bp, Artificial Sequence
  Synthetic oligonucleotide; AGG chr2 60536828 60536847 60536844 +
ggctgccccaagcagatagg

SEQ ID NO: 168175 - DNA, 20 bp, Artificial Sequence
  Synthetic oligonucleotide; GGG chr2 60536829 60536848 60536845 +
gctgccccaagcagatagga

SEQ ID NO: 168176 - DNA, 20 bp, Artificial Sequence
  Synthetic oligonucleotide; GGG chr2 60536830 60536849 60536846 +
ctgccccaagcagataggag

SEQ ID NO: 168177 - DNA, 20 bp, Artificial Sequence
  Synthetic oligonucleotide; GAG chr2 60536832 60536851 60536848 +
gccccaagcagataggaggg

SEQ ID NO: 168178 - DNA, 20 bp, Artificial Sequence
  Synthetic oligonucleotide; AGG chr2 60536833 60536852 60536849 +
ccccaagcagataggagggg

SEQ ID NO: 168179 - DNA, 20 bp, Artificial Sequence
  Synthetic oligonucleotide; GGG chr2 60536834 60536853 60536850 +
cccaagcagataggagggga

SEQ ID NO: 168180 - DNA, 20 bp, Artificial Sequence
  Synthetic oligonucleotide; GGG chr2 60536835 60536854 60536851 +
ccaagcagataggaggggag

SEQ ID NO: 168181 - DNA, 20 bp, Artificial Sequence
  Synthetic oligonucleotide; GGG chr2 60536836 60536855 60536852 +
caagcagataggaggggagg

SEQ ID NO: 168182 - DNA, 20 bp, Artificial Sequence
  Synthetic oligonucleotide; CAG chr2 60536842 60536861 60536858 +
gataggaggggagggggacc

SEQ ID NO: 168183 - DNA, 20 bp, Artificial Sequence
  Synthetic oligonucleotide; GAG chr2 60536844 60536863 60536860 +
taggaggggagggggaccca

SEQ ID NO: 168184 - DNA, 20 bp, Artificial Sequence
  Synthetic oligonucleotide; TGG chr2 60536848 60536867 60536864 +
aggggagggggacccagagc

SEQ ID NO: 168185 - DNA, 20 bp, Artificial Sequence
  Synthetic oligonucleotide; GGG chr2 60536849 60536868 60536865 +
ggggagggggacccagagct

SEQ ID NO: 168186 - DNA, 20 bp, Artificial Sequence
  Synthetic oligonucleotide; AAG chr2 60536854 60536873 60536870 +
gggggacccagagctgggac

SEQ ID NO: 168187 - DNA, 20 bp, Artificial Sequence
  Synthetic oligonucleotide; AAG chr2 60536862 60536881 60536878 +
cagagctgggacaagcacaa

SEQ ID NO: 168188 - DNA, 20 bp, Artificial Sequence
  Synthetic oligonucleotide; CAG chr2 60536866 60536885 60536882 +
gctgggacaagcacaaaaga

SEQ ID NO: 168189 - DNA, 20 bp, Artificial Sequence
  Synthetic oligonucleotide; AGG chr2 60536867 60536886 60536883 +
ctgggacaagcacaaaagac

SEQ ID NO: 168190 - DNA, 20 bp, Artificial Sequence
  Synthetic oligonucleotide; CAG chr2 60536891 60536910 60536907 +
ccaacaacaatgcctgctgt

SEQ ID NO: 168191 - DNA, 20 bp, Artificial Sequence
  Synthetic oligonucleotide; CAG chr2 60536894 60536913 60536910 +
acaacaatgcctgctgtcag

SEQ ID NO: 168192 - DNA, 20 bp, Artificial Sequence
  Synthetic oligonucleotide; CAG chr2 60536913 60536932 60536929 +
gcagctgaattatttttata

SEQ ID NO: 168193 - DNA, 20 bp, Artificial Sequence
  Synthetic oligonucleotide; AGG chr2 60536914 60536933 60536930 +
cagctgaattatttttatac

SEQ ID NO: 168194 - DNA, 20 bp, Artificial Sequence
  Synthetic oligonucleotide; AAG chr2 60536941 60536960 60536957 +
tttatctctattgtacaaac

SEQ ID NO: 168195 - DNA, 20 bp, Artificial Sequence
  Synthetic oligonucleotide; AAG chr2 60536966 60536985 60536982 +
cgtgtctgtgctgacttgtt

SEQ ID NO: 168196 - DNA, 20 bp, Artificial Sequence
  Synthetic oligonucleotide; TAG chr2 60536984 60537003 60537000 +
ttaagcaatccacttgtatg

SEQ ID NO: 168197 - DNA, 20 bp, Artificial Sequence
  Synthetic oligonucleotide; AAG chr2 60536990 60537009 60537006 +
aatccacttgtatgtagaat

SEQ ID NO: 168198 - DNA, 20 bp, Artificial Sequence
  Synthetic oligonucleotide; CAG chr2 60537014 60537033 60537030 +
ttttttttctttcttgctac

SEQ ID NO: 168199 - DNA, 20 bp, Artificial Sequence
  Synthetic oligonucleotide; CAG chr2 60537022 60537041 60537038 +
ctttcttgctaccagtcaca

SEQ ID NO: 168200 - DNA, 20 bp, Artificial Sequence
  Synthetic oligonucleotide; AAG chr2 60537029 60537048 60537045 +
gctaccagtcacacagctcc

SEQ ID NO: 168201 - DNA, 20 bp, Artificial Sequence
  Synthetic oligonucleotide; CAG chr2 60537034 60537053 60537050 +
cagtcacacagctccaagat

SEQ ID NO: 168202 - DNA, 20 bp, Artificial Sequence
  Synthetic oligonucleotide; AAG chr2 60537037 60537056 60537053 +
tcacacagctccaagatcag

SEQ ID NO: 168203 - DNA, 20 bp, Artificial Sequence
  Synthetic oligonucleotide; TAG chr2 60537047 60537066 60537063 +
ccaagatcagaagaaataca

SEQ ID NO: 168204 - DNA, 20 bp, Artificial Sequence
  Synthetic oligonucleotide; AAG chr2 60537056 60537075 60537072 +
gaagaaatacatagtctttg

SEQ ID NO: 168205 - DNA, 20 bp, Artificial Sequence
  Synthetic oligonucleotide; TAG chr2 60537073 60537092 60537089 +
ttgaagctgctcaaatgttt

SEQ ID NO: 168206 - DNA, 20 bp, Artificial Sequence
  Synthetic oligonucleotide; AAG chr2 60537080 60537099 60537096 +
tgctcaaatgttttagttaa

SEQ ID NO: 168207 - DNA, 20 bp, Artificial Sequence
  Synthetic oligonucleotide; AGG chr2 60537081 60537100 60537097 +
gctcaaatgttttagttaaa

SEQ ID NO: 168208 - DNA, 20 bp, Artificial Sequence
  Synthetic oligonucleotide; CAG chr2 60537085 60537104 60537101 +
aaatgttttagttaaaagga

SEQ ID NO: 168209 - DNA, 20 bp, Artificial Sequence
  Synthetic oligonucleotide; CAG chr2 60537088 60537107 60537104 +
tgttttagttaaaaggacag

SEQ ID NO: 168210 - DNA, 20 bp, Artificial Sequence
  Synthetic oligonucleotide; AAG chr2 60537100 60537119 60537116 +
aaggacagcagttgttttca

SEQ ID NO: 168211 - DNA, 20 bp, Artificial Sequence
  Synthetic oligonucleotide; AAG chr2 60537107 60537126 60537123 +
gcagttgttttcaaagatcc

SEQ ID NO: 168212 - DNA, 20 bp, Artificial Sequence
  Synthetic oligonucleotide; GAG chr2 60537109 60537128 60537125 +
agttgttttcaaagatccaa

SEQ ID NO: 168213 - DNA, 20 bp, Artificial Sequence
  Synthetic oligonucleotide; CAG chr2 60537121 60537140 60537137 +
agatccaagagtatctttat

SEQ ID NO: 168214 - DNA, 20 bp, Artificial Sequence
  Synthetic oligonucleotide; GAG chr2 60537179 60537198 60537195 +
acataacaaaaacataacat

SEQ ID NO: 168215 - DNA, 20 bp, Artificial Sequence
  Synthetic oligonucleotide; AAG chr2 60537182 60537201 60537198 +
taacaaaaacataacatgag

SEQ ID NO: 168216 - DNA, 20 bp, Artificial Sequence
  Synthetic oligonucleotide; AGG chr2 60537183 60537202 60537199 +
aacaaaaacataacatgaga

SEQ ID NO: 168217 - DNA, 20 bp, Artificial Sequence
  Synthetic oligonucleotide; CAG chr2 60537212 60537231 60537228 +
tttattattaaaattttttt

SEQ ID NO: 168218 - DNA, 20 bp, Artificial Sequence
  Synthetic oligonucleotide; CAG chr2 60537231 60537250 60537247 +
tcagcctttaaatcattctt

SEQ ID NO: 168219 - DNA, 20 bp, Artificial Sequence
  Synthetic oligonucleotide; TAG chr2 60537234 60537253 60537250 +
gcctttaaatcattcttcag

SEQ ID NO: 168220 - DNA, 20 bp, Artificial Sequence
  Synthetic oligonucleotide; CAG chr2 60537245 60537264 60537261 +
attcttcagtagccaatgtt

SEQ ID NO: 168221 - DNA, 20 bp, Artificial Sequence
  Synthetic oligonucleotide; AAG chr2 60537259 60537278 60537275 +
aatgttcagttttaaatgta

SEQ ID NO: 168222 - DNA, 20 bp, Artificial Sequence
  Synthetic oligonucleotide; AGG chr2 60537260 60537279 60537276 +
atgttcagttttaaatgtaa

SEQ ID NO: 168223 - DNA, 20 bp, Artificial Sequence
  Synthetic oligonucleotide; TAG chr2 60537282 60537301 60537298 +
gaataatttttttaaaatat

SEQ ID NO: 168224 - DNA, 20 bp, Artificial Sequence
  Synthetic oligonucleotide; AGG chr2 60537283 60537302 60537299 +
aataatttttttaaaatatt

SEQ ID NO: 168225 - DNA, 20 bp, Artificial Sequence
  Synthetic oligonucleotide; GGG chr2 60537284 60537303 60537300 +
ataatttttttaaaatatta

SEQ ID NO: 168226 - DNA, 20 bp, Artificial Sequence
  Synthetic oligonucleotide; TGG chr2 60537292 60537311 60537308 +
tttaaaatattagggtgtga

SEQ ID NO: 168227 - DNA, 20 bp, Artificial Sequence
  Synthetic oligonucleotide; GAG chr2 60537294 60537313 60537310 +
taaaatattagggtgtgatg

SEQ ID NO: 168228 - DNA, 20 bp, Artificial Sequence
  Synthetic oligonucleotide; GAG chr2 60537296 60537315 60537312 +
aaatattagggtgtgatgga

SEQ ID NO: 168229 - DNA, 20 bp, Artificial Sequence
  Synthetic oligonucleotide; GAG chr2 60537307 60537326 60537323 +
tgtgatggagagaaactcac

SEQ ID NO: 168230 - DNA, 20 bp, Artificial Sequence
  Synthetic oligonucleotide; AAG chr2 60537314 60537333 60537330 +
gagagaaactcacgagattt

SEQ ID NO: 168231 - DNA, 20 bp, Artificial Sequence
  Synthetic oligonucleotide; TGG chr2 60537326 60537345 60537342 +
cgagatttaagatttaacat

SEQ ID NO: 168232 - DNA, 20 bp, Artificial Sequence
  Synthetic oligonucleotide; TGG chr2 60537347 60537366 60537363 +
ggttaatgcattgttttaac

SEQ ID NO: 168233 - DNA, 20 bp, Artificial Sequence
  Synthetic oligonucleotide; AAG chr2 60537357 60537376 60537373 +
ttgttttaactggaaactga

SEQ ID NO: 168234 - DNA, 20 bp, Artificial Sequence
  Synthetic oligonucleotide; AGG chr2 60537358 60537377 60537374 +
tgttttaactggaaactgaa

SEQ ID NO: 168235 - DNA, 20 bp, Artificial Sequence
  Synthetic oligonucleotide; CGG chr2 60537363 60537382 60537379 +
taactggaaactgaaaggat

SEQ ID NO: 168236 - DNA, 20 bp, Artificial Sequence
  Synthetic oligonucleotide; GGG chr2 60537364 60537383 60537380 +
aactggaaactgaaaggatc

SEQ ID NO: 168237 - DNA, 20 bp, Artificial Sequence
  Synthetic oligonucleotide; GGG chr2 60537365 60537384 60537381 +
actggaaactgaaaggatcg

SEQ ID NO: 168238 - DNA, 20 bp, Artificial Sequence
  Synthetic oligonucleotide; CAG chr2 60537368 60537387 60537384 +
ggaaactgaaaggatcgggg

SEQ ID NO: 168239 - DNA, 20 bp, Artificial Sequence
  Synthetic oligonucleotide; AGG chr2 60537369 60537388 60537385 +
gaaactgaaaggatcggggc

SEQ ID NO: 168240 - DNA, 20 bp, Artificial Sequence
  Synthetic oligonucleotide; GGG chr2 60537370 60537389 60537386 +
aaactgaaaggatcggggca

SEQ ID NO: 168241 - DNA, 20 bp, Artificial Sequence
  Synthetic oligonucleotide; GGG chr2 60537371 60537390 60537387 +
aactgaaaggatcggggcag

SEQ ID NO: 168242 - DNA, 20 bp, Artificial Sequence
  Synthetic oligonucleotide; GAG chr2 60537373 60537392 60537389 +
ctgaaaggatcggggcaggg

SEQ ID NO: 168243 - DNA, 20 bp, Artificial Sequence
  Synthetic oligonucleotide; TGG chr2 60537382 60537401 60537398 +
tcggggcaggggagttaaaa

SEQ ID NO: 168244 - DNA, 20 bp, Artificial Sequence
  Synthetic oligonucleotide; GGG chr2 60537383 60537402 60537399 +
cggggcaggggagttaaaat

SEQ ID NO: 168245 - DNA, 20 bp, Artificial Sequence
  Synthetic oligonucleotide; GGG chr2 60537384 60537403 60537400 +
ggggcaggggagttaaaatg

SEQ ID NO: 168246 - DNA, 20 bp, Artificial Sequence
  Synthetic oligonucleotide; GAG chr2 60537386 60537405 60537402 +
ggcaggggagttaaaatggg

SEQ ID NO: 168247 - DNA, 20 bp, Artificial Sequence
  Synthetic oligonucleotide; TGG chr2 60537393 60537412 60537409 +
gagttaaaatggggagtaaa

SEQ ID NO: 168248 - DNA, 20 bp, Artificial Sequence
  Synthetic oligonucleotide; GAG chr2 60537402 60537421 60537418 +
tggggagtaaatggttcact

SEQ ID NO: 168249 - DNA, 20 bp, Artificial Sequence
  Synthetic oligonucleotide; AGG chr2 60537403 60537422 60537419 +
ggggagtaaatggttcactg

SEQ ID NO: 168250 - DNA, 20 bp, Artificial Sequence
  Synthetic oligonucleotide; GGG chr2 60537404 60537423 60537420 +
gggagtaaatggttcactga

SEQ ID NO: 168251 - DNA, 20 bp, Artificial Sequence
  Synthetic oligonucleotide; GGG chr2 60537405 60537424 60537421 +
ggagtaaatggttcactgag

SEQ ID NO: 168252 - DNA, 20 bp, Artificial Sequence
  Synthetic oligonucleotide; TGG chr2 60537441 60537460 60537457 +
gtaaataaatcataaaatca

SEQ ID NO: 168253 - DNA, 20 bp, Artificial Sequence
  Synthetic oligonucleotide; GAG chr2 60537452 60537471 60537468 +
ataaaatcatggtatacctt

SEQ ID NO: 168254 - DNA, 20 bp, Artificial Sequence
  Synthetic oligonucleotide; TGG chr2 60537456 60537475 60537472 +
aatcatggtataccttgagt

SEQ ID NO: 168255 - DNA, 20 bp, Artificial Sequence
  Synthetic oligonucleotide; AAG chr2 60537461 60537480 60537477 +
tggtataccttgagttggtg

SEQ ID NO: 168256 - DNA, 20 bp, Artificial Sequence
  Synthetic oligonucleotide; AGG chr2 60537462 60537481 60537478 +
ggtataccttgagttggtga

SEQ ID NO: 168257 - DNA, 20 bp, Artificial Sequence
  Synthetic oligonucleotide; GAG chr2 60537464 60537483 60537480 +
tataccttgagttggtgaag

SEQ ID NO: 168258 - DNA, 20 bp, Artificial Sequence
  Synthetic oligonucleotide; CAG chr2 60537474 60537493 60537490 +
gttggtgaaggagaatactt

SEQ ID NO: 168259 - DNA, 20 bp, Artificial Sequence
  Synthetic oligonucleotide; AGG chr2 60537475 60537494 60537491 +
ttggtgaaggagaatacttc

SEQ ID NO: 168260 - DNA, 20 bp, Artificial Sequence
  Synthetic oligonucleotide; TGG chr2 60537480 60537499 60537496 +
gaaggagaatacttcaggtt

SEQ ID NO: 168261 - DNA, 20 bp, Artificial Sequence
  Synthetic oligonucleotide; TAG chr2 60537489 60537508 60537505 +
tacttcaggtttggttctct

SEQ ID NO: 168262 - DNA, 20 bp, Artificial Sequence
  Synthetic oligonucleotide; GAG chr2 60537498 60537517 60537514 +
tttggttctcttagtttttt

SEQ ID NO: 168263 - DNA, 20 bp, Artificial Sequence
  Synthetic oligonucleotide; AGG chr2 60537499 60537518 60537515 +
ttggttctcttagttttttg

SEQ ID NO: 168264 - DNA, 20 bp, Artificial Sequence
  Synthetic oligonucleotide; GAG chr2 60537515 60537534 60537531 +
tttgaggtttgtttttgttt

SEQ ID NO: 168265 - DNA, 20 bp, Artificial Sequence
  Synthetic oligonucleotide; AGG chr2 60537516 60537535 60537532 +
ttgaggtttgtttttgtttg

SEQ ID NO: 168266 - DNA, 20 bp, Artificial Sequence
  Synthetic oligonucleotide; GAG chr2 60537518 60537537 60537534 +
gaggtttgtttttgtttgag

SEQ ID NO: 168267 - DNA, 20 bp, Artificial Sequence
  Synthetic oligonucleotide; AGG chr2 60537519 60537538 60537535 +
aggtttgtttttgtttgagg

SEQ ID NO: 168268 - DNA, 20 bp, Artificial Sequence
  Synthetic oligonucleotide; CAG chr2 60537524 60537543 60537540 +
tgtttttgtttgaggaggtg

SEQ ID NO: 168269 - DNA, 20 bp, Artificial Sequence
  Synthetic oligonucleotide; AGG chr2 60537525 60537544 60537541 +
gtttttgtttgaggaggtgc

SEQ ID NO: 168270 - DNA, 20 bp, Artificial Sequence
  Synthetic oligonucleotide; GGG chr2 60537526 60537545 60537542 +
tttttgtttgaggaggtgca

SEQ ID NO: 168271 - DNA, 20 bp, Artificial Sequence
  Synthetic oligonucleotide; TGG chr2 60537531 60537550 60537547 +
gtttgaggaggtgcagggat

SEQ ID NO: 168272 - DNA, 20 bp, Artificial Sequence
  Synthetic oligonucleotide; CAG chr2 60537565 60537584 60537581 +
aactctatatttaaaatgta

SEQ ID NO: 168273 - DNA, 20 bp, Artificial Sequence
  Synthetic oligonucleotide; AGG chr2 60537566 60537585 60537582 +
actctatatttaaaatgtac

SEQ ID NO: 168274 - DNA, 20 bp, Artificial Sequence
  Synthetic oligonucleotide; CAG chr2 60537571 60537590 60537587 +
atatttaaaatgtacaggaa

SEQ ID NO: 168275 - DNA, 20 bp, Artificial Sequence
  Synthetic oligonucleotide; TGG chr2 60537577 60537596 60537593 +
aaaatgtacaggaacagact

SEQ ID NO: 168276 - DNA, 20 bp, Artificial Sequence
  Synthetic oligonucleotide; TAG chr2 60537584 60537603 60537600 +
acaggaacagacttggcaca

SEQ ID NO: 168277 - DNA, 20 bp, Artificial Sequence
  Synthetic oligonucleotide; AAG chr2 60537605 60537624 60537621 +
agtgctttgtgctccaacat

SEQ ID NO: 168278 - DNA, 20 bp, Artificial Sequence
  Synthetic oligonucleotide; AAG chr2 60537613 60537632 60537629 +
gtgctccaacataagaatcc

SEQ ID NO: 168279 - DNA, 20 bp, Artificial Sequence
  Synthetic oligonucleotide; CAG chr2 60537642 60537661 60537658 +
tttatttccctaaaaattaa

SEQ ID NO: 168280 - DNA, 20 bp, Artificial Sequence
  Synthetic oligonucleotide; CAG chr2 60537659 60537678 60537675 +
taacagatgtgatttccttg

SEQ ID NO: 168281 - DNA, 20 bp, Artificial Sequence
  Synthetic oligonucleotide; AAG chr2 60537686 60537705 60537702 +
tttatgcatcattacatatt

SEQ ID NO: 168282 - DNA, 20 bp, Artificial Sequence
  Synthetic oligonucleotide; TAG chr2 60537732 60537751 60537748 +
aatttaaatgccctgatgct

SEQ ID NO: 168283 - DNA, 20 bp, Artificial Sequence
  Synthetic oligonucleotide; AAG chr2 60537739 60537758 60537755 +
atgccctgatgcttagcaaa

SEQ ID NO: 168284 - DNA, 20 bp, Artificial Sequence
  Synthetic oligonucleotide; TAG chr2 60537757 60537776 60537773 +
aaaagcttccttgtgttttt

SEQ ID NO: 168285 - DNA, 20 bp, Artificial Sequence
  Synthetic oligonucleotide; AAG chr2 60537761 60537780 60537777 +
gcttccttgtgttttttaga

SEQ ID NO: 168286 - DNA, 20 bp, Artificial Sequence
  Synthetic oligonucleotide; AAG chr2 60537770 60537789 60537786 +
tgttttttagaaagttcaaa

SEQ ID NO: 168287 - DNA, 20 bp, Artificial Sequence
  Synthetic oligonucleotide; TAG chr2 60537777 60537796 60537793 +
tagaaagttcaaaaagcaaa

SEQ ID NO: 168288 - DNA, 20 bp, Artificial Sequence
  Synthetic oligonucleotide; AAG chr2 60537781 60537800 60537797 +
aagttcaaaaagcaaataga

SEQ ID NO: 168289 - DNA, 20 bp, Artificial Sequence
  Synthetic oligonucleotide; AGG chr2 60537782 60537801 60537798 +
agttcaaaaagcaaatagaa

SEQ ID NO: 168290 - DNA, 20 bp, Artificial Sequence
  Synthetic oligonucleotide; GAG chr2 60537786 60537805 60537802 +
caaaaagcaaatagaaaggc

SEQ ID NO: 168291 - DNA, 20 bp, Artificial Sequence
  Synthetic oligonucleotide; AGG chr2 60537787 60537806 60537803 +
aaaaagcaaatagaaaggcg

SEQ ID NO: 168292 - DNA, 20 bp, Artificial Sequence
  Synthetic oligonucleotide; TAG chr2 60537790 60537809 60537806 +
aagcaaatagaaaggcgagg

SEQ ID NO: 168293 - DNA, 20 bp, Artificial Sequence
  Synthetic oligonucleotide; AGG chr2 60537791 60537810 60537807 +
agcaaatagaaaggcgaggt

SEQ ID NO: 168294 - DNA, 20 bp, Artificial Sequence
  Synthetic oligonucleotide; CAG chr2 60537801 60537820 60537817 +
aaggcgaggtaggtatacaa

SEQ ID NO: 168295 - DNA, 20 bp, Artificial Sequence
  Synthetic oligonucleotide; TGG chr2 60537807 60537826 60537823 +
aggtaggtatacaacagcac

SEQ ID NO: 168296 - DNA, 20 bp, Artificial Sequence
  Synthetic oligonucleotide; AAG chr2 60537821 60537840 60537837 +
cagcactggttttctttttg

SEQ ID NO: 168297 - DNA, 20 bp, Artificial Sequence
  Synthetic oligonucleotide; AGG chr2 60537822 60537841 60537838 +
agcactggttttctttttga

SEQ ID NO: 168298 - DNA, 20 bp, Artificial Sequence
  Synthetic oligonucleotide; CAG chr2 60537833 60537852 60537849 +
tctttttgaaggcacccttg

SEQ ID NO: 168299 - DNA, 20 bp, Artificial Sequence
  Synthetic oligonucleotide; AGG chr2 60537834 60537853 60537850 +
ctttttgaaggcacccttgc

SEQ ID NO: 168300 - DNA, 20 bp, Artificial Sequence
  Synthetic oligonucleotide; TGG chr2 60537866 60537885 60537882 +
aattccattctttattttaa

SEQ ID NO: 168301 - DNA, 20 bp, Artificial Sequence
  Synthetic oligonucleotide; GGG chr2 60537867 60537886 60537883 +
attccattctttattttaat

SEQ ID NO: 168302 - DNA, 20 bp, Artificial Sequence
  Synthetic oligonucleotide; GAG chr2 60537869 60537888 60537885 +
tccattctttattttaatgg

SEQ ID NO: 168303 - DNA, 20 bp, Artificial Sequence
  Synthetic oligonucleotide; CAG chr2 60537880 60537899 60537896 +
ttttaatgggagtttttaat

SEQ ID NO: 168304 - DNA, 20 bp, Artificial Sequence
  Synthetic oligonucleotide; TGG chr2 60537883 60537902 60537899 +
taatgggagtttttaatcag

SEQ ID NO: 168305 - DNA, 20 bp, Artificial Sequence
  Synthetic oligonucleotide; TAG chr2 60537918 60537937 60537934 +
ctaaaactaaaatcaaattg

SEQ ID NO: 168306 - DNA, 20 bp, Artificial Sequence
  Synthetic oligonucleotide; AGG chr2 60537919 60537938 60537935 +
taaaactaaaatcaaattgt

SEQ ID NO: 168307 - DNA, 20 bp, Artificial Sequence
  Synthetic oligonucleotide; TGG chr2 60537935 60537954 60537951 +
ttgtaggtgcaattgttcat

SEQ ID NO: 168308 - DNA, 20 bp, Artificial Sequence
  Synthetic oligonucleotide; CAG chr2 60537950 60537969 60537966 +
ttcattggcaatgctaacaa

SEQ ID NO: 168309 - DNA, 20 bp, Artificial Sequence
  Synthetic oligonucleotide; GAG chr2 60537954 60537973 60537970 +
ttggcaatgctaacaacagt

SEQ ID NO: 168310 - DNA, 20 bp, Artificial Sequence
  Synthetic oligonucleotide; GAG chr2 60537979 60537998 60537995 +
tacaaacaaaaactcattgt

SEQ ID NO: 168311 - DNA, 20 bp, Artificial Sequence
  Synthetic oligonucleotide; AAG chr2 60537988 60538007 60538004 +
aaactcattgtgagtgacca

SEQ ID NO: 168312 - DNA, 20 bp, Artificial Sequence
  Synthetic oligonucleotide; AGG chr2 60537989 60538008 60538005 +
aactcattgtgagtgaccaa

SEQ ID NO: 168313 - DNA, 20 bp, Artificial Sequence
  Synthetic oligonucleotide; CAG chr2 60537996 60538015 60538012 +
tgtgagtgaccaaaggtccc

SEQ ID NO: 168314 - DNA, 20 bp, Artificial Sequence
  Synthetic oligonucleotide; AGG chr2 60537997 60538016 60538013 +
gtgagtgaccaaaggtcccc

SEQ ID NO: 168315 - DNA, 20 bp, Artificial Sequence
  Synthetic oligonucleotide; CAG chr2 60538026 60538045 60538042 +
cttcatcaacatacctgctc

SEQ ID NO: 168316 - DNA, 20 bp, Artificial Sequence
  Synthetic oligonucleotide; AGG chr2 60538027 60538046 60538043 +
ttcatcaacatacctgctcc

SEQ ID NO: 168317 - DNA, 20 bp, Artificial Sequence
  Synthetic oligonucleotide; TGG chr2 60538037 60538056 60538053 +
tacctgctccaggttcccac

SEQ ID NO: 168318 - DNA, 20 bp, Artificial Sequence
  Synthetic oligonucleotide; GGG chr2 60538038 60538057 60538054 +
acctgctccaggttcccact

SEQ ID NO: 168319 - DNA, 20 bp, Artificial Sequence
  Synthetic oligonucleotide; TGG chr2 60538048 60538067 60538064 +
ggttcccactgggaattctc

SEQ ID NO: 168320 - DNA, 20 bp, Artificial Sequence
  Synthetic oligonucleotide; CAG chr2 60538051 60538070 60538067 +
tcccactgggaattctctgg

SEQ ID NO: 168321 - DNA, 20 bp, Artificial Sequence
  Synthetic oligonucleotide; GAG chr2 60538053 60538072 60538069 +
ccactgggaattctctggca

SEQ ID NO: 168322 - DNA, 20 bp, Artificial Sequence
  Synthetic oligonucleotide; CAG chr2 60538063 60538082 60538079 +
ttctctggcagagactgatt

SEQ ID NO: 168323 - DNA, 20 bp, Artificial Sequence
  Synthetic oligonucleotide; CAG chr2 60538084 60538103 60538100 +
agttctgaataacatgctgc

SEQ ID NO: 168324 - DNA, 20 bp, Artificial Sequence
  Synthetic oligonucleotide; TGG chr2 60538094 60538113 60538110 +
aacatgctgccagccctatc

SEQ ID NO: 168325 - DNA, 20 bp, Artificial Sequence
  Synthetic oligonucleotide; AAG chr2 60538099 60538118 60538115 +
gctgccagccctatctggaa

SEQ ID NO: 168326 - DNA, 20 bp, Artificial Sequence
  Synthetic oligonucleotide; AGG chr2 60538100 60538119 60538116 +
ctgccagccctatctggaaa

SEQ ID NO: 168327 - DNA, 20 bp, Artificial Sequence
  Synthetic oligonucleotide; GGG chr2 60538101 60538120 60538117 +
tgccagccctatctggaaaa

SEQ ID NO: 168328 - DNA, 20 bp, Artificial Sequence
  Synthetic oligonucleotide; AAG chr2 60538109 60538128 60538125 +
ctatctggaaaagggtgtgc

SEQ ID NO: 168329 - DNA, 20 bp, Artificial Sequence
  Synthetic oligonucleotide; AGG chr2 60538110 60538129 60538126 +
tatctggaaaagggtgtgca

SEQ ID NO: 168330 - DNA, 20 bp, Artificial Sequence
  Synthetic oligonucleotide; CAG chr2 60538132 60538151 60538148 +
gcgccttctcgcctctttta

SEQ ID NO: 168331 - DNA, 20 bp, Artificial Sequence
  Synthetic oligonucleotide; AGG chr2 60538133 60538152 60538149 +
cgccttctcgcctcttttac

SEQ ID NO: 168332 - DNA, 20 bp, Artificial Sequence
  Synthetic oligonucleotide; AAG chr2 60538136 60538155 60538152 +
cttctcgcctcttttacagg

SEQ ID NO: 168333 - DNA, 20 bp, Artificial Sequence
  Synthetic oligonucleotide; TAG chr2 60538162 60538181 60538178 +
aaacctgatcatctcacctt

SEQ ID NO: 168334 - DNA, 20 bp, Artificial Sequence
  Synthetic oligonucleotide; AGG chr2 60538163 60538182 60538179 +
aacctgatcatctcaccttt

SEQ ID NO: 168335 - DNA, 20 bp, Artificial Sequence
  Synthetic oligonucleotide; TAG chr2 60538184 60538203 60538200 +
ggtatatataatttgttgtt

SEQ ID NO: 168336 - DNA, 20 bp, Artificial Sequence
  Synthetic oligonucleotide; GAG chr2 60538193 60538212 60538209 +
aatttgttgtttagcactct

SEQ ID NO: 168337 - DNA, 20 bp, Artificial Sequence
  Synthetic oligonucleotide; TGG chr2 60538200 60538219 60538216 +
tgtttagcactctgagaact

SEQ ID NO: 168338 - DNA, 20 bp, Artificial Sequence
  Synthetic oligonucleotide; AAG chr2 60538218 60538237 60538234 +
cttggtattttatctatcta

SEQ ID NO: 168339 - DNA, 20 bp, Artificial Sequence
  Synthetic oligonucleotide; GAG chr2 60538220 60538239 60538236 +
tggtattttatctatctaaa

SEQ ID NO: 168340 - DNA, 20 bp, Artificial Sequence
  Synthetic oligonucleotide; AAG chr2 60538229 60538248 60538245 +
atctatctaaagagatcaaa

SEQ ID NO: 168341 - DNA, 20 bp, Artificial Sequence
  Synthetic oligonucleotide; AGG chr2 60538230 60538249 60538246 +
tctatctaaagagatcaaaa

SEQ ID NO: 168342 - DNA, 20 bp, Artificial Sequence
  Synthetic oligonucleotide; GGG chr2 60538231 60538250 60538247 +
ctatctaaagagatcaaaaa

SEQ ID NO: 168343 - DNA, 20 bp, Artificial Sequence
  Synthetic oligonucleotide; AAG chr2 60538237 60538256 60538253 +
aaagagatcaaaaagggcaa

SEQ ID NO: 168344 - DNA, 20 bp, Artificial Sequence
  Synthetic oligonucleotide; TGG chr2 60538241 60538260 60538257 +
agatcaaaaagggcaaaaga

SEQ ID NO: 168345 - DNA, 20 bp, Artificial Sequence
  Synthetic oligonucleotide; GAG chr2 60538243 60538262 60538259 +
atcaaaaagggcaaaagatg

SEQ ID NO: 168346 - DNA, 20 bp, Artificial Sequence
  Synthetic oligonucleotide; GAG chr2 60538247 60538266 60538263 +
aaaagggcaaaagatggagc

SEQ ID NO: 168347 - DNA, 20 bp, Artificial Sequence
  Synthetic oligonucleotide; GAG chr2 60538252 60538271 60538268 +
ggcaaaagatggagcgagct

SEQ ID NO: 168348 - DNA, 20 bp, Artificial Sequence
  Synthetic oligonucleotide; AGG chr2 60538253 60538272 60538269 +
gcaaaagatggagcgagctg

SEQ ID NO: 168349 - DNA, 20 bp, Artificial Sequence
  Synthetic oligonucleotide; CAG chr2 60538258 60538277 60538274 +
agatggagcgagctgaggcc

SEQ ID NO: 168350 - DNA, 20 bp, Artificial Sequence
  Synthetic oligonucleotide; TAG chr2 60538263 60538282 60538279 +
gagcgagctgaggcccagcc

SEQ ID NO: 168351 - DNA, 20 bp, Artificial Sequence
  Synthetic oligonucleotide; TGG chr2 60538269 60538288 60538285 +
gctgaggcccagcctagctc

SEQ ID NO: 168352 - DNA, 20 bp, Artificial Sequence
  Synthetic oligonucleotide; TAG chr2 60538304 60538323 60538320 +
tcgtgcactgcgcgttgcct

SEQ ID NO: 168353 - DNA, 20 bp, Artificial Sequence
  Synthetic oligonucleotide; GAG chr2 60538306 60538325 60538322 +
gtgcactgcgcgttgcctta

SEQ ID NO: 168354 - DNA, 20 bp, Artificial Sequence
  Synthetic oligonucleotide; AGG chr2 60538307 60538326 60538323 +
tgcactgcgcgttgccttag

SEQ ID NO: 168355 - DNA, 20 bp, Artificial Sequence
  Synthetic oligonucleotide; GAG chr2 60538309 60538328 60538325 +
cactgcgcgttgccttagag

SEQ ID NO: 168356 - DNA, 20 bp, Artificial Sequence
  Synthetic oligonucleotide; CAG chr2 60538321 60538340 60538337 +
ccttagaggagcaacctgtg

SEQ ID NO: 168357 - DNA, 20 bp, Artificial Sequence
  Synthetic oligonucleotide; AGG chr2 60538322 60538341 60538338 +
cttagaggagcaacctgtgc

SEQ ID NO: 168358 - DNA, 20 bp, Artificial Sequence
  Synthetic oligonucleotide; CAG chr2 60538334 60538353 60538350 +
acctgtgcaggtaaatcttc

SEQ ID NO: 168359 - DNA, 20 bp, Artificial Sequence
  Synthetic oligonucleotide; CAG chr2 60538337 60538356 60538353 +
tgtgcaggtaaatcttccag

SEQ ID NO: 168360 - DNA, 20 bp, Artificial Sequence
  Synthetic oligonucleotide; CAG chr2 60538348 60538367 60538364 +
atcttccagcagcattgcat

SEQ ID NO: 168361 - DNA, 20 bp, Artificial Sequence
  Synthetic oligonucleotide; CAG chr2 60538363 60538382 60538379 +
tgcatcagatccactcacat

SEQ ID NO: 168362 - DNA, 20 bp, Artificial Sequence
  Synthetic oligonucleotide; CAG chr2 60538370 60538389 60538386 +
gatccactcacatcagtctc

SEQ ID NO: 168363 - DNA, 20 bp, Artificial Sequence
  Synthetic oligonucleotide; AGG chr2 60538371 60538390 60538387 +
atccactcacatcagtctcc

SEQ ID NO: 168364 - DNA, 20 bp, Artificial Sequence
  Synthetic oligonucleotide; GGG chr2 60538372 60538391 60538388 +
tccactcacatcagtctcca

SEQ ID NO: 168365 - DNA, 20 bp, Artificial Sequence
  Synthetic oligonucleotide; AAG chr2 60538381 60538400 60538397 +
atcagtctccagggtgaacc

SEQ ID NO: 168366 - DNA, 20 bp, Artificial Sequence
  Synthetic oligonucleotide; GAG chr2 60538383 60538402 60538399 +
cagtctccagggtgaaccaa

SEQ ID NO: 168367 - DNA, 20 bp, Artificial Sequence
  Synthetic oligonucleotide; CAG chr2 60538395 60538414 60538411 +
tgaaccaagagatgacactt

SEQ ID NO: 168368 - DNA, 20 bp, Artificial Sequence
  Synthetic oligonucleotide; CAG chr2 60538425 60538444 60538441 +
tctgcaaacttctaattcgc

SEQ ID NO: 168369 - DNA, 20 bp, Artificial Sequence
  Synthetic oligonucleotide; TAG chr2 60538432 60538451 60538448 +
acttctaattcgccagttct

SEQ ID NO: 168370 - DNA, 20 bp, Artificial Sequence
  Synthetic oligonucleotide; CAG chr2 60538435 60538454 60538451 +
tctaattcgccagttcttag

SEQ ID NO: 168371 - DNA, 20 bp, Artificial Sequence
  Synthetic oligonucleotide; AAG chr2 60538449 60538468 60538465 +
tcttagcagcttatttttcc

SEQ ID NO: 168372 - DNA, 20 bp, Artificial Sequence
  Synthetic oligonucleotide; CAG chr2 60538462 60538481 60538478 +
tttttccaagtgttttgttt

SEQ ID NO: 168373 - DNA, 20 bp, Artificial Sequence
  Synthetic oligonucleotide; AGG chr2 60538463 60538482 60538479 +
ttttccaagtgttttgtttc

SEQ ID NO: 168374 - DNA, 20 bp, Artificial Sequence
  Synthetic oligonucleotide; TGG chr2 60538494 60538513 60538510 +
atttttctttatacgttttg

SEQ ID NO: 168375 - DNA, 20 bp, Artificial Sequence
  Synthetic oligonucleotide; CAG chr2 60538518 60538537 60538534 +
tctaccacaactgcttctga

SEQ ID NO: 168376 - DNA, 20 bp, Artificial Sequence
  Synthetic oligonucleotide; AAG chr2 60538536 60538555 60538552 +
gacagctgttgattctgtta

SEQ ID NO: 168377 - DNA, 20 bp, Artificial Sequence
  Synthetic oligonucleotide; AGG chr2 60538537 60538556 60538553 +
acagctgttgattctgttaa

SEQ ID NO: 168378 - DNA, 20 bp, Artificial Sequence
  Synthetic oligonucleotide; AAG chr2 60538571 60538590 60538587 +
aaaatcttctttaaaacctc

SEQ ID NO: 168379 - DNA, 20 bp, Artificial Sequence
  Synthetic oligonucleotide; TGG chr2 60538579 60538598 60538595 +
ctttaaaacctcaagcaatg

SEQ ID NO: 168380 - DNA, 20 bp, Artificial Sequence
  Synthetic oligonucleotide; TGG chr2 60538596 60538615 60538612 +
atgtggactcaaaaatataa

SEQ ID NO: 168381 - DNA, 20 bp, Artificial Sequence
  Synthetic oligonucleotide; TGG chr2 60538612 60538631 60538628 +
ataatggtgaaatattttaa

SEQ ID NO: 168382 - DNA, 20 bp, Artificial Sequence
  Synthetic oligonucleotide; CAG chr2 60538620 60538639 60538636 +
gaaatattttaatggaattc

SEQ ID NO: 168383 - DNA, 20 bp, Artificial Sequence
  Synthetic oligonucleotide; AAG chr2 60538627 60538646 60538643 +
tttaatggaattccagttga

SEQ ID NO: 168384 - DNA, 20 bp, Artificial Sequence
  Synthetic oligonucleotide; AAG chr2 60538644 60538663 60538660 +
tgaaagttgttttttaaaaa

SEQ ID NO: 168385 - DNA, 20 bp, Artificial Sequence
  Synthetic oligonucleotide; AAG chr2 60538655 60538674 60538671 +
ttttaaaaaaagtacaaatg

SEQ ID NO: 168386 - DNA, 20 bp, Artificial Sequence
  Synthetic oligonucleotide; AGG chr2 60538656 60538675 60538672 +
tttaaaaaaagtacaaatga

SEQ ID NO: 168387 - DNA, 20 bp, Artificial Sequence
  Synthetic oligonucleotide; CAG chr2 60538661 60538680 60538677 +
aaaaagtacaaatgaaggta

SEQ ID NO: 168388 - DNA, 20 bp, Artificial Sequence
  Synthetic oligonucleotide; AAG chr2 60538664 60538683 60538680 +
aagtacaaatgaaggtacag

SEQ ID NO: 168389 - DNA, 20 bp, Artificial Sequence
  Synthetic oligonucleotide; TAG chr2 60538672 60538691 60538688 +
atgaaggtacagaagtcctt

SEQ ID NO: 168390 - DNA, 20 bp, Artificial Sequence
  Synthetic oligonucleotide; CAG chr2 60538677 60538696 60538693 +
ggtacagaagtcctttagat

SEQ ID NO: 168391 - DNA, 20 bp, Artificial Sequence
  Synthetic oligonucleotide; TAG chr2 60538683 60538702 60538699 +
gaagtcctttagatcagtac

SEQ ID NO: 168392 - DNA, 20 bp, Artificial Sequence
  Synthetic oligonucleotide; TGG chr2 60538767 60538786 60538783 +
gtgtgtgtgtgtgtgtgtaa

SEQ ID NO: 168393 - DNA, 20 bp, Artificial Sequence
  Synthetic oligonucleotide; GGG chr2 60538768 60538787 60538784 +
tgtgtgtgtgtgtgtgtaat

SEQ ID NO: 168394 - DNA, 20 bp, Artificial Sequence
  Synthetic oligonucleotide; GGG chr2 60538769 60538788 60538785 +
gtgtgtgtgtgtgtgtaatg

SEQ ID NO: 168395 - DNA, 20 bp, Artificial Sequence
  Synthetic oligonucleotide; AAG chr2 60538773 60538792 60538789 +
gtgtgtgtgtgtaatgggga

SEQ ID NO: 168396 - DNA, 20 bp, Artificial Sequence
  Synthetic oligonucleotide; GAG chr2 60538775 60538794 60538791 +
gtgtgtgtgtaatggggaaa

SEQ ID NO: 168397 - DNA, 20 bp, Artificial Sequence
  Synthetic oligonucleotide; AGG chr2 60538776 60538795 60538792 +
tgtgtgtgtaatggggaaag

SEQ ID NO: 168398 - DNA, 20 bp, Artificial Sequence
  Synthetic oligonucleotide; GGG chr2 60538777 60538796 60538793 +
gtgtgtgtaatggggaaaga

SEQ ID NO: 168399 - DNA, 20 bp, Artificial Sequence
  Synthetic oligonucleotide; GGG chr2 60538778 60538797 60538794 +
tgtgtgtaatggggaaagag

SEQ ID NO: 168400 - DNA, 20 bp, Artificial Sequence
  Synthetic oligonucleotide; CGG chr2 60538842 60538861 60538858 +
ttcaaatcacatacttttaa

SEQ ID NO: 168401 - DNA, 20 bp, Artificial Sequence
  Synthetic oligonucleotide; GGG chr2 60538843 60538862 60538859 +
tcaaatcacatacttttaac

SEQ ID NO: 168402 - DNA, 20 bp, Artificial Sequence
  Synthetic oligonucleotide; AAG chr2 60538848 60538867 60538864 +
tcacatacttttaacgggaa

SEQ ID NO: 168403 - DNA, 20 bp, Artificial Sequence
  Synthetic oligonucleotide; TGG chr2 60538852 60538871 60538868 +
atacttttaacgggaaaagc

SEQ ID NO: 168404 - DNA, 20 bp, Artificial Sequence
  Synthetic oligonucleotide; TGG chr2 60538860 60538879 60538876 +
aacgggaaaagctggaactg

SEQ ID NO: 168405 - DNA, 20 bp, Artificial Sequence
  Synthetic oligonucleotide; CAG chr2 60538936 60538955 60538952 +
tatgttgcatttctccatac

SEQ ID NO: 168406 - DNA, 20 bp, Artificial Sequence
  Synthetic oligonucleotide; TGG chr2 60538956 60538975 60538972 +
cagcacatgcaaaaaaattc

SEQ ID NO: 168407 - DNA, 20 bp, Artificial Sequence
  Synthetic oligonucleotide; TGG chr2 60538959 60538978 60538975 +
cacatgcaaaaaaattctgg

SEQ ID NO: 168408 - DNA, 20 bp, Artificial Sequence
  Synthetic oligonucleotide; TGG chr2 60538967 60538986 60538983 +
aaaaaattctggtggtgaat

SEQ ID NO: 168409 - DNA, 20 bp, Artificial Sequence
  Synthetic oligonucleotide; GGG chr2 60538968 60538987 60538984 +
aaaaattctggtggtgaatt

SEQ ID NO: 168410 - DNA, 20 bp, Artificial Sequence
  Synthetic oligonucleotide; GAG chr2 60538970 60538989 60538986 +
aaattctggtggtgaattgg

SEQ ID NO: 168411 - DNA, 20 bp, Artificial Sequence
  Synthetic oligonucleotide; AGG chr2 60538971 60538990 60538987 +
aattctggtggtgaattggg

SEQ ID NO: 168412 - DNA, 20 bp, Artificial Sequence
  Synthetic oligonucleotide; TGG chr2 60538974 60538993 60538990 +
tctggtggtgaattgggagg

SEQ ID NO: 168413 - DNA, 20 bp, Artificial Sequence
  Synthetic oligonucleotide; CAG chr2 60538977 60538996 60538993 +
ggtggtgaattgggaggtgg

SEQ ID NO: 168414 - DNA, 20 bp, Artificial Sequence
  Synthetic oligonucleotide; GAG chr2 60538979 60538998 60538995 +
tggtgaattgggaggtggca

SEQ ID NO: 168415 - DNA, 20 bp, Artificial Sequence
  Synthetic oligonucleotide; TGG chr2 60538983 60539002 60538999 +
gaattgggaggtggcagagt

SEQ ID NO: 168416 - DNA, 20 bp, Artificial Sequence
  Synthetic oligonucleotide; GGG chr2 60538984 60539003 60539000 +
aattgggaggtggcagagtt

SEQ ID NO: 168417 - DNA, 20 bp, Artificial Sequence
  Synthetic oligonucleotide; GGG chr2 60538985 60539004 60539001 +
attgggaggtggcagagttg

SEQ ID NO: 168418 - DNA, 20 bp, Artificial Sequence
  Synthetic oligonucleotide; GAG chr2 60538987 60539006 60539003 +
tgggaggtggcagagttggg

SEQ ID NO: 168419 - DNA, 20 bp, Artificial Sequence
  Synthetic oligonucleotide; AAG chr2 60538998 60539017 60539014 +
agagttggggagacaactcc

SEQ ID NO: 168420 - DNA, 20 bp, Artificial Sequence
  Synthetic oligonucleotide; GAG chr2 60539000 60539019 60539016 +
agttggggagacaactccaa

SEQ ID NO: 168421 - DNA, 20 bp, Artificial Sequence
  Synthetic oligonucleotide; AAG chr2 60539003 60539022 60539019 +
tggggagacaactccaagag

SEQ ID NO: 168422 - DNA, 20 bp, Artificial Sequence
  Synthetic oligonucleotide; AAG chr2 60539008 60539027 60539024 +
agacaactccaagagaagaa

SEQ ID NO: 168423 - DNA, 20 bp, Artificial Sequence
  Synthetic oligonucleotide; AGG chr2 60539009 60539028 60539025 +
gacaactccaagagaagaaa

SEQ ID NO: 168424 - DNA, 20 bp, Artificial Sequence
  Synthetic oligonucleotide; TAG chr2 60539032 60539051 60539048 +
atgatgttttcatttcgcta

SEQ ID NO: 168425 - DNA, 20 bp, Artificial Sequence
  Synthetic oligonucleotide; AAG chr2 60539039 60539058 60539055 +
tttcatttcgctatagatca

SEQ ID NO: 168426 - DNA, 20 bp, Artificial Sequence
  Synthetic oligonucleotide; AGG chr2 60539040 60539059 60539056 +
ttcatttcgctatagatcaa

SEQ ID NO: 168427 - DNA, 20 bp, Artificial Sequence
  Synthetic oligonucleotide; GAG chr2 60539042 60539061 60539058 +
catttcgctatagatcaaag

SEQ ID NO: 168428 - DNA, 20 bp, Artificial Sequence
  Synthetic oligonucleotide; AAG chr2 60539048 60539067 60539064 +
gctatagatcaaaggagaac

SEQ ID NO: 168429 - DNA, 20 bp, Artificial Sequence
  Synthetic oligonucleotide; TGG chr2 60539053 60539072 60539069 +
agatcaaaggagaacaagaa

SEQ ID NO: 168430 - DNA, 20 bp, Artificial Sequence
  Synthetic oligonucleotide; TGG chr2 60539062 60539081 60539078 +
gagaacaagaatggaaactg

SEQ ID NO: 168431 - DNA, 20 bp, Artificial Sequence
  Synthetic oligonucleotide; GAG chr2 60539071 60539090 60539087 +
aatggaaactgtggcatatc

SEQ ID NO: 168432 - DNA, 20 bp, Artificial Sequence
  Synthetic oligonucleotide; TGG chr2 60539100 60539119 60539116 +
tccattgctgtctttcacac

SEQ ID NO: 168433 - DNA, 20 bp, Artificial Sequence
  Synthetic oligonucleotide; GGG chr2 60539101 60539120 60539117 +
ccattgctgtctttcacact

SEQ ID NO: 168434 - DNA, 20 bp, Artificial Sequence
  Synthetic oligonucleotide; AAG chr2 60539110 60539129 60539126 +
tctttcacactgggctatct

SEQ ID NO: 168435 - DNA, 20 bp, Artificial Sequence
  Synthetic oligonucleotide; CAG chr2 60539127 60539146 60539143 +
tctaagtttatacaattccc

SEQ ID NO: 168436 - DNA, 20 bp, Artificial Sequence
  Synthetic oligonucleotide; TAG chr2 60539132 60539151 60539148 +
gtttatacaattccccagac

SEQ ID NO: 168437 - DNA, 20 bp, Artificial Sequence
  Synthetic oligonucleotide; AAG chr2 60539144 60539163 60539160 +
ccccagactagctgcatatt

SEQ ID NO: 168438 - DNA, 20 bp, Artificial Sequence
  Synthetic oligonucleotide; CAG chr2 60539158 60539177 60539174 +
catattaagcttgctgtgta

SEQ ID NO: 168439 - DNA, 20 bp, Artificial Sequence
  Synthetic oligonucleotide; TGG chr2 60539169 60539188 60539185 +
tgctgtgtacagctttatta

SEQ ID NO: 168440 - DNA, 20 bp, Artificial Sequence
  Synthetic oligonucleotide; TGG chr2 60539174 60539193 60539190 +
tgtacagctttattatggtg

SEQ ID NO: 168441 - DNA, 20 bp, Artificial Sequence
  Synthetic oligonucleotide; TGG chr2 60539177 60539196 60539193 +
acagctttattatggtgtgg

SEQ ID NO: 168442 - DNA, 20 bp, Artificial Sequence
  Synthetic oligonucleotide; TGG chr2 60539180 60539199 60539196 +
gctttattatggtgtggtgg

SEQ ID NO: 168443 - DNA, 20 bp, Artificial Sequence
  Synthetic oligonucleotide; AAG chr2 60539183 60539202 60539199 +
ttattatggtgtggtggtgg

SEQ ID NO: 168444 - DNA, 20 bp, Artificial Sequence
  Synthetic oligonucleotide; AAG chr2 60539186 60539205 60539202 +
ttatggtgtggtggtggaag

SEQ ID NO: 168445 - DNA, 20 bp, Artificial Sequence
  Synthetic oligonucleotide; CAG chr2 60539200 60539219 60539216 +
tggaagaagcattaatattc

SEQ ID NO: 168446 - DNA, 20 bp, Artificial Sequence
  Synthetic oligonucleotide; CAG chr2 60539215 60539234 60539231 +
tattccagctccgcatctga

SEQ ID NO: 168447 - DNA, 20 bp, Artificial Sequence
  Synthetic oligonucleotide; AGG chr2 60539216 60539235 60539232 +
attccagctccgcatctgac

SEQ ID NO: 168448 - DNA, 20 bp, Artificial Sequence
  Synthetic oligonucleotide; GGG chr2 60539217 60539236 60539233 +
ttccagctccgcatctgaca

SEQ ID NO: 168449 - DNA, 20 bp, Artificial Sequence
  Synthetic oligonucleotide; GAG chr2 60539239 60539258 60539255 +
gcatttacatgcgcccatct

SEQ ID NO: 168450 - DNA, 20 bp, Artificial Sequence
  Synthetic oligonucleotide; CGG chr2 60539242 60539261 60539258 +
tttacatgcgcccatctgag

SEQ ID NO: 168451 - DNA, 20 bp, Artificial Sequence
  Synthetic oligonucleotide; GAG chr2 60539250 60539269 60539266 +
cgcccatctgagcggcacct

SEQ ID NO: 168452 - DNA, 20 bp, Artificial Sequence
  Synthetic oligonucleotide; GAG chr2 60539252 60539271 60539268 +
cccatctgagcggcacctga

SEQ ID NO: 168453 - DNA, 20 bp, Artificial Sequence
  Synthetic oligonucleotide; AAG chr2 60539262 60539281 60539278 +
cggcacctgagagctcctcc

SEQ ID NO: 168454 - DNA, 20 bp, Artificial Sequence
  Synthetic oligonucleotide; AGG chr2 60539263 60539282 60539279 +
ggcacctgagagctcctcca

SEQ ID NO: 168455 - DNA, 20 bp, Artificial Sequence
  Synthetic oligonucleotide; CAG chr2 60539268 60539287 60539284 +
ctgagagctcctccaaggtg

SEQ ID NO: 168456 - DNA, 20 bp, Artificial Sequence
  Synthetic oligonucleotide; AAG chr2 60539290 60539309 60539306 +
gtaactgtgcgcctattgta

SEQ ID NO: 168457 - DNA, 20 bp, Artificial Sequence
  Synthetic oligonucleotide; AGG chr2 60539291 60539310 60539307 +
taactgtgcgcctattgtaa

SEQ ID NO: 168458 - DNA, 20 bp, Artificial Sequence
  Synthetic oligonucleotide; AAG chr2 60539300 60539319 60539316 +
gcctattgtaaaggcaaatg

SEQ ID NO: 168459 - DNA, 20 bp, Artificial Sequence
  Synthetic oligonucleotide; TGG chr2 60539319 60539338 60539335 +
gaagctcacctattccctgc

SEQ ID NO: 168460 - DNA, 20 bp, Artificial Sequence
  Synthetic oligonucleotide; GGG chr2 60539320 60539339 60539336 +
aagctcacctattccctgct

SEQ ID NO: 168461 - DNA, 20 bp, Artificial Sequence
  Synthetic oligonucleotide; CAG chr2 60539325 60539344 60539341 +
cacctattccctgctgggat

SEQ ID NO: 168462 - DNA, 20 bp, Artificial Sequence
  Synthetic oligonucleotide; AAG chr2 60539328 60539347 60539344 +
ctattccctgctgggatcag

SEQ ID NO: 168463 - DNA, 20 bp, Artificial Sequence
  Synthetic oligonucleotide; CAG chr2 60539391 60539410 60539407 +
aacctaactcaatgccattg

SEQ ID NO: 168464 - DNA, 20 bp, Artificial Sequence
  Synthetic oligonucleotide; GAG chr2 60539404 60539423 60539420 +
gccattgcagaatgacgaat

SEQ ID NO: 168465 - DNA, 20 bp, Artificial Sequence
  Synthetic oligonucleotide; CAG chr2 60539409 60539428 60539425 +
tgcagaatgacgaatgagct

SEQ ID NO: 168466 - DNA, 20 bp, Artificial Sequence
  Synthetic oligonucleotide; TAG chr2 60539415 60539434 60539431 +
atgacgaatgagctcagaaa

SEQ ID NO: 168467 - DNA, 20 bp, Artificial Sequence
  Synthetic oligonucleotide; AAG chr2 60539423 60539442 60539439 +
tgagctcagaaatagacccc

SEQ ID NO: 168468 - DNA, 20 bp, Artificial Sequence
  Synthetic oligonucleotide; AAG chr2 60539440 60539459 60539456 +
cccaagttactaaccctgct

SEQ ID NO: 168469 - DNA, 20 bp, Artificial Sequence
  Synthetic oligonucleotide; CAG chr2 60539445 60539464 60539461 +
gttactaaccctgctaagaa

SEQ ID NO: 168470 - DNA, 20 bp, Artificial Sequence
  Synthetic oligonucleotide; AAG chr2 60539451 60539470 60539467 +
aaccctgctaagaacagcaa

SEQ ID NO: 168471 - DNA, 20 bp, Artificial Sequence
  Synthetic oligonucleotide; TAG chr2 60539481 60539500 60539497 +
tgaaatgttttaaaaatgca

SEQ ID NO: 168472 - DNA, 20 bp, Artificial Sequence
  Synthetic oligonucleotide; AGG chr2 60539482 60539501 60539498 +
gaaatgttttaaaaatgcat

SEQ ID NO: 168473 - DNA, 20 bp, Artificial Sequence
  Synthetic oligonucleotide; GGG chr2 60539483 60539502 60539499 +
aaatgttttaaaaatgcata

SEQ ID NO: 168474 - DNA, 20 bp, Artificial Sequence
  Synthetic oligonucleotide; GAG chr2 60539485 60539504 60539501 +
atgttttaaaaatgcatagg

SEQ ID NO: 168475 - DNA, 20 bp, Artificial Sequence
  Synthetic oligonucleotide; CAG chr2 60539490 60539509 60539506 +
ttaaaaatgcatagggagtg

SEQ ID NO: 168476 - DNA, 20 bp, Artificial Sequence
  Synthetic oligonucleotide; TGG chr2 60539494 60539513 60539510 +
aaatgcatagggagtgcagc

SEQ ID NO: 168477 - DNA, 20 bp, Artificial Sequence
  Synthetic oligonucleotide; CAG chr2 60539498 60539517 60539514 +
gcatagggagtgcagctggc

SEQ ID NO: 168478 - DNA, 20 bp, Artificial Sequence
  Synthetic oligonucleotide; AAG chr2 60539505 60539524 60539521 +
gagtgcagctggccagtaaa

SEQ ID NO: 168479 - DNA, 20 bp, Artificial Sequence
  Synthetic oligonucleotide; CAG chr2 60539508 60539527 60539524 +
tgcagctggccagtaaaaag

SEQ ID NO: 168480 - DNA, 20 bp, Artificial Sequence
  Synthetic oligonucleotide; AGG chr2 60539509 60539528 60539525 +
gcagctggccagtaaaaagc

SEQ ID NO: 168481 - DNA, 20 bp, Artificial Sequence
  Synthetic oligonucleotide; GGG chr2 60539510 60539529 60539526 +
cagctggccagtaaaaagca

SEQ ID NO: 168482 - DNA, 20 bp, Artificial Sequence
  Synthetic oligonucleotide; GAG chr2 60539512 60539531 60539528 +
gctggccagtaaaaagcagg

SEQ ID NO: 168483 - DNA, 20 bp, Artificial Sequence
  Synthetic oligonucleotide; TGG chr2 60539537 60539556 60539553 +
aaattccaatgaacccaata

SEQ ID NO: 168484 - DNA, 20 bp, Artificial Sequence
  Synthetic oligonucleotide; AAG chr2 60539543 60539562 60539559 +
caatgaacccaatatggaat

SEQ ID NO: 168485 - DNA, 20 bp, Artificial Sequence
  Synthetic oligonucleotide; TAG chr2 60539564 60539583 60539580 +
agttacattttaaaactgat

SEQ ID NO: 168486 - DNA, 20 bp, Artificial Sequence
  Synthetic oligonucleotide; CAG chr2 60539572 60539591 60539588 +
tttaaaactgattagaaata

SEQ ID NO: 168487 - DNA, 20 bp, Artificial Sequence
  Synthetic oligonucleotide; TGG chr2 60539587 60539606 60539603 +
aaatacagtctgatgtttac

SEQ ID NO: 168488 - DNA, 20 bp, Artificial Sequence
  Synthetic oligonucleotide; GAG chr2 60539599 60539618 60539615 +
atgtttactggcttcaaatt

SEQ ID NO: 168489 - DNA, 20 bp, Artificial Sequence
  Synthetic oligonucleotide; TGG chr2 60539604 60539623 60539620 +
tactggcttcaaattgagtt

SEQ ID NO: 168490 - DNA, 20 bp, Artificial Sequence
  Synthetic oligonucleotide; AAG chr2 60539611 60539630 60539627 +
ttcaaattgagtttggcatc

SEQ ID NO: 168491 - DNA, 20 bp, Artificial Sequence
  Synthetic oligonucleotide; TGG chr2 60539619 60539638 60539635 +
gagtttggcatcaagtatac

SEQ ID NO: 168492 - DNA, 20 bp, Artificial Sequence
  Synthetic oligonucleotide; TGG chr2 60539634 60539653 60539650 +
tatactggctttaataatgc

SEQ ID NO: 168493 - DNA, 20 bp, Artificial Sequence
  Synthetic oligonucleotide; TGG chr2 60539672 60539691 60539688 +
tattattttaaatctgcctt

SEQ ID NO: 168494 - DNA, 20 bp, Artificial Sequence
  Synthetic oligonucleotide; TAG chr2 60539679 60539698 60539695 +
ttaaatctgcctttggtctc

SEQ ID NO: 168495 - DNA, 20 bp, Artificial Sequence
  Synthetic oligonucleotide; AGG chr2 60539680 60539699 60539696 +
taaatctgcctttggtctct

SEQ ID NO: 168496 - DNA, 20 bp, Artificial Sequence
  Synthetic oligonucleotide; GAG chr2 60539682 60539701 60539698 +
aatctgcctttggtctctag

SEQ ID NO: 168497 - DNA, 20 bp, Artificial Sequence
  Synthetic oligonucleotide; TAG chr2 60539691 60539710 60539707 +
ttggtctctaggagcacatg

SEQ ID NO: 168498 - DNA, 20 bp, Artificial Sequence
  Synthetic oligonucleotide; GAG chr2 60539693 60539712 60539709 +
ggtctctaggagcacatgta

SEQ ID NO: 168499 - DNA, 20 bp, Artificial Sequence
  Synthetic oligonucleotide; GAG chr2 60539695 60539714 60539711 +
tctctaggagcacatgtaga

SEQ ID NO: 168500 - DNA, 20 bp, Artificial Sequence
  Synthetic oligonucleotide; AAG chr2 60539701 60539720 60539717 +
ggagcacatgtagagagcta

SEQ ID NO: 168501 - DNA, 20 bp, Artificial Sequence
  Synthetic oligonucleotide; CAG chr2 60539717 60539736 60539733 +
gctaaagaattcttatttgt

SEQ ID NO: 168502 - DNA, 20 bp, Artificial Sequence
  Synthetic oligonucleotide; AGG chr2 60539718 60539737 60539734 +
ctaaagaattcttatttgtc

SEQ ID NO: 168503 - DNA, 20 bp, Artificial Sequence
  Synthetic oligonucleotide; TGG chr2 60539731 60539750 60539747 +
atttgtcaggttacatttcc

SEQ ID NO: 168504 - DNA, 20 bp, Artificial Sequence
  Synthetic oligonucleotide; AAG chr2 60539739 60539758 60539755 +
ggttacatttcctggaaatt

SEQ ID NO: 168505 - DNA, 20 bp, Artificial Sequence
  Synthetic oligonucleotide; CAG chr2 60539749 60539768 60539765 +
cctggaaattaagtttgtga

SEQ ID NO: 168506 - DNA, 20 bp, Artificial Sequence
  Synthetic oligonucleotide; CAG chr2 60539762 60539781 60539778 +
tttgtgacagaaaatgactc

SEQ ID NO: 168507 - DNA, 20 bp, Artificial Sequence
  Synthetic oligonucleotide; TAG chr2 60539765 60539784 60539781 +
gtgacagaaaatgactccag

SEQ ID NO: 168508 - DNA, 20 bp, Artificial Sequence
  Synthetic oligonucleotide; TGG chr2 60539776 60539795 60539792 +
tgactccagtagcaataata

SEQ ID NO: 168509 - DNA, 20 bp, Artificial Sequence
  Synthetic oligonucleotide; TAG chr2 60539796 60539815 60539812 +
tggttcgtgctcaaattaat

SEQ ID NO: 168510 - DNA, 20 bp, Artificial Sequence
  Synthetic oligonucleotide; AGG chr2 60539797 60539816 60539813 +
ggttcgtgctcaaattaatt

SEQ ID NO: 168511 - DNA, 20 bp, Artificial Sequence
  Synthetic oligonucleotide; TGG chr2 60539819 60539838 60539835 +
gtcatgttgtaaaaactacg

SEQ ID NO: 168512 - DNA, 20 bp, Artificial Sequence
  Synthetic oligonucleotide; AAG chr2 60539831 60539850 60539847 +
aaactacgtggcaaattaca

SEQ ID NO: 168513 - DNA, 20 bp, Artificial Sequence
  Synthetic oligonucleotide; AGG chr2 60539832 60539851 60539848 +
aactacgtggcaaattacaa

SEQ ID NO: 168514 - DNA, 20 bp, Artificial Sequence
  Synthetic oligonucleotide; TGG chr2 60539850 60539869 60539866 +
aaaggtaaatttactgatat

SEQ ID NO: 168515 - DNA, 20 bp, Artificial Sequence
  Synthetic oligonucleotide; CAG chr2 60539854 60539873 60539870 +
gtaaatttactgatattggc

SEQ ID NO: 168516 - DNA, 20 bp, Artificial Sequence
  Synthetic oligonucleotide; TGG chr2 60539869 60539888 60539885 +
ttggccagtgctctataccc

SEQ ID NO: 168517 - DNA, 20 bp, Artificial Sequence
  Synthetic oligonucleotide; AAG chr2 60539877 60539896 60539893 +
tgctctataccctggtcgta

SEQ ID NO: 168518 - DNA, 20 bp, Artificial Sequence
  Synthetic oligonucleotide; AGG chr2 60539878 60539897 60539894 +
gctctataccctggtcgtaa

SEQ ID NO: 168519 - DNA, 20 bp, Artificial Sequence
  Synthetic oligonucleotide; GGG chr2 60539879 60539898 60539895 +
ctctataccctggtcgtaaa

SEQ ID NO: 168520 - DNA, 20 bp, Artificial Sequence
  Synthetic oligonucleotide; GGG chr2 60539880 60539899 60539896 +
tctataccctggtcgtaaag

SEQ ID NO: 168521 - DNA, 20 bp, Artificial Sequence
  Synthetic oligonucleotide; GAG chr2 60539882 60539901 60539898 +
tataccctggtcgtaaaggg

SEQ ID NO: 168522 - DNA, 20 bp, Artificial Sequence
  Synthetic oligonucleotide; AAG chr2 60539885 60539904 60539901 +
accctggtcgtaaaggggag

SEQ ID NO: 168523 - DNA, 20 bp, Artificial Sequence
  Synthetic oligonucleotide; AAG chr2 60539894 60539913 60539910 +
gtaaaggggagaagctgttt

SEQ ID NO: 168524 - DNA, 20 bp, Artificial Sequence
  Synthetic oligonucleotide; AGG chr2 60539895 60539914 60539911 +
taaaggggagaagctgttta

SEQ ID NO: 168525 - DNA, 20 bp, Artificial Sequence
  Synthetic oligonucleotide; TAG chr2 60539911 60539930 60539927 +
tttaaggatgcccatttacc

SEQ ID NO: 168526 - DNA, 20 bp, Artificial Sequence
  Synthetic oligonucleotide; AGG chr2 60539912 60539931 60539928 +
ttaaggatgcccatttacct

SEQ ID NO: 168527 - DNA, 20 bp, Artificial Sequence
  Synthetic oligonucleotide; TAG chr2 60539915 60539934 60539931 +
aggatgcccatttacctagg

SEQ ID NO: 168528 - DNA, 20 bp, Artificial Sequence
  Synthetic oligonucleotide; AGG chr2 60539916 60539935 60539932 +
ggatgcccatttacctaggt

SEQ ID NO: 168529 - DNA, 20 bp, Artificial Sequence
  Synthetic oligonucleotide; GAG chr2 60539918 60539937 60539934 +
atgcccatttacctaggtag

SEQ ID NO: 168530 - DNA, 20 bp, Artificial Sequence
  Synthetic oligonucleotide; AAG chr2 60539923 60539942 60539939 +
catttacctaggtaggagaa

SEQ ID NO: 168531 - DNA, 20 bp, Artificial Sequence
  Synthetic oligonucleotide; AAG chr2 60539930 60539949 60539946 +
ctaggtaggagaaaagaacc

SEQ ID NO: 168532 - DNA, 20 bp, Artificial Sequence
  Synthetic oligonucleotide; AGG chr2 60539931 60539950 60539947 +
taggtaggagaaaagaacca

SEQ ID NO: 168533 - DNA, 20 bp, Artificial Sequence
  Synthetic oligonucleotide; GAG chr2 60539933 60539952 60539949 +
ggtaggagaaaagaaccaag

SEQ ID NO: 168534 - DNA, 20 bp, Artificial Sequence
  Synthetic oligonucleotide; AGG chr2 60539934 60539953 60539950 +
gtaggagaaaagaaccaagg

SEQ ID NO: 168535 - DNA, 20 bp, Artificial Sequence
  Synthetic oligonucleotide; GGG chr2 60539935 60539954 60539951 +
taggagaaaagaaccaagga

SEQ ID NO: 168536 - DNA, 20 bp, Artificial Sequence
  Synthetic oligonucleotide; GAG chr2 60539937 60539956 60539953 +
ggagaaaagaaccaaggagg

SEQ ID NO: 168537 - DNA, 20 bp, Artificial Sequence
  Synthetic oligonucleotide; AGG chr2 60539938 60539957 60539954 +
gagaaaagaaccaaggaggg

SEQ ID NO: 168538 - DNA, 20 bp, Artificial Sequence
  Synthetic oligonucleotide; GGG chr2 60539939 60539958 60539955 +
agaaaagaaccaaggaggga

SEQ ID NO: 168539 - DNA, 20 bp, Artificial Sequence
  Synthetic oligonucleotide; GAG chr2 60539941 60539960 60539957 +
aaaagaaccaaggagggagg

SEQ ID NO: 168540 - DNA, 20 bp, Artificial Sequence
  Synthetic oligonucleotide; CAG chr2 60539948 60539967 60539964 +
ccaaggagggagggagacaa

SEQ ID NO: 168541 - DNA, 20 bp, Artificial Sequence
  Synthetic oligonucleotide; TAG chr2 60539981 60540000 60539997 +
atttgtattacaaataaaaa

SEQ ID NO: 168542 - DNA, 20 bp, Artificial Sequence
  Synthetic oligonucleotide; TAG chr2 60539984 60540003 60540000 +
tgtattacaaataaaaatag

SEQ ID NO: 168543 - DNA, 20 bp, Artificial Sequence
  Synthetic oligonucleotide; TAG chr2 60540007 60540026 60540023 +
tcattatccattaaattata

SEQ ID NO: 168544 - DNA, 20 bp, Artificial Sequence
  Synthetic oligonucleotide; AAG chr2 60540093 60540112 60540109 +
ttgatttgaaataatgttaa

SEQ ID NO: 168545 - DNA, 20 bp, Artificial Sequence
  Synthetic oligonucleotide; TGG chr2 60540096 60540115 60540112 +
atttgaaataatgttaaaag

SEQ ID NO: 168546 - DNA, 20 bp, Artificial Sequence
  Synthetic oligonucleotide; GGG chr2 60540097 60540116 60540113 +
tttgaaataatgttaaaagt

SEQ ID NO: 168547 - DNA, 20 bp, Artificial Sequence
  Synthetic oligonucleotide; AAG chr2 60540104 60540123 60540120 +
taatgttaaaagtgggctct

SEQ ID NO: 168548 - DNA, 20 bp, Artificial Sequence
  Synthetic oligonucleotide; TAG chr2 60540108 60540127 60540124 +
gttaaaagtgggctctaagt

SEQ ID NO: 168549 - DNA, 20 bp, Artificial Sequence
  Synthetic oligonucleotide; TAG chr2 60540152 60540171 60540168 +
aaataacaacactgctgaca

SEQ ID NO: 168550 - DNA, 20 bp, Artificial Sequence
  Synthetic oligonucleotide; AAG chr2 60540179 60540198 60540195 +
gacccaaatgaaatctgaac

SEQ ID NO: 168551 - DNA, 20 bp, Artificial Sequence
  Synthetic oligonucleotide; CAG chr2 60540182 60540201 60540198 +
ccaaatgaaatctgaacaag

SEQ ID NO: 168552 - DNA, 20 bp, Artificial Sequence
  Synthetic oligonucleotide; AAG chr2 60540186 60540205 60540202 +
atgaaatctgaacaagcaga

SEQ ID NO: 168553 - DNA, 20 bp, Artificial Sequence
  Synthetic oligonucleotide; AGG chr2 60540187 60540206 60540203 +
tgaaatctgaacaagcagaa

SEQ ID NO: 168554 - DNA, 20 bp, Artificial Sequence
  Synthetic oligonucleotide; AAG chr2 60540195 60540214 60540211 +
gaacaagcagaaaggtacta

SEQ ID NO: 168555 - DNA, 20 bp, Artificial Sequence
  Synthetic oligonucleotide; TGG chr2 60540203 60540222 60540219 +
agaaaggtactaaagatgct

SEQ ID NO: 168556 - DNA, 20 bp, Artificial Sequence
  Synthetic oligonucleotide; AAG chr2 60540227 60540246 60540243 +
gattaaatctcatgctaaaa

SEQ ID NO: 168557 - DNA, 20 bp, Artificial Sequence
  Synthetic oligonucleotide; TGG chr2 60540230 60540249 60540246 +
taaatctcatgctaaaaaag

SEQ ID NO: 168558 - DNA, 20 bp, Artificial Sequence
  Synthetic oligonucleotide; AAG chr2 60540234 60540253 60540250 +
tctcatgctaaaaaagtggc

SEQ ID NO: 168559 - DNA, 20 bp, Artificial Sequence
  Synthetic oligonucleotide; AGG chr2 60540235 60540254 60540251 +
ctcatgctaaaaaagtggca

SEQ ID NO: 168560 - DNA, 20 bp, Artificial Sequence
  Synthetic oligonucleotide; CAG chr2 60540241 60540260 60540257 +
ctaaaaaagtggcaaggtgc

SEQ ID NO: 168561 - DNA, 20 bp, Artificial Sequence
  Synthetic oligonucleotide; AGG chr2 60540242 60540261 60540258 +
taaaaaagtggcaaggtgcc

SEQ ID NO: 168562 - DNA, 20 bp, Artificial Sequence
  Synthetic oligonucleotide; TGG chr2 60540246 60540265 60540262 +
aaagtggcaaggtgccaggc

SEQ ID NO: 168563 - DNA, 20 bp, Artificial Sequence
  Synthetic oligonucleotide; GGG chr2 60540247 60540266 60540263 +
aagtggcaaggtgccaggct

SEQ ID NO: 168564 - DNA, 20 bp, Artificial Sequence
  Synthetic oligonucleotide; CAG chr2 60540252 60540271 60540268 +
gcaaggtgccaggctgggtc

SEQ ID NO: 168565 - DNA, 20 bp, Artificial Sequence
  Synthetic oligonucleotide; AAG chr2 60540264 60540283 60540280 +
gctgggtccagcttgatgct

SEQ ID NO: 168566 - DNA, 20 bp, Artificial Sequence
  Synthetic oligonucleotide; AAG chr2 60540283 60540302 60540299 +
taagtgctttttattgcaca

SEQ ID NO: 168567 - DNA, 20 bp, Artificial Sequence
  Synthetic oligonucleotide; TGG chr2 60540287 60540306 60540303 +
tgctttttattgcacaaagc

SEQ ID NO: 168568 - DNA, 20 bp, Artificial Sequence
  Synthetic oligonucleotide; CAG chr2 60540308 60540327 60540324 +
ggtactactgtatgtaaaaa

SEQ ID NO: 168569 - DNA, 20 bp, Artificial Sequence
  Synthetic oligonucleotide; TGG chr2 60540314 60540333 60540330 +
actgtatgtaaaaacagact

SEQ ID NO: 168570 - DNA, 20 bp, Artificial Sequence
  Synthetic oligonucleotide; GGG chr2 60540315 60540334 60540331 +
ctgtatgtaaaaacagactt

SEQ ID NO: 168571 - DNA, 20 bp, Artificial Sequence
  Synthetic oligonucleotide; TGG chr2 60540320 60540339 60540336 +
tgtaaaaacagacttgggct

SEQ ID NO: 168572 - DNA, 20 bp, Artificial Sequence
  Synthetic oligonucleotide; GGG chr2 60540321 60540340 60540337 +
gtaaaaacagacttgggctt

SEQ ID NO: 168573 - DNA, 20 bp, Artificial Sequence
  Synthetic oligonucleotide; GGG chr2 60540322 60540341 60540338 +
taaaaacagacttgggcttg

SEQ ID NO: 168574 - DNA, 20 bp, Artificial Sequence
  Synthetic oligonucleotide; AAG chr2 60540357 60540376 60540373 +
aatgacttctttgtgcaata

SEQ ID NO: 168575 - DNA, 20 bp, Artificial Sequence
  Synthetic oligonucleotide; AGG chr2 60540358 60540377 60540374 +
atgacttctttgtgcaataa

SEQ ID NO: 168576 - DNA, 20 bp, Artificial Sequence
  Synthetic oligonucleotide; GGG chr2 60540359 60540378 60540375 +
tgacttctttgtgcaataaa

SEQ ID NO: 168577 - DNA, 20 bp, Artificial Sequence
  Synthetic oligonucleotide; CAG chr2 60540368 60540387 60540384 +
tgtgcaataaagggtgtgaa

SEQ ID NO: 168578 - DNA, 20 bp, Artificial Sequence
  Synthetic oligonucleotide; AAG chr2 60540379 60540398 60540395 +
gggtgtgaacagaccaacca

SEQ ID NO: 168579 - DNA, 20 bp, Artificial Sequence
  Synthetic oligonucleotide; TAG chr2 60540382 60540401 60540398 +
tgtgaacagaccaaccaaag

SEQ ID NO: 168580 - DNA, 20 bp, Artificial Sequence
  Synthetic oligonucleotide; CAG chr2 60540399 60540418 60540415 +
aagtagattaaattaacatc

SEQ ID NO: 168581 - DNA, 20 bp, Artificial Sequence
  Synthetic oligonucleotide; TGG chr2 60540413 60540432 60540429 +
aacatccagtgacgcaatct

SEQ ID NO: 168582 - DNA, 20 bp, Artificial Sequence
  Synthetic oligonucleotide; TAG chr2 60540426 60540445 60540442 +
gcaatcttggtgcatctccc

SEQ ID NO: 168583 - DNA, 20 bp, Artificial Sequence
  Synthetic oligonucleotide; CGG chr2 60540444 60540463 60540460 +
cctagctgtgctttctactt

SEQ ID NO: 168584 - DNA, 20 bp, Artificial Sequence
  Synthetic oligonucleotide; AAG chr2 60540469 60540488 60540485 +
aaatttaatatttcccccca

SEQ ID NO: 168585 - DNA, 20 bp, Artificial Sequence
  Synthetic oligonucleotide; AGG chr2 60540470 60540489 60540486 +
aatttaatatttccccccaa

SEQ ID NO: 168586 - DNA, 20 bp, Artificial Sequence
  Synthetic oligonucleotide; AAG chr2 60540474 60540493 60540490 +
taatatttccccccaaagga

SEQ ID NO: 168587 - DNA, 20 bp, Artificial Sequence
  Synthetic oligonucleotide; CAG chr2 60540504 60540523 60540520 +
ttgtttcctttcttactgac

SEQ ID NO: 168588 - DNA, 20 bp, Artificial Sequence
  Synthetic oligonucleotide; AAG chr2 60540513 60540532 60540529 +
ttcttactgaccagcacgca

SEQ ID NO: 168589 - DNA, 20 bp, Artificial Sequence
  Synthetic oligonucleotide; GAG chr2 60540555 60540574 60540571 +
ctttattaaacattttcatt

SEQ ID NO: 168590 - DNA, 20 bp, Artificial Sequence
  Synthetic oligonucleotide; TAG chr2 60540587 60540606 60540603 +
aaatctaaaaaatgtttccc

SEQ ID NO: 168591 - DNA, 20 bp, Artificial Sequence
  Synthetic oligonucleotide; AGG chr2 60540588 60540607 60540604 +
aatctaaaaaatgtttccct

SEQ ID NO: 168592 - DNA, 20 bp, Artificial Sequence
  Synthetic oligonucleotide; TAG chr2 60540619 60540638 60540635 +
gttttttatgtaccccaatt

SEQ ID NO: 168593 - DNA, 20 bp, Artificial Sequence
  Synthetic oligonucleotide; TAG chr2 60540633 60540652 60540649 +
ccaatttagtactcccacat

SEQ ID NO: 168594 - DNA, 20 bp, Artificial Sequence
  Synthetic oligonucleotide; TGG chr2 60540646 60540665 60540662 +
cccacattagccaaactaca

SEQ ID NO: 168595 - DNA, 20 bp, Artificial Sequence
  Synthetic oligonucleotide; AAG chr2 60540649 60540668 60540665 +
acattagccaaactacatgg

SEQ ID NO: 168596 - DNA, 20 bp, Artificial Sequence
  Synthetic oligonucleotide; CAG chr2 60540655 60540674 60540671 +
gccaaactacatggaagctg

SEQ ID NO: 168597 - DNA, 20 bp, Artificial Sequence
  Synthetic oligonucleotide; CAG chr2 60540677 60540696 60540693 +
gtgtgaaattaatgattttc

SEQ ID NO: 168598 - DNA, 20 bp, Artificial Sequence
  Synthetic oligonucleotide; AGG chr2 60540678 60540697 60540694 +
tgtgaaattaatgattttcc

SEQ ID NO: 168599 - DNA, 20 bp, Artificial Sequence
  Synthetic oligonucleotide; AAG chr2 60540688 60540707 60540704 +
atgattttccaggactctaa

SEQ ID NO: 168600 - DNA, 20 bp, Artificial Sequence
  Synthetic oligonucleotide; AAG chr2 60540702 60540721 60540718 +
ctctaaaagatgccattaat

SEQ ID NO: 168601 - DNA, 20 bp, Artificial Sequence
  Synthetic oligonucleotide; GAG chr2 60540726 60540745 60540742 +
atccaactcgcctcctccct

SEQ ID NO: 168602 - DNA, 20 bp, Artificial Sequence
  Synthetic oligonucleotide; AAG chr2 60540732 60540751 60540748 +
ctcgcctcctccctgagctg

SEQ ID NO: 168603 - DNA, 20 bp, Artificial Sequence
  Synthetic oligonucleotide; AGG chr2 60540733 60540752 60540749 +
tcgcctcctccctgagctga

SEQ ID NO: 168604 - DNA, 20 bp, Artificial Sequence
  Synthetic oligonucleotide; CAG chr2 60540772 60540791 60540788 +
tgcctgcacgtttctacacc

SEQ ID NO: 168605 - DNA, 20 bp, Artificial Sequence
  Synthetic oligonucleotide; CAG chr2 60540785 60540804 60540801 +
ctacacccagttgcattttc

SEQ ID NO: 168606 - DNA, 20 bp, Artificial Sequence
  Synthetic oligonucleotide; CAG chr2 60540796 60540815 60540812 +
tgcattttccagcccatgtg

SEQ ID NO: 168607 - DNA, 20 bp, Artificial Sequence
  Synthetic oligonucleotide; AAG chr2 60540825 60540844 60540841 +
aattatatgccacattcact

SEQ ID NO: 168608 - DNA, 20 bp, Artificial Sequence
  Synthetic oligonucleotide; GAG chr2 60540827 60540846 60540843 +
ttatatgccacattcactaa

SEQ ID NO: 168609 - DNA, 20 bp, Artificial Sequence
  Synthetic oligonucleotide; AAG chr2 60540831 60540850 60540847 +
atgccacattcactaagaga

SEQ ID NO: 168610 - DNA, 20 bp, Artificial Sequence
  Synthetic oligonucleotide; AGG chr2 60540832 60540851 60540848 +
tgccacattcactaagagaa

SEQ ID NO: 168611 - DNA, 20 bp, Artificial Sequence
  Synthetic oligonucleotide; CAG chr2 60540851 60540870 60540867 +
aaggtgtgcaaaacatattt

SEQ ID NO: 168612 - DNA, 20 bp, Artificial Sequence
  Synthetic oligonucleotide; TAG chr2 60540862 60540881 60540878 +
aacatatttcagatccttta

SEQ ID NO: 168613 - DNA, 20 bp, Artificial Sequence
  Synthetic oligonucleotide; AAG chr2 60540867 60540886 60540883 +
atttcagatcctttatagta

SEQ ID NO: 168614 - DNA, 20 bp, Artificial Sequence
  Synthetic oligonucleotide; AGG chr2 60540868 60540887 60540884 +
tttcagatcctttatagtaa

SEQ ID NO: 168615 - DNA, 20 bp, Artificial Sequence
  Synthetic oligonucleotide; AAG chr2 60540889 60540908 60540905 +
ggcacaacttgcaacacaac

SEQ ID NO: 168616 - DNA, 20 bp, Artificial Sequence
  Synthetic oligonucleotide; AGG chr2 60540890 60540909 60540906 +
gcacaacttgcaacacaaca

SEQ ID NO: 168617 - DNA, 20 bp, Artificial Sequence
  Synthetic oligonucleotide; TGG chr2 60540895 60540914 60540911 +
acttgcaacacaacaaggaa

SEQ ID NO: 168618 - DNA, 20 bp, Artificial Sequence
  Synthetic oligonucleotide; GGG chr2 60540896 60540915 60540912 +
cttgcaacacaacaaggaat

SEQ ID NO: 168619 - DNA, 20 bp, Artificial Sequence
  Synthetic oligonucleotide; GGG chr2 60540897 60540916 60540913 +
ttgcaacacaacaaggaatg

SEQ ID NO: 168620 - DNA, 20 bp, Artificial Sequence
  Synthetic oligonucleotide; AAG chr2 60540906 60540925 60540922 +
aacaaggaatggggtgattt

SEQ ID NO: 168621 - DNA, 20 bp, Artificial Sequence
  Synthetic oligonucleotide; CAG chr2 60540915 60540934 60540931 +
tggggtgatttaagaaatta

SEQ ID NO: 168622 - DNA, 20 bp, Artificial Sequence
  Synthetic oligonucleotide; TGG chr2 60540921 60540940 60540937 +
gatttaagaaattacagcac

SEQ ID NO: 168623 - DNA, 20 bp, Artificial Sequence
  Synthetic oligonucleotide; TGG chr2 60540971 60540990 60540987 +
tgtgtgtgtgtgtgtgtgtg

SEQ ID NO: 168624 - DNA, 20 bp, Artificial Sequence
  Synthetic oligonucleotide; AAG chr2 60540997 60541016 60541013 +
ttttgtttttttgttttttt

SEQ ID NO: 168625 - DNA, 20 bp, Artificial Sequence
  Synthetic oligonucleotide; CAG chr2 60541006 60541025 60541022 +
tttgtttttttaagctttca

SEQ ID NO: 168626 - DNA, 20 bp, Artificial Sequence
  Synthetic oligonucleotide; CAG chr2 60541017 60541036 60541033 +
aagctttcacagaataaaca

SEQ ID NO: 168627 - DNA, 20 bp, Artificial Sequence
  Synthetic oligonucleotide; GAG chr2 60541019 60541038 60541035 +
gctttcacagaataaacaca

SEQ ID NO: 168628 - DNA, 20 bp, Artificial Sequence
  Synthetic oligonucleotide; CGG chr2 60541024 60541043 60541040 +
cacagaataaacacagagaa

SEQ ID NO: 168629 - DNA, 20 bp, Artificial Sequence
  Synthetic oligonucleotide; GGG chr2 60541025 60541044 60541041 +
acagaataaacacagagaac

SEQ ID NO: 168630 - DNA, 20 bp, Artificial Sequence
  Synthetic oligonucleotide; GAG chr2 60541027 60541046 60541043 +
agaataaacacagagaacgg

SEQ ID NO: 168631 - DNA, 20 bp, Artificial Sequence
  Synthetic oligonucleotide; AGG chr2 60541028 60541047 60541044 +
gaataaacacagagaacggg

SEQ ID NO: 168632 - DNA, 20 bp, Artificial Sequence
  Synthetic oligonucleotide; GGG chr2 60541029 60541048 60541045 +
aataaacacagagaacggga

SEQ ID NO: 168633 - DNA, 20 bp, Artificial Sequence
  Synthetic oligonucleotide; AAG chr2 60541062 60541081 60541078 +
cccctctgctcctgttcttg

SEQ ID NO: 168634 - DNA, 20 bp, Artificial Sequence
  Synthetic oligonucleotide; AAG chr2 60541091 60541110 60541107 +
catatttgtgtttccaataa

SEQ ID NO: 168635 - DNA, 20 bp, Artificial Sequence
  Synthetic oligonucleotide; AGG chr2 60541092 60541111 60541108 +
atatttgtgtttccaataaa

SEQ ID NO: 168636 - DNA, 20 bp, Artificial Sequence
  Synthetic oligonucleotide; CAG chr2 60541120 60541139 60541136 +
tttacattaactgtctgtaa

SEQ ID NO: 168637 - DNA, 20 bp, Artificial Sequence
  Synthetic oligonucleotide; CAG chr2 60541123 60541142 60541139 +
acattaactgtctgtaacag

SEQ ID NO: 168638 - DNA, 20 bp, Artificial Sequence
  Synthetic oligonucleotide; AGG chr2 60541124 60541143 60541140 +
cattaactgtctgtaacagc

SEQ ID NO: 168639 - DNA, 20 bp, Artificial Sequence
  Synthetic oligonucleotide; GAG chr2 60541126 60541145 60541142 +
ttaactgtctgtaacagcag

SEQ ID NO: 168640 - DNA, 20 bp, Artificial Sequence
  Synthetic oligonucleotide; CAG chr2 60541130 60541149 60541146 +
ctgtctgtaacagcaggaga

SEQ ID NO: 168641 - DNA, 20 bp, Artificial Sequence
  Synthetic oligonucleotide; CAG chr2 60541162 60541181 60541178 +
cacaatctccacatcacaca

SEQ ID NO: 168642 - DNA, 20 bp, Artificial Sequence
  Synthetic oligonucleotide; AGG chr2 60541163 60541182 60541179 +
acaatctccacatcacacac

SEQ ID NO: 168643 - DNA, 20 bp, Artificial Sequence
  Synthetic oligonucleotide; TGG chr2 60541183 60541202 60541199 +
aggatgatcttcatatcacg

SEQ ID NO: 168644 - DNA, 20 bp, Artificial Sequence
  Synthetic oligonucleotide; AAG chr2 60541212 60541231 60541228 +
tctcaaaacattatttataa

SEQ ID NO: 168645 - DNA, 20 bp, Artificial Sequence
  Synthetic oligonucleotide; TAG chr2 60541220 60541239 60541236 +
cattatttataaaagatgac

SEQ ID NO: 168646 - DNA, 20 bp, Artificial Sequence
  Synthetic oligonucleotide; AGG chr2 60541221 60541240 60541237 +
attatttataaaagatgact

SEQ ID NO: 168647 - DNA, 20 bp, Artificial Sequence
  Synthetic oligonucleotide; AAG chr2 60541257 60541276 60541273 +
catcttttctgtgtcaccac

SEQ ID NO: 168648 - DNA, 20 bp, Artificial Sequence
  Synthetic oligonucleotide; AGG chr2 60541258 60541277 60541274 +
atcttttctgtgtcaccaca

SEQ ID NO: 168649 - DNA, 20 bp, Artificial Sequence
  Synthetic oligonucleotide; GGG chr2 60541259 60541278 60541275 +
tcttttctgtgtcaccacaa

SEQ ID NO: 168650 - DNA, 20 bp, Artificial Sequence
  Synthetic oligonucleotide; AAG chr2 60541271 60541290 60541287 +
caccacaagggtaatgtctg

SEQ ID NO: 168651 - DNA, 20 bp, Artificial Sequence
  Synthetic oligonucleotide; AAG chr2 60541274 60541293 60541290 +
cacaagggtaatgtctgaag

SEQ ID NO: 168652 - DNA, 20 bp, Artificial Sequence
  Synthetic oligonucleotide; TGG chr2 60541279 60541298 60541295 +
gggtaatgtctgaagaagtt

SEQ ID NO: 168653 - DNA, 20 bp, Artificial Sequence
  Synthetic oligonucleotide; GGG chr2 60541280 60541299 60541296 +
ggtaatgtctgaagaagttt

SEQ ID NO: 168654 - DNA, 20 bp, Artificial Sequence
  Synthetic oligonucleotide; TAG chr2 60541288 60541307 60541304 +
ctgaagaagtttgggatctt

SEQ ID NO: 168655 - DNA, 20 bp, Artificial Sequence
  Synthetic oligonucleotide; AGG chr2 60541289 60541308 60541305 +
tgaagaagtttgggatcttt

SEQ ID NO: 168656 - DNA, 20 bp, Artificial Sequence
  Synthetic oligonucleotide; TAG chr2 60541305 60541324 60541321 +
ctttaggatcttctacattt

SEQ ID NO: 168657 - DNA, 20 bp, Artificial Sequence
  Synthetic oligonucleotide; TGG chr2 60541328 60541347 60541344 +
atatattttttttttccttt

SEQ ID NO: 168658 - DNA, 20 bp, Artificial Sequence
  Synthetic oligonucleotide; TAG chr2 60541338 60541357 60541354 +
tttttccttttggctttcct

SEQ ID NO: 168659 - DNA, 20 bp, Artificial Sequence
  Synthetic oligonucleotide; AAG chr2 60541342 60541361 60541358 +
tccttttggctttccttagt

SEQ ID NO: 168660 - DNA, 20 bp, Artificial Sequence
  Synthetic oligonucleotide; TAG chr2 60541347 60541366 60541363 +
ttggctttccttagtaagtt

SEQ ID NO: 168661 - DNA, 20 bp, Artificial Sequence
  Synthetic oligonucleotide; CAG chr2 60541350 60541369 60541366 +
gctttccttagtaagtttag

SEQ ID NO: 168662 - DNA, 20 bp, Artificial Sequence
  Synthetic oligonucleotide; CGG chr2 60541358 60541377 60541374 +
tagtaagtttagcagccatg

SEQ ID NO: 168663 - DNA, 20 bp, Artificial Sequence
  Synthetic oligonucleotide; GGG chr2 60541359 60541378 60541375 +
agtaagtttagcagccatgc

SEQ ID NO: 168664 - DNA, 20 bp, Artificial Sequence
  Synthetic oligonucleotide; AAG chr2 60541377 60541396 60541393 +
gcgggccactgtgtttaatt

SEQ ID NO: 168665 - DNA, 20 bp, Artificial Sequence
  Synthetic oligonucleotide; AAG chr2 60541387 60541406 60541403 +
gtgtttaattaagctttcaa

SEQ ID NO: 168666 - DNA, 20 bp, Artificial Sequence
  Synthetic oligonucleotide; TAG chr2 60541411 60541430 60541427 +
cctgacaatgccaacaattg

SEQ ID NO: 168667 - DNA, 20 bp, Artificial Sequence
  Synthetic oligonucleotide; AGG chr2 60541412 60541431 60541428 +
ctgacaatgccaacaattgt

SEQ ID NO: 168668 - DNA, 20 bp, Artificial Sequence
  Synthetic oligonucleotide; CGG chr2 60541424 60541443 60541440 +
acaattgtaggacacttctg

SEQ ID NO: 168669 - DNA, 20 bp, Artificial Sequence
  Synthetic oligonucleotide; CAG chr2 60541449 60541468 60541465 +
caatcatgcaatcactgtga

SEQ ID NO: 168670 - DNA, 20 bp, Artificial Sequence
  Synthetic oligonucleotide; TAG chr2 60541471 60541490 60541487 +
gttctatttacaatttgtct

SEQ ID NO: 168671 - DNA, 20 bp, Artificial Sequence
  Synthetic oligonucleotide; AAG chr2 60541475 60541494 60541491 +
tatttacaatttgtcttaga

SEQ ID NO: 168672 - DNA, 20 bp, Artificial Sequence
  Synthetic oligonucleotide; GAG chr2 60541477 60541496 60541493 +
tttacaatttgtcttagaaa

SEQ ID NO: 168673 - DNA, 20 bp, Artificial Sequence
  Synthetic oligonucleotide; AAG chr2 60541512 60541531 60541528 +
tgtactttgacaaaacatcc

SEQ ID NO: 168674 - DNA, 20 bp, Artificial Sequence
  Synthetic oligonucleotide; CAG chr2 60541519 60541538 60541535 +
tgacaaaacatccaagctgc

SEQ ID NO: 168675 - DNA, 20 bp, Artificial Sequence
  Synthetic oligonucleotide; CAG chr2 60541554 60541573 60541570 +
ctctgtcttatttacaaata

SEQ ID NO: 168676 - DNA, 20 bp, Artificial Sequence
  Synthetic oligonucleotide; TAG chr2 60541565 60541584 60541581 +
ttacaaatacagcttgtata

SEQ ID NO: 168677 - DNA, 20 bp, Artificial Sequence
  Synthetic oligonucleotide; AGG chr2 60541566 60541585 60541582 +
tacaaatacagcttgtatat

SEQ ID NO: 168678 - DNA, 20 bp, Artificial Sequence
  Synthetic oligonucleotide; CAG chr2 60541574 60541593 60541590 +
cagcttgtatataggactcc

SEQ ID NO: 168679 - DNA, 20 bp, Artificial Sequence
  Synthetic oligonucleotide; TAG chr2 60541589 60541608 60541605 +
actcccagtttcatgaacat

SEQ ID NO: 168680 - DNA, 20 bp, Artificial Sequence
  Synthetic oligonucleotide; TGG chr2 60541596 60541615 60541612 +
gtttcatgaacattagtctt

SEQ ID NO: 168681 - DNA, 20 bp, Artificial Sequence
  Synthetic oligonucleotide; TAG chr2 60541600 60541619 60541616 +
catgaacattagtctttgga

SEQ ID NO: 168682 - DNA, 20 bp, Artificial Sequence
  Synthetic oligonucleotide; TGG chr2 60541603 60541622 60541619 +
gaacattagtctttggatag

SEQ ID NO: 168683 - DNA, 20 bp, Artificial Sequence
  Synthetic oligonucleotide; TAG chr2 60541617 60541636 60541633 +
ggatagtggcctcacaaaca

SEQ ID NO: 168684 - DNA, 20 bp, Artificial Sequence
  Synthetic oligonucleotide; AGG chr2 60541618 60541637 60541634 +
gatagtggcctcacaaacat

SEQ ID NO: 168685 - DNA, 20 bp, Artificial Sequence
  Synthetic oligonucleotide; TAG chr2 60541637 60541656 60541653 +
taggctccctatgaaaatcc

SEQ ID NO: 168686 - DNA, 20 bp, Artificial Sequence
  Synthetic oligonucleotide; AGG chr2 60541638 60541657 60541654 +
aggctccctatgaaaatcct

SEQ ID NO: 168687 - DNA, 20 bp, Artificial Sequence
  Synthetic oligonucleotide; TAG chr2 60541648 60541667 60541664 +
tgaaaatcctaggtacttat

SEQ ID NO: 168688 - DNA, 20 bp, Artificial Sequence
  Synthetic oligonucleotide; TGG chr2 60541672 60541691 60541688 +
aaacaatattctctactctc

SEQ ID NO: 168689 - DNA, 20 bp, Artificial Sequence
  Synthetic oligonucleotide; AAG chr2 60541681 60541700 60541697 +
tctctactctctggattttg

SEQ ID NO: 168690 - DNA, 20 bp, Artificial Sequence
  Synthetic oligonucleotide; AGG chr2 60541682 60541701 60541698 +
ctctactctctggattttga

SEQ ID NO: 168691 - DNA, 20 bp, Artificial Sequence
  Synthetic oligonucleotide; AAG chr2 60541686 60541705 60541702 +
actctctggattttgaaggt

SEQ ID NO: 168692 - DNA, 20 bp, Artificial Sequence
  Synthetic oligonucleotide; CAG chr2 60541701 60541720 60541717 +
aaggtaagtaaaatgttcac

SEQ ID NO: 168693 - DNA, 20 bp, Artificial Sequence
  Synthetic oligonucleotide; TGG chr2 60541718 60541737 60541734 +
caccagtatattgttttttg

SEQ ID NO: 168694 - DNA, 20 bp, Artificial Sequence
  Synthetic oligonucleotide; TAG chr2 60541721 60541740 60541737 +
cagtatattgttttttgtgg

SEQ ID NO: 168695 - DNA, 20 bp, Artificial Sequence
  Synthetic oligonucleotide; TGG chr2 60541724 60541743 60541740 +
tatattgttttttgtggtag

SEQ ID NO: 168696 - DNA, 20 bp, Artificial Sequence
  Synthetic oligonucleotide; CAG chr2 60541765 60541784 60541781 +
gccatgctgaaaattcactt

SEQ ID NO: 168697 - DNA, 20 bp, Artificial Sequence
  Synthetic oligonucleotide; AAG chr2 60541768 60541787 60541784 +
atgctgaaaattcacttcag

SEQ ID NO: 168698 - DNA, 20 bp, Artificial Sequence
  Synthetic oligonucleotide; CAG chr2 60541772 60541791 60541788 +
tgaaaattcacttcagaagt

SEQ ID NO: 168699 - DNA, 20 bp, Artificial Sequence
  Synthetic oligonucleotide; CAG chr2 60541786 60541805 60541802 +
agaagtcagtcgtttttatt

SEQ ID NO: 168700 - DNA, 20 bp, Artificial Sequence
  Synthetic oligonucleotide; AAG chr2 60541802 60541821 60541818 +
tattcagaatcacataaata

SEQ ID NO: 168701 - DNA, 20 bp, Artificial Sequence
  Synthetic oligonucleotide; GAG chr2 60541804 60541823 60541820 +
ttcagaatcacataaataaa

SEQ ID NO: 168702 - DNA, 20 bp, Artificial Sequence
  Synthetic oligonucleotide; AAG chr2 60541809 60541828 60541825 +
aatcacataaataaagagaa

SEQ ID NO: 168703 - DNA, 20 bp, Artificial Sequence
  Synthetic oligonucleotide; AAG chr2 60541818 60541837 60541834 +
aataaagagaaaagaaaaat

SEQ ID NO: 168704 - DNA, 20 bp, Artificial Sequence
  Synthetic oligonucleotide; TAG chr2 60541821 60541840 60541837 +
aaagagaaaagaaaaataag

SEQ ID NO: 168705 - DNA, 20 bp, Artificial Sequence
  Synthetic oligonucleotide; TAG chr2 60541830 60541849 60541846 +
agaaaaataagtagtcataa

SEQ ID NO: 168706 - DNA, 20 bp, Artificial Sequence
  Synthetic oligonucleotide; TAG chr2 60541847 60541866 60541863 +
taatagcatactataattta

SEQ ID NO: 168707 - DNA, 20 bp, Artificial Sequence
  Synthetic oligonucleotide; AAG chr2 60541871 60541890 60541887 +
ctcatttacaattacaccat

SEQ ID NO: 168708 - DNA, 20 bp, Artificial Sequence
  Synthetic oligonucleotide; AGG chr2 60541872 60541891 60541888 +
tcatttacaattacaccata

SEQ ID NO: 168709 - DNA, 20 bp, Artificial Sequence
  Synthetic oligonucleotide; CAG chr2 60541892 60541911 60541908 +
aggtacacaaatacatcctc

SEQ ID NO: 168710 - DNA, 20 bp, Artificial Sequence
  Synthetic oligonucleotide; CAG chr2 60541897 60541916 60541913 +
cacaaatacatcctccagtt

SEQ ID NO: 168711 - DNA, 20 bp, Artificial Sequence
  Synthetic oligonucleotide; GAG chr2 60541903 60541922 60541919 +
tacatcctccagttcagtct

SEQ ID NO: 168712 - DNA, 20 bp, Artificial Sequence
  Synthetic oligonucleotide; TAG chr2 60541907 60541926 60541923 +
tcctccagttcagtctgagc

SEQ ID NO: 168713 - DNA, 20 bp, Artificial Sequence
  Synthetic oligonucleotide; AGG chr2 60541908 60541927 60541924 +
cctccagttcagtctgagct

SEQ ID NO: 168714 - DNA, 20 bp, Artificial Sequence
  Synthetic oligonucleotide; GAG chr2 60541910 60541929 60541926 +
tccagttcagtctgagctag

SEQ ID NO: 168715 - DNA, 20 bp, Artificial Sequence
  Synthetic oligonucleotide; GAG chr2 60541912 60541931 60541928 +
cagttcagtctgagctagga

SEQ ID NO: 168716 - DNA, 20 bp, Artificial Sequence
  Synthetic oligonucleotide; CAG chr2 60541918 60541937 60541934 +
agtctgagctaggagagaat

SEQ ID NO: 168717 - DNA, 20 bp, Artificial Sequence
  Synthetic oligonucleotide; TGG chr2 60541923 60541942 60541939 +
gagctaggagagaatcagaa

SEQ ID NO: 168718 - DNA, 20 bp, Artificial Sequence
  Synthetic oligonucleotide; AAG chr2 60541933 60541952 60541949 +
agaatcagaatggatacaaa

SEQ ID NO: 168719 - DNA, 20 bp, Artificial Sequence
  Synthetic oligonucleotide; AAG chr2 60541938 60541957 60541954 +
cagaatggatacaaaaagaa

SEQ ID NO: 168720 - DNA, 20 bp, Artificial Sequence
  Synthetic oligonucleotide; AGG chr2 60541939 60541958 60541955 +
agaatggatacaaaaagaaa

SEQ ID NO: 168721 - DNA, 20 bp, Artificial Sequence
  Synthetic oligonucleotide; AAG chr2 60541943 60541962 60541959 +
tggatacaaaaagaaaaggt

SEQ ID NO: 168722 - DNA, 20 bp, Artificial Sequence
  Synthetic oligonucleotide; AAG chr2 60541966 60541985 60541982 +
ttcattttctaaattctgaa

SEQ ID NO: 168723 - DNA, 20 bp, Artificial Sequence
  Synthetic oligonucleotide; AAG chr2 60541992 60542011 60542008 +
attgtatttgatttactttt

SEQ ID NO: 168724 - DNA, 20 bp, Artificial Sequence
  Synthetic oligonucleotide; GAG chr2 60541994 60542013 60542010 +
tgtatttgatttacttttaa

SEQ ID NO: 168725 - DNA, 20 bp, Artificial Sequence
  Synthetic oligonucleotide; TAG chr2 60542041 60542060 60542057 +
attactatatctcccttctt

SEQ ID NO: 168726 - DNA, 20 bp, Artificial Sequence
  Synthetic oligonucleotide; GAG chr2 60542043 60542062 60542059 +
tactatatctcccttcttta

SEQ ID NO: 168727 - DNA, 20 bp, Artificial Sequence
  Synthetic oligonucleotide; CAG chr2 60542076 60542095 60542092 +
atatatcattatctaaatac

SEQ ID NO: 168728 - DNA, 20 bp, Artificial Sequence
  Synthetic oligonucleotide; TAG chr2 60542089 60542108 60542105 +
taaataccagctatactgtc

SEQ ID NO: 168729 - DNA, 20 bp, Artificial Sequence
  Synthetic oligonucleotide; AGG chr2 60542090 60542109 60542106 +
aaataccagctatactgtct

SEQ ID NO: 168730 - DNA, 20 bp, Artificial Sequence
  Synthetic oligonucleotide; AAG chr2 60542141 60542160 60542157 +
tgtctatgttcatgatttta

SEQ ID NO: 168731 - DNA, 20 bp, Artificial Sequence
  Synthetic oligonucleotide; GAG chr2 60542143 60542162 60542159 +
tctatgttcatgattttaaa

SEQ ID NO: 168732 - DNA, 20 bp, Artificial Sequence
  Synthetic oligonucleotide; CAG chr2 60542165 60542184 60542181 +
gaaaaaatgttatatatcaa

SEQ ID NO: 168733 - DNA, 20 bp, Artificial Sequence
  Synthetic oligonucleotide; AGG chr2 60542166 60542185 60542182 +
aaaaaatgttatatatcaac

SEQ ID NO: 168734 - DNA, 20 bp, Artificial Sequence
  Synthetic oligonucleotide; GAG chr2 60542168 60542187 60542184 +
aaaatgttatatatcaacag

SEQ ID NO: 168735 - DNA, 20 bp, Artificial Sequence
  Synthetic oligonucleotide; CAG chr2 60542171 60542190 60542187 +
atgttatatatcaacaggag

SEQ ID NO: 168736 - DNA, 20 bp, Artificial Sequence
  Synthetic oligonucleotide; TAG chr2 60542190 60542209 60542206 +
gcagactttactacatttta

SEQ ID NO: 168737 - DNA, 20 bp, Artificial Sequence
  Synthetic oligonucleotide; AGG chr2 60542191 60542210 60542207 +
cagactttactacattttat

SEQ ID NO: 168738 - DNA, 20 bp, Artificial Sequence
  Synthetic oligonucleotide; TAG chr2 60542213 60542232 60542229 +
gacttgtcatattttttctc

SEQ ID NO: 168739 - DNA, 20 bp, Artificial Sequence
  Synthetic oligonucleotide; AAG chr2 60542225 60542244 60542241 +
tttttctctagtctctcaaa

SEQ ID NO: 168740 - DNA, 20 bp, Artificial Sequence
  Synthetic oligonucleotide; CAG chr2 60542240 60542259 60542256 +
tcaaaaagctaactttatga

SEQ ID NO: 168741 - DNA, 20 bp, Artificial Sequence
  Synthetic oligonucleotide; AAG chr2 60542258 60542277 60542274 +
gacagcccaaacctaattta

SEQ ID NO: 168742 - DNA, 20 bp, Artificial Sequence
  Synthetic oligonucleotide; AAG chr2 60542276 60542295 60542292 +
taaagattcctatgtgcaat

SEQ ID NO: 168743 - DNA, 20 bp, Artificial Sequence
  Synthetic oligonucleotide; TGG chr2 60542302 60542321 60542318 +
aaacctcaaatctgacatga

SEQ ID NO: 168744 - DNA, 20 bp, Artificial Sequence
  Synthetic oligonucleotide; GGG chr2 60542303 60542322 60542319 +
aacctcaaatctgacatgat

SEQ ID NO: 168745 - DNA, 20 bp, Artificial Sequence
  Synthetic oligonucleotide; TGG chr2 60542314 60542333 60542330 +
tgacatgatgggataatgtt

SEQ ID NO: 168746 - DNA, 20 bp, Artificial Sequence
  Synthetic oligonucleotide; GGG chr2 60542315 60542334 60542331 +
gacatgatgggataatgttt

SEQ ID NO: 168747 - DNA, 20 bp, Artificial Sequence
  Synthetic oligonucleotide; AAG chr2 60542328 60542347 60542344 +
aatgtttgggtcttttctat

SEQ ID NO: 168748 - DNA, 20 bp, Artificial Sequence
  Synthetic oligonucleotide; AGG chr2 60542329 60542348 60542345 +
atgtttgggtcttttctata

SEQ ID NO: 168749 - DNA, 20 bp, Artificial Sequence
  Synthetic oligonucleotide; GGG chr2 60542330 60542349 60542346 +
tgtttgggtcttttctataa

SEQ ID NO: 168750 - DNA, 20 bp, Artificial Sequence
  Synthetic oligonucleotide; CAG chr2 60542335 60542354 60542351 +
gggtcttttctataagggaa

SEQ ID NO: 168751 - DNA, 20 bp, Artificial Sequence
  Synthetic oligonucleotide; CAG chr2 60542338 60542357 60542354 +
tcttttctataagggaacag

SEQ ID NO: 168752 - DNA, 20 bp, Artificial Sequence
  Synthetic oligonucleotide; CAG chr2 60542350 60542369 60542366 +
gggaacagcagtttcacatt

SEQ ID NO: 168753 - DNA, 20 bp, Artificial Sequence
  Synthetic oligonucleotide; GAG chr2 60542390 60542409 60542406 +
ttccccccatcataaaatat

SEQ ID NO: 168754 - DNA, 20 bp, Artificial Sequence
  Synthetic oligonucleotide; AAG chr2 60542403 60542422 60542419 +
aaaatatgagactaaaaaaa

SEQ ID NO: 168755 - DNA, 20 bp, Artificial Sequence
  Synthetic oligonucleotide; AAG chr2 60542435 60542454 60542451 +
caaaacaaaacccctattga

SEQ ID NO: 168756 - DNA, 20 bp, Artificial Sequence
  Synthetic oligonucleotide; AAG chr2 60542448 60542467 60542464 +
ctattgaaagctctgactgc

SEQ ID NO: 168757 - DNA, 20 bp, Artificial Sequence
  Synthetic oligonucleotide; AAG chr2 60542454 60542473 60542470 +
aaagctctgactgcaagtca

SEQ ID NO: 168758 - DNA, 20 bp, Artificial Sequence
  Synthetic oligonucleotide; AGG chr2 60542455 60542474 60542471 +
aagctctgactgcaagtcaa

SEQ ID NO: 168759 - DNA, 20 bp, Artificial Sequence
  Synthetic oligonucleotide; GAG chr2 60542470 60542489 60542486 +
gtcaaaggctgctgatatct

SEQ ID NO: 168760 - DNA, 20 bp, Artificial Sequence
  Synthetic oligonucleotide; AGG chr2 60542471 60542490 60542487 +
tcaaaggctgctgatatctg

SEQ ID NO: 168761 - DNA, 20 bp, Artificial Sequence
  Synthetic oligonucleotide; GGG chr2 60542472 60542491 60542488 +
caaaggctgctgatatctga

SEQ ID NO: 168762 - DNA, 20 bp, Artificial Sequence
  Synthetic oligonucleotide; TGG chr2 60542475 60542494 60542491 +
aggctgctgatatctgaggg

SEQ ID NO: 168763 - DNA, 20 bp, Artificial Sequence
  Synthetic oligonucleotide; TGG chr2 60542503 60542522 60542519 +
tgacacacatattgatgaac

SEQ ID NO: 168764 - DNA, 20 bp, Artificial Sequence
  Synthetic oligonucleotide; GGG chr2 60542504 60542523 60542520 +
gacacacatattgatgaact

SEQ ID NO: 168765 - DNA, 20 bp, Artificial Sequence
  Synthetic oligonucleotide; AAG chr2 60542519 60542538 60542535 +
gaactgggcccacacaacat

SEQ ID NO: 168766 - DNA, 20 bp, Artificial Sequence
  Synthetic oligonucleotide; CAG chr2 60542533 60542552 60542549 +
caacataagctgctaattcc

SEQ ID NO: 168767 - DNA, 20 bp, Artificial Sequence
  Synthetic oligonucleotide; TGG chr2 60542565 60542584 60542581 +
tactacttcaatgatctcaa

SEQ ID NO: 168768 - DNA, 20 bp, Artificial Sequence
  Synthetic oligonucleotide; AAG chr2 60542611 60542630 60542627 +
atatttaaataaaatgaaaa

SEQ ID NO: 168769 - DNA, 20 bp, Artificial Sequence
  Synthetic oligonucleotide; CAG chr2 60542638 60542657 60542654 +
ctgattaacatctatgtgta

SEQ ID NO: 168770 - DNA, 20 bp, Artificial Sequence
  Synthetic oligonucleotide; TGG chr2 60542655 60542674 60542671 +
gtacagctcatatgtgtacg

SEQ ID NO: 168771 - DNA, 20 bp, Artificial Sequence
  Synthetic oligonucleotide; AAG chr2 60542661 60542680 60542677 +
ctcatatgtgtacgtggatg

SEQ ID NO: 168772 - DNA, 20 bp, Artificial Sequence
  Synthetic oligonucleotide; TGG chr2 60542664 60542683 60542680 +
atatgtgtacgtggatgaag

SEQ ID NO: 168773 - DNA, 20 bp, Artificial Sequence
  Synthetic oligonucleotide; GGG chr2 60542665 60542684 60542681 +
tatgtgtacgtggatgaagt

SEQ ID NO: 168774 - DNA, 20 bp, Artificial Sequence
  Synthetic oligonucleotide; GGG chr2 60542666 60542685 60542682 +
atgtgtacgtggatgaagtg

SEQ ID NO: 168775 - DNA, 20 bp, Artificial Sequence
  Synthetic oligonucleotide; GGG chr2 60542667 60542686 60542683 +
tgtgtacgtggatgaagtgg

SEQ ID NO: 168776 - DNA, 20 bp, Artificial Sequence
  Synthetic oligonucleotide; GAG chr2 60542669 60542688 60542685 +
tgtacgtggatgaagtgggg

SEQ ID NO: 168777 - DNA, 20 bp, Artificial Sequence
  Synthetic oligonucleotide; CAG chr2 60542691 60542710 60542707 +
gcacatacccatctattcac

SEQ ID NO: 168778 - DNA, 20 bp, Artificial Sequence
  Synthetic oligonucleotide; AGG chr2 60542692 60542711 60542708 +
cacatacccatctattcacc

SEQ ID NO: 168779 - DNA, 20 bp, Artificial Sequence
  Synthetic oligonucleotide; AAG chr2 60542699 60542718 60542715 +
ccatctattcaccaggtaaa

SEQ ID NO: 168780 - DNA, 20 bp, Artificial Sequence
  Synthetic oligonucleotide; CAG chr2 60542720 60542739 60542736 +
agaatcctctaaaaaatact

SEQ ID NO: 168781 - DNA, 20 bp, Artificial Sequence
  Synthetic oligonucleotide; TGG chr2 60542725 60542744 60542741 +
cctctaaaaaatactcagtt

SEQ ID NO: 168782 - DNA, 20 bp, Artificial Sequence
  Synthetic oligonucleotide; GGG chr2 60542726 60542745 60542742 +
ctctaaaaaatactcagttt

SEQ ID NO: 168783 - DNA, 20 bp, Artificial Sequence
  Synthetic oligonucleotide; CAG chr2 60542730 60542749 60542746 +
aaaaaatactcagtttgggc

SEQ ID NO: 168784 - DNA, 20 bp, Artificial Sequence
  Synthetic oligonucleotide; AGG chr2 60542731 60542750 60542747 +
aaaaatactcagtttgggcc

SEQ ID NO: 168785 - DNA, 20 bp, Artificial Sequence
  Synthetic oligonucleotide; CGG chr2 60542736 60542755 60542752 +
tactcagtttgggccaggtg

SEQ ID NO: 168786 - DNA, 20 bp, Artificial Sequence
  Synthetic oligonucleotide; AAG chr2 60542745 60542764 60542761 +
tgggccaggtgcggtcgctc

SEQ ID NO: 168787 - DNA, 20 bp, Artificial Sequence
  Synthetic oligonucleotide; CAG chr2 60542758 60542777 60542774 +
gtcgctcaagcctgtaatcc

SEQ ID NO: 168788 - DNA, 20 bp, Artificial Sequence
  Synthetic oligonucleotide; TGG chr2 60542766 60542785 60542782 +
agcctgtaatcccagcactt

SEQ ID NO: 168789 - DNA, 20 bp, Artificial Sequence
  Synthetic oligonucleotide; GGG chr2 60542767 60542786 60542783 +
gcctgtaatcccagcacttt

SEQ ID NO: 168790 - DNA, 20 bp, Artificial Sequence
  Synthetic oligonucleotide; GAG chr2 60542769 60542788 60542785 +
ctgtaatcccagcactttgg

SEQ ID NO: 168791 - DNA, 20 bp, Artificial Sequence
  Synthetic oligonucleotide; AGG chr2 60542770 60542789 60542786 +
tgtaatcccagcactttggg

SEQ ID NO: 168792 - DNA, 20 bp, Artificial Sequence
  Synthetic oligonucleotide; AAG chr2 60542775 60542794 60542791 +
tcccagcactttgggaggcc

SEQ ID NO: 168793 - DNA, 20 bp, Artificial Sequence
  Synthetic oligonucleotide; CAG chr2 60542779 60542798 60542795 +
agcactttgggaggccaagc

SEQ ID NO: 168794 - DNA, 20 bp, Artificial Sequence
  Synthetic oligonucleotide; AGG chr2 60542780 60542799 60542796 +
gcactttgggaggccaagcc

SEQ ID NO: 168795 - DNA, 20 bp, Artificial Sequence
  Synthetic oligonucleotide; TGG chr2 60542783 60542802 60542799 +
ctttgggaggccaagccagg

SEQ ID NO: 168796 - DNA, 20 bp, Artificial Sequence
  Synthetic oligonucleotide; GAG chr2 60542793 60542812 60542809 +
ccaagccaggtggatcacct

SEQ ID NO: 168797 - DNA, 20 bp, Artificial Sequence
  Synthetic oligonucleotide; AGG chr2 60542794 60542813 60542810 +
caagccaggtggatcacctg

SEQ ID NO: 168798 - DNA, 20 bp, Artificial Sequence
  Synthetic oligonucleotide; CAG chr2 60542798 60542817 60542814 +
ccaggtggatcacctgaggt

SEQ ID NO: 168799 - DNA, 20 bp, Artificial Sequence
  Synthetic oligonucleotide; AGG chr2 60542799 60542818 60542815 +
caggtggatcacctgaggtc

SEQ ID NO: 168800 - DNA, 20 bp, Artificial Sequence
  Synthetic oligonucleotide; GAG chr2 60542801 60542820 60542817 +
ggtggatcacctgaggtcag

SEQ ID NO: 168801 - DNA, 20 bp, Artificial Sequence
  Synthetic oligonucleotide; AAG chr2 60542807 60542826 60542823 +
tcacctgaggtcaggagttc

SEQ ID NO: 168802 - DNA, 20 bp, Artificial Sequence
  Synthetic oligonucleotide; CAG chr2 60542812 60542831 60542828 +
tgaggtcaggagttcaagac

SEQ ID NO: 168803 - DNA, 20 bp, Artificial Sequence
  Synthetic oligonucleotide; TGG chr2 60542817 60542836 60542833 +
tcaggagttcaagaccagcc

SEQ ID NO: 168804 - DNA, 20 bp, Artificial Sequence
  Synthetic oligonucleotide; TGG chr2 60542826 60542845 60542842 +
caagaccagcctggccaaca

SEQ ID NO: 168805 - DNA, 20 bp, Artificial Sequence
  Synthetic oligonucleotide; TAG chr2 60542862 60542881 60542878 +
ctactgaaaatacaaaaaac

SEQ ID NO: 168806 - DNA, 20 bp, Artificial Sequence
  Synthetic oligonucleotide; TGG chr2 60542866 60542885 60542882 +
tgaaaatacaaaaaactagc

SEQ ID NO: 168807 - DNA, 20 bp, Artificial Sequence
  Synthetic oligonucleotide; GGG chr2 60542867 60542886 60542883 +
gaaaatacaaaaaactagct

SEQ ID NO: 168808 - DNA, 20 bp, Artificial Sequence
  Synthetic oligonucleotide; TAG chr2 60542872 60542891 60542888 +
tacaaaaaactagctgggcg

SEQ ID NO: 168809 - DNA, 20 bp, Artificial Sequence
  Synthetic oligonucleotide; TGG chr2 60542875 60542894 60542891 +
aaaaaactagctgggcgtag

SEQ ID NO: 168810 - DNA, 20 bp, Artificial Sequence
  Synthetic oligonucleotide; CAG chr2 60542894 60542913 60542910 +
gtggcacacgcctgtaatcc

SEQ ID NO: 168811 - DNA, 20 bp, Artificial Sequence
  Synthetic oligonucleotide; TGG chr2 60542902 60542921 60542918 +
cgcctgtaatcccagctact

SEQ ID NO: 168812 - DNA, 20 bp, Artificial Sequence
  Synthetic oligonucleotide; GGG chr2 60542903 60542922 60542919 +
gcctgtaatcccagctactt

SEQ ID NO: 168813 - DNA, 20 bp, Artificial Sequence
  Synthetic oligonucleotide; GAG chr2 60542905 60542924 60542921 +
ctgtaatcccagctacttgg

SEQ ID NO: 168814 - DNA, 20 bp, Artificial Sequence
  Synthetic oligonucleotide; AGG chr2 60542906 60542925 60542922 +
tgtaatcccagctacttggg

SEQ ID NO: 168815 - DNA, 20 bp, Artificial Sequence
  Synthetic oligonucleotide; GAG chr2 60542911 60542930 60542927 +
tcccagctacttgggaggct

SEQ ID NO: 168816 - DNA, 20 bp, Artificial Sequence
  Synthetic oligonucleotide; AGG chr2 60542912 60542931 60542928 +
cccagctacttgggaggctg

SEQ ID NO: 168817 - DNA, 20 bp, Artificial Sequence
  Synthetic oligonucleotide; CAG chr2 60542915 60542934 60542931 +
agctacttgggaggctgagg

SEQ ID NO: 168818 - DNA, 20 bp, Artificial Sequence
  Synthetic oligonucleotide; AGG chr2 60542916 60542935 60542932 +
gctacttgggaggctgaggc

SEQ ID NO: 168819 - DNA, 20 bp, Artificial Sequence
  Synthetic oligonucleotide; GAG chr2 60542918 60542937 60542934 +
tacttgggaggctgaggcag

SEQ ID NO: 168820 - DNA, 20 bp, Artificial Sequence
  Synthetic oligonucleotide; TAG chr2 60542934 60542953 60542950 +
gcaggagaatcgcttgaacc

SEQ ID NO: 168821 - DNA, 20 bp, Artificial Sequence
  Synthetic oligonucleotide; AGG chr2 60542935 60542954 60542951 +
caggagaatcgcttgaacct

SEQ ID NO: 168822 - DNA, 20 bp, Artificial Sequence
  Synthetic oligonucleotide; GAG chr2 60542937 60542956 60542953 +
ggagaatcgcttgaacctag

SEQ ID NO: 168823 - DNA, 20 bp, Artificial Sequence
  Synthetic oligonucleotide; AGG chr2 60542938 60542957 60542954 +
gagaatcgcttgaacctagg

SEQ ID NO: 168824 - DNA, 20 bp, Artificial Sequence
  Synthetic oligonucleotide; CAG chr2 60542941 60542960 60542957 +
aatcgcttgaacctaggagg

SEQ ID NO: 168825 - DNA, 20 bp, Artificial Sequence
  Synthetic oligonucleotide; GAG chr2 60542943 60542962 60542959 +
tcgcttgaacctaggaggca

SEQ ID NO: 168826 - DNA, 20 bp, Artificial Sequence
  Synthetic oligonucleotide; AGG chr2 60542944 60542963 60542960 +
cgcttgaacctaggaggcag

SEQ ID NO: 168827 - DNA, 20 bp, Artificial Sequence
  Synthetic oligonucleotide; CAG chr2 60542950 60542969 60542966 +
aacctaggaggcagaggttg

SEQ ID NO: 168828 - DNA, 20 bp, Artificial Sequence
  Synthetic oligonucleotide; GAG chr2 60542954 60542973 60542970 +
taggaggcagaggttgcagt

SEQ ID NO: 168829 - DNA, 20 bp, Artificial Sequence
  Synthetic oligonucleotide; CAG chr2 60542979 60542998 60542995 +
aaaatcatgccactgcactc

SEQ ID NO: 168830 - DNA, 20 bp, Artificial Sequence
  Synthetic oligonucleotide; TGG chr2 60542984 60543003 60543000 +
catgccactgcactccagcc

SEQ ID NO: 168831 - DNA, 20 bp, Artificial Sequence
  Synthetic oligonucleotide; GGG chr2 60542985 60543004 60543001 +
atgccactgcactccagcct

SEQ ID NO: 168832 - DNA, 20 bp, Artificial Sequence
  Synthetic oligonucleotide; AAG chr2 60542992 60543011 60543008 +
tgcactccagcctgggcaac

SEQ ID NO: 168833 - DNA, 20 bp, Artificial Sequence
  Synthetic oligonucleotide; GAG chr2 60542994 60543013 60543010 +
cactccagcctgggcaacaa

SEQ ID NO: 168834 - DNA, 20 bp, Artificial Sequence
  Synthetic oligonucleotide; CAG chr2 60543036 60543055 60543052 +
aaaaaaaaaaaaaaaaaact

SEQ ID NO: 168835 - DNA, 20 bp, Artificial Sequence
  Synthetic oligonucleotide; TGG chr2 60543041 60543060 60543057 +
aaaaaaaaaaaaactcagct

SEQ ID NO: 168836 - DNA, 20 bp, Artificial Sequence
  Synthetic oligonucleotide; GAG chr2 60543043 60543062 60543059 +
aaaaaaaaaaactcagcttg

SEQ ID NO: 168837 - DNA, 20 bp, Artificial Sequence
  Synthetic oligonucleotide; GAG chr2 60543045 60543064 60543061 +
aaaaaaaaactcagcttgga

SEQ ID NO: 168838 - DNA, 20 bp, Artificial Sequence
  Synthetic oligonucleotide; AGG chr2 60543046 60543065 60543062 +
aaaaaaaactcagcttggag

SEQ ID NO: 168839 - DNA, 20 bp, Artificial Sequence
  Synthetic oligonucleotide; GAG chr2 60543052 60543071 60543068 +
aactcagcttggagaggcct

SEQ ID NO: 168840 - DNA, 20 bp, Artificial Sequence
  Synthetic oligonucleotide; CAG chr2 60543057 60543076 60543073 +
agcttggagaggcctgagta

SEQ ID NO: 168841 - DNA, 20 bp, Artificial Sequence
  Synthetic oligonucleotide; AAG chr2 60543083 60543102 60543099 +
aaatgcataccattttactc

SEQ ID NO: 168842 - DNA, 20 bp, Artificial Sequence
  Synthetic oligonucleotide; AAG chr2 60543091 60543110 60543107 +
accattttactcaagattta

SEQ ID NO: 168843 - DNA, 20 bp, Artificial Sequence
  Synthetic oligonucleotide; AAG chr2 60543119 60543138 60543135 +
tgccttattctcctatctga

SEQ ID NO: 168844 - DNA, 20 bp, Artificial Sequence
  Synthetic oligonucleotide; AAG chr2 60543133 60543152 60543149 +
atctgaaagtcccgaattct

SEQ ID NO: 168845 - DNA, 20 bp, Artificial Sequence
  Synthetic oligonucleotide; TAG chr2 60543148 60543167 60543164 +
attctaagctttatttatct

SEQ ID NO: 168846 - DNA, 20 bp, Artificial Sequence
  Synthetic oligonucleotide; AGG chr2 60543149 60543168 60543165 +
ttctaagctttatttatctt

SEQ ID NO: 168847 - DNA, 20 bp, Artificial Sequence
  Synthetic oligonucleotide; AAG chr2 60543152 60543171 60543168 +
taagctttatttatcttagg

SEQ ID NO: 168848 - DNA, 20 bp, Artificial Sequence
  Synthetic oligonucleotide; AAG chr2 60543155 60543174 60543171 +
gctttatttatcttaggaag

SEQ ID NO: 168849 - DNA, 20 bp, Artificial Sequence
  Synthetic oligonucleotide; TAG chr2 60543196 60543215 60543212 +
cttgcttcctgcctataaaa

SEQ ID NO: 168850 - DNA, 20 bp, Artificial Sequence
  Synthetic oligonucleotide; CAG chr2 60543201 60543220 60543217 +
ttcctgcctataaaatagta

SEQ ID NO: 168851 - DNA, 20 bp, Artificial Sequence
  Synthetic oligonucleotide; AGG chr2 60543202 60543221 60543218 +
tcctgcctataaaatagtac

SEQ ID NO: 168852 - DNA, 20 bp, Artificial Sequence
  Synthetic oligonucleotide; CAG chr2 60543209 60543228 60543225 +
tataaaatagtacaggctca

SEQ ID NO: 168853 - DNA, 20 bp, Artificial Sequence
  Synthetic oligonucleotide; AAG chr2 60543244 60543263 60543260 +
caacttacatcactttaata

SEQ ID NO: 168854 - DNA, 20 bp, Artificial Sequence
  Synthetic oligonucleotide; CAG chr2 60543258 60543277 60543274 +
ttaataaagcctttcctacc

SEQ ID NO: 168855 - DNA, 20 bp, Artificial Sequence
  Synthetic oligonucleotide; TGG chr2 60543286 60543305 60543302 +
ttaaatgactaccttttatg

SEQ ID NO: 168856 - DNA, 20 bp, Artificial Sequence
  Synthetic oligonucleotide; TAG chr2 60543307 60543326 60543323 +
ggttgccaaacacattcttc

SEQ ID NO: 168857 - DNA, 20 bp, Artificial Sequence
  Synthetic oligonucleotide; GAG chr2 60543309 60543328 60543325 +
ttgccaaacacattcttcta

SEQ ID NO: 168858 - DNA, 20 bp, Artificial Sequence
  Synthetic oligonucleotide; AAG chr2 60543341 60543360 60543357 +
tatatctctttccttaatac

SEQ ID NO: 168859 - DNA, 20 bp, Artificial Sequence
  Synthetic oligonucleotide; AGG chr2 60543342 60543361 60543358 +
atatctctttccttaataca

SEQ ID NO: 168860 - DNA, 20 bp, Artificial Sequence
  Synthetic oligonucleotide; AAG chr2 60543426 60543445 60543442 +
gtttccttcctcatcataaa

SEQ ID NO: 168861 - DNA, 20 bp, Artificial Sequence
  Synthetic oligonucleotide; AAG chr2 60543431 60543450 60543447 +
cttcctcatcataaaaagaa

SEQ ID NO: 168862 - DNA, 20 bp, Artificial Sequence
  Synthetic oligonucleotide; CAG chr2 60543434 60543453 60543450 +
cctcatcataaaaagaaaag

SEQ ID NO: 168863 - DNA, 20 bp, Artificial Sequence
  Synthetic oligonucleotide; TGG chr2 60543440 60543459 60543456 +
cataaaaagaaaagcagact

SEQ ID NO: 168864 - DNA, 20 bp, Artificial Sequence
  Synthetic oligonucleotide; CAG chr2 60543450 60543469 60543466 +
aaagcagacttggaattgtg

SEQ ID NO: 168865 - DNA, 20 bp, Artificial Sequence
  Synthetic oligonucleotide; TAG chr2 60543461 60543480 60543477 +
ggaattgtgcagacgtgctt

SEQ ID NO: 168866 - DNA, 20 bp, Artificial Sequence
  Synthetic oligonucleotide; GAG chr2 60543463 60543482 60543479 +
aattgtgcagacgtgcttta

SEQ ID NO: 168867 - DNA, 20 bp, Artificial Sequence
  Synthetic oligonucleotide; TGG chr2 60543469 60543488 60543485 +
gcagacgtgctttagagaaa

SEQ ID NO: 168868 - DNA, 20 bp, Artificial Sequence
  Synthetic oligonucleotide; GGG chr2 60543470 60543489 60543486 +
cagacgtgctttagagaaat

SEQ ID NO: 168869 - DNA, 20 bp, Artificial Sequence
  Synthetic oligonucleotide; TGG chr2 60543474 60543493 60543490 +
cgtgctttagagaaatgggc

SEQ ID NO: 168870 - DNA, 20 bp, Artificial Sequence
  Synthetic oligonucleotide; GGG chr2 60543475 60543494 60543491 +
gtgctttagagaaatgggct

SEQ ID NO: 168871 - DNA, 20 bp, Artificial Sequence
  Synthetic oligonucleotide; GGG chr2 60543476 60543495 60543492 +
tgctttagagaaatgggctg

SEQ ID NO: 168872 - DNA, 20 bp, Artificial Sequence
  Synthetic oligonucleotide; GGG chr2 60543477 60543496 60543493 +
gctttagagaaatgggctgg

SEQ ID NO: 168873 - DNA, 20 bp, Artificial Sequence
  Synthetic oligonucleotide; CAG chr2 60543488 60543507 60543504 +
atgggctgggggtacacaca

SEQ ID NO: 168874 - DNA, 20 bp, Artificial Sequence
  Synthetic oligonucleotide; CAG chr2 60543499 60543518 60543515 +
gtacacacacagccgtcttc

SEQ ID NO: 168875 - DNA, 20 bp, Artificial Sequence
  Synthetic oligonucleotide; CAG chr2 60543512 60543531 60543528 +
cgtcttccagaacttcgctt

SEQ ID NO: 168876 - DNA, 20 bp, Artificial Sequence
  Synthetic oligonucleotide; AGG chr2 60543513 60543532 60543529 +
gtcttccagaacttcgcttc

SEQ ID NO: 168877 - DNA, 20 bp, Artificial Sequence
  Synthetic oligonucleotide; GGG chr2 60543514 60543533 60543530 +
tcttccagaacttcgcttca

SEQ ID NO: 168878 - DNA, 20 bp, Artificial Sequence
  Synthetic oligonucleotide; GGG chr2 60543515 60543534 60543531 +
cttccagaacttcgcttcag

SEQ ID NO: 168879 - DNA, 20 bp, Artificial Sequence
  Synthetic oligonucleotide; GAG chr2 60543523 60543542 60543539 +
acttcgcttcaggggcacct

SEQ ID NO: 168880 - DNA, 20 bp, Artificial Sequence
  Synthetic oligonucleotide; AGG chr2 60543524 60543543 60543540 +
cttcgcttcaggggcacctg

SEQ ID NO: 168881 - DNA, 20 bp, Artificial Sequence
  Synthetic oligonucleotide; GGG chr2 60543525 60543544 60543541 +
ttcgcttcaggggcacctga

SEQ ID NO: 168882 - DNA, 20 bp, Artificial Sequence
  Synthetic oligonucleotide; CAG chr2 60543529 60543548 60543545 +
cttcaggggcacctgagggc

SEQ ID NO: 168883 - DNA, 20 bp, Artificial Sequence
  Synthetic oligonucleotide; GAG chr2 60543531 60543550 60543547 +
tcaggggcacctgagggcca

SEQ ID NO: 168884 - DNA, 20 bp, Artificial Sequence
  Synthetic oligonucleotide; CGG chr2 60543537 60543556 60543553 +
gcacctgagggccagagcgt

SEQ ID NO: 168885 - DNA, 20 bp, Artificial Sequence
  Synthetic oligonucleotide; TGG chr2 60543553 60543572 60543569 +
gcgtcggaatttatgtgcaa

SEQ ID NO: 168886 - DNA, 20 bp, Artificial Sequence
  Synthetic oligonucleotide; TAG chr2 60543556 60543575 60543572 +
tcggaatttatgtgcaatgg

SEQ ID NO: 168887 - DNA, 20 bp, Artificial Sequence
  Synthetic oligonucleotide; TAG chr2 60543575 60543594 60543591 +
gtagaatgttaacttcacca

SEQ ID NO: 168888 - DNA, 20 bp, Artificial Sequence
  Synthetic oligonucleotide; AGG chr2 60543576 60543595 60543592 +
tagaatgttaacttcaccat

SEQ ID NO: 168889 - DNA, 20 bp, Artificial Sequence
  Synthetic oligonucleotide; GAG chr2 60543607 60543626 60543623 +
aattcattactgtgaattat

SEQ ID NO: 168890 - DNA, 20 bp, Artificial Sequence
  Synthetic oligonucleotide; AAG chr2 60543610 60543629 60543626 +
tcattactgtgaattatgag

SEQ ID NO: 168891 - DNA, 20 bp, Artificial Sequence
  Synthetic oligonucleotide; TAG chr2 60543622 60543641 60543638 +
attatgagaagtcgtgattc

SEQ ID NO: 168892 - DNA, 20 bp, Artificial Sequence
  Synthetic oligonucleotide; GAG chr2 60543643 60543662 60543659 +
agttactgacatctcacttt

SEQ ID NO: 168893 - DNA, 20 bp, Artificial Sequence
  Synthetic oligonucleotide; CAG chr2 60543668 60543687 60543684 +
gtgaccacactatttatgtt

SEQ ID NO: 168894 - DNA, 20 bp, Artificial Sequence
  Synthetic oligonucleotide; CAG chr2 60543672 60543691 60543688 +
ccacactatttatgttcagc

SEQ ID NO: 168895 - DNA, 20 bp, Artificial Sequence
  Synthetic oligonucleotide; CAG chr2 60543678 60543697 60543694 +
tatttatgttcagccagttc

SEQ ID NO: 168896 - DNA, 20 bp, Artificial Sequence
  Synthetic oligonucleotide; AGG chr2 60543679 60543698 60543695 +
atttatgttcagccagttcc

SEQ ID NO: 168897 - DNA, 20 bp, Artificial Sequence
  Synthetic oligonucleotide; GGG chr2 60543680 60543699 60543696 +
tttatgttcagccagttcca

SEQ ID NO: 168898 - DNA, 20 bp, Artificial Sequence
  Synthetic oligonucleotide; TGG chr2 60543683 60543702 60543699 +
atgttcagccagttccaggg

SEQ ID NO: 168899 - DNA, 20 bp, Artificial Sequence
  Synthetic oligonucleotide; GGG chr2 60543684 60543703 60543700 +
tgttcagccagttccagggt

SEQ ID NO: 168900 - DNA, 20 bp, Artificial Sequence
  Synthetic oligonucleotide; CAG chr2 60543689 60543708 60543705 +
agccagttccagggtgggaa

SEQ ID NO: 168901 - DNA, 20 bp, Artificial Sequence
  Synthetic oligonucleotide; AGG chr2 60543690 60543709 60543706 +
gccagttccagggtgggaac

SEQ ID NO: 168902 - DNA, 20 bp, Artificial Sequence
  Synthetic oligonucleotide; AAG chr2 60543709 60543728 60543725 +
caggtgattaaacacaatga

SEQ ID NO: 168903 - DNA, 20 bp, Artificial Sequence
  Synthetic oligonucleotide; AAG chr2 60543717 60543736 60543733 +
taaacacaatgaaagaaatc

SEQ ID NO: 168904 - DNA, 20 bp, Artificial Sequence
  Synthetic oligonucleotide; AAG chr2 60543743 60543762 60543759 +
ttgtaattattcatgcacga

SEQ ID NO: 168905 - DNA, 20 bp, Artificial Sequence
  Synthetic oligonucleotide; AGG chr2 60543744 60543763 60543760 +
tgtaattattcatgcacgaa

SEQ ID NO: 168906 - DNA, 20 bp, Artificial Sequence
  Synthetic oligonucleotide; TGG chr2 60543758 60543777 60543774 +
cacgaaaggtttacctcacc

SEQ ID NO: 168907 - DNA, 20 bp, Artificial Sequence
  Synthetic oligonucleotide; GGG chr2 60543759 60543778 60543775 +
acgaaaggtttacctcacct

SEQ ID NO: 168908 - DNA, 20 bp, Artificial Sequence
  Synthetic oligonucleotide; CAG chr2 60543765 60543784 60543781 +
ggtttacctcacctgggtca

SEQ ID NO: 168909 - DNA, 20 bp, Artificial Sequence
  Synthetic oligonucleotide; TAG chr2 60543795 60543814 60543811 +
tgtgcgcccattgaatatct

SEQ ID NO: 168910 - DNA, 20 bp, Artificial Sequence
  Synthetic oligonucleotide; TAG chr2 60543804 60543823 60543820 +
attgaatatcttagacatct

SEQ ID NO: 168911 - DNA, 20 bp, Artificial Sequence
  Synthetic oligonucleotide; GAG chr2 60543806 60543825 60543822 +
tgaatatcttagacatctta

SEQ ID NO: 168912 - DNA, 20 bp, Artificial Sequence
  Synthetic oligonucleotide; GAG chr2 60543808 60543827 60543824 +
aatatcttagacatcttaga

SEQ ID NO: 168913 - DNA, 20 bp, Artificial Sequence
  Synthetic oligonucleotide; CAG chr2 60543821 60543840 60543837 +
tcttagagagcttttcgtct

SEQ ID NO: 168914 - DNA, 20 bp, Artificial Sequence
  Synthetic oligonucleotide; TAG chr2 60543840 60543859 60543856 +
tcagttaaatgattgattat

SEQ ID NO: 168915 - DNA, 20 bp, Artificial Sequence
  Synthetic oligonucleotide; TGG chr2 60543872 60543891 60543888 +
atatattttaaatttgcttt

SEQ ID NO: 168916 - DNA, 20 bp, Artificial Sequence
  Synthetic oligonucleotide; TGG chr2 60543878 60543897 60543894 +
tttaaatttgcttttggttt

SEQ ID NO: 168917 - DNA, 20 bp, Artificial Sequence
  Synthetic oligonucleotide; TAG chr2 60543887 60543906 60543903 +
gcttttggttttggcttctc

SEQ ID NO: 168918 - DNA, 20 bp, Artificial Sequence
  Synthetic oligonucleotide; AGG chr2 60543888 60543907 60543904 +
cttttggttttggcttctct

SEQ ID NO: 168919 - DNA, 20 bp, Artificial Sequence
  Synthetic oligonucleotide; CAG chr2 60543927 60543946 60543943 +
gttctttaaaaaaataataa

SEQ ID NO: 168920 - DNA, 20 bp, Artificial Sequence
  Synthetic oligonucleotide; TAG chr2 60543936 60543955 60543952 +
aaaaataataacagaacctt

SEQ ID NO: 168921 - DNA, 20 bp, Artificial Sequence
  Synthetic oligonucleotide; CAG chr2 60543944 60543963 60543960 +
taacagaacctttagacaac

SEQ ID NO: 168922 - DNA, 20 bp, Artificial Sequence
  Synthetic oligonucleotide; AGG chr2 60543945 60543964 60543961 +
aacagaacctttagacaacc

SEQ ID NO: 168923 - DNA, 20 bp, Artificial Sequence
  Synthetic oligonucleotide; GGG chr2 60543946 60543965 60543962 +
acagaacctttagacaacca

SEQ ID NO: 168924 - DNA, 20 bp, Artificial Sequence
  Synthetic oligonucleotide; GAG chr2 60543948 60543967 60543964 +
agaacctttagacaaccagg

SEQ ID NO: 168925 - DNA, 20 bp, Artificial Sequence
  Synthetic oligonucleotide; AAG chr2 60543954 60543973 60543970 +
tttagacaaccagggagttc

SEQ ID NO: 168926 - DNA, 20 bp, Artificial Sequence
  Synthetic oligonucleotide; TAG chr2 60543980 60543999 60543996 +
atatctcttatttccctaca

SEQ ID NO: 168927 - DNA, 20 bp, Artificial Sequence
  Synthetic oligonucleotide; TAG chr2 60543994 60544013 60544010 +
cctacatagattcacaacta

SEQ ID NO: 168928 - DNA, 20 bp, Artificial Sequence
  Synthetic oligonucleotide; CAG chr2 60543997 60544016 60544013 +
acatagattcacaactatag

SEQ ID NO: 168929 - DNA, 20 bp, Artificial Sequence
  Synthetic oligonucleotide; AAG chr2 60544003 60544022 60544019 +
attcacaactatagcagtaa

SEQ ID NO: 168930 - DNA, 20 bp, Artificial Sequence
  Synthetic oligonucleotide; AAG chr2 60544020 60544039 60544036 +
taaaagtcttaactatatgt

SEQ ID NO: 168931 - DNA, 20 bp, Artificial Sequence
  Synthetic oligonucleotide; AGG chr2 60544021 60544040 60544037 +
aaaagtcttaactatatgta

SEQ ID NO: 168932 - DNA, 20 bp, Artificial Sequence
  Synthetic oligonucleotide; CAG chr2 60544033 60544052 60544049 +
tatatgtaaggccttccccc

SEQ ID NO: 168933 - DNA, 20 bp, Artificial Sequence
  Synthetic oligonucleotide; TAG chr2 60544040 60544059 60544056 +
aaggccttccccccagcatt

SEQ ID NO: 168934 - DNA, 20 bp, Artificial Sequence
  Synthetic oligonucleotide; CAG chr2 60544059 60544078 60544075 +
ttagattcctcctctaaata

SEQ ID NO: 168935 - DNA, 20 bp, Artificial Sequence
  Synthetic oligonucleotide; GAG chr2 60544061 60544080 60544077 +
agattcctcctctaaataca

SEQ ID NO: 168936 - DNA, 20 bp, Artificial Sequence
  Synthetic oligonucleotide; AGG chr2 60544062 60544081 60544078 +
gattcctcctctaaatacag

SEQ ID NO: 168937 - DNA, 20 bp, Artificial Sequence
  Synthetic oligonucleotide; CAG chr2 60544067 60544086 60544083 +
ctcctctaaatacagaggca

SEQ ID NO: 168938 - DNA, 20 bp, Artificial Sequence
  Synthetic oligonucleotide; GAG chr2 60544077 60544096 60544093 +
tacagaggcacagaattttt

SEQ ID NO: 168939 - DNA, 20 bp, Artificial Sequence
  Synthetic oligonucleotide; TGG chr2 60544081 60544100 60544097 +
gaggcacagaatttttgagc

SEQ ID NO: 168940 - DNA, 20 bp, Artificial Sequence
  Synthetic oligonucleotide; AAG chr2 60544091 60544110 60544107 +
atttttgagctggttaatct

SEQ ID NO: 168941 - DNA, 20 bp, Artificial Sequence
  Synthetic oligonucleotide; TGG chr2 60544109 60544128 60544125 +
ctaagactgaataacctatt

SEQ ID NO: 168942 - DNA, 20 bp, Artificial Sequence
  Synthetic oligonucleotide; GGG chr2 60544110 60544129 60544126 +
taagactgaataacctattt

SEQ ID NO: 168943 - DNA, 20 bp, Artificial Sequence
  Synthetic oligonucleotide; CAG chr2 60544117 60544136 60544133 +
gaataacctatttgggacct

SEQ ID NO: 168944 - DNA, 20 bp, Artificial Sequence
  Synthetic oligonucleotide; AAG chr2 60544121 60544140 60544137 +
aacctatttgggacctcagt

SEQ ID NO: 168945 - DNA, 20 bp, Artificial Sequence
  Synthetic oligonucleotide; AAG chr2 60544124 60544143 60544140 +
ctatttgggacctcagtaag

SEQ ID NO: 168946 - DNA, 20 bp, Artificial Sequence
  Synthetic oligonucleotide; TGG chr2 60544129 60544148 60544145 +
tgggacctcagtaagaagtg

SEQ ID NO: 168947 - DNA, 20 bp, Artificial Sequence
  Synthetic oligonucleotide; CAG chr2 60544149 60544168 60544165 +
tggttttaattcttgcttga

SEQ ID NO: 168948 - DNA, 20 bp, Artificial Sequence
  Synthetic oligonucleotide; GAG chr2 60544175 60544194 60544191 +
ctgtgttttgtcttttaaac

SEQ ID NO: 168949 - DNA, 20 bp, Artificial Sequence
  Synthetic oligonucleotide; CAG chr2 60544178 60544197 60544194 +
tgttttgtcttttaaacgag

SEQ ID NO: 168950 - DNA, 20 bp, Artificial Sequence
  Synthetic oligonucleotide; AAG chr2 60544212 60544231 60544228 +
aatacgatgttacatcacgc

SEQ ID NO: 168951 - DNA, 20 bp, Artificial Sequence
  Synthetic oligonucleotide; TGG chr2 60544229 60544248 60544245 +
cgcaagtgttactccatatt

SEQ ID NO: 168952 - DNA, 20 bp, Artificial Sequence
  Synthetic oligonucleotide; TAG chr2 60544237 60544256 60544253 +
ttactccatatttggtgatt

SEQ ID NO: 168953 - DNA, 20 bp, Artificial Sequence
  Synthetic oligonucleotide; AAG chr2 60544241 60544260 60544257 +
tccatatttggtgatttagc

SEQ ID NO: 168954 - DNA, 20 bp, Artificial Sequence
  Synthetic oligonucleotide; AGG chr2 60544242 60544261 60544258 +
ccatatttggtgatttagca

SEQ ID NO: 168955 - DNA, 20 bp, Artificial Sequence
  Synthetic oligonucleotide; TGG chr2 60544248 60544267 60544264 +
ttggtgatttagcaaggctt

SEQ ID NO: 168956 - DNA, 20 bp, Artificial Sequence
  Synthetic oligonucleotide; AAG chr2 60544258 60544277 60544274 +
agcaaggctttggatctccg

SEQ ID NO: 168957 - DNA, 20 bp, Artificial Sequence
  Synthetic oligonucleotide; CAG chr2 60544329 60544348 60544345 +
acttctgttcattttccttc

SEQ ID NO: 168958 - DNA, 20 bp, Artificial Sequence
  Synthetic oligonucleotide; AAG chr2 60544336 60544355 60544352 +
ttcattttccttccagtcac

SEQ ID NO: 168959 - DNA, 20 bp, Artificial Sequence
  Synthetic oligonucleotide; TGG chr2 60544347 60544366 60544363 +
tccagtcacaagacaacaca

SEQ ID NO: 168960 - DNA, 20 bp, Artificial Sequence
  Synthetic oligonucleotide; TGG chr2 60544353 60544372 60544369 +
cacaagacaacacatggaaa

SEQ ID NO: 168961 - DNA, 20 bp, Artificial Sequence
  Synthetic oligonucleotide; TGG chr2 60544373 60544392 60544389 +
tggtcattcccacatcctgc

SEQ ID NO: 168962 - DNA, 20 bp, Artificial Sequence
  Synthetic oligonucleotide; GGG chr2 60544374 60544393 60544390 +
ggtcattcccacatcctgct

SEQ ID NO: 168963 - DNA, 20 bp, Artificial Sequence
  Synthetic oligonucleotide; GGG chr2 60544375 60544394 60544391 +
gtcattcccacatcctgctg

SEQ ID NO: 168964 - DNA, 20 bp, Artificial Sequence
  Synthetic oligonucleotide; GGG chr2 60544376 60544395 60544392 +
tcattcccacatcctgctgg

SEQ ID NO: 168965 - DNA, 20 bp, Artificial Sequence
  Synthetic oligonucleotide; GGG chr2 60544377 60544396 60544393 +
cattcccacatcctgctggg

SEQ ID NO: 168966 - DNA, 20 bp, Artificial Sequence
  Synthetic oligonucleotide; TAG chr2 60544380 60544399 60544396 +
tcccacatcctgctgggggg

SEQ ID NO: 168967 - DNA, 20 bp, Artificial Sequence
  Synthetic oligonucleotide; AGG chr2 60544381 60544400 60544397 +
cccacatcctgctggggggt

SEQ ID NO: 168968 - DNA, 20 bp, Artificial Sequence
  Synthetic oligonucleotide; GGG chr2 60544382 60544401 60544398 +
ccacatcctgctggggggta

SEQ ID NO: 168969 - DNA, 20 bp, Artificial Sequence
  Synthetic oligonucleotide; GGG chr2 60544383 60544402 60544399 +
cacatcctgctggggggtag

SEQ ID NO: 168970 - DNA, 20 bp, Artificial Sequence
  Synthetic oligonucleotide; GAG chr2 60544385 60544404 60544401 +
catcctgctggggggtaggg

SEQ ID NO: 168971 - DNA, 20 bp, Artificial Sequence
  Synthetic oligonucleotide; AAG chr2 60544414 60544433 60544430 +
tcttcacctacatgtcacat

SEQ ID NO: 168972 - DNA, 20 bp, Artificial Sequence
  Synthetic oligonucleotide; AGG chr2 60544415 60544434 60544431 +
cttcacctacatgtcacata

SEQ ID NO: 168973 - DNA, 20 bp, Artificial Sequence
  Synthetic oligonucleotide; TGG chr2 60544424 60544443 60544440 +
catgtcacataaggtaaatg

SEQ ID NO: 168974 - DNA, 20 bp, Artificial Sequence
  Synthetic oligonucleotide; TGG chr2 60544427 60544446 60544443 +
gtcacataaggtaaatgtgg

SEQ ID NO: 168975 - DNA, 20 bp, Artificial Sequence
  Synthetic oligonucleotide; AAG chr2 60544434 60544453 60544450 +
aaggtaaatgtggtggattc

SEQ ID NO: 168976 - DNA, 20 bp, Artificial Sequence
  Synthetic oligonucleotide; CAG chr2 60544455 60544474 60544471 +
agaaatacactccacaaatg

SEQ ID NO: 168977 - DNA, 20 bp, Artificial Sequence
  Synthetic oligonucleotide; TAG chr2 60544464 60544483 60544480 +
ctccacaaatgcagcttccc

SEQ ID NO: 168978 - DNA, 20 bp, Artificial Sequence
  Synthetic oligonucleotide; CAG chr2 60544467 60544486 60544483 +
cacaaatgcagcttccctag

SEQ ID NO: 168979 - DNA, 20 bp, Artificial Sequence
  Synthetic oligonucleotide; CAG chr2 60544470 60544489 60544486 +
aaatgcagcttccctagcag

SEQ ID NO: 168980 - DNA, 20 bp, Artificial Sequence
  Synthetic oligonucleotide; AAG chr2 60544489 60544508 60544505 +
gcagatttcccatttcacta

SEQ ID NO: 168981 - DNA, 20 bp, Artificial Sequence
  Synthetic oligonucleotide; AGG chr2 60544490 60544509 60544506 +
cagatttcccatttcactaa

SEQ ID NO: 168982 - DNA, 20 bp, Artificial Sequence
  Synthetic oligonucleotide; GGG chr2 60544491 60544510 60544507 +
agatttcccatttcactaaa

SEQ ID NO: 168983 - DNA, 20 bp, Artificial Sequence
  Synthetic oligonucleotide; AAG chr2 60544495 60544514 60544511 +
ttcccatttcactaaaggga

SEQ ID NO: 168984 - DNA, 20 bp, Artificial Sequence
  Synthetic oligonucleotide; GAG chr2 60544503 60544522 60544519 +
tcactaaagggaaagtatct

SEQ ID NO: 168985 - DNA, 20 bp, Artificial Sequence
  Synthetic oligonucleotide; CAG chr2 60544514 60544533 60544530 +
aaagtatctgagtgctatca

SEQ ID NO: 168986 - DNA, 20 bp, Artificial Sequence
  Synthetic oligonucleotide; AAG chr2 60544518 60544537 60544534 +
tatctgagtgctatcacaga

SEQ ID NO: 168987 - DNA, 20 bp, Artificial Sequence
  Synthetic oligonucleotide; AAG chr2 60544530 60544549 60544546 +
atcacagaaagcactaaaaa

SEQ ID NO: 168988 - DNA, 20 bp, Artificial Sequence
  Synthetic oligonucleotide; AAG chr2 60544534 60544553 60544550 +
cagaaagcactaaaaaaaga

SEQ ID NO: 168989 - DNA, 20 bp, Artificial Sequence
  Synthetic oligonucleotide; TGG chr2 60544550 60544569 60544566 +
aagaaagaaaatgccatgtt

SEQ ID NO: 168990 - DNA, 20 bp, Artificial Sequence
  Synthetic oligonucleotide; TAG chr2 60544570 60544589 60544586 +
tggttttaatgatcaaattc

SEQ ID NO: 168991 - DNA, 20 bp, Artificial Sequence
  Synthetic oligonucleotide; GAG chr2 60544572 60544591 60544588 +
gttttaatgatcaaattcta

SEQ ID NO: 168992 - DNA, 20 bp, Artificial Sequence
  Synthetic oligonucleotide; AGG chr2 60544573 60544592 60544589 +
ttttaatgatcaaattctag

SEQ ID NO: 168993 - DNA, 20 bp, Artificial Sequence
  Synthetic oligonucleotide; GGG chr2 60544574 60544593 60544590 +
tttaatgatcaaattctaga

SEQ ID NO: 168994 - DNA, 20 bp, Artificial Sequence
  Synthetic oligonucleotide; GGG chr2 60544575 60544594 60544591 +
ttaatgatcaaattctagag

SEQ ID NO: 168995 - DNA, 20 bp, Artificial Sequence
  Synthetic oligonucleotide; GGG chr2 60544576 60544595 60544592 +
taatgatcaaattctagagg

SEQ ID NO: 168996 - DNA, 20 bp, Artificial Sequence
  Synthetic oligonucleotide; GAG chr2 60544578 60544597 60544594 +
atgatcaaattctagagggg

SEQ ID NO: 168997 - DNA, 20 bp, Artificial Sequence
  Synthetic oligonucleotide; GAG chr2 60544580 60544599 60544596 +
gatcaaattctagaggggga

SEQ ID NO: 168998 - DNA, 20 bp, Artificial Sequence
  Synthetic oligonucleotide; AGG chr2 60544581 60544600 60544597 +
atcaaattctagagggggag

SEQ ID NO: 168999 - DNA, 20 bp, Artificial Sequence
  Synthetic oligonucleotide; GAG chr2 60544583 60544602 60544599 +
caaattctagagggggagag

SEQ ID NO: 169000 - DNA, 20 bp, Artificial Sequence
  Synthetic oligonucleotide; TAG chr2 60544611 60544630 60544627 +
atatgacatttaatcccctc

SEQ ID NO: 169001 - DNA, 20 bp, Artificial Sequence
  Synthetic oligonucleotide; TGG chr2 60544629 60544648 60544645 +
tctagaccactgacctatta

SEQ ID NO: 169002 - DNA, 20 bp, Artificial Sequence
  Synthetic oligonucleotide; TGG chr2 60544642 60544661 60544658 +
cctattatggttcaactttg

SEQ ID NO: 169003 - DNA, 20 bp, Artificial Sequence
  Synthetic oligonucleotide; TAG chr2 60544651 60544670 60544667 +
gttcaactttgtggtcaaac

SEQ ID NO: 169004 - DNA, 20 bp, Artificial Sequence
  Synthetic oligonucleotide; AGG chr2 60544652 60544671 60544668 +
ttcaactttgtggtcaaact

SEQ ID NO: 169005 - DNA, 20 bp, Artificial Sequence
  Synthetic oligonucleotide; CGG chr2 60544656 60544675 60544672 +
actttgtggtcaaactaggt

SEQ ID NO: 169006 - DNA, 20 bp, Artificial Sequence
  Synthetic oligonucleotide; GAG chr2 60544658 60544677 60544674 +
tttgtggtcaaactaggtcg

SEQ ID NO: 169007 - DNA, 20 bp, Artificial Sequence
  Synthetic oligonucleotide; GAG chr2 60544660 60544679 60544676 +
tgtggtcaaactaggtcgga

SEQ ID NO: 169008 - DNA, 20 bp, Artificial Sequence
  Synthetic oligonucleotide; AAG chr2 60544665 60544684 60544681 +
tcaaactaggtcggagagac

SEQ ID NO: 169009 - DNA, 20 bp, Artificial Sequence
  Synthetic oligonucleotide; CAG chr2 60544671 60544690 60544687 +
taggtcggagagacaagttc

SEQ ID NO: 169010 - DNA, 20 bp, Artificial Sequence
  Synthetic oligonucleotide; CGG chr2 60544731 60544750 60544747 +
tgaacaaacctcttgccttt

SEQ ID NO: 169011 - DNA, 20 bp, Artificial Sequence
  Synthetic oligonucleotide; GGG chr2 60544732 60544751 60544748 +
gaacaaacctcttgcctttc

SEQ ID NO: 169012 - DNA, 20 bp, Artificial Sequence
  Synthetic oligonucleotide; GAG chr2 60544734 60544753 60544750 +
acaaacctcttgcctttcgg

SEQ ID NO: 169013 - DNA, 20 bp, Artificial Sequence
  Synthetic oligonucleotide; TGG chr2 60544738 60544757 60544754 +
acctcttgcctttcgggagc

SEQ ID NO: 169014 - DNA, 20 bp, Artificial Sequence
  Synthetic oligonucleotide; GGG chr2 60544739 60544758 60544755 +
cctcttgcctttcgggagct

SEQ ID NO: 169015 - DNA, 20 bp, Artificial Sequence
  Synthetic oligonucleotide; TGG chr2 60544742 60544761 60544758 +
cttgcctttcgggagctggg

SEQ ID NO: 169016 - DNA, 20 bp, Artificial Sequence
  Synthetic oligonucleotide; TAG chr2 60544745 60544764 60544761 +
gcctttcgggagctgggtgg

SEQ ID NO: 169017 - DNA, 20 bp, Artificial Sequence
  Synthetic oligonucleotide; AGG chr2 60544746 60544765 60544762 +
cctttcgggagctgggtggt

SEQ ID NO: 169018 - DNA, 20 bp, Artificial Sequence
  Synthetic oligonucleotide; TAG chr2 60544749 60544768 60544765 +
ttcgggagctgggtggtagg

SEQ ID NO: 169019 - DNA, 20 bp, Artificial Sequence
  Synthetic oligonucleotide; TGG chr2 60544753 60544772 60544769 +
ggagctgggtggtaggtaga

SEQ ID NO: 169020 - DNA, 20 bp, Artificial Sequence
  Synthetic oligonucleotide; AAG chr2 60544756 60544775 60544772 +
gctgggtggtaggtagatgg

SEQ ID NO: 169021 - DNA, 20 bp, Artificial Sequence
  Synthetic oligonucleotide; AAG chr2 60544760 60544779 60544776 +
ggtggtaggtagatggaaga

SEQ ID NO: 169022 - DNA, 20 bp, Artificial Sequence
  Synthetic oligonucleotide; CAG chr2 60544774 60544793 60544790 +
ggaagaaagcgatccaccaa

SEQ ID NO: 169023 - DNA, 20 bp, Artificial Sequence
  Synthetic oligonucleotide; AGG chr2 60544775 60544794 60544791 +
gaagaaagcgatccaccaac

SEQ ID NO: 169024 - DNA, 20 bp, Artificial Sequence
  Synthetic oligonucleotide; TGG chr2 60544780 60544799 60544796 +
aagcgatccaccaacaggca

SEQ ID NO: 169025 - DNA, 20 bp, Artificial Sequence
  Synthetic oligonucleotide; CAG chr2 60544797 60544816 60544813 +
gcatggcatgtctgtcatca

SEQ ID NO: 169026 - DNA, 20 bp, Artificial Sequence
  Synthetic oligonucleotide; AAG chr2 60544830 60544849 60544846 +
gacttttgtctaacatgctc

SEQ ID NO: 169027 - DNA, 20 bp, Artificial Sequence
  Synthetic oligonucleotide; GAG chr2 60544846 60544865 60544862 +
gctcaagcaaaaaatgtttt

SEQ ID NO: 169028 - DNA, 20 bp, Artificial Sequence
  Synthetic oligonucleotide; AGG chr2 60544847 60544866 60544863 +
ctcaagcaaaaaatgttttg

SEQ ID NO: 169029 - DNA, 20 bp, Artificial Sequence
  Synthetic oligonucleotide; GGG chr2 60544848 60544867 60544864 +
tcaagcaaaaaatgttttga

SEQ ID NO: 169030 - DNA, 20 bp, Artificial Sequence
  Synthetic oligonucleotide; TAG chr2 60544859 60544878 60544875 +
atgttttgagggtcactata

SEQ ID NO: 169031 - DNA, 20 bp, Artificial Sequence
  Synthetic oligonucleotide; TAG chr2 60544879 60544898 60544895 +
tagtgttactgtttatcact

SEQ ID NO: 169032 - DNA, 20 bp, Artificial Sequence
  Synthetic oligonucleotide; GAG chr2 60544881 60544900 60544897 +
gtgttactgtttatcactta

SEQ ID NO: 169033 - DNA, 20 bp, Artificial Sequence
  Synthetic oligonucleotide; AAG chr2 60544884 60544903 60544900 +
ttactgtttatcacttagag

SEQ ID NO: 169034 - DNA, 20 bp, Artificial Sequence
  Synthetic oligonucleotide; AGG chr2 60544885 60544904 60544901 +
tactgtttatcacttagaga

SEQ ID NO: 169035 - DNA, 20 bp, Artificial Sequence
  Synthetic oligonucleotide; GGG chr2 60544886 60544905 60544902 +
actgtttatcacttagagaa

SEQ ID NO: 169036 - DNA, 20 bp, Artificial Sequence
  Synthetic oligonucleotide; AAG chr2 60544894 60544913 60544910 +
tcacttagagaagggaattt

SEQ ID NO: 169037 - DNA, 20 bp, Artificial Sequence
  Synthetic oligonucleotide; TAG chr2 60544906 60544925 60544922 +
gggaatttaagtcccactgc

SEQ ID NO: 169038 - DNA, 20 bp, Artificial Sequence
  Synthetic oligonucleotide; GAG chr2 60544929 60544948 60544945 +
cctttaattccttttccctt

SEQ ID NO: 169039 - DNA, 20 bp, Artificial Sequence
  Synthetic oligonucleotide; GAG chr2 60544937 60544956 60544953 +
tccttttcccttgagctgcc

SEQ ID NO: 169040 - DNA, 20 bp, Artificial Sequence
  Synthetic oligonucleotide; TAG chr2 60544953 60544972 60544969 +
tgccgagaaacccacacacc

SEQ ID NO: 169041 - DNA, 20 bp, Artificial Sequence
  Synthetic oligonucleotide; AAG chr2 60544980 60544999 60544996 +
ctccctgctaaaattaacca

SEQ ID NO: 169042 - DNA, 20 bp, Artificial Sequence
  Synthetic oligonucleotide; AGG chr2 60544981 60545000 60544997 +
tccctgctaaaattaaccaa

SEQ ID NO: 169043 - DNA, 20 bp, Artificial Sequence
  Synthetic oligonucleotide; GAG chr2 60544983 60545002 60544999 +
cctgctaaaattaaccaaag

SEQ ID NO: 169044 - DNA, 20 bp, Artificial Sequence
  Synthetic oligonucleotide; AGG chr2 60544984 60545003 60545000 +
ctgctaaaattaaccaaagg

SEQ ID NO: 169045 - DNA, 20 bp, Artificial Sequence
  Synthetic oligonucleotide; GGG chr2 60544985 60545004 60545001 +
tgctaaaattaaccaaagga

SEQ ID NO: 169046 - DNA, 20 bp, Artificial Sequence
  Synthetic oligonucleotide; GAG chr2 60544987 60545006 60545003 +
ctaaaattaaccaaaggagg

SEQ ID NO: 169047 - DNA, 20 bp, Artificial Sequence
  Synthetic oligonucleotide; AGG chr2 60544988 60545007 60545004 +
taaaattaaccaaaggaggg

SEQ ID NO: 169048 - DNA, 20 bp, Artificial Sequence
  Synthetic oligonucleotide; GGG chr2 60544989 60545008 60545005 +
aaaattaaccaaaggaggga

SEQ ID NO: 169049 - DNA, 20 bp, Artificial Sequence
  Synthetic oligonucleotide; AAG chr2 60545019 60545038 60545035 +
atacgtgtgtgtatttttcc

SEQ ID NO: 169050 - DNA, 20 bp, Artificial Sequence
  Synthetic oligonucleotide; TAG chr2 60545042 60545061 60545058 +
aaaatttttacattgtgtta

SEQ ID NO: 169051 - DNA, 20 bp, Artificial Sequence
  Synthetic oligonucleotide; CAG chr2 60545045 60545064 60545061 +
atttttacattgtgttatag

SEQ ID NO: 169052 - DNA, 20 bp, Artificial Sequence
  Synthetic oligonucleotide; CAG chr2 60545051 60545070 60545067 +
acattgtgttatagcagaaa

SEQ ID NO: 169053 - DNA, 20 bp, Artificial Sequence
  Synthetic oligonucleotide; TGG chr2 60545054 60545073 60545070 +
ttgtgttatagcagaaacag

SEQ ID NO: 169054 - DNA, 20 bp, Artificial Sequence
  Synthetic oligonucleotide; GAG chr2 60545056 60545075 60545072 +
gtgttatagcagaaacagtg

SEQ ID NO: 169055 - DNA, 20 bp, Artificial Sequence
  Synthetic oligonucleotide; TGG chr2 60545061 60545080 60545077 +
atagcagaaacagtggagtc

SEQ ID NO: 169056 - DNA, 20 bp, Artificial Sequence
  Synthetic oligonucleotide; TGG chr2 60545066 60545085 60545082 +
agaaacagtggagtctggac

SEQ ID NO: 169057 - DNA, 20 bp, Artificial Sequence
  Synthetic oligonucleotide; AAG chr2 60545077 60545096 60545093 +
agtctggactggacatttgt

SEQ ID NO: 169058 - DNA, 20 bp, Artificial Sequence
  Synthetic oligonucleotide; AGG chr2 60545078 60545097 60545094 +
gtctggactggacatttgta

SEQ ID NO: 169059 - DNA, 20 bp, Artificial Sequence
  Synthetic oligonucleotide; GGG chr2 60545079 60545098 60545095 +
tctggactggacatttgtaa

SEQ ID NO: 169060 - DNA, 20 bp, Artificial Sequence
  Synthetic oligonucleotide; TGG chr2 60545089 60545108 60545105 +
acatttgtaagggtgacatg

SEQ ID NO: 169061 - DNA, 20 bp, Artificial Sequence
  Synthetic oligonucleotide; AAG chr2 60545115 60545134 60545131 +
tgtaaaccacaaacaaaatc

SEQ ID NO: 169062 - DNA, 20 bp, Artificial Sequence
  Synthetic oligonucleotide; CAG chr2 60545139 60545158 60545155 +
tacatctgtcaaaaccacat

SEQ ID NO: 169063 - DNA, 20 bp, Artificial Sequence
  Synthetic oligonucleotide; GAG chr2 60545141 60545160 60545157 +
catctgtcaaaaccacatca

SEQ ID NO: 169064 - DNA, 20 bp, Artificial Sequence
  Synthetic oligonucleotide; AAG chr2 60545146 60545165 60545162 +
gtcaaaaccacatcagagac

SEQ ID NO: 169065 - DNA, 20 bp, Artificial Sequence
  Synthetic oligonucleotide; GAG chr2 60545148 60545167 60545164 +
caaaaccacatcagagacaa

SEQ ID NO: 169066 - DNA, 20 bp, Artificial Sequence
  Synthetic oligonucleotide; GAG chr2 60545150 60545169 60545166 +
aaaccacatcagagacaaga

SEQ ID NO: 169067 - DNA, 20 bp, Artificial Sequence
  Synthetic oligonucleotide; GAG chr2 60545152 60545171 60545168 +
accacatcagagacaagaga

SEQ ID NO: 169068 - DNA, 20 bp, Artificial Sequence
  Synthetic oligonucleotide; CAG chr2 60545157 60545176 60545173 +
atcagagacaagagagagca

SEQ ID NO: 169069 - DNA, 20 bp, Artificial Sequence
  Synthetic oligonucleotide; GAG chr2 60545159 60545178 60545175 +
cagagacaagagagagcaca

SEQ ID NO: 169070 - DNA, 20 bp, Artificial Sequence
  Synthetic oligonucleotide; AAG chr2 60545162 60545181 60545178 +
agacaagagagagcacagag

SEQ ID NO: 169071 - DNA, 20 bp, Artificial Sequence
  Synthetic oligonucleotide; TAG chr2 60545176 60545195 60545192 +
acagagaagcatttatcatt

SEQ ID NO: 169072 - DNA, 20 bp, Artificial Sequence
  Synthetic oligonucleotide; GAG chr2 60545181 60545200 60545197 +
gaagcatttatcatttagct

SEQ ID NO: 169073 - DNA, 20 bp, Artificial Sequence
  Synthetic oligonucleotide; AGG chr2 60545182 60545201 60545198 +
aagcatttatcatttagctg

SEQ ID NO: 169074 - DNA, 20 bp, Artificial Sequence
  Synthetic oligonucleotide; GAG chr2 60545184 60545203 60545200 +
gcatttatcatttagctgag

SEQ ID NO: 169075 - DNA, 20 bp, Artificial Sequence
  Synthetic oligonucleotide; AGG chr2 60545185 60545204 60545201 +
catttatcatttagctgagg

SEQ ID NO: 169076 - DNA, 20 bp, Artificial Sequence
  Synthetic oligonucleotide; CAG chr2 60545188 60545207 60545204 +
ttatcatttagctgaggagg

SEQ ID NO: 169077 - DNA, 20 bp, Artificial Sequence
  Synthetic oligonucleotide; AGG chr2 60545189 60545208 60545205 +
tatcatttagctgaggaggc

SEQ ID NO: 169078 - DNA, 20 bp, Artificial Sequence
  Synthetic oligonucleotide; CAG chr2 60545195 60545214 60545211 +
ttagctgaggaggcaggctg

SEQ ID NO: 169079 - DNA, 20 bp, Artificial Sequence
  Synthetic oligonucleotide; AGG chr2 60545196 60545215 60545212 +
tagctgaggaggcaggctgc

SEQ ID NO: 169080 - DNA, 20 bp, Artificial Sequence
  Synthetic oligonucleotide; GGG chr2 60545197 60545216 60545213 +
agctgaggaggcaggctgca

SEQ ID NO: 169081 - DNA, 20 bp, Artificial Sequence
  Synthetic oligonucleotide; GAG chr2 60545199 60545218 60545215 +
ctgaggaggcaggctgcagg

SEQ ID NO: 169082 - DNA, 20 bp, Artificial Sequence
  Synthetic oligonucleotide; CAG chr2 60545202 60545221 60545218 +
aggaggcaggctgcagggag

SEQ ID NO: 169083 - DNA, 20 bp, Artificial Sequence
  Synthetic oligonucleotide; GAG chr2 60545258 60545277 60545274 +
aacatgcccttaaacttttc

SEQ ID NO: 169084 - DNA, 20 bp, Artificial Sequence
  Synthetic oligonucleotide; AAG chr2 60545262 60545281 60545278 +
tgcccttaaacttttcgagt

SEQ ID NO: 169085 - DNA, 20 bp, Artificial Sequence
  Synthetic oligonucleotide; CAG chr2 60545280 60545299 60545296 +
gtaagcatgtctgtgcgctt

SEQ ID NO: 169086 - DNA, 20 bp, Artificial Sequence
  Synthetic oligonucleotide; TGG chr2 60545301 60545320 60545317 +
agcaactgccctctctactc

SEQ ID NO: 169087 - DNA, 20 bp, Artificial Sequence
  Synthetic oligonucleotide; TGG chr2 60545306 60545325 60545322 +
ctgccctctctactctggcc

SEQ ID NO: 169088 - DNA, 20 bp, Artificial Sequence
  Synthetic oligonucleotide; CAG chr2 60545310 60545329 60545326 +
cctctctactctggcctggc

SEQ ID NO: 169089 - DNA, 20 bp, Artificial Sequence
  Synthetic oligonucleotide; TGG chr2 60545320 60545339 60545336 +
ctggcctggccagtcgaaaa

SEQ ID NO: 169090 - DNA, 20 bp, Artificial Sequence
  Synthetic oligonucleotide; AAG chr2 60545330 60545349 60545346 +
cagtcgaaaatggcatctta

SEQ ID NO: 169091 - DNA, 20 bp, Artificial Sequence
  Synthetic oligonucleotide; AAG chr2 60545335 60545354 60545351 +
gaaaatggcatcttaaagtc

SEQ ID NO: 169092 - DNA, 20 bp, Artificial Sequence
  Synthetic oligonucleotide; AGG chr2 60545336 60545355 60545352 +
aaaatggcatcttaaagtca

SEQ ID NO: 169093 - DNA, 20 bp, Artificial Sequence
  Synthetic oligonucleotide; TGG chr2 60545342 60545361 60545358 +
gcatcttaaagtcaaggtca

SEQ ID NO: 169094 - DNA, 20 bp, Artificial Sequence
  Synthetic oligonucleotide; CGG chr2 60545358 60545377 60545374 +
gtcatggtgtcatcccacca

SEQ ID NO: 169095 - DNA, 20 bp, Artificial Sequence
  Synthetic oligonucleotide; GGG chr2 60545359 60545378 60545375 +
tcatggtgtcatcccaccac

SEQ ID NO: 169096 - DNA, 20 bp, Artificial Sequence
  Synthetic oligonucleotide; GGG chr2 60545360 60545379 60545376 +
catggtgtcatcccaccacg

SEQ ID NO: 169097 - DNA, 20 bp, Artificial Sequence
  Synthetic oligonucleotide; CAG chr2 60545376 60545395 60545392 +
cacggggctgtgtttaatta

SEQ ID NO: 169098 - DNA, 20 bp, Artificial Sequence
  Synthetic oligonucleotide; CGG chr2 60545386 60545405 60545402 +
tgtttaattacagccccatc

SEQ ID NO: 169099 - DNA, 20 bp, Artificial Sequence
  Synthetic oligonucleotide; GGG chr2 60545387 60545406 60545403 +
gtttaattacagccccatcc

SEQ ID NO: 169100 - DNA, 20 bp, Artificial Sequence
  Synthetic oligonucleotide; CAG chr2 60545394 60545413 60545410 +
tacagccccatccgggctga

SEQ ID NO: 169101 - DNA, 20 bp, Artificial Sequence
  Synthetic oligonucleotide; TGG chr2 60545403 60545422 60545419 +
atccgggctgacagccaata

SEQ ID NO: 169102 - DNA, 20 bp, Artificial Sequence
  Synthetic oligonucleotide; AAG chr2 60545410 60545429 60545426 +
ctgacagccaatatggatcc

SEQ ID NO: 169103 - DNA, 20 bp, Artificial Sequence
  Synthetic oligonucleotide; AGG chr2 60545411 60545430 60545427 +
tgacagccaatatggatcca

SEQ ID NO: 169104 - DNA, 20 bp, Artificial Sequence
  Synthetic oligonucleotide; TAG chr2 60545415 60545434 60545431 +
agccaatatggatccaaggc

SEQ ID NO: 169105 - DNA, 20 bp, Artificial Sequence
  Synthetic oligonucleotide; AAG chr2 60545423 60545442 60545439 +
tggatccaaggctagccctg

SEQ ID NO: 169106 - DNA, 20 bp, Artificial Sequence
  Synthetic oligonucleotide; CAG chr2 60545428 60545447 60545444 +
ccaaggctagccctgaagct

SEQ ID NO: 169107 - DNA, 20 bp, Artificial Sequence
  Synthetic oligonucleotide; CAG chr2 60545463 60545482 60545479 +
accacctccaactaccctgc

SEQ ID NO: 169108 - DNA, 20 bp, Artificial Sequence
  Synthetic oligonucleotide; CAG chr2 60545478 60545497 60545494 +
cctgccagcccactctactt

SEQ ID NO: 169109 - DNA, 20 bp, Artificial Sequence
  Synthetic oligonucleotide; AGG chr2 60545479 60545498 60545495 +
ctgccagcccactctacttc

SEQ ID NO: 169110 - DNA, 20 bp, Artificial Sequence
  Synthetic oligonucleotide; GGG chr2 60545480 60545499 60545496 +
tgccagcccactctacttca

SEQ ID NO: 169111 - DNA, 20 bp, Artificial Sequence
  Synthetic oligonucleotide; AAG chr2 60545483 60545502 60545499 +
cagcccactctacttcaggg

SEQ ID NO: 169112 - DNA, 20 bp, Artificial Sequence
  Synthetic oligonucleotide; GAG chr2 60545490 60545509 60545506 +
ctctacttcagggaagcctt

SEQ ID NO: 169113 - DNA, 20 bp, Artificial Sequence
  Synthetic oligonucleotide; GAG chr2 60545496 60545515 60545512 +
ttcagggaagccttgagaac

SEQ ID NO: 169114 - DNA, 20 bp, Artificial Sequence
  Synthetic oligonucleotide; AAG chr2 60545509 60545528 60545525 +
tgagaacgagctgaacccct

SEQ ID NO: 169115 - DNA, 20 bp, Artificial Sequence
  Synthetic oligonucleotide; AGG chr2 60545510 60545529 60545526 +
gagaacgagctgaaccccta

SEQ ID NO: 169116 - DNA, 20 bp, Artificial Sequence
  Synthetic oligonucleotide; GAG chr2 60545512 60545531 60545528 +
gaacgagctgaacccctaag

SEQ ID NO: 169117 - DNA, 20 bp, Artificial Sequence
  Synthetic oligonucleotide; AGG chr2 60545513 60545532 60545529 +
aacgagctgaacccctaagg

SEQ ID NO: 169118 - DNA, 20 bp, Artificial Sequence
  Synthetic oligonucleotide; TGG chr2 60545518 60545537 60545534 +
gctgaacccctaaggaggcc

SEQ ID NO: 169119 - DNA, 20 bp, Artificial Sequence
  Synthetic oligonucleotide; CAG chr2 60545522 60545541 60545538 +
aacccctaaggaggcctggc

SEQ ID NO: 169120 - DNA, 20 bp, Artificial Sequence
  Synthetic oligonucleotide; GAG chr2 60545532 60545551 60545548 +
gaggcctggccagatgttct

SEQ ID NO: 169121 - DNA, 20 bp, Artificial Sequence
  Synthetic oligonucleotide; AAG chr2 60545541 60545560 60545557 +
ccagatgttctgagtcaaac

SEQ ID NO: 169122 - DNA, 20 bp, Artificial Sequence
  Synthetic oligonucleotide; TGG chr2 60545548 60545567 60545564 +
ttctgagtcaaacaagtcat

SEQ ID NO: 169123 - DNA, 20 bp, Artificial Sequence
  Synthetic oligonucleotide; TGG chr2 60545571 60545590 60545587 +
ctgaactgcaaatgcctata

SEQ ID NO: 169124 - DNA, 20 bp, Artificial Sequence
  Synthetic oligonucleotide; AAG chr2 60545598 60545617 60545614 +
tttgcctctgacacgtcacc

SEQ ID NO: 169125 - DNA, 20 bp, Artificial Sequence
  Synthetic oligonucleotide; AGG chr2 60545599 60545618 60545615 +
ttgcctctgacacgtcacca

SEQ ID NO: 169126 - DNA, 20 bp, Artificial Sequence
  Synthetic oligonucleotide; TGG chr2 60545603 60545622 60545619 +
ctctgacacgtcaccaaggc

SEQ ID NO: 169127 - DNA, 20 bp, Artificial Sequence
  Synthetic oligonucleotide; TGG chr2 60545609 60545628 60545625 +
cacgtcaccaaggctggaaa

SEQ ID NO: 169128 - DNA, 20 bp, Artificial Sequence
  Synthetic oligonucleotide; TGG chr2 60545616 60545635 60545632 +
ccaaggctggaaatggacaa

SEQ ID NO: 169129 - DNA, 20 bp, Artificial Sequence
  Synthetic oligonucleotide; AAG chr2 60545619 60545638 60545635 +
aggctggaaatggacaatgg

SEQ ID NO: 169130 - DNA, 20 bp, Artificial Sequence
  Synthetic oligonucleotide; TGG chr2 60545623 60545642 60545639 +
tggaaatggacaatggaagc

SEQ ID NO: 169131 - DNA, 20 bp, Artificial Sequence
  Synthetic oligonucleotide; TAG chr2 60545628 60545647 60545644 +
atggacaatggaagctggac

SEQ ID NO: 169132 - DNA, 20 bp, Artificial Sequence
  Synthetic oligonucleotide; AGG chr2 60545629 60545648 60545645 +
tggacaatggaagctggact

SEQ ID NO: 169133 - DNA, 20 bp, Artificial Sequence
  Synthetic oligonucleotide; TAG chr2 60545634 60545653 60545650 +
aatggaagctggactaggtg

SEQ ID NO: 169134 - DNA, 20 bp, Artificial Sequence
  Synthetic oligonucleotide; AAG chr2 60545639 60545658 60545655 +
aagctggactaggtgtagta

SEQ ID NO: 169135 - DNA, 20 bp, Artificial Sequence
  Synthetic oligonucleotide; GAG chr2 60545658 60545677 60545674 +
aaagctcaatacttcaaaat

SEQ ID NO: 169136 - DNA, 20 bp, Artificial Sequence
  Synthetic oligonucleotide; AAG chr2 60545661 60545680 60545677 +
gctcaatacttcaaaatgag

SEQ ID NO: 169137 - DNA, 20 bp, Artificial Sequence
  Synthetic oligonucleotide; AGG chr2 60545662 60545681 60545678 +
ctcaatacttcaaaatgaga

SEQ ID NO: 169138 - DNA, 20 bp, Artificial Sequence
  Synthetic oligonucleotide; TGG chr2 60545665 60545684 60545681 +
aatacttcaaaatgagaagg

SEQ ID NO: 169139 - DNA, 20 bp, Artificial Sequence
  Synthetic oligonucleotide; GGG chr2 60545666 60545685 60545682 +
atacttcaaaatgagaaggt

SEQ ID NO: 169140 - DNA, 20 bp, Artificial Sequence
  Synthetic oligonucleotide; GGG chr2 60545667 60545686 60545683 +
tacttcaaaatgagaaggtg

SEQ ID NO: 169141 - DNA, 20 bp, Artificial Sequence
  Synthetic oligonucleotide; TGG chr2 60545671 60545690 60545687 +
tcaaaatgagaaggtgggga

SEQ ID NO: 169142 - DNA, 20 bp, Artificial Sequence
  Synthetic oligonucleotide; GGG chr2 60545672 60545691 60545688 +
caaaatgagaaggtggggat

SEQ ID NO: 169143 - DNA, 20 bp, Artificial Sequence
  Synthetic oligonucleotide; GGG chr2 60545673 60545692 60545689 +
aaaatgagaaggtggggatg

SEQ ID NO: 169144 - DNA, 20 bp, Artificial Sequence
  Synthetic oligonucleotide; AAG chr2 60545676 60545695 60545692 +
atgagaaggtggggatgggg

SEQ ID NO: 169145 - DNA, 20 bp, Artificial Sequence
  Synthetic oligonucleotide; AAG chr2 60545681 60545700 60545697 +
aaggtggggatggggaagaa

SEQ ID NO: 169146 - DNA, 20 bp, Artificial Sequence
  Synthetic oligonucleotide; CAG chr2 60545698 60545717 60545714 +
gaaaagaaatccaaaatcga

SEQ ID NO: 169147 - DNA, 20 bp, Artificial Sequence
  Synthetic oligonucleotide; CAG chr2 60545704 60545723 60545720 +
aaatccaaaatcgacagatc

SEQ ID NO: 169148 - DNA, 20 bp, Artificial Sequence
  Synthetic oligonucleotide; GAG chr2 60545706 60545725 60545722 +
atccaaaatcgacagatcca

SEQ ID NO: 169149 - DNA, 20 bp, Artificial Sequence
  Synthetic oligonucleotide; GAG chr2 60545708 60545727 60545724 +
ccaaaatcgacagatccaga

SEQ ID NO: 169150 - DNA, 20 bp, Artificial Sequence
  Synthetic oligonucleotide; AAG chr2 60545711 60545730 60545727 +
aaatcgacagatccagagag

SEQ ID NO: 169151 - DNA, 20 bp, Artificial Sequence
  Synthetic oligonucleotide; AGG chr2 60545712 60545731 60545728 +
aatcgacagatccagagaga

SEQ ID NO: 169152 - DNA, 20 bp, Artificial Sequence
  Synthetic oligonucleotide; CAG chr2 60545752 60545771 60545768 +
tatcctgcctacatctgatt

SEQ ID NO: 169153 - DNA, 20 bp, Artificial Sequence
  Synthetic oligonucleotide; GAG chr2 60545756 60545775 60545772 +
ctgcctacatctgattcagt

SEQ ID NO: 169154 - DNA, 20 bp, Artificial Sequence
  Synthetic oligonucleotide; AGG chr2 60545757 60545776 60545773 +
tgcctacatctgattcagtg

SEQ ID NO: 169155 - DNA, 20 bp, Artificial Sequence
  Synthetic oligonucleotide; TGG chr2 60545760 60545779 60545776 +
ctacatctgattcagtgagg

SEQ ID NO: 169156 - DNA, 20 bp, Artificial Sequence
  Synthetic oligonucleotide; TGG chr2 60545786 60545805 60545802 +
atatttatttttctgtgttc

SEQ ID NO: 169157 - DNA, 20 bp, Artificial Sequence
  Synthetic oligonucleotide; AAG chr2 60545793 60545812 60545809 +
tttttctgtgttctggacgt

SEQ ID NO: 169158 - DNA, 20 bp, Artificial Sequence
  Synthetic oligonucleotide; CAG chr2 60545799 60545818 60545815 +
tgtgttctggacgtaagcaa

SEQ ID NO: 169159 - DNA, 20 bp, Artificial Sequence
  Synthetic oligonucleotide; CAG chr2 60545822 60545841 60545838 +
aaatgattattttaacatta

SEQ ID NO: 169160 - DNA, 20 bp, Artificial Sequence
  Synthetic oligonucleotide; AGG chr2 60545823 60545842 60545839 +
aatgattattttaacattac

SEQ ID NO: 169161 - DNA, 20 bp, Artificial Sequence
  Synthetic oligonucleotide; GGG chr2 60545824 60545843 60545840 +
atgattattttaacattaca

SEQ ID NO: 169162 - DNA, 20 bp, Artificial Sequence
  Synthetic oligonucleotide; TGG chr2 60545833 60545852 60545849 +
ttaacattacagggctgtca

SEQ ID NO: 169163 - DNA, 20 bp, Artificial Sequence
  Synthetic oligonucleotide; CAG chr2 60545837 60545856 60545853 +
cattacagggctgtcatgga

SEQ ID NO: 169164 - DNA, 20 bp, Artificial Sequence
  Synthetic oligonucleotide; TAG chr2 60545845 60545864 60545861 +
ggctgtcatggacagtcaca

SEQ ID NO: 169165 - DNA, 20 bp, Artificial Sequence
  Synthetic oligonucleotide; GAG chr2 60545847 60545866 60545863 +
ctgtcatggacagtcacata

SEQ ID NO: 169166 - DNA, 20 bp, Artificial Sequence
  Synthetic oligonucleotide; TAG chr2 60545853 60545872 60545869 +
tggacagtcacatagagtaa

SEQ ID NO: 169167 - DNA, 20 bp, Artificial Sequence
  Synthetic oligonucleotide; GAG chr2 60545855 60545874 60545871 +
gacagtcacatagagtaata

SEQ ID NO: 169168 - DNA, 20 bp, Artificial Sequence
  Synthetic oligonucleotide; AAG chr2 60545859 60545878 60545875 +
gtcacatagagtaatagaga

SEQ ID NO: 169169 - DNA, 20 bp, Artificial Sequence
  Synthetic oligonucleotide; TGG chr2 60545884 60545903 60545900 +
cttcacaactccttactgct

SEQ ID NO: 169170 - DNA, 20 bp, Artificial Sequence
  Synthetic oligonucleotide; CAG chr2 60545890 60545909 60545906 +
aactccttactgcttggcta

SEQ ID NO: 169171 - DNA, 20 bp, Artificial Sequence
  Synthetic oligonucleotide; AAG chr2 60545909 60545928 60545925 +
acagcacctctgaaaatgaa

SEQ ID NO: 169172 - DNA, 20 bp, Artificial Sequence
  Synthetic oligonucleotide; CAG chr2 60545924 60545943 60545940 +
atgaaaagaaaacatgcaaa

SEQ ID NO: 169173 - DNA, 20 bp, Artificial Sequence
  Synthetic oligonucleotide; TGG chr2 60545969 60545988 60545985 +
acctgctatgtgttcctgtt

SEQ ID NO: 169174 - DNA, 20 bp, Artificial Sequence
  Synthetic oligonucleotide; GGG chr2 60545970 60545989 60545986 +
cctgctatgtgttcctgttt

SEQ ID NO: 169175 - DNA, 20 bp, Artificial Sequence
  Synthetic oligonucleotide; GGG chr2 60545971 60545990 60545987 +
ctgctatgtgttcctgtttg

SEQ ID NO: 169176 - DNA, 20 bp, Artificial Sequence
  Synthetic oligonucleotide; TAG chr2 60545984 60546003 60546000 +
ctgtttggggcaaattcctc

SEQ ID NO: 169177 - DNA, 20 bp, Artificial Sequence
  Synthetic oligonucleotide; TGG chr2 60546015 60546034 60546031 +
gataaacaatcgtcatcctc

SEQ ID NO: 169178 - DNA, 20 bp, Artificial Sequence
  Synthetic oligonucleotide; TGG chr2 60546025 60546044 60546041 +
cgtcatcctctggcgtgacc

SEQ ID NO: 169179 - DNA, 20 bp, Artificial Sequence
  Synthetic oligonucleotide; CGG chr2 60546041 60546060 60546057 +
gacctggatgccaacctcca

SEQ ID NO: 169180 - DNA, 20 bp, Artificial Sequence
  Synthetic oligonucleotide; GGG chr2 60546042 60546061 60546058 +
acctggatgccaacctccac

SEQ ID NO: 169181 - DNA, 20 bp, Artificial Sequence
  Synthetic oligonucleotide; TGG chr2 60546047 60546066 60546063 +
gatgccaacctccacgggat

SEQ ID NO: 169182 - DNA, 20 bp, Artificial Sequence
  Synthetic oligonucleotide; TGG chr2 60546069 60546088 60546085 +
gatgcttttttcatctcgat

SEQ ID NO: 169183 - DNA, 20 bp, Artificial Sequence
  Synthetic oligonucleotide; AAG chr2 60546074 60546093 60546090 +
ttttttcatctcgattggtg

SEQ ID NO: 169184 - DNA, 20 bp, Artificial Sequence
  Synthetic oligonucleotide; AGG chr2 60546075 60546094 60546091 +
tttttcatctcgattggtga

SEQ ID NO: 169185 - DNA, 20 bp, Artificial Sequence
  Synthetic oligonucleotide; GGG chr2 60546076 60546095 60546092 +
ttttcatctcgattggtgaa

SEQ ID NO: 169186 - DNA, 20 bp, Artificial Sequence
  Synthetic oligonucleotide; GGG chr2 60546077 60546096 60546093 +
tttcatctcgattggtgaag

SEQ ID NO: 169187 - DNA, 20 bp, Artificial Sequence
  Synthetic oligonucleotide; AAG chr2 60546080 60546099 60546096 +
catctcgattggtgaagggg

SEQ ID NO: 169188 - DNA, 20 bp, Artificial Sequence
  Synthetic oligonucleotide; AGG chr2 60546081 60546100 60546097 +
atctcgattggtgaagggga

SEQ ID NO: 169189 - DNA, 20 bp, Artificial Sequence
  Synthetic oligonucleotide; TGG chr2 60546084 60546103 60546100 +
tcgattggtgaaggggaagg

SEQ ID NO: 169190 - DNA, 20 bp, Artificial Sequence
  Synthetic oligonucleotide; CAG chr2 60546095 60546114 60546111 +
aggggaaggtggcttatcca

SEQ ID NO: 169191 - DNA, 20 bp, Artificial Sequence
  Synthetic oligonucleotide; AAG chr2 60546106 60546125 60546122 +
gcttatccacagctttttct

SEQ ID NO: 169192 - DNA, 20 bp, Artificial Sequence
  Synthetic oligonucleotide; CAG chr2 60546109 60546128 60546125 +
tatccacagctttttctaag

SEQ ID NO: 169193 - DNA, 20 bp, Artificial Sequence
  Synthetic oligonucleotide; GAG chr2 60546111 60546130 60546127 +
tccacagctttttctaagca

SEQ ID NO: 169194 - DNA, 20 bp, Artificial Sequence
  Synthetic oligonucleotide; AGG chr2 60546112 60546131 60546128 +
ccacagctttttctaagcag

SEQ ID NO: 169195 - DNA, 20 bp, Artificial Sequence
  Synthetic oligonucleotide; AAG chr2 60546153 60546172 60546169 +
cgtttgtgctcgataaaaat

SEQ ID NO: 169196 - DNA, 20 bp, Artificial Sequence
  Synthetic oligonucleotide; TGG chr2 60546168 60546187 60546184 +
aaaataagaatgtcccccaa

SEQ ID NO: 169197 - DNA, 20 bp, Artificial Sequence
  Synthetic oligonucleotide; GGG chr2 60546169 60546188 60546185 +
aaataagaatgtcccccaat

SEQ ID NO: 169198 - DNA, 20 bp, Artificial Sequence
  Synthetic oligonucleotide; AAG chr2 60546172 60546191 60546188 +
taagaatgtcccccaatggg

SEQ ID NO: 169199 - DNA, 20 bp, Artificial Sequence
  Synthetic oligonucleotide; TGG chr2 60546181 60546200 60546197 +
cccccaatgggaagttcatc

SEQ ID NO: 169200 - DNA, 20 bp, Artificial Sequence
  Synthetic oligonucleotide; CAG chr2 60546193 60546212 60546209 +
agttcatctggcactgccca

SEQ ID NO: 169201 - DNA, 20 bp, Artificial Sequence
  Synthetic oligonucleotide; AGG chr2 60546194 60546213 60546210 +
gttcatctggcactgcccac

SEQ ID NO: 169202 - DNA, 20 bp, Artificial Sequence
  Synthetic oligonucleotide; GAG chr2 60546198 60546217 60546214 +
atctggcactgcccacaggt

SEQ ID NO: 169203 - DNA, 20 bp, Artificial Sequence
  Synthetic oligonucleotide; AGG chr2 60546199 60546218 60546215 +
tctggcactgcccacaggtg

SEQ ID NO: 169204 - DNA, 20 bp, Artificial Sequence
  Synthetic oligonucleotide; GAG chr2 60546201 60546220 60546217 +
tggcactgcccacaggtgag

SEQ ID NO: 169205 - DNA, 20 bp, Artificial Sequence
  Synthetic oligonucleotide; AGG chr2 60546202 60546221 60546218 +
ggcactgcccacaggtgagg

SEQ ID NO: 169206 - DNA, 20 bp, Artificial Sequence
  Synthetic oligonucleotide; TGG chr2 60546219 60546238 60546235 +
aggaggtcatgatccccttc

SEQ ID NO: 169207 - DNA, 20 bp, Artificial Sequence
  Synthetic oligonucleotide; GAG chr2 60546221 60546240 60546237 +
gaggtcatgatccccttctg

SEQ ID NO: 169208 - DNA, 20 bp, Artificial Sequence
  Synthetic oligonucleotide; CGG chr2 60546231 60546250 60546247 +
tccccttctggagctcccaa

SEQ ID NO: 169209 - DNA, 20 bp, Artificial Sequence
  Synthetic oligonucleotide; GGG chr2 60546232 60546251 60546248 +
ccccttctggagctcccaac

SEQ ID NO: 169210 - DNA, 20 bp, Artificial Sequence
  Synthetic oligonucleotide; TGG chr2 60546238 60546257 60546254 +
ctggagctcccaacgggccg

SEQ ID NO: 169211 - DNA, 20 bp, Artificial Sequence
  Synthetic oligonucleotide; TGG chr2 60546243 60546262 60546259 +
gctcccaacgggccgtggtc

SEQ ID NO: 169212 - DNA, 20 bp, Artificial Sequence
  Synthetic oligonucleotide; AAG chr2 60546258 60546277 60546274 +
tggtctggttcatcatctgt

SEQ ID NO: 169213 - DNA, 20 bp, Artificial Sequence
  Synthetic oligonucleotide; TGG chr2 60546263 60546282 60546279 +
tggttcatcatctgtaagaa

SEQ ID NO: 169214 - DNA, 20 bp, Artificial Sequence
  Synthetic oligonucleotide; AAG chr2 60546270 60546289 60546286 +
tcatctgtaagaatggcttc

SEQ ID NO: 169215 - DNA, 20 bp, Artificial Sequence
  Synthetic oligonucleotide; GAG chr2 60546272 60546291 60546288 +
atctgtaagaatggcttcaa

SEQ ID NO: 169216 - DNA, 20 bp, Artificial Sequence
  Synthetic oligonucleotide; AGG chr2 60546273 60546292 60546289 +
tctgtaagaatggcttcaag

SEQ ID NO: 169217 - DNA, 20 bp, Artificial Sequence
  Synthetic oligonucleotide; CGG chr2 60546278 60546297 60546294 +
aagaatggcttcaagaggct

SEQ ID NO: 169218 - DNA, 20 bp, Artificial Sequence
  Synthetic oligonucleotide; TGG chr2 60546284 60546303 60546300 +
ggcttcaagaggctcggctg

SEQ ID NO: 169219 - DNA, 20 bp, Artificial Sequence
  Synthetic oligonucleotide; TGG chr2 60546288 60546307 60546304 +
tcaagaggctcggctgtggt

SEQ ID NO: 169220 - DNA, 20 bp, Artificial Sequence
  Synthetic oligonucleotide; GAG chr2 60546290 60546309 60546306 +
aagaggctcggctgtggttg

SEQ ID NO: 169221 - DNA, 20 bp, Artificial Sequence
  Synthetic oligonucleotide; AAG chr2 60546299 60546318 60546315 +
ggctgtggttggagaaacaa

SEQ ID NO: 169222 - DNA, 20 bp, Artificial Sequence
  Synthetic oligonucleotide; TAG chr2 60546311 60546330 60546327 +
agaaacaaaagcacaattat

SEQ ID NO: 169223 - DNA, 20 bp, Artificial Sequence
  Synthetic oligonucleotide; GAG chr2 60546313 60546332 60546329 +
aaacaaaagcacaattatta

SEQ ID NO: 169224 - DNA, 20 bp, Artificial Sequence
  Synthetic oligonucleotide; CAG chr2 60546319 60546338 60546335 +
aagcacaattattagagtgc

SEQ ID NO: 169225 - DNA, 20 bp, Artificial Sequence
  Synthetic oligonucleotide; GAG chr2 60546321 60546340 60546337 +
gcacaattattagagtgcca

SEQ ID NO: 169226 - DNA, 20 bp, Artificial Sequence
  Synthetic oligonucleotide; GAG chr2 60546323 60546342 60546339 +
acaattattagagtgccaga

SEQ ID NO: 169227 - DNA, 20 bp, Artificial Sequence
  Synthetic oligonucleotide; AGG chr2 60546324 60546343 60546340 +
caattattagagtgccagag

SEQ ID NO: 169228 - DNA, 20 bp, Artificial Sequence
  Synthetic oligonucleotide; CAG chr2 60546328 60546347 60546344 +
tattagagtgccagagagga

SEQ ID NO: 169229 - DNA, 20 bp, Artificial Sequence
  Synthetic oligonucleotide; AAG chr2 60546332 60546351 60546348 +
agagtgccagagaggacaga

SEQ ID NO: 169230 - DNA, 20 bp, Artificial Sequence
  Synthetic oligonucleotide; AGG chr2 60546333 60546352 60546349 +
gagtgccagagaggacagaa

SEQ ID NO: 169231 - DNA, 20 bp, Artificial Sequence
  Synthetic oligonucleotide; GGG chr2 60546334 60546353 60546350 +
agtgccagagaggacagaaa

SEQ ID NO: 169232 - DNA, 20 bp, Artificial Sequence
  Synthetic oligonucleotide; GGG chr2 60546335 60546354 60546351 +
gtgccagagaggacagaaag

SEQ ID NO: 169233 - DNA, 20 bp, Artificial Sequence
  Synthetic oligonucleotide; GAG chr2 60546337 60546356 60546353 +
gccagagaggacagaaaggg

SEQ ID NO: 169234 - DNA, 20 bp, Artificial Sequence
  Synthetic oligonucleotide; AAG chr2 60546340 60546359 60546356 +
agagaggacagaaaggggag

SEQ ID NO: 169235 - DNA, 20 bp, Artificial Sequence
  Synthetic oligonucleotide; AAG chr2 60546380 60546399 60546396 +
ccatcccaccacatcatgta

SEQ ID NO: 169236 - DNA, 20 bp, Artificial Sequence
  Synthetic oligonucleotide; TAG chr2 60546389 60546408 60546405 +
cacatcatgtaaagtgtttc

SEQ ID NO: 169237 - DNA, 20 bp, Artificial Sequence
  Synthetic oligonucleotide; AGG chr2 60546390 60546409 60546406 +
acatcatgtaaagtgtttct

SEQ ID NO: 169238 - DNA, 20 bp, Artificial Sequence
  Synthetic oligonucleotide; CAG chr2 60546410 60546429 60546426 +
aggcttctctatataatacc

SEQ ID NO: 169239 - DNA, 20 bp, Artificial Sequence
  Synthetic oligonucleotide; GAG chr2 60546420 60546439 60546436 +
atataatacccagaaaatgt

SEQ ID NO: 169240 - DNA, 20 bp, Artificial Sequence
  Synthetic oligonucleotide; AAG chr2 60546431 60546450 60546447 +
agaaaatgtgagcatacaaa

SEQ ID NO: 169241 - DNA, 20 bp, Artificial Sequence
  Synthetic oligonucleotide; AAG chr2 60546437 60546456 60546453 +
tgtgagcatacaaaaagtac

SEQ ID NO: 169242 - DNA, 20 bp, Artificial Sequence
  Synthetic oligonucleotide; AGG chr2 60546438 60546457 60546454 +
gtgagcatacaaaaagtaca

SEQ ID NO: 169243 - DNA, 20 bp, Artificial Sequence
  Synthetic oligonucleotide; AAG chr2 60546446 60546465 60546462 +
acaaaaagtacaaggatgtg

SEQ ID NO: 169244 - DNA, 20 bp, Artificial Sequence
  Synthetic oligonucleotide; AGG chr2 60546447 60546466 60546463 +
caaaaagtacaaggatgtga

SEQ ID NO: 169245 - DNA, 20 bp, Artificial Sequence
  Synthetic oligonucleotide; CAG chr2 60546458 60546477 60546474 +
aggatgtgaaggttatcaac

SEQ ID NO: 169246 - DNA, 20 bp, Artificial Sequence
  Synthetic oligonucleotide; GAG chr2 60546460 60546479 60546476 +
gatgtgaaggttatcaacca

SEQ ID NO: 169247 - DNA, 20 bp, Artificial Sequence
  Synthetic oligonucleotide; GAG chr2 60546462 60546481 60546478 +
tgtgaaggttatcaaccaga

SEQ ID NO: 169248 - DNA, 20 bp, Artificial Sequence
  Synthetic oligonucleotide; GAG chr2 60546478 60546497 60546494 +
cagagagcaaatttgtcaat

SEQ ID NO: 169249 - DNA, 20 bp, Artificial Sequence
  Synthetic oligonucleotide; AGG chr2 60546479 60546498 60546495 +
agagagcaaatttgtcaatg

SEQ ID NO: 169250 - DNA, 20 bp, Artificial Sequence
  Synthetic oligonucleotide; AAG chr2 60546500 60546519 60546516 +
ggcaaatcatcacatatgta

SEQ ID NO: 169251 - DNA, 20 bp, Artificial Sequence
  Synthetic oligonucleotide; CAG chr2 60546507 60546526 60546523 +
catcacatatgtaaagaaaa

SEQ ID NO: 169252 - DNA, 20 bp, Artificial Sequence
  Synthetic oligonucleotide; CAG chr2 60546527 60546546 60546543 +
cagtcttccttgcataactc

SEQ ID NO: 169253 - DNA, 20 bp, Artificial Sequence
  Synthetic oligonucleotide; GAG chr2 60546529 60546548 60546545 +
gtcttccttgcataactcca

SEQ ID NO: 169254 - DNA, 20 bp, Artificial Sequence
  Synthetic oligonucleotide; CAG chr2 60546568 60546587 60546584 +
tatacccatgcacacaccca

SEQ ID NO: 169255 - DNA, 20 bp, Artificial Sequence
  Synthetic oligonucleotide; TGG chr2 60546584 60546603 60546600 +
cccacagcaacaaatgtgtc

SEQ ID NO: 169256 - DNA, 20 bp, Artificial Sequence
  Synthetic oligonucleotide; AAG chr2 60546592 60546611 60546608 +
aacaaatgtgtctggtttgt

SEQ ID NO: 169257 - DNA, 20 bp, Artificial Sequence
  Synthetic oligonucleotide; TAG chr2 60546597 60546616 60546613 +
atgtgtctggtttgtaagtt

SEQ ID NO: 169258 - DNA, 20 bp, Artificial Sequence
  Synthetic oligonucleotide; AAG chr2 60546601 60546620 60546617 +
gtctggtttgtaagtttaga

SEQ ID NO: 169259 - DNA, 20 bp, Artificial Sequence
  Synthetic oligonucleotide; TAG chr2 60546617 60546636 60546633 +
tagaaagaatgctacttaaa

SEQ ID NO: 169260 - DNA, 20 bp, Artificial Sequence
  Synthetic oligonucleotide; CAG chr2 60546626 60546645 60546642 +
tgctacttaaatagttaaca

SEQ ID NO: 169261 - DNA, 20 bp, Artificial Sequence
  Synthetic oligonucleotide; AGG chr2 60546627 60546646 60546643 +
gctacttaaatagttaacac

SEQ ID NO: 169262 - DNA, 20 bp, Artificial Sequence
  Synthetic oligonucleotide; GGG chr2 60546628 60546647 60546644 +
ctacttaaatagttaacaca

SEQ ID NO: 169263 - DNA, 20 bp, Artificial Sequence
  Synthetic oligonucleotide; AAG chr2 60546637 60546656 60546653 +
tagttaacacagggaacata

SEQ ID NO: 169264 - DNA, 20 bp, Artificial Sequence
  Synthetic oligonucleotide; AAG chr2 60546641 60546660 60546657 +
taacacagggaacataaaga

SEQ ID NO: 169265 - DNA, 20 bp, Artificial Sequence
  Synthetic oligonucleotide; AAG chr2 60546660 60546679 60546676 +
aaagcttaaataataactac

SEQ ID NO: 169266 - DNA, 20 bp, Artificial Sequence
  Synthetic oligonucleotide; TGG chr2 60546669 60546688 60546685 +
ataataactacaagaaaaac

SEQ ID NO: 169267 - DNA, 20 bp, Artificial Sequence
  Synthetic oligonucleotide; AAG chr2 60546682 60546701 60546698 +
gaaaaactggttaaaaaaaa

SEQ ID NO: 169268 - DNA, 20 bp, Artificial Sequence
  Synthetic oligonucleotide; TGG chr2 60546685 60546704 60546701 +
aaactggttaaaaaaaaaag

SEQ ID NO: 169269 - DNA, 20 bp, Artificial Sequence
  Synthetic oligonucleotide; TAG chr2 60546689 60546708 60546705 +
tggttaaaaaaaaaagtgga

SEQ ID NO: 169270 - DNA, 20 bp, Artificial Sequence
  Synthetic oligonucleotide; AAG chr2 60546724 60546743 60546740 +
tttcttttttcctatacacc

SEQ ID NO: 169271 - DNA, 20 bp, Artificial Sequence
  Synthetic oligonucleotide; AAG chr2 60546742 60546761 60546758 +
ccaagttgtccattgtgcca

SEQ ID NO: 169272 - DNA, 20 bp, Artificial Sequence
  Synthetic oligonucleotide; AAG chr2 60546750 60546769 60546766 +
tccattgtgccaaagaatga

SEQ ID NO: 169273 - DNA, 20 bp, Artificial Sequence
  Synthetic oligonucleotide; AGG chr2 60546751 60546770 60546767 +
ccattgtgccaaagaatgaa

SEQ ID NO: 169274 - DNA, 20 bp, Artificial Sequence
  Synthetic oligonucleotide; GAG chr2 60546753 60546772 60546769 +
attgtgccaaagaatgaaag

SEQ ID NO: 169275 - DNA, 20 bp, Artificial Sequence
  Synthetic oligonucleotide; GAG chr2 60546755 60546774 60546771 +
tgtgccaaagaatgaaagga

SEQ ID NO: 169276 - DNA, 20 bp, Artificial Sequence
  Synthetic oligonucleotide; AGG chr2 60546756 60546775 60546772 +
gtgccaaagaatgaaaggag

SEQ ID NO: 169277 - DNA, 20 bp, Artificial Sequence
  Synthetic oligonucleotide; AAG chr2 60546803 60546822 60546819 +
gtgtgaatgtatatactcct

SEQ ID NO: 169278 - DNA, 20 bp, Artificial Sequence
  Synthetic oligonucleotide; CAG chr2 60546810 60546829 60546826 +
tgtatatactcctaagtaaa

SEQ ID NO: 169279 - DNA, 20 bp, Artificial Sequence
  Synthetic oligonucleotide; TGG chr2 60546816 60546835 60546832 +
tactcctaagtaaacagaca

SEQ ID NO: 169280 - DNA, 20 bp, Artificial Sequence
  Synthetic oligonucleotide; TAG chr2 60546829 60546848 60546845 +
acagacatggcttcataaat

SEQ ID NO: 169281 - DNA, 20 bp, Artificial Sequence
  Synthetic oligonucleotide; AAG chr2 60546833 60546852 60546849 +
acatggcttcataaattaga

SEQ ID NO: 169282 - DNA, 20 bp, Artificial Sequence
  Synthetic oligonucleotide; AAG chr2 60546881 60546900 60546897 +
cacatttacactgctgtaat

SEQ ID NO: 169283 - DNA, 20 bp, Artificial Sequence
  Synthetic oligonucleotide; CGG chr2 60546909 60546928 60546925 +
gactgcatgcacctatgaaa

SEQ ID NO: 169284 - DNA, 20 bp, Artificial Sequence
  Synthetic oligonucleotide; CAG chr2 60546933 60546952 60546949 +
tctaaataataatcatgtcg

SEQ ID NO: 169285 - DNA, 20 bp, Artificial Sequence
  Synthetic oligonucleotide; CAG chr2 60546975 60546994 60546991 +
aacctttctgctctcactct

SEQ ID NO: 169286 - DNA, 20 bp, Artificial Sequence
  Synthetic oligonucleotide; CAG chr2 60546978 60546997 60546994 +
ctttctgctctcactctcag

SEQ ID NO: 169287 - DNA, 20 bp, Artificial Sequence
  Synthetic oligonucleotide; AAG chr2 60546994 60547013 60547010 +
tcagcagtgccacaaaatca

SEQ ID NO: 169288 - DNA, 20 bp, Artificial Sequence
  Synthetic oligonucleotide; CGG chr2 60547011 60547030 60547027 +
tcaaagaaataccaaatgca

SEQ ID NO: 169289 - DNA, 20 bp, Artificial Sequence
  Synthetic oligonucleotide; GGG chr2 60547012 60547031 60547028 +
caaagaaataccaaatgcac

SEQ ID NO: 169290 - DNA, 20 bp, Artificial Sequence
  Synthetic oligonucleotide; CAG chr2 60547015 60547034 60547031 +
agaaataccaaatgcacggg

SEQ ID NO: 169291 - DNA, 20 bp, Artificial Sequence
  Synthetic oligonucleotide; CAG chr2 60547025 60547044 60547041 +
aatgcacgggcagtatttct

SEQ ID NO: 169292 - DNA, 20 bp, Artificial Sequence
  Synthetic oligonucleotide; TAG chr2 60547034 60547053 60547050 +
gcagtatttctcagacacat

SEQ ID NO: 169293 - DNA, 20 bp, Artificial Sequence
  Synthetic oligonucleotide; TGG chr2 60547042 60547061 60547058 +
tctcagacacattagctaaa

SEQ ID NO: 169294 - DNA, 20 bp, Artificial Sequence
  Synthetic oligonucleotide; GGG chr2 60547043 60547062 60547059 +
ctcagacacattagctaaat

SEQ ID NO: 169295 - DNA, 20 bp, Artificial Sequence
  Synthetic oligonucleotide; GAG chr2 60547054 60547073 60547070 +
tagctaaatgggatactttt

SEQ ID NO: 169296 - DNA, 20 bp, Artificial Sequence
  Synthetic oligonucleotide; AAG chr2 60547062 60547081 60547078 +
tgggatacttttgagtactt

SEQ ID NO: 169297 - DNA, 20 bp, Artificial Sequence
  Synthetic oligonucleotide; AAG chr2 60547070 60547089 60547086 +
ttttgagtacttaagaaaat

SEQ ID NO: 169298 - DNA, 20 bp, Artificial Sequence
  Synthetic oligonucleotide; TAG chr2 60547078 60547097 60547094 +
acttaagaaaataagccaat

SEQ ID NO: 169299 - DNA, 20 bp, Artificial Sequence
  Synthetic oligonucleotide; GAG chr2 60547099 60547118 60547115 +
agtcattttttttttattct

SEQ ID NO: 169300 - DNA, 20 bp, Artificial Sequence
  Synthetic oligonucleotide; TGG chr2 60547105 60547124 60547121 +
tttttttttattctgagaaa

SEQ ID NO: 169301 - DNA, 20 bp, Artificial Sequence
  Synthetic oligonucleotide; TGG chr2 60547140 60547159 60547156 +
attctaaacatgtttgcact

SEQ ID NO: 169302 - DNA, 20 bp, Artificial Sequence
  Synthetic oligonucleotide; TGG chr2 60547143 60547162 60547159 +
ctaaacatgtttgcacttgg

SEQ ID NO: 169303 - DNA, 20 bp, Artificial Sequence
  Synthetic oligonucleotide; CAG chr2 60547164 60547183 60547180 +
ggcatctatgatataaaaat

SEQ ID NO: 169304 - DNA, 20 bp, Artificial Sequence
  Synthetic oligonucleotide; TGG chr2 60547169 60547188 60547185 +
ctatgatataaaaatcagaa

SEQ ID NO: 169305 - DNA, 20 bp, Artificial Sequence
  Synthetic oligonucleotide; AAG chr2 60547174 60547193 60547190 +
atataaaaatcagaatggtc

SEQ ID NO: 169306 - DNA, 20 bp, Artificial Sequence
  Synthetic oligonucleotide; CAG chr2 60547191 60547210 60547207 +
gtcaagcaaacaccacattt

SEQ ID NO: 169307 - DNA, 20 bp, Artificial Sequence
  Synthetic oligonucleotide; GAG chr2 60547193 60547212 60547209 +
caagcaaacaccacatttca

SEQ ID NO: 169308 - DNA, 20 bp, Artificial Sequence
  Synthetic oligonucleotide; AAG chr2 60547197 60547216 60547213 +
caaacaccacatttcagagc

SEQ ID NO: 169309 - DNA, 20 bp, Artificial Sequence
  Synthetic oligonucleotide; AGG chr2 60547198 60547217 60547214 +
aaacaccacatttcagagca

SEQ ID NO: 169310 - DNA, 20 bp, Artificial Sequence
  Synthetic oligonucleotide; GAG chr2 60547203 60547222 60547219 +
ccacatttcagagcaaggct

SEQ ID NO: 169311 - DNA, 20 bp, Artificial Sequence
  Synthetic oligonucleotide; AAG chr2 60547206 60547225 60547222 +
catttcagagcaaggctgag

SEQ ID NO: 169312 - DNA, 20 bp, Artificial Sequence
  Synthetic oligonucleotide; TAG chr2 60547218 60547237 60547234 +
aggctgagaagtcctttctt

SEQ ID NO: 169313 - DNA, 20 bp, Artificial Sequence
  Synthetic oligonucleotide; AAG chr2 60547249 60547268 60547265 +
tacttcgcctaatgttgtca

SEQ ID NO: 169314 - DNA, 20 bp, Artificial Sequence
  Synthetic oligonucleotide; TGG chr2 60547252 60547271 60547268 +
ttcgcctaatgttgtcaaag

SEQ ID NO: 169315 - DNA, 20 bp, Artificial Sequence
  Synthetic oligonucleotide; GAG chr2 60547270 60547289 60547286 +
agtggactaattttctgaat

SEQ ID NO: 169316 - DNA, 20 bp, Artificial Sequence
  Synthetic oligonucleotide; GAG chr2 60547292 60547311 60547308 +
gctccaaaatgcttcattat

SEQ ID NO: 169317 - DNA, 20 bp, Artificial Sequence
  Synthetic oligonucleotide; CAG chr2 60547318 60547337 60547334 +
atttctgcacacataatcac

SEQ ID NO: 169318 - DNA, 20 bp, Artificial Sequence
  Synthetic oligonucleotide; CGG chr2 60547321 60547340 60547337 +
tctgcacacataatcaccag

SEQ ID NO: 169319 - DNA, 20 bp, Artificial Sequence
  Synthetic oligonucleotide; TGG chr2 60547325 60547344 60547341 +
cacacataatcaccagcgga

SEQ ID NO: 169320 - DNA, 20 bp, Artificial Sequence
  Synthetic oligonucleotide; AAG chr2 60547334 60547353 60547350 +
tcaccagcggatggtataac

SEQ ID NO: 169321 - DNA, 20 bp, Artificial Sequence
  Synthetic oligonucleotide; AGG chr2 60547335 60547354 60547351 +
caccagcggatggtataaca

SEQ ID NO: 169322 - DNA, 20 bp, Artificial Sequence
  Synthetic oligonucleotide; TAG chr2 60547338 60547357 60547354 +
cagcggatggtataacaagg

SEQ ID NO: 169323 - DNA, 20 bp, Artificial Sequence
  Synthetic oligonucleotide; CAG chr2 60547394 60547413 60547410 +
aactttgtactaaaatactc

SEQ ID NO: 169324 - DNA, 20 bp, Artificial Sequence
  Synthetic oligonucleotide; CAG chr2 60547409 60547428 60547425 +
tactccagcatctactttac

SEQ ID NO: 169325 - DNA, 20 bp, Artificial Sequence
  Synthetic oligonucleotide; AAG chr2 60547427 60547446 60547443 +
accagcttctatcatttttt

SEQ ID NO: 169326 - DNA, 20 bp, Artificial Sequence
  Synthetic oligonucleotide; AAG chr2 60547436 60547455 60547452 +
tatcattttttaagcttcca

SEQ ID NO: 169327 - DNA, 20 bp, Artificial Sequence
  Synthetic oligonucleotide; AGG chr2 60547437 60547456 60547453 +
atcattttttaagcttccaa

SEQ ID NO: 169328 - DNA, 20 bp, Artificial Sequence
  Synthetic oligonucleotide; GGG chr2 60547438 60547457 60547454 +
tcattttttaagcttccaaa

SEQ ID NO: 169329 - DNA, 20 bp, Artificial Sequence
  Synthetic oligonucleotide; GGG chr2 60547439 60547458 60547455 +
cattttttaagcttccaaag

SEQ ID NO: 169330 - DNA, 20 bp, Artificial Sequence
  Synthetic oligonucleotide; AAG chr2 60547444 60547463 60547460 +
tttaagcttccaaaggggaa

SEQ ID NO: 169331 - DNA, 20 bp, Artificial Sequence
  Synthetic oligonucleotide; GAG chr2 60547446 60547465 60547462 +
taagcttccaaaggggaaaa

SEQ ID NO: 169332 - DNA, 20 bp, Artificial Sequence
  Synthetic oligonucleotide; GAG chr2 60547448 60547467 60547464 +
agcttccaaaggggaaaaga

SEQ ID NO: 169333 - DNA, 20 bp, Artificial Sequence
  Synthetic oligonucleotide; TGG chr2 60547452 60547471 60547468 +
tccaaaggggaaaagagagt

SEQ ID NO: 169334 - DNA, 20 bp, Artificial Sequence
  Synthetic oligonucleotide; AAG chr2 60547456 60547475 60547472 +
aaggggaaaagagagttggt

SEQ ID NO: 169335 - DNA, 20 bp, Artificial Sequence
  Synthetic oligonucleotide; CAG chr2 60547527 60547546 60547543 +
atcacaaaatacaaaacatc

SEQ ID NO: 169336 - DNA, 20 bp, Artificial Sequence
  Synthetic oligonucleotide; AGG chr2 60547528 60547547 60547544 +
tcacaaaatacaaaacatcc

SEQ ID NO: 169337 - DNA, 20 bp, Artificial Sequence
  Synthetic oligonucleotide; CAG chr2 60547538 60547557 60547554 +
caaaacatccaggatgctgc

SEQ ID NO: 169338 - DNA, 20 bp, Artificial Sequence
  Synthetic oligonucleotide; AAG chr2 60547553 60547572 60547569 +
gctgccagttaataaaactg

SEQ ID NO: 169339 - DNA, 20 bp, Artificial Sequence
  Synthetic oligonucleotide; CAG chr2 60547556 60547575 60547572 +
gccagttaataaaactgaag

SEQ ID NO: 169340 - DNA, 20 bp, Artificial Sequence
  Synthetic oligonucleotide; AAG chr2 60547568 60547587 60547584 +
aactgaagcagaaaatgtac

SEQ ID NO: 169341 - DNA, 20 bp, Artificial Sequence
  Synthetic oligonucleotide; CAG chr2 60547578 60547597 60547594 +
gaaaatgtacaagtcttaaa

SEQ ID NO: 169342 - DNA, 20 bp, Artificial Sequence
  Synthetic oligonucleotide; CAG chr2 60547586 60547605 60547602 +
acaagtcttaaacagttaat

SEQ ID NO: 169343 - DNA, 20 bp, Artificial Sequence
  Synthetic oligonucleotide; TAG chr2 60547601 60547620 60547617 +
ttaatcagtctgaccttctt

SEQ ID NO: 169344 - DNA, 20 bp, Artificial Sequence
  Synthetic oligonucleotide; AAG chr2 60547605 60547624 60547621 +
tcagtctgaccttctttagc

SEQ ID NO: 169345 - DNA, 20 bp, Artificial Sequence
  Synthetic oligonucleotide; AAG chr2 60547635 60547654 60547651 +
ttttacatttaatgaactta

SEQ ID NO: 169346 - DNA, 20 bp, Artificial Sequence
  Synthetic oligonucleotide; CAG chr2 60547641 60547660 60547657 +
atttaatgaacttaaagcca

SEQ ID NO: 169347 - DNA, 20 bp, Artificial Sequence
  Synthetic oligonucleotide; GAG chr2 60547643 60547662 60547659 +
ttaatgaacttaaagccaca

SEQ ID NO: 169348 - DNA, 20 bp, Artificial Sequence
  Synthetic oligonucleotide; TAG chr2 60547656 60547675 60547672 +
agccacagagaatcaaaaaa

SEQ ID NO: 169349 - DNA, 20 bp, Artificial Sequence
  Synthetic oligonucleotide; GAG chr2 60547669 60547688 60547685 +
caaaaaatagattttaattt

SEQ ID NO: 169350 - DNA, 20 bp, Artificial Sequence
  Synthetic oligonucleotide; TAG chr2 60547674 60547693 60547690 +
aatagattttaatttgagtg

SEQ ID NO: 169351 - DNA, 20 bp, Artificial Sequence
  Synthetic oligonucleotide; TGG chr2 60547682 60547701 60547698 +
ttaatttgagtgtagaatat

SEQ ID NO: 169352 - DNA, 20 bp, Artificial Sequence
  Synthetic oligonucleotide; CAG chr2 60547687 60547706 60547703 +
ttgagtgtagaatattggaa

SEQ ID NO: 169353 - DNA, 20 bp, Artificial Sequence
  Synthetic oligonucleotide; AAG chr2 60547699 60547718 60547715 +
tattggaacagattttgata

SEQ ID NO: 169354 - DNA, 20 bp, Artificial Sequence
  Synthetic oligonucleotide; CAG chr2 60547712 60547731 60547728 +
tttgataaagtgcaaaaatc

SEQ ID NO: 169355 - DNA, 20 bp, Artificial Sequence
  Synthetic oligonucleotide; CAG chr2 60547721 60547740 60547737 +
gtgcaaaaatccagtgaact

SEQ ID NO: 169356 - DNA, 20 bp, Artificial Sequence
  Synthetic oligonucleotide; AGG chr2 60547722 60547741 60547738 +
tgcaaaaatccagtgaactc

SEQ ID NO: 169357 - DNA, 20 bp, Artificial Sequence
  Synthetic oligonucleotide; CAG chr2 60547747 60547766 60547763 +
aaatttatttcaaccctacc

SEQ ID NO: 169358 - DNA, 20 bp, Artificial Sequence
  Synthetic oligonucleotide; AGG chr2 60547748 60547767 60547764 +
aatttatttcaaccctaccc

SEQ ID NO: 169359 - DNA, 20 bp, Artificial Sequence
  Synthetic oligonucleotide; GAG chr2 60547760 60547779 60547776 +
ccctacccaggctgaatatt

SEQ ID NO: 169360 - DNA, 20 bp, Artificial Sequence
  Synthetic oligonucleotide; AGG chr2 60547761 60547780 60547777 +
cctacccaggctgaatattg

SEQ ID NO: 169361 - DNA, 20 bp, Artificial Sequence
  Synthetic oligonucleotide; GGG chr2 60547762 60547781 60547778 +
ctacccaggctgaatattga

SEQ ID NO: 169362 - DNA, 20 bp, Artificial Sequence
  Synthetic oligonucleotide; GGG chr2 60547763 60547782 60547779 +
tacccaggctgaatattgag

SEQ ID NO: 169363 - DNA, 20 bp, Artificial Sequence
  Synthetic oligonucleotide; GGG chr2 60547764 60547783 60547780 +
acccaggctgaatattgagg

SEQ ID NO: 169364 - DNA, 20 bp, Artificial Sequence
  Synthetic oligonucleotide; AAG chr2 60547767 60547786 60547783 +
caggctgaatattgaggggg

SEQ ID NO: 169365 - DNA, 20 bp, Artificial Sequence
  Synthetic oligonucleotide; TGG chr2 60547773 60547792 60547789 +
gaatattgagggggaagatc

SEQ ID NO: 169366 - DNA, 20 bp, Artificial Sequence
  Synthetic oligonucleotide; GAG chr2 60547775 60547794 60547791 +
atattgagggggaagatctg

SEQ ID NO: 169367 - DNA, 20 bp, Artificial Sequence
  Synthetic oligonucleotide; CAG chr2 60547785 60547804 60547801 +
ggaagatctggagtaactcc

SEQ ID NO: 169368 - DNA, 20 bp, Artificial Sequence
  Synthetic oligonucleotide; TAG chr2 60547794 60547813 60547810 +
ggagtaactcccagatgtgc

SEQ ID NO: 169369 - DNA, 20 bp, Artificial Sequence
  Synthetic oligonucleotide; AGG chr2 60547795 60547814 60547811 +
gagtaactcccagatgtgct

SEQ ID NO: 169370 - DNA, 20 bp, Artificial Sequence
  Synthetic oligonucleotide; GAG chr2 60547810 60547829 60547826 +
gtgctaggtgaaataatatt

SEQ ID NO: 169371 - DNA, 20 bp, Artificial Sequence
  Synthetic oligonucleotide; GAG chr2 60547812 60547831 60547828 +
gctaggtgaaataatattga

SEQ ID NO: 169372 - DNA, 20 bp, Artificial Sequence
  Synthetic oligonucleotide; GAG chr2 60547814 60547833 60547830 +
taggtgaaataatattgaga

SEQ ID NO: 169373 - DNA, 20 bp, Artificial Sequence
  Synthetic oligonucleotide; TAG chr2 60547824 60547843 60547840 +
aatattgagagagccctgcc

SEQ ID NO: 169374 - DNA, 20 bp, Artificial Sequence
  Synthetic oligonucleotide; AAG chr2 60547841 60547860 60547857 +
gcctagctgcacctgtgctc

SEQ ID NO: 169375 - DNA, 20 bp, Artificial Sequence
  Synthetic oligonucleotide; TAG chr2 60547844 60547863 60547860 +
tagctgcacctgtgctcaag

SEQ ID NO: 169376 - DNA, 20 bp, Artificial Sequence
  Synthetic oligonucleotide; AGG chr2 60547845 60547864 60547861 +
agctgcacctgtgctcaagt

SEQ ID NO: 169377 - DNA, 20 bp, Artificial Sequence
  Synthetic oligonucleotide; TAG chr2 60547863 60547882 60547879 +
gtaggacatctcataatttc

SEQ ID NO: 169378 - DNA, 20 bp, Artificial Sequence
  Synthetic oligonucleotide; TGG chr2 60547870 60547889 60547886 +
atctcataatttctagcctc

SEQ ID NO: 169379 - DNA, 20 bp, Artificial Sequence
  Synthetic oligonucleotide; AAG chr2 60547893 60547912 60547909 +
tactcctcctaatttaacat

SEQ ID NO: 169380 - DNA, 20 bp, Artificial Sequence
  Synthetic oligonucleotide; AGG chr2 60547894 60547913 60547910 +
actcctcctaatttaacata

SEQ ID NO: 169381 - DNA, 20 bp, Artificial Sequence
  Synthetic oligonucleotide; CAG chr2 60547903 60547922 60547919 +
aatttaacataaggtcacca

SEQ ID NO: 169382 - DNA, 20 bp, Artificial Sequence
  Synthetic oligonucleotide; AGG chr2 60547904 60547923 60547920 +
atttaacataaggtcaccac

SEQ ID NO: 169383 - DNA, 20 bp, Artificial Sequence
  Synthetic oligonucleotide; AAG chr2 60547913 60547932 60547929 +
aaggtcaccacaggaatatg

SEQ ID NO: 169384 - DNA, 20 bp, Artificial Sequence
  Synthetic oligonucleotide; AGG chr2 60547914 60547933 60547930 +
aggtcaccacaggaatatga

SEQ ID NO: 169385 - DNA, 20 bp, Artificial Sequence
  Synthetic oligonucleotide; AAG chr2 60547934 60547953 60547950 +
aggttatattcctactaata

SEQ ID NO: 169386 - DNA, 20 bp, Artificial Sequence
  Synthetic oligonucleotide; CAG chr2 60547938 60547957 60547954 +
tatattcctactaataaaga

SEQ ID NO: 169387 - DNA, 20 bp, Artificial Sequence
  Synthetic oligonucleotide; AAG chr2 60547943 60547962 60547959 +
tcctactaataaagacagta

SEQ ID NO: 169388 - DNA, 20 bp, Artificial Sequence
  Synthetic oligonucleotide; AAG chr2 60547947 60547966 60547963 +
actaataaagacagtaaagt

SEQ ID NO: 169389 - DNA, 20 bp, Artificial Sequence
  Synthetic oligonucleotide; TGG chr2 60547976 60547995 60547992 +
tgtttctttgcccaacatac

SEQ ID NO: 169390 - DNA, 20 bp, Artificial Sequence
  Synthetic oligonucleotide; AAG chr2 60547983 60548002 60547999 +
ttgcccaacatactggccaa

SEQ ID NO: 169391 - DNA, 20 bp, Artificial Sequence
  Synthetic oligonucleotide; CAG chr2 60547993 60548012 60548009 +
tactggccaaaagataaata

SEQ ID NO: 169392 - DNA, 20 bp, Artificial Sequence
  Synthetic oligonucleotide; AAG chr2 60548022 60548041 60548038 +
tatgcatacttttcaaataa

SEQ ID NO: 169393 - DNA, 20 bp, Artificial Sequence
  Synthetic oligonucleotide; AAG chr2 60548025 60548044 60548041 +
gcatacttttcaaataaaag

SEQ ID NO: 169394 - DNA, 20 bp, Artificial Sequence
  Synthetic oligonucleotide; CAG chr2 60548033 60548052 60548049 +
ttcaaataaaagaagacaaa

SEQ ID NO: 169395 - DNA, 20 bp, Artificial Sequence
  Synthetic oligonucleotide; AAG chr2 60548036 60548055 60548052 +
aaataaaagaagacaaacag

SEQ ID NO: 169396 - DNA, 20 bp, Artificial Sequence
  Synthetic oligonucleotide; AAG chr2 60548096 60548115 60548112 +
catttgcttccattttgacc

SEQ ID NO: 169397 - DNA, 20 bp, Artificial Sequence
  Synthetic oligonucleotide; GAG chr2 60548100 60548119 60548116 +
tgcttccattttgaccaagt

SEQ ID NO: 169398 - DNA, 20 bp, Artificial Sequence
  Synthetic oligonucleotide; AGG chr2 60548101 60548120 60548117 +
gcttccattttgaccaagtg

SEQ ID NO: 169399 - DNA, 20 bp, Artificial Sequence
  Synthetic oligonucleotide; TAG chr2 60548106 60548125 60548122 +
cattttgaccaagtgaggaa

SEQ ID NO: 169400 - DNA, 20 bp, Artificial Sequence
  Synthetic oligonucleotide; AGG chr2 60548107 60548126 60548123 +
attttgaccaagtgaggaat

SEQ ID NO: 169401 - DNA, 20 bp, Artificial Sequence
  Synthetic oligonucleotide; GGG chr2 60548108 60548127 60548124 +
ttttgaccaagtgaggaata

SEQ ID NO: 169402 - DNA, 20 bp, Artificial Sequence
  Synthetic oligonucleotide; AAG chr2 60548145 60548164 60548161 +
atattcctgttgtctgaatt

SEQ ID NO: 169403 - DNA, 20 bp, Artificial Sequence
  Synthetic oligonucleotide; AGG chr2 60548146 60548165 60548162 +
tattcctgttgtctgaatta

SEQ ID NO: 169404 - DNA, 20 bp, Artificial Sequence
  Synthetic oligonucleotide; AAG chr2 60548154 60548173 60548170 +
ttgtctgaattaaggatttt

SEQ ID NO: 169405 - DNA, 20 bp, Artificial Sequence
  Synthetic oligonucleotide; TGG chr2 60548173 60548192 60548189 +
taagtacacattgataaatg

SEQ ID NO: 169406 - DNA, 20 bp, Artificial Sequence
  Synthetic oligonucleotide; TAG chr2 60548186 60548205 60548202 +
ataaatgtggcttttttgtt

SEQ ID NO: 169407 - DNA, 20 bp, Artificial Sequence
  Synthetic oligonucleotide; TAG chr2 60548192 60548211 60548208 +
gtggcttttttgtttagcat

SEQ ID NO: 169408 - DNA, 20 bp, Artificial Sequence
  Synthetic oligonucleotide; AAG chr2 60548199 60548218 60548215 +
ttttgtttagcattagctac

SEQ ID NO: 169409 - DNA, 20 bp, Artificial Sequence
  Synthetic oligonucleotide; GAG chr2 60548206 60548225 60548222 +
tagcattagctacaagttct

SEQ ID NO: 169410 - DNA, 20 bp, Artificial Sequence
  Synthetic oligonucleotide; AGG chr2 60548207 60548226 60548223 +
agcattagctacaagttctg

SEQ ID NO: 169411 - DNA, 20 bp, Artificial Sequence
  Synthetic oligonucleotide; CAG chr2 60548214 60548233 60548230 +
gctacaagttctgaggttta

SEQ ID NO: 169412 - DNA, 20 bp, Artificial Sequence
  Synthetic oligonucleotide; AAG chr2 60548221 60548240 60548237 +
gttctgaggtttacagactg

SEQ ID NO: 169413 - DNA, 20 bp, Artificial Sequence
  Synthetic oligonucleotide; AGG chr2 60548222 60548241 60548238 +
ttctgaggtttacagactga

SEQ ID NO: 169414 - DNA, 20 bp, Artificial Sequence
  Synthetic oligonucleotide; AAG chr2 60548225 60548244 60548241 +
tgaggtttacagactgaagg

SEQ ID NO: 169415 - DNA, 20 bp, Artificial Sequence
  Synthetic oligonucleotide; TAG chr2 60548231 60548250 60548247 +
ttacagactgaaggaagact

SEQ ID NO: 169416 - DNA, 20 bp, Artificial Sequence
  Synthetic oligonucleotide; AGG chr2 60548232 60548251 60548248 +
tacagactgaaggaagactt

SEQ ID NO: 169417 - DNA, 20 bp, Artificial Sequence
  Synthetic oligonucleotide; TAG chr2 60548256 60548275 60548272 +
aaatattttatcaaacttac

SEQ ID NO: 169418 - DNA, 20 bp, Artificial Sequence
  Synthetic oligonucleotide; TAG chr2 60548263 60548282 60548279 +
ttatcaaacttactagtaca

SEQ ID NO: 169419 - DNA, 20 bp, Artificial Sequence
  Synthetic oligonucleotide; AAG chr2 60548304 60548323 60548320 +
aattttttatttccaccgtt

SEQ ID NO: 169420 - DNA, 20 bp, Artificial Sequence
  Synthetic oligonucleotide; AAG chr2 60548333 60548352 60548349 +
ttttttttttttttgttccc

SEQ ID NO: 169421 - DNA, 20 bp, Artificial Sequence
  Synthetic oligonucleotide; AGG chr2 60548334 60548353 60548350 +
tttttttttttttgttccca

SEQ ID NO: 169422 - DNA, 20 bp, Artificial Sequence
  Synthetic oligonucleotide; AAG chr2 60548353 60548372 60548369 +
aaggtctgacacatttctaa

SEQ ID NO: 169423 - DNA, 20 bp, Artificial Sequence
  Synthetic oligonucleotide; TGG chr2 60548356 60548375 60548372 +
gtctgacacatttctaaaag

SEQ ID NO: 169424 - DNA, 20 bp, Artificial Sequence
  Synthetic oligonucleotide; GGG chr2 60548357 60548376 60548373 +
tctgacacatttctaaaagt

SEQ ID NO: 169425 - DNA, 20 bp, Artificial Sequence
  Synthetic oligonucleotide; TAG chr2 60548369 60548388 60548385 +
ctaaaagtgggaatattatt

SEQ ID NO: 169426 - DNA, 20 bp, Artificial Sequence
  Synthetic oligonucleotide; AGG chr2 60548370 60548389 60548386 +
taaaagtgggaatattattt

SEQ ID NO: 169427 - DNA, 20 bp, Artificial Sequence
  Synthetic oligonucleotide; AAG chr2 60548378 60548397 60548394 +
ggaatattatttaggtgcaa

SEQ ID NO: 169428 - DNA, 20 bp, Artificial Sequence
  Synthetic oligonucleotide; AGG chr2 60548379 60548398 60548395 +
gaatattatttaggtgcaaa

SEQ ID NO: 169429 - DNA, 20 bp, Artificial Sequence
  Synthetic oligonucleotide; TAG chr2 60548393 60548412 60548409 +
tgcaaaaggaaatattctcc

SEQ ID NO: 169430 - DNA, 20 bp, Artificial Sequence
  Synthetic oligonucleotide; AGG chr2 60548394 60548413 60548410 +
gcaaaaggaaatattctcct

SEQ ID NO: 169431 - DNA, 20 bp, Artificial Sequence
  Synthetic oligonucleotide; TAG chr2 60548404 60548423 60548420 +
atattctcctaggtatcaaa

SEQ ID NO: 169432 - DNA, 20 bp, Artificial Sequence
  Synthetic oligonucleotide; AAG chr2 60548410 60548429 60548426 +
tcctaggtatcaaatagtta

SEQ ID NO: 169433 - DNA, 20 bp, Artificial Sequence
  Synthetic oligonucleotide; AGG chr2 60548411 60548430 60548427 +
cctaggtatcaaatagttaa

SEQ ID NO: 169434 - DNA, 20 bp, Artificial Sequence
  Synthetic oligonucleotide; TGG chr2 60548419 60548438 60548435 +
tcaaatagttaaaggtaatg

SEQ ID NO: 169435 - DNA, 20 bp, Artificial Sequence
  Synthetic oligonucleotide; CAG chr2 60548429 60548448 60548445 +
aaaggtaatgtggttcaaaa

SEQ ID NO: 169436 - DNA, 20 bp, Artificial Sequence
  Synthetic oligonucleotide; TGG chr2 60548435 60548454 60548451 +
aatgtggttcaaaacagact

SEQ ID NO: 169437 - DNA, 20 bp, Artificial Sequence
  Synthetic oligonucleotide; AAG chr2 60548441 60548460 60548457 +
gttcaaaacagacttggtta

SEQ ID NO: 169438 - DNA, 20 bp, Artificial Sequence
  Synthetic oligonucleotide; TAG chr2 60548455 60548474 60548471 +
tggttaaagtcttctaaatg

SEQ ID NO: 169439 - DNA, 20 bp, Artificial Sequence
  Synthetic oligonucleotide; CGG chr2 60548484 60548503 60548500 +
aactgatttacaatcaaaac

SEQ ID NO: 169440 - DNA, 20 bp, Artificial Sequence
  Synthetic oligonucleotide; GGG chr2 60548485 60548504 60548501 +
actgatttacaatcaaaacc

SEQ ID NO: 169441 - DNA, 20 bp, Artificial Sequence
  Synthetic oligonucleotide; AAG chr2 60548493 60548512 60548509 +
acaatcaaaaccgggaaatg

SEQ ID NO: 169442 - DNA, 20 bp, Artificial Sequence
  Synthetic oligonucleotide; TGG chr2 60548496 60548515 60548512 +
atcaaaaccgggaaatgaag

SEQ ID NO: 169443 - DNA, 20 bp, Artificial Sequence
  Synthetic oligonucleotide; CAG chr2 60548504 60548523 60548520 +
cgggaaatgaagtggtaatt

SEQ ID NO: 169444 - DNA, 20 bp, Artificial Sequence
  Synthetic oligonucleotide; GAG chr2 60548506 60548525 60548522 +
ggaaatgaagtggtaattca

SEQ ID NO: 169445 - DNA, 20 bp, Artificial Sequence
  Synthetic oligonucleotide; AGG chr2 60548507 60548526 60548523 +
gaaatgaagtggtaattcag

SEQ ID NO: 169446 - DNA, 20 bp, Artificial Sequence
  Synthetic oligonucleotide; TAG chr2 60548549 60548568 60548565 +
atttcacctaattaatttta

SEQ ID NO: 169447 - DNA, 20 bp, Artificial Sequence
  Synthetic oligonucleotide; AGG chr2 60548550 60548569 60548566 +
tttcacctaattaattttat

SEQ ID NO: 169448 - DNA, 20 bp, Artificial Sequence
  Synthetic oligonucleotide; GAG chr2 60548552 60548571 60548568 +
tcacctaattaattttatag

SEQ ID NO: 169449 - DNA, 20 bp, Artificial Sequence
  Synthetic oligonucleotide; AGG chr2 60548553 60548572 60548569 +
cacctaattaattttatagg

SEQ ID NO: 169450 - DNA, 20 bp, Artificial Sequence
  Synthetic oligonucleotide; AAG chr2 60548558 60548577 60548574 +
aattaattttataggaggca

SEQ ID NO: 169451 - DNA, 20 bp, Artificial Sequence
  Synthetic oligonucleotide; AAG chr2 60548575 60548594 60548591 +
gcaaagttcttgaaaataac

SEQ ID NO: 169452 - DNA, 20 bp, Artificial Sequence
  Synthetic oligonucleotide; CAG chr2 60548591 60548610 60548607 +
taacaagatgatcaaatgta

SEQ ID NO: 169453 - DNA, 20 bp, Artificial Sequence
  Synthetic oligonucleotide; AAG chr2 60548654 60548673 60548670 +
gtaaattattgctaattaac

SEQ ID NO: 169454 - DNA, 20 bp, Artificial Sequence
  Synthetic oligonucleotide; CGG chr2 60548691 60548710 60548707 +
gtatgaaatacgtttaacat

SEQ ID NO: 169455 - DNA, 20 bp, Artificial Sequence
  Synthetic oligonucleotide; TGG chr2 60548711 60548730 60548727 +
cggtctccttgcaaaacatt

SEQ ID NO: 169456 - DNA, 20 bp, Artificial Sequence
  Synthetic oligonucleotide; TAG chr2 60548715 60548734 60548731 +
ctccttgcaaaacatttggc

SEQ ID NO: 169457 - DNA, 20 bp, Artificial Sequence
  Synthetic oligonucleotide; TGG chr2 60548718 60548737 60548734 +
cttgcaaaacatttggctag

SEQ ID NO: 169458 - DNA, 20 bp, Artificial Sequence
  Synthetic oligonucleotide; CAG chr2 60548725 60548744 60548741 +
aacatttggctagtggtgtt

SEQ ID NO: 169459 - DNA, 20 bp, Artificial Sequence
  Synthetic oligonucleotide; GAG chr2 60548727 60548746 60548743 +
catttggctagtggtgttca

SEQ ID NO: 169460 - DNA, 20 bp, Artificial Sequence
  Synthetic oligonucleotide; TGG chr2 60548758 60548777 60548774 +
aaacgtgtttttatcattgc

SEQ ID NO: 169461 - DNA, 20 bp, Artificial Sequence
  Synthetic oligonucleotide; CAG chr2 60548776 60548795 60548792 +
gctggtatattattaaaaat

SEQ ID NO: 169462 - DNA, 20 bp, Artificial Sequence
  Synthetic oligonucleotide; AAG chr2 60548782 60548801 60548798 +
atattattaaaaatcagaca

SEQ ID NO: 169463 - DNA, 20 bp, Artificial Sequence
  Synthetic oligonucleotide; TGG chr2 60548785 60548804 60548801 +
ttattaaaaatcagacaaag

SEQ ID NO: 169464 - DNA, 20 bp, Artificial Sequence
  Synthetic oligonucleotide; GGG chr2 60548786 60548805 60548802 +
tattaaaaatcagacaaagt

SEQ ID NO: 169465 - DNA, 20 bp, Artificial Sequence
  Synthetic oligonucleotide; AAG chr2 60548794 60548813 60548810 +
atcagacaaagtgggacaca

SEQ ID NO: 169466 - DNA, 20 bp, Artificial Sequence
  Synthetic oligonucleotide; TGG chr2 60548820 60548839 60548836 +
atatgaaaatacaattctca

SEQ ID NO: 169467 - DNA, 20 bp, Artificial Sequence
  Synthetic oligonucleotide; TAG chr2 60548825 60548844 60548841 +
aaaatacaattctcatggtg

SEQ ID NO: 169468 - DNA, 20 bp, Artificial Sequence
  Synthetic oligonucleotide; CAG chr2 60548856 60548875 60548872 +
tttgcattgacatcttttct

SEQ ID NO: 169469 - DNA, 20 bp, Artificial Sequence
  Synthetic oligonucleotide; TGG chr2 60548859 60548878 60548875 +
gcattgacatcttttctcag

SEQ ID NO: 169470 - DNA, 20 bp, Artificial Sequence
  Synthetic oligonucleotide; TGG chr2 60548880 60548899 60548896 +
ggcaatcaacatttcctttc

SEQ ID NO: 169471 - DNA, 20 bp, Artificial Sequence
  Synthetic oligonucleotide; GGG chr2 60548881 60548900 60548897 +
gcaatcaacatttcctttct

SEQ ID NO: 169472 - DNA, 20 bp, Artificial Sequence
  Synthetic oligonucleotide; CAG chr2 60548947 60548966 60548963 +
ctaaaaaccttcctaaccct

SEQ ID NO: 169473 - DNA, 20 bp, Artificial Sequence
  Synthetic oligonucleotide; AAG chr2 60549012 60549031 60549028 +
ccaacaataccaacatttct

SEQ ID NO: 169474 - DNA, 20 bp, Artificial Sequence
  Synthetic oligonucleotide; CGG chr2 60549018 60549037 60549034 +
ataccaacatttctaagctc

SEQ ID NO: 169475 - DNA, 20 bp, Artificial Sequence
  Synthetic oligonucleotide; CGG chr2 60549030 60549049 60549046 +
ctaagctccggcctaaactc

SEQ ID NO: 169476 - DNA, 20 bp, Artificial Sequence
  Synthetic oligonucleotide; AAG chr2 60549038 60549057 60549054 +
cggcctaaactccggctaca

SEQ ID NO: 169477 - DNA, 20 bp, Artificial Sequence
  Synthetic oligonucleotide; CAG chr2 60549041 60549060 60549057 +
cctaaactccggctacaaag

SEQ ID NO: 169478 - DNA, 20 bp, Artificial Sequence
  Synthetic oligonucleotide; AGG chr2 60549042 60549061 60549058 +
ctaaactccggctacaaagc

SEQ ID NO: 169479 - DNA, 20 bp, Artificial Sequence
  Synthetic oligonucleotide; GGG chr2 60549043 60549062 60549059 +
taaactccggctacaaagca

SEQ ID NO: 169480 - DNA, 20 bp, Artificial Sequence
  Synthetic oligonucleotide; GAG chr2 60549045 60549064 60549061 +
aactccggctacaaagcagg

SEQ ID NO: 169481 - DNA, 20 bp, Artificial Sequence
  Synthetic oligonucleotide; AAG chr2 60549058 60549077 60549074 +
aagcagggagtcctcgattg

SEQ ID NO: 169482 - DNA, 20 bp, Artificial Sequence
  Synthetic oligonucleotide; TGG chr2 60549061 60549080 60549077 +
cagggagtcctcgattgaag

SEQ ID NO: 169483 - DNA, 20 bp, Artificial Sequence
  Synthetic oligonucleotide; AAG chr2 60549064 60549083 60549080 +
ggagtcctcgattgaagtgg

SEQ ID NO: 169484 - DNA, 20 bp, Artificial Sequence
  Synthetic oligonucleotide; AGG chr2 60549065 60549084 60549081 +
gagtcctcgattgaagtgga

SEQ ID NO: 169485 - DNA, 20 bp, Artificial Sequence
  Synthetic oligonucleotide; GGG chr2 60549066 60549085 60549082 +
agtcctcgattgaagtggaa

SEQ ID NO: 169486 - DNA, 20 bp, Artificial Sequence
  Synthetic oligonucleotide; GAG chr2 60549068 60549087 60549084 +
tcctcgattgaagtggaagg

SEQ ID NO: 169487 - DNA, 20 bp, Artificial Sequence
  Synthetic oligonucleotide; TGG chr2 60549071 60549090 60549087 +
tcgattgaagtggaagggag

SEQ ID NO: 169488 - DNA, 20 bp, Artificial Sequence
  Synthetic oligonucleotide; GGG chr2 60549072 60549091 60549088 +
cgattgaagtggaagggagt

SEQ ID NO: 169489 - DNA, 20 bp, Artificial Sequence
  Synthetic oligonucleotide; TAG chr2 60549092 60549111 60549108 +
gggcaaataatcataataat

SEQ ID NO: 169490 - DNA, 20 bp, Artificial Sequence
  Synthetic oligonucleotide; GAG chr2 60549112 60549131 60549128 +
tagccgcgaattctctctac

SEQ ID NO: 169491 - DNA, 20 bp, Artificial Sequence
  Synthetic oligonucleotide; AGG chr2 60549113 60549132 60549129 +
agccgcgaattctctctacg

SEQ ID NO: 169492 - DNA, 20 bp, Artificial Sequence
  Synthetic oligonucleotide; GGG chr2 60549114 60549133 60549130 +
gccgcgaattctctctacga

SEQ ID NO: 169493 - DNA, 20 bp, Artificial Sequence
  Synthetic oligonucleotide; GGG chr2 60549115 60549134 60549131 +
ccgcgaattctctctacgag

SEQ ID NO: 169494 - DNA, 20 bp, Artificial Sequence
  Synthetic oligonucleotide; GAG chr2 60549117 60549136 60549133 +
gcgaattctctctacgaggg

SEQ ID NO: 169495 - DNA, 20 bp, Artificial Sequence
  Synthetic oligonucleotide; AGG chr2 60549118 60549137 60549134 +
cgaattctctctacgagggg

SEQ ID NO: 169496 - DNA, 20 bp, Artificial Sequence
  Synthetic oligonucleotide; AAG chr2 60549121 60549140 60549137 +
attctctctacgaggggagg

SEQ ID NO: 169497 - DNA, 20 bp, Artificial Sequence
  Synthetic oligonucleotide; TAG chr2 60549127 60549146 60549143 +
tctacgaggggaggaagaaa

SEQ ID NO: 169498 - DNA, 20 bp, Artificial Sequence
  Synthetic oligonucleotide; CAG chr2 60549155 60549174 60549171 +
aaaatgcttctacgttcaaa

SEQ ID NO: 169499 - DNA, 20 bp, Artificial Sequence
  Synthetic oligonucleotide; AAG chr2 60549159 60549178 60549175 +
tgcttctacgttcaaacagc

SEQ ID NO: 169500 - DNA, 20 bp, Artificial Sequence
  Synthetic oligonucleotide; CAG chr2 60549163 60549182 60549179 +
tctacgttcaaacagcaaga

SEQ ID NO: 169501 - DNA, 20 bp, Artificial Sequence
  Synthetic oligonucleotide; TGG chr2 60549168 60549187 60549184 +
gttcaaacagcaagacagcc

SEQ ID NO: 169502 - DNA, 20 bp, Artificial Sequence
  Synthetic oligonucleotide; CAG chr2 60549186 60549205 60549202 +
cctggaacgtctcaatgtct

SEQ ID NO: 169503 - DNA, 20 bp, Artificial Sequence
  Synthetic oligonucleotide; CAG chr2 60549192 60549211 60549208 +
acgtctcaatgtctcagtga

SEQ ID NO: 169504 - DNA, 20 bp, Artificial Sequence
  Synthetic oligonucleotide; GAG chr2 60549198 60549217 60549214 +
caatgtctcagtgacagact

SEQ ID NO: 169505 - DNA, 20 bp, Artificial Sequence
  Synthetic oligonucleotide; TAG chr2 60549219 60549238 60549235 +
agatctctttcctctctgtg

SEQ ID NO: 169506 - DNA, 20 bp, Artificial Sequence
  Synthetic oligonucleotide; AAG chr2 60549228 60549247 60549244 +
tcctctctgtgtagttgcaa

SEQ ID NO: 169507 - DNA, 20 bp, Artificial Sequence
  Synthetic oligonucleotide; AAG chr2 60549240 60549259 60549256 +
agttgcaaaagaataaattt

SEQ ID NO: 169508 - DNA, 20 bp, Artificial Sequence
  Synthetic oligonucleotide; AGG chr2 60549241 60549260 60549257 +
gttgcaaaagaataaattta

SEQ ID NO: 169509 - DNA, 20 bp, Artificial Sequence
  Synthetic oligonucleotide; GGG chr2 60549242 60549261 60549258 +
ttgcaaaagaataaatttaa

SEQ ID NO: 169510 - DNA, 20 bp, Artificial Sequence
  Synthetic oligonucleotide; TAG chr2 60549261 60549280 60549277 +
agggaaaaaaataatcctta

SEQ ID NO: 169511 - DNA, 20 bp, Artificial Sequence
  Synthetic oligonucleotide; AGG chr2 60549262 60549281 60549278 +
gggaaaaaaataatccttat

SEQ ID NO: 169512 - DNA, 20 bp, Artificial Sequence
  Synthetic oligonucleotide; TGG chr2 60549271 60549290 60549287 +
ataatccttataggaaatgt

SEQ ID NO: 169513 - DNA, 20 bp, Artificial Sequence
  Synthetic oligonucleotide; AAG chr2 60549275 60549294 60549291 +
tccttataggaaatgttggt

SEQ ID NO: 169514 - DNA, 20 bp, Artificial Sequence
  Synthetic oligonucleotide; AGG chr2 60549276 60549295 60549292 +
ccttataggaaatgttggta

SEQ ID NO: 169515 - DNA, 20 bp, Artificial Sequence
  Synthetic oligonucleotide; GAG chr2 60549278 60549297 60549294 +
ttataggaaatgttggtaag

SEQ ID NO: 169516 - DNA, 20 bp, Artificial Sequence
  Synthetic oligonucleotide; GAG chr2 60549282 60549301 60549298 +
aggaaatgttggtaaggagc

SEQ ID NO: 169517 - DNA, 20 bp, Artificial Sequence
  Synthetic oligonucleotide; GAG chr2 60549291 60549310 60549307 +
tggtaaggagcgagcaaaac

SEQ ID NO: 169518 - DNA, 20 bp, Artificial Sequence
  Synthetic oligonucleotide; GAG chr2 60549293 60549312 60549309 +
gtaaggagcgagcaaaacga

SEQ ID NO: 169519 - DNA, 20 bp, Artificial Sequence
  Synthetic oligonucleotide; CGG chr2 60549300 60549319 60549316 +
gcgagcaaaacgagagctgc

SEQ ID NO: 169520 - DNA, 20 bp, Artificial Sequence
  Synthetic oligonucleotide; GGG chr2 60549301 60549320 60549317 +
cgagcaaaacgagagctgcc

SEQ ID NO: 169521 - DNA, 20 bp, Artificial Sequence
  Synthetic oligonucleotide; GGG chr2 60549302 60549321 60549318 +
gagcaaaacgagagctgccg

SEQ ID NO: 169522 - DNA, 20 bp, Artificial Sequence
  Synthetic oligonucleotide; GAG chr2 60549304 60549323 60549320 +
gcaaaacgagagctgccggg

SEQ ID NO: 169523 - DNA, 20 bp, Artificial Sequence
  Synthetic oligonucleotide; CGG chr2 60549307 60549326 60549323 +
aaacgagagctgccggggag

SEQ ID NO: 169524 - DNA, 20 bp, Artificial Sequence
  Synthetic oligonucleotide; GAG chr2 60549309 60549328 60549325 +
acgagagctgccggggagcg

SEQ ID NO: 169525 - DNA, 20 bp, Artificial Sequence
  Synthetic oligonucleotide; AGG chr2 60549310 60549329 60549326 +
cgagagctgccggggagcgg

SEQ ID NO: 169526 - DNA, 20 bp, Artificial Sequence
  Synthetic oligonucleotide; GGG chr2 60549311 60549330 60549327 +
gagagctgccggggagcgga

SEQ ID NO: 169527 - DNA, 20 bp, Artificial Sequence
  Synthetic oligonucleotide; GGG chr2 60549312 60549331 60549328 +
agagctgccggggagcggag

SEQ ID NO: 169528 - DNA, 20 bp, Artificial Sequence
  Synthetic oligonucleotide; GGG chr2 60549313 60549332 60549329 +
gagctgccggggagcggagg

SEQ ID NO: 169529 - DNA, 20 bp, Artificial Sequence
  Synthetic oligonucleotide; GAG chr2 60549315 60549334 60549331 +
gctgccggggagcggagggg

SEQ ID NO: 169530 - DNA, 20 bp, Artificial Sequence
  Synthetic oligonucleotide; AGG chr2 60549316 60549335 60549332 +
ctgccggggagcggaggggg

SEQ ID NO: 169531 - DNA, 20 bp, Artificial Sequence
  Synthetic oligonucleotide; GGG chr2 60549317 60549336 60549333 +
tgccggggagcggaggggga

SEQ ID NO: 169532 - DNA, 20 bp, Artificial Sequence
  Synthetic oligonucleotide; GGG chr2 60549318 60549337 60549334 +
gccggggagcggagggggag

SEQ ID NO: 169533 - DNA, 20 bp, Artificial Sequence
  Synthetic oligonucleotide; GGG chr2 60549319 60549338 60549335 +
ccggggagcggagggggagg

SEQ ID NO: 169534 - DNA, 20 bp, Artificial Sequence
  Synthetic oligonucleotide; AAG chr2 60549323 60549342 60549339 +
ggagcggagggggaggggga

SEQ ID NO: 169535 - DNA, 20 bp, Artificial Sequence
  Synthetic oligonucleotide; AGG chr2 60549324 60549343 60549340 +
gagcggagggggagggggaa

SEQ ID NO: 169536 - DNA, 20 bp, Artificial Sequence
  Synthetic oligonucleotide; GGG chr2 60549325 60549344 60549341 +
agcggagggggagggggaaa

SEQ ID NO: 169537 - DNA, 20 bp, Artificial Sequence
  Synthetic oligonucleotide; GAG chr2 60549327 60549346 60549343 +
cggagggggagggggaaagg

SEQ ID NO: 169538 - DNA, 20 bp, Artificial Sequence
  Synthetic oligonucleotide; AAG chr2 60549340 60549359 60549356 +
ggaaagggagatgtgtcttc

SEQ ID NO: 169539 - DNA, 20 bp, Artificial Sequence
  Synthetic oligonucleotide; AAG chr2 60549353 60549372 60549369 +
tgtcttcaagtttgctttcc

SEQ ID NO: 169540 - DNA, 20 bp, Artificial Sequence
  Synthetic oligonucleotide; CAG chr2 60549378 60549397 60549394 +
cttctccttgattgtcttaa

SEQ ID NO: 169541 - DNA, 20 bp, Artificial Sequence
  Synthetic oligonucleotide; AGG chr2 60549379 60549398 60549395 +
ttctccttgattgtcttaac

SEQ ID NO: 169542 - DNA, 20 bp, Artificial Sequence
  Synthetic oligonucleotide; GGG chr2 60549380 60549399 60549396 +
tctccttgattgtcttaaca

SEQ ID NO: 169543 - DNA, 20 bp, Artificial Sequence
  Synthetic oligonucleotide; AAG chr2 60549385 60549404 60549401 +
ttgattgtcttaacagggta

SEQ ID NO: 169544 - DNA, 20 bp, Artificial Sequence
  Synthetic oligonucleotide; AAG chr2 60549388 60549407 60549404 +
attgtcttaacagggtaaag

SEQ ID NO: 169545 - DNA, 20 bp, Artificial Sequence
  Synthetic oligonucleotide; CGG chr2 60549395 60549414 60549411 +
taacagggtaaagaagcaaa

SEQ ID NO: 169546 - DNA, 20 bp, Artificial Sequence
  Synthetic oligonucleotide; GAG chr2 60549397 60549416 60549413 +
acagggtaaagaagcaaacg

SEQ ID NO: 169547 - DNA, 20 bp, Artificial Sequence
  Synthetic oligonucleotide; AGG chr2 60549398 60549417 60549414 +
cagggtaaagaagcaaacgg

SEQ ID NO: 169548 - DNA, 20 bp, Artificial Sequence
  Synthetic oligonucleotide; CAG chr2 60549409 60549428 60549425 +
agcaaacggaggctgaaatt

SEQ ID NO: 169549 - DNA, 20 bp, Artificial Sequence
  Synthetic oligonucleotide; GAG chr2 60549411 60549430 60549427 +
caaacggaggctgaaattca

SEQ ID NO: 169550 - DNA, 20 bp, Artificial Sequence
  Synthetic oligonucleotide; GAG chr2 60549413 60549432 60549429 +
aacggaggctgaaattcaga

SEQ ID NO: 169551 - DNA, 20 bp, Artificial Sequence
  Synthetic oligonucleotide; AGG chr2 60549414 60549433 60549430 +
acggaggctgaaattcagag

SEQ ID NO: 169552 - DNA, 20 bp, Artificial Sequence
  Synthetic oligonucleotide; AAG chr2 60549419 60549438 60549435 +
ggctgaaattcagagaggaa

SEQ ID NO: 169553 - DNA, 20 bp, Artificial Sequence
  Synthetic oligonucleotide; AAG chr2 60549424 60549443 60549440 +
aaattcagagaggaaaagca

SEQ ID NO: 169554 - DNA, 20 bp, Artificial Sequence
  Synthetic oligonucleotide; AAG chr2 60549433 60549452 60549449 +
gaggaaaagcaaagaaacaa

SEQ ID NO: 169555 - DNA, 20 bp, Artificial Sequence
  Synthetic oligonucleotide; AAG chr2 60549438 60549457 60549454 +
aaagcaaagaaacaaaagca

SEQ ID NO: 169556 - DNA, 20 bp, Artificial Sequence
  Synthetic oligonucleotide; CGG chr2 60549442 60549461 60549458 +
caaagaaacaaaagcaaagc

SEQ ID NO: 169557 - DNA, 20 bp, Artificial Sequence
  Synthetic oligonucleotide; GGG chr2 60549443 60549462 60549459 +
aaagaaacaaaagcaaagcc

SEQ ID NO: 169558 - DNA, 20 bp, Artificial Sequence
  Synthetic oligonucleotide; GGG chr2 60549444 60549463 60549460 +
aagaaacaaaagcaaagccg

SEQ ID NO: 169559 - DNA, 20 bp, Artificial Sequence
  Synthetic oligonucleotide; GGG chr2 60549445 60549464 60549461 +
agaaacaaaagcaaagccgg

SEQ ID NO: 169560 - DNA, 20 bp, Artificial Sequence
  Synthetic oligonucleotide; CAG chr2 60549451 60549470 60549467 +
aaaagcaaagccgggggcta

SEQ ID NO: 169561 - DNA, 20 bp, Artificial Sequence
  Synthetic oligonucleotide; AGG chr2 60549452 60549471 60549468 +
aaagcaaagccgggggctac

SEQ ID NO: 169562 - DNA, 20 bp, Artificial Sequence
  Synthetic oligonucleotide; CGG chr2 60549457 60549476 60549473 +
aaagccgggggctacaggcc

SEQ ID NO: 169563 - DNA, 20 bp, Artificial Sequence
  Synthetic oligonucleotide; GGG chr2 60549458 60549477 60549474 +
aagccgggggctacaggccc

SEQ ID NO: 169564 - DNA, 20 bp, Artificial Sequence
  Synthetic oligonucleotide; GGG chr2 60549459 60549478 60549475 +
agccgggggctacaggcccg

SEQ ID NO: 169565 - DNA, 20 bp, Artificial Sequence
  Synthetic oligonucleotide; CAG chr2 60549462 60549481 60549478 +
cgggggctacaggcccgggg

SEQ ID NO: 169566 - DNA, 20 bp, Artificial Sequence
  Synthetic oligonucleotide; AGG chr2 60549463 60549482 60549479 +
gggggctacaggcccggggc

SEQ ID NO: 169567 - DNA, 20 bp, Artificial Sequence
  Synthetic oligonucleotide; GGG chr2 60549464 60549483 60549480 +
ggggctacaggcccggggca

SEQ ID NO: 169568 - DNA, 20 bp, Artificial Sequence
  Synthetic oligonucleotide; GGG chr2 60549465 60549484 60549481 +
gggctacaggcccggggcag

SEQ ID NO: 169569 - DNA, 20 bp, Artificial Sequence
  Synthetic oligonucleotide; CGG chr2 60549471 60549490 60549487 +
caggcccggggcaggggccc

SEQ ID NO: 169570 - DNA, 20 bp, Artificial Sequence
  Synthetic oligonucleotide; AAG chr2 60549475 60549494 60549491 +
cccggggcaggggccccggc

SEQ ID NO: 169571 - DNA, 20 bp, Artificial Sequence
  Synthetic oligonucleotide; AGG chr2 60549476 60549495 60549492 +
ccggggcaggggccccggca

SEQ ID NO: 169572 - DNA, 20 bp, Artificial Sequence
  Synthetic oligonucleotide; GGG chr2 60549477 60549496 60549493 +
cggggcaggggccccggcaa

SEQ ID NO: 169573 - DNA, 20 bp, Artificial Sequence
  Synthetic oligonucleotide; TGG chr2 60549480 60549499 60549496 +
ggcaggggccccggcaaggg

SEQ ID NO: 169574 - DNA, 20 bp, Artificial Sequence
  Synthetic oligonucleotide; CAG chr2 60549489 60549508 60549505 +
cccggcaagggtggaccgtg

SEQ ID NO: 169575 - DNA, 20 bp, Artificial Sequence
  Synthetic oligonucleotide; AAG chr2 60549493 60549512 60549509 +
gcaagggtggaccgtgcaga

SEQ ID NO: 169576 - DNA, 20 bp, Artificial Sequence
  Synthetic oligonucleotide; AAG chr2 60549498 60549517 60549514 +
ggtggaccgtgcagaaagtg

SEQ ID NO: 169577 - DNA, 20 bp, Artificial Sequence
  Synthetic oligonucleotide; TGG chr2 60549502 60549521 60549518 +
gaccgtgcagaaagtgaagt

SEQ ID NO: 169578 - DNA, 20 bp, Artificial Sequence
  Synthetic oligonucleotide; GGG chr2 60549503 60549522 60549519 +
accgtgcagaaagtgaagtt

SEQ ID NO: 169579 - DNA, 20 bp, Artificial Sequence
  Synthetic oligonucleotide; CGG chr2 60549508 60549527 60549524 +
gcagaaagtgaagttgggcg

SEQ ID NO: 169580 - DNA, 20 bp, Artificial Sequence
  Synthetic oligonucleotide; GGG chr2 60549509 60549528 60549525 +
cagaaagtgaagttgggcgc

SEQ ID NO: 169581 - DNA, 20 bp, Artificial Sequence
  Synthetic oligonucleotide; GGG chr2 60549510 60549529 60549526 +
agaaagtgaagttgggcgcg

SEQ ID NO: 169582 - DNA, 20 bp, Artificial Sequence
  Synthetic oligonucleotide; GAG chr2 60549518 60549537 60549534 +
aagttgggcgcggggactct

SEQ ID NO: 169583 - DNA, 20 bp, Artificial Sequence
  Synthetic oligonucleotide; AGG chr2 60549519 60549538 60549535 +
agttgggcgcggggactctg

SEQ ID NO: 169584 - DNA, 20 bp, Artificial Sequence
  Synthetic oligonucleotide; AAG chr2 60549526 60549545 60549542 +
cgcggggactctgaggcaca

SEQ ID NO: 169585 - DNA, 20 bp, Artificial Sequence
  Synthetic oligonucleotide; GAG chr2 60549530 60549549 60549546 +
gggactctgaggcacaaagc

SEQ ID NO: 169586 - DNA, 20 bp, Artificial Sequence
  Synthetic oligonucleotide; CAG chr2 60549533 60549552 60549549 +
actctgaggcacaaagcgag

SEQ ID NO: 169587 - DNA, 20 bp, Artificial Sequence
  Synthetic oligonucleotide; TGG chr2 60549541 60549560 60549557 +
gcacaaagcgagcagcgtgc

SEQ ID NO: 169588 - DNA, 20 bp, Artificial Sequence
  Synthetic oligonucleotide; CAG chr2 60549547 60549566 60549563 +
agcgagcagcgtgctggctg

SEQ ID NO: 169589 - DNA, 20 bp, Artificial Sequence
  Synthetic oligonucleotide; AGG chr2 60549548 60549567 60549564 +
gcgagcagcgtgctggctgc

SEQ ID NO: 169590 - DNA, 20 bp, Artificial Sequence
  Synthetic oligonucleotide; CAG chr2 60549579 60549598 60549595 +
gcgcttgctgcgaacacgtg

SEQ ID NO: 169591 - DNA, 20 bp, Artificial Sequence
  Synthetic oligonucleotide; CAG chr2 60549582 60549601 60549598 +
cttgctgcgaacacgtgcag

SEQ ID NO: 169592 - DNA, 20 bp, Artificial Sequence
  Synthetic oligonucleotide; CGG chr2 60549585 60549604 60549601 +
gctgcgaacacgtgcagcag

SEQ ID NO: 169593 - DNA, 20 bp, Artificial Sequence
  Synthetic oligonucleotide; CGG chr2 60549591 60549610 60549607 +
aacacgtgcagcagcggccg

SEQ ID NO: 169594 - DNA, 20 bp, Artificial Sequence
  Synthetic oligonucleotide; GGG chr2 60549592 60549611 60549608 +
acacgtgcagcagcggccgc

SEQ ID NO: 169595 - DNA, 20 bp, Artificial Sequence
  Synthetic oligonucleotide; GGG chr2 60549593 60549612 60549609 +
cacgtgcagcagcggccgcg

SEQ ID NO: 169596 - DNA, 20 bp, Artificial Sequence
  Synthetic oligonucleotide; TGG chr2 60549599 60549618 60549615 +
cagcagcggccgcggggcct

SEQ ID NO: 169597 - DNA, 20 bp, Artificial Sequence
  Synthetic oligonucleotide; GGG chr2 60549600 60549619 60549616 +
agcagcggccgcggggcctt

SEQ ID NO: 169598 - DNA, 20 bp, Artificial Sequence
  Synthetic oligonucleotide; GGG chr2 60549601 60549620 60549617 +
gcagcggccgcggggccttg

SEQ ID NO: 169599 - DNA, 20 bp, Artificial Sequence
  Synthetic oligonucleotide; CGG chr2 60549606 60549625 60549622 +
ggccgcggggccttggggcc

SEQ ID NO: 169600 - DNA, 20 bp, Artificial Sequence
  Synthetic oligonucleotide; GGG chr2 60549607 60549626 60549623 +
gccgcggggccttggggccc

SEQ ID NO: 169601 - DNA, 20 bp, Artificial Sequence
  Synthetic oligonucleotide; GGG chr2 60549608 60549627 60549624 +
ccgcggggccttggggcccg

SEQ ID NO: 169602 - DNA, 20 bp, Artificial Sequence
  Synthetic oligonucleotide; GGG chr2 60549609 60549628 60549625 +
cgcggggccttggggcccgg

SEQ ID NO: 169603 - DNA, 20 bp, Artificial Sequence
  Synthetic oligonucleotide; CGG chr2 60549614 60549633 60549630 +
ggccttggggcccgggggcc

SEQ ID NO: 169604 - DNA, 20 bp, Artificial Sequence
  Synthetic oligonucleotide; GAG chr2 60549616 60549635 60549632 +
ccttggggcccgggggcccg

SEQ ID NO: 169605 - DNA, 20 bp, Artificial Sequence
  Synthetic oligonucleotide; CGG chr2 60549620 60549639 60549636 +
ggggcccgggggcccggaga

SEQ ID NO: 169606 - DNA, 20 bp, Artificial Sequence
  Synthetic oligonucleotide; GAG chr2 60549622 60549641 60549638 +
ggcccgggggcccggagacg

SEQ ID NO: 169607 - DNA, 20 bp, Artificial Sequence
  Synthetic oligonucleotide; AGG chr2 60549623 60549642 60549639 +
gcccgggggcccggagacgg

SEQ ID NO: 169608 - DNA, 20 bp, Artificial Sequence
  Synthetic oligonucleotide; GGG chr2 60549624 60549643 60549640 +
cccgggggcccggagacgga

SEQ ID NO: 169609 - DNA, 20 bp, Artificial Sequence
  Synthetic oligonucleotide; CAG chr2 60549627 60549646 60549643 +
gggggcccggagacggaggg

SEQ ID NO: 169610 - DNA, 20 bp, Artificial Sequence
  Synthetic oligonucleotide; CAG chr2 60549631 60549650 60549647 +
gcccggagacggagggcagc

SEQ ID NO: 169611 - DNA, 20 bp, Artificial Sequence
  Synthetic oligonucleotide; AGG chr2 60549632 60549651 60549648 +
cccggagacggagggcagcc

SEQ ID NO: 169612 - DNA, 20 bp, Artificial Sequence
  Synthetic oligonucleotide; GGG chr2 60549633 60549652 60549649 +
ccggagacggagggcagcca

SEQ ID NO: 169613 - DNA, 20 bp, Artificial Sequence
  Synthetic oligonucleotide; GGG chr2 60549634 60549653 60549650 +
cggagacggagggcagccag

SEQ ID NO: 169614 - DNA, 20 bp, Artificial Sequence
  Synthetic oligonucleotide; CAG chr2 60549663 60549682 60549679 +
ctgctgcctccatgcccgtc

SEQ ID NO: 169615 - DNA, 20 bp, Artificial Sequence
  Synthetic oligonucleotide; CGG chr2 60549668 60549687 60549684 +
gcctccatgcccgtccagct

SEQ ID NO: 169616 - DNA, 20 bp, Artificial Sequence
  Synthetic oligonucleotide; CAG chr2 60549672 60549691 60549688 +
ccatgcccgtccagctcggc

SEQ ID NO: 169617 - DNA, 20 bp, Artificial Sequence
  Synthetic oligonucleotide; CGG chr2 60549677 60549696 60549693 +
cccgtccagctcggccagct

SEQ ID NO: 169618 - DNA, 20 bp, Artificial Sequence
  Synthetic oligonucleotide; CGG chr2 60549683 60549702 60549699 +
cagctcggccagctcggccg

SEQ ID NO: 169619 - DNA, 20 bp, Artificial Sequence
  Synthetic oligonucleotide; GGG chr2 60549684 60549703 60549700 +
agctcggccagctcggccgc

SEQ ID NO: 169620 - DNA, 20 bp, Artificial Sequence
  Synthetic oligonucleotide; GGG chr2 60549685 60549704 60549701 +
gctcggccagctcggccgcg

SEQ ID NO: 169621 - DNA, 20 bp, Artificial Sequence
  Synthetic oligonucleotide; CGG chr2 60549691 60549710 60549707 +
ccagctcggccgcggggtga

SEQ ID NO: 169622 - DNA, 20 bp, Artificial Sequence
  Synthetic oligonucleotide; TGG chr2 60549699 60549718 60549715 +
gccgcggggtgacggttccc

SEQ ID NO: 169623 - DNA, 20 bp, Artificial Sequence
  Synthetic oligonucleotide; GGG chr2 60549700 60549719 60549716 +
ccgcggggtgacggttccct

SEQ ID NO: 169624 - DNA, 20 bp, Artificial Sequence
  Synthetic oligonucleotide; CAG chr2 60549708 60549727 60549724 +
tgacggttccctgggcctgc

SEQ ID NO: 169625 - DNA, 20 bp, Artificial Sequence
  Synthetic oligonucleotide; TGG chr2 60549712 60549731 60549728 +
ggttccctgggcctgccagt

SEQ ID NO: 169626 - DNA, 20 bp, Artificial Sequence
  Synthetic oligonucleotide; AAG chr2 60549720 60549739 60549736 +
gggcctgccagttggtgaaa

SEQ ID NO: 169627 - DNA, 20 bp, Artificial Sequence
  Synthetic oligonucleotide; AGG chr2 60549721 60549740 60549737 +
ggcctgccagttggtgaaaa

SEQ ID NO: 169628 - DNA, 20 bp, Artificial Sequence
  Synthetic oligonucleotide; AAG chr2 60549724 60549743 60549740 +
ctgccagttggtgaaaaagg

SEQ ID NO: 169629 - DNA, 20 bp, Artificial Sequence
  Synthetic oligonucleotide; GAG chr2 60549728 60549747 60549744 +
cagttggtgaaaaaggaagt

SEQ ID NO: 169630 - DNA, 20 bp, Artificial Sequence
  Synthetic oligonucleotide; AGG chr2 60549729 60549748 60549745 +
agttggtgaaaaaggaagtg

SEQ ID NO: 169631 - DNA, 20 bp, Artificial Sequence
  Synthetic oligonucleotide; TGG chr2 60549734 60549753 60549750 +
gtgaaaaaggaagtgaggtt

SEQ ID NO: 169632 - DNA, 20 bp, Artificial Sequence
  Synthetic oligonucleotide; CGG chr2 60549743 60549762 60549759 +
gaagtgaggtttggaaaacc

SEQ ID NO: 169633 - DNA, 20 bp, Artificial Sequence
  Synthetic oligonucleotide; TGG chr2 60549747 60549766 60549763 +
tgaggtttggaaaacccggc

SEQ ID NO: 169634 - DNA, 20 bp, Artificial Sequence
  Synthetic oligonucleotide; TGG chr2 60549756 60549775 60549772 +
gaaaacccggctggttaacc

SEQ ID NO: 169635 - DNA, 20 bp, Artificial Sequence
  Synthetic oligonucleotide; CAG chr2 60549761 60549780 60549777 +
cccggctggttaacctggtg

SEQ ID NO: 169636 - DNA, 20 bp, Artificial Sequence
  Synthetic oligonucleotide; CAG chr2 60549767 60549786 60549783 +
tggttaacctggtgcagtct

SEQ ID NO: 169637 - DNA, 20 bp, Artificial Sequence
  Synthetic oligonucleotide; AAG chr2 60549788 60549807 60549804 +
agtatctccgcacacacctc

SEQ ID NO: 169638 - DNA, 20 bp, Artificial Sequence
  Synthetic oligonucleotide; CGG chr2 60549793 60549812 60549809 +
ctccgcacacacctcaagcg

SEQ ID NO: 169639 - DNA, 20 bp, Artificial Sequence
  Synthetic oligonucleotide; GGG chr2 60549794 60549813 60549810 +
tccgcacacacctcaagcgc

SEQ ID NO: 169640 - DNA, 20 bp, Artificial Sequence
  Synthetic oligonucleotide; GAG chr2 60549801 60549820 60549817 +
acacctcaagcgcgggtcct

SEQ ID NO: 169641 - DNA, 20 bp, Artificial Sequence
  Synthetic oligonucleotide; AAG chr2 60549821 60549840 60549837 +
gagattcattctgtgtccac

SEQ ID NO: 169642 - DNA, 20 bp, Artificial Sequence
  Synthetic oligonucleotide; TGG chr2 60549840 60549859 60549856 +
caagcttacactttttactt

SEQ ID NO: 169643 - DNA, 20 bp, Artificial Sequence
  Synthetic oligonucleotide; GGG chr2 60549841 60549860 60549857 +
aagcttacactttttacttt

SEQ ID NO: 169644 - DNA, 20 bp, Artificial Sequence
  Synthetic oligonucleotide; GGG chr2 60549842 60549861 60549858 +
agcttacactttttactttg

SEQ ID NO: 169645 - DNA, 20 bp, Artificial Sequence
  Synthetic oligonucleotide; GGG chr2 60549843 60549862 60549859 +
gcttacactttttactttgg

SEQ ID NO: 169646 - DNA, 20 bp, Artificial Sequence
  Synthetic oligonucleotide; TGG chr2 60549876 60549895 60549892 +
atgcatttcccccgcaattc

SEQ ID NO: 169647 - DNA, 20 bp, Artificial Sequence
  Synthetic oligonucleotide; GGG chr2 60549877 60549896 60549893 +
tgcatttcccccgcaattct

SEQ ID NO: 169648 - DNA, 20 bp, Artificial Sequence
  Synthetic oligonucleotide; TGG chr2 60549883 60549902 60549899 +
tcccccgcaattctgggcac

SEQ ID NO: 169649 - DNA, 20 bp, Artificial Sequence
  Synthetic oligonucleotide; GGG chr2 60549884 60549903 60549900 +
cccccgcaattctgggcact

SEQ ID NO: 169650 - DNA, 20 bp, Artificial Sequence
  Synthetic oligonucleotide; CGG chr2 60549893 60549912 60549909 +
ttctgggcactgggtgtgcg

SEQ ID NO: 169651 - DNA, 20 bp, Artificial Sequence
  Synthetic oligonucleotide; CGG chr2 60549896 60549915 60549912 +
tgggcactgggtgtgcgcgg

SEQ ID NO: 169652 - DNA, 20 bp, Artificial Sequence
  Synthetic oligonucleotide; CGG chr2 60549899 60549918 60549915 +
gcactgggtgtgcgcggcgg

SEQ ID NO: 169653 - DNA, 20 bp, Artificial Sequence
  Synthetic oligonucleotide; CGG chr2 60549905 60549924 60549921 +
ggtgtgcgcggcggcggctg

SEQ ID NO: 169654 - DNA, 20 bp, Artificial Sequence
  Synthetic oligonucleotide; GAG chr2 60549977 60549996 60549993 +
attactattgttgtgattcc

SEQ ID NO: 169655 - DNA, 20 bp, Artificial Sequence
  Synthetic oligonucleotide; GAG chr2 60549984 60550003 60550000 +
ttgttgtgattccgagctcc

SEQ ID NO: 169656 - DNA, 20 bp, Artificial Sequence
  Synthetic oligonucleotide; AGG chr2 60549985 60550004 60550001 +
tgttgtgattccgagctccg

SEQ ID NO: 169657 - DNA, 20 bp, Artificial Sequence
  Synthetic oligonucleotide; GAG chr2 60549989 60550008 60550005 +
gtgattccgagctccgaggc

SEQ ID NO: 169658 - DNA, 20 bp, Artificial Sequence
  Synthetic oligonucleotide; GAG chr2 60549991 60550010 60550007 +
gattccgagctccgaggcga

SEQ ID NO: 169659 - DNA, 20 bp, Artificial Sequence
  Synthetic oligonucleotide; AGG chr2 60549992 60550011 60550008 +
attccgagctccgaggcgag

SEQ ID NO: 169660 - DNA, 20 bp, Artificial Sequence
  Synthetic oligonucleotide; GGG chr2 60549993 60550012 60550009 +
ttccgagctccgaggcgaga

SEQ ID NO: 169661 - DNA, 20 bp, Artificial Sequence
  Synthetic oligonucleotide; GGG chr2 60549994 60550013 60550010 +
tccgagctccgaggcgagag

SEQ ID NO: 169662 - DNA, 20 bp, Artificial Sequence
  Synthetic oligonucleotide; GGG chr2 60549995 60550014 60550011 +
ccgagctccgaggcgagagg

SEQ ID NO: 169663 - DNA, 20 bp, Artificial Sequence
  Synthetic oligonucleotide; GGG chr2 60549996 60550015 60550012 +
cgagctccgaggcgagaggg

SEQ ID NO: 169664 - DNA, 20 bp, Artificial Sequence
  Synthetic oligonucleotide; GGG chr2 60549997 60550016 60550013 +
gagctccgaggcgagagggg

SEQ ID NO: 169665 - DNA, 20 bp, Artificial Sequence
  Synthetic oligonucleotide; CGG chr2 60550003 60550022 60550019 +
cgaggcgagagggggggtgt

SEQ ID NO: 169666 - DNA, 20 bp, Artificial Sequence
  Synthetic oligonucleotide; GGG chr2 60550004 60550023 60550020 +
gaggcgagagggggggtgtc

SEQ ID NO: 169667 - DNA, 20 bp, Artificial Sequence
  Synthetic oligonucleotide; CAG chr2 60550010 60550029 60550026 +
agagggggggtgtcgggctg

SEQ ID NO: 169668 - DNA, 20 bp, Artificial Sequence
  Synthetic oligonucleotide; GAG chr2 60550012 60550031 60550028 +
agggggggtgtcgggctgca

SEQ ID NO: 169669 - DNA, 20 bp, Artificial Sequence
  Synthetic oligonucleotide; CAG chr2 60550020 60550039 60550036 +
tgtcgggctgcagagccgcc

SEQ ID NO: 169670 - DNA, 20 bp, Artificial Sequence
  Synthetic oligonucleotide; AAG chr2 60550024 60550043 60550040 +
gggctgcagagccgcccagc

SEQ ID NO: 169671 - DNA, 20 bp, Artificial Sequence
  Synthetic oligonucleotide; CAG chr2 60550028 60550047 60550044 +
tgcagagccgcccagcaagc

SEQ ID NO: 169672 - DNA, 20 bp, Artificial Sequence
  Synthetic oligonucleotide; GAG chr2 60550033 60550052 60550049 +
agccgcccagcaagccagcc

SEQ ID NO: 169673 - DNA, 20 bp, Artificial Sequence
  Synthetic oligonucleotide; AGG chr2 60550034 60550053 60550050 +
gccgcccagcaagccagccg

SEQ ID NO: 169674 - DNA, 20 bp, Artificial Sequence
  Synthetic oligonucleotide; GAG chr2 60550042 60550061 60550058 +
gcaagccagccgaggccacc

SEQ ID NO: 169675 - DNA, 20 bp, Artificial Sequence
  Synthetic oligonucleotide; AGG chr2 60550043 60550062 60550059 +
caagccagccgaggccaccg

SEQ ID NO: 169676 - DNA, 20 bp, Artificial Sequence
  Synthetic oligonucleotide; TGG chr2 60550059 60550078 60550075 +
accgaggtctgtgctttgca

SEQ ID NO: 169677 - DNA, 20 bp, Artificial Sequence
  Synthetic oligonucleotide; GGG chr2 60550060 60550079 60550076 +
ccgaggtctgtgctttgcat

SEQ ID NO: 169678 - DNA, 20 bp, Artificial Sequence
  Synthetic oligonucleotide; GGG chr2 60550061 60550080 60550077 +
cgaggtctgtgctttgcatg

SEQ ID NO: 169679 - DNA, 20 bp, Artificial Sequence
  Synthetic oligonucleotide; GGG chr2 60550062 60550081 60550078 +
gaggtctgtgctttgcatgg

SEQ ID NO: 169680 - DNA, 20 bp, Artificial Sequence
  Synthetic oligonucleotide; GAG chr2 60550066 60550085 60550082 +
tctgtgctttgcatgggggt

SEQ ID NO: 169681 - DNA, 20 bp, Artificial Sequence
  Synthetic oligonucleotide; AGG chr2 60550067 60550086 60550083 +
ctgtgctttgcatgggggtg

SEQ ID NO: 169682 - DNA, 20 bp, Artificial Sequence
  Synthetic oligonucleotide; GGG chr2 60550068 60550087 60550084 +
tgtgctttgcatgggggtga

SEQ ID NO: 169683 - DNA, 20 bp, Artificial Sequence
  Synthetic oligonucleotide; GGG chr2 60550069 60550088 60550085 +
gtgctttgcatgggggtgag

SEQ ID NO: 169684 - DNA, 20 bp, Artificial Sequence
  Synthetic oligonucleotide; GGG chr2 60550070 60550089 60550086 +
tgctttgcatgggggtgagg

SEQ ID NO: 169685 - DNA, 20 bp, Artificial Sequence
  Synthetic oligonucleotide; TGG chr2 60550073 60550092 60550089 +
tttgcatgggggtgaggggg

SEQ ID NO: 169686 - DNA, 20 bp, Artificial Sequence
  Synthetic oligonucleotide; AAG chr2 60550076 60550095 60550092 +
gcatgggggtgagggggtgg

SEQ ID NO: 169687 - DNA, 20 bp, Artificial Sequence
  Synthetic oligonucleotide; AAG chr2 60550079 60550098 60550095 +
tgggggtgagggggtggaag

SEQ ID NO: 169688 - DNA, 20 bp, Artificial Sequence
  Synthetic oligonucleotide; GAG chr2 60550083 60550102 60550099 +
ggtgagggggtggaagaagt

SEQ ID NO: 169689 - DNA, 20 bp, Artificial Sequence
  Synthetic oligonucleotide; AGG chr2 60550084 60550103 60550100 +
gtgagggggtggaagaagtg

SEQ ID NO: 169690 - DNA, 20 bp, Artificial Sequence
  Synthetic oligonucleotide; TGG chr2 60550088 60550107 60550104 +
gggggtggaagaagtgaggc

SEQ ID NO: 169691 - DNA, 20 bp, Artificial Sequence
  Synthetic oligonucleotide; GAG chr2 60550090 60550109 60550106 +
gggtggaagaagtgaggctg

SEQ ID NO: 169692 - DNA, 20 bp, Artificial Sequence
  Synthetic oligonucleotide; AAG chr2 60550096 60550115 60550112 +
aagaagtgaggctggagacc

SEQ ID NO: 169693 - DNA, 20 bp, Artificial Sequence
  Synthetic oligonucleotide; CGG chr2 60550124 60550143 60550140 +
acttgccatatccccctctt

SEQ ID NO: 169694 - DNA, 20 bp, Artificial Sequence
  Synthetic oligonucleotide; AAG chr2 60550137 60550156 60550153 +
ccctcttcggccatgccccg

SEQ ID NO: 169695 - DNA, 20 bp, Artificial Sequence
  Synthetic oligonucleotide; TAG chr2 60550143 60550162 60550159 +
tcggccatgccccgaagccc

SEQ ID NO: 169696 - DNA, 20 bp, Artificial Sequence
  Synthetic oligonucleotide; GAG chr2 60550145 60550164 60550161 +
ggccatgccccgaagcccta

SEQ ID NO: 169697 - DNA, 20 bp, Artificial Sequence
  Synthetic oligonucleotide; CGG chr2 60550158 60550177 60550174 +
agccctagagcgcgcactcc

SEQ ID NO: 169698 - DNA, 20 bp, Artificial Sequence
  Synthetic oligonucleotide; CGG chr2 60550181 60550200 60550197 +
ttcctccctaccaaaaatgc

SEQ ID NO: 169699 - DNA, 20 bp, Artificial Sequence
  Synthetic oligonucleotide; AAG chr2 60550190 60550209 60550206 +
accaaaaatgccggccccga

SEQ ID NO: 169700 - DNA, 20 bp, Artificial Sequence
  Synthetic oligonucleotide; AAG chr2 60550194 60550213 60550210 +
aaaatgccggccccgaaaga

SEQ ID NO: 169701 - DNA, 20 bp, Artificial Sequence
  Synthetic oligonucleotide; GAG chr2 60550217 60550236 60550233 +
cgaaaactgcaccgtgctcc

SEQ ID NO: 169702 - DNA, 20 bp, Artificial Sequence
  Synthetic oligonucleotide; CGG chr2 60550222 60550241 60550238 +
actgcaccgtgctccgagcc

SEQ ID NO: 169703 - DNA, 20 bp, Artificial Sequence
  Synthetic oligonucleotide; TGG chr2 60550232 60550251 60550248 +
gctccgagcccggcgcgcgc

SEQ ID NO: 169704 - DNA, 20 bp, Artificial Sequence
  Synthetic oligonucleotide; CAG chr2 60550238 60550257 60550254 +
agcccggcgcgcgctggtct

SEQ ID NO: 169705 - DNA, 20 bp, Artificial Sequence
  Synthetic oligonucleotide; CGG chr2 60550249 60550268 60550265 +
cgctggtctcagctcgcgca

SEQ ID NO: 169706 - DNA, 20 bp, Artificial Sequence
  Synthetic oligonucleotide; GGG chr2 60550250 60550269 60550266 +
gctggtctcagctcgcgcac

SEQ ID NO: 169707 - DNA, 20 bp, Artificial Sequence
  Synthetic oligonucleotide; GGG chr2 60550251 60550270 60550267 +
ctggtctcagctcgcgcacg

SEQ ID NO: 169708 - DNA, 20 bp, Artificial Sequence
  Synthetic oligonucleotide; GGG chr2 60550252 60550271 60550268 +
tggtctcagctcgcgcacgg

SEQ ID NO: 169709 - DNA, 20 bp, Artificial Sequence
  Synthetic oligonucleotide; CGG chr2 60550258 60550277 60550274 +
cagctcgcgcacgggggtgt

SEQ ID NO: 169710 - DNA, 20 bp, Artificial Sequence
  Synthetic oligonucleotide; CGG chr2 60550270 60550289 60550286 +
gggggtgtcggccgcgcgcc

SEQ ID NO: 169711 - DNA, 20 bp, Artificial Sequence
  Synthetic oligonucleotide; CGG chr2 60550284 60550303 60550300 +
cgcgcccggtcgcttctccg

SEQ ID NO: 169712 - DNA, 20 bp, Artificial Sequence
  Synthetic oligonucleotide; CGG chr2 60550290 60550309 60550306 +
cggtcgcttctccgcggccc

SEQ ID NO: 169713 - DNA, 20 bp, Artificial Sequence
  Synthetic oligonucleotide; CAG chr2 60550294 60550313 60550310 +
cgcttctccgcggccccggc

SEQ ID NO: 169714 - DNA, 20 bp, Artificial Sequence
  Synthetic oligonucleotide; AAG chr2 60550297 60550316 60550313 +
ttctccgcggccccggccag

SEQ ID NO: 169715 - DNA, 20 bp, Artificial Sequence
  Synthetic oligonucleotide; AAG chr2 60550308 60550327 60550324 +
cccggccagaagcattttta

SEQ ID NO: 169716 - DNA, 20 bp, Artificial Sequence
  Synthetic oligonucleotide; AAG chr2 60550319 60550338 60550335 +
gcatttttaaagtcaaaatg

SEQ ID NO: 169717 - DNA, 20 bp, Artificial Sequence
  Synthetic oligonucleotide; AAG chr2 60550326 60550345 60550342 +
taaagtcaaaatgaagaaca

SEQ ID NO: 169718 - DNA, 20 bp, Artificial Sequence
  Synthetic oligonucleotide; CGG chr2 60550334 60550353 60550350 +
aaatgaagaacaaagacata

SEQ ID NO: 169719 - DNA, 20 bp, Artificial Sequence
  Synthetic oligonucleotide; GGG chr2 60550335 60550354 60550351 +
aatgaagaacaaagacatac

SEQ ID NO: 169720 - DNA, 20 bp, Artificial Sequence
  Synthetic oligonucleotide; GGG chr2 60550336 60550355 60550352 +
atgaagaacaaagacatacg

SEQ ID NO: 169721 - DNA, 20 bp, Artificial Sequence
  Synthetic oligonucleotide; TGG chr2 60550342 60550361 60550358 +
aacaaagacatacggggtga

SEQ ID NO: 169722 - DNA, 20 bp, Artificial Sequence
  Synthetic oligonucleotide; GGG chr2 60550343 60550362 60550359 +
acaaagacatacggggtgat

SEQ ID NO: 169723 - DNA, 20 bp, Artificial Sequence
  Synthetic oligonucleotide; GGG chr2 60550344 60550363 60550360 +
caaagacatacggggtgatg

SEQ ID NO: 169724 - DNA, 20 bp, Artificial Sequence
  Synthetic oligonucleotide; GGG chr2 60550345 60550364 60550361 +
aaagacatacggggtgatgg

SEQ ID NO: 169725 - DNA, 20 bp, Artificial Sequence
  Synthetic oligonucleotide; GAG chr2 60550347 60550366 60550363 +
agacatacggggtgatgggg

SEQ ID NO: 169726 - DNA, 20 bp, Artificial Sequence
  Synthetic oligonucleotide; GAG chr2 60550349 60550368 60550365 +
acatacggggtgatggggga

SEQ ID NO: 169727 - DNA, 20 bp, Artificial Sequence
  Synthetic oligonucleotide; AAG chr2 60550353 60550372 60550369 +
acggggtgatgggggagaga

SEQ ID NO: 169728 - DNA, 20 bp, Artificial Sequence
  Synthetic oligonucleotide; AGG chr2 60550354 60550373 60550370 +
cggggtgatgggggagagaa

SEQ ID NO: 169729 - DNA, 20 bp, Artificial Sequence
  Synthetic oligonucleotide; GGG chr2 60550355 60550374 60550371 +
ggggtgatgggggagagaaa

SEQ ID NO: 169730 - DNA, 20 bp, Artificial Sequence
  Synthetic oligonucleotide; AAG chr2 60550400 60550419 60550416 +
cccccacccccaccctcgca

SEQ ID NO: 169731 - DNA, 20 bp, Artificial Sequence
  Synthetic oligonucleotide; CGG chr2 60550415 60550434 60550431 +
tcgcaaagctcgttcctccc

SEQ ID NO: 169732 - DNA, 20 bp, Artificial Sequence
  Synthetic oligonucleotide; GAG chr2 60550420 60550439 60550436 +
aagctcgttcctccccggac

SEQ ID NO: 169733 - DNA, 20 bp, Artificial Sequence
  Synthetic oligonucleotide; CGG chr2 60550429 60550448 60550445 +
cctccccggacgagaatcgc

SEQ ID NO: 169734 - DNA, 20 bp, Artificial Sequence
  Synthetic oligonucleotide; GGG chr2 60550430 60550449 60550446 +
ctccccggacgagaatcgcc

SEQ ID NO: 169735 - DNA, 20 bp, Artificial Sequence
  Synthetic oligonucleotide; CAG chr2 60550433 60550452 60550449 +
cccggacgagaatcgccggg

SEQ ID NO: 169736 - DNA, 20 bp, Artificial Sequence
  Synthetic oligonucleotide; AGG chr2 60550434 60550453 60550450 +
ccggacgagaatcgccgggc

SEQ ID NO: 169737 - DNA, 20 bp, Artificial Sequence
  Synthetic oligonucleotide; GAG chr2 60550436 60550455 60550452 +
ggacgagaatcgccgggcag

SEQ ID NO: 169738 - DNA, 20 bp, Artificial Sequence
  Synthetic oligonucleotide; AGG chr2 60550437 60550456 60550453 +
gacgagaatcgccgggcagg

SEQ ID NO: 169739 - DNA, 20 bp, Artificial Sequence
  Synthetic oligonucleotide; TGG chr2 60550440 60550459 60550456 +
gagaatcgccgggcaggagg

SEQ ID NO: 169740 - DNA, 20 bp, Artificial Sequence
  Synthetic oligonucleotide; GGG chr2 60550441 60550460 60550457 +
agaatcgccgggcaggaggt

SEQ ID NO: 169741 - DNA, 20 bp, Artificial Sequence
  Synthetic oligonucleotide; GGG chr2 60550442 60550461 60550458 +
gaatcgccgggcaggaggtg

SEQ ID NO: 169742 - DNA, 20 bp, Artificial Sequence
  Synthetic oligonucleotide; GGG chr2 60550443 60550462 60550459 +
aatcgccgggcaggaggtgg

SEQ ID NO: 169743 - DNA, 20 bp, Artificial Sequence
  Synthetic oligonucleotide; GAG chr2 60550445 60550464 60550461 +
tcgccgggcaggaggtgggg

SEQ ID NO: 169744 - DNA, 20 bp, Artificial Sequence
  Synthetic oligonucleotide; AGG chr2 60550446 60550465 60550462 +
cgccgggcaggaggtggggg

SEQ ID NO: 169745 - DNA, 20 bp, Artificial Sequence
  Synthetic oligonucleotide; TGG chr2 60550452 60550471 60550468 +
gcaggaggtgggggaggctc

SEQ ID NO: 169746 - DNA, 20 bp, Artificial Sequence
  Synthetic oligonucleotide; CAG chr2 60550457 60550476 60550473 +
aggtgggggaggctctggta

SEQ ID NO: 169747 - DNA, 20 bp, Artificial Sequence
  Synthetic oligonucleotide; AGG chr2 60550458 60550477 60550474 +
ggtgggggaggctctggtac

SEQ ID NO: 169748 - DNA, 20 bp, Artificial Sequence
  Synthetic oligonucleotide; AAG chr2 60550464 60550483 60550480 +
ggaggctctggtacaggttc

SEQ ID NO: 169749 - DNA, 20 bp, Artificial Sequence
  Synthetic oligonucleotide; GAG chr2 60550473 60550492 60550489 +
ggtacaggttcaagttcgct

SEQ ID NO: 169750 - DNA, 20 bp, Artificial Sequence
  Synthetic oligonucleotide; TAG chr2 60550500 60550519 60550516 +
cttgatcttgttctgcctcc

SEQ ID NO: 169751 - DNA, 20 bp, Artificial Sequence
  Synthetic oligonucleotide; TGG chr2 60550511 60550530 60550527 +
tctgcctcctagcgaccgaa

SEQ ID NO: 169752 - DNA, 20 bp, Artificial Sequence
  Synthetic oligonucleotide; CAG chr2 60550520 60550539 60550536 +
tagcgaccgaatggctcatt

SEQ ID NO: 169753 - DNA, 20 bp, Artificial Sequence
  Synthetic oligonucleotide; TAG chr2 60550529 60550548 60550545 +
aatggctcattcagcccaca

SEQ ID NO: 169754 - DNA, 20 bp, Artificial Sequence
  Synthetic oligonucleotide; CAG chr2 60550532 60550551 60550548 +
ggctcattcagcccacatag

SEQ ID NO: 169755 - DNA, 20 bp, Artificial Sequence
  Synthetic oligonucleotide; GAG chr2 60550534 60550553 60550550 +
ctcattcagcccacatagca

SEQ ID NO: 169756 - DNA, 20 bp, Artificial Sequence
  Synthetic oligonucleotide; AGG chr2 60550535 60550554 60550551 +
tcattcagcccacatagcag

SEQ ID NO: 169757 - DNA, 20 bp, Artificial Sequence
  Synthetic oligonucleotide; CGG chr2 60550538 60550557 60550554 +
ttcagcccacatagcagagg

SEQ ID NO: 169758 - DNA, 20 bp, Artificial Sequence
  Synthetic oligonucleotide; GGG chr2 60550539 60550558 60550555 +
tcagcccacatagcagaggc

SEQ ID NO: 169759 - DNA, 20 bp, Artificial Sequence
  Synthetic oligonucleotide; GGG chr2 60550540 60550559 60550556 +
cagcccacatagcagaggcg

SEQ ID NO: 169760 - DNA, 20 bp, Artificial Sequence
  Synthetic oligonucleotide; GGG chr2 60550541 60550560 60550557 +
agcccacatagcagaggcgg

SEQ ID NO: 169761 - DNA, 20 bp, Artificial Sequence
  Synthetic oligonucleotide; GGG chr2 60550542 60550561 60550558 +
gcccacatagcagaggcggg

SEQ ID NO: 169762 - DNA, 20 bp, Artificial Sequence
  Synthetic oligonucleotide; CGG chr2 60550545 60550564 60550561 +
cacatagcagaggcgggggg

SEQ ID NO: 169763 - DNA, 20 bp, Artificial Sequence
  Synthetic oligonucleotide; GGG chr2 60550546 60550565 60550562 +
acatagcagaggcggggggc

SEQ ID NO: 169764 - DNA, 20 bp, Artificial Sequence
  Synthetic oligonucleotide; GGG chr2 60550547 60550566 60550563 +
catagcagaggcggggggcg

SEQ ID NO: 169765 - DNA, 20 bp, Artificial Sequence
  Synthetic oligonucleotide; GGG chr2 60550548 60550567 60550564 +
atagcagaggcggggggcgg

SEQ ID NO: 169766 - DNA, 20 bp, Artificial Sequence
  Synthetic oligonucleotide; GGG chr2 60550549 60550568 60550565 +
tagcagaggcggggggcggg

SEQ ID NO: 169767 - DNA, 20 bp, Artificial Sequence
  Synthetic oligonucleotide; GGG chr2 60550550 60550569 60550566 +
agcagaggcggggggcgggg

SEQ ID NO: 169768 - DNA, 20 bp, Artificial Sequence
  Synthetic oligonucleotide; TGG chr2 60550553 60550572 60550569 +
agaggcggggggcggggggg

SEQ ID NO: 169769 - DNA, 20 bp, Artificial Sequence
  Synthetic oligonucleotide; GAG chr2 60550560 60550579 60550576 +
gggggcgggggggtggtact

SEQ ID NO: 169770 - DNA, 20 bp, Artificial Sequence
  Synthetic oligonucleotide; AGG chr2 60550561 60550580 60550577 +
ggggcgggggggtggtactg

SEQ ID NO: 169771 - DNA, 20 bp, Artificial Sequence
  Synthetic oligonucleotide; CGG chr2 60550566 60550585 60550582 +
gggggggtggtactgaggac

SEQ ID NO: 169772 - DNA, 20 bp, Artificial Sequence
  Synthetic oligonucleotide; GGG chr2 60550567 60550586 60550583 +
ggggggtggtactgaggacc

SEQ ID NO: 169773 - DNA, 20 bp, Artificial Sequence
  Synthetic oligonucleotide; TGG chr2 60550571 60550590 60550587 +
ggtggtactgaggaccggga

SEQ ID NO: 169774 - DNA, 20 bp, Artificial Sequence
  Synthetic oligonucleotide; GAG chr2 60550588 60550607 60550604 +
ggatggctcctgccccctct

SEQ ID NO: 169775 - DNA, 20 bp, Artificial Sequence
  Synthetic oligonucleotide; CAG chr2 60550595 60550614 60550611 +
tcctgccccctctgagcacc

SEQ ID NO: 169776 - DNA, 20 bp, Artificial Sequence
  Synthetic oligonucleotide; GAG chr2 60550603 60550622 60550619 +
cctctgagcacccagaaaat

SEQ ID NO: 169777 - DNA, 20 bp, Artificial Sequence
  Synthetic oligonucleotide; AGG chr2 60550604 60550623 60550620 +
ctctgagcacccagaaaatg

SEQ ID NO: 169778 - DNA, 20 bp, Artificial Sequence
  Synthetic oligonucleotide; CAG chr2 60550608 60550627 60550624 +
gagcacccagaaaatgagga

SEQ ID NO: 169779 - DNA, 20 bp, Artificial Sequence
  Synthetic oligonucleotide; AAG chr2 60550612 60550631 60550628 +
acccagaaaatgaggacaga

SEQ ID NO: 169780 - DNA, 20 bp, Artificial Sequence
  Synthetic oligonucleotide; AAG chr2 60550615 60550634 60550631 +
cagaaaatgaggacagaaag

SEQ ID NO: 169781 - DNA, 20 bp, Artificial Sequence
  Synthetic oligonucleotide; TGG chr2 60550618 60550637 60550634 +
aaaatgaggacagaaagaag

SEQ ID NO: 169782 - DNA, 20 bp, Artificial Sequence
  Synthetic oligonucleotide; TGG chr2 60550642 60550661 60550658 +
cccctcaccccctcccaaac

SEQ ID NO: 169783 - DNA, 20 bp, Artificial Sequence
  Synthetic oligonucleotide; CGG chr2 60550656 60550675 60550672 +
ccaaactggccctttaaccc

SEQ ID NO: 169784 - DNA, 20 bp, Artificial Sequence
  Synthetic oligonucleotide; GGG chr2 60550657 60550676 60550673 +
caaactggccctttaacccc

SEQ ID NO: 169785 - DNA, 20 bp, Artificial Sequence
  Synthetic oligonucleotide; CAG chr2 60550661 60550680 60550677 +
ctggccctttaaccccggga

SEQ ID NO: 169786 - DNA, 20 bp, Artificial Sequence
  Synthetic oligonucleotide; AGG chr2 60550662 60550681 60550678 +
tggccctttaaccccgggac

SEQ ID NO: 169787 - DNA, 20 bp, Artificial Sequence
  Synthetic oligonucleotide; GAG chr2 60550664 60550683 60550680 +
gccctttaaccccgggacag

SEQ ID NO: 169788 - DNA, 20 bp, Artificial Sequence
  Synthetic oligonucleotide; AGG chr2 60550665 60550684 60550681 +
ccctttaaccccgggacagg

SEQ ID NO: 169789 - DNA, 20 bp, Artificial Sequence
  Synthetic oligonucleotide; GAG chr2 60550667 60550686 60550683 +
ctttaaccccgggacaggag

SEQ ID NO: 169790 - DNA, 20 bp, Artificial Sequence
  Synthetic oligonucleotide; AGG chr2 60550668 60550687 60550684 +
tttaaccccgggacaggagg

SEQ ID NO: 169791 - DNA, 20 bp, Artificial Sequence
  Synthetic oligonucleotide; GGG chr2 60550669 60550688 60550685 +
ttaaccccgggacaggagga

SEQ ID NO: 169792 - DNA, 20 bp, Artificial Sequence
  Synthetic oligonucleotide; GGG chr2 60550670 60550689 60550686 +
taaccccgggacaggaggag

SEQ ID NO: 169793 - DNA, 20 bp, Artificial Sequence
  Synthetic oligonucleotide; GGG chr2 60550671 60550690 60550687 +
aaccccgggacaggaggagg

SEQ ID NO: 169794 - DNA, 20 bp, Artificial Sequence
  Synthetic oligonucleotide; CAG chr2 60550686 60550705 60550702 +
ggagggggtactaaccctcc

SEQ ID NO: 169795 - DNA, 20 bp, Artificial Sequence
  Synthetic oligonucleotide; TAG chr2 60550691 60550710 60550707 +
gggtactaaccctcccagcc

SEQ ID NO: 169796 - DNA, 20 bp, Artificial Sequence
  Synthetic oligonucleotide; GAG chr2 60550693 60550712 60550709 +
gtactaaccctcccagccta

SEQ ID NO: 169797 - DNA, 20 bp, Artificial Sequence
  Synthetic oligonucleotide; AAG chr2 60550702 60550721 60550718 +
ctcccagcctagagtgtccc

SEQ ID NO: 169798 - DNA, 20 bp, Artificial Sequence
  Synthetic oligonucleotide; TGG chr2 60550706 60550725 60550722 +
cagcctagagtgtcccaaga

SEQ ID NO: 169799 - DNA, 20 bp, Artificial Sequence
  Synthetic oligonucleotide; CAG chr2 60550712 60550731 60550728 +
agagtgtcccaagatggacc

SEQ ID NO: 169800 - DNA, 20 bp, Artificial Sequence
  Synthetic oligonucleotide; AGG chr2 60550713 60550732 60550729 +
gagtgtcccaagatggaccc

SEQ ID NO: 169801 - DNA, 20 bp, Artificial Sequence
  Synthetic oligonucleotide; GAG chr2 60550715 60550734 60550731 +
gtgtcccaagatggacccag

SEQ ID NO: 169802 - DNA, 20 bp, Artificial Sequence
  Synthetic oligonucleotide; AGG chr2 60550716 60550735 60550732 +
tgtcccaagatggacccagg

SEQ ID NO: 169803 - DNA, 20 bp, Artificial Sequence
  Synthetic oligonucleotide; GGG chr2 60550717 60550736 60550733 +
gtcccaagatggacccagga

SEQ ID NO: 169804 - DNA, 20 bp, Artificial Sequence
  Synthetic oligonucleotide; GAG chr2 60550719 60550738 60550735 +
cccaagatggacccaggagg

SEQ ID NO: 169805 - DNA, 20 bp, Artificial Sequence
  Synthetic oligonucleotide; GAG chr2 60550721 60550740 60550737 +
caagatggacccaggaggga

SEQ ID NO: 169806 - DNA, 20 bp, Artificial Sequence
  Synthetic oligonucleotide; AGG chr2 60550722 60550741 60550738 +
aagatggacccaggagggag

SEQ ID NO: 169807 - DNA, 20 bp, Artificial Sequence
  Synthetic oligonucleotide; GGG chr2 60550723 60550742 60550739 +
agatggacccaggagggaga

SEQ ID NO: 169808 - DNA, 20 bp, Artificial Sequence
  Synthetic oligonucleotide; GGG chr2 60550724 60550743 60550740 +
gatggacccaggagggagag

SEQ ID NO: 169809 - DNA, 20 bp, Artificial Sequence
  Synthetic oligonucleotide; GAG chr2 60550730 60550749 60550746 +
cccaggagggagaggggtac

SEQ ID NO: 169810 - DNA, 20 bp, Artificial Sequence
  Synthetic oligonucleotide; AGG chr2 60550731 60550750 60550747 +
ccaggagggagaggggtacg

SEQ ID NO: 169811 - DNA, 20 bp, Artificial Sequence
  Synthetic oligonucleotide; GGG chr2 60550732 60550751 60550748 +
caggagggagaggggtacga

SEQ ID NO: 169812 - DNA, 20 bp, Artificial Sequence
  Synthetic oligonucleotide; GAG chr2 60550734 60550753 60550750 +
ggagggagaggggtacgagg

SEQ ID NO: 169813 - DNA, 20 bp, Artificial Sequence
  Synthetic oligonucleotide; CAG chr2 60550737 60550756 60550753 +
gggagaggggtacgagggag

SEQ ID NO: 169814 - DNA, 20 bp, Artificial Sequence
  Synthetic oligonucleotide; TGG chr2 60550742 60550761 60550758 +
aggggtacgagggagcagcc

SEQ ID NO: 169815 - DNA, 20 bp, Artificial Sequence
  Synthetic oligonucleotide; CGG chr2 60550756 60550775 60550772 +
gcagcctggactgcgcgccc

SEQ ID NO: 169816 - DNA, 20 bp, Artificial Sequence
  Synthetic oligonucleotide; GAG chr2 60550769 60550788 60550785 +
cgcgccccggtctgtccttt

SEQ ID NO: 169817 - DNA, 20 bp, Artificial Sequence
  Synthetic oligonucleotide; AAG chr2 60550791 60550810 60550807 +
gcccccactgcatccttccg

SEQ ID NO: 169818 - DNA, 20 bp, Artificial Sequence
  Synthetic oligonucleotide; AAG chr2 60550794 60550813 60550810 +
cccactgcatccttccgaag

SEQ ID NO: 169819 - DNA, 20 bp, Artificial Sequence
  Synthetic oligonucleotide; AGG chr2 60550795 60550814 60550811 +
ccactgcatccttccgaaga

SEQ ID NO: 169820 - DNA, 20 bp, Artificial Sequence
  Synthetic oligonucleotide; GGG chr2 60550796 60550815 60550812 +
cactgcatccttccgaagaa

SEQ ID NO: 169821 - DNA, 20 bp, Artificial Sequence
  Synthetic oligonucleotide; GAG chr2 60550811 60550830 60550827 +
aagaagggcctgactttccc

SEQ ID NO: 169822 - DNA, 20 bp, Artificial Sequence
  Synthetic oligonucleotide; CGG chr2 60550842 60550861 60550858 +
acactgcccttccttcccgc

SEQ ID NO: 169823 - DNA, 20 bp, Artificial Sequence
  Synthetic oligonucleotide; TGG chr2 60550849 60550868 60550865 +
ccttccttcccgccggtacc

SEQ ID NO: 169824 - DNA, 20 bp, Artificial Sequence
  Synthetic oligonucleotide; CGG chr2 60550853 60550872 60550869 +
ccttcccgccggtacctggc

SEQ ID NO: 169825 - DNA, 20 bp, Artificial Sequence
  Synthetic oligonucleotide; GGG chr2 60550854 60550873 60550870 +
cttcccgccggtacctggcc

SEQ ID NO: 169826 - DNA, 20 bp, Artificial Sequence
  Synthetic oligonucleotide; CGG chr2 60550898 60550917 60550914 +
cgccgcgtctgatccgcatc

SEQ ID NO: 169827 - DNA, 20 bp, Artificial Sequence
  Synthetic oligonucleotide; CGG chr2 60550903 60550922 60550919 +
cgtctgatccgcatccggcg

SEQ ID NO: 169828 - DNA, 20 bp, Artificial Sequence
  Synthetic oligonucleotide; CGG chr2 60550907 60550926 60550923 +
tgatccgcatccggcgcggc

SEQ ID NO: 169829 - DNA, 20 bp, Artificial Sequence
  Synthetic oligonucleotide; GGG chr2 60550908 60550927 60550924 +
gatccgcatccggcgcggcc

SEQ ID NO: 169830 - DNA, 20 bp, Artificial Sequence
  Synthetic oligonucleotide; GGG chr2 60550909 60550928 60550925 +
atccgcatccggcgcggccg

SEQ ID NO: 169831 - DNA, 20 bp, Artificial Sequence
  Synthetic oligonucleotide; GGG chr2 60550910 60550929 60550926 +
tccgcatccggcgcggccgg

SEQ ID NO: 169832 - DNA, 20 bp, Artificial Sequence
  Synthetic oligonucleotide; GAG chr2 60550912 60550931 60550928 +
cgcatccggcgcggccgggg

SEQ ID NO: 169833 - DNA, 20 bp, Artificial Sequence
  Synthetic oligonucleotide; TGG chr2 60550916 60550935 60550932 +
tccggcgcggccgggggagt

SEQ ID NO: 169834 - DNA, 20 bp, Artificial Sequence
  Synthetic oligonucleotide; GGG chr2 60550917 60550936 60550933 +
ccggcgcggccgggggagtt

SEQ ID NO: 169835 - DNA, 20 bp, Artificial Sequence
  Synthetic oligonucleotide; GGG chr2 60550918 60550937 60550934 +
cggcgcggccgggggagttg

SEQ ID NO: 169836 - DNA, 20 bp, Artificial Sequence
  Synthetic oligonucleotide; GGG chr2 60550919 60550938 60550935 +
ggcgcggccgggggagttgg

SEQ ID NO: 169837 - DNA, 20 bp, Artificial Sequence
  Synthetic oligonucleotide; CGG chr2 60550922 60550941 60550938 +
gcggccgggggagttggggg

SEQ ID NO: 169838 - DNA, 20 bp, Artificial Sequence
  Synthetic oligonucleotide; GGG chr2 60550923 60550942 60550939 +
cggccgggggagttgggggc

SEQ ID NO: 169839 - DNA, 20 bp, Artificial Sequence
  Synthetic oligonucleotide; GGG chr2 60550924 60550943 60550940 +
ggccgggggagttgggggcg

SEQ ID NO: 169840 - DNA, 20 bp, Artificial Sequence
  Synthetic oligonucleotide; GGG chr2 60550925 60550944 60550941 +
gccgggggagttgggggcgg

SEQ ID NO: 169841 - DNA, 20 bp, Artificial Sequence
  Synthetic oligonucleotide; GAG chr2 60550927 60550946 60550943 +
cgggggagttgggggcgggg

SEQ ID NO: 169842 - DNA, 20 bp, Artificial Sequence
  Synthetic oligonucleotide; GAG chr2 60550929 60550948 60550945 +
ggggagttgggggcggggga

SEQ ID NO: 169843 - DNA, 20 bp, Artificial Sequence
  Synthetic oligonucleotide; CGG chr2 60550932 60550951 60550948 +
gagttgggggcgggggagag

SEQ ID NO: 169844 - DNA, 20 bp, Artificial Sequence
  Synthetic oligonucleotide; GAG chr2 60550936 60550955 60550952 +
tgggggcgggggagagcggc

SEQ ID NO: 169845 - DNA, 20 bp, Artificial Sequence
  Synthetic oligonucleotide; AGG chr2 60550937 60550956 60550953 +
gggggcgggggagagcggcg

SEQ ID NO: 169846 - DNA, 20 bp, Artificial Sequence
  Synthetic oligonucleotide; GGG chr2 60550938 60550957 60550954 +
ggggcgggggagagcggcga

SEQ ID NO: 169847 - DNA, 20 bp, Artificial Sequence
  Synthetic oligonucleotide; GAG chr2 60550940 60550959 60550956 +
ggcgggggagagcggcgagg

SEQ ID NO: 169848 - DNA, 20 bp, Artificial Sequence
  Synthetic oligonucleotide; AGG chr2 60550941 60550960 60550957 +
gcgggggagagcggcgaggg

SEQ ID NO: 169849 - DNA, 20 bp, Artificial Sequence
  Synthetic oligonucleotide; GGG chr2 60550942 60550961 60550958 +
cgggggagagcggcgaggga

SEQ ID NO: 169850 - DNA, 20 bp, Artificial Sequence
  Synthetic oligonucleotide; GAG chr2 60550949 60550968 60550965 +
gagcggcgagggagggatgc

SEQ ID NO: 169851 - DNA, 20 bp, Artificial Sequence
  Synthetic oligonucleotide; AGG chr2 60550950 60550969 60550966 +
agcggcgagggagggatgcg

SEQ ID NO: 169852 - DNA, 20 bp, Artificial Sequence
  Synthetic oligonucleotide; GGG chr2 60550951 60550970 60550967 +
gcggcgagggagggatgcga

SEQ ID NO: 169853 - DNA, 20 bp, Artificial Sequence
  Synthetic oligonucleotide; GGG chr2 60550952 60550971 60550968 +
cggcgagggagggatgcgag

SEQ ID NO: 169854 - DNA, 20 bp, Artificial Sequence
  Synthetic oligonucleotide; GGG chr2 60550953 60550972 60550969 +
ggcgagggagggatgcgagg

SEQ ID NO: 169855 - DNA, 20 bp, Artificial Sequence
  Synthetic oligonucleotide; TGG chr2 60550956 60550975 60550972 +
gagggagggatgcgaggggg

SEQ ID NO: 169856 - DNA, 20 bp, Artificial Sequence
  Synthetic oligonucleotide; GGG chr2 60550957 60550976 60550973 +
agggagggatgcgagggggt

SEQ ID NO: 169857 - DNA, 20 bp, Artificial Sequence
  Synthetic oligonucleotide; GGG chr2 60550958 60550977 60550974 +
gggagggatgcgagggggtg

SEQ ID NO: 169858 - DNA, 20 bp, Artificial Sequence
  Synthetic oligonucleotide; GAG chr2 60550960 60550979 60550976 +
gagggatgcgagggggtggg

SEQ ID NO: 169859 - DNA, 20 bp, Artificial Sequence
  Synthetic oligonucleotide; GAG chr2 60550962 60550981 60550978 +
gggatgcgagggggtgggga

SEQ ID NO: 169860 - DNA, 20 bp, Artificial Sequence
  Synthetic oligonucleotide; AGG chr2 60550963 60550982 60550979 +
ggatgcgagggggtggggag

SEQ ID NO: 169861 - DNA, 20 bp, Artificial Sequence
  Synthetic oligonucleotide; GGG chr2 60550964 60550983 60550980 +
gatgcgagggggtggggaga

SEQ ID NO: 169862 - DNA, 20 bp, Artificial Sequence
  Synthetic oligonucleotide; GAG chr2 60550966 60550985 60550982 +
tgcgagggggtggggagagg

SEQ ID NO: 169863 - DNA, 20 bp, Artificial Sequence
  Synthetic oligonucleotide; AGG chr2 60550967 60550986 60550983 +
gcgagggggtggggagaggg

SEQ ID NO: 169864 - DNA, 20 bp, Artificial Sequence
  Synthetic oligonucleotide; GGG chr2 60550968 60550987 60550984 +
cgagggggtggggagaggga

SEQ ID NO: 169865 - DNA, 20 bp, Artificial Sequence
  Synthetic oligonucleotide; CGG chr2 60550984 60551003 60551000 +
gggagggccgcgcaacgtgc

SEQ ID NO: 169866 - DNA, 20 bp, Artificial Sequence
  Synthetic oligonucleotide; GGG chr2 60550985 60551004 60551001 +
ggagggccgcgcaacgtgcc

SEQ ID NO: 169867 - DNA, 20 bp, Artificial Sequence
  Synthetic oligonucleotide; GGG chr2 60550986 60551005 60551002 +
gagggccgcgcaacgtgccg

SEQ ID NO: 169868 - DNA, 20 bp, Artificial Sequence
  Synthetic oligonucleotide; TGG chr2 60550989 60551008 60551005 +
ggccgcgcaacgtgccgggg

SEQ ID NO: 169869 - DNA, 20 bp, Artificial Sequence
  Synthetic oligonucleotide; GGG chr2 60550990 60551009 60551006 +
gccgcgcaacgtgccggggt

SEQ ID NO: 169870 - DNA, 20 bp, Artificial Sequence
  Synthetic oligonucleotide; GGG chr2 60550991 60551010 60551007 +
ccgcgcaacgtgccggggtg

SEQ ID NO: 169871 - DNA, 20 bp, Artificial Sequence
  Synthetic oligonucleotide; GGG chr2 60550992 60551011 60551008 +
cgcgcaacgtgccggggtgg

SEQ ID NO: 169872 - DNA, 20 bp, Artificial Sequence
  Synthetic oligonucleotide; GAG chr2 60550994 60551013 60551010 +
cgcaacgtgccggggtgggg

SEQ ID NO: 169873 - DNA, 20 bp, Artificial Sequence
  Synthetic oligonucleotide; AAG chr2 60551003 60551022 60551019 +
ccggggtgggggagcttccg

SEQ ID NO: 169874 - DNA, 20 bp, Artificial Sequence
  Synthetic oligonucleotide; AAG chr2 60551014 60551033 60551030 +
gagcttccgaagtgtgtgac

SEQ ID NO: 169875 - DNA, 20 bp, Artificial Sequence
  Synthetic oligonucleotide; CAG chr2 60551020 60551039 60551036 +
ccgaagtgtgtgacaagttc

SEQ ID NO: 169876 - DNA, 20 bp, Artificial Sequence
  Synthetic oligonucleotide; AGG chr2 60551021 60551040 60551037 +
cgaagtgtgtgacaagttcc

SEQ ID NO: 169877 - DNA, 20 bp, Artificial Sequence
  Synthetic oligonucleotide; GGG chr2 60551022 60551041 60551038 +
gaagtgtgtgacaagttcca

SEQ ID NO: 169878 - DNA, 20 bp, Artificial Sequence
  Synthetic oligonucleotide; CAG chr2 60551027 60551046 60551043 +
gtgtgacaagttccagggcc

SEQ ID NO: 169879 - DNA, 20 bp, Artificial Sequence
  Synthetic oligonucleotide; CAG chr2 60551084 60551103 60551100 +
accacccctttaaaaaaaca

SEQ ID NO: 169880 - DNA, 20 bp, Artificial Sequence
  Synthetic oligonucleotide; AAG chr2 60551091 60551110 60551107 +
ctttaaaaaaacacagaacc

SEQ ID NO: 169881 - DNA, 20 bp, Artificial Sequence
  Synthetic oligonucleotide; TAG chr2 60551096 60551115 60551112 +
aaaaaacacagaaccaagta

SEQ ID NO: 169882 - DNA, 20 bp, Artificial Sequence
  Synthetic oligonucleotide; AGG chr2 60551097 60551116 60551113 +
aaaaacacagaaccaagtat

SEQ ID NO: 169883 - DNA, 20 bp, Artificial Sequence
  Synthetic oligonucleotide; TGG chr2 60551100 60551119 60551116 +
aacacagaaccaagtatagg

SEQ ID NO: 169884 - DNA, 20 bp, Artificial Sequence
  Synthetic oligonucleotide; AAG chr2 60551129 60551148 60551145 +
aaaactgcatcaaaaattta

SEQ ID NO: 169885 - DNA, 20 bp, Artificial Sequence
  Synthetic oligonucleotide; AAG chr2 60551133 60551152 60551149 +
ctgcatcaaaaatttaaagt

SEQ ID NO: 169886 - DNA, 20 bp, Artificial Sequence
  Synthetic oligonucleotide; GAG chr2 60551147 60551166 60551163 +
taaagtaagaatcataaatt

SEQ ID NO: 169887 - DNA, 20 bp, Artificial Sequence
  Synthetic oligonucleotide; TAG chr2 60551150 60551169 60551166 +
agtaagaatcataaattgag

SEQ ID NO: 169888 - DNA, 20 bp, Artificial Sequence
  Synthetic oligonucleotide; AGG chr2 60551151 60551170 60551167 +
gtaagaatcataaattgagt

SEQ ID NO: 169889 - DNA, 20 bp, Artificial Sequence
  Synthetic oligonucleotide; GGG chr2 60551152 60551171 60551168 +
taagaatcataaattgagta

SEQ ID NO: 169890 - DNA, 20 bp, Artificial Sequence
  Synthetic oligonucleotide; GGG chr2 60551153 60551172 60551169 +
aagaatcataaattgagtag

SEQ ID NO: 169891 - DNA, 20 bp, Artificial Sequence
  Synthetic oligonucleotide; GGG chr2 60551154 60551173 60551170 +
agaatcataaattgagtagg

SEQ ID NO: 169892 - DNA, 20 bp, Artificial Sequence
  Synthetic oligonucleotide; GGG chr2 60551155 60551174 60551171 +
gaatcataaattgagtaggg

SEQ ID NO: 169893 - DNA, 20 bp, Artificial Sequence
  Synthetic oligonucleotide; GGG chr2 60551156 60551175 60551172 +
aatcataaattgagtagggg

SEQ ID NO: 169894 - DNA, 20 bp, Artificial Sequence
  Synthetic oligonucleotide; TGG chr2 60551163 60551182 60551179 +
aattgagtagggggggaatg

SEQ ID NO: 169895 - DNA, 20 bp, Artificial Sequence
  Synthetic oligonucleotide; GGG chr2 60551164 60551183 60551180 +
attgagtagggggggaatgt

SEQ ID NO: 169896 - DNA, 20 bp, Artificial Sequence
  Synthetic oligonucleotide; AAG chr2 60551205 60551224 60551221 +
ccttgctgccaaactttcct

SEQ ID NO: 169897 - DNA, 20 bp, Artificial Sequence
  Synthetic oligonucleotide; CAG chr2 60551227 60551246 60551243 +
gtgcccaccgcccgcctttc

SEQ ID NO: 169898 - DNA, 20 bp, Artificial Sequence
  Synthetic oligonucleotide; AGG chr2 60551228 60551247 60551244 +
tgcccaccgcccgcctttcc

SEQ ID NO: 169899 - DNA, 20 bp, Artificial Sequence
  Synthetic oligonucleotide; CAG chr2 60551233 60551252 60551249 +
accgcccgcctttccaggcg

SEQ ID NO: 169900 - DNA, 20 bp, Artificial Sequence
  Synthetic oligonucleotide; CAG chr2 60551237 60551256 60551253 +
cccgcctttccaggcgcagt

SEQ ID NO: 169901 - DNA, 20 bp, Artificial Sequence
  Synthetic oligonucleotide; CGG chr2 60551240 60551259 60551256 +
gcctttccaggcgcagtcag

SEQ ID NO: 169902 - DNA, 20 bp, Artificial Sequence
  Synthetic oligonucleotide; GGG chr2 60551241 60551260 60551257 +
cctttccaggcgcagtcagc

SEQ ID NO: 169903 - DNA, 20 bp, Artificial Sequence
  Synthetic oligonucleotide; GAG chr2 60551243 60551262 60551259 +
tttccaggcgcagtcagcgg

SEQ ID NO: 169904 - DNA, 20 bp, Artificial Sequence
  Synthetic oligonucleotide; CAG chr2 60551247 60551266 60551263 +
caggcgcagtcagcgggaga

SEQ ID NO: 169905 - DNA, 20 bp, Artificial Sequence
  Synthetic oligonucleotide; CAG chr2 60551260 60551279 60551276 +
cgggagacagccaccaccac

SEQ ID NO: 169906 - DNA, 20 bp, Artificial Sequence
  Synthetic oligonucleotide; CAG chr2 60551271 60551290 60551287 +
caccaccaccagctcttata

SEQ ID NO: 169907 - DNA, 20 bp, Artificial Sequence
  Synthetic oligonucleotide; AAG chr2 60551280 60551299 60551296 +
cagctcttatacagactcac

SEQ ID NO: 169908 - DNA, 20 bp, Artificial Sequence
  Synthetic oligonucleotide; CAG chr2 60551288 60551307 60551304 +
atacagactcacaagaacct

SEQ ID NO: 169909 - DNA, 20 bp, Artificial Sequence
  Synthetic oligonucleotide; AAG chr2 60551294 60551313 60551310 +
actcacaagaacctcagacc

SEQ ID NO: 169910 - DNA, 20 bp, Artificial Sequence
  Synthetic oligonucleotide; CAG chr2 60551298 60551317 60551314 +
acaagaacctcagaccaagc

SEQ ID NO: 169911 - DNA, 20 bp, Artificial Sequence
  Synthetic oligonucleotide; AGG chr2 60551299 60551318 60551315 +
caagaacctcagaccaagcc

SEQ ID NO: 169912 - DNA, 20 bp, Artificial Sequence
  Synthetic oligonucleotide; TGG chr2 60551304 60551323 60551320 +
acctcagaccaagccaggcc

SEQ ID NO: 169913 - DNA, 20 bp, Artificial Sequence
  Synthetic oligonucleotide; GGG chr2 60551305 60551324 60551321 +
cctcagaccaagccaggcct

SEQ ID NO: 169914 - DNA, 20 bp, Artificial Sequence
  Synthetic oligonucleotide; GGG chr2 60551306 60551325 60551322 +
ctcagaccaagccaggcctg

SEQ ID NO: 169915 - DNA, 20 bp, Artificial Sequence
  Synthetic oligonucleotide; AAG chr2 60551309 60551328 60551325 +
agaccaagccaggcctgggg

SEQ ID NO: 169916 - DNA, 20 bp, Artificial Sequence
  Synthetic oligonucleotide; GAG chr2 60551311 60551330 60551327 +
accaagccaggcctggggaa

SEQ ID NO: 169917 - DNA, 20 bp, Artificial Sequence
  Synthetic oligonucleotide; AGG chr2 60551312 60551331 60551328 +
ccaagccaggcctggggaag

SEQ ID NO: 169918 - DNA, 20 bp, Artificial Sequence
  Synthetic oligonucleotide; GGG chr2 60551313 60551332 60551329 +
caagccaggcctggggaaga

SEQ ID NO: 169919 - DNA, 20 bp, Artificial Sequence
  Synthetic oligonucleotide; AAG chr2 60551317 60551336 60551333 +
ccaggcctggggaagagggc

SEQ ID NO: 169920 - DNA, 20 bp, Artificial Sequence
  Synthetic oligonucleotide; AAG chr2 60551325 60551344 60551341 +
ggggaagagggcaagaccca

SEQ ID NO: 169921 - DNA, 20 bp, Artificial Sequence
  Synthetic oligonucleotide; AGG chr2 60551326 60551345 60551342 +
gggaagagggcaagacccaa

SEQ ID NO: 169922 - DNA, 20 bp, Artificial Sequence
  Synthetic oligonucleotide; GGG chr2 60551327 60551346 60551343 +
ggaagagggcaagacccaaa

SEQ ID NO: 169923 - DNA, 20 bp, Artificial Sequence
  Synthetic oligonucleotide; AAG chr2 60551332 60551351 60551348 +
agggcaagacccaaagggtg

SEQ ID NO: 169924 - DNA, 20 bp, Artificial Sequence
  Synthetic oligonucleotide; CGG chr2 60551339 60551358 60551355 +
gacccaaagggtgaagtgct

SEQ ID NO: 169925 - DNA, 20 bp, Artificial Sequence
  Synthetic oligonucleotide; GGG chr2 60551340 60551359 60551356 +
acccaaagggtgaagtgctc

SEQ ID NO: 169926 - DNA, 20 bp, Artificial Sequence
  Synthetic oligonucleotide; GGG chr2 60551341 60551360 60551357 +
cccaaagggtgaagtgctcg

SEQ ID NO: 169927 - DNA, 20 bp, Artificial Sequence
  Synthetic oligonucleotide; CAG chr2 60551347 60551366 60551363 +
gggtgaagtgctcggggtcc

SEQ ID NO: 169928 - DNA, 20 bp, Artificial Sequence
  Synthetic oligonucleotide; AGG chr2 60551348 60551367 60551364 +
ggtgaagtgctcggggtccc

SEQ ID NO: 169929 - DNA, 20 bp, Artificial Sequence
  Synthetic oligonucleotide; CAG chr2 60551354 60551373 60551370 +
gtgctcggggtcccaggatc

SEQ ID NO: 169930 - DNA, 20 bp, Artificial Sequence
  Synthetic oligonucleotide; CGG chr2 60551403 60551422 60551419 +
acttctcccctgcccttccc

SEQ ID NO: 169931 - DNA, 20 bp, Artificial Sequence
  Synthetic oligonucleotide; TGG chr2 60551419 60551438 60551435 +
tccccggcaaccccgccacc

SEQ ID NO: 169932 - DNA, 20 bp, Artificial Sequence
  Synthetic oligonucleotide; TAG chr2 60551424 60551443 60551440 +
ggcaaccccgccacctggcc

SEQ ID NO: 169933 - DNA, 20 bp, Artificial Sequence
  Synthetic oligonucleotide; CGG chr2 60551434 60551453 60551450 +
ccacctggcctagtcgtgct

SEQ ID NO: 169934 - DNA, 20 bp, Artificial Sequence
  Synthetic oligonucleotide; GGG chr2 60551435 60551454 60551451 +
cacctggcctagtcgtgctc

SEQ ID NO: 169935 - DNA, 20 bp, Artificial Sequence
  Synthetic oligonucleotide; GGG chr2 60551436 60551455 60551452 +
acctggcctagtcgtgctcg

SEQ ID NO: 169936 - DNA, 20 bp, Artificial Sequence
  Synthetic oligonucleotide; CAG chr2 60551441 60551460 60551457 +
gcctagtcgtgctcggggcg

SEQ ID NO: 169937 - DNA, 20 bp, Artificial Sequence
  Synthetic oligonucleotide; AGG chr2 60551442 60551461 60551458 +
cctagtcgtgctcggggcgc

SEQ ID NO: 169938 - DNA, 20 bp, Artificial Sequence
  Synthetic oligonucleotide; GGG chr2 60551443 60551462 60551459 +
ctagtcgtgctcggggcgca

SEQ ID NO: 169939 - DNA, 20 bp, Artificial Sequence
  Synthetic oligonucleotide; GGG chr2 60551444 60551463 60551460 +
tagtcgtgctcggggcgcag

SEQ ID NO: 169940 - DNA, 20 bp, Artificial Sequence
  Synthetic oligonucleotide; GGG chr2 60551445 60551464 60551461 +
agtcgtgctcggggcgcagg

SEQ ID NO: 169941 - DNA, 20 bp, Artificial Sequence
  Synthetic oligonucleotide; TGG chr2 60551450 60551469 60551466 +
tgctcggggcgcagggggac

SEQ ID NO: 169942 - DNA, 20 bp, Artificial Sequence
  Synthetic oligonucleotide; CAG chr2 60551457 60551476 60551473 +
ggcgcagggggactggtgac

SEQ ID NO: 169943 - DNA, 20 bp, Artificial Sequence
  Synthetic oligonucleotide; CGG chr2 60551462 60551481 60551478 +
agggggactggtgaccagac

SEQ ID NO: 169944 - DNA, 20 bp, Artificial Sequence
  Synthetic oligonucleotide; GGG chr2 60551463 60551482 60551479 +
gggggactggtgaccagacc

SEQ ID NO: 169945 - DNA, 20 bp, Artificial Sequence
  Synthetic oligonucleotide; CGG chr2 60551466 60551485 60551482 +
ggactggtgaccagaccggg

SEQ ID NO: 169946 - DNA, 20 bp, Artificial Sequence
  Synthetic oligonucleotide; GGG chr2 60551467 60551486 60551483 +
gactggtgaccagaccgggc

SEQ ID NO: 169947 - DNA, 20 bp, Artificial Sequence
  Synthetic oligonucleotide; GGG chr2 60551468 60551487 60551484 +
actggtgaccagaccgggcg

SEQ ID NO: 169948 - DNA, 20 bp, Artificial Sequence
  Synthetic oligonucleotide; TGG chr2 60551471 60551490 60551487 +
ggtgaccagaccgggcgggg

SEQ ID NO: 169949 - DNA, 20 bp, Artificial Sequence
  Synthetic oligonucleotide; GGG chr2 60551472 60551491 60551488 +
gtgaccagaccgggcggggt

SEQ ID NO: 169950 - DNA, 20 bp, Artificial Sequence
  Synthetic oligonucleotide; GGG chr2 60551473 60551492 60551489 +
tgaccagaccgggcggggtg

SEQ ID NO: 169951 - DNA, 20 bp, Artificial Sequence
  Synthetic oligonucleotide; GGG chr2 60551474 60551493 60551490 +
gaccagaccgggcggggtgg

SEQ ID NO: 169952 - DNA, 20 bp, Artificial Sequence
  Synthetic oligonucleotide; GGG chr2 60551475 60551494 60551491 +
accagaccgggcggggtggg

SEQ ID NO: 169953 - DNA, 20 bp, Artificial Sequence
  Synthetic oligonucleotide; TGG chr2 60551478 60551497 60551494 +
agaccgggcggggtgggggg

SEQ ID NO: 169954 - DNA, 20 bp, Artificial Sequence
  Synthetic oligonucleotide; GGG chr2 60551479 60551498 60551495 +
gaccgggcggggtggggggt

SEQ ID NO: 169955 - DNA, 20 bp, Artificial Sequence
  Synthetic oligonucleotide; CAG chr2 60551482 60551501 60551498 +
cgggcggggtggggggtggg

SEQ ID NO: 169956 - DNA, 20 bp, Artificial Sequence
  Synthetic oligonucleotide; AGG chr2 60551483 60551502 60551499 +
gggcggggtggggggtgggc

SEQ ID NO: 169957 - DNA, 20 bp, Artificial Sequence
  Synthetic oligonucleotide; GGG chr2 60551484 60551503 60551500 +
ggcggggtggggggtgggca

SEQ ID NO: 169958 - DNA, 20 bp, Artificial Sequence
  Synthetic oligonucleotide; AAG chr2 60551488 60551507 60551504 +
gggtggggggtgggcaggga

SEQ ID NO: 169959 - DNA, 20 bp, Artificial Sequence
  Synthetic oligonucleotide; TGG chr2 60551495 60551514 60551511 +
gggtgggcagggaaagcacg

SEQ ID NO: 169960 - DNA, 20 bp, Artificial Sequence
  Synthetic oligonucleotide; CGG chr2 60551509 60551528 60551525 +
agcacgtggtgacctcctcg

SEQ ID NO: 169961 - DNA, 20 bp, Artificial Sequence
  Synthetic oligonucleotide; GAG chr2 60551516 60551535 60551532 +
ggtgacctcctcgcggtccc

SEQ ID NO: 169962 - DNA, 20 bp, Artificial Sequence
  Synthetic oligonucleotide; TGG chr2 60551522 60551541 60551538 +
ctcctcgcggtcccgagctg

SEQ ID NO: 169963 - DNA, 20 bp, Artificial Sequence
  Synthetic oligonucleotide; AAG chr2 60551527 60551546 60551543 +
cgcggtcccgagctgtggac

SEQ ID NO: 169964 - DNA, 20 bp, Artificial Sequence
  Synthetic oligonucleotide; GAG chr2 60551529 60551548 60551545 +
cggtcccgagctgtggacaa

SEQ ID NO: 169965 - DNA, 20 bp, Artificial Sequence
  Synthetic oligonucleotide; GAG chr2 60551538 60551557 60551554 +
gctgtggacaagagacgtct

SEQ ID NO: 169966 - DNA, 20 bp, Artificial Sequence
  Synthetic oligonucleotide; AAG chr2 60551542 60551561 60551558 +
tggacaagagacgtctgaga

SEQ ID NO: 169967 - DNA, 20 bp, Artificial Sequence
  Synthetic oligonucleotide; CAG chr2 60551549 60551568 60551565 +
gagacgtctgagaaagtacc

SEQ ID NO: 169968 - DNA, 20 bp, Artificial Sequence
  Synthetic oligonucleotide; AGG chr2 60551550 60551569 60551566 +
agacgtctgagaaagtaccc

SEQ ID NO: 169969 - DNA, 20 bp, Artificial Sequence
  Synthetic oligonucleotide; GGG chr2 60551551 60551570 60551567 +
gacgtctgagaaagtaccca

SEQ ID NO: 169970 - DNA, 20 bp, Artificial Sequence
  Synthetic oligonucleotide; CGG chr2 60551554 60551573 60551570 +
gtctgagaaagtacccaggg

SEQ ID NO: 169971 - DNA, 20 bp, Artificial Sequence
  Synthetic oligonucleotide; GAG chr2 60551556 60551575 60551572 +
ctgagaaagtacccagggcg

SEQ ID NO: 169972 - DNA, 20 bp, Artificial Sequence
  Synthetic oligonucleotide; AGG chr2 60551557 60551576 60551573 +
tgagaaagtacccagggcgg

SEQ ID NO: 169973 - DNA, 20 bp, Artificial Sequence
  Synthetic oligonucleotide; GGG chr2 60551558 60551577 60551574 +
gagaaagtacccagggcgga

SEQ ID NO: 169974 - DNA, 20 bp, Artificial Sequence
  Synthetic oligonucleotide; GGG chr2 60551559 60551578 60551575 +
agaaagtacccagggcggag

SEQ ID NO: 169975 - DNA, 20 bp, Artificial Sequence
  Synthetic oligonucleotide; GAG chr2 60551561 60551580 60551577 +
aaagtacccagggcggaggg

SEQ ID NO: 169976 - DNA, 20 bp, Artificial Sequence
  Synthetic oligonucleotide; AGG chr2 60551562 60551581 60551578 +
aagtacccagggcggagggg

SEQ ID NO: 169977 - DNA, 20 bp, Artificial Sequence
  Synthetic oligonucleotide; GGG chr2 60551563 60551582 60551579 +
agtacccagggcggagggga

SEQ ID NO: 169978 - DNA, 20 bp, Artificial Sequence
  Synthetic oligonucleotide; GGG chr2 60551564 60551583 60551580 +
gtacccagggcggaggggag

SEQ ID NO: 169979 - DNA, 20 bp, Artificial Sequence
  Synthetic oligonucleotide; GAG chr2 60551566 60551585 60551582 +
acccagggcggaggggaggg

SEQ ID NO: 169980 - DNA, 20 bp, Artificial Sequence
  Synthetic oligonucleotide; AGG chr2 60551567 60551586 60551583 +
cccagggcggaggggagggg

SEQ ID NO: 169981 - DNA, 20 bp, Artificial Sequence
  Synthetic oligonucleotide; CAG chr2 60551572 60551591 60551588 +
ggcggaggggaggggaggcg

SEQ ID NO: 169982 - DNA, 20 bp, Artificial Sequence
  Synthetic oligonucleotide; CAG chr2 60551587 60551606 60551603 +
aggcgcagaacgcgctttta

SEQ ID NO: 169983 - DNA, 20 bp, Artificial Sequence
  Synthetic oligonucleotide; AAG chr2 60551618 60551637 60551634 +
caaaataaaaatgctttgca

SEQ ID NO: 169984 - DNA, 20 bp, Artificial Sequence
  Synthetic oligonucleotide; GAG chr2 60551623 60551642 60551639 +
taaaaatgctttgcaaagcc

SEQ ID NO: 169985 - DNA, 20 bp, Artificial Sequence
  Synthetic oligonucleotide; CAG chr2 60551633 60551652 60551649 +
ttgcaaagccgagtttcacc

SEQ ID NO: 169986 - DNA, 20 bp, Artificial Sequence
  Synthetic oligonucleotide; CAG chr2 60551645 60551664 60551661 +
gtttcacccagccgatttcg

SEQ ID NO: 169987 - DNA, 20 bp, Artificial Sequence
  Synthetic oligonucleotide; TGG chr2 60551650 60551669 60551666 +
acccagccgatttcgcagtc

SEQ ID NO: 169988 - DNA, 20 bp, Artificial Sequence
  Synthetic oligonucleotide; GGG chr2 60551651 60551670 60551667 +
cccagccgatttcgcagtct

SEQ ID NO: 169989 - DNA, 20 bp, Artificial Sequence
  Synthetic oligonucleotide; GAG chr2 60551653 60551672 60551669 +
cagccgatttcgcagtctgg

SEQ ID NO: 169990 - DNA, 20 bp, Artificial Sequence
  Synthetic oligonucleotide; AGG chr2 60551654 60551673 60551670 +
agccgatttcgcagtctggg

SEQ ID NO: 169991 - DNA, 20 bp, Artificial Sequence
  Synthetic oligonucleotide; GAG chr2 60551659 60551678 60551675 +
atttcgcagtctgggaggtc

SEQ ID NO: 169992 - DNA, 20 bp, Artificial Sequence
  Synthetic oligonucleotide; AAG chr2 60551662 60551681 60551678 +
tcgcagtctgggaggtcgag

SEQ ID NO: 169993 - DNA, 20 bp, Artificial Sequence
  Synthetic oligonucleotide; GAG chr2 60551664 60551683 60551680 +
gcagtctgggaggtcgagaa

SEQ ID NO: 169994 - DNA, 20 bp, Artificial Sequence
  Synthetic oligonucleotide; AGG chr2 60551665 60551684 60551681 +
cagtctgggaggtcgagaag

SEQ ID NO: 169995 - DNA, 20 bp, Artificial Sequence
  Synthetic oligonucleotide; CGG chr2 60551671 60551690 60551687 +
gggaggtcgagaagaggtct

SEQ ID NO: 169996 - DNA, 20 bp, Artificial Sequence
  Synthetic oligonucleotide; TGG chr2 60551682 60551701 60551698 +
aagaggtctcggcattgtgc

SEQ ID NO: 169997 - DNA, 20 bp, Artificial Sequence
  Synthetic oligonucleotide; GGG chr2 60551683 60551702 60551699 +
agaggtctcggcattgtgct

SEQ ID NO: 169998 - DNA, 20 bp, Artificial Sequence
  Synthetic oligonucleotide; GGG chr2 60551684 60551703 60551700 +
gaggtctcggcattgtgctg

SEQ ID NO: 169999 - DNA, 20 bp, Artificial Sequence
  Synthetic oligonucleotide; GGG chr2 60551685 60551704 60551701 +
aggtctcggcattgtgctgg

SEQ ID NO: 170000 - DNA, 20 bp, Artificial Sequence
  Synthetic oligonucleotide; CGG chr2 60551688 60551707 60551704 +
tctcggcattgtgctggggg

SEQ ID NO: 170001 - DNA, 20 bp, Artificial Sequence
  Synthetic oligonucleotide; CAG chr2 60551693 60551712 60551709 +
gcattgtgctgggggcggac

SEQ ID NO: 170002 - DNA, 20 bp, Artificial Sequence
  Synthetic oligonucleotide; AGG chr2 60551694 60551713 60551710 +
cattgtgctgggggcggacc

SEQ ID NO: 170003 - DNA, 20 bp, Artificial Sequence
  Synthetic oligonucleotide; CGG chr2 60551701 60551720 60551717 +
ctgggggcggaccaggacca

SEQ ID NO: 170004 - DNA, 20 bp, Artificial Sequence
  Synthetic oligonucleotide; GGG chr2 60551702 60551721 60551718 +
tgggggcggaccaggaccac

SEQ ID NO: 170005 - DNA, 20 bp, Artificial Sequence
  Synthetic oligonucleotide; CAG chr2 60551706 60551725 60551722 +
ggcggaccaggaccacgggc

SEQ ID NO: 170006 - DNA, 20 bp, Artificial Sequence
  Synthetic oligonucleotide; AGG chr2 60551707 60551726 60551723 +
gcggaccaggaccacgggcc

SEQ ID NO: 170007 - DNA, 20 bp, Artificial Sequence
  Synthetic oligonucleotide; TGG chr2 60551711 60551730 60551727 +
accaggaccacgggccaggc

SEQ ID NO: 170008 - DNA, 20 bp, Artificial Sequence
  Synthetic oligonucleotide; CGG chr2 60551716 60551735 60551732 +
gaccacgggccaggctggcg

SEQ ID NO: 170009 - DNA, 20 bp, Artificial Sequence
  Synthetic oligonucleotide; GAG chr2 60551718 60551737 60551734 +
ccacgggccaggctggcgcg

SEQ ID NO: 170010 - DNA, 20 bp, Artificial Sequence
  Synthetic oligonucleotide; TGG chr2 60551729 60551748 60551745 +
gctggcgcggagacactgcg

SEQ ID NO: 170011 - DNA, 20 bp, Artificial Sequence
  Synthetic oligonucleotide; TGG chr2 60551746 60551765 60551762 +
gcgtggcctgccgccgtgcc

SEQ ID NO: 170012 - DNA, 20 bp, Artificial Sequence
  Synthetic oligonucleotide; CGG chr2 60551749 60551768 60551765 +
tggcctgccgccgtgcctgg

SEQ ID NO: 170013 - DNA, 20 bp, Artificial Sequence
  Synthetic oligonucleotide; GGG chr2 60551750 60551769 60551766 +
ggcctgccgccgtgcctggc

SEQ ID NO: 170014 - DNA, 20 bp, Artificial Sequence
  Synthetic oligonucleotide; TGG chr2 60551753 60551772 60551769 +
ctgccgccgtgcctggcggg

SEQ ID NO: 170015 - DNA, 20 bp, Artificial Sequence
  Synthetic oligonucleotide; GGG chr2 60551754 60551773 60551770 +
tgccgccgtgcctggcgggt

SEQ ID NO: 170016 - DNA, 20 bp, Artificial Sequence
  Synthetic oligonucleotide; CGG chr2 60551760 60551779 60551776 +
cgtgcctggcgggtgggcgc

SEQ ID NO: 170017 - DNA, 20 bp, Artificial Sequence
  Synthetic oligonucleotide; GGG chr2 60551761 60551780 60551777 +
gtgcctggcgggtgggcgcc

SEQ ID NO: 170018 - DNA, 20 bp, Artificial Sequence
  Synthetic oligonucleotide; CGG chr2 60551767 60551786 60551783 +
ggcgggtgggcgccgggcgc

SEQ ID NO: 170019 - DNA, 20 bp, Artificial Sequence
  Synthetic oligonucleotide; GGG chr2 60551768 60551787 60551784 +
gcgggtgggcgccgggcgcc

SEQ ID NO: 170020 - DNA, 20 bp, Artificial Sequence
  Synthetic oligonucleotide; TGG chr2 60551771 60551790 60551787 +
ggtgggcgccgggcgccggg

SEQ ID NO: 170021 - DNA, 20 bp, Artificial Sequence
  Synthetic oligonucleotide; GGG chr2 60551772 60551791 60551788 +
gtgggcgccgggcgccgggt

SEQ ID NO: 170022 - DNA, 20 bp, Artificial Sequence
  Synthetic oligonucleotide; CGG chr2 60551780 60551799 60551796 +
cgggcgccgggtgggcgatc

SEQ ID NO: 170023 - DNA, 20 bp, Artificial Sequence
  Synthetic oligonucleotide; GGG chr2 60551781 60551800 60551797 +
gggcgccgggtgggcgatcc

SEQ ID NO: 170024 - DNA, 20 bp, Artificial Sequence
  Synthetic oligonucleotide; GGG chr2 60551782 60551801 60551798 +
ggcgccgggtgggcgatccg

SEQ ID NO: 170025 - DNA, 20 bp, Artificial Sequence
  Synthetic oligonucleotide; TGG chr2 60551786 60551805 60551802 +
ccgggtgggcgatccggggc

SEQ ID NO: 170026 - DNA, 20 bp, Artificial Sequence
  Synthetic oligonucleotide; GGG chr2 60551787 60551806 60551803 +
cgggtgggcgatccggggct

SEQ ID NO: 170027 - DNA, 20 bp, Artificial Sequence
  Synthetic oligonucleotide; TGG chr2 60551791 60551810 60551807 +
tgggcgatccggggctgggc

SEQ ID NO: 170028 - DNA, 20 bp, Artificial Sequence
  Synthetic oligonucleotide; GGG chr2 60551792 60551811 60551808 +
gggcgatccggggctgggct

SEQ ID NO: 170029 - DNA, 20 bp, Artificial Sequence
  Synthetic oligonucleotide; GGG chr2 60551793 60551812 60551809 +
ggcgatccggggctgggctg

SEQ ID NO: 170030 - DNA, 20 bp, Artificial Sequence
  Synthetic oligonucleotide; CGG chr2 60551798 60551817 60551814 +
tccggggctgggctggggcg

SEQ ID NO: 170031 - DNA, 20 bp, Artificial Sequence
  Synthetic oligonucleotide; GAG chr2 60551802 60551821 60551818 +
gggctgggctggggcgcggc

SEQ ID NO: 170032 - DNA, 20 bp, Artificial Sequence
  Synthetic oligonucleotide; AGG chr2 60551803 60551822 60551819 +
ggctgggctggggcgcggcg

SEQ ID NO: 170033 - DNA, 20 bp, Artificial Sequence
  Synthetic oligonucleotide; CGG chr2 60551807 60551826 60551823 +
gggctggggcgcggcgaggt

SEQ ID NO: 170034 - DNA, 20 bp, Artificial Sequence
  Synthetic oligonucleotide; GGG chr2 60551808 60551827 60551824 +
ggctggggcgcggcgaggtc

SEQ ID NO: 170035 - DNA, 20 bp, Artificial Sequence
  Synthetic oligonucleotide; AAG chr2 60551812 60551831 60551828 +
ggggcgcggcgaggtcgggc

SEQ ID NO: 170036 - DNA, 20 bp, Artificial Sequence
  Synthetic oligonucleotide; AGG chr2 60551813 60551832 60551829 +
gggcgcggcgaggtcgggca

SEQ ID NO: 170037 - DNA, 20 bp, Artificial Sequence
  Synthetic oligonucleotide; CGG chr2 60551818 60551837 60551834 +
cggcgaggtcgggcaaggcc

SEQ ID NO: 170038 - DNA, 20 bp, Artificial Sequence
  Synthetic oligonucleotide; GGG chr2 60551819 60551838 60551835 +
ggcgaggtcgggcaaggccc

SEQ ID NO: 170039 - DNA, 20 bp, Artificial Sequence
  Synthetic oligonucleotide; GAG chr2 60551823 60551842 60551839 +
aggtcgggcaaggcccgggc

SEQ ID NO: 170040 - DNA, 20 bp, Artificial Sequence
  Synthetic oligonucleotide; AGG chr2 60551824 60551843 60551840 +
ggtcgggcaaggcccgggcg

SEQ ID NO: 170041 - DNA, 20 bp, Artificial Sequence
  Synthetic oligonucleotide; CAG chr2 60551828 60551847 60551844 +
gggcaaggcccgggcgaggc

SEQ ID NO: 170042 - DNA, 20 bp, Artificial Sequence
  Synthetic oligonucleotide; AGG chr2 60551829 60551848 60551845 +
ggcaaggcccgggcgaggcc

SEQ ID NO: 170043 - DNA, 20 bp, Artificial Sequence
  Synthetic oligonucleotide; CGG chr2 60551851 60551870 60551867 +
gccgccgccgccgcctgctc

SEQ ID NO: 170044 - DNA, 20 bp, Artificial Sequence
  Synthetic oligonucleotide; GGG chr2 60551852 60551871 60551868 +
ccgccgccgccgcctgctcc

SEQ ID NO: 170045 - DNA, 20 bp, Artificial Sequence
  Synthetic oligonucleotide; GGG chr2 60551853 60551872 60551869 +
cgccgccgccgcctgctccg

SEQ ID NO: 170046 - DNA, 20 bp, Artificial Sequence
  Synthetic oligonucleotide; CGG chr2 60551871 60551890 60551887 +
cggggctgccgcgccgcgct

SEQ ID NO: 170047 - DNA, 20 bp, Artificial Sequence
  Synthetic oligonucleotide; TGG chr2 60551890 60551909 60551906 +
tcggtcctctgtctgtttgt

SEQ ID NO: 170048 - DNA, 20 bp, Artificial Sequence
  Synthetic oligonucleotide; CAG chr2 60551893 60551912 60551909 +
gtcctctgtctgtttgttgg

SEQ ID NO: 170049 - DNA, 20 bp, Artificial Sequence
  Synthetic oligonucleotide; AGG chr2 60551894 60551913 60551910 +
tcctctgtctgtttgttggc

SEQ ID NO: 170050 - DNA, 20 bp, Artificial Sequence
  Synthetic oligonucleotide; GAG chr2 60551896 60551915 60551912 +
ctctgtctgtttgttggcag

SEQ ID NO: 170051 - DNA, 20 bp, Artificial Sequence
  Synthetic oligonucleotide; AGG chr2 60551897 60551916 60551913 +
tctgtctgtttgttggcagg

SEQ ID NO: 170052 - DNA, 20 bp, Artificial Sequence
  Synthetic oligonucleotide; CGG chr2 60551912 60551931 60551928 +
gcaggaggctcccgcacacg

SEQ ID NO: 170053 - DNA, 20 bp, Artificial Sequence
  Synthetic oligonucleotide; CAG chr2 60551929 60551948 60551945 +
acgcggtgcttgtaaacatt

SEQ ID NO: 170054 - DNA, 20 bp, Artificial Sequence
  Synthetic oligonucleotide; GAG chr2 60551936 60551955 60551952 +
gcttgtaaacattcagacac

SEQ ID NO: 170055 - DNA, 20 bp, Artificial Sequence
  Synthetic oligonucleotide; TAG chr2 60551991 60552010 60552007 +
tttgaaaatcttccaaaaaa

SEQ ID NO: 170056 - DNA, 20 bp, Artificial Sequence
  Synthetic oligonucleotide; AAG chr2 60551995 60552014 60552011 +
aaaatcttccaaaaaatagt

SEQ ID NO: 170057 - DNA, 20 bp, Artificial Sequence
  Synthetic oligonucleotide; GAG chr2 60551997 60552016 60552013 +
aatcttccaaaaaatagtaa

SEQ ID NO: 170058 - DNA, 20 bp, Artificial Sequence
  Synthetic oligonucleotide; AGG chr2 60551998 60552017 60552014 +
atcttccaaaaaatagtaag

SEQ ID NO: 170059 - DNA, 20 bp, Artificial Sequence
  Synthetic oligonucleotide; GAG chr2 60552000 60552019 60552016 +
cttccaaaaaatagtaagag

SEQ ID NO: 170060 - DNA, 20 bp, Artificial Sequence
  Synthetic oligonucleotide; AGG chr2 60552001 60552020 60552017 +
ttccaaaaaatagtaagagg

SEQ ID NO: 170061 - DNA, 20 bp, Artificial Sequence
  Synthetic oligonucleotide; GGG chr2 60552002 60552021 60552018 +
tccaaaaaatagtaagagga

SEQ ID NO: 170062 - DNA, 20 bp, Artificial Sequence
  Synthetic oligonucleotide; GAG chr2 60552004 60552023 60552020 +
caaaaaatagtaagaggagg

SEQ ID NO: 170063 - DNA, 20 bp, Artificial Sequence
  Synthetic oligonucleotide; CGG chr2 60552031 60552050 60552047 +
tctctccctctccgtgccgt

SEQ ID NO: 170064 - DNA, 20 bp, Artificial Sequence
  Synthetic oligonucleotide; AAG chr2 60552040 60552059 60552056 +
ctccgtgccgtcggcgccct

SEQ ID NO: 170065 - DNA, 20 bp, Artificial Sequence
  Synthetic oligonucleotide; AAG chr2 60552053 60552072 60552069 +
gcgccctaagtttgcaactg

SEQ ID NO: 170066 - DNA, 20 bp, Artificial Sequence
  Synthetic oligonucleotide; AGG chr2 60552054 60552073 60552070 +
cgccctaagtttgcaactga

SEQ ID NO: 170067 - DNA, 20 bp, Artificial Sequence
  Synthetic oligonucleotide; GGG chr2 60552055 60552074 60552071 +
gccctaagtttgcaactgaa

SEQ ID NO: 170068 - DNA, 20 bp, Artificial Sequence
  Synthetic oligonucleotide; GGG chr2 60552056 60552075 60552072 +
ccctaagtttgcaactgaag

SEQ ID NO: 170069 - DNA, 20 bp, Artificial Sequence
  Synthetic oligonucleotide; TGG chr2 60552061 60552080 60552077 +
agtttgcaactgaaggggtt

SEQ ID NO: 170070 - DNA, 20 bp, Artificial Sequence
  Synthetic oligonucleotide; GGG chr2 60552062 60552081 60552078 +
gtttgcaactgaaggggttt

SEQ ID NO: 170071 - DNA, 20 bp, Artificial Sequence
  Synthetic oligonucleotide; GGG chr2 60552063 60552082 60552079 +
tttgcaactgaaggggtttg

SEQ ID NO: 170072 - DNA, 20 bp, Artificial Sequence
  Synthetic oligonucleotide; GGG chr2 60552064 60552083 60552080 +
ttgcaactgaaggggtttgg

SEQ ID NO: 170073 - DNA, 20 bp, Artificial Sequence
  Synthetic oligonucleotide; AAG chr2 60552067 60552086 60552083 +
caactgaaggggtttggggg

SEQ ID NO: 170074 - DNA, 20 bp, Artificial Sequence
  Synthetic oligonucleotide; GAG chr2 60552069 60552088 60552085 +
actgaaggggtttgggggaa

SEQ ID NO: 170075 - DNA, 20 bp, Artificial Sequence
  Synthetic oligonucleotide; AGG chr2 60552070 60552089 60552086 +
ctgaaggggtttgggggaag

SEQ ID NO: 170076 - DNA, 20 bp, Artificial Sequence
  Synthetic oligonucleotide; GGG chr2 60552071 60552090 60552087 +
tgaaggggtttgggggaaga

SEQ ID NO: 170077 - DNA, 20 bp, Artificial Sequence
  Synthetic oligonucleotide; TAG chr2 60552092 60552111 60552108 +
ggtgattgtaaatttttttc

SEQ ID NO: 170078 - DNA, 20 bp, Artificial Sequence
  Synthetic oligonucleotide; GAG chr2 60552097 60552116 60552113 +
ttgtaaatttttttctagat

SEQ ID NO: 170079 - DNA, 20 bp, Artificial Sequence
  Synthetic oligonucleotide; GAG chr2 60552099 60552118 60552115 +
gtaaatttttttctagatga

SEQ ID NO: 170080 - DNA, 20 bp, Artificial Sequence
  Synthetic oligonucleotide; GAG chr2 60552107 60552126 60552123 +
ttttctagatgagagattgt

SEQ ID NO: 170081 - DNA, 20 bp, Artificial Sequence
  Synthetic oligonucleotide; CAG chr2 60552117 60552136 60552133 +
gagagattgtgagatttttg

SEQ ID NO: 170082 - DNA, 20 bp, Artificial Sequence
  Synthetic oligonucleotide; AGG chr2 60552118 60552137 60552134 +
agagattgtgagatttttgc

SEQ ID NO: 170083 - DNA, 20 bp, Artificial Sequence
  Synthetic oligonucleotide; GGG chr2 60552119 60552138 60552135 +
gagattgtgagatttttgca

SEQ ID NO: 170084 - DNA, 20 bp, Artificial Sequence
  Synthetic oligonucleotide; GGG chr2 60552120 60552139 60552136 +
agattgtgagatttttgcag

SEQ ID NO: 170085 - DNA, 20 bp, Artificial Sequence
  Synthetic oligonucleotide; GGG chr2 60552121 60552140 60552137 +
gattgtgagatttttgcagg

SEQ ID NO: 170086 - DNA, 20 bp, Artificial Sequence
  Synthetic oligonucleotide; GGG chr2 60552122 60552141 60552138 +
attgtgagatttttgcaggg

SEQ ID NO: 170087 - DNA, 20 bp, Artificial Sequence
  Synthetic oligonucleotide; TGG chr2 60552126 60552145 60552142 +
tgagatttttgcaggggggc

SEQ ID NO: 170088 - DNA, 20 bp, Artificial Sequence
  Synthetic oligonucleotide; TGG chr2 60552129 60552148 60552145 +
gatttttgcaggggggctgg

SEQ ID NO: 170089 - DNA, 20 bp, Artificial Sequence
  Synthetic oligonucleotide; GGG chr2 60552130 60552149 60552146 +
atttttgcaggggggctggt

SEQ ID NO: 170090 - DNA, 20 bp, Artificial Sequence
  Synthetic oligonucleotide; GGG chr2 60552131 60552150 60552147 +
tttttgcaggggggctggtg

SEQ ID NO: 170091 - DNA, 20 bp, Artificial Sequence
  Synthetic oligonucleotide; GGG chr2 60552132 60552151 60552148 +
ttttgcaggggggctggtgg

SEQ ID NO: 170092 - DNA, 20 bp, Artificial Sequence
  Synthetic oligonucleotide; GAG chr2 60552134 60552153 60552150 +
ttgcaggggggctggtgggg

SEQ ID NO: 170093 - DNA, 20 bp, Artificial Sequence
  Synthetic oligonucleotide; AAG chr2 60552140 60552159 60552156 +
gggggctggtgggggagtca

SEQ ID NO: 170094 - DNA, 20 bp, Artificial Sequence
  Synthetic oligonucleotide; GAG chr2 60552142 60552161 60552158 +
gggctggtgggggagtcaaa

SEQ ID NO: 170095 - DNA, 20 bp, Artificial Sequence
  Synthetic oligonucleotide; AAG chr2 60552145 60552164 60552161 +
ctggtgggggagtcaaagag

SEQ ID NO: 170096 - DNA, 20 bp, Artificial Sequence
  Synthetic oligonucleotide; AGG chr2 60552146 60552165 60552162 +
tggtgggggagtcaaagaga

SEQ ID NO: 170097 - DNA, 20 bp, Artificial Sequence
  Synthetic oligonucleotide; CAG chr2 60552155 60552174 60552171 +
agtcaaagagaaggccgtca

SEQ ID NO: 170098 - DNA, 20 bp, Artificial Sequence
  Synthetic oligonucleotide; AAG chr2 60552160 60552179 60552176 +
aagagaaggccgtcacagaa

SEQ ID NO: 170099 - DNA, 20 bp, Artificial Sequence
  Synthetic oligonucleotide; AGG chr2 60552161 60552180 60552177 +
agagaaggccgtcacagaaa

SEQ ID NO: 170100 - DNA, 20 bp, Artificial Sequence
  Synthetic oligonucleotide; GGG chr2 60552162 60552181 60552178 +
gagaaggccgtcacagaaaa

SEQ ID NO: 170101 - DNA, 20 bp, Artificial Sequence
  Synthetic oligonucleotide; TGG chr2 60552166 60552185 60552182 +
aggccgtcacagaaaagggt

SEQ ID NO: 170102 - DNA, 20 bp, Artificial Sequence
  Synthetic oligonucleotide; CAG chr2 60552169 60552188 60552185 +
ccgtcacagaaaagggttgg

SEQ ID NO: 170103 - DNA, 20 bp, Artificial Sequence
  Synthetic oligonucleotide; GAG chr2 60552171 60552190 60552187 +
gtcacagaaaagggttggca

SEQ ID NO: 170104 - DNA, 20 bp, Artificial Sequence
  Synthetic oligonucleotide; TGG chr2 60552178 60552197 60552194 +
aaaagggttggcagagcgtt

SEQ ID NO: 170105 - DNA, 20 bp, Artificial Sequence
  Synthetic oligonucleotide; CGG chr2 60552184 60552203 60552200 +
gttggcagagcgtttggctt

SEQ ID NO: 170106 - DNA, 20 bp, Artificial Sequence
  Synthetic oligonucleotide; TGG chr2 60552189 60552208 60552205 +
cagagcgtttggcttcggtt

SEQ ID NO: 170107 - DNA, 20 bp, Artificial Sequence
  Synthetic oligonucleotide; GGG chr2 60552190 60552209 60552206 +
agagcgtttggcttcggttt

SEQ ID NO: 170108 - DNA, 20 bp, Artificial Sequence
  Synthetic oligonucleotide; GGG chr2 60552191 60552210 60552207 +
gagcgtttggcttcggtttg

SEQ ID NO: 170109 - DNA, 20 bp, Artificial Sequence
  Synthetic oligonucleotide; GGG chr2 60552192 60552211 60552208 +
agcgtttggcttcggtttgg

SEQ ID NO: 170110 - DNA, 20 bp, Artificial Sequence
  Synthetic oligonucleotide; AAG chr2 60552196 60552215 60552212 +
tttggcttcggtttgggggc

SEQ ID NO: 170111 - DNA, 20 bp, Artificial Sequence
  Synthetic oligonucleotide; CAG chr2 60552263 60552282 60552279 +
gtatttatttatttatgtgc

SEQ ID NO: 170112 - DNA, 20 bp, Artificial Sequence
  Synthetic oligonucleotide; GAG chr2 60552285 60552304 60552301 +
gtcttctccttgctgcctct

SEQ ID NO: 170113 - DNA, 20 bp, Artificial Sequence
  Synthetic oligonucleotide; AGG chr2 60552286 60552305 60552302 +
tcttctccttgctgcctctg

SEQ ID NO: 170114 - DNA, 20 bp, Artificial Sequence
  Synthetic oligonucleotide; CGG chr2 60552291 60552310 60552307 +
tccttgctgcctctgaggtt

SEQ ID NO: 170115 - DNA, 20 bp, Artificial Sequence
  Synthetic oligonucleotide; CGG chr2 60552295 60552314 60552311 +
tgctgcctctgaggttcggt

SEQ ID NO: 170116 - DNA, 20 bp, Artificial Sequence
  Synthetic oligonucleotide; GGG chr2 60552296 60552315 60552312 +
gctgcctctgaggttcggtc

SEQ ID NO: 170117 - DNA, 20 bp, Artificial Sequence
  Synthetic oligonucleotide; GAG chr2 60552298 60552317 60552314 +
tgcctctgaggttcggtcgg

SEQ ID NO: 170118 - DNA, 20 bp, Artificial Sequence
  Synthetic oligonucleotide; AGG chr2 60552299 60552318 60552315 +
gcctctgaggttcggtcggg

SEQ ID NO: 170119 - DNA, 20 bp, Artificial Sequence
  Synthetic oligonucleotide; GGG chr2 60552300 60552319 60552316 +
cctctgaggttcggtcggga

SEQ ID NO: 170120 - DNA, 20 bp, Artificial Sequence
  Synthetic oligonucleotide; GGG chr2 60552301 60552320 60552317 +
ctctgaggttcggtcgggag

SEQ ID NO: 170121 - DNA, 20 bp, Artificial Sequence
  Synthetic oligonucleotide; GAG chr2 60552303 60552322 60552319 +
ctgaggttcggtcgggaggg

SEQ ID NO: 170122 - DNA, 20 bp, Artificial Sequence
  Synthetic oligonucleotide; AGG chr2 60552304 60552323 60552320 +
tgaggttcggtcgggagggg

SEQ ID NO: 170123 - DNA, 20 bp, Artificial Sequence
  Synthetic oligonucleotide; GGG chr2 60552305 60552324 60552321 +
gaggttcggtcgggagggga

SEQ ID NO: 170124 - DNA, 20 bp, Artificial Sequence
  Synthetic oligonucleotide; CAG chr2 60552308 60552327 60552324 +
gttcggtcgggaggggaggg

SEQ ID NO: 170125 - DNA, 20 bp, Artificial Sequence
  Synthetic oligonucleotide; CGG chr2 60552311 60552330 60552327 +
cggtcgggaggggagggcag

SEQ ID NO: 170126 - DNA, 20 bp, Artificial Sequence
  Synthetic oligonucleotide; CAG chr2 60552319 60552338 60552335 +
aggggagggcagcggcaacc

SEQ ID NO: 170127 - DNA, 20 bp, Artificial Sequence
  Synthetic oligonucleotide; AGG chr2 60552320 60552339 60552336 +
ggggagggcagcggcaaccc

SEQ ID NO: 170128 - DNA, 20 bp, Artificial Sequence
  Synthetic oligonucleotide; GAG chr2 60552322 60552341 60552338 +
ggagggcagcggcaacccag

SEQ ID NO: 170129 - DNA, 20 bp, Artificial Sequence
  Synthetic oligonucleotide; AGG chr2 60552323 60552342 60552339 +
gagggcagcggcaacccagg

SEQ ID NO: 170130 - DNA, 20 bp, Artificial Sequence
  Synthetic oligonucleotide; CAG chr2 60552326 60552345 60552342 +
ggcagcggcaacccaggagg

SEQ ID NO: 170131 - DNA, 20 bp, Artificial Sequence
  Synthetic oligonucleotide; CAG chr2 60552329 60552348 60552345 +
agcggcaacccaggaggcag

SEQ ID NO: 170132 - DNA, 20 bp, Artificial Sequence
  Synthetic oligonucleotide; CGG chr2 60552334 60552353 60552350 +
caacccaggaggcagcagtc

SEQ ID NO: 170133 - DNA, 20 bp, Artificial Sequence
  Synthetic oligonucleotide; GGG chr2 60552335 60552354 60552351 +
aacccaggaggcagcagtcc

SEQ ID NO: 170134 - DNA, 20 bp, Artificial Sequence
  Synthetic oligonucleotide; CGG chr2 60552366 60552385 60552382 +
ctccctctcccgcgtgcccc

SEQ ID NO: 170135 - DNA, 20 bp, Artificial Sequence
  Synthetic oligonucleotide; CGG chr2 60552382 60552401 60552398 +
cccccggccgcctcctcccc

SEQ ID NO: 170136 - DNA, 20 bp, Artificial Sequence
  Synthetic oligonucleotide; TAG chr2 60552388 60552407 60552404 +
gccgcctcctcccccggccc

SEQ ID NO: 170137 - DNA, 20 bp, Artificial Sequence
  Synthetic oligonucleotide; CGG chr2 60552402 60552421 60552418 +
cggccctagctcctgccctt

SEQ ID NO: 170138 - DNA, 20 bp, Artificial Sequence
  Synthetic oligonucleotide; CGG chr2 60552405 60552424 60552421 +
ccctagctcctgcccttcgg

SEQ ID NO: 170139 - DNA, 20 bp, Artificial Sequence
  Synthetic oligonucleotide; CGG chr2 60552408 60552427 60552424 +
tagctcctgcccttcggcgg

SEQ ID NO: 170140 - DNA, 20 bp, Artificial Sequence
  Synthetic oligonucleotide; CGG chr2 60552411 60552430 60552427 +
ctcctgcccttcggcggcgg

SEQ ID NO: 170141 - DNA, 20 bp, Artificial Sequence
  Synthetic oligonucleotide; CGG chr2 60552414 60552433 60552430 +
ctgcccttcggcggcggcgg

SEQ ID NO: 170142 - DNA, 20 bp, Artificial Sequence
  Synthetic oligonucleotide; CGG chr2 60552417 60552436 60552433 +
cccttcggcggcggcggcgg

SEQ ID NO: 170143 - DNA, 20 bp, Artificial Sequence
  Synthetic oligonucleotide; CGG chr2 60552420 60552439 60552436 +
ttcggcggcggcggcggcgg

SEQ ID NO: 170144 - DNA, 20 bp, Artificial Sequence
  Synthetic oligonucleotide; CGG chr2 60552425 60552444 60552441 +
cggcggcggcggcggcggcg

SEQ ID NO: 170145 - DNA, 20 bp, Artificial Sequence
  Synthetic oligonucleotide; GGG chr2 60552426 60552445 60552442 +
ggcggcggcggcggcggcgc

SEQ ID NO: 170146 - DNA, 20 bp, Artificial Sequence
  Synthetic oligonucleotide; GAG chr2 60552428 60552447 60552444 +
cggcggcggcggcggcgcgg

SEQ ID NO: 170147 - DNA, 20 bp, Artificial Sequence
  Synthetic oligonucleotide; AGG chr2 60552429 60552448 60552445 +
ggcggcggcggcggcgcggg

SEQ ID NO: 170148 - DNA, 20 bp, Artificial Sequence
  Synthetic oligonucleotide; GGG chr2 60552430 60552449 60552446 +
gcggcggcggcggcgcggga

SEQ ID NO: 170149 - DNA, 20 bp, Artificial Sequence
  Synthetic oligonucleotide; AAG chr2 60552434 60552453 60552450 +
cggcggcggcgcgggagggc

SEQ ID NO: 170150 - DNA, 20 bp, Artificial Sequence
  Synthetic oligonucleotide; GAG chr2 60552440 60552459 60552456 +
cggcgcgggagggcaagcgc

SEQ ID NO: 170151 - DNA, 20 bp, Artificial Sequence
  Synthetic oligonucleotide; AGG chr2 60552441 60552460 60552457 +
ggcgcgggagggcaagcgcg

SEQ ID NO: 170152 - DNA, 20 bp, Artificial Sequence
  Synthetic oligonucleotide; GAG chr2 60552443 60552462 60552459 +
cgcgggagggcaagcgcgag

SEQ ID NO: 170153 - DNA, 20 bp, Artificial Sequence
  Synthetic oligonucleotide; CGG chr2 60552447 60552466 60552463 +
ggagggcaagcgcgaggagc

SEQ ID NO: 170154 - DNA, 20 bp, Artificial Sequence
  Synthetic oligonucleotide; AAG chr2 60552455 60552474 60552471 +
agcgcgaggagccggcacaa

SEQ ID NO: 170155 - DNA, 20 bp, Artificial Sequence
  Synthetic oligonucleotide; AGG chr2 60552456 60552475 60552472 +
gcgcgaggagccggcacaaa

SEQ ID NO: 170156 - DNA, 20 bp, Artificial Sequence
  Synthetic oligonucleotide; CAG chr2 60552459 60552478 60552475 +
cgaggagccggcacaaaagg

SEQ ID NO: 170157 - DNA, 20 bp, Artificial Sequence
  Synthetic oligonucleotide; CGG chr2 60552462 60552481 60552478 +
ggagccggcacaaaaggcag

SEQ ID NO: 170158 - DNA, 20 bp, Artificial Sequence
  Synthetic oligonucleotide; GGG chr2 60552463 60552482 60552479 +
gagccggcacaaaaggcagc

SEQ ID NO: 170159 - DNA, 20 bp, Artificial Sequence
  Synthetic oligonucleotide; TGG chr2 60552481 60552500 60552497 +
gcgggacaaacacccacctc

SEQ ID NO: 170160 - DNA, 20 bp, Artificial Sequence
  Synthetic oligonucleotide; CGG chr2 60552485 60552504 60552501 +
gacaaacacccacctctggc

SEQ ID NO: 170161 - DNA, 20 bp, Artificial Sequence
  Synthetic oligonucleotide; AAG chr2 60552493 60552512 60552509 +
cccacctctggccggaacaa

SEQ ID NO: 170162 - DNA, 20 bp, Artificial Sequence
  Synthetic oligonucleotide; AGG chr2 60552494 60552513 60552510 +
ccacctctggccggaacaaa

SEQ ID NO: 170163 - DNA, 20 bp, Artificial Sequence
  Synthetic oligonucleotide; CGG chr2 60552497 60552516 60552513 +
cctctggccggaacaaaagg

SEQ ID NO: 170164 - DNA, 20 bp, Artificial Sequence
  Synthetic oligonucleotide; CAG chr2 60552500 60552519 60552516 +
ctggccggaacaaaaggcgg

SEQ ID NO: 170165 - DNA, 20 bp, Artificial Sequence
  Synthetic oligonucleotide; CGG chr2 60552506 60552525 60552522 +
ggaacaaaaggcggcagtgc

SEQ ID NO: 170166 - DNA, 20 bp, Artificial Sequence
  Synthetic oligonucleotide; CGG chr2 60552528 60552547 60552544 +
gccgcgtctcccgtccttcc

SEQ ID NO: 170167 - DNA, 20 bp, Artificial Sequence
  Synthetic oligonucleotide; CGG chr2 60552536 60552555 60552552 +
tcccgtccttcccggtccca

SEQ ID NO: 170168 - DNA, 20 bp, Artificial Sequence
  Synthetic oligonucleotide; CGG chr2 60552554 60552573 60552570 +
cacggctctccccgtcgccg

SEQ ID NO: 170169 - DNA, 20 bp, Artificial Sequence
  Synthetic oligonucleotide; CGG chr2 60552574 60552593 60552590 +
cggcccctctcccgactccg

SEQ ID NO: 170170 - DNA, 20 bp, Artificial Sequence
  Synthetic oligonucleotide; CAG chr2 60552580 60552599 60552596 +
ctctcccgactccgcggact

SEQ ID NO: 170171 - DNA, 20 bp, Artificial Sequence
  Synthetic oligonucleotide; AGG chr2 60552581 60552600 60552597 +
tctcccgactccgcggactc

SEQ ID NO: 170172 - DNA, 20 bp, Artificial Sequence
  Synthetic oligonucleotide; GAG chr2 60552583 60552602 60552599 +
tcccgactccgcggactcag

SEQ ID NO: 170173 - DNA, 20 bp, Artificial Sequence
  Synthetic oligonucleotide; CGG chr2 60552589 60552608 60552605 +
ctccgcggactcaggagcgc

SEQ ID NO: 170174 - DNA, 20 bp, Artificial Sequence
  Synthetic oligonucleotide; GGG chr2 60552590 60552609 60552606 +
tccgcggactcaggagcgcc

SEQ ID NO: 170175 - DNA, 20 bp, Artificial Sequence
  Synthetic oligonucleotide; GGG chr2 60552591 60552610 60552607 +
ccgcggactcaggagcgccg

SEQ ID NO: 170176 - DNA, 20 bp, Artificial Sequence
  Synthetic oligonucleotide; GGG chr2 60552592 60552611 60552608 +
cgcggactcaggagcgccgg

SEQ ID NO: 170177 - DNA, 20 bp, Artificial Sequence
  Synthetic oligonucleotide; CAG chr2 60552605 60552624 60552621 +
gcgccgggggcccctttcca

SEQ ID NO: 170178 - DNA, 20 bp, Artificial Sequence
  Synthetic oligonucleotide; TGG chr2 60552627 60552646 60552643 +
gtgccactttctcactattg

SEQ ID NO: 170179 - DNA, 20 bp, Artificial Sequence
  Synthetic oligonucleotide; GGG chr2 60552628 60552647 60552644 +
tgccactttctcactattgt

SEQ ID NO: 170180 - DNA, 20 bp, Artificial Sequence
  Synthetic oligonucleotide; GGG chr2 60552629 60552648 60552645 +
gccactttctcactattgtg

SEQ ID NO: 170181 - DNA, 20 bp, Artificial Sequence
  Synthetic oligonucleotide; GAG chr2 60552666 60552685 60552682 +
cccgctgcacacttgaccgt

SEQ ID NO: 170182 - DNA, 20 bp, Artificial Sequence
  Synthetic oligonucleotide; TGG chr2 60552674 60552693 60552690 +
acacttgaccgtgagcgcgc

SEQ ID NO: 170183 - DNA, 20 bp, Artificial Sequence
  Synthetic oligonucleotide; AAG chr2 60552684 60552703 60552700 +
gtgagcgcgctggtgtccaa

SEQ ID NO: 170184 - DNA, 20 bp, Artificial Sequence
  Synthetic oligonucleotide; CAG chr2 60552688 60552707 60552704 +
gcgcgctggtgtccaaaagc

SEQ ID NO: 170185 - DNA, 20 bp, Artificial Sequence
  Synthetic oligonucleotide; CGG chr2 60552709 60552728 60552725 +
agtctcacctcttttctccc

SEQ ID NO: 170186 - DNA, 20 bp, Artificial Sequence
  Synthetic oligonucleotide; GGG chr2 60552710 60552729 60552726 +
gtctcacctcttttctcccc

SEQ ID NO: 170187 - DNA, 20 bp, Artificial Sequence
  Synthetic oligonucleotide; TAG chr2 60552723 60552742 60552739 +
tctccccgggaatcgttttt

SEQ ID NO: 170188 - DNA, 20 bp, Artificial Sequence
  Synthetic oligonucleotide; CGG chr2 60552764 60552783 60552780 +
cctacccccccattttctta

SEQ ID NO: 170189 - DNA, 20 bp, Artificial Sequence
  Synthetic oligonucleotide; GAG chr2 60552768 60552787 60552784 +
cccccccattttcttacggt

SEQ ID NO: 170190 - DNA, 20 bp, Artificial Sequence
  Synthetic oligonucleotide; TGG chr2 60552771 60552790 60552787 +
ccccattttcttacggtgag

SEQ ID NO: 170191 - DNA, 20 bp, Artificial Sequence
  Synthetic oligonucleotide; GGG chr2 60552772 60552791 60552788 +
cccattttcttacggtgagt

SEQ ID NO: 170192 - DNA, 20 bp, Artificial Sequence
  Synthetic oligonucleotide; AAG chr2 60552775 60552794 60552791 +
attttcttacggtgagtggg

SEQ ID NO: 170193 - DNA, 20 bp, Artificial Sequence
  Synthetic oligonucleotide; CAG chr2 60552796 60552815 60552812 +
agcaacctccctttccccac

SEQ ID NO: 170194 - DNA, 20 bp, Artificial Sequence
  Synthetic oligonucleotide; CAG chr2 60552809 60552828 60552825 +
tccccaccagctcccacccc

SEQ ID NO: 170195 - DNA, 20 bp, Artificial Sequence
  Synthetic oligonucleotide; AGG chr2 60552810 60552829 60552826 +
ccccaccagctcccaccccc

SEQ ID NO: 170196 - DNA, 20 bp, Artificial Sequence
  Synthetic oligonucleotide; GAG chr2 60552822 60552841 60552838 +
ccacccccaggtttgcatgt

SEQ ID NO: 170197 - DNA, 20 bp, Artificial Sequence
  Synthetic oligonucleotide; TAG chr2 60552838 60552857 60552854 +
atgtgagttgttcgcaacct

SEQ ID NO: 170198 - DNA, 20 bp, Artificial Sequence
  Synthetic oligonucleotide; TGG chr2 60552864 60552883 60552880 +
tgttcattattttgcaaaac

SEQ ID NO: 170199 - DNA, 20 bp, Artificial Sequence
  Synthetic oligonucleotide; CGG chr2 60552867 60552886 60552883 +
tcattattttgcaaaactgg

SEQ ID NO: 170200 - DNA, 20 bp, Artificial Sequence
  Synthetic oligonucleotide; GGG chr2 60552868 60552887 60552884 +
cattattttgcaaaactggc

SEQ ID NO: 170201 - DNA, 20 bp, Artificial Sequence
  Synthetic oligonucleotide; GGG chr2 60552869 60552888 60552885 +
attattttgcaaaactggcg

SEQ ID NO: 170202 - DNA, 20 bp, Artificial Sequence
  Synthetic oligonucleotide; CGG chr2 60552872 60552891 60552888 +
attttgcaaaactggcgggg

SEQ ID NO: 170203 - DNA, 20 bp, Artificial Sequence
  Synthetic oligonucleotide; GGG chr2 60552873 60552892 60552889 +
ttttgcaaaactggcggggc

SEQ ID NO: 170204 - DNA, 20 bp, Artificial Sequence
  Synthetic oligonucleotide; GGG chr2 60552874 60552893 60552890 +
tttgcaaaactggcggggcg

SEQ ID NO: 170205 - DNA, 20 bp, Artificial Sequence
  Synthetic oligonucleotide; GGG chr2 60552875 60552894 60552891 +
ttgcaaaactggcggggcgg

SEQ ID NO: 170206 - DNA, 20 bp, Artificial Sequence
  Synthetic oligonucleotide; GGG chr2 60552876 60552895 60552892 +
tgcaaaactggcggggcggg

SEQ ID NO: 170207 - DNA, 20 bp, Artificial Sequence
  Synthetic oligonucleotide; GGG chr2 60552877 60552896 60552893 +
gcaaaactggcggggcgggg

SEQ ID NO: 170208 - DNA, 20 bp, Artificial Sequence
  Synthetic oligonucleotide; GGG chr2 60552878 60552897 60552894 +
caaaactggcggggcggggg

SEQ ID NO: 170209 - DNA, 20 bp, Artificial Sequence
  Synthetic oligonucleotide; GAG chr2 60552880 60552899 60552896 +
aaactggcggggcggggggg

SEQ ID NO: 170210 - DNA, 20 bp, Artificial Sequence
  Synthetic oligonucleotide; TGG chr2 60552883 60552902 60552899 +
ctggcggggcggggggggag

SEQ ID NO: 170211 - DNA, 20 bp, Artificial Sequence
  Synthetic oligonucleotide; AAG chr2 60552908 60552927 60552924 +
tcattgcattccttttcgaa

SEQ ID NO: 170212 - DNA, 20 bp, Artificial Sequence
  Synthetic oligonucleotide; GAG chr2 60552910 60552929 60552926 +
attgcattccttttcgaaaa

SEQ ID NO: 170213 - DNA, 20 bp, Artificial Sequence
  Synthetic oligonucleotide; AAG chr2 60552918 60552937 60552934 +
ccttttcgaaaagagaaata

SEQ ID NO: 170214 - DNA, 20 bp, Artificial Sequence
  Synthetic oligonucleotide; CGG chr2 60552921 60552940 60552937 +
tttcgaaaagagaaataaag

SEQ ID NO: 170215 - DNA, 20 bp, Artificial Sequence
  Synthetic oligonucleotide; CGG chr2 60552924 60552943 60552940 +
cgaaaagagaaataaagcgg

SEQ ID NO: 170216 - DNA, 20 bp, Artificial Sequence
  Synthetic oligonucleotide; AAG chr2 60552928 60552947 60552944 +
aagagaaataaagcggcgga

SEQ ID NO: 170217 - DNA, 20 bp, Artificial Sequence
  Synthetic oligonucleotide; AGG chr2 60552929 60552948 60552945 +
agagaaataaagcggcggaa

SEQ ID NO: 170218 - DNA, 20 bp, Artificial Sequence
  Synthetic oligonucleotide; GAG chr2 60552931 60552950 60552947 +
agaaataaagcggcggaaag

SEQ ID NO: 170219 - DNA, 20 bp, Artificial Sequence
  Synthetic oligonucleotide; AGG chr2 60552932 60552951 60552948 +
gaaataaagcggcggaaagg

SEQ ID NO: 170220 - DNA, 20 bp, Artificial Sequence
  Synthetic oligonucleotide; AAG chr2 60552936 60552955 60552952 +
taaagcggcggaaaggagga

SEQ ID NO: 170221 - DNA, 20 bp, Artificial Sequence
  Synthetic oligonucleotide; GAG chr2 60552938 60552957 60552954 +
aagcggcggaaaggaggaaa

SEQ ID NO: 170222 - DNA, 20 bp, Artificial Sequence
  Synthetic oligonucleotide; AGG chr2 60552939 60552958 60552955 +
agcggcggaaaggaggaaag

SEQ ID NO: 170223 - DNA, 20 bp, Artificial Sequence
  Synthetic oligonucleotide; GAG chr2 60552941 60552960 60552957 +
cggcggaaaggaggaaagag

SEQ ID NO: 170224 - DNA, 20 bp, Artificial Sequence
  Synthetic oligonucleotide; AGG chr2 60552942 60552961 60552958 +
ggcggaaaggaggaaagagg

SEQ ID NO: 170225 - DNA, 20 bp, Artificial Sequence
  Synthetic oligonucleotide; GAG chr2 60552944 60552963 60552960 +
cggaaaggaggaaagaggag

SEQ ID NO: 170226 - DNA, 20 bp, Artificial Sequence
  Synthetic oligonucleotide; AAG chr2 60552977 60552996 60552993 +
gtaaaattaaataaaattaa

SEQ ID NO: 170227 - DNA, 20 bp, Artificial Sequence
  Synthetic oligonucleotide; AGG chr2 60552978 60552997 60552994 +
taaaattaaataaaattaaa

SEQ ID NO: 170228 - DNA, 20 bp, Artificial Sequence
  Synthetic oligonucleotide; AAG chr2 60552996 60553015 60553012 +
aaaggtgcgtgctgtctcaa

SEQ ID NO: 170229 - DNA, 20 bp, Artificial Sequence
  Synthetic oligonucleotide; CGG chr2 60553007 60553026 60553023 +
ctgtctcaaaagtgcataca

SEQ ID NO: 170230 - DNA, 20 bp, Artificial Sequence
  Synthetic oligonucleotide; TGG chr2 60553013 60553032 60553029 +
caaaagtgcatacacggcaa

SEQ ID NO: 170231 - DNA, 20 bp, Artificial Sequence
  Synthetic oligonucleotide; CAG chr2 60553019 60553038 60553035 +
tgcatacacggcaatggttc

SEQ ID NO: 170232 - DNA, 20 bp, Artificial Sequence
  Synthetic oligonucleotide; TGG chr2 60553023 60553042 60553039 +
tacacggcaatggttccaga

SEQ ID NO: 170233 - DNA, 20 bp, Artificial Sequence
  Synthetic oligonucleotide; GGG chr2 60553024 60553043 60553040 +
acacggcaatggttccagat

SEQ ID NO: 170234 - DNA, 20 bp, Artificial Sequence
  Synthetic oligonucleotide; GAG chr2 60553029 60553048 60553045 +
gcaatggttccagatgggat

SEQ ID NO: 170235 - DNA, 20 bp, Artificial Sequence
  Synthetic oligonucleotide; AGG chr2 60553030 60553049 60553046 +
caatggttccagatgggatg

SEQ ID NO: 170236 - DNA, 20 bp, Artificial Sequence
  Synthetic oligonucleotide; GGG chr2 60553031 60553050 60553047 +
aatggttccagatgggatga

SEQ ID NO: 170237 - DNA, 20 bp, Artificial Sequence
  Synthetic oligonucleotide; CGG chr2 60553068 60553087 60553084 +
atctcttttacctcgactct

SEQ ID NO: 170238 - DNA, 20 bp, Artificial Sequence
  Synthetic oligonucleotide; GAG chr2 60553070 60553089 60553086 +
ctcttttacctcgactctcg

SEQ ID NO: 170239 - DNA, 20 bp, Artificial Sequence
  Synthetic oligonucleotide; AGG chr2 60553071 60553090 60553087 +
tcttttacctcgactctcgg

SEQ ID NO: 170240 - DNA, 20 bp, Artificial Sequence
  Synthetic oligonucleotide; TAG chr2 60553137 60553156 60553153 +
ctccccctcgcttttgcttc

SEQ ID NO: 170241 - DNA, 20 bp, Artificial Sequence
  Synthetic oligonucleotide; TGG chr2 60553184 60553203 60553200 +
ataattattattactattat

SEQ ID NO: 170242 - DNA, 20 bp, Artificial Sequence
  Synthetic oligonucleotide; GGG chr2 60553185 60553204 60553201 +
taattattattactattatt

SEQ ID NO: 170243 - DNA, 20 bp, Artificial Sequence
  Synthetic oligonucleotide; GAG chr2 60553198 60553217 60553214 +
tattattgggttacttacgc

SEQ ID NO: 170244 - DNA, 20 bp, Artificial Sequence
  Synthetic oligonucleotide; AAG chr2 60553216 60553235 60553232 +
gcgagaattcccgtttgctt

SEQ ID NO: 170245 - DNA, 20 bp, Artificial Sequence
  Synthetic oligonucleotide; TGG chr2 60553222 60553241 60553238 +
attcccgtttgcttaagtgc

SEQ ID NO: 170246 - DNA, 20 bp, Artificial Sequence
  Synthetic oligonucleotide; GGG chr2 60553223 60553242 60553239 +
ttcccgtttgcttaagtgct

SEQ ID NO: 170247 - DNA, 20 bp, Artificial Sequence
  Synthetic oligonucleotide; GGG chr2 60553224 60553243 60553240 +
tcccgtttgcttaagtgctg

SEQ ID NO: 170248 - DNA, 20 bp, Artificial Sequence
  Synthetic oligonucleotide; CGG chr2 60553240 60553259 60553256 +
gctggggtttgccttgcttg

SEQ ID NO: 170249 - DNA, 20 bp, Artificial Sequence
  Synthetic oligonucleotide; GAG chr2 60553244 60553263 60553260 +
gggtttgccttgcttgcggc

SEQ ID NO: 170250 - DNA, 20 bp, Artificial Sequence
  Synthetic oligonucleotide; TGG chr2 60553250 60553269 60553266 +
gccttgcttgcggcgagaca

SEQ ID NO: 170251 - DNA, 20 bp, Artificial Sequence
  Synthetic oligonucleotide; TGG chr2 60553253 60553272 60553269 +
ttgcttgcggcgagacatgg

SEQ ID NO: 170252 - DNA, 20 bp, Artificial Sequence
  Synthetic oligonucleotide; GGG chr2 60553254 60553273 60553270 +
tgcttgcggcgagacatggt

SEQ ID NO: 170253 - DNA, 20 bp, Artificial Sequence
  Synthetic oligonucleotide; CGG chr2 60553260 60553279 60553276 +
cggcgagacatggtgggctg

SEQ ID NO: 170254 - DNA, 20 bp, Artificial Sequence
  Synthetic oligonucleotide; GGG chr2 60553261 60553280 60553277 +
ggcgagacatggtgggctgc

SEQ ID NO: 170255 - DNA, 20 bp, Artificial Sequence
  Synthetic oligonucleotide; GGG chr2 60553262 60553281 60553278 +
gcgagacatggtgggctgcg

SEQ ID NO: 170256 - DNA, 20 bp, Artificial Sequence
  Synthetic oligonucleotide; CGG chr2 60553265 60553284 60553281 +
agacatggtgggctgcgggg

SEQ ID NO: 170257 - DNA, 20 bp, Artificial Sequence
  Synthetic oligonucleotide; GGG chr2 60553266 60553285 60553282 +
gacatggtgggctgcggggc

SEQ ID NO: 170258 - DNA, 20 bp, Artificial Sequence
  Synthetic oligonucleotide; CGG chr2 60553269 60553288 60553285 +
atggtgggctgcggggcggg

SEQ ID NO: 170259 - DNA, 20 bp, Artificial Sequence
  Synthetic oligonucleotide; CGG chr2 60553272 60553291 60553288 +
gtgggctgcggggcgggcgg

SEQ ID NO: 170260 - DNA, 20 bp, Artificial Sequence
  Synthetic oligonucleotide; CGG chr2 60553275 60553294 60553291 +
ggctgcggggcgggcggcgg

SEQ ID NO: 170261 - DNA, 20 bp, Artificial Sequence
  Synthetic oligonucleotide; CGG chr2 60553278 60553297 60553294 +
tgcggggcgggcggcggcgg

SEQ ID NO: 170262 - DNA, 20 bp, Artificial Sequence
  Synthetic oligonucleotide; CGG chr2 60553281 60553300 60553297 +
ggggcgggcggcggcggcgg

SEQ ID NO: 170263 - DNA, 20 bp, Artificial Sequence
  Synthetic oligonucleotide; CGG chr2 60553284 60553303 60553300 +
gcgggcggcggcggcggcgg

SEQ ID NO: 170264 - DNA, 20 bp, Artificial Sequence
  Synthetic oligonucleotide; CGG chr2 60553287 60553306 60553303 +
ggcggcggcggcggcggcgg

SEQ ID NO: 170265 - DNA, 20 bp, Artificial Sequence
  Synthetic oligonucleotide; CGG chr2 60553290 60553309 60553306 +
ggcggcggcggcggcggcgg

SEQ ID NO: 170266 - DNA, 20 bp, Artificial Sequence
  Synthetic oligonucleotide; CGG chr2 60553293 60553312 60553309 +
ggcggcggcggcggcggcgg

SEQ ID NO: 170267 - DNA, 20 bp, Artificial Sequence
  Synthetic oligonucleotide; GGG chr2 60553294 60553313 60553310 +
gcggcggcggcggcggcggc

SEQ ID NO: 170268 - DNA, 20 bp, Artificial Sequence
  Synthetic oligonucleotide; CGG chr2 60553297 60553316 60553313 +
gcggcggcggcggcggcggg

SEQ ID NO: 170269 - DNA, 20 bp, Artificial Sequence
  Synthetic oligonucleotide; CGG chr2 60553304 60553323 60553320 +
cggcggcggcgggcggacga

SEQ ID NO: 170270 - DNA, 20 bp, Artificial Sequence
  Synthetic oligonucleotide; CGG chr2 60553309 60553328 60553325 +
gcggcgggcggacgacggct

SEQ ID NO: 170271 - DNA, 20 bp, Artificial Sequence
  Synthetic oligonucleotide; CGG chr2 60553319 60553338 60553335 +
gacgacggctcggttcacat

SEQ ID NO: 170272 - DNA, 20 bp, Artificial Sequence
  Synthetic oligonucleotide; GGG chr2 60553320 60553339 60553336 +
acgacggctcggttcacatc

SEQ ID NO: 170273 - DNA, 20 bp, Artificial Sequence
  Synthetic oligonucleotide; GAG chr2 60553322 60553341 60553338 +
gacggctcggttcacatcgg

SEQ ID NO: 170274 - DNA, 20 bp, Artificial Sequence
  Synthetic oligonucleotide; GAG chr2 60553324 60553343 60553340 +
cggctcggttcacatcggga

SEQ ID NO: 170275 - DNA, 20 bp, Artificial Sequence
  Synthetic oligonucleotide; CGG chr2 60553328 60553347 60553344 +
tcggttcacatcgggagagc

SEQ ID NO: 170276 - DNA, 20 bp, Artificial Sequence
  Synthetic oligonucleotide; GGG chr2 60553329 60553348 60553345 +
cggttcacatcgggagagcc

SEQ ID NO: 170277 - DNA, 20 bp, Artificial Sequence
  Synthetic oligonucleotide; TAG chr2 60553333 60553352 60553349 +
tcacatcgggagagccgggt

SEQ ID NO: 170278 - DNA, 20 bp, Artificial Sequence
  Synthetic oligonucleotide; AAG chr2 60553337 60553356 60553353 +
atcgggagagccgggttaga

SEQ ID NO: 170279 - DNA, 20 bp, Artificial Sequence
  Synthetic oligonucleotide; AAG chr2 60553340 60553359 60553356 +
gggagagccgggttagaaag

SEQ ID NO: 170280 - DNA, 20 bp, Artificial Sequence
  Synthetic oligonucleotide; AGG chr2 60553341 60553360 60553357 +
ggagagccgggttagaaaga

SEQ ID NO: 170281 - DNA, 20 bp, Artificial Sequence
  Synthetic oligonucleotide; GAG chr2 60553343 60553362 60553359 +
agagccgggttagaaagaag

SEQ ID NO: 170282 - DNA, 20 bp, Artificial Sequence
  Synthetic oligonucleotide; CAG chr2 60553350 60553369 60553366 +
ggttagaaagaaggagactc

SEQ ID NO: 170283 - DNA, 20 bp, Artificial Sequence
  Synthetic oligonucleotide; GAG chr2 60553352 60553371 60553368 +
ttagaaagaaggagactcca

SEQ ID NO: 170284 - DNA, 20 bp, Artificial Sequence
  Synthetic oligonucleotide; CAG chr2 60553368 60553387 60553384 +
tccagagaaaatatcttcat

SEQ ID NO: 170285 - DNA, 20 bp, Artificial Sequence
  Synthetic oligonucleotide; TAG chr2 60553395 60553414 60553411 +
ttttgacatccaaaataaat

SEQ ID NO: 170286 - DNA, 20 bp, Artificial Sequence
  Synthetic oligonucleotide; AAG chr2 60553408 60553427 60553424 +
aataaattagaaataataca

SEQ ID NO: 170287 - DNA, 20 bp, Artificial Sequence
  Synthetic oligonucleotide; TGG chr2 60553412 60553431 60553428 +
aattagaaataatacaaaga

SEQ ID NO: 170288 - DNA, 20 bp, Artificial Sequence
  Synthetic oligonucleotide; CAG chr2 60553417 60553436 60553433 +
gaaataatacaaagatggcg

SEQ ID NO: 170289 - DNA, 20 bp, Artificial Sequence
  Synthetic oligonucleotide; AGG chr2 60553418 60553437 60553434 +
aaataatacaaagatggcgc

SEQ ID NO: 170290 - DNA, 20 bp, Artificial Sequence
  Synthetic oligonucleotide; GGG chr2 60553419 60553438 60553435 +
aataatacaaagatggcgca

SEQ ID NO: 170291 - DNA, 20 bp, Artificial Sequence
  Synthetic oligonucleotide; AAG chr2 60553422 60553441 60553438 +
aatacaaagatggcgcaggg

SEQ ID NO: 170292 - DNA, 20 bp, Artificial Sequence
  Synthetic oligonucleotide; TGG chr2 60553433 60553452 60553449 +
ggcgcagggaagatgaattg

SEQ ID NO: 170293 - DNA, 20 bp, Artificial Sequence
  Synthetic oligonucleotide; GGG chr2 60553434 60553453 60553450 +
gcgcagggaagatgaattgt

SEQ ID NO: 170294 - DNA, 20 bp, Artificial Sequence
  Synthetic oligonucleotide; GAG chr2 60553436 60553455 60553452 +
gcagggaagatgaattgtgg

SEQ ID NO: 170295 - DNA, 20 bp, Artificial Sequence
  Synthetic oligonucleotide; GAG chr2 60553438 60553457 60553454 +
agggaagatgaattgtggga

SEQ ID NO: 170296 - DNA, 20 bp, Artificial Sequence
  Synthetic oligonucleotide; TGG chr2 60553447 60553466 60553463 +
gaattgtgggagagccgtca

SEQ ID NO: 170297 - DNA, 20 bp, Artificial Sequence
  Synthetic oligonucleotide; AAG chr2 60553459 60553478 60553475 +
agccgtcatggctttttttt

SEQ ID NO: 170298 - DNA, 20 bp, Artificial Sequence
  Synthetic oligonucleotide; AAG chr2 60553490 60553509 60553506 +
aaaaaaaaaaaaaaaaaaaa

SEQ ID NO: 170299 - DNA, 20 bp, Artificial Sequence
  Synthetic oligonucleotide; GAG chr2 60553492 60553511 60553508 +
aaaaaaaaaaaaaaaaaaaa

SEQ ID NO: 170300 - DNA, 20 bp, Artificial Sequence
  Synthetic oligonucleotide; AGG chr2 60553493 60553512 60553509 +
aaaaaaaaaaaaaaaaaaag

SEQ ID NO: 170301 - DNA, 20 bp, Artificial Sequence
  Synthetic oligonucleotide; GGG chr2 60553494 60553513 60553510 +
aaaaaaaaaaaaaaaaaaga

SEQ ID NO: 170302 - DNA, 20 bp, Artificial Sequence
  Synthetic oligonucleotide; GAG chr2 60553496 60553515 60553512 +
aaaaaaaaaaaaaaaagagg

SEQ ID NO: 170303 - DNA, 20 bp, Artificial Sequence
  Synthetic oligonucleotide; GAG chr2 60553498 60553517 60553514 +
aaaaaaaaaaaaaagaggga

SEQ ID NO: 170304 - DNA, 20 bp, Artificial Sequence
  Synthetic oligonucleotide; GAG chr2 60553500 60553519 60553516 +
aaaaaaaaaaaagagggaga

SEQ ID NO: 170305 - DNA, 20 bp, Artificial Sequence
  Synthetic oligonucleotide; GAG chr2 60553502 60553521 60553518 +
aaaaaaaaaagagggagaga

SEQ ID NO: 170306 - DNA, 20 bp, Artificial Sequence
  Synthetic oligonucleotide; GAG chr2 60553504 60553523 60553520 +
aaaaaaaagagggagagaga

SEQ ID NO: 170307 - DNA, 20 bp, Artificial Sequence
  Synthetic oligonucleotide; AAG chr2 60553507 60553526 60553523 +
aaaaagagggagagagagag

SEQ ID NO: 170308 - DNA, 20 bp, Artificial Sequence
  Synthetic oligonucleotide; GAG chr2 60553509 60553528 60553525 +
aaagagggagagagagagaa

SEQ ID NO: 170309 - DNA, 20 bp, Artificial Sequence
  Synthetic oligonucleotide; GAG chr2 60553511 60553530 60553527 +
agagggagagagagagaaga

SEQ ID NO: 170310 - DNA, 20 bp, Artificial Sequence
  Synthetic oligonucleotide; TAG chr2 60553515 60553534 60553531 +
ggagagagagagaagagaga

SEQ ID NO: 170311 - DNA, 20 bp, Artificial Sequence
  Synthetic oligonucleotide; GAG chr2 60553517 60553536 60553533 +
agagagagagaagagagata

SEQ ID NO: 170312 - DNA, 20 bp, Artificial Sequence
  Synthetic oligonucleotide; AGG chr2 60553518 60553537 60553534 +
gagagagagaagagagatag

SEQ ID NO: 170313 - DNA, 20 bp, Artificial Sequence
  Synthetic oligonucleotide; GGG chr2 60553519 60553538 60553535 +
agagagagaagagagataga

SEQ ID NO: 170314 - DNA, 20 bp, Artificial Sequence
  Synthetic oligonucleotide; GAG chr2 60553521 60553540 60553537 +
agagagaagagagatagagg

SEQ ID NO: 170315 - DNA, 20 bp, Artificial Sequence
  Synthetic oligonucleotide; GAG chr2 60553523 60553542 60553539 +
agagaagagagatagaggga

SEQ ID NO: 170316 - DNA, 20 bp, Artificial Sequence
  Synthetic oligonucleotide; GAG chr2 60553525 60553544 60553541 +
agaagagagatagagggaga

SEQ ID NO: 170317 - DNA, 20 bp, Artificial Sequence
  Synthetic oligonucleotide; GAG chr2 60553527 60553546 60553543 +
aagagagatagagggagaga

SEQ ID NO: 170318 - DNA, 20 bp, Artificial Sequence
  Synthetic oligonucleotide; GAG chr2 60553529 60553548 60553545 +
gagagatagagggagagaga

SEQ ID NO: 170319 - DNA, 20 bp, Artificial Sequence
  Synthetic oligonucleotide; GAG chr2 60553531 60553550 60553547 +
gagatagagggagagagaga

SEQ ID NO: 170320 - DNA, 20 bp, Artificial Sequence
  Synthetic oligonucleotide; GAG chr2 60553533 60553552 60553549 +
gatagagggagagagagaga

SEQ ID NO: 170321 - DNA, 20 bp, Artificial Sequence
  Synthetic oligonucleotide; GAG chr2 60553535 60553554 60553551 +
tagagggagagagagagaga

SEQ ID NO: 170322 - DNA, 20 bp, Artificial Sequence
  Synthetic oligonucleotide; TGG chr2 60553548 60553567 60553564 +
agagagagagatgaaaaaaa

SEQ ID NO: 170323 - DNA, 20 bp, Artificial Sequence
  Synthetic oligonucleotide; AAG chr2 60553554 60553573 60553570 +
agagatgaaaaaaatggcaa

SEQ ID NO: 170324 - DNA, 20 bp, Artificial Sequence
  Synthetic oligonucleotide; GAG chr2 60553564 60553583 60553580 +
aaaatggcaaaagcccccct

SEQ ID NO: 170325 - DNA, 20 bp, Artificial Sequence
  Synthetic oligonucleotide; AAG chr2 60553571 60553590 60553587 +
caaaagcccccctgagctgc

SEQ ID NO: 170326 - DNA, 20 bp, Artificial Sequence
  Synthetic oligonucleotide; AAG chr2 60553577 60553596 60553593 +
cccccctgagctgcaagttc

SEQ ID NO: 170327 - DNA, 20 bp, Artificial Sequence
  Synthetic oligonucleotide; CGG chr2 60553582 60553601 60553598 +
ctgagctgcaagttcaagtg

SEQ ID NO: 170328 - DNA, 20 bp, Artificial Sequence
  Synthetic oligonucleotide; CAG chr2 60553612 60553631 60553628 +
gtccctgcgaacttgaacgt

SEQ ID NO: 170329 - DNA, 20 bp, Artificial Sequence
  Synthetic oligonucleotide; AGG chr2 60553613 60553632 60553629 +
tccctgcgaacttgaacgtc

SEQ ID NO: 170330 - DNA, 20 bp, Artificial Sequence
  Synthetic oligonucleotide; GAG chr2 60553615 60553634 60553631 +
cctgcgaacttgaacgtcag

SEQ ID NO: 170331 - DNA, 20 bp, Artificial Sequence
  Synthetic oligonucleotide; TGG chr2 60553620 60553639 60553636 +
gaacttgaacgtcaggagtc

SEQ ID NO: 170332 - DNA, 20 bp, Artificial Sequence
  Synthetic oligonucleotide; TGG chr2 60553624 60553643 60553640 +
ttgaacgtcaggagtctgga

SEQ ID NO: 170333 - DNA, 20 bp, Artificial Sequence
  Synthetic oligonucleotide; CAG chr2 60553628 60553647 60553644 +
acgtcaggagtctggatgga

SEQ ID NO: 170334 - DNA, 20 bp, Artificial Sequence
  Synthetic oligonucleotide; GAG chr2 60553630 60553649 60553646 +
gtcaggagtctggatggaca

SEQ ID NO: 170335 - DNA, 20 bp, Artificial Sequence
  Synthetic oligonucleotide; TGG chr2 60553645 60553664 60553661 +
ggacagagacacacaaaaca

SEQ ID NO: 170336 - DNA, 20 bp, Artificial Sequence
  Synthetic oligonucleotide; GGG chr2 60553646 60553665 60553662 +
gacagagacacacaaaacat

SEQ ID NO: 170337 - DNA, 20 bp, Artificial Sequence
  Synthetic oligonucleotide; CAG chr2 60553649 60553668 60553665 +
agagacacacaaaacatggg

SEQ ID NO: 170338 - DNA, 20 bp, Artificial Sequence
  Synthetic oligonucleotide; AGG chr2 60553650 60553669 60553666 +
gagacacacaaaacatgggc

SEQ ID NO: 170339 - DNA, 20 bp, Artificial Sequence
  Synthetic oligonucleotide; GGG chr2 60553651 60553670 60553667 +
agacacacaaaacatgggca

SEQ ID NO: 170340 - DNA, 20 bp, Artificial Sequence
  Synthetic oligonucleotide; GAG chr2 60553655 60553674 60553671 +
acacaaaacatgggcagggc

SEQ ID NO: 170341 - DNA, 20 bp, Artificial Sequence
  Synthetic oligonucleotide; CAG chr2 60553658 60553677 60553674 +
caaaacatgggcagggcgag

SEQ ID NO: 170342 - DNA, 20 bp, Artificial Sequence
  Synthetic oligonucleotide; AGG chr2 60553659 60553678 60553675 +
aaaacatgggcagggcgagc

SEQ ID NO: 170343 - DNA, 20 bp, Artificial Sequence
  Synthetic oligonucleotide; GAG chr2 60553661 60553680 60553677 +
aacatgggcagggcgagcag

SEQ ID NO: 170344 - DNA, 20 bp, Artificial Sequence
  Synthetic oligonucleotide; GAG chr2 60553663 60553682 60553679 +
catgggcagggcgagcagga

SEQ ID NO: 170345 - DNA, 20 bp, Artificial Sequence
  Synthetic oligonucleotide; AAG chr2 60553666 60553685 60553682 +
gggcagggcgagcaggagag

SEQ ID NO: 170346 - DNA, 20 bp, Artificial Sequence
  Synthetic oligonucleotide; AGG chr2 60553667 60553686 60553683 +
ggcagggcgagcaggagaga

SEQ ID NO: 170347 - DNA, 20 bp, Artificial Sequence
  Synthetic oligonucleotide; GGG chr2 60553668 60553687 60553684 +
gcagggcgagcaggagagaa

SEQ ID NO: 170348 - DNA, 20 bp, Artificial Sequence
  Synthetic oligonucleotide; GGG chr2 60553669 60553688 60553685 +
cagggcgagcaggagagaag

SEQ ID NO: 170349 - DNA, 20 bp, Artificial Sequence
  Synthetic oligonucleotide; GAG chr2 60553671 60553690 60553687 +
gggcgagcaggagagaaggg

SEQ ID NO: 170350 - DNA, 20 bp, Artificial Sequence
  Synthetic oligonucleotide; AGG chr2 60553672 60553691 60553688 +
ggcgagcaggagagaagggg

SEQ ID NO: 170351 - DNA, 20 bp, Artificial Sequence
  Synthetic oligonucleotide; GAG chr2 60553674 60553693 60553690 +
cgagcaggagagaaggggag

SEQ ID NO: 170352 - DNA, 20 bp, Artificial Sequence
  Synthetic oligonucleotide; AGG chr2 60553675 60553694 60553691 +
gagcaggagagaaggggagg

SEQ ID NO: 170353 - DNA, 20 bp, Artificial Sequence
  Synthetic oligonucleotide; GGG chr2 60553676 60553695 60553692 +
agcaggagagaaggggagga

SEQ ID NO: 170354 - DNA, 20 bp, Artificial Sequence
  Synthetic oligonucleotide; AAG chr2 60553679 60553698 60553695 +
aggagagaaggggaggaggg

SEQ ID NO: 170355 - DNA, 20 bp, Artificial Sequence
  Synthetic oligonucleotide; AGG chr2 60553680 60553699 60553696 +
ggagagaaggggaggaggga

SEQ ID NO: 170356 - DNA, 20 bp, Artificial Sequence
  Synthetic oligonucleotide; GGG chr2 60553681 60553700 60553697 +
gagagaaggggaggagggaa

SEQ ID NO: 170357 - DNA, 20 bp, Artificial Sequence
  Synthetic oligonucleotide; GGG chr2 60553682 60553701 60553698 +
agagaaggggaggagggaag

SEQ ID NO: 170358 - DNA, 20 bp, Artificial Sequence
  Synthetic oligonucleotide; AAG chr2 60553685 60553704 60553701 +
gaaggggaggagggaagggg

SEQ ID NO: 170359 - DNA, 20 bp, Artificial Sequence
  Synthetic oligonucleotide; TGG chr2 60553698 60553717 60553714 +
gaaggggaagctcacaccaa

SEQ ID NO: 170360 - DNA, 20 bp, Artificial Sequence
  Synthetic oligonucleotide; CAG chr2 60553709 60553728 60553725 +
tcacaccaatggacacacat

SEQ ID NO: 170361 - DNA, 20 bp, Artificial Sequence
  Synthetic oligonucleotide; AGG chr2 60553710 60553729 60553726 +
cacaccaatggacacacatc

SEQ ID NO: 170362 - DNA, 20 bp, Artificial Sequence
  Synthetic oligonucleotide; GGG chr2 60553711 60553730 60553727 +
acaccaatggacacacatca

SEQ ID NO: 170363 - DNA, 20 bp, Artificial Sequence
  Synthetic oligonucleotide; GGG chr2 60553712 60553731 60553728 +
caccaatggacacacatcag

SEQ ID NO: 170364 - DNA, 20 bp, Artificial Sequence
  Synthetic oligonucleotide; TGG chr2 60553716 60553735 60553732 +
aatggacacacatcaggggc

SEQ ID NO: 170365 - DNA, 20 bp, Artificial Sequence
  Synthetic oligonucleotide; AAG chr2 60553727 60553746 60553743 +
atcaggggctggacatgaaa

SEQ ID NO: 170366 - DNA, 20 bp, Artificial Sequence
  Synthetic oligonucleotide; GAG chr2 60553729 60553748 60553745 +
caggggctggacatgaaaaa

SEQ ID NO: 170367 - DNA, 20 bp, Artificial Sequence
  Synthetic oligonucleotide; CAG chr2 60553734 60553753 60553750 +
gctggacatgaaaaagagac

SEQ ID NO: 170368 - DNA, 20 bp, Artificial Sequence
  Synthetic oligonucleotide; AGG chr2 60553735 60553754 60553751 +
ctggacatgaaaaagagacc

SEQ ID NO: 170369 - DNA, 20 bp, Artificial Sequence
  Synthetic oligonucleotide; AAG chr2 60553740 60553759 60553756 +
catgaaaaagagaccaggac

SEQ ID NO: 170370 - DNA, 20 bp, Artificial Sequence
  Synthetic oligonucleotide; TGG chr2 60553747 60553766 60553763 +
aagagaccaggacaagccaa

SEQ ID NO: 170371 - DNA, 20 bp, Artificial Sequence
  Synthetic oligonucleotide; CAG chr2 60553751 60553770 60553767 +
gaccaggacaagccaatggc

SEQ ID NO: 170372 - DNA, 20 bp, Artificial Sequence
  Synthetic oligonucleotide; CGG chr2 60553756 60553775 60553772 +
ggacaagccaatggccagtg

SEQ ID NO: 170373 - DNA, 20 bp, Artificial Sequence
  Synthetic oligonucleotide; GGG chr2 60553757 60553776 60553773 +
gacaagccaatggccagtgc

SEQ ID NO: 170374 - DNA, 20 bp, Artificial Sequence
  Synthetic oligonucleotide; GGG chr2 60553758 60553777 60553774 +
acaagccaatggccagtgcg

SEQ ID NO: 170375 - DNA, 20 bp, Artificial Sequence
  Synthetic oligonucleotide; GAG chr2 60553760 60553779 60553776 +
aagccaatggccagtgcggg

SEQ ID NO: 170376 - DNA, 20 bp, Artificial Sequence
  Synthetic oligonucleotide; AGG chr2 60553761 60553780 60553777 +
agccaatggccagtgcgggg

SEQ ID NO: 170377 - DNA, 20 bp, Artificial Sequence
  Synthetic oligonucleotide; GGG chr2 60553762 60553781 60553778 +
gccaatggccagtgcgggga

SEQ ID NO: 170378 - DNA, 20 bp, Artificial Sequence
  Synthetic oligonucleotide; GGG chr2 60553763 60553782 60553779 +
ccaatggccagtgcggggag

SEQ ID NO: 170379 - DNA, 20 bp, Artificial Sequence
  Synthetic oligonucleotide; GGG chr2 60553764 60553783 60553780 +
caatggccagtgcggggagg

SEQ ID NO: 170380 - DNA, 20 bp, Artificial Sequence
  Synthetic oligonucleotide; GAG chr2 60553766 60553785 60553782 +
atggccagtgcggggagggg

SEQ ID NO: 170381 - DNA, 20 bp, Artificial Sequence
  Synthetic oligonucleotide; AGG chr2 60553767 60553786 60553783 +
tggccagtgcggggaggggg

SEQ ID NO: 170382 - DNA, 20 bp, Artificial Sequence
  Synthetic oligonucleotide; CGG chr2 60553772 60553791 60553788 +
agtgcggggagggggaggtg

SEQ ID NO: 170383 - DNA, 20 bp, Artificial Sequence
  Synthetic oligonucleotide; GGG chr2 60553773 60553792 60553789 +
gtgcggggagggggaggtgc

SEQ ID NO: 170384 - DNA, 20 bp, Artificial Sequence
  Synthetic oligonucleotide; GGG chr2 60553774 60553793 60553790 +
tgcggggagggggaggtgcg

SEQ ID NO: 170385 - DNA, 20 bp, Artificial Sequence
  Synthetic oligonucleotide; CGG chr2 60553777 60553796 60553793 +
ggggagggggaggtgcgggg

SEQ ID NO: 170386 - DNA, 20 bp, Artificial Sequence
  Synthetic oligonucleotide; GGG chr2 60553778 60553797 60553794 +
gggagggggaggtgcggggc

SEQ ID NO: 170387 - DNA, 20 bp, Artificial Sequence
  Synthetic oligonucleotide; GGG chr2 60553779 60553798 60553795 +
ggagggggaggtgcggggcg

SEQ ID NO: 170388 - DNA, 20 bp, Artificial Sequence
  Synthetic oligonucleotide; GGG chr2 60553780 60553799 60553796 +
gagggggaggtgcggggcgg

SEQ ID NO: 170389 - DNA, 20 bp, Artificial Sequence
  Synthetic oligonucleotide; GGG chr2 60553781 60553800 60553797 +
agggggaggtgcggggcggg

SEQ ID NO: 170390 - DNA, 20 bp, Artificial Sequence
  Synthetic oligonucleotide; CGG chr2 60553789 60553808 60553805 +
gtgcggggcggggggctccg

SEQ ID NO: 170391 - DNA, 20 bp, Artificial Sequence
  Synthetic oligonucleotide; CAG chr2 60553796 60553815 60553812 +
gcggggggctccgcggacgc

SEQ ID NO: 170392 - DNA, 20 bp, Artificial Sequence
  Synthetic oligonucleotide; CGG chr2 60553802 60553821 60553818 +
ggctccgcggacgccagacg

SEQ ID NO: 170393 - DNA, 20 bp, Artificial Sequence
  Synthetic oligonucleotide; CGG chr2 60553809 60553828 60553825 +
cggacgccagacgcggcccc

SEQ ID NO: 170394 - DNA, 20 bp, Artificial Sequence
  Synthetic oligonucleotide; GGG chr2 60553810 60553829 60553826 +
ggacgccagacgcggccccc

SEQ ID NO: 170395 - DNA, 20 bp, Artificial Sequence
  Synthetic oligonucleotide; GGG chr2 60553811 60553830 60553827 +
gacgccagacgcggcccccg

SEQ ID NO: 170396 - DNA, 20 bp, Artificial Sequence
  Synthetic oligonucleotide; GGG chr2 60553812 60553831 60553828 +
acgccagacgcggcccccgg

SEQ ID NO: 170397 - DNA, 20 bp, Artificial Sequence
  Synthetic oligonucleotide; GAG chr2 60553814 60553833 60553830 +
gccagacgcggcccccgggg

SEQ ID NO: 170398 - DNA, 20 bp, Artificial Sequence
  Synthetic oligonucleotide; AGG chr2 60553815 60553834 60553831 +
ccagacgcggcccccggggg

SEQ ID NO: 170399 - DNA, 20 bp, Artificial Sequence
  Synthetic oligonucleotide; GGG chr2 60553816 60553835 60553832 +
cagacgcggcccccggggga

SEQ ID NO: 170400 - DNA, 20 bp, Artificial Sequence
  Synthetic oligonucleotide; GGG chr2 60553817 60553836 60553833 +
agacgcggcccccgggggag

SEQ ID NO: 170401 - DNA, 20 bp, Artificial Sequence
  Synthetic oligonucleotide; CGG chr2 60553820 60553839 60553836 +
cgcggcccccgggggagggg

SEQ ID NO: 170402 - DNA, 20 bp, Artificial Sequence
  Synthetic oligonucleotide; GGG chr2 60553821 60553840 60553837 +
gcggcccccgggggaggggc

SEQ ID NO: 170403 - DNA, 20 bp, Artificial Sequence
  Synthetic oligonucleotide; GAG chr2 60553826 60553845 60553842 +
ccccgggggaggggcgggcc

SEQ ID NO: 170404 - DNA, 20 bp, Artificial Sequence
  Synthetic oligonucleotide; AGG chr2 60553827 60553846 60553843 +
cccgggggaggggcgggccg

SEQ ID NO: 170405 - DNA, 20 bp, Artificial Sequence
  Synthetic oligonucleotide; GGG chr2 60553828 60553847 60553844 +
ccgggggaggggcgggccga

SEQ ID NO: 170406 - DNA, 20 bp, Artificial Sequence
  Synthetic oligonucleotide; GGG chr2 60553829 60553848 60553845 +
cgggggaggggcgggccgag

SEQ ID NO: 170407 - DNA, 20 bp, Artificial Sequence
  Synthetic oligonucleotide; GAG chr2 60553831 60553850 60553847 +
ggggaggggcgggccgaggg

SEQ ID NO: 170408 - DNA, 20 bp, Artificial Sequence
  Synthetic oligonucleotide; AGG chr2 60553832 60553851 60553848 +
gggaggggcgggccgagggg

SEQ ID NO: 170409 - DNA, 20 bp, Artificial Sequence
  Synthetic oligonucleotide; GGG chr2 60553833 60553852 60553849 +
ggaggggcgggccgagggga

SEQ ID NO: 170410 - DNA, 20 bp, Artificial Sequence
  Synthetic oligonucleotide; GGG chr2 60553834 60553853 60553850 +
gaggggcgggccgaggggag

SEQ ID NO: 170411 - DNA, 20 bp, Artificial Sequence
  Synthetic oligonucleotide; GGG chr2 60553835 60553854 60553851 +
aggggcgggccgaggggagg

SEQ ID NO: 170412 - DNA, 20 bp, Artificial Sequence
  Synthetic oligonucleotide; TGG chr2 60553841 60553860 60553857 +
gggccgaggggagggggcgc

SEQ ID NO: 170413 - DNA, 20 bp, Artificial Sequence
  Synthetic oligonucleotide; GGG chr2 60553842 60553861 60553858 +
ggccgaggggagggggcgct

SEQ ID NO: 170414 - DNA, 20 bp, Artificial Sequence
  Synthetic oligonucleotide; GGG chr2 60553843 60553862 60553859 +
gccgaggggagggggcgctg

SEQ ID NO: 170415 - DNA, 20 bp, Artificial Sequence
  Synthetic oligonucleotide; CGG chr2 60553849 60553868 60553865 +
gggagggggcgctggggccg

SEQ ID NO: 170416 - DNA, 20 bp, Artificial Sequence
  Synthetic oligonucleotide; GGG chr2 60553850 60553869 60553866 +
ggagggggcgctggggccgc

SEQ ID NO: 170417 - DNA, 20 bp, Artificial Sequence
  Synthetic oligonucleotide; CAG chr2 60553858 60553877 60553874 +
cgctggggccgcgggctcac

SEQ ID NO: 170418 - DNA, 20 bp, Artificial Sequence
  Synthetic oligonucleotide; TGG chr2 60553861 60553880 60553877 +
tggggccgcgggctcaccag

SEQ ID NO: 170419 - DNA, 20 bp, Artificial Sequence
  Synthetic oligonucleotide; CAG chr2 60553867 60553886 60553883 +
cgcgggctcaccagtggccg

SEQ ID NO: 170420 - DNA, 20 bp, Artificial Sequence
  Synthetic oligonucleotide; GAG chr2 60553871 60553890 60553887 +
ggctcaccagtggccgcagc

SEQ ID NO: 170421 - DNA, 20 bp, Artificial Sequence
  Synthetic oligonucleotide; CGG chr2 60553879 60553898 60553895 +
agtggccgcagcgagcgccg

SEQ ID NO: 170422 - DNA, 20 bp, Artificial Sequence
  Synthetic oligonucleotide; CGG chr2 60553882 60553901 60553898 +
ggccgcagcgagcgccgcgg

SEQ ID NO: 170423 - DNA, 20 bp, Artificial Sequence
  Synthetic oligonucleotide; TGG chr2 60553885 60553904 60553901 +
cgcagcgagcgccgcggcgg

SEQ ID NO: 170424 - DNA, 20 bp, Artificial Sequence
  Synthetic oligonucleotide; TGG chr2 60553890 60553909 60553906 +
cgagcgccgcggcggtggcg

SEQ ID NO: 170425 - DNA, 20 bp, Artificial Sequence
  Synthetic oligonucleotide; CGG chr2 60553894 60553913 60553910 +
cgccgcggcggtggcgtggc

SEQ ID NO: 170426 - DNA, 20 bp, Artificial Sequence
  Synthetic oligonucleotide; GGG chr2 60553895 60553914 60553911 +
gccgcggcggtggcgtggcc

SEQ ID NO: 170427 - DNA, 20 bp, Artificial Sequence
  Synthetic oligonucleotide; GAG chr2 60553897 60553916 60553913 +
cgcggcggtggcgtggccgg

SEQ ID NO: 170428 - DNA, 20 bp, Artificial Sequence
  Synthetic oligonucleotide; GAG chr2 60553899 60553918 60553915 +
cggcggtggcgtggccggga

SEQ ID NO: 170429 - DNA, 20 bp, Artificial Sequence
  Synthetic oligonucleotide; AAG chr2 60553902 60553921 60553918 +
cggtggcgtggccgggagag

SEQ ID NO: 170430 - DNA, 20 bp, Artificial Sequence
  Synthetic oligonucleotide; AAG chr2 60553906 60553925 60553922 +
ggcgtggccgggagagaaga

SEQ ID NO: 170431 - DNA, 20 bp, Artificial Sequence
  Synthetic oligonucleotide; AGG chr2 60553907 60553926 60553923 +
gcgtggccgggagagaagaa

SEQ ID NO: 170432 - DNA, 20 bp, Artificial Sequence
  Synthetic oligonucleotide; GGG chr2 60553908 60553927 60553924 +
cgtggccgggagagaagaaa

SEQ ID NO: 170433 - DNA, 20 bp, Artificial Sequence
  Synthetic oligonucleotide; GGG chr2 60553909 60553928 60553925 +
gtggccgggagagaagaaag

SEQ ID NO: 170434 - DNA, 20 bp, Artificial Sequence
  Synthetic oligonucleotide; TGG chr2 60553912 60553931 60553928 +
gccgggagagaagaaagggg

SEQ ID NO: 170435 - DNA, 20 bp, Artificial Sequence
  Synthetic oligonucleotide; CAG chr2 60553915 60553934 60553931 +
gggagagaagaaaggggtgg

SEQ ID NO: 170436 - DNA, 20 bp, Artificial Sequence
  Synthetic oligonucleotide; AGG chr2 60553916 60553935 60553932 +
ggagagaagaaaggggtggc

SEQ ID NO: 170437 - DNA, 20 bp, Artificial Sequence
  Synthetic oligonucleotide; GGG chr2 60553917 60553936 60553933 +
gagagaagaaaggggtggca

SEQ ID NO: 170438 - DNA, 20 bp, Artificial Sequence
  Synthetic oligonucleotide; GGG chr2 60553918 60553937 60553934 +
agagaagaaaggggtggcag

SEQ ID NO: 170439 - DNA, 20 bp, Artificial Sequence
  Synthetic oligonucleotide; TGG chr2 60553921 60553940 60553937 +
gaagaaaggggtggcagggg

SEQ ID NO: 170440 - DNA, 20 bp, Artificial Sequence
  Synthetic oligonucleotide; GGG chr2 60553922 60553941 60553938 +
aagaaaggggtggcaggggt

SEQ ID NO: 170441 - DNA, 20 bp, Artificial Sequence
  Synthetic oligonucleotide; GAG chr2 60553924 60553943 60553940 +
gaaaggggtggcaggggtgg

SEQ ID NO: 170442 - DNA, 20 bp, Artificial Sequence
  Synthetic oligonucleotide; AGG chr2 60553925 60553944 60553941 +
aaaggggtggcaggggtggg

SEQ ID NO: 170443 - DNA, 20 bp, Artificial Sequence
  Synthetic oligonucleotide; AAG chr2 60553929 60553948 60553945 +
gggtggcaggggtgggagga

SEQ ID NO: 170444 - DNA, 20 bp, Artificial Sequence
  Synthetic oligonucleotide; AGG chr2 60553930 60553949 60553946 +
ggtggcaggggtgggaggaa

SEQ ID NO: 170445 - DNA, 20 bp, Artificial Sequence
  Synthetic oligonucleotide; GGG chr2 60553931 60553950 60553947 +
gtggcaggggtgggaggaaa

SEQ ID NO: 170446 - DNA, 20 bp, Artificial Sequence
  Synthetic oligonucleotide; TGG chr2 60553934 60553953 60553950 +
gcaggggtgggaggaaaggg

SEQ ID NO: 170447 - DNA, 20 bp, Artificial Sequence
  Synthetic oligonucleotide; GGG chr2 60553935 60553954 60553951 +
caggggtgggaggaaagggt

SEQ ID NO: 170448 - DNA, 20 bp, Artificial Sequence
  Synthetic oligonucleotide; GGG chr2 60553936 60553955 60553952 +
aggggtgggaggaaagggtg

SEQ ID NO: 170449 - DNA, 20 bp, Artificial Sequence
  Synthetic oligonucleotide; GGG chr2 60553937 60553956 60553953 +
ggggtgggaggaaagggtgg

SEQ ID NO: 170450 - DNA, 20 bp, Artificial Sequence
  Synthetic oligonucleotide; GGG chr2 60553938 60553957 60553954 +
gggtgggaggaaagggtggg

SEQ ID NO: 170451 - DNA, 20 bp, Artificial Sequence
  Synthetic oligonucleotide; GGG chr2 60553939 60553958 60553955 +
ggtgggaggaaagggtgggg

SEQ ID NO: 170452 - DNA, 20 bp, Artificial Sequence
  Synthetic oligonucleotide; GAG chr2 60553941 60553960 60553957 +
tgggaggaaagggtgggggg

SEQ ID NO: 170453 - DNA, 20 bp, Artificial Sequence
  Synthetic oligonucleotide; AAG chr2 60553945 60553964 60553961 +
aggaaagggtgggggggagc

SEQ ID NO: 170454 - DNA, 20 bp, Artificial Sequence
  Synthetic oligonucleotide; CGG chr2 60553976 60553995 60553992 +
cctgctcccccccacacacg

SEQ ID NO: 170455 - DNA, 20 bp, Artificial Sequence
  Synthetic oligonucleotide; AAG chr2 60553991 60554010 60554007 +
acacgcggactctaaaatga

SEQ ID NO: 170456 - DNA, 20 bp, Artificial Sequence
  Synthetic oligonucleotide; AAG chr2 60554005 60554024 60554021 +
aaatgaaagattattcaaaa

SEQ ID NO: 170457 - DNA, 20 bp, Artificial Sequence
  Synthetic oligonucleotide; TAG chr2 60554015 60554034 60554031 +
ttattcaaaaaagaaaaaaa

SEQ ID NO: 170458 - DNA, 20 bp, Artificial Sequence
  Synthetic oligonucleotide; GAG chr2 60554017 60554036 60554033 +
attcaaaaaagaaaaaaata

SEQ ID NO: 170459 - DNA, 20 bp, Artificial Sequence
  Synthetic oligonucleotide; GAG chr2 60554021 60554040 60554037 +
aaaaaagaaaaaaatagagc

SEQ ID NO: 170460 - DNA, 20 bp, Artificial Sequence
  Synthetic oligonucleotide; GAG chr2 60554023 60554042 60554039 +
aaaagaaaaaaatagagcga

SEQ ID NO: 170461 - DNA, 20 bp, Artificial Sequence
  Synthetic oligonucleotide; CGG chr2 60554031 60554050 60554047 +
aaaatagagcgagagtgcac

SEQ ID NO: 170462 - DNA, 20 bp, Artificial Sequence
  Synthetic oligonucleotide; GGG chr2 60554032 60554051 60554048 +
aaatagagcgagagtgcacc

SEQ ID NO: 170463 - DNA, 20 bp, Artificial Sequence
  Synthetic oligonucleotide; GAG chr2 60554034 60554053 60554050 +
atagagcgagagtgcaccgg

SEQ ID NO: 170464 - DNA, 20 bp, Artificial Sequence
  Synthetic oligonucleotide; AGG chr2 60554035 60554054 60554051 +
tagagcgagagtgcaccggg

SEQ ID NO: 170465 - DNA, 20 bp, Artificial Sequence
  Synthetic oligonucleotide; CAG chr2 60554041 60554060 60554057 +
gagagtgcaccgggaggctg

SEQ ID NO: 170466 - DNA, 20 bp, Artificial Sequence
  Synthetic oligonucleotide; CGG chr2 60554047 60554066 60554063 +
gcaccgggaggctgcagccc

SEQ ID NO: 170467 - DNA, 20 bp, Artificial Sequence
  Synthetic oligonucleotide; GGG chr2 60554048 60554067 60554064 +
caccgggaggctgcagcccc

SEQ ID NO: 170468 - DNA, 20 bp, Artificial Sequence
  Synthetic oligonucleotide; TGG chr2 60554052 60554071 60554068 +
gggaggctgcagccccgggc

SEQ ID NO: 170469 - DNA, 20 bp, Artificial Sequence
  Synthetic oligonucleotide; GGG chr2 60554053 60554072 60554069 +
ggaggctgcagccccgggct

SEQ ID NO: 170470 - DNA, 20 bp, Artificial Sequence
  Synthetic oligonucleotide; GGG chr2 60554054 60554073 60554070 +
gaggctgcagccccgggctg

SEQ ID NO: 170471 - DNA, 20 bp, Artificial Sequence
  Synthetic oligonucleotide; AAG chr2 60554057 60554076 60554073 +
gctgcagccccgggctgggg

SEQ ID NO: 170472 - DNA, 20 bp, Artificial Sequence
  Synthetic oligonucleotide; CGG chr2 60554062 60554081 60554078 +
agccccgggctggggaagcg

SEQ ID NO: 170473 - DNA, 20 bp, Artificial Sequence
  Synthetic oligonucleotide; GGG chr2 60554063 60554082 60554079 +
gccccgggctggggaagcgc

SEQ ID NO: 170474 - DNA, 20 bp, Artificial Sequence
  Synthetic oligonucleotide; CGG chr2 60554066 60554085 60554082 +
ccgggctggggaagcgcggg

SEQ ID NO: 170475 - DNA, 20 bp, Artificial Sequence
  Synthetic oligonucleotide; GAG chr2 60554068 60554087 60554084 +
gggctggggaagcgcgggcg

SEQ ID NO: 170476 - DNA, 20 bp, Artificial Sequence
  Synthetic oligonucleotide; AGG chr2 60554069 60554088 60554085 +
ggctggggaagcgcgggcgg

SEQ ID NO: 170477 - DNA, 20 bp, Artificial Sequence
  Synthetic oligonucleotide; GGG chr2 60554070 60554089 60554086 +
gctggggaagcgcgggcgga

SEQ ID NO: 170478 - DNA, 20 bp, Artificial Sequence
  Synthetic oligonucleotide; AAG chr2 60554073 60554092 60554089 +
ggggaagcgcgggcggaggg

SEQ ID NO: 170479 - DNA, 20 bp, Artificial Sequence
  Synthetic oligonucleotide; CAG chr2 60554077 60554096 60554093 +
aagcgcgggcggagggaagc

SEQ ID NO: 170480 - DNA, 20 bp, Artificial Sequence
  Synthetic oligonucleotide; AGG chr2 60554078 60554097 60554094 +
agcgcgggcggagggaagcc

SEQ ID NO: 170481 - DNA, 20 bp, Artificial Sequence
  Synthetic oligonucleotide; TAG chr2 60554081 60554100 60554097 +
gcgggcggagggaagccagg

SEQ ID NO: 170482 - DNA, 20 bp, Artificial Sequence
  Synthetic oligonucleotide; GAG chr2 60554083 60554102 60554099 +
gggcggagggaagccaggta

SEQ ID NO: 170483 - DNA, 20 bp, Artificial Sequence
  Synthetic oligonucleotide; CGG chr2 60554093 60554112 60554109 +
aagccaggtagagttgctcc

SEQ ID NO: 170484 - DNA, 20 bp, Artificial Sequence
  Synthetic oligonucleotide; TGG chr2 60554160 60554179 60554176 +
ccgcgctcgctccccgcgtg

SEQ ID NO: 170485 - DNA, 20 bp, Artificial Sequence
  Synthetic oligonucleotide; CAG chr2 60554167 60554186 60554183 +
cgctccccgcgtgtggacgc

SEQ ID NO: 170486 - DNA, 20 bp, Artificial Sequence
  Synthetic oligonucleotide; AGG chr2 60554168 60554187 60554184 +
gctccccgcgtgtggacgcc

SEQ ID NO: 170487 - DNA, 20 bp, Artificial Sequence
  Synthetic oligonucleotide; GGG chr2 60554169 60554188 60554185 +
ctccccgcgtgtggacgcca

SEQ ID NO: 170488 - DNA, 20 bp, Artificial Sequence
  Synthetic oligonucleotide; GGG chr2 60554170 60554189 60554186 +
tccccgcgtgtggacgccag

SEQ ID NO: 170489 - DNA, 20 bp, Artificial Sequence
  Synthetic oligonucleotide; AAG chr2 60554176 60554195 60554192 +
cgtgtggacgccaggggccg

SEQ ID NO: 170490 - DNA, 20 bp, Artificial Sequence
  Synthetic oligonucleotide; AAG chr2 60554182 60554201 60554198 +
gacgccaggggccgaagtaa

SEQ ID NO: 170491 - DNA, 20 bp, Artificial Sequence
  Synthetic oligonucleotide; GAG chr2 60554189 60554208 60554205 +
ggggccgaagtaaaagcccc

SEQ ID NO: 170492 - DNA, 20 bp, Artificial Sequence
  Synthetic oligonucleotide; CGG chr2 60554196 60554215 60554212 +
aagtaaaagccccgagcccg

SEQ ID NO: 170493 - DNA, 20 bp, Artificial Sequence
  Synthetic oligonucleotide; CGG chr2 60554206 60554225 60554222 +
cccgagcccgcggctgcgct

SEQ ID NO: 170494 - DNA, 20 bp, Artificial Sequence
  Synthetic oligonucleotide; GGG chr2 60554207 60554226 60554223 +
ccgagcccgcggctgcgctc

SEQ ID NO: 170495 - DNA, 20 bp, Artificial Sequence
  Synthetic oligonucleotide; GAG chr2 60554221 60554240 60554237 +
gcgctcgggaaactttgccc

SEQ ID NO: 170496 - DNA, 20 bp, Artificial Sequence
  Synthetic oligonucleotide; AGG chr2 60554222 60554241 60554238 +
cgctcgggaaactttgcccg

SEQ ID NO: 170497 - DNA, 20 bp, Artificial Sequence
  Synthetic oligonucleotide; GAG chr2 60554224 60554243 60554240 +
ctcgggaaactttgcccgag

SEQ ID NO: 170498 - DNA, 20 bp, Artificial Sequence
  Synthetic oligonucleotide; GAG chr2 60554226 60554245 60554242 +
cgggaaactttgcccgagga

SEQ ID NO: 170499 - DNA, 20 bp, Artificial Sequence
  Synthetic oligonucleotide; AGG chr2 60554227 60554246 60554243 +
gggaaactttgcccgaggag

SEQ ID NO: 170500 - DNA, 20 bp, Artificial Sequence
  Synthetic oligonucleotide; CAG chr2 60554231 60554250 60554247 +
aactttgcccgaggagagga

SEQ ID NO: 170501 - DNA, 20 bp, Artificial Sequence
  Synthetic oligonucleotide; AAG chr2 60554236 60554255 60554252 +
tgcccgaggagaggacagca

SEQ ID NO: 170502 - DNA, 20 bp, Artificial Sequence
  Synthetic oligonucleotide; AAG chr2 60554251 60554270 60554267 +
cagcaaagaaaaatcacccg

SEQ ID NO: 170503 - DNA, 20 bp, Artificial Sequence
  Synthetic oligonucleotide; GAG chr2 60554256 60554275 60554272 +
aagaaaaatcacccgaagtt

SEQ ID NO: 170504 - DNA, 20 bp, Artificial Sequence
  Synthetic oligonucleotide; GAG chr2 60554258 60554277 60554274 +
gaaaaatcacccgaagttga

SEQ ID NO: 170505 - DNA, 20 bp, Artificial Sequence
  Synthetic oligonucleotide; GAG chr2 60554263 60554282 60554279 +
atcacccgaagttgagagct

SEQ ID NO: 170506 - DNA, 20 bp, Artificial Sequence
  Synthetic oligonucleotide; AAG chr2 60554271 60554290 60554287 +
aagttgagagctgagcctcc

SEQ ID NO: 170507 - DNA, 20 bp, Artificial Sequence
  Synthetic oligonucleotide; CAG chr2 60554277 60554296 60554293 +
agagctgagcctccaagtta

SEQ ID NO: 170508 - DNA, 20 bp, Artificial Sequence
  Synthetic oligonucleotide; CAG chr2 60554285 60554304 60554301 +
gcctccaagttacagctccg

SEQ ID NO: 170509 - DNA, 20 bp, Artificial Sequence
  Synthetic oligonucleotide; CGG chr2 60554288 60554307 60554304 +
tccaagttacagctccgcag

SEQ ID NO: 170510 - DNA, 20 bp, Artificial Sequence
  Synthetic oligonucleotide; GGG chr2 60554289 60554308 60554305 +
ccaagttacagctccgcagc

SEQ ID NO: 170511 - DNA, 20 bp, Artificial Sequence
  Synthetic oligonucleotide; GAG chr2 60554293 60554312 60554309 +
gttacagctccgcagcgggc

SEQ ID NO: 170512 - DNA, 20 bp, Artificial Sequence
  Synthetic oligonucleotide; AGG chr2 60554294 60554313 60554310 +
ttacagctccgcagcgggcg

SEQ ID NO: 170513 - DNA, 20 bp, Artificial Sequence
  Synthetic oligonucleotide; GGG chr2 60554295 60554314 60554311 +
tacagctccgcagcgggcga

SEQ ID NO: 170514 - DNA, 20 bp, Artificial Sequence
  Synthetic oligonucleotide; GGG chr2 60554296 60554315 60554312 +
acagctccgcagcgggcgag

SEQ ID NO: 170515 - DNA, 20 bp, Artificial Sequence
  Synthetic oligonucleotide; GAG chr2 60554298 60554317 60554314 +
agctccgcagcgggcgaggg

SEQ ID NO: 170516 - DNA, 20 bp, Artificial Sequence
  Synthetic oligonucleotide; AGG chr2 60554299 60554318 60554315 +
gctccgcagcgggcgagggg

SEQ ID NO: 170517 - DNA, 20 bp, Artificial Sequence
  Synthetic oligonucleotide; TGG chr2 60554302 60554321 60554318 +
ccgcagcgggcgaggggagg

SEQ ID NO: 170518 - DNA, 20 bp, Artificial Sequence
  Synthetic oligonucleotide; GGG chr2 60554303 60554322 60554319 +
cgcagcgggcgaggggaggt

SEQ ID NO: 170519 - DNA, 20 bp, Artificial Sequence
  Synthetic oligonucleotide; GAG chr2 60554305 60554324 60554321 +
cagcgggcgaggggaggtgg

SEQ ID NO: 170520 - DNA, 20 bp, Artificial Sequence
  Synthetic oligonucleotide; AGG chr2 60554306 60554325 60554322 +
agcgggcgaggggaggtggg

SEQ ID NO: 170521 - DNA, 20 bp, Artificial Sequence
  Synthetic oligonucleotide; GGG chr2 60554307 60554326 60554323 +
gcgggcgaggggaggtggga

SEQ ID NO: 170522 - DNA, 20 bp, Artificial Sequence
  Synthetic oligonucleotide; GAG chr2 60554309 60554328 60554325 +
gggcgaggggaggtgggagg

SEQ ID NO: 170523 - DNA, 20 bp, Artificial Sequence
  Synthetic oligonucleotide; CGG chr2 60554316 60554335 60554332 +
gggaggtgggagggagcgca

SEQ ID NO: 170524 - DNA, 20 bp, Artificial Sequence
  Synthetic oligonucleotide; CGG chr2 60554324 60554343 60554340 +
ggagggagcgcacggcaacg

SEQ ID NO: 170525 - DNA, 20 bp, Artificial Sequence
  Synthetic oligonucleotide; CAG chr2 60554331 60554350 60554347 +
gcgcacggcaacgcggaatc

SEQ ID NO: 170526 - DNA, 20 bp, Artificial Sequence
  Synthetic oligonucleotide; AAG chr2 60554337 60554356 60554353 +
ggcaacgcggaatccagcct

SEQ ID NO: 170527 - DNA, 20 bp, Artificial Sequence
  Synthetic oligonucleotide; TGG chr2 60554342 60554361 60554358 +
cgcggaatccagcctaagtt

SEQ ID NO: 170528 - DNA, 20 bp, Artificial Sequence
  Synthetic oligonucleotide; GAG chr2 60554344 60554363 60554360 +
cggaatccagcctaagtttg

SEQ ID NO: 170529 - DNA, 20 bp, Artificial Sequence
  Synthetic oligonucleotide; AGG chr2 60554345 60554364 60554361 +
ggaatccagcctaagtttgg

SEQ ID NO: 170530 - DNA, 20 bp, Artificial Sequence
  Synthetic oligonucleotide; GGG chr2 60554346 60554365 60554362 +
gaatccagcctaagtttgga

SEQ ID NO: 170531 - DNA, 20 bp, Artificial Sequence
  Synthetic oligonucleotide; CGG chr2 60554352 60554371 60554368 +
agcctaagtttggagggctg

SEQ ID NO: 170532 - DNA, 20 bp, Artificial Sequence
  Synthetic oligonucleotide; GGG chr2 60554353 60554372 60554369 +
gcctaagtttggagggctgc

SEQ ID NO: 170533 - DNA, 20 bp, Artificial Sequence
  Synthetic oligonucleotide; CGG chr2 60554358 60554377 60554374 +
agtttggagggctgcgggtc

SEQ ID NO: 170534 - DNA, 20 bp, Artificial Sequence
  Synthetic oligonucleotide; AAG chr2 60554361 60554380 60554377 +
ttggagggctgcgggtccgg

SEQ ID NO: 170535 - DNA, 20 bp, Artificial Sequence
  Synthetic oligonucleotide; AGG chr2 60554362 60554381 60554378 +
tggagggctgcgggtccgga

SEQ ID NO: 170536 - DNA, 20 bp, Artificial Sequence
  Synthetic oligonucleotide; GGG chr2 60554363 60554382 60554379 +
ggagggctgcgggtccggaa

SEQ ID NO: 170537 - DNA, 20 bp, Artificial Sequence
  Synthetic oligonucleotide; CAG chr2 60554366 60554385 60554382 +
gggctgcgggtccggaaggg

SEQ ID NO: 170538 - DNA, 20 bp, Artificial Sequence
  Synthetic oligonucleotide; AAG chr2 60554374 60554393 60554390 +
ggtccggaagggcagcgccc

SEQ ID NO: 170539 - DNA, 20 bp, Artificial Sequence
  Synthetic oligonucleotide; CAG chr2 60554381 60554400 60554397 +
aagggcagcgcccaagtctc

SEQ ID NO: 170540 - DNA, 20 bp, Artificial Sequence
  Synthetic oligonucleotide; AGG chr2 60554382 60554401 60554398 +
agggcagcgcccaagtctcc

SEQ ID NO: 170541 - DNA, 20 bp, Artificial Sequence
  Synthetic oligonucleotide; GAG chr2 60554384 60554403 60554400 +
ggcagcgcccaagtctccag

SEQ ID NO: 170542 - DNA, 20 bp, Artificial Sequence
  Synthetic oligonucleotide; CGG chr2 60554393 60554412 60554409 +
caagtctccaggagcccgcg

SEQ ID NO: 170543 - DNA, 20 bp, Artificial Sequence
  Synthetic oligonucleotide; TGG chr2 60554398 60554417 60554414 +
ctccaggagcccgcgcggcc

SEQ ID NO: 170544 - DNA, 20 bp, Artificial Sequence
  Synthetic oligonucleotide; AAG chr2 60554402 60554421 60554418 +
aggagcccgcgcggcctgga

SEQ ID NO: 170545 - DNA, 20 bp, Artificial Sequence
  Synthetic oligonucleotide; GAG chr2 60554404 60554423 60554420 +
gagcccgcgcggcctggaaa

SEQ ID NO: 170546 - DNA, 20 bp, Artificial Sequence
  Synthetic oligonucleotide; AGG chr2 60554405 60554424 60554421 +
agcccgcgcggcctggaaag

SEQ ID NO: 170547 - DNA, 20 bp, Artificial Sequence
  Synthetic oligonucleotide; GGG chr2 60554406 60554425 60554422 +
gcccgcgcggcctggaaaga

SEQ ID NO: 170548 - DNA, 20 bp, Artificial Sequence
  Synthetic oligonucleotide; GGG chr2 60554407 60554426 60554423 +
cccgcgcggcctggaaagag

SEQ ID NO: 170549 - DNA, 20 bp, Artificial Sequence
  Synthetic oligonucleotide; CGG chr2 60554412 60554431 60554428 +
gcggcctggaaagaggggac

SEQ ID NO: 170550 - DNA, 20 bp, Artificial Sequence
  Synthetic oligonucleotide; GGG chr2 60554413 60554432 60554429 +
cggcctggaaagaggggacc

SEQ ID NO: 170551 - DNA, 20 bp, Artificial Sequence
  Synthetic oligonucleotide; GGG chr2 60554414 60554433 60554430 +
ggcctggaaagaggggaccg

SEQ ID NO: 170552 - DNA, 20 bp, Artificial Sequence
  Synthetic oligonucleotide; GAG chr2 60554416 60554435 60554432 +
cctggaaagaggggaccggg

SEQ ID NO: 170553 - DNA, 20 bp, Artificial Sequence
  Synthetic oligonucleotide; GAG chr2 60554418 60554437 60554434 +
tggaaagaggggaccgggga

SEQ ID NO: 170554 - DNA, 20 bp, Artificial Sequence
  Synthetic oligonucleotide; AGG chr2 60554419 60554438 60554435 +
ggaaagaggggaccggggag

SEQ ID NO: 170555 - DNA, 20 bp, Artificial Sequence
  Synthetic oligonucleotide; CAG chr2 60554422 60554441 60554438 +
aagaggggaccggggagagg

SEQ ID NO: 170556 - DNA, 20 bp, Artificial Sequence
  Synthetic oligonucleotide; AGG chr2 60554423 60554442 60554439 +
agaggggaccggggagaggc

SEQ ID NO: 170557 - DNA, 20 bp, Artificial Sequence
  Synthetic oligonucleotide; CGG chr2 60554426 60554445 60554442 +
ggggaccggggagaggcagg

SEQ ID NO: 170558 - DNA, 20 bp, Artificial Sequence
  Synthetic oligonucleotide; CAG chr2 60554431 60554450 60554447 +
ccggggagaggcaggcggcg

SEQ ID NO: 170559 - DNA, 20 bp, Artificial Sequence
  Synthetic oligonucleotide; AGG chr2 60554432 60554451 60554448 +
cggggagaggcaggcggcgc

SEQ ID NO: 170560 - DNA, 20 bp, Artificial Sequence
  Synthetic oligonucleotide; CGG chr2 60554436 60554455 60554452 +
gagaggcaggcggcgcaggc

SEQ ID NO: 170561 - DNA, 20 bp, Artificial Sequence
  Synthetic oligonucleotide; GGG chr2 60554437 60554456 60554453 +
agaggcaggcggcgcaggcc

SEQ ID NO: 170562 - DNA, 20 bp, Artificial Sequence
  Synthetic oligonucleotide; GGG chr2 60554438 60554457 60554454 +
gaggcaggcggcgcaggccg

SEQ ID NO: 170563 - DNA, 20 bp, Artificial Sequence
  Synthetic oligonucleotide; GAG chr2 60554444 60554463 60554460 +
ggcggcgcaggccggggccc

SEQ ID NO: 170564 - DNA, 20 bp, Artificial Sequence
  Synthetic oligonucleotide; AGG chr2 60554445 60554464 60554461 +
gcggcgcaggccggggcccg

SEQ ID NO: 170565 - DNA, 20 bp, Artificial Sequence
  Synthetic oligonucleotide; GGG chr2 60554446 60554465 60554462 +
cggcgcaggccggggcccga

SEQ ID NO: 170566 - DNA, 20 bp, Artificial Sequence
  Synthetic oligonucleotide; AAG chr2 60554456 60554475 60554472 +
cggggcccgagggcgccccc

SEQ ID NO: 170567 - DNA, 20 bp, Artificial Sequence
  Synthetic oligonucleotide; AGG chr2 60554457 60554476 60554473 +
ggggcccgagggcgccccca

SEQ ID NO: 170568 - DNA, 20 bp, Artificial Sequence
  Synthetic oligonucleotide; GAG chr2 60554462 60554481 60554478 +
ccgagggcgcccccaaggcc

SEQ ID NO: 170569 - DNA, 20 bp, Artificial Sequence
  Synthetic oligonucleotide; CAG chr2 60554466 60554485 60554482 +
gggcgcccccaaggccgagc

SEQ ID NO: 170570 - DNA, 20 bp, Artificial Sequence
  Synthetic oligonucleotide; AGG chr2 60554467 60554486 60554483 +
ggcgcccccaaggccgagcc

SEQ ID NO: 170571 - DNA, 20 bp, Artificial Sequence
  Synthetic oligonucleotide; GGG chr2 60554468 60554487 60554484 +
gcgcccccaaggccgagcca

SEQ ID NO: 170572 - DNA, 20 bp, Artificial Sequence
  Synthetic oligonucleotide; CGG chr2 60554473 60554492 60554489 +
cccaaggccgagccagggac

SEQ ID NO: 170573 - DNA, 20 bp, Artificial Sequence
  Synthetic oligonucleotide; GGG chr2 60554474 60554493 60554490 +
ccaaggccgagccagggacc

SEQ ID NO: 170574 - DNA, 20 bp, Artificial Sequence
  Synthetic oligonucleotide; GAG chr2 60554482 60554501 60554498 +
gagccagggaccgggaatct

SEQ ID NO: 170575 - DNA, 20 bp, Artificial Sequence
  Synthetic oligonucleotide; AAG chr2 60554494 60554513 60554510 +
gggaatctgagcgccccgcc

SEQ ID NO: 170576 - DNA, 20 bp, Artificial Sequence
  Synthetic oligonucleotide; TGG chr2 60554501 60554520 60554517 +
tgagcgccccgccaagcgac

SEQ ID NO: 170577 - DNA, 20 bp, Artificial Sequence
  Synthetic oligonucleotide; GGG chr2 60554502 60554521 60554518 +
gagcgccccgccaagcgact

SEQ ID NO: 170578 - DNA, 20 bp, Artificial Sequence
  Synthetic oligonucleotide; AAG chr2 60554520 60554539 60554536 +
ctgggtctgaatgcaactga

SEQ ID NO: 170579 - DNA, 20 bp, Artificial Sequence
  Synthetic oligonucleotide; GAG chr2 60554527 60554546 60554543 +
tgaatgcaactgaaagcgcc

SEQ ID NO: 170580 - DNA, 20 bp, Artificial Sequence
  Synthetic oligonucleotide; CGG chr2 60554534 60554553 60554550 +
aactgaaagcgccgagtccc

SEQ ID NO: 170581 - DNA, 20 bp, Artificial Sequence
  Synthetic oligonucleotide; AAG chr2 60554542 60554561 60554558 +
gcgccgagtccccggctcct

SEQ ID NO: 170582 - DNA, 20 bp, Artificial Sequence
  Synthetic oligonucleotide; AGG chr2 60554543 60554562 60554559 +
cgccgagtccccggctccta

SEQ ID NO: 170583 - DNA, 20 bp, Artificial Sequence
  Synthetic oligonucleotide; GGG chr2 60554544 60554563 60554560 +
gccgagtccccggctcctaa

SEQ ID NO: 170584 - DNA, 20 bp, Artificial Sequence
  Synthetic oligonucleotide; CAG chr2 60554550 60554569 60554566 +
tccccggctcctaagggtcg

SEQ ID NO: 170585 - DNA, 20 bp, Artificial Sequence
  Synthetic oligonucleotide; AAG chr2 60554554 60554573 60554570 +
cggctcctaagggtcgcaga

SEQ ID NO: 170586 - DNA, 20 bp, Artificial Sequence
  Synthetic oligonucleotide; GAG chr2 60554556 60554575 60554572 +
gctcctaagggtcgcagaaa

SEQ ID NO: 170587 - DNA, 20 bp, Artificial Sequence
  Synthetic oligonucleotide; GAG chr2 60554558 60554577 60554574 +
tcctaagggtcgcagaaaga

SEQ ID NO: 170588 - DNA, 20 bp, Artificial Sequence
  Synthetic oligonucleotide; GAG chr2 60554564 60554583 60554580 +
gggtcgcagaaagagagccc

SEQ ID NO: 170589 - DNA, 20 bp, Artificial Sequence
  Synthetic oligonucleotide; AGG chr2 60554565 60554584 60554581 +
ggtcgcagaaagagagcccg

SEQ ID NO: 170590 - DNA, 20 bp, Artificial Sequence
  Synthetic oligonucleotide; AAG chr2 60554572 60554591 60554588 +
gaaagagagcccgaggaata

SEQ ID NO: 170591 - DNA, 20 bp, Artificial Sequence
  Synthetic oligonucleotide; GAG chr2 60554578 60554597 60554594 +
gagcccgaggaataaagaac

SEQ ID NO: 170592 - DNA, 20 bp, Artificial Sequence
  Synthetic oligonucleotide; AGG chr2 60554579 60554598 60554595 +
agcccgaggaataaagaacg

SEQ ID NO: 170593 - DNA, 20 bp, Artificial Sequence
  Synthetic oligonucleotide; GAG chr2 60554581 60554600 60554597 +
cccgaggaataaagaacgag

SEQ ID NO: 170594 - DNA, 20 bp, Artificial Sequence
  Synthetic oligonucleotide; CAG chr2 60554585 60554604 60554601 +
aggaataaagaacgaggagc

SEQ ID NO: 170595 - DNA, 20 bp, Artificial Sequence
  Synthetic oligonucleotide; GAG chr2 60554587 60554606 60554603 +
gaataaagaacgaggagcca

SEQ ID NO: 170596 - DNA, 20 bp, Artificial Sequence
  Synthetic oligonucleotide; TGG chr2 60554592 60554611 60554608 +
aagaacgaggagccagagtc

SEQ ID NO: 170597 - DNA, 20 bp, Artificial Sequence
  Synthetic oligonucleotide; CGG chr2 60554599 60554618 60554615 +
aggagccagagtctggcccc

SEQ ID NO: 170598 - DNA, 20 bp, Artificial Sequence
  Synthetic oligonucleotide; GAG chr2 60554601 60554620 60554617 +
gagccagagtctggcccccg

SEQ ID NO: 170599 - DNA, 20 bp, Artificial Sequence
  Synthetic oligonucleotide; AGG chr2 60554602 60554621 60554618 +
agccagagtctggcccccgg

SEQ ID NO: 170600 - DNA, 20 bp, Artificial Sequence
  Synthetic oligonucleotide; GGG chr2 60554603 60554622 60554619 +
gccagagtctggcccccgga

SEQ ID NO: 170601 - DNA, 20 bp, Artificial Sequence
  Synthetic oligonucleotide; GGG chr2 60554604 60554623 60554620 +
ccagagtctggcccccggag

SEQ ID NO: 170602 - DNA, 20 bp, Artificial Sequence
  Synthetic oligonucleotide; GAG chr2 60554606 60554625 60554622 +
agagtctggcccccggaggg

SEQ ID NO: 170603 - DNA, 20 bp, Artificial Sequence
  Synthetic oligonucleotide; CGG chr2 60554612 60554631 60554628 +
tggcccccggaggggagcgc

SEQ ID NO: 170604 - DNA, 20 bp, Artificial Sequence
  Synthetic oligonucleotide; GGG chr2 60554613 60554632 60554629 +
ggcccccggaggggagcgcc

SEQ ID NO: 170605 - DNA, 20 bp, Artificial Sequence
  Synthetic oligonucleotide; GGG chr2 60554614 60554633 60554630 +
gcccccggaggggagcgccg

SEQ ID NO: 170606 - DNA, 20 bp, Artificial Sequence
  Synthetic oligonucleotide; GGG chr2 60554615 60554634 60554631 +
cccccggaggggagcgccgg

SEQ ID NO: 170607 - DNA, 20 bp, Artificial Sequence
  Synthetic oligonucleotide; TGG chr2 60554620 60554639 60554636 +
ggaggggagcgccgggggcc

SEQ ID NO: 170608 - DNA, 20 bp, Artificial Sequence
  Synthetic oligonucleotide; GGG chr2 60554621 60554640 60554637 +
gaggggagcgccgggggcct

SEQ ID NO: 170609 - DNA, 20 bp, Artificial Sequence
  Synthetic oligonucleotide; AAG chr2 60554625 60554644 60554641 +
ggagcgccgggggcctgggc

SEQ ID NO: 170610 - DNA, 20 bp, Artificial Sequence
  Synthetic oligonucleotide; GAG chr2 60554627 60554646 60554643 +
agcgccgggggcctgggcaa

SEQ ID NO: 170611 - DNA, 20 bp, Artificial Sequence
  Synthetic oligonucleotide; GAG chr2 60554629 60554648 60554645 +
cgccgggggcctgggcaaga

SEQ ID NO: 170612 - DNA, 20 bp, Artificial Sequence
  Synthetic oligonucleotide; AGG chr2 60554630 60554649 60554646 +
gccgggggcctgggcaagag

SEQ ID NO: 170613 - DNA, 20 bp, Artificial Sequence
  Synthetic oligonucleotide; GAG chr2 60554637 60554656 60554653 +
gcctgggcaagagaggcacc

SEQ ID NO: 170614 - DNA, 20 bp, Artificial Sequence
  Synthetic oligonucleotide; AGG chr2 60554638 60554657 60554654 +
cctgggcaagagaggcaccg

SEQ ID NO: 170615 - DNA, 20 bp, Artificial Sequence
  Synthetic oligonucleotide; GAG chr2 60554654 60554673 60554670 +
accgaggcgtccacctctct

SEQ ID NO: 170616 - DNA, 20 bp, Artificial Sequence
  Synthetic oligonucleotide; GAG chr2 60554656 60554675 60554672 +
cgaggcgtccacctctctga

SEQ ID NO: 170617 - DNA, 20 bp, Artificial Sequence
  Synthetic oligonucleotide; AGG chr2 60554657 60554676 60554673 +
gaggcgtccacctctctgag

SEQ ID NO: 170618 - DNA, 20 bp, Artificial Sequence
  Synthetic oligonucleotide; GAG chr2 60554662 60554681 60554678 +
gtccacctctctgagaggcc

SEQ ID NO: 170619 - DNA, 20 bp, Artificial Sequence
  Synthetic oligonucleotide; AGG chr2 60554663 60554682 60554679 +
tccacctctctgagaggccg

SEQ ID NO: 170620 - DNA, 20 bp, Artificial Sequence
  Synthetic oligonucleotide; AAG chr2 60554669 60554688 60554685 +
tctctgagaggccgaggaca

SEQ ID NO: 170621 - DNA, 20 bp, Artificial Sequence
  Synthetic oligonucleotide; CGG chr2 60554674 60554693 60554690 +
gagaggccgaggacaaagcg

SEQ ID NO: 170622 - DNA, 20 bp, Artificial Sequence
  Synthetic oligonucleotide; GGG chr2 60554675 60554694 60554691 +
agaggccgaggacaaagcgc

SEQ ID NO: 170623 - DNA, 20 bp, Artificial Sequence
  Synthetic oligonucleotide; CAG chr2 60554678 60554697 60554694 +
ggccgaggacaaagcgcggg

SEQ ID NO: 170624 - DNA, 20 bp, Artificial Sequence
  Synthetic oligonucleotide; CGG chr2 60554684 60554703 60554700 +
ggacaaagcgcgggcagtcc

SEQ ID NO: 170625 - DNA, 20 bp, Artificial Sequence
  Synthetic oligonucleotide; GGG chr2 60554685 60554704 60554701 +
gacaaagcgcgggcagtccc

SEQ ID NO: 170626 - DNA, 20 bp, Artificial Sequence
  Synthetic oligonucleotide; GAG chr2 60554687 60554706 60554703 +
caaagcgcgggcagtcccgg

SEQ ID NO: 170627 - DNA, 20 bp, Artificial Sequence
  Synthetic oligonucleotide; CAG chr2 60554693 60554712 60554709 +
gcgggcagtcccgggagtcc

SEQ ID NO: 170628 - DNA, 20 bp, Artificial Sequence
  Synthetic oligonucleotide; TGG chr2 60554700 60554719 60554716 +
gtcccgggagtcccagtccc

SEQ ID NO: 170629 - DNA, 20 bp, Artificial Sequence
  Synthetic oligonucleotide; GGG chr2 60554701 60554720 60554717 +
tcccgggagtcccagtccct

SEQ ID NO: 170630 - DNA, 20 bp, Artificial Sequence
  Synthetic oligonucleotide; CGG chr2 60554714 60554733 60554730 +
agtccctgggaatgtgctca

SEQ ID NO: 170631 - DNA, 20 bp, Artificial Sequence
  Synthetic oligonucleotide; CGG chr2 60554722 60554741 60554738 +
ggaatgtgctcacggcgccg

SEQ ID NO: 170632 - DNA, 20 bp, Artificial Sequence
  Synthetic oligonucleotide; GGG chr2 60554723 60554742 60554739 +
gaatgtgctcacggcgccgc

SEQ ID NO: 170633 - DNA, 20 bp, Artificial Sequence
  Synthetic oligonucleotide; GAG chr2 60554725 60554744 60554741 +
atgtgctcacggcgccgcgg

SEQ ID NO: 170634 - DNA, 20 bp, Artificial Sequence
  Synthetic oligonucleotide; AGG chr2 60554726 60554745 60554742 +
tgtgctcacggcgccgcggg

SEQ ID NO: 170635 - DNA, 20 bp, Artificial Sequence
  Synthetic oligonucleotide; GAG chr2 60554734 60554753 60554750 +
cggcgccgcgggaggtcccc

SEQ ID NO: 170636 - DNA, 20 bp, Artificial Sequence
  Synthetic oligonucleotide; CGG chr2 60554738 60554757 60554754 +
gccgcgggaggtccccgagc

SEQ ID NO: 170637 - DNA, 20 bp, Artificial Sequence
  Synthetic oligonucleotide; GGG chr2 60554739 60554758 60554755 +
ccgcgggaggtccccgagcc

SEQ ID NO: 170638 - DNA, 20 bp, Artificial Sequence
  Synthetic oligonucleotide; TGG chr2 60554746 60554765 60554762 +
aggtccccgagccgggtccc

SEQ ID NO: 170639 - DNA, 20 bp, Artificial Sequence
  Synthetic oligonucleotide; GGG chr2 60554747 60554766 60554763 +
ggtccccgagccgggtccct

SEQ ID NO: 170640 - DNA, 20 bp, Artificial Sequence
  Synthetic oligonucleotide; GAG chr2 60554749 60554768 60554765 +
tccccgagccgggtccctgg

SEQ ID NO: 170641 - DNA, 20 bp, Artificial Sequence
  Synthetic oligonucleotide; AGG chr2 60554750 60554769 60554766 +
ccccgagccgggtccctggg

SEQ ID NO: 170642 - DNA, 20 bp, Artificial Sequence
  Synthetic oligonucleotide; GGG chr2 60554751 60554770 60554767 +
cccgagccgggtccctggga

SEQ ID NO: 170643 - DNA, 20 bp, Artificial Sequence
  Synthetic oligonucleotide; CAG chr2 60554772 60554791 60554788 +
ggacacaccccctcccactc

SEQ ID NO: 170644 - DNA, 20 bp, Artificial Sequence
  Synthetic oligonucleotide; GAG chr2 60554774 60554793 60554790 +
acacaccccctcccactcca

SEQ ID NO: 170645 - DNA, 20 bp, Artificial Sequence
  Synthetic oligonucleotide; AAG chr2 60554786 60554805 60554802 +
ccactccagagcaactgcaa

SEQ ID NO: 170646 - DNA, 20 bp, Artificial Sequence
  Synthetic oligonucleotide; CAG chr2 60554791 60554810 60554807 +
ccagagcaactgcaaaagca

SEQ ID NO: 170647 - DNA, 20 bp, Artificial Sequence
  Synthetic oligonucleotide; GAG chr2 60554793 60554812 60554809 +
agagcaactgcaaaagcaca

SEQ ID NO: 170648 - DNA, 20 bp, Artificial Sequence
  Synthetic oligonucleotide; AGG chr2 60554794 60554813 60554810 +
gagcaactgcaaaagcacag

SEQ ID NO: 170649 - DNA, 20 bp, Artificial Sequence
  Synthetic oligonucleotide; GGG chr2 60554795 60554814 60554811 +
agcaactgcaaaagcacaga

SEQ ID NO: 170650 - DNA, 20 bp, Artificial Sequence
  Synthetic oligonucleotide; TGG chr2 60554799 60554818 60554815 +
actgcaaaagcacagaggga

SEQ ID NO: 170651 - DNA, 20 bp, Artificial Sequence
  Synthetic oligonucleotide; GGG chr2 60554800 60554819 60554816 +
ctgcaaaagcacagagggat

SEQ ID NO: 170652 - DNA, 20 bp, Artificial Sequence
  Synthetic oligonucleotide; AAG chr2 60554803 60554822 60554819 +
caaaagcacagagggatggg

SEQ ID NO: 170653 - DNA, 20 bp, Artificial Sequence
  Synthetic oligonucleotide; CGG chr2 60554819 60554838 60554835 +
tgggaagaaaatgtttctta

SEQ ID NO: 170654 - DNA, 20 bp, Artificial Sequence
  Synthetic oligonucleotide; GGG chr2 60554820 60554839 60554836 +
gggaagaaaatgtttcttac

SEQ ID NO: 170655 - DNA, 20 bp, Artificial Sequence
  Synthetic oligonucleotide; CAG chr2 60554823 60554842 60554839 +
aagaaaatgtttcttacggg

SEQ ID NO: 170656 - DNA, 20 bp, Artificial Sequence
  Synthetic oligonucleotide; GAG chr2 60554825 60554844 60554841 +
gaaaatgtttcttacgggca

SEQ ID NO: 170657 - DNA, 20 bp, Artificial Sequence
  Synthetic oligonucleotide; CAG chr2 60554852 60554871 60554868 +
actgttcctgtgctgttacc

SEQ ID NO: 170658 - DNA, 20 bp, Artificial Sequence
  Synthetic oligonucleotide; AGG chr2 60554853 60554872 60554869 +
ctgttcctgtgctgttaccc

SEQ ID NO: 170659 - DNA, 20 bp, Artificial Sequence
  Synthetic oligonucleotide; GGG chr2 60554854 60554873 60554870 +
tgttcctgtgctgttaccca

SEQ ID NO: 170660 - DNA, 20 bp, Artificial Sequence
  Synthetic oligonucleotide; AAG chr2 60554858 60554877 60554874 +
cctgtgctgttacccaggga

SEQ ID NO: 170661 - DNA, 20 bp, Artificial Sequence
  Synthetic oligonucleotide; GAG chr2 60554860 60554879 60554876 +
tgtgctgttacccagggaaa

SEQ ID NO: 170662 - DNA, 20 bp, Artificial Sequence
  Synthetic oligonucleotide; TGG chr2 60554867 60554886 60554883 +
ttacccagggaaagagaaaa

SEQ ID NO: 170663 - DNA, 20 bp, Artificial Sequence
  Synthetic oligonucleotide; GGG chr2 60554868 60554887 60554884 +
tacccagggaaagagaaaat

SEQ ID NO: 170664 - DNA, 20 bp, Artificial Sequence
  Synthetic oligonucleotide; TGG chr2 60554873 60554892 60554889 +
agggaaagagaaaatgggaa

SEQ ID NO: 170665 - DNA, 20 bp, Artificial Sequence
  Synthetic oligonucleotide; GAG chr2 60554875 60554894 60554891 +
ggaaagagaaaatgggaatg

SEQ ID NO: 170666 - DNA, 20 bp, Artificial Sequence
  Synthetic oligonucleotide; GAG chr2 60554877 60554896 60554893 +
aaagagaaaatgggaatgga

SEQ ID NO: 170667 - DNA, 20 bp, Artificial Sequence
  Synthetic oligonucleotide; GAG chr2 60554879 60554898 60554895 +
agagaaaatgggaatggaga

SEQ ID NO: 170668 - DNA, 20 bp, Artificial Sequence
  Synthetic oligonucleotide; GAG chr2 60554881 60554900 60554897 +
agaaaatgggaatggagaga

SEQ ID NO: 170669 - DNA, 20 bp, Artificial Sequence
  Synthetic oligonucleotide; CAG chr2 60554887 60554906 60554903 +
tgggaatggagagagagcga

SEQ ID NO: 170670 - DNA, 20 bp, Artificial Sequence
  Synthetic oligonucleotide; AGG chr2 60554888 60554907 60554904 +
gggaatggagagagagcgac

SEQ ID NO: 170671 - DNA, 20 bp, Artificial Sequence
  Synthetic oligonucleotide; CAG chr2 60554895 60554914 60554911 +
gagagagagcgacaggctcg

SEQ ID NO: 170672 - DNA, 20 bp, Artificial Sequence
  Synthetic oligonucleotide; AGG chr2 60554896 60554915 60554912 +
agagagagcgacaggctcgc

SEQ ID NO: 170673 - DNA, 20 bp, Artificial Sequence
  Synthetic oligonucleotide; GAG chr2 60554898 60554917 60554914 +
agagagcgacaggctcgcag

SEQ ID NO: 170674 - DNA, 20 bp, Artificial Sequence
  Synthetic oligonucleotide; CAG chr2 60554901 60554920 60554917 +
gagcgacaggctcgcaggag

SEQ ID NO: 170675 - DNA, 20 bp, Artificial Sequence
  Synthetic oligonucleotide; CGG chr2 60554904 60554923 60554920 +
cgacaggctcgcaggagcag

SEQ ID NO: 170676 - DNA, 20 bp, Artificial Sequence
  Synthetic oligonucleotide; GGG chr2 60554905 60554924 60554921 +
gacaggctcgcaggagcagc

SEQ ID NO: 170677 - DNA, 20 bp, Artificial Sequence
  Synthetic oligonucleotide; GGG chr2 60554906 60554925 60554922 +
acaggctcgcaggagcagcg

SEQ ID NO: 170678 - DNA, 20 bp, Artificial Sequence
  Synthetic oligonucleotide; GAG chr2 60554908 60554927 60554924 +
aggctcgcaggagcagcggg

SEQ ID NO: 170679 - DNA, 20 bp, Artificial Sequence
  Synthetic oligonucleotide; CGG chr2 60554915 60554934 60554931 +
caggagcagcggggagacca

SEQ ID NO: 170680 - DNA, 20 bp, Artificial Sequence
  Synthetic oligonucleotide; TGG chr2 60554918 60554937 60554934 +
gagcagcggggagaccacgg

SEQ ID NO: 170681 - DNA, 20 bp, Artificial Sequence
  Synthetic oligonucleotide; GAG chr2 60554922 60554941 60554938 +
agcggggagaccacggtggt

SEQ ID NO: 170682 - DNA, 20 bp, Artificial Sequence
  Synthetic oligonucleotide; CGG chr2 60554935 60554954 60554951 +
cggtggtgagatgaccgcct

SEQ ID NO: 170683 - DNA, 20 bp, Artificial Sequence
  Synthetic oligonucleotide; GGG chr2 60554936 60554955 60554952 +
ggtggtgagatgaccgcctc

SEQ ID NO: 170684 - DNA, 20 bp, Artificial Sequence
  Synthetic oligonucleotide; CAG chr2 60554955 60554974 60554971 +
cgggtcaccgccgcgctccc

SEQ ID NO: 170685 - DNA, 20 bp, Artificial Sequence
  Synthetic oligonucleotide; AGG chr2 60554956 60554975 60554972 +
gggtcaccgccgcgctcccc

SEQ ID NO: 170686 - DNA, 20 bp, Artificial Sequence
  Synthetic oligonucleotide; CGG chr2 60554965 60554984 60554981 +
ccgcgctccccaggcgccgc

SEQ ID NO: 170687 - DNA, 20 bp, Artificial Sequence
  Synthetic oligonucleotide; AAG chr2 60554970 60554989 60554986 +
ctccccaggcgccgccggcc

SEQ ID NO: 170688 - DNA, 20 bp, Artificial Sequence
  Synthetic oligonucleotide; AGG chr2 60554971 60554990 60554987 +
tccccaggcgccgccggcca

SEQ ID NO: 170689 - DNA, 20 bp, Artificial Sequence
  Synthetic oligonucleotide; CAG chr2 60554982 60555001 60554998 +
cgccggccaaggcgcacacc

SEQ ID NO: 170690 - DNA, 20 bp, Artificial Sequence
  Synthetic oligonucleotide; AGG chr2 60554983 60555002 60554999 +
gccggccaaggcgcacaccc

SEQ ID NO: 170691 - DNA, 20 bp, Artificial Sequence
  Synthetic oligonucleotide; GAG chr2 60554985 60555004 60555001 +
cggccaaggcgcacacccag

SEQ ID NO: 170692 - DNA, 20 bp, Artificial Sequence
  Synthetic oligonucleotide; CAG chr2 60554989 60555008 60555005 +
caaggcgcacacccaggagc

SEQ ID NO: 170693 - DNA, 20 bp, Artificial Sequence
  Synthetic oligonucleotide; CAG chr2 60554992 60555011 60555008 +
ggcgcacacccaggagccag

SEQ ID NO: 170694 - DNA, 20 bp, Artificial Sequence
  Synthetic oligonucleotide; CAG chr2 60555013 60555032 60555029 +
agccccctctcgcctttctg

SEQ ID NO: 170695 - DNA, 20 bp, Artificial Sequence
  Synthetic oligonucleotide; TGG chr2 60555024 60555043 60555040 +
gcctttctgcagacgttccc

SEQ ID NO: 170696 - DNA, 20 bp, Artificial Sequence
  Synthetic oligonucleotide; TAG chr2 60555031 60555050 60555047 +
tgcagacgttccctggaaat

SEQ ID NO: 170697 - DNA, 20 bp, Artificial Sequence
  Synthetic oligonucleotide; AGG chr2 60555032 60555051 60555048 +
gcagacgttccctggaaatt

SEQ ID NO: 170698 - DNA, 20 bp, Artificial Sequence
  Synthetic oligonucleotide; GGG chr2 60555033 60555052 60555049 +
cagacgttccctggaaatta

SEQ ID NO: 170699 - DNA, 20 bp, Artificial Sequence
  Synthetic oligonucleotide; AAG chr2 60555036 60555055 60555052 +
acgttccctggaaattaggg

SEQ ID NO: 170700 - DNA, 20 bp, Artificial Sequence
  Synthetic oligonucleotide; TGG chr2 60555045 60555064 60555061 +
ggaaattagggaagacctgt

SEQ ID NO: 170701 - DNA, 20 bp, Artificial Sequence
  Synthetic oligonucleotide; AAG chr2 60555110 60555129 60555126 +
cgcgtgctgccgctgtcaaa

SEQ ID NO: 170702 - DNA, 20 bp, Artificial Sequence
  Synthetic oligonucleotide; CGG chr2 60555113 60555132 60555129 +
gtgctgccgctgtcaaaaag

SEQ ID NO: 170703 - DNA, 20 bp, Artificial Sequence
  Synthetic oligonucleotide; GGG chr2 60555114 60555133 60555130 +
tgctgccgctgtcaaaaagc

SEQ ID NO: 170704 - DNA, 20 bp, Artificial Sequence
  Synthetic oligonucleotide; TGG chr2 60555125 60555144 60555141 +
tcaaaaagcgggcttcactc

SEQ ID NO: 170705 - DNA, 20 bp, Artificial Sequence
  Synthetic oligonucleotide; TGG chr2 60555130 60555149 60555146 +
aagcgggcttcactctggcg

SEQ ID NO: 170706 - DNA, 20 bp, Artificial Sequence
  Synthetic oligonucleotide; GGG chr2 60555131 60555150 60555147 +
agcgggcttcactctggcgt

SEQ ID NO: 170707 - DNA, 20 bp, Artificial Sequence
  Synthetic oligonucleotide; CAG chr2 60555141 60555160 60555157 +
actctggcgtgggatacttt

SEQ ID NO: 170708 - DNA, 20 bp, Artificial Sequence
  Synthetic oligonucleotide; CAG chr2 60555160 60555179 60555176 +
tcagttttacgtaaaatgta

SEQ ID NO: 170709 - DNA, 20 bp, Artificial Sequence
  Synthetic oligonucleotide; CAG chr2 60555166 60555185 60555182 +
ttacgtaaaatgtacagcaa

SEQ ID NO: 170710 - DNA, 20 bp, Artificial Sequence
  Synthetic oligonucleotide; TGG chr2 60555182 60555201 60555198 +
gcaacagcaccccctgcgat

SEQ ID NO: 170711 - DNA, 20 bp, Artificial Sequence
  Synthetic oligonucleotide; AAG chr2 60555186 60555205 60555202 +
cagcaccccctgcgattgga

SEQ ID NO: 170712 - DNA, 20 bp, Artificial Sequence
  Synthetic oligonucleotide; CAG chr2 60555195 60555214 60555211 +
ctgcgattggaaagtttatt

SEQ ID NO: 170713 - DNA, 20 bp, Artificial Sequence
  Synthetic oligonucleotide; AAG chr2 60555211 60555230 60555227 +
tattcagaaacgtgcctgta

SEQ ID NO: 170714 - DNA, 20 bp, Artificial Sequence
  Synthetic oligonucleotide; TGG chr2 60555219 60555238 60555235 +
aacgtgcctgtaaagtcccc

SEQ ID NO: 170715 - DNA, 20 bp, Artificial Sequence
  Synthetic oligonucleotide; CAG chr2 60555236 60555255 60555252 +
ccctggcgcctcccgcctcc

SEQ ID NO: 170716 - DNA, 20 bp, Artificial Sequence
  Synthetic oligonucleotide; CAG chr2 60555252 60555271 60555268 +
ctcccagcctccctgcctgc

SEQ ID NO: 170717 - DNA, 20 bp, Artificial Sequence
  Synthetic oligonucleotide; CAG chr2 60555265 60555284 60555281 +
tgcctgccagcaccactctg

SEQ ID NO: 170718 - DNA, 20 bp, Artificial Sequence
  Synthetic oligonucleotide; CGG chr2 60555284 60555303 60555300 +
gcagccgccgccgccgccgc

SEQ ID NO: 170719 - DNA, 20 bp, Artificial Sequence
  Synthetic oligonucleotide; GGG chr2 60555285 60555304 60555301 +
cagccgccgccgccgccgcc

SEQ ID NO: 170720 - DNA, 20 bp, Artificial Sequence
  Synthetic oligonucleotide; GGG chr2 60555286 60555305 60555302 +
agccgccgccgccgccgccg

SEQ ID NO: 170721 - DNA, 20 bp, Artificial Sequence
  Synthetic oligonucleotide; GAG chr2 60555288 60555307 60555304 +
ccgccgccgccgccgccggg

SEQ ID NO: 170722 - DNA, 20 bp, Artificial Sequence
  Synthetic oligonucleotide; CAG chr2 60555295 60555314 60555311 +
cgccgccgccggggagatcg

SEQ ID NO: 170723 - DNA, 20 bp, Artificial Sequence
  Synthetic oligonucleotide; TGG chr2 60555312 60555331 60555328 +
tcgcagtccgattccaaatc

SEQ ID NO: 170724 - DNA, 20 bp, Artificial Sequence
  Synthetic oligonucleotide; AAG chr2 60555315 60555334 60555331 +
cagtccgattccaaatctgg

SEQ ID NO: 170725 - DNA, 20 bp, Artificial Sequence
  Synthetic oligonucleotide; AGG chr2 60555316 60555335 60555332 +
agtccgattccaaatctgga

SEQ ID NO: 170726 - DNA, 20 bp, Artificial Sequence
  Synthetic oligonucleotide; GAG chr2 60555318 60555337 60555334 +
tccgattccaaatctggaag

SEQ ID NO: 170727 - DNA, 20 bp, Artificial Sequence
  Synthetic oligonucleotide; TGG chr2 60555322 60555341 60555338 +
attccaaatctggaaggagt

SEQ ID NO: 170728 - DNA, 20 bp, Artificial Sequence
  Synthetic oligonucleotide; GGG chr2 60555323 60555342 60555339 +
ttccaaatctggaaggagtt

SEQ ID NO: 170729 - DNA, 20 bp, Artificial Sequence
  Synthetic oligonucleotide; GGG chr2 60555324 60555343 60555340 +
tccaaatctggaaggagttg

SEQ ID NO: 170730 - DNA, 20 bp, Artificial Sequence
  Synthetic oligonucleotide; GGG chr2 60555325 60555344 60555341 +
ccaaatctggaaggagttgg

SEQ ID NO: 170731 - DNA, 20 bp, Artificial Sequence
  Synthetic oligonucleotide; GGG chr2 60555326 60555345 60555342 +
caaatctggaaggagttggg

SEQ ID NO: 170732 - DNA, 20 bp, Artificial Sequence
  Synthetic oligonucleotide; GAG chr2 60555328 60555347 60555344 +
aatctggaaggagttggggg

SEQ ID NO: 170733 - DNA, 20 bp, Artificial Sequence
  Synthetic oligonucleotide; GAG chr2 60555330 60555349 60555346 +
tctggaaggagttgggggga

SEQ ID NO: 170734 - DNA, 20 bp, Artificial Sequence
  Synthetic oligonucleotide; AGG chr2 60555331 60555350 60555347 +
ctggaaggagttggggggag

SEQ ID NO: 170735 - DNA, 20 bp, Artificial Sequence
  Synthetic oligonucleotide; GAG chr2 60555333 60555352 60555349 +
ggaaggagttggggggagag

SEQ ID NO: 170736 - DNA, 20 bp, Artificial Sequence
  Synthetic oligonucleotide; TGG chr2 60555338 60555357 60555354 +
gagttggggggagaggagaa

SEQ ID NO: 170737 - DNA, 20 bp, Artificial Sequence
  Synthetic oligonucleotide; CAG chr2 60555344 60555363 60555360 +
gggggagaggagaatggact

SEQ ID NO: 170738 - DNA, 20 bp, Artificial Sequence
  Synthetic oligonucleotide; AGG chr2 60555345 60555364 60555361 +
ggggagaggagaatggactc

SEQ ID NO: 170739 - DNA, 20 bp, Artificial Sequence
  Synthetic oligonucleotide; AAG chr2 60555351 60555370 60555367 +
aggagaatggactcaggtcc

SEQ ID NO: 170740 - DNA, 20 bp, Artificial Sequence
  Synthetic oligonucleotide; AGG chr2 60555352 60555371 60555368 +
ggagaatggactcaggtcca

SEQ ID NO: 170741 - DNA, 20 bp, Artificial Sequence
  Synthetic oligonucleotide; GGG chr2 60555353 60555372 60555369 +
gagaatggactcaggtccaa

SEQ ID NO: 170742 - DNA, 20 bp, Artificial Sequence
  Synthetic oligonucleotide; GAG chr2 60555355 60555374 60555371 +
gaatggactcaggtccaagg

SEQ ID NO: 170743 - DNA, 20 bp, Artificial Sequence
  Synthetic oligonucleotide; AGG chr2 60555356 60555375 60555372 +
aatggactcaggtccaaggg

SEQ ID NO: 170744 - DNA, 20 bp, Artificial Sequence
  Synthetic oligonucleotide; CGG chr2 60555361 60555380 60555377 +
actcaggtccaagggaggtg

SEQ ID NO: 170745 - DNA, 20 bp, Artificial Sequence
  Synthetic oligonucleotide; GAG chr2 60555363 60555382 60555379 +
tcaggtccaagggaggtgcg

SEQ ID NO: 170746 - DNA, 20 bp, Artificial Sequence
  Synthetic oligonucleotide; AGG chr2 60555364 60555383 60555380 +
caggtccaagggaggtgcgg

SEQ ID NO: 170747 - DNA, 20 bp, Artificial Sequence
  Synthetic oligonucleotide; GGG chr2 60555365 60555384 60555381 +
aggtccaagggaggtgcgga

SEQ ID NO: 170748 - DNA, 20 bp, Artificial Sequence
  Synthetic oligonucleotide; CAG chr2 60555370 60555389 60555386 +
caagggaggtgcggagggtg

SEQ ID NO: 170749 - DNA, 20 bp, Artificial Sequence
  Synthetic oligonucleotide; AGG chr2 60555371 60555390 60555387 +
aagggaggtgcggagggtgc

SEQ ID NO: 170750 - DNA, 20 bp, Artificial Sequence
  Synthetic oligonucleotide; GGG chr2 60555372 60555391 60555388 +
agggaggtgcggagggtgca

SEQ ID NO: 170751 - DNA, 20 bp, Artificial Sequence
  Synthetic oligonucleotide; TGG chr2 60555375 60555394 60555391 +
gaggtgcggagggtgcaggg

SEQ ID NO: 170752 - DNA, 20 bp, Artificial Sequence
  Synthetic oligonucleotide; GAG chr2 60555377 60555396 60555393 +
ggtgcggagggtgcagggtg

SEQ ID NO: 170753 - DNA, 20 bp, Artificial Sequence
  Synthetic oligonucleotide; CGG chr2 60555381 60555400 60555397 +
cggagggtgcagggtggaga

SEQ ID NO: 170754 - DNA, 20 bp, Artificial Sequence
  Synthetic oligonucleotide; GGG chr2 60555382 60555401 60555398 +
ggagggtgcagggtggagac

SEQ ID NO: 170755 - DNA, 20 bp, Artificial Sequence
  Synthetic oligonucleotide; TGG chr2 60555391 60555410 60555407 +
agggtggagacgggtcgcca

SEQ ID NO: 170756 - DNA, 20 bp, Artificial Sequence
  Synthetic oligonucleotide; GAG chr2 60555399 60555418 60555415 +
gacgggtcgccatggcccgc

SEQ ID NO: 170757 - DNA, 20 bp, Artificial Sequence
  Synthetic oligonucleotide; GAG chr2 60555407 60555426 60555423 +
gccatggcccgcgagaccct

SEQ ID NO: 170758 - DNA, 20 bp, Artificial Sequence
  Synthetic oligonucleotide; CAG chr2 60555413 60555432 60555429 +
gcccgcgagaccctgagctg

SEQ ID NO: 170759 - DNA, 20 bp, Artificial Sequence
  Synthetic oligonucleotide; AGG chr2 60555414 60555433 60555430 +
cccgcgagaccctgagctgc

SEQ ID NO: 170760 - DNA, 20 bp, Artificial Sequence
  Synthetic oligonucleotide; TGG chr2 60555417 60555436 60555433 +
gcgagaccctgagctgcagg

SEQ ID NO: 170761 - DNA, 20 bp, Artificial Sequence
  Synthetic oligonucleotide; GAG chr2 60555428 60555447 60555444 +
agctgcaggtggatatgtgt

SEQ ID NO: 170762 - DNA, 20 bp, Artificial Sequence
  Synthetic oligonucleotide; CAG chr2 60555439 60555458 60555455 +
gatatgtgtgagtgtgtctg

SEQ ID NO: 170763 - DNA, 20 bp, Artificial Sequence
  Synthetic oligonucleotide; GAG chr2 60555441 60555460 60555457 +
tatgtgtgagtgtgtctgca

SEQ ID NO: 170764 - DNA, 20 bp, Artificial Sequence
  Synthetic oligonucleotide; GAG chr2 60555445 60555464 60555461 +
tgtgagtgtgtctgcagagc

SEQ ID NO: 170765 - DNA, 20 bp, Artificial Sequence
  Synthetic oligonucleotide; AGG chr2 60555446 60555465 60555462 +
gtgagtgtgtctgcagagcg

SEQ ID NO: 170766 - DNA, 20 bp, Artificial Sequence
  Synthetic oligonucleotide; GAG chr2 60555448 60555467 60555464 +
gagtgtgtctgcagagcgag

SEQ ID NO: 170767 - DNA, 20 bp, Artificial Sequence
  Synthetic oligonucleotide; CGG chr2 60555468 60555487 60555484 +
gagccctccttccctctcct

SEQ ID NO: 170768 - DNA, 20 bp, Artificial Sequence
  Synthetic oligonucleotide; GAG chr2 60555470 60555489 60555486 +
gccctccttccctctcctcg

SEQ ID NO: 170769 - DNA, 20 bp, Artificial Sequence
  Synthetic oligonucleotide; CGG chr2 60555473 60555492 60555489 +
ctccttccctctcctcggag

SEQ ID NO: 170770 - DNA, 20 bp, Artificial Sequence
  Synthetic oligonucleotide; CAG chr2 60555508 60555527 60555524 +
cgtcttctcatccccctctt

SEQ ID NO: 170771 - DNA, 20 bp, Artificial Sequence
  Synthetic oligonucleotide; AAG chr2 60555515 60555534 60555531 +
tcatccccctcttcagtcta

SEQ ID NO: 170772 - DNA, 20 bp, Artificial Sequence
  Synthetic oligonucleotide; AGG chr2 60555516 60555535 60555532 +
catccccctcttcagtctaa

SEQ ID NO: 170773 - DNA, 20 bp, Artificial Sequence
  Synthetic oligonucleotide; GGG chr2 60555517 60555536 60555533 +
atccccctcttcagtctaaa

SEQ ID NO: 170774 - DNA, 20 bp, Artificial Sequence
  Synthetic oligonucleotide; CGG chr2 60555545 60555564 60555561 +
cttccgtaaactcacccacc

SEQ ID NO: 170775 - DNA, 20 bp, Artificial Sequence
  Synthetic oligonucleotide; TGG chr2 60555548 60555567 60555564 +
ccgtaaactcacccacccgg

SEQ ID NO: 170776 - DNA, 20 bp, Artificial Sequence
  Synthetic oligonucleotide; GGG chr2 60555549 60555568 60555565 +
cgtaaactcacccacccggt

SEQ ID NO: 170777 - DNA, 20 bp, Artificial Sequence
  Synthetic oligonucleotide; GGG chr2 60555550 60555569 60555566 +
gtaaactcacccacccggtg

SEQ ID NO: 170778 - DNA, 20 bp, Artificial Sequence
  Synthetic oligonucleotide; GGG chr2 60555551 60555570 60555567 +
taaactcacccacccggtgg

SEQ ID NO: 170779 - DNA, 20 bp, Artificial Sequence
  Synthetic oligonucleotide; GGG chr2 60555552 60555571 60555568 +
aaactcacccacccggtggg

SEQ ID NO: 170780 - DNA, 20 bp, Artificial Sequence
  Synthetic oligonucleotide; GGG chr2 60555553 60555572 60555569 +
aactcacccacccggtgggg

SEQ ID NO: 170781 - DNA, 20 bp, Artificial Sequence
  Synthetic oligonucleotide; AAG chr2 60555568 60555587 60555584 +
tgggggggctttattgtttt

SEQ ID NO: 170782 - DNA, 20 bp, Artificial Sequence
  Synthetic oligonucleotide; GAG chr2 60555572 60555591 60555588 +
ggggctttattgttttaagc

SEQ ID NO: 170783 - DNA, 20 bp, Artificial Sequence
  Synthetic oligonucleotide; AGG chr2 60555573 60555592 60555589 +
gggctttattgttttaagcg

SEQ ID NO: 170784 - DNA, 20 bp, Artificial Sequence
  Synthetic oligonucleotide; GGG chr2 60555574 60555593 60555590 +
ggctttattgttttaagcga

SEQ ID NO: 170785 - DNA, 20 bp, Artificial Sequence
  Synthetic oligonucleotide; CGG chr2 60555580 60555599 60555596 +
attgttttaagcgagggccc

SEQ ID NO: 170786 - DNA, 20 bp, Artificial Sequence
  Synthetic oligonucleotide; GGG chr2 60555581 60555600 60555597 +
ttgttttaagcgagggcccc

SEQ ID NO: 170787 - DNA, 20 bp, Artificial Sequence
  Synthetic oligonucleotide; CAG chr2 60555607 60555626 60555623 +
gcacgcgctcacccatcccg

SEQ ID NO: 170788 - DNA, 20 bp, Artificial Sequence
  Synthetic oligonucleotide; CGG chr2 60555616 60555635 60555632 +
cacccatcccgcagccctgc

SEQ ID NO: 170789 - DNA, 20 bp, Artificial Sequence
  Synthetic oligonucleotide; AAG chr2 60555620 60555639 60555636 +
catcccgcagccctgccggc

SEQ ID NO: 170790 - DNA, 20 bp, Artificial Sequence
  Synthetic oligonucleotide; CGG chr2 60555623 60555642 60555639 +
cccgcagccctgccggcaag

SEQ ID NO: 170791 - DNA, 20 bp, Artificial Sequence
  Synthetic oligonucleotide; TAG chr2 60555647 60555666 60555663 +
tgtttattcctgtttcgtct

SEQ ID NO: 170792 - DNA, 20 bp, Artificial Sequence
  Synthetic oligonucleotide; AAG chr2 60555652 60555671 60555668 +
attcctgtttcgtcttagta

SEQ ID NO: 170793 - DNA, 20 bp, Artificial Sequence
  Synthetic oligonucleotide; AAG chr2 60555659 60555678 60555675 +
tttcgtcttagtaaagtttc

SEQ ID NO: 170794 - DNA, 20 bp, Artificial Sequence
  Synthetic oligonucleotide; TAG chr2 60555672 60555691 60555688 +
aagtttcaagtctactgtgt

SEQ ID NO: 170795 - DNA, 20 bp, Artificial Sequence
  Synthetic oligonucleotide; TGG chr2 60555683 60555702 60555699 +
ctactgtgttagaaaatgac

SEQ ID NO: 170796 - DNA, 20 bp, Artificial Sequence
  Synthetic oligonucleotide; TAG chr2 60555692 60555711 60555708 +
tagaaaatgactggcttgcc

SEQ ID NO: 170797 - DNA, 20 bp, Artificial Sequence
  Synthetic oligonucleotide; CGG chr2 60555697 60555716 60555713 +
aatgactggcttgcctagct

SEQ ID NO: 170798 - DNA, 20 bp, Artificial Sequence
  Synthetic oligonucleotide; CGG chr2 60555700 60555719 60555716 +
gactggcttgcctagctcgg

SEQ ID NO: 170799 - DNA, 20 bp, Artificial Sequence
  Synthetic oligonucleotide; GAG chr2 60555702 60555721 60555718 +
ctggcttgcctagctcggcg

SEQ ID NO: 170800 - DNA, 20 bp, Artificial Sequence
  Synthetic oligonucleotide; CGG chr2 60555708 60555727 60555724 +
tgcctagctcggcggagctt

SEQ ID NO: 170801 - DNA, 20 bp, Artificial Sequence
  Synthetic oligonucleotide; AAG chr2 60555719 60555738 60555735 +
gcggagcttcggacccctct

SEQ ID NO: 170802 - DNA, 20 bp, Artificial Sequence
  Synthetic oligonucleotide; AGG chr2 60555720 60555739 60555736 +
cggagcttcggacccctcta

SEQ ID NO: 170803 - DNA, 20 bp, Artificial Sequence
  Synthetic oligonucleotide; AAG chr2 60555723 60555742 60555739 +
agcttcggacccctctaagg

SEQ ID NO: 170804 - DNA, 20 bp, Artificial Sequence
  Synthetic oligonucleotide; AAG chr2 60555728 60555747 60555744 +
cggacccctctaaggaagaa

SEQ ID NO: 170805 - DNA, 20 bp, Artificial Sequence
  Synthetic oligonucleotide; AGG chr2 60555729 60555748 60555745 +
ggacccctctaaggaagaaa

SEQ ID NO: 170806 - DNA, 20 bp, Artificial Sequence
  Synthetic oligonucleotide; GAG chr2 60555731 60555750 60555747 +
acccctctaaggaagaaaag

SEQ ID NO: 170807 - DNA, 20 bp, Artificial Sequence
  Synthetic oligonucleotide; AGG chr2 60555732 60555751 60555748 +
cccctctaaggaagaaaagg

SEQ ID NO: 170808 - DNA, 20 bp, Artificial Sequence
  Synthetic oligonucleotide; GAG chr2 60555752 60555771 60555768 +
aggttttgatgctcaacatt

SEQ ID NO: 170809 - DNA, 20 bp, Artificial Sequence
  Synthetic oligonucleotide; GAG chr2 60555754 60555773 60555770 +
gttttgatgctcaacattga

SEQ ID NO: 170810 - DNA, 20 bp, Artificial Sequence
  Synthetic oligonucleotide; GAG chr2 60555756 60555775 60555772 +
tttgatgctcaacattgaga

SEQ ID NO: 170811 - DNA, 20 bp, Artificial Sequence
  Synthetic oligonucleotide; TGG chr2 60555762 60555781 60555778 +
gctcaacattgagagagatg

SEQ ID NO: 170812 - DNA, 20 bp, Artificial Sequence
  Synthetic oligonucleotide; GGG chr2 60555763 60555782 60555779 +
ctcaacattgagagagatgt

SEQ ID NO: 170813 - DNA, 20 bp, Artificial Sequence
  Synthetic oligonucleotide; TGG chr2 60555772 60555791 60555788 +
gagagagatgtgggctgtac

SEQ ID NO: 170814 - DNA, 20 bp, Artificial Sequence
  Synthetic oligonucleotide; GGG chr2 60555773 60555792 60555789 +
agagagatgtgggctgtact

SEQ ID NO: 170815 - DNA, 20 bp, Artificial Sequence
  Synthetic oligonucleotide; TGG chr2 60555788 60555807 60555804 +
gtactgggattgtgtcaatg

SEQ ID NO: 170816 - DNA, 20 bp, Artificial Sequence
  Synthetic oligonucleotide; CAG chr2 60555816 60555835 60555832 +
tgtttgttgttgtttccctc

SEQ ID NO: 170817 - DNA, 20 bp, Artificial Sequence
  Synthetic oligonucleotide; TGG chr2 60555823 60555842 60555839 +
tgttgtttccctccagtttg

SEQ ID NO: 170818 - DNA, 20 bp, Artificial Sequence
  Synthetic oligonucleotide; GGG chr2 60555824 60555843 60555840 +
gttgtttccctccagtttgt

SEQ ID NO: 170819 - DNA, 20 bp, Artificial Sequence
  Synthetic oligonucleotide; GAG chr2 60555826 60555845 60555842 +
tgtttccctccagtttgtgg

SEQ ID NO: 170820 - DNA, 20 bp, Artificial Sequence
  Synthetic oligonucleotide; AGG chr2 60555827 60555846 60555843 +
gtttccctccagtttgtggg

SEQ ID NO: 170821 - DNA, 20 bp, Artificial Sequence
  Synthetic oligonucleotide; GGG chr2 60555828 60555847 60555844 +
tttccctccagtttgtggga

SEQ ID NO: 170822 - DNA, 20 bp, Artificial Sequence
  Synthetic oligonucleotide; GAG chr2 60555830 60555849 60555846 +
tccctccagtttgtgggagg

SEQ ID NO: 170823 - DNA, 20 bp, Artificial Sequence
  Synthetic oligonucleotide; AAG chr2 60555849 60555868 60555865 +
ggagacctcaaattctgttt

SEQ ID NO: 170824 - DNA, 20 bp, Artificial Sequence
  Synthetic oligonucleotide; AAG chr2 60555852 60555871 60555868 +
gacctcaaattctgtttaag

SEQ ID NO: 170825 - DNA, 20 bp, Artificial Sequence
  Synthetic oligonucleotide; CGG chr2 60555855 60555874 60555871 +
ctcaaattctgtttaagaag

SEQ ID NO: 170826 - DNA, 20 bp, Artificial Sequence
  Synthetic oligonucleotide; GGG chr2 60555856 60555875 60555872 +
tcaaattctgtttaagaagc

SEQ ID NO: 170827 - DNA, 20 bp, Artificial Sequence
  Synthetic oligonucleotide; GAG chr2 60555858 60555877 60555874 +
aaattctgtttaagaagcgg

SEQ ID NO: 170828 - DNA, 20 bp, Artificial Sequence
  Synthetic oligonucleotide; AGG chr2 60555859 60555878 60555875 +
aattctgtttaagaagcggg

SEQ ID NO: 170829 - DNA, 20 bp, Artificial Sequence
  Synthetic oligonucleotide; TAG chr2 60555868 60555887 60555884 +
taagaagcgggaggattcac

SEQ ID NO: 170830 - DNA, 20 bp, Artificial Sequence
  Synthetic oligonucleotide; AAG chr2 60555871 60555890 60555887 +
gaagcgggaggattcactag

SEQ ID NO: 170831 - DNA, 20 bp, Artificial Sequence
  Synthetic oligonucleotide; AAG chr2 60555876 60555895 60555892 +
gggaggattcactagaagtt

SEQ ID NO: 170832 - DNA, 20 bp, Artificial Sequence
  Synthetic oligonucleotide; TAG chr2 60555884 60555903 60555900 +
tcactagaagttaagctctg

SEQ ID NO: 170833 - DNA, 20 bp, Artificial Sequence
  Synthetic oligonucleotide; GAG chr2 60555918 60555937 60555934 +
caccatttccccttttcact

SEQ ID NO: 170834 - DNA, 20 bp, Artificial Sequence
  Synthetic oligonucleotide; CAG chr2 60555926 60555945 60555942 +
ccccttttcactgagttctt

SEQ ID NO: 170835 - DNA, 20 bp, Artificial Sequence
  Synthetic oligonucleotide; GAG chr2 60555928 60555947 60555944 +
ccttttcactgagttcttca

SEQ ID NO: 170836 - DNA, 20 bp, Artificial Sequence
  Synthetic oligonucleotide; CAG chr2 60555931 60555950 60555947 +
tttcactgagttcttcagag

SEQ ID NO: 170837 - DNA, 20 bp, Artificial Sequence
  Synthetic oligonucleotide; AGG chr2 60555932 60555951 60555948 +
ttcactgagttcttcagagc

SEQ ID NO: 170838 - DNA, 20 bp, Artificial Sequence
  Synthetic oligonucleotide; CAG chr2 60555936 60555955 60555952 +
ctgagttcttcagagcaggt

SEQ ID NO: 170839 - DNA, 20 bp, Artificial Sequence
  Synthetic oligonucleotide; CAG chr2 60555955 60555974 60555971 +
tcagcatctctattccacca

SEQ ID NO: 170840 - DNA, 20 bp, Artificial Sequence
  Synthetic oligonucleotide; CAG chr2 60555980 60555999 60555996 +
tgctttttgtcttgttaaac

SEQ ID NO: 170841 - DNA, 20 bp, Artificial Sequence
  Synthetic oligonucleotide; TGG chr2 60555986 60556005 60556002 +
ttgtcttgttaaaccagcct

SEQ ID NO: 170842 - DNA, 20 bp, Artificial Sequence
  Synthetic oligonucleotide; GAG chr2 60555988 60556007 60556004 +
gtcttgttaaaccagccttg

SEQ ID NO: 170843 - DNA, 20 bp, Artificial Sequence
  Synthetic oligonucleotide; AAG chr2 60555998 60556017 60556014 +
accagccttggagtcaccaa

SEQ ID NO: 170844 - DNA, 20 bp, Artificial Sequence
  Synthetic oligonucleotide; TGG chr2 60556011 60556030 60556027 +
tcaccaaaagaatgtcttct

SEQ ID NO: 170845 - DNA, 20 bp, Artificial Sequence
  Synthetic oligonucleotide; GGG chr2 60556012 60556031 60556028 +
caccaaaagaatgtcttctt

SEQ ID NO: 170846 - DNA, 20 bp, Artificial Sequence
  Synthetic oligonucleotide; GGG chr2 60556013 60556032 60556029 +
accaaaagaatgtcttcttg

SEQ ID NO: 170847 - DNA, 20 bp, Artificial Sequence
  Synthetic oligonucleotide; GGG chr2 60556014 60556033 60556030 +
ccaaaagaatgtcttcttgg

SEQ ID NO: 170848 - DNA, 20 bp, Artificial Sequence
  Synthetic oligonucleotide; GGG chr2 60556015 60556034 60556031 +
caaaagaatgtcttcttggg

SEQ ID NO: 170849 - DNA, 20 bp, Artificial Sequence
  Synthetic oligonucleotide; TGG chr2 60556018 60556037 60556034 +
aagaatgtcttcttgggggg

SEQ ID NO: 170850 - DNA, 20 bp, Artificial Sequence
  Synthetic oligonucleotide; CGG chr2 60556021 60556040 60556037 +
aatgtcttcttggggggtgg

SEQ ID NO: 170851 - DNA, 20 bp, Artificial Sequence
  Synthetic oligonucleotide; GGG chr2 60556022 60556041 60556038 +
atgtcttcttggggggtggc

SEQ ID NO: 170852 - DNA, 20 bp, Artificial Sequence
  Synthetic oligonucleotide; GGG chr2 60556023 60556042 60556039 +
tgtcttcttggggggtggcg

SEQ ID NO: 170853 - DNA, 20 bp, Artificial Sequence
  Synthetic oligonucleotide; GGG chr2 60556024 60556043 60556040 +
gtcttcttggggggtggcgg

SEQ ID NO: 170854 - DNA, 20 bp, Artificial Sequence
  Synthetic oligonucleotide; GAG chr2 60556026 60556045 60556042 +
cttcttggggggtggcgggg

SEQ ID NO: 170855 - DNA, 20 bp, Artificial Sequence
  Synthetic oligonucleotide; AGG chr2 60556027 60556046 60556043 +
ttcttggggggtggcggggg

SEQ ID NO: 170856 - DNA, 20 bp, Artificial Sequence
  Synthetic oligonucleotide; TGG chr2 60556036 60556055 60556052 +
ggtggcgggggaggacgacg

SEQ ID NO: 170857 - DNA, 20 bp, Artificial Sequence
  Synthetic oligonucleotide; GGG chr2 60556037 60556056 60556053 +
gtggcgggggaggacgacgt

SEQ ID NO: 170858 - DNA, 20 bp, Artificial Sequence
  Synthetic oligonucleotide; GGG chr2 60556038 60556057 60556054 +
tggcgggggaggacgacgtg

SEQ ID NO: 170859 - DNA, 20 bp, Artificial Sequence
  Synthetic oligonucleotide; GGG chr2 60556039 60556058 60556055 +
ggcgggggaggacgacgtgg

SEQ ID NO: 170860 - DNA, 20 bp, Artificial Sequence
  Synthetic oligonucleotide; CGG chr2 60556043 60556062 60556059 +
ggggaggacgacgtggggga

SEQ ID NO: 170861 - DNA, 20 bp, Artificial Sequence
  Synthetic oligonucleotide; TGG chr2 60556047 60556066 60556063 +
aggacgacgtgggggacggt

SEQ ID NO: 170862 - DNA, 20 bp, Artificial Sequence
  Synthetic oligonucleotide; GAG chr2 60556049 60556068 60556065 +
gacgacgtgggggacggttg

SEQ ID NO: 170863 - DNA, 20 bp, Artificial Sequence
  Synthetic oligonucleotide; AGG chr2 60556050 60556069 60556066 +
acgacgtgggggacggttgg

SEQ ID NO: 170864 - DNA, 20 bp, Artificial Sequence
  Synthetic oligonucleotide; GGG chr2 60556051 60556070 60556067 +
cgacgtgggggacggttgga

SEQ ID NO: 170865 - DNA, 20 bp, Artificial Sequence
  Synthetic oligonucleotide; AAG chr2 60556054 60556073 60556070 +
cgtgggggacggttggaggg

SEQ ID NO: 170866 - DNA, 20 bp, Artificial Sequence
  Synthetic oligonucleotide; AGG chr2 60556055 60556074 60556071 +
gtgggggacggttggaggga

SEQ ID NO: 170867 - DNA, 20 bp, Artificial Sequence
  Synthetic oligonucleotide; AAG chr2 60556060 60556079 60556076 +
ggacggttggagggaaggtg

SEQ ID NO: 170868 - DNA, 20 bp, Artificial Sequence
  Synthetic oligonucleotide; GAG chr2 60556062 60556081 60556078 +
acggttggagggaaggtgaa

SEQ ID NO: 170869 - DNA, 20 bp, Artificial Sequence
  Synthetic oligonucleotide; GAG chr2 60556064 60556083 60556080 +
ggttggagggaaggtgaaga

SEQ ID NO: 170870 - DNA, 20 bp, Artificial Sequence
  Synthetic oligonucleotide; AGG chr2 60556065 60556084 60556081 +
gttggagggaaggtgaagag

SEQ ID NO: 170871 - DNA, 20 bp, Artificial Sequence
  Synthetic oligonucleotide; GGG chr2 60556066 60556085 60556082 +
ttggagggaaggtgaagaga

SEQ ID NO: 170872 - DNA, 20 bp, Artificial Sequence
  Synthetic oligonucleotide; AAG chr2 60556069 60556088 60556085 +
gagggaaggtgaagagaggg

SEQ ID NO: 170873 - DNA, 20 bp, Artificial Sequence
  Synthetic oligonucleotide; AAG chr2 60556072 60556091 60556088 +
ggaaggtgaagagagggaag

SEQ ID NO: 170874 - DNA, 20 bp, Artificial Sequence
  Synthetic oligonucleotide; AAG chr2 60556076 60556095 60556092 +
ggtgaagagagggaagaaga

SEQ ID NO: 170875 - DNA, 20 bp, Artificial Sequence
  Synthetic oligonucleotide; TGG chr2 60556085 60556104 60556101 +
agggaagaagaaagtgcaac

SEQ ID NO: 170876 - DNA, 20 bp, Artificial Sequence
  Synthetic oligonucleotide; GGG chr2 60556086 60556105 60556102 +
gggaagaagaaagtgcaact

SEQ ID NO: 170877 - DNA, 20 bp, Artificial Sequence
  Synthetic oligonucleotide; GAG chr2 60556088 60556107 60556104 +
gaagaagaaagtgcaactgg

SEQ ID NO: 170878 - DNA, 20 bp, Artificial Sequence
  Synthetic oligonucleotide; AGG chr2 60556089 60556108 60556105 +
aagaagaaagtgcaactggg

SEQ ID NO: 170879 - DNA, 20 bp, Artificial Sequence
  Synthetic oligonucleotide; AAG chr2 60556114 60556133 60556130 +
tttgaaaaataaataaataa

SEQ ID NO: 170880 - DNA, 20 bp, Artificial Sequence
  Synthetic oligonucleotide; AAG chr2 60556119 60556138 60556135 +
aaaataaataaataaaagaa

SEQ ID NO: 170881 - DNA, 20 bp, Artificial Sequence
  Synthetic oligonucleotide; CAG chr2 60556128 60556147 60556144 +
aaataaaagaaaagcccctt

SEQ ID NO: 170882 - DNA, 20 bp, Artificial Sequence
  Synthetic oligonucleotide; AGG chr2 60556129 60556148 60556145 +
aataaaagaaaagccccttc

SEQ ID NO: 170883 - DNA, 20 bp, Artificial Sequence
  Synthetic oligonucleotide; TAG chr2 60556138 60556157 60556154 +
aaagccccttcaggtaacaa

SEQ ID NO: 170884 - DNA, 20 bp, Artificial Sequence
  Synthetic oligonucleotide; GAG chr2 60556142 60556161 60556158 +
ccccttcaggtaacaatagt

SEQ ID NO: 170885 - DNA, 20 bp, Artificial Sequence
  Synthetic oligonucleotide; CAG chr2 60556146 60556165 60556162 +
ttcaggtaacaatagtgagc

SEQ ID NO: 170886 - DNA, 20 bp, Artificial Sequence
  Synthetic oligonucleotide; CAG chr2 60556156 60556175 60556172 +
aatagtgagccagattcttt

SEQ ID NO: 170887 - DNA, 20 bp, Artificial Sequence
  Synthetic oligonucleotide; AAG chr2 60556163 60556182 60556179 +
agccagattctttcagaacc

SEQ ID NO: 170888 - DNA, 20 bp, Artificial Sequence
  Synthetic oligonucleotide; CAG chr2 60556171 60556190 60556187 +
tctttcagaaccaagctttt

SEQ ID NO: 170889 - DNA, 20 bp, Artificial Sequence
  Synthetic oligonucleotide; AAG chr2 60556203 60556222 60556219 +
ttgttcccacccgtccataa

SEQ ID NO: 170890 - DNA, 20 bp, Artificial Sequence
  Synthetic oligonucleotide; TAG chr2 60556214 60556233 60556230 +
cgtccataaaagtccatcta

SEQ ID NO: 170891 - DNA, 20 bp, Artificial Sequence
  Synthetic oligonucleotide; GAG chr2 60556216 60556235 60556232 +
tccataaaagtccatctata

SEQ ID NO: 170892 - DNA, 20 bp, Artificial Sequence
  Synthetic oligonucleotide; AAG chr2 60556219 60556238 60556235 +
ataaaagtccatctatagag

SEQ ID NO: 170893 - DNA, 20 bp, Artificial Sequence
  Synthetic oligonucleotide; GAG chr2 60556232 60556251 60556248 +
tatagagaagatatataaat

SEQ ID NO: 170894 - DNA, 20 bp, Artificial Sequence
  Synthetic oligonucleotide; GAG chr2 60556236 60556255 60556252 +
gagaagatatataaatgagc

SEQ ID NO: 170895 - DNA, 20 bp, Artificial Sequence
  Synthetic oligonucleotide; GAG chr2 60556240 60556259 60556256 +
agatatataaatgagcgagt

SEQ ID NO: 170896 - DNA, 20 bp, Artificial Sequence
  Synthetic oligonucleotide; TGG chr2 60556248 60556267 60556264 +
aaatgagcgagtgagtgttg

SEQ ID NO: 170897 - DNA, 20 bp, Artificial Sequence
  Synthetic oligonucleotide; TGG chr2 60556282 60556301 60556298 +
tatgtatgatttatatataa

SEQ ID NO: 170898 - DNA, 20 bp, Artificial Sequence
  Synthetic oligonucleotide; AAG chr2 60556293 60556312 60556309 +
tatatataatggtgtgtata

SEQ ID NO: 170899 - DNA, 20 bp, Artificial Sequence
  Synthetic oligonucleotide; CGG chr2 60556301 60556320 60556317 +
atggtgtgtataaagctttt

SEQ ID NO: 170900 - DNA, 20 bp, Artificial Sequence
  Synthetic oligonucleotide; GGG chr2 60556302 60556321 60556318 +
tggtgtgtataaagcttttc

SEQ ID NO: 170901 - DNA, 20 bp, Artificial Sequence
  Synthetic oligonucleotide; GGG chr2 60556303 60556322 60556319 +
ggtgtgtataaagcttttcg

SEQ ID NO: 170902 - DNA, 20 bp, Artificial Sequence
  Synthetic oligonucleotide; TGG chr2 60556307 60556326 60556323 +
tgtataaagcttttcggggt

SEQ ID NO: 170903 - DNA, 20 bp, Artificial Sequence
  Synthetic oligonucleotide; TAG chr2 60556313 60556332 60556329 +
aagcttttcggggttggctg

SEQ ID NO: 170904 - DNA, 20 bp, Artificial Sequence
  Synthetic oligonucleotide; AAG chr2 60556322 60556341 60556338 +
ggggttggctgtagtgtaaa

SEQ ID NO: 170905 - DNA, 20 bp, Artificial Sequence
  Synthetic oligonucleotide; AAG chr2 60556346 60556365 60556362 +
aatgactttattacctctga

SEQ ID NO: 170906 - DNA, 20 bp, Artificial Sequence
  Synthetic oligonucleotide; AGG chr2 60556347 60556366 60556363 +
atgactttattacctctgaa

SEQ ID NO: 170907 - DNA, 20 bp, Artificial Sequence
  Synthetic oligonucleotide; TGG chr2 60556355 60556374 60556371 +
attacctctgaaaggttctg

SEQ ID NO: 170908 - DNA, 20 bp, Artificial Sequence
  Synthetic oligonucleotide; CAG chr2 60556369 60556388 60556385 +
gttctgtggttcacatttaa

SEQ ID NO: 170909 - DNA, 20 bp, Artificial Sequence
  Synthetic oligonucleotide; TGG chr2 60556417 60556436 60556433 +
aattgtgtgcgctctgacga

SEQ ID NO: 170910 - DNA, 20 bp, Artificial Sequence
  Synthetic oligonucleotide; CAG chr2 60556428 60556447 60556444 +
ctctgacgatggcaccctat

SEQ ID NO: 170911 - DNA, 20 bp, Artificial Sequence
  Synthetic oligonucleotide; AGG chr2 60556429 60556448 60556445 +
tctgacgatggcaccctatc

SEQ ID NO: 170912 - DNA, 20 bp, Artificial Sequence
  Synthetic oligonucleotide; GGG chr2 60556430 60556449 60556446 +
ctgacgatggcaccctatca

SEQ ID NO: 170913 - DNA, 20 bp, Artificial Sequence
  Synthetic oligonucleotide; TGG chr2 60556443 60556462 60556459 +
cctatcagggctgctatctg

SEQ ID NO: 170914 - DNA, 20 bp, Artificial Sequence
  Synthetic oligonucleotide; TGG chr2 60556464 60556483 60556480 +
ggctatttccaataaataac

SEQ ID NO: 170915 - DNA, 20 bp, Artificial Sequence
  Synthetic oligonucleotide; TAG chr2 60556503 60556522 60556519 +
ttcctttttaaaaaaaaaca

SEQ ID NO: 170916 - DNA, 20 bp, Artificial Sequence
  Synthetic oligonucleotide; AGG chr2 60556504 60556523 60556520 +
tcctttttaaaaaaaaacat

SEQ ID NO: 170917 - DNA, 20 bp, Artificial Sequence
  Synthetic oligonucleotide; AAG chr2 60556512 60556531 60556528 +
aaaaaaaaacataggaaatt

SEQ ID NO: 170918 - DNA, 20 bp, Artificial Sequence
  Synthetic oligonucleotide; TAG chr2 60556519 60556538 60556535 +
aacataggaaattaagcact

SEQ ID NO: 170919 - DNA, 20 bp, Artificial Sequence
  Synthetic oligonucleotide; AAG chr2 60556526 60556545 60556542 +
gaaattaagcacttagttac

SEQ ID NO: 170920 - DNA, 20 bp, Artificial Sequence
  Synthetic oligonucleotide; TAG chr2 60556529 60556548 60556545 +
attaagcacttagttacaag

SEQ ID NO: 170921 - DNA, 20 bp, Artificial Sequence
  Synthetic oligonucleotide; AGG chr2 60556530 60556549 60556546 +
ttaagcacttagttacaagt

SEQ ID NO: 170922 - DNA, 20 bp, Artificial Sequence
  Synthetic oligonucleotide; AAG chr2 60556540 60556559 60556543 -
tagcagacctacttgtaact

SEQ ID NO: 170923 - DNA, 20 bp, Artificial Sequence
  Synthetic oligonucleotide; AAG chr2 60556509 60556528 60556512 -
ttcctatgtttttttttaaa

SEQ ID NO: 170924 - DNA, 20 bp, Artificial Sequence
  Synthetic oligonucleotide; AGG chr2 60556508 60556527 60556511 -
tcctatgtttttttttaaaa

SEQ ID NO: 170925 - DNA, 20 bp, Artificial Sequence
  Synthetic oligonucleotide; CAG chr2 60556486 60556505 60556489 -
gaaaatcaataaaatgttgc

SEQ ID NO: 170926 - DNA, 20 bp, Artificial Sequence
  Synthetic oligonucleotide; TGG chr2 60556475 60556494 60556478 -
aaatgttgccagttatttat

SEQ ID NO: 170927 - DNA, 20 bp, Artificial Sequence
  Synthetic oligonucleotide; TAG chr2 60556469 60556488 60556472 -
tgccagttatttattggaaa

SEQ ID NO: 170928 - DNA, 20 bp, Artificial Sequence
  Synthetic oligonucleotide; CAG chr2 60556463 60556482 60556466 -
ttatttattggaaatagcca

SEQ ID NO: 170929 - DNA, 20 bp, Artificial Sequence
  Synthetic oligonucleotide; TAG chr2 60556459 60556478 60556462 -
ttattggaaatagccacaga

SEQ ID NO: 170930 - DNA, 20 bp, Artificial Sequence
  Synthetic oligonucleotide; CAG chr2 60556456 60556475 60556459 -
ttggaaatagccacagatag

SEQ ID NO: 170931 - DNA, 20 bp, Artificial Sequence
  Synthetic oligonucleotide; TAG chr2 60556447 60556466 60556450 -
gccacagatagcagccctga

SEQ ID NO: 170932 - DNA, 20 bp, Artificial Sequence
  Synthetic oligonucleotide; AGG chr2 60556446 60556465 60556449 -
ccacagatagcagccctgat

SEQ ID NO: 170933 - DNA, 20 bp, Artificial Sequence
  Synthetic oligonucleotide; GGG chr2 60556445 60556464 60556448 -
cacagatagcagccctgata

SEQ ID NO: 170934 - DNA, 20 bp, Artificial Sequence
  Synthetic oligonucleotide; CAG chr2 60556433 60556452 60556436 -
ccctgatagggtgccatcgt

SEQ ID NO: 170935 - DNA, 20 bp, Artificial Sequence
  Synthetic oligonucleotide; GAG chr2 60556431 60556450 60556434 -
ctgatagggtgccatcgtca

SEQ ID NO: 170936 - DNA, 20 bp, Artificial Sequence
  Synthetic oligonucleotide; CAG chr2 60556399 60556418 60556402 -
ttgtgtaatgaattgtaatt

SEQ ID NO: 170937 - DNA, 20 bp, Artificial Sequence
  Synthetic oligonucleotide; AAG chr2 60556396 60556415 60556399 -
tgtaatgaattgtaattcag

SEQ ID NO: 170938 - DNA, 20 bp, Artificial Sequence
  Synthetic oligonucleotide; CAG chr2 60556375 60556394 60556378 -
agactgttaaatgtgaacca

SEQ ID NO: 170939 - DNA, 20 bp, Artificial Sequence
  Synthetic oligonucleotide; CAG chr2 60556365 60556384 60556368 -
atgtgaaccacagaaccttt

SEQ ID NO: 170940 - DNA, 20 bp, Artificial Sequence
  Synthetic oligonucleotide; GAG chr2 60556363 60556382 60556366 -
gtgaaccacagaacctttca

SEQ ID NO: 170941 - DNA, 20 bp, Artificial Sequence
  Synthetic oligonucleotide; AGG chr2 60556362 60556381 60556365 -
tgaaccacagaacctttcag

SEQ ID NO: 170942 - DNA, 20 bp, Artificial Sequence
  Synthetic oligonucleotide; AAG chr2 60556354 60556373 60556357 -
agaacctttcagaggtaata

SEQ ID NO: 170943 - DNA, 20 bp, Artificial Sequence
  Synthetic oligonucleotide; CAG chr2 60556333 60556352 60556336 -
agtcattactttttacacta

SEQ ID NO: 170944 - DNA, 20 bp, Artificial Sequence
  Synthetic oligonucleotide; AAG chr2 60556319 60556338 60556322 -
acactacagccaaccccgaa

SEQ ID NO: 170945 - DNA, 20 bp, Artificial Sequence
  Synthetic oligonucleotide; TAG chr2 60556234 60556253 60556237 -
tcatttatatatcttctcta

SEQ ID NO: 170946 - DNA, 20 bp, Artificial Sequence
  Synthetic oligonucleotide; TGG chr2 60556230 60556249 60556233 -
ttatatatcttctctataga

SEQ ID NO: 170947 - DNA, 20 bp, Artificial Sequence
  Synthetic oligonucleotide; TGG chr2 60556220 60556239 60556223 -
tctctatagatggactttta

SEQ ID NO: 170948 - DNA, 20 bp, Artificial Sequence
  Synthetic oligonucleotide; CGG chr2 60556216 60556235 60556219 -
tatagatggacttttatgga

SEQ ID NO: 170949 - DNA, 20 bp, Artificial Sequence
  Synthetic oligonucleotide; GGG chr2 60556215 60556234 60556218 -
atagatggacttttatggac

SEQ ID NO: 170950 - DNA, 20 bp, Artificial Sequence
  Synthetic oligonucleotide; TGG chr2 60556212 60556231 60556215 -
gatggacttttatggacggg

SEQ ID NO: 170951 - DNA, 20 bp, Artificial Sequence
  Synthetic oligonucleotide; GGG chr2 60556211 60556230 60556214 -
atggacttttatggacgggt

SEQ ID NO: 170952 - DNA, 20 bp, Artificial Sequence
  Synthetic oligonucleotide; AAG chr2 60556189 60556208 60556192 -
gaacaatattcaaatctgaa

SEQ ID NO: 170953 - DNA, 20 bp, Artificial Sequence
  Synthetic oligonucleotide; TGG chr2 60556184 60556203 60556187 -
atattcaaatctgaaaagct

SEQ ID NO: 170954 - DNA, 20 bp, Artificial Sequence
  Synthetic oligonucleotide; AAG chr2 60556175 60556194 60556178 -
tctgaaaagcttggttctga

SEQ ID NO: 170955 - DNA, 20 bp, Artificial Sequence
  Synthetic oligonucleotide; TGG chr2 60556168 60556187 60556171 -
agcttggttctgaaagaatc

SEQ ID NO: 170956 - DNA, 20 bp, Artificial Sequence
  Synthetic oligonucleotide; AAG chr2 60556148 60556167 60556151 -
tggctcactattgttacctg

SEQ ID NO: 170957 - DNA, 20 bp, Artificial Sequence
  Synthetic oligonucleotide; AGG chr2 60556147 60556166 60556150 -
ggctcactattgttacctga

SEQ ID NO: 170958 - DNA, 20 bp, Artificial Sequence
  Synthetic oligonucleotide; GGG chr2 60556146 60556165 60556149 -
gctcactattgttacctgaa

SEQ ID NO: 170959 - DNA, 20 bp, Artificial Sequence
  Synthetic oligonucleotide; GGG chr2 60556145 60556164 60556148 -
ctcactattgttacctgaag

SEQ ID NO: 170960 - DNA, 20 bp, Artificial Sequence
  Synthetic oligonucleotide; AAG chr2 60556116 60556135 60556119 -
ttttatttatttatttttca

SEQ ID NO: 170961 - DNA, 20 bp, Artificial Sequence
  Synthetic oligonucleotide; AGG chr2 60556115 60556134 60556118 -
tttatttatttatttttcaa

SEQ ID NO: 170962 - DNA, 20 bp, Artificial Sequence
  Synthetic oligonucleotide; CAG chr2 60556107 60556126 60556110 -
tttatttttcaaaggcctcc

SEQ ID NO: 170963 - DNA, 20 bp, Artificial Sequence
  Synthetic oligonucleotide; AAG chr2 60556032 60556051 60556035 -
gtcctcccccgccacccccc

SEQ ID NO: 170964 - DNA, 20 bp, Artificial Sequence
  Synthetic oligonucleotide; AAG chr2 60556029 60556048 60556032 -
ctcccccgccaccccccaag

SEQ ID NO: 170965 - DNA, 20 bp, Artificial Sequence
  Synthetic oligonucleotide; TGG chr2 60556017 60556036 60556020 -
cccccaagaagacattcttt

SEQ ID NO: 170966 - DNA, 20 bp, Artificial Sequence
  Synthetic oligonucleotide; AAG chr2 60556007 60556026 60556010 -
gacattcttttggtgactcc

SEQ ID NO: 170967 - DNA, 20 bp, Artificial Sequence
  Synthetic oligonucleotide; AGG chr2 60556006 60556025 60556009 -
acattcttttggtgactcca

SEQ ID NO: 170968 - DNA, 20 bp, Artificial Sequence
  Synthetic oligonucleotide; TGG chr2 60556002 60556021 60556005 -
tcttttggtgactccaaggc

SEQ ID NO: 170969 - DNA, 20 bp, Artificial Sequence
  Synthetic oligonucleotide; AAG chr2 60555993 60556012 60555996 -
gactccaaggctggtttaac

SEQ ID NO: 170970 - DNA, 20 bp, Artificial Sequence
  Synthetic oligonucleotide; AAG chr2 60555985 60556004 60555988 -
ggctggtttaacaagacaaa

SEQ ID NO: 170971 - DNA, 20 bp, Artificial Sequence
  Synthetic oligonucleotide; CAG chr2 60555982 60556001 60555985 -
tggtttaacaagacaaaaag

SEQ ID NO: 170972 - DNA, 20 bp, Artificial Sequence
  Synthetic oligonucleotide; TGG chr2 60555975 60555994 60555978 -
acaagacaaaaagcagactg

SEQ ID NO: 170973 - DNA, 20 bp, Artificial Sequence
  Synthetic oligonucleotide; TGG chr2 60555972 60555991 60555975 -
agacaaaaagcagactgtgg

SEQ ID NO: 170974 - DNA, 20 bp, Artificial Sequence
  Synthetic oligonucleotide; TAG chr2 60555967 60555986 60555970 -
aaaagcagactgtggtggaa

SEQ ID NO: 170975 - DNA, 20 bp, Artificial Sequence
  Synthetic oligonucleotide; GAG chr2 60555965 60555984 60555968 -
aagcagactgtggtggaata

SEQ ID NO: 170976 - DNA, 20 bp, Artificial Sequence
  Synthetic oligonucleotide; AAG chr2 60555946 60555965 60555949 -
agagatgctgacctgctctg

SEQ ID NO: 170977 - DNA, 20 bp, Artificial Sequence
  Synthetic oligonucleotide; CAG chr2 60555939 60555958 60555942 -
ctgacctgctctgaagaact

SEQ ID NO: 170978 - DNA, 20 bp, Artificial Sequence
  Synthetic oligonucleotide; AAG chr2 60555932 60555951 60555935 -
gctctgaagaactcagtgaa

SEQ ID NO: 170979 - DNA, 20 bp, Artificial Sequence
  Synthetic oligonucleotide; AGG chr2 60555931 60555950 60555934 -
ctctgaagaactcagtgaaa

SEQ ID NO: 170980 - DNA, 20 bp, Artificial Sequence
  Synthetic oligonucleotide; GGG chr2 60555930 60555949 60555933 -
tctgaagaactcagtgaaaa

SEQ ID NO: 170981 - DNA, 20 bp, Artificial Sequence
  Synthetic oligonucleotide; GGG chr2 60555929 60555948 60555932 -
ctgaagaactcagtgaaaag

SEQ ID NO: 170982 - DNA, 20 bp, Artificial Sequence
  Synthetic oligonucleotide; TGG chr2 60555923 60555942 60555926 -
aactcagtgaaaaggggaaa

SEQ ID NO: 170983 - DNA, 20 bp, Artificial Sequence
  Synthetic oligonucleotide; AAG chr2 60555910 60555929 60555913 -
ggggaaatggtgtcacacac

SEQ ID NO: 170984 - DNA, 20 bp, Artificial Sequence
  Synthetic oligonucleotide; CAG chr2 60555904 60555923 60555907 -
atggtgtcacacacaagcta

SEQ ID NO: 170985 - DNA, 20 bp, Artificial Sequence
  Synthetic oligonucleotide; GAG chr2 60555902 60555921 60555905 -
ggtgtcacacacaagctaca

SEQ ID NO: 170986 - DNA, 20 bp, Artificial Sequence
  Synthetic oligonucleotide; TAG chr2 60555890 60555909 60555893 -
aagctacagagcttaacttc

SEQ ID NO: 170987 - DNA, 20 bp, Artificial Sequence
  Synthetic oligonucleotide; CAG chr2 60555866 60555885 60555869 -
gaatcctcccgcttcttaaa

SEQ ID NO: 170988 - DNA, 20 bp, Artificial Sequence
  Synthetic oligonucleotide; GAG chr2 60555858 60555877 60555861 -
ccgcttcttaaacagaattt

SEQ ID NO: 170989 - DNA, 20 bp, Artificial Sequence
  Synthetic oligonucleotide; AGG chr2 60555857 60555876 60555860 -
cgcttcttaaacagaatttg

SEQ ID NO: 170990 - DNA, 20 bp, Artificial Sequence
  Synthetic oligonucleotide; TGG chr2 60555838 60555857 60555841 -
gaggtctccctcccacaaac

SEQ ID NO: 170991 - DNA, 20 bp, Artificial Sequence
  Synthetic oligonucleotide; GAG chr2 60555836 60555855 60555839 -
ggtctccctcccacaaactg

SEQ ID NO: 170992 - DNA, 20 bp, Artificial Sequence
  Synthetic oligonucleotide; AGG chr2 60555835 60555854 60555838 -
gtctccctcccacaaactgg

SEQ ID NO: 170993 - DNA, 20 bp, Artificial Sequence
  Synthetic oligonucleotide; GGG chr2 60555834 60555853 60555837 -
tctccctcccacaaactgga

SEQ ID NO: 170994 - DNA, 20 bp, Artificial Sequence
  Synthetic oligonucleotide; CAG chr2 60555794 60555813 60555797 -
aaaccacattgacacaatcc

SEQ ID NO: 170995 - DNA, 20 bp, Artificial Sequence
  Synthetic oligonucleotide; CAG chr2 60555789 60555808 60555792 -
acattgacacaatcccagta

SEQ ID NO: 170996 - DNA, 20 bp, Artificial Sequence
  Synthetic oligonucleotide; GAG chr2 60555766 60555785 60555769 -
cccacatctctctcaatgtt

SEQ ID NO: 170997 - DNA, 20 bp, Artificial Sequence
  Synthetic oligonucleotide; TAG chr2 60555740 60555759 60555743 -
caaaacctccttttcttcct

SEQ ID NO: 170998 - DNA, 20 bp, Artificial Sequence
  Synthetic oligonucleotide; GAG chr2 60555738 60555757 60555741 -
aaacctccttttcttcctta

SEQ ID NO: 170999 - DNA, 20 bp, Artificial Sequence
  Synthetic oligonucleotide; AGG chr2 60555737 60555756 60555740 -
aacctccttttcttccttag

SEQ ID NO: 171000 - DNA, 20 bp, Artificial Sequence
  Synthetic oligonucleotide; GGG chr2 60555736 60555755 60555739 -
acctccttttcttccttaga

SEQ ID NO: 171001 - DNA, 20 bp, Artificial Sequence
  Synthetic oligonucleotide; GGG chr2 60555735 60555754 60555738 -
cctccttttcttccttagag

SEQ ID NO: 171002 - DNA, 20 bp, Artificial Sequence
  Synthetic oligonucleotide; AAG chr2 60555728 60555747 60555731 -
ttcttccttagaggggtccg

SEQ ID NO: 171003 - DNA, 20 bp, Artificial Sequence
  Synthetic oligonucleotide; GAG chr2 60555718 60555737 60555721 -
gaggggtccgaagctccgcc

SEQ ID NO: 171004 - DNA, 20 bp, Artificial Sequence
  Synthetic oligonucleotide; TAG chr2 60555714 60555733 60555717 -
ggtccgaagctccgccgagc

SEQ ID NO: 171005 - DNA, 20 bp, Artificial Sequence
  Synthetic oligonucleotide; AGG chr2 60555713 60555732 60555716 -
gtccgaagctccgccgagct

SEQ ID NO: 171006 - DNA, 20 bp, Artificial Sequence
  Synthetic oligonucleotide; AAG chr2 60555709 60555728 60555712 -
gaagctccgccgagctaggc

SEQ ID NO: 171007 - DNA, 20 bp, Artificial Sequence
  Synthetic oligonucleotide; CAG chr2 60555705 60555724 60555708 -
ctccgccgagctaggcaagc

SEQ ID NO: 171008 - DNA, 20 bp, Artificial Sequence
  Synthetic oligonucleotide; CAG chr2 60555689 60555708 60555692 -
aagccagtcattttctaaca

SEQ ID NO: 171009 - DNA, 20 bp, Artificial Sequence
  Synthetic oligonucleotide; TAG chr2 60555686 60555705 60555689 -
ccagtcattttctaacacag

SEQ ID NO: 171010 - DNA, 20 bp, Artificial Sequence
  Synthetic oligonucleotide; AAG chr2 60555668 60555687 60555671 -
agtagacttgaaactttact

SEQ ID NO: 171011 - DNA, 20 bp, Artificial Sequence
  Synthetic oligonucleotide; CAG chr2 60555659 60555678 60555662 -
gaaactttactaagacgaaa

SEQ ID NO: 171012 - DNA, 20 bp, Artificial Sequence
  Synthetic oligonucleotide; AGG chr2 60555658 60555677 60555661 -
aaactttactaagacgaaac

SEQ ID NO: 171013 - DNA, 20 bp, Artificial Sequence
  Synthetic oligonucleotide; CAG chr2 60555649 60555668 60555652 -
taagacgaaacaggaataaa

SEQ ID NO: 171014 - DNA, 20 bp, Artificial Sequence
  Synthetic oligonucleotide; CGG chr2 60555638 60555657 60555641 -
aggaataaacagccgcttgc

SEQ ID NO: 171015 - DNA, 20 bp, Artificial Sequence
  Synthetic oligonucleotide; CAG chr2 60555635 60555654 60555638 -
aataaacagccgcttgccgg

SEQ ID NO: 171016 - DNA, 20 bp, Artificial Sequence
  Synthetic oligonucleotide; AGG chr2 60555634 60555653 60555637 -
ataaacagccgcttgccggc

SEQ ID NO: 171017 - DNA, 20 bp, Artificial Sequence
  Synthetic oligonucleotide; GGG chr2 60555633 60555652 60555636 -
taaacagccgcttgccggca

SEQ ID NO: 171018 - DNA, 20 bp, Artificial Sequence
  Synthetic oligonucleotide; CGG chr2 60555627 60555646 60555630 -
gccgcttgccggcagggctg

SEQ ID NO: 171019 - DNA, 20 bp, Artificial Sequence
  Synthetic oligonucleotide; GGG chr2 60555626 60555645 60555629 -
ccgcttgccggcagggctgc

SEQ ID NO: 171020 - DNA, 20 bp, Artificial Sequence
  Synthetic oligonucleotide; TGG chr2 60555622 60555641 60555625 -
ttgccggcagggctgcggga

SEQ ID NO: 171021 - DNA, 20 bp, Artificial Sequence
  Synthetic oligonucleotide; GGG chr2 60555621 60555640 60555624 -
tgccggcagggctgcgggat

SEQ ID NO: 171022 - DNA, 20 bp, Artificial Sequence
  Synthetic oligonucleotide; GAG chr2 60555617 60555636 60555620 -
ggcagggctgcgggatgggt

SEQ ID NO: 171023 - DNA, 20 bp, Artificial Sequence
  Synthetic oligonucleotide; AAG chr2 60555607 60555626 60555610 -
cgggatgggtgagcgcgtgc

SEQ ID NO: 171024 - DNA, 20 bp, Artificial Sequence
  Synthetic oligonucleotide; CGG chr2 60555602 60555621 60555605 -
tgggtgagcgcgtgcaagcc

SEQ ID NO: 171025 - DNA, 20 bp, Artificial Sequence
  Synthetic oligonucleotide; GGG chr2 60555601 60555620 60555604 -
gggtgagcgcgtgcaagccc

SEQ ID NO: 171026 - DNA, 20 bp, Artificial Sequence
  Synthetic oligonucleotide; GGG chr2 60555600 60555619 60555603 -
ggtgagcgcgtgcaagcccg

SEQ ID NO: 171027 - DNA, 20 bp, Artificial Sequence
  Synthetic oligonucleotide; AAG chr2 60555579 60555598 60555582 -
ggccctcgcttaaaacaata

SEQ ID NO: 171028 - DNA, 20 bp, Artificial Sequence
  Synthetic oligonucleotide; CGG chr2 60555567 60555586 60555570 -
aaacaataaagcccccccac

SEQ ID NO: 171029 - DNA, 20 bp, Artificial Sequence
  Synthetic oligonucleotide; GGG chr2 60555566 60555585 60555569 -
aacaataaagcccccccacc

SEQ ID NO: 171030 - DNA, 20 bp, Artificial Sequence
  Synthetic oligonucleotide; TGG chr2 60555563 60555582 60555566 -
aataaagcccccccaccggg

SEQ ID NO: 171031 - DNA, 20 bp, Artificial Sequence
  Synthetic oligonucleotide; GGG chr2 60555562 60555581 60555565 -
ataaagcccccccaccgggt

SEQ ID NO: 171032 - DNA, 20 bp, Artificial Sequence
  Synthetic oligonucleotide; GAG chr2 60555558 60555577 60555561 -
agcccccccaccgggtgggt

SEQ ID NO: 171033 - DNA, 20 bp, Artificial Sequence
  Synthetic oligonucleotide; CGG chr2 60555551 60555570 60555554 -
ccaccgggtgggtgagttta

SEQ ID NO: 171034 - DNA, 20 bp, Artificial Sequence
  Synthetic oligonucleotide; AAG chr2 60555548 60555567 60555551 -
ccgggtgggtgagtttacgg

SEQ ID NO: 171035 - DNA, 20 bp, Artificial Sequence
  Synthetic oligonucleotide; TAG chr2 60555535 60555554 60555538 -
tttacggaagcgacaccctt

SEQ ID NO: 171036 - DNA, 20 bp, Artificial Sequence
  Synthetic oligonucleotide; AAG chr2 60555528 60555547 60555531 -
aagcgacaccctttagactg

SEQ ID NO: 171037 - DNA, 20 bp, Artificial Sequence
  Synthetic oligonucleotide; GAG chr2 60555526 60555545 60555529 -
gcgacaccctttagactgaa

SEQ ID NO: 171038 - DNA, 20 bp, Artificial Sequence
  Synthetic oligonucleotide; AGG chr2 60555525 60555544 60555528 -
cgacaccctttagactgaag

SEQ ID NO: 171039 - DNA, 20 bp, Artificial Sequence
  Synthetic oligonucleotide; GGG chr2 60555524 60555543 60555527 -
gacaccctttagactgaaga

SEQ ID NO: 171040 - DNA, 20 bp, Artificial Sequence
  Synthetic oligonucleotide; GGG chr2 60555523 60555542 60555526 -
acaccctttagactgaagag

SEQ ID NO: 171041 - DNA, 20 bp, Artificial Sequence
  Synthetic oligonucleotide; GGG chr2 60555522 60555541 60555525 -
caccctttagactgaagagg

SEQ ID NO: 171042 - DNA, 20 bp, Artificial Sequence
  Synthetic oligonucleotide; GAG chr2 60555517 60555536 60555520 -
tttagactgaagagggggat

SEQ ID NO: 171043 - DNA, 20 bp, Artificial Sequence
  Synthetic oligonucleotide; AAG chr2 60555514 60555533 60555517 -
agactgaagagggggatgag

SEQ ID NO: 171044 - DNA, 20 bp, Artificial Sequence
  Synthetic oligonucleotide; CGG chr2 60555510 60555529 60555513 -
tgaagagggggatgagaaga

SEQ ID NO: 171045 - DNA, 20 bp, Artificial Sequence
  Synthetic oligonucleotide; GGG chr2 60555509 60555528 60555512 -
gaagagggggatgagaagac

SEQ ID NO: 171046 - DNA, 20 bp, Artificial Sequence
  Synthetic oligonucleotide; GGG chr2 60555508 60555527 60555511 -
aagagggggatgagaagacg

SEQ ID NO: 171047 - DNA, 20 bp, Artificial Sequence
  Synthetic oligonucleotide; GGG chr2 60555507 60555526 60555510 -
agagggggatgagaagacgg

SEQ ID NO: 171048 - DNA, 20 bp, Artificial Sequence
  Synthetic oligonucleotide; TGG chr2 60555501 60555520 60555504 -
ggatgagaagacgggggttg

SEQ ID NO: 171049 - DNA, 20 bp, Artificial Sequence
  Synthetic oligonucleotide; GAG chr2 60555489 60555508 60555492 -
gggggttgtggaaccgctcc

SEQ ID NO: 171050 - DNA, 20 bp, Artificial Sequence
  Synthetic oligonucleotide; AGG chr2 60555488 60555507 60555491 -
ggggttgtggaaccgctccg

SEQ ID NO: 171051 - DNA, 20 bp, Artificial Sequence
  Synthetic oligonucleotide; GAG chr2 60555486 60555505 60555489 -
ggttgtggaaccgctccgag

SEQ ID NO: 171052 - DNA, 20 bp, Artificial Sequence
  Synthetic oligonucleotide; GAG chr2 60555484 60555503 60555487 -
ttgtggaaccgctccgagga

SEQ ID NO: 171053 - DNA, 20 bp, Artificial Sequence
  Synthetic oligonucleotide; AGG chr2 60555483 60555502 60555486 -
tgtggaaccgctccgaggag

SEQ ID NO: 171054 - DNA, 20 bp, Artificial Sequence
  Synthetic oligonucleotide; GGG chr2 60555482 60555501 60555485 -
gtggaaccgctccgaggaga

SEQ ID NO: 171055 - DNA, 20 bp, Artificial Sequence
  Synthetic oligonucleotide; AAG chr2 60555479 60555498 60555482 -
gaaccgctccgaggagaggg

SEQ ID NO: 171056 - DNA, 20 bp, Artificial Sequence
  Synthetic oligonucleotide; AGG chr2 60555478 60555497 60555481 -
aaccgctccgaggagaggga

SEQ ID NO: 171057 - DNA, 20 bp, Artificial Sequence
  Synthetic oligonucleotide; GAG chr2 60555476 60555495 60555479 -
ccgctccgaggagagggaag

SEQ ID NO: 171058 - DNA, 20 bp, Artificial Sequence
  Synthetic oligonucleotide; AGG chr2 60555475 60555494 60555478 -
cgctccgaggagagggaagg

SEQ ID NO: 171059 - DNA, 20 bp, Artificial Sequence
  Synthetic oligonucleotide; GGG chr2 60555474 60555493 60555477 -
gctccgaggagagggaagga

SEQ ID NO: 171060 - DNA, 20 bp, Artificial Sequence
  Synthetic oligonucleotide; CAG chr2 60555459 60555478 60555462 -
aaggagggctcctcgctctg

SEQ ID NO: 171061 - DNA, 20 bp, Artificial Sequence
  Synthetic oligonucleotide; CAG chr2 60555433 60555452 60555436 -
cactcacacatatccacctg

SEQ ID NO: 171062 - DNA, 20 bp, Artificial Sequence
  Synthetic oligonucleotide; CAG chr2 60555428 60555447 60555431 -
acacatatccacctgcagct

SEQ ID NO: 171063 - DNA, 20 bp, Artificial Sequence
  Synthetic oligonucleotide; AGG chr2 60555427 60555446 60555430 -
cacatatccacctgcagctc

SEQ ID NO: 171064 - DNA, 20 bp, Artificial Sequence
  Synthetic oligonucleotide; GGG chr2 60555426 60555445 60555429 -
acatatccacctgcagctca

SEQ ID NO: 171065 - DNA, 20 bp, Artificial Sequence
  Synthetic oligonucleotide; CGG chr2 60555418 60555437 60555421 -
acctgcagctcagggtctcg

SEQ ID NO: 171066 - DNA, 20 bp, Artificial Sequence
  Synthetic oligonucleotide; GGG chr2 60555417 60555436 60555420 -
cctgcagctcagggtctcgc

SEQ ID NO: 171067 - DNA, 20 bp, Artificial Sequence
  Synthetic oligonucleotide; TGG chr2 60555411 60555430 60555414 -
gctcagggtctcgcgggcca

SEQ ID NO: 171068 - DNA, 20 bp, Artificial Sequence
  Synthetic oligonucleotide; TGG chr2 60555372 60555391 60555375 -
tgcaccctccgcacctccct

SEQ ID NO: 171069 - DNA, 20 bp, Artificial Sequence
  Synthetic oligonucleotide; GAG chr2 60555365 60555384 60555368 -
tccgcacctcccttggacct

SEQ ID NO: 171070 - DNA, 20 bp, Artificial Sequence
  Synthetic oligonucleotide; CAG chr2 60555334 60555353 60555337 -
cctctccccccaactccttc

SEQ ID NO: 171071 - DNA, 20 bp, Artificial Sequence
  Synthetic oligonucleotide; TGG chr2 60555328 60555347 60555331 -
cccccaactccttccagatt

SEQ ID NO: 171072 - DNA, 20 bp, Artificial Sequence
  Synthetic oligonucleotide; CGG chr2 60555322 60555341 60555325 -
actccttccagatttggaat

SEQ ID NO: 171073 - DNA, 20 bp, Artificial Sequence
  Synthetic oligonucleotide; CGG chr2 60555306 60555325 60555309 -
gaatcggactgcgatctccc

SEQ ID NO: 171074 - DNA, 20 bp, Artificial Sequence
  Synthetic oligonucleotide; CGG chr2 60555303 60555322 60555306 -
tcggactgcgatctccccgg

SEQ ID NO: 171075 - DNA, 20 bp, Artificial Sequence
  Synthetic oligonucleotide; CGG chr2 60555300 60555319 60555303 -
gactgcgatctccccggcgg

SEQ ID NO: 171076 - DNA, 20 bp, Artificial Sequence
  Synthetic oligonucleotide; CGG chr2 60555297 60555316 60555300 -
tgcgatctccccggcggcgg

SEQ ID NO: 171077 - DNA, 20 bp, Artificial Sequence
  Synthetic oligonucleotide; CGG chr2 60555294 60555313 60555297 -
gatctccccggcggcggcgg

SEQ ID NO: 171078 - DNA, 20 bp, Artificial Sequence
  Synthetic oligonucleotide; CGG chr2 60555291 60555310 60555294 -
ctccccggcggcggcggcgg

SEQ ID NO: 171079 - DNA, 20 bp, Artificial Sequence
  Synthetic oligonucleotide; CAG chr2 60555285 60555304 60555288 -
ggcggcggcggcggcggctg

SEQ ID NO: 171080 - DNA, 20 bp, Artificial Sequence
  Synthetic oligonucleotide; GAG chr2 60555283 60555302 60555286 -
cggcggcggcggcggctgca

SEQ ID NO: 171081 - DNA, 20 bp, Artificial Sequence
  Synthetic oligonucleotide; TGG chr2 60555280 60555299 60555283 -
cggcggcggcggctgcagag

SEQ ID NO: 171082 - DNA, 20 bp, Artificial Sequence
  Synthetic oligonucleotide; TGG chr2 60555274 60555293 60555277 -
cggcggctgcagagtggtgc

SEQ ID NO: 171083 - DNA, 20 bp, Artificial Sequence
  Synthetic oligonucleotide; CAG chr2 60555271 60555290 60555274 -
cggctgcagagtggtgctgg

SEQ ID NO: 171084 - DNA, 20 bp, Artificial Sequence
  Synthetic oligonucleotide; AGG chr2 60555270 60555289 60555273 -
ggctgcagagtggtgctggc

SEQ ID NO: 171085 - DNA, 20 bp, Artificial Sequence
  Synthetic oligonucleotide; CAG chr2 60555267 60555286 60555270 -
tgcagagtggtgctggcagg

SEQ ID NO: 171086 - DNA, 20 bp, Artificial Sequence
  Synthetic oligonucleotide; AGG chr2 60555266 60555285 60555269 -
gcagagtggtgctggcaggc

SEQ ID NO: 171087 - DNA, 20 bp, Artificial Sequence
  Synthetic oligonucleotide; GGG chr2 60555265 60555284 60555268 -
cagagtggtgctggcaggca

SEQ ID NO: 171088 - DNA, 20 bp, Artificial Sequence
  Synthetic oligonucleotide; GAG chr2 60555263 60555282 60555266 -
gagtggtgctggcaggcagg

SEQ ID NO: 171089 - DNA, 20 bp, Artificial Sequence
  Synthetic oligonucleotide; AGG chr2 60555262 60555281 60555265 -
agtggtgctggcaggcaggg

SEQ ID NO: 171090 - DNA, 20 bp, Artificial Sequence
  Synthetic oligonucleotide; TGG chr2 60555258 60555277 60555261 -
gtgctggcaggcagggaggc

SEQ ID NO: 171091 - DNA, 20 bp, Artificial Sequence
  Synthetic oligonucleotide; GGG chr2 60555257 60555276 60555260 -
tgctggcaggcagggaggct

SEQ ID NO: 171092 - DNA, 20 bp, Artificial Sequence
  Synthetic oligonucleotide; GAG chr2 60555255 60555274 60555258 -
ctggcaggcagggaggctgg

SEQ ID NO: 171093 - DNA, 20 bp, Artificial Sequence
  Synthetic oligonucleotide; AGG chr2 60555254 60555273 60555257 -
tggcaggcagggaggctggg

SEQ ID NO: 171094 - DNA, 20 bp, Artificial Sequence
  Synthetic oligonucleotide; CGG chr2 60555251 60555270 60555254 -
caggcagggaggctgggagg

SEQ ID NO: 171095 - DNA, 20 bp, Artificial Sequence
  Synthetic oligonucleotide; GGG chr2 60555250 60555269 60555253 -
aggcagggaggctgggaggc

SEQ ID NO: 171096 - DNA, 20 bp, Artificial Sequence
  Synthetic oligonucleotide; GAG chr2 60555248 60555267 60555251 -
gcagggaggctgggaggcgg

SEQ ID NO: 171097 - DNA, 20 bp, Artificial Sequence
  Synthetic oligonucleotide; AGG chr2 60555247 60555266 60555250 -
cagggaggctgggaggcggg

SEQ ID NO: 171098 - DNA, 20 bp, Artificial Sequence
  Synthetic oligonucleotide; CAG chr2 60555241 60555260 60555244 -
ggctgggaggcgggaggcgc

SEQ ID NO: 171099 - DNA, 20 bp, Artificial Sequence
  Synthetic oligonucleotide; AGG chr2 60555240 60555259 60555243 -
gctgggaggcgggaggcgcc

SEQ ID NO: 171100 - DNA, 20 bp, Artificial Sequence
  Synthetic oligonucleotide; GGG chr2 60555239 60555258 60555242 -
ctgggaggcgggaggcgcca

SEQ ID NO: 171101 - DNA, 20 bp, Artificial Sequence
  Synthetic oligonucleotide; GGG chr2 60555238 60555257 60555241 -
tgggaggcgggaggcgccag

SEQ ID NO: 171102 - DNA, 20 bp, Artificial Sequence
  Synthetic oligonucleotide; CAG chr2 60555229 60555248 60555232 -
ggaggcgccaggggacttta

SEQ ID NO: 171103 - DNA, 20 bp, Artificial Sequence
  Synthetic oligonucleotide; AGG chr2 60555228 60555247 60555231 -
gaggcgccaggggactttac

SEQ ID NO: 171104 - DNA, 20 bp, Artificial Sequence
  Synthetic oligonucleotide; CAG chr2 60555198 60555217 60555201 -
ctgaataaactttccaatcg

SEQ ID NO: 171105 - DNA, 20 bp, Artificial Sequence
  Synthetic oligonucleotide; AGG chr2 60555197 60555216 60555200 -
tgaataaactttccaatcgc

SEQ ID NO: 171106 - DNA, 20 bp, Artificial Sequence
  Synthetic oligonucleotide; GGG chr2 60555196 60555215 60555199 -
gaataaactttccaatcgca

SEQ ID NO: 171107 - DNA, 20 bp, Artificial Sequence
  Synthetic oligonucleotide; GGG chr2 60555195 60555214 60555198 -
aataaactttccaatcgcag

SEQ ID NO: 171108 - DNA, 20 bp, Artificial Sequence
  Synthetic oligonucleotide; GGG chr2 60555194 60555213 60555197 -
ataaactttccaatcgcagg

SEQ ID NO: 171109 - DNA, 20 bp, Artificial Sequence
  Synthetic oligonucleotide; AAG chr2 60555160 60555179 60555163 -
tacattttacgtaaaactga

SEQ ID NO: 171110 - DNA, 20 bp, Artificial Sequence
  Synthetic oligonucleotide; CAG chr2 60555147 60555166 60555150 -
aaactgaaagtatcccacgc

SEQ ID NO: 171111 - DNA, 20 bp, Artificial Sequence
  Synthetic oligonucleotide; GAG chr2 60555145 60555164 60555148 -
actgaaagtatcccacgcca

SEQ ID NO: 171112 - DNA, 20 bp, Artificial Sequence
  Synthetic oligonucleotide; AAG chr2 60555140 60555159 60555143 -
aagtatcccacgccagagtg

SEQ ID NO: 171113 - DNA, 20 bp, Artificial Sequence
  Synthetic oligonucleotide; CAG chr2 60555125 60555144 60555128 -
gagtgaagcccgctttttga

SEQ ID NO: 171114 - DNA, 20 bp, Artificial Sequence
  Synthetic oligonucleotide; CGG chr2 60555122 60555141 60555125 -
tgaagcccgctttttgacag

SEQ ID NO: 171115 - DNA, 20 bp, Artificial Sequence
  Synthetic oligonucleotide; CAG chr2 60555119 60555138 60555122 -
agcccgctttttgacagcgg

SEQ ID NO: 171116 - DNA, 20 bp, Artificial Sequence
  Synthetic oligonucleotide; AAG chr2 60555087 60555106 60555090 -
gtgtgtgcgtgtgtgcatta

SEQ ID NO: 171117 - DNA, 20 bp, Artificial Sequence
  Synthetic oligonucleotide; GAG chr2 60555085 60555104 60555088 -
gtgtgcgtgtgtgcattaaa

SEQ ID NO: 171118 - DNA, 20 bp, Artificial Sequence
  Synthetic oligonucleotide; CAG chr2 60555081 60555100 60555084 -
gcgtgtgtgcattaaagaga

SEQ ID NO: 171119 - DNA, 20 bp, Artificial Sequence
  Synthetic oligonucleotide; AGG chr2 60555080 60555099 60555083 -
cgtgtgtgcattaaagagac

SEQ ID NO: 171120 - DNA, 20 bp, Artificial Sequence
  Synthetic oligonucleotide; GGG chr2 60555079 60555098 60555082 -
gtgtgtgcattaaagagaca

SEQ ID NO: 171121 - DNA, 20 bp, Artificial Sequence
  Synthetic oligonucleotide; CAG chr2 60555064 60555083 60555067 -
agacagggttttatttccaa

SEQ ID NO: 171122 - DNA, 20 bp, Artificial Sequence
  Synthetic oligonucleotide; AGG chr2 60555063 60555082 60555066 -
gacagggttttatttccaac

SEQ ID NO: 171123 - DNA, 20 bp, Artificial Sequence
  Synthetic oligonucleotide; CAG chr2 60555046 60555065 60555049 -
aacaggtcttccctaatttc

SEQ ID NO: 171124 - DNA, 20 bp, Artificial Sequence
  Synthetic oligonucleotide; AGG chr2 60555045 60555064 60555048 -
acaggtcttccctaatttcc

SEQ ID NO: 171125 - DNA, 20 bp, Artificial Sequence
  Synthetic oligonucleotide; GGG chr2 60555044 60555063 60555047 -
caggtcttccctaatttcca

SEQ ID NO: 171126 - DNA, 20 bp, Artificial Sequence
  Synthetic oligonucleotide; CAG chr2 60555033 60555052 60555036 -
taatttccagggaacgtctg

SEQ ID NO: 171127 - DNA, 20 bp, Artificial Sequence
  Synthetic oligonucleotide; AAG chr2 60555029 60555048 60555032 -
ttccagggaacgtctgcaga

SEQ ID NO: 171128 - DNA, 20 bp, Artificial Sequence
  Synthetic oligonucleotide; AGG chr2 60555028 60555047 60555031 -
tccagggaacgtctgcagaa

SEQ ID NO: 171129 - DNA, 20 bp, Artificial Sequence
  Synthetic oligonucleotide; GAG chr2 60555024 60555043 60555027 -
gggaacgtctgcagaaaggc

SEQ ID NO: 171130 - DNA, 20 bp, Artificial Sequence
  Synthetic oligonucleotide; GAG chr2 60555022 60555041 60555025 -
gaacgtctgcagaaaggcga

SEQ ID NO: 171131 - DNA, 20 bp, Artificial Sequence
  Synthetic oligonucleotide; AGG chr2 60555021 60555040 60555024 -
aacgtctgcagaaaggcgag

SEQ ID NO: 171132 - DNA, 20 bp, Artificial Sequence
  Synthetic oligonucleotide; GGG chr2 60555020 60555039 60555023 -
acgtctgcagaaaggcgaga

SEQ ID NO: 171133 - DNA, 20 bp, Artificial Sequence
  Synthetic oligonucleotide; GGG chr2 60555019 60555038 60555022 -
cgtctgcagaaaggcgagag

SEQ ID NO: 171134 - DNA, 20 bp, Artificial Sequence
  Synthetic oligonucleotide; GGG chr2 60555018 60555037 60555021 -
gtctgcagaaaggcgagagg

SEQ ID NO: 171135 - DNA, 20 bp, Artificial Sequence
  Synthetic oligonucleotide; TGG chr2 60555011 60555030 60555014 -
gaaaggcgagagggggctgc

SEQ ID NO: 171136 - DNA, 20 bp, Artificial Sequence
  Synthetic oligonucleotide; TGG chr2 60555004 60555023 60555007 -
gagagggggctgctggctcc

SEQ ID NO: 171137 - DNA, 20 bp, Artificial Sequence
  Synthetic oligonucleotide; GGG chr2 60555003 60555022 60555006 -
agagggggctgctggctcct

SEQ ID NO: 171138 - DNA, 20 bp, Artificial Sequence
  Synthetic oligonucleotide; TGG chr2 60554991 60555010 60554994 -
tggctcctgggtgtgcgcct

SEQ ID NO: 171139 - DNA, 20 bp, Artificial Sequence
  Synthetic oligonucleotide; CGG chr2 60554987 60555006 60554990 -
tcctgggtgtgcgccttggc

SEQ ID NO: 171140 - DNA, 20 bp, Artificial Sequence
  Synthetic oligonucleotide; CGG chr2 60554984 60555003 60554987 -
tgggtgtgcgccttggccgg

SEQ ID NO: 171141 - DNA, 20 bp, Artificial Sequence
  Synthetic oligonucleotide; TGG chr2 60554977 60554996 60554980 -
gcgccttggccggcggcgcc

SEQ ID NO: 171142 - DNA, 20 bp, Artificial Sequence
  Synthetic oligonucleotide; GGG chr2 60554976 60554995 60554979 -
cgccttggccggcggcgcct

SEQ ID NO: 171143 - DNA, 20 bp, Artificial Sequence
  Synthetic oligonucleotide; GGG chr2 60554975 60554994 60554978 -
gccttggccggcggcgcctg

SEQ ID NO: 171144 - DNA, 20 bp, Artificial Sequence
  Synthetic oligonucleotide; GAG chr2 60554973 60554992 60554976 -
cttggccggcggcgcctggg

SEQ ID NO: 171145 - DNA, 20 bp, Artificial Sequence
  Synthetic oligonucleotide; CGG chr2 60554968 60554987 60554971 -
ccggcggcgcctggggagcg

SEQ ID NO: 171146 - DNA, 20 bp, Artificial Sequence
  Synthetic oligonucleotide; CGG chr2 60554965 60554984 60554968 -
gcggcgcctggggagcgcgg

SEQ ID NO: 171147 - DNA, 20 bp, Artificial Sequence
  Synthetic oligonucleotide; GAG chr2 60554956 60554975 60554959 -
ggggagcgcggcggtgaccc

SEQ ID NO: 171148 - DNA, 20 bp, Artificial Sequence
  Synthetic oligonucleotide; AGG chr2 60554955 60554974 60554958 -
gggagcgcggcggtgacccg

SEQ ID NO: 171149 - DNA, 20 bp, Artificial Sequence
  Synthetic oligonucleotide; CGG chr2 60554952 60554971 60554955 -
agcgcggcggtgacccgagg

SEQ ID NO: 171150 - DNA, 20 bp, Artificial Sequence
  Synthetic oligonucleotide; TGG chr2 60554935 60554954 60554938 -
aggcggtcatctcaccaccg

SEQ ID NO: 171151 - DNA, 20 bp, Artificial Sequence
  Synthetic oligonucleotide; GAG chr2 60554914 60554933 60554917 -
ggtctccccgctgctcctgc

SEQ ID NO: 171152 - DNA, 20 bp, Artificial Sequence
  Synthetic oligonucleotide; TGG chr2 60554874 60554893 60554877 -
attcccattttctctttccc

SEQ ID NO: 171153 - DNA, 20 bp, Artificial Sequence
  Synthetic oligonucleotide; GGG chr2 60554873 60554892 60554876 -
ttcccattttctctttccct

SEQ ID NO: 171154 - DNA, 20 bp, Artificial Sequence
  Synthetic oligonucleotide; CAG chr2 60554867 60554886 60554870 -
ttttctctttccctgggtaa

SEQ ID NO: 171155 - DNA, 20 bp, Artificial Sequence
  Synthetic oligonucleotide; CAG chr2 60554862 60554881 60554865 -
tctttccctgggtaacagca

SEQ ID NO: 171156 - DNA, 20 bp, Artificial Sequence
  Synthetic oligonucleotide; AGG chr2 60554861 60554880 60554864 -
ctttccctgggtaacagcac

SEQ ID NO: 171157 - DNA, 20 bp, Artificial Sequence
  Synthetic oligonucleotide; CAG chr2 60554856 60554875 60554859 -
cctgggtaacagcacaggaa

SEQ ID NO: 171158 - DNA, 20 bp, Artificial Sequence
  Synthetic oligonucleotide; AAG chr2 60554838 60554857 60554841 -
aacagttgtgctctgcccgt

SEQ ID NO: 171159 - DNA, 20 bp, Artificial Sequence
  Synthetic oligonucleotide; CAG chr2 60554803 60554822 60554806 -
cccatccctctgtgcttttg

SEQ ID NO: 171160 - DNA, 20 bp, Artificial Sequence
  Synthetic oligonucleotide; TGG chr2 60554794 60554813 60554797 -
ctgtgcttttgcagttgctc

SEQ ID NO: 171161 - DNA, 20 bp, Artificial Sequence
  Synthetic oligonucleotide; GAG chr2 60554792 60554811 60554795 -
gtgcttttgcagttgctctg

SEQ ID NO: 171162 - DNA, 20 bp, Artificial Sequence
  Synthetic oligonucleotide; TGG chr2 60554789 60554808 60554792 -
cttttgcagttgctctggag

SEQ ID NO: 171163 - DNA, 20 bp, Artificial Sequence
  Synthetic oligonucleotide; GGG chr2 60554788 60554807 60554791 -
ttttgcagttgctctggagt

SEQ ID NO: 171164 - DNA, 20 bp, Artificial Sequence
  Synthetic oligonucleotide; GAG chr2 60554786 60554805 60554789 -
ttgcagttgctctggagtgg

SEQ ID NO: 171165 - DNA, 20 bp, Artificial Sequence
  Synthetic oligonucleotide; AGG chr2 60554785 60554804 60554788 -
tgcagttgctctggagtggg

SEQ ID NO: 171166 - DNA, 20 bp, Artificial Sequence
  Synthetic oligonucleotide; GGG chr2 60554784 60554803 60554787 -
gcagttgctctggagtggga

SEQ ID NO: 171167 - DNA, 20 bp, Artificial Sequence
  Synthetic oligonucleotide; GGG chr2 60554783 60554802 60554786 -
cagttgctctggagtgggag

SEQ ID NO: 171168 - DNA, 20 bp, Artificial Sequence
  Synthetic oligonucleotide; GGG chr2 60554782 60554801 60554785 -
agttgctctggagtgggagg

SEQ ID NO: 171169 - DNA, 20 bp, Artificial Sequence
  Synthetic oligonucleotide; CAG chr2 60554768 60554787 60554771 -
gggagggggtgtgtccctcc

SEQ ID NO: 171170 - DNA, 20 bp, Artificial Sequence
  Synthetic oligonucleotide; AGG chr2 60554767 60554786 60554770 -
ggagggggtgtgtccctccc

SEQ ID NO: 171171 - DNA, 20 bp, Artificial Sequence
  Synthetic oligonucleotide; GGG chr2 60554766 60554785 60554769 -
gagggggtgtgtccctccca

SEQ ID NO: 171172 - DNA, 20 bp, Artificial Sequence
  Synthetic oligonucleotide; CGG chr2 60554760 60554779 60554763 -
gtgtgtccctcccagggacc

SEQ ID NO: 171173 - DNA, 20 bp, Artificial Sequence
  Synthetic oligonucleotide; CGG chr2 60554755 60554774 60554758 -
tccctcccagggacccggct

SEQ ID NO: 171174 - DNA, 20 bp, Artificial Sequence
  Synthetic oligonucleotide; GGG chr2 60554754 60554773 60554757 -
ccctcccagggacccggctc

SEQ ID NO: 171175 - DNA, 20 bp, Artificial Sequence
  Synthetic oligonucleotide; GGG chr2 60554753 60554772 60554756 -
cctcccagggacccggctcg

SEQ ID NO: 171176 - DNA, 20 bp, Artificial Sequence
  Synthetic oligonucleotide; CGG chr2 60554742 60554761 60554745 -
cccggctcggggacctcccg

SEQ ID NO: 171177 - DNA, 20 bp, Artificial Sequence
  Synthetic oligonucleotide; GAG chr2 60554733 60554752 60554736 -
gggacctcccgcggcgccgt

SEQ ID NO: 171178 - DNA, 20 bp, Artificial Sequence
  Synthetic oligonucleotide; CAG chr2 60554722 60554741 60554725 -
cggcgccgtgagcacattcc

SEQ ID NO: 171179 - DNA, 20 bp, Artificial Sequence
  Synthetic oligonucleotide; AGG chr2 60554721 60554740 60554724 -
ggcgccgtgagcacattccc

SEQ ID NO: 171180 - DNA, 20 bp, Artificial Sequence
  Synthetic oligonucleotide; GGG chr2 60554720 60554739 60554723 -
gcgccgtgagcacattccca

SEQ ID NO: 171181 - DNA, 20 bp, Artificial Sequence
  Synthetic oligonucleotide; TGG chr2 60554715 60554734 60554718 -
gtgagcacattcccagggac

SEQ ID NO: 171182 - DNA, 20 bp, Artificial Sequence
  Synthetic oligonucleotide; GGG chr2 60554714 60554733 60554717 -
tgagcacattcccagggact

SEQ ID NO: 171183 - DNA, 20 bp, Artificial Sequence
  Synthetic oligonucleotide; CGG chr2 60554706 60554725 60554709 -
ttcccagggactgggactcc

SEQ ID NO: 171184 - DNA, 20 bp, Artificial Sequence
  Synthetic oligonucleotide; GGG chr2 60554705 60554724 60554708 -
tcccagggactgggactccc

SEQ ID NO: 171185 - DNA, 20 bp, Artificial Sequence
  Synthetic oligonucleotide; CGG chr2 60554683 60554702 60554686 -
gactgcccgcgctttgtcct

SEQ ID NO: 171186 - DNA, 20 bp, Artificial Sequence
  Synthetic oligonucleotide; CAG chr2 60554675 60554694 60554678 -
gcgctttgtcctcggcctct

SEQ ID NO: 171187 - DNA, 20 bp, Artificial Sequence
  Synthetic oligonucleotide; GAG chr2 60554673 60554692 60554676 -
gctttgtcctcggcctctca

SEQ ID NO: 171188 - DNA, 20 bp, Artificial Sequence
  Synthetic oligonucleotide; GAG chr2 60554671 60554690 60554674 -
tttgtcctcggcctctcaga

SEQ ID NO: 171189 - DNA, 20 bp, Artificial Sequence
  Synthetic oligonucleotide; AGG chr2 60554670 60554689 60554673 -
ttgtcctcggcctctcagag

SEQ ID NO: 171190 - DNA, 20 bp, Artificial Sequence
  Synthetic oligonucleotide; TGG chr2 60554667 60554686 60554670 -
tcctcggcctctcagagagg

SEQ ID NO: 171191 - DNA, 20 bp, Artificial Sequence
  Synthetic oligonucleotide; CGG chr2 60554658 60554677 60554661 -
tctcagagaggtggacgcct

SEQ ID NO: 171192 - DNA, 20 bp, Artificial Sequence
  Synthetic oligonucleotide; CAG chr2 60554642 60554661 60554645 -
gcctcggtgcctctcttgcc

SEQ ID NO: 171193 - DNA, 20 bp, Artificial Sequence
  Synthetic oligonucleotide; AGG chr2 60554641 60554660 60554644 -
cctcggtgcctctcttgccc

SEQ ID NO: 171194 - DNA, 20 bp, Artificial Sequence
  Synthetic oligonucleotide; CGG chr2 60554634 60554653 60554637 -
gcctctcttgcccaggcccc

SEQ ID NO: 171195 - DNA, 20 bp, Artificial Sequence
  Synthetic oligonucleotide; CGG chr2 60554621 60554640 60554624 -
aggcccccggcgctcccctc

SEQ ID NO: 171196 - DNA, 20 bp, Artificial Sequence
  Synthetic oligonucleotide; GGG chr2 60554620 60554639 60554623 -
ggcccccggcgctcccctcc

SEQ ID NO: 171197 - DNA, 20 bp, Artificial Sequence
  Synthetic oligonucleotide; GGG chr2 60554619 60554638 60554622 -
gcccccggcgctcccctccg

SEQ ID NO: 171198 - DNA, 20 bp, Artificial Sequence
  Synthetic oligonucleotide; GGG chr2 60554618 60554637 60554621 -
cccccggcgctcccctccgg

SEQ ID NO: 171199 - DNA, 20 bp, Artificial Sequence
  Synthetic oligonucleotide; CAG chr2 60554614 60554633 60554617 -
cggcgctcccctccgggggc

SEQ ID NO: 171200 - DNA, 20 bp, Artificial Sequence
  Synthetic oligonucleotide; TGG chr2 60554607 60554626 60554610 -
cccctccgggggccagactc

SEQ ID NO: 171201 - DNA, 20 bp, Artificial Sequence
  Synthetic oligonucleotide; CGG chr2 60554585 60554604 60554588 -
gctcctcgttctttattcct

SEQ ID NO: 171202 - DNA, 20 bp, Artificial Sequence
  Synthetic oligonucleotide; GGG chr2 60554584 60554603 60554587 -
ctcctcgttctttattcctc

SEQ ID NO: 171203 - DNA, 20 bp, Artificial Sequence
  Synthetic oligonucleotide; TAG chr2 60554563 60554582 60554566 -
ggctctctttctgcgaccct

SEQ ID NO: 171204 - DNA, 20 bp, Artificial Sequence
  Synthetic oligonucleotide; AGG chr2 60554562 60554581 60554565 -
gctctctttctgcgaccctt

SEQ ID NO: 171205 - DNA, 20 bp, Artificial Sequence
  Synthetic oligonucleotide; GAG chr2 60554560 60554579 60554563 -
tctctttctgcgacccttag

SEQ ID NO: 171206 - DNA, 20 bp, Artificial Sequence
  Synthetic oligonucleotide; CGG chr2 60554556 60554575 60554559 -
tttctgcgacccttaggagc

SEQ ID NO: 171207 - DNA, 20 bp, Artificial Sequence
  Synthetic oligonucleotide; GGG chr2 60554555 60554574 60554558 -
ttctgcgacccttaggagcc

SEQ ID NO: 171208 - DNA, 20 bp, Artificial Sequence
  Synthetic oligonucleotide; GGG chr2 60554554 60554573 60554557 -
tctgcgacccttaggagccg

SEQ ID NO: 171209 - DNA, 20 bp, Artificial Sequence
  Synthetic oligonucleotide; CGG chr2 60554548 60554567 60554551 -
acccttaggagccggggact

SEQ ID NO: 171210 - DNA, 20 bp, Artificial Sequence
  Synthetic oligonucleotide; CAG chr2 60554539 60554558 60554542 -
agccggggactcggcgcttt

SEQ ID NO: 171211 - DNA, 20 bp, Artificial Sequence
  Synthetic oligonucleotide; CAG chr2 60554529 60554548 60554532 -
tcggcgctttcagttgcatt

SEQ ID NO: 171212 - DNA, 20 bp, Artificial Sequence
  Synthetic oligonucleotide; CAG chr2 60554523 60554542 60554526 -
ctttcagttgcattcagacc

SEQ ID NO: 171213 - DNA, 20 bp, Artificial Sequence
  Synthetic oligonucleotide; TGG chr2 60554515 60554534 60554518 -
tgcattcagacccagtcgct

SEQ ID NO: 171214 - DNA, 20 bp, Artificial Sequence
  Synthetic oligonucleotide; CGG chr2 60554512 60554531 60554515 -
attcagacccagtcgcttgg

SEQ ID NO: 171215 - DNA, 20 bp, Artificial Sequence
  Synthetic oligonucleotide; GGG chr2 60554511 60554530 60554514 -
ttcagacccagtcgcttggc

SEQ ID NO: 171216 - DNA, 20 bp, Artificial Sequence
  Synthetic oligonucleotide; GGG chr2 60554510 60554529 60554513 -
tcagacccagtcgcttggcg

SEQ ID NO: 171217 - DNA, 20 bp, Artificial Sequence
  Synthetic oligonucleotide; CAG chr2 60554503 60554522 60554506 -
cagtcgcttggcggggcgct

SEQ ID NO: 171218 - DNA, 20 bp, Artificial Sequence
  Synthetic oligonucleotide; CGG chr2 60554495 60554514 60554498 -
tggcggggcgctcagattcc

SEQ ID NO: 171219 - DNA, 20 bp, Artificial Sequence
  Synthetic oligonucleotide; TGG chr2 60554488 60554507 60554491 -
gcgctcagattcccggtccc

SEQ ID NO: 171220 - DNA, 20 bp, Artificial Sequence
  Synthetic oligonucleotide; CGG chr2 60554483 60554502 60554486 -
cagattcccggtccctggct

SEQ ID NO: 171221 - DNA, 20 bp, Artificial Sequence
  Synthetic oligonucleotide; TGG chr2 60554477 60554496 60554480 -
cccggtccctggctcggcct

SEQ ID NO: 171222 - DNA, 20 bp, Artificial Sequence
  Synthetic oligonucleotide; GGG chr2 60554476 60554495 60554479 -
ccggtccctggctcggcctt

SEQ ID NO: 171223 - DNA, 20 bp, Artificial Sequence
  Synthetic oligonucleotide; GGG chr2 60554475 60554494 60554478 -
cggtccctggctcggccttg

SEQ ID NO: 171224 - DNA, 20 bp, Artificial Sequence
  Synthetic oligonucleotide; GGG chr2 60554474 60554493 60554477 -
ggtccctggctcggccttgg

SEQ ID NO: 171225 - DNA, 20 bp, Artificial Sequence
  Synthetic oligonucleotide; CGG chr2 60554465 60554484 60554468 -
ctcggccttgggggcgccct

SEQ ID NO: 171226 - DNA, 20 bp, Artificial Sequence
  Synthetic oligonucleotide; GGG chr2 60554464 60554483 60554467 -
tcggccttgggggcgccctc

SEQ ID NO: 171227 - DNA, 20 bp, Artificial Sequence
  Synthetic oligonucleotide; CGG chr2 60554458 60554477 60554461 -
ttgggggcgccctcgggccc

SEQ ID NO: 171228 - DNA, 20 bp, Artificial Sequence
  Synthetic oligonucleotide; CGG chr2 60554434 60554453 60554437 -
ctgcgccgcctgcctctccc

SEQ ID NO: 171229 - DNA, 20 bp, Artificial Sequence
  Synthetic oligonucleotide; CAG chr2 60554420 60554439 60554423 -
tctccccggtcccctctttc

SEQ ID NO: 171230 - DNA, 20 bp, Artificial Sequence
  Synthetic oligonucleotide; AGG chr2 60554419 60554438 60554422 -
ctccccggtcccctctttcc

SEQ ID NO: 171231 - DNA, 20 bp, Artificial Sequence
  Synthetic oligonucleotide; CGG chr2 60554411 60554430 60554414 -
tcccctctttccaggccgcg

SEQ ID NO: 171232 - DNA, 20 bp, Artificial Sequence
  Synthetic oligonucleotide; GGG chr2 60554410 60554429 60554413 -
cccctctttccaggccgcgc

SEQ ID NO: 171233 - DNA, 20 bp, Artificial Sequence
  Synthetic oligonucleotide; TGG chr2 60554403 60554422 60554406 -
ttccaggccgcgcgggctcc

SEQ ID NO: 171234 - DNA, 20 bp, Artificial Sequence
  Synthetic oligonucleotide; GAG chr2 60554401 60554420 60554404 -
ccaggccgcgcgggctcctg

SEQ ID NO: 171235 - DNA, 20 bp, Artificial Sequence
  Synthetic oligonucleotide; TGG chr2 60554395 60554414 60554398 -
cgcgcgggctcctggagact

SEQ ID NO: 171236 - DNA, 20 bp, Artificial Sequence
  Synthetic oligonucleotide; GGG chr2 60554394 60554413 60554397 -
gcgcgggctcctggagactt

SEQ ID NO: 171237 - DNA, 20 bp, Artificial Sequence
  Synthetic oligonucleotide; CGG chr2 60554380 60554399 60554383 -
agacttgggcgctgcccttc

SEQ ID NO: 171238 - DNA, 20 bp, Artificial Sequence
  Synthetic oligonucleotide; CAG chr2 60554372 60554391 60554375 -
gcgctgcccttccggacccg

SEQ ID NO: 171239 - DNA, 20 bp, Artificial Sequence
  Synthetic oligonucleotide; TAG chr2 60554358 60554377 60554361 -
gacccgcagccctccaaact

SEQ ID NO: 171240 - DNA, 20 bp, Artificial Sequence
  Synthetic oligonucleotide; AGG chr2 60554357 60554376 60554360 -
acccgcagccctccaaactt

SEQ ID NO: 171241 - DNA, 20 bp, Artificial Sequence
  Synthetic oligonucleotide; TGG chr2 60554353 60554372 60554356 -
gcagccctccaaacttaggc

SEQ ID NO: 171242 - DNA, 20 bp, Artificial Sequence
  Synthetic oligonucleotide; CGG chr2 60554305 60554324 60554308 -
ccacctcccctcgcccgctg

SEQ ID NO: 171243 - DNA, 20 bp, Artificial Sequence
  Synthetic oligonucleotide; GAG chr2 60554303 60554322 60554306 -
acctcccctcgcccgctgcg

SEQ ID NO: 171244 - DNA, 20 bp, Artificial Sequence
  Synthetic oligonucleotide; TGG chr2 60554292 60554311 60554295 -
cccgctgcggagctgtaact

SEQ ID NO: 171245 - DNA, 20 bp, Artificial Sequence
  Synthetic oligonucleotide; GAG chr2 60554290 60554309 60554293 -
cgctgcggagctgtaacttg

SEQ ID NO: 171246 - DNA, 20 bp, Artificial Sequence
  Synthetic oligonucleotide; AGG chr2 60554289 60554308 60554292 -
gctgcggagctgtaacttgg

SEQ ID NO: 171247 - DNA, 20 bp, Artificial Sequence
  Synthetic oligonucleotide; CAG chr2 60554284 60554303 60554287 -
ggagctgtaacttggaggct

SEQ ID NO: 171248 - DNA, 20 bp, Artificial Sequence
  Synthetic oligonucleotide; CGG chr2 60554271 60554290 60554274 -
ggaggctcagctctcaactt

SEQ ID NO: 171249 - DNA, 20 bp, Artificial Sequence
  Synthetic oligonucleotide; GGG chr2 60554270 60554289 60554273 -
gaggctcagctctcaacttc

SEQ ID NO: 171250 - DNA, 20 bp, Artificial Sequence
  Synthetic oligonucleotide; CGG chr2 60554242 60554261 60554245 -
tttctttgctgtcctctcct

SEQ ID NO: 171251 - DNA, 20 bp, Artificial Sequence
  Synthetic oligonucleotide; GGG chr2 60554241 60554260 60554244 -
ttctttgctgtcctctcctc

SEQ ID NO: 171252 - DNA, 20 bp, Artificial Sequence
  Synthetic oligonucleotide; AAG chr2 60554236 60554255 60554239 -
tgctgtcctctcctcgggca

SEQ ID NO: 171253 - DNA, 20 bp, Artificial Sequence
  Synthetic oligonucleotide; GAG chr2 60554227 60554246 60554230 -
ctcctcgggcaaagtttccc

SEQ ID NO: 171254 - DNA, 20 bp, Artificial Sequence
  Synthetic oligonucleotide; CAG chr2 60554222 60554241 60554225 -
cgggcaaagtttcccgagcg

SEQ ID NO: 171255 - DNA, 20 bp, Artificial Sequence
  Synthetic oligonucleotide; CGG chr2 60554216 60554235 60554219 -
aagtttcccgagcgcagccg

SEQ ID NO: 171256 - DNA, 20 bp, Artificial Sequence
  Synthetic oligonucleotide; GGG chr2 60554215 60554234 60554218 -
agtttcccgagcgcagccgc

SEQ ID NO: 171257 - DNA, 20 bp, Artificial Sequence
  Synthetic oligonucleotide; CGG chr2 60554210 60554229 60554213 -
cccgagcgcagccgcgggct

SEQ ID NO: 171258 - DNA, 20 bp, Artificial Sequence
  Synthetic oligonucleotide; GGG chr2 60554209 60554228 60554212 -
ccgagcgcagccgcgggctc

SEQ ID NO: 171259 - DNA, 20 bp, Artificial Sequence
  Synthetic oligonucleotide; GGG chr2 60554208 60554227 60554211 -
cgagcgcagccgcgggctcg

SEQ ID NO: 171260 - DNA, 20 bp, Artificial Sequence
  Synthetic oligonucleotide; CGG chr2 60554196 60554215 60554199 -
cgggctcggggcttttactt

SEQ ID NO: 171261 - DNA, 20 bp, Artificial Sequence
  Synthetic oligonucleotide; TGG chr2 60554189 60554208 60554192 -
ggggcttttacttcggcccc

SEQ ID NO: 171262 - DNA, 20 bp, Artificial Sequence
  Synthetic oligonucleotide; CGG chr2 60554176 60554195 60554179 -
cggcccctggcgtccacacg

SEQ ID NO: 171263 - DNA, 20 bp, Artificial Sequence
  Synthetic oligonucleotide; GGG chr2 60554175 60554194 60554178 -
ggcccctggcgtccacacgc

SEQ ID NO: 171264 - DNA, 20 bp, Artificial Sequence
  Synthetic oligonucleotide; GGG chr2 60554174 60554193 60554177 -
gcccctggcgtccacacgcg

SEQ ID NO: 171265 - DNA, 20 bp, Artificial Sequence
  Synthetic oligonucleotide; GAG chr2 60554172 60554191 60554175 -
ccctggcgtccacacgcggg

SEQ ID NO: 171266 - DNA, 20 bp, Artificial Sequence
  Synthetic oligonucleotide; GAG chr2 60554168 60554187 60554171 -
ggcgtccacacgcggggagc

SEQ ID NO: 171267 - DNA, 20 bp, Artificial Sequence
  Synthetic oligonucleotide; CGG chr2 60554163 60554182 60554166 -
ccacacgcggggagcgagcg

SEQ ID NO: 171268 - DNA, 20 bp, Artificial Sequence
  Synthetic oligonucleotide; CGG chr2 60554160 60554179 60554163 -
cacgcggggagcgagcgcgg

SEQ ID NO: 171269 - DNA, 20 bp, Artificial Sequence
  Synthetic oligonucleotide; CGG chr2 60554157 60554176 60554160 -
gcggggagcgagcgcggcgg

SEQ ID NO: 171270 - DNA, 20 bp, Artificial Sequence
  Synthetic oligonucleotide; CGG chr2 60554154 60554173 60554157 -
gggagcgagcgcggcggcgg

SEQ ID NO: 171271 - DNA, 20 bp, Artificial Sequence
  Synthetic oligonucleotide; GGG chr2 60554153 60554172 60554156 -
ggagcgagcgcggcggcggc

SEQ ID NO: 171272 - DNA, 20 bp, Artificial Sequence
  Synthetic oligonucleotide; GGG chr2 60554152 60554171 60554155 -
gagcgagcgcggcggcggcg

SEQ ID NO: 171273 - DNA, 20 bp, Artificial Sequence
  Synthetic oligonucleotide; GAG chr2 60554150 60554169 60554153 -
gcgagcgcggcggcggcggg

SEQ ID NO: 171274 - DNA, 20 bp, Artificial Sequence
  Synthetic oligonucleotide; AGG chr2 60554149 60554168 60554152 -
cgagcgcggcggcggcgggg

SEQ ID NO: 171275 - DNA, 20 bp, Artificial Sequence
  Synthetic oligonucleotide; GGG chr2 60554148 60554167 60554151 -
gagcgcggcggcggcgggga

SEQ ID NO: 171276 - DNA, 20 bp, Artificial Sequence
  Synthetic oligonucleotide; GGG chr2 60554147 60554166 60554150 -
agcgcggcggcggcggggag

SEQ ID NO: 171277 - DNA, 20 bp, Artificial Sequence
  Synthetic oligonucleotide; AAG chr2 60554144 60554163 60554147 -
gcggcggcggcggggagggg

SEQ ID NO: 171278 - DNA, 20 bp, Artificial Sequence
  Synthetic oligonucleotide; TGG chr2 60554141 60554160 60554144 -
gcggcggcggggaggggaag

SEQ ID NO: 171279 - DNA, 20 bp, Artificial Sequence
  Synthetic oligonucleotide; GGG chr2 60554140 60554159 60554143 -
cggcggcggggaggggaagt

SEQ ID NO: 171280 - DNA, 20 bp, Artificial Sequence
  Synthetic oligonucleotide; CGG chr2 60554129 60554148 60554132 -
aggggaagtgggtgtgcgta

SEQ ID NO: 171281 - DNA, 20 bp, Artificial Sequence
  Synthetic oligonucleotide; GAG chr2 60554127 60554146 60554130 -
gggaagtgggtgtgcgtacg

SEQ ID NO: 171282 - DNA, 20 bp, Artificial Sequence
  Synthetic oligonucleotide; AGG chr2 60554126 60554145 60554129 -
ggaagtgggtgtgcgtacgg

SEQ ID NO: 171283 - DNA, 20 bp, Artificial Sequence
  Synthetic oligonucleotide; GAG chr2 60554124 60554143 60554127 -
aagtgggtgtgcgtacggag

SEQ ID NO: 171284 - DNA, 20 bp, Artificial Sequence
  Synthetic oligonucleotide; AGG chr2 60554123 60554142 60554126 -
agtgggtgtgcgtacggagg

SEQ ID NO: 171285 - DNA, 20 bp, Artificial Sequence
  Synthetic oligonucleotide; GGG chr2 60554122 60554141 60554125 -
gtgggtgtgcgtacggagga

SEQ ID NO: 171286 - DNA, 20 bp, Artificial Sequence
  Synthetic oligonucleotide; CGG chr2 60554115 60554134 60554118 -
tgcgtacggaggagggtgtc

SEQ ID NO: 171287 - DNA, 20 bp, Artificial Sequence
  Synthetic oligonucleotide; GGG chr2 60554114 60554133 60554117 -
gcgtacggaggagggtgtcc

SEQ ID NO: 171288 - DNA, 20 bp, Artificial Sequence
  Synthetic oligonucleotide; GAG chr2 60554112 60554131 60554115 -
gtacggaggagggtgtccgg

SEQ ID NO: 171289 - DNA, 20 bp, Artificial Sequence
  Synthetic oligonucleotide; TGG chr2 60554099 60554118 60554102 -
tgtccgggagcaactctacc

SEQ ID NO: 171290 - DNA, 20 bp, Artificial Sequence
  Synthetic oligonucleotide; CAG chr2 60554074 60554093 60554077 -
tccctccgcccgcgcttccc

SEQ ID NO: 171291 - DNA, 20 bp, Artificial Sequence
  Synthetic oligonucleotide; CGG chr2 60554069 60554088 60554072 -
ccgcccgcgcttccccagcc

SEQ ID NO: 171292 - DNA, 20 bp, Artificial Sequence
  Synthetic oligonucleotide; GGG chr2 60554068 60554087 60554071 -
cgcccgcgcttccccagccc

SEQ ID NO: 171293 - DNA, 20 bp, Artificial Sequence
  Synthetic oligonucleotide; GGG chr2 60554067 60554086 60554070 -
gcccgcgcttccccagcccg

SEQ ID NO: 171294 - DNA, 20 bp, Artificial Sequence
  Synthetic oligonucleotide; CAG chr2 60554061 60554080 60554064 -
gcttccccagcccggggctg

SEQ ID NO: 171295 - DNA, 20 bp, Artificial Sequence
  Synthetic oligonucleotide; CGG chr2 60554053 60554072 60554056 -
agcccggggctgcagcctcc

SEQ ID NO: 171296 - DNA, 20 bp, Artificial Sequence
  Synthetic oligonucleotide; TAG chr2 60554005 60554024 60554008 -
ttttgaataatctttcattt

SEQ ID NO: 171297 - DNA, 20 bp, Artificial Sequence
  Synthetic oligonucleotide; GAG chr2 60554003 60554022 60554006 -
ttgaataatctttcatttta

SEQ ID NO: 171298 - DNA, 20 bp, Artificial Sequence
  Synthetic oligonucleotide; TGG chr2 60553990 60554009 60553993 -
cattttagagtccgcgtgtg

SEQ ID NO: 171299 - DNA, 20 bp, Artificial Sequence
  Synthetic oligonucleotide; GGG chr2 60553989 60554008 60553992 -
attttagagtccgcgtgtgt

SEQ ID NO: 171300 - DNA, 20 bp, Artificial Sequence
  Synthetic oligonucleotide; GGG chr2 60553988 60554007 60553991 -
ttttagagtccgcgtgtgtg

SEQ ID NO: 171301 - DNA, 20 bp, Artificial Sequence
  Synthetic oligonucleotide; GGG chr2 60553987 60554006 60553990 -
tttagagtccgcgtgtgtgg

SEQ ID NO: 171302 - DNA, 20 bp, Artificial Sequence
  Synthetic oligonucleotide; GGG chr2 60553986 60554005 60553989 -
ttagagtccgcgtgtgtggg

SEQ ID NO: 171303 - DNA, 20 bp, Artificial Sequence
  Synthetic oligonucleotide; GGG chr2 60553985 60554004 60553988 -
tagagtccgcgtgtgtgggg

SEQ ID NO: 171304 - DNA, 20 bp, Artificial Sequence
  Synthetic oligonucleotide; GAG chr2 60553983 60554002 60553986 -
gagtccgcgtgtgtgggggg

SEQ ID NO: 171305 - DNA, 20 bp, Artificial Sequence
  Synthetic oligonucleotide; CAG chr2 60553980 60553999 60553983 -
tccgcgtgtgtgggggggag

SEQ ID NO: 171306 - DNA, 20 bp, Artificial Sequence
  Synthetic oligonucleotide; AGG chr2 60553979 60553998 60553982 -
ccgcgtgtgtgggggggagc

SEQ ID NO: 171307 - DNA, 20 bp, Artificial Sequence
  Synthetic oligonucleotide; GGG chr2 60553978 60553997 60553981 -
cgcgtgtgtgggggggagca

SEQ ID NO: 171308 - DNA, 20 bp, Artificial Sequence
  Synthetic oligonucleotide; CGG chr2 60553916 60553935 60553919 -
gccacccctttcttctctcc

SEQ ID NO: 171309 - DNA, 20 bp, Artificial Sequence
  Synthetic oligonucleotide; CGG chr2 60553899 60553918 60553902 -
tcccggccacgccaccgccg

SEQ ID NO: 171310 - DNA, 20 bp, Artificial Sequence
  Synthetic oligonucleotide; CGG chr2 60553887 60553906 60553890 -
caccgccgcggcgctcgctg

SEQ ID NO: 171311 - DNA, 20 bp, Artificial Sequence
  Synthetic oligonucleotide; TGG chr2 60553880 60553899 60553883 -
gcggcgctcgctgcggccac

SEQ ID NO: 171312 - DNA, 20 bp, Artificial Sequence
  Synthetic oligonucleotide; GAG chr2 60553876 60553895 60553879 -
cgctcgctgcggccactggt

SEQ ID NO: 171313 - DNA, 20 bp, Artificial Sequence
  Synthetic oligonucleotide; CGG chr2 60553869 60553888 60553872 -
tgcggccactggtgagcccg

SEQ ID NO: 171314 - DNA, 20 bp, Artificial Sequence
  Synthetic oligonucleotide; CAG chr2 60553863 60553882 60553866 -
cactggtgagcccgcggccc

SEQ ID NO: 171315 - DNA, 20 bp, Artificial Sequence
  Synthetic oligonucleotide; CGG chr2 60553847 60553866 60553850 -
gccccagcgccccctcccct

SEQ ID NO: 171316 - DNA, 20 bp, Artificial Sequence
  Synthetic oligonucleotide; CGG chr2 60553831 60553850 60553834 -
ccctcggcccgcccctcccc

SEQ ID NO: 171317 - DNA, 20 bp, Artificial Sequence
  Synthetic oligonucleotide; GGG chr2 60553830 60553849 60553833 -
cctcggcccgcccctccccc

SEQ ID NO: 171318 - DNA, 20 bp, Artificial Sequence
  Synthetic oligonucleotide; GGG chr2 60553829 60553848 60553832 -
ctcggcccgcccctcccccg

SEQ ID NO: 171319 - DNA, 20 bp, Artificial Sequence
  Synthetic oligonucleotide; GGG chr2 60553828 60553847 60553831 -
tcggcccgcccctcccccgg

SEQ ID NO: 171320 - DNA, 20 bp, Artificial Sequence
  Synthetic oligonucleotide; TGG chr2 60553818 60553837 60553821 -
cctcccccgggggccgcgtc

SEQ ID NO: 171321 - DNA, 20 bp, Artificial Sequence
  Synthetic oligonucleotide; CGG chr2 60553809 60553828 60553812 -
ggggccgcgtctggcgtccg

SEQ ID NO: 171322 - DNA, 20 bp, Artificial Sequence
  Synthetic oligonucleotide; GAG chr2 60553807 60553826 60553810 -
ggccgcgtctggcgtccgcg

SEQ ID NO: 171323 - DNA, 20 bp, Artificial Sequence
  Synthetic oligonucleotide; TGG chr2 60553773 60553792 60553776 -
gcacctccccctccccgcac

SEQ ID NO: 171324 - DNA, 20 bp, Artificial Sequence
  Synthetic oligonucleotide; TGG chr2 60553766 60553785 60553769 -
cccctccccgcactggccat

SEQ ID NO: 171325 - DNA, 20 bp, Artificial Sequence
  Synthetic oligonucleotide; TGG chr2 60553756 60553775 60553759 -
cactggccattggcttgtcc

SEQ ID NO: 171326 - DNA, 20 bp, Artificial Sequence
  Synthetic oligonucleotide; CAG chr2 60553738 60553757 60553741 -
cctggtctctttttcatgtc

SEQ ID NO: 171327 - DNA, 20 bp, Artificial Sequence
  Synthetic oligonucleotide; TGG chr2 60553717 60553736 60553720 -
agcccctgatgtgtgtccat

SEQ ID NO: 171328 - DNA, 20 bp, Artificial Sequence
  Synthetic oligonucleotide; GAG chr2 60553711 60553730 60553714 -
tgatgtgtgtccattggtgt

SEQ ID NO: 171329 - DNA, 20 bp, Artificial Sequence
  Synthetic oligonucleotide; CAG chr2 60553642 60553661 60553645 -
tttgtgtgtctctgtccatc

SEQ ID NO: 171330 - DNA, 20 bp, Artificial Sequence
  Synthetic oligonucleotide; AAG chr2 60553626 60553645 60553629 -
catccagactcctgacgttc

SEQ ID NO: 171331 - DNA, 20 bp, Artificial Sequence
  Synthetic oligonucleotide; CAG chr2 60553619 60553638 60553622 -
actcctgacgttcaagttcg

SEQ ID NO: 171332 - DNA, 20 bp, Artificial Sequence
  Synthetic oligonucleotide; AGG chr2 60553618 60553637 60553621 -
ctcctgacgttcaagttcgc

SEQ ID NO: 171333 - DNA, 20 bp, Artificial Sequence
  Synthetic oligonucleotide; GGG chr2 60553617 60553636 60553620 -
tcctgacgttcaagttcgca

SEQ ID NO: 171334 - DNA, 20 bp, Artificial Sequence
  Synthetic oligonucleotide; CAG chr2 60553590 60553609 60553593 -
cacgtccgcacttgaacttg

SEQ ID NO: 171335 - DNA, 20 bp, Artificial Sequence
  Synthetic oligonucleotide; CAG chr2 60553585 60553604 60553588 -
ccgcacttgaacttgcagct

SEQ ID NO: 171336 - DNA, 20 bp, Artificial Sequence
  Synthetic oligonucleotide; AGG chr2 60553584 60553603 60553587 -
cgcacttgaacttgcagctc

SEQ ID NO: 171337 - DNA, 20 bp, Artificial Sequence
  Synthetic oligonucleotide; GGG chr2 60553583 60553602 60553586 -
gcacttgaacttgcagctca

SEQ ID NO: 171338 - DNA, 20 bp, Artificial Sequence
  Synthetic oligonucleotide; GGG chr2 60553582 60553601 60553585 -
cacttgaacttgcagctcag

SEQ ID NO: 171339 - DNA, 20 bp, Artificial Sequence
  Synthetic oligonucleotide; GGG chr2 60553581 60553600 60553584 -
acttgaacttgcagctcagg

SEQ ID NO: 171340 - DNA, 20 bp, Artificial Sequence
  Synthetic oligonucleotide; GGG chr2 60553580 60553599 60553583 -
cttgaacttgcagctcaggg

SEQ ID NO: 171341 - DNA, 20 bp, Artificial Sequence
  Synthetic oligonucleotide; AAG chr2 60553473 60553492 60553476 -
ttttttttttgcttaaaaaa

SEQ ID NO: 171342 - DNA, 20 bp, Artificial Sequence
  Synthetic oligonucleotide; CGG chr2 60553464 60553483 60553467 -
tgcttaaaaaaaagccatga

SEQ ID NO: 171343 - DNA, 20 bp, Artificial Sequence
  Synthetic oligonucleotide; TGG chr2 60553407 60553426 60553410 -
gtattatttctaatttattt

SEQ ID NO: 171344 - DNA, 20 bp, Artificial Sequence
  Synthetic oligonucleotide; AAG chr2 60553397 60553416 60553400 -
taatttattttggatgtcaa

SEQ ID NO: 171345 - DNA, 20 bp, Artificial Sequence
  Synthetic oligonucleotide; AGG chr2 60553396 60553415 60553399 -
aatttattttggatgtcaaa

SEQ ID NO: 171346 - DNA, 20 bp, Artificial Sequence
  Synthetic oligonucleotide; AAG chr2 60553385 60553404 60553388 -
gatgtcaaaaggcactgatg

SEQ ID NO: 171347 - DNA, 20 bp, Artificial Sequence
  Synthetic oligonucleotide; TGG chr2 60553372 60553391 60553375 -
actgatgaagatattttctc

SEQ ID NO: 171348 - DNA, 20 bp, Artificial Sequence
  Synthetic oligonucleotide; GAG chr2 60553370 60553389 60553373 -
tgatgaagatattttctctg

SEQ ID NO: 171349 - DNA, 20 bp, Artificial Sequence
  Synthetic oligonucleotide; CGG chr2 60553350 60553369 60553353 -
gagtctccttctttctaacc

SEQ ID NO: 171350 - DNA, 20 bp, Artificial Sequence
  Synthetic oligonucleotide; GAG chr2 60553330 60553349 60553333 -
cggctctcccgatgtgaacc

SEQ ID NO: 171351 - DNA, 20 bp, Artificial Sequence
  Synthetic oligonucleotide; CAG chr2 60553280 60553299 60553283 -
cgccgccgccgcccgccccg

SEQ ID NO: 171352 - DNA, 20 bp, Artificial Sequence
  Synthetic oligonucleotide; AAG chr2 60553259 60553278 60553262 -
agcccaccatgtctcgccgc

SEQ ID NO: 171353 - DNA, 20 bp, Artificial Sequence
  Synthetic oligonucleotide; AAG chr2 60553255 60553274 60553258 -
caccatgtctcgccgcaagc

SEQ ID NO: 171354 - DNA, 20 bp, Artificial Sequence
  Synthetic oligonucleotide; AGG chr2 60553254 60553273 60553257 -
accatgtctcgccgcaagca

SEQ ID NO: 171355 - DNA, 20 bp, Artificial Sequence
  Synthetic oligonucleotide; CAG chr2 60553244 60553263 60553247 -
gccgcaagcaaggcaaaccc

SEQ ID NO: 171356 - DNA, 20 bp, Artificial Sequence
  Synthetic oligonucleotide; AAG chr2 60553236 60553255 60553239 -
caaggcaaaccccagcactt

SEQ ID NO: 171357 - DNA, 20 bp, Artificial Sequence
  Synthetic oligonucleotide; CGG chr2 60553229 60553248 60553232 -
aaccccagcacttaagcaaa

SEQ ID NO: 171358 - DNA, 20 bp, Artificial Sequence
  Synthetic oligonucleotide; GGG chr2 60553228 60553247 60553231 -
accccagcacttaagcaaac

SEQ ID NO: 171359 - DNA, 20 bp, Artificial Sequence
  Synthetic oligonucleotide; AAG chr2 60553214 60553233 60553217 -
gcaaacgggaattctcgcgt

SEQ ID NO: 171360 - DNA, 20 bp, Artificial Sequence
  Synthetic oligonucleotide; TAG chr2 60553200 60553219 60553203 -
tcgcgtaagtaacccaataa

SEQ ID NO: 171361 - DNA, 20 bp, Artificial Sequence
  Synthetic oligonucleotide; GAG chr2 60553174 60553193 60553177 -
taataattattaataatcac

SEQ ID NO: 171362 - DNA, 20 bp, Artificial Sequence
  Synthetic oligonucleotide; GAG chr2 60553172 60553191 60553175 -
ataattattaataatcacga

SEQ ID NO: 171363 - DNA, 20 bp, Artificial Sequence
  Synthetic oligonucleotide; CAG chr2 60553165 60553184 60553168 -
ttaataatcacgagagcgcg

SEQ ID NO: 171364 - DNA, 20 bp, Artificial Sequence
  Synthetic oligonucleotide; AGG chr2 60553164 60553183 60553167 -
taataatcacgagagcgcgc

SEQ ID NO: 171365 - DNA, 20 bp, Artificial Sequence
  Synthetic oligonucleotide; TAG chr2 60553159 60553178 60553162 -
atcacgagagcgcgcaggac

SEQ ID NO: 171366 - DNA, 20 bp, Artificial Sequence
  Synthetic oligonucleotide; AAG chr2 60553156 60553175 60553159 -
acgagagcgcgcaggactag

SEQ ID NO: 171367 - DNA, 20 bp, Artificial Sequence
  Synthetic oligonucleotide; AAG chr2 60553150 60553169 60553153 -
gcgcgcaggactagaagcaa

SEQ ID NO: 171368 - DNA, 20 bp, Artificial Sequence
  Synthetic oligonucleotide; GAG chr2 60553146 60553165 60553149 -
gcaggactagaagcaaaagc

SEQ ID NO: 171369 - DNA, 20 bp, Artificial Sequence
  Synthetic oligonucleotide; AGG chr2 60553145 60553164 60553148 -
caggactagaagcaaaagcg

SEQ ID NO: 171370 - DNA, 20 bp, Artificial Sequence
  Synthetic oligonucleotide; GGG chr2 60553144 60553163 60553147 -
aggactagaagcaaaagcga

SEQ ID NO: 171371 - DNA, 20 bp, Artificial Sequence
  Synthetic oligonucleotide; GGG chr2 60553143 60553162 60553146 -
ggactagaagcaaaagcgag

SEQ ID NO: 171372 - DNA, 20 bp, Artificial Sequence
  Synthetic oligonucleotide; GGG chr2 60553142 60553161 60553145 -
gactagaagcaaaagcgagg

SEQ ID NO: 171373 - DNA, 20 bp, Artificial Sequence
  Synthetic oligonucleotide; GAG chr2 60553140 60553159 60553143 -
ctagaagcaaaagcgagggg

SEQ ID NO: 171374 - DNA, 20 bp, Artificial Sequence
  Synthetic oligonucleotide; GAG chr2 60553138 60553157 60553141 -
agaagcaaaagcgaggggga

SEQ ID NO: 171375 - DNA, 20 bp, Artificial Sequence
  Synthetic oligonucleotide; GAG chr2 60553136 60553155 60553139 -
aagcaaaagcgagggggaga

SEQ ID NO: 171376 - DNA, 20 bp, Artificial Sequence
  Synthetic oligonucleotide; AGG chr2 60553135 60553154 60553138 -
agcaaaagcgagggggagag

SEQ ID NO: 171377 - DNA, 20 bp, Artificial Sequence
  Synthetic oligonucleotide; GGG chr2 60553134 60553153 60553137 -
gcaaaagcgagggggagaga

SEQ ID NO: 171378 - DNA, 20 bp, Artificial Sequence
  Synthetic oligonucleotide; GGG chr2 60553133 60553152 60553136 -
caaaagcgagggggagagag

SEQ ID NO: 171379 - DNA, 20 bp, Artificial Sequence
  Synthetic oligonucleotide; GAG chr2 60553102 60553121 60553105 -
tgcatttttaaatttttcac

SEQ ID NO: 171380 - DNA, 20 bp, Artificial Sequence
  Synthetic oligonucleotide; GAG chr2 60553089 60553108 60553092 -
ttttcacgagaaaaacctcc

SEQ ID NO: 171381 - DNA, 20 bp, Artificial Sequence
  Synthetic oligonucleotide; GAG chr2 60553087 60553106 60553090 -
ttcacgagaaaaacctccga

SEQ ID NO: 171382 - DNA, 20 bp, Artificial Sequence
  Synthetic oligonucleotide; GAG chr2 60553082 60553101 60553085 -
gagaaaaacctccgagagtc

SEQ ID NO: 171383 - DNA, 20 bp, Artificial Sequence
  Synthetic oligonucleotide; AGG chr2 60553081 60553100 60553084 -
agaaaaacctccgagagtcg

SEQ ID NO: 171384 - DNA, 20 bp, Artificial Sequence
  Synthetic oligonucleotide; AAG chr2 60553075 60553094 60553078 -
acctccgagagtcgaggtaa

SEQ ID NO: 171385 - DNA, 20 bp, Artificial Sequence
  Synthetic oligonucleotide; GAG chr2 60553073 60553092 60553076 -
ctccgagagtcgaggtaaaa

SEQ ID NO: 171386 - DNA, 20 bp, Artificial Sequence
  Synthetic oligonucleotide; AAG chr2 60553067 60553086 60553070 -
gagtcgaggtaaaagagata

SEQ ID NO: 171387 - DNA, 20 bp, Artificial Sequence
  Synthetic oligonucleotide; AGG chr2 60553066 60553085 60553069 -
agtcgaggtaaaagagataa

SEQ ID NO: 171388 - DNA, 20 bp, Artificial Sequence
  Synthetic oligonucleotide; GGG chr2 60553065 60553084 60553068 -
gtcgaggtaaaagagataaa

SEQ ID NO: 171389 - DNA, 20 bp, Artificial Sequence
  Synthetic oligonucleotide; GGG chr2 60553064 60553083 60553067 -
tcgaggtaaaagagataaag

SEQ ID NO: 171390 - DNA, 20 bp, Artificial Sequence
  Synthetic oligonucleotide; GGG chr2 60553063 60553082 60553066 -
cgaggtaaaagagataaagg

SEQ ID NO: 171391 - DNA, 20 bp, Artificial Sequence
  Synthetic oligonucleotide; TGG chr2 60553041 60553060 60553044 -
gaaaaaaccctcatcccatc

SEQ ID NO: 171392 - DNA, 20 bp, Artificial Sequence
  Synthetic oligonucleotide; GAG chr2 60553014 60553033 60553017 -
attgccgtgtatgcactttt

SEQ ID NO: 171393 - DNA, 20 bp, Artificial Sequence
  Synthetic oligonucleotide; CAG chr2 60553010 60553029 60553013 -
ccgtgtatgcacttttgaga

SEQ ID NO: 171394 - DNA, 20 bp, Artificial Sequence
  Synthetic oligonucleotide; AAG chr2 60552922 60552941 60552925 -
gctttatttctcttttcgaa

SEQ ID NO: 171395 - DNA, 20 bp, Artificial Sequence
  Synthetic oligonucleotide; AGG chr2 60552921 60552940 60552924 -
ctttatttctcttttcgaaa

SEQ ID NO: 171396 - DNA, 20 bp, Artificial Sequence
  Synthetic oligonucleotide; CAG chr2 60552886 60552905 60552889 -
ccactccccccccgccccgc

SEQ ID NO: 171397 - DNA, 20 bp, Artificial Sequence
  Synthetic oligonucleotide; AAG chr2 60552859 60552878 60552862 -
gcaaaataatgaacaatgct

SEQ ID NO: 171398 - DNA, 20 bp, Artificial Sequence
  Synthetic oligonucleotide; AGG chr2 60552858 60552877 60552861 -
caaaataatgaacaatgcta

SEQ ID NO: 171399 - DNA, 20 bp, Artificial Sequence
  Synthetic oligonucleotide; TGG chr2 60552831 60552850 60552834 -
gaacaactcacatgcaaacc

SEQ ID NO: 171400 - DNA, 20 bp, Artificial Sequence
  Synthetic oligonucleotide; GGG chr2 60552830 60552849 60552833 -
aacaactcacatgcaaacct

SEQ ID NO: 171401 - DNA, 20 bp, Artificial Sequence
  Synthetic oligonucleotide; GGG chr2 60552829 60552848 60552832 -
acaactcacatgcaaacctg

SEQ ID NO: 171402 - DNA, 20 bp, Artificial Sequence
  Synthetic oligonucleotide; GGG chr2 60552828 60552847 60552831 -
caactcacatgcaaacctgg

SEQ ID NO: 171403 - DNA, 20 bp, Artificial Sequence
  Synthetic oligonucleotide; TGG chr2 60552825 60552844 60552828 -
ctcacatgcaaacctggggg

SEQ ID NO: 171404 - DNA, 20 bp, Artificial Sequence
  Synthetic oligonucleotide; GGG chr2 60552824 60552843 60552827 -
tcacatgcaaacctgggggt

SEQ ID NO: 171405 - DNA, 20 bp, Artificial Sequence
  Synthetic oligonucleotide; GAG chr2 60552822 60552841 60552825 -
acatgcaaacctgggggtgg

SEQ ID NO: 171406 - DNA, 20 bp, Artificial Sequence
  Synthetic oligonucleotide; TGG chr2 60552818 60552837 60552821 -
gcaaacctgggggtgggagc

SEQ ID NO: 171407 - DNA, 20 bp, Artificial Sequence
  Synthetic oligonucleotide; TGG chr2 60552815 60552834 60552818 -
aacctgggggtgggagctgg

SEQ ID NO: 171408 - DNA, 20 bp, Artificial Sequence
  Synthetic oligonucleotide; GGG chr2 60552814 60552833 60552817 -
acctgggggtgggagctggt

SEQ ID NO: 171409 - DNA, 20 bp, Artificial Sequence
  Synthetic oligonucleotide; GGG chr2 60552813 60552832 60552816 -
cctgggggtgggagctggtg

SEQ ID NO: 171410 - DNA, 20 bp, Artificial Sequence
  Synthetic oligonucleotide; AAG chr2 60552809 60552828 60552812 -
ggggtgggagctggtgggga

SEQ ID NO: 171411 - DNA, 20 bp, Artificial Sequence
  Synthetic oligonucleotide; AGG chr2 60552808 60552827 60552811 -
gggtgggagctggtggggaa

SEQ ID NO: 171412 - DNA, 20 bp, Artificial Sequence
  Synthetic oligonucleotide; GGG chr2 60552807 60552826 60552810 -
ggtgggagctggtggggaaa

SEQ ID NO: 171413 - DNA, 20 bp, Artificial Sequence
  Synthetic oligonucleotide; GAG chr2 60552805 60552824 60552808 -
tgggagctggtggggaaagg

SEQ ID NO: 171414 - DNA, 20 bp, Artificial Sequence
  Synthetic oligonucleotide; AGG chr2 60552804 60552823 60552807 -
gggagctggtggggaaaggg

SEQ ID NO: 171415 - DNA, 20 bp, Artificial Sequence
  Synthetic oligonucleotide; AAG chr2 60552783 60552802 60552786 -
ggttgcttcccactcaccgt

SEQ ID NO: 171416 - DNA, 20 bp, Artificial Sequence
  Synthetic oligonucleotide; TGG chr2 60552776 60552795 60552779 -
tcccactcaccgtaagaaaa

SEQ ID NO: 171417 - DNA, 20 bp, Artificial Sequence
  Synthetic oligonucleotide; GGG chr2 60552775 60552794 60552778 -
cccactcaccgtaagaaaat

SEQ ID NO: 171418 - DNA, 20 bp, Artificial Sequence
  Synthetic oligonucleotide; GGG chr2 60552774 60552793 60552777 -
ccactcaccgtaagaaaatg

SEQ ID NO: 171419 - DNA, 20 bp, Artificial Sequence
  Synthetic oligonucleotide; GGG chr2 60552773 60552792 60552776 -
cactcaccgtaagaaaatgg

SEQ ID NO: 171420 - DNA, 20 bp, Artificial Sequence
  Synthetic oligonucleotide; GGG chr2 60552772 60552791 60552775 -
actcaccgtaagaaaatggg

SEQ ID NO: 171421 - DNA, 20 bp, Artificial Sequence
  Synthetic oligonucleotide; GGG chr2 60552771 60552790 60552774 -
ctcaccgtaagaaaatgggg

SEQ ID NO: 171422 - DNA, 20 bp, Artificial Sequence
  Synthetic oligonucleotide; TAG chr2 60552768 60552787 60552771 -
accgtaagaaaatggggggg

SEQ ID NO: 171423 - DNA, 20 bp, Artificial Sequence
  Synthetic oligonucleotide; AGG chr2 60552767 60552786 60552770 -
ccgtaagaaaatgggggggt

SEQ ID NO: 171424 - DNA, 20 bp, Artificial Sequence
  Synthetic oligonucleotide; GGG chr2 60552766 60552785 60552769 -
cgtaagaaaatgggggggta

SEQ ID NO: 171425 - DNA, 20 bp, Artificial Sequence
  Synthetic oligonucleotide; GAG chr2 60552764 60552783 60552767 -
taagaaaatgggggggtagg

SEQ ID NO: 171426 - DNA, 20 bp, Artificial Sequence
  Synthetic oligonucleotide; AGG chr2 60552763 60552782 60552766 -
aagaaaatgggggggtaggg

SEQ ID NO: 171427 - DNA, 20 bp, Artificial Sequence
  Synthetic oligonucleotide; GGG chr2 60552762 60552781 60552765 -
agaaaatgggggggtaggga

SEQ ID NO: 171428 - DNA, 20 bp, Artificial Sequence
  Synthetic oligonucleotide; GAG chr2 60552760 60552779 60552763 -
aaaatgggggggtagggagg

SEQ ID NO: 171429 - DNA, 20 bp, Artificial Sequence
  Synthetic oligonucleotide; GAG chr2 60552756 60552775 60552759 -
tgggggggtagggagggagt

SEQ ID NO: 171430 - DNA, 20 bp, Artificial Sequence
  Synthetic oligonucleotide; AAG chr2 60552750 60552769 60552753 -
ggtagggagggagtgagtac

SEQ ID NO: 171431 - DNA, 20 bp, Artificial Sequence
  Synthetic oligonucleotide; CGG chr2 60552731 60552750 60552734 -
caagtctaaaaaacgattcc

SEQ ID NO: 171432 - DNA, 20 bp, Artificial Sequence
  Synthetic oligonucleotide; GGG chr2 60552730 60552749 60552733 -
aagtctaaaaaacgattccc

SEQ ID NO: 171433 - DNA, 20 bp, Artificial Sequence
  Synthetic oligonucleotide; GGG chr2 60552729 60552748 60552732 -
agtctaaaaaacgattcccg

SEQ ID NO: 171434 - DNA, 20 bp, Artificial Sequence
  Synthetic oligonucleotide; GAG chr2 60552727 60552746 60552730 -
tctaaaaaacgattcccggg

SEQ ID NO: 171435 - DNA, 20 bp, Artificial Sequence
  Synthetic oligonucleotide; AAG chr2 60552722 60552741 60552725 -
aaaacgattcccggggagaa

SEQ ID NO: 171436 - DNA, 20 bp, Artificial Sequence
  Synthetic oligonucleotide; GAG chr2 60552720 60552739 60552723 -
aacgattcccggggagaaaa

SEQ ID NO: 171437 - DNA, 20 bp, Artificial Sequence
  Synthetic oligonucleotide; AGG chr2 60552719 60552738 60552722 -
acgattcccggggagaaaag

SEQ ID NO: 171438 - DNA, 20 bp, Artificial Sequence
  Synthetic oligonucleotide; GAG chr2 60552715 60552734 60552718 -
ttcccggggagaaaagaggt

SEQ ID NO: 171439 - DNA, 20 bp, Artificial Sequence
  Synthetic oligonucleotide; TGG chr2 60552710 60552729 60552713 -
ggggagaaaagaggtgagac

SEQ ID NO: 171440 - DNA, 20 bp, Artificial Sequence
  Synthetic oligonucleotide; TGG chr2 60552703 60552722 60552706 -
aaagaggtgagactggcttt

SEQ ID NO: 171441 - DNA, 20 bp, Artificial Sequence
  Synthetic oligonucleotide; CAG chr2 60552696 60552715 60552699 -
tgagactggcttttggacac

SEQ ID NO: 171442 - DNA, 20 bp, Artificial Sequence
  Synthetic oligonucleotide; CGG chr2 60552685 60552704 60552688 -
tttggacaccagcgcgctca

SEQ ID NO: 171443 - DNA, 20 bp, Artificial Sequence
  Synthetic oligonucleotide; AAG chr2 60552680 60552699 60552683 -
acaccagcgcgctcacggtc

SEQ ID NO: 171444 - DNA, 20 bp, Artificial Sequence
  Synthetic oligonucleotide; CAG chr2 60552673 60552692 60552676 -
cgcgctcacggtcaagtgtg

SEQ ID NO: 171445 - DNA, 20 bp, Artificial Sequence
  Synthetic oligonucleotide; CGG chr2 60552670 60552689 60552673 -
gctcacggtcaagtgtgcag

SEQ ID NO: 171446 - DNA, 20 bp, Artificial Sequence
  Synthetic oligonucleotide; GGG chr2 60552669 60552688 60552672 -
ctcacggtcaagtgtgcagc

SEQ ID NO: 171447 - DNA, 20 bp, Artificial Sequence
  Synthetic oligonucleotide; GAG chr2 60552667 60552686 60552670 -
cacggtcaagtgtgcagcgg

SEQ ID NO: 171448 - DNA, 20 bp, Artificial Sequence
  Synthetic oligonucleotide; AGG chr2 60552666 60552685 60552669 -
acggtcaagtgtgcagcggg

SEQ ID NO: 171449 - DNA, 20 bp, Artificial Sequence
  Synthetic oligonucleotide; AAG chr2 60552662 60552681 60552665 -
tcaagtgtgcagcgggagga

SEQ ID NO: 171450 - DNA, 20 bp, Artificial Sequence
  Synthetic oligonucleotide; TAG chr2 60552659 60552678 60552662 -
agtgtgcagcgggaggaaag

SEQ ID NO: 171451 - DNA, 20 bp, Artificial Sequence
  Synthetic oligonucleotide; TAG chr2 60552644 60552663 60552647 -
gaaagtagtcatccccacaa

SEQ ID NO: 171452 - DNA, 20 bp, Artificial Sequence
  Synthetic oligonucleotide; GAG chr2 60552640 60552659 60552643 -
gtagtcatccccacaatagt

SEQ ID NO: 171453 - DNA, 20 bp, Artificial Sequence
  Synthetic oligonucleotide; AAG chr2 60552636 60552655 60552639 -
tcatccccacaatagtgaga

SEQ ID NO: 171454 - DNA, 20 bp, Artificial Sequence
  Synthetic oligonucleotide; TGG chr2 60552633 60552652 60552636 -
tccccacaatagtgagaaag

SEQ ID NO: 171455 - DNA, 20 bp, Artificial Sequence
  Synthetic oligonucleotide; TGG chr2 60552625 60552644 60552628 -
atagtgagaaagtggcactg

SEQ ID NO: 171456 - DNA, 20 bp, Artificial Sequence
  Synthetic oligonucleotide; AAG chr2 60552621 60552640 60552624 -
tgagaaagtggcactgtgga

SEQ ID NO: 171457 - DNA, 20 bp, Artificial Sequence
  Synthetic oligonucleotide; AGG chr2 60552620 60552639 60552623 -
gagaaagtggcactgtggaa

SEQ ID NO: 171458 - DNA, 20 bp, Artificial Sequence
  Synthetic oligonucleotide; GGG chr2 60552619 60552638 60552622 -
agaaagtggcactgtggaaa

SEQ ID NO: 171459 - DNA, 20 bp, Artificial Sequence
  Synthetic oligonucleotide; GGG chr2 60552618 60552637 60552621 -
gaaagtggcactgtggaaag

SEQ ID NO: 171460 - DNA, 20 bp, Artificial Sequence
  Synthetic oligonucleotide; CGG chr2 60552611 60552630 60552614 -
gcactgtggaaaggggcccc

SEQ ID NO: 171461 - DNA, 20 bp, Artificial Sequence
  Synthetic oligonucleotide; GAG chr2 60552601 60552620 60552604 -
aaggggcccccggcgctcct

SEQ ID NO: 171462 - DNA, 20 bp, Artificial Sequence
  Synthetic oligonucleotide; CGG chr2 60552594 60552613 60552597 -
ccccggcgctcctgagtccg

SEQ ID NO: 171463 - DNA, 20 bp, Artificial Sequence
  Synthetic oligonucleotide; GAG chr2 60552592 60552611 60552595 -
ccggcgctcctgagtccgcg

SEQ ID NO: 171464 - DNA, 20 bp, Artificial Sequence
  Synthetic oligonucleotide; CGG chr2 60552588 60552607 60552591 -
cgctcctgagtccgcggagt

SEQ ID NO: 171465 - DNA, 20 bp, Artificial Sequence
  Synthetic oligonucleotide; GGG chr2 60552587 60552606 60552590 -
gctcctgagtccgcggagtc

SEQ ID NO: 171466 - DNA, 20 bp, Artificial Sequence
  Synthetic oligonucleotide; GAG chr2 60552585 60552604 60552588 -
tcctgagtccgcggagtcgg

SEQ ID NO: 171467 - DNA, 20 bp, Artificial Sequence
  Synthetic oligonucleotide; GAG chr2 60552583 60552602 60552586 -
ctgagtccgcggagtcggga

SEQ ID NO: 171468 - DNA, 20 bp, Artificial Sequence
  Synthetic oligonucleotide; AGG chr2 60552582 60552601 60552585 -
tgagtccgcggagtcgggag

SEQ ID NO: 171469 - DNA, 20 bp, Artificial Sequence
  Synthetic oligonucleotide; GGG chr2 60552581 60552600 60552584 -
gagtccgcggagtcgggaga

SEQ ID NO: 171470 - DNA, 20 bp, Artificial Sequence
  Synthetic oligonucleotide; GGG chr2 60552580 60552599 60552583 -
agtccgcggagtcgggagag

SEQ ID NO: 171471 - DNA, 20 bp, Artificial Sequence
  Synthetic oligonucleotide; CGG chr2 60552574 60552593 60552577 -
cggagtcgggagaggggccg

SEQ ID NO: 171472 - DNA, 20 bp, Artificial Sequence
  Synthetic oligonucleotide; CGG chr2 60552568 60552587 60552571 -
cgggagaggggccgcggcga

SEQ ID NO: 171473 - DNA, 20 bp, Artificial Sequence
  Synthetic oligonucleotide; GGG chr2 60552567 60552586 60552570 -
gggagaggggccgcggcgac

SEQ ID NO: 171474 - DNA, 20 bp, Artificial Sequence
  Synthetic oligonucleotide; GGG chr2 60552566 60552585 60552569 -
ggagaggggccgcggcgacg

SEQ ID NO: 171475 - DNA, 20 bp, Artificial Sequence
  Synthetic oligonucleotide; GAG chr2 60552564 60552583 60552567 -
agaggggccgcggcgacggg

SEQ ID NO: 171476 - DNA, 20 bp, Artificial Sequence
  Synthetic oligonucleotide; GAG chr2 60552562 60552581 60552565 -
aggggccgcggcgacgggga

SEQ ID NO: 171477 - DNA, 20 bp, Artificial Sequence
  Synthetic oligonucleotide; TGG chr2 60552556 60552575 60552559 -
cgcggcgacggggagagccg

SEQ ID NO: 171478 - DNA, 20 bp, Artificial Sequence
  Synthetic oligonucleotide; GGG chr2 60552555 60552574 60552558 -
gcggcgacggggagagccgt

SEQ ID NO: 171479 - DNA, 20 bp, Artificial Sequence
  Synthetic oligonucleotide; CGG chr2 60552550 60552569 60552553 -
gacggggagagccgtgggac

SEQ ID NO: 171480 - DNA, 20 bp, Artificial Sequence
  Synthetic oligonucleotide; GGG chr2 60552549 60552568 60552552 -
acggggagagccgtgggacc

SEQ ID NO: 171481 - DNA, 20 bp, Artificial Sequence
  Synthetic oligonucleotide; AAG chr2 60552546 60552565 60552549 -
gggagagccgtgggaccggg

SEQ ID NO: 171482 - DNA, 20 bp, Artificial Sequence
  Synthetic oligonucleotide; AGG chr2 60552545 60552564 60552548 -
ggagagccgtgggaccggga

SEQ ID NO: 171483 - DNA, 20 bp, Artificial Sequence
  Synthetic oligonucleotide; CGG chr2 60552541 60552560 60552544 -
agccgtgggaccgggaagga

SEQ ID NO: 171484 - DNA, 20 bp, Artificial Sequence
  Synthetic oligonucleotide; GGG chr2 60552540 60552559 60552543 -
gccgtgggaccgggaaggac

SEQ ID NO: 171485 - DNA, 20 bp, Artificial Sequence
  Synthetic oligonucleotide; GAG chr2 60552538 60552557 60552541 -
cgtgggaccgggaaggacgg

SEQ ID NO: 171486 - DNA, 20 bp, Artificial Sequence
  Synthetic oligonucleotide; CGG chr2 60552532 60552551 60552535 -
accgggaaggacgggagacg

SEQ ID NO: 171487 - DNA, 20 bp, Artificial Sequence
  Synthetic oligonucleotide; CGG chr2 60552528 60552547 60552531 -
ggaaggacgggagacgcggc

SEQ ID NO: 171488 - DNA, 20 bp, Artificial Sequence
  Synthetic oligonucleotide; CGG chr2 60552507 60552526 60552510 -
ggcactgccgccttttgttc

SEQ ID NO: 171489 - DNA, 20 bp, Artificial Sequence
  Synthetic oligonucleotide; CAG chr2 60552503 60552522 60552506 -
ctgccgccttttgttccggc

SEQ ID NO: 171490 - DNA, 20 bp, Artificial Sequence
  Synthetic oligonucleotide; GAG chr2 60552501 60552520 60552504 -
gccgccttttgttccggcca

SEQ ID NO: 171491 - DNA, 20 bp, Artificial Sequence
  Synthetic oligonucleotide; AGG chr2 60552500 60552519 60552503 -
ccgccttttgttccggccag

SEQ ID NO: 171492 - DNA, 20 bp, Artificial Sequence
  Synthetic oligonucleotide; TGG chr2 60552497 60552516 60552500 -
ccttttgttccggccagagg

SEQ ID NO: 171493 - DNA, 20 bp, Artificial Sequence
  Synthetic oligonucleotide; GGG chr2 60552496 60552515 60552499 -
cttttgttccggccagaggt

SEQ ID NO: 171494 - DNA, 20 bp, Artificial Sequence
  Synthetic oligonucleotide; CGG chr2 60552469 60552488 60552472 -
tgtcccgctgccttttgtgc

SEQ ID NO: 171495 - DNA, 20 bp, Artificial Sequence
  Synthetic oligonucleotide; AAG chr2 60552422 60552441 60552425 -
cgccgccgccgccgccgccg

SEQ ID NO: 171496 - DNA, 20 bp, Artificial Sequence
  Synthetic oligonucleotide; AGG chr2 60552421 60552440 60552424 -
gccgccgccgccgccgccga

SEQ ID NO: 171497 - DNA, 20 bp, Artificial Sequence
  Synthetic oligonucleotide; GGG chr2 60552420 60552439 60552423 -
ccgccgccgccgccgccgaa

SEQ ID NO: 171498 - DNA, 20 bp, Artificial Sequence
  Synthetic oligonucleotide; CAG chr2 60552417 60552436 60552420 -
ccgccgccgccgccgaaggg

SEQ ID NO: 171499 - DNA, 20 bp, Artificial Sequence
  Synthetic oligonucleotide; AGG chr2 60552416 60552435 60552419 -
cgccgccgccgccgaagggc

SEQ ID NO: 171500 - DNA, 20 bp, Artificial Sequence
  Synthetic oligonucleotide; GAG chr2 60552414 60552433 60552417 -
ccgccgccgccgaagggcag

SEQ ID NO: 171501 - DNA, 20 bp, Artificial Sequence
  Synthetic oligonucleotide; TAG chr2 60552410 60552429 60552413 -
cgccgccgaagggcaggagc

SEQ ID NO: 171502 - DNA, 20 bp, Artificial Sequence
  Synthetic oligonucleotide; AGG chr2 60552409 60552428 60552412 -
gccgccgaagggcaggagct

SEQ ID NO: 171503 - DNA, 20 bp, Artificial Sequence
  Synthetic oligonucleotide; GGG chr2 60552408 60552427 60552411 -
ccgccgaagggcaggagcta

SEQ ID NO: 171504 - DNA, 20 bp, Artificial Sequence
  Synthetic oligonucleotide; CGG chr2 60552404 60552423 60552407 -
cgaagggcaggagctagggc

SEQ ID NO: 171505 - DNA, 20 bp, Artificial Sequence
  Synthetic oligonucleotide; GGG chr2 60552403 60552422 60552406 -
gaagggcaggagctagggcc

SEQ ID NO: 171506 - DNA, 20 bp, Artificial Sequence
  Synthetic oligonucleotide; GGG chr2 60552402 60552421 60552405 -
aagggcaggagctagggccg

SEQ ID NO: 171507 - DNA, 20 bp, Artificial Sequence
  Synthetic oligonucleotide; GGG chr2 60552401 60552420 60552404 -
agggcaggagctagggccgg

SEQ ID NO: 171508 - DNA, 20 bp, Artificial Sequence
  Synthetic oligonucleotide; GAG chr2 60552399 60552418 60552402 -
ggcaggagctagggccgggg

SEQ ID NO: 171509 - DNA, 20 bp, Artificial Sequence
  Synthetic oligonucleotide; AGG chr2 60552398 60552417 60552401 -
gcaggagctagggccggggg

SEQ ID NO: 171510 - DNA, 20 bp, Artificial Sequence
  Synthetic oligonucleotide; GAG chr2 60552396 60552415 60552399 -
aggagctagggccgggggag

SEQ ID NO: 171511 - DNA, 20 bp, Artificial Sequence
  Synthetic oligonucleotide; AGG chr2 60552395 60552414 60552398 -
ggagctagggccgggggagg

SEQ ID NO: 171512 - DNA, 20 bp, Artificial Sequence
  Synthetic oligonucleotide; CGG chr2 60552392 60552411 60552395 -
gctagggccgggggaggagg

SEQ ID NO: 171513 - DNA, 20 bp, Artificial Sequence
  Synthetic oligonucleotide; CGG chr2 60552388 60552407 60552391 -
gggccgggggaggaggcggc

SEQ ID NO: 171514 - DNA, 20 bp, Artificial Sequence
  Synthetic oligonucleotide; GGG chr2 60552387 60552406 60552390 -
ggccgggggaggaggcggcc

SEQ ID NO: 171515 - DNA, 20 bp, Artificial Sequence
  Synthetic oligonucleotide; GGG chr2 60552386 60552405 60552389 -
gccgggggaggaggcggccg

SEQ ID NO: 171516 - DNA, 20 bp, Artificial Sequence
  Synthetic oligonucleotide; GGG chr2 60552385 60552404 60552388 -
ccgggggaggaggcggccgg

SEQ ID NO: 171517 - DNA, 20 bp, Artificial Sequence
  Synthetic oligonucleotide; CGG chr2 60552378 60552397 60552381 -
aggaggcggccgggggcacg

SEQ ID NO: 171518 - DNA, 20 bp, Artificial Sequence
  Synthetic oligonucleotide; GGG chr2 60552377 60552396 60552380 -
ggaggcggccgggggcacgc

SEQ ID NO: 171519 - DNA, 20 bp, Artificial Sequence
  Synthetic oligonucleotide; GAG chr2 60552375 60552394 60552378 -
aggcggccgggggcacgcgg

SEQ ID NO: 171520 - DNA, 20 bp, Artificial Sequence
  Synthetic oligonucleotide; GAG chr2 60552373 60552392 60552376 -
gcggccgggggcacgcggga

SEQ ID NO: 171521 - DNA, 20 bp, Artificial Sequence
  Synthetic oligonucleotide; AGG chr2 60552372 60552391 60552375 -
cggccgggggcacgcgggag

SEQ ID NO: 171522 - DNA, 20 bp, Artificial Sequence
  Synthetic oligonucleotide; GGG chr2 60552371 60552390 60552374 -
ggccgggggcacgcgggaga

SEQ ID NO: 171523 - DNA, 20 bp, Artificial Sequence
  Synthetic oligonucleotide; GAG chr2 60552369 60552388 60552372 -
ccgggggcacgcgggagagg

SEQ ID NO: 171524 - DNA, 20 bp, Artificial Sequence
  Synthetic oligonucleotide; AGG chr2 60552368 60552387 60552371 -
cgggggcacgcgggagaggg

SEQ ID NO: 171525 - DNA, 20 bp, Artificial Sequence
  Synthetic oligonucleotide; GGG chr2 60552367 60552386 60552370 -
gggggcacgcgggagaggga

SEQ ID NO: 171526 - DNA, 20 bp, Artificial Sequence
  Synthetic oligonucleotide; GAG chr2 60552365 60552384 60552368 -
gggcacgcgggagagggagg

SEQ ID NO: 171527 - DNA, 20 bp, Artificial Sequence
  Synthetic oligonucleotide; AGG chr2 60552364 60552383 60552367 -
ggcacgcgggagagggaggg

SEQ ID NO: 171528 - DNA, 20 bp, Artificial Sequence
  Synthetic oligonucleotide; GGG chr2 60552363 60552382 60552366 -
gcacgcgggagagggaggga

SEQ ID NO: 171529 - DNA, 20 bp, Artificial Sequence
  Synthetic oligonucleotide; GAG chr2 60552361 60552380 60552364 -
acgcgggagagggagggagg

SEQ ID NO: 171530 - DNA, 20 bp, Artificial Sequence
  Synthetic oligonucleotide; CGG chr2 60552356 60552375 60552359 -
ggagagggagggagggagcc

SEQ ID NO: 171531 - DNA, 20 bp, Artificial Sequence
  Synthetic oligonucleotide; TGG chr2 60552341 60552360 60552344 -
gagcccggactgctgcctcc

SEQ ID NO: 171532 - DNA, 20 bp, Artificial Sequence
  Synthetic oligonucleotide; GGG chr2 60552340 60552359 60552343 -
agcccggactgctgcctcct

SEQ ID NO: 171533 - DNA, 20 bp, Artificial Sequence
  Synthetic oligonucleotide; CAG chr2 60552306 60552325 60552309 -
ctcccctcccgaccgaacct

SEQ ID NO: 171534 - DNA, 20 bp, Artificial Sequence
  Synthetic oligonucleotide; GAG chr2 60552304 60552323 60552307 -
cccctcccgaccgaacctca

SEQ ID NO: 171535 - DNA, 20 bp, Artificial Sequence
  Synthetic oligonucleotide; AGG chr2 60552303 60552322 60552306 -
ccctcccgaccgaacctcag

SEQ ID NO: 171536 - DNA, 20 bp, Artificial Sequence
  Synthetic oligonucleotide; CAG chr2 60552300 60552319 60552303 -
tcccgaccgaacctcagagg

SEQ ID NO: 171537 - DNA, 20 bp, Artificial Sequence
  Synthetic oligonucleotide; AAG chr2 60552296 60552315 60552299 -
gaccgaacctcagaggcagc

SEQ ID NO: 171538 - DNA, 20 bp, Artificial Sequence
  Synthetic oligonucleotide; AGG chr2 60552295 60552314 60552298 -
accgaacctcagaggcagca

SEQ ID NO: 171539 - DNA, 20 bp, Artificial Sequence
  Synthetic oligonucleotide; GAG chr2 60552293 60552312 60552296 -
cgaacctcagaggcagcaag

SEQ ID NO: 171540 - DNA, 20 bp, Artificial Sequence
  Synthetic oligonucleotide; AAG chr2 60552290 60552309 60552293 -
acctcagaggcagcaaggag

SEQ ID NO: 171541 - DNA, 20 bp, Artificial Sequence
  Synthetic oligonucleotide; TGG chr2 60552285 60552304 60552288 -
agaggcagcaaggagaagac

SEQ ID NO: 171542 - DNA, 20 bp, Artificial Sequence
  Synthetic oligonucleotide; AAG chr2 60552241 60552260 60552244 -
aaaaataaaataaataaaac

SEQ ID NO: 171543 - DNA, 20 bp, Artificial Sequence
  Synthetic oligonucleotide; AGG chr2 60552240 60552259 60552243 -
aaaataaaataaataaaaca

SEQ ID NO: 171544 - DNA, 20 bp, Artificial Sequence
  Synthetic oligonucleotide; AAG chr2 60552236 60552255 60552239 -
taaaataaataaaacaaggc

SEQ ID NO: 171545 - DNA, 20 bp, Artificial Sequence
  Synthetic oligonucleotide; GAG chr2 60552234 60552253 60552237 -
aaataaataaaacaaggcaa

SEQ ID NO: 171546 - DNA, 20 bp, Artificial Sequence
  Synthetic oligonucleotide; AAG chr2 60552204 60552223 60552207 -
aatttcttgcccccaaaccg

SEQ ID NO: 171547 - DNA, 20 bp, Artificial Sequence
  Synthetic oligonucleotide; CGG chr2 60552172 60552191 60552175 -
ctgccaacccttttctgtga

SEQ ID NO: 171548 - DNA, 20 bp, Artificial Sequence
  Synthetic oligonucleotide; CAG chr2 60552148 60552167 60552151 -
cttctctttgactcccccac

SEQ ID NO: 171549 - DNA, 20 bp, Artificial Sequence
  Synthetic oligonucleotide; TAG chr2 60552114 60552133 60552117 -
aaatctcacaatctctcatc

SEQ ID NO: 171550 - DNA, 20 bp, Artificial Sequence
  Synthetic oligonucleotide; CAG chr2 60552073 60552092 60552076 -
cctcttcccccaaacccctt

SEQ ID NO: 171551 - DNA, 20 bp, Artificial Sequence
  Synthetic oligonucleotide; TAG chr2 60552061 60552080 60552064 -
aaccccttcagttgcaaact

SEQ ID NO: 171552 - DNA, 20 bp, Artificial Sequence
  Synthetic oligonucleotide; AGG chr2 60552060 60552079 60552063 -
accccttcagttgcaaactt

SEQ ID NO: 171553 - DNA, 20 bp, Artificial Sequence
  Synthetic oligonucleotide; GGG chr2 60552059 60552078 60552062 -
ccccttcagttgcaaactta

SEQ ID NO: 171554 - DNA, 20 bp, Artificial Sequence
  Synthetic oligonucleotide; CGG chr2 60552050 60552069 60552053 -
ttgcaaacttagggcgccga

SEQ ID NO: 171555 - DNA, 20 bp, Artificial Sequence
  Synthetic oligonucleotide; CGG chr2 60552045 60552064 60552048 -
aacttagggcgccgacggca

SEQ ID NO: 171556 - DNA, 20 bp, Artificial Sequence
  Synthetic oligonucleotide; GAG chr2 60552043 60552062 60552046 -
cttagggcgccgacggcacg

SEQ ID NO: 171557 - DNA, 20 bp, Artificial Sequence
  Synthetic oligonucleotide; GAG chr2 60552041 60552060 60552044 -
tagggcgccgacggcacgga

SEQ ID NO: 171558 - DNA, 20 bp, Artificial Sequence
  Synthetic oligonucleotide; AGG chr2 60552040 60552059 60552043 -
agggcgccgacggcacggag

SEQ ID NO: 171559 - DNA, 20 bp, Artificial Sequence
  Synthetic oligonucleotide; GGG chr2 60552039 60552058 60552042 -
gggcgccgacggcacggaga

SEQ ID NO: 171560 - DNA, 20 bp, Artificial Sequence
  Synthetic oligonucleotide; GAG chr2 60552037 60552056 60552040 -
gcgccgacggcacggagagg

SEQ ID NO: 171561 - DNA, 20 bp, Artificial Sequence
  Synthetic oligonucleotide; GAG chr2 60552035 60552054 60552038 -
gccgacggcacggagaggga

SEQ ID NO: 171562 - DNA, 20 bp, Artificial Sequence
  Synthetic oligonucleotide; GAG chr2 60552033 60552052 60552036 -
cgacggcacggagagggaga

SEQ ID NO: 171563 - DNA, 20 bp, Artificial Sequence
  Synthetic oligonucleotide; AGG chr2 60552032 60552051 60552035 -
gacggcacggagagggagag

SEQ ID NO: 171564 - DNA, 20 bp, Artificial Sequence
  Synthetic oligonucleotide; TGG chr2 60552006 60552025 60552009 -
tccctcctcttactattttt

SEQ ID NO: 171565 - DNA, 20 bp, Artificial Sequence
  Synthetic oligonucleotide; AAG chr2 60552003 60552022 60552006 -
ctcctcttactattttttgg

SEQ ID NO: 171566 - DNA, 20 bp, Artificial Sequence
  Synthetic oligonucleotide; AAG chr2 60551989 60552008 60551992 -
ttttggaagattttcaaaaa

SEQ ID NO: 171567 - DNA, 20 bp, Artificial Sequence
  Synthetic oligonucleotide; TGG chr2 60551986 60552005 60551989 -
tggaagattttcaaaaaaag

SEQ ID NO: 171568 - DNA, 20 bp, Artificial Sequence
  Synthetic oligonucleotide; AAG chr2 60551983 60552002 60551986 -
aagattttcaaaaaaagtgg

SEQ ID NO: 171569 - DNA, 20 bp, Artificial Sequence
  Synthetic oligonucleotide; TGG chr2 60551980 60551999 60551983 -
attttcaaaaaaagtggaag

SEQ ID NO: 171570 - DNA, 20 bp, Artificial Sequence
  Synthetic oligonucleotide; TGG chr2 60551969 60551988 60551972 -
aagtggaagtggattttgat

SEQ ID NO: 171571 - DNA, 20 bp, Artificial Sequence
  Synthetic oligonucleotide; GGG chr2 60551968 60551987 60551971 -
agtggaagtggattttgatt

SEQ ID NO: 171572 - DNA, 20 bp, Artificial Sequence
  Synthetic oligonucleotide; AAG chr2 60551940 60551959 60551943 -
tctcgtgtctgaatgtttac

SEQ ID NO: 171573 - DNA, 20 bp, Artificial Sequence
  Synthetic oligonucleotide; CGG chr2 60551926 60551945 60551929 -
gtttacaagcaccgcgtgtg

SEQ ID NO: 171574 - DNA, 20 bp, Artificial Sequence
  Synthetic oligonucleotide; GGG chr2 60551925 60551944 60551928 -
tttacaagcaccgcgtgtgc

SEQ ID NO: 171575 - DNA, 20 bp, Artificial Sequence
  Synthetic oligonucleotide; GAG chr2 60551923 60551942 60551926 -
tacaagcaccgcgtgtgcgg

SEQ ID NO: 171576 - DNA, 20 bp, Artificial Sequence
  Synthetic oligonucleotide; CAG chr2 60551905 60551924 60551908 -
gggagcctcctgccaacaaa

SEQ ID NO: 171577 - DNA, 20 bp, Artificial Sequence
  Synthetic oligonucleotide; CAG chr2 60551901 60551920 60551904 -
gcctcctgccaacaaacaga

SEQ ID NO: 171578 - DNA, 20 bp, Artificial Sequence
  Synthetic oligonucleotide; GAG chr2 60551899 60551918 60551902 -
ctcctgccaacaaacagaca

SEQ ID NO: 171579 - DNA, 20 bp, Artificial Sequence
  Synthetic oligonucleotide; AGG chr2 60551898 60551917 60551901 -
tcctgccaacaaacagacag

SEQ ID NO: 171580 - DNA, 20 bp, Artificial Sequence
  Synthetic oligonucleotide; GAG chr2 60551892 60551911 60551895 -
caacaaacagacagaggacc

SEQ ID NO: 171581 - DNA, 20 bp, Artificial Sequence
  Synthetic oligonucleotide; CGG chr2 60551887 60551906 60551890 -
aacagacagaggaccgagcg

SEQ ID NO: 171582 - DNA, 20 bp, Artificial Sequence
  Synthetic oligonucleotide; CGG chr2 60551882 60551901 60551885 -
acagaggaccgagcgcggcg

SEQ ID NO: 171583 - DNA, 20 bp, Artificial Sequence
  Synthetic oligonucleotide; CAG chr2 60551879 60551898 60551882 -
gaggaccgagcgcggcgcgg

SEQ ID NO: 171584 - DNA, 20 bp, Artificial Sequence
  Synthetic oligonucleotide; CGG chr2 60551873 60551892 60551876 -
cgagcgcggcgcggcagccc

SEQ ID NO: 171585 - DNA, 20 bp, Artificial Sequence
  Synthetic oligonucleotide; GAG chr2 60551871 60551890 60551874 -
agcgcggcgcggcagccccg

SEQ ID NO: 171586 - DNA, 20 bp, Artificial Sequence
  Synthetic oligonucleotide; CAG chr2 60551868 60551887 60551871 -
gcggcgcggcagccccggag

SEQ ID NO: 171587 - DNA, 20 bp, Artificial Sequence
  Synthetic oligonucleotide; AGG chr2 60551867 60551886 60551870 -
cggcgcggcagccccggagc

SEQ ID NO: 171588 - DNA, 20 bp, Artificial Sequence
  Synthetic oligonucleotide; CGG chr2 60551864 60551883 60551867 -
cgcggcagccccggagcagg

SEQ ID NO: 171589 - DNA, 20 bp, Artificial Sequence
  Synthetic oligonucleotide; CGG chr2 60551861 60551880 60551864 -
ggcagccccggagcaggcgg

SEQ ID NO: 171590 - DNA, 20 bp, Artificial Sequence
  Synthetic oligonucleotide; CGG chr2 60551858 60551877 60551861 -
agccccggagcaggcggcgg

SEQ ID NO: 171591 - DNA, 20 bp, Artificial Sequence
  Synthetic oligonucleotide; CGG chr2 60551855 60551874 60551858 -
cccggagcaggcggcggcgg

SEQ ID NO: 171592 - DNA, 20 bp, Artificial Sequence
  Synthetic oligonucleotide; TGG chr2 60551850 60551869 60551853 -
agcaggcggcggcggcggcc

SEQ ID NO: 171593 - DNA, 20 bp, Artificial Sequence
  Synthetic oligonucleotide; CGG chr2 60551840 60551859 60551843 -
ggcggcggcctggcctcgcc

SEQ ID NO: 171594 - DNA, 20 bp, Artificial Sequence
  Synthetic oligonucleotide; GGG chr2 60551839 60551858 60551842 -
gcggcggcctggcctcgccc

SEQ ID NO: 171595 - DNA, 20 bp, Artificial Sequence
  Synthetic oligonucleotide; CAG chr2 60551813 60551832 60551816 -
tgcccgacctcgccgcgccc

SEQ ID NO: 171596 - DNA, 20 bp, Artificial Sequence
  Synthetic oligonucleotide; CAG chr2 60551808 60551827 60551811 -
gacctcgccgcgccccagcc

SEQ ID NO: 171597 - DNA, 20 bp, Artificial Sequence
  Synthetic oligonucleotide; CGG chr2 60551802 60551821 60551805 -
gccgcgccccagcccagccc

SEQ ID NO: 171598 - DNA, 20 bp, Artificial Sequence
  Synthetic oligonucleotide; CGG chr2 60551789 60551808 60551792 -
ccagccccggatcgcccacc

SEQ ID NO: 171599 - DNA, 20 bp, Artificial Sequence
  Synthetic oligonucleotide; CGG chr2 60551782 60551801 60551785 -
cggatcgcccacccggcgcc

SEQ ID NO: 171600 - DNA, 20 bp, Artificial Sequence
  Synthetic oligonucleotide; CAG chr2 60551768 60551787 60551771 -
ggcgcccggcgcccacccgc

SEQ ID NO: 171601 - DNA, 20 bp, Artificial Sequence
  Synthetic oligonucleotide; AGG chr2 60551767 60551786 60551770 -
gcgcccggcgcccacccgcc

SEQ ID NO: 171602 - DNA, 20 bp, Artificial Sequence
  Synthetic oligonucleotide; CGG chr2 60551762 60551781 60551765 -
cggcgcccacccgccaggca

SEQ ID NO: 171603 - DNA, 20 bp, Artificial Sequence
  Synthetic oligonucleotide; CGG chr2 60551759 60551778 60551762 -
cgcccacccgccaggcacgg

SEQ ID NO: 171604 - DNA, 20 bp, Artificial Sequence
  Synthetic oligonucleotide; CAG chr2 60551756 60551775 60551759 -
ccacccgccaggcacggcgg

SEQ ID NO: 171605 - DNA, 20 bp, Artificial Sequence
  Synthetic oligonucleotide; AGG chr2 60551755 60551774 60551758 -
cacccgccaggcacggcggc

SEQ ID NO: 171606 - DNA, 20 bp, Artificial Sequence
  Synthetic oligonucleotide; CAG chr2 60551747 60551766 60551750 -
aggcacggcggcaggccacg

SEQ ID NO: 171607 - DNA, 20 bp, Artificial Sequence
  Synthetic oligonucleotide; CAG chr2 60551733 60551752 60551736 -
gccacgcagtgtctccgcgc

SEQ ID NO: 171608 - DNA, 20 bp, Artificial Sequence
  Synthetic oligonucleotide; TGG chr2 60551728 60551747 60551731 -
gcagtgtctccgcgccagcc

SEQ ID NO: 171609 - DNA, 20 bp, Artificial Sequence
  Synthetic oligonucleotide; TGG chr2 60551721 60551740 60551724 -
ctccgcgccagcctggcccg

SEQ ID NO: 171610 - DNA, 20 bp, Artificial Sequence
  Synthetic oligonucleotide; TGG chr2 60551715 60551734 60551718 -
gccagcctggcccgtggtcc

SEQ ID NO: 171611 - DNA, 20 bp, Artificial Sequence
  Synthetic oligonucleotide; CAG chr2 60551704 60551723 60551707 -
ccgtggtcctggtccgcccc

SEQ ID NO: 171612 - DNA, 20 bp, Artificial Sequence
  Synthetic oligonucleotide; GAG chr2 60551692 60551711 60551695 -
tccgcccccagcacaatgcc

SEQ ID NO: 171613 - DNA, 20 bp, Artificial Sequence
  Synthetic oligonucleotide; CAG chr2 60551672 60551691 60551675 -
gagacctcttctcgacctcc

SEQ ID NO: 171614 - DNA, 20 bp, Artificial Sequence
  Synthetic oligonucleotide; CGG chr2 60551659 60551678 60551662 -
gacctcccagactgcgaaat

SEQ ID NO: 171615 - DNA, 20 bp, Artificial Sequence
  Synthetic oligonucleotide; TGG chr2 60551655 60551674 60551658 -
tcccagactgcgaaatcggc

SEQ ID NO: 171616 - DNA, 20 bp, Artificial Sequence
  Synthetic oligonucleotide; GGG chr2 60551654 60551673 60551657 -
cccagactgcgaaatcggct

SEQ ID NO: 171617 - DNA, 20 bp, Artificial Sequence
  Synthetic oligonucleotide; CGG chr2 60551644 60551663 60551647 -
gaaatcggctgggtgaaact

SEQ ID NO: 171618 - DNA, 20 bp, Artificial Sequence
  Synthetic oligonucleotide; AAG chr2 60551634 60551653 60551637 -
gggtgaaactcggctttgca

SEQ ID NO: 171619 - DNA, 20 bp, Artificial Sequence
  Synthetic oligonucleotide; CAG chr2 60551618 60551637 60551621 -
tgcaaagcatttttattttg

SEQ ID NO: 171620 - DNA, 20 bp, Artificial Sequence
  Synthetic oligonucleotide; AGG chr2 60551617 60551636 60551620 -
gcaaagcatttttattttgc

SEQ ID NO: 171621 - DNA, 20 bp, Artificial Sequence
  Synthetic oligonucleotide; GGG chr2 60551616 60551635 60551619 -
caaagcatttttattttgca

SEQ ID NO: 171622 - DNA, 20 bp, Artificial Sequence
  Synthetic oligonucleotide; AAG chr2 60551604 60551623 60551607 -
attttgcagggcaactgtaa

SEQ ID NO: 171623 - DNA, 20 bp, Artificial Sequence
  Synthetic oligonucleotide; TGG chr2 60551571 60551590 60551574 -
gcctcccctcccctccgccc

SEQ ID NO: 171624 - DNA, 20 bp, Artificial Sequence
  Synthetic oligonucleotide; GGG chr2 60551570 60551589 60551573 -
cctcccctcccctccgccct

SEQ ID NO: 171625 - DNA, 20 bp, Artificial Sequence
  Synthetic oligonucleotide; CAG chr2 60551559 60551578 60551562 -
ctccgccctgggtactttct

SEQ ID NO: 171626 - DNA, 20 bp, Artificial Sequence
  Synthetic oligonucleotide; CAG chr2 60551542 60551561 60551545 -
tctcagacgtctcttgtcca

SEQ ID NO: 171627 - DNA, 20 bp, Artificial Sequence
  Synthetic oligonucleotide; CGG chr2 60551537 60551556 60551540 -
gacgtctcttgtccacagct

SEQ ID NO: 171628 - DNA, 20 bp, Artificial Sequence
  Synthetic oligonucleotide; GGG chr2 60551536 60551555 60551539 -
acgtctcttgtccacagctc

SEQ ID NO: 171629 - DNA, 20 bp, Artificial Sequence
  Synthetic oligonucleotide; GAG chr2 60551528 60551547 60551531 -
tgtccacagctcgggaccgc

SEQ ID NO: 171630 - DNA, 20 bp, Artificial Sequence
  Synthetic oligonucleotide; AGG chr2 60551527 60551546 60551530 -
gtccacagctcgggaccgcg

SEQ ID NO: 171631 - DNA, 20 bp, Artificial Sequence
  Synthetic oligonucleotide; GAG chr2 60551525 60551544 60551528 -
ccacagctcgggaccgcgag

SEQ ID NO: 171632 - DNA, 20 bp, Artificial Sequence
  Synthetic oligonucleotide; AGG chr2 60551524 60551543 60551527 -
cacagctcgggaccgcgagg

SEQ ID NO: 171633 - DNA, 20 bp, Artificial Sequence
  Synthetic oligonucleotide; CGG chr2 60551484 60551503 60551487 -
tgcccaccccccaccccgcc

SEQ ID NO: 171634 - DNA, 20 bp, Artificial Sequence
  Synthetic oligonucleotide; TGG chr2 60551479 60551498 60551482 -
accccccaccccgcccggtc

SEQ ID NO: 171635 - DNA, 20 bp, Artificial Sequence
  Synthetic oligonucleotide; CAG chr2 60551472 60551491 60551475 -
accccgcccggtctggtcac

SEQ ID NO: 171636 - DNA, 20 bp, Artificial Sequence
  Synthetic oligonucleotide; GAG chr2 60551455 60551474 60551458 -
caccagtccccctgcgcccc

SEQ ID NO: 171637 - DNA, 20 bp, Artificial Sequence
  Synthetic oligonucleotide; TAG chr2 60551446 60551465 60551449 -
ccctgcgccccgagcacgac

SEQ ID NO: 171638 - DNA, 20 bp, Artificial Sequence
  Synthetic oligonucleotide; AGG chr2 60551445 60551464 60551448 -
cctgcgccccgagcacgact

SEQ ID NO: 171639 - DNA, 20 bp, Artificial Sequence
  Synthetic oligonucleotide; CAG chr2 60551441 60551460 60551444 -
cgccccgagcacgactaggc

SEQ ID NO: 171640 - DNA, 20 bp, Artificial Sequence
  Synthetic oligonucleotide; AGG chr2 60551440 60551459 60551443 -
gccccgagcacgactaggcc

SEQ ID NO: 171641 - DNA, 20 bp, Artificial Sequence
  Synthetic oligonucleotide; TGG chr2 60551437 60551456 60551440 -
ccgagcacgactaggccagg

SEQ ID NO: 171642 - DNA, 20 bp, Artificial Sequence
  Synthetic oligonucleotide; CGG chr2 60551434 60551453 60551437 -
agcacgactaggccaggtgg

SEQ ID NO: 171643 - DNA, 20 bp, Artificial Sequence
  Synthetic oligonucleotide; GGG chr2 60551433 60551452 60551436 -
gcacgactaggccaggtggc

SEQ ID NO: 171644 - DNA, 20 bp, Artificial Sequence
  Synthetic oligonucleotide; GGG chr2 60551432 60551451 60551435 -
cacgactaggccaggtggcg

SEQ ID NO: 171645 - DNA, 20 bp, Artificial Sequence
  Synthetic oligonucleotide; CGG chr2 60551425 60551444 60551428 -
aggccaggtggcggggttgc

SEQ ID NO: 171646 - DNA, 20 bp, Artificial Sequence
  Synthetic oligonucleotide; GGG chr2 60551424 60551443 60551427 -
ggccaggtggcggggttgcc

SEQ ID NO: 171647 - DNA, 20 bp, Artificial Sequence
  Synthetic oligonucleotide; GGG chr2 60551423 60551442 60551426 -
gccaggtggcggggttgccg

SEQ ID NO: 171648 - DNA, 20 bp, Artificial Sequence
  Synthetic oligonucleotide; AAG chr2 60551420 60551439 60551423 -
aggtggcggggttgccgggg

SEQ ID NO: 171649 - DNA, 20 bp, Artificial Sequence
  Synthetic oligonucleotide; AGG chr2 60551419 60551438 60551422 -
ggtggcggggttgccgggga

SEQ ID NO: 171650 - DNA, 20 bp, Artificial Sequence
  Synthetic oligonucleotide; GGG chr2 60551418 60551437 60551421 -
gtggcggggttgccggggaa

SEQ ID NO: 171651 - DNA, 20 bp, Artificial Sequence
  Synthetic oligonucleotide; CAG chr2 60551415 60551434 60551418 -
gcggggttgccggggaaggg

SEQ ID NO: 171652 - DNA, 20 bp, Artificial Sequence
  Synthetic oligonucleotide; AGG chr2 60551414 60551433 60551417 -
cggggttgccggggaagggc

SEQ ID NO: 171653 - DNA, 20 bp, Artificial Sequence
  Synthetic oligonucleotide; GGG chr2 60551413 60551432 60551416 -
ggggttgccggggaagggca

SEQ ID NO: 171654 - DNA, 20 bp, Artificial Sequence
  Synthetic oligonucleotide; GGG chr2 60551412 60551431 60551415 -
gggttgccggggaagggcag

SEQ ID NO: 171655 - DNA, 20 bp, Artificial Sequence
  Synthetic oligonucleotide; GAG chr2 60551410 60551429 60551413 -
gttgccggggaagggcaggg

SEQ ID NO: 171656 - DNA, 20 bp, Artificial Sequence
  Synthetic oligonucleotide; AAG chr2 60551407 60551426 60551410 -
gccggggaagggcaggggag

SEQ ID NO: 171657 - DNA, 20 bp, Artificial Sequence
  Synthetic oligonucleotide; GAG chr2 60551397 60551416 60551400 -
ggcaggggagaagtgtgttt

SEQ ID NO: 171658 - DNA, 20 bp, Artificial Sequence
  Synthetic oligonucleotide; AAG chr2 60551384 60551403 60551387 -
tgtgtttgagtgtgcatttt

SEQ ID NO: 171659 - DNA, 20 bp, Artificial Sequence
  Synthetic oligonucleotide; AGG chr2 60551383 60551402 60551386 -
gtgtttgagtgtgcatttta

SEQ ID NO: 171660 - DNA, 20 bp, Artificial Sequence
  Synthetic oligonucleotide; GGG chr2 60551382 60551401 60551385 -
tgtttgagtgtgcattttaa

SEQ ID NO: 171661 - DNA, 20 bp, Artificial Sequence
  Synthetic oligonucleotide; TGG chr2 60551376 60551395 60551379 -
agtgtgcattttaagggcgc

SEQ ID NO: 171662 - DNA, 20 bp, Artificial Sequence
  Synthetic oligonucleotide; TGG chr2 60551369 60551388 60551372 -
attttaagggcgctggatcc

SEQ ID NO: 171663 - DNA, 20 bp, Artificial Sequence
  Synthetic oligonucleotide; GGG chr2 60551368 60551387 60551371 -
ttttaagggcgctggatcct

SEQ ID NO: 171664 - DNA, 20 bp, Artificial Sequence
  Synthetic oligonucleotide; GAG chr2 60551360 60551379 60551363 -
gcgctggatcctgggacccc

SEQ ID NO: 171665 - DNA, 20 bp, Artificial Sequence
  Synthetic oligonucleotide; TGG chr2 60551345 60551364 60551348 -
accccgagcacttcaccctt

SEQ ID NO: 171666 - DNA, 20 bp, Artificial Sequence
  Synthetic oligonucleotide; GGG chr2 60551344 60551363 60551347 -
ccccgagcacttcacccttt

SEQ ID NO: 171667 - DNA, 20 bp, Artificial Sequence
  Synthetic oligonucleotide; CAG chr2 60551326 60551345 60551329 -
ttgggtcttgccctcttccc

SEQ ID NO: 171668 - DNA, 20 bp, Artificial Sequence
  Synthetic oligonucleotide; AGG chr2 60551325 60551344 60551328 -
tgggtcttgccctcttcccc

SEQ ID NO: 171669 - DNA, 20 bp, Artificial Sequence
  Synthetic oligonucleotide; TGG chr2 60551320 60551339 60551323 -
cttgccctcttccccaggcc

SEQ ID NO: 171670 - DNA, 20 bp, Artificial Sequence
  Synthetic oligonucleotide; TGG chr2 60551315 60551334 60551318 -
cctcttccccaggcctggct

SEQ ID NO: 171671 - DNA, 20 bp, Artificial Sequence
  Synthetic oligonucleotide; GAG chr2 60551309 60551328 60551312 -
ccccaggcctggcttggtct

SEQ ID NO: 171672 - DNA, 20 bp, Artificial Sequence
  Synthetic oligonucleotide; AGG chr2 60551308 60551327 60551311 -
cccaggcctggcttggtctg

SEQ ID NO: 171673 - DNA, 20 bp, Artificial Sequence
  Synthetic oligonucleotide; GAG chr2 60551298 60551317 60551301 -
gcttggtctgaggttcttgt

SEQ ID NO: 171674 - DNA, 20 bp, Artificial Sequence
  Synthetic oligonucleotide; AAG chr2 60551288 60551307 60551291 -
aggttcttgtgagtctgtat

SEQ ID NO: 171675 - DNA, 20 bp, Artificial Sequence
  Synthetic oligonucleotide; GAG chr2 60551286 60551305 60551289 -
gttcttgtgagtctgtataa

SEQ ID NO: 171676 - DNA, 20 bp, Artificial Sequence
  Synthetic oligonucleotide; TGG chr2 60551282 60551301 60551285 -
ttgtgagtctgtataagagc

SEQ ID NO: 171677 - DNA, 20 bp, Artificial Sequence
  Synthetic oligonucleotide; TGG chr2 60551279 60551298 60551282 -
tgagtctgtataagagctgg

SEQ ID NO: 171678 - DNA, 20 bp, Artificial Sequence
  Synthetic oligonucleotide; TGG chr2 60551276 60551295 60551279 -
gtctgtataagagctggtgg

SEQ ID NO: 171679 - DNA, 20 bp, Artificial Sequence
  Synthetic oligonucleotide; TGG chr2 60551273 60551292 60551276 -
tgtataagagctggtggtgg

SEQ ID NO: 171680 - DNA, 20 bp, Artificial Sequence
  Synthetic oligonucleotide; TGG chr2 60551249 60551268 60551252 -
tgtctcccgctgactgcgcc

SEQ ID NO: 171681 - DNA, 20 bp, Artificial Sequence
  Synthetic oligonucleotide; AAG chr2 60551245 60551264 60551248 -
tcccgctgactgcgcctgga

SEQ ID NO: 171682 - DNA, 20 bp, Artificial Sequence
  Synthetic oligonucleotide; AGG chr2 60551244 60551263 60551247 -
cccgctgactgcgcctggaa

SEQ ID NO: 171683 - DNA, 20 bp, Artificial Sequence
  Synthetic oligonucleotide; CGG chr2 60551241 60551260 60551244 -
gctgactgcgcctggaaagg

SEQ ID NO: 171684 - DNA, 20 bp, Artificial Sequence
  Synthetic oligonucleotide; GGG chr2 60551240 60551259 60551243 -
ctgactgcgcctggaaaggc

SEQ ID NO: 171685 - DNA, 20 bp, Artificial Sequence
  Synthetic oligonucleotide; CGG chr2 60551237 60551256 60551240 -
actgcgcctggaaaggcggg

SEQ ID NO: 171686 - DNA, 20 bp, Artificial Sequence
  Synthetic oligonucleotide; TGG chr2 60551234 60551253 60551237 -
gcgcctggaaaggcgggcgg

SEQ ID NO: 171687 - DNA, 20 bp, Artificial Sequence
  Synthetic oligonucleotide; GGG chr2 60551233 60551252 60551236 -
cgcctggaaaggcgggcggt

SEQ ID NO: 171688 - DNA, 20 bp, Artificial Sequence
  Synthetic oligonucleotide; TAG chr2 60551226 60551245 60551229 -
aaaggcgggcggtgggcact

SEQ ID NO: 171689 - DNA, 20 bp, Artificial Sequence
  Synthetic oligonucleotide; AGG chr2 60551225 60551244 60551228 -
aaggcgggcggtgggcactt

SEQ ID NO: 171690 - DNA, 20 bp, Artificial Sequence
  Synthetic oligonucleotide; AAG chr2 60551221 60551240 60551224 -
cgggcggtgggcacttagga

SEQ ID NO: 171691 - DNA, 20 bp, Artificial Sequence
  Synthetic oligonucleotide; TGG chr2 60551216 60551235 60551219 -
ggtgggcacttaggaaagtt

SEQ ID NO: 171692 - DNA, 20 bp, Artificial Sequence
  Synthetic oligonucleotide; CAG chr2 60551213 60551232 60551216 -
gggcacttaggaaagtttgg

SEQ ID NO: 171693 - DNA, 20 bp, Artificial Sequence
  Synthetic oligonucleotide; AAG chr2 60551209 60551228 60551212 -
acttaggaaagtttggcagc

SEQ ID NO: 171694 - DNA, 20 bp, Artificial Sequence
  Synthetic oligonucleotide; AGG chr2 60551208 60551227 60551211 -
cttaggaaagtttggcagca

SEQ ID NO: 171695 - DNA, 20 bp, Artificial Sequence
  Synthetic oligonucleotide; GGG chr2 60551207 60551226 60551210 -
ttaggaaagtttggcagcaa

SEQ ID NO: 171696 - DNA, 20 bp, Artificial Sequence
  Synthetic oligonucleotide; AAG chr2 60551203 60551222 60551206 -
gaaagtttggcagcaaggga

SEQ ID NO: 171697 - DNA, 20 bp, Artificial Sequence
  Synthetic oligonucleotide; AAG chr2 60551199 60551218 60551202 -
gtttggcagcaagggaaaga

SEQ ID NO: 171698 - DNA, 20 bp, Artificial Sequence
  Synthetic oligonucleotide; AGG chr2 60551198 60551217 60551201 -
tttggcagcaagggaaagaa

SEQ ID NO: 171699 - DNA, 20 bp, Artificial Sequence
  Synthetic oligonucleotide; GAG chr2 60551192 60551211 60551195 -
agcaagggaaagaaaggcgt

SEQ ID NO: 171700 - DNA, 20 bp, Artificial Sequence
  Synthetic oligonucleotide; AGG chr2 60551191 60551210 60551194 -
gcaagggaaagaaaggcgtg

SEQ ID NO: 171701 - DNA, 20 bp, Artificial Sequence
  Synthetic oligonucleotide; GGG chr2 60551190 60551209 60551193 -
caagggaaagaaaggcgtga

SEQ ID NO: 171702 - DNA, 20 bp, Artificial Sequence
  Synthetic oligonucleotide; CAG chr2 60551136 60551155 60551139 -
cttactttaaatttttgatg

SEQ ID NO: 171703 - DNA, 20 bp, Artificial Sequence
  Synthetic oligonucleotide; AAG chr2 60551128 60551147 60551131 -
aaatttttgatgcagtttta

SEQ ID NO: 171704 - DNA, 20 bp, Artificial Sequence
  Synthetic oligonucleotide; AGG chr2 60551127 60551146 60551130 -
aatttttgatgcagttttaa

SEQ ID NO: 171705 - DNA, 20 bp, Artificial Sequence
  Synthetic oligonucleotide; TGG chr2 60551112 60551131 60551115 -
tttaaaggaccacctatact

SEQ ID NO: 171706 - DNA, 20 bp, Artificial Sequence
  Synthetic oligonucleotide; AAG chr2 60551094 60551113 60551097 -
cttggttctgtgttttttta

SEQ ID NO: 171707 - DNA, 20 bp, Artificial Sequence
  Synthetic oligonucleotide; AGG chr2 60551093 60551112 60551096 -
ttggttctgtgtttttttaa

SEQ ID NO: 171708 - DNA, 20 bp, Artificial Sequence
  Synthetic oligonucleotide; GGG chr2 60551092 60551111 60551095 -
tggttctgtgtttttttaaa

SEQ ID NO: 171709 - DNA, 20 bp, Artificial Sequence
  Synthetic oligonucleotide; GGG chr2 60551091 60551110 60551094 -
ggttctgtgtttttttaaag

SEQ ID NO: 171710 - DNA, 20 bp, Artificial Sequence
  Synthetic oligonucleotide; TGG chr2 60551088 60551107 60551091 -
tctgtgtttttttaaagggg

SEQ ID NO: 171711 - DNA, 20 bp, Artificial Sequence
  Synthetic oligonucleotide; TGG chr2 60551085 60551104 60551088 -
gtgtttttttaaaggggtgg

SEQ ID NO: 171712 - DNA, 20 bp, Artificial Sequence
  Synthetic oligonucleotide; TGG chr2 60551082 60551101 60551085 -
tttttttaaaggggtggtgg

SEQ ID NO: 171713 - DNA, 20 bp, Artificial Sequence
  Synthetic oligonucleotide; GGG chr2 60551081 60551100 60551084 -
ttttttaaaggggtggtggt

SEQ ID NO: 171714 - DNA, 20 bp, Artificial Sequence
  Synthetic oligonucleotide; GGG chr2 60551080 60551099 60551083 -
tttttaaaggggtggtggtg

SEQ ID NO: 171715 - DNA, 20 bp, Artificial Sequence
  Synthetic oligonucleotide; GGG chr2 60551079 60551098 60551082 -
ttttaaaggggtggtggtgg

SEQ ID NO: 171716 - DNA, 20 bp, Artificial Sequence
  Synthetic oligonucleotide; GGG chr2 60551078 60551097 60551081 -
tttaaaggggtggtggtggg

SEQ ID NO: 171717 - DNA, 20 bp, Artificial Sequence
  Synthetic oligonucleotide; CAG chr2 60551069 60551088 60551072 -
gtggtggtggggggtgcgca

SEQ ID NO: 171718 - DNA, 20 bp, Artificial Sequence
  Synthetic oligonucleotide; AGG chr2 60551068 60551087 60551071 -
tggtggtggggggtgcgcac

SEQ ID NO: 171719 - DNA, 20 bp, Artificial Sequence
  Synthetic oligonucleotide; GGG chr2 60551067 60551086 60551070 -
ggtggtggggggtgcgcaca

SEQ ID NO: 171720 - DNA, 20 bp, Artificial Sequence
  Synthetic oligonucleotide; TGG chr2 60551049 60551068 60551052 -
cagggaatttaatttttcac

SEQ ID NO: 171721 - DNA, 20 bp, Artificial Sequence
  Synthetic oligonucleotide; GGG chr2 60551048 60551067 60551051 -
agggaatttaatttttcact

SEQ ID NO: 171722 - DNA, 20 bp, Artificial Sequence
  Synthetic oligonucleotide; TGG chr2 60551042 60551061 60551045 -
tttaatttttcactgggccc

SEQ ID NO: 171723 - DNA, 20 bp, Artificial Sequence
  Synthetic oligonucleotide; CGG chr2 60551023 60551042 60551026 -
ctggaacttgtcacacactt

SEQ ID NO: 171724 - DNA, 20 bp, Artificial Sequence
  Synthetic oligonucleotide; AAG chr2 60551020 60551039 60551023 -
gaacttgtcacacacttcgg

SEQ ID NO: 171725 - DNA, 20 bp, Artificial Sequence
  Synthetic oligonucleotide; CGG chr2 60551006 60551025 60551009 -
cttcggaagctcccccaccc

SEQ ID NO: 171726 - DNA, 20 bp, Artificial Sequence
  Synthetic oligonucleotide; CGG chr2 60550994 60551013 60550997 -
ccccaccccggcacgttgcg

SEQ ID NO: 171727 - DNA, 20 bp, Artificial Sequence
  Synthetic oligonucleotide; CGG chr2 60550929 60550948 60550932 -
tcccccgcccccaactcccc

SEQ ID NO: 171728 - DNA, 20 bp, Artificial Sequence
  Synthetic oligonucleotide; CGG chr2 60550920 60550939 60550923 -
cccaactcccccggccgcgc

SEQ ID NO: 171729 - DNA, 20 bp, Artificial Sequence
  Synthetic oligonucleotide; CGG chr2 60550914 60550933 60550917 -
tcccccggccgcgccggatg

SEQ ID NO: 171730 - DNA, 20 bp, Artificial Sequence
  Synthetic oligonucleotide; CAG chr2 60550909 60550928 60550912 -
cggccgcgccggatgcggat

SEQ ID NO: 171731 - DNA, 20 bp, Artificial Sequence
  Synthetic oligonucleotide; CGG chr2 60550903 60550922 60550906 -
cgccggatgcggatcagacg

SEQ ID NO: 171732 - DNA, 20 bp, Artificial Sequence
  Synthetic oligonucleotide; CGG chr2 60550896 60550915 60550899 -
tgcggatcagacgcggcgcg

SEQ ID NO: 171733 - DNA, 20 bp, Artificial Sequence
  Synthetic oligonucleotide; CGG chr2 60550893 60550912 60550896 -
ggatcagacgcggcgcgcgg

SEQ ID NO: 171734 - DNA, 20 bp, Artificial Sequence
  Synthetic oligonucleotide; AAG chr2 60550886 60550905 60550889 -
acgcggcgcgcggcggtgtg

SEQ ID NO: 171735 - DNA, 20 bp, Artificial Sequence
  Synthetic oligonucleotide; CAG chr2 60550880 60550899 60550883 -
cgcgcggcggtgtgaagtta

SEQ ID NO: 171736 - DNA, 20 bp, Artificial Sequence
  Synthetic oligonucleotide; CGG chr2 60550875 60550894 60550878 -
ggcggtgtgaagttacagcc

SEQ ID NO: 171737 - DNA, 20 bp, Artificial Sequence
  Synthetic oligonucleotide; CAG chr2 60550871 60550890 60550874 -
gtgtgaagttacagcccggc

SEQ ID NO: 171738 - DNA, 20 bp, Artificial Sequence
  Synthetic oligonucleotide; AGG chr2 60550870 60550889 60550873 -
tgtgaagttacagcccggcc

SEQ ID NO: 171739 - DNA, 20 bp, Artificial Sequence
  Synthetic oligonucleotide; CGG chr2 60550864 60550883 60550867 -
gttacagcccggccaggtac

SEQ ID NO: 171740 - DNA, 20 bp, Artificial Sequence
  Synthetic oligonucleotide; CGG chr2 60550861 60550880 60550864 -
acagcccggccaggtaccgg

SEQ ID NO: 171741 - DNA, 20 bp, Artificial Sequence
  Synthetic oligonucleotide; GGG chr2 60550860 60550879 60550863 -
cagcccggccaggtaccggc

SEQ ID NO: 171742 - DNA, 20 bp, Artificial Sequence
  Synthetic oligonucleotide; AAG chr2 60550857 60550876 60550860 -
cccggccaggtaccggcggg

SEQ ID NO: 171743 - DNA, 20 bp, Artificial Sequence
  Synthetic oligonucleotide; AGG chr2 60550856 60550875 60550859 -
ccggccaggtaccggcggga

SEQ ID NO: 171744 - DNA, 20 bp, Artificial Sequence
  Synthetic oligonucleotide; AAG chr2 60550853 60550872 60550856 -
gccaggtaccggcgggaagg

SEQ ID NO: 171745 - DNA, 20 bp, Artificial Sequence
  Synthetic oligonucleotide; AGG chr2 60550852 60550871 60550855 -
ccaggtaccggcgggaagga

SEQ ID NO: 171746 - DNA, 20 bp, Artificial Sequence
  Synthetic oligonucleotide; GGG chr2 60550851 60550870 60550854 -
caggtaccggcgggaaggaa

SEQ ID NO: 171747 - DNA, 20 bp, Artificial Sequence
  Synthetic oligonucleotide; CAG chr2 60550848 60550867 60550851 -
gtaccggcgggaaggaaggg

SEQ ID NO: 171748 - DNA, 20 bp, Artificial Sequence
  Synthetic oligonucleotide; CAG chr2 60550839 60550858 60550842 -
ggaaggaagggcagtgttcg

SEQ ID NO: 171749 - DNA, 20 bp, Artificial Sequence
  Synthetic oligonucleotide; AGG chr2 60550838 60550857 60550841 -
gaaggaagggcagtgttcgc

SEQ ID NO: 171750 - DNA, 20 bp, Artificial Sequence
  Synthetic oligonucleotide; CGG chr2 60550832 60550851 60550835 -
agggcagtgttcgcaggact

SEQ ID NO: 171751 - DNA, 20 bp, Artificial Sequence
  Synthetic oligonucleotide; GGG chr2 60550831 60550850 60550834 -
gggcagtgttcgcaggactc

SEQ ID NO: 171752 - DNA, 20 bp, Artificial Sequence
  Synthetic oligonucleotide; AAG chr2 60550827 60550846 60550830 -
agtgttcgcaggactcggga

SEQ ID NO: 171753 - DNA, 20 bp, Artificial Sequence
  Synthetic oligonucleotide; CAG chr2 60550823 60550842 60550826 -
ttcgcaggactcgggaaagt

SEQ ID NO: 171754 - DNA, 20 bp, Artificial Sequence
  Synthetic oligonucleotide; AGG chr2 60550822 60550841 60550825 -
tcgcaggactcgggaaagtc

SEQ ID NO: 171755 - DNA, 20 bp, Artificial Sequence
  Synthetic oligonucleotide; CGG chr2 60550811 60550830 60550814 -
gggaaagtcaggcccttctt

SEQ ID NO: 171756 - DNA, 20 bp, Artificial Sequence
  Synthetic oligonucleotide; AAG chr2 60550808 60550827 60550811 -
aaagtcaggcccttcttcgg

SEQ ID NO: 171757 - DNA, 20 bp, Artificial Sequence
  Synthetic oligonucleotide; AGG chr2 60550807 60550826 60550810 -
aagtcaggcccttcttcgga

SEQ ID NO: 171758 - DNA, 20 bp, Artificial Sequence
  Synthetic oligonucleotide; CAG chr2 60550801 60550820 60550804 -
ggcccttcttcggaaggatg

SEQ ID NO: 171759 - DNA, 20 bp, Artificial Sequence
  Synthetic oligonucleotide; TGG chr2 60550798 60550817 60550801 -
ccttcttcggaaggatgcag

SEQ ID NO: 171760 - DNA, 20 bp, Artificial Sequence
  Synthetic oligonucleotide; GGG chr2 60550797 60550816 60550800 -
cttcttcggaaggatgcagt

SEQ ID NO: 171761 - DNA, 20 bp, Artificial Sequence
  Synthetic oligonucleotide; GGG chr2 60550796 60550815 60550799 -
ttcttcggaaggatgcagtg

SEQ ID NO: 171762 - DNA, 20 bp, Artificial Sequence
  Synthetic oligonucleotide; GGG chr2 60550795 60550814 60550798 -
tcttcggaaggatgcagtgg

SEQ ID NO: 171763 - DNA, 20 bp, Artificial Sequence
  Synthetic oligonucleotide; AAG chr2 60550788 60550807 60550791 -
aaggatgcagtgggggctca

SEQ ID NO: 171764 - DNA, 20 bp, Artificial Sequence
  Synthetic oligonucleotide; AGG chr2 60550787 60550806 60550790 -
aggatgcagtgggggctcaa

SEQ ID NO: 171765 - DNA, 20 bp, Artificial Sequence
  Synthetic oligonucleotide; CAG chr2 60550783 60550802 60550786 -
tgcagtgggggctcaaagga

SEQ ID NO: 171766 - DNA, 20 bp, Artificial Sequence
  Synthetic oligonucleotide; CGG chr2 60550778 60550797 60550781 -
tgggggctcaaaggacagac

SEQ ID NO: 171767 - DNA, 20 bp, Artificial Sequence
  Synthetic oligonucleotide; GGG chr2 60550777 60550796 60550780 -
gggggctcaaaggacagacc

SEQ ID NO: 171768 - DNA, 20 bp, Artificial Sequence
  Synthetic oligonucleotide; GGG chr2 60550776 60550795 60550779 -
ggggctcaaaggacagaccg

SEQ ID NO: 171769 - DNA, 20 bp, Artificial Sequence
  Synthetic oligonucleotide; CAG chr2 60550769 60550788 60550772 -
aaaggacagaccggggcgcg

SEQ ID NO: 171770 - DNA, 20 bp, Artificial Sequence
  Synthetic oligonucleotide; CAG chr2 60550764 60550783 60550767 -
acagaccggggcgcgcagtc

SEQ ID NO: 171771 - DNA, 20 bp, Artificial Sequence
  Synthetic oligonucleotide; AGG chr2 60550763 60550782 60550766 -
cagaccggggcgcgcagtcc

SEQ ID NO: 171772 - DNA, 20 bp, Artificial Sequence
  Synthetic oligonucleotide; TGG chr2 60550734 60550753 60550737 -
cctcgtacccctctccctcc

SEQ ID NO: 171773 - DNA, 20 bp, Artificial Sequence
  Synthetic oligonucleotide; GGG chr2 60550733 60550752 60550736 -
ctcgtacccctctccctcct

SEQ ID NO: 171774 - DNA, 20 bp, Artificial Sequence
  Synthetic oligonucleotide; TGG chr2 60550723 60550742 60550726 -
tctccctcctgggtccatct

SEQ ID NO: 171775 - DNA, 20 bp, Artificial Sequence
  Synthetic oligonucleotide; GGG chr2 60550722 60550741 60550725 -
ctccctcctgggtccatctt

SEQ ID NO: 171776 - DNA, 20 bp, Artificial Sequence
  Synthetic oligonucleotide; TAG chr2 60550713 60550732 60550716 -
gggtccatcttgggacactc

SEQ ID NO: 171777 - DNA, 20 bp, Artificial Sequence
  Synthetic oligonucleotide; AGG chr2 60550712 60550731 60550715 -
ggtccatcttgggacactct

SEQ ID NO: 171778 - DNA, 20 bp, Artificial Sequence
  Synthetic oligonucleotide; TGG chr2 60550708 60550727 60550711 -
catcttgggacactctaggc

SEQ ID NO: 171779 - DNA, 20 bp, Artificial Sequence
  Synthetic oligonucleotide; GGG chr2 60550707 60550726 60550710 -
atcttgggacactctaggct

SEQ ID NO: 171780 - DNA, 20 bp, Artificial Sequence
  Synthetic oligonucleotide; GAG chr2 60550705 60550724 60550708 -
cttgggacactctaggctgg

SEQ ID NO: 171781 - DNA, 20 bp, Artificial Sequence
  Synthetic oligonucleotide; AGG chr2 60550704 60550723 60550707 -
ttgggacactctaggctggg

SEQ ID NO: 171782 - DNA, 20 bp, Artificial Sequence
  Synthetic oligonucleotide; GGG chr2 60550703 60550722 60550706 -
tgggacactctaggctggga

SEQ ID NO: 171783 - DNA, 20 bp, Artificial Sequence
  Synthetic oligonucleotide; TAG chr2 60550699 60550718 60550702 -
acactctaggctgggagggt

SEQ ID NO: 171784 - DNA, 20 bp, Artificial Sequence
  Synthetic oligonucleotide; CGG chr2 60550678 60550697 60550681 -
agtaccccctcctcctgtcc

SEQ ID NO: 171785 - DNA, 20 bp, Artificial Sequence
  Synthetic oligonucleotide; GGG chr2 60550677 60550696 60550680 -
gtaccccctcctcctgtccc

SEQ ID NO: 171786 - DNA, 20 bp, Artificial Sequence
  Synthetic oligonucleotide; GGG chr2 60550676 60550695 60550679 -
taccccctcctcctgtcccg

SEQ ID NO: 171787 - DNA, 20 bp, Artificial Sequence
  Synthetic oligonucleotide; AAG chr2 60550670 60550689 60550673 -
ctcctcctgtcccggggtta

SEQ ID NO: 171788 - DNA, 20 bp, Artificial Sequence
  Synthetic oligonucleotide; AGG chr2 60550669 60550688 60550672 -
tcctcctgtcccggggttaa

SEQ ID NO: 171789 - DNA, 20 bp, Artificial Sequence
  Synthetic oligonucleotide; GGG chr2 60550668 60550687 60550671 -
cctcctgtcccggggttaaa

SEQ ID NO: 171790 - DNA, 20 bp, Artificial Sequence
  Synthetic oligonucleotide; CAG chr2 60550664 60550683 60550667 -
ctgtcccggggttaaagggc

SEQ ID NO: 171791 - DNA, 20 bp, Artificial Sequence
  Synthetic oligonucleotide; TGG chr2 60550659 60550678 60550662 -
ccggggttaaagggccagtt

SEQ ID NO: 171792 - DNA, 20 bp, Artificial Sequence
  Synthetic oligonucleotide; GGG chr2 60550658 60550677 60550661 -
cggggttaaagggccagttt

SEQ ID NO: 171793 - DNA, 20 bp, Artificial Sequence
  Synthetic oligonucleotide; GAG chr2 60550656 60550675 60550659 -
gggttaaagggccagtttgg

SEQ ID NO: 171794 - DNA, 20 bp, Artificial Sequence
  Synthetic oligonucleotide; AGG chr2 60550655 60550674 60550658 -
ggttaaagggccagtttggg

SEQ ID NO: 171795 - DNA, 20 bp, Artificial Sequence
  Synthetic oligonucleotide; GGG chr2 60550654 60550673 60550657 -
gttaaagggccagtttggga

SEQ ID NO: 171796 - DNA, 20 bp, Artificial Sequence
  Synthetic oligonucleotide; GGG chr2 60550653 60550672 60550656 -
ttaaagggccagtttgggag

SEQ ID NO: 171797 - DNA, 20 bp, Artificial Sequence
  Synthetic oligonucleotide; GGG chr2 60550652 60550671 60550655 -
taaagggccagtttgggagg

SEQ ID NO: 171798 - DNA, 20 bp, Artificial Sequence
  Synthetic oligonucleotide; GAG chr2 60550648 60550667 60550651 -
gggccagtttgggagggggt

SEQ ID NO: 171799 - DNA, 20 bp, Artificial Sequence
  Synthetic oligonucleotide; AGG chr2 60550647 60550666 60550650 -
ggccagtttgggagggggtg

SEQ ID NO: 171800 - DNA, 20 bp, Artificial Sequence
  Synthetic oligonucleotide; GGG chr2 60550646 60550665 60550649 -
gccagtttgggagggggtga

SEQ ID NO: 171801 - DNA, 20 bp, Artificial Sequence
  Synthetic oligonucleotide; GGG chr2 60550645 60550664 60550648 -
ccagtttgggagggggtgag

SEQ ID NO: 171802 - DNA, 20 bp, Artificial Sequence
  Synthetic oligonucleotide; GGG chr2 60550644 60550663 60550647 -
cagtttgggagggggtgagg

SEQ ID NO: 171803 - DNA, 20 bp, Artificial Sequence
  Synthetic oligonucleotide; TGG chr2 60550617 60550636 60550620 -
ttctttctgtcctcattttc

SEQ ID NO: 171804 - DNA, 20 bp, Artificial Sequence
  Synthetic oligonucleotide; GGG chr2 60550616 60550635 60550619 -
tctttctgtcctcattttct

SEQ ID NO: 171805 - DNA, 20 bp, Artificial Sequence
  Synthetic oligonucleotide; CAG chr2 60550609 60550628 60550612 -
gtcctcattttctgggtgct

SEQ ID NO: 171806 - DNA, 20 bp, Artificial Sequence
  Synthetic oligonucleotide; GAG chr2 60550607 60550626 60550610 -
cctcattttctgggtgctca

SEQ ID NO: 171807 - DNA, 20 bp, Artificial Sequence
  Synthetic oligonucleotide; AGG chr2 60550606 60550625 60550609 -
ctcattttctgggtgctcag

SEQ ID NO: 171808 - DNA, 20 bp, Artificial Sequence
  Synthetic oligonucleotide; GGG chr2 60550605 60550624 60550608 -
tcattttctgggtgctcaga

SEQ ID NO: 171809 - DNA, 20 bp, Artificial Sequence
  Synthetic oligonucleotide; GGG chr2 60550604 60550623 60550607 -
cattttctgggtgctcagag

SEQ ID NO: 171810 - DNA, 20 bp, Artificial Sequence
  Synthetic oligonucleotide; GGG chr2 60550603 60550622 60550606 -
attttctgggtgctcagagg

SEQ ID NO: 171811 - DNA, 20 bp, Artificial Sequence
  Synthetic oligonucleotide; CAG chr2 60550600 60550619 60550603 -
ttctgggtgctcagaggggg

SEQ ID NO: 171812 - DNA, 20 bp, Artificial Sequence
  Synthetic oligonucleotide; AGG chr2 60550599 60550618 60550602 -
tctgggtgctcagagggggc

SEQ ID NO: 171813 - DNA, 20 bp, Artificial Sequence
  Synthetic oligonucleotide; GAG chr2 60550597 60550616 60550600 -
tgggtgctcagagggggcag

SEQ ID NO: 171814 - DNA, 20 bp, Artificial Sequence
  Synthetic oligonucleotide; CGG chr2 60550588 60550607 60550591 -
agagggggcaggagccatcc

SEQ ID NO: 171815 - DNA, 20 bp, Artificial Sequence
  Synthetic oligonucleotide; CAG chr2 60550581 60550600 60550584 -
gcaggagccatcccggtcct

SEQ ID NO: 171816 - DNA, 20 bp, Artificial Sequence
  Synthetic oligonucleotide; TGG chr2 60550547 60550566 60550550 -
cgccccccgcctctgctatg

SEQ ID NO: 171817 - DNA, 20 bp, Artificial Sequence
  Synthetic oligonucleotide; GGG chr2 60550546 60550565 60550549 -
gccccccgcctctgctatgt

SEQ ID NO: 171818 - DNA, 20 bp, Artificial Sequence
  Synthetic oligonucleotide; GAG chr2 60550537 60550556 60550540 -
ctctgctatgtgggctgaat

SEQ ID NO: 171819 - DNA, 20 bp, Artificial Sequence
  Synthetic oligonucleotide; CGG chr2 60550529 60550548 60550532 -
tgtgggctgaatgagccatt

SEQ ID NO: 171820 - DNA, 20 bp, Artificial Sequence
  Synthetic oligonucleotide; TAG chr2 60550522 60550541 60550525 -
tgaatgagccattcggtcgc

SEQ ID NO: 171821 - DNA, 20 bp, Artificial Sequence
  Synthetic oligonucleotide; AGG chr2 60550521 60550540 60550524 -
gaatgagccattcggtcgct

SEQ ID NO: 171822 - DNA, 20 bp, Artificial Sequence
  Synthetic oligonucleotide; GAG chr2 60550519 60550538 60550522 -
atgagccattcggtcgctag

SEQ ID NO: 171823 - DNA, 20 bp, Artificial Sequence
  Synthetic oligonucleotide; AGG chr2 60550518 60550537 60550521 -
tgagccattcggtcgctagg

SEQ ID NO: 171824 - DNA, 20 bp, Artificial Sequence
  Synthetic oligonucleotide; CAG chr2 60550515 60550534 60550518 -
gccattcggtcgctaggagg

SEQ ID NO: 171825 - DNA, 20 bp, Artificial Sequence
  Synthetic oligonucleotide; AAG chr2 60550509 60550528 60550512 -
cggtcgctaggaggcagaac

SEQ ID NO: 171826 - DNA, 20 bp, Artificial Sequence
  Synthetic oligonucleotide; AAG chr2 60550503 60550522 60550506 -
ctaggaggcagaacaagatc

SEQ ID NO: 171827 - DNA, 20 bp, Artificial Sequence
  Synthetic oligonucleotide; AAG chr2 60550499 60550518 60550502 -
gaggcagaacaagatcaaga

SEQ ID NO: 171828 - DNA, 20 bp, Artificial Sequence
  Synthetic oligonucleotide; CAG chr2 60550494 60550513 60550497 -
agaacaagatcaagaaagct

SEQ ID NO: 171829 - DNA, 20 bp, Artificial Sequence
  Synthetic oligonucleotide; CAG chr2 60550474 60550493 60550477 -
cagcgaacttgaacctgtac

SEQ ID NO: 171830 - DNA, 20 bp, Artificial Sequence
  Synthetic oligonucleotide; GAG chr2 60550472 60550491 60550475 -
gcgaacttgaacctgtacca

SEQ ID NO: 171831 - DNA, 20 bp, Artificial Sequence
  Synthetic oligonucleotide; CGG chr2 60550451 60550470 60550454 -
agcctcccccacctcctgcc

SEQ ID NO: 171832 - DNA, 20 bp, Artificial Sequence
  Synthetic oligonucleotide; CGG chr2 60550437 60550456 60550440 -
cctgcccggcgattctcgtc

SEQ ID NO: 171833 - DNA, 20 bp, Artificial Sequence
  Synthetic oligonucleotide; GGG chr2 60550436 60550455 60550439 -
ctgcccggcgattctcgtcc

SEQ ID NO: 171834 - DNA, 20 bp, Artificial Sequence
  Synthetic oligonucleotide; GGG chr2 60550435 60550454 60550438 -
tgcccggcgattctcgtccg

SEQ ID NO: 171835 - DNA, 20 bp, Artificial Sequence
  Synthetic oligonucleotide; GAG chr2 60550433 60550452 60550436 -
cccggcgattctcgtccggg

SEQ ID NO: 171836 - DNA, 20 bp, Artificial Sequence
  Synthetic oligonucleotide; AGG chr2 60550432 60550451 60550435 -
ccggcgattctcgtccgggg

SEQ ID NO: 171837 - DNA, 20 bp, Artificial Sequence
  Synthetic oligonucleotide; GAG chr2 60550426 60550445 60550429 -
attctcgtccggggaggaac

SEQ ID NO: 171838 - DNA, 20 bp, Artificial Sequence
  Synthetic oligonucleotide; GAG chr2 60550417 60550436 60550420 -
cggggaggaacgagctttgc

SEQ ID NO: 171839 - DNA, 20 bp, Artificial Sequence
  Synthetic oligonucleotide; AGG chr2 60550416 60550435 60550419 -
ggggaggaacgagctttgcg

SEQ ID NO: 171840 - DNA, 20 bp, Artificial Sequence
  Synthetic oligonucleotide; GGG chr2 60550415 60550434 60550418 -
gggaggaacgagctttgcga

SEQ ID NO: 171841 - DNA, 20 bp, Artificial Sequence
  Synthetic oligonucleotide; TGG chr2 60550412 60550431 60550415 -
aggaacgagctttgcgaggg

SEQ ID NO: 171842 - DNA, 20 bp, Artificial Sequence
  Synthetic oligonucleotide; GGG chr2 60550411 60550430 60550414 -
ggaacgagctttgcgagggt

SEQ ID NO: 171843 - DNA, 20 bp, Artificial Sequence
  Synthetic oligonucleotide; GGG chr2 60550410 60550429 60550413 -
gaacgagctttgcgagggtg

SEQ ID NO: 171844 - DNA, 20 bp, Artificial Sequence
  Synthetic oligonucleotide; GGG chr2 60550409 60550428 60550412 -
aacgagctttgcgagggtgg

SEQ ID NO: 171845 - DNA, 20 bp, Artificial Sequence
  Synthetic oligonucleotide; TGG chr2 60550406 60550425 60550409 -
gagctttgcgagggtggggg

SEQ ID NO: 171846 - DNA, 20 bp, Artificial Sequence
  Synthetic oligonucleotide; GGG chr2 60550405 60550424 60550408 -
agctttgcgagggtgggggt

SEQ ID NO: 171847 - DNA, 20 bp, Artificial Sequence
  Synthetic oligonucleotide; GGG chr2 60550404 60550423 60550407 -
gctttgcgagggtgggggtg

SEQ ID NO: 171848 - DNA, 20 bp, Artificial Sequence
  Synthetic oligonucleotide; GGG chr2 60550403 60550422 60550406 -
ctttgcgagggtgggggtgg

SEQ ID NO: 171849 - DNA, 20 bp, Artificial Sequence
  Synthetic oligonucleotide; GGG chr2 60550402 60550421 60550405 -
tttgcgagggtgggggtggg

SEQ ID NO: 171850 - DNA, 20 bp, Artificial Sequence
  Synthetic oligonucleotide; AAG chr2 60550398 60550417 60550401 -
cgagggtgggggtgggggga

SEQ ID NO: 171851 - DNA, 20 bp, Artificial Sequence
  Synthetic oligonucleotide; CGG chr2 60550393 60550412 60550396 -
gtgggggtggggggaaagaa

SEQ ID NO: 171852 - DNA, 20 bp, Artificial Sequence
  Synthetic oligonucleotide; TAG chr2 60550389 60550408 60550392 -
gggtggggggaaagaacggt

SEQ ID NO: 171853 - DNA, 20 bp, Artificial Sequence
  Synthetic oligonucleotide; AGG chr2 60550388 60550407 60550391 -
ggtggggggaaagaacggtt

SEQ ID NO: 171854 - DNA, 20 bp, Artificial Sequence
  Synthetic oligonucleotide; CAG chr2 60550385 60550404 60550388 -
ggggggaaagaacggttagg

SEQ ID NO: 171855 - DNA, 20 bp, Artificial Sequence
  Synthetic oligonucleotide; TGG chr2 60550316 60550335 60550319 -
tttgactttaaaaatgcttc

SEQ ID NO: 171856 - DNA, 20 bp, Artificial Sequence
  Synthetic oligonucleotide; CGG chr2 60550312 60550331 60550315 -
actttaaaaatgcttctggc

SEQ ID NO: 171857 - DNA, 20 bp, Artificial Sequence
  Synthetic oligonucleotide; GGG chr2 60550311 60550330 60550314 -
ctttaaaaatgcttctggcc

SEQ ID NO: 171858 - DNA, 20 bp, Artificial Sequence
  Synthetic oligonucleotide; GGG chr2 60550310 60550329 60550313 -
tttaaaaatgcttctggccg

SEQ ID NO: 171859 - DNA, 20 bp, Artificial Sequence
  Synthetic oligonucleotide; CGG chr2 60550304 60550323 60550307 -
aatgcttctggccggggccg

SEQ ID NO: 171860 - DNA, 20 bp, Artificial Sequence
  Synthetic oligonucleotide; GAG chr2 60550302 60550321 60550305 -
tgcttctggccggggccgcg

SEQ ID NO: 171861 - DNA, 20 bp, Artificial Sequence
  Synthetic oligonucleotide; AAG chr2 60550299 60550318 60550302 -
ttctggccggggccgcggag

SEQ ID NO: 171862 - DNA, 20 bp, Artificial Sequence
  Synthetic oligonucleotide; CGG chr2 60550292 60550311 60550295 -
cggggccgcggagaagcgac

SEQ ID NO: 171863 - DNA, 20 bp, Artificial Sequence
  Synthetic oligonucleotide; GGG chr2 60550291 60550310 60550294 -
ggggccgcggagaagcgacc

SEQ ID NO: 171864 - DNA, 20 bp, Artificial Sequence
  Synthetic oligonucleotide; CGG chr2 60550284 60550303 60550287 -
cggagaagcgaccgggcgcg

SEQ ID NO: 171865 - DNA, 20 bp, Artificial Sequence
  Synthetic oligonucleotide; GAG chr2 60550264 60550283 60550267 -
cggccgacacccccgtgcgc

SEQ ID NO: 171866 - DNA, 20 bp, Artificial Sequence
  Synthetic oligonucleotide; GAG chr2 60550259 60550278 60550262 -
gacacccccgtgcgcgagct

SEQ ID NO: 171867 - DNA, 20 bp, Artificial Sequence
  Synthetic oligonucleotide; CAG chr2 60550254 60550273 60550257 -
ccccgtgcgcgagctgagac

SEQ ID NO: 171868 - DNA, 20 bp, Artificial Sequence
  Synthetic oligonucleotide; CGG chr2 60550244 60550263 60550247 -
gagctgagaccagcgcgcgc

SEQ ID NO: 171869 - DNA, 20 bp, Artificial Sequence
  Synthetic oligonucleotide; GGG chr2 60550243 60550262 60550246 -
agctgagaccagcgcgcgcc

SEQ ID NO: 171870 - DNA, 20 bp, Artificial Sequence
  Synthetic oligonucleotide; CGG chr2 60550238 60550257 60550241 -
agaccagcgcgcgccgggct

SEQ ID NO: 171871 - DNA, 20 bp, Artificial Sequence
  Synthetic oligonucleotide; GAG chr2 60550236 60550255 60550239 -
accagcgcgcgccgggctcg

SEQ ID NO: 171872 - DNA, 20 bp, Artificial Sequence
  Synthetic oligonucleotide; CGG chr2 60550231 60550250 60550234 -
cgcgcgccgggctcggagca

SEQ ID NO: 171873 - DNA, 20 bp, Artificial Sequence
  Synthetic oligonucleotide; CAG chr2 60550226 60550245 60550229 -
gccgggctcggagcacggtg

SEQ ID NO: 171874 - DNA, 20 bp, Artificial Sequence
  Synthetic oligonucleotide; CGG chr2 60550209 60550228 60550212 -
gtgcagttttcgctttcttt

SEQ ID NO: 171875 - DNA, 20 bp, Artificial Sequence
  Synthetic oligonucleotide; GGG chr2 60550208 60550227 60550211 -
tgcagttttcgctttctttc

SEQ ID NO: 171876 - DNA, 20 bp, Artificial Sequence
  Synthetic oligonucleotide; GGG chr2 60550207 60550226 60550210 -
gcagttttcgctttctttcg

SEQ ID NO: 171877 - DNA, 20 bp, Artificial Sequence
  Synthetic oligonucleotide; CGG chr2 60550203 60550222 60550206 -
ttttcgctttctttcggggc

SEQ ID NO: 171878 - DNA, 20 bp, Artificial Sequence
  Synthetic oligonucleotide; TGG chr2 60550194 60550213 60550197 -
tctttcggggccggcatttt

SEQ ID NO: 171879 - DNA, 20 bp, Artificial Sequence
  Synthetic oligonucleotide; TAG chr2 60550191 60550210 60550194 -
ttcggggccggcatttttgg

SEQ ID NO: 171880 - DNA, 20 bp, Artificial Sequence
  Synthetic oligonucleotide; AGG chr2 60550190 60550209 60550193 -
tcggggccggcatttttggt

SEQ ID NO: 171881 - DNA, 20 bp, Artificial Sequence
  Synthetic oligonucleotide; GGG chr2 60550189 60550208 60550192 -
cggggccggcatttttggta

SEQ ID NO: 171882 - DNA, 20 bp, Artificial Sequence
  Synthetic oligonucleotide; GAG chr2 60550187 60550206 60550190 -
gggccggcatttttggtagg

SEQ ID NO: 171883 - DNA, 20 bp, Artificial Sequence
  Synthetic oligonucleotide; AGG chr2 60550186 60550205 60550189 -
ggccggcatttttggtaggg

SEQ ID NO: 171884 - DNA, 20 bp, Artificial Sequence
  Synthetic oligonucleotide; CGG chr2 60550180 60550199 60550183 -
catttttggtagggaggaac

SEQ ID NO: 171885 - DNA, 20 bp, Artificial Sequence
  Synthetic oligonucleotide; GGG chr2 60550179 60550198 60550182 -
atttttggtagggaggaacc

SEQ ID NO: 171886 - DNA, 20 bp, Artificial Sequence
  Synthetic oligonucleotide; GAG chr2 60550177 60550196 60550180 -
ttttggtagggaggaaccgg

SEQ ID NO: 171887 - DNA, 20 bp, Artificial Sequence
  Synthetic oligonucleotide; TAG chr2 60550165 60550184 60550168 -
ggaaccgggagtgcgcgctc

SEQ ID NO: 171888 - DNA, 20 bp, Artificial Sequence
  Synthetic oligonucleotide; AGG chr2 60550164 60550183 60550167 -
gaaccgggagtgcgcgctct

SEQ ID NO: 171889 - DNA, 20 bp, Artificial Sequence
  Synthetic oligonucleotide; GGG chr2 60550163 60550182 60550166 -
aaccgggagtgcgcgctcta

SEQ ID NO: 171890 - DNA, 20 bp, Artificial Sequence
  Synthetic oligonucleotide; CGG chr2 60550157 60550176 60550160 -
gagtgcgcgctctagggctt

SEQ ID NO: 171891 - DNA, 20 bp, Artificial Sequence
  Synthetic oligonucleotide; GGG chr2 60550156 60550175 60550159 -
agtgcgcgctctagggcttc

SEQ ID NO: 171892 - DNA, 20 bp, Artificial Sequence
  Synthetic oligonucleotide; GGG chr2 60550155 60550174 60550158 -
gtgcgcgctctagggcttcg

SEQ ID NO: 171893 - DNA, 20 bp, Artificial Sequence
  Synthetic oligonucleotide; TGG chr2 60550150 60550169 60550153 -
cgctctagggcttcggggca

SEQ ID NO: 171894 - DNA, 20 bp, Artificial Sequence
  Synthetic oligonucleotide; AAG chr2 60550144 60550163 60550147 -
agggcttcggggcatggccg

SEQ ID NO: 171895 - DNA, 20 bp, Artificial Sequence
  Synthetic oligonucleotide; GAG chr2 60550142 60550161 60550145 -
ggcttcggggcatggccgaa

SEQ ID NO: 171896 - DNA, 20 bp, Artificial Sequence
  Synthetic oligonucleotide; AGG chr2 60550141 60550160 60550144 -
gcttcggggcatggccgaag

SEQ ID NO: 171897 - DNA, 20 bp, Artificial Sequence
  Synthetic oligonucleotide; GGG chr2 60550140 60550159 60550143 -
cttcggggcatggccgaaga

SEQ ID NO: 171898 - DNA, 20 bp, Artificial Sequence
  Synthetic oligonucleotide; GGG chr2 60550139 60550158 60550142 -
ttcggggcatggccgaagag

SEQ ID NO: 171899 - DNA, 20 bp, Artificial Sequence
  Synthetic oligonucleotide; GGG chr2 60550138 60550157 60550141 -
tcggggcatggccgaagagg

SEQ ID NO: 171900 - DNA, 20 bp, Artificial Sequence
  Synthetic oligonucleotide; TGG chr2 60550132 60550151 60550135 -
catggccgaagagggggata

SEQ ID NO: 171901 - DNA, 20 bp, Artificial Sequence
  Synthetic oligonucleotide; AAG chr2 60550128 60550147 60550131 -
gccgaagagggggatatggc

SEQ ID NO: 171902 - DNA, 20 bp, Artificial Sequence
  Synthetic oligonucleotide; TGG chr2 60550117 60550136 60550120 -
ggatatggcaagtttgcact

SEQ ID NO: 171903 - DNA, 20 bp, Artificial Sequence
  Synthetic oligonucleotide; CAG chr2 60550110 60550129 60550113 -
gcaagtttgcacttggtctc

SEQ ID NO: 171904 - DNA, 20 bp, Artificial Sequence
  Synthetic oligonucleotide; AAG chr2 60550075 60550094 60550078 -
caccccctcacccccatgca

SEQ ID NO: 171905 - DNA, 20 bp, Artificial Sequence
  Synthetic oligonucleotide; CAG chr2 60550070 60550089 60550073 -
cctcacccccatgcaaagca

SEQ ID NO: 171906 - DNA, 20 bp, Artificial Sequence
  Synthetic oligonucleotide; CGG chr2 60550063 60550082 60550066 -
cccatgcaaagcacagacct

SEQ ID NO: 171907 - DNA, 20 bp, Artificial Sequence
  Synthetic oligonucleotide; TGG chr2 60550060 60550079 60550063 -
atgcaaagcacagacctcgg

SEQ ID NO: 171908 - DNA, 20 bp, Artificial Sequence
  Synthetic oligonucleotide; CGG chr2 60550054 60550073 60550057 -
agcacagacctcggtggcct

SEQ ID NO: 171909 - DNA, 20 bp, Artificial Sequence
  Synthetic oligonucleotide; TGG chr2 60550050 60550069 60550053 -
cagacctcggtggcctcggc

SEQ ID NO: 171910 - DNA, 20 bp, Artificial Sequence
  Synthetic oligonucleotide; TGG chr2 60550042 60550061 60550045 -
ggtggcctcggctggcttgc

SEQ ID NO: 171911 - DNA, 20 bp, Artificial Sequence
  Synthetic oligonucleotide; GGG chr2 60550041 60550060 60550044 -
gtggcctcggctggcttgct

SEQ ID NO: 171912 - DNA, 20 bp, Artificial Sequence
  Synthetic oligonucleotide; CGG chr2 60550038 60550057 60550041 -
gcctcggctggcttgctggg

SEQ ID NO: 171913 - DNA, 20 bp, Artificial Sequence
  Synthetic oligonucleotide; CAG chr2 60550030 60550049 60550033 -
tggcttgctgggcggctctg

SEQ ID NO: 171914 - DNA, 20 bp, Artificial Sequence
  Synthetic oligonucleotide; CGG chr2 60550005 60550024 60550008 -
cgacaccccccctctcgcct

SEQ ID NO: 171915 - DNA, 20 bp, Artificial Sequence
  Synthetic oligonucleotide; GAG chr2 60550003 60550022 60550006 -
acaccccccctctcgcctcg

SEQ ID NO: 171916 - DNA, 20 bp, Artificial Sequence
  Synthetic oligonucleotide; CGG chr2 60549998 60550017 60550001 -
ccccctctcgcctcggagct

SEQ ID NO: 171917 - DNA, 20 bp, Artificial Sequence
  Synthetic oligonucleotide; TAG chr2 60549984 60550003 60549987 -
ggagctcggaatcacaacaa

SEQ ID NO: 171918 - DNA, 20 bp, Artificial Sequence
  Synthetic oligonucleotide; TAG chr2 60549978 60549997 60549981 -
cggaatcacaacaatagtaa

SEQ ID NO: 171919 - DNA, 20 bp, Artificial Sequence
  Synthetic oligonucleotide; CGG chr2 60549958 60549977 60549961 -
tagttatcatcataatgatg

SEQ ID NO: 171920 - DNA, 20 bp, Artificial Sequence
  Synthetic oligonucleotide; GGG chr2 60549957 60549976 60549960 -
agttatcatcataatgatgc

SEQ ID NO: 171921 - DNA, 20 bp, Artificial Sequence
  Synthetic oligonucleotide; CAG chr2 60549954 60549973 60549957 -
tatcatcataatgatgcggg

SEQ ID NO: 171922 - DNA, 20 bp, Artificial Sequence
  Synthetic oligonucleotide; AGG chr2 60549953 60549972 60549956 -
atcatcataatgatgcgggc

SEQ ID NO: 171923 - DNA, 20 bp, Artificial Sequence
  Synthetic oligonucleotide; CAG chr2 60549950 60549969 60549953 -
atcataatgatgcgggcagg

SEQ ID NO: 171924 - DNA, 20 bp, Artificial Sequence
  Synthetic oligonucleotide; CAG chr2 60549925 60549944 60549928 -
tcattaataatgaataaccg

SEQ ID NO: 171925 - DNA, 20 bp, Artificial Sequence
  Synthetic oligonucleotide; CAG chr2 60549905 60549924 60549908 -
cagccgccgccgcgcacacc

SEQ ID NO: 171926 - DNA, 20 bp, Artificial Sequence
  Synthetic oligonucleotide; CAG chr2 60549898 60549917 60549901 -
cgccgcgcacacccagtgcc

SEQ ID NO: 171927 - DNA, 20 bp, Artificial Sequence
  Synthetic oligonucleotide; CGG chr2 60549890 60549909 60549893 -
acacccagtgcccagaattg

SEQ ID NO: 171928 - DNA, 20 bp, Artificial Sequence
  Synthetic oligonucleotide; GGG chr2 60549889 60549908 60549892 -
cacccagtgcccagaattgc

SEQ ID NO: 171929 - DNA, 20 bp, Artificial Sequence
  Synthetic oligonucleotide; GGG chr2 60549888 60549907 60549891 -
acccagtgcccagaattgcg

SEQ ID NO: 171930 - DNA, 20 bp, Artificial Sequence
  Synthetic oligonucleotide; GGG chr2 60549887 60549906 60549890 -
cccagtgcccagaattgcgg

SEQ ID NO: 171931 - DNA, 20 bp, Artificial Sequence
  Synthetic oligonucleotide; CAG chr2 60549873 60549892 60549876 -
ttgcgggggaaatgcatttg

SEQ ID NO: 171932 - DNA, 20 bp, Artificial Sequence
  Synthetic oligonucleotide; GAG chr2 60549871 60549890 60549874 -
gcgggggaaatgcatttgca

SEQ ID NO: 171933 - DNA, 20 bp, Artificial Sequence
  Synthetic oligonucleotide; AAG chr2 60549860 60549879 60549863 -
gcatttgcagagatccccca

SEQ ID NO: 171934 - DNA, 20 bp, Artificial Sequence
  Synthetic oligonucleotide; AAG chr2 60549853 60549872 60549856 -
cagagatcccccaaagtaaa

SEQ ID NO: 171935 - DNA, 20 bp, Artificial Sequence
  Synthetic oligonucleotide; AAG chr2 60549847 60549866 60549850 -
tcccccaaagtaaaaagtgt

SEQ ID NO: 171936 - DNA, 20 bp, Artificial Sequence
  Synthetic oligonucleotide; TGG chr2 60549840 60549859 60549843 -
aagtaaaaagtgtaagcttg

SEQ ID NO: 171937 - DNA, 20 bp, Artificial Sequence
  Synthetic oligonucleotide; CAG chr2 60549834 60549853 60549837 -
aaagtgtaagcttgtggaca

SEQ ID NO: 171938 - DNA, 20 bp, Artificial Sequence
  Synthetic oligonucleotide; CAG chr2 60549822 60549841 60549825 -
tgtggacacagaatgaatct

SEQ ID NO: 171939 - DNA, 20 bp, Artificial Sequence
  Synthetic oligonucleotide; AGG chr2 60549821 60549840 60549824 -
gtggacacagaatgaatctc

SEQ ID NO: 171940 - DNA, 20 bp, Artificial Sequence
  Synthetic oligonucleotide; GAG chr2 60549808 60549827 60549811 -
gaatctcaggacccgcgctt

SEQ ID NO: 171941 - DNA, 20 bp, Artificial Sequence
  Synthetic oligonucleotide; AGG chr2 60549807 60549826 60549810 -
aatctcaggacccgcgcttg

SEQ ID NO: 171942 - DNA, 20 bp, Artificial Sequence
  Synthetic oligonucleotide; CGG chr2 60549798 60549817 60549801 -
acccgcgcttgaggtgtgtg

SEQ ID NO: 171943 - DNA, 20 bp, Artificial Sequence
  Synthetic oligonucleotide; GAG chr2 60549796 60549815 60549799 -
ccgcgcttgaggtgtgtgcg

SEQ ID NO: 171944 - DNA, 20 bp, Artificial Sequence
  Synthetic oligonucleotide; GAG chr2 60549788 60549807 60549791 -
gaggtgtgtgcggagatact

SEQ ID NO: 171945 - DNA, 20 bp, Artificial Sequence
  Synthetic oligonucleotide; CAG chr2 60549778 60549797 60549781 -
cggagatactgagactgcac

SEQ ID NO: 171946 - DNA, 20 bp, Artificial Sequence
  Synthetic oligonucleotide; AGG chr2 60549777 60549796 60549780 -
ggagatactgagactgcacc

SEQ ID NO: 171947 - DNA, 20 bp, Artificial Sequence
  Synthetic oligonucleotide; CAG chr2 60549769 60549788 60549772 -
tgagactgcaccaggttaac

SEQ ID NO: 171948 - DNA, 20 bp, Artificial Sequence
  Synthetic oligonucleotide; CGG chr2 60549765 60549784 60549768 -
actgcaccaggttaaccagc

SEQ ID NO: 171949 - DNA, 20 bp, Artificial Sequence
  Synthetic oligonucleotide; GGG chr2 60549764 60549783 60549767 -
ctgcaccaggttaaccagcc

SEQ ID NO: 171950 - DNA, 20 bp, Artificial Sequence
  Synthetic oligonucleotide; TGG chr2 60549730 60549749 60549733 -
tcacttcctttttcaccaac

SEQ ID NO: 171951 - DNA, 20 bp, Artificial Sequence
  Synthetic oligonucleotide; CAG chr2 60549727 60549746 60549730 -
cttcctttttcaccaactgg

SEQ ID NO: 171952 - DNA, 20 bp, Artificial Sequence
  Synthetic oligonucleotide; AGG chr2 60549726 60549745 60549729 -
ttcctttttcaccaactggc

SEQ ID NO: 171953 - DNA, 20 bp, Artificial Sequence
  Synthetic oligonucleotide; CAG chr2 60549721 60549740 60549724 -
ttttcaccaactggcaggcc

SEQ ID NO: 171954 - DNA, 20 bp, Artificial Sequence
  Synthetic oligonucleotide; AGG chr2 60549720 60549739 60549723 -
tttcaccaactggcaggccc

SEQ ID NO: 171955 - DNA, 20 bp, Artificial Sequence
  Synthetic oligonucleotide; GGG chr2 60549719 60549738 60549722 -
ttcaccaactggcaggccca

SEQ ID NO: 171956 - DNA, 20 bp, Artificial Sequence
  Synthetic oligonucleotide; CGG chr2 60549703 60549722 60549706 -
cccagggaaccgtcaccccg

SEQ ID NO: 171957 - DNA, 20 bp, Artificial Sequence
  Synthetic oligonucleotide; GAG chr2 60549698 60549717 60549701 -
ggaaccgtcaccccgcggcc

SEQ ID NO: 171958 - DNA, 20 bp, Artificial Sequence
  Synthetic oligonucleotide; TGG chr2 60549694 60549713 60549697 -
ccgtcaccccgcggccgagc

SEQ ID NO: 171959 - DNA, 20 bp, Artificial Sequence
  Synthetic oligonucleotide; GAG chr2 60549689 60549708 60549692 -
accccgcggccgagctggcc

SEQ ID NO: 171960 - DNA, 20 bp, Artificial Sequence
  Synthetic oligonucleotide; TGG chr2 60549685 60549704 60549688 -
cgcggccgagctggccgagc

SEQ ID NO: 171961 - DNA, 20 bp, Artificial Sequence
  Synthetic oligonucleotide; CGG chr2 60549681 60549700 60549684 -
gccgagctggccgagctgga

SEQ ID NO: 171962 - DNA, 20 bp, Artificial Sequence
  Synthetic oligonucleotide; GGG chr2 60549680 60549699 60549683 -
ccgagctggccgagctggac

SEQ ID NO: 171963 - DNA, 20 bp, Artificial Sequence
  Synthetic oligonucleotide; TGG chr2 60549675 60549694 60549678 -
ctggccgagctggacgggca

SEQ ID NO: 171964 - DNA, 20 bp, Artificial Sequence
  Synthetic oligonucleotide; GAG chr2 60549673 60549692 60549676 -
ggccgagctggacgggcatg

SEQ ID NO: 171965 - DNA, 20 bp, Artificial Sequence
  Synthetic oligonucleotide; AGG chr2 60549672 60549691 60549675 -
gccgagctggacgggcatgg

SEQ ID NO: 171966 - DNA, 20 bp, Artificial Sequence
  Synthetic oligonucleotide; CAG chr2 60549669 60549688 60549672 -
gagctggacgggcatggagg

SEQ ID NO: 171967 - DNA, 20 bp, Artificial Sequence
  Synthetic oligonucleotide; CAG chr2 60549666 60549685 60549669 -
ctggacgggcatggaggcag

SEQ ID NO: 171968 - DNA, 20 bp, Artificial Sequence
  Synthetic oligonucleotide; CAG chr2 60549662 60549681 60549665 -
acgggcatggaggcagcagt

SEQ ID NO: 171969 - DNA, 20 bp, Artificial Sequence
  Synthetic oligonucleotide; AGG chr2 60549661 60549680 60549664 -
cgggcatggaggcagcagtc

SEQ ID NO: 171970 - DNA, 20 bp, Artificial Sequence
  Synthetic oligonucleotide; GGG chr2 60549660 60549679 60549663 -
gggcatggaggcagcagtca

SEQ ID NO: 171971 - DNA, 20 bp, Artificial Sequence
  Synthetic oligonucleotide; TGG chr2 60549653 60549672 60549656 -
gaggcagcagtcagggcccc

SEQ ID NO: 171972 - DNA, 20 bp, Artificial Sequence
  Synthetic oligonucleotide; CGG chr2 60549636 60549655 60549639 -
ccctggctgccctccgtctc

SEQ ID NO: 171973 - DNA, 20 bp, Artificial Sequence
  Synthetic oligonucleotide; GGG chr2 60549635 60549654 60549638 -
cctggctgccctccgtctcc

SEQ ID NO: 171974 - DNA, 20 bp, Artificial Sequence
  Synthetic oligonucleotide; CGG chr2 60549628 60549647 60549631 -
gccctccgtctccgggcccc

SEQ ID NO: 171975 - DNA, 20 bp, Artificial Sequence
  Synthetic oligonucleotide; GGG chr2 60549627 60549646 60549630 -
ccctccgtctccgggccccc

SEQ ID NO: 171976 - DNA, 20 bp, Artificial Sequence
  Synthetic oligonucleotide; AAG chr2 60549620 60549639 60549623 -
tctccgggcccccgggcccc

SEQ ID NO: 171977 - DNA, 20 bp, Artificial Sequence
  Synthetic oligonucleotide; AGG chr2 60549619 60549638 60549622 -
ctccgggcccccgggcccca

SEQ ID NO: 171978 - DNA, 20 bp, Artificial Sequence
  Synthetic oligonucleotide; CGG chr2 60549611 60549630 60549614 -
ccccgggccccaaggccccg

SEQ ID NO: 171979 - DNA, 20 bp, Artificial Sequence
  Synthetic oligonucleotide; CAG chr2 60549589 60549608 60549592 -
gccgctgctgcacgtgttcg

SEQ ID NO: 171980 - DNA, 20 bp, Artificial Sequence
  Synthetic oligonucleotide; AAG chr2 60549585 60549604 60549588 -
ctgctgcacgtgttcgcagc

SEQ ID NO: 171981 - DNA, 20 bp, Artificial Sequence
  Synthetic oligonucleotide; CGG chr2 60549580 60549599 60549583 -
gcacgtgttcgcagcaagcg

SEQ ID NO: 171982 - DNA, 20 bp, Artificial Sequence
  Synthetic oligonucleotide; CGG chr2 60549577 60549596 60549580 -
cgtgttcgcagcaagcgcgg

SEQ ID NO: 171983 - DNA, 20 bp, Artificial Sequence
  Synthetic oligonucleotide; GGG chr2 60549576 60549595 60549579 -
gtgttcgcagcaagcgcggc

SEQ ID NO: 171984 - DNA, 20 bp, Artificial Sequence
  Synthetic oligonucleotide; GAG chr2 60549574 60549593 60549577 -
gttcgcagcaagcgcggcgg

SEQ ID NO: 171985 - DNA, 20 bp, Artificial Sequence
  Synthetic oligonucleotide; CAG chr2 60549567 60549586 60549570 -
gcaagcgcggcgggagcctg

SEQ ID NO: 171986 - DNA, 20 bp, Artificial Sequence
  Synthetic oligonucleotide; CAG chr2 60549563 60549582 60549566 -
gcgcggcgggagcctgcagc

SEQ ID NO: 171987 - DNA, 20 bp, Artificial Sequence
  Synthetic oligonucleotide; CAG chr2 60549539 60549558 60549542 -
acgctgctcgctttgtgcct

SEQ ID NO: 171988 - DNA, 20 bp, Artificial Sequence
  Synthetic oligonucleotide; GAG chr2 60549537 60549556 60549540 -
gctgctcgctttgtgcctca

SEQ ID NO: 171989 - DNA, 20 bp, Artificial Sequence
  Synthetic oligonucleotide; CGG chr2 60549507 60549526 60549510 -
gcccaacttcactttctgca

SEQ ID NO: 171990 - DNA, 20 bp, Artificial Sequence
  Synthetic oligonucleotide; CGG chr2 60549493 60549512 60549496 -
tctgcacggtccacccttgc

SEQ ID NO: 171991 - DNA, 20 bp, Artificial Sequence
  Synthetic oligonucleotide; GGG chr2 60549492 60549511 60549495 -
ctgcacggtccacccttgcc

SEQ ID NO: 171992 - DNA, 20 bp, Artificial Sequence
  Synthetic oligonucleotide; GGG chr2 60549491 60549510 60549494 -
tgcacggtccacccttgccg

SEQ ID NO: 171993 - DNA, 20 bp, Artificial Sequence
  Synthetic oligonucleotide; CGG chr2 60549479 60549498 60549482 -
ccttgccggggcccctgccc

SEQ ID NO: 171994 - DNA, 20 bp, Artificial Sequence
  Synthetic oligonucleotide; GGG chr2 60549478 60549497 60549481 -
cttgccggggcccctgcccc

SEQ ID NO: 171995 - DNA, 20 bp, Artificial Sequence
  Synthetic oligonucleotide; TAG chr2 60549471 60549490 60549474 -
gggcccctgccccgggcctg

SEQ ID NO: 171996 - DNA, 20 bp, Artificial Sequence
  Synthetic oligonucleotide; CGG chr2 60549464 60549483 60549467 -
tgccccgggcctgtagcccc

SEQ ID NO: 171997 - DNA, 20 bp, Artificial Sequence
  Synthetic oligonucleotide; CAG chr2 60549424 60549443 60549427 -
tgcttttcctctctgaattt

SEQ ID NO: 171998 - DNA, 20 bp, Artificial Sequence
  Synthetic oligonucleotide; AAG chr2 60549396 60549415 60549399 -
gtttgcttctttaccctgtt

SEQ ID NO: 171999 - DNA, 20 bp, Artificial Sequence
  Synthetic oligonucleotide; AAG chr2 60549387 60549406 60549390 -
tttaccctgttaagacaatc

SEQ ID NO: 172000 - DNA, 20 bp, Artificial Sequence
  Synthetic oligonucleotide; AGG chr2 60549386 60549405 60549389 -
ttaccctgttaagacaatca

SEQ ID NO: 172001 - DNA, 20 bp, Artificial Sequence
  Synthetic oligonucleotide; GAG chr2 60549384 60549403 60549387 -
accctgttaagacaatcaag

SEQ ID NO: 172002 - DNA, 20 bp, Artificial Sequence
  Synthetic oligonucleotide; AAG chr2 60549381 60549400 60549384 -
ctgttaagacaatcaaggag

SEQ ID NO: 172003 - DNA, 20 bp, Artificial Sequence
  Synthetic oligonucleotide; AGG chr2 60549380 60549399 60549383 -
tgttaagacaatcaaggaga

SEQ ID NO: 172004 - DNA, 20 bp, Artificial Sequence
  Synthetic oligonucleotide; TGG chr2 60549374 60549393 60549377 -
gacaatcaaggagaaggact

SEQ ID NO: 172005 - DNA, 20 bp, Artificial Sequence
  Synthetic oligonucleotide; AAG chr2 60549370 60549389 60549373 -
atcaaggagaaggacttgga

SEQ ID NO: 172006 - DNA, 20 bp, Artificial Sequence
  Synthetic oligonucleotide; AAG chr2 60549359 60549378 60549362 -
ggacttggaaagcaaacttg

SEQ ID NO: 172007 - DNA, 20 bp, Artificial Sequence
  Synthetic oligonucleotide; CGG chr2 60549322 60549341 60549325 -
ccccctccccctccgctccc

SEQ ID NO: 172008 - DNA, 20 bp, Artificial Sequence
  Synthetic oligonucleotide; CAG chr2 60549319 60549338 60549322 -
cctccccctccgctccccgg

SEQ ID NO: 172009 - DNA, 20 bp, Artificial Sequence
  Synthetic oligonucleotide; AAG chr2 60549280 60549299 60549283 -
tccttaccaacatttcctat

SEQ ID NO: 172010 - DNA, 20 bp, Artificial Sequence
  Synthetic oligonucleotide; AGG chr2 60549279 60549298 60549282 -
ccttaccaacatttcctata

SEQ ID NO: 172011 - DNA, 20 bp, Artificial Sequence
  Synthetic oligonucleotide; CAG chr2 60549237 60549256 60549240 -
tttattcttttgcaactaca

SEQ ID NO: 172012 - DNA, 20 bp, Artificial Sequence
  Synthetic oligonucleotide; GAG chr2 60549235 60549254 60549238 -
tattcttttgcaactacaca

SEQ ID NO: 172013 - DNA, 20 bp, Artificial Sequence
  Synthetic oligonucleotide; GAG chr2 60549233 60549252 60549236 -
ttcttttgcaactacacaga

SEQ ID NO: 172014 - DNA, 20 bp, Artificial Sequence
  Synthetic oligonucleotide; AGG chr2 60549232 60549251 60549235 -
tcttttgcaactacacagag

SEQ ID NO: 172015 - DNA, 20 bp, Artificial Sequence
  Synthetic oligonucleotide; AAG chr2 60549228 60549247 60549231 -
ttgcaactacacagagagga

SEQ ID NO: 172016 - DNA, 20 bp, Artificial Sequence
  Synthetic oligonucleotide; GAG chr2 60549226 60549245 60549229 -
gcaactacacagagaggaaa

SEQ ID NO: 172017 - DNA, 20 bp, Artificial Sequence
  Synthetic oligonucleotide; CAG chr2 60549219 60549238 60549222 -
cacagagaggaaagagatct

SEQ ID NO: 172018 - DNA, 20 bp, Artificial Sequence
  Synthetic oligonucleotide; GAG chr2 60549207 60549226 60549210 -
agagatctcagtctgtcact

SEQ ID NO: 172019 - DNA, 20 bp, Artificial Sequence
  Synthetic oligonucleotide; GAG chr2 60549199 60549218 60549202 -
cagtctgtcactgagacatt

SEQ ID NO: 172020 - DNA, 20 bp, Artificial Sequence
  Synthetic oligonucleotide; CAG chr2 60549190 60549209 60549193 -
actgagacattgagacgttc

SEQ ID NO: 172021 - DNA, 20 bp, Artificial Sequence
  Synthetic oligonucleotide; AGG chr2 60549189 60549208 60549192 -
ctgagacattgagacgttcc

SEQ ID NO: 172022 - DNA, 20 bp, Artificial Sequence
  Synthetic oligonucleotide; TAG chr2 60549167 60549186 60549170 -
gctgtcttgctgtttgaacg

SEQ ID NO: 172023 - DNA, 20 bp, Artificial Sequence
  Synthetic oligonucleotide; AAG chr2 60549164 60549183 60549167 -
gtcttgctgtttgaacgtag

SEQ ID NO: 172024 - DNA, 20 bp, Artificial Sequence
  Synthetic oligonucleotide; TAG chr2 60549131 60549150 60549134 -
tctatttcttcctcccctcg

SEQ ID NO: 172025 - DNA, 20 bp, Artificial Sequence
  Synthetic oligonucleotide; GAG chr2 60549129 60549148 60549132 -
tatttcttcctcccctcgta

SEQ ID NO: 172026 - DNA, 20 bp, Artificial Sequence
  Synthetic oligonucleotide; GAG chr2 60549127 60549146 60549130 -
tttcttcctcccctcgtaga

SEQ ID NO: 172027 - DNA, 20 bp, Artificial Sequence
  Synthetic oligonucleotide; CGG chr2 60549118 60549137 60549121 -
cccctcgtagagagaattcg

SEQ ID NO: 172028 - DNA, 20 bp, Artificial Sequence
  Synthetic oligonucleotide; GAG chr2 60549073 60549092 60549076 -
cactcccttccacttcaatc

SEQ ID NO: 172029 - DNA, 20 bp, Artificial Sequence
  Synthetic oligonucleotide; AGG chr2 60549072 60549091 60549075 -
actcccttccacttcaatcg

SEQ ID NO: 172030 - DNA, 20 bp, Artificial Sequence
  Synthetic oligonucleotide; TAG chr2 60549056 60549075 60549059 -
atcgaggactccctgctttg

SEQ ID NO: 172031 - DNA, 20 bp, Artificial Sequence
  Synthetic oligonucleotide; CGG chr2 60549052 60549071 60549055 -
aggactccctgctttgtagc

SEQ ID NO: 172032 - DNA, 20 bp, Artificial Sequence
  Synthetic oligonucleotide; GAG chr2 60549050 60549069 60549053 -
gactccctgctttgtagccg

SEQ ID NO: 172033 - DNA, 20 bp, Artificial Sequence
  Synthetic oligonucleotide; TAG chr2 60549045 60549064 60549048 -
cctgctttgtagccggagtt

SEQ ID NO: 172034 - DNA, 20 bp, Artificial Sequence
  Synthetic oligonucleotide; AGG chr2 60549044 60549063 60549047 -
ctgctttgtagccggagttt

SEQ ID NO: 172035 - DNA, 20 bp, Artificial Sequence
  Synthetic oligonucleotide; CGG chr2 60549040 60549059 60549043 -
tttgtagccggagtttaggc

SEQ ID NO: 172036 - DNA, 20 bp, Artificial Sequence
  Synthetic oligonucleotide; GAG chr2 60549038 60549057 60549041 -
tgtagccggagtttaggccg

SEQ ID NO: 172037 - DNA, 20 bp, Artificial Sequence
  Synthetic oligonucleotide; TAG chr2 60549033 60549052 60549036 -
ccggagtttaggccggagct

SEQ ID NO: 172038 - DNA, 20 bp, Artificial Sequence
  Synthetic oligonucleotide; TGG chr2 60549024 60549043 60549027 -
aggccggagcttagaaatgt

SEQ ID NO: 172039 - DNA, 20 bp, Artificial Sequence
  Synthetic oligonucleotide; TGG chr2 60549015 60549034 60549018 -
cttagaaatgttggtattgt

SEQ ID NO: 172040 - DNA, 20 bp, Artificial Sequence
  Synthetic oligonucleotide; GGG chr2 60549014 60549033 60549017 -
ttagaaatgttggtattgtt

SEQ ID NO: 172041 - DNA, 20 bp, Artificial Sequence
  Synthetic oligonucleotide; GGG chr2 60549013 60549032 60549016 -
tagaaatgttggtattgttg

SEQ ID NO: 172042 - DNA, 20 bp, Artificial Sequence
  Synthetic oligonucleotide; AAG chr2 60549008 60549027 60549011 -
atgttggtattgttggggcg

SEQ ID NO: 172043 - DNA, 20 bp, Artificial Sequence
  Synthetic oligonucleotide; AGG chr2 60549007 60549026 60549010 -
tgttggtattgttggggcga

SEQ ID NO: 172044 - DNA, 20 bp, Artificial Sequence
  Synthetic oligonucleotide; GAG chr2 60549005 60549024 60549008 -
ttggtattgttggggcgaag

SEQ ID NO: 172045 - DNA, 20 bp, Artificial Sequence
  Synthetic oligonucleotide; AGG chr2 60549004 60549023 60549007 -
tggtattgttggggcgaagg

SEQ ID NO: 172046 - DNA, 20 bp, Artificial Sequence
  Synthetic oligonucleotide; TGG chr2 60549000 60549019 60549003 -
attgttggggcgaaggagga

SEQ ID NO: 172047 - DNA, 20 bp, Artificial Sequence
  Synthetic oligonucleotide; GAG chr2 60548998 60549017 60549001 -
tgttggggcgaaggaggatg

SEQ ID NO: 172048 - DNA, 20 bp, Artificial Sequence
  Synthetic oligonucleotide; GAG chr2 60548988 60549007 60548991 -
aaggaggatggagttgaatt

SEQ ID NO: 172049 - DNA, 20 bp, Artificial Sequence
  Synthetic oligonucleotide; AGG chr2 60548987 60549006 60548990 -
aggaggatggagttgaattg

SEQ ID NO: 172050 - DNA, 20 bp, Artificial Sequence
  Synthetic oligonucleotide; GGG chr2 60548986 60549005 60548989 -
ggaggatggagttgaattga

SEQ ID NO: 172051 - DNA, 20 bp, Artificial Sequence
  Synthetic oligonucleotide; GAG chr2 60548984 60549003 60548987 -
aggatggagttgaattgagg

SEQ ID NO: 172052 - DNA, 20 bp, Artificial Sequence
  Synthetic oligonucleotide; AGG chr2 60548983 60549002 60548986 -
ggatggagttgaattgaggg

SEQ ID NO: 172053 - DNA, 20 bp, Artificial Sequence
  Synthetic oligonucleotide; GGG chr2 60548982 60549001 60548985 -
gatggagttgaattgaggga

SEQ ID NO: 172054 - DNA, 20 bp, Artificial Sequence
  Synthetic oligonucleotide; GGG chr2 60548981 60549000 60548984 -
atggagttgaattgagggag

SEQ ID NO: 172055 - DNA, 20 bp, Artificial Sequence
  Synthetic oligonucleotide; GGG chr2 60548980 60548999 60548983 -
tggagttgaattgagggagg

SEQ ID NO: 172056 - DNA, 20 bp, Artificial Sequence
  Synthetic oligonucleotide; TGG chr2 60548973 60548992 60548976 -
gaattgagggagggggtaaa

SEQ ID NO: 172057 - DNA, 20 bp, Artificial Sequence
  Synthetic oligonucleotide; GAG chr2 60548968 60548987 60548971 -
gagggagggggtaaatggct

SEQ ID NO: 172058 - DNA, 20 bp, Artificial Sequence
  Synthetic oligonucleotide; AGG chr2 60548967 60548986 60548970 -
agggagggggtaaatggctg

SEQ ID NO: 172059 - DNA, 20 bp, Artificial Sequence
  Synthetic oligonucleotide; GGG chr2 60548966 60548985 60548969 -
gggagggggtaaatggctga

SEQ ID NO: 172060 - DNA, 20 bp, Artificial Sequence
  Synthetic oligonucleotide; TAG chr2 60548962 60548981 60548965 -
gggggtaaatggctgagggt

SEQ ID NO: 172061 - DNA, 20 bp, Artificial Sequence
  Synthetic oligonucleotide; AGG chr2 60548961 60548980 60548964 -
ggggtaaatggctgagggtt

SEQ ID NO: 172062 - DNA, 20 bp, Artificial Sequence
  Synthetic oligonucleotide; AAG chr2 60548958 60548977 60548961 -
gtaaatggctgagggttagg

SEQ ID NO: 172063 - DNA, 20 bp, Artificial Sequence
  Synthetic oligonucleotide; AGG chr2 60548957 60548976 60548960 -
taaatggctgagggttagga

SEQ ID NO: 172064 - DNA, 20 bp, Artificial Sequence
  Synthetic oligonucleotide; TAG chr2 60548950 60548969 60548953 -
ctgagggttaggaaggtttt

SEQ ID NO: 172065 - DNA, 20 bp, Artificial Sequence
  Synthetic oligonucleotide; AGG chr2 60548949 60548968 60548952 -
tgagggttaggaaggttttt

SEQ ID NO: 172066 - DNA, 20 bp, Artificial Sequence
  Synthetic oligonucleotide; GGG chr2 60548948 60548967 60548951 -
gagggttaggaaggttttta

SEQ ID NO: 172067 - DNA, 20 bp, Artificial Sequence
  Synthetic oligonucleotide; AAG chr2 60548944 60548963 60548947 -
gttaggaaggtttttaggga

SEQ ID NO: 172068 - DNA, 20 bp, Artificial Sequence
  Synthetic oligonucleotide; AGG chr2 60548943 60548962 60548946 -
ttaggaaggtttttagggaa

SEQ ID NO: 172069 - DNA, 20 bp, Artificial Sequence
  Synthetic oligonucleotide; GGG chr2 60548942 60548961 60548945 -
taggaaggtttttagggaaa

SEQ ID NO: 172070 - DNA, 20 bp, Artificial Sequence
  Synthetic oligonucleotide; GGG chr2 60548941 60548960 60548944 -
aggaaggtttttagggaaag

SEQ ID NO: 172071 - DNA, 20 bp, Artificial Sequence
  Synthetic oligonucleotide; CAG chr2 60548922 60548941 60548925 -
ggggaatttgcattaaaatg

SEQ ID NO: 172072 - DNA, 20 bp, Artificial Sequence
  Synthetic oligonucleotide; GAG chr2 60548920 60548939 60548923 -
ggaatttgcattaaaatgca

SEQ ID NO: 172073 - DNA, 20 bp, Artificial Sequence
  Synthetic oligonucleotide; CAG chr2 60548910 60548929 60548913 -
ttaaaatgcagagaaattat

SEQ ID NO: 172074 - DNA, 20 bp, Artificial Sequence
  Synthetic oligonucleotide; CAG chr2 60548902 60548921 60548905 -
cagagaaattatcagatgcc

SEQ ID NO: 172075 - DNA, 20 bp, Artificial Sequence
  Synthetic oligonucleotide; AAG chr2 60548898 60548917 60548901 -
gaaattatcagatgcccaga

SEQ ID NO: 172076 - DNA, 20 bp, Artificial Sequence
  Synthetic oligonucleotide; AGG chr2 60548897 60548916 60548900 -
aaattatcagatgcccagaa

SEQ ID NO: 172077 - DNA, 20 bp, Artificial Sequence
  Synthetic oligonucleotide; GAG chr2 60548877 60548896 60548880 -
aggaaatgttgattgccact

SEQ ID NO: 172078 - DNA, 20 bp, Artificial Sequence
  Synthetic oligonucleotide; AAG chr2 60548872 60548891 60548875 -
atgttgattgccactgagaa

SEQ ID NO: 172079 - DNA, 20 bp, Artificial Sequence
  Synthetic oligonucleotide; CAG chr2 60548855 60548874 60548858 -
gaaaagatgtcaatgcaaat

SEQ ID NO: 172080 - DNA, 20 bp, Artificial Sequence
  Synthetic oligonucleotide; TAG chr2 60548852 60548871 60548855 -
aagatgtcaatgcaaatcag

SEQ ID NO: 172081 - DNA, 20 bp, Artificial Sequence
  Synthetic oligonucleotide; GAG chr2 60548839 60548858 60548842 -
aaatcagtagactacaccat

SEQ ID NO: 172082 - DNA, 20 bp, Artificial Sequence
  Synthetic oligonucleotide; CAG chr2 60548780 60548799 60548783 -
tctgatttttaataatatac

SEQ ID NO: 172083 - DNA, 20 bp, Artificial Sequence
  Synthetic oligonucleotide; TGG chr2 60548758 60548777 60548761 -
gcaatgataaaaacacgttt

SEQ ID NO: 172084 - DNA, 20 bp, Artificial Sequence
  Synthetic oligonucleotide; TAG chr2 60548737 60548756 60548740 -
ggtatttctctgaacaccac

SEQ ID NO: 172085 - DNA, 20 bp, Artificial Sequence
  Synthetic oligonucleotide; AAG chr2 60548721 60548740 60548724 -
ccactagccaaatgttttgc

SEQ ID NO: 172086 - DNA, 20 bp, Artificial Sequence
  Synthetic oligonucleotide; AGG chr2 60548720 60548739 60548723 -
cactagccaaatgttttgca

SEQ ID NO: 172087 - DNA, 20 bp, Artificial Sequence
  Synthetic oligonucleotide; GAG chr2 60548718 60548737 60548721 -
ctagccaaatgttttgcaag

SEQ ID NO: 172088 - DNA, 20 bp, Artificial Sequence
  Synthetic oligonucleotide; TAG chr2 60548689 60548708 60548692 -
gttaaacgtatttcatacat

SEQ ID NO: 172089 - DNA, 20 bp, Artificial Sequence
  Synthetic oligonucleotide; TAG chr2 60548668 60548687 60548671 -
agaatataattcttgttaat

SEQ ID NO: 172090 - DNA, 20 bp, Artificial Sequence
  Synthetic oligonucleotide; AAG chr2 60548651 60548670 60548654 -
aattagcaataatttacgtt

SEQ ID NO: 172091 - DNA, 20 bp, Artificial Sequence
  Synthetic oligonucleotide; GAG chr2 60548649 60548668 60548652 -
ttagcaataatttacgttaa

SEQ ID NO: 172092 - DNA, 20 bp, Artificial Sequence
  Synthetic oligonucleotide; TAG chr2 60548644 60548663 60548647 -
aataatttacgttaagagca

SEQ ID NO: 172093 - DNA, 20 bp, Artificial Sequence
  Synthetic oligonucleotide; GAG chr2 60548633 60548652 60548636 -
ttaagagcatagaaaatgtt

SEQ ID NO: 172094 - DNA, 20 bp, Artificial Sequence
  Synthetic oligonucleotide; AGG chr2 60548632 60548651 60548635 -
taagagcatagaaaatgttg

SEQ ID NO: 172095 - DNA, 20 bp, Artificial Sequence
  Synthetic oligonucleotide; CAG chr2 60548626 60548645 60548629 -
catagaaaatgttgaggtta

SEQ ID NO: 172096 - DNA, 20 bp, Artificial Sequence
  Synthetic oligonucleotide; AGG chr2 60548625 60548644 60548628 -
atagaaaatgttgaggttac

SEQ ID NO: 172097 - DNA, 20 bp, Artificial Sequence
  Synthetic oligonucleotide; AAG chr2 60548586 60548605 60548589 -
ttgatcatcttgttattttc

SEQ ID NO: 172098 - DNA, 20 bp, Artificial Sequence
  Synthetic oligonucleotide; TAG chr2 60548559 60548578 60548562 -
ttgcctcctataaaattaat

SEQ ID NO: 172099 - DNA, 20 bp, Artificial Sequence
  Synthetic oligonucleotide; AGG chr2 60548558 60548577 60548561 -
tgcctcctataaaattaatt

SEQ ID NO: 172100 - DNA, 20 bp, Artificial Sequence
  Synthetic oligonucleotide; TGG chr2 60548548 60548567 60548551 -
aaaattaattaggtgaaatg

SEQ ID NO: 172101 - DNA, 20 bp, Artificial Sequence
  Synthetic oligonucleotide; GAG chr2 60548546 60548565 60548549 -
aattaattaggtgaaatgtg

SEQ ID NO: 172102 - DNA, 20 bp, Artificial Sequence
  Synthetic oligonucleotide; AGG chr2 60548545 60548564 60548548 -
attaattaggtgaaatgtgg

SEQ ID NO: 172103 - DNA, 20 bp, Artificial Sequence
  Synthetic oligonucleotide; CAG chr2 60548536 60548555 60548539 -
gtgaaatgtggaggtgtaat

SEQ ID NO: 172104 - DNA, 20 bp, Artificial Sequence
  Synthetic oligonucleotide; CGG chr2 60548506 60548525 60548509 -
tgaattaccacttcatttcc

SEQ ID NO: 172105 - DNA, 20 bp, Artificial Sequence
  Synthetic oligonucleotide; CAG chr2 60548489 60548508 60548492 -
tcccggttttgattgtaaat

SEQ ID NO: 172106 - DNA, 20 bp, Artificial Sequence
  Synthetic oligonucleotide; CAG chr2 60548484 60548503 60548487 -
gttttgattgtaaatcagtt

SEQ ID NO: 172107 - DNA, 20 bp, Artificial Sequence
  Synthetic oligonucleotide; TAG chr2 60548471 60548490 60548474 -
atcagttcagtcactacatt

SEQ ID NO: 172108 - DNA, 20 bp, Artificial Sequence
  Synthetic oligonucleotide; AAG chr2 60548468 60548487 60548471 -
agttcagtcactacatttag

SEQ ID NO: 172109 - DNA, 20 bp, Artificial Sequence
  Synthetic oligonucleotide; AAG chr2 60548456 60548475 60548459 -
acatttagaagactttaacc

SEQ ID NO: 172110 - DNA, 20 bp, Artificial Sequence
  Synthetic oligonucleotide; TAG chr2 60548415 60548434 60548418 -
acctttaactatttgatacc

SEQ ID NO: 172111 - DNA, 20 bp, Artificial Sequence
  Synthetic oligonucleotide; AGG chr2 60548414 60548433 60548417 -
cctttaactatttgatacct

SEQ ID NO: 172112 - DNA, 20 bp, Artificial Sequence
  Synthetic oligonucleotide; GAG chr2 60548412 60548431 60548415 -
tttaactatttgatacctag

SEQ ID NO: 172113 - DNA, 20 bp, Artificial Sequence
  Synthetic oligonucleotide; TAG chr2 60548372 60548391 60548375 -
ctaaataatattcccacttt

SEQ ID NO: 172114 - DNA, 20 bp, Artificial Sequence
  Synthetic oligonucleotide; CAG chr2 60548361 60548380 60548364 -
tcccacttttagaaatgtgt

SEQ ID NO: 172115 - DNA, 20 bp, Artificial Sequence
  Synthetic oligonucleotide; TGG chr2 60548354 60548373 60548357 -
tttagaaatgtgtcagacct

SEQ ID NO: 172116 - DNA, 20 bp, Artificial Sequence
  Synthetic oligonucleotide; GGG chr2 60548353 60548372 60548356 -
ttagaaatgtgtcagacctt

SEQ ID NO: 172117 - DNA, 20 bp, Artificial Sequence
  Synthetic oligonucleotide; AAG chr2 60548333 60548352 60548336 -
gggaacaaaaaaaaaaaaaa

SEQ ID NO: 172118 - DNA, 20 bp, Artificial Sequence
  Synthetic oligonucleotide; CGG chr2 60548322 60548341 60548325 -
aaaaaaaaaaagaatcttaa

SEQ ID NO: 172119 - DNA, 20 bp, Artificial Sequence
  Synthetic oligonucleotide; TGG chr2 60548319 60548338 60548322 -
aaaaaaaagaatcttaacgg

SEQ ID NO: 172120 - DNA, 20 bp, Artificial Sequence
  Synthetic oligonucleotide; AAG chr2 60548292 60548311 60548295 -
aaaaaatttttttttttgca

SEQ ID NO: 172121 - DNA, 20 bp, Artificial Sequence
  Synthetic oligonucleotide; AGG chr2 60548291 60548310 60548294 -
aaaaatttttttttttgcaa

SEQ ID NO: 172122 - DNA, 20 bp, Artificial Sequence
  Synthetic oligonucleotide; TAG chr2 60548278 60548297 60548281 -
tttgcaaaggttctatgtac

SEQ ID NO: 172123 - DNA, 20 bp, Artificial Sequence
  Synthetic oligonucleotide; AAG chr2 60548274 60548293 60548277 -
caaaggttctatgtactagt

SEQ ID NO: 172124 - DNA, 20 bp, Artificial Sequence
  Synthetic oligonucleotide; AAG chr2 60548252 60548271 60548255 -
gtttgataaaatattttcct

SEQ ID NO: 172125 - DNA, 20 bp, Artificial Sequence
  Synthetic oligonucleotide; CAG chr2 60548241 60548260 60548244 -
tattttcctaagtcttcctt

SEQ ID NO: 172126 - DNA, 20 bp, Artificial Sequence
  Synthetic oligonucleotide; CAG chr2 60548227 60548246 60548230 -
ttccttcagtctgtaaacct

SEQ ID NO: 172127 - DNA, 20 bp, Artificial Sequence
  Synthetic oligonucleotide; TAG chr2 60548218 60548237 60548221 -
tctgtaaacctcagaacttg

SEQ ID NO: 172128 - DNA, 20 bp, Artificial Sequence
  Synthetic oligonucleotide; AAG chr2 60548199 60548218 60548202 -
gtagctaatgctaaacaaaa

SEQ ID NO: 172129 - DNA, 20 bp, Artificial Sequence
  Synthetic oligonucleotide; CAG chr2 60548161 60548180 60548164 -
tgtacttaaaatccttaatt

SEQ ID NO: 172130 - DNA, 20 bp, Artificial Sequence
  Synthetic oligonucleotide; CAG chr2 60548154 60548173 60548157 -
aaaatccttaattcagacaa

SEQ ID NO: 172131 - DNA, 20 bp, Artificial Sequence
  Synthetic oligonucleotide; AGG chr2 60548153 60548172 60548156 -
aaatccttaattcagacaac

SEQ ID NO: 172132 - DNA, 20 bp, Artificial Sequence
  Synthetic oligonucleotide; GAG chr2 60548142 60548161 60548145 -
tcagacaacaggaatatttt

SEQ ID NO: 172133 - DNA, 20 bp, Artificial Sequence
  Synthetic oligonucleotide; GAG chr2 60548136 60548155 60548139 -
aacaggaatattttgagaat

SEQ ID NO: 172134 - DNA, 20 bp, Artificial Sequence
  Synthetic oligonucleotide; TGG chr2 60548117 60548136 60548120 -
tgagttccctattcctcact

SEQ ID NO: 172135 - DNA, 20 bp, Artificial Sequence
  Synthetic oligonucleotide; TGG chr2 60548108 60548127 60548111 -
tattcctcacttggtcaaaa

SEQ ID NO: 172136 - DNA, 20 bp, Artificial Sequence
  Synthetic oligonucleotide; AAG chr2 60548105 60548124 60548108 -
tcctcacttggtcaaaatgg

SEQ ID NO: 172137 - DNA, 20 bp, Artificial Sequence
  Synthetic oligonucleotide; AAG chr2 60548095 60548114 60548098 -
gtcaaaatggaagcaaatgt

SEQ ID NO: 172138 - DNA, 20 bp, Artificial Sequence
  Synthetic oligonucleotide; GAG chr2 60548093 60548112 60548096 -
caaaatggaagcaaatgtaa

SEQ ID NO: 172139 - DNA, 20 bp, Artificial Sequence
  Synthetic oligonucleotide; AAG chr2 60548090 60548109 60548093 -
aatggaagcaaatgtaagag

SEQ ID NO: 172140 - DNA, 20 bp, Artificial Sequence
  Synthetic oligonucleotide; AAG chr2 60548078 60548097 60548081 -
tgtaagagaagaatgacatt

SEQ ID NO: 172141 - DNA, 20 bp, Artificial Sequence
  Synthetic oligonucleotide; AGG chr2 60548077 60548096 60548080 -
gtaagagaagaatgacatta

SEQ ID NO: 172142 - DNA, 20 bp, Artificial Sequence
  Synthetic oligonucleotide; CAG chr2 60548067 60548086 60548070 -
aatgacattaaggcacaatg

SEQ ID NO: 172143 - DNA, 20 bp, Artificial Sequence
  Synthetic oligonucleotide; GAG chr2 60548065 60548084 60548068 -
tgacattaaggcacaatgca

SEQ ID NO: 172144 - DNA, 20 bp, Artificial Sequence
  Synthetic oligonucleotide; AGG chr2 60548064 60548083 60548067 -
gacattaaggcacaatgcag

SEQ ID NO: 172145 - DNA, 20 bp, Artificial Sequence
  Synthetic oligonucleotide; AAG chr2 60548033 60548052 60548036 -
tttgtcttcttttatttgaa

SEQ ID NO: 172146 - DNA, 20 bp, Artificial Sequence
  Synthetic oligonucleotide; TGG chr2 60548002 60548021 60548005 -
tgtattctgtatttatcttt

SEQ ID NO: 172147 - DNA, 20 bp, Artificial Sequence
  Synthetic oligonucleotide; CAG chr2 60547998 60548017 60548001 -
ttctgtatttatcttttggc

SEQ ID NO: 172148 - DNA, 20 bp, Artificial Sequence
  Synthetic oligonucleotide; TGG chr2 60547990 60548009 60547993 -
ttatcttttggccagtatgt

SEQ ID NO: 172149 - DNA, 20 bp, Artificial Sequence
  Synthetic oligonucleotide; GGG chr2 60547989 60548008 60547992 -
tatcttttggccagtatgtt

SEQ ID NO: 172150 - DNA, 20 bp, Artificial Sequence
  Synthetic oligonucleotide; AAG chr2 60547984 60548003 60547987 -
tttggccagtatgttgggca

SEQ ID NO: 172151 - DNA, 20 bp, Artificial Sequence
  Synthetic oligonucleotide; AAG chr2 60547975 60547994 60547978 -
tatgttgggcaaagaaacat

SEQ ID NO: 172152 - DNA, 20 bp, Artificial Sequence
  Synthetic oligonucleotide; TAG chr2 60547951 60547970 60547954 -
gcttactttactgtctttat

SEQ ID NO: 172153 - DNA, 20 bp, Artificial Sequence
  Synthetic oligonucleotide; TAG chr2 60547948 60547967 60547951 -
tactttactgtctttattag

SEQ ID NO: 172154 - DNA, 20 bp, Artificial Sequence
  Synthetic oligonucleotide; AGG chr2 60547947 60547966 60547950 -
actttactgtctttattagt

SEQ ID NO: 172155 - DNA, 20 bp, Artificial Sequence
  Synthetic oligonucleotide; TGG chr2 60547923 60547942 60547926 -
atataaccttcatattcctg

SEQ ID NO: 172156 - DNA, 20 bp, Artificial Sequence
  Synthetic oligonucleotide; TAG chr2 60547904 60547923 60547907 -
gtggtgaccttatgttaaat

SEQ ID NO: 172157 - DNA, 20 bp, Artificial Sequence
  Synthetic oligonucleotide; AGG chr2 60547903 60547922 60547906 -
tggtgaccttatgttaaatt

SEQ ID NO: 172158 - DNA, 20 bp, Artificial Sequence
  Synthetic oligonucleotide; GAG chr2 60547901 60547920 60547904 -
gtgaccttatgttaaattag

SEQ ID NO: 172159 - DNA, 20 bp, Artificial Sequence
  Synthetic oligonucleotide; AGG chr2 60547900 60547919 60547903 -
tgaccttatgttaaattagg

SEQ ID NO: 172160 - DNA, 20 bp, Artificial Sequence
  Synthetic oligonucleotide; GAG chr2 60547898 60547917 60547901 -
accttatgttaaattaggag

SEQ ID NO: 172161 - DNA, 20 bp, Artificial Sequence
  Synthetic oligonucleotide; CAG chr2 60547892 60547911 60547895 -
tgttaaattaggaggagtac

SEQ ID NO: 172162 - DNA, 20 bp, Artificial Sequence
  Synthetic oligonucleotide; GAG chr2 60547890 60547909 60547893 -
ttaaattaggaggagtacca

SEQ ID NO: 172163 - DNA, 20 bp, Artificial Sequence
  Synthetic oligonucleotide; AGG chr2 60547889 60547908 60547892 -
taaattaggaggagtaccag

SEQ ID NO: 172164 - DNA, 20 bp, Artificial Sequence
  Synthetic oligonucleotide; TAG chr2 60547885 60547904 60547888 -
ttaggaggagtaccagaggc

SEQ ID NO: 172165 - DNA, 20 bp, Artificial Sequence
  Synthetic oligonucleotide; GAG chr2 60547875 60547894 60547878 -
taccagaggctagaaattat

SEQ ID NO: 172166 - DNA, 20 bp, Artificial Sequence
  Synthetic oligonucleotide; GAG chr2 60547861 60547880 60547864 -
aattatgagatgtcctactt

SEQ ID NO: 172167 - DNA, 20 bp, Artificial Sequence
  Synthetic oligonucleotide; CAG chr2 60547856 60547875 60547859 -
tgagatgtcctacttgagca

SEQ ID NO: 172168 - DNA, 20 bp, Artificial Sequence
  Synthetic oligonucleotide; AGG chr2 60547855 60547874 60547858 -
gagatgtcctacttgagcac

SEQ ID NO: 172169 - DNA, 20 bp, Artificial Sequence
  Synthetic oligonucleotide; CAG chr2 60547850 60547869 60547853 -
gtcctacttgagcacaggtg

SEQ ID NO: 172170 - DNA, 20 bp, Artificial Sequence
  Synthetic oligonucleotide; TAG chr2 60547846 60547865 60547849 -
tacttgagcacaggtgcagc

SEQ ID NO: 172171 - DNA, 20 bp, Artificial Sequence
  Synthetic oligonucleotide; AGG chr2 60547845 60547864 60547848 -
acttgagcacaggtgcagct

SEQ ID NO: 172172 - DNA, 20 bp, Artificial Sequence
  Synthetic oligonucleotide; CAG chr2 60547842 60547861 60547845 -
tgagcacaggtgcagctagg

SEQ ID NO: 172173 - DNA, 20 bp, Artificial Sequence
  Synthetic oligonucleotide; AGG chr2 60547841 60547860 60547844 -
gagcacaggtgcagctaggc

SEQ ID NO: 172174 - DNA, 20 bp, Artificial Sequence
  Synthetic oligonucleotide; GGG chr2 60547840 60547859 60547843 -
agcacaggtgcagctaggca

SEQ ID NO: 172175 - DNA, 20 bp, Artificial Sequence
  Synthetic oligonucleotide; TAG chr2 60547816 60547835 60547819 -
tctctcaatattatttcacc

SEQ ID NO: 172176 - DNA, 20 bp, Artificial Sequence
  Synthetic oligonucleotide; TGG chr2 60547807 60547826 60547810 -
attatttcacctagcacatc

SEQ ID NO: 172177 - DNA, 20 bp, Artificial Sequence
  Synthetic oligonucleotide; GGG chr2 60547806 60547825 60547809 -
ttatttcacctagcacatct

SEQ ID NO: 172178 - DNA, 20 bp, Artificial Sequence
  Synthetic oligonucleotide; GAG chr2 60547804 60547823 60547807 -
atttcacctagcacatctgg

SEQ ID NO: 172179 - DNA, 20 bp, Artificial Sequence
  Synthetic oligonucleotide; CAG chr2 60547795 60547814 60547798 -
agcacatctgggagttactc

SEQ ID NO: 172180 - DNA, 20 bp, Artificial Sequence
  Synthetic oligonucleotide; CAG chr2 60547774 60547793 60547777 -
agatcttccccctcaatatt

SEQ ID NO: 172181 - DNA, 20 bp, Artificial Sequence
  Synthetic oligonucleotide; TGG chr2 60547769 60547788 60547772 -
ttccccctcaatattcagcc

SEQ ID NO: 172182 - DNA, 20 bp, Artificial Sequence
  Synthetic oligonucleotide; GGG chr2 60547768 60547787 60547771 -
tccccctcaatattcagcct

SEQ ID NO: 172183 - DNA, 20 bp, Artificial Sequence
  Synthetic oligonucleotide; TAG chr2 60547765 60547784 60547768 -
ccctcaatattcagcctggg

SEQ ID NO: 172184 - DNA, 20 bp, Artificial Sequence
  Synthetic oligonucleotide; AGG chr2 60547764 60547783 60547767 -
cctcaatattcagcctgggt

SEQ ID NO: 172185 - DNA, 20 bp, Artificial Sequence
  Synthetic oligonucleotide; GGG chr2 60547763 60547782 60547766 -
ctcaatattcagcctgggta

SEQ ID NO: 172186 - DNA, 20 bp, Artificial Sequence
  Synthetic oligonucleotide; GAG chr2 60547742 60547761 60547745 -
ggttgaaataaatttaacct

SEQ ID NO: 172187 - DNA, 20 bp, Artificial Sequence
  Synthetic oligonucleotide; TGG chr2 60547734 60547753 60547737 -
taaatttaacctgagttcac

SEQ ID NO: 172188 - DNA, 20 bp, Artificial Sequence
  Synthetic oligonucleotide; TGG chr2 60547661 60547680 60547664 -
atctattttttgattctctg

SEQ ID NO: 172189 - DNA, 20 bp, Artificial Sequence
  Synthetic oligonucleotide; AAG chr2 60547654 60547673 60547657 -
ttttgattctctgtggcttt

SEQ ID NO: 172190 - DNA, 20 bp, Artificial Sequence
  Synthetic oligonucleotide; TGG chr2 60547634 60547653 60547637 -
aagttcattaaatgtaaaat

SEQ ID NO: 172191 - DNA, 20 bp, Artificial Sequence
  Synthetic oligonucleotide; CAG chr2 60547631 60547650 60547634 -
ttcattaaatgtaaaattgg

SEQ ID NO: 172192 - DNA, 20 bp, Artificial Sequence
  Synthetic oligonucleotide; AAG chr2 60547621 60547640 60547624 -
gtaaaattggcagcttgcta

SEQ ID NO: 172193 - DNA, 20 bp, Artificial Sequence
  Synthetic oligonucleotide; AAG chr2 60547618 60547637 60547621 -
aaattggcagcttgctaaag

SEQ ID NO: 172194 - DNA, 20 bp, Artificial Sequence
  Synthetic oligonucleotide; AGG chr2 60547617 60547636 60547620 -
aattggcagcttgctaaaga

SEQ ID NO: 172195 - DNA, 20 bp, Artificial Sequence
  Synthetic oligonucleotide; CAG chr2 60547613 60547632 60547616 -
ggcagcttgctaaagaaggt

SEQ ID NO: 172196 - DNA, 20 bp, Artificial Sequence
  Synthetic oligonucleotide; AAG chr2 60547595 60547614 60547598 -
gtcagactgattaactgttt

SEQ ID NO: 172197 - DNA, 20 bp, Artificial Sequence
  Synthetic oligonucleotide; CAG chr2 60547573 60547592 60547576 -
gacttgtacattttctgctt

SEQ ID NO: 172198 - DNA, 20 bp, Artificial Sequence
  Synthetic oligonucleotide; TGG chr2 60547560 60547579 60547563 -
tctgcttcagttttattaac

SEQ ID NO: 172199 - DNA, 20 bp, Artificial Sequence
  Synthetic oligonucleotide; CAG chr2 60547557 60547576 60547560 -
gcttcagttttattaactgg

SEQ ID NO: 172200 - DNA, 20 bp, Artificial Sequence
  Synthetic oligonucleotide; TGG chr2 60547549 60547568 60547552 -
tttattaactggcagcatcc

SEQ ID NO: 172201 - DNA, 20 bp, Artificial Sequence
  Synthetic oligonucleotide; TAG chr2 60547510 60547529 60547513 -
gattttttttttttttttga

SEQ ID NO: 172202 - DNA, 20 bp, Artificial Sequence
  Synthetic oligonucleotide; GAG chr2 60547508 60547527 60547511 -
ttttttttttttttttgata

SEQ ID NO: 172203 - DNA, 20 bp, Artificial Sequence
  Synthetic oligonucleotide; AAG chr2 60547504 60547523 60547507 -
ttttttttttttgatagagc

SEQ ID NO: 172204 - DNA, 20 bp, Artificial Sequence
  Synthetic oligonucleotide; AAG chr2 60547498 60547517 60547501 -
ttttttgatagagcaagcat

SEQ ID NO: 172205 - DNA, 20 bp, Artificial Sequence
  Synthetic oligonucleotide; AAG chr2 60547488 60547507 60547491 -
gagcaagcataagatttcac

SEQ ID NO: 172206 - DNA, 20 bp, Artificial Sequence
  Synthetic oligonucleotide; CAG chr2 60547485 60547504 60547488 -
caagcataagatttcacaag

SEQ ID NO: 172207 - DNA, 20 bp, Artificial Sequence
  Synthetic oligonucleotide; GAG chr2 60547483 60547502 60547486 -
agcataagatttcacaagca

SEQ ID NO: 172208 - DNA, 20 bp, Artificial Sequence
  Synthetic oligonucleotide; TGG chr2 60547456 60547475 60547459 -
accaactctcttttcccctt

SEQ ID NO: 172209 - DNA, 20 bp, Artificial Sequence
  Synthetic oligonucleotide; AAG chr2 60547453 60547472 60547456 -
aactctcttttcccctttgg

SEQ ID NO: 172210 - DNA, 20 bp, Artificial Sequence
  Synthetic oligonucleotide; TAG chr2 60547438 60547457 60547441 -
tttggaagcttaaaaaatga

SEQ ID NO: 172211 - DNA, 20 bp, Artificial Sequence
  Synthetic oligonucleotide; AAG chr2 60547435 60547454 60547438 -
ggaagcttaaaaaatgatag

SEQ ID NO: 172212 - DNA, 20 bp, Artificial Sequence
  Synthetic oligonucleotide; TGG chr2 60547431 60547450 60547434 -
gcttaaaaaatgatagaagc

SEQ ID NO: 172213 - DNA, 20 bp, Artificial Sequence
  Synthetic oligonucleotide; AAG chr2 60547426 60547445 60547429 -
aaaaatgatagaagctggta

SEQ ID NO: 172214 - DNA, 20 bp, Artificial Sequence
  Synthetic oligonucleotide; TAG chr2 60547423 60547442 60547426 -
aatgatagaagctggtaaag

SEQ ID NO: 172215 - DNA, 20 bp, Artificial Sequence
  Synthetic oligonucleotide; TGG chr2 60547416 60547435 60547419 -
gaagctggtaaagtagatgc

SEQ ID NO: 172216 - DNA, 20 bp, Artificial Sequence
  Synthetic oligonucleotide; GAG chr2 60547414 60547433 60547417 -
agctggtaaagtagatgctg

SEQ ID NO: 172217 - DNA, 20 bp, Artificial Sequence
  Synthetic oligonucleotide; TAG chr2 60547406 60547425 60547409 -
aagtagatgctggagtattt

SEQ ID NO: 172218 - DNA, 20 bp, Artificial Sequence
  Synthetic oligonucleotide; AAG chr2 60547399 60547418 60547402 -
tgctggagtattttagtaca

SEQ ID NO: 172219 - DNA, 20 bp, Artificial Sequence
  Synthetic oligonucleotide; AAG chr2 60547386 60547405 60547389 -
tagtacaaagttaaaaaaaa

SEQ ID NO: 172220 - DNA, 20 bp, Artificial Sequence
  Synthetic oligonucleotide; CAG chr2 60547379 60547398 60547382 -
aagttaaaaaaaaaagcaaa

SEQ ID NO: 172221 - DNA, 20 bp, Artificial Sequence
  Synthetic oligonucleotide; AGG chr2 60547378 60547397 60547381 -
agttaaaaaaaaaagcaaac

SEQ ID NO: 172222 - DNA, 20 bp, Artificial Sequence
  Synthetic oligonucleotide; AAG chr2 60547374 60547393 60547377 -
aaaaaaaaaagcaaacagga

SEQ ID NO: 172223 - DNA, 20 bp, Artificial Sequence
  Synthetic oligonucleotide; AAG chr2 60547370 60547389 60547373 -
aaaaaagcaaacaggaaaga

SEQ ID NO: 172224 - DNA, 20 bp, Artificial Sequence
  Synthetic oligonucleotide; TGG chr2 60547340 60547359 60547343 -
taccttgttataccatccgc

SEQ ID NO: 172225 - DNA, 20 bp, Artificial Sequence
  Synthetic oligonucleotide; CAG chr2 60547325 60547344 60547328 -
tccgctggtgattatgtgtg

SEQ ID NO: 172226 - DNA, 20 bp, Artificial Sequence
  Synthetic oligonucleotide; TAG chr2 60547319 60547338 60547322 -
ggtgattatgtgtgcagaaa

SEQ ID NO: 172227 - DNA, 20 bp, Artificial Sequence
  Synthetic oligonucleotide; AAG chr2 60547306 60547325 60547309 -
gcagaaatagtctcataatg

SEQ ID NO: 172228 - DNA, 20 bp, Artificial Sequence
  Synthetic oligonucleotide; TGG chr2 60547298 60547317 60547301 -
agtctcataatgaagcattt

SEQ ID NO: 172229 - DNA, 20 bp, Artificial Sequence
  Synthetic oligonucleotide; GAG chr2 60547296 60547315 60547299 -
tctcataatgaagcattttg

SEQ ID NO: 172230 - DNA, 20 bp, Artificial Sequence
  Synthetic oligonucleotide; CAG chr2 60547287 60547306 60547290 -
gaagcattttggagctcatt

SEQ ID NO: 172231 - DNA, 20 bp, Artificial Sequence
  Synthetic oligonucleotide; TAG chr2 60547279 60547298 60547282 -
ttggagctcattcagaaaat

SEQ ID NO: 172232 - DNA, 20 bp, Artificial Sequence
  Synthetic oligonucleotide; TAG chr2 60547260 60547279 60547263 -
ttagtccactttgacaacat

SEQ ID NO: 172233 - DNA, 20 bp, Artificial Sequence
  Synthetic oligonucleotide; AGG chr2 60547259 60547278 60547262 -
tagtccactttgacaacatt

SEQ ID NO: 172234 - DNA, 20 bp, Artificial Sequence
  Synthetic oligonucleotide; AAG chr2 60547254 60547273 60547257 -
cactttgacaacattaggcg

SEQ ID NO: 172235 - DNA, 20 bp, Artificial Sequence
  Synthetic oligonucleotide; AAG chr2 60547245 60547264 60547248 -
aacattaggcgaagtatttc

SEQ ID NO: 172236 - DNA, 20 bp, Artificial Sequence
  Synthetic oligonucleotide; AAG chr2 60547238 60547257 60547241 -
ggcgaagtatttcaagtcta

SEQ ID NO: 172237 - DNA, 20 bp, Artificial Sequence
  Synthetic oligonucleotide; AAG chr2 60547234 60547253 60547237 -
aagtatttcaagtctaaaga

SEQ ID NO: 172238 - DNA, 20 bp, Artificial Sequence
  Synthetic oligonucleotide; AGG chr2 60547233 60547252 60547236 -
agtatttcaagtctaaagaa

SEQ ID NO: 172239 - DNA, 20 bp, Artificial Sequence
  Synthetic oligonucleotide; CAG chr2 60547224 60547243 60547227 -
agtctaaagaaaggacttct

SEQ ID NO: 172240 - DNA, 20 bp, Artificial Sequence
  Synthetic oligonucleotide; TGG chr2 60547206 60547225 60547209 -
ctcagccttgctctgaaatg

SEQ ID NO: 172241 - DNA, 20 bp, Artificial Sequence
  Synthetic oligonucleotide; TAG chr2 60547172 60547191 60547175 -
ccattctgatttttatatca

SEQ ID NO: 172242 - DNA, 20 bp, Artificial Sequence
  Synthetic oligonucleotide; AAG chr2 60547161 60547180 60547164 -
tttatatcatagatgccacc

SEQ ID NO: 172243 - DNA, 20 bp, Artificial Sequence
  Synthetic oligonucleotide; TAG chr2 60547146 60547165 60547149 -
ccaccaagtgcaaacatgtt

SEQ ID NO: 172244 - DNA, 20 bp, Artificial Sequence
  Synthetic oligonucleotide; TAG chr2 60547136 60547155 60547139 -
caaacatgtttagaatatta

SEQ ID NO: 172245 - DNA, 20 bp, Artificial Sequence
  Synthetic oligonucleotide; AGG chr2 60547135 60547154 60547138 -
aaacatgtttagaatattat

SEQ ID NO: 172246 - DNA, 20 bp, Artificial Sequence
  Synthetic oligonucleotide; CAG chr2 60547120 60547139 60547123 -
attataggcattccatttct

SEQ ID NO: 172247 - DNA, 20 bp, Artificial Sequence
  Synthetic oligonucleotide; TGG chr2 60547096 60547115 60547099 -
ataaaaaaaaaatgactaat

SEQ ID NO: 172248 - DNA, 20 bp, Artificial Sequence
  Synthetic oligonucleotide; AAG chr2 60547082 60547101 60547085 -
actaattggcttattttctt

SEQ ID NO: 172249 - DNA, 20 bp, Artificial Sequence
  Synthetic oligonucleotide; AAG chr2 60547072 60547091 60547075 -
ttattttcttaagtactcaa

SEQ ID NO: 172250 - DNA, 20 bp, Artificial Sequence
  Synthetic oligonucleotide; TAG chr2 60547060 60547079 60547063 -
gtactcaaaagtatcccatt

SEQ ID NO: 172251 - DNA, 20 bp, Artificial Sequence
  Synthetic oligonucleotide; GAG chr2 60547046 60547065 60547049 -
cccatttagctaatgtgtct

SEQ ID NO: 172252 - DNA, 20 bp, Artificial Sequence
  Synthetic oligonucleotide; TGG chr2 60547025 60547044 60547028 -
agaaatactgcccgtgcatt

SEQ ID NO: 172253 - DNA, 20 bp, Artificial Sequence
  Synthetic oligonucleotide; TGG chr2 60547006 60547025 60547009 -
ttggtatttctttgattttg

SEQ ID NO: 172254 - DNA, 20 bp, Artificial Sequence
  Synthetic oligonucleotide; GAG chr2 60546996 60547015 60546999 -
tttgattttgtggcactgct

SEQ ID NO: 172255 - DNA, 20 bp, Artificial Sequence
  Synthetic oligonucleotide; GAG chr2 60546994 60547013 60546997 -
tgattttgtggcactgctga

SEQ ID NO: 172256 - DNA, 20 bp, Artificial Sequence
  Synthetic oligonucleotide; GAG chr2 60546990 60547009 60546993 -
tttgtggcactgctgagagt

SEQ ID NO: 172257 - DNA, 20 bp, Artificial Sequence
  Synthetic oligonucleotide; GAG chr2 60546988 60547007 60546991 -
tgtggcactgctgagagtga

SEQ ID NO: 172258 - DNA, 20 bp, Artificial Sequence
  Synthetic oligonucleotide; CAG chr2 60546985 60547004 60546988 -
ggcactgctgagagtgagag

SEQ ID NO: 172259 - DNA, 20 bp, Artificial Sequence
  Synthetic oligonucleotide; AAG chr2 60546981 60547000 60546984 -
ctgctgagagtgagagcaga

SEQ ID NO: 172260 - DNA, 20 bp, Artificial Sequence
  Synthetic oligonucleotide; AGG chr2 60546980 60546999 60546983 -
tgctgagagtgagagcagaa

SEQ ID NO: 172261 - DNA, 20 bp, Artificial Sequence
  Synthetic oligonucleotide; TGG chr2 60546973 60546992 60546976 -
agtgagagcagaaaggtttt

SEQ ID NO: 172262 - DNA, 20 bp, Artificial Sequence
  Synthetic oligonucleotide; CAG chr2 60546970 60546989 60546973 -
gagagcagaaaggtttttgg

SEQ ID NO: 172263 - DNA, 20 bp, Artificial Sequence
  Synthetic oligonucleotide; TAG chr2 60546937 60546956 60546940 -
gctgcgacatgattattatt

SEQ ID NO: 172264 - DNA, 20 bp, Artificial Sequence
  Synthetic oligonucleotide; TAG chr2 60546924 60546943 60546927 -
tattatttagatccgtttca

SEQ ID NO: 172265 - DNA, 20 bp, Artificial Sequence
  Synthetic oligonucleotide; AGG chr2 60546923 60546942 60546926 -
attatttagatccgtttcat

SEQ ID NO: 172266 - DNA, 20 bp, Artificial Sequence
  Synthetic oligonucleotide; CAG chr2 60546914 60546933 60546917 -
atccgtttcataggtgcatg

SEQ ID NO: 172267 - DNA, 20 bp, Artificial Sequence
  Synthetic oligonucleotide; CAG chr2 60546897 60546916 60546900 -
atgcagtcgttttcttatta

SEQ ID NO: 172268 - DNA, 20 bp, Artificial Sequence
  Synthetic oligonucleotide; CAG chr2 60546894 60546913 60546897 -
cagtcgttttcttattacag

SEQ ID NO: 172269 - DNA, 20 bp, Artificial Sequence
  Synthetic oligonucleotide; TGG chr2 60546883 60546902 60546886 -
ttattacagcagtgtaaatg

SEQ ID NO: 172270 - DNA, 20 bp, Artificial Sequence
  Synthetic oligonucleotide; TAG chr2 60546862 60546881 60546865 -
ggcacatttttcatgtgaca

SEQ ID NO: 172271 - DNA, 20 bp, Artificial Sequence
  Synthetic oligonucleotide; TAG chr2 60546859 60546878 60546862 -
acatttttcatgtgacatag

SEQ ID NO: 172272 - DNA, 20 bp, Artificial Sequence
  Synthetic oligonucleotide; AAG chr2 60546842 60546861 60546845 -
tagtagctttctaatttatg

SEQ ID NO: 172273 - DNA, 20 bp, Artificial Sequence
  Synthetic oligonucleotide; TAG chr2 60546824 60546843 60546827 -
tgaagccatgtctgtttact

SEQ ID NO: 172274 - DNA, 20 bp, Artificial Sequence
  Synthetic oligonucleotide; AGG chr2 60546823 60546842 60546826 -
gaagccatgtctgtttactt

SEQ ID NO: 172275 - DNA, 20 bp, Artificial Sequence
  Synthetic oligonucleotide; GAG chr2 60546821 60546840 60546824 -
agccatgtctgtttacttag

SEQ ID NO: 172276 - DNA, 20 bp, Artificial Sequence
  Synthetic oligonucleotide; AAG chr2 60546800 60546819 60546803 -
agtatatacattcacacaca

SEQ ID NO: 172277 - DNA, 20 bp, Artificial Sequence
  Synthetic oligonucleotide; AGG chr2 60546799 60546818 60546802 -
gtatatacattcacacacaa

SEQ ID NO: 172278 - DNA, 20 bp, Artificial Sequence
  Synthetic oligonucleotide; GGG chr2 60546798 60546817 60546801 -
tatatacattcacacacaaa

SEQ ID NO: 172279 - DNA, 20 bp, Artificial Sequence
  Synthetic oligonucleotide; TGG chr2 60546762 60546781 60546765 -
tcacctctcctttcattctt

SEQ ID NO: 172280 - DNA, 20 bp, Artificial Sequence
  Synthetic oligonucleotide; TGG chr2 60546754 60546773 60546757 -
cctttcattctttggcacaa

SEQ ID NO: 172281 - DNA, 20 bp, Artificial Sequence
  Synthetic oligonucleotide; TGG chr2 60546745 60546764 60546748 -
ctttggcacaatggacaact

SEQ ID NO: 172282 - DNA, 20 bp, Artificial Sequence
  Synthetic oligonucleotide; TAG chr2 60546738 60546757 60546741 -
acaatggacaacttggtgta

SEQ ID NO: 172283 - DNA, 20 bp, Artificial Sequence
  Synthetic oligonucleotide; AGG chr2 60546737 60546756 60546740 -
caatggacaacttggtgtat

SEQ ID NO: 172284 - DNA, 20 bp, Artificial Sequence
  Synthetic oligonucleotide; AAG chr2 60546730 60546749 60546733 -
caacttggtgtataggaaaa

SEQ ID NO: 172285 - DNA, 20 bp, Artificial Sequence
  Synthetic oligonucleotide; TGG chr2 60546718 60546737 60546721 -
taggaaaaaagaaacaaatt

SEQ ID NO: 172286 - DNA, 20 bp, Artificial Sequence
  Synthetic oligonucleotide; CAG chr2 60546691 60546710 60546694 -
tatccacttttttttttaac

SEQ ID NO: 172287 - DNA, 20 bp, Artificial Sequence
  Synthetic oligonucleotide; TAG chr2 60546679 60546698 60546682 -
tttttaaccagtttttcttg

SEQ ID NO: 172288 - DNA, 20 bp, Artificial Sequence
  Synthetic oligonucleotide; AAG chr2 60546667 60546686 60546670 -
ttttcttgtagttattattt

SEQ ID NO: 172289 - DNA, 20 bp, Artificial Sequence
  Synthetic oligonucleotide; AAG chr2 60546634 60546653 60546637 -
gttccctgtgttaactattt

SEQ ID NO: 172290 - DNA, 20 bp, Artificial Sequence
  Synthetic oligonucleotide; TAG chr2 60546631 60546650 60546634 -
ccctgtgttaactatttaag

SEQ ID NO: 172291 - DNA, 20 bp, Artificial Sequence
  Synthetic oligonucleotide; CAG chr2 60546606 60546625 60546609 -
ttctttctaaacttacaaac

SEQ ID NO: 172292 - DNA, 20 bp, Artificial Sequence
  Synthetic oligonucleotide; TGG chr2 60546588 60546607 60546591 -
accagacacatttgttgctg

SEQ ID NO: 172293 - DNA, 20 bp, Artificial Sequence
  Synthetic oligonucleotide; GGG chr2 60546587 60546606 60546590 -
ccagacacatttgttgctgt

SEQ ID NO: 172294 - DNA, 20 bp, Artificial Sequence
  Synthetic oligonucleotide; TGG chr2 60546576 60546595 60546579 -
tgttgctgtgggtgtgtgca

SEQ ID NO: 172295 - DNA, 20 bp, Artificial Sequence
  Synthetic oligonucleotide; GGG chr2 60546575 60546594 60546578 -
gttgctgtgggtgtgtgcat

SEQ ID NO: 172296 - DNA, 20 bp, Artificial Sequence
  Synthetic oligonucleotide; TGG chr2 60546549 60546568 60546552 -
atgtgtgtgtgtgtgttctc

SEQ ID NO: 172297 - DNA, 20 bp, Artificial Sequence
  Synthetic oligonucleotide; GAG chr2 60546547 60546566 60546550 -
gtgtgtgtgtgtgttctctg

SEQ ID NO: 172298 - DNA, 20 bp, Artificial Sequence
  Synthetic oligonucleotide; AAG chr2 60546538 60546557 60546541 -
tgtgttctctggagttatgc

SEQ ID NO: 172299 - DNA, 20 bp, Artificial Sequence
  Synthetic oligonucleotide; AGG chr2 60546537 60546556 60546540 -
gtgttctctggagttatgca

SEQ ID NO: 172300 - DNA, 20 bp, Artificial Sequence
  Synthetic oligonucleotide; AAG chr2 60546534 60546553 60546537 -
ttctctggagttatgcaagg

SEQ ID NO: 172301 - DNA, 20 bp, Artificial Sequence
  Synthetic oligonucleotide; TGG chr2 60546480 60546499 60546483 -
tcattgacaaatttgctctc

SEQ ID NO: 172302 - DNA, 20 bp, Artificial Sequence
  Synthetic oligonucleotide; TGG chr2 60546432 60546451 60546435 -
ttttgtatgctcacattttc

SEQ ID NO: 172303 - DNA, 20 bp, Artificial Sequence
  Synthetic oligonucleotide; GGG chr2 60546431 60546450 60546434 -
tttgtatgctcacattttct

SEQ ID NO: 172304 - DNA, 20 bp, Artificial Sequence
  Synthetic oligonucleotide; TAG chr2 60546421 60546440 60546424 -
cacattttctgggtattata

SEQ ID NO: 172305 - DNA, 20 bp, Artificial Sequence
  Synthetic oligonucleotide; GAG chr2 60546419 60546438 60546422 -
cattttctgggtattatata

SEQ ID NO: 172306 - DNA, 20 bp, Artificial Sequence
  Synthetic oligonucleotide; AAG chr2 60546416 60546435 60546419 -
tttctgggtattatatagag

SEQ ID NO: 172307 - DNA, 20 bp, Artificial Sequence
  Synthetic oligonucleotide; TAG chr2 60546411 60546430 60546414 -
gggtattatatagagaagcc

SEQ ID NO: 172308 - DNA, 20 bp, Artificial Sequence
  Synthetic oligonucleotide; TGG chr2 60546391 60546410 60546394 -
tagaaacactttacatgatg

SEQ ID NO: 172309 - DNA, 20 bp, Artificial Sequence
  Synthetic oligonucleotide; TGG chr2 60546388 60546407 60546391 -
aaacactttacatgatgtgg

SEQ ID NO: 172310 - DNA, 20 bp, Artificial Sequence
  Synthetic oligonucleotide; GGG chr2 60546387 60546406 60546390 -
aacactttacatgatgtggt

SEQ ID NO: 172311 - DNA, 20 bp, Artificial Sequence
  Synthetic oligonucleotide; TGG chr2 60546383 60546402 60546386 -
ctttacatgatgtggtggga

SEQ ID NO: 172312 - DNA, 20 bp, Artificial Sequence
  Synthetic oligonucleotide; TGG chr2 60546378 60546397 60546381 -
catgatgtggtgggatggca

SEQ ID NO: 172313 - DNA, 20 bp, Artificial Sequence
  Synthetic oligonucleotide; GGG chr2 60546377 60546396 60546380 -
atgatgtggtgggatggcat

SEQ ID NO: 172314 - DNA, 20 bp, Artificial Sequence
  Synthetic oligonucleotide; GGG chr2 60546376 60546395 60546379 -
tgatgtggtgggatggcatg

SEQ ID NO: 172315 - DNA, 20 bp, Artificial Sequence
  Synthetic oligonucleotide; GAG chr2 60546371 60546390 60546374 -
tggtgggatggcatggggtt

SEQ ID NO: 172316 - DNA, 20 bp, Artificial Sequence
  Synthetic oligonucleotide; TGG chr2 60546341 60546360 60546344 -
tctcccctttctgtcctctc

SEQ ID NO: 172317 - DNA, 20 bp, Artificial Sequence
  Synthetic oligonucleotide; CAG chr2 60546304 60546323 60546307 -
tgcttttgtttctccaacca

SEQ ID NO: 172318 - DNA, 20 bp, Artificial Sequence
  Synthetic oligonucleotide; GAG chr2 60546299 60546318 60546302 -
ttgtttctccaaccacagcc

SEQ ID NO: 172319 - DNA, 20 bp, Artificial Sequence
  Synthetic oligonucleotide; AAG chr2 60546289 60546308 60546292 -
aaccacagccgagcctcttg

SEQ ID NO: 172320 - DNA, 20 bp, Artificial Sequence
  Synthetic oligonucleotide; CAG chr2 60546277 60546296 60546280 -
gcctcttgaagccattctta

SEQ ID NO: 172321 - DNA, 20 bp, Artificial Sequence
  Synthetic oligonucleotide; CAG chr2 60546265 60546284 60546268 -
cattcttacagatgatgaac

SEQ ID NO: 172322 - DNA, 20 bp, Artificial Sequence
  Synthetic oligonucleotide; CGG chr2 60546258 60546277 60546261 -
acagatgatgaaccagacca

SEQ ID NO: 172323 - DNA, 20 bp, Artificial Sequence
  Synthetic oligonucleotide; TGG chr2 60546250 60546269 60546253 -
tgaaccagaccacggcccgt

SEQ ID NO: 172324 - DNA, 20 bp, Artificial Sequence
  Synthetic oligonucleotide; GGG chr2 60546249 60546268 60546252 -
gaaccagaccacggcccgtt

SEQ ID NO: 172325 - DNA, 20 bp, Artificial Sequence
  Synthetic oligonucleotide; GAG chr2 60546247 60546266 60546250 -
accagaccacggcccgttgg

SEQ ID NO: 172326 - DNA, 20 bp, Artificial Sequence
  Synthetic oligonucleotide; CAG chr2 60546241 60546260 60546244 -
ccacggcccgttgggagctc

SEQ ID NO: 172327 - DNA, 20 bp, Artificial Sequence
  Synthetic oligonucleotide; AAG chr2 60546238 60546257 60546241 -
cggcccgttgggagctccag

SEQ ID NO: 172328 - DNA, 20 bp, Artificial Sequence
  Synthetic oligonucleotide; AGG chr2 60546237 60546256 60546240 -
ggcccgttgggagctccaga

SEQ ID NO: 172329 - DNA, 20 bp, Artificial Sequence
  Synthetic oligonucleotide; GGG chr2 60546236 60546255 60546239 -
gcccgttgggagctccagaa

SEQ ID NO: 172330 - DNA, 20 bp, Artificial Sequence
  Synthetic oligonucleotide; GGG chr2 60546235 60546254 60546238 -
cccgttgggagctccagaag

SEQ ID NO: 172331 - DNA, 20 bp, Artificial Sequence
  Synthetic oligonucleotide; TGG chr2 60546213 60546232 60546216 -
gatcatgacctcctcacctg

SEQ ID NO: 172332 - DNA, 20 bp, Artificial Sequence
  Synthetic oligonucleotide; GGG chr2 60546212 60546231 60546215 -
atcatgacctcctcacctgt

SEQ ID NO: 172333 - DNA, 20 bp, Artificial Sequence
  Synthetic oligonucleotide; CAG chr2 60546209 60546228 60546212 -
atgacctcctcacctgtggg

SEQ ID NO: 172334 - DNA, 20 bp, Artificial Sequence
  Synthetic oligonucleotide; CAG chr2 60546203 60546222 60546206 -
tcctcacctgtgggcagtgc

SEQ ID NO: 172335 - DNA, 20 bp, Artificial Sequence
  Synthetic oligonucleotide; TGG chr2 60546187 60546206 60546190 -
gtgccagatgaacttcccat

SEQ ID NO: 172336 - DNA, 20 bp, Artificial Sequence
  Synthetic oligonucleotide; GGG chr2 60546186 60546205 60546189 -
tgccagatgaacttcccatt

SEQ ID NO: 172337 - DNA, 20 bp, Artificial Sequence
  Synthetic oligonucleotide; GGG chr2 60546185 60546204 60546188 -
gccagatgaacttcccattg

SEQ ID NO: 172338 - DNA, 20 bp, Artificial Sequence
  Synthetic oligonucleotide; GGG chr2 60546184 60546203 60546187 -
ccagatgaacttcccattgg

SEQ ID NO: 172339 - DNA, 20 bp, Artificial Sequence
  Synthetic oligonucleotide; GAG chr2 60546164 60546183 60546167 -
gggacattcttatttttatc

SEQ ID NO: 172340 - DNA, 20 bp, Artificial Sequence
  Synthetic oligonucleotide; CGG chr2 60546155 60546174 60546158 -
ttatttttatcgagcacaaa

SEQ ID NO: 172341 - DNA, 20 bp, Artificial Sequence
  Synthetic oligonucleotide; TGG chr2 60546141 60546160 60546144 -
cacaaacggaaacaatgcaa

SEQ ID NO: 172342 - DNA, 20 bp, Artificial Sequence
  Synthetic oligonucleotide; CAG chr2 60546138 60546157 60546141 -
aaacggaaacaatgcaatgg

SEQ ID NO: 172343 - DNA, 20 bp, Artificial Sequence
  Synthetic oligonucleotide; TAG chr2 60546127 60546146 60546130 -
atgcaatggcagcctctgct

SEQ ID NO: 172344 - DNA, 20 bp, Artificial Sequence
  Synthetic oligonucleotide; AAG chr2 60546121 60546140 60546124 -
tggcagcctctgcttagaaa

SEQ ID NO: 172345 - DNA, 20 bp, Artificial Sequence
  Synthetic oligonucleotide; TGG chr2 60546115 60546134 60546118 -
cctctgcttagaaaaagctg

SEQ ID NO: 172346 - DNA, 20 bp, Artificial Sequence
  Synthetic oligonucleotide; AAG chr2 60546110 60546129 60546113 -
gcttagaaaaagctgtggat

SEQ ID NO: 172347 - DNA, 20 bp, Artificial Sequence
  Synthetic oligonucleotide; GAG chr2 60546086 60546105 60546089 -
caccttccccttcaccaatc

SEQ ID NO: 172348 - DNA, 20 bp, Artificial Sequence
  Synthetic oligonucleotide; AAG chr2 60546076 60546095 60546079 -
ttcaccaatcgagatgaaaa

SEQ ID NO: 172349 - DNA, 20 bp, Artificial Sequence
  Synthetic oligonucleotide; TGG chr2 60546061 60546080 60546064 -
gaaaaaagcatccaatcccg

SEQ ID NO: 172350 - DNA, 20 bp, Artificial Sequence
  Synthetic oligonucleotide; GAG chr2 60546059 60546078 60546062 -
aaaaagcatccaatcccgtg

SEQ ID NO: 172351 - DNA, 20 bp, Artificial Sequence
  Synthetic oligonucleotide; AGG chr2 60546058 60546077 60546061 -
aaaagcatccaatcccgtgg

SEQ ID NO: 172352 - DNA, 20 bp, Artificial Sequence
  Synthetic oligonucleotide; TGG chr2 60546054 60546073 60546057 -
gcatccaatcccgtggaggt

SEQ ID NO: 172353 - DNA, 20 bp, Artificial Sequence
  Synthetic oligonucleotide; CAG chr2 60546047 60546066 60546050 -
atcccgtggaggttggcatc

SEQ ID NO: 172354 - DNA, 20 bp, Artificial Sequence
  Synthetic oligonucleotide; AGG chr2 60546046 60546065 60546049 -
tcccgtggaggttggcatcc

SEQ ID NO: 172355 - DNA, 20 bp, Artificial Sequence
  Synthetic oligonucleotide; CAG chr2 60546037 60546056 60546040 -
ggttggcatccaggtcacgc

SEQ ID NO: 172356 - DNA, 20 bp, Artificial Sequence
  Synthetic oligonucleotide; GAG chr2 60546035 60546054 60546038 -
ttggcatccaggtcacgcca

SEQ ID NO: 172357 - DNA, 20 bp, Artificial Sequence
  Synthetic oligonucleotide; AGG chr2 60546034 60546053 60546037 -
tggcatccaggtcacgccag

SEQ ID NO: 172358 - DNA, 20 bp, Artificial Sequence
  Synthetic oligonucleotide; TAG chr2 60546006 60546025 60546009 -
gattgtttatcaacgtcatc

SEQ ID NO: 172359 - DNA, 20 bp, Artificial Sequence
  Synthetic oligonucleotide; GAG chr2 60546004 60546023 60546007 -
ttgtttatcaacgtcatcta

SEQ ID NO: 172360 - DNA, 20 bp, Artificial Sequence
  Synthetic oligonucleotide; AGG chr2 60546003 60546022 60546006 -
tgtttatcaacgtcatctag

SEQ ID NO: 172361 - DNA, 20 bp, Artificial Sequence
  Synthetic oligonucleotide; CAG chr2 60545987 60546006 60545990 -
ctagaggaatttgccccaaa

SEQ ID NO: 172362 - DNA, 20 bp, Artificial Sequence
  Synthetic oligonucleotide; AGG chr2 60545986 60546005 60545989 -
tagaggaatttgccccaaac

SEQ ID NO: 172363 - DNA, 20 bp, Artificial Sequence
  Synthetic oligonucleotide; TAG chr2 60545977 60545996 60545980 -
ttgccccaaacaggaacaca

SEQ ID NO: 172364 - DNA, 20 bp, Artificial Sequence
  Synthetic oligonucleotide; CAG chr2 60545974 60545993 60545977 -
ccccaaacaggaacacatag

SEQ ID NO: 172365 - DNA, 20 bp, Artificial Sequence
  Synthetic oligonucleotide; AGG chr2 60545973 60545992 60545976 -
cccaaacaggaacacatagc

SEQ ID NO: 172366 - DNA, 20 bp, Artificial Sequence
  Synthetic oligonucleotide; GAG chr2 60545965 60545984 60545968 -
ggaacacatagcaggtaaat

SEQ ID NO: 172367 - DNA, 20 bp, Artificial Sequence
  Synthetic oligonucleotide; AAG chr2 60545962 60545981 60545965 -
acacatagcaggtaaatgag

SEQ ID NO: 172368 - DNA, 20 bp, Artificial Sequence
  Synthetic oligonucleotide; AAG chr2 60545958 60545977 60545961 -
atagcaggtaaatgagaagc

SEQ ID NO: 172369 - DNA, 20 bp, Artificial Sequence
  Synthetic oligonucleotide; AGG chr2 60545957 60545976 60545960 -
tagcaggtaaatgagaagca

SEQ ID NO: 172370 - DNA, 20 bp, Artificial Sequence
  Synthetic oligonucleotide; GAG chr2 60545955 60545974 60545958 -
gcaggtaaatgagaagcaag

SEQ ID NO: 172371 - DNA, 20 bp, Artificial Sequence
  Synthetic oligonucleotide; AAG chr2 60545950 60545969 60545953 -
taaatgagaagcaaggagaa

SEQ ID NO: 172372 - DNA, 20 bp, Artificial Sequence
  Synthetic oligonucleotide; CAG chr2 60545921 60545940 60545924 -
gcatgttttcttttcatttt

SEQ ID NO: 172373 - DNA, 20 bp, Artificial Sequence
  Synthetic oligonucleotide; GAG chr2 60545919 60545938 60545922 -
atgttttcttttcattttca

SEQ ID NO: 172374 - DNA, 20 bp, Artificial Sequence
  Synthetic oligonucleotide; AGG chr2 60545918 60545937 60545921 -
tgttttcttttcattttcag

SEQ ID NO: 172375 - DNA, 20 bp, Artificial Sequence
  Synthetic oligonucleotide; TAG chr2 60545910 60545929 60545913 -
tttcattttcagaggtgctg

SEQ ID NO: 172376 - DNA, 20 bp, Artificial Sequence
  Synthetic oligonucleotide; AAG chr2 60545905 60545924 60545908 -
ttttcagaggtgctgtagcc

SEQ ID NO: 172377 - DNA, 20 bp, Artificial Sequence
  Synthetic oligonucleotide; CAG chr2 60545902 60545921 60545905 -
tcagaggtgctgtagccaag

SEQ ID NO: 172378 - DNA, 20 bp, Artificial Sequence
  Synthetic oligonucleotide; AAG chr2 60545898 60545917 60545901 -
aggtgctgtagccaagcagt

SEQ ID NO: 172379 - DNA, 20 bp, Artificial Sequence
  Synthetic oligonucleotide; AGG chr2 60545897 60545916 60545900 -
ggtgctgtagccaagcagta

SEQ ID NO: 172380 - DNA, 20 bp, Artificial Sequence
  Synthetic oligonucleotide; GAG chr2 60545895 60545914 60545898 -
tgctgtagccaagcagtaag

SEQ ID NO: 172381 - DNA, 20 bp, Artificial Sequence
  Synthetic oligonucleotide; AAG chr2 60545887 60545906 60545890 -
ccaagcagtaaggagttgtg

SEQ ID NO: 172382 - DNA, 20 bp, Artificial Sequence
  Synthetic oligonucleotide; CAG chr2 60545850 60545869 60545853 -
ctctatgtgactgtccatga

SEQ ID NO: 172383 - DNA, 20 bp, Artificial Sequence
  Synthetic oligonucleotide; CAG chr2 60545808 60545827 60545811 -
tcatttctgttgcttacgtc

SEQ ID NO: 172384 - DNA, 20 bp, Artificial Sequence
  Synthetic oligonucleotide; CAG chr2 60545801 60545820 60545804 -
tgttgcttacgtccagaaca

SEQ ID NO: 172385 - DNA, 20 bp, Artificial Sequence
  Synthetic oligonucleotide; CAG chr2 60545769 60545788 60545772 -
tattttccacctcactgaat

SEQ ID NO: 172386 - DNA, 20 bp, Artificial Sequence
  Synthetic oligonucleotide; TAG chr2 60545763 60545782 60545766 -
ccacctcactgaatcagatg

SEQ ID NO: 172387 - DNA, 20 bp, Artificial Sequence
  Synthetic oligonucleotide; AGG chr2 60545762 60545781 60545765 -
cacctcactgaatcagatgt

SEQ ID NO: 172388 - DNA, 20 bp, Artificial Sequence
  Synthetic oligonucleotide; CAG chr2 60545759 60545778 60545762 -
ctcactgaatcagatgtagg

SEQ ID NO: 172389 - DNA, 20 bp, Artificial Sequence
  Synthetic oligonucleotide; AGG chr2 60545758 60545777 60545761 -
tcactgaatcagatgtaggc

SEQ ID NO: 172390 - DNA, 20 bp, Artificial Sequence
  Synthetic oligonucleotide; TAG chr2 60545754 60545773 60545757 -
tgaatcagatgtaggcagga

SEQ ID NO: 172391 - DNA, 20 bp, Artificial Sequence
  Synthetic oligonucleotide; AGG chr2 60545753 60545772 60545756 -
gaatcagatgtaggcaggat

SEQ ID NO: 172392 - DNA, 20 bp, Artificial Sequence
  Synthetic oligonucleotide; CAG chr2 60545741 60545760 60545744 -
ggcaggataggtacacacat

SEQ ID NO: 172393 - DNA, 20 bp, Artificial Sequence
  Synthetic oligonucleotide; TGG chr2 60545726 60545745 60545729 -
cacatcagacaccttctctc

SEQ ID NO: 172394 - DNA, 20 bp, Artificial Sequence
  Synthetic oligonucleotide; TGG chr2 60545711 60545730 60545714 -
ctctctggatctgtcgattt

SEQ ID NO: 172395 - DNA, 20 bp, Artificial Sequence
  Synthetic oligonucleotide; AAG chr2 60545672 60545691 60545675 -
atccccaccttctcattttg

SEQ ID NO: 172396 - DNA, 20 bp, Artificial Sequence
  Synthetic oligonucleotide; GAG chr2 60545665 60545684 60545668 -
ccttctcattttgaagtatt

SEQ ID NO: 172397 - DNA, 20 bp, Artificial Sequence
  Synthetic oligonucleotide; TAG chr2 60545650 60545669 60545653 -
gtattgagctttactacacc

SEQ ID NO: 172398 - DNA, 20 bp, Artificial Sequence
  Synthetic oligonucleotide; CAG chr2 60545645 60545664 60545648 -
gagctttactacacctagtc

SEQ ID NO: 172399 - DNA, 20 bp, Artificial Sequence
  Synthetic oligonucleotide; CAG chr2 60545625 60545644 60545628 -
cagcttccattgtccatttc

SEQ ID NO: 172400 - DNA, 20 bp, Artificial Sequence
  Synthetic oligonucleotide; TGG chr2 60545619 60545638 60545622 -
ccattgtccatttccagcct

SEQ ID NO: 172401 - DNA, 20 bp, Artificial Sequence
  Synthetic oligonucleotide; CAG chr2 60545608 60545627 60545611 -
ttccagccttggtgacgtgt

SEQ ID NO: 172402 - DNA, 20 bp, Artificial Sequence
  Synthetic oligonucleotide; GAG chr2 60545606 60545625 60545609 -
ccagccttggtgacgtgtca

SEQ ID NO: 172403 - DNA, 20 bp, Artificial Sequence
  Synthetic oligonucleotide; AGG chr2 60545605 60545624 60545608 -
cagccttggtgacgtgtcag

SEQ ID NO: 172404 - DNA, 20 bp, Artificial Sequence
  Synthetic oligonucleotide; AAG chr2 60545600 60545619 60545603 -
ttggtgacgtgtcagaggca

SEQ ID NO: 172405 - DNA, 20 bp, Artificial Sequence
  Synthetic oligonucleotide; TGG chr2 60545597 60545616 60545600 -
gtgacgtgtcagaggcaaag

SEQ ID NO: 172406 - DNA, 20 bp, Artificial Sequence
  Synthetic oligonucleotide; TAG chr2 60545589 60545608 60545592 -
tcagaggcaaagtggccata

SEQ ID NO: 172407 - DNA, 20 bp, Artificial Sequence
  Synthetic oligonucleotide; AGG chr2 60545588 60545607 60545591 -
cagaggcaaagtggccatat

SEQ ID NO: 172408 - DNA, 20 bp, Artificial Sequence
  Synthetic oligonucleotide; CAG chr2 60545579 60545598 60545582 -
agtggccatataggcatttg

SEQ ID NO: 172409 - DNA, 20 bp, Artificial Sequence
  Synthetic oligonucleotide; CAG chr2 60545574 60545593 60545577 -
ccatataggcatttgcagtt

SEQ ID NO: 172410 - DNA, 20 bp, Artificial Sequence
  Synthetic oligonucleotide; CAG chr2 60545553 60545572 60545556 -
agccaatgacttgtttgact

SEQ ID NO: 172411 - DNA, 20 bp, Artificial Sequence
  Synthetic oligonucleotide; TGG chr2 60545544 60545563 60545547 -
cttgtttgactcagaacatc

SEQ ID NO: 172412 - DNA, 20 bp, Artificial Sequence
  Synthetic oligonucleotide; CAG chr2 60545540 60545559 60545543 -
tttgactcagaacatctggc

SEQ ID NO: 172413 - DNA, 20 bp, Artificial Sequence
  Synthetic oligonucleotide; AGG chr2 60545539 60545558 60545542 -
ttgactcagaacatctggcc

SEQ ID NO: 172414 - DNA, 20 bp, Artificial Sequence
  Synthetic oligonucleotide; TAG chr2 60545530 60545549 60545533 -
aacatctggccaggcctcct

SEQ ID NO: 172415 - DNA, 20 bp, Artificial Sequence
  Synthetic oligonucleotide; AGG chr2 60545529 60545548 60545532 -
acatctggccaggcctcctt

SEQ ID NO: 172416 - DNA, 20 bp, Artificial Sequence
  Synthetic oligonucleotide; GGG chr2 60545528 60545547 60545531 -
catctggccaggcctcctta

SEQ ID NO: 172417 - DNA, 20 bp, Artificial Sequence
  Synthetic oligonucleotide; GGG chr2 60545527 60545546 60545530 -
atctggccaggcctccttag

SEQ ID NO: 172418 - DNA, 20 bp, Artificial Sequence
  Synthetic oligonucleotide; CAG chr2 60545522 60545541 60545525 -
gccaggcctccttaggggtt

SEQ ID NO: 172419 - DNA, 20 bp, Artificial Sequence
  Synthetic oligonucleotide; AAG chr2 60545510 60545529 60545513 -
taggggttcagctcgttctc

SEQ ID NO: 172420 - DNA, 20 bp, Artificial Sequence
  Synthetic oligonucleotide; AGG chr2 60545509 60545528 60545512 -
aggggttcagctcgttctca

SEQ ID NO: 172421 - DNA, 20 bp, Artificial Sequence
  Synthetic oligonucleotide; AAG chr2 60545498 60545517 60545501 -
tcgttctcaaggcttccctg

SEQ ID NO: 172422 - DNA, 20 bp, Artificial Sequence
  Synthetic oligonucleotide; TAG chr2 60545495 60545514 60545498 -
ttctcaaggcttccctgaag

SEQ ID NO: 172423 - DNA, 20 bp, Artificial Sequence
  Synthetic oligonucleotide; GAG chr2 60545493 60545512 60545496 -
ctcaaggcttccctgaagta

SEQ ID NO: 172424 - DNA, 20 bp, Artificial Sequence
  Synthetic oligonucleotide; TGG chr2 60545490 60545509 60545493 -
aaggcttccctgaagtagag

SEQ ID NO: 172425 - DNA, 20 bp, Artificial Sequence
  Synthetic oligonucleotide; GGG chr2 60545489 60545508 60545492 -
aggcttccctgaagtagagt

SEQ ID NO: 172426 - DNA, 20 bp, Artificial Sequence
  Synthetic oligonucleotide; TGG chr2 60545485 60545504 60545488 -
ttccctgaagtagagtgggc

SEQ ID NO: 172427 - DNA, 20 bp, Artificial Sequence
  Synthetic oligonucleotide; CAG chr2 60545482 60545501 60545485 -
cctgaagtagagtgggctgg

SEQ ID NO: 172428 - DNA, 20 bp, Artificial Sequence
  Synthetic oligonucleotide; AGG chr2 60545481 60545500 60545484 -
ctgaagtagagtgggctggc

SEQ ID NO: 172429 - DNA, 20 bp, Artificial Sequence
  Synthetic oligonucleotide; GGG chr2 60545480 60545499 60545483 -
tgaagtagagtgggctggca

SEQ ID NO: 172430 - DNA, 20 bp, Artificial Sequence
  Synthetic oligonucleotide; TAG chr2 60545477 60545496 60545480 -
agtagagtgggctggcaggg

SEQ ID NO: 172431 - DNA, 20 bp, Artificial Sequence
  Synthetic oligonucleotide; TGG chr2 60545473 60545492 60545476 -
gagtgggctggcagggtagt

SEQ ID NO: 172432 - DNA, 20 bp, Artificial Sequence
  Synthetic oligonucleotide; GAG chr2 60545471 60545490 60545474 -
gtgggctggcagggtagttg

SEQ ID NO: 172433 - DNA, 20 bp, Artificial Sequence
  Synthetic oligonucleotide; AGG chr2 60545470 60545489 60545473 -
tgggctggcagggtagttgg

SEQ ID NO: 172434 - DNA, 20 bp, Artificial Sequence
  Synthetic oligonucleotide; TGG chr2 60545467 60545486 60545470 -
gctggcagggtagttggagg

SEQ ID NO: 172435 - DNA, 20 bp, Artificial Sequence
  Synthetic oligonucleotide; TGG chr2 60545464 60545483 60545467 -
ggcagggtagttggaggtgg

SEQ ID NO: 172436 - DNA, 20 bp, Artificial Sequence
  Synthetic oligonucleotide; AAG chr2 60545460 60545479 60545463 -
gggtagttggaggtggtgga

SEQ ID NO: 172437 - DNA, 20 bp, Artificial Sequence
  Synthetic oligonucleotide; GAG chr2 60545458 60545477 60545461 -
gtagttggaggtggtggaaa

SEQ ID NO: 172438 - DNA, 20 bp, Artificial Sequence
  Synthetic oligonucleotide; GAG chr2 60545449 60545468 60545452 -
ggtggtggaaagagttaact

SEQ ID NO: 172439 - DNA, 20 bp, Artificial Sequence
  Synthetic oligonucleotide; CAG chr2 60545443 60545462 60545446 -
ggaaagagttaactgagctt

SEQ ID NO: 172440 - DNA, 20 bp, Artificial Sequence
  Synthetic oligonucleotide; AGG chr2 60545442 60545461 60545445 -
gaaagagttaactgagcttc

SEQ ID NO: 172441 - DNA, 20 bp, Artificial Sequence
  Synthetic oligonucleotide; GGG chr2 60545441 60545460 60545444 -
aaagagttaactgagcttca

SEQ ID NO: 172442 - DNA, 20 bp, Artificial Sequence
  Synthetic oligonucleotide; TAG chr2 60545437 60545456 60545440 -
agttaactgagcttcagggc

SEQ ID NO: 172443 - DNA, 20 bp, Artificial Sequence
  Synthetic oligonucleotide; TGG chr2 60545431 60545450 60545434 -
ctgagcttcagggctagcct

SEQ ID NO: 172444 - DNA, 20 bp, Artificial Sequence
  Synthetic oligonucleotide; TGG chr2 60545420 60545439 60545423 -
ggctagccttggatccatat

SEQ ID NO: 172445 - DNA, 20 bp, Artificial Sequence
  Synthetic oligonucleotide; CAG chr2 60545413 60545432 60545416 -
cttggatccatattggctgt

SEQ ID NO: 172446 - DNA, 20 bp, Artificial Sequence
  Synthetic oligonucleotide; CGG chr2 60545408 60545427 60545411 -
atccatattggctgtcagcc

SEQ ID NO: 172447 - DNA, 20 bp, Artificial Sequence
  Synthetic oligonucleotide; TGG chr2 60545404 60545423 60545407 -
atattggctgtcagcccgga

SEQ ID NO: 172448 - DNA, 20 bp, Artificial Sequence
  Synthetic oligonucleotide; GGG chr2 60545403 60545422 60545406 -
tattggctgtcagcccggat

SEQ ID NO: 172449 - DNA, 20 bp, Artificial Sequence
  Synthetic oligonucleotide; GGG chr2 60545402 60545421 60545405 -
attggctgtcagcccggatg

SEQ ID NO: 172450 - DNA, 20 bp, Artificial Sequence
  Synthetic oligonucleotide; CAG chr2 60545386 60545405 60545389 -
gatggggctgtaattaaaca

SEQ ID NO: 172451 - DNA, 20 bp, Artificial Sequence
  Synthetic oligonucleotide; TGG chr2 60545378 60545397 60545381 -
tgtaattaaacacagccccg

SEQ ID NO: 172452 - DNA, 20 bp, Artificial Sequence
  Synthetic oligonucleotide; TGG chr2 60545375 60545394 60545378 -
aattaaacacagccccgtgg

SEQ ID NO: 172453 - DNA, 20 bp, Artificial Sequence
  Synthetic oligonucleotide; GGG chr2 60545374 60545393 60545377 -
attaaacacagccccgtggt

SEQ ID NO: 172454 - DNA, 20 bp, Artificial Sequence
  Synthetic oligonucleotide; AAG chr2 60545349 60545368 60545352 -
gacaccatgaccttgacttt

SEQ ID NO: 172455 - DNA, 20 bp, Artificial Sequence
  Synthetic oligonucleotide; TGG chr2 60545332 60545351 60545335 -
tttaagatgccattttcgac

SEQ ID NO: 172456 - DNA, 20 bp, Artificial Sequence
  Synthetic oligonucleotide; CAG chr2 60545328 60545347 60545331 -
agatgccattttcgactggc

SEQ ID NO: 172457 - DNA, 20 bp, Artificial Sequence
  Synthetic oligonucleotide; AGG chr2 60545327 60545346 60545330 -
gatgccattttcgactggcc

SEQ ID NO: 172458 - DNA, 20 bp, Artificial Sequence
  Synthetic oligonucleotide; CAG chr2 60545323 60545342 60545326 -
ccattttcgactggccaggc

SEQ ID NO: 172459 - DNA, 20 bp, Artificial Sequence
  Synthetic oligonucleotide; GAG chr2 60545321 60545340 60545324 -
attttcgactggccaggcca

SEQ ID NO: 172460 - DNA, 20 bp, Artificial Sequence
  Synthetic oligonucleotide; TAG chr2 60545318 60545337 60545321 -
ttcgactggccaggccagag

SEQ ID NO: 172461 - DNA, 20 bp, Artificial Sequence
  Synthetic oligonucleotide; GAG chr2 60545316 60545335 60545319 -
cgactggccaggccagagta

SEQ ID NO: 172462 - DNA, 20 bp, Artificial Sequence
  Synthetic oligonucleotide; GAG chr2 60545314 60545333 60545317 -
actggccaggccagagtaga

SEQ ID NO: 172463 - DNA, 20 bp, Artificial Sequence
  Synthetic oligonucleotide; AGG chr2 60545313 60545332 60545316 -
ctggccaggccagagtagag

SEQ ID NO: 172464 - DNA, 20 bp, Artificial Sequence
  Synthetic oligonucleotide; GGG chr2 60545312 60545331 60545315 -
tggccaggccagagtagaga

SEQ ID NO: 172465 - DNA, 20 bp, Artificial Sequence
  Synthetic oligonucleotide; CAG chr2 60545309 60545328 60545312 -
ccaggccagagtagagaggg

SEQ ID NO: 172466 - DNA, 20 bp, Artificial Sequence
  Synthetic oligonucleotide; AAG chr2 60545300 60545319 60545303 -
agtagagagggcagttgctg

SEQ ID NO: 172467 - DNA, 20 bp, Artificial Sequence
  Synthetic oligonucleotide; CAG chr2 60545293 60545312 60545296 -
agggcagttgctgaagcgca

SEQ ID NO: 172468 - DNA, 20 bp, Artificial Sequence
  Synthetic oligonucleotide; AAG chr2 60545275 60545294 60545278 -
cacagacatgcttactcgaa

SEQ ID NO: 172469 - DNA, 20 bp, Artificial Sequence
  Synthetic oligonucleotide; AAG chr2 60545269 60545288 60545272 -
catgcttactcgaaaagttt

SEQ ID NO: 172470 - DNA, 20 bp, Artificial Sequence
  Synthetic oligonucleotide; AGG chr2 60545268 60545287 60545271 -
atgcttactcgaaaagttta

SEQ ID NO: 172471 - DNA, 20 bp, Artificial Sequence
  Synthetic oligonucleotide; GGG chr2 60545267 60545286 60545270 -
tgcttactcgaaaagtttaa

SEQ ID NO: 172472 - DNA, 20 bp, Artificial Sequence
  Synthetic oligonucleotide; TGG chr2 60545259 60545278 60545262 -
cgaaaagtttaagggcatgt

SEQ ID NO: 172473 - DNA, 20 bp, Artificial Sequence
  Synthetic oligonucleotide; AAG chr2 60545247 60545266 60545250 -
gggcatgttggaaatttcaa

SEQ ID NO: 172474 - DNA, 20 bp, Artificial Sequence
  Synthetic oligonucleotide; AGG chr2 60545246 60545265 60545249 -
ggcatgttggaaatttcaaa

SEQ ID NO: 172475 - DNA, 20 bp, Artificial Sequence
  Synthetic oligonucleotide; TGG chr2 60545242 60545261 60545245 -
tgttggaaatttcaaaaggt

SEQ ID NO: 172476 - DNA, 20 bp, Artificial Sequence
  Synthetic oligonucleotide; CAG chr2 60545234 60545253 60545237 -
atttcaaaaggttggtttga

SEQ ID NO: 172477 - DNA, 20 bp, Artificial Sequence
  Synthetic oligonucleotide; AGG chr2 60545233 60545252 60545236 -
tttcaaaaggttggtttgac

SEQ ID NO: 172478 - DNA, 20 bp, Artificial Sequence
  Synthetic oligonucleotide; CGG chr2 60545228 60545247 60545231 -
aaaggttggtttgacaggaa

SEQ ID NO: 172479 - DNA, 20 bp, Artificial Sequence
  Synthetic oligonucleotide; CAG chr2 60545215 60545234 60545218 -
acaggaacggctgctccctg

SEQ ID NO: 172480 - DNA, 20 bp, Artificial Sequence
  Synthetic oligonucleotide; CAG chr2 60545202 60545221 60545205 -
ctccctgcagcctgcctcct

SEQ ID NO: 172481 - DNA, 20 bp, Artificial Sequence
  Synthetic oligonucleotide; TGG chr2 60545156 60545175 60545159 -
gctctctcttgtctctgatg

SEQ ID NO: 172482 - DNA, 20 bp, Artificial Sequence
  Synthetic oligonucleotide; CAG chr2 60545147 60545166 60545150 -
tgtctctgatgtggttttga

SEQ ID NO: 172483 - DNA, 20 bp, Artificial Sequence
  Synthetic oligonucleotide; TGG chr2 60545124 60545143 60545127 -
atgtatcttgattttgtttg

SEQ ID NO: 172484 - DNA, 20 bp, Artificial Sequence
  Synthetic oligonucleotide; CAG chr2 60545115 60545134 60545118 -
gattttgtttgtggtttaca

SEQ ID NO: 172485 - DNA, 20 bp, Artificial Sequence
  Synthetic oligonucleotide; CAG chr2 60545088 60545107 60545091 -
atgtcacccttacaaatgtc

SEQ ID NO: 172486 - DNA, 20 bp, Artificial Sequence
  Synthetic oligonucleotide; CAG chr2 60545083 60545102 60545086 -
acccttacaaatgtccagtc

SEQ ID NO: 172487 - DNA, 20 bp, Artificial Sequence
  Synthetic oligonucleotide; TGG chr2 60545040 60545059 60545043 -
acacaatgtaaaaattttct

SEQ ID NO: 172488 - DNA, 20 bp, Artificial Sequence
  Synthetic oligonucleotide; CAG chr2 60545015 60545034 60545018 -
aaatacacacacgtattcaa

SEQ ID NO: 172489 - DNA, 20 bp, Artificial Sequence
  Synthetic oligonucleotide; TGG chr2 60545000 60545019 60545003 -
ttcaacagccctccctcctt

SEQ ID NO: 172490 - DNA, 20 bp, Artificial Sequence
  Synthetic oligonucleotide; TAG chr2 60544990 60545009 60544993 -
ctccctcctttggttaattt

SEQ ID NO: 172491 - DNA, 20 bp, Artificial Sequence
  Synthetic oligonucleotide; CAG chr2 60544987 60545006 60544990 -
cctcctttggttaattttag

SEQ ID NO: 172492 - DNA, 20 bp, Artificial Sequence
  Synthetic oligonucleotide; AGG chr2 60544986 60545005 60544989 -
ctcctttggttaattttagc

SEQ ID NO: 172493 - DNA, 20 bp, Artificial Sequence
  Synthetic oligonucleotide; GGG chr2 60544985 60545004 60544988 -
tcctttggttaattttagca

SEQ ID NO: 172494 - DNA, 20 bp, Artificial Sequence
  Synthetic oligonucleotide; GAG chr2 60544983 60545002 60544986 -
ctttggttaattttagcagg

SEQ ID NO: 172495 - DNA, 20 bp, Artificial Sequence
  Synthetic oligonucleotide; AGG chr2 60544982 60545001 60544985 -
tttggttaattttagcaggg

SEQ ID NO: 172496 - DNA, 20 bp, Artificial Sequence
  Synthetic oligonucleotide; CAG chr2 60544979 60544998 60544982 -
ggttaattttagcagggagg

SEQ ID NO: 172497 - DNA, 20 bp, Artificial Sequence
  Synthetic oligonucleotide; TAG chr2 60544975 60544994 60544978 -
aattttagcagggaggcagc

SEQ ID NO: 172498 - DNA, 20 bp, Artificial Sequence
  Synthetic oligonucleotide; AGG chr2 60544974 60544993 60544977 -
attttagcagggaggcagct

SEQ ID NO: 172499 - DNA, 20 bp, Artificial Sequence
  Synthetic oligonucleotide; TGG chr2 60544967 60544986 60544970 -
cagggaggcagctaggtgtg

SEQ ID NO: 172500 - DNA, 20 bp, Artificial Sequence
  Synthetic oligonucleotide; GGG chr2 60544966 60544985 60544969 -
agggaggcagctaggtgtgt

SEQ ID NO: 172501 - DNA, 20 bp, Artificial Sequence
  Synthetic oligonucleotide; CGG chr2 60544958 60544977 60544961 -
agctaggtgtgtgggtttct

SEQ ID NO: 172502 - DNA, 20 bp, Artificial Sequence
  Synthetic oligonucleotide; CAG chr2 60544955 60544974 60544958 -
taggtgtgtgggtttctcgg

SEQ ID NO: 172503 - DNA, 20 bp, Artificial Sequence
  Synthetic oligonucleotide; AAG chr2 60544949 60544968 60544952 -
tgtgggtttctcggcagctc

SEQ ID NO: 172504 - DNA, 20 bp, Artificial Sequence
  Synthetic oligonucleotide; AGG chr2 60544948 60544967 60544951 -
gtgggtttctcggcagctca

SEQ ID NO: 172505 - DNA, 20 bp, Artificial Sequence
  Synthetic oligonucleotide; GGG chr2 60544947 60544966 60544950 -
tgggtttctcggcagctcaa

SEQ ID NO: 172506 - DNA, 20 bp, Artificial Sequence
  Synthetic oligonucleotide; AAG chr2 60544942 60544961 60544945 -
ttctcggcagctcaagggaa

SEQ ID NO: 172507 - DNA, 20 bp, Artificial Sequence
  Synthetic oligonucleotide; AGG chr2 60544941 60544960 60544944 -
tctcggcagctcaagggaaa

SEQ ID NO: 172508 - DNA, 20 bp, Artificial Sequence
  Synthetic oligonucleotide; AAG chr2 60544933 60544952 60544936 -
gctcaagggaaaaggaatta

SEQ ID NO: 172509 - DNA, 20 bp, Artificial Sequence
  Synthetic oligonucleotide; AGG chr2 60544932 60544951 60544935 -
ctcaagggaaaaggaattaa

SEQ ID NO: 172510 - DNA, 20 bp, Artificial Sequence
  Synthetic oligonucleotide; TAG chr2 60544928 60544947 60544931 -
agggaaaaggaattaaaggc

SEQ ID NO: 172511 - DNA, 20 bp, Artificial Sequence
  Synthetic oligonucleotide; CAG chr2 60544925 60544944 60544928 -
gaaaaggaattaaaggctag

SEQ ID NO: 172512 - DNA, 20 bp, Artificial Sequence
  Synthetic oligonucleotide; TGG chr2 60544922 60544941 60544925 -
aaggaattaaaggctagcag

SEQ ID NO: 172513 - DNA, 20 bp, Artificial Sequence
  Synthetic oligonucleotide; GGG chr2 60544921 60544940 60544924 -
aggaattaaaggctagcagt

SEQ ID NO: 172514 - DNA, 20 bp, Artificial Sequence
  Synthetic oligonucleotide; AAG chr2 60544900 60544919 60544903 -
ggacttaaattcccttctct

SEQ ID NO: 172515 - DNA, 20 bp, Artificial Sequence
  Synthetic oligonucleotide; CAG chr2 60544890 60544909 60544893 -
tcccttctctaagtgataaa

SEQ ID NO: 172516 - DNA, 20 bp, Artificial Sequence
  Synthetic oligonucleotide; TAG chr2 60544877 60544896 60544880 -
tgataaacagtaacactata

SEQ ID NO: 172517 - DNA, 20 bp, Artificial Sequence
  Synthetic oligonucleotide; GAG chr2 60544850 60544869 60544853 -
cctcaaaacattttttgctt

SEQ ID NO: 172518 - DNA, 20 bp, Artificial Sequence
  Synthetic oligonucleotide; TAG chr2 60544842 60544861 60544845 -
cattttttgcttgagcatgt

SEQ ID NO: 172519 - DNA, 20 bp, Artificial Sequence
  Synthetic oligonucleotide; AAG chr2 60544835 60544854 60544838 -
tgcttgagcatgttagacaa

SEQ ID NO: 172520 - DNA, 20 bp, Artificial Sequence
  Synthetic oligonucleotide; CAG chr2 60544826 60544845 60544829 -
atgttagacaaaagtcaatg

SEQ ID NO: 172521 - DNA, 20 bp, Artificial Sequence
  Synthetic oligonucleotide; CAG chr2 60544811 60544830 60544814 -
caatgcagattctgtgatga

SEQ ID NO: 172522 - DNA, 20 bp, Artificial Sequence
  Synthetic oligonucleotide; TGG chr2 60544793 60544812 60544796 -
gacagacatgccatgcctgt

SEQ ID NO: 172523 - DNA, 20 bp, Artificial Sequence
  Synthetic oligonucleotide; TGG chr2 60544790 60544809 60544793 -
agacatgccatgcctgttgg

SEQ ID NO: 172524 - DNA, 20 bp, Artificial Sequence
  Synthetic oligonucleotide; CAG chr2 60544760 60544779 60544763 -
tcttccatctacctaccacc

SEQ ID NO: 172525 - DNA, 20 bp, Artificial Sequence
  Synthetic oligonucleotide; AAG chr2 60544750 60544769 60544753 -
acctaccacccagctcccga

SEQ ID NO: 172526 - DNA, 20 bp, Artificial Sequence
  Synthetic oligonucleotide; AGG chr2 60544749 60544768 60544752 -
cctaccacccagctcccgaa

SEQ ID NO: 172527 - DNA, 20 bp, Artificial Sequence
  Synthetic oligonucleotide; AAG chr2 60544745 60544764 60544748 -
ccacccagctcccgaaaggc

SEQ ID NO: 172528 - DNA, 20 bp, Artificial Sequence
  Synthetic oligonucleotide; GAG chr2 60544743 60544762 60544746 -
acccagctcccgaaaggcaa

SEQ ID NO: 172529 - DNA, 20 bp, Artificial Sequence
  Synthetic oligonucleotide; AGG chr2 60544742 60544761 60544745 -
cccagctcccgaaaggcaag

SEQ ID NO: 172530 - DNA, 20 bp, Artificial Sequence
  Synthetic oligonucleotide; CAG chr2 60544733 60544752 60544736 -
cgaaaggcaagaggtttgtt

SEQ ID NO: 172531 - DNA, 20 bp, Artificial Sequence
  Synthetic oligonucleotide; TAG chr2 60544727 60544746 60544730 -
gcaagaggtttgttcagttt

SEQ ID NO: 172532 - DNA, 20 bp, Artificial Sequence
  Synthetic oligonucleotide; AGG chr2 60544726 60544745 60544729 -
caagaggtttgttcagtttt

SEQ ID NO: 172533 - DNA, 20 bp, Artificial Sequence
  Synthetic oligonucleotide; AAG chr2 60544722 60544741 60544725 -
aggtttgttcagttttagga

SEQ ID NO: 172534 - DNA, 20 bp, Artificial Sequence
  Synthetic oligonucleotide; AGG chr2 60544721 60544740 60544724 -
ggtttgttcagttttaggaa

SEQ ID NO: 172535 - DNA, 20 bp, Artificial Sequence
  Synthetic oligonucleotide; TAG chr2 60544718 60544737 60544721 -
ttgttcagttttaggaaagg

SEQ ID NO: 172536 - DNA, 20 bp, Artificial Sequence
  Synthetic oligonucleotide; TGG chr2 60544693 60544712 60544696 -
catatcatgaattgattcac

SEQ ID NO: 172537 - DNA, 20 bp, Artificial Sequence
  Synthetic oligonucleotide; TAG chr2 60544673 60544692 60544676 -
tggaacttgtctctccgacc

SEQ ID NO: 172538 - DNA, 20 bp, Artificial Sequence
  Synthetic oligonucleotide; AAG chr2 60544660 60544679 60544663 -
tccgacctagtttgaccaca

SEQ ID NO: 172539 - DNA, 20 bp, Artificial Sequence
  Synthetic oligonucleotide; TAG chr2 60544646 60544665 60544649 -
accacaaagttgaaccataa

SEQ ID NO: 172540 - DNA, 20 bp, Artificial Sequence
  Synthetic oligonucleotide; AGG chr2 60544645 60544664 60544648 -
ccacaaagttgaaccataat

SEQ ID NO: 172541 - DNA, 20 bp, Artificial Sequence
  Synthetic oligonucleotide; CAG chr2 60544641 60544660 60544644 -
aaagttgaaccataataggt

SEQ ID NO: 172542 - DNA, 20 bp, Artificial Sequence
  Synthetic oligonucleotide; TGG chr2 60544638 60544657 60544641 -
gttgaaccataataggtcag

SEQ ID NO: 172543 - DNA, 20 bp, Artificial Sequence
  Synthetic oligonucleotide; TAG chr2 60544633 60544652 60544636 -
accataataggtcagtggtc

SEQ ID NO: 172544 - DNA, 20 bp, Artificial Sequence
  Synthetic oligonucleotide; GAG chr2 60544631 60544650 60544634 -
cataataggtcagtggtcta

SEQ ID NO: 172545 - DNA, 20 bp, Artificial Sequence
  Synthetic oligonucleotide; AGG chr2 60544630 60544649 60544633 -
ataataggtcagtggtctag

SEQ ID NO: 172546 - DNA, 20 bp, Artificial Sequence
  Synthetic oligonucleotide; GGG chr2 60544629 60544648 60544632 -
taataggtcagtggtctaga

SEQ ID NO: 172547 - DNA, 20 bp, Artificial Sequence
  Synthetic oligonucleotide; GGG chr2 60544628 60544647 60544631 -
aataggtcagtggtctagag

SEQ ID NO: 172548 - DNA, 20 bp, Artificial Sequence
  Synthetic oligonucleotide; TAG chr2 60544592 60544611 60544595 -
ttatttctcctctccccctc

SEQ ID NO: 172549 - DNA, 20 bp, Artificial Sequence
  Synthetic oligonucleotide; TGG chr2 60544566 60544585 60544569 -
ttgatcattaaaaccaaaca

SEQ ID NO: 172550 - DNA, 20 bp, Artificial Sequence
  Synthetic oligonucleotide; TAG chr2 60544546 60544565 60544549 -
tggcattttctttctttttt

SEQ ID NO: 172551 - DNA, 20 bp, Artificial Sequence
  Synthetic oligonucleotide; TAG chr2 60544531 60544550 60544534 -
ttttttagtgctttctgtga

SEQ ID NO: 172552 - DNA, 20 bp, Artificial Sequence
  Synthetic oligonucleotide; CAG chr2 60544524 60544543 60544527 -
gtgctttctgtgatagcact

SEQ ID NO: 172553 - DNA, 20 bp, Artificial Sequence
  Synthetic oligonucleotide; TAG chr2 60544509 60544528 60544512 -
gcactcagatactttccctt

SEQ ID NO: 172554 - DNA, 20 bp, Artificial Sequence
  Synthetic oligonucleotide; TGG chr2 60544501 60544520 60544504 -
atactttccctttagtgaaa

SEQ ID NO: 172555 - DNA, 20 bp, Artificial Sequence
  Synthetic oligonucleotide; GGG chr2 60544500 60544519 60544503 -
tactttccctttagtgaaat

SEQ ID NO: 172556 - DNA, 20 bp, Artificial Sequence
  Synthetic oligonucleotide; TAG chr2 60544486 60544505 60544489 -
tgaaatgggaaatctgctgc

SEQ ID NO: 172557 - DNA, 20 bp, Artificial Sequence
  Synthetic oligonucleotide; AGG chr2 60544485 60544504 60544488 -
gaaatgggaaatctgctgct

SEQ ID NO: 172558 - DNA, 20 bp, Artificial Sequence
  Synthetic oligonucleotide; GGG chr2 60544484 60544503 60544487 -
aaatgggaaatctgctgcta

SEQ ID NO: 172559 - DNA, 20 bp, Artificial Sequence
  Synthetic oligonucleotide; AAG chr2 60544481 60544500 60544484 -
tgggaaatctgctgctaggg

SEQ ID NO: 172560 - DNA, 20 bp, Artificial Sequence
  Synthetic oligonucleotide; TGG chr2 60544469 60544488 60544472 -
tgctagggaagctgcatttg

SEQ ID NO: 172561 - DNA, 20 bp, Artificial Sequence
  Synthetic oligonucleotide; GAG chr2 60544467 60544486 60544470 -
ctagggaagctgcatttgtg

SEQ ID NO: 172562 - DNA, 20 bp, Artificial Sequence
  Synthetic oligonucleotide; TAG chr2 60544424 60544443 60544427 -
catttaccttatgtgacatg

SEQ ID NO: 172563 - DNA, 20 bp, Artificial Sequence
  Synthetic oligonucleotide; AGG chr2 60544423 60544442 60544426 -
atttaccttatgtgacatgt

SEQ ID NO: 172564 - DNA, 20 bp, Artificial Sequence
  Synthetic oligonucleotide; AAG chr2 60544418 60544437 60544421 -
ccttatgtgacatgtaggtg

SEQ ID NO: 172565 - DNA, 20 bp, Artificial Sequence
  Synthetic oligonucleotide; CAG chr2 60544395 60544414 60544398 -
attttatctcccctaccccc

SEQ ID NO: 172566 - DNA, 20 bp, Artificial Sequence
  Synthetic oligonucleotide; CAG chr2 60544392 60544411 60544395 -
ttatctcccctaccccccag

SEQ ID NO: 172567 - DNA, 20 bp, Artificial Sequence
  Synthetic oligonucleotide; AGG chr2 60544391 60544410 60544394 -
tatctcccctaccccccagc

SEQ ID NO: 172568 - DNA, 20 bp, Artificial Sequence
  Synthetic oligonucleotide; TGG chr2 60544385 60544404 60544388 -
ccctaccccccagcaggatg

SEQ ID NO: 172569 - DNA, 20 bp, Artificial Sequence
  Synthetic oligonucleotide; GGG chr2 60544384 60544403 60544387 -
cctaccccccagcaggatgt

SEQ ID NO: 172570 - DNA, 20 bp, Artificial Sequence
  Synthetic oligonucleotide; TGG chr2 60544351 60544370 60544354 -
tccatgtgttgtcttgtgac

SEQ ID NO: 172571 - DNA, 20 bp, Artificial Sequence
  Synthetic oligonucleotide; AAG chr2 60544348 60544367 60544351 -
atgtgttgtcttgtgactgg

SEQ ID NO: 172572 - DNA, 20 bp, Artificial Sequence
  Synthetic oligonucleotide; AGG chr2 60544347 60544366 60544350 -
tgtgttgtcttgtgactgga

SEQ ID NO: 172573 - DNA, 20 bp, Artificial Sequence
  Synthetic oligonucleotide; CAG chr2 60544336 60544355 60544339 -
gtgactggaaggaaaatgaa

SEQ ID NO: 172574 - DNA, 20 bp, Artificial Sequence
  Synthetic oligonucleotide; AAG chr2 60544333 60544352 60544336 -
actggaaggaaaatgaacag

SEQ ID NO: 172575 - DNA, 20 bp, Artificial Sequence
  Synthetic oligonucleotide; AAG chr2 60544327 60544346 60544330 -
aggaaaatgaacagaagtgt

SEQ ID NO: 172576 - DNA, 20 bp, Artificial Sequence
  Synthetic oligonucleotide; AGG chr2 60544326 60544345 60544329 -
ggaaaatgaacagaagtgta

SEQ ID NO: 172577 - DNA, 20 bp, Artificial Sequence
  Synthetic oligonucleotide; AAG chr2 60544312 60544331 60544315 -
agtgtaaggcatgattaatg

SEQ ID NO: 172578 - DNA, 20 bp, Artificial Sequence
  Synthetic oligonucleotide; AAG chr2 60544308 60544327 60544311 -
taaggcatgattaatgaagc

SEQ ID NO: 172579 - DNA, 20 bp, Artificial Sequence
  Synthetic oligonucleotide; GAG chr2 60544306 60544325 60544309 -
aggcatgattaatgaagcaa

SEQ ID NO: 172580 - DNA, 20 bp, Artificial Sequence
  Synthetic oligonucleotide; CAG chr2 60544303 60544322 60544306 -
catgattaatgaagcaagag

SEQ ID NO: 172581 - DNA, 20 bp, Artificial Sequence
  Synthetic oligonucleotide; AGG chr2 60544302 60544321 60544305 -
atgattaatgaagcaagagc

SEQ ID NO: 172582 - DNA, 20 bp, Artificial Sequence
  Synthetic oligonucleotide; CGG chr2 60544299 60544318 60544302 -
attaatgaagcaagagcagg

SEQ ID NO: 172583 - DNA, 20 bp, Artificial Sequence
  Synthetic oligonucleotide; AAG chr2 60544296 60544315 60544299 -
aatgaagcaagagcaggcgg

SEQ ID NO: 172584 - DNA, 20 bp, Artificial Sequence
  Synthetic oligonucleotide; AGG chr2 60544295 60544314 60544298 -
atgaagcaagagcaggcgga

SEQ ID NO: 172585 - DNA, 20 bp, Artificial Sequence
  Synthetic oligonucleotide; GGG chr2 60544294 60544313 60544297 -
tgaagcaagagcaggcggaa

SEQ ID NO: 172586 - DNA, 20 bp, Artificial Sequence
  Synthetic oligonucleotide; GGG chr2 60544293 60544312 60544296 -
gaagcaagagcaggcggaag

SEQ ID NO: 172587 - DNA, 20 bp, Artificial Sequence
  Synthetic oligonucleotide; CGG chr2 60544278 60544297 60544281 -
ggaaggggatttgtcgtctt

SEQ ID NO: 172588 - DNA, 20 bp, Artificial Sequence
  Synthetic oligonucleotide; GAG chr2 60544276 60544295 60544279 -
aaggggatttgtcgtcttcg

SEQ ID NO: 172589 - DNA, 20 bp, Artificial Sequence
  Synthetic oligonucleotide; AAG chr2 60544268 60544287 60544271 -
ttgtcgtcttcggagatcca

SEQ ID NO: 172590 - DNA, 20 bp, Artificial Sequence
  Synthetic oligonucleotide; TGG chr2 60544245 60544264 60544248 -
ccttgctaaatcaccaaata

SEQ ID NO: 172591 - DNA, 20 bp, Artificial Sequence
  Synthetic oligonucleotide; GAG chr2 60544243 60544262 60544246 -
ttgctaaatcaccaaatatg

SEQ ID NO: 172592 - DNA, 20 bp, Artificial Sequence
  Synthetic oligonucleotide; GAG chr2 60544204 60544223 60544207 -
taacatcgtatttacatatc

SEQ ID NO: 172593 - DNA, 20 bp, Artificial Sequence
  Synthetic oligonucleotide; AAG chr2 60544189 60544208 60544192 -
atatcgagctgctcgtttaa

SEQ ID NO: 172594 - DNA, 20 bp, Artificial Sequence
  Synthetic oligonucleotide; CAG chr2 60544178 60544197 60544181 -
ctcgtttaaaagacaaaaca

SEQ ID NO: 172595 - DNA, 20 bp, Artificial Sequence
  Synthetic oligonucleotide; AAG chr2 60544167 60544186 60544170 -
gacaaaacacagtgtctgtc

SEQ ID NO: 172596 - DNA, 20 bp, Artificial Sequence
  Synthetic oligonucleotide; AAG chr2 60544163 60544182 60544166 -
aaacacagtgtctgtcaagc

SEQ ID NO: 172597 - DNA, 20 bp, Artificial Sequence
  Synthetic oligonucleotide; GAG chr2 60544138 60544157 60544141 -
ttaaaaccacacttcttact

SEQ ID NO: 172598 - DNA, 20 bp, Artificial Sequence
  Synthetic oligonucleotide; AGG chr2 60544137 60544156 60544140 -
taaaaccacacttcttactg

SEQ ID NO: 172599 - DNA, 20 bp, Artificial Sequence
  Synthetic oligonucleotide; TAG chr2 60544127 60544146 60544130 -
cttcttactgaggtcccaaa

SEQ ID NO: 172600 - DNA, 20 bp, Artificial Sequence
  Synthetic oligonucleotide; AGG chr2 60544126 60544145 60544129 -
ttcttactgaggtcccaaat

SEQ ID NO: 172601 - DNA, 20 bp, Artificial Sequence
  Synthetic oligonucleotide; CAG chr2 60544118 60544137 60544121 -
gaggtcccaaataggttatt

SEQ ID NO: 172602 - DNA, 20 bp, Artificial Sequence
  Synthetic oligonucleotide; TAG chr2 60544112 60544131 60544115 -
ccaaataggttattcagtct

SEQ ID NO: 172603 - DNA, 20 bp, Artificial Sequence
  Synthetic oligonucleotide; CAG chr2 60544103 60544122 60544106 -
ttattcagtcttagattaac

SEQ ID NO: 172604 - DNA, 20 bp, Artificial Sequence
  Synthetic oligonucleotide; TAG chr2 60544075 60544094 60544078 -
aaattctgtgcctctgtatt

SEQ ID NO: 172605 - DNA, 20 bp, Artificial Sequence
  Synthetic oligonucleotide; GAG chr2 60544073 60544092 60544076 -
attctgtgcctctgtattta

SEQ ID NO: 172606 - DNA, 20 bp, Artificial Sequence
  Synthetic oligonucleotide; AGG chr2 60544072 60544091 60544075 -
ttctgtgcctctgtatttag

SEQ ID NO: 172607 - DNA, 20 bp, Artificial Sequence
  Synthetic oligonucleotide; GAG chr2 60544070 60544089 60544073 -
ctgtgcctctgtatttagag

SEQ ID NO: 172608 - DNA, 20 bp, Artificial Sequence
  Synthetic oligonucleotide; AGG chr2 60544069 60544088 60544072 -
tgtgcctctgtatttagagg

SEQ ID NO: 172609 - DNA, 20 bp, Artificial Sequence
  Synthetic oligonucleotide; TGG chr2 60544055 60544074 60544058 -
tagaggaggaatctaaatgc

SEQ ID NO: 172610 - DNA, 20 bp, Artificial Sequence
  Synthetic oligonucleotide; GGG chr2 60544054 60544073 60544057 -
agaggaggaatctaaatgct

SEQ ID NO: 172611 - DNA, 20 bp, Artificial Sequence
  Synthetic oligonucleotide; GGG chr2 60544053 60544072 60544056 -
gaggaggaatctaaatgctg

SEQ ID NO: 172612 - DNA, 20 bp, Artificial Sequence
  Synthetic oligonucleotide; GGG chr2 60544052 60544071 60544055 -
aggaggaatctaaatgctgg

SEQ ID NO: 172613 - DNA, 20 bp, Artificial Sequence
  Synthetic oligonucleotide; GGG chr2 60544051 60544070 60544054 -
ggaggaatctaaatgctggg

SEQ ID NO: 172614 - DNA, 20 bp, Artificial Sequence
  Synthetic oligonucleotide; AAG chr2 60544048 60544067 60544051 -
ggaatctaaatgctgggggg

SEQ ID NO: 172615 - DNA, 20 bp, Artificial Sequence
  Synthetic oligonucleotide; AGG chr2 60544047 60544066 60544050 -
gaatctaaatgctgggggga

SEQ ID NO: 172616 - DNA, 20 bp, Artificial Sequence
  Synthetic oligonucleotide; TAG chr2 60544035 60544054 60544038 -
tggggggaaggccttacata

SEQ ID NO: 172617 - DNA, 20 bp, Artificial Sequence
  Synthetic oligonucleotide; AAG chr2 60544030 60544049 60544033 -
ggaaggccttacatatagtt

SEQ ID NO: 172618 - DNA, 20 bp, Artificial Sequence
  Synthetic oligonucleotide; TAG chr2 60544014 60544033 60544017 -
agttaagacttttactgcta

SEQ ID NO: 172619 - DNA, 20 bp, Artificial Sequence
  Synthetic oligonucleotide; TAG chr2 60543998 60544017 60544001 -
gctatagttgtgaatctatg

SEQ ID NO: 172620 - DNA, 20 bp, Artificial Sequence
  Synthetic oligonucleotide; AGG chr2 60543997 60544016 60544000 -
ctatagttgtgaatctatgt

SEQ ID NO: 172621 - DNA, 20 bp, Artificial Sequence
  Synthetic oligonucleotide; GGG chr2 60543996 60544015 60543999 -
tatagttgtgaatctatgta

SEQ ID NO: 172622 - DNA, 20 bp, Artificial Sequence
  Synthetic oligonucleotide; AAG chr2 60543989 60544008 60543992 -
gtgaatctatgtagggaaat

SEQ ID NO: 172623 - DNA, 20 bp, Artificial Sequence
  Synthetic oligonucleotide; GAG chr2 60543987 60544006 60543990 -
gaatctatgtagggaaataa

SEQ ID NO: 172624 - DNA, 20 bp, Artificial Sequence
  Synthetic oligonucleotide; TGG chr2 60543966 60543985 60543969 -
agatatttgcttgaactccc

SEQ ID NO: 172625 - DNA, 20 bp, Artificial Sequence
  Synthetic oligonucleotide; AAG chr2 60543956 60543975 60543959 -
ttgaactccctggttgtcta

SEQ ID NO: 172626 - DNA, 20 bp, Artificial Sequence
  Synthetic oligonucleotide; AGG chr2 60543955 60543974 60543958 -
tgaactccctggttgtctaa

SEQ ID NO: 172627 - DNA, 20 bp, Artificial Sequence
  Synthetic oligonucleotide; AAG chr2 60543933 60543952 60543936 -
gttctgttattattttttta

SEQ ID NO: 172628 - DNA, 20 bp, Artificial Sequence
  Synthetic oligonucleotide; AAG chr2 60543927 60543946 60543930 -
ttattatttttttaaagaac

SEQ ID NO: 172629 - DNA, 20 bp, Artificial Sequence
  Synthetic oligonucleotide; TAG chr2 60543919 60543938 60543922 -
tttttaaagaacaagtataa

SEQ ID NO: 172630 - DNA, 20 bp, Artificial Sequence
  Synthetic oligonucleotide; CAG chr2 60543916 60543935 60543919 -
ttaaagaacaagtataatag

SEQ ID NO: 172631 - DNA, 20 bp, Artificial Sequence
  Synthetic oligonucleotide; GAG chr2 60543914 60543933 60543917 -
aaagaacaagtataatagca

SEQ ID NO: 172632 - DNA, 20 bp, Artificial Sequence
  Synthetic oligonucleotide; TAG chr2 60543909 60543928 60543912 -
acaagtataatagcagagcc

SEQ ID NO: 172633 - DNA, 20 bp, Artificial Sequence
  Synthetic oligonucleotide; GAG chr2 60543907 60543926 60543910 -
aagtataatagcagagccta

SEQ ID NO: 172634 - DNA, 20 bp, Artificial Sequence
  Synthetic oligonucleotide; AAG chr2 60543904 60543923 60543907 -
tataatagcagagcctagag

SEQ ID NO: 172635 - DNA, 20 bp, Artificial Sequence
  Synthetic oligonucleotide; AAG chr2 60543891 60543910 60543894 -
cctagagaagccaaaaccaa

SEQ ID NO: 172636 - DNA, 20 bp, Artificial Sequence
  Synthetic oligonucleotide; TAG chr2 60543868 60543887 60543871 -
caaatttaaaatatatttta

SEQ ID NO: 172637 - DNA, 20 bp, Artificial Sequence
  Synthetic oligonucleotide; GAG chr2 60543842 60543861 60543845 -
taataatcaatcatttaact

SEQ ID NO: 172638 - DNA, 20 bp, Artificial Sequence
  Synthetic oligonucleotide; AAG chr2 60543834 60543853 60543837 -
aatcatttaactgagacgaa

SEQ ID NO: 172639 - DNA, 20 bp, Artificial Sequence
  Synthetic oligonucleotide; AAG chr2 60543825 60543844 60543828 -
actgagacgaaaagctctct

SEQ ID NO: 172640 - DNA, 20 bp, Artificial Sequence
  Synthetic oligonucleotide; AAG chr2 60543816 60543835 60543819 -
aaaagctctctaagatgtct

SEQ ID NO: 172641 - DNA, 20 bp, Artificial Sequence
  Synthetic oligonucleotide; TGG chr2 60543805 60543824 60543808 -
aagatgtctaagatattcaa

SEQ ID NO: 172642 - DNA, 20 bp, Artificial Sequence
  Synthetic oligonucleotide; GGG chr2 60543804 60543823 60543807 -
agatgtctaagatattcaat

SEQ ID NO: 172643 - DNA, 20 bp, Artificial Sequence
  Synthetic oligonucleotide; AAG chr2 60543793 60543812 60543796 -
atattcaatgggcgcacaac

SEQ ID NO: 172644 - DNA, 20 bp, Artificial Sequence
  Synthetic oligonucleotide; CAG chr2 60543780 60543799 60543783 -
gcacaacaagtgctgtgacc

SEQ ID NO: 172645 - DNA, 20 bp, Artificial Sequence
  Synthetic oligonucleotide; AGG chr2 60543779 60543798 60543782 -
cacaacaagtgctgtgaccc

SEQ ID NO: 172646 - DNA, 20 bp, Artificial Sequence
  Synthetic oligonucleotide; GAG chr2 60543775 60543794 60543778 -
acaagtgctgtgacccaggt

SEQ ID NO: 172647 - DNA, 20 bp, Artificial Sequence
  Synthetic oligonucleotide; AGG chr2 60543774 60543793 60543777 -
caagtgctgtgacccaggtg

SEQ ID NO: 172648 - DNA, 20 bp, Artificial Sequence
  Synthetic oligonucleotide; AAG chr2 60543744 60543763 60543747 -
ttcgtgcatgaataattaca

SEQ ID NO: 172649 - DNA, 20 bp, Artificial Sequence
  Synthetic oligonucleotide; TGG chr2 60543700 60543719 60543703 -
ttaatcacctgttcccaccc

SEQ ID NO: 172650 - DNA, 20 bp, Artificial Sequence
  Synthetic oligonucleotide; TGG chr2 60543694 60543713 60543697 -
acctgttcccaccctggaac

SEQ ID NO: 172651 - DNA, 20 bp, Artificial Sequence
  Synthetic oligonucleotide; TAG chr2 60543680 60543699 60543683 -
tggaactggctgaacataaa

SEQ ID NO: 172652 - DNA, 20 bp, Artificial Sequence
  Synthetic oligonucleotide; TGG chr2 60543675 60543694 60543678 -
ctggctgaacataaatagtg

SEQ ID NO: 172653 - DNA, 20 bp, Artificial Sequence
  Synthetic oligonucleotide; AAG chr2 60543662 60543681 60543665 -
aatagtgtggtcacatctca

SEQ ID NO: 172654 - DNA, 20 bp, Artificial Sequence
  Synthetic oligonucleotide; GAG chr2 60543658 60543677 60543661 -
gtgtggtcacatctcaaagt

SEQ ID NO: 172655 - DNA, 20 bp, Artificial Sequence
  Synthetic oligonucleotide; CAG chr2 60543651 60543670 60543654 -
cacatctcaaagtgagatgt

SEQ ID NO: 172656 - DNA, 20 bp, Artificial Sequence
  Synthetic oligonucleotide; TAG chr2 60543644 60543663 60543647 -
caaagtgagatgtcagtaac

SEQ ID NO: 172657 - DNA, 20 bp, Artificial Sequence
  Synthetic oligonucleotide; CAG chr2 60543619 60543638 60543622 -
tcacgacttctcataattca

SEQ ID NO: 172658 - DNA, 20 bp, Artificial Sequence
  Synthetic oligonucleotide; AAG chr2 60543607 60543626 60543610 -
ataattcacagtaatgaatt

SEQ ID NO: 172659 - DNA, 20 bp, Artificial Sequence
  Synthetic oligonucleotide; GAG chr2 60543605 60543624 60543608 -
aattcacagtaatgaattaa

SEQ ID NO: 172660 - DNA, 20 bp, Artificial Sequence
  Synthetic oligonucleotide; TGG chr2 60543595 60543614 60543598 -
aatgaattaagagtttccta

SEQ ID NO: 172661 - DNA, 20 bp, Artificial Sequence
  Synthetic oligonucleotide; AAG chr2 60543590 60543609 60543593 -
attaagagtttcctatggtg

SEQ ID NO: 172662 - DNA, 20 bp, Artificial Sequence
  Synthetic oligonucleotide; TGG chr2 60543551 60543570 60543554 -
gcacataaattccgacgctc

SEQ ID NO: 172663 - DNA, 20 bp, Artificial Sequence
  Synthetic oligonucleotide; CAG chr2 60543544 60543563 60543547 -
aattccgacgctctggccct

SEQ ID NO: 172664 - DNA, 20 bp, Artificial Sequence
  Synthetic oligonucleotide; AGG chr2 60543543 60543562 60543546 -
attccgacgctctggccctc

SEQ ID NO: 172665 - DNA, 20 bp, Artificial Sequence
  Synthetic oligonucleotide; AAG chr2 60543532 60543551 60543535 -
ctggccctcaggtgcccctg

SEQ ID NO: 172666 - DNA, 20 bp, Artificial Sequence
  Synthetic oligonucleotide; AAG chr2 60543527 60543546 60543530 -
cctcaggtgcccctgaagcg

SEQ ID NO: 172667 - DNA, 20 bp, Artificial Sequence
  Synthetic oligonucleotide; TGG chr2 60543521 60543540 60543524 -
gtgcccctgaagcgaagttc

SEQ ID NO: 172668 - DNA, 20 bp, Artificial Sequence
  Synthetic oligonucleotide; AAG chr2 60543518 60543537 60543521 -
cccctgaagcgaagttctgg

SEQ ID NO: 172669 - DNA, 20 bp, Artificial Sequence
  Synthetic oligonucleotide; CGG chr2 60543514 60543533 60543517 -
tgaagcgaagttctggaaga

SEQ ID NO: 172670 - DNA, 20 bp, Artificial Sequence
  Synthetic oligonucleotide; CAG chr2 60543496 60543515 60543499 -
gacggctgtgtgtgtacccc

SEQ ID NO: 172671 - DNA, 20 bp, Artificial Sequence
  Synthetic oligonucleotide; AAG chr2 60543481 60543500 60543484 -
acccccagcccatttctcta

SEQ ID NO: 172672 - DNA, 20 bp, Artificial Sequence
  Synthetic oligonucleotide; AAG chr2 60543461 60543480 60543464 -
aagcacgtctgcacaattcc

SEQ ID NO: 172673 - DNA, 20 bp, Artificial Sequence
  Synthetic oligonucleotide; GAG chr2 60543438 60543457 60543441 -
tctgcttttctttttatgat

SEQ ID NO: 172674 - DNA, 20 bp, Artificial Sequence
  Synthetic oligonucleotide; AGG chr2 60543437 60543456 60543440 -
ctgcttttctttttatgatg

SEQ ID NO: 172675 - DNA, 20 bp, Artificial Sequence
  Synthetic oligonucleotide; AAG chr2 60543434 60543453 60543437 -
cttttctttttatgatgagg

SEQ ID NO: 172676 - DNA, 20 bp, Artificial Sequence
  Synthetic oligonucleotide; AGG chr2 60543433 60543452 60543436 -
ttttctttttatgatgagga

SEQ ID NO: 172677 - DNA, 20 bp, Artificial Sequence
  Synthetic oligonucleotide; CAG chr2 60543421 60543440 60543424 -
gatgaggaaggaaacaataa

SEQ ID NO: 172678 - DNA, 20 bp, Artificial Sequence
  Synthetic oligonucleotide; CAG chr2 60543410 60543429 60543413 -
aaacaataacagtaatcatt

SEQ ID NO: 172679 - DNA, 20 bp, Artificial Sequence
  Synthetic oligonucleotide; TAG chr2 60543407 60543426 60543410 -
caataacagtaatcattcag

SEQ ID NO: 172680 - DNA, 20 bp, Artificial Sequence
  Synthetic oligonucleotide; AAG chr2 60543383 60543402 60543386 -
tatttgaattgtgtcacaaa

SEQ ID NO: 172681 - DNA, 20 bp, Artificial Sequence
  Synthetic oligonucleotide; AAG chr2 60543379 60543398 60543382 -
tgaattgtgtcacaaaaaga

SEQ ID NO: 172682 - DNA, 20 bp, Artificial Sequence
  Synthetic oligonucleotide; AGG chr2 60543378 60543397 60543381 -
gaattgtgtcacaaaaagaa

SEQ ID NO: 172683 - DNA, 20 bp, Artificial Sequence
  Synthetic oligonucleotide; GAG chr2 60543376 60543395 60543379 -
attgtgtcacaaaaagaaag

SEQ ID NO: 172684 - DNA, 20 bp, Artificial Sequence
  Synthetic oligonucleotide; AAG chr2 60543373 60543392 60543376 -
gtgtcacaaaaagaaaggag

SEQ ID NO: 172685 - DNA, 20 bp, Artificial Sequence
  Synthetic oligonucleotide; AAG chr2 60543356 60543375 60543359 -
gagaagcaatgccttgtatt

SEQ ID NO: 172686 - DNA, 20 bp, Artificial Sequence
  Synthetic oligonucleotide; AGG chr2 60543355 60543374 60543358 -
agaagcaatgccttgtatta

SEQ ID NO: 172687 - DNA, 20 bp, Artificial Sequence
  Synthetic oligonucleotide; AAG chr2 60543351 60543370 60543354 -
gcaatgccttgtattaagga

SEQ ID NO: 172688 - DNA, 20 bp, Artificial Sequence
  Synthetic oligonucleotide; GAG chr2 60543349 60543368 60543352 -
aatgccttgtattaaggaaa

SEQ ID NO: 172689 - DNA, 20 bp, Artificial Sequence
  Synthetic oligonucleotide; TAG chr2 60543329 60543348 60543332 -
gagatatattgatgaatctc

SEQ ID NO: 172690 - DNA, 20 bp, Artificial Sequence
  Synthetic oligonucleotide; AAG chr2 60543326 60543345 60543329 -
atatattgatgaatctctag

SEQ ID NO: 172691 - DNA, 20 bp, Artificial Sequence
  Synthetic oligonucleotide; TGG chr2 60543315 60543334 60543318 -
aatctctagaagaatgtgtt

SEQ ID NO: 172692 - DNA, 20 bp, Artificial Sequence
  Synthetic oligonucleotide; AAG chr2 60543301 60543320 60543304 -
tgtgtttggcaaccacataa

SEQ ID NO: 172693 - DNA, 20 bp, Artificial Sequence
  Synthetic oligonucleotide; AGG chr2 60543300 60543319 60543303 -
gtgtttggcaaccacataaa

SEQ ID NO: 172694 - DNA, 20 bp, Artificial Sequence
  Synthetic oligonucleotide; TAG chr2 60543297 60543316 60543300 -
tttggcaaccacataaaagg

SEQ ID NO: 172695 - DNA, 20 bp, Artificial Sequence
  Synthetic oligonucleotide; AAG chr2 60543288 60543307 60543291 -
cacataaaaggtagtcattt

SEQ ID NO: 172696 - DNA, 20 bp, Artificial Sequence
  Synthetic oligonucleotide; TGG chr2 60543280 60543299 60543283 -
aggtagtcatttaagcgtgc

SEQ ID NO: 172697 - DNA, 20 bp, Artificial Sequence
  Synthetic oligonucleotide; GGG chr2 60543279 60543298 60543282 -
ggtagtcatttaagcgtgct

SEQ ID NO: 172698 - DNA, 20 bp, Artificial Sequence
  Synthetic oligonucleotide; TAG chr2 60543276 60543295 60543279 -
agtcatttaagcgtgctggg

SEQ ID NO: 172699 - DNA, 20 bp, Artificial Sequence
  Synthetic oligonucleotide; AGG chr2 60543275 60543294 60543278 -
gtcatttaagcgtgctgggt

SEQ ID NO: 172700 - DNA, 20 bp, Artificial Sequence
  Synthetic oligonucleotide; AAG chr2 60543271 60543290 60543274 -
tttaagcgtgctgggtagga

SEQ ID NO: 172701 - DNA, 20 bp, Artificial Sequence
  Synthetic oligonucleotide; AGG chr2 60543270 60543289 60543273 -
ttaagcgtgctgggtaggaa

SEQ ID NO: 172702 - DNA, 20 bp, Artificial Sequence
  Synthetic oligonucleotide; AAG chr2 60543259 60543278 60543262 -
gggtaggaaaggctttatta

SEQ ID NO: 172703 - DNA, 20 bp, Artificial Sequence
  Synthetic oligonucleotide; AAG chr2 60543250 60543269 60543253 -
aggctttattaaagtgatgt

SEQ ID NO: 172704 - DNA, 20 bp, Artificial Sequence
  Synthetic oligonucleotide; TGG chr2 60543246 60543265 60543249 -
tttattaaagtgatgtaagt

SEQ ID NO: 172705 - DNA, 20 bp, Artificial Sequence
  Synthetic oligonucleotide; GAG chr2 60543239 60543258 60543242 -
aagtgatgtaagttggattt

SEQ ID NO: 172706 - DNA, 20 bp, Artificial Sequence
  Synthetic oligonucleotide; GAG chr2 60543228 60543247 60543231 -
gttggatttgagttcactgt

SEQ ID NO: 172707 - DNA, 20 bp, Artificial Sequence
  Synthetic oligonucleotide; TAG chr2 60543211 60543230 60543214 -
tgtgagcctgtactatttta

SEQ ID NO: 172708 - DNA, 20 bp, Artificial Sequence
  Synthetic oligonucleotide; AGG chr2 60543210 60543229 60543213 -
gtgagcctgtactattttat

SEQ ID NO: 172709 - DNA, 20 bp, Artificial Sequence
  Synthetic oligonucleotide; CAG chr2 60543207 60543226 60543210 -
agcctgtactattttatagg

SEQ ID NO: 172710 - DNA, 20 bp, Artificial Sequence
  Synthetic oligonucleotide; AGG chr2 60543206 60543225 60543209 -
gcctgtactattttataggc

SEQ ID NO: 172711 - DNA, 20 bp, Artificial Sequence
  Synthetic oligonucleotide; AAG chr2 60543203 60543222 60543206 -
tgtactattttataggcagg

SEQ ID NO: 172712 - DNA, 20 bp, Artificial Sequence
  Synthetic oligonucleotide; AAG chr2 60543199 60543218 60543202 -
ctattttataggcaggaagc

SEQ ID NO: 172713 - DNA, 20 bp, Artificial Sequence
  Synthetic oligonucleotide; CAG chr2 60543189 60543208 60543192 -
ggcaggaagcaagaataaaa

SEQ ID NO: 172714 - DNA, 20 bp, Artificial Sequence
  Synthetic oligonucleotide; CAG chr2 60543183 60543202 60543186 -
aagcaagaataaaacagtga

SEQ ID NO: 172715 - DNA, 20 bp, Artificial Sequence
  Synthetic oligonucleotide; AAG chr2 60543169 60543188 60543172 -
cagtgacagatcttcttcct

SEQ ID NO: 172716 - DNA, 20 bp, Artificial Sequence
  Synthetic oligonucleotide; AAG chr2 60543159 60543178 60543162 -
tcttcttcctaagataaata

SEQ ID NO: 172717 - DNA, 20 bp, Artificial Sequence
  Synthetic oligonucleotide; TAG chr2 60543154 60543173 60543157 -
ttcctaagataaataaagct

SEQ ID NO: 172718 - DNA, 20 bp, Artificial Sequence
  Synthetic oligonucleotide; CGG chr2 60543147 60543166 60543150 -
gataaataaagcttagaatt

SEQ ID NO: 172719 - DNA, 20 bp, Artificial Sequence
  Synthetic oligonucleotide; GGG chr2 60543146 60543165 60543149 -
ataaataaagcttagaattc

SEQ ID NO: 172720 - DNA, 20 bp, Artificial Sequence
  Synthetic oligonucleotide; CAG chr2 60543138 60543157 60543141 -
agcttagaattcgggacttt

SEQ ID NO: 172721 - DNA, 20 bp, Artificial Sequence
  Synthetic oligonucleotide; TAG chr2 60543134 60543153 60543137 -
tagaattcgggactttcaga

SEQ ID NO: 172722 - DNA, 20 bp, Artificial Sequence
  Synthetic oligonucleotide; AGG chr2 60543133 60543152 60543136 -
agaattcgggactttcagat

SEQ ID NO: 172723 - DNA, 20 bp, Artificial Sequence
  Synthetic oligonucleotide; GAG chr2 60543131 60543150 60543134 -
aattcgggactttcagatag

SEQ ID NO: 172724 - DNA, 20 bp, Artificial Sequence
  Synthetic oligonucleotide; AAG chr2 60543125 60543144 60543128 -
ggactttcagataggagaat

SEQ ID NO: 172725 - DNA, 20 bp, Artificial Sequence
  Synthetic oligonucleotide; AGG chr2 60543124 60543143 60543127 -
gactttcagataggagaata

SEQ ID NO: 172726 - DNA, 20 bp, Artificial Sequence
  Synthetic oligonucleotide; CAG chr2 60543121 60543140 60543124 -
tttcagataggagaataagg

SEQ ID NO: 172727 - DNA, 20 bp, Artificial Sequence
  Synthetic oligonucleotide; GAG chr2 60543119 60543138 60543122 -
tcagataggagaataaggca

SEQ ID NO: 172728 - DNA, 20 bp, Artificial Sequence
  Synthetic oligonucleotide; GAG chr2 60543103 60543122 60543106 -
ggcagagttctttaaatctt

SEQ ID NO: 172729 - DNA, 20 bp, Artificial Sequence
  Synthetic oligonucleotide; TGG chr2 60543095 60543114 60543098 -
tctttaaatcttgagtaaaa

SEQ ID NO: 172730 - DNA, 20 bp, Artificial Sequence
  Synthetic oligonucleotide; CAG chr2 60543073 60543092 60543076 -
gtatgcattttcactgtact

SEQ ID NO: 172731 - DNA, 20 bp, Artificial Sequence
  Synthetic oligonucleotide; AGG chr2 60543072 60543091 60543075 -
tatgcattttcactgtactc

SEQ ID NO: 172732 - DNA, 20 bp, Artificial Sequence
  Synthetic oligonucleotide; AAG chr2 60543062 60543081 60543065 -
cactgtactcaggcctctcc

SEQ ID NO: 172733 - DNA, 20 bp, Artificial Sequence
  Synthetic oligonucleotide; GAG chr2 60543057 60543076 60543060 -
tactcaggcctctccaagct

SEQ ID NO: 172734 - DNA, 20 bp, Artificial Sequence
  Synthetic oligonucleotide; TAG chr2 60543031 60543050 60543034 -
tttttttttttttttttttt

SEQ ID NO: 172735 - DNA, 20 bp, Artificial Sequence
  Synthetic oligonucleotide; CAG chr2 60543027 60543046 60543030 -
tttttttttttttttttaga

SEQ ID NO: 172736 - DNA, 20 bp, Artificial Sequence
  Synthetic oligonucleotide; GAG chr2 60543025 60543044 60543028 -
tttttttttttttttagaca

SEQ ID NO: 172737 - DNA, 20 bp, Artificial Sequence
  Synthetic oligonucleotide; CAG chr2 60543006 60543025 60543009 -
agagttttgctcttgttgcc

SEQ ID NO: 172738 - DNA, 20 bp, Artificial Sequence
  Synthetic oligonucleotide; AGG chr2 60543005 60543024 60543008 -
gagttttgctcttgttgccc

SEQ ID NO: 172739 - DNA, 20 bp, Artificial Sequence
  Synthetic oligonucleotide; TGG chr2 60543001 60543020 60543004 -
tttgctcttgttgcccaggc

SEQ ID NO: 172740 - DNA, 20 bp, Artificial Sequence
  Synthetic oligonucleotide; GAG chr2 60542999 60543018 60543002 -
tgctcttgttgcccaggctg

SEQ ID NO: 172741 - DNA, 20 bp, Artificial Sequence
  Synthetic oligonucleotide; CAG chr2 60542994 60543013 60542997 -
ttgttgcccaggctggagtg

SEQ ID NO: 172742 - DNA, 20 bp, Artificial Sequence
  Synthetic oligonucleotide; TGG chr2 60542991 60543010 60542994 -
ttgcccaggctggagtgcag

SEQ ID NO: 172743 - DNA, 20 bp, Artificial Sequence
  Synthetic oligonucleotide; TGG chr2 60542980 60542999 60542983 -
ggagtgcagtggcatgattt

SEQ ID NO: 172744 - DNA, 20 bp, Artificial Sequence
  Synthetic oligonucleotide; TAG chr2 60542956 60542975 60542959 -
tcactgcaacctctgcctcc

SEQ ID NO: 172745 - DNA, 20 bp, Artificial Sequence
  Synthetic oligonucleotide; AGG chr2 60542955 60542974 60542958 -
cactgcaacctctgcctcct

SEQ ID NO: 172746 - DNA, 20 bp, Artificial Sequence
  Synthetic oligonucleotide; AAG chr2 60542949 60542968 60542952 -
aacctctgcctcctaggttc

SEQ ID NO: 172747 - DNA, 20 bp, Artificial Sequence
  Synthetic oligonucleotide; CAG chr2 60542932 60542951 60542935 -
ttcaagcgattctcctgcct

SEQ ID NO: 172748 - DNA, 20 bp, Artificial Sequence
  Synthetic oligonucleotide; AAG chr2 60542923 60542942 60542926 -
ttctcctgcctcagcctccc

SEQ ID NO: 172749 - DNA, 20 bp, Artificial Sequence
  Synthetic oligonucleotide; TAG chr2 60542920 60542939 60542923 -
tcctgcctcagcctcccaag

SEQ ID NO: 172750 - DNA, 20 bp, Artificial Sequence
  Synthetic oligonucleotide; TGG chr2 60542916 60542935 60542919 -
gcctcagcctcccaagtagc

SEQ ID NO: 172751 - DNA, 20 bp, Artificial Sequence
  Synthetic oligonucleotide; GGG chr2 60542915 60542934 60542918 -
cctcagcctcccaagtagct

SEQ ID NO: 172752 - DNA, 20 bp, Artificial Sequence
  Synthetic oligonucleotide; CAG chr2 60542908 60542927 60542911 -
ctcccaagtagctgggatta

SEQ ID NO: 172753 - DNA, 20 bp, Artificial Sequence
  Synthetic oligonucleotide; AGG chr2 60542907 60542926 60542910 -
tcccaagtagctgggattac

SEQ ID NO: 172754 - DNA, 20 bp, Artificial Sequence
  Synthetic oligonucleotide; CAG chr2 60542888 60542907 60542891 -
caggcgtgtgccactacgcc

SEQ ID NO: 172755 - DNA, 20 bp, Artificial Sequence
  Synthetic oligonucleotide; TAG chr2 60542884 60542903 60542887 -
cgtgtgccactacgcccagc

SEQ ID NO: 172756 - DNA, 20 bp, Artificial Sequence
  Synthetic oligonucleotide; CAG chr2 60542868 60542887 60542871 -
cagctagttttttgtatttt

SEQ ID NO: 172757 - DNA, 20 bp, Artificial Sequence
  Synthetic oligonucleotide; TAG chr2 60542865 60542884 60542868 -
ctagttttttgtattttcag

SEQ ID NO: 172758 - DNA, 20 bp, Artificial Sequence
  Synthetic oligonucleotide; GAG chr2 60542863 60542882 60542866 -
agttttttgtattttcagta

SEQ ID NO: 172759 - DNA, 20 bp, Artificial Sequence
  Synthetic oligonucleotide; AGG chr2 60542862 60542881 60542865 -
gttttttgtattttcagtag

SEQ ID NO: 172760 - DNA, 20 bp, Artificial Sequence
  Synthetic oligonucleotide; CAG chr2 60542859 60542878 60542862 -
ttttgtattttcagtagagg

SEQ ID NO: 172761 - DNA, 20 bp, Artificial Sequence
  Synthetic oligonucleotide; AGG chr2 60542858 60542877 60542861 -
tttgtattttcagtagaggc

SEQ ID NO: 172762 - DNA, 20 bp, Artificial Sequence
  Synthetic oligonucleotide; GGG chr2 60542857 60542876 60542860 -
ttgtattttcagtagaggca

SEQ ID NO: 172763 - DNA, 20 bp, Artificial Sequence
  Synthetic oligonucleotide; TGG chr2 60542843 60542862 60542846 -
gaggcagggtttcaccatgt

SEQ ID NO: 172764 - DNA, 20 bp, Artificial Sequence
  Synthetic oligonucleotide; CAG chr2 60542839 60542858 60542842 -
cagggtttcaccatgttggc

SEQ ID NO: 172765 - DNA, 20 bp, Artificial Sequence
  Synthetic oligonucleotide; AGG chr2 60542838 60542857 60542841 -
agggtttcaccatgttggcc

SEQ ID NO: 172766 - DNA, 20 bp, Artificial Sequence
  Synthetic oligonucleotide; TGG chr2 60542834 60542853 60542837 -
tttcaccatgttggccaggc

SEQ ID NO: 172767 - DNA, 20 bp, Artificial Sequence
  Synthetic oligonucleotide; CAG chr2 60542814 60542833 60542817 -
tggtcttgaactcctgacct

SEQ ID NO: 172768 - DNA, 20 bp, Artificial Sequence
  Synthetic oligonucleotide; AGG chr2 60542813 60542832 60542816 -
ggtcttgaactcctgacctc

SEQ ID NO: 172769 - DNA, 20 bp, Artificial Sequence
  Synthetic oligonucleotide; TGG chr2 60542801 60542820 60542804 -
ctgacctcaggtgatccacc

SEQ ID NO: 172770 - DNA, 20 bp, Artificial Sequence
  Synthetic oligonucleotide; TGG chr2 60542796 60542815 60542799 -
ctcaggtgatccacctggct

SEQ ID NO: 172771 - DNA, 20 bp, Artificial Sequence
  Synthetic oligonucleotide; AAG chr2 60542786 60542805 60542789 -
ccacctggcttggcctccca

SEQ ID NO: 172772 - DNA, 20 bp, Artificial Sequence
  Synthetic oligonucleotide; TGG chr2 60542780 60542799 60542783 -
ggcttggcctcccaaagtgc

SEQ ID NO: 172773 - DNA, 20 bp, Artificial Sequence
  Synthetic oligonucleotide; GGG chr2 60542779 60542798 60542782 -
gcttggcctcccaaagtgct

SEQ ID NO: 172774 - DNA, 20 bp, Artificial Sequence
  Synthetic oligonucleotide; CAG chr2 60542772 60542791 60542775 -
ctcccaaagtgctgggatta

SEQ ID NO: 172775 - DNA, 20 bp, Artificial Sequence
  Synthetic oligonucleotide; AGG chr2 60542771 60542790 60542774 -
tcccaaagtgctgggattac

SEQ ID NO: 172776 - DNA, 20 bp, Artificial Sequence
  Synthetic oligonucleotide; GAG chr2 60542765 60542784 60542768 -
agtgctgggattacaggctt

SEQ ID NO: 172777 - DNA, 20 bp, Artificial Sequence
  Synthetic oligonucleotide; TGG chr2 60542752 60542771 60542755 -
caggcttgagcgaccgcacc

SEQ ID NO: 172778 - DNA, 20 bp, Artificial Sequence
  Synthetic oligonucleotide; GAG chr2 60542741 60542760 60542744 -
gaccgcacctggcccaaact

SEQ ID NO: 172779 - DNA, 20 bp, Artificial Sequence
  Synthetic oligonucleotide; TAG chr2 60542731 60542750 60542734 -
ggcccaaactgagtattttt

SEQ ID NO: 172780 - DNA, 20 bp, Artificial Sequence
  Synthetic oligonucleotide; GAG chr2 60542729 60542748 60542732 -
cccaaactgagtatttttta

SEQ ID NO: 172781 - DNA, 20 bp, Artificial Sequence
  Synthetic oligonucleotide; AGG chr2 60542728 60542747 60542731 -
ccaaactgagtattttttag

SEQ ID NO: 172782 - DNA, 20 bp, Artificial Sequence
  Synthetic oligonucleotide; TGG chr2 60542713 60542732 60542716 -
tttagaggattctttttacc

SEQ ID NO: 172783 - DNA, 20 bp, Artificial Sequence
  Synthetic oligonucleotide; TAG chr2 60542706 60542725 60542709 -
gattctttttacctggtgaa

SEQ ID NO: 172784 - DNA, 20 bp, Artificial Sequence
  Synthetic oligonucleotide; TGG chr2 60542702 60542721 60542705 -
ctttttacctggtgaataga

SEQ ID NO: 172785 - DNA, 20 bp, Artificial Sequence
  Synthetic oligonucleotide; GGG chr2 60542701 60542720 60542704 -
tttttacctggtgaatagat

SEQ ID NO: 172786 - DNA, 20 bp, Artificial Sequence
  Synthetic oligonucleotide; GAG chr2 60542664 60542683 60542667 -
cttcatccacgtacacatat

SEQ ID NO: 172787 - DNA, 20 bp, Artificial Sequence
  Synthetic oligonucleotide; TAG chr2 60542652 60542671 60542655 -
acacatatgagctgtacaca

SEQ ID NO: 172788 - DNA, 20 bp, Artificial Sequence
  Synthetic oligonucleotide; CAG chr2 60542641 60542660 60542644 -
ctgtacacatagatgttaat

SEQ ID NO: 172789 - DNA, 20 bp, Artificial Sequence
  Synthetic oligonucleotide; AGG chr2 60542640 60542659 60542643 -
tgtacacatagatgttaatc

SEQ ID NO: 172790 - DNA, 20 bp, Artificial Sequence
  Synthetic oligonucleotide; GAG chr2 60542583 60542602 60542586 -
ttgtgtgattgtgatccatt

SEQ ID NO: 172791 - DNA, 20 bp, Artificial Sequence
  Synthetic oligonucleotide; AAG chr2 60542573 60542592 60542576 -
gtgatccattgagatcattg

SEQ ID NO: 172792 - DNA, 20 bp, Artificial Sequence
  Synthetic oligonucleotide; TAG chr2 60542570 60542589 60542573 -
atccattgagatcattgaag

SEQ ID NO: 172793 - DNA, 20 bp, Artificial Sequence
  Synthetic oligonucleotide; TAG chr2 60542559 60542578 60542562 -
tcattgaagtagtattaatt

SEQ ID NO: 172794 - DNA, 20 bp, Artificial Sequence
  Synthetic oligonucleotide; TGG chr2 60542555 60542574 60542558 -
tgaagtagtattaatttagc

SEQ ID NO: 172795 - DNA, 20 bp, Artificial Sequence
  Synthetic oligonucleotide; GGG chr2 60542554 60542573 60542557 -
gaagtagtattaatttagct

SEQ ID NO: 172796 - DNA, 20 bp, Artificial Sequence
  Synthetic oligonucleotide; TAG chr2 60542548 60542567 60542551 -
gtattaatttagctgggaat

SEQ ID NO: 172797 - DNA, 20 bp, Artificial Sequence
  Synthetic oligonucleotide; CAG chr2 60542545 60542564 60542548 -
ttaatttagctgggaattag

SEQ ID NO: 172798 - DNA, 20 bp, Artificial Sequence
  Synthetic oligonucleotide; TGG chr2 60542531 60542550 60542534 -
aattagcagcttatgttgtg

SEQ ID NO: 172799 - DNA, 20 bp, Artificial Sequence
  Synthetic oligonucleotide; GGG chr2 60542530 60542549 60542533 -
attagcagcttatgttgtgt

SEQ ID NO: 172800 - DNA, 20 bp, Artificial Sequence
  Synthetic oligonucleotide; CAG chr2 60542525 60542544 60542528 -
cagcttatgttgtgtgggcc

SEQ ID NO: 172801 - DNA, 20 bp, Artificial Sequence
  Synthetic oligonucleotide; CAG chr2 60542491 60542510 60542494 -
gtgtgtcaaatatccaccct

SEQ ID NO: 172802 - DNA, 20 bp, Artificial Sequence
  Synthetic oligonucleotide; CAG chr2 60542484 60542503 60542487 -
aaatatccaccctcagatat

SEQ ID NO: 172803 - DNA, 20 bp, Artificial Sequence
  Synthetic oligonucleotide; CAG chr2 60542481 60542500 60542484 -
tatccaccctcagatatcag

SEQ ID NO: 172804 - DNA, 20 bp, Artificial Sequence
  Synthetic oligonucleotide; CAG chr2 60542467 60542486 60542470 -
tatcagcagcctttgacttg

SEQ ID NO: 172805 - DNA, 20 bp, Artificial Sequence
  Synthetic oligonucleotide; CAG chr2 60542463 60542482 60542466 -
agcagcctttgacttgcagt

SEQ ID NO: 172806 - DNA, 20 bp, Artificial Sequence
  Synthetic oligonucleotide; GAG chr2 60542461 60542480 60542464 -
cagcctttgacttgcagtca

SEQ ID NO: 172807 - DNA, 20 bp, Artificial Sequence
  Synthetic oligonucleotide; TAG chr2 60542451 60542470 60542454 -
cttgcagtcagagctttcaa

SEQ ID NO: 172808 - DNA, 20 bp, Artificial Sequence
  Synthetic oligonucleotide; AGG chr2 60542450 60542469 60542453 -
ttgcagtcagagctttcaat

SEQ ID NO: 172809 - DNA, 20 bp, Artificial Sequence
  Synthetic oligonucleotide; GGG chr2 60542449 60542468 60542452 -
tgcagtcagagctttcaata

SEQ ID NO: 172810 - DNA, 20 bp, Artificial Sequence
  Synthetic oligonucleotide; GGG chr2 60542448 60542467 60542451 -
gcagtcagagctttcaatag

SEQ ID NO: 172811 - DNA, 20 bp, Artificial Sequence
  Synthetic oligonucleotide; TAG chr2 60542417 60542436 60542420 -
tgttttgttttctttttttt

SEQ ID NO: 172812 - DNA, 20 bp, Artificial Sequence
  Synthetic oligonucleotide; TGG chr2 60542399 60542418 60542402 -
tttagtctcatattttatga

SEQ ID NO: 172813 - DNA, 20 bp, Artificial Sequence
  Synthetic oligonucleotide; GGG chr2 60542398 60542417 60542401 -
ttagtctcatattttatgat

SEQ ID NO: 172814 - DNA, 20 bp, Artificial Sequence
  Synthetic oligonucleotide; GGG chr2 60542397 60542416 60542400 -
tagtctcatattttatgatg

SEQ ID NO: 172815 - DNA, 20 bp, Artificial Sequence
  Synthetic oligonucleotide; GGG chr2 60542396 60542415 60542399 -
agtctcatattttatgatgg

SEQ ID NO: 172816 - DNA, 20 bp, Artificial Sequence
  Synthetic oligonucleotide; GGG chr2 60542395 60542414 60542398 -
gtctcatattttatgatggg

SEQ ID NO: 172817 - DNA, 20 bp, Artificial Sequence
  Synthetic oligonucleotide; TGG chr2 60542383 60542402 60542386 -
atgatggggggaaatattca

SEQ ID NO: 172818 - DNA, 20 bp, Artificial Sequence
  Synthetic oligonucleotide; AAG chr2 60542380 60542399 60542383 -
atggggggaaatattcatgg

SEQ ID NO: 172819 - DNA, 20 bp, Artificial Sequence
  Synthetic oligonucleotide; TAG chr2 60542347 60542366 60542350 -
gtgaaactgctgttccctta

SEQ ID NO: 172820 - DNA, 20 bp, Artificial Sequence
  Synthetic oligonucleotide; AAG chr2 60542342 60542361 60542345 -
actgctgttcccttatagaa

SEQ ID NO: 172821 - DNA, 20 bp, Artificial Sequence
  Synthetic oligonucleotide; CAG chr2 60542316 60542335 60542319 -
caaacattatcccatcatgt

SEQ ID NO: 172822 - DNA, 20 bp, Artificial Sequence
  Synthetic oligonucleotide; GAG chr2 60542309 60542328 60542312 -
tatcccatcatgtcagattt

SEQ ID NO: 172823 - DNA, 20 bp, Artificial Sequence
  Synthetic oligonucleotide; AGG chr2 60542308 60542327 60542311 -
atcccatcatgtcagatttg

SEQ ID NO: 172824 - DNA, 20 bp, Artificial Sequence
  Synthetic oligonucleotide; TGG chr2 60542302 60542321 60542305 -
tcatgtcagatttgaggttt

SEQ ID NO: 172825 - DNA, 20 bp, Artificial Sequence
  Synthetic oligonucleotide; TAG chr2 60542288 60542307 60542291 -
aggttttggcttattgcaca

SEQ ID NO: 172826 - DNA, 20 bp, Artificial Sequence
  Synthetic oligonucleotide; AGG chr2 60542287 60542306 60542290 -
ggttttggcttattgcacat

SEQ ID NO: 172827 - DNA, 20 bp, Artificial Sequence
  Synthetic oligonucleotide; TAG chr2 60542273 60542292 60542276 -
gcacataggaatctttaaat

SEQ ID NO: 172828 - DNA, 20 bp, Artificial Sequence
  Synthetic oligonucleotide; AGG chr2 60542272 60542291 60542275 -
cacataggaatctttaaatt

SEQ ID NO: 172829 - DNA, 20 bp, Artificial Sequence
  Synthetic oligonucleotide; TGG chr2 60542267 60542286 60542270 -
aggaatctttaaattaggtt

SEQ ID NO: 172830 - DNA, 20 bp, Artificial Sequence
  Synthetic oligonucleotide; GGG chr2 60542266 60542285 60542269 -
ggaatctttaaattaggttt

SEQ ID NO: 172831 - DNA, 20 bp, Artificial Sequence
  Synthetic oligonucleotide; AAG chr2 60542255 60542274 60542258 -
attaggtttgggctgtcata

SEQ ID NO: 172832 - DNA, 20 bp, Artificial Sequence
  Synthetic oligonucleotide; TAG chr2 60542251 60542270 60542254 -
ggtttgggctgtcataaagt

SEQ ID NO: 172833 - DNA, 20 bp, Artificial Sequence
  Synthetic oligonucleotide; GAG chr2 60542242 60542261 60542245 -
tgtcataaagttagcttttt

SEQ ID NO: 172834 - DNA, 20 bp, Artificial Sequence
  Synthetic oligonucleotide; GAG chr2 60542240 60542259 60542243 -
tcataaagttagctttttga

SEQ ID NO: 172835 - DNA, 20 bp, Artificial Sequence
  Synthetic oligonucleotide; TAG chr2 60542235 60542254 60542238 -
aagttagctttttgagagac

SEQ ID NO: 172836 - DNA, 20 bp, Artificial Sequence
  Synthetic oligonucleotide; GAG chr2 60542233 60542252 60542236 -
gttagctttttgagagacta

SEQ ID NO: 172837 - DNA, 20 bp, Artificial Sequence
  Synthetic oligonucleotide; AAG chr2 60542218 60542237 60542221 -
gactagagaaaaaatatgac

SEQ ID NO: 172838 - DNA, 20 bp, Artificial Sequence
  Synthetic oligonucleotide; TAG chr2 60542203 60542222 60542206 -
atgacaagtcctataaaatg

SEQ ID NO: 172839 - DNA, 20 bp, Artificial Sequence
  Synthetic oligonucleotide; AAG chr2 60542198 60542217 60542201 -
aagtcctataaaatgtagta

SEQ ID NO: 172840 - DNA, 20 bp, Artificial Sequence
  Synthetic oligonucleotide; TAG chr2 60542147 60542166 60542150 -
tctctttaaaatcatgaaca

SEQ ID NO: 172841 - DNA, 20 bp, Artificial Sequence
  Synthetic oligonucleotide; CAG chr2 60542134 60542153 60542137 -
atgaacatagacatttatat

SEQ ID NO: 172842 - DNA, 20 bp, Artificial Sequence
  Synthetic oligonucleotide; AGG chr2 60542133 60542152 60542136 -
tgaacatagacatttatatc

SEQ ID NO: 172843 - DNA, 20 bp, Artificial Sequence
  Synthetic oligonucleotide; GGG chr2 60542132 60542151 60542135 -
gaacatagacatttatatca

SEQ ID NO: 172844 - DNA, 20 bp, Artificial Sequence
  Synthetic oligonucleotide; TAG chr2 60542111 60542130 60542114 -
ggtatttaaaattatttgcc

SEQ ID NO: 172845 - DNA, 20 bp, Artificial Sequence
  Synthetic oligonucleotide; CAG chr2 60542107 60542126 60542110 -
tttaaaattatttgcctaga

SEQ ID NO: 172846 - DNA, 20 bp, Artificial Sequence
  Synthetic oligonucleotide; TAG chr2 60542102 60542121 60542105 -
aattatttgcctagacagta

SEQ ID NO: 172847 - DNA, 20 bp, Artificial Sequence
  Synthetic oligonucleotide; TGG chr2 60542098 60542117 60542101 -
atttgcctagacagtatagc

SEQ ID NO: 172848 - DNA, 20 bp, Artificial Sequence
  Synthetic oligonucleotide; TAG chr2 60542091 60542110 60542094 -
tagacagtatagctggtatt

SEQ ID NO: 172849 - DNA, 20 bp, Artificial Sequence
  Synthetic oligonucleotide; CAG chr2 60542076 60542095 60542079 -
gtatttagataatgatatat

SEQ ID NO: 172850 - DNA, 20 bp, Artificial Sequence
  Synthetic oligonucleotide; CAG chr2 60542072 60542091 60542075 -
ttagataatgatatatcaga

SEQ ID NO: 172851 - DNA, 20 bp, Artificial Sequence
  Synthetic oligonucleotide; AAG chr2 60542061 60542080 60542064 -
tatatcagacagatactcta

SEQ ID NO: 172852 - DNA, 20 bp, Artificial Sequence
  Synthetic oligonucleotide; AAG chr2 60542058 60542077 60542061 -
atcagacagatactctaaag

SEQ ID NO: 172853 - DNA, 20 bp, Artificial Sequence
  Synthetic oligonucleotide; AGG chr2 60542057 60542076 60542060 -
tcagacagatactctaaaga

SEQ ID NO: 172854 - DNA, 20 bp, Artificial Sequence
  Synthetic oligonucleotide; GGG chr2 60542056 60542075 60542059 -
cagacagatactctaaagaa

SEQ ID NO: 172855 - DNA, 20 bp, Artificial Sequence
  Synthetic oligonucleotide; GAG chr2 60542054 60542073 60542057 -
gacagatactctaaagaagg

SEQ ID NO: 172856 - DNA, 20 bp, Artificial Sequence
  Synthetic oligonucleotide; TAG chr2 60542048 60542067 60542051 -
tactctaaagaagggagata

SEQ ID NO: 172857 - DNA, 20 bp, Artificial Sequence
  Synthetic oligonucleotide; TGG chr2 60542035 60542054 60542038 -
ggagatatagtaattcaaaa

SEQ ID NO: 172858 - DNA, 20 bp, Artificial Sequence
  Synthetic oligonucleotide; TAG chr2 60542024 60542043 60542027 -
aattcaaaatggaaatacat

SEQ ID NO: 172859 - DNA, 20 bp, Artificial Sequence
  Synthetic oligonucleotide; AAG chr2 60542010 60542029 60542013 -
atacattagcatgctcttaa

SEQ ID NO: 172860 - DNA, 20 bp, Artificial Sequence
  Synthetic oligonucleotide; CAG chr2 60541984 60542003 60541987 -
atcaaatacaatatgctttt

SEQ ID NO: 172861 - DNA, 20 bp, Artificial Sequence
  Synthetic oligonucleotide; TAG chr2 60541977 60541996 60541980 -
acaatatgcttttcagaatt

SEQ ID NO: 172862 - DNA, 20 bp, Artificial Sequence
  Synthetic oligonucleotide; TAG chr2 60541929 60541948 60541932 -
tatccattctgattctctcc

SEQ ID NO: 172863 - DNA, 20 bp, Artificial Sequence
  Synthetic oligonucleotide; CAG chr2 60541924 60541943 60541927 -
attctgattctctcctagct

SEQ ID NO: 172864 - DNA, 20 bp, Artificial Sequence
  Synthetic oligonucleotide; TGG chr2 60541914 60541933 60541917 -
tctcctagctcagactgaac

SEQ ID NO: 172865 - DNA, 20 bp, Artificial Sequence
  Synthetic oligonucleotide; GAG chr2 60541912 60541931 60541915 -
tcctagctcagactgaactg

SEQ ID NO: 172866 - DNA, 20 bp, Artificial Sequence
  Synthetic oligonucleotide; AGG chr2 60541911 60541930 60541914 -
cctagctcagactgaactgg

SEQ ID NO: 172867 - DNA, 20 bp, Artificial Sequence
  Synthetic oligonucleotide; TGG chr2 60541890 60541909 60541893 -
ggatgtatttgtgtacctta

SEQ ID NO: 172868 - DNA, 20 bp, Artificial Sequence
  Synthetic oligonucleotide; GAG chr2 60541874 60541893 60541877 -
cttatggtgtaattgtaaat

SEQ ID NO: 172869 - DNA, 20 bp, Artificial Sequence
  Synthetic oligonucleotide; TAG chr2 60541860 60541879 60541863 -
gtaaatgagactataaatta

SEQ ID NO: 172870 - DNA, 20 bp, Artificial Sequence
  Synthetic oligonucleotide; AAG chr2 60541785 60541804 60541788 -
ataaaaacgactgacttctg

SEQ ID NO: 172871 - DNA, 20 bp, Artificial Sequence
  Synthetic oligonucleotide; CAG chr2 60541774 60541793 60541777 -
tgacttctgaagtgaatttt

SEQ ID NO: 172872 - DNA, 20 bp, Artificial Sequence
  Synthetic oligonucleotide; TGG chr2 60541769 60541788 60541772 -
tctgaagtgaattttcagca

SEQ ID NO: 172873 - DNA, 20 bp, Artificial Sequence
  Synthetic oligonucleotide; CAG chr2 60541766 60541785 60541769 -
gaagtgaattttcagcatgg

SEQ ID NO: 172874 - DNA, 20 bp, Artificial Sequence
  Synthetic oligonucleotide; TGG chr2 60541723 60541742 60541726 -
taccacaaaaaacaatatac

SEQ ID NO: 172875 - DNA, 20 bp, Artificial Sequence
  Synthetic oligonucleotide; CAG chr2 60541694 60541713 60541697 -
ttttacttaccttcaaaatc

SEQ ID NO: 172876 - DNA, 20 bp, Artificial Sequence
  Synthetic oligonucleotide; GAG chr2 60541692 60541711 60541695 -
ttacttaccttcaaaatcca

SEQ ID NO: 172877 - DNA, 20 bp, Artificial Sequence
  Synthetic oligonucleotide; GAG chr2 60541690 60541709 60541693 -
acttaccttcaaaatccaga

SEQ ID NO: 172878 - DNA, 20 bp, Artificial Sequence
  Synthetic oligonucleotide; TAG chr2 60541687 60541706 60541690 -
taccttcaaaatccagagag

SEQ ID NO: 172879 - DNA, 20 bp, Artificial Sequence
  Synthetic oligonucleotide; GAG chr2 60541685 60541704 60541688 -
ccttcaaaatccagagagta

SEQ ID NO: 172880 - DNA, 20 bp, Artificial Sequence
  Synthetic oligonucleotide; AAG chr2 60541666 60541685 60541669 -
agagaatattgttttctaat

SEQ ID NO: 172881 - DNA, 20 bp, Artificial Sequence
  Synthetic oligonucleotide; TAG chr2 60541659 60541678 60541662 -
attgttttctaataagtacc

SEQ ID NO: 172882 - DNA, 20 bp, Artificial Sequence
  Synthetic oligonucleotide; AGG chr2 60541658 60541677 60541661 -
ttgttttctaataagtacct

SEQ ID NO: 172883 - DNA, 20 bp, Artificial Sequence
  Synthetic oligonucleotide; TAG chr2 60541648 60541667 60541651 -
ataagtacctaggattttca

SEQ ID NO: 172884 - DNA, 20 bp, Artificial Sequence
  Synthetic oligonucleotide; AGG chr2 60541647 60541666 60541650 -
taagtacctaggattttcat

SEQ ID NO: 172885 - DNA, 20 bp, Artificial Sequence
  Synthetic oligonucleotide; GGG chr2 60541646 60541665 60541649 -
aagtacctaggattttcata

SEQ ID NO: 172886 - DNA, 20 bp, Artificial Sequence
  Synthetic oligonucleotide; GAG chr2 60541644 60541663 60541647 -
gtacctaggattttcatagg

SEQ ID NO: 172887 - DNA, 20 bp, Artificial Sequence
  Synthetic oligonucleotide; GAG chr2 60541630 60541649 60541633 -
catagggagcctatgtttgt

SEQ ID NO: 172888 - DNA, 20 bp, Artificial Sequence
  Synthetic oligonucleotide; AGG chr2 60541629 60541648 60541632 -
atagggagcctatgtttgtg

SEQ ID NO: 172889 - DNA, 20 bp, Artificial Sequence
  Synthetic oligonucleotide; AAG chr2 60541616 60541635 60541619 -
gtttgtgaggccactatcca

SEQ ID NO: 172890 - DNA, 20 bp, Artificial Sequence
  Synthetic oligonucleotide; TGG chr2 60541596 60541615 60541599 -
aagactaatgttcatgaaac

SEQ ID NO: 172891 - DNA, 20 bp, Artificial Sequence
  Synthetic oligonucleotide; GGG chr2 60541595 60541614 60541598 -
agactaatgttcatgaaact

SEQ ID NO: 172892 - DNA, 20 bp, Artificial Sequence
  Synthetic oligonucleotide; GAG chr2 60541593 60541612 60541596 -
actaatgttcatgaaactgg

SEQ ID NO: 172893 - DNA, 20 bp, Artificial Sequence
  Synthetic oligonucleotide; AAG chr2 60541580 60541599 60541583 -
aaactgggagtcctatatac

SEQ ID NO: 172894 - DNA, 20 bp, Artificial Sequence
  Synthetic oligonucleotide; AAG chr2 60541563 60541582 60541566 -
tacaagctgtatttgtaaat

SEQ ID NO: 172895 - DNA, 20 bp, Artificial Sequence
  Synthetic oligonucleotide; CAG chr2 60541559 60541578 60541562 -
agctgtatttgtaaataaga

SEQ ID NO: 172896 - DNA, 20 bp, Artificial Sequence
  Synthetic oligonucleotide; GAG chr2 60541557 60541576 60541560 -
ctgtatttgtaaataagaca

SEQ ID NO: 172897 - DNA, 20 bp, Artificial Sequence
  Synthetic oligonucleotide; AAG chr2 60541553 60541572 60541556 -
atttgtaaataagacagaga

SEQ ID NO: 172898 - DNA, 20 bp, Artificial Sequence
  Synthetic oligonucleotide; AGG chr2 60541552 60541571 60541555 -
tttgtaaataagacagagaa

SEQ ID NO: 172899 - DNA, 20 bp, Artificial Sequence
  Synthetic oligonucleotide; TGG chr2 60541541 60541560 60541544 -
gacagagaaaggttgtgaac

SEQ ID NO: 172900 - DNA, 20 bp, Artificial Sequence
  Synthetic oligonucleotide; CAG chr2 60541538 60541557 60541541 -
agagaaaggttgtgaactgg

SEQ ID NO: 172901 - DNA, 20 bp, Artificial Sequence
  Synthetic oligonucleotide; TGG chr2 60541533 60541552 60541536 -
aaggttgtgaactggcagct

SEQ ID NO: 172902 - DNA, 20 bp, Artificial Sequence
  Synthetic oligonucleotide; AAG chr2 60541519 60541538 60541522 -
gcagcttggatgttttgtca

SEQ ID NO: 172903 - DNA, 20 bp, Artificial Sequence
  Synthetic oligonucleotide; CAG chr2 60541508 60541527 60541511 -
gttttgtcaaagtacaatgt

SEQ ID NO: 172904 - DNA, 20 bp, Artificial Sequence
  Synthetic oligonucleotide; GAG chr2 60541506 60541525 60541509 -
tttgtcaaagtacaatgtca

SEQ ID NO: 172905 - DNA, 20 bp, Artificial Sequence
  Synthetic oligonucleotide; AAG chr2 60541492 60541511 60541495 -
atgtcagagaaactctttct

SEQ ID NO: 172906 - DNA, 20 bp, Artificial Sequence
  Synthetic oligonucleotide; TAG chr2 60541477 60541496 60541480 -
tttctaagacaaattgtaaa

SEQ ID NO: 172907 - DNA, 20 bp, Artificial Sequence
  Synthetic oligonucleotide; CAG chr2 60541466 60541485 60541469 -
aattgtaaatagaactgtca

SEQ ID NO: 172908 - DNA, 20 bp, Artificial Sequence
  Synthetic oligonucleotide; GAG chr2 60541450 60541469 60541453 -
gtcacagtgattgcatgatt

SEQ ID NO: 172909 - DNA, 20 bp, Artificial Sequence
  Synthetic oligonucleotide; CAG chr2 60541444 60541463 60541447 -
gtgattgcatgattgagccg

SEQ ID NO: 172910 - DNA, 20 bp, Artificial Sequence
  Synthetic oligonucleotide; AAG chr2 60541441 60541460 60541444 -
attgcatgattgagccgcag

SEQ ID NO: 172911 - DNA, 20 bp, Artificial Sequence
  Synthetic oligonucleotide; TGG chr2 60541424 60541443 60541427 -
cagaagtgtcctacaattgt

SEQ ID NO: 172912 - DNA, 20 bp, Artificial Sequence
  Synthetic oligonucleotide; CAG chr2 60541415 60541434 60541418 -
cctacaattgttggcattgt

SEQ ID NO: 172913 - DNA, 20 bp, Artificial Sequence
  Synthetic oligonucleotide; AGG chr2 60541414 60541433 60541417 -
ctacaattgttggcattgtc

SEQ ID NO: 172914 - DNA, 20 bp, Artificial Sequence
  Synthetic oligonucleotide; AAG chr2 60541403 60541422 60541406 -
ggcattgtcaggacttttga

SEQ ID NO: 172915 - DNA, 20 bp, Artificial Sequence
  Synthetic oligonucleotide; CAG chr2 60541388 60541407 60541391 -
tttgaaagcttaattaaaca

SEQ ID NO: 172916 - DNA, 20 bp, Artificial Sequence
  Synthetic oligonucleotide; TGG chr2 60541385 60541404 60541388 -
gaaagcttaattaaacacag

SEQ ID NO: 172917 - DNA, 20 bp, Artificial Sequence
  Synthetic oligonucleotide; TGG chr2 60541376 60541395 60541379 -
attaaacacagtggcccgca

SEQ ID NO: 172918 - DNA, 20 bp, Artificial Sequence
  Synthetic oligonucleotide; AAG chr2 60541359 60541378 60541362 -
gcatggctgctaaacttact

SEQ ID NO: 172919 - DNA, 20 bp, Artificial Sequence
  Synthetic oligonucleotide; AGG chr2 60541358 60541377 60541361 -
catggctgctaaacttacta

SEQ ID NO: 172920 - DNA, 20 bp, Artificial Sequence
  Synthetic oligonucleotide; AAG chr2 60541354 60541373 60541357 -
gctgctaaacttactaagga

SEQ ID NO: 172921 - DNA, 20 bp, Artificial Sequence
  Synthetic oligonucleotide; AAG chr2 60541347 60541366 60541350 -
aacttactaaggaaagccaa

SEQ ID NO: 172922 - DNA, 20 bp, Artificial Sequence
  Synthetic oligonucleotide; AGG chr2 60541346 60541365 60541349 -
acttactaaggaaagccaaa

SEQ ID NO: 172923 - DNA, 20 bp, Artificial Sequence
  Synthetic oligonucleotide; TAG chr2 60541320 60541339 60541323 -
aaaaaaatatatctaaaatg

SEQ ID NO: 172924 - DNA, 20 bp, Artificial Sequence
  Synthetic oligonucleotide; AAG chr2 60541317 60541336 60541320 -
aaaatatatctaaaatgtag

SEQ ID NO: 172925 - DNA, 20 bp, Artificial Sequence
  Synthetic oligonucleotide; AAG chr2 60541308 60541327 60541311 -
ctaaaatgtagaagatccta

SEQ ID NO: 172926 - DNA, 20 bp, Artificial Sequence
  Synthetic oligonucleotide; CAG chr2 60541291 60541310 60541294 -
ctaaagatcccaaacttctt

SEQ ID NO: 172927 - DNA, 20 bp, Artificial Sequence
  Synthetic oligonucleotide; TGG chr2 60541276 60541295 60541279 -
ttcttcagacattacccttg

SEQ ID NO: 172928 - DNA, 20 bp, Artificial Sequence
  Synthetic oligonucleotide; CAG chr2 60541268 60541287 60541271 -
acattacccttgtggtgaca

SEQ ID NO: 172929 - DNA, 20 bp, Artificial Sequence
  Synthetic oligonucleotide; AAG chr2 60541263 60541282 60541266 -
acccttgtggtgacacagaa

SEQ ID NO: 172930 - DNA, 20 bp, Artificial Sequence
  Synthetic oligonucleotide; TAG chr2 60541242 60541261 60541245 -
agatgcattgtgcattttcc

SEQ ID NO: 172931 - DNA, 20 bp, Artificial Sequence
  Synthetic oligonucleotide; GAG chr2 60541216 60541235 60541219 -
tcttttataaataatgtttt

SEQ ID NO: 172932 - DNA, 20 bp, Artificial Sequence
  Synthetic oligonucleotide; TAG chr2 60541211 60541230 60541214 -
tataaataatgttttgagaa

SEQ ID NO: 172933 - DNA, 20 bp, Artificial Sequence
  Synthetic oligonucleotide; AGG chr2 60541210 60541229 60541213 -
ataaataatgttttgagaat

SEQ ID NO: 172934 - DNA, 20 bp, Artificial Sequence
  Synthetic oligonucleotide; AAG chr2 60541194 60541213 60541197 -
gaataggtccacgtgatatg

SEQ ID NO: 172935 - DNA, 20 bp, Artificial Sequence
  Synthetic oligonucleotide; TGG chr2 60541173 60541192 60541176 -
agatcatcctgtgtgtgatg

SEQ ID NO: 172936 - DNA, 20 bp, Artificial Sequence
  Synthetic oligonucleotide; GAG chr2 60541171 60541190 60541174 -
atcatcctgtgtgtgatgtg

SEQ ID NO: 172937 - DNA, 20 bp, Artificial Sequence
  Synthetic oligonucleotide; TAG chr2 60541161 60541180 60541164 -
gtgtgatgtggagattgtgt

SEQ ID NO: 172938 - DNA, 20 bp, Artificial Sequence
  Synthetic oligonucleotide; CAG chr2 60541137 60541156 60541140 -
ttttctgtctcctgctgtta

SEQ ID NO: 172939 - DNA, 20 bp, Artificial Sequence
  Synthetic oligonucleotide; CAG chr2 60541133 60541152 60541136 -
ctgtctcctgctgttacaga

SEQ ID NO: 172940 - DNA, 20 bp, Artificial Sequence
  Synthetic oligonucleotide; TGG chr2 60541118 60541137 60541121 -
acagacagttaatgtaaaaa

SEQ ID NO: 172941 - DNA, 20 bp, Artificial Sequence
  Synthetic oligonucleotide; TGG chr2 60541107 60541126 60541110 -
atgtaaaaatggccttttat

SEQ ID NO: 172942 - DNA, 20 bp, Artificial Sequence
  Synthetic oligonucleotide; AAG chr2 60541081 60541100 60541084 -
cacaaatatgtattcacttc

SEQ ID NO: 172943 - DNA, 20 bp, Artificial Sequence
  Synthetic oligonucleotide; CAG chr2 60541076 60541095 60541079 -
atatgtattcacttcaagaa

SEQ ID NO: 172944 - DNA, 20 bp, Artificial Sequence
  Synthetic oligonucleotide; AGG chr2 60541075 60541094 60541078 -
tatgtattcacttcaagaac

SEQ ID NO: 172945 - DNA, 20 bp, Artificial Sequence
  Synthetic oligonucleotide; GAG chr2 60541073 60541092 60541076 -
tgtattcacttcaagaacag

SEQ ID NO: 172946 - DNA, 20 bp, Artificial Sequence
  Synthetic oligonucleotide; CAG chr2 60541070 60541089 60541073 -
attcacttcaagaacaggag

SEQ ID NO: 172947 - DNA, 20 bp, Artificial Sequence
  Synthetic oligonucleotide; GAG chr2 60541068 60541087 60541071 -
tcacttcaagaacaggagca

SEQ ID NO: 172948 - DNA, 20 bp, Artificial Sequence
  Synthetic oligonucleotide; AGG chr2 60541067 60541086 60541070 -
cacttcaagaacaggagcag

SEQ ID NO: 172949 - DNA, 20 bp, Artificial Sequence
  Synthetic oligonucleotide; GGG chr2 60541066 60541085 60541069 -
acttcaagaacaggagcaga

SEQ ID NO: 172950 - DNA, 20 bp, Artificial Sequence
  Synthetic oligonucleotide; GGG chr2 60541065 60541084 60541068 -
cttcaagaacaggagcagag

SEQ ID NO: 172951 - DNA, 20 bp, Artificial Sequence
  Synthetic oligonucleotide; GGG chr2 60541064 60541083 60541067 -
ttcaagaacaggagcagagg

SEQ ID NO: 172952 - DNA, 20 bp, Artificial Sequence
  Synthetic oligonucleotide; AAG chr2 60541058 60541077 60541061 -
aacaggagcagagggggaca

SEQ ID NO: 172953 - DNA, 20 bp, Artificial Sequence
  Synthetic oligonucleotide; AAG chr2 60541023 60541042 60541026 -
tctctgtgtttattctgtga

SEQ ID NO: 172954 - DNA, 20 bp, Artificial Sequence
  Synthetic oligonucleotide; CAG chr2 60540943 60540962 60540946 -
cacacacacacacacaaaac

SEQ ID NO: 172955 - DNA, 20 bp, Artificial Sequence
  Synthetic oligonucleotide; AAG chr2 60540899 60540918 60540902 -
cccattccttgttgtgttgc

SEQ ID NO: 172956 - DNA, 20 bp, Artificial Sequence
  Synthetic oligonucleotide; AAG chr2 60540880 60540899 60540883 -
caagttgtgcctttactata

SEQ ID NO: 172957 - DNA, 20 bp, Artificial Sequence
  Synthetic oligonucleotide; AGG chr2 60540879 60540898 60540882 -
aagttgtgcctttactataa

SEQ ID NO: 172958 - DNA, 20 bp, Artificial Sequence
  Synthetic oligonucleotide; TAG chr2 60540846 60540865 60540849 -
tgttttgcacacctttctct

SEQ ID NO: 172959 - DNA, 20 bp, Artificial Sequence
  Synthetic oligonucleotide; TGG chr2 60540837 60540856 60540840 -
cacctttctcttagtgaatg

SEQ ID NO: 172960 - DNA, 20 bp, Artificial Sequence
  Synthetic oligonucleotide; TGG chr2 60540824 60540843 60540827 -
gtgaatgtggcatataattg

SEQ ID NO: 172961 - DNA, 20 bp, Artificial Sequence
  Synthetic oligonucleotide; GAG chr2 60540822 60540841 60540825 -
gaatgtggcatataattgtg

SEQ ID NO: 172962 - DNA, 20 bp, Artificial Sequence
  Synthetic oligonucleotide; TGG chr2 60540812 60540831 60540815 -
tataattgtggagctgcaca

SEQ ID NO: 172963 - DNA, 20 bp, Artificial Sequence
  Synthetic oligonucleotide; GGG chr2 60540811 60540830 60540814 -
ataattgtggagctgcacat

SEQ ID NO: 172964 - DNA, 20 bp, Artificial Sequence
  Synthetic oligonucleotide; TGG chr2 60540807 60540826 60540810 -
ttgtggagctgcacatgggc

SEQ ID NO: 172965 - DNA, 20 bp, Artificial Sequence
  Synthetic oligonucleotide; TGG chr2 60540794 60540813 60540797 -
catgggctggaaaatgcaac

SEQ ID NO: 172966 - DNA, 20 bp, Artificial Sequence
  Synthetic oligonucleotide; GGG chr2 60540793 60540812 60540796 -
atgggctggaaaatgcaact

SEQ ID NO: 172967 - DNA, 20 bp, Artificial Sequence
  Synthetic oligonucleotide; TAG chr2 60540788 60540807 60540791 -
ctggaaaatgcaactgggtg

SEQ ID NO: 172968 - DNA, 20 bp, Artificial Sequence
  Synthetic oligonucleotide; CAG chr2 60540778 60540797 60540781 -
caactgggtgtagaaacgtg

SEQ ID NO: 172969 - DNA, 20 bp, Artificial Sequence
  Synthetic oligonucleotide; AGG chr2 60540777 60540796 60540780 -
aactgggtgtagaaacgtgc

SEQ ID NO: 172970 - DNA, 20 bp, Artificial Sequence
  Synthetic oligonucleotide; CAG chr2 60540774 60540793 60540777 -
tgggtgtagaaacgtgcagg

SEQ ID NO: 172971 - DNA, 20 bp, Artificial Sequence
  Synthetic oligonucleotide; AGG chr2 60540773 60540792 60540776 -
gggtgtagaaacgtgcaggc

SEQ ID NO: 172972 - DNA, 20 bp, Artificial Sequence
  Synthetic oligonucleotide; GGG chr2 60540772 60540791 60540775 -
ggtgtagaaacgtgcaggca

SEQ ID NO: 172973 - DNA, 20 bp, Artificial Sequence
  Synthetic oligonucleotide; CAG chr2 60540768 60540787 60540771 -
tagaaacgtgcaggcagggt

SEQ ID NO: 172974 - DNA, 20 bp, Artificial Sequence
  Synthetic oligonucleotide; AGG chr2 60540767 60540786 60540770 -
agaaacgtgcaggcagggtc

SEQ ID NO: 172975 - DNA, 20 bp, Artificial Sequence
  Synthetic oligonucleotide; CAG chr2 60540763 60540782 60540766 -
acgtgcaggcagggtcagga

SEQ ID NO: 172976 - DNA, 20 bp, Artificial Sequence
  Synthetic oligonucleotide; AGG chr2 60540762 60540781 60540765 -
cgtgcaggcagggtcaggac

SEQ ID NO: 172977 - DNA, 20 bp, Artificial Sequence
  Synthetic oligonucleotide; CAG chr2 60540752 60540771 60540755 -
gggtcaggacaggcaacctt

SEQ ID NO: 172978 - DNA, 20 bp, Artificial Sequence
  Synthetic oligonucleotide; CAG chr2 60540747 60540766 60540750 -
aggacaggcaaccttcagct

SEQ ID NO: 172979 - DNA, 20 bp, Artificial Sequence
  Synthetic oligonucleotide; AGG chr2 60540746 60540765 60540749 -
ggacaggcaaccttcagctc

SEQ ID NO: 172980 - DNA, 20 bp, Artificial Sequence
  Synthetic oligonucleotide; GGG chr2 60540745 60540764 60540748 -
gacaggcaaccttcagctca

SEQ ID NO: 172981 - DNA, 20 bp, Artificial Sequence
  Synthetic oligonucleotide; GAG chr2 60540743 60540762 60540746 -
caggcaaccttcagctcagg

SEQ ID NO: 172982 - DNA, 20 bp, Artificial Sequence
  Synthetic oligonucleotide; AGG chr2 60540742 60540761 60540745 -
aggcaaccttcagctcaggg

SEQ ID NO: 172983 - DNA, 20 bp, Artificial Sequence
  Synthetic oligonucleotide; GAG chr2 60540740 60540759 60540743 -
gcaaccttcagctcagggag

SEQ ID NO: 172984 - DNA, 20 bp, Artificial Sequence
  Synthetic oligonucleotide; AGG chr2 60540739 60540758 60540742 -
caaccttcagctcagggagg

SEQ ID NO: 172985 - DNA, 20 bp, Artificial Sequence
  Synthetic oligonucleotide; GAG chr2 60540735 60540754 60540738 -
cttcagctcagggaggaggc

SEQ ID NO: 172986 - DNA, 20 bp, Artificial Sequence
  Synthetic oligonucleotide; TGG chr2 60540731 60540750 60540734 -
agctcagggaggaggcgagt

SEQ ID NO: 172987 - DNA, 20 bp, Artificial Sequence
  Synthetic oligonucleotide; TGG chr2 60540717 60540736 60540720 -
gcgagttggatgcttattaa

SEQ ID NO: 172988 - DNA, 20 bp, Artificial Sequence
  Synthetic oligonucleotide; TAG chr2 60540707 60540726 60540710 -
tgcttattaatggcatcttt

SEQ ID NO: 172989 - DNA, 20 bp, Artificial Sequence
  Synthetic oligonucleotide; GAG chr2 60540705 60540724 60540708 -
cttattaatggcatctttta

SEQ ID NO: 172990 - DNA, 20 bp, Artificial Sequence
  Synthetic oligonucleotide; TGG chr2 60540699 60540718 60540702 -
aatggcatcttttagagtcc

SEQ ID NO: 172991 - DNA, 20 bp, Artificial Sequence
  Synthetic oligonucleotide; CAG chr2 60540675 60540694 60540678 -
aaatcattaatttcacactg

SEQ ID NO: 172992 - DNA, 20 bp, Artificial Sequence
  Synthetic oligonucleotide; TAG chr2 60540664 60540683 60540667 -
ttcacactgcagcttccatg

SEQ ID NO: 172993 - DNA, 20 bp, Artificial Sequence
  Synthetic oligonucleotide; TGG chr2 60540659 60540678 60540662 -
actgcagcttccatgtagtt

SEQ ID NO: 172994 - DNA, 20 bp, Artificial Sequence
  Synthetic oligonucleotide; TGG chr2 60540650 60540669 60540653 -
tccatgtagtttggctaatg

SEQ ID NO: 172995 - DNA, 20 bp, Artificial Sequence
  Synthetic oligonucleotide; GGG chr2 60540649 60540668 60540652 -
ccatgtagtttggctaatgt

SEQ ID NO: 172996 - DNA, 20 bp, Artificial Sequence
  Synthetic oligonucleotide; GAG chr2 60540647 60540666 60540650 -
atgtagtttggctaatgtgg

SEQ ID NO: 172997 - DNA, 20 bp, Artificial Sequence
  Synthetic oligonucleotide; TGG chr2 60540636 60540655 60540639 -
ctaatgtgggagtactaaat

SEQ ID NO: 172998 - DNA, 20 bp, Artificial Sequence
  Synthetic oligonucleotide; GGG chr2 60540635 60540654 60540638 -
taatgtgggagtactaaatt

SEQ ID NO: 172999 - DNA, 20 bp, Artificial Sequence
  Synthetic oligonucleotide; GGG chr2 60540634 60540653 60540637 -
aatgtgggagtactaaattg

SEQ ID NO: 173000 - DNA, 20 bp, Artificial Sequence
  Synthetic oligonucleotide; TAG chr2 60540609 60540628 60540612 -
cataaaaaacatgcaaatcc

SEQ ID NO: 173001 - DNA, 20 bp, Artificial Sequence
  Synthetic oligonucleotide; AGG chr2 60540608 60540627 60540611 -
ataaaaaacatgcaaatcct

SEQ ID NO: 173002 - DNA, 20 bp, Artificial Sequence
  Synthetic oligonucleotide; GGG chr2 60540607 60540626 60540610 -
taaaaaacatgcaaatccta

SEQ ID NO: 173003 - DNA, 20 bp, Artificial Sequence
  Synthetic oligonucleotide; TAG chr2 60540594 60540613 60540597 -
aatcctagggaaacattttt

SEQ ID NO: 173004 - DNA, 20 bp, Artificial Sequence
  Synthetic oligonucleotide; AAG chr2 60540558 60540577 60540561 -
ctcaatgaaaatgtttaata

SEQ ID NO: 173005 - DNA, 20 bp, Artificial Sequence
  Synthetic oligonucleotide; AGG chr2 60540557 60540576 60540560 -
tcaatgaaaatgtttaataa

SEQ ID NO: 173006 - DNA, 20 bp, Artificial Sequence
  Synthetic oligonucleotide; GAG chr2 60540555 60540574 60540558 -
aatgaaaatgtttaataaag

SEQ ID NO: 173007 - DNA, 20 bp, Artificial Sequence
  Synthetic oligonucleotide; TAG chr2 60540550 60540569 60540553 -
aaatgtttaataaaggagaa

SEQ ID NO: 173008 - DNA, 20 bp, Artificial Sequence
  Synthetic oligonucleotide; AGG chr2 60540549 60540568 60540552 -
aatgtttaataaaggagaat

SEQ ID NO: 173009 - DNA, 20 bp, Artificial Sequence
  Synthetic oligonucleotide; TGG chr2 60540542 60540561 60540545 -
aataaaggagaataggtgaa

SEQ ID NO: 173010 - DNA, 20 bp, Artificial Sequence
  Synthetic oligonucleotide; TGG chr2 60540539 60540558 60540542 -
aaaggagaataggtgaatgg

SEQ ID NO: 173011 - DNA, 20 bp, Artificial Sequence
  Synthetic oligonucleotide; TGG chr2 60540526 60540545 60540529 -
tgaatggtggctttgcgtgc

SEQ ID NO: 173012 - DNA, 20 bp, Artificial Sequence
  Synthetic oligonucleotide; CAG chr2 60540522 60540541 60540525 -
tggtggctttgcgtgctggt

SEQ ID NO: 173013 - DNA, 20 bp, Artificial Sequence
  Synthetic oligonucleotide; AAG chr2 60540518 60540537 60540521 -
ggctttgcgtgctggtcagt

SEQ ID NO: 173014 - DNA, 20 bp, Artificial Sequence
  Synthetic oligonucleotide; AAG chr2 60540514 60540533 60540517 -
ttgcgtgctggtcagtaaga

SEQ ID NO: 173015 - DNA, 20 bp, Artificial Sequence
  Synthetic oligonucleotide; AGG chr2 60540513 60540532 60540516 -
tgcgtgctggtcagtaagaa

SEQ ID NO: 173016 - DNA, 20 bp, Artificial Sequence
  Synthetic oligonucleotide; TGG chr2 60540500 60540519 60540503 -
gtaagaaaggaaacaaattt

SEQ ID NO: 173017 - DNA, 20 bp, Artificial Sequence
  Synthetic oligonucleotide; TGG chr2 60540489 60540508 60540492 -
aacaaattttggctttcctt

SEQ ID NO: 173018 - DNA, 20 bp, Artificial Sequence
  Synthetic oligonucleotide; GGG chr2 60540488 60540507 60540491 -
acaaattttggctttccttt

SEQ ID NO: 173019 - DNA, 20 bp, Artificial Sequence
  Synthetic oligonucleotide; GGG chr2 60540487 60540506 60540490 -
caaattttggctttcctttg

SEQ ID NO: 173020 - DNA, 20 bp, Artificial Sequence
  Synthetic oligonucleotide; GGG chr2 60540486 60540505 60540489 -
aaattttggctttcctttgg

SEQ ID NO: 173021 - DNA, 20 bp, Artificial Sequence
  Synthetic oligonucleotide; GGG chr2 60540485 60540504 60540488 -
aattttggctttcctttggg

SEQ ID NO: 173022 - DNA, 20 bp, Artificial Sequence
  Synthetic oligonucleotide; AAG chr2 60540464 60540483 60540467 -
ggaaatattaaatttaaccg

SEQ ID NO: 173023 - DNA, 20 bp, Artificial Sequence
  Synthetic oligonucleotide; TAG chr2 60540461 60540480 60540464 -
aatattaaatttaaccgaag

SEQ ID NO: 173024 - DNA, 20 bp, Artificial Sequence
  Synthetic oligonucleotide; AAG chr2 60540457 60540476 60540460 -
ttaaatttaaccgaagtaga

SEQ ID NO: 173025 - DNA, 20 bp, Artificial Sequence
  Synthetic oligonucleotide; CAG chr2 60540452 60540471 60540455 -
tttaaccgaagtagaaagca

SEQ ID NO: 173026 - DNA, 20 bp, Artificial Sequence
  Synthetic oligonucleotide; TAG chr2 60540448 60540467 60540451 -
accgaagtagaaagcacagc

SEQ ID NO: 173027 - DNA, 20 bp, Artificial Sequence
  Synthetic oligonucleotide; AGG chr2 60540447 60540466 60540450 -
ccgaagtagaaagcacagct

SEQ ID NO: 173028 - DNA, 20 bp, Artificial Sequence
  Synthetic oligonucleotide; GGG chr2 60540446 60540465 60540449 -
cgaagtagaaagcacagcta

SEQ ID NO: 173029 - DNA, 20 bp, Artificial Sequence
  Synthetic oligonucleotide; GAG chr2 60540444 60540463 60540447 -
aagtagaaagcacagctagg

SEQ ID NO: 173030 - DNA, 20 bp, Artificial Sequence
  Synthetic oligonucleotide; AAG chr2 60540434 60540453 60540437 -
cacagctagggagatgcacc

SEQ ID NO: 173031 - DNA, 20 bp, Artificial Sequence
  Synthetic oligonucleotide; TGG chr2 60540421 60540440 60540424 -
atgcaccaagattgcgtcac

SEQ ID NO: 173032 - DNA, 20 bp, Artificial Sequence
  Synthetic oligonucleotide; TGG chr2 60540399 60540418 60540402 -
gatgttaatttaatctactt

SEQ ID NO: 173033 - DNA, 20 bp, Artificial Sequence
  Synthetic oligonucleotide; TGG chr2 60540395 60540414 60540398 -
ttaatttaatctactttggt

SEQ ID NO: 173034 - DNA, 20 bp, Artificial Sequence
  Synthetic oligonucleotide; AAG chr2 60540368 60540387 60540371 -
ttcacaccctttattgcaca

SEQ ID NO: 173035 - DNA, 20 bp, Artificial Sequence
  Synthetic oligonucleotide; AAG chr2 60540365 60540384 60540368 -
acaccctttattgcacaaag

SEQ ID NO: 173036 - DNA, 20 bp, Artificial Sequence
  Synthetic oligonucleotide; AAG chr2 60540341 60540360 60540344 -
catttgacaaaatttacccc

SEQ ID NO: 173037 - DNA, 20 bp, Artificial Sequence
  Synthetic oligonucleotide; AAG chr2 60540335 60540354 60540338 -
acaaaatttaccccaagccc

SEQ ID NO: 173038 - DNA, 20 bp, Artificial Sequence
  Synthetic oligonucleotide; CAG chr2 60540318 60540337 60540321 -
cccaagtctgtttttacata

SEQ ID NO: 173039 - DNA, 20 bp, Artificial Sequence
  Synthetic oligonucleotide; TAG chr2 60540315 60540334 60540318 -
aagtctgtttttacatacag

SEQ ID NO: 173040 - DNA, 20 bp, Artificial Sequence
  Synthetic oligonucleotide; CAG chr2 60540309 60540328 60540312 -
gtttttacatacagtagtac

SEQ ID NO: 173041 - DNA, 20 bp, Artificial Sequence
  Synthetic oligonucleotide; AAG chr2 60540292 60540311 60540295 -
taccagctttgtgcaataaa

SEQ ID NO: 173042 - DNA, 20 bp, Artificial Sequence
  Synthetic oligonucleotide; TAG chr2 60540285 60540304 60540288 -
tttgtgcaataaaaagcact

SEQ ID NO: 173043 - DNA, 20 bp, Artificial Sequence
  Synthetic oligonucleotide; AAG chr2 60540278 60540297 60540281 -
aataaaaagcacttagcatc

SEQ ID NO: 173044 - DNA, 20 bp, Artificial Sequence
  Synthetic oligonucleotide; TGG chr2 60540274 60540293 60540277 -
aaaagcacttagcatcaagc

SEQ ID NO: 173045 - DNA, 20 bp, Artificial Sequence
  Synthetic oligonucleotide; CAG chr2 60540268 60540287 60540271 -
acttagcatcaagctggacc

SEQ ID NO: 173046 - DNA, 20 bp, Artificial Sequence
  Synthetic oligonucleotide; TGG chr2 60540263 60540282 60540266 -
gcatcaagctggacccagcc

SEQ ID NO: 173047 - DNA, 20 bp, Artificial Sequence
  Synthetic oligonucleotide; TAG chr2 60540244 60540263 60540247 -
ctggcaccttgccacttttt

SEQ ID NO: 173048 - DNA, 20 bp, Artificial Sequence
  Synthetic oligonucleotide; GAG chr2 60540238 60540257 60540241 -
ccttgccacttttttagcat

SEQ ID NO: 173049 - DNA, 20 bp, Artificial Sequence
  Synthetic oligonucleotide; AAG chr2 60540224 60540243 60540227 -
tagcatgagatttaatcacc

SEQ ID NO: 173050 - DNA, 20 bp, Artificial Sequence
  Synthetic oligonucleotide; TAG chr2 60540215 60540234 60540218 -
atttaatcaccaagcatctt

SEQ ID NO: 173051 - DNA, 20 bp, Artificial Sequence
  Synthetic oligonucleotide; CAG chr2 60540196 60540215 60540199 -
ttagtacctttctgcttgtt

SEQ ID NO: 173052 - DNA, 20 bp, Artificial Sequence
  Synthetic oligonucleotide; TGG chr2 60540185 60540204 60540188 -
ctgcttgttcagatttcatt

SEQ ID NO: 173053 - DNA, 20 bp, Artificial Sequence
  Synthetic oligonucleotide; GGG chr2 60540184 60540203 60540187 -
tgcttgttcagatttcattt

SEQ ID NO: 173054 - DNA, 20 bp, Artificial Sequence
  Synthetic oligonucleotide; TGG chr2 60540178 60540197 60540181 -
ttcagatttcatttgggtca

SEQ ID NO: 173055 - DNA, 20 bp, Artificial Sequence
  Synthetic oligonucleotide; CAG chr2 60540169 60540188 60540172 -
catttgggtcatggctatgt

SEQ ID NO: 173056 - DNA, 20 bp, Artificial Sequence
  Synthetic oligonucleotide; CAG chr2 60540166 60540185 60540169 -
ttgggtcatggctatgtcag

SEQ ID NO: 173057 - DNA, 20 bp, Artificial Sequence
  Synthetic oligonucleotide; AAG chr2 60540151 60540170 60540154 -
gtcagcagtgttgttatttc

SEQ ID NO: 173058 - DNA, 20 bp, Artificial Sequence
  Synthetic oligonucleotide; AGG chr2 60540150 60540169 60540153 -
tcagcagtgttgttatttca

SEQ ID NO: 173059 - DNA, 20 bp, Artificial Sequence
  Synthetic oligonucleotide; AAG chr2 60540137 60540156 60540140 -
tatttcaaggattaaaaaaa

SEQ ID NO: 173060 - DNA, 20 bp, Artificial Sequence
  Synthetic oligonucleotide; TAG chr2 60540125 60540144 60540128 -
taaaaaaaaagattctaact

SEQ ID NO: 173061 - DNA, 20 bp, Artificial Sequence
  Synthetic oligonucleotide; GAG chr2 60540123 60540142 60540126 -
aaaaaaaagattctaactta

SEQ ID NO: 173062 - DNA, 20 bp, Artificial Sequence
  Synthetic oligonucleotide; AAG chr2 60540095 60540114 60540098 -
ttttaacattatttcaaatc

SEQ ID NO: 173063 - DNA, 20 bp, Artificial Sequence
  Synthetic oligonucleotide; CAG chr2 60540092 60540111 60540095 -
taacattatttcaaatcaag

SEQ ID NO: 173064 - DNA, 20 bp, Artificial Sequence
  Synthetic oligonucleotide; AGG chr2 60540091 60540110 60540094 -
aacattatttcaaatcaagc

SEQ ID NO: 173065 - DNA, 20 bp, Artificial Sequence
  Synthetic oligonucleotide; TGG chr2 60540067 60540086 60540070 -
ttttatgttatgtatcaatt

SEQ ID NO: 173066 - DNA, 20 bp, Artificial Sequence
  Synthetic oligonucleotide; AAG chr2 60540052 60540071 60540055 -
caatttggatgacattaatg

SEQ ID NO: 173067 - DNA, 20 bp, Artificial Sequence
  Synthetic oligonucleotide; CAG chr2 60540034 60540053 60540037 -
tgaagttcataaaatatgtt

SEQ ID NO: 173068 - DNA, 20 bp, Artificial Sequence
  Synthetic oligonucleotide; TGG chr2 60540017 60540036 60540020 -
gttcagactatataatttaa

SEQ ID NO: 173069 - DNA, 20 bp, Artificial Sequence
  Synthetic oligonucleotide; TAG chr2 60539982 60540001 60539985 -
atttttatttgtaatacaaa

SEQ ID NO: 173070 - DNA, 20 bp, Artificial Sequence
  Synthetic oligonucleotide; AGG chr2 60539981 60540000 60539984 -
tttttatttgtaatacaaat

SEQ ID NO: 173071 - DNA, 20 bp, Artificial Sequence
  Synthetic oligonucleotide; TGG chr2 60539951 60539970 60539954 -
ctgttgtctccctccctcct

SEQ ID NO: 173072 - DNA, 20 bp, Artificial Sequence
  Synthetic oligonucleotide; TAG chr2 60539933 60539952 60539936 -
cttggttcttttctcctacc

SEQ ID NO: 173073 - DNA, 20 bp, Artificial Sequence
  Synthetic oligonucleotide; AGG chr2 60539932 60539951 60539935 -
ttggttcttttctcctacct

SEQ ID NO: 173074 - DNA, 20 bp, Artificial Sequence
  Synthetic oligonucleotide; TGG chr2 60539925 60539944 60539928 -
ttttctcctacctaggtaaa

SEQ ID NO: 173075 - DNA, 20 bp, Artificial Sequence
  Synthetic oligonucleotide; GGG chr2 60539924 60539943 60539927 -
tttctcctacctaggtaaat

SEQ ID NO: 173076 - DNA, 20 bp, Artificial Sequence
  Synthetic oligonucleotide; CAG chr2 60539911 60539930 60539914 -
ggtaaatgggcatccttaaa

SEQ ID NO: 173077 - DNA, 20 bp, Artificial Sequence
  Synthetic oligonucleotide; CAG chr2 60539891 60539910 60539894 -
cagcttctcccctttacgac

SEQ ID NO: 173078 - DNA, 20 bp, Artificial Sequence
  Synthetic oligonucleotide; AGG chr2 60539890 60539909 60539893 -
agcttctcccctttacgacc

SEQ ID NO: 173079 - DNA, 20 bp, Artificial Sequence
  Synthetic oligonucleotide; GGG chr2 60539889 60539908 60539892 -
gcttctcccctttacgacca

SEQ ID NO: 173080 - DNA, 20 bp, Artificial Sequence
  Synthetic oligonucleotide; TAG chr2 60539884 60539903 60539887 -
tcccctttacgaccagggta

SEQ ID NO: 173081 - DNA, 20 bp, Artificial Sequence
  Synthetic oligonucleotide; GAG chr2 60539882 60539901 60539885 -
ccctttacgaccagggtata

SEQ ID NO: 173082 - DNA, 20 bp, Artificial Sequence
  Synthetic oligonucleotide; TGG chr2 60539876 60539895 60539879 -
acgaccagggtatagagcac

SEQ ID NO: 173083 - DNA, 20 bp, Artificial Sequence
  Synthetic oligonucleotide; CAG chr2 60539866 60539885 60539869 -
tatagagcactggccaatat

SEQ ID NO: 173084 - DNA, 20 bp, Artificial Sequence
  Synthetic oligonucleotide; TAG chr2 60539837 60539856 60539840 -
tacctttgtaatttgccacg

SEQ ID NO: 173085 - DNA, 20 bp, Artificial Sequence
  Synthetic oligonucleotide; GAG chr2 60539808 60539827 60539811 -
caacatgacctaattaattt

SEQ ID NO: 173086 - DNA, 20 bp, Artificial Sequence
  Synthetic oligonucleotide; TGG chr2 60539784 60539803 60539787 -
acgaaccatattattgctac

SEQ ID NO: 173087 - DNA, 20 bp, Artificial Sequence
  Synthetic oligonucleotide; GAG chr2 60539782 60539801 60539785 -
gaaccatattattgctactg

SEQ ID NO: 173088 - DNA, 20 bp, Artificial Sequence
  Synthetic oligonucleotide; CAG chr2 60539753 60539772 60539756 -
tctgtcacaaacttaatttc

SEQ ID NO: 173089 - DNA, 20 bp, Artificial Sequence
  Synthetic oligonucleotide; AGG chr2 60539752 60539771 60539755 -
ctgtcacaaacttaatttcc

SEQ ID NO: 173090 - DNA, 20 bp, Artificial Sequence
  Synthetic oligonucleotide; AAG chr2 60539731 60539750 60539734 -
ggaaatgtaacctgacaaat

SEQ ID NO: 173091 - DNA, 20 bp, Artificial Sequence
  Synthetic oligonucleotide; TAG chr2 60539721 60539740 60539724 -
cctgacaaataagaattctt

SEQ ID NO: 173092 - DNA, 20 bp, Artificial Sequence
  Synthetic oligonucleotide; TAG chr2 60539701 60539720 60539704 -
tagctctctacatgtgctcc

SEQ ID NO: 173093 - DNA, 20 bp, Artificial Sequence
  Synthetic oligonucleotide; GAG chr2 60539699 60539718 60539702 -
gctctctacatgtgctccta

SEQ ID NO: 173094 - DNA, 20 bp, Artificial Sequence
  Synthetic oligonucleotide; AAG chr2 60539692 60539711 60539695 -
acatgtgctcctagagacca

SEQ ID NO: 173095 - DNA, 20 bp, Artificial Sequence
  Synthetic oligonucleotide; AGG chr2 60539691 60539710 60539694 -
catgtgctcctagagaccaa

SEQ ID NO: 173096 - DNA, 20 bp, Artificial Sequence
  Synthetic oligonucleotide; CAG chr2 60539688 60539707 60539691 -
gtgctcctagagaccaaagg

SEQ ID NO: 173097 - DNA, 20 bp, Artificial Sequence
  Synthetic oligonucleotide; AAG chr2 60539662 60539681 60539665 -
taaaataataataattttaa

SEQ ID NO: 173098 - DNA, 20 bp, Artificial Sequence
  Synthetic oligonucleotide; CAG chr2 60539656 60539675 60539659 -
aataataattttaaaagtgc

SEQ ID NO: 173099 - DNA, 20 bp, Artificial Sequence
  Synthetic oligonucleotide; AAG chr2 60539645 60539664 60539648 -
taaaagtgccagcattatta

SEQ ID NO: 173100 - DNA, 20 bp, Artificial Sequence
  Synthetic oligonucleotide; CAG chr2 60539641 60539660 60539644 -
agtgccagcattattaaagc

SEQ ID NO: 173101 - DNA, 20 bp, Artificial Sequence
  Synthetic oligonucleotide; AAG chr2 60539613 60539632 60539616 -
ttgatgccaaactcaatttg

SEQ ID NO: 173102 - DNA, 20 bp, Artificial Sequence
  Synthetic oligonucleotide; CAG chr2 60539609 60539628 60539612 -
tgccaaactcaatttgaagc

SEQ ID NO: 173103 - DNA, 20 bp, Artificial Sequence
  Synthetic oligonucleotide; CAG chr2 60539599 60539618 60539602 -
aatttgaagccagtaaacat

SEQ ID NO: 173104 - DNA, 20 bp, Artificial Sequence
  Synthetic oligonucleotide; CAG chr2 60539582 60539601 60539585 -
catcagactgtatttctaat

SEQ ID NO: 173105 - DNA, 20 bp, Artificial Sequence
  Synthetic oligonucleotide; TGG chr2 60539554 60539573 60539557 -
aaatgtaacttattccatat

SEQ ID NO: 173106 - DNA, 20 bp, Artificial Sequence
  Synthetic oligonucleotide; GGG chr2 60539553 60539572 60539556 -
aatgtaacttattccatatt

SEQ ID NO: 173107 - DNA, 20 bp, Artificial Sequence
  Synthetic oligonucleotide; TGG chr2 60539545 60539564 60539548 -
ttattccatattgggttcat

SEQ ID NO: 173108 - DNA, 20 bp, Artificial Sequence
  Synthetic oligonucleotide; TGG chr2 60539520 60539539 60539523 -
tttgtctccctgctttttac

SEQ ID NO: 173109 - DNA, 20 bp, Artificial Sequence
  Synthetic oligonucleotide; CAG chr2 60539516 60539535 60539519 -
tctccctgctttttactggc

SEQ ID NO: 173110 - DNA, 20 bp, Artificial Sequence
  Synthetic oligonucleotide; CAG chr2 60539483 60539502 60539486 -
tatgcatttttaaaacattt

SEQ ID NO: 173111 - DNA, 20 bp, Artificial Sequence
  Synthetic oligonucleotide; AAG chr2 60539478 60539497 60539481 -
atttttaaaacatttcagca

SEQ ID NO: 173112 - DNA, 20 bp, Artificial Sequence
  Synthetic oligonucleotide; AGG chr2 60539477 60539496 60539480 -
tttttaaaacatttcagcaa

SEQ ID NO: 173113 - DNA, 20 bp, Artificial Sequence
  Synthetic oligonucleotide; TAG chr2 60539461 60539480 60539464 -
gcaaaggcttttgctgttct

SEQ ID NO: 173114 - DNA, 20 bp, Artificial Sequence
  Synthetic oligonucleotide; CAG chr2 60539458 60539477 60539461 -
aaggcttttgctgttcttag

SEQ ID NO: 173115 - DNA, 20 bp, Artificial Sequence
  Synthetic oligonucleotide; AGG chr2 60539457 60539476 60539460 -
aggcttttgctgttcttagc

SEQ ID NO: 173116 - DNA, 20 bp, Artificial Sequence
  Synthetic oligonucleotide; GGG chr2 60539456 60539475 60539459 -
ggcttttgctgttcttagca

SEQ ID NO: 173117 - DNA, 20 bp, Artificial Sequence
  Synthetic oligonucleotide; TAG chr2 60539452 60539471 60539455 -
tttgctgttcttagcagggt

SEQ ID NO: 173118 - DNA, 20 bp, Artificial Sequence
  Synthetic oligonucleotide; TGG chr2 60539444 60539463 60539447 -
tcttagcagggttagtaact

SEQ ID NO: 173119 - DNA, 20 bp, Artificial Sequence
  Synthetic oligonucleotide; GGG chr2 60539443 60539462 60539446 -
cttagcagggttagtaactt

SEQ ID NO: 173120 - DNA, 20 bp, Artificial Sequence
  Synthetic oligonucleotide; GGG chr2 60539442 60539461 60539445 -
ttagcagggttagtaacttg

SEQ ID NO: 173121 - DNA, 20 bp, Artificial Sequence
  Synthetic oligonucleotide; GAG chr2 60539430 60539449 60539433 -
gtaacttggggtctatttct

SEQ ID NO: 173122 - DNA, 20 bp, Artificial Sequence
  Synthetic oligonucleotide; TGG chr2 60539408 60539427 60539411 -
gctcattcgtcattctgcaa

SEQ ID NO: 173123 - DNA, 20 bp, Artificial Sequence
  Synthetic oligonucleotide; GAG chr2 60539401 60539420 60539404 -
cgtcattctgcaatggcatt

SEQ ID NO: 173124 - DNA, 20 bp, Artificial Sequence
  Synthetic oligonucleotide; TAG chr2 60539397 60539416 60539400 -
attctgcaatggcattgagt

SEQ ID NO: 173125 - DNA, 20 bp, Artificial Sequence
  Synthetic oligonucleotide; AGG chr2 60539396 60539415 60539399 -
ttctgcaatggcattgagtt

SEQ ID NO: 173126 - DNA, 20 bp, Artificial Sequence
  Synthetic oligonucleotide; TGG chr2 60539392 60539411 60539395 -
gcaatggcattgagttaggt

SEQ ID NO: 173127 - DNA, 20 bp, Artificial Sequence
  Synthetic oligonucleotide; AAG chr2 60539388 60539407 60539391 -
tggcattgagttaggttggc

SEQ ID NO: 173128 - DNA, 20 bp, Artificial Sequence
  Synthetic oligonucleotide; AGG chr2 60539387 60539406 60539390 -
ggcattgagttaggttggca

SEQ ID NO: 173129 - DNA, 20 bp, Artificial Sequence
  Synthetic oligonucleotide; GGG chr2 60539386 60539405 60539389 -
gcattgagttaggttggcaa

SEQ ID NO: 173130 - DNA, 20 bp, Artificial Sequence
  Synthetic oligonucleotide; AAG chr2 60539383 60539402 60539386 -
ttgagttaggttggcaaggg

SEQ ID NO: 173131 - DNA, 20 bp, Artificial Sequence
  Synthetic oligonucleotide; AGG chr2 60539382 60539401 60539385 -
tgagttaggttggcaaggga

SEQ ID NO: 173132 - DNA, 20 bp, Artificial Sequence
  Synthetic oligonucleotide; GAG chr2 60539375 60539394 60539378 -
ggttggcaagggaaggattt

SEQ ID NO: 173133 - DNA, 20 bp, Artificial Sequence
  Synthetic oligonucleotide; AGG chr2 60539374 60539393 60539377 -
gttggcaagggaaggatttg

SEQ ID NO: 173134 - DNA, 20 bp, Artificial Sequence
  Synthetic oligonucleotide; TGG chr2 60539369 60539388 60539372 -
caagggaaggatttgaggca

SEQ ID NO: 173135 - DNA, 20 bp, Artificial Sequence
  Synthetic oligonucleotide; GGG chr2 60539368 60539387 60539371 -
aagggaaggatttgaggcat

SEQ ID NO: 173136 - DNA, 20 bp, Artificial Sequence
  Synthetic oligonucleotide; GGG chr2 60539367 60539386 60539370 -
agggaaggatttgaggcatg

SEQ ID NO: 173137 - DNA, 20 bp, Artificial Sequence
  Synthetic oligonucleotide; GGG chr2 60539366 60539385 60539369 -
gggaaggatttgaggcatgg

SEQ ID NO: 173138 - DNA, 20 bp, Artificial Sequence
  Synthetic oligonucleotide; GGG chr2 60539365 60539384 60539368 -
ggaaggatttgaggcatggg

SEQ ID NO: 173139 - DNA, 20 bp, Artificial Sequence
  Synthetic oligonucleotide; TGG chr2 60539362 60539381 60539365 -
aggatttgaggcatgggggg

SEQ ID NO: 173140 - DNA, 20 bp, Artificial Sequence
  Synthetic oligonucleotide; GAG chr2 60539358 60539377 60539361 -
tttgaggcatggggggtggt

SEQ ID NO: 173141 - DNA, 20 bp, Artificial Sequence
  Synthetic oligonucleotide; AGG chr2 60539357 60539376 60539360 -
ttgaggcatggggggtggtg

SEQ ID NO: 173142 - DNA, 20 bp, Artificial Sequence
  Synthetic oligonucleotide; CAG chr2 60539341 60539360 60539344 -
ggtgaggtcacttctgatcc

SEQ ID NO: 173143 - DNA, 20 bp, Artificial Sequence
  Synthetic oligonucleotide; CAG chr2 60539338 60539357 60539341 -
gaggtcacttctgatcccag

SEQ ID NO: 173144 - DNA, 20 bp, Artificial Sequence
  Synthetic oligonucleotide; AGG chr2 60539337 60539356 60539340 -
aggtcacttctgatcccagc

SEQ ID NO: 173145 - DNA, 20 bp, Artificial Sequence
  Synthetic oligonucleotide; GGG chr2 60539336 60539355 60539339 -
ggtcacttctgatcccagca

SEQ ID NO: 173146 - DNA, 20 bp, Artificial Sequence
  Synthetic oligonucleotide; TAG chr2 60539331 60539350 60539334 -
cttctgatcccagcagggaa

SEQ ID NO: 173147 - DNA, 20 bp, Artificial Sequence
  Synthetic oligonucleotide; AGG chr2 60539330 60539349 60539333 -
ttctgatcccagcagggaat

SEQ ID NO: 173148 - DNA, 20 bp, Artificial Sequence
  Synthetic oligonucleotide; GAG chr2 60539326 60539345 60539329 -
gatcccagcagggaataggt

SEQ ID NO: 173149 - DNA, 20 bp, Artificial Sequence
  Synthetic oligonucleotide; TAG chr2 60539305 60539324 60539308 -
agcttcatttgcctttacaa

SEQ ID NO: 173150 - DNA, 20 bp, Artificial Sequence
  Synthetic oligonucleotide; AGG chr2 60539304 60539323 60539307 -
gcttcatttgcctttacaat

SEQ ID NO: 173151 - DNA, 20 bp, Artificial Sequence
  Synthetic oligonucleotide; CAG chr2 60539297 60539316 60539300 -
ttgcctttacaataggcgca

SEQ ID NO: 173152 - DNA, 20 bp, Artificial Sequence
  Synthetic oligonucleotide; TGG chr2 60539283 60539302 60539286 -
ggcgcacagttactgcacct

SEQ ID NO: 173153 - DNA, 20 bp, Artificial Sequence
  Synthetic oligonucleotide; GAG chr2 60539281 60539300 60539284 -
cgcacagttactgcaccttg

SEQ ID NO: 173154 - DNA, 20 bp, Artificial Sequence
  Synthetic oligonucleotide; AGG chr2 60539280 60539299 60539283 -
gcacagttactgcaccttgg

SEQ ID NO: 173155 - DNA, 20 bp, Artificial Sequence
  Synthetic oligonucleotide; GAG chr2 60539278 60539297 60539281 -
acagttactgcaccttggag

SEQ ID NO: 173156 - DNA, 20 bp, Artificial Sequence
  Synthetic oligonucleotide; CAG chr2 60539271 60539290 60539274 -
ctgcaccttggaggagctct

SEQ ID NO: 173157 - DNA, 20 bp, Artificial Sequence
  Synthetic oligonucleotide; AGG chr2 60539270 60539289 60539273 -
tgcaccttggaggagctctc

SEQ ID NO: 173158 - DNA, 20 bp, Artificial Sequence
  Synthetic oligonucleotide; CAG chr2 60539260 60539279 60539263 -
aggagctctcaggtgccgct

SEQ ID NO: 173159 - DNA, 20 bp, Artificial Sequence
  Synthetic oligonucleotide; TGG chr2 60539256 60539275 60539259 -
gctctcaggtgccgctcaga

SEQ ID NO: 173160 - DNA, 20 bp, Artificial Sequence
  Synthetic oligonucleotide; GGG chr2 60539255 60539274 60539258 -
ctctcaggtgccgctcagat

SEQ ID NO: 173161 - DNA, 20 bp, Artificial Sequence
  Synthetic oligonucleotide; CAG chr2 60539234 60539253 60539237 -
ggcgcatgtaaatgccctgt

SEQ ID NO: 173162 - DNA, 20 bp, Artificial Sequence
  Synthetic oligonucleotide; CGG chr2 60539228 60539247 60539231 -
tgtaaatgccctgtcagatg

SEQ ID NO: 173163 - DNA, 20 bp, Artificial Sequence
  Synthetic oligonucleotide; GAG chr2 60539226 60539245 60539229 -
taaatgccctgtcagatgcg

SEQ ID NO: 173164 - DNA, 20 bp, Artificial Sequence
  Synthetic oligonucleotide; TGG chr2 60539222 60539241 60539225 -
tgccctgtcagatgcggagc

SEQ ID NO: 173165 - DNA, 20 bp, Artificial Sequence
  Synthetic oligonucleotide; AAG chr2 60539184 60539203 60539187 -
tccaccaccacaccataata

SEQ ID NO: 173166 - DNA, 20 bp, Artificial Sequence
  Synthetic oligonucleotide; CAG chr2 60539174 60539193 60539177 -
caccataataaagctgtaca

SEQ ID NO: 173167 - DNA, 20 bp, Artificial Sequence
  Synthetic oligonucleotide; AAG chr2 60539170 60539189 60539173 -
ataataaagctgtacacagc

SEQ ID NO: 173168 - DNA, 20 bp, Artificial Sequence
  Synthetic oligonucleotide; CAG chr2 60539158 60539177 60539161 -
tacacagcaagcttaatatg

SEQ ID NO: 173169 - DNA, 20 bp, Artificial Sequence
  Synthetic oligonucleotide; TAG chr2 60539154 60539173 60539157 -
cagcaagcttaatatgcagc

SEQ ID NO: 173170 - DNA, 20 bp, Artificial Sequence
  Synthetic oligonucleotide; TGG chr2 60539149 60539168 60539152 -
agcttaatatgcagctagtc

SEQ ID NO: 173171 - DNA, 20 bp, Artificial Sequence
  Synthetic oligonucleotide; GGG chr2 60539148 60539167 60539151 -
gcttaatatgcagctagtct

SEQ ID NO: 173172 - DNA, 20 bp, Artificial Sequence
  Synthetic oligonucleotide; GGG chr2 60539147 60539166 60539150 -
cttaatatgcagctagtctg

SEQ ID NO: 173173 - DNA, 20 bp, Artificial Sequence
  Synthetic oligonucleotide; TAG chr2 60539131 60539150 60539134 -
tctggggaattgtataaact

SEQ ID NO: 173174 - DNA, 20 bp, Artificial Sequence
  Synthetic oligonucleotide; TAG chr2 60539127 60539146 60539130 -
gggaattgtataaacttaga

SEQ ID NO: 173175 - DNA, 20 bp, Artificial Sequence
  Synthetic oligonucleotide; CAG chr2 60539122 60539141 60539125 -
ttgtataaacttagatagcc

SEQ ID NO: 173176 - DNA, 20 bp, Artificial Sequence
  Synthetic oligonucleotide; AAG chr2 60539114 60539133 60539117 -
acttagatagcccagtgtga

SEQ ID NO: 173177 - DNA, 20 bp, Artificial Sequence
  Synthetic oligonucleotide; CAG chr2 60539110 60539129 60539113 -
agatagcccagtgtgaaaga

SEQ ID NO: 173178 - DNA, 20 bp, Artificial Sequence
  Synthetic oligonucleotide; TGG chr2 60539104 60539123 60539107 -
cccagtgtgaaagacagcaa

SEQ ID NO: 173179 - DNA, 20 bp, Artificial Sequence
  Synthetic oligonucleotide; CAG chr2 60539082 60539101 60539085 -
gaaaaatgctcgatatgcca

SEQ ID NO: 173180 - DNA, 20 bp, Artificial Sequence
  Synthetic oligonucleotide; TAG chr2 60539052 60539071 60539055 -
tcttgttctcctttgatcta

SEQ ID NO: 173181 - DNA, 20 bp, Artificial Sequence
  Synthetic oligonucleotide; TGG chr2 60539019 60539038 60539022 -
acatcatccttttcttctct

SEQ ID NO: 173182 - DNA, 20 bp, Artificial Sequence
  Synthetic oligonucleotide; GAG chr2 60539017 60539036 60539020 -
atcatccttttcttctcttg

SEQ ID NO: 173183 - DNA, 20 bp, Artificial Sequence
  Synthetic oligonucleotide; CAG chr2 60538978 60538997 60538981 -
gccacctcccaattcaccac

SEQ ID NO: 173184 - DNA, 20 bp, Artificial Sequence
  Synthetic oligonucleotide; TGG chr2 60538958 60538977 60538961 -
cagaatttttttgcatgtgc

SEQ ID NO: 173185 - DNA, 20 bp, Artificial Sequence
  Synthetic oligonucleotide; TGG chr2 60538953 60538972 60538956 -
tttttttgcatgtgctggta

SEQ ID NO: 173186 - DNA, 20 bp, Artificial Sequence
  Synthetic oligonucleotide; GAG chr2 60538951 60538970 60538954 -
tttttgcatgtgctggtatg

SEQ ID NO: 173187 - DNA, 20 bp, Artificial Sequence
  Synthetic oligonucleotide; TGG chr2 60538924 60538943 60538927 -
gcaacataatttgtttcata

SEQ ID NO: 173188 - DNA, 20 bp, Artificial Sequence
  Synthetic oligonucleotide; CAG chr2 60538914 60538933 60538917 -
ttgtttcatatggttaatta

SEQ ID NO: 173189 - DNA, 20 bp, Artificial Sequence
  Synthetic oligonucleotide; AGG chr2 60538913 60538932 60538916 -
tgtttcatatggttaattac

SEQ ID NO: 173190 - DNA, 20 bp, Artificial Sequence
  Synthetic oligonucleotide; TAG chr2 60538886 60538905 60538889 -
tgaatatttaaaattttaaa

SEQ ID NO: 173191 - DNA, 20 bp, Artificial Sequence
  Synthetic oligonucleotide; CAG chr2 60538880 60538899 60538883 -
tttaaaattttaaatagcca

SEQ ID NO: 173192 - DNA, 20 bp, Artificial Sequence
  Synthetic oligonucleotide; CAG chr2 60538874 60538893 60538877 -
attttaaatagccacagttc

SEQ ID NO: 173193 - DNA, 20 bp, Artificial Sequence
  Synthetic oligonucleotide; AAG chr2 60538858 60538877 60538861 -
gttccagcttttcccgttaa

SEQ ID NO: 173194 - DNA, 20 bp, Artificial Sequence
  Synthetic oligonucleotide; AAG chr2 60538840 60538859 60538843 -
aaaagtatgtgatttgaaca

SEQ ID NO: 173195 - DNA, 20 bp, Artificial Sequence
  Synthetic oligonucleotide; AGG chr2 60538839 60538858 60538842 -
aaagtatgtgatttgaacaa

SEQ ID NO: 173196 - DNA, 20 bp, Artificial Sequence
  Synthetic oligonucleotide; GGG chr2 60538838 60538857 60538841 -
aagtatgtgatttgaacaaa

SEQ ID NO: 173197 - DNA, 20 bp, Artificial Sequence
  Synthetic oligonucleotide; GAG chr2 60538836 60538855 60538839 -
gtatgtgatttgaacaaagg

SEQ ID NO: 173198 - DNA, 20 bp, Artificial Sequence
  Synthetic oligonucleotide; CAG chr2 60538831 60538850 60538834 -
tgatttgaacaaagggagta

SEQ ID NO: 173199 - DNA, 20 bp, Artificial Sequence
  Synthetic oligonucleotide; TGG chr2 60538816 60538835 60538819 -
gagtacagtgtaaatatttg

SEQ ID NO: 173200 - DNA, 20 bp, Artificial Sequence
  Synthetic oligonucleotide; CAG chr2 60538742 60538761 60538745 -
cacacacacacacacacaca

SEQ ID NO: 173201 - DNA, 20 bp, Artificial Sequence
  Synthetic oligonucleotide; GAG chr2 60538740 60538759 60538743 -
cacacacacacacacacaca

SEQ ID NO: 173202 - DNA, 20 bp, Artificial Sequence
  Synthetic oligonucleotide; GAG chr2 60538738 60538757 60538741 -
cacacacacacacacacaga

SEQ ID NO: 173203 - DNA, 20 bp, Artificial Sequence
  Synthetic oligonucleotide; GAG chr2 60538736 60538755 60538739 -
cacacacacacacacagaga

SEQ ID NO: 173204 - DNA, 20 bp, Artificial Sequence
  Synthetic oligonucleotide; GAG chr2 60538734 60538753 60538737 -
cacacacacacacagagaga

SEQ ID NO: 173205 - DNA, 20 bp, Artificial Sequence
  Synthetic oligonucleotide; GAG chr2 60538732 60538751 60538735 -
cacacacacacagagagaga

SEQ ID NO: 173206 - DNA, 20 bp, Artificial Sequence
  Synthetic oligonucleotide; GAG chr2 60538730 60538749 60538733 -
cacacacacagagagagaga

SEQ ID NO: 173207 - DNA, 20 bp, Artificial Sequence
  Synthetic oligonucleotide; GAG chr2 60538728 60538747 60538731 -
cacacacagagagagagaga

SEQ ID NO: 173208 - DNA, 20 bp, Artificial Sequence
  Synthetic oligonucleotide; GAG chr2 60538726 60538745 60538729 -
cacacagagagagagagaga

SEQ ID NO: 173209 - DNA, 20 bp, Artificial Sequence
  Synthetic oligonucleotide; GAG chr2 60538724 60538743 60538727 -
cacagagagagagagagaga

SEQ ID NO: 173210 - DNA, 20 bp, Artificial Sequence
  Synthetic oligonucleotide; CAG chr2 60538716 60538735 60538719 -
gagagagagagagagacatt

SEQ ID NO: 173211 - DNA, 20 bp, Artificial Sequence
  Synthetic oligonucleotide; TAG chr2 60538705 60538724 60538708 -
agagacattcagtttaaatc

SEQ ID NO: 173212 - DNA, 20 bp, Artificial Sequence
  Synthetic oligonucleotide; AAG chr2 60538692 60538711 60538695 -
ttaaatctagtactgatcta

SEQ ID NO: 173213 - DNA, 20 bp, Artificial Sequence
  Synthetic oligonucleotide; AGG chr2 60538691 60538710 60538694 -
taaatctagtactgatctaa

SEQ ID NO: 173214 - DNA, 20 bp, Artificial Sequence
  Synthetic oligonucleotide; TGG chr2 60538642 60538661 60538645 -
tttaaaaaacaactttcaac

SEQ ID NO: 173215 - DNA, 20 bp, Artificial Sequence
  Synthetic oligonucleotide; GAG chr2 60538606 60538625 60538609 -
tatttcaccattatattttt

SEQ ID NO: 173216 - DNA, 20 bp, Artificial Sequence
  Synthetic oligonucleotide; GAG chr2 60538591 60538610 60538594 -
tttttgagtccacattgctt

SEQ ID NO: 173217 - DNA, 20 bp, Artificial Sequence
  Synthetic oligonucleotide; AGG chr2 60538590 60538609 60538593 -
ttttgagtccacattgcttg

SEQ ID NO: 173218 - DNA, 20 bp, Artificial Sequence
  Synthetic oligonucleotide; AAG chr2 60538582 60538601 60538585 -
ccacattgcttgaggtttta

SEQ ID NO: 173219 - DNA, 20 bp, Artificial Sequence
  Synthetic oligonucleotide; AAG chr2 60538579 60538598 60538582 -
cattgcttgaggttttaaag

SEQ ID NO: 173220 - DNA, 20 bp, Artificial Sequence
  Synthetic oligonucleotide; CAG chr2 60538553 60538572 60538556 -
tttataatgtgttcctttaa

SEQ ID NO: 173221 - DNA, 20 bp, Artificial Sequence
  Synthetic oligonucleotide; CAG chr2 60538544 60538563 60538547 -
tgttcctttaacagaatcaa

SEQ ID NO: 173222 - DNA, 20 bp, Artificial Sequence
  Synthetic oligonucleotide; CAG chr2 60538537 60538556 60538540 -
ttaacagaatcaacagctgt

SEQ ID NO: 173223 - DNA, 20 bp, Artificial Sequence
  Synthetic oligonucleotide; AAG chr2 60538534 60538553 60538537 -
acagaatcaacagctgtcag

SEQ ID NO: 173224 - DNA, 20 bp, Artificial Sequence
  Synthetic oligonucleotide; CAG chr2 60538531 60538550 60538534 -
gaatcaacagctgtcagaag

SEQ ID NO: 173225 - DNA, 20 bp, Artificial Sequence
  Synthetic oligonucleotide; TGG chr2 60538525 60538544 60538528 -
acagctgtcagaagcagttg

SEQ ID NO: 173226 - DNA, 20 bp, Artificial Sequence
  Synthetic oligonucleotide; TAG chr2 60538522 60538541 60538525 -
gctgtcagaagcagttgtgg

SEQ ID NO: 173227 - DNA, 20 bp, Artificial Sequence
  Synthetic oligonucleotide; AAG chr2 60538503 60538522 60538506 -
gtagatccacaaaacgtata

SEQ ID NO: 173228 - DNA, 20 bp, Artificial Sequence
  Synthetic oligonucleotide; TGG chr2 60538470 60538489 60538473 -
gtttcctgaaacaaaacact

SEQ ID NO: 173229 - DNA, 20 bp, Artificial Sequence
  Synthetic oligonucleotide; AAG chr2 60538461 60538480 60538464 -
aacaaaacacttggaaaaat

SEQ ID NO: 173230 - DNA, 20 bp, Artificial Sequence
  Synthetic oligonucleotide; AAG chr2 60538453 60538472 60538456 -
acttggaaaaataagctgct

SEQ ID NO: 173231 - DNA, 20 bp, Artificial Sequence
  Synthetic oligonucleotide; TGG chr2 60538447 60538466 60538450 -
aaaaataagctgctaagaac

SEQ ID NO: 173232 - DNA, 20 bp, Artificial Sequence
  Synthetic oligonucleotide; TAG chr2 60538439 60538458 60538442 -
gctgctaagaactggcgaat

SEQ ID NO: 173233 - DNA, 20 bp, Artificial Sequence
  Synthetic oligonucleotide; AAG chr2 60538436 60538455 60538439 -
gctaagaactggcgaattag

SEQ ID NO: 173234 - DNA, 20 bp, Artificial Sequence
  Synthetic oligonucleotide; CAG chr2 60538429 60538448 60538432 -
actggcgaattagaagtttg

SEQ ID NO: 173235 - DNA, 20 bp, Artificial Sequence
  Synthetic oligonucleotide; CAG chr2 60538425 60538444 60538428 -
gcgaattagaagtttgcaga

SEQ ID NO: 173236 - DNA, 20 bp, Artificial Sequence
  Synthetic oligonucleotide; AGG chr2 60538424 60538443 60538427 -
cgaattagaagtttgcagac

SEQ ID NO: 173237 - DNA, 20 bp, Artificial Sequence
  Synthetic oligonucleotide; GGG chr2 60538423 60538442 60538426 -
gaattagaagtttgcagaca

SEQ ID NO: 173238 - DNA, 20 bp, Artificial Sequence
  Synthetic oligonucleotide; AAG chr2 60538415 60538434 60538418 -
agtttgcagacagggaactg

SEQ ID NO: 173239 - DNA, 20 bp, Artificial Sequence
  Synthetic oligonucleotide; TGG chr2 60538402 60538421 60538405 -
ggaactgaagtgtcatctct

SEQ ID NO: 173240 - DNA, 20 bp, Artificial Sequence
  Synthetic oligonucleotide; TGG chr2 60538392 60538411 60538395 -
tgtcatctcttggttcaccc

SEQ ID NO: 173241 - DNA, 20 bp, Artificial Sequence
  Synthetic oligonucleotide; GAG chr2 60538390 60538409 60538393 -
tcatctcttggttcaccctg

SEQ ID NO: 173242 - DNA, 20 bp, Artificial Sequence
  Synthetic oligonucleotide; GAG chr2 60538379 60538398 60538382 -
ttcaccctggagactgatgt

SEQ ID NO: 173243 - DNA, 20 bp, Artificial Sequence
  Synthetic oligonucleotide; TGG chr2 60538376 60538395 60538379 -
accctggagactgatgtgag

SEQ ID NO: 173244 - DNA, 20 bp, Artificial Sequence
  Synthetic oligonucleotide; TGG chr2 60538356 60538375 60538359 -
tggatctgatgcaatgctgc

SEQ ID NO: 173245 - DNA, 20 bp, Artificial Sequence
  Synthetic oligonucleotide; AAG chr2 60538353 60538372 60538356 -
atctgatgcaatgctgctgg

SEQ ID NO: 173246 - DNA, 20 bp, Artificial Sequence
  Synthetic oligonucleotide; CAG chr2 60538339 60538358 60538342 -
tgctggaagatttacctgca

SEQ ID NO: 173247 - DNA, 20 bp, Artificial Sequence
  Synthetic oligonucleotide; AGG chr2 60538338 60538357 60538341 -
gctggaagatttacctgcac

SEQ ID NO: 173248 - DNA, 20 bp, Artificial Sequence
  Synthetic oligonucleotide; AAG chr2 60538325 60538344 60538328 -
cctgcacaggttgctcctct

SEQ ID NO: 173249 - DNA, 20 bp, Artificial Sequence
  Synthetic oligonucleotide; AGG chr2 60538324 60538343 60538327 -
ctgcacaggttgctcctcta

SEQ ID NO: 173250 - DNA, 20 bp, Artificial Sequence
  Synthetic oligonucleotide; CAG chr2 60538314 60538333 60538317 -
tgctcctctaaggcaacgcg

SEQ ID NO: 173251 - DNA, 20 bp, Artificial Sequence
  Synthetic oligonucleotide; CAG chr2 60538291 60538310 60538294 -
tgcacgattgacgtatgcac

SEQ ID NO: 173252 - DNA, 20 bp, Artificial Sequence
  Synthetic oligonucleotide; GAG chr2 60538289 60538308 60538292 -
cacgattgacgtatgcacca

SEQ ID NO: 173253 - DNA, 20 bp, Artificial Sequence
  Synthetic oligonucleotide; TAG chr2 60538285 60538304 60538288 -
attgacgtatgcaccagagc

SEQ ID NO: 173254 - DNA, 20 bp, Artificial Sequence
  Synthetic oligonucleotide; AGG chr2 60538284 60538303 60538287 -
ttgacgtatgcaccagagct

SEQ ID NO: 173255 - DNA, 20 bp, Artificial Sequence
  Synthetic oligonucleotide; TGG chr2 60538280 60538299 60538283 -
cgtatgcaccagagctaggc

SEQ ID NO: 173256 - DNA, 20 bp, Artificial Sequence
  Synthetic oligonucleotide; GGG chr2 60538279 60538298 60538282 -
gtatgcaccagagctaggct

SEQ ID NO: 173257 - DNA, 20 bp, Artificial Sequence
  Synthetic oligonucleotide; CAG chr2 60538273 60538292 60538276 -
accagagctaggctgggcct

SEQ ID NO: 173258 - DNA, 20 bp, Artificial Sequence
  Synthetic oligonucleotide; TAG chr2 60538238 60538257 60538241 -
tttgccctttttgatctctt

SEQ ID NO: 173259 - DNA, 20 bp, Artificial Sequence
  Synthetic oligonucleotide; TAG chr2 60538234 60538253 60538237 -
ccctttttgatctctttaga

SEQ ID NO: 173260 - DNA, 20 bp, Artificial Sequence
  Synthetic oligonucleotide; AAG chr2 60538221 60538240 60538224 -
ctttagatagataaaatacc

SEQ ID NO: 173261 - DNA, 20 bp, Artificial Sequence
  Synthetic oligonucleotide; CAG chr2 60538214 60538233 60538217 -
tagataaaataccaagttct

SEQ ID NO: 173262 - DNA, 20 bp, Artificial Sequence
  Synthetic oligonucleotide; GAG chr2 60538212 60538231 60538215 -
gataaaataccaagttctca

SEQ ID NO: 173263 - DNA, 20 bp, Artificial Sequence
  Synthetic oligonucleotide; AAG chr2 60538182 60538201 60538185 -
caacaaattatatataccta

SEQ ID NO: 173264 - DNA, 20 bp, Artificial Sequence
  Synthetic oligonucleotide; AGG chr2 60538181 60538200 60538184 -
aacaaattatatatacctaa

SEQ ID NO: 173265 - DNA, 20 bp, Artificial Sequence
  Synthetic oligonucleotide; GAG chr2 60538177 60538196 60538180 -
aattatatatacctaaaggt

SEQ ID NO: 173266 - DNA, 20 bp, Artificial Sequence
  Synthetic oligonucleotide; CAG chr2 60538169 60538188 60538172 -
atacctaaaggtgagatgat

SEQ ID NO: 173267 - DNA, 20 bp, Artificial Sequence
  Synthetic oligonucleotide; AGG chr2 60538168 60538187 60538171 -
tacctaaaggtgagatgatc

SEQ ID NO: 173268 - DNA, 20 bp, Artificial Sequence
  Synthetic oligonucleotide; AAG chr2 60538149 60538168 60538152 -
caggtttaaacttcctgtaa

SEQ ID NO: 173269 - DNA, 20 bp, Artificial Sequence
  Synthetic oligonucleotide; GAG chr2 60538147 60538166 60538150 -
ggtttaaacttcctgtaaaa

SEQ ID NO: 173270 - DNA, 20 bp, Artificial Sequence
  Synthetic oligonucleotide; AGG chr2 60538146 60538165 60538149 -
gtttaaacttcctgtaaaag

SEQ ID NO: 173271 - DNA, 20 bp, Artificial Sequence
  Synthetic oligonucleotide; GAG chr2 60538142 60538161 60538145 -
aaacttcctgtaaaagaggc

SEQ ID NO: 173272 - DNA, 20 bp, Artificial Sequence
  Synthetic oligonucleotide; AAG chr2 60538139 60538158 60538142 -
cttcctgtaaaagaggcgag

SEQ ID NO: 173273 - DNA, 20 bp, Artificial Sequence
  Synthetic oligonucleotide; AGG chr2 60538138 60538157 60538141 -
ttcctgtaaaagaggcgaga

SEQ ID NO: 173274 - DNA, 20 bp, Artificial Sequence
  Synthetic oligonucleotide; CAG chr2 60538116 60538135 60538119 -
gcgccttgcacacccttttc

SEQ ID NO: 173275 - DNA, 20 bp, Artificial Sequence
  Synthetic oligonucleotide; TAG chr2 60538112 60538131 60538115 -
cttgcacacccttttccaga

SEQ ID NO: 173276 - DNA, 20 bp, Artificial Sequence
  Synthetic oligonucleotide; AGG chr2 60538111 60538130 60538114 -
ttgcacacccttttccagat

SEQ ID NO: 173277 - DNA, 20 bp, Artificial Sequence
  Synthetic oligonucleotide; GGG chr2 60538110 60538129 60538113 -
tgcacacccttttccagata

SEQ ID NO: 173278 - DNA, 20 bp, Artificial Sequence
  Synthetic oligonucleotide; TGG chr2 60538106 60538125 60538109 -
cacccttttccagatagggc

SEQ ID NO: 173279 - DNA, 20 bp, Artificial Sequence
  Synthetic oligonucleotide; CAG chr2 60538103 60538122 60538106 -
ccttttccagatagggctgg

SEQ ID NO: 173280 - DNA, 20 bp, Artificial Sequence
  Synthetic oligonucleotide; CAG chr2 60538091 60538110 60538094 -
agggctggcagcatgttatt

SEQ ID NO: 173281 - DNA, 20 bp, Artificial Sequence
  Synthetic oligonucleotide; CAG chr2 60538080 60538099 60538083 -
catgttattcagaactgaat

SEQ ID NO: 173282 - DNA, 20 bp, Artificial Sequence
  Synthetic oligonucleotide; CAG chr2 60538070 60538089 60538073 -
agaactgaatcagtctctgc

SEQ ID NO: 173283 - DNA, 20 bp, Artificial Sequence
  Synthetic oligonucleotide; GAG chr2 60538068 60538087 60538071 -
aactgaatcagtctctgcca

SEQ ID NO: 173284 - DNA, 20 bp, Artificial Sequence
  Synthetic oligonucleotide; CAG chr2 60538059 60538078 60538062 -
agtctctgccagagaattcc

SEQ ID NO: 173285 - DNA, 20 bp, Artificial Sequence
  Synthetic oligonucleotide; TGG chr2 60538056 60538075 60538059 -
ctctgccagagaattcccag

SEQ ID NO: 173286 - DNA, 20 bp, Artificial Sequence
  Synthetic oligonucleotide; GGG chr2 60538055 60538074 60538058 -
tctgccagagaattcccagt

SEQ ID NO: 173287 - DNA, 20 bp, Artificial Sequence
  Synthetic oligonucleotide; TGG chr2 60538048 60538067 60538051 -
gagaattcccagtgggaacc

SEQ ID NO: 173288 - DNA, 20 bp, Artificial Sequence
  Synthetic oligonucleotide; GAG chr2 60538046 60538065 60538049 -
gaattcccagtgggaacctg

SEQ ID NO: 173289 - DNA, 20 bp, Artificial Sequence
  Synthetic oligonucleotide; CAG chr2 60538043 60538062 60538046 -
ttcccagtgggaacctggag

SEQ ID NO: 173290 - DNA, 20 bp, Artificial Sequence
  Synthetic oligonucleotide; AGG chr2 60538042 60538061 60538045 -
tcccagtgggaacctggagc

SEQ ID NO: 173291 - DNA, 20 bp, Artificial Sequence
  Synthetic oligonucleotide; AAG chr2 60538029 60538048 60538032 -
ctggagcaggtatgttgatg

SEQ ID NO: 173292 - DNA, 20 bp, Artificial Sequence
  Synthetic oligonucleotide; AGG chr2 60538028 60538047 60538031 -
tggagcaggtatgttgatga

SEQ ID NO: 173293 - DNA, 20 bp, Artificial Sequence
  Synthetic oligonucleotide; GGG chr2 60538027 60538046 60538030 -
ggagcaggtatgttgatgaa

SEQ ID NO: 173294 - DNA, 20 bp, Artificial Sequence
  Synthetic oligonucleotide; GGG chr2 60538026 60538045 60538029 -
gagcaggtatgttgatgaag

SEQ ID NO: 173295 - DNA, 20 bp, Artificial Sequence
  Synthetic oligonucleotide; TGG chr2 60538018 60538037 60538021 -
atgttgatgaaggggatacc

SEQ ID NO: 173296 - DNA, 20 bp, Artificial Sequence
  Synthetic oligonucleotide; GGG chr2 60538017 60538036 60538020 -
tgttgatgaaggggatacct

SEQ ID NO: 173297 - DNA, 20 bp, Artificial Sequence
  Synthetic oligonucleotide; GGG chr2 60538016 60538035 60538019 -
gttgatgaaggggatacctg

SEQ ID NO: 173298 - DNA, 20 bp, Artificial Sequence
  Synthetic oligonucleotide; TGG chr2 60538008 60538027 60538011 -
aggggatacctggggacctt

SEQ ID NO: 173299 - DNA, 20 bp, Artificial Sequence
  Synthetic oligonucleotide; GAG chr2 60537994 60538013 60537997 -
gacctttggtcactcacaat

SEQ ID NO: 173300 - DNA, 20 bp, Artificial Sequence
  Synthetic oligonucleotide; TAG chr2 60537966 60537985 60537969 -
gtttgtattctcactgttgt

SEQ ID NO: 173301 - DNA, 20 bp, Artificial Sequence
  Synthetic oligonucleotide; TAG chr2 60537927 60537946 60537930 -
ttgcacctacaatttgattt

SEQ ID NO: 173302 - DNA, 20 bp, Artificial Sequence
  Synthetic oligonucleotide; TAG chr2 60537921 60537940 60537924 -
ctacaatttgattttagttt

SEQ ID NO: 173303 - DNA, 20 bp, Artificial Sequence
  Synthetic oligonucleotide; TAG chr2 60537917 60537936 60537920 -
aatttgattttagttttaga

SEQ ID NO: 173304 - DNA, 20 bp, Artificial Sequence
  Synthetic oligonucleotide; GAG chr2 60537915 60537934 60537918 -
tttgattttagttttagata

SEQ ID NO: 173305 - DNA, 20 bp, Artificial Sequence
  Synthetic oligonucleotide; AGG chr2 60537914 60537933 60537917 -
ttgattttagttttagatag

SEQ ID NO: 173306 - DNA, 20 bp, Artificial Sequence
  Synthetic oligonucleotide; AAG chr2 60537878 60537897 60537881 -
taaaaactcccattaaaata

SEQ ID NO: 173307 - DNA, 20 bp, Artificial Sequence
  Synthetic oligonucleotide; TGG chr2 60537873 60537892 60537876 -
actcccattaaaataaagaa

SEQ ID NO: 173308 - DNA, 20 bp, Artificial Sequence
  Synthetic oligonucleotide; AAG chr2 60537852 60537871 60537855 -
ggaattattgtgaaacctgc

SEQ ID NO: 173309 - DNA, 20 bp, Artificial Sequence
  Synthetic oligonucleotide; AGG chr2 60537851 60537870 60537854 -
gaattattgtgaaacctgca

SEQ ID NO: 173310 - DNA, 20 bp, Artificial Sequence
  Synthetic oligonucleotide; GGG chr2 60537850 60537869 60537853 -
aattattgtgaaacctgcaa

SEQ ID NO: 173311 - DNA, 20 bp, Artificial Sequence
  Synthetic oligonucleotide; AAG chr2 60537837 60537856 60537840 -
cctgcaagggtgccttcaaa

SEQ ID NO: 173312 - DNA, 20 bp, Artificial Sequence
  Synthetic oligonucleotide; CAG chr2 60537829 60537848 60537832 -
ggtgccttcaaaaagaaaac

SEQ ID NO: 173313 - DNA, 20 bp, Artificial Sequence
  Synthetic oligonucleotide; AAG chr2 60537769 60537788 60537772 -
ttgaactttctaaaaaacac

SEQ ID NO: 173314 - DNA, 20 bp, Artificial Sequence
  Synthetic oligonucleotide; AGG chr2 60537768 60537787 60537771 -
tgaactttctaaaaaacaca

SEQ ID NO: 173315 - DNA, 20 bp, Artificial Sequence
  Synthetic oligonucleotide; AAG chr2 60537765 60537784 60537768 -
actttctaaaaaacacaagg

SEQ ID NO: 173316 - DNA, 20 bp, Artificial Sequence
  Synthetic oligonucleotide; AAG chr2 60537753 60537772 60537756 -
acacaaggaagctttttgct

SEQ ID NO: 173317 - DNA, 20 bp, Artificial Sequence
  Synthetic oligonucleotide; CAG chr2 60537747 60537766 60537750 -
ggaagctttttgctaagcat

SEQ ID NO: 173318 - DNA, 20 bp, Artificial Sequence
  Synthetic oligonucleotide; AGG chr2 60537746 60537765 60537749 -
gaagctttttgctaagcatc

SEQ ID NO: 173319 - DNA, 20 bp, Artificial Sequence
  Synthetic oligonucleotide; GGG chr2 60537745 60537764 60537748 -
aagctttttgctaagcatca

SEQ ID NO: 173320 - DNA, 20 bp, Artificial Sequence
  Synthetic oligonucleotide; CAG chr2 60537723 60537742 60537726 -
gcatttaaatttatattcat

SEQ ID NO: 173321 - DNA, 20 bp, Artificial Sequence
  Synthetic oligonucleotide; AAG chr2 60537686 60537705 60537689 -
aatatgtaatgatgcataaa

SEQ ID NO: 173322 - DNA, 20 bp, Artificial Sequence
  Synthetic oligonucleotide; AGG chr2 60537685 60537704 60537688 -
atatgtaatgatgcataaaa

SEQ ID NO: 173323 - DNA, 20 bp, Artificial Sequence
  Synthetic oligonucleotide; AAG chr2 60537678 60537697 60537681 -
atgatgcataaaaaggctgc

SEQ ID NO: 173324 - DNA, 20 bp, Artificial Sequence
  Synthetic oligonucleotide; AGG chr2 60537677 60537696 60537680 -
tgatgcataaaaaggctgca

SEQ ID NO: 173325 - DNA, 20 bp, Artificial Sequence
  Synthetic oligonucleotide; TAG chr2 60537654 60537673 60537657 -
aaatcacatctgttaatttt

SEQ ID NO: 173326 - DNA, 20 bp, Artificial Sequence
  Synthetic oligonucleotide; AGG chr2 60537653 60537672 60537656 -
aatcacatctgttaattttt

SEQ ID NO: 173327 - DNA, 20 bp, Artificial Sequence
  Synthetic oligonucleotide; GGG chr2 60537652 60537671 60537655 -
atcacatctgttaattttta

SEQ ID NO: 173328 - DNA, 20 bp, Artificial Sequence
  Synthetic oligonucleotide; AAG chr2 60537644 60537663 60537647 -
tgttaatttttagggaaata

SEQ ID NO: 173329 - DNA, 20 bp, Artificial Sequence
  Synthetic oligonucleotide; TAG chr2 60537639 60537658 60537642 -
atttttagggaaataaagtg

SEQ ID NO: 173330 - DNA, 20 bp, Artificial Sequence
  Synthetic oligonucleotide; TGG chr2 60537634 60537653 60537637 -
tagggaaataaagtgtagct

SEQ ID NO: 173331 - DNA, 20 bp, Artificial Sequence
  Synthetic oligonucleotide; TGG chr2 60537621 60537640 60537624 -
tgtagcttggattcttatgt

SEQ ID NO: 173332 - DNA, 20 bp, Artificial Sequence
  Synthetic oligonucleotide; GAG chr2 60537619 60537638 60537622 -
tagcttggattcttatgttg

SEQ ID NO: 173333 - DNA, 20 bp, Artificial Sequence
  Synthetic oligonucleotide; AAG chr2 60537612 60537631 60537615 -
gattcttatgttggagcaca

SEQ ID NO: 173334 - DNA, 20 bp, Artificial Sequence
  Synthetic oligonucleotide; AAG chr2 60537598 60537617 60537601 -
agcacaaagcactatgtgcc

SEQ ID NO: 173335 - DNA, 20 bp, Artificial Sequence
  Synthetic oligonucleotide; TAG chr2 60537572 60537591 60537575 -
gttcctgtacattttaaata

SEQ ID NO: 173336 - DNA, 20 bp, Artificial Sequence
  Synthetic oligonucleotide; GAG chr2 60537570 60537589 60537573 -
tcctgtacattttaaatata

SEQ ID NO: 173337 - DNA, 20 bp, Artificial Sequence
  Synthetic oligonucleotide; TGG chr2 60537557 60537576 60537560 -
aaatatagagttttaatatt

SEQ ID NO: 173338 - DNA, 20 bp, Artificial Sequence
  Synthetic oligonucleotide; AAG chr2 60537510 60537529 60537513 -
aaaacaaacctcaaaaaact

SEQ ID NO: 173339 - DNA, 20 bp, Artificial Sequence
  Synthetic oligonucleotide; GAG chr2 60537508 60537527 60537511 -
aacaaacctcaaaaaactaa

SEQ ID NO: 173340 - DNA, 20 bp, Artificial Sequence
  Synthetic oligonucleotide; AAG chr2 60537494 60537513 60537497 -
aactaagagaaccaaacctg

SEQ ID NO: 173341 - DNA, 20 bp, Artificial Sequence
  Synthetic oligonucleotide; AAG chr2 60537472 60537491 60537475 -
gtattctccttcaccaactc

SEQ ID NO: 173342 - DNA, 20 bp, Artificial Sequence
  Synthetic oligonucleotide; AGG chr2 60537471 60537490 60537474 -
tattctccttcaccaactca

SEQ ID NO: 173343 - DNA, 20 bp, Artificial Sequence
  Synthetic oligonucleotide; TAG chr2 60537438 60537457 60537441 -
ttttatgatttatttacatt

SEQ ID NO: 173344 - DNA, 20 bp, Artificial Sequence
  Synthetic oligonucleotide; AGG chr2 60537437 60537456 60537440 -
tttatgatttatttacattt

SEQ ID NO: 173345 - DNA, 20 bp, Artificial Sequence
  Synthetic oligonucleotide; GGG chr2 60537436 60537455 60537439 -
ttatgatttatttacattta

SEQ ID NO: 173346 - DNA, 20 bp, Artificial Sequence
  Synthetic oligonucleotide; GGG chr2 60537435 60537454 60537438 -
tatgatttatttacatttag

SEQ ID NO: 173347 - DNA, 20 bp, Artificial Sequence
  Synthetic oligonucleotide; GGG chr2 60537434 60537453 60537437 -
atgatttatttacatttagg

SEQ ID NO: 173348 - DNA, 20 bp, Artificial Sequence
  Synthetic oligonucleotide; GGG chr2 60537433 60537452 60537436 -
tgatttatttacatttaggg

SEQ ID NO: 173349 - DNA, 20 bp, Artificial Sequence
  Synthetic oligonucleotide; CAG chr2 60537423 60537442 60537426 -
acatttaggggggaacccct

SEQ ID NO: 173350 - DNA, 20 bp, Artificial Sequence
  Synthetic oligonucleotide; CAG chr2 60537376 60537395 60537379 -
ctcccctgccccgatccttt

SEQ ID NO: 173351 - DNA, 20 bp, Artificial Sequence
  Synthetic oligonucleotide; CAG chr2 60537369 60537388 60537372 -
gccccgatcctttcagtttc

SEQ ID NO: 173352 - DNA, 20 bp, Artificial Sequence
  Synthetic oligonucleotide; GAG chr2 60537325 60537344 60537328 -
tgttaaatcttaaatctcgt

SEQ ID NO: 173353 - DNA, 20 bp, Artificial Sequence
  Synthetic oligonucleotide; TGG chr2 60537260 60537279 60537263 -
ttacatttaaaactgaacat

SEQ ID NO: 173354 - DNA, 20 bp, Artificial Sequence
  Synthetic oligonucleotide; AAG chr2 60537251 60537270 60537254 -
aaactgaacattggctactg

SEQ ID NO: 173355 - DNA, 20 bp, Artificial Sequence
  Synthetic oligonucleotide; AAG chr2 60537239 60537258 60537242 -
ggctactgaagaatgattta

SEQ ID NO: 173356 - DNA, 20 bp, Artificial Sequence
  Synthetic oligonucleotide; AGG chr2 60537238 60537257 60537241 -
gctactgaagaatgatttaa

SEQ ID NO: 173357 - DNA, 20 bp, Artificial Sequence
  Synthetic oligonucleotide; AAG chr2 60537178 60537197 60537181 -
tgttatgtttttgttatgtt

SEQ ID NO: 173358 - DNA, 20 bp, Artificial Sequence
  Synthetic oligonucleotide; AGG chr2 60537177 60537196 60537180 -
gttatgtttttgttatgtta

SEQ ID NO: 173359 - DNA, 20 bp, Artificial Sequence
  Synthetic oligonucleotide; GAG chr2 60537175 60537194 60537178 -
tatgtttttgttatgttaag

SEQ ID NO: 173360 - DNA, 20 bp, Artificial Sequence
  Synthetic oligonucleotide; AAG chr2 60537160 60537179 60537163 -
ttaaggagaaaaaaatcaat

SEQ ID NO: 173361 - DNA, 20 bp, Artificial Sequence
  Synthetic oligonucleotide; AGG chr2 60537159 60537178 60537162 -
taaggagaaaaaaatcaata

SEQ ID NO: 173362 - DNA, 20 bp, Artificial Sequence
  Synthetic oligonucleotide; AAG chr2 60537138 60537157 60537141 -
ggaaaaatttaattctgata

SEQ ID NO: 173363 - DNA, 20 bp, Artificial Sequence
  Synthetic oligonucleotide; TGG chr2 60537128 60537147 60537131 -
aattctgataaagatactct

SEQ ID NO: 173364 - DNA, 20 bp, Artificial Sequence
  Synthetic oligonucleotide; GAG chr2 60537085 60537104 60537088 -
tccttttaactaaaacattt

SEQ ID NO: 173365 - DNA, 20 bp, Artificial Sequence
  Synthetic oligonucleotide; CAG chr2 60537082 60537101 60537085 -
ttttaactaaaacatttgag

SEQ ID NO: 173366 - DNA, 20 bp, Artificial Sequence
  Synthetic oligonucleotide; AAG chr2 60537074 60537093 60537077 -
aaaacatttgagcagcttca

SEQ ID NO: 173367 - DNA, 20 bp, Artificial Sequence
  Synthetic oligonucleotide; TGG chr2 60537050 60537069 60537053 -
ctatgtatttcttctgatct

SEQ ID NO: 173368 - DNA, 20 bp, Artificial Sequence
  Synthetic oligonucleotide; GAG chr2 60537048 60537067 60537051 -
atgtatttcttctgatcttg

SEQ ID NO: 173369 - DNA, 20 bp, Artificial Sequence
  Synthetic oligonucleotide; TGG chr2 60537036 60537055 60537039 -
tgatcttggagctgtgtgac

SEQ ID NO: 173370 - DNA, 20 bp, Artificial Sequence
  Synthetic oligonucleotide; TAG chr2 60537033 60537052 60537036 -
tcttggagctgtgtgactgg

SEQ ID NO: 173371 - DNA, 20 bp, Artificial Sequence
  Synthetic oligonucleotide; AAG chr2 60537029 60537048 60537032 -
ggagctgtgtgactggtagc

SEQ ID NO: 173372 - DNA, 20 bp, Artificial Sequence
  Synthetic oligonucleotide; AAG chr2 60537025 60537044 60537028 -
ctgtgtgactggtagcaaga

SEQ ID NO: 173373 - DNA, 20 bp, Artificial Sequence
  Synthetic oligonucleotide; AAG chr2 60536999 60537018 60537002 -
aaaaatcttattctacatac

SEQ ID NO: 173374 - DNA, 20 bp, Artificial Sequence
  Synthetic oligonucleotide; TGG chr2 60536996 60537015 60536999 -
aatcttattctacatacaag

SEQ ID NO: 173375 - DNA, 20 bp, Artificial Sequence
  Synthetic oligonucleotide; AAG chr2 60536983 60537002 60536986 -
atacaagtggattgcttaac

SEQ ID NO: 173376 - DNA, 20 bp, Artificial Sequence
  Synthetic oligonucleotide; CAG chr2 60536979 60536998 60536982 -
aagtggattgcttaacaagt

SEQ ID NO: 173377 - DNA, 20 bp, Artificial Sequence
  Synthetic oligonucleotide; CAG chr2 60536974 60536993 60536977 -
gattgcttaacaagtcagca

SEQ ID NO: 173378 - DNA, 20 bp, Artificial Sequence
  Synthetic oligonucleotide; TAG chr2 60536951 60536970 60536954 -
acacgtacttgtttgtacaa

SEQ ID NO: 173379 - DNA, 20 bp, Artificial Sequence
  Synthetic oligonucleotide; GAG chr2 60536949 60536968 60536952 -
acgtacttgtttgtacaata

SEQ ID NO: 173380 - DNA, 20 bp, Artificial Sequence
  Synthetic oligonucleotide; CAG chr2 60536920 60536939 60536923 -
attcctgtataaaaataatt

SEQ ID NO: 173381 - DNA, 20 bp, Artificial Sequence
  Synthetic oligonucleotide; CAG chr2 60536910 60536929 60536913 -
aaaaataattcagctgctga

SEQ ID NO: 173382 - DNA, 20 bp, Artificial Sequence
  Synthetic oligonucleotide; CAG chr2 60536907 60536926 60536910 -
aataattcagctgctgacag

SEQ ID NO: 173383 - DNA, 20 bp, Artificial Sequence
  Synthetic oligonucleotide; AGG chr2 60536906 60536925 60536909 -
ataattcagctgctgacagc

SEQ ID NO: 173384 - DNA, 20 bp, Artificial Sequence
  Synthetic oligonucleotide; TGG chr2 60536894 60536913 60536897 -
ctgacagcaggcattgttgt

SEQ ID NO: 173385 - DNA, 20 bp, Artificial Sequence
  Synthetic oligonucleotide; CAG chr2 60536870 60536889 60536873 -
cctgtcttttgtgcttgtcc

SEQ ID NO: 173386 - DNA, 20 bp, Artificial Sequence
  Synthetic oligonucleotide; TGG chr2 60536864 60536883 60536867 -
ttttgtgcttgtcccagctc

SEQ ID NO: 173387 - DNA, 20 bp, Artificial Sequence
  Synthetic oligonucleotide; GGG chr2 60536863 60536882 60536866 -
tttgtgcttgtcccagctct

SEQ ID NO: 173388 - DNA, 20 bp, Artificial Sequence
  Synthetic oligonucleotide; TGG chr2 60536838 60536857 60536841 -
cccctcccctcctatctgct

SEQ ID NO: 173389 - DNA, 20 bp, Artificial Sequence
  Synthetic oligonucleotide; GGG chr2 60536837 60536856 60536840 -
ccctcccctcctatctgctt

SEQ ID NO: 173390 - DNA, 20 bp, Artificial Sequence
  Synthetic oligonucleotide; GGG chr2 60536836 60536855 60536839 -
cctcccctcctatctgcttg

SEQ ID NO: 173391 - DNA, 20 bp, Artificial Sequence
  Synthetic oligonucleotide; CAG chr2 60536833 60536852 60536836 -
cccctcctatctgcttgggg

SEQ ID NO: 173392 - DNA, 20 bp, Artificial Sequence
  Synthetic oligonucleotide; CAG chr2 60536807 60536826 60536810 -
gctgcctgcacactgctgac

SEQ ID NO: 173393 - DNA, 20 bp, Artificial Sequence
  Synthetic oligonucleotide; AAG chr2 60536804 60536823 60536807 -
gcctgcacactgctgaccag

SEQ ID NO: 173394 - DNA, 20 bp, Artificial Sequence
  Synthetic oligonucleotide; AAG chr2 60536785 60536804 60536788 -
gaagttaattgctatatatt

SEQ ID NO: 173395 - DNA, 20 bp, Artificial Sequence
  Synthetic oligonucleotide; TAG chr2 60536778 60536797 60536781 -
attgctatatattaagtata

SEQ ID NO: 173396 - DNA, 20 bp, Artificial Sequence
  Synthetic oligonucleotide; AGG chr2 60536777 60536796 60536780 -
ttgctatatattaagtatat

SEQ ID NO: 173397 - DNA, 20 bp, Artificial Sequence
  Synthetic oligonucleotide; AAG chr2 60536763 60536782 60536766 -
gtatataggtattgtattta

SEQ ID NO: 173398 - DNA, 20 bp, Artificial Sequence
  Synthetic oligonucleotide; GAG chr2 60536761 60536780 60536764 -
atataggtattgtatttaaa

SEQ ID NO: 173399 - DNA, 20 bp, Artificial Sequence
  Synthetic oligonucleotide; AGG chr2 60536760 60536779 60536763 -
tataggtattgtatttaaag

SEQ ID NO: 173400 - DNA, 20 bp, Artificial Sequence
  Synthetic oligonucleotide; AAG chr2 60536749 60536768 60536752 -
tatttaaagaggaatatctc

SEQ ID NO: 173401 - DNA, 20 bp, Artificial Sequence
  Synthetic oligonucleotide; AGG chr2 60536748 60536767 60536751 -
atttaaagaggaatatctca

SEQ ID NO: 173402 - DNA, 20 bp, Artificial Sequence
  Synthetic oligonucleotide; CGG chr2 60536706 60536725 60536709 -
tttactttctgatgtgattg

SEQ ID NO: 173403 - DNA, 20 bp, Artificial Sequence
  Synthetic oligonucleotide; CAG chr2 60536697 60536716 60536700 -
tgatgtgattgcggtgttgc

SEQ ID NO: 173404 - DNA, 20 bp, Artificial Sequence
  Synthetic oligonucleotide; CAG chr2 60536694 60536713 60536697 -
tgtgattgcggtgttgccag

SEQ ID NO: 173405 - DNA, 20 bp, Artificial Sequence
  Synthetic oligonucleotide; AGG chr2 60536693 60536712 60536696 -
gtgattgcggtgttgccagc

SEQ ID NO: 173406 - DNA, 20 bp, Artificial Sequence
  Synthetic oligonucleotide; GGG chr2 60536692 60536711 60536695 -
tgattgcggtgttgccagca

SEQ ID NO: 173407 - DNA, 20 bp, Artificial Sequence
  Synthetic oligonucleotide; GGG chr2 60536691 60536710 60536694 -
gattgcggtgttgccagcag

SEQ ID NO: 173408 - DNA, 20 bp, Artificial Sequence
  Synthetic oligonucleotide; GGG chr2 60536690 60536709 60536693 -
attgcggtgttgccagcagg

SEQ ID NO: 173409 - DNA, 20 bp, Artificial Sequence
  Synthetic oligonucleotide; GGG chr2 60536689 60536708 60536692 -
ttgcggtgttgccagcaggg

SEQ ID NO: 173410 - DNA, 20 bp, Artificial Sequence
  Synthetic oligonucleotide; TGG chr2 60536686 60536705 60536689 -
cggtgttgccagcagggggg

SEQ ID NO: 173411 - DNA, 20 bp, Artificial Sequence
  Synthetic oligonucleotide; CAG chr2 60536683 60536702 60536686 -
tgttgccagcaggggggtgg

SEQ ID NO: 173412 - DNA, 20 bp, Artificial Sequence
  Synthetic oligonucleotide; AGG chr2 60536682 60536701 60536685 -
gttgccagcaggggggtggc

SEQ ID NO: 173413 - DNA, 20 bp, Artificial Sequence
  Synthetic oligonucleotide; TAG chr2 60536667 60536686 60536670 -
gtggcaggcaaacgctctaa

SEQ ID NO: 173414 - DNA, 20 bp, Artificial Sequence
  Synthetic oligonucleotide; AGG chr2 60536666 60536685 60536669 -
tggcaggcaaacgctctaat

SEQ ID NO: 173415 - DNA, 20 bp, Artificial Sequence
  Synthetic oligonucleotide; GGG chr2 60536665 60536684 60536668 -
ggcaggcaaacgctctaata

SEQ ID NO: 173416 - DNA, 20 bp, Artificial Sequence
  Synthetic oligonucleotide; AAG chr2 60536651 60536670 60536654 -
ctaatagggaaaatcacttg

SEQ ID NO: 173417 - DNA, 20 bp, Artificial Sequence
  Synthetic oligonucleotide; AGG chr2 60536650 60536669 60536653 -
taatagggaaaatcacttga

SEQ ID NO: 173418 - DNA, 20 bp, Artificial Sequence
  Synthetic oligonucleotide; CAG chr2 60536647 60536666 60536650 -
tagggaaaatcacttgaagg

SEQ ID NO: 173419 - DNA, 20 bp, Artificial Sequence
  Synthetic oligonucleotide; TAG chr2 60536643 60536662 60536646 -
gaaaatcacttgaaggcagt

SEQ ID NO: 173420 - DNA, 20 bp, Artificial Sequence
  Synthetic oligonucleotide; AGG chr2 60536642 60536661 60536645 -
aaaatcacttgaaggcagtt

SEQ ID NO: 173421 - DNA, 20 bp, Artificial Sequence
  Synthetic oligonucleotide; GGG chr2 60536641 60536660 60536644 -
aaatcacttgaaggcagtta

SEQ ID NO: 173422 - DNA, 20 bp, Artificial Sequence
  Synthetic oligonucleotide; GGG chr2 60536640 60536659 60536643 -
aatcacttgaaggcagttag

SEQ ID NO: 173423 - DNA, 20 bp, Artificial Sequence
  Synthetic oligonucleotide; TGG chr2 60536632 60536651 60536635 -
gaaggcagttaggggaaatt

SEQ ID NO: 173424 - DNA, 20 bp, Artificial Sequence
  Synthetic oligonucleotide; AAG chr2 60536624 60536643 60536627 -
ttaggggaaatttggccttc

SEQ ID NO: 173425 - DNA, 20 bp, Artificial Sequence
  Synthetic oligonucleotide; TAG chr2 60536607 60536626 60536610 -
ttcaagtcccatttgctctg

SEQ ID NO: 173426 - DNA, 20 bp, Artificial Sequence
  Synthetic oligonucleotide; TAG chr2 60536602 60536621 60536605 -
gtcccatttgctctgtagtg

SEQ ID NO: 173427 - DNA, 20 bp, Artificial Sequence
  Synthetic oligonucleotide; TGG chr2 60536596 60536615 60536599 -
tttgctctgtagtgtagcat

SEQ ID NO: 173428 - DNA, 20 bp, Artificial Sequence
  Synthetic oligonucleotide; TAG chr2 60536514 60536533 60536517 -
ctcattgaactctactcatg

SEQ ID NO: 173429 - DNA, 20 bp, Artificial Sequence
  Synthetic oligonucleotide; GAG chr2 60536512 60536531 60536515 -
cattgaactctactcatgta

SEQ ID NO: 173430 - DNA, 20 bp, Artificial Sequence
  Synthetic oligonucleotide; TAG chr2 60536503 60536522 60536506 -
ctactcatgtagagtaacat

SEQ ID NO: 173431 - DNA, 20 bp, Artificial Sequence
  Synthetic oligonucleotide; CGG chr2 60536493 60536512 60536496 -
agagtaacattagtgtcaaa

SEQ ID NO: 173432 - DNA, 20 bp, Artificial Sequence
  Synthetic oligonucleotide; TGG chr2 60536487 60536506 60536490 -
acattagtgtcaaacggaat

SEQ ID NO: 173433 - DNA, 20 bp, Artificial Sequence
  Synthetic oligonucleotide; CAG chr2 60536483 60536502 60536486 -
tagtgtcaaacggaattggt

SEQ ID NO: 173434 - DNA, 20 bp, Artificial Sequence
  Synthetic oligonucleotide; AGG chr2 60536482 60536501 60536485 -
agtgtcaaacggaattggtc

SEQ ID NO: 173435 - DNA, 20 bp, Artificial Sequence
  Synthetic oligonucleotide; TGG chr2 60536475 60536494 60536478 -
aacggaattggtcaggactg

SEQ ID NO: 173436 - DNA, 20 bp, Artificial Sequence
  Synthetic oligonucleotide; TGG chr2 60536467 60536486 60536470 -
tggtcaggactgtggacctg

SEQ ID NO: 173437 - DNA, 20 bp, Artificial Sequence
  Synthetic oligonucleotide; CAG chr2 60536458 60536477 60536461 -
ctgtggacctgtggctcata

SEQ ID NO: 173438 - DNA, 20 bp, Artificial Sequence
  Synthetic oligonucleotide; TGG chr2 60536454 60536473 60536457 -
ggacctgtggctcatacaga

SEQ ID NO: 173439 - DNA, 20 bp, Artificial Sequence
  Synthetic oligonucleotide; TGG chr2 60536448 60536467 60536451 -
gtggctcatacagatggttg

SEQ ID NO: 173440 - DNA, 20 bp, Artificial Sequence
  Synthetic oligonucleotide; TGG chr2 60536442 60536461 60536445 -
catacagatggttgtggatg

SEQ ID NO: 173441 - DNA, 20 bp, Artificial Sequence
  Synthetic oligonucleotide; GGG chr2 60536441 60536460 60536444 -
atacagatggttgtggatgt

SEQ ID NO: 173442 - DNA, 20 bp, Artificial Sequence
  Synthetic oligonucleotide; CAG chr2 60536431 60536450 60536434 -
ttgtggatgtgggttccatg

SEQ ID NO: 173443 - DNA, 20 bp, Artificial Sequence
  Synthetic oligonucleotide; TGG chr2 60536392 60536411 60536395 -
ttctaataaatgttaaaatg

SEQ ID NO: 173444 - DNA, 20 bp, Artificial Sequence
  Synthetic oligonucleotide; GAG chr2 60536380 60536399 60536383 -
ttaaaatgtggcacatttct

SEQ ID NO: 173445 - DNA, 20 bp, Artificial Sequence
  Synthetic oligonucleotide; CAG chr2 60536377 60536396 60536380 -
aaatgtggcacatttctgag

SEQ ID NO: 173446 - DNA, 20 bp, Artificial Sequence
  Synthetic oligonucleotide; AGG chr2 60536376 60536395 60536379 -
aatgtggcacatttctgagc

SEQ ID NO: 173447 - DNA, 20 bp, Artificial Sequence
  Synthetic oligonucleotide; GGG chr2 60536375 60536394 60536378 -
atgtggcacatttctgagca

SEQ ID NO: 173448 - DNA, 20 bp, Artificial Sequence
  Synthetic oligonucleotide; AAG chr2 60536369 60536388 60536372 -
cacatttctgagcagggccc

SEQ ID NO: 173449 - DNA, 20 bp, Artificial Sequence
  Synthetic oligonucleotide; AGG chr2 60536368 60536387 60536371 -
acatttctgagcagggccca

SEQ ID NO: 173450 - DNA, 20 bp, Artificial Sequence
  Synthetic oligonucleotide; AAG chr2 60536363 60536382 60536366 -
tctgagcagggcccaaggat

SEQ ID NO: 173451 - DNA, 20 bp, Artificial Sequence
  Synthetic oligonucleotide; GAG chr2 60536361 60536380 60536364 -
tgagcagggcccaaggataa

SEQ ID NO: 173452 - DNA, 20 bp, Artificial Sequence
  Synthetic oligonucleotide; GAG chr2 60536359 60536378 60536362 -
agcagggcccaaggataaga

SEQ ID NO: 173453 - DNA, 20 bp, Artificial Sequence
  Synthetic oligonucleotide; AAG chr2 60536354 60536373 60536357 -
ggcccaaggataagagagtt

SEQ ID NO: 173454 - DNA, 20 bp, Artificial Sequence
  Synthetic oligonucleotide; CAG chr2 60536347 60536366 60536350 -
ggataagagagttaagaaat

SEQ ID NO: 173455 - DNA, 20 bp, Artificial Sequence
  Synthetic oligonucleotide; AGG chr2 60536346 60536365 60536349 -
gataagagagttaagaaatc

SEQ ID NO: 173456 - DNA, 20 bp, Artificial Sequence
  Synthetic oligonucleotide; GGG chr2 60536345 60536364 60536348 -
ataagagagttaagaaatca

SEQ ID NO: 173457 - DNA, 20 bp, Artificial Sequence
  Synthetic oligonucleotide; GGG chr2 60536344 60536363 60536347 -
taagagagttaagaaatcag

SEQ ID NO: 173458 - DNA, 20 bp, Artificial Sequence
  Synthetic oligonucleotide; GGG chr2 60536343 60536362 60536346 -
aagagagttaagaaatcagg

SEQ ID NO: 173459 - DNA, 20 bp, Artificial Sequence
  Synthetic oligonucleotide; TAG chr2 60536340 60536359 60536343 -
agagttaagaaatcaggggg

SEQ ID NO: 173460 - DNA, 20 bp, Artificial Sequence
  Synthetic oligonucleotide; GAG chr2 60536332 60536351 60536335 -
gaaatcagggggtagtacct

SEQ ID NO: 173461 - DNA, 20 bp, Artificial Sequence
  Synthetic oligonucleotide; CGG chr2 60536282 60536301 60536285 -
cttgataacatccacatttc

SEQ ID NO: 173462 - DNA, 20 bp, Artificial Sequence
  Synthetic oligonucleotide; AAG chr2 60536278 60536297 60536281 -
ataacatccacatttccggt

SEQ ID NO: 173463 - DNA, 20 bp, Artificial Sequence
  Synthetic oligonucleotide; TAG chr2 60536267 60536286 60536270 -
atttccggtaagatcaactc

SEQ ID NO: 173464 - DNA, 20 bp, Artificial Sequence
  Synthetic oligonucleotide; AGG chr2 60536266 60536285 60536269 -
tttccggtaagatcaactct

SEQ ID NO: 173465 - DNA, 20 bp, Artificial Sequence
  Synthetic oligonucleotide; GAG chr2 60536264 60536283 60536267 -
tccggtaagatcaactctag

SEQ ID NO: 173466 - DNA, 20 bp, Artificial Sequence
  Synthetic oligonucleotide; AAG chr2 60536260 60536279 60536263 -
gtaagatcaactctaggaga

SEQ ID NO: 173467 - DNA, 20 bp, Artificial Sequence
  Synthetic oligonucleotide; GAG chr2 60536254 60536273 60536257 -
tcaactctaggagaaagtct

SEQ ID NO: 173468 - DNA, 20 bp, Artificial Sequence
  Synthetic oligonucleotide; AGG chr2 60536253 60536272 60536256 -
caactctaggagaaagtctg

SEQ ID NO: 173469 - DNA, 20 bp, Artificial Sequence
  Synthetic oligonucleotide; TGG chr2 60536249 60536268 60536252 -
tctaggagaaagtctgaggc

SEQ ID NO: 173470 - DNA, 20 bp, Artificial Sequence
  Synthetic oligonucleotide; GGG chr2 60536248 60536267 60536251 -
ctaggagaaagtctgaggct

SEQ ID NO: 173471 - DNA, 20 bp, Artificial Sequence
  Synthetic oligonucleotide; GGG chr2 60536247 60536266 60536250 -
taggagaaagtctgaggctg

SEQ ID NO: 173472 - DNA, 20 bp, Artificial Sequence
  Synthetic oligonucleotide; GGG chr2 60536246 60536265 60536249 -
aggagaaagtctgaggctgg

SEQ ID NO: 173473 - DNA, 20 bp, Artificial Sequence
  Synthetic oligonucleotide; GAG chr2 60536244 60536263 60536247 -
gagaaagtctgaggctgggg

SEQ ID NO: 173474 - DNA, 20 bp, Artificial Sequence
  Synthetic oligonucleotide; GAG chr2 60536242 60536261 60536245 -
gaaagtctgaggctggggga

SEQ ID NO: 173475 - DNA, 20 bp, Artificial Sequence
  Synthetic oligonucleotide; GAG chr2 60536240 60536259 60536243 -
aagtctgaggctgggggaga

SEQ ID NO: 173476 - DNA, 20 bp, Artificial Sequence
  Synthetic oligonucleotide; AGG chr2 60536239 60536258 60536242 -
agtctgaggctgggggagag

SEQ ID NO: 173477 - DNA, 20 bp, Artificial Sequence
  Synthetic oligonucleotide; GGG chr2 60536238 60536257 60536241 -
gtctgaggctgggggagaga

SEQ ID NO: 173478 - DNA, 20 bp, Artificial Sequence
  Synthetic oligonucleotide; GGG chr2 60536237 60536256 60536240 -
tctgaggctgggggagagag

SEQ ID NO: 173479 - DNA, 20 bp, Artificial Sequence
  Synthetic oligonucleotide; GGG chr2 60536236 60536255 60536239 -
ctgaggctgggggagagagg

SEQ ID NO: 173480 - DNA, 20 bp, Artificial Sequence
  Synthetic oligonucleotide; GAG chr2 60536234 60536253 60536237 -
gaggctgggggagagagggg

SEQ ID NO: 173481 - DNA, 20 bp, Artificial Sequence
  Synthetic oligonucleotide; AAG chr2 60536231 60536250 60536234 -
gctgggggagagagggggag

SEQ ID NO: 173482 - DNA, 20 bp, Artificial Sequence
  Synthetic oligonucleotide; AGG chr2 60536230 60536249 60536233 -
ctgggggagagagggggaga

SEQ ID NO: 173483 - DNA, 20 bp, Artificial Sequence
  Synthetic oligonucleotide; GGG chr2 60536229 60536248 60536232 -
tgggggagagagggggagaa

SEQ ID NO: 173484 - DNA, 20 bp, Artificial Sequence
  Synthetic oligonucleotide; CGG chr2 60536224 60536243 60536227 -
gagagagggggagaagggtg

SEQ ID NO: 173485 - DNA, 20 bp, Artificial Sequence
  Synthetic oligonucleotide; GAG chr2 60536222 60536241 60536225 -
gagagggggagaagggtgcg

SEQ ID NO: 173486 - DNA, 20 bp, Artificial Sequence
  Synthetic oligonucleotide; GAG chr2 60536220 60536239 60536223 -
gagggggagaagggtgcgga

SEQ ID NO: 173487 - DNA, 20 bp, Artificial Sequence
  Synthetic oligonucleotide; GAG chr2 60536218 60536237 60536221 -
gggggagaagggtgcggaga

SEQ ID NO: 173488 - DNA, 20 bp, Artificial Sequence
  Synthetic oligonucleotide; AGG chr2 60536217 60536236 60536220 -
ggggagaagggtgcggagag

SEQ ID NO: 173489 - DNA, 20 bp, Artificial Sequence
  Synthetic oligonucleotide; TGG chr2 60536210 60536229 60536213 -
agggtgcggagagaggttct

SEQ ID NO: 173490 - DNA, 20 bp, Artificial Sequence
  Synthetic oligonucleotide; TAG chr2 60536195 60536214 60536198 -
gttcttggaatattcttcga

SEQ ID NO: 173491 - DNA, 20 bp, Artificial Sequence
  Synthetic oligonucleotide; CAG chr2 60536192 60536211 60536195 -
cttggaatattcttcgatag

SEQ ID NO: 173492 - DNA, 20 bp, Artificial Sequence
  Synthetic oligonucleotide; CAG chr2 60536172 60536191 60536175 -
cagttcaaatgaaatcccca

SEQ ID NO: 173493 - DNA, 20 bp, Artificial Sequence
  Synthetic oligonucleotide; CAG chr2 60536169 60536188 60536172 -
ttcaaatgaaatccccacag

SEQ ID NO: 173494 - DNA, 20 bp, Artificial Sequence
  Synthetic oligonucleotide; GAG chr2 60536167 60536186 60536170 -
caaatgaaatccccacagca

SEQ ID NO: 173495 - DNA, 20 bp, Artificial Sequence
  Synthetic oligonucleotide; GAG chr2 60536165 60536184 60536168 -
aatgaaatccccacagcaga

SEQ ID NO: 173496 - DNA, 20 bp, Artificial Sequence
  Synthetic oligonucleotide; TGG chr2 60536158 60536177 60536161 -
tccccacagcagagagcttt

SEQ ID NO: 173497 - DNA, 20 bp, Artificial Sequence
  Synthetic oligonucleotide; GGG chr2 60536157 60536176 60536160 -
ccccacagcagagagctttt

SEQ ID NO: 173498 - DNA, 20 bp, Artificial Sequence
  Synthetic oligonucleotide; TAG chr2 60536152 60536171 60536155 -
cagcagagagcttttgggtc

SEQ ID NO: 173499 - DNA, 20 bp, Artificial Sequence
  Synthetic oligonucleotide; CAG chr2 60536149 60536168 60536152 -
cagagagcttttgggtctag

SEQ ID NO: 173500 - DNA, 20 bp, Artificial Sequence
  Synthetic oligonucleotide; TGG chr2 60536146 60536165 60536149 -
agagcttttgggtctagcag

SEQ ID NO: 173501 - DNA, 20 bp, Artificial Sequence
  Synthetic oligonucleotide; GAG chr2 60536144 60536163 60536147 -
agcttttgggtctagcagtg

SEQ ID NO: 173502 - DNA, 20 bp, Artificial Sequence
  Synthetic oligonucleotide; CGG chr2 60536141 60536160 60536144 -
ttttgggtctagcagtggag

SEQ ID NO: 173503 - DNA, 20 bp, Artificial Sequence
  Synthetic oligonucleotide; AAG chr2 60536137 60536156 60536140 -
gggtctagcagtggagcggt

SEQ ID NO: 173504 - DNA, 20 bp, Artificial Sequence
  Synthetic oligonucleotide; TGG chr2 60536133 60536152 60536136 -
ctagcagtggagcggtaagc

SEQ ID NO: 173505 - DNA, 20 bp, Artificial Sequence
  Synthetic oligonucleotide; GGG chr2 60536132 60536151 60536135 -
tagcagtggagcggtaagct

SEQ ID NO: 173506 - DNA, 20 bp, Artificial Sequence
  Synthetic oligonucleotide; TGG chr2 60536124 60536143 60536127 -
gagcggtaagctgggacacg

SEQ ID NO: 173507 - DNA, 20 bp, Artificial Sequence
  Synthetic oligonucleotide; AAG chr2 60536114 60536133 60536117 -
ctgggacacgtggcctttcg

SEQ ID NO: 173508 - DNA, 20 bp, Artificial Sequence
  Synthetic oligonucleotide; CAG chr2 60536101 60536120 60536104 -
cctttcgaagctgttattct

SEQ ID NO: 173509 - DNA, 20 bp, Artificial Sequence
  Synthetic oligonucleotide; CAG chr2 60536084 60536103 60536087 -
tctcagtctgacttgcacac

SEQ ID NO: 173510 - DNA, 20 bp, Artificial Sequence
  Synthetic oligonucleotide; GAG chr2 60536079 60536098 60536082 -
gtctgacttgcacaccagct

SEQ ID NO: 173511 - DNA, 20 bp, Artificial Sequence
  Synthetic oligonucleotide; TAG chr2 60536075 60536094 60536078 -
gacttgcacaccagctgaga

SEQ ID NO: 173512 - DNA, 20 bp, Artificial Sequence
  Synthetic oligonucleotide; AGG chr2 60536074 60536093 60536077 -
acttgcacaccagctgagat

SEQ ID NO: 173513 - DNA, 20 bp, Artificial Sequence
  Synthetic oligonucleotide; TGG chr2 60536043 60536062 60536046 -
tatactttcttgctttcacc

SEQ ID NO: 173514 - DNA, 20 bp, Artificial Sequence
  Synthetic oligonucleotide; GGG chr2 60536042 60536061 60536045 -
atactttcttgctttcacct

SEQ ID NO: 173515 - DNA, 20 bp, Artificial Sequence
  Synthetic oligonucleotide; TGG chr2 60536038 60536057 60536041 -
tttcttgctttcacctgggt

SEQ ID NO: 173516 - DNA, 20 bp, Artificial Sequence
  Synthetic oligonucleotide; GAG chr2 60536036 60536055 60536039 -
tcttgctttcacctgggttg

SEQ ID NO: 173517 - DNA, 20 bp, Artificial Sequence
  Synthetic oligonucleotide; GAG chr2 60536034 60536053 60536037 -
ttgctttcacctgggttgga

SEQ ID NO: 173518 - DNA, 20 bp, Artificial Sequence
  Synthetic oligonucleotide; AGG chr2 60536033 60536052 60536036 -
tgctttcacctgggttggag

SEQ ID NO: 173519 - DNA, 20 bp, Artificial Sequence
  Synthetic oligonucleotide; TGG chr2 60536029 60536048 60536032 -
ttcacctgggttggagaggt

SEQ ID NO: 173520 - DNA, 20 bp, Artificial Sequence
  Synthetic oligonucleotide; GGG chr2 60536028 60536047 60536031 -
tcacctgggttggagaggtt

SEQ ID NO: 173521 - DNA, 20 bp, Artificial Sequence
  Synthetic oligonucleotide; GGG chr2 60536027 60536046 60536030 -
cacctgggttggagaggttg

SEQ ID NO: 173522 - DNA, 20 bp, Artificial Sequence
  Synthetic oligonucleotide; TGG chr2 60536023 60536042 60536026 -
tgggttggagaggttggggt

SEQ ID NO: 173523 - DNA, 20 bp, Artificial Sequence
  Synthetic oligonucleotide; GGG chr2 60536022 60536041 60536025 -
gggttggagaggttggggtt

SEQ ID NO: 173524 - DNA, 20 bp, Artificial Sequence
  Synthetic oligonucleotide; GAG chr2 60536020 60536039 60536023 -
gttggagaggttggggttgg

SEQ ID NO: 173525 - DNA, 20 bp, Artificial Sequence
  Synthetic oligonucleotide; AGG chr2 60536019 60536038 60536022 -
ttggagaggttggggttggg

SEQ ID NO: 173526 - DNA, 20 bp, Artificial Sequence
  Synthetic oligonucleotide; AAG chr2 60536016 60536035 60536019 -
gagaggttggggttgggagg

SEQ ID NO: 173527 - DNA, 20 bp, Artificial Sequence
  Synthetic oligonucleotide; GAG chr2 60536014 60536033 60536017 -
gaggttggggttgggaggaa

SEQ ID NO: 173528 - DNA, 20 bp, Artificial Sequence
  Synthetic oligonucleotide; AGG chr2 60536013 60536032 60536016 -
aggttggggttgggaggaag

SEQ ID NO: 173529 - DNA, 20 bp, Artificial Sequence
  Synthetic oligonucleotide; GAG chr2 60536011 60536030 60536014 -
gttggggttgggaggaagag

SEQ ID NO: 173530 - DNA, 20 bp, Artificial Sequence
  Synthetic oligonucleotide; AGG chr2 60536010 60536029 60536013 -
ttggggttgggaggaagagg

SEQ ID NO: 173531 - DNA, 20 bp, Artificial Sequence
  Synthetic oligonucleotide; GAG chr2 60536008 60536027 60536011 -
ggggttgggaggaagaggag

SEQ ID NO: 173532 - DNA, 20 bp, Artificial Sequence
  Synthetic oligonucleotide; TGG chr2 60536000 60536019 60536003 -
gaggaagaggaggagttcat

SEQ ID NO: 173533 - DNA, 20 bp, Artificial Sequence
  Synthetic oligonucleotide; GGG chr2 60535999 60536018 60536002 -
aggaagaggaggagttcatt

SEQ ID NO: 173534 - DNA, 20 bp, Artificial Sequence
  Synthetic oligonucleotide; TAG chr2 60535985 60536004 60535988 -
ttcattgggaattctgtcac

SEQ ID NO: 173535 - DNA, 20 bp, Artificial Sequence
  Synthetic oligonucleotide; CAG chr2 60535968 60535987 60535971 -
cactagaattttttaaatgt

SEQ ID NO: 173536 - DNA, 20 bp, Artificial Sequence
  Synthetic oligonucleotide; AGG chr2 60535967 60535986 60535970 -
actagaattttttaaatgtc

SEQ ID NO: 173537 - DNA, 20 bp, Artificial Sequence
  Synthetic oligonucleotide; GAG chr2 60535965 60535984 60535968 -
tagaattttttaaatgtcag

SEQ ID NO: 173538 - DNA, 20 bp, Artificial Sequence
  Synthetic oligonucleotide; AGG chr2 60535964 60535983 60535967 -
agaattttttaaatgtcagg

SEQ ID NO: 173539 - DNA, 20 bp, Artificial Sequence
  Synthetic oligonucleotide; TAG chr2 60535960 60535979 60535963 -
ttttttaaatgtcaggaggt

SEQ ID NO: 173540 - DNA, 20 bp, Artificial Sequence
  Synthetic oligonucleotide; AAG chr2 60535956 60535975 60535959 -
ttaaatgtcaggaggttagc

SEQ ID NO: 173541 - DNA, 20 bp, Artificial Sequence
  Synthetic oligonucleotide; AGG chr2 60535955 60535974 60535958 -
taaatgtcaggaggttagca

SEQ ID NO: 173542 - DNA, 20 bp, Artificial Sequence
  Synthetic oligonucleotide; GAG chr2 60535949 60535968 60535952 -
tcaggaggttagcaaggtgt

SEQ ID NO: 173543 - DNA, 20 bp, Artificial Sequence
  Synthetic oligonucleotide; TAG chr2 60535945 60535964 60535948 -
gaggttagcaaggtgtgagt

SEQ ID NO: 173544 - DNA, 20 bp, Artificial Sequence
  Synthetic oligonucleotide; AAG chr2 60535937 60535956 60535940 -
caaggtgtgagttagcattc

SEQ ID NO: 173545 - DNA, 20 bp, Artificial Sequence
  Synthetic oligonucleotide; AAG chr2 60535932 60535951 60535935 -
tgtgagttagcattcaagca

SEQ ID NO: 173546 - DNA, 20 bp, Artificial Sequence
  Synthetic oligonucleotide; AGG chr2 60535931 60535950 60535934 -
gtgagttagcattcaagcaa

SEQ ID NO: 173547 - DNA, 20 bp, Artificial Sequence
  Synthetic oligonucleotide; CAG chr2 60535919 60535938 60535922 -
tcaagcaaaggattcttctc

SEQ ID NO: 173548 - DNA, 20 bp, Artificial Sequence
  Synthetic oligonucleotide; TAG chr2 60535914 60535933 60535917 -
caaaggattcttctccagac

SEQ ID NO: 173549 - DNA, 20 bp, Artificial Sequence
  Synthetic oligonucleotide; TGG chr2 60535907 60535926 60535910 -
ttcttctccagactagtaat

SEQ ID NO: 173550 - DNA, 20 bp, Artificial Sequence
  Synthetic oligonucleotide; AAG chr2 60535903 60535922 60535906 -
tctccagactagtaattgga

SEQ ID NO: 173551 - DNA, 20 bp, Artificial Sequence
  Synthetic oligonucleotide; CAG chr2 60535890 60535909 60535893 -
aattggaaagcctgcaaatc

SEQ ID NO: 173552 - DNA, 20 bp, Artificial Sequence
  Synthetic oligonucleotide; AGG chr2 60535889 60535908 60535892 -
attggaaagcctgcaaatcc

SEQ ID NO: 173553 - DNA, 20 bp, Artificial Sequence
  Synthetic oligonucleotide; TGG chr2 60535863 60535882 60535866 -
ccacgatactctctaataac

SEQ ID NO: 173554 - DNA, 20 bp, Artificial Sequence
  Synthetic oligonucleotide; GGG chr2 60535862 60535881 60535865 -
cacgatactctctaataact

SEQ ID NO: 173555 - DNA, 20 bp, Artificial Sequence
  Synthetic oligonucleotide; GGG chr2 60535861 60535880 60535864 -
acgatactctctaataactg

SEQ ID NO: 173556 - DNA, 20 bp, Artificial Sequence
  Synthetic oligonucleotide; TGG chr2 60535858 60535877 60535861 -
atactctctaataactgggg

SEQ ID NO: 173557 - DNA, 20 bp, Artificial Sequence
  Synthetic oligonucleotide; GGG chr2 60535857 60535876 60535860 -
tactctctaataactggggt

SEQ ID NO: 173558 - DNA, 20 bp, Artificial Sequence
  Synthetic oligonucleotide; TGG chr2 60535853 60535872 60535856 -
ctctaataactggggtggga

SEQ ID NO: 173559 - DNA, 20 bp, Artificial Sequence
  Synthetic oligonucleotide; TGG chr2 60535850 60535869 60535853 -
taataactggggtgggatgg

SEQ ID NO: 173560 - DNA, 20 bp, Artificial Sequence
  Synthetic oligonucleotide; TGG chr2 60535847 60535866 60535850 -
taactggggtgggatggtgg

SEQ ID NO: 173561 - DNA, 20 bp, Artificial Sequence
  Synthetic oligonucleotide; TGG chr2 60535844 60535863 60535847 -
ctggggtgggatggtggtgg

SEQ ID NO: 173562 - DNA, 20 bp, Artificial Sequence
  Synthetic oligonucleotide; GGG chr2 60535843 60535862 60535846 -
tggggtgggatggtggtggt

SEQ ID NO: 173563 - DNA, 20 bp, Artificial Sequence
  Synthetic oligonucleotide; TGG chr2 60535840 60535859 60535843 -
ggtgggatggtggtggtggg

SEQ ID NO: 173564 - DNA, 20 bp, Artificial Sequence
  Synthetic oligonucleotide; CAG chr2 60535816 60535835 60535819 -
caccacaactttctgaatgt

SEQ ID NO: 173565 - DNA, 20 bp, Artificial Sequence
  Synthetic oligonucleotide; TGG chr2 60535787 60535806 60535790 -
tctgcatgacccgttcacca

SEQ ID NO: 173566 - DNA, 20 bp, Artificial Sequence
  Synthetic oligonucleotide; CGG chr2 60535776 60535795 60535779 -
cgttcaccatggattaaatg

SEQ ID NO: 173567 - DNA, 20 bp, Artificial Sequence
  Synthetic oligonucleotide; TGG chr2 60535772 60535791 60535775 -
caccatggattaaatgcggc

SEQ ID NO: 173568 - DNA, 20 bp, Artificial Sequence
  Synthetic oligonucleotide; TGG chr2 60535762 60535781 60535765 -
taaatgcggctggtgccgaa

SEQ ID NO: 173569 - DNA, 20 bp, Artificial Sequence
  Synthetic oligonucleotide; GAG chr2 60535760 60535779 60535763 -
aatgcggctggtgccgaatg

SEQ ID NO: 173570 - DNA, 20 bp, Artificial Sequence
  Synthetic oligonucleotide; AGG chr2 60535759 60535778 60535762 -
atgcggctggtgccgaatgg

SEQ ID NO: 173571 - DNA, 20 bp, Artificial Sequence
  Synthetic oligonucleotide; CAG chr2 60535752 60535771 60535755 -
tggtgccgaatggaggaaat

SEQ ID NO: 173572 - DNA, 20 bp, Artificial Sequence
  Synthetic oligonucleotide; AAG chr2 60535748 60535767 60535751 -
gccgaatggaggaaatcaga

SEQ ID NO: 173573 - DNA, 20 bp, Artificial Sequence
  Synthetic oligonucleotide; AGG chr2 60535747 60535766 60535750 -
ccgaatggaggaaatcagaa

SEQ ID NO: 173574 - DNA, 20 bp, Artificial Sequence
  Synthetic oligonucleotide; AAG chr2 60535736 60535755 60535739 -
aaatcagaaaggcaaatctc

SEQ ID NO: 173575 - DNA, 20 bp, Artificial Sequence
  Synthetic oligonucleotide; CAG chr2 60535730 60535749 60535733 -
gaaaggcaaatctcaagcaa

SEQ ID NO: 173576 - DNA, 20 bp, Artificial Sequence
  Synthetic oligonucleotide; AGG chr2 60535729 60535748 60535732 -
aaaggcaaatctcaagcaac

SEQ ID NO: 173577 - DNA, 20 bp, Artificial Sequence
  Synthetic oligonucleotide; CAG chr2 60535714 60535733 60535717 -
gcaacaggatttgcactcct

SEQ ID NO: 173578 - DNA, 20 bp, Artificial Sequence
  Synthetic oligonucleotide; AAG chr2 60535711 60535730 60535714 -
acaggatttgcactcctcag

SEQ ID NO: 173579 - DNA, 20 bp, Artificial Sequence
  Synthetic oligonucleotide; CAG chr2 60535703 60535722 60535706 -
tgcactcctcagaagtaaac

SEQ ID NO: 173580 - DNA, 20 bp, Artificial Sequence
  Synthetic oligonucleotide; TGG chr2 60535662 60535681 60535665 -
ctgtgcttctcctttcttgc

SEQ ID NO: 173581 - DNA, 20 bp, Artificial Sequence
  Synthetic oligonucleotide; TGG chr2 60535651 60535670 60535654 -
ctttcttgctggtttccctt

SEQ ID NO: 173582 - DNA, 20 bp, Artificial Sequence
  Synthetic oligonucleotide; AAG chr2 60535648 60535667 60535651 -
tcttgctggtttccctttgg

SEQ ID NO: 173583 - DNA, 20 bp, Artificial Sequence
  Synthetic oligonucleotide; CAG chr2 60535645 60535664 60535648 -
tgctggtttccctttggaag

SEQ ID NO: 173584 - DNA, 20 bp, Artificial Sequence
  Synthetic oligonucleotide; AAG chr2 60535617 60535636 60535620 -
tctaaaattaatgccactcc

SEQ ID NO: 173585 - DNA, 20 bp, Artificial Sequence
  Synthetic oligonucleotide; AAG chr2 60535605 60535624 60535608 -
gccactccaagccaatgaaa

SEQ ID NO: 173586 - DNA, 20 bp, Artificial Sequence
  Synthetic oligonucleotide; CAG chr2 60535588 60535607 60535591 -
aaaaagctgtttttatacca

SEQ ID NO: 173587 - DNA, 20 bp, Artificial Sequence
  Synthetic oligonucleotide; TGG chr2 60535585 60535604 60535588 -
aagctgtttttataccacag

SEQ ID NO: 173588 - DNA, 20 bp, Artificial Sequence
  Synthetic oligonucleotide; CAG chr2 60535573 60535592 60535576 -
taccacagtggatgtttaca

SEQ ID NO: 173589 - DNA, 20 bp, Artificial Sequence
  Synthetic oligonucleotide; AGG chr2 60535572 60535591 60535575 -
accacagtggatgtttacac

SEQ ID NO: 173590 - DNA, 20 bp, Artificial Sequence
  Synthetic oligonucleotide; GAG chr2 60535570 60535589 60535573 -
cacagtggatgtttacacag

SEQ ID NO: 173591 - DNA, 20 bp, Artificial Sequence
  Synthetic oligonucleotide; GAG chr2 60535568 60535587 60535571 -
cagtggatgtttacacagga

SEQ ID NO: 173592 - DNA, 20 bp, Artificial Sequence
  Synthetic oligonucleotide; GAG chr2 60535558 60535577 60535561 -
ttacacaggagagacaactt

SEQ ID NO: 173593 - DNA, 20 bp, Artificial Sequence
  Synthetic oligonucleotide; AGG chr2 60535557 60535576 60535560 -
tacacaggagagacaacttg

SEQ ID NO: 173594 - DNA, 20 bp, Artificial Sequence
  Synthetic oligonucleotide; GGG chr2 60535556 60535575 60535559 -
acacaggagagacaacttga

SEQ ID NO: 173595 - DNA, 20 bp, Artificial Sequence
  Synthetic oligonucleotide; GGG chr2 60535555 60535574 60535558 -
cacaggagagacaacttgag

SEQ ID NO: 173596 - DNA, 20 bp, Artificial Sequence
  Synthetic oligonucleotide; GGG chr2 60535554 60535573 60535557 -
acaggagagacaacttgagg

SEQ ID NO: 173597 - DNA, 20 bp, Artificial Sequence
  Synthetic oligonucleotide; AAG chr2 60535549 60535568 60535552 -
agagacaacttgagggggaa

SEQ ID NO: 173598 - DNA, 20 bp, Artificial Sequence
  Synthetic oligonucleotide; AGG chr2 60535548 60535567 60535551 -
gagacaacttgagggggaaa

SEQ ID NO: 173599 - DNA, 20 bp, Artificial Sequence
  Synthetic oligonucleotide; TGG chr2 60535540 60535559 60535543 -
ttgagggggaaaaggctttt

SEQ ID NO: 173600 - DNA, 20 bp, Artificial Sequence
  Synthetic oligonucleotide; AAG chr2 60535537 60535556 60535540 -
agggggaaaaggctttttgg

SEQ ID NO: 173601 - DNA, 20 bp, Artificial Sequence
  Synthetic oligonucleotide; AGG chr2 60535536 60535555 60535539 -
gggggaaaaggctttttgga

SEQ ID NO: 173602 - DNA, 20 bp, Artificial Sequence
  Synthetic oligonucleotide; GGG chr2 60535535 60535554 60535538 -
ggggaaaaggctttttggaa

SEQ ID NO: 173603 - DNA, 20 bp, Artificial Sequence
  Synthetic oligonucleotide; TGG chr2 60535532 60535551 60535535 -
gaaaaggctttttggaaggg

SEQ ID NO: 173604 - DNA, 20 bp, Artificial Sequence
  Synthetic oligonucleotide; GAG chr2 60535530 60535549 60535533 -
aaaggctttttggaagggtg

SEQ ID NO: 173605 - DNA, 20 bp, Artificial Sequence
  Synthetic oligonucleotide; AGG chr2 60535529 60535548 60535532 -
aaggctttttggaagggtgg

SEQ ID NO: 173606 - DNA, 20 bp, Artificial Sequence
  Synthetic oligonucleotide; GGG chr2 60535528 60535547 60535531 -
aggctttttggaagggtgga

SEQ ID NO: 173607 - DNA, 20 bp, Artificial Sequence
  Synthetic oligonucleotide; TGG chr2 60535504 60535523 60535507 -
ctcgtgttaatctgttctgt

SEQ ID NO: 173608 - DNA, 20 bp, Artificial Sequence
  Synthetic oligonucleotide; GAG chr2 60535502 60535521 60535505 -
cgtgttaatctgttctgttg

SEQ ID NO: 173609 - DNA, 20 bp, Artificial Sequence
  Synthetic oligonucleotide; AGG chr2 60535501 60535520 60535504 -
gtgttaatctgttctgttgg

SEQ ID NO: 173610 - DNA, 20 bp, Artificial Sequence
  Synthetic oligonucleotide; CAG chr2 60535492 60535511 60535495 -
tgttctgttggaggactatg

SEQ ID NO: 173611 - DNA, 20 bp, Artificial Sequence
  Synthetic oligonucleotide; GAG chr2 60535479 60535498 60535482 -
gactatgcagtattgcctat

SEQ ID NO: 173612 - DNA, 20 bp, Artificial Sequence
  Synthetic oligonucleotide; TGG chr2 60535470 60535489 60535473 -
gtattgcctatgagcgactc

SEQ ID NO: 173613 - DNA, 20 bp, Artificial Sequence
  Synthetic oligonucleotide; GGG chr2 60535469 60535488 60535472 -
tattgcctatgagcgactct

SEQ ID NO: 173614 - DNA, 20 bp, Artificial Sequence
  Synthetic oligonucleotide; TAG chr2 60535442 60535461 60535445 -
ttttgataaattaccatgtt

SEQ ID NO: 173615 - DNA, 20 bp, Artificial Sequence
  Synthetic oligonucleotide; GAG chr2 60535440 60535459 60535443 -
ttgataaattaccatgttta

SEQ ID NO: 173616 - DNA, 20 bp, Artificial Sequence
  Synthetic oligonucleotide; TAG chr2 60535436 60535455 60535439 -
taaattaccatgtttagaga

SEQ ID NO: 173617 - DNA, 20 bp, Artificial Sequence
  Synthetic oligonucleotide; AGG chr2 60535435 60535454 60535438 -
aaattaccatgtttagagat

SEQ ID NO: 173618 - DNA, 20 bp, Artificial Sequence
  Synthetic oligonucleotide; TGG chr2 60535430 60535449 60535433 -
accatgtttagagataggtt

SEQ ID NO: 173619 - DNA, 20 bp, Artificial Sequence
  Synthetic oligonucleotide; AAG chr2 60535422 60535441 60535425 -
tagagataggtttggctctt

SEQ ID NO: 173620 - DNA, 20 bp, Artificial Sequence
  Synthetic oligonucleotide; AGG chr2 60535421 60535440 60535424 -
agagataggtttggctctta

SEQ ID NO: 173621 - DNA, 20 bp, Artificial Sequence
  Synthetic oligonucleotide; GGG chr2 60535420 60535439 60535423 -
gagataggtttggctcttaa

SEQ ID NO: 173622 - DNA, 20 bp, Artificial Sequence
  Synthetic oligonucleotide; TAG chr2 60535415 60535434 60535418 -
aggtttggctcttaagggct

SEQ ID NO: 173623 - DNA, 20 bp, Artificial Sequence
  Synthetic oligonucleotide; AAG chr2 60535401 60535420 60535404 -
agggcttagttttatgaaca

SEQ ID NO: 173624 - DNA, 20 bp, Artificial Sequence
  Synthetic oligonucleotide; CAG chr2 60535382 60535401 60535385 -
aaagtccgtgacgatgtttg

SEQ ID NO: 173625 - DNA, 20 bp, Artificial Sequence
  Synthetic oligonucleotide; TAG chr2 60535364 60535383 60535367 -
tgcagcctctgtttgtatct

SEQ ID NO: 173626 - DNA, 20 bp, Artificial Sequence
  Synthetic oligonucleotide; TGG chr2 60535355 60535374 60535358 -
tgtttgtatcttagcccctt

SEQ ID NO: 173627 - DNA, 20 bp, Artificial Sequence
  Synthetic oligonucleotide; TAG chr2 60535346 60535365 60535349 -
cttagcccctttggcttgac

SEQ ID NO: 173628 - DNA, 20 bp, Artificial Sequence
  Synthetic oligonucleotide; AAG chr2 60535343 60535362 60535346 -
agcccctttggcttgactag

SEQ ID NO: 173629 - DNA, 20 bp, Artificial Sequence
  Synthetic oligonucleotide; TAG chr2 60535331 60535350 60535334 -
ttgactagaagctctatgtt

SEQ ID NO: 173630 - DNA, 20 bp, Artificial Sequence
  Synthetic oligonucleotide; AAG chr2 60535325 60535344 60535328 -
agaagctctatgtttagttt

SEQ ID NO: 173631 - DNA, 20 bp, Artificial Sequence
  Synthetic oligonucleotide; CAG chr2 60535320 60535339 60535323 -
ctctatgtttagtttaagct

SEQ ID NO: 173632 - DNA, 20 bp, Artificial Sequence
  Synthetic oligonucleotide; TGG chr2 60535315 60535334 60535318 -
tgtttagtttaagctcagtc

SEQ ID NO: 173633 - DNA, 20 bp, Artificial Sequence
  Synthetic oligonucleotide; AAG chr2 60535312 60535331 60535315 -
ttagtttaagctcagtctgg

SEQ ID NO: 173634 - DNA, 20 bp, Artificial Sequence
  Synthetic oligonucleotide; GAG chr2 60535283 60535302 60535286 -
caattttgcattaaaaaaat

SEQ ID NO: 173635 - DNA, 20 bp, Artificial Sequence
  Synthetic oligonucleotide; AGG chr2 60535282 60535301 60535285 -
aattttgcattaaaaaaatg

SEQ ID NO: 173636 - DNA, 20 bp, Artificial Sequence
  Synthetic oligonucleotide; TAG chr2 60535273 60535292 60535276 -
ttaaaaaaatgaggaaatca

SEQ ID NO: 173637 - DNA, 20 bp, Artificial Sequence
  Synthetic oligonucleotide; AGG chr2 60535272 60535291 60535275 -
taaaaaaatgaggaaatcat

SEQ ID NO: 173638 - DNA, 20 bp, Artificial Sequence
  Synthetic oligonucleotide; AAG chr2 60535269 60535288 60535272 -
aaaaatgaggaaatcatagg

SEQ ID NO: 173639 - DNA, 20 bp, Artificial Sequence
  Synthetic oligonucleotide; TGG chr2 60535249 60535268 60535252 -
aagaaaaaccctttgctttt

SEQ ID NO: 173640 - DNA, 20 bp, Artificial Sequence
  Synthetic oligonucleotide; AAG chr2 60535222 60535241 60535225 -
atcttactgataatttgcta

SEQ ID NO: 173641 - DNA, 20 bp, Artificial Sequence
  Synthetic oligonucleotide; AAG chr2 60535205 60535224 60535208 -
ctaaagctcatttgaatttt

SEQ ID NO: 173642 - DNA, 20 bp, Artificial Sequence
  Synthetic oligonucleotide; AAG chr2 60535185 60535204 60535188 -
aagcacttctttaatcttca

SEQ ID NO: 173643 - DNA, 20 bp, Artificial Sequence
  Synthetic oligonucleotide; AGG chr2 60535184 60535203 60535187 -
agcacttctttaatcttcaa

SEQ ID NO: 173644 - DNA, 20 bp, Artificial Sequence
  Synthetic oligonucleotide; TGG chr2 60535158 60535177 60535161 -
aattgctttatgaatatgca

SEQ ID NO: 173645 - DNA, 20 bp, Artificial Sequence
  Synthetic oligonucleotide; TGG chr2 60535153 60535172 60535156 -
ctttatgaatatgcatggtg

SEQ ID NO: 173646 - DNA, 20 bp, Artificial Sequence
  Synthetic oligonucleotide; GGG chr2 60535152 60535171 60535155 -
tttatgaatatgcatggtgt

SEQ ID NO: 173647 - DNA, 20 bp, Artificial Sequence
  Synthetic oligonucleotide; CAG chr2 60535149 60535168 60535152 -
atgaatatgcatggtgtggg

SEQ ID NO: 173648 - DNA, 20 bp, Artificial Sequence
  Synthetic oligonucleotide; CAG chr2 60535142 60535161 60535145 -
tgcatggtgtgggcagactt

SEQ ID NO: 173649 - DNA, 20 bp, Artificial Sequence
  Synthetic oligonucleotide; TAG chr2 60535130 60535149 60535133 -
gcagacttcagttcattacc

SEQ ID NO: 173650 - DNA, 20 bp, Artificial Sequence
  Synthetic oligonucleotide; TAG chr2 60535107 60535126 60535110 -
ttgtaaattctaatgaccat

SEQ ID NO: 173651 - DNA, 20 bp, Artificial Sequence
  Synthetic oligonucleotide; AGG chr2 60535106 60535125 60535109 -
tgtaaattctaatgaccatt

SEQ ID NO: 173652 - DNA, 20 bp, Artificial Sequence
  Synthetic oligonucleotide; CAG chr2 60535097 60535116 60535100 -
taatgaccattaggtccttc

SEQ ID NO: 173653 - DNA, 20 bp, Artificial Sequence
  Synthetic oligonucleotide; TGG chr2 60535066 60535085 60535069 -
aattgttttgcatttttgat

SEQ ID NO: 173654 - DNA, 20 bp, Artificial Sequence
  Synthetic oligonucleotide; CGG chr2 60535045 60535064 60535048 -
ggcctattaacatgtacatt

SEQ ID NO: 173655 - DNA, 20 bp, Artificial Sequence
  Synthetic oligonucleotide; CAG chr2 60535035 60535054 60535038 -
catgtacattcggtgcacat

SEQ ID NO: 173656 - DNA, 20 bp, Artificial Sequence
  Synthetic oligonucleotide; AGG chr2 60535034 60535053 60535037 -
atgtacattcggtgcacatc

SEQ ID NO: 173657 - DNA, 20 bp, Artificial Sequence
  Synthetic oligonucleotide; TGG chr2 60535030 60535049 60535033 -
acattcggtgcacatcaggc

SEQ ID NO: 173658 - DNA, 20 bp, Artificial Sequence
  Synthetic oligonucleotide; CAG chr2 60535022 60535041 60535025 -
tgcacatcaggctggcctgt

SEQ ID NO: 173659 - DNA, 20 bp, Artificial Sequence
  Synthetic oligonucleotide; AAG chr2 60535012 60535031 60535015 -
gctggcctgtcagcctgctg

SEQ ID NO: 173660 - DNA, 20 bp, Artificial Sequence
  Synthetic oligonucleotide; AGG chr2 60535011 60535030 60535014 -
ctggcctgtcagcctgctga

SEQ ID NO: 173661 - DNA, 20 bp, Artificial Sequence
  Synthetic oligonucleotide; GAG chr2 60535009 60535028 60535012 -
ggcctgtcagcctgctgaag

SEQ ID NO: 173662 - DNA, 20 bp, Artificial Sequence
  Synthetic oligonucleotide; AAG chr2 60535000 60535019 60535003 -
gcctgctgaaggagaaaaaa

SEQ ID NO: 173663 - DNA, 20 bp, Artificial Sequence
  Synthetic oligonucleotide; AGG chr2 60534999 60535018 60535002 -
cctgctgaaggagaaaaaaa

SEQ ID NO: 173664 - DNA, 20 bp, Artificial Sequence
  Synthetic oligonucleotide; TAG chr2 60534983 60535002 60534986 -
aaaaaggtgaaaattgttta

SEQ ID NO: 173665 - DNA, 20 bp, Artificial Sequence
  Synthetic oligonucleotide; AAG chr2 60534976 60534995 60534979 -
tgaaaattgtttatagcacc

SEQ ID NO: 173666 - DNA, 20 bp, Artificial Sequence
  Synthetic oligonucleotide; TAG chr2 60534968 60534987 60534971 -
gtttatagcaccaagattct

SEQ ID NO: 173667 - DNA, 20 bp, Artificial Sequence
  Synthetic oligonucleotide; AAG chr2 60534927 60534946 60534930 -
ttgatgatgtaaaaaaatta

SEQ ID NO: 173668 - DNA, 20 bp, Artificial Sequence
  Synthetic oligonucleotide; CAG chr2 60534924 60534943 60534927 -
atgatgtaaaaaaattaaag

SEQ ID NO: 173669 - DNA, 20 bp, Artificial Sequence
  Synthetic oligonucleotide; AAG chr2 60534907 60534926 60534910 -
aagcagtgttttttcttctc

SEQ ID NO: 173670 - DNA, 20 bp, Artificial Sequence
  Synthetic oligonucleotide; AAG chr2 60534899 60534918 60534902 -
ttttttcttctcaagattaa

SEQ ID NO: 173671 - DNA, 20 bp, Artificial Sequence
  Synthetic oligonucleotide; AAG chr2 60534890 60534909 60534893 -
ctcaagattaaaagttcacc

SEQ ID NO: 173672 - DNA, 20 bp, Artificial Sequence
  Synthetic oligonucleotide; GAG chr2 60534888 60534907 60534891 -
caagattaaaagttcaccaa

SEQ ID NO: 173673 - DNA, 20 bp, Artificial Sequence
  Synthetic oligonucleotide; AAG chr2 60534824 60534843 60534827 -
attaatgtaatttgcatatg

SEQ ID NO: 173674 - DNA, 20 bp, Artificial Sequence
  Synthetic oligonucleotide; TAG chr2 60534786 60534805 60534789 -
tttgatcatgttttgtgtat

SEQ ID NO: 173675 - DNA, 20 bp, Artificial Sequence
  Synthetic oligonucleotide; CAG chr2 60534777 60534796 60534780 -
gttttgtgtattagctgcct

SEQ ID NO: 173676 - DNA, 20 bp, Artificial Sequence
  Synthetic oligonucleotide; TGG chr2 60534774 60534793 60534777 -
ttgtgtattagctgcctcag

SEQ ID NO: 173677 - DNA, 20 bp, Artificial Sequence
  Synthetic oligonucleotide; CAG chr2 60534761 60534780 60534764 -
gcctcagtggctctcctcct

SEQ ID NO: 173678 - DNA, 20 bp, Artificial Sequence
  Synthetic oligonucleotide; CAG chr2 60534752 60534771 60534755 -
gctctcctcctcagatgccc

SEQ ID NO: 173679 - DNA, 20 bp, Artificial Sequence
  Synthetic oligonucleotide; TAG chr2 60534749 60534768 60534752 -
ctcctcctcagatgccccag

SEQ ID NO: 173680 - DNA, 20 bp, Artificial Sequence
  Synthetic oligonucleotide; AAG chr2 60534745 60534764 60534748 -
tcctcagatgccccagtaga

SEQ ID NO: 173681 - DNA, 20 bp, Artificial Sequence
  Synthetic oligonucleotide; AGG chr2 60534744 60534763 60534747 -
cctcagatgccccagtagaa

SEQ ID NO: 173682 - DNA, 20 bp, Artificial Sequence
  Synthetic oligonucleotide; GAG chr2 60534742 60534761 60534745 -
tcagatgccccagtagaaag

SEQ ID NO: 173683 - DNA, 20 bp, Artificial Sequence
  Synthetic oligonucleotide; AAG chr2 60534717 60534736 60534720 -
aaatgatgcatcttcttgcc

SEQ ID NO: 173684 - DNA, 20 bp, Artificial Sequence
  Synthetic oligonucleotide; TAG chr2 60534707 60534726 60534710 -
tcttcttgccaagtttcctt

SEQ ID NO: 173685 - DNA, 20 bp, Artificial Sequence
  Synthetic oligonucleotide; GAG chr2 60534698 60534717 60534701 -
caagtttcctttagtgaatt

SEQ ID NO: 173686 - DNA, 20 bp, Artificial Sequence
  Synthetic oligonucleotide; AGG chr2 60534697 60534716 60534700 -
aagtttcctttagtgaattg

SEQ ID NO: 173687 - DNA, 20 bp, Artificial Sequence
  Synthetic oligonucleotide; TAG chr2 60534691 60534710 60534694 -
cctttagtgaattgaggaat

SEQ ID NO: 173688 - DNA, 20 bp, Artificial Sequence
  Synthetic oligonucleotide; AAG chr2 60534688 60534707 60534691 -
ttagtgaattgaggaattag

SEQ ID NO: 173689 - DNA, 20 bp, Artificial Sequence
  Synthetic oligonucleotide; GAG chr2 60534676 60534695 60534679 -
ggaattagaagtctaacctt

SEQ ID NO: 173690 - DNA, 20 bp, Artificial Sequence
  Synthetic oligonucleotide; AAG chr2 60534637 60534656 60534640 -
atccgttttcttttaacgtt

SEQ ID NO: 173691 - DNA, 20 bp, Artificial Sequence
  Synthetic oligonucleotide; CAG chr2 60534632 60534651 60534635 -
ttttcttttaacgttaagta

SEQ ID NO: 173692 - DNA, 20 bp, Artificial Sequence
  Synthetic oligonucleotide; TGG chr2 60534616 60534635 60534619 -
agtacagtttgtgaacgtgt

SEQ ID NO: 173693 - DNA, 20 bp, Artificial Sequence
  Synthetic oligonucleotide; TGG chr2 60534612 60534631 60534615 -
cagtttgtgaacgtgttggc

SEQ ID NO: 173694 - DNA, 20 bp, Artificial Sequence
  Synthetic oligonucleotide; TGG chr2 60534595 60534614 60534598 -
ggctggaaatcgttctcatt

SEQ ID NO: 173695 - DNA, 20 bp, Artificial Sequence
  Synthetic oligonucleotide; GGG chr2 60534594 60534613 60534597 -
gctggaaatcgttctcattt

SEQ ID NO: 173696 - DNA, 20 bp, Artificial Sequence
  Synthetic oligonucleotide; GGG chr2 60534593 60534612 60534596 -
ctggaaatcgttctcatttg

SEQ ID NO: 173697 - DNA, 20 bp, Artificial Sequence
  Synthetic oligonucleotide; GAG chr2 60534591 60534610 60534594 -
ggaaatcgttctcatttggg

SEQ ID NO: 173698 - DNA, 20 bp, Artificial Sequence
  Synthetic oligonucleotide; AAG chr2 60534588 60534607 60534591 -
aatcgttctcatttggggag

SEQ ID NO: 173699 - DNA, 20 bp, Artificial Sequence
  Synthetic oligonucleotide; AAG chr2 60534573 60534592 60534576 -
gggagaagactgtaaaattt

SEQ ID NO: 173700 - DNA, 20 bp, Artificial Sequence
  Synthetic oligonucleotide; GAG chr2 60534561 60534580 60534564 -
taaaatttaagtatatgatt

SEQ ID NO: 173701 - DNA, 20 bp, Artificial Sequence
  Synthetic oligonucleotide; AGG chr2 60534560 60534579 60534563 -
aaaatttaagtatatgattg

SEQ ID NO: 173702 - DNA, 20 bp, Artificial Sequence
  Synthetic oligonucleotide; CAG chr2 60534551 60534570 60534554 -
gtatatgattgaggcacttc

SEQ ID NO: 173703 - DNA, 20 bp, Artificial Sequence
  Synthetic oligonucleotide; TAG chr2 60534543 60534562 60534546 -
ttgaggcacttccagataca

SEQ ID NO: 173704 - DNA, 20 bp, Artificial Sequence
  Synthetic oligonucleotide; GAG chr2 60534541 60534560 60534544 -
gaggcacttccagatacata

SEQ ID NO: 173705 - DNA, 20 bp, Artificial Sequence
  Synthetic oligonucleotide; CAG chr2 60534500 60534519 60534503 -
tctgttccccacgaacattg

SEQ ID NO: 173706 - DNA, 20 bp, Artificial Sequence
  Synthetic oligonucleotide; AGG chr2 60534499 60534518 60534502 -
ctgttccccacgaacattgc

SEQ ID NO: 173707 - DNA, 20 bp, Artificial Sequence
  Synthetic oligonucleotide; GGG chr2 60534498 60534517 60534501 -
tgttccccacgaacattgca

SEQ ID NO: 173708 - DNA, 20 bp, Artificial Sequence
  Synthetic oligonucleotide; CAG chr2 60534495 60534514 60534498 -
tccccacgaacattgcaggg

SEQ ID NO: 173709 - DNA, 20 bp, Artificial Sequence
  Synthetic oligonucleotide; TAG chr2 60534483 60534502 60534486 -
ttgcagggcagttttattgt

SEQ ID NO: 173710 - DNA, 20 bp, Artificial Sequence
  Synthetic oligonucleotide; CAG chr2 60534480 60534499 60534483 -
cagggcagttttattgttag

SEQ ID NO: 173711 - DNA, 20 bp, Artificial Sequence
  Synthetic oligonucleotide; TGG chr2 60534472 60534491 60534475 -
ttttattgttagcagtttga

SEQ ID NO: 173712 - DNA, 20 bp, Artificial Sequence
  Synthetic oligonucleotide; CAG chr2 60534469 60534488 60534472 -
tattgttagcagtttgatgg

SEQ ID NO: 173713 - DNA, 20 bp, Artificial Sequence
  Synthetic oligonucleotide; AGG chr2 60534468 60534487 60534471 -
attgttagcagtttgatggc

SEQ ID NO: 173714 - DNA, 20 bp, Artificial Sequence
  Synthetic oligonucleotide; AAG chr2 60534465 60534484 60534468 -
gttagcagtttgatggcagg

SEQ ID NO: 173715 - DNA, 20 bp, Artificial Sequence
  Synthetic oligonucleotide; TGG chr2 60534459 60534478 60534462 -
agtttgatggcaggaagcct

SEQ ID NO: 173716 - DNA, 20 bp, Artificial Sequence
  Synthetic oligonucleotide; TAG chr2 60534450 60534469 60534453 -
gcaggaagccttggctatta

SEQ ID NO: 173717 - DNA, 20 bp, Artificial Sequence
  Synthetic oligonucleotide; AAG chr2 60534441 60534460 60534444 -
cttggctattatagtgtatt

SEQ ID NO: 173718 - DNA, 20 bp, Artificial Sequence
  Synthetic oligonucleotide; CAG chr2 60534434 60534453 60534437 -
attatagtgtattaagacat

SEQ ID NO: 173719 - DNA, 20 bp, Artificial Sequence
  Synthetic oligonucleotide; AGG chr2 60534433 60534452 60534436 -
ttatagtgtattaagacatc

SEQ ID NO: 173720 - DNA, 20 bp, Artificial Sequence
  Synthetic oligonucleotide; TGG chr2 60534421 60534440 60534424 -
aagacatcaggttcctcctt

SEQ ID NO: 173721 - DNA, 20 bp, Artificial Sequence
  Synthetic oligonucleotide; GAG chr2 60534419 60534438 60534422 -
gacatcaggttcctcctttg

SEQ ID NO: 173722 - DNA, 20 bp, Artificial Sequence
  Synthetic oligonucleotide; AGG chr2 60534418 60534437 60534421 -
acatcaggttcctcctttgg

SEQ ID NO: 173723 - DNA, 20 bp, Artificial Sequence
  Synthetic oligonucleotide; GAG chr2 60534416 60534435 60534419 -
atcaggttcctcctttggag

SEQ ID NO: 173724 - DNA, 20 bp, Artificial Sequence
  Synthetic oligonucleotide; AGG chr2 60534415 60534434 60534418 -
tcaggttcctcctttggagg

SEQ ID NO: 173725 - DNA, 20 bp, Artificial Sequence
  Synthetic oligonucleotide; GGG chr2 60534414 60534433 60534417 -
caggttcctcctttggagga

SEQ ID NO: 173726 - DNA, 20 bp, Artificial Sequence
  Synthetic oligonucleotide; AAG chr2 60534411 60534430 60534414 -
gttcctcctttggaggaggg

SEQ ID NO: 173727 - DNA, 20 bp, Artificial Sequence
  Synthetic oligonucleotide; AGG chr2 60534410 60534429 60534413 -
ttcctcctttggaggaggga

SEQ ID NO: 173728 - DNA, 20 bp, Artificial Sequence
  Synthetic oligonucleotide; CAG chr2 60534404 60534423 60534407 -
ctttggaggagggaaggcta

SEQ ID NO: 173729 - DNA, 20 bp, Artificial Sequence
  Synthetic oligonucleotide; TAG chr2 60534375 60534394 60534378 -
aaacctttctaacaatgctt

SEQ ID NO: 173730 - DNA, 20 bp, Artificial Sequence
  Synthetic oligonucleotide; AGG chr2 60534374 60534393 60534377 -
aacctttctaacaatgcttt

SEQ ID NO: 173731 - DNA, 20 bp, Artificial Sequence
  Synthetic oligonucleotide; TAG chr2 60534362 60534381 60534365 -
aatgctttaggtttcttctt

SEQ ID NO: 173732 - DNA, 20 bp, Artificial Sequence
  Synthetic oligonucleotide; TAG chr2 60534358 60534377 60534361 -
ctttaggtttcttctttaga

SEQ ID NO: 173733 - DNA, 20 bp, Artificial Sequence
  Synthetic oligonucleotide; TGG chr2 60534354 60534373 60534357 -
aggtttcttctttagataga

SEQ ID NO: 173734 - DNA, 20 bp, Artificial Sequence
  Synthetic oligonucleotide; TGG chr2 60534350 60534369 60534353 -
ttcttctttagatagatggc

SEQ ID NO: 173735 - DNA, 20 bp, Artificial Sequence
  Synthetic oligonucleotide; AAG chr2 60534341 60534360 60534344 -
agatagatggctggcaccta

SEQ ID NO: 173736 - DNA, 20 bp, Artificial Sequence
  Synthetic oligonucleotide; AGG chr2 60534340 60534359 60534343 -
gatagatggctggcacctaa

SEQ ID NO: 173737 - DNA, 20 bp, Artificial Sequence
  Synthetic oligonucleotide; TGG chr2 60534334 60534353 60534337 -
tggctggcacctaaaggact

SEQ ID NO: 173738 - DNA, 20 bp, Artificial Sequence
  Synthetic oligonucleotide; GGG chr2 60534333 60534352 60534336 -
ggctggcacctaaaggactt

SEQ ID NO: 173739 - DNA, 20 bp, Artificial Sequence
  Synthetic oligonucleotide; TGG chr2 60534328 60534347 60534331 -
gcacctaaaggacttgggcc

SEQ ID NO: 173740 - DNA, 20 bp, Artificial Sequence
  Synthetic oligonucleotide; GGG chr2 60534327 60534346 60534330 -
cacctaaaggacttgggcct

SEQ ID NO: 173741 - DNA, 20 bp, Artificial Sequence
  Synthetic oligonucleotide; TGG chr2 60534322 60534341 60534325 -
aaaggacttgggcctgggtt

SEQ ID NO: 173742 - DNA, 20 bp, Artificial Sequence
  Synthetic oligonucleotide; TAG chr2 60534302 60534321 60534305 -
tggctgactcttttatcttt

SEQ ID NO: 173743 - DNA, 20 bp, Artificial Sequence
  Synthetic oligonucleotide; AAG chr2 60534296 60534315 60534299 -
actcttttatcttttagatc

SEQ ID NO: 173744 - DNA, 20 bp, Artificial Sequence
  Synthetic oligonucleotide; AAG chr2 60534292 60534311 60534295 -
ttttatcttttagatcaagt

SEQ ID NO: 173745 - DNA, 20 bp, Artificial Sequence
  Synthetic oligonucleotide; CAG chr2 60534279 60534298 60534282 -
atcaagtaagttttctcatt

SEQ ID NO: 173746 - DNA, 20 bp, Artificial Sequence
  Synthetic oligonucleotide; GAG chr2 60534266 60534285 60534269 -
tctcattcagctgctgctct

SEQ ID NO: 173747 - DNA, 20 bp, Artificial Sequence
  Synthetic oligonucleotide; AAG chr2 60534236 60534255 60534239 -
gtgtcctcccctcatcacca

SEQ ID NO: 173748 - DNA, 20 bp, Artificial Sequence
  Synthetic oligonucleotide; TGG chr2 60534226 60534245 60534229 -
ctcatcaccaaagtatatcc

SEQ ID NO: 173749 - DNA, 20 bp, Artificial Sequence
  Synthetic oligonucleotide; CAG chr2 60534219 60534238 60534222 -
ccaaagtatatcctggtctc

SEQ ID NO: 173750 - DNA, 20 bp, Artificial Sequence
  Synthetic oligonucleotide; AGG chr2 60534218 60534237 60534221 -
caaagtatatcctggtctcc

SEQ ID NO: 173751 - DNA, 20 bp, Artificial Sequence
  Synthetic oligonucleotide; TGG chr2 60534210 60534229 60534213 -
atcctggtctccaggctccc

SEQ ID NO: 173752 - DNA, 20 bp, Artificial Sequence
  Synthetic oligonucleotide; GGG chr2 60534209 60534228 60534212 -
tcctggtctccaggctccct

SEQ ID NO: 173753 - DNA, 20 bp, Artificial Sequence
  Synthetic oligonucleotide; CAG chr2 60534202 60534221 60534205 -
ctccaggctccctgggctcc

SEQ ID NO: 173754 - DNA, 20 bp, Artificial Sequence
  Synthetic oligonucleotide; AAG chr2 60534189 60534208 60534192 -
gggctcccagtgtctccctc

SEQ ID NO: 173755 - DNA, 20 bp, Artificial Sequence
  Synthetic oligonucleotide; AGG chr2 60534188 60534207 60534191 -
ggctcccagtgtctccctca

SEQ ID NO: 173756 - DNA, 20 bp, Artificial Sequence
  Synthetic oligonucleotide; GAG chr2 60534180 60534199 60534183 -
gtgtctccctcaaggtacac

SEQ ID NO: 173757 - DNA, 20 bp, Artificial Sequence
  Synthetic oligonucleotide; TGG chr2 60534172 60534191 60534175 -
ctcaaggtacacgagtgccc

SEQ ID NO: 173758 - DNA, 20 bp, Artificial Sequence
  Synthetic oligonucleotide; TGG chr2 60534169 60534188 60534172 -
aaggtacacgagtgccctgg

SEQ ID NO: 173759 - DNA, 20 bp, Artificial Sequence
  Synthetic oligonucleotide; AAG chr2 60534159 60534178 60534162 -
agtgccctggtggtgaaaac

SEQ ID NO: 173760 - DNA, 20 bp, Artificial Sequence
  Synthetic oligonucleotide; AGG chr2 60534158 60534177 60534161 -
gtgccctggtggtgaaaaca

SEQ ID NO: 173761 - DNA, 20 bp, Artificial Sequence
  Synthetic oligonucleotide; CGG chr2 60534145 60534164 60534148 -
gaaaacaaggtgctaactaa

SEQ ID NO: 173762 - DNA, 20 bp, Artificial Sequence
  Synthetic oligonucleotide; GAG chr2 60534130 60534149 60534133 -
actaacggtttccgattttt

SEQ ID NO: 173763 - DNA, 20 bp, Artificial Sequence
  Synthetic oligonucleotide; GAG chr2 60534128 60534147 60534131 -
taacggtttccgatttttga

SEQ ID NO: 173764 - DNA, 20 bp, Artificial Sequence
  Synthetic oligonucleotide; TGG chr2 60534115 60534134 60534118 -
tttttgagagcctgtgattt

SEQ ID NO: 173765 - DNA, 20 bp, Artificial Sequence
  Synthetic oligonucleotide; TGG chr2 60534061 60534080 60534064 -
gtattattgatgttcatctt

SEQ ID NO: 173766 - DNA, 20 bp, Artificial Sequence
  Synthetic oligonucleotide; GAG chr2 60534053 60534072 60534056 -
gatgttcatctttggtttat

SEQ ID NO: 173767 - DNA, 20 bp, Artificial Sequence
  Synthetic oligonucleotide; TGG chr2 60534042 60534061 60534045 -
ttggtttatgagtttatcac

SEQ ID NO: 173768 - DNA, 20 bp, Artificial Sequence
  Synthetic oligonucleotide; AAG chr2 60534034 60534053 60534037 -
tgagtttatcactggttaac

SEQ ID NO: 173769 - DNA, 20 bp, Artificial Sequence
  Synthetic oligonucleotide; CAG chr2 60534031 60534050 60534034 -
gtttatcactggttaacaag

SEQ ID NO: 173770 - DNA, 20 bp, Artificial Sequence
  Synthetic oligonucleotide; CAG chr2 60534025 60534044 60534028 -
cactggttaacaagcagaat

SEQ ID NO: 173771 - DNA, 20 bp, Artificial Sequence
  Synthetic oligonucleotide; CAG chr2 60534020 60534039 60534023 -
gttaacaagcagaatcagaa

SEQ ID NO: 173772 - DNA, 20 bp, Artificial Sequence
  Synthetic oligonucleotide; AAG chr2 60533980 60533999 60533983 -
ttaaaacgaatgtttaatga

SEQ ID NO: 173773 - DNA, 20 bp, Artificial Sequence
  Synthetic oligonucleotide; TGG chr2 60533963 60533982 60533966 -
tgaaagaaaataaattgtga

SEQ ID NO: 173774 - DNA, 20 bp, Artificial Sequence
  Synthetic oligonucleotide; CAG chr2 60533952 60533971 60533955 -
aaattgtgatggaaaatgaa

SEQ ID NO: 173775 - DNA, 20 bp, Artificial Sequence
  Synthetic oligonucleotide; AAG chr2 60533944 60533963 60533947 -
atggaaaatgaacagtgtgt

SEQ ID NO: 173776 - DNA, 20 bp, Artificial Sequence
  Synthetic oligonucleotide; GAG chr2 60533916 60533935 60533919 -
taactataattttaacctcc

SEQ ID NO: 173777 - DNA, 20 bp, Artificial Sequence
  Synthetic oligonucleotide; AGG chr2 60533915 60533934 60533918 -
aactataattttaacctccg

SEQ ID NO: 173778 - DNA, 20 bp, Artificial Sequence
  Synthetic oligonucleotide; GGG chr2 60533914 60533933 60533917 -
actataattttaacctccga

SEQ ID NO: 173779 - DNA, 20 bp, Artificial Sequence
  Synthetic oligonucleotide; TAG chr2 60533908 60533927 60533911 -
attttaacctccgagggacc

SEQ ID NO: 173780 - DNA, 20 bp, Artificial Sequence
  Synthetic oligonucleotide; AAG chr2 60533868 60533887 60533871 -
ttccatccataccatgctaa

SEQ ID NO: 173781 - DNA, 20 bp, Artificial Sequence
  Synthetic oligonucleotide; CAG chr2 60533858 60533877 60533861 -
accatgctaaaagcatgctt

SEQ ID NO: 173782 - DNA, 20 bp, Artificial Sequence
  Synthetic oligonucleotide; AAG chr2 60533851 60533870 60533854 -
taaaagcatgcttcagttta

SEQ ID NO: 173783 - DNA, 20 bp, Artificial Sequence
  Synthetic oligonucleotide; CAG chr2 60533837 60533856 60533840 -
agtttaaagttgttaatatt

SEQ ID NO: 173784 - DNA, 20 bp, Artificial Sequence
  Synthetic oligonucleotide; TGG chr2 60533833 60533852 60533836 -
taaagttgttaatattcagc

SEQ ID NO: 173785 - DNA, 20 bp, Artificial Sequence
  Synthetic oligonucleotide; GGG chr2 60533832 60533851 60533835 -
aaagttgttaatattcagct

SEQ ID NO: 173786 - DNA, 20 bp, Artificial Sequence
  Synthetic oligonucleotide; CAG chr2 60533826 60533845 60533829 -
gttaatattcagctgggaaa

SEQ ID NO: 173787 - DNA, 20 bp, Artificial Sequence
  Synthetic oligonucleotide; CAG chr2 60533819 60533838 60533822 -
ttcagctgggaaacagtatc

SEQ ID NO: 173788 - DNA, 20 bp, Artificial Sequence
  Synthetic oligonucleotide; AAG chr2 60533799 60533818 60533802 -
cagaacacaaataaattatt

SEQ ID NO: 173789 - DNA, 20 bp, Artificial Sequence
  Synthetic oligonucleotide; TAG chr2 60533783 60533802 60533786 -
tattaagtgcatgaactttt

SEQ ID NO: 173790 - DNA, 20 bp, Artificial Sequence
  Synthetic oligonucleotide; AGG chr2 60533782 60533801 60533785 -
attaagtgcatgaacttttt

SEQ ID NO: 173791 - DNA, 20 bp, Artificial Sequence
  Synthetic oligonucleotide; CAG chr2 60533779 60533798 60533782 -
aagtgcatgaactttttagg

SEQ ID NO: 173792 - DNA, 20 bp, Artificial Sequence
  Synthetic oligonucleotide; AAG chr2 60533775 60533794 60533778 -
gcatgaactttttaggcagt

SEQ ID NO: 173793 - DNA, 20 bp, Artificial Sequence
  Synthetic oligonucleotide; TGG chr2 60533763 60533782 60533766 -
taggcagtaagatgaactga

SEQ ID NO: 173794 - DNA, 20 bp, Artificial Sequence
  Synthetic oligonucleotide; GGG chr2 60533762 60533781 60533765 -
aggcagtaagatgaactgat

SEQ ID NO: 173795 - DNA, 20 bp, Artificial Sequence
  Synthetic oligonucleotide; GGG chr2 60533761 60533780 60533764 -
ggcagtaagatgaactgatg

SEQ ID NO: 173796 - DNA, 20 bp, Artificial Sequence
  Synthetic oligonucleotide; GAG chr2 60533749 60533768 60533752 -
aactgatggggtccatctgt

SEQ ID NO: 173797 - DNA, 20 bp, Artificial Sequence
  Synthetic oligonucleotide; CAG chr2 60533743 60533762 60533746 -
tggggtccatctgtgagatc

SEQ ID NO: 173798 - DNA, 20 bp, Artificial Sequence
  Synthetic oligonucleotide; AGG chr2 60533742 60533761 60533745 -
ggggtccatctgtgagatcc

SEQ ID NO: 173799 - DNA, 20 bp, Artificial Sequence
  Synthetic oligonucleotide; GGG chr2 60533741 60533760 60533744 -
gggtccatctgtgagatcca

SEQ ID NO: 173800 - DNA, 20 bp, Artificial Sequence
  Synthetic oligonucleotide; GGG chr2 60533740 60533759 60533743 -
ggtccatctgtgagatccag

SEQ ID NO: 173801 - DNA, 20 bp, Artificial Sequence
  Synthetic oligonucleotide; GAG chr2 60533718 60533737 60533721 -
gctttttatttgtgtgtgtc

SEQ ID NO: 173802 - DNA, 20 bp, Artificial Sequence
  Synthetic oligonucleotide; CAG chr2 60533692 60533711 60533695 -
ttctgccctctccgacttca

SEQ ID NO: 173803 - DNA, 20 bp, Artificial Sequence
  Synthetic oligonucleotide; TGG chr2 60533685 60533704 60533688 -
ctctccgacttcacagcctt

SEQ ID NO: 173804 - DNA, 20 bp, Artificial Sequence
  Synthetic oligonucleotide; CGG chr2 60533678 60533697 60533681 -
acttcacagcctttggtctc

SEQ ID NO: 173805 - DNA, 20 bp, Artificial Sequence
  Synthetic oligonucleotide; AAG chr2 60533614 60533633 60533617 -
cttgatgtaattgctttact

SEQ ID NO: 173806 - DNA, 20 bp, Artificial Sequence
  Synthetic oligonucleotide; TGG chr2 60533595 60533614 60533598 -
taagatatgatgaaatctaa

SEQ ID NO: 173807 - DNA, 20 bp, Artificial Sequence
  Synthetic oligonucleotide; TGG chr2 60533573 60533592 60533576 -
gataatttgctatttgaaaa

SEQ ID NO: 173808 - DNA, 20 bp, Artificial Sequence
  Synthetic oligonucleotide; TGG chr2 60533545 60533564 60533548 -
aaaaatcttcatactttatg

SEQ ID NO: 173809 - DNA, 20 bp, Artificial Sequence
  Synthetic oligonucleotide; GGG chr2 60533544 60533563 60533547 -
aaaatcttcatactttatgt

SEQ ID NO: 173810 - DNA, 20 bp, Artificial Sequence
  Synthetic oligonucleotide; GGG chr2 60533543 60533562 60533546 -
aaatcttcatactttatgtg

SEQ ID NO: 173811 - DNA, 20 bp, Artificial Sequence
  Synthetic oligonucleotide; GAG chr2 60533538 60533557 60533541 -
ttcatactttatgtggggct

SEQ ID NO: 173812 - DNA, 20 bp, Artificial Sequence
  Synthetic oligonucleotide; TGG chr2 60533535 60533554 60533538 -
atactttatgtggggctgag

SEQ ID NO: 173813 - DNA, 20 bp, Artificial Sequence
  Synthetic oligonucleotide; GGG chr2 60533534 60533553 60533537 -
tactttatgtggggctgagt

SEQ ID NO: 173814 - DNA, 20 bp, Artificial Sequence
  Synthetic oligonucleotide; CAG chr2 60533531 60533550 60533534 -
tttatgtggggctgagtggg

SEQ ID NO: 173815 - DNA, 20 bp, Artificial Sequence
  Synthetic oligonucleotide; TGG chr2 60533528 60533547 60533531 -
atgtggggctgagtgggcag

SEQ ID NO: 173816 - DNA, 20 bp, Artificial Sequence
  Synthetic oligonucleotide; GAG chr2 60533526 60533545 60533529 -
gtggggctgagtgggcagtg

SEQ ID NO: 173817 - DNA, 20 bp, Artificial Sequence
  Synthetic oligonucleotide; AAG chr2 60533522 60533541 60533525 -
ggctgagtgggcagtggaga

SEQ ID NO: 173818 - DNA, 20 bp, Artificial Sequence
  Synthetic oligonucleotide; AGG chr2 60533521 60533540 60533524 -
gctgagtgggcagtggagaa

SEQ ID NO: 173819 - DNA, 20 bp, Artificial Sequence
  Synthetic oligonucleotide; GGG chr2 60533520 60533539 60533523 -
ctgagtgggcagtggagaaa

SEQ ID NO: 173820 - DNA, 20 bp, Artificial Sequence
  Synthetic oligonucleotide; GGG chr2 60533519 60533538 60533522 -
tgagtgggcagtggagaaag

SEQ ID NO: 173821 - DNA, 20 bp, Artificial Sequence
  Synthetic oligonucleotide; CAG chr2 60533512 60533531 60533515 -
gcagtggagaaaggggtatt

SEQ ID NO: 173822 - DNA, 20 bp, Artificial Sequence
  Synthetic oligonucleotide; CGG chr2 60533503 60533522 60533506 -
aaaggggtattcagctgacc

SEQ ID NO: 173823 - DNA, 20 bp, Artificial Sequence
  Synthetic oligonucleotide; AAG chr2 60533495 60533514 60533498 -
attcagctgacccggtattt

SEQ ID NO: 173824 - DNA, 20 bp, Artificial Sequence
  Synthetic oligonucleotide; AAG chr2 60533482 60533501 60533485 -
ggtatttaagaaaacaaaac

SEQ ID NO: 173825 - DNA, 20 bp, Artificial Sequence
  Synthetic oligonucleotide; CAG chr2 60533454 60533473 60533457 -
ctaacttatgcatgctgctt

SEQ ID NO: 173826 - DNA, 20 bp, Artificial Sequence
  Synthetic oligonucleotide; TGG chr2 60533445 60533464 60533448 -
gcatgctgcttcagtcgcgt

SEQ ID NO: 173827 - DNA, 20 bp, Artificial Sequence
  Synthetic oligonucleotide; TGG chr2 60533439 60533458 60533442 -
tgcttcagtcgcgttggctg

SEQ ID NO: 173828 - DNA, 20 bp, Artificial Sequence
  Synthetic oligonucleotide; TAG chr2 60533435 60533454 60533438 -
tcagtcgcgttggctgtgga

SEQ ID NO: 173829 - DNA, 20 bp, Artificial Sequence
  Synthetic oligonucleotide; AGG chr2 60533434 60533453 60533437 -
cagtcgcgttggctgtggat

SEQ ID NO: 173830 - DNA, 20 bp, Artificial Sequence
  Synthetic oligonucleotide; AAG chr2 60533431 60533450 60533434 -
tcgcgttggctgtggatagg

SEQ ID NO: 173831 - DNA, 20 bp, Artificial Sequence
  Synthetic oligonucleotide; AGG chr2 60533430 60533449 60533433 -
cgcgttggctgtggatagga

SEQ ID NO: 173832 - DNA, 20 bp, Artificial Sequence
  Synthetic oligonucleotide; TGG chr2 60533414 60533433 60533417 -
aggaaggtctttgtgacata

SEQ ID NO: 173833 - DNA, 20 bp, Artificial Sequence
  Synthetic oligonucleotide; AAG chr2 60533411 60533430 60533414 -
aaggtctttgtgacatatgg

SEQ ID NO: 173834 - DNA, 20 bp, Artificial Sequence
  Synthetic oligonucleotide; CAG chr2 60533407 60533426 60533410 -
tctttgtgacatatggaagc

SEQ ID NO: 173835 - DNA, 20 bp, Artificial Sequence
  Synthetic oligonucleotide; AAG chr2 60533320 60533339 60533323 -
ctctctcccccaaactttac

SEQ ID NO: 173836 - DNA, 20 bp, Artificial Sequence
  Synthetic oligonucleotide; AAG chr2 60533316 60533335 60533319 -
ctcccccaaactttacaaga

SEQ ID NO: 173837 - DNA, 20 bp, Artificial Sequence
  Synthetic oligonucleotide; AGG chr2 60533315 60533334 60533318 -
tcccccaaactttacaagaa

SEQ ID NO: 173838 - DNA, 20 bp, Artificial Sequence
  Synthetic oligonucleotide; GGG chr2 60533314 60533333 60533317 -
cccccaaactttacaagaaa

SEQ ID NO: 173839 - DNA, 20 bp, Artificial Sequence
  Synthetic oligonucleotide; AAG chr2 60533303 60533322 60533306 -
tacaagaaagggatcctaac

SEQ ID NO: 173840 - DNA, 20 bp, Artificial Sequence
  Synthetic oligonucleotide; AGG chr2 60533302 60533321 60533305 -
acaagaaagggatcctaaca

SEQ ID NO: 173841 - DNA, 20 bp, Artificial Sequence
  Synthetic oligonucleotide; AAG chr2 60533295 60533314 60533298 -
agggatcctaacaaggtaaa

SEQ ID NO: 173842 - DNA, 20 bp, Artificial Sequence
  Synthetic oligonucleotide; TAG chr2 60533283 60533302 60533286 -
aaggtaaaaagtaaacaatt

SEQ ID NO: 173843 - DNA, 20 bp, Artificial Sequence
  Synthetic oligonucleotide; AAG chr2 60533273 60533292 60533276 -
gtaaacaatttagtcatcac

SEQ ID NO: 173844 - DNA, 20 bp, Artificial Sequence
  Synthetic oligonucleotide; CAG chr2 60533260 60533279 60533263 -
tcatcacaagccttattatt

SEQ ID NO: 173845 - DNA, 20 bp, Artificial Sequence
  Synthetic oligonucleotide; CAG chr2 60533251 60533270 60533254 -
gccttattattcagtctatc

SEQ ID NO: 173846 - DNA, 20 bp, Artificial Sequence
  Synthetic oligonucleotide; AGG chr2 60533250 60533269 60533253 -
ccttattattcagtctatcc

SEQ ID NO: 173847 - DNA, 20 bp, Artificial Sequence
  Synthetic oligonucleotide; GAG chr2 60533248 60533267 60533251 -
ttattattcagtctatccag

SEQ ID NO: 173848 - DNA, 20 bp, Artificial Sequence
  Synthetic oligonucleotide; CGG chr2 60533234 60533253 60533237 -
atccaggagttttgccatgt

SEQ ID NO: 173849 - DNA, 20 bp, Artificial Sequence
  Synthetic oligonucleotide; CAG chr2 60533218 60533237 60533221 -
atgtcggtttatttaacttc

SEQ ID NO: 173850 - DNA, 20 bp, Artificial Sequence
  Synthetic oligonucleotide; AGG chr2 60533217 60533236 60533220 -
tgtcggtttatttaacttcc

SEQ ID NO: 173851 - DNA, 20 bp, Artificial Sequence
  Synthetic oligonucleotide; CAG chr2 60533198 60533217 60533201 -
caggaatgtaaacactgaca

SEQ ID NO: 173852 - DNA, 20 bp, Artificial Sequence
  Synthetic oligonucleotide; TAG chr2 60533192 60533211 60533195 -
tgtaaacactgacacagccc

SEQ ID NO: 173853 - DNA, 20 bp, Artificial Sequence
  Synthetic oligonucleotide; AAG chr2 60533189 60533208 60533192 -
aaacactgacacagccctag

SEQ ID NO: 173854 - DNA, 20 bp, Artificial Sequence
  Synthetic oligonucleotide; CAG chr2 60533186 60533205 60533189 -
cactgacacagccctagaag

SEQ ID NO: 173855 - DNA, 20 bp, Artificial Sequence
  Synthetic oligonucleotide; AAG chr2 60533182 60533201 60533185 -
gacacagccctagaagcagc

SEQ ID NO: 173856 - DNA, 20 bp, Artificial Sequence
  Synthetic oligonucleotide; AAG chr2 60533178 60533197 60533181 -
cagccctagaagcagcaaga

SEQ ID NO: 173857 - DNA, 20 bp, Artificial Sequence
  Synthetic oligonucleotide; CAG chr2 60533171 60533190 60533174 -
agaagcagcaagaaagatta

SEQ ID NO: 173858 - DNA, 20 bp, Artificial Sequence
  Synthetic oligonucleotide; TAG chr2 60533165 60533184 60533168 -
agcaagaaagattacagtat

SEQ ID NO: 173859 - DNA, 20 bp, Artificial Sequence
  Synthetic oligonucleotide; GAG chr2 60533163 60533182 60533166 -
caagaaagattacagtatta

SEQ ID NO: 173860 - DNA, 20 bp, Artificial Sequence
  Synthetic oligonucleotide; GAG chr2 60533150 60533169 60533153 -
agtattagagttaaaaacgt

SEQ ID NO: 173861 - DNA, 20 bp, Artificial Sequence
  Synthetic oligonucleotide; TGG chr2 60533145 60533164 60533148 -
tagagttaaaaacgtgagca

SEQ ID NO: 173862 - DNA, 20 bp, Artificial Sequence
  Synthetic oligonucleotide; GAG chr2 60533143 60533162 60533146 -
gagttaaaaacgtgagcatg

SEQ ID NO: 173863 - DNA, 20 bp, Artificial Sequence
  Synthetic oligonucleotide; AGG chr2 60533142 60533161 60533145 -
agttaaaaacgtgagcatgg

SEQ ID NO: 173864 - DNA, 20 bp, Artificial Sequence
  Synthetic oligonucleotide; GAG chr2 60533140 60533159 60533143 -
ttaaaaacgtgagcatggag

SEQ ID NO: 173865 - DNA, 20 bp, Artificial Sequence
  Synthetic oligonucleotide; TGG chr2 60533091 60533110 60533094 -
cactttacattgaaacataa

SEQ ID NO: 173866 - DNA, 20 bp, Artificial Sequence
  Synthetic oligonucleotide; AAG chr2 60533087 60533106 60533090 -
ttacattgaaacataatggt

SEQ ID NO: 173867 - DNA, 20 bp, Artificial Sequence
  Synthetic oligonucleotide; AAG chr2 60533080 60533099 60533083 -
gaaacataatggtaagtcaa

SEQ ID NO: 173868 - DNA, 20 bp, Artificial Sequence
  Synthetic oligonucleotide; TGG chr2 60533073 60533092 60533076 -
aatggtaagtcaaaagtgac

SEQ ID NO: 173869 - DNA, 20 bp, Artificial Sequence
  Synthetic oligonucleotide; TGG chr2 60533055 60533074 60533058 -
actggaaacttctgcttata

SEQ ID NO: 173870 - DNA, 20 bp, Artificial Sequence
  Synthetic oligonucleotide; GAG chr2 60533053 60533072 60533056 -
tggaaacttctgcttatatg

SEQ ID NO: 173871 - DNA, 20 bp, Artificial Sequence
  Synthetic oligonucleotide; TAG chr2 60533033 60533052 60533036 -
gagtacaaatttcattctaa

SEQ ID NO: 173872 - DNA, 20 bp, Artificial Sequence
  Synthetic oligonucleotide; TGG chr2 60533028 60533047 60533031 -
caaatttcattctaatagat

SEQ ID NO: 173873 - DNA, 20 bp, Artificial Sequence
  Synthetic oligonucleotide; TAG chr2 60533018 60533037 60533021 -
tctaatagattggcataatc

SEQ ID NO: 173874 - DNA, 20 bp, Artificial Sequence
  Synthetic oligonucleotide; CAG chr2 60533009 60533028 60533012 -
ttggcataatctagtgtacc

SEQ ID NO: 173875 - DNA, 20 bp, Artificial Sequence
  Synthetic oligonucleotide; AGG chr2 60533008 60533027 60533011 -
tggcataatctagtgtaccc

SEQ ID NO: 173876 - DNA, 20 bp, Artificial Sequence
  Synthetic oligonucleotide; GGG chr2 60533007 60533026 60533010 -
ggcataatctagtgtaccca

SEQ ID NO: 173877 - DNA, 20 bp, Artificial Sequence
  Synthetic oligonucleotide; TAG chr2 60533004 60533023 60533007 -
ataatctagtgtacccaggg

SEQ ID NO: 173878 - DNA, 20 bp, Artificial Sequence
  Synthetic oligonucleotide; TGG chr2 60532989 60533008 60532992 -
cagggtagattgttatataa

SEQ ID NO: 173879 - DNA, 20 bp, Artificial Sequence
  Synthetic oligonucleotide; GAG chr2 60532987 60533006 60532990 -
gggtagattgttatataatg

SEQ ID NO: 173880 - DNA, 20 bp, Artificial Sequence
  Synthetic oligonucleotide; AAG chr2 60532968 60532987 60532971 -
ggagaaactgtataaatgtc

SEQ ID NO: 173881 - DNA, 20 bp, Artificial Sequence
  Synthetic oligonucleotide; CAG chr2 60532949 60532968 60532952 -
caagtacacaaataattcta

SEQ ID NO: 173882 - DNA, 20 bp, Artificial Sequence
  Synthetic oligonucleotide; AGG chr2 60532948 60532967 60532951 -
aagtacacaaataattctac

SEQ ID NO: 173883 - DNA, 20 bp, Artificial Sequence
  Synthetic oligonucleotide; AAG chr2 60532945 60532964 60532948 -
tacacaaataattctacagg

SEQ ID NO: 173884 - DNA, 20 bp, Artificial Sequence
  Synthetic oligonucleotide; AAG chr2 60532934 60532953 60532937 -
ttctacaggaagtaaataaa

SEQ ID NO: 173885 - DNA, 20 bp, Artificial Sequence
  Synthetic oligonucleotide; TAG chr2 60532928 60532947 60532931 -
aggaagtaaataaaaagtat

SEQ ID NO: 173886 - DNA, 20 bp, Artificial Sequence
  Synthetic oligonucleotide; AAG chr2 60532917 60532936 60532920 -
aaaaagtattagaatttctt

SEQ ID NO: 173887 - DNA, 20 bp, Artificial Sequence
  Synthetic oligonucleotide; TGG chr2 60532900 60532919 60532903 -
cttaagtcaccattaaattt

SEQ ID NO: 173888 - DNA, 20 bp, Artificial Sequence
  Synthetic oligonucleotide; TGG chr2 60532897 60532916 60532900 -
aagtcaccattaaattttgg

SEQ ID NO: 173889 - DNA, 20 bp, Artificial Sequence
  Synthetic oligonucleotide; TGG chr2 60532894 60532913 60532897 -
tcaccattaaattttggtgg

SEQ ID NO: 173890 - DNA, 20 bp, Artificial Sequence
  Synthetic oligonucleotide; GGG chr2 60532893 60532912 60532896 -
caccattaaattttggtggt

SEQ ID NO: 173891 - DNA, 20 bp, Artificial Sequence
  Synthetic oligonucleotide; TAG chr2 60532880 60532899 60532883 -
tggtggtgggacaatctcat

SEQ ID NO: 173892 - DNA, 20 bp, Artificial Sequence
  Synthetic oligonucleotide; TGG chr2 60532861 60532880 60532864 -
ttagctccttcaaaatcatg

SEQ ID NO: 173893 - DNA, 20 bp, Artificial Sequence
  Synthetic oligonucleotide; AAG chr2 60532850 60532869 60532853 -
aaaatcatgtggctttgcat

SEQ ID NO: 173894 - DNA, 20 bp, Artificial Sequence
  Synthetic oligonucleotide; CAG chr2 60532828 60532847 60532831 -
gtcttttgaaaatgtatttt

SEQ ID NO: 173895 - DNA, 20 bp, Artificial Sequence
  Synthetic oligonucleotide; AGG chr2 60532827 60532846 60532830 -
tcttttgaaaatgtattttc

SEQ ID NO: 173896 - DNA, 20 bp, Artificial Sequence
  Synthetic oligonucleotide; GGG chr2 60532826 60532845 60532829 -
cttttgaaaatgtattttca

SEQ ID NO: 173897 - DNA, 20 bp, Artificial Sequence
  Synthetic oligonucleotide; CAG chr2 60532817 60532836 60532820 -
atgtattttcagggaattta

SEQ ID NO: 173898 - DNA, 20 bp, Artificial Sequence
  Synthetic oligonucleotide; TGG chr2 60532813 60532832 60532816 -
attttcagggaatttacaga

SEQ ID NO: 173899 - DNA, 20 bp, Artificial Sequence
  Synthetic oligonucleotide; CAG chr2 60532787 60532806 60532790 -
aacattgttttaatccaaac

SEQ ID NO: 173900 - DNA, 20 bp, Artificial Sequence
  Synthetic oligonucleotide; AAG chr2 60532740 60532759 60532743 -
aaaaattgtactgtttttcg

SEQ ID NO: 173901 - DNA, 20 bp, Artificial Sequence
  Synthetic oligonucleotide; AAG chr2 60532731 60532750 60532734 -
actgtttttcgaagtactta

SEQ ID NO: 173902 - DNA, 20 bp, Artificial Sequence
  Synthetic oligonucleotide; AGG chr2 60532730 60532749 60532733 -
ctgtttttcgaagtacttaa

SEQ ID NO: 173903 - DNA, 20 bp, Artificial Sequence
  Synthetic oligonucleotide; GGG chr2 60532729 60532748 60532732 -
tgtttttcgaagtacttaaa

SEQ ID NO: 173904 - DNA, 20 bp, Artificial Sequence
  Synthetic oligonucleotide; GAG chr2 60532727 60532746 60532730 -
tttttcgaagtacttaaagg

SEQ ID NO: 173905 - DNA, 20 bp, Artificial Sequence
  Synthetic oligonucleotide; TGG chr2 60532724 60532743 60532727 -
ttcgaagtacttaaagggag

SEQ ID NO: 173906 - DNA, 20 bp, Artificial Sequence
  Synthetic oligonucleotide; GAG chr2 60532722 60532741 60532725 -
cgaagtacttaaagggagtg

SEQ ID NO: 173907 - DNA, 20 bp, Artificial Sequence
  Synthetic oligonucleotide; AGG chr2 60532721 60532740 60532724 -
gaagtacttaaagggagtgg

SEQ ID NO: 173908 - DNA, 20 bp, Artificial Sequence
  Synthetic oligonucleotide; GGG chr2 60532720 60532739 60532723 -
aagtacttaaagggagtgga

SEQ ID NO: 173909 - DNA, 20 bp, Artificial Sequence
  Synthetic oligonucleotide; GGG chr2 60532719 60532738 60532722 -
agtacttaaagggagtggag

SEQ ID NO: 173910 - DNA, 20 bp, Artificial Sequence
  Synthetic oligonucleotide; TAG chr2 60532716 60532735 60532719 -
acttaaagggagtggagggg

SEQ ID NO: 173911 - DNA, 20 bp, Artificial Sequence
  Synthetic oligonucleotide; AAG chr2 60532712 60532731 60532715 -
aaagggagtggaggggtaga

SEQ ID NO: 173912 - DNA, 20 bp, Artificial Sequence
  Synthetic oligonucleotide; AAG chr2 60532704 60532723 60532707 -
tggaggggtagaaagcatat

SEQ ID NO: 173913 - DNA, 20 bp, Artificial Sequence
  Synthetic oligonucleotide; TGG chr2 60532685 60532704 60532688 -
taagtgaatccatctcactg

SEQ ID NO: 173914 - DNA, 20 bp, Artificial Sequence
  Synthetic oligonucleotide; AAG chr2 60532669 60532688 60532672 -
actgtggcaaactgtttttc

SEQ ID NO: 173915 - DNA, 20 bp, Artificial Sequence
  Synthetic oligonucleotide; AAG chr2 60532664 60532683 60532667 -
ggcaaactgtttttcaagta

SEQ ID NO: 173916 - DNA, 20 bp, Artificial Sequence
  Synthetic oligonucleotide; CAG chr2 60532625 60532644 60532628 -
cacatgatctgaaatttgat

SEQ ID NO: 173917 - DNA, 20 bp, Artificial Sequence
  Synthetic oligonucleotide; AAG chr2 60532604 60532623 60532607 -
agcaaacatatccttatgcc

SEQ ID NO: 173918 - DNA, 20 bp, Artificial Sequence
  Synthetic oligonucleotide; AGG chr2 60532603 60532622 60532606 -
gcaaacatatccttatgcca

SEQ ID NO: 173919 - DNA, 20 bp, Artificial Sequence
  Synthetic oligonucleotide; AAG chr2 60532551 60532570 60532554 -
tttttcgccattcacatacc

SEQ ID NO: 173920 - DNA, 20 bp, Artificial Sequence
  Synthetic oligonucleotide; AGG chr2 60532550 60532569 60532553 -
ttttcgccattcacatacca

SEQ ID NO: 173921 - DNA, 20 bp, Artificial Sequence
  Synthetic oligonucleotide; CAG chr2 60532537 60532556 60532540 -
cataccaaggttctgtaaat

SEQ ID NO: 173922 - DNA, 20 bp, Artificial Sequence
  Synthetic oligonucleotide; CAG chr2 60532529 60532548 60532532 -
ggttctgtaaatcagtaaac

SEQ ID NO: 173923 - DNA, 20 bp, Artificial Sequence
  Synthetic oligonucleotide; AGG chr2 60532528 60532547 60532531 -
gttctgtaaatcagtaaacc

SEQ ID NO: 173924 - DNA, 20 bp, Artificial Sequence
  Synthetic oligonucleotide; CAG chr2 60532525 60532544 60532528 -
ctgtaaatcagtaaaccagg

SEQ ID NO: 173925 - DNA, 20 bp, Artificial Sequence
  Synthetic oligonucleotide; GAG chr2 60532523 60532542 60532526 -
gtaaatcagtaaaccaggca

SEQ ID NO: 173926 - DNA, 20 bp, Artificial Sequence
  Synthetic oligonucleotide; GAG chr2 60532521 60532540 60532524 -
aaatcagtaaaccaggcaga

SEQ ID NO: 173927 - DNA, 20 bp, Artificial Sequence
  Synthetic oligonucleotide; AAG chr2 60532508 60532527 60532511 -
aggcagagagtaactattgt

SEQ ID NO: 173928 - DNA, 20 bp, Artificial Sequence
  Synthetic oligonucleotide; AGG chr2 60532507 60532526 60532510 -
ggcagagagtaactattgta

SEQ ID NO: 173929 - DNA, 20 bp, Artificial Sequence
  Synthetic oligonucleotide; GGG chr2 60532506 60532525 60532509 -
gcagagagtaactattgtaa

SEQ ID NO: 173930 - DNA, 20 bp, Artificial Sequence
  Synthetic oligonucleotide; GGG chr2 60532505 60532524 60532508 -
cagagagtaactattgtaag

SEQ ID NO: 173931 - DNA, 20 bp, Artificial Sequence
  Synthetic oligonucleotide; GGG chr2 60532504 60532523 60532507 -
agagagtaactattgtaagg

SEQ ID NO: 173932 - DNA, 20 bp, Artificial Sequence
  Synthetic oligonucleotide; CAG chr2 60532483 60532502 60532486 -
ggaaaccaaatcataatacc

SEQ ID NO: 173933 - DNA, 20 bp, Artificial Sequence
  Synthetic oligonucleotide; GAG chr2 60532481 60532500 60532484 -
aaaccaaatcataataccca

SEQ ID NO: 173934 - DNA, 20 bp, Artificial Sequence
  Synthetic oligonucleotide; TGG chr2 60532478 60532497 60532481 -
ccaaatcataatacccagag

SEQ ID NO: 173935 - DNA, 20 bp, Artificial Sequence
  Synthetic oligonucleotide; CAG chr2 60532473 60532492 60532476 -
tcataatacccagagtggcc

SEQ ID NO: 173936 - DNA, 20 bp, Artificial Sequence
  Synthetic oligonucleotide; AAG chr2 60532470 60532489 60532473 -
taatacccagagtggcccag

SEQ ID NO: 173937 - DNA, 20 bp, Artificial Sequence
  Synthetic oligonucleotide; AAG chr2 60532456 60532475 60532459 -
gcccagaagctgtctttctg

SEQ ID NO: 173938 - DNA, 20 bp, Artificial Sequence
  Synthetic oligonucleotide; AAG chr2 60532426 60532445 60532429 -
aacgccaccaccaccaaaaa

SEQ ID NO: 173939 - DNA, 20 bp, Artificial Sequence
  Synthetic oligonucleotide; AAG chr2 60532401 60532420 60532404 -
aaacaaaaaaacaaaaaaca

SEQ ID NO: 173940 - DNA, 20 bp, Artificial Sequence
  Synthetic oligonucleotide; TGG chr2 60532369 60532388 60532372 -
acaaaacctttttaaaaaac

SEQ ID NO: 173941 - DNA, 20 bp, Artificial Sequence
  Synthetic oligonucleotide; CAG chr2 60532360 60532379 60532363 -
ttttaaaaaactggaaatga

SEQ ID NO: 173942 - DNA, 20 bp, Artificial Sequence
  Synthetic oligonucleotide; TAG chr2 60532355 60532374 60532358 -
aaaaactggaaatgacagaa

SEQ ID NO: 173943 - DNA, 20 bp, Artificial Sequence
  Synthetic oligonucleotide; AAG chr2 60532346 60532365 60532349 -
aaatgacagaatagttttaa

SEQ ID NO: 173944 - DNA, 20 bp, Artificial Sequence
  Synthetic oligonucleotide; AGG chr2 60532345 60532364 60532348 -
aatgacagaatagttttaaa

SEQ ID NO: 173945 - DNA, 20 bp, Artificial Sequence
  Synthetic oligonucleotide; AAG chr2 60532316 60532335 60532319 -
aaaaaaacccaaaaaccaaa

SEQ ID NO: 173946 - DNA, 20 bp, Artificial Sequence
  Synthetic oligonucleotide; TAG chr2 60532273 60532292 60532276 -
tcaaaacttcaaactattaa

SEQ ID NO: 173947 - DNA, 20 bp, Artificial Sequence
  Synthetic oligonucleotide; CAG chr2 60532265 60532284 60532268 -
tcaaactattaatagaccac

SEQ ID NO: 173948 - DNA, 20 bp, Artificial Sequence
  Synthetic oligonucleotide; GAG chr2 60532261 60532280 60532264 -
actattaatagaccaccagt

SEQ ID NO: 173949 - DNA, 20 bp, Artificial Sequence
  Synthetic oligonucleotide; TAG chr2 60532257 60532276 60532260 -
ttaatagaccaccagtgaga

SEQ ID NO: 173950 - DNA, 20 bp, Artificial Sequence
  Synthetic oligonucleotide; GAG chr2 60532226 60532245 60532229 -
tgtgccttgaaatgcaaaat

SEQ ID NO: 173951 - DNA, 20 bp, Artificial Sequence
  Synthetic oligonucleotide; AGG chr2 60532225 60532244 60532228 -
gtgccttgaaatgcaaaatg

SEQ ID NO: 173952 - DNA, 20 bp, Artificial Sequence
  Synthetic oligonucleotide; GGG chr2 60532224 60532243 60532227 -
tgccttgaaatgcaaaatga

SEQ ID NO: 173953 - DNA, 20 bp, Artificial Sequence
  Synthetic oligonucleotide; TAG chr2 60532214 60532233 60532217 -
tgcaaaatgagggaaataat

SEQ ID NO: 173954 - DNA, 20 bp, Artificial Sequence
  Synthetic oligonucleotide; CAG chr2 60532211 60532230 60532214 -
aaaatgagggaaataattag

SEQ ID NO: 173955 - DNA, 20 bp, Artificial Sequence
  Synthetic oligonucleotide; GAG chr2 60532209 60532228 60532212 -
aatgagggaaataattagca

SEQ ID NO: 173956 - DNA, 20 bp, Artificial Sequence
  Synthetic oligonucleotide; AGG chr2 60532208 60532227 60532211 -
atgagggaaataattagcag

SEQ ID NO: 173957 - DNA, 20 bp, Artificial Sequence
  Synthetic oligonucleotide; AAG chr2 60532185 60532204 60532188 -
aacaaaattctcaaaatttg

SEQ ID NO: 173958 - DNA, 20 bp, Artificial Sequence
  Synthetic oligonucleotide; TGG chr2 60532167 60532186 60532170 -
tgaagaacttctgtgattac

SEQ ID NO: 173959 - DNA, 20 bp, Artificial Sequence
  Synthetic oligonucleotide; GGG chr2 60532166 60532185 60532169 -
gaagaacttctgtgattact

SEQ ID NO: 173960 - DNA, 20 bp, Artificial Sequence
  Synthetic oligonucleotide; GGG chr2 60532165 60532184 60532168 -
aagaacttctgtgattactg

SEQ ID NO: 173961 - DNA, 20 bp, Artificial Sequence
  Synthetic oligonucleotide; GGG chr2 60532164 60532183 60532167 -
agaacttctgtgattactgg

SEQ ID NO: 173962 - DNA, 20 bp, Artificial Sequence
  Synthetic oligonucleotide; CAG chr2 60532159 60532178 60532162 -
ttctgtgattactgggggta

SEQ ID NO: 173963 - DNA, 20 bp, Artificial Sequence
  Synthetic oligonucleotide; AAG chr2 60532152 60532171 60532155 -
attactgggggtacagtgaa

SEQ ID NO: 173964 - DNA, 20 bp, Artificial Sequence
  Synthetic oligonucleotide; TAG chr2 60532121 60532140 60532124 -
aatttcttcctgatcttaat

SEQ ID NO: 173965 - DNA, 20 bp, Artificial Sequence
  Synthetic oligonucleotide; CGG chr2 60532107 60532126 60532110 -
cttaattagattcgattgtg

SEQ ID NO: 173966 - DNA, 20 bp, Artificial Sequence
  Synthetic oligonucleotide; TGG chr2 60532104 60532123 60532107 -
aattagattcgattgtgcgg

SEQ ID NO: 173967 - DNA, 20 bp, Artificial Sequence
  Synthetic oligonucleotide; GGG chr2 60532103 60532122 60532106 -
attagattcgattgtgcggt

SEQ ID NO: 173968 - DNA, 20 bp, Artificial Sequence
  Synthetic oligonucleotide; TGG chr2 60532095 60532114 60532098 -
cgattgtgcggtgggtgtgt

SEQ ID NO: 173969 - DNA, 20 bp, Artificial Sequence
  Synthetic oligonucleotide; TGG chr2 60532089 60532108 60532092 -
tgcggtgggtgtgttggatt

SEQ ID NO: 173970 - DNA, 20 bp, Artificial Sequence
  Synthetic oligonucleotide; GGG chr2 60532088 60532107 60532091 -
gcggtgggtgtgttggattt

SEQ ID NO: 173971 - DNA, 20 bp, Artificial Sequence
  Synthetic oligonucleotide; GGG chr2 60532087 60532106 60532090 -
cggtgggtgtgttggatttg

SEQ ID NO: 173972 - DNA, 20 bp, Artificial Sequence
  Synthetic oligonucleotide; GGG chr2 60532086 60532105 60532089 -
ggtgggtgtgttggatttgg

SEQ ID NO: 173973 - DNA, 20 bp, Artificial Sequence
  Synthetic oligonucleotide; GGG chr2 60532085 60532104 60532088 -
gtgggtgtgttggatttggg

SEQ ID NO: 173974 - DNA, 20 bp, Artificial Sequence
  Synthetic oligonucleotide; GAG chr2 60532083 60532102 60532086 -
gggtgtgttggatttggggg

SEQ ID NO: 173975 - DNA, 20 bp, Artificial Sequence
  Synthetic oligonucleotide; AGG chr2 60532082 60532101 60532085 -
ggtgtgttggatttgggggg

SEQ ID NO: 173976 - DNA, 20 bp, Artificial Sequence
  Synthetic oligonucleotide; GGG chr2 60532081 60532100 60532084 -
gtgtgttggatttgggggga

SEQ ID NO: 173977 - DNA, 20 bp, Artificial Sequence
  Synthetic oligonucleotide; GGG chr2 60532080 60532099 60532083 -
tgtgttggatttggggggag

SEQ ID NO: 173978 - DNA, 20 bp, Artificial Sequence
  Synthetic oligonucleotide; CAG chr2 60532077 60532096 60532080 -
gttggatttggggggagggg

SEQ ID NO: 173979 - DNA, 20 bp, Artificial Sequence
  Synthetic oligonucleotide; GAG chr2 60532075 60532094 60532078 -
tggatttggggggaggggca

SEQ ID NO: 173980 - DNA, 20 bp, Artificial Sequence
  Synthetic oligonucleotide; AGG chr2 60532074 60532093 60532077 -
ggatttggggggaggggcag

SEQ ID NO: 173981 - DNA, 20 bp, Artificial Sequence
  Synthetic oligonucleotide; CAG chr2 60532071 60532090 60532074 -
tttggggggaggggcagagg

SEQ ID NO: 173982 - DNA, 20 bp, Artificial Sequence
  Synthetic oligonucleotide; AGG chr2 60532070 60532089 60532073 -
ttggggggaggggcagaggc

SEQ ID NO: 173983 - DNA, 20 bp, Artificial Sequence
  Synthetic oligonucleotide; GGG chr2 60532069 60532088 60532072 -
tggggggaggggcagaggca

SEQ ID NO: 173984 - DNA, 20 bp, Artificial Sequence
  Synthetic oligonucleotide; GAG chr2 60532067 60532086 60532070 -
gggggaggggcagaggcagg

SEQ ID NO: 173985 - DNA, 20 bp, Artificial Sequence
  Synthetic oligonucleotide; TGG chr2 60532061 60532080 60532064 -
ggggcagaggcagggagtgc

SEQ ID NO: 173986 - DNA, 20 bp, Artificial Sequence
  Synthetic oligonucleotide; GGG chr2 60532060 60532079 60532063 -
gggcagaggcagggagtgct

SEQ ID NO: 173987 - DNA, 20 bp, Artificial Sequence
  Synthetic oligonucleotide; GGG chr2 60532059 60532078 60532062 -
ggcagaggcagggagtgctg

SEQ ID NO: 173988 - DNA, 20 bp, Artificial Sequence
  Synthetic oligonucleotide; GAG chr2 60532055 60532074 60532058 -
gaggcagggagtgctggggt

SEQ ID NO: 173989 - DNA, 20 bp, Artificial Sequence
  Synthetic oligonucleotide; AGG chr2 60532054 60532073 60532057 -
aggcagggagtgctggggtg

SEQ ID NO: 173990 - DNA, 20 bp, Artificial Sequence
  Synthetic oligonucleotide; GAG chr2 60532048 60532067 60532051 -
ggagtgctggggtgaggcgt

SEQ ID NO: 173991 - DNA, 20 bp, Artificial Sequence
  Synthetic oligonucleotide; AGG chr2 60532047 60532066 60532050 -
gagtgctggggtgaggcgtg

SEQ ID NO: 173992 - DNA, 20 bp, Artificial Sequence
  Synthetic oligonucleotide; GAG chr2 60532042 60532061 60532045 -
ctggggtgaggcgtgaggct

SEQ ID NO: 173993 - DNA, 20 bp, Artificial Sequence
  Synthetic oligonucleotide; TGG chr2 60532034 60532053 60532037 -
aggcgtgaggctgagtgttg

SEQ ID NO: 173994 - DNA, 20 bp, Artificial Sequence
  Synthetic oligonucleotide; GAG chr2 60532032 60532051 60532035 -
gcgtgaggctgagtgttgtg

SEQ ID NO: 173995 - DNA, 20 bp, Artificial Sequence
  Synthetic oligonucleotide; CAG chr2 60532028 60532047 60532031 -
gaggctgagtgttgtggaga

SEQ ID NO: 173996 - DNA, 20 bp, Artificial Sequence
  Synthetic oligonucleotide; AGG chr2 60532027 60532046 60532030 -
aggctgagtgttgtggagac

SEQ ID NO: 173997 - DNA, 20 bp, Artificial Sequence
  Synthetic oligonucleotide; TAG chr2 60532023 60532042 60532026 -
tgagtgttgtggagacaggt

SEQ ID NO: 173998 - DNA, 20 bp, Artificial Sequence
  Synthetic oligonucleotide; CAG chr2 60532020 60532039 60532023 -
gtgttgtggagacaggttag

SEQ ID NO: 173999 - DNA, 20 bp, Artificial Sequence
  Synthetic oligonucleotide; AGG chr2 60532019 60532038 60532022 -
tgttgtggagacaggttagc

SEQ ID NO: 174000 - DNA, 20 bp, Artificial Sequence
  Synthetic oligonucleotide; GGG chr2 60532018 60532037 60532021 -
gttgtggagacaggttagca

SEQ ID NO: 174001 - DNA, 20 bp, Artificial Sequence
  Synthetic oligonucleotide; GGG chr2 60532017 60532036 60532020 -
ttgtggagacaggttagcag

SEQ ID NO: 174002 - DNA, 20 bp, Artificial Sequence
  Synthetic oligonucleotide; CGG chr2 60532012 60532031 60532015 -
gagacaggttagcaggggcc

SEQ ID NO: 174003 - DNA, 20 bp, Artificial Sequence
  Synthetic oligonucleotide; CGG chr2 60532009 60532028 60532012 -
acaggttagcaggggcccgg

SEQ ID NO: 174004 - DNA, 20 bp, Artificial Sequence
  Synthetic oligonucleotide; TGG chr2 60532004 60532023 60532007 -
ttagcaggggcccggcggtg

SEQ ID NO: 174005 - DNA, 20 bp, Artificial Sequence
  Synthetic oligonucleotide; CAG chr2 60532001 60532020 60532004 -
gcaggggcccggcggtgtgg

SEQ ID NO: 174006 - DNA, 20 bp, Artificial Sequence
  Synthetic oligonucleotide; AGG chr2 60532000 60532019 60532003 -
caggggcccggcggtgtggc

SEQ ID NO: 174007 - DNA, 20 bp, Artificial Sequence
  Synthetic oligonucleotide; AAG chr2 60531993 60532012 60531996 -
ccggcggtgtggcaggaaca

SEQ ID NO: 174008 - DNA, 20 bp, Artificial Sequence
  Synthetic oligonucleotide; AGG chr2 60531992 60532011 60531995 -
cggcggtgtggcaggaacaa

SEQ ID NO: 174009 - DNA, 20 bp, Artificial Sequence
  Synthetic oligonucleotide; CAG chr2 60531989 60532008 60531992 -
cggtgtggcaggaacaaagg

SEQ ID NO: 174010 - DNA, 20 bp, Artificial Sequence
  Synthetic oligonucleotide; TGG chr2 60531976 60531995 60531979 -
acaaaggcagcttccaacgc

SEQ ID NO: 174011 - DNA, 20 bp, Artificial Sequence
  Synthetic oligonucleotide; CAG chr2 60531971 60531990 60531974 -
ggcagcttccaacgctggtg

SEQ ID NO: 174012 - DNA, 20 bp, Artificial Sequence
  Synthetic oligonucleotide; AGG chr2 60531970 60531989 60531973 -
gcagcttccaacgctggtgc

SEQ ID NO: 174013 - DNA, 20 bp, Artificial Sequence
  Synthetic oligonucleotide; GAG chr2 60531962 60531981 60531965 -
caacgctggtgcaggattcc

SEQ ID NO: 174014 - DNA, 20 bp, Artificial Sequence
  Synthetic oligonucleotide; CAG chr2 60531951 60531970 60531954 -
caggattccgagccttaacc

SEQ ID NO: 174015 - DNA, 20 bp, Artificial Sequence
  Synthetic oligonucleotide; TGG chr2 60531941 60531960 60531944 -
agccttaacccagatgctca

SEQ ID NO: 174016 - DNA, 20 bp, Artificial Sequence
  Synthetic oligonucleotide; TAG chr2 60531933 60531952 60531936 -
cccagatgctcatggtgccc

SEQ ID NO: 174017 - DNA, 20 bp, Artificial Sequence
  Synthetic oligonucleotide; GAG chr2 60531926 60531945 60531929 -
gctcatggtgccctagtctt

SEQ ID NO: 174018 - DNA, 20 bp, Artificial Sequence
  Synthetic oligonucleotide; TAG chr2 60531914 60531933 60531917 -
ctagtcttgagttcttcatt

SEQ ID NO: 174019 - DNA, 20 bp, Artificial Sequence
  Synthetic oligonucleotide; AGG chr2 60531913 60531932 60531916 -
tagtcttgagttcttcattt

SEQ ID NO: 174020 - DNA, 20 bp, Artificial Sequence
  Synthetic oligonucleotide; TGG chr2 60531910 60531929 60531913 -
tcttgagttcttcatttagg

SEQ ID NO: 174021 - DNA, 20 bp, Artificial Sequence
  Synthetic oligonucleotide; GGG chr2 60531909 60531928 60531912 -
cttgagttcttcatttaggt

SEQ ID NO: 174022 - DNA, 20 bp, Artificial Sequence
  Synthetic oligonucleotide; TGG chr2 60531894 60531913 60531897 -
taggtgggcttatttcccac

SEQ ID NO: 174023 - DNA, 20 bp, Artificial Sequence
  Synthetic oligonucleotide; GGG chr2 60531893 60531912 60531896 -
aggtgggcttatttcccact

SEQ ID NO: 174024 - DNA, 20 bp, Artificial Sequence
  Synthetic oligonucleotide; TGG chr2 60531888 60531907 60531891 -
ggcttatttcccactgggtc

SEQ ID NO: 174025 - DNA, 20 bp, Artificial Sequence
  Synthetic oligonucleotide; GGG chr2 60531887 60531906 60531890 -
gcttatttcccactgggtct

SEQ ID NO: 174026 - DNA, 20 bp, Artificial Sequence
  Synthetic oligonucleotide; GGG chr2 60531886 60531905 60531889 -
cttatttcccactgggtctg

SEQ ID NO: 174027 - DNA, 20 bp, Artificial Sequence
  Synthetic oligonucleotide; GGG chr2 60531885 60531904 60531888 -
ttatttcccactgggtctgg

SEQ ID NO: 174028 - DNA, 20 bp, Artificial Sequence
  Synthetic oligonucleotide; GAG chr2 60531866 60531885 60531869 -
ggggatttcatttgtccttt

SEQ ID NO: 174029 - DNA, 20 bp, Artificial Sequence
  Synthetic oligonucleotide; AGG chr2 60531865 60531884 60531868 -
gggatttcatttgtcctttg

SEQ ID NO: 174030 - DNA, 20 bp, Artificial Sequence
  Synthetic oligonucleotide; GGG chr2 60531864 60531883 60531867 -
ggatttcatttgtcctttga

SEQ ID NO: 174031 - DNA, 20 bp, Artificial Sequence
  Synthetic oligonucleotide; GGG chr2 60531863 60531882 60531866 -
gatttcatttgtcctttgag

SEQ ID NO: 174032 - DNA, 20 bp, Artificial Sequence
  Synthetic oligonucleotide; CAG chr2 60531860 60531879 60531863 -
ttcatttgtcctttgagggg

SEQ ID NO: 174033 - DNA, 20 bp, Artificial Sequence
  Synthetic oligonucleotide; AGG chr2 60531859 60531878 60531862 -
tcatttgtcctttgaggggc

SEQ ID NO: 174034 - DNA, 20 bp, Artificial Sequence
  Synthetic oligonucleotide; GGG chr2 60531858 60531877 60531861 -
catttgtcctttgaggggca

SEQ ID NO: 174035 - DNA, 20 bp, Artificial Sequence
  Synthetic oligonucleotide; TGG chr2 60531855 60531874 60531858 -
ttgtcctttgaggggcaggg

SEQ ID NO: 174036 - DNA, 20 bp, Artificial Sequence
  Synthetic oligonucleotide; CAG chr2 60531845 60531864 60531848 -
aggggcagggtggacactga

SEQ ID NO: 174037 - DNA, 20 bp, Artificial Sequence
  Synthetic oligonucleotide; CAG chr2 60531840 60531859 60531843 -
cagggtggacactgacagaa

SEQ ID NO: 174038 - DNA, 20 bp, Artificial Sequence
  Synthetic oligonucleotide; CGG chr2 60531834 60531853 60531837 -
ggacactgacagaacagctg

SEQ ID NO: 174039 - DNA, 20 bp, Artificial Sequence
  Synthetic oligonucleotide; CGG chr2 60531830 60531849 60531833 -
actgacagaacagctgcggc

SEQ ID NO: 174040 - DNA, 20 bp, Artificial Sequence
  Synthetic oligonucleotide; CAG chr2 60531827 60531846 60531830 -
gacagaacagctgcggccgg

SEQ ID NO: 174041 - DNA, 20 bp, Artificial Sequence
  Synthetic oligonucleotide; GAG chr2 60531825 60531844 60531828 -
cagaacagctgcggccggca

SEQ ID NO: 174042 - DNA, 20 bp, Artificial Sequence
  Synthetic oligonucleotide; GAG chr2 60531823 60531842 60531826 -
gaacagctgcggccggcaga

SEQ ID NO: 174043 - DNA, 20 bp, Artificial Sequence
  Synthetic oligonucleotide; AGG chr2 60531822 60531841 60531825 -
aacagctgcggccggcagag

SEQ ID NO: 174044 - DNA, 20 bp, Artificial Sequence
  Synthetic oligonucleotide; GGG chr2 60531821 60531840 60531824 -
acagctgcggccggcagaga

SEQ ID NO: 174045 - DNA, 20 bp, Artificial Sequence
  Synthetic oligonucleotide; TGG chr2 60531818 60531837 60531821 -
gctgcggccggcagagaggg

SEQ ID NO: 174046 - DNA, 20 bp, Artificial Sequence
  Synthetic oligonucleotide; TAG chr2 60531814 60531833 60531817 -
cggccggcagagagggtggt

SEQ ID NO: 174047 - DNA, 20 bp, Artificial Sequence
  Synthetic oligonucleotide; AGG chr2 60531813 60531832 60531816 -
ggccggcagagagggtggtt

SEQ ID NO: 174048 - DNA, 20 bp, Artificial Sequence
  Synthetic oligonucleotide; AAG chr2 60531810 60531829 60531813 -
cggcagagagggtggttagg

SEQ ID NO: 174049 - DNA, 20 bp, Artificial Sequence
  Synthetic oligonucleotide; GAG chr2 60531808 60531827 60531811 -
gcagagagggtggttaggaa

SEQ ID NO: 174050 - DNA, 20 bp, Artificial Sequence
  Synthetic oligonucleotide; AGG chr2 60531807 60531826 60531810 -
cagagagggtggttaggaag

SEQ ID NO: 174051 - DNA, 20 bp, Artificial Sequence
  Synthetic oligonucleotide; GGG chr2 60531806 60531825 60531809 -
agagagggtggttaggaaga

SEQ ID NO: 174052 - DNA, 20 bp, Artificial Sequence
  Synthetic oligonucleotide; AAG chr2 60531803 60531822 60531806 -
gagggtggttaggaagaggg

SEQ ID NO: 174053 - DNA, 20 bp, Artificial Sequence
  Synthetic oligonucleotide; CAG chr2 60531800 60531819 60531803 -
ggtggttaggaagagggaag

SEQ ID NO: 174054 - DNA, 20 bp, Artificial Sequence
  Synthetic oligonucleotide; TGG chr2 60531793 60531812 60531796 -
aggaagagggaagcagcctg

SEQ ID NO: 174055 - DNA, 20 bp, Artificial Sequence
  Synthetic oligonucleotide; GGG chr2 60531792 60531811 60531795 -
ggaagagggaagcagcctgt

SEQ ID NO: 174056 - DNA, 20 bp, Artificial Sequence
  Synthetic oligonucleotide; TGG chr2 60531773 60531792 60531776 -
tgggtaacttcccgaccaca

SEQ ID NO: 174057 - DNA, 20 bp, Artificial Sequence
  Synthetic oligonucleotide; AAG chr2 60531769 60531788 60531772 -
taacttcccgaccacatgga

SEQ ID NO: 174058 - DNA, 20 bp, Artificial Sequence
  Synthetic oligonucleotide; AGG chr2 60531768 60531787 60531771 -
aacttcccgaccacatggaa

SEQ ID NO: 174059 - DNA, 20 bp, Artificial Sequence
  Synthetic oligonucleotide; AAG chr2 60531759 60531778 60531762 -
accacatggaaaggctgaat

SEQ ID NO: 174060 - DNA, 20 bp, Artificial Sequence
  Synthetic oligonucleotide; TGG chr2 60531750 60531769 60531753 -
aaaggctgaataagacgtta

SEQ ID NO: 174061 - DNA, 20 bp, Artificial Sequence
  Synthetic oligonucleotide; TGG chr2 60531738 60531757 60531741 -
agacgttatggaccctgcct

SEQ ID NO: 174062 - DNA, 20 bp, Artificial Sequence
  Synthetic oligonucleotide; GGG chr2 60531737 60531756 60531740 -
gacgttatggaccctgcctt

SEQ ID NO: 174063 - DNA, 20 bp, Artificial Sequence
  Synthetic oligonucleotide; TGG chr2 60531731 60531750 60531734 -
atggaccctgccttgggtac

SEQ ID NO: 174064 - DNA, 20 bp, Artificial Sequence
  Synthetic oligonucleotide; GGG chr2 60531730 60531749 60531733 -
tggaccctgccttgggtact

SEQ ID NO: 174065 - DNA, 20 bp, Artificial Sequence
  Synthetic oligonucleotide; GGG chr2 60531729 60531748 60531732 -
ggaccctgccttgggtactg

SEQ ID NO: 174066 - DNA, 20 bp, Artificial Sequence
  Synthetic oligonucleotide; CAG chr2 60531725 60531744 60531728 -
cctgccttgggtactggggt

SEQ ID NO: 174067 - DNA, 20 bp, Artificial Sequence
  Synthetic oligonucleotide; TGG chr2 60531715 60531734 60531718 -
gtactggggtcagcgtctcc

SEQ ID NO: 174068 - DNA, 20 bp, Artificial Sequence
  Synthetic oligonucleotide; TGG chr2 60531712 60531731 60531715 -
ctggggtcagcgtctcctgg

SEQ ID NO: 174069 - DNA, 20 bp, Artificial Sequence
  Synthetic oligonucleotide; CAG chr2 60531701 60531720 60531704 -
gtctcctggtggtgtctgca

SEQ ID NO: 174070 - DNA, 20 bp, Artificial Sequence
  Synthetic oligonucleotide; AGG chr2 60531700 60531719 60531703 -
tctcctggtggtgtctgcac

SEQ ID NO: 174071 - DNA, 20 bp, Artificial Sequence
  Synthetic oligonucleotide; GGG chr2 60531699 60531718 60531702 -
ctcctggtggtgtctgcaca

SEQ ID NO: 174072 - DNA, 20 bp, Artificial Sequence
  Synthetic oligonucleotide; CAG chr2 60531685 60531704 60531688 -
tgcacagggccccccaatgc

SEQ ID NO: 174073 - DNA, 20 bp, Artificial Sequence
  Synthetic oligonucleotide; AGG chr2 60531684 60531703 60531687 -
gcacagggccccccaatgcc

SEQ ID NO: 174074 - DNA, 20 bp, Artificial Sequence
  Synthetic oligonucleotide; GGG chr2 60531683 60531702 60531686 -
cacagggccccccaatgcca

SEQ ID NO: 174075 - DNA, 20 bp, Artificial Sequence
  Synthetic oligonucleotide; GAG chr2 60531660 60531679 60531663 -
cactgccaaaacacgctctt

SEQ ID NO: 174076 - DNA, 20 bp, Artificial Sequence
  Synthetic oligonucleotide; TGG chr2 60531652 60531671 60531655 -
aaacacgctcttgagtttaa

SEQ ID NO: 174077 - DNA, 20 bp, Artificial Sequence
  Synthetic oligonucleotide; TAG chr2 60531649 60531668 60531652 -
cacgctcttgagtttaatgg

SEQ ID NO: 174078 - DNA, 20 bp, Artificial Sequence
  Synthetic oligonucleotide; TGG chr2 60531646 60531665 60531649 -
gctcttgagtttaatggtag

SEQ ID NO: 174079 - DNA, 20 bp, Artificial Sequence
  Synthetic oligonucleotide; TGG chr2 60531642 60531661 60531645 -
ttgagtttaatggtagtggt

SEQ ID NO: 174080 - DNA, 20 bp, Artificial Sequence
  Synthetic oligonucleotide; GAG chr2 60531636 60531655 60531639 -
ttaatggtagtggttggtct

SEQ ID NO: 174081 - DNA, 20 bp, Artificial Sequence
  Synthetic oligonucleotide; AAG chr2 60531625 60531644 60531628 -
ggttggtctgagtcctgcca

SEQ ID NO: 174082 - DNA, 20 bp, Artificial Sequence
  Synthetic oligonucleotide; TGG chr2 60531618 60531637 60531621 -
ctgagtcctgccaaagtgta

SEQ ID NO: 174083 - DNA, 20 bp, Artificial Sequence
  Synthetic oligonucleotide; GAG chr2 60531616 60531635 60531619 -
gagtcctgccaaagtgtatg

SEQ ID NO: 174084 - DNA, 20 bp, Artificial Sequence
  Synthetic oligonucleotide; AAG chr2 60531612 60531631 60531615 -
cctgccaaagtgtatggagc

SEQ ID NO: 174085 - DNA, 20 bp, Artificial Sequence
  Synthetic oligonucleotide; TGG chr2 60531603 60531622 60531606 -
gtgtatggagcaagtttcat

SEQ ID NO: 174086 - DNA, 20 bp, Artificial Sequence
  Synthetic oligonucleotide; TGG chr2 60531599 60531618 60531602 -
atggagcaagtttcattggc

SEQ ID NO: 174087 - DNA, 20 bp, Artificial Sequence
  Synthetic oligonucleotide; AAG chr2 60531571 60531590 60531574 -
ccccttgcatgaaataataa

SEQ ID NO: 174088 - DNA, 20 bp, Artificial Sequence
  Synthetic oligonucleotide; TGG chr2 60531565 60531584 60531568 -
gcatgaaataataaaagccc

SEQ ID NO: 174089 - DNA, 20 bp, Artificial Sequence
  Synthetic oligonucleotide; AAG chr2 60531560 60531579 60531563 -
aaataataaaagccctggcc

SEQ ID NO: 174090 - DNA, 20 bp, Artificial Sequence
  Synthetic oligonucleotide; AGG chr2 60531559 60531578 60531562 -
aataataaaagccctggcca

SEQ ID NO: 174091 - DNA, 20 bp, Artificial Sequence
  Synthetic oligonucleotide; TGG chr2 60531497 60531516 60531500 -
tgtattttattaatattttt

SEQ ID NO: 174092 - DNA, 20 bp, Artificial Sequence
  Synthetic oligonucleotide; GAG chr2 60531495 60531514 60531498 -
tattttattaatattttttg

SEQ ID NO: 174093 - DNA, 20 bp, Artificial Sequence
  Synthetic oligonucleotide; AGG chr2 60531494 60531513 60531497 -
attttattaatattttttgg

SEQ ID NO: 174094 - DNA, 20 bp, Artificial Sequence
  Synthetic oligonucleotide; GGG chr2 60531493 60531512 60531496 -
ttttattaatattttttgga

SEQ ID NO: 174095 - DNA, 20 bp, Artificial Sequence
  Synthetic oligonucleotide; TAG chr2 60531466 60531485 60531469 -
tgctctcatttgaccatttg

SEQ ID NO: 174096 - DNA, 20 bp, Artificial Sequence
  Synthetic oligonucleotide; TGG chr2 60531441 60531460 60531444 -
ataattaatgcattccgtac

SEQ ID NO: 174097 - DNA, 20 bp, Artificial Sequence
  Synthetic oligonucleotide; AAG chr2 60531431 60531450 60531434 -
cattccgtactggttgtaaa

SEQ ID NO: 174098 - DNA, 20 bp, Artificial Sequence
  Synthetic oligonucleotide; AAG chr2 60531409 60531428 60531412 -
gtgtgcttgcatttaattgc

SEQ ID NO: 174099 - DNA, 20 bp, Artificial Sequence
  Synthetic oligonucleotide; CAG chr2 60531405 60531424 60531408 -
gcttgcatttaattgcaagt

SEQ ID NO: 174100 - DNA, 20 bp, Artificial Sequence
  Synthetic oligonucleotide; AGG chr2 60531404 60531423 60531407 -
cttgcatttaattgcaagtc

SEQ ID NO: 174101 - DNA, 20 bp, Artificial Sequence
  Synthetic oligonucleotide; GGG chr2 60531403 60531422 60531406 -
ttgcatttaattgcaagtca

SEQ ID NO: 174102 - DNA, 20 bp, Artificial Sequence
  Synthetic oligonucleotide; TGG chr2 60531392 60531411 60531395 -
tgcaagtcagggtaaattaa

SEQ ID NO: 174103 - DNA, 20 bp, Artificial Sequence
  Synthetic oligonucleotide; CAG chr2 60531352 60531371 60531355 -
actcacttaaaatattcttg

SEQ ID NO: 174104 - DNA, 20 bp, Artificial Sequence
  Synthetic oligonucleotide; AAG chr2 60531343 60531362 60531346 -
aaatattcttgcagaacgca

SEQ ID NO: 174105 - DNA, 20 bp, Artificial Sequence
  Synthetic oligonucleotide; AGG chr2 60531342 60531361 60531345 -
aatattcttgcagaacgcaa

SEQ ID NO: 174106 - DNA, 20 bp, Artificial Sequence
  Synthetic oligonucleotide; GAG chr2 60531340 60531359 60531343 -
tattcttgcagaacgcaaag

SEQ ID NO: 174107 - DNA, 20 bp, Artificial Sequence
  Synthetic oligonucleotide; AGG chr2 60531339 60531358 60531342 -
attcttgcagaacgcaaagg

SEQ ID NO: 174108 - DNA, 20 bp, Artificial Sequence
  Synthetic oligonucleotide; GGG chr2 60531338 60531357 60531341 -
ttcttgcagaacgcaaagga

SEQ ID NO: 174109 - DNA, 20 bp, Artificial Sequence
  Synthetic oligonucleotide; GGG chr2 60531337 60531356 60531340 -
tcttgcagaacgcaaaggag

SEQ ID NO: 174110 - DNA, 20 bp, Artificial Sequence
  Synthetic oligonucleotide; GGG chr2 60531336 60531355 60531339 -
cttgcagaacgcaaaggagg

SEQ ID NO: 174111 - DNA, 20 bp, Artificial Sequence
  Synthetic oligonucleotide; CAG chr2 60531333 60531352 60531336 -
gcagaacgcaaaggaggggg

SEQ ID NO: 174112 - DNA, 20 bp, Artificial Sequence
  Synthetic oligonucleotide; CAG chr2 60531327 60531346 60531330 -
cgcaaaggagggggcagtcc

SEQ ID NO: 174113 - DNA, 20 bp, Artificial Sequence
  Synthetic oligonucleotide; TGG chr2 60531308 60531327 60531311 -
ccagtatttaatttattttc

SEQ ID NO: 174114 - DNA, 20 bp, Artificial Sequence
  Synthetic oligonucleotide; TAG chr2 60531303 60531322 60531306 -
atttaatttattttctggtt

SEQ ID NO: 174115 - DNA, 20 bp, Artificial Sequence
  Synthetic oligonucleotide; TAG chr2 60531297 60531316 60531300 -
tttattttctggtttagtgt

SEQ ID NO: 174116 - DNA, 20 bp, Artificial Sequence
  Synthetic oligonucleotide; GAG chr2 60531291 60531310 60531294 -
ttctggtttagtgttagtgt

SEQ ID NO: 174117 - DNA, 20 bp, Artificial Sequence
  Synthetic oligonucleotide; GAG chr2 60531289 60531308 60531292 -
ctggtttagtgttagtgtga

SEQ ID NO: 174118 - DNA, 20 bp, Artificial Sequence
  Synthetic oligonucleotide; AGG chr2 60531288 60531307 60531291 -
tggtttagtgttagtgtgag

SEQ ID NO: 174119 - DNA, 20 bp, Artificial Sequence
  Synthetic oligonucleotide; GGG chr2 60531287 60531306 60531290 -
ggtttagtgttagtgtgaga

SEQ ID NO: 174120 - DNA, 20 bp, Artificial Sequence
  Synthetic oligonucleotide; AAG chr2 60531279 60531298 60531282 -
gttagtgtgagagggtcgaa

SEQ ID NO: 174121 - DNA, 20 bp, Artificial Sequence
  Synthetic oligonucleotide; TGG chr2 60531270 60531289 60531273 -
agagggtcgaaaagattctg

SEQ ID NO: 174122 - DNA, 20 bp, Artificial Sequence
  Synthetic oligonucleotide; GGG chr2 60531269 60531288 60531272 -
gagggtcgaaaagattctgt

SEQ ID NO: 174123 - DNA, 20 bp, Artificial Sequence
  Synthetic oligonucleotide; CGG chr2 60531261 60531280 60531264 -
aaaagattctgtgggtccaa

SEQ ID NO: 174124 - DNA, 20 bp, Artificial Sequence
  Synthetic oligonucleotide; GGG chr2 60531260 60531279 60531263 -
aaagattctgtgggtccaac

SEQ ID NO: 174125 - DNA, 20 bp, Artificial Sequence
  Synthetic oligonucleotide; CAG chr2 60531240 60531259 60531243 -
gggatttgtgtctgtgtgtg

SEQ ID NO: 174126 - DNA, 20 bp, Artificial Sequence
  Synthetic oligonucleotide; AGG chr2 60531239 60531258 60531242 -
ggatttgtgtctgtgtgtgc

SEQ ID NO: 174127 - DNA, 20 bp, Artificial Sequence
  Synthetic oligonucleotide; CGG chr2 60531231 60531250 60531234 -
gtctgtgtgtgcaggaccgt

SEQ ID NO: 174128 - DNA, 20 bp, Artificial Sequence
  Synthetic oligonucleotide; GGG chr2 60531230 60531249 60531233 -
tctgtgtgtgcaggaccgtc

SEQ ID NO: 174129 - DNA, 20 bp, Artificial Sequence
  Synthetic oligonucleotide; CAG chr2 60531222 60531241 60531225 -
tgcaggaccgtcgggcaaca

SEQ ID NO: 174130 - DNA, 20 bp, Artificial Sequence
  Synthetic oligonucleotide; GAG chr2 60531220 60531239 60531223 -
caggaccgtcgggcaacaca

SEQ ID NO: 174131 - DNA, 20 bp, Artificial Sequence
  Synthetic oligonucleotide; AGG chr2 60531219 60531238 60531222 -
aggaccgtcgggcaacacag

SEQ ID NO: 174132 - DNA, 20 bp, Artificial Sequence
  Synthetic oligonucleotide; GGG chr2 60531218 60531237 60531221 -
ggaccgtcgggcaacacaga

SEQ ID NO: 174133 - DNA, 20 bp, Artificial Sequence
  Synthetic oligonucleotide; GAG chr2 60531216 60531235 60531219 -
accgtcgggcaacacagagg

SEQ ID NO: 174134 - DNA, 20 bp, Artificial Sequence
  Synthetic oligonucleotide; AGG chr2 60531215 60531234 60531218 -
ccgtcgggcaacacagaggg

SEQ ID NO: 174135 - DNA, 20 bp, Artificial Sequence
  Synthetic oligonucleotide; GAG chr2 60531213 60531232 60531216 -
gtcgggcaacacagagggag

SEQ ID NO: 174136 - DNA, 20 bp, Artificial Sequence
  Synthetic oligonucleotide; TGG chr2 60531203 60531222 60531206 -
acagagggaggagaaaaacc

SEQ ID NO: 174137 - DNA, 20 bp, Artificial Sequence
  Synthetic oligonucleotide; CGG chr2 60531198 60531217 60531201 -
gggaggagaaaaacctggac

SEQ ID NO: 174138 - DNA, 20 bp, Artificial Sequence
  Synthetic oligonucleotide; GAG chr2 60531196 60531215 60531199 -
gaggagaaaaacctggaccg

SEQ ID NO: 174139 - DNA, 20 bp, Artificial Sequence
  Synthetic oligonucleotide; TAG chr2 60531193 60531212 60531196 -
gagaaaaacctggaccggag

SEQ ID NO: 174140 - DNA, 20 bp, Artificial Sequence
  Synthetic oligonucleotide; AGG chr2 60531192 60531211 60531195 -
agaaaaacctggaccggagt

SEQ ID NO: 174141 - DNA, 20 bp, Artificial Sequence
  Synthetic oligonucleotide; GGG chr2 60531191 60531210 60531194 -
gaaaaacctggaccggagta

SEQ ID NO: 174142 - DNA, 20 bp, Artificial Sequence
  Synthetic oligonucleotide; TAG chr2 60531188 60531207 60531191 -
aaacctggaccggagtaggg

SEQ ID NO: 174143 - DNA, 20 bp, Artificial Sequence
  Synthetic oligonucleotide; CAG chr2 60531184 60531203 60531187 -
ctggaccggagtagggtagc

SEQ ID NO: 174144 - DNA, 20 bp, Artificial Sequence
  Synthetic oligonucleotide; AGG chr2 60531183 60531202 60531186 -
tggaccggagtagggtagcc

SEQ ID NO: 174145 - DNA, 20 bp, Artificial Sequence
  Synthetic oligonucleotide; GAG chr2 60531181 60531200 60531184 -
gaccggagtagggtagccag

SEQ ID NO: 174146 - DNA, 20 bp, Artificial Sequence
  Synthetic oligonucleotide; GAG chr2 60531151 60531170 60531154 -
tttttttttctctaatttct

SEQ ID NO: 174147 - DNA, 20 bp, Artificial Sequence
  Synthetic oligonucleotide; AGG chr2 60531150 60531169 60531153 -
ttttttttctctaatttctg

SEQ ID NO: 174148 - DNA, 20 bp, Artificial Sequence
  Synthetic oligonucleotide; CAG chr2 60531143 60531162 60531146 -
tctctaatttctgaggttgc

SEQ ID NO: 174149 - DNA, 20 bp, Artificial Sequence
  Synthetic oligonucleotide; AGG chr2 60531142 60531161 60531145 -
ctctaatttctgaggttgcc

SEQ ID NO: 174150 - DNA, 20 bp, Artificial Sequence
  Synthetic oligonucleotide; GAG chr2 60531140 60531159 60531143 -
ctaatttctgaggttgccag

SEQ ID NO: 174151 - DNA, 20 bp, Artificial Sequence
  Synthetic oligonucleotide; AGG chr2 60531139 60531158 60531142 -
taatttctgaggttgccagg

SEQ ID NO: 174152 - DNA, 20 bp, Artificial Sequence
  Synthetic oligonucleotide; GGG chr2 60531138 60531157 60531141 -
aatttctgaggttgccagga

SEQ ID NO: 174153 - DNA, 20 bp, Artificial Sequence
  Synthetic oligonucleotide; GGG chr2 60531137 60531156 60531140 -
atttctgaggttgccaggag

SEQ ID NO: 174154 - DNA, 20 bp, Artificial Sequence
  Synthetic oligonucleotide; AAG chr2 60531131 60531150 60531134 -
gaggttgccaggaggggctt

SEQ ID NO: 174155 - DNA, 20 bp, Artificial Sequence
  Synthetic oligonucleotide; AAG chr2 60531126 60531145 60531129 -
tgccaggaggggcttaagca

SEQ ID NO: 174156 - DNA, 20 bp, Artificial Sequence
  Synthetic oligonucleotide; TGG chr2 60531123 60531142 60531126 -
caggaggggcttaagcaaag

SEQ ID NO: 174157 - DNA, 20 bp, Artificial Sequence
  Synthetic oligonucleotide; AAG chr2 60531118 60531137 60531121 -
ggggcttaagcaaagtggtc

SEQ ID NO: 174158 - DNA, 20 bp, Artificial Sequence
  Synthetic oligonucleotide; CGG chr2 60531104 60531123 60531107 -
gtggtcaagtccatctgctc

SEQ ID NO: 174159 - DNA, 20 bp, Artificial Sequence
  Synthetic oligonucleotide; GAG chr2 60531102 60531121 60531105 -
ggtcaagtccatctgctccg

SEQ ID NO: 174160 - DNA, 20 bp, Artificial Sequence
  Synthetic oligonucleotide; AAG chr2 60531099 60531118 60531102 -
caagtccatctgctccggag

SEQ ID NO: 174161 - DNA, 20 bp, Artificial Sequence
  Synthetic oligonucleotide; AGG chr2 60531098 60531117 60531101 -
aagtccatctgctccggaga

SEQ ID NO: 174162 - DNA, 20 bp, Artificial Sequence
  Synthetic oligonucleotide; TGG chr2 60531095 60531114 60531098 -
tccatctgctccggagaagg

SEQ ID NO: 174163 - DNA, 20 bp, Artificial Sequence
  Synthetic oligonucleotide; AAG chr2 60531090 60531109 60531093 -
ctgctccggagaaggtggta

SEQ ID NO: 174164 - DNA, 20 bp, Artificial Sequence
  Synthetic oligonucleotide; AAG chr2 60531085 60531104 60531088 -
ccggagaaggtggtaaagaa

SEQ ID NO: 174165 - DNA, 20 bp, Artificial Sequence
  Synthetic oligonucleotide; GAG chr2 60531083 60531102 60531086 -
ggagaaggtggtaaagaaaa

SEQ ID NO: 174166 - DNA, 20 bp, Artificial Sequence
  Synthetic oligonucleotide; AGG chr2 60531082 60531101 60531085 -
gagaaggtggtaaagaaaag

SEQ ID NO: 174167 - DNA, 20 bp, Artificial Sequence
  Synthetic oligonucleotide; TAG chr2 60531078 60531097 60531081 -
aggtggtaaagaaaagaggt

SEQ ID NO: 174168 - DNA, 20 bp, Artificial Sequence
  Synthetic oligonucleotide; TGG chr2 60531075 60531094 60531078 -
tggtaaagaaaagaggttag

SEQ ID NO: 174169 - DNA, 20 bp, Artificial Sequence
  Synthetic oligonucleotide; AAG chr2 60531071 60531090 60531074 -
aaagaaaagaggttagtggc

SEQ ID NO: 174170 - DNA, 20 bp, Artificial Sequence
  Synthetic oligonucleotide; GAG chr2 60531069 60531088 60531072 -
agaaaagaggttagtggcaa

SEQ ID NO: 174171 - DNA, 20 bp, Artificial Sequence
  Synthetic oligonucleotide; AGG chr2 60531068 60531087 60531071 -
gaaaagaggttagtggcaag

SEQ ID NO: 174172 - DNA, 20 bp, Artificial Sequence
  Synthetic oligonucleotide; GGG chr2 60531067 60531086 60531070 -
aaaagaggttagtggcaaga

SEQ ID NO: 174173 - DNA, 20 bp, Artificial Sequence
  Synthetic oligonucleotide; AAG chr2 60531064 60531083 60531067 -
agaggttagtggcaagaggg

SEQ ID NO: 174174 - DNA, 20 bp, Artificial Sequence
  Synthetic oligonucleotide; AGG chr2 60531063 60531082 60531066 -
gaggttagtggcaagaggga

SEQ ID NO: 174175 - DNA, 20 bp, Artificial Sequence
  Synthetic oligonucleotide; GAG chr2 60531061 60531080 60531064 -
ggttagtggcaagagggaag

SEQ ID NO: 174176 - DNA, 20 bp, Artificial Sequence
  Synthetic oligonucleotide; AAG chr2 60531054 60531073 60531057 -
ggcaagagggaaggagcaca

SEQ ID NO: 174177 - DNA, 20 bp, Artificial Sequence
  Synthetic oligonucleotide; AGG chr2 60531053 60531072 60531056 -
gcaagagggaaggagcacaa

SEQ ID NO: 174178 - DNA, 20 bp, Artificial Sequence
  Synthetic oligonucleotide; GGG chr2 60531052 60531071 60531055 -
caagagggaaggagcacaaa

SEQ ID NO: 174179 - DNA, 20 bp, Artificial Sequence
  Synthetic oligonucleotide; TGG chr2 60531037 60531056 60531040 -
acaaagggaaaattgtacat

SEQ ID NO: 174180 - DNA, 20 bp, Artificial Sequence
  Synthetic oligonucleotide; GGG chr2 60531036 60531055 60531039 -
caaagggaaaattgtacatt

SEQ ID NO: 174181 - DNA, 20 bp, Artificial Sequence
  Synthetic oligonucleotide; GAG chr2 60531034 60531053 60531037 -
aagggaaaattgtacattgg

SEQ ID NO: 174182 - DNA, 20 bp, Artificial Sequence
  Synthetic oligonucleotide; TGG chr2 60531019 60531038 60531022 -
attgggagcgttactctccc

SEQ ID NO: 174183 - DNA, 20 bp, Artificial Sequence
  Synthetic oligonucleotide; TGG chr2 60531013 60531032 60531016 -
agcgttactctccctggcca

SEQ ID NO: 174184 - DNA, 20 bp, Artificial Sequence
  Synthetic oligonucleotide; TAG chr2 60531008 60531027 60531011 -
tactctccctggccatggtg

SEQ ID NO: 174185 - DNA, 20 bp, Artificial Sequence
  Synthetic oligonucleotide; CAG chr2 60531004 60531023 60531007 -
ctccctggccatggtgtagc

SEQ ID NO: 174186 - DNA, 20 bp, Artificial Sequence
  Synthetic oligonucleotide; TGG chr2 60530999 60531018 60531002 -
tggccatggtgtagccagac

SEQ ID NO: 174187 - DNA, 20 bp, Artificial Sequence
  Synthetic oligonucleotide; TAG chr2 60530994 60531013 60530997 -
atggtgtagccagactggtt

SEQ ID NO: 174188 - DNA, 20 bp, Artificial Sequence
  Synthetic oligonucleotide; CAG chr2 60530991 60531010 60530994 -
gtgtagccagactggtttag

SEQ ID NO: 174189 - DNA, 20 bp, Artificial Sequence
  Synthetic oligonucleotide; CAG chr2 60530987 60531006 60530990 -
agccagactggtttagcaga

SEQ ID NO: 174190 - DNA, 20 bp, Artificial Sequence
  Synthetic oligonucleotide; TAG chr2 60530979 60530998 60530982 -
tggtttagcagacagaatga

SEQ ID NO: 174191 - DNA, 20 bp, Artificial Sequence
  Synthetic oligonucleotide; CAG chr2 60530966 60530985 60530969 -
agaatgatagattgttttgt

SEQ ID NO: 174192 - DNA, 20 bp, Artificial Sequence
  Synthetic oligonucleotide; AGG chr2 60530965 60530984 60530968 -
gaatgatagattgttttgtc

SEQ ID NO: 174193 - DNA, 20 bp, Artificial Sequence
  Synthetic oligonucleotide; GGG chr2 60530964 60530983 60530967 -
aatgatagattgttttgtca

SEQ ID NO: 174194 - DNA, 20 bp, Artificial Sequence
  Synthetic oligonucleotide; GGG chr2 60530963 60530982 60530966 -
atgatagattgttttgtcag

SEQ ID NO: 174195 - DNA, 20 bp, Artificial Sequence
  Synthetic oligonucleotide; CAG chr2 60530957 60530976 60530960 -
gattgttttgtcaggggtcc

SEQ ID NO: 174196 - DNA, 20 bp, Artificial Sequence
  Synthetic oligonucleotide; AGG chr2 60530956 60530975 60530959 -
attgttttgtcaggggtccc

SEQ ID NO: 174197 - DNA, 20 bp, Artificial Sequence
  Synthetic oligonucleotide; GGG chr2 60530955 60530974 60530958 -
ttgttttgtcaggggtccca

SEQ ID NO: 174198 - DNA, 20 bp, Artificial Sequence
  Synthetic oligonucleotide; AAG chr2 60530937 60530956 60530940 -
cagggtgcgccctgaacttg

SEQ ID NO: 174199 - DNA, 20 bp, Artificial Sequence
  Synthetic oligonucleotide; TAG chr2 60530916 60530935 60530919 -
agcactttgtttatcttgaa

SEQ ID NO: 174200 - DNA, 20 bp, Artificial Sequence
  Synthetic oligonucleotide; AAG chr2 60530912 60530931 60530915 -
ctttgtttatcttgaataga

SEQ ID NO: 174201 - DNA, 20 bp, Artificial Sequence
  Synthetic oligonucleotide; AGG chr2 60530911 60530930 60530914 -
tttgtttatcttgaatagaa

SEQ ID NO: 174202 - DNA, 20 bp, Artificial Sequence
  Synthetic oligonucleotide; GGG chr2 60530910 60530929 60530913 -
ttgtttatcttgaatagaaa

SEQ ID NO: 174203 - DNA, 20 bp, Artificial Sequence
  Synthetic oligonucleotide; AAG chr2 60530905 60530924 60530908 -
tatcttgaatagaaagggaa

SEQ ID NO: 174204 - DNA, 20 bp, Artificial Sequence
  Synthetic oligonucleotide; CAG chr2 60530900 60530919 60530903 -
tgaatagaaagggaaaagcg

SEQ ID NO: 174205 - DNA, 20 bp, Artificial Sequence
  Synthetic oligonucleotide; TAG chr2 60530883 60530902 60530886 -
gcgcagacataatcgatgtc

SEQ ID NO: 174206 - DNA, 20 bp, Artificial Sequence
  Synthetic oligonucleotide; TAG chr2 60530876 60530895 60530879 -
cataatcgatgtctagtttt

SEQ ID NO: 174207 - DNA, 20 bp, Artificial Sequence
  Synthetic oligonucleotide; AGG chr2 60530875 60530894 60530878 -
ataatcgatgtctagttttt

SEQ ID NO: 174208 - DNA, 20 bp, Artificial Sequence
  Synthetic oligonucleotide; GAG chr2 60530873 60530892 60530876 -
aatcgatgtctagtttttag

SEQ ID NO: 174209 - DNA, 20 bp, Artificial Sequence
  Synthetic oligonucleotide; AAG chr2 60530865 60530884 60530868 -
tctagtttttaggagctcga

SEQ ID NO: 174210 - DNA, 20 bp, Artificial Sequence
  Synthetic oligonucleotide; GAG chr2 60530863 60530882 60530866 -
tagtttttaggagctcgaaa

SEQ ID NO: 174211 - DNA, 20 bp, Artificial Sequence
  Synthetic oligonucleotide; AGG chr2 60530862 60530881 60530865 -
agtttttaggagctcgaaag

SEQ ID NO: 174212 - DNA, 20 bp, Artificial Sequence
  Synthetic oligonucleotide; TAG chr2 60530859 60530878 60530862 -
ttttaggagctcgaaagagg

SEQ ID NO: 174213 - DNA, 20 bp, Artificial Sequence
  Synthetic oligonucleotide; AGG chr2 60530858 60530877 60530861 -
tttaggagctcgaaagaggt

SEQ ID NO: 174214 - DNA, 20 bp, Artificial Sequence
  Synthetic oligonucleotide; GAG chr2 60530856 60530875 60530859 -
taggagctcgaaagaggtag

SEQ ID NO: 174215 - DNA, 20 bp, Artificial Sequence
  Synthetic oligonucleotide; CAG chr2 60530851 60530870 60530854 -
gctcgaaagaggtaggagaa

SEQ ID NO: 174216 - DNA, 20 bp, Artificial Sequence
  Synthetic oligonucleotide; GAG chr2 60530849 60530868 60530852 -
tcgaaagaggtaggagaaca

SEQ ID NO: 174217 - DNA, 20 bp, Artificial Sequence
  Synthetic oligonucleotide; AAG chr2 60530846 60530865 60530849 -
aaagaggtaggagaacagag

SEQ ID NO: 174218 - DNA, 20 bp, Artificial Sequence
  Synthetic oligonucleotide; CAG chr2 60530840 60530859 60530843 -
gtaggagaacagagaagact

SEQ ID NO: 174219 - DNA, 20 bp, Artificial Sequence
  Synthetic oligonucleotide; AGG chr2 60530839 60530858 60530842 -
taggagaacagagaagactc

SEQ ID NO: 174220 - DNA, 20 bp, Artificial Sequence
  Synthetic oligonucleotide; GAG chr2 60530837 60530856 60530840 -
ggagaacagagaagactcag

SEQ ID NO: 174221 - DNA, 20 bp, Artificial Sequence
  Synthetic oligonucleotide; AGG chr2 60530836 60530855 60530839 -
gagaacagagaagactcagg

SEQ ID NO: 174222 - DNA, 20 bp, Artificial Sequence
  Synthetic oligonucleotide; GGG chr2 60530835 60530854 60530838 -
agaacagagaagactcagga

SEQ ID NO: 174223 - DNA, 20 bp, Artificial Sequence
  Synthetic oligonucleotide; GGG chr2 60530834 60530853 60530837 -
gaacagagaagactcaggag

SEQ ID NO: 174224 - DNA, 20 bp, Artificial Sequence
  Synthetic oligonucleotide; TAG chr2 60530831 60530850 60530834 -
cagagaagactcaggagggg

SEQ ID NO: 174225 - DNA, 20 bp, Artificial Sequence
  Synthetic oligonucleotide; TGG chr2 60530828 60530847 60530831 -
agaagactcaggaggggtag

SEQ ID NO: 174226 - DNA, 20 bp, Artificial Sequence
  Synthetic oligonucleotide; GGG chr2 60530827 60530846 60530830 -
gaagactcaggaggggtagt

SEQ ID NO: 174227 - DNA, 20 bp, Artificial Sequence
  Synthetic oligonucleotide; GAG chr2 60530825 60530844 60530828 -
agactcaggaggggtagtgg

SEQ ID NO: 174228 - DNA, 20 bp, Artificial Sequence
  Synthetic oligonucleotide; AGG chr2 60530824 60530843 60530827 -
gactcaggaggggtagtggg

SEQ ID NO: 174229 - DNA, 20 bp, Artificial Sequence
  Synthetic oligonucleotide; TGG chr2 60530821 60530840 60530824 -
tcaggaggggtagtgggagg

SEQ ID NO: 174230 - DNA, 20 bp, Artificial Sequence
  Synthetic oligonucleotide; GGG chr2 60530820 60530839 60530823 -
caggaggggtagtgggaggt

SEQ ID NO: 174231 - DNA, 20 bp, Artificial Sequence
  Synthetic oligonucleotide; GGG chr2 60530819 60530838 60530822 -
aggaggggtagtgggaggtg

SEQ ID NO: 174232 - DNA, 20 bp, Artificial Sequence
  Synthetic oligonucleotide; GGG chr2 60530818 60530837 60530821 -
ggaggggtagtgggaggtgg

SEQ ID NO: 174233 - DNA, 20 bp, Artificial Sequence
  Synthetic oligonucleotide; GAG chr2 60530816 60530835 60530819 -
aggggtagtgggaggtgggg

SEQ ID NO: 174234 - DNA, 20 bp, Artificial Sequence
  Synthetic oligonucleotide; AGG chr2 60530815 60530834 60530818 -
ggggtagtgggaggtggggg

SEQ ID NO: 174235 - DNA, 20 bp, Artificial Sequence
  Synthetic oligonucleotide; CAG chr2 60530810 60530829 60530813 -
agtgggaggtgggggaggtg

SEQ ID NO: 174236 - DNA, 20 bp, Artificial Sequence
  Synthetic oligonucleotide; AGG chr2 60530809 60530828 60530812 -
gtgggaggtgggggaggtgc

SEQ ID NO: 174237 - DNA, 20 bp, Artificial Sequence
  Synthetic oligonucleotide; TGG chr2 60530803 60530822 60530806 -
ggtgggggaggtgcaggccc

SEQ ID NO: 174238 - DNA, 20 bp, Artificial Sequence
  Synthetic oligonucleotide; TGG chr2 60530797 60530816 60530800 -
ggaggtgcaggccctggttg

SEQ ID NO: 174239 - DNA, 20 bp, Artificial Sequence
  Synthetic oligonucleotide; CAG chr2 60530783 60530802 60530786 -
tggttgtggttgtccattaa

SEQ ID NO: 174240 - DNA, 20 bp, Artificial Sequence
  Synthetic oligonucleotide; TGG chr2 60530773 60530792 60530776 -
tgtccattaacagatgaact

SEQ ID NO: 174241 - DNA, 20 bp, Artificial Sequence
  Synthetic oligonucleotide; GAG chr2 60530768 60530787 60530771 -
attaacagatgaacttggcc

SEQ ID NO: 174242 - DNA, 20 bp, Artificial Sequence
  Synthetic oligonucleotide; AGG chr2 60530767 60530786 60530770 -
ttaacagatgaacttggccg

SEQ ID NO: 174243 - DNA, 20 bp, Artificial Sequence
  Synthetic oligonucleotide; GGG chr2 60530766 60530785 60530769 -
taacagatgaacttggccga

SEQ ID NO: 174244 - DNA, 20 bp, Artificial Sequence
  Synthetic oligonucleotide; CAG chr2 60530762 60530781 60530765 -
agatgaacttggccgagggc

SEQ ID NO: 174245 - DNA, 20 bp, Artificial Sequence
  Synthetic oligonucleotide; AGG chr2 60530761 60530780 60530764 -
gatgaacttggccgagggcc

SEQ ID NO: 174246 - DNA, 20 bp, Artificial Sequence
  Synthetic oligonucleotide; TAG chr2 60530755 60530774 60530758 -
cttggccgagggccaggctt

SEQ ID NO: 174247 - DNA, 20 bp, Artificial Sequence
  Synthetic oligonucleotide; GAG chr2 60530750 60530769 60530753 -
ccgagggccaggctttagat

SEQ ID NO: 174248 - DNA, 20 bp, Artificial Sequence
  Synthetic oligonucleotide; GAG chr2 60530748 60530767 60530751 -
gagggccaggctttagatga

SEQ ID NO: 174249 - DNA, 20 bp, Artificial Sequence
  Synthetic oligonucleotide; CAG chr2 60530740 60530759 60530743 -
ggctttagatgagagcgtgt

SEQ ID NO: 174250 - DNA, 20 bp, Artificial Sequence
  Synthetic oligonucleotide; AGG chr2 60530739 60530758 60530742 -
gctttagatgagagcgtgtc

SEQ ID NO: 174251 - DNA, 20 bp, Artificial Sequence
  Synthetic oligonucleotide; GGG chr2 60530738 60530757 60530741 -
ctttagatgagagcgtgtca

SEQ ID NO: 174252 - DNA, 20 bp, Artificial Sequence
  Synthetic oligonucleotide; CAG chr2 60530732 60530751 60530735 -
atgagagcgtgtcagggccc

SEQ ID NO: 174253 - DNA, 20 bp, Artificial Sequence
  Synthetic oligonucleotide; CAG chr2 60530727 60530746 60530730 -
agcgtgtcagggccccagtg

SEQ ID NO: 174254 - DNA, 20 bp, Artificial Sequence
  Synthetic oligonucleotide; AAG chr2 60530722 60530741 60530725 -
gtcagggccccagtgcagcc

SEQ ID NO: 174255 - DNA, 20 bp, Artificial Sequence
  Synthetic oligonucleotide; CAG chr2 60530713 60530732 60530716 -
ccagtgcagccaagcctttt

SEQ ID NO: 174256 - DNA, 20 bp, Artificial Sequence
  Synthetic oligonucleotide; TGG chr2 60530644 60530663 60530647 -
actgtacatcaaatgctccc

SEQ ID NO: 174257 - DNA, 20 bp, Artificial Sequence
  Synthetic oligonucleotide; TGG chr2 60530636 60530655 60530639 -
tcaaatgctccctggtcttt

SEQ ID NO: 174258 - DNA, 20 bp, Artificial Sequence
  Synthetic oligonucleotide; AAG chr2 60530630 60530649 60530633 -
gctccctggtcttttggcta

SEQ ID NO: 174259 - DNA, 20 bp, Artificial Sequence
  Synthetic oligonucleotide; AGG chr2 60530629 60530648 60530632 -
ctccctggtcttttggctaa

SEQ ID NO: 174260 - DNA, 20 bp, Artificial Sequence
  Synthetic oligonucleotide; AAG chr2 60530601 60530620 60530604 -
aaataaaaaataaaaaaaaa

SEQ ID NO: 174261 - DNA, 20 bp, Artificial Sequence
  Synthetic oligonucleotide; GAG chr2 60530599 60530618 60530602 -
ataaaaaataaaaaaaaaaa

SEQ ID NO: 174262 - DNA, 20 bp, Artificial Sequence
  Synthetic oligonucleotide; CAG chr2 60530591 60530610 60530594 -
taaaaaaaaaaagagacgca

SEQ ID NO: 174263 - DNA, 20 bp, Artificial Sequence
  Synthetic oligonucleotide; CAG chr2 60530564 60530583 60530567 -
attttttccctcctctgaac

SEQ ID NO: 174264 - DNA, 20 bp, Artificial Sequence
  Synthetic oligonucleotide; GAG chr2 60530559 60530578 60530562 -
ttccctcctctgaaccagtt

SEQ ID NO: 174265 - DNA, 20 bp, Artificial Sequence
  Synthetic oligonucleotide; AGG chr2 60530558 60530577 60530561 -
tccctcctctgaaccagttg

SEQ ID NO: 174266 - DNA, 20 bp, Artificial Sequence
  Synthetic oligonucleotide; CAG chr2 60530554 60530573 60530557 -
tcctctgaaccagttgaggc

SEQ ID NO: 174267 - DNA, 20 bp, Artificial Sequence
  Synthetic oligonucleotide; TGG chr2 60530546 60530565 60530549 -
accagttgaggccagtcttt

SEQ ID NO: 174268 - DNA, 20 bp, Artificial Sequence
  Synthetic oligonucleotide; CGG chr2 60530534 60530553 60530537 -
cagtcttttggctacatatg

SEQ ID NO: 174269 - DNA, 20 bp, Artificial Sequence
  Synthetic oligonucleotide; GGG chr2 60530533 60530552 60530536 -
agtcttttggctacatatgc

SEQ ID NO: 174270 - DNA, 20 bp, Artificial Sequence
  Synthetic oligonucleotide; TGG chr2 60530515 60530534 60530518 -
gcgggttctatcatctttcc

SEQ ID NO: 174271 - DNA, 20 bp, Artificial Sequence
  Synthetic oligonucleotide; TGG chr2 60530504 60530523 60530507 -
catctttcctggcttgccgt

SEQ ID NO: 174272 - DNA, 20 bp, Artificial Sequence
  Synthetic oligonucleotide; GGG chr2 60530503 60530522 60530506 -
atctttcctggcttgccgtt

SEQ ID NO: 174273 - DNA, 20 bp, Artificial Sequence
  Synthetic oligonucleotide; AAG chr2 60530495 60530514 60530498 -
tggcttgccgttgggaaaaa

SEQ ID NO: 174274 - DNA, 20 bp, Artificial Sequence
  Synthetic oligonucleotide; CAG chr2 60530480 60530499 60530483 -
aaaaaaagttgtgataacgc

SEQ ID NO: 174275 - DNA, 20 bp, Artificial Sequence
  Synthetic oligonucleotide; GAG chr2 60530471 60530490 60530474 -
tgtgataacgccagtaaccc

SEQ ID NO: 174276 - DNA, 20 bp, Artificial Sequence
  Synthetic oligonucleotide; AGG chr2 60530470 60530489 60530473 -
gtgataacgccagtaacccg

SEQ ID NO: 174277 - DNA, 20 bp, Artificial Sequence
  Synthetic oligonucleotide; GGG chr2 60530469 60530488 60530472 -
tgataacgccagtaacccga

SEQ ID NO: 174278 - DNA, 20 bp, Artificial Sequence
  Synthetic oligonucleotide; CAG chr2 60530465 60530484 60530468 -
aacgccagtaacccgagggc

SEQ ID NO: 174279 - DNA, 20 bp, Artificial Sequence
  Synthetic oligonucleotide; TGG chr2 60530461 60530480 60530464 -
ccagtaacccgagggccaga

SEQ ID NO: 174280 - DNA, 20 bp, Artificial Sequence
  Synthetic oligonucleotide; GGG chr2 60530460 60530479 60530463 -
cagtaacccgagggccagat

SEQ ID NO: 174281 - DNA, 20 bp, Artificial Sequence
  Synthetic oligonucleotide; AAG chr2 60530457 60530476 60530460 -
taacccgagggccagatggg

SEQ ID NO: 174282 - DNA, 20 bp, Artificial Sequence
  Synthetic oligonucleotide; AGG chr2 60530456 60530475 60530459 -
aacccgagggccagatggga

SEQ ID NO: 174283 - DNA, 20 bp, Artificial Sequence
  Synthetic oligonucleotide; GGG chr2 60530455 60530474 60530458 -
acccgagggccagatgggaa

SEQ ID NO: 174284 - DNA, 20 bp, Artificial Sequence
  Synthetic oligonucleotide; TGG chr2 60530450 60530469 60530453 -
agggccagatgggaagggtt

SEQ ID NO: 174285 - DNA, 20 bp, Artificial Sequence
  Synthetic oligonucleotide; CAG chr2 60530440 60530459 60530443 -
gggaagggtttggttgtgtt

SEQ ID NO: 174286 - DNA, 20 bp, Artificial Sequence
  Synthetic oligonucleotide; AGG chr2 60530439 60530458 60530442 -
ggaagggtttggttgtgttc

SEQ ID NO: 174287 - DNA, 20 bp, Artificial Sequence
  Synthetic oligonucleotide; CAG chr2 60530432 60530451 60530435 -
tttggttgtgttcaggcgac

SEQ ID NO: 174288 - DNA, 20 bp, Artificial Sequence
  Synthetic oligonucleotide; AGG chr2 60530431 60530450 60530434 -
ttggttgtgttcaggcgacc

SEQ ID NO: 174289 - DNA, 20 bp, Artificial Sequence
  Synthetic oligonucleotide; GAG chr2 60530425 60530444 60530428 -
gtgttcaggcgaccaggtgt

SEQ ID NO: 174290 - DNA, 20 bp, Artificial Sequence
  Synthetic oligonucleotide; GAG chr2 60530423 60530442 60530426 -
gttcaggcgaccaggtgtga

SEQ ID NO: 174291 - DNA, 20 bp, Artificial Sequence
  Synthetic oligonucleotide; TGG chr2 60530416 60530435 60530419 -
cgaccaggtgtgagagctcg

SEQ ID NO: 174292 - DNA, 20 bp, Artificial Sequence
  Synthetic oligonucleotide; CAG chr2 60530411 60530430 60530414 -
aggtgtgagagctcgtggtg

SEQ ID NO: 174293 - DNA, 20 bp, Artificial Sequence
  Synthetic oligonucleotide; TGG chr2 60530408 60530427 60530411 -
tgtgagagctcgtggtgcag

SEQ ID NO: 174294 - DNA, 20 bp, Artificial Sequence
  Synthetic oligonucleotide; GGG chr2 60530407 60530426 60530410 -
gtgagagctcgtggtgcagt

SEQ ID NO: 174295 - DNA, 20 bp, Artificial Sequence
  Synthetic oligonucleotide; GGG chr2 60530406 60530425 60530409 -
tgagagctcgtggtgcagtg

SEQ ID NO: 174296 - DNA, 20 bp, Artificial Sequence
  Synthetic oligonucleotide; TGG chr2 60530403 60530422 60530406 -
gagctcgtggtgcagtgggg

SEQ ID NO: 174297 - DNA, 20 bp, Artificial Sequence
  Synthetic oligonucleotide; GGG chr2 60530402 60530421 60530405 -
agctcgtggtgcagtggggt

SEQ ID NO: 174298 - DNA, 20 bp, Artificial Sequence
  Synthetic oligonucleotide; GGG chr2 60530401 60530420 60530404 -
gctcgtggtgcagtggggtg

SEQ ID NO: 174299 - DNA, 20 bp, Artificial Sequence
  Synthetic oligonucleotide; TGG chr2 60530396 60530415 60530399 -
tggtgcagtggggtggggcg

SEQ ID NO: 174300 - DNA, 20 bp, Artificial Sequence
  Synthetic oligonucleotide; CGG chr2 60530392 60530411 60530395 -
gcagtggggtggggcgtggc

SEQ ID NO: 174301 - DNA, 20 bp, Artificial Sequence
  Synthetic oligonucleotide; CAG chr2 60530375 60530394 60530378 -
ggccggcgtgcctgcgtgtg

SEQ ID NO: 174302 - DNA, 20 bp, Artificial Sequence
  Synthetic oligonucleotide; AGG chr2 60530374 60530393 60530377 -
gccggcgtgcctgcgtgtgc

SEQ ID NO: 174303 - DNA, 20 bp, Artificial Sequence
  Synthetic oligonucleotide; AAG chr2 60530370 60530389 60530373 -
gcgtgcctgcgtgtgcaggt

SEQ ID NO: 174304 - DNA, 20 bp, Artificial Sequence
  Synthetic oligonucleotide; CAG chr2 60530363 60530382 60530366 -
tgcgtgtgcaggtaagaaat

SEQ ID NO: 174305 - DNA, 20 bp, Artificial Sequence
  Synthetic oligonucleotide; TGG chr2 60530360 60530379 60530363 -
gtgtgcaggtaagaaatcag

SEQ ID NO: 174306 - DNA, 20 bp, Artificial Sequence
  Synthetic oligonucleotide; TGG chr2 60530330 60530349 60530333 -
tttttttttttttttttaaa

SEQ ID NO: 174307 - DNA, 20 bp, Artificial Sequence
  Synthetic oligonucleotide; AAG chr2 60530324 60530343 60530327 -
tttttttttttaaatggctg

SEQ ID NO: 174308 - DNA, 20 bp, Artificial Sequence
  Synthetic oligonucleotide; TGG chr2 60530311 60530330 60530314 -
atggctgaagtttaacttgt

SEQ ID NO: 174309 - DNA, 20 bp, Artificial Sequence
  Synthetic oligonucleotide; AAG chr2 60530308 60530327 60530311 -
gctgaagtttaacttgttgg

SEQ ID NO: 174310 - DNA, 20 bp, Artificial Sequence
  Synthetic oligonucleotide; AGG chr2 60530307 60530326 60530310 -
ctgaagtttaacttgttgga

SEQ ID NO: 174311 - DNA, 20 bp, Artificial Sequence
  Synthetic oligonucleotide; GGG chr2 60530306 60530325 60530309 -
tgaagtttaacttgttggaa

SEQ ID NO: 174312 - DNA, 20 bp, Artificial Sequence
  Synthetic oligonucleotide; AAG chr2 60530293 60530312 60530296 -
gttggaagggcctgtgaatt

SEQ ID NO: 174313 - DNA, 20 bp, Artificial Sequence
  Synthetic oligonucleotide; CGG chr2 60530286 60530305 60530289 -
gggcctgtgaattaagctgt

SEQ ID NO: 174314 - DNA, 20 bp, Artificial Sequence
  Synthetic oligonucleotide; TGG chr2 60530283 60530302 60530286 -
cctgtgaattaagctgtcgg

SEQ ID NO: 174315 - DNA, 20 bp, Artificial Sequence
  Synthetic oligonucleotide; GAG chr2 60530278 60530297 60530281 -
gaattaagctgtcggtggct

SEQ ID NO: 174316 - DNA, 20 bp, Artificial Sequence
  Synthetic oligonucleotide; AAG chr2 60530262 60530281 60530265 -
ggctgagaacgataatatgc

SEQ ID NO: 174317 - DNA, 20 bp, Artificial Sequence
  Synthetic oligonucleotide; AGG chr2 60530261 60530280 60530264 -
gctgagaacgataatatgca

SEQ ID NO: 174318 - DNA, 20 bp, Artificial Sequence
  Synthetic oligonucleotide; AAG chr2 60530258 60530277 60530261 -
gagaacgataatatgcaagg

SEQ ID NO: 174319 - DNA, 20 bp, Artificial Sequence
  Synthetic oligonucleotide; AGG chr2 60530257 60530276 60530260 -
agaacgataatatgcaagga

SEQ ID NO: 174320 - DNA, 20 bp, Artificial Sequence
  Synthetic oligonucleotide; AAG chr2 60530251 60530270 60530254 -
ataatatgcaaggaaggctc

SEQ ID NO: 174321 - DNA, 20 bp, Artificial Sequence
  Synthetic oligonucleotide; AGG chr2 60530250 60530269 60530253 -
taatatgcaaggaaggctca

SEQ ID NO: 174322 - DNA, 20 bp, Artificial Sequence
  Synthetic oligonucleotide; AAG chr2 60530247 60530266 60530250 -
tatgcaaggaaggctcaagg

SEQ ID NO: 174323 - DNA, 20 bp, Artificial Sequence
  Synthetic oligonucleotide; AGG chr2 60530246 60530265 60530249 -
atgcaaggaaggctcaagga

SEQ ID NO: 174324 - DNA, 20 bp, Artificial Sequence
  Synthetic oligonucleotide; AAG chr2 60530240 60530259 60530243 -
ggaaggctcaaggaaggctc

SEQ ID NO: 174325 - DNA, 20 bp, Artificial Sequence
  Synthetic oligonucleotide; AAG chr2 60530236 60530255 60530239 -
ggctcaaggaaggctcaaga

SEQ ID NO: 174326 - DNA, 20 bp, Artificial Sequence
  Synthetic oligonucleotide; AGG chr2 60530235 60530254 60530238 -
gctcaaggaaggctcaagaa

SEQ ID NO: 174327 - DNA, 20 bp, Artificial Sequence
  Synthetic oligonucleotide; CAG chr2 60530231 60530250 60530234 -
aaggaaggctcaagaaaggc

SEQ ID NO: 174328 - DNA, 20 bp, Artificial Sequence
  Synthetic oligonucleotide; AGG chr2 60530230 60530249 60530233 -
aggaaggctcaagaaaggcc

SEQ ID NO: 174329 - DNA, 20 bp, Artificial Sequence
  Synthetic oligonucleotide; GGG chr2 60530229 60530248 60530232 -
ggaaggctcaagaaaggcca

SEQ ID NO: 174330 - DNA, 20 bp, Artificial Sequence
  Synthetic oligonucleotide; GGG chr2 60530228 60530247 60530231 -
gaaggctcaagaaaggccag

SEQ ID NO: 174331 - DNA, 20 bp, Artificial Sequence
  Synthetic oligonucleotide; TGG chr2 60530225 60530244 60530228 -
ggctcaagaaaggccagggg

SEQ ID NO: 174332 - DNA, 20 bp, Artificial Sequence
  Synthetic oligonucleotide; GGG chr2 60530224 60530243 60530227 -
gctcaagaaaggccaggggt

SEQ ID NO: 174333 - DNA, 20 bp, Artificial Sequence
  Synthetic oligonucleotide; GGG chr2 60530223 60530242 60530226 -
ctcaagaaaggccaggggtg

SEQ ID NO: 174334 - DNA, 20 bp, Artificial Sequence
  Synthetic oligonucleotide; AAG chr2 60530218 60530237 60530221 -
gaaaggccaggggtggggaa

SEQ ID NO: 174335 - DNA, 20 bp, Artificial Sequence
  Synthetic oligonucleotide; AGG chr2 60530217 60530236 60530220 -
aaaggccaggggtggggaaa

SEQ ID NO: 174336 - DNA, 20 bp, Artificial Sequence
  Synthetic oligonucleotide; TAG chr2 60530205 60530224 60530208 -
tggggaaaaggtgctcttgt

SEQ ID NO: 174337 - DNA, 20 bp, Artificial Sequence
  Synthetic oligonucleotide; GAG chr2 60530203 60530222 60530206 -
gggaaaaggtgctcttgtta

SEQ ID NO: 174338 - DNA, 20 bp, Artificial Sequence
  Synthetic oligonucleotide; AGG chr2 60530202 60530221 60530205 -
ggaaaaggtgctcttgttag

SEQ ID NO: 174339 - DNA, 20 bp, Artificial Sequence
  Synthetic oligonucleotide; CAG chr2 60530197 60530216 60530200 -
aggtgctcttgttagaggcg

SEQ ID NO: 174340 - DNA, 20 bp, Artificial Sequence
  Synthetic oligonucleotide; TGG chr2 60530187 60530206 60530190 -
gttagaggcgcagcctttcc

SEQ ID NO: 174341 - DNA, 20 bp, Artificial Sequence
  Synthetic oligonucleotide; GGG chr2 60530186 60530205 60530189 -
ttagaggcgcagcctttcct

SEQ ID NO: 174342 - DNA, 20 bp, Artificial Sequence
  Synthetic oligonucleotide; CAG chr2 60530183 60530202 60530186 -
gaggcgcagcctttcctggg

SEQ ID NO: 174343 - DNA, 20 bp, Artificial Sequence
  Synthetic oligonucleotide; AGG chr2 60530182 60530201 60530185 -
aggcgcagcctttcctgggc

SEQ ID NO: 174344 - DNA, 20 bp, Artificial Sequence
  Synthetic oligonucleotide; CAG chr2 60530176 60530195 60530179 -
agcctttcctgggcaggacc

SEQ ID NO: 174345 - DNA, 20 bp, Artificial Sequence
  Synthetic oligonucleotide; AGG chr2 60530175 60530194 60530178 -
gcctttcctgggcaggaccc

SEQ ID NO: 174346 - DNA, 20 bp, Artificial Sequence
  Synthetic oligonucleotide; TGG chr2 60530167 60530186 60530170 -
tgggcaggacccaggaccga

SEQ ID NO: 174347 - DNA, 20 bp, Artificial Sequence
  Synthetic oligonucleotide; TGG chr2 60530150 60530169 60530153 -
cgatggcaaacccatgtgtt

SEQ ID NO: 174348 - DNA, 20 bp, Artificial Sequence
  Synthetic oligonucleotide; GGG chr2 60530149 60530168 60530152 -
gatggcaaacccatgtgttt

SEQ ID NO: 174349 - DNA, 20 bp, Artificial Sequence
  Synthetic oligonucleotide; TGG chr2 60530116 60530135 60530119 -
tctcgattttcttatcttct

SEQ ID NO: 174350 - DNA, 20 bp, Artificial Sequence
  Synthetic oligonucleotide; TAG chr2 60530096 60530115 60530099 -
tggcctcttcctgtgttttt

SEQ ID NO: 174351 - DNA, 20 bp, Artificial Sequence
  Synthetic oligonucleotide; TGG chr2 60530059 60530078 60530062 -
atgcattcatatatgaatgt

SEQ ID NO: 174352 - DNA, 20 bp, Artificial Sequence
  Synthetic oligonucleotide; AAG chr2 60530055 60530074 60530058 -
attcatatatgaatgttggc

SEQ ID NO: 174353 - DNA, 20 bp, Artificial Sequence
  Synthetic oligonucleotide; CAG chr2 60530052 60530071 60530055 -
catatatgaatgttggcaag

SEQ ID NO: 174354 - DNA, 20 bp, Artificial Sequence
  Synthetic oligonucleotide; AGG chr2 60530051 60530070 60530054 -
atatatgaatgttggcaagc

SEQ ID NO: 174355 - DNA, 20 bp, Artificial Sequence
  Synthetic oligonucleotide; GAG chr2 60530049 60530068 60530052 -
atatgaatgttggcaagcag

SEQ ID NO: 174356 - DNA, 20 bp, Artificial Sequence
  Synthetic oligonucleotide; TAG chr2 60530017 60530036 60530020 -
caataacttcctgacatttt

SEQ ID NO: 174357 - DNA, 20 bp, Artificial Sequence
  Synthetic oligonucleotide; CAG chr2 60530001 60530020 60530004 -
tttttagctcttttaatgtg

SEQ ID NO: 174358 - DNA, 20 bp, Artificial Sequence
  Synthetic oligonucleotide; AAG chr2 60529980 60529999 60529983 -
agtctttgccctcctgccac

SEQ ID NO: 174359 - DNA, 20 bp, Artificial Sequence
  Synthetic oligonucleotide; TGG chr2 60529977 60529996 60529980 -
ctttgccctcctgccacaag

SEQ ID NO: 174360 - DNA, 20 bp, Artificial Sequence
  Synthetic oligonucleotide; AAG chr2 60529972 60529991 60529975 -
ccctcctgccacaagtggcg

SEQ ID NO: 174361 - DNA, 20 bp, Artificial Sequence
  Synthetic oligonucleotide; TGG chr2 60529945 60529964 60529948 -
tgaatttccctgttactaac

SEQ ID NO: 174362 - DNA, 20 bp, Artificial Sequence
  Synthetic oligonucleotide; CAG chr2 60529942 60529961 60529945 -
atttccctgttactaactgg

SEQ ID NO: 174363 - DNA, 20 bp, Artificial Sequence
  Synthetic oligonucleotide; AGG chr2 60529941 60529960 60529944 -
tttccctgttactaactggc

SEQ ID NO: 174364 - DNA, 20 bp, Artificial Sequence
  Synthetic oligonucleotide; GAG chr2 60529939 60529958 60529942 -
tccctgttactaactggcag

SEQ ID NO: 174365 - DNA, 20 bp, Artificial Sequence
  Synthetic oligonucleotide; AGG chr2 60529938 60529957 60529941 -
ccctgttactaactggcagg

SEQ ID NO: 174366 - DNA, 20 bp, Artificial Sequence
  Synthetic oligonucleotide; TAG chr2 60529928 60529947 60529931 -
aactggcaggaggcatgttc

SEQ ID NO: 174367 - DNA, 20 bp, Artificial Sequence
  Synthetic oligonucleotide; CAG chr2 60529918 60529937 60529921 -
aggcatgttctagttcccac

SEQ ID NO: 174368 - DNA, 20 bp, Artificial Sequence
  Synthetic oligonucleotide; GAG chr2 60529916 60529935 60529919 -
gcatgttctagttcccacca

SEQ ID NO: 174369 - DNA, 20 bp, Artificial Sequence
  Synthetic oligonucleotide; AGG chr2 60529915 60529934 60529918 -
catgttctagttcccaccag

SEQ ID NO: 174370 - DNA, 20 bp, Artificial Sequence
  Synthetic oligonucleotide; GAG chr2 60529913 60529932 60529916 -
tgttctagttcccaccagag

SEQ ID NO: 174371 - DNA, 20 bp, Artificial Sequence
  Synthetic oligonucleotide; TGG chr2 60529906 60529925 60529909 -
gttcccaccagaggagctgc

SEQ ID NO: 174372 - DNA, 20 bp, Artificial Sequence
  Synthetic oligonucleotide; GGG chr2 60529905 60529924 60529908 -
ttcccaccagaggagctgct

SEQ ID NO: 174373 - DNA, 20 bp, Artificial Sequence
  Synthetic oligonucleotide; GGG chr2 60529904 60529923 60529907 -
tcccaccagaggagctgctg

SEQ ID NO: 174374 - DNA, 20 bp, Artificial Sequence
  Synthetic oligonucleotide; AAG chr2 60529898 60529917 60529901 -
cagaggagctgctggggcta

SEQ ID NO: 174375 - DNA, 20 bp, Artificial Sequence
  Synthetic oligonucleotide; TGG chr2 60529894 60529913 60529897 -
ggagctgctggggctaaagc

SEQ ID NO: 174376 - DNA, 20 bp, Artificial Sequence
  Synthetic oligonucleotide; GGG chr2 60529893 60529912 60529896 -
gagctgctggggctaaagct

SEQ ID NO: 174377 - DNA, 20 bp, Artificial Sequence
  Synthetic oligonucleotide; TAG chr2 60529886 60529905 60529889 -
tggggctaaagctgggttca

SEQ ID NO: 174378 - DNA, 20 bp, Artificial Sequence
  Synthetic oligonucleotide; TAG chr2 60529874 60529893 60529877 -
tgggttcatagaatcccacc

SEQ ID NO: 174379 - DNA, 20 bp, Artificial Sequence
  Synthetic oligonucleotide; AGG chr2 60529873 60529892 60529876 -
gggttcatagaatcccacct

SEQ ID NO: 174380 - DNA, 20 bp, Artificial Sequence
  Synthetic oligonucleotide; GGG chr2 60529872 60529891 60529875 -
ggttcatagaatcccaccta

SEQ ID NO: 174381 - DNA, 20 bp, Artificial Sequence
  Synthetic oligonucleotide; GGG chr2 60529871 60529890 60529874 -
gttcatagaatcccacctag

SEQ ID NO: 174382 - DNA, 20 bp, Artificial Sequence
  Synthetic oligonucleotide; CAG chr2 60529864 60529883 60529867 -
gaatcccacctaggggacac

SEQ ID NO: 174383 - DNA, 20 bp, Artificial Sequence
  Synthetic oligonucleotide; AGG chr2 60529863 60529882 60529866 -
aatcccacctaggggacacc

SEQ ID NO: 174384 - DNA, 20 bp, Artificial Sequence
  Synthetic oligonucleotide; GGG chr2 60529862 60529881 60529865 -
atcccacctaggggacacca

SEQ ID NO: 174385 - DNA, 20 bp, Artificial Sequence
  Synthetic oligonucleotide; AAG chr2 60529854 60529873 60529857 -
taggggacaccagggctttc

SEQ ID NO: 174386 - DNA, 20 bp, Artificial Sequence
  Synthetic oligonucleotide; TGG chr2 60529851 60529870 60529854 -
gggacaccagggctttcaag

SEQ ID NO: 174387 - DNA, 20 bp, Artificial Sequence
  Synthetic oligonucleotide; TGG chr2 60529846 60529865 60529849 -
accagggctttcaagtggtt

SEQ ID NO: 174388 - DNA, 20 bp, Artificial Sequence
  Synthetic oligonucleotide; GGG chr2 60529845 60529864 60529848 -
ccagggctttcaagtggttt

SEQ ID NO: 174389 - DNA, 20 bp, Artificial Sequence
  Synthetic oligonucleotide; GGG chr2 60529844 60529863 60529847 -
cagggctttcaagtggtttg

SEQ ID NO: 174390 - DNA, 20 bp, Artificial Sequence
  Synthetic oligonucleotide; TAG chr2 60529794 60529813 60529797 -
aaaaaatatttttcccatca

SEQ ID NO: 174391 - DNA, 20 bp, Artificial Sequence
  Synthetic oligonucleotide; AAG chr2 60529784 60529803 60529787 -
tttcccatcatagacttgaa

SEQ ID NO: 174392 - DNA, 20 bp, Artificial Sequence
  Synthetic oligonucleotide; AGG chr2 60529783 60529802 60529786 -
ttcccatcatagacttgaaa

SEQ ID NO: 174393 - DNA, 20 bp, Artificial Sequence
  Synthetic oligonucleotide; TGG chr2 60529729 60529748 60529732 -
aaaatcacatttacttcccc

SEQ ID NO: 174394 - DNA, 20 bp, Artificial Sequence
  Synthetic oligonucleotide; TAG chr2 60529725 60529744 60529728 -
tcacatttacttcccctggc

SEQ ID NO: 174395 - DNA, 20 bp, Artificial Sequence
  Synthetic oligonucleotide; AGG chr2 60529724 60529743 60529727 -
cacatttacttcccctggct

SEQ ID NO: 174396 - DNA, 20 bp, Artificial Sequence
  Synthetic oligonucleotide; AAG chr2 60529715 60529734 60529718 -
ttcccctggctaggcctcat

SEQ ID NO: 174397 - DNA, 20 bp, Artificial Sequence
  Synthetic oligonucleotide; AGG chr2 60529714 60529733 60529717 -
tcccctggctaggcctcata

SEQ ID NO: 174398 - DNA, 20 bp, Artificial Sequence
  Synthetic oligonucleotide; GGG chr2 60529713 60529732 60529716 -
cccctggctaggcctcataa

SEQ ID NO: 174399 - DNA, 20 bp, Artificial Sequence
  Synthetic oligonucleotide; GAG chr2 60529711 60529730 60529714 -
cctggctaggcctcataagg

SEQ ID NO: 174400 - DNA, 20 bp, Artificial Sequence
  Synthetic oligonucleotide; AGG chr2 60529710 60529729 60529713 -
ctggctaggcctcataaggg

SEQ ID NO: 174401 - DNA, 20 bp, Artificial Sequence
  Synthetic oligonucleotide; CAG chr2 60529707 60529726 60529710 -
gctaggcctcataagggagg

SEQ ID NO: 174402 - DNA, 20 bp, Artificial Sequence
  Synthetic oligonucleotide; AGG chr2 60529706 60529725 60529709 -
ctaggcctcataagggaggc

SEQ ID NO: 174403 - DNA, 20 bp, Artificial Sequence
  Synthetic oligonucleotide; TAG chr2 60529686 60529705 60529689 -
aggatttccttctccttttc

SEQ ID NO: 174404 - DNA, 20 bp, Artificial Sequence
  Synthetic oligonucleotide; TAG chr2 60529683 60529702 60529686 -
atttccttctccttttctag

SEQ ID NO: 174405 - DNA, 20 bp, Artificial Sequence
  Synthetic oligonucleotide; TGG chr2 60529669 60529688 60529672 -
ttctagtagcaaataaaaac

SEQ ID NO: 174406 - DNA, 20 bp, Artificial Sequence
  Synthetic oligonucleotide; GGG chr2 60529668 60529687 60529671 -
tctagtagcaaataaaaact

SEQ ID NO: 174407 - DNA, 20 bp, Artificial Sequence
  Synthetic oligonucleotide; TGG chr2 60529659 60529678 60529662 -
aaataaaaactgggaaaatt

SEQ ID NO: 174408 - DNA, 20 bp, Artificial Sequence
  Synthetic oligonucleotide; GGG chr2 60529658 60529677 60529661 -
aataaaaactgggaaaattt

SEQ ID NO: 174409 - DNA, 20 bp, Artificial Sequence
  Synthetic oligonucleotide; GGG chr2 60529657 60529676 60529660 -
ataaaaactgggaaaatttg

SEQ ID NO: 174410 - DNA, 20 bp, Artificial Sequence
  Synthetic oligonucleotide; GGG chr2 60529656 60529675 60529659 -
taaaaactgggaaaatttgg

SEQ ID NO: 174411 - DNA, 20 bp, Artificial Sequence
  Synthetic oligonucleotide; TGG chr2 60529649 60529668 60529652 -
tgggaaaatttgggggcctc

SEQ ID NO: 174412 - DNA, 20 bp, Artificial Sequence
  Synthetic oligonucleotide; GGG chr2 60529648 60529667 60529651 -
gggaaaatttgggggcctct

SEQ ID NO: 174413 - DNA, 20 bp, Artificial Sequence
  Synthetic oligonucleotide; TGG chr2 60529636 60529655 60529639 -
gggcctctgggtttatccca

SEQ ID NO: 174414 - DNA, 20 bp, Artificial Sequence
  Synthetic oligonucleotide; CAG chr2 60529604 60529623 60529607 -
cccgctcccgcccgccaact

SEQ ID NO: 174415 - DNA, 20 bp, Artificial Sequence
  Synthetic oligonucleotide; AAG chr2 60529599 60529618 60529602 -
tcccgcccgccaactcagcc

SEQ ID NO: 174416 - DNA, 20 bp, Artificial Sequence
  Synthetic oligonucleotide; TAG chr2 60529592 60529611 60529595 -
cgccaactcagccaagccct

SEQ ID NO: 174417 - DNA, 20 bp, Artificial Sequence
  Synthetic oligonucleotide; GAG chr2 60529590 60529609 60529593 -
ccaactcagccaagccctta

SEQ ID NO: 174418 - DNA, 20 bp, Artificial Sequence
  Synthetic oligonucleotide; AGG chr2 60529589 60529608 60529592 -
caactcagccaagcccttag

SEQ ID NO: 174419 - DNA, 20 bp, Artificial Sequence
  Synthetic oligonucleotide; CAG chr2 60529586 60529605 60529589 -
ctcagccaagcccttagagg

SEQ ID NO: 174420 - DNA, 20 bp, Artificial Sequence
  Synthetic oligonucleotide; TAG chr2 60529569 60529588 60529572 -
aggcagtcttctctcccacc

SEQ ID NO: 174421 - DNA, 20 bp, Artificial Sequence
  Synthetic oligonucleotide; GAG chr2 60529551 60529570 60529554 -
cctagatgtctttgtaacct

SEQ ID NO: 174422 - DNA, 20 bp, Artificial Sequence
  Synthetic oligonucleotide; TGG chr2 60529547 60529566 60529550 -
gatgtctttgtaacctgagc

SEQ ID NO: 174423 - DNA, 20 bp, Artificial Sequence
  Synthetic oligonucleotide; AAG chr2 60529543 60529562 60529546 -
tctttgtaacctgagctggt

SEQ ID NO: 174424 - DNA, 20 bp, Artificial Sequence
  Synthetic oligonucleotide; AAG chr2 60529539 60529558 60529542 -
tgtaacctgagctggtaaga

SEQ ID NO: 174425 - DNA, 20 bp, Artificial Sequence
  Synthetic oligonucleotide; AGG chr2 60529538 60529557 60529541 -
gtaacctgagctggtaagaa

SEQ ID NO: 174426 - DNA, 20 bp, Artificial Sequence
  Synthetic oligonucleotide; GGG chr2 60529537 60529556 60529540 -
taacctgagctggtaagaaa

SEQ ID NO: 174427 - DNA, 20 bp, Artificial Sequence
  Synthetic oligonucleotide; GAG chr2 60529535 60529554 60529538 -
acctgagctggtaagaaagg

SEQ ID NO: 174428 - DNA, 20 bp, Artificial Sequence
  Synthetic oligonucleotide; AGG chr2 60529534 60529553 60529537 -
cctgagctggtaagaaaggg

SEQ ID NO: 174429 - DNA, 20 bp, Artificial Sequence
  Synthetic oligonucleotide; GAG chr2 60529532 60529551 60529535 -
tgagctggtaagaaagggag

SEQ ID NO: 174430 - DNA, 20 bp, Artificial Sequence
  Synthetic oligonucleotide; AGG chr2 60529531 60529550 60529534 -
gagctggtaagaaagggagg

SEQ ID NO: 174431 - DNA, 20 bp, Artificial Sequence
  Synthetic oligonucleotide; GGG chr2 60529530 60529549 60529533 -
agctggtaagaaagggagga

SEQ ID NO: 174432 - DNA, 20 bp, Artificial Sequence
  Synthetic oligonucleotide; CAG chr2 60529526 60529545 60529529 -
ggtaagaaagggaggaggga

SEQ ID NO: 174433 - DNA, 20 bp, Artificial Sequence
  Synthetic oligonucleotide; AAG chr2 60529522 60529541 60529525 -
agaaagggaggagggacaga

SEQ ID NO: 174434 - DNA, 20 bp, Artificial Sequence
  Synthetic oligonucleotide; GAG chr2 60529520 60529539 60529523 -
aaagggaggagggacagaaa

SEQ ID NO: 174435 - DNA, 20 bp, Artificial Sequence
  Synthetic oligonucleotide; AGG chr2 60529519 60529538 60529522 -
aagggaggagggacagaaag

SEQ ID NO: 174436 - DNA, 20 bp, Artificial Sequence
  Synthetic oligonucleotide; GGG chr2 60529518 60529537 60529521 -
agggaggagggacagaaaga

SEQ ID NO: 174437 - DNA, 20 bp, Artificial Sequence
  Synthetic oligonucleotide; GGG chr2 60529517 60529536 60529520 -
gggaggagggacagaaagag

SEQ ID NO: 174438 - DNA, 20 bp, Artificial Sequence
  Synthetic oligonucleotide; TGG chr2 60529447 60529466 60529450 -
tttgattacacgaaataaaa

SEQ ID NO: 174439 - DNA, 20 bp, Artificial Sequence
  Synthetic oligonucleotide; TAG chr2 60529442 60529461 60529445 -
ttacacgaaataaaatggtt

SEQ ID NO: 174440 - DNA, 20 bp, Artificial Sequence
  Synthetic oligonucleotide; AGG chr2 60529441 60529460 60529444 -
tacacgaaataaaatggttt

SEQ ID NO: 174441 - DNA, 20 bp, Artificial Sequence
  Synthetic oligonucleotide; GAG chr2 60529436 60529455 60529439 -
gaaataaaatggtttaggct

SEQ ID NO: 174442 - DNA, 20 bp, Artificial Sequence
  Synthetic oligonucleotide; AGG chr2 60529435 60529454 60529438 -
aaataaaatggtttaggctg

SEQ ID NO: 174443 - DNA, 20 bp, Artificial Sequence
  Synthetic oligonucleotide; GGG chr2 60529434 60529453 60529437 -
aataaaatggtttaggctga

SEQ ID NO: 174444 - DNA, 20 bp, Artificial Sequence
  Synthetic oligonucleotide; AAG chr2 60529429 60529448 60529432 -
aatggtttaggctgagggta

SEQ ID NO: 174445 - DNA, 20 bp, Artificial Sequence
  Synthetic oligonucleotide; AAG chr2 60529426 60529445 60529429 -
ggtttaggctgagggtaaag

SEQ ID NO: 174446 - DNA, 20 bp, Artificial Sequence
  Synthetic oligonucleotide; TAG chr2 60529411 60529430 60529414 -
taaagaagtaataccatttc

SEQ ID NO: 174447 - DNA, 20 bp, Artificial Sequence
  Synthetic oligonucleotide; TGG chr2 60529397 60529416 60529400 -
catttctagttgtgcaacct

SEQ ID NO: 174448 - DNA, 20 bp, Artificial Sequence
  Synthetic oligonucleotide; GGG chr2 60529396 60529415 60529399 -
atttctagttgtgcaacctt

SEQ ID NO: 174449 - DNA, 20 bp, Artificial Sequence
  Synthetic oligonucleotide; CAG chr2 60529393 60529412 60529396 -
tctagttgtgcaaccttggg

SEQ ID NO: 174450 - DNA, 20 bp, Artificial Sequence
  Synthetic oligonucleotide; AAG chr2 60529378 60529397 60529381 -
ttgggcagatttcattccct

SEQ ID NO: 174451 - DNA, 20 bp, Artificial Sequence
  Synthetic oligonucleotide; AAG chr2 60529354 60529373 60529357 -
ctccgcttcctcaatctgta

SEQ ID NO: 174452 - DNA, 20 bp, Artificial Sequence
  Synthetic oligonucleotide; TGG chr2 60529351 60529370 60529354 -
cgcttcctcaatctgtaaag

SEQ ID NO: 174453 - DNA, 20 bp, Artificial Sequence
  Synthetic oligonucleotide; GGG chr2 60529350 60529369 60529353 -
gcttcctcaatctgtaaagt

SEQ ID NO: 174454 - DNA, 20 bp, Artificial Sequence
  Synthetic oligonucleotide; GGG chr2 60529349 60529368 60529352 -
cttcctcaatctgtaaagtg

SEQ ID NO: 174455 - DNA, 20 bp, Artificial Sequence
  Synthetic oligonucleotide; GAG chr2 60529347 60529366 60529350 -
tcctcaatctgtaaagtggg

SEQ ID NO: 174456 - DNA, 20 bp, Artificial Sequence
  Synthetic oligonucleotide; CGG chr2 60529339 60529358 60529342 -
ctgtaaagtggggagaatca

SEQ ID NO: 174457 - DNA, 20 bp, Artificial Sequence
  Synthetic oligonucleotide; GGG chr2 60529338 60529357 60529341 -
tgtaaagtggggagaatcac

SEQ ID NO: 174458 - DNA, 20 bp, Artificial Sequence
  Synthetic oligonucleotide; GGG chr2 60529337 60529356 60529340 -
gtaaagtggggagaatcacg

SEQ ID NO: 174459 - DNA, 20 bp, Artificial Sequence
  Synthetic oligonucleotide; TAG chr2 60529325 60529344 60529328 -
gaatcacggggcttgcctca

SEQ ID NO: 174460 - DNA, 20 bp, Artificial Sequence
  Synthetic oligonucleotide; AGG chr2 60529324 60529343 60529327 -
aatcacggggcttgcctcat

SEQ ID NO: 174461 - DNA, 20 bp, Artificial Sequence
  Synthetic oligonucleotide; GGG chr2 60529323 60529342 60529326 -
atcacggggcttgcctcata

SEQ ID NO: 174462 - DNA, 20 bp, Artificial Sequence
  Synthetic oligonucleotide; GAG chr2 60529315 60529334 60529318 -
gcttgcctcatagggccttt

SEQ ID NO: 174463 - DNA, 20 bp, Artificial Sequence
  Synthetic oligonucleotide; GAG chr2 60529304 60529323 60529307 -
agggcctttgagcatcctat

SEQ ID NO: 174464 - DNA, 20 bp, Artificial Sequence
  Synthetic oligonucleotide; GAG chr2 60529302 60529321 60529305 -
ggcctttgagcatcctatga

SEQ ID NO: 174465 - DNA, 20 bp, Artificial Sequence
  Synthetic oligonucleotide; TGG chr2 60529295 60529314 60529298 -
gagcatcctatgagagcatg

SEQ ID NO: 174466 - DNA, 20 bp, Artificial Sequence
  Synthetic oligonucleotide; GGG chr2 60529294 60529313 60529297 -
agcatcctatgagagcatgt

SEQ ID NO: 174467 - DNA, 20 bp, Artificial Sequence
  Synthetic oligonucleotide; GGG chr2 60529293 60529312 60529296 -
gcatcctatgagagcatgtg

SEQ ID NO: 174468 - DNA, 20 bp, Artificial Sequence
  Synthetic oligonucleotide; GGG chr2 60529292 60529311 60529295 -
catcctatgagagcatgtgg

SEQ ID NO: 174469 - DNA, 20 bp, Artificial Sequence
  Synthetic oligonucleotide; TGG chr2 60529286 60529305 60529289 -
atgagagcatgtgggggcgc

SEQ ID NO: 174470 - DNA, 20 bp, Artificial Sequence
  Synthetic oligonucleotide; GGG chr2 60529285 60529304 60529288 -
tgagagcatgtgggggcgct

SEQ ID NO: 174471 - DNA, 20 bp, Artificial Sequence
  Synthetic oligonucleotide; CAG chr2 60529280 60529299 60529283 -
gcatgtgggggcgctgggct

SEQ ID NO: 174472 - DNA, 20 bp, Artificial Sequence
  Synthetic oligonucleotide; TGG chr2 60529274 60529293 60529277 -
gggggcgctgggctcagtgc

SEQ ID NO: 174473 - DNA, 20 bp, Artificial Sequence
  Synthetic oligonucleotide; GGG chr2 60529273 60529292 60529276 -
ggggcgctgggctcagtgct

SEQ ID NO: 174474 - DNA, 20 bp, Artificial Sequence
  Synthetic oligonucleotide; TGG chr2 60529266 60529285 60529269 -
tgggctcagtgctgggcaca

SEQ ID NO: 174475 - DNA, 20 bp, Artificial Sequence
  Synthetic oligonucleotide; AAG chr2 60529248 60529267 60529251 -
catggtaaaacatgtcacaa

SEQ ID NO: 174476 - DNA, 20 bp, Artificial Sequence
  Synthetic oligonucleotide; CGG chr2 60529232 60529251 60529235 -
acaaaagctcattactatta

SEQ ID NO: 174477 - DNA, 20 bp, Artificial Sequence
  Synthetic oligonucleotide; TGG chr2 60529219 60529238 60529222 -
actattacggttatgactca

SEQ ID NO: 174478 - DNA, 20 bp, Artificial Sequence
  Synthetic oligonucleotide; TGG chr2 60529214 60529233 60529217 -
tacggttatgactcatggct

SEQ ID NO: 174479 - DNA, 20 bp, Artificial Sequence
  Synthetic oligonucleotide; TGG chr2 60529198 60529217 60529201 -
ggcttggaactgtgtgctcc

SEQ ID NO: 174480 - DNA, 20 bp, Artificial Sequence
  Synthetic oligonucleotide; GGG chr2 60529197 60529216 60529200 -
gcttggaactgtgtgctcct

SEQ ID NO: 174481 - DNA, 20 bp, Artificial Sequence
  Synthetic oligonucleotide; GGG chr2 60529196 60529215 60529199 -
cttggaactgtgtgctcctg

SEQ ID NO: 174482 - DNA, 20 bp, Artificial Sequence
  Synthetic oligonucleotide; AAG chr2 60529188 60529207 60529191 -
tgtgtgctcctggggtctca

SEQ ID NO: 174483 - DNA, 20 bp, Artificial Sequence
  Synthetic oligonucleotide; TAG chr2 60529185 60529204 60529188 -
gtgctcctggggtctcaaag

SEQ ID NO: 174484 - DNA, 20 bp, Artificial Sequence
  Synthetic oligonucleotide; TGG chr2 60529171 60529190 60529174 -
tcaaagtagttcccccatta

SEQ ID NO: 174485 - DNA, 20 bp, Artificial Sequence
  Synthetic oligonucleotide; GGG chr2 60529170 60529189 60529173 -
caaagtagttcccccattat

SEQ ID NO: 174486 - DNA, 20 bp, Artificial Sequence
  Synthetic oligonucleotide; GGG chr2 60529169 60529188 60529172 -
aaagtagttcccccattatg

SEQ ID NO: 174487 - DNA, 20 bp, Artificial Sequence
  Synthetic oligonucleotide; GAG chr2 60529165 60529184 60529168 -
tagttcccccattatggggt

SEQ ID NO: 174488 - DNA, 20 bp, Artificial Sequence
  Synthetic oligonucleotide; CAG chr2 60529162 60529181 60529165 -
ttcccccattatggggtgag

SEQ ID NO: 174489 - DNA, 20 bp, Artificial Sequence
  Synthetic oligonucleotide; AGG chr2 60529161 60529180 60529164 -
tcccccattatggggtgagc

SEQ ID NO: 174490 - DNA, 20 bp, Artificial Sequence
  Synthetic oligonucleotide; TGG chr2 60529157 60529176 60529160 -
ccattatggggtgagcaggt

SEQ ID NO: 174491 - DNA, 20 bp, Artificial Sequence
  Synthetic oligonucleotide; GGG chr2 60529156 60529175 60529159 -
cattatggggtgagcaggtt

SEQ ID NO: 174492 - DNA, 20 bp, Artificial Sequence
  Synthetic oligonucleotide; GAG chr2 60529151 60529170 60529154 -
tggggtgagcaggttgggat

SEQ ID NO: 174493 - DNA, 20 bp, Artificial Sequence
  Synthetic oligonucleotide; GAG chr2 60529149 60529168 60529152 -
gggtgagcaggttgggatga

SEQ ID NO: 174494 - DNA, 20 bp, Artificial Sequence
  Synthetic oligonucleotide; AAG chr2 60529146 60529165 60529149 -
tgagcaggttgggatgagag

SEQ ID NO: 174495 - DNA, 20 bp, Artificial Sequence
  Synthetic oligonucleotide; GAG chr2 60529144 60529163 60529147 -
agcaggttgggatgagagaa

SEQ ID NO: 174496 - DNA, 20 bp, Artificial Sequence
  Synthetic oligonucleotide; CAG chr2 60529141 60529160 60529144 -
aggttgggatgagagaagag

SEQ ID NO: 174497 - DNA, 20 bp, Artificial Sequence
  Synthetic oligonucleotide; AGG chr2 60529140 60529159 60529143 -
ggttgggatgagagaagagc

SEQ ID NO: 174498 - DNA, 20 bp, Artificial Sequence
  Synthetic oligonucleotide; GGG chr2 60529139 60529158 60529142 -
gttgggatgagagaagagca

SEQ ID NO: 174499 - DNA, 20 bp, Artificial Sequence
  Synthetic oligonucleotide; CAG chr2 60529136 60529155 60529139 -
gggatgagagaagagcaggg

SEQ ID NO: 174500 - DNA, 20 bp, Artificial Sequence
  Synthetic oligonucleotide; AGG chr2 60529135 60529154 60529138 -
ggatgagagaagagcagggc

SEQ ID NO: 174501 - DNA, 20 bp, Artificial Sequence
  Synthetic oligonucleotide; TGG chr2 60529132 60529151 60529135 -
tgagagaagagcagggcagg

SEQ ID NO: 174502 - DNA, 20 bp, Artificial Sequence
  Synthetic oligonucleotide; GGG chr2 60529131 60529150 60529134 -
gagagaagagcagggcaggt

SEQ ID NO: 174503 - DNA, 20 bp, Artificial Sequence
  Synthetic oligonucleotide; GGG chr2 60529130 60529149 60529133 -
agagaagagcagggcaggtg

SEQ ID NO: 174504 - DNA, 20 bp, Artificial Sequence
  Synthetic oligonucleotide; GGG chr2 60529129 60529148 60529132 -
gagaagagcagggcaggtgg

SEQ ID NO: 174505 - DNA, 20 bp, Artificial Sequence
  Synthetic oligonucleotide; AAG chr2 60529122 60529141 60529125 -
gcagggcaggtgggggtcta

SEQ ID NO: 174506 - DNA, 20 bp, Artificial Sequence
  Synthetic oligonucleotide; GAG chr2 60529120 60529139 60529123 -
agggcaggtgggggtctaaa

SEQ ID NO: 174507 - DNA, 20 bp, Artificial Sequence
  Synthetic oligonucleotide; CAG chr2 60529115 60529134 60529118 -
aggtgggggtctaaagagct

SEQ ID NO: 174508 - DNA, 20 bp, Artificial Sequence
  Synthetic oligonucleotide; AGG chr2 60529114 60529133 60529117 -
ggtgggggtctaaagagctc

SEQ ID NO: 174509 - DNA, 20 bp, Artificial Sequence
  Synthetic oligonucleotide; GGG chr2 60529113 60529132 60529116 -
gtgggggtctaaagagctca

SEQ ID NO: 174510 - DNA, 20 bp, Artificial Sequence
  Synthetic oligonucleotide; TGG chr2 60529096 60529115 60529099 -
tcagggtctcattatgtttc

SEQ ID NO: 174511 - DNA, 20 bp, Artificial Sequence
  Synthetic oligonucleotide; TGG chr2 60529093 60529112 60529096 -
gggtctcattatgtttctgg

SEQ ID NO: 174512 - DNA, 20 bp, Artificial Sequence
  Synthetic oligonucleotide; CAG chr2 60529090 60529109 60529093 -
tctcattatgtttctggtgg

SEQ ID NO: 174513 - DNA, 20 bp, Artificial Sequence
  Synthetic oligonucleotide; TGG chr2 60529079 60529098 60529082 -
ttctggtggcagctccctcg

SEQ ID NO: 174514 - DNA, 20 bp, Artificial Sequence
  Synthetic oligonucleotide; GGG chr2 60529078 60529097 60529081 -
tctggtggcagctccctcgt

SEQ ID NO: 174515 - DNA, 20 bp, Artificial Sequence
  Synthetic oligonucleotide; TGG chr2 60529075 60529094 60529078 -
ggtggcagctccctcgtggg

SEQ ID NO: 174516 - DNA, 20 bp, Artificial Sequence
  Synthetic oligonucleotide; GGG chr2 60529074 60529093 60529077 -
gtggcagctccctcgtgggt

SEQ ID NO: 174517 - DNA, 20 bp, Artificial Sequence
  Synthetic oligonucleotide; GAG chr2 60529072 60529091 60529075 -
ggcagctccctcgtgggtgg

SEQ ID NO: 174518 - DNA, 20 bp, Artificial Sequence
  Synthetic oligonucleotide; TAG chr2 60529056 60529075 60529059 -
gtgggagtcccctctcccca

SEQ ID NO: 174519 - DNA, 20 bp, Artificial Sequence
  Synthetic oligonucleotide; GAG chr2 60529037 60529056 60529040 -
atagacgtgtgttgccttac

SEQ ID NO: 174520 - DNA, 20 bp, Artificial Sequence
  Synthetic oligonucleotide; GAG chr2 60529035 60529054 60529038 -
agacgtgtgttgccttacga

SEQ ID NO: 174521 - DNA, 20 bp, Artificial Sequence
  Synthetic oligonucleotide; AGG chr2 60529034 60529053 60529037 -
gacgtgtgttgccttacgag

SEQ ID NO: 174522 - DNA, 20 bp, Artificial Sequence
  Synthetic oligonucleotide; TGG chr2 60529019 60529038 60529022 -
acgagaggcttgtgcctgcc

SEQ ID NO: 174523 - DNA, 20 bp, Artificial Sequence
  Synthetic oligonucleotide; GGG chr2 60529018 60529037 60529021 -
cgagaggcttgtgcctgcct

SEQ ID NO: 174524 - DNA, 20 bp, Artificial Sequence
  Synthetic oligonucleotide; CAG chr2 60529006 60529025 60529009 -
gcctgcctgggtgtgtgaca

SEQ ID NO: 174525 - DNA, 20 bp, Artificial Sequence
  Synthetic oligonucleotide; TGG chr2 60528997 60529016 60529000 -
ggtgtgtgacacagttactc

SEQ ID NO: 174526 - DNA, 20 bp, Artificial Sequence
  Synthetic oligonucleotide; GGG chr2 60528996 60529015 60528999 -
gtgtgtgacacagttactct

SEQ ID NO: 174527 - DNA, 20 bp, Artificial Sequence
  Synthetic oligonucleotide; CAG chr2 60528991 60529010 60528994 -
tgacacagttactctgggtt

SEQ ID NO: 174528 - DNA, 20 bp, Artificial Sequence
  Synthetic oligonucleotide; TAG chr2 60528972 60528991 60528975 -
tcagatttctatgttactgc

SEQ ID NO: 174529 - DNA, 20 bp, Artificial Sequence
  Synthetic oligonucleotide; TGG chr2 60528968 60528987 60528971 -
atttctatgttactgctagc

SEQ ID NO: 174530 - DNA, 20 bp, Artificial Sequence
  Synthetic oligonucleotide; TGG chr2 60528964 60528983 60528967 -
ctatgttactgctagctggt

SEQ ID NO: 174531 - DNA, 20 bp, Artificial Sequence
  Synthetic oligonucleotide; GGG chr2 60528963 60528982 60528966 -
tatgttactgctagctggtt

SEQ ID NO: 174532 - DNA, 20 bp, Artificial Sequence
  Synthetic oligonucleotide; GAG chr2 60528961 60528980 60528964 -
tgttactgctagctggttgg

SEQ ID NO: 174533 - DNA, 20 bp, Artificial Sequence
  Synthetic oligonucleotide; GAG chr2 60528959 60528978 60528962 -
ttactgctagctggttggga

SEQ ID NO: 174534 - DNA, 20 bp, Artificial Sequence
  Synthetic oligonucleotide; GAG chr2 60528953 60528972 60528956 -
ctagctggttgggagagtct

SEQ ID NO: 174535 - DNA, 20 bp, Artificial Sequence
  Synthetic oligonucleotide; AGG chr2 60528952 60528971 60528955 -
tagctggttgggagagtctg

SEQ ID NO: 174536 - DNA, 20 bp, Artificial Sequence
  Synthetic oligonucleotide; GGG chr2 60528951 60528970 60528954 -
agctggttgggagagtctga

SEQ ID NO: 174537 - DNA, 20 bp, Artificial Sequence
  Synthetic oligonucleotide; TGG chr2 60528925 60528944 60528928 -
catttcacctctctgtgaaa

SEQ ID NO: 174538 - DNA, 20 bp, Artificial Sequence
  Synthetic oligonucleotide; GAG chr2 60528923 60528942 60528926 -
tttcacctctctgtgaaatg

SEQ ID NO: 174539 - DNA, 20 bp, Artificial Sequence
  Synthetic oligonucleotide; AAG chr2 60528913 60528932 60528916 -
ctgtgaaatggagataactc

SEQ ID NO: 174540 - DNA, 20 bp, Artificial Sequence
  Synthetic oligonucleotide; AGG chr2 60528912 60528931 60528915 -
tgtgaaatggagataactca

SEQ ID NO: 174541 - DNA, 20 bp, Artificial Sequence
  Synthetic oligonucleotide; TAG chr2 60528897 60528916 60528900 -
actcaaggtcccttacctca

SEQ ID NO: 174542 - DNA, 20 bp, Artificial Sequence
  Synthetic oligonucleotide; GAG chr2 60528895 60528914 60528898 -
tcaaggtcccttacctcata

SEQ ID NO: 174543 - DNA, 20 bp, Artificial Sequence
  Synthetic oligonucleotide; GAG chr2 60528885 60528904 60528888 -
ttacctcatagagtccatgt

SEQ ID NO: 174544 - DNA, 20 bp, Artificial Sequence
  Synthetic oligonucleotide; AAG chr2 60528882 60528901 60528885 -
cctcatagagtccatgtgag

SEQ ID NO: 174545 - DNA, 20 bp, Artificial Sequence
  Synthetic oligonucleotide; GAG chr2 60528874 60528893 60528877 -
agtccatgtgagaagtaaat

SEQ ID NO: 174546 - DNA, 20 bp, Artificial Sequence
  Synthetic oligonucleotide; AGG chr2 60528873 60528892 60528876 -
gtccatgtgagaagtaaatg

SEQ ID NO: 174547 - DNA, 20 bp, Artificial Sequence
  Synthetic oligonucleotide; GGG chr2 60528872 60528891 60528875 -
tccatgtgagaagtaaatga

SEQ ID NO: 174548 - DNA, 20 bp, Artificial Sequence
  Synthetic oligonucleotide; AAG chr2 60528868 60528887 60528871 -
tgtgagaagtaaatgaggga

SEQ ID NO: 174549 - DNA, 20 bp, Artificial Sequence
  Synthetic oligonucleotide; CAG chr2 60528863 60528882 60528866 -
gaagtaaatgagggaaagca

SEQ ID NO: 174550 - DNA, 20 bp, Artificial Sequence
  Synthetic oligonucleotide; CGG chr2 60528847 60528866 60528850 -
agcacagacattactcgctc

SEQ ID NO: 174551 - DNA, 20 bp, Artificial Sequence
  Synthetic oligonucleotide; GGG chr2 60528846 60528865 60528849 -
gcacagacattactcgctcc

SEQ ID NO: 174552 - DNA, 20 bp, Artificial Sequence
  Synthetic oligonucleotide; GGG chr2 60528845 60528864 60528848 -
cacagacattactcgctccg

SEQ ID NO: 174553 - DNA, 20 bp, Artificial Sequence
  Synthetic oligonucleotide; GGG chr2 60528844 60528863 60528847 -
acagacattactcgctccgg

SEQ ID NO: 174554 - DNA, 20 bp, Artificial Sequence
  Synthetic oligonucleotide; CAG chr2 60528832 60528851 60528835 -
cgctccgggggctgcacctc

SEQ ID NO: 174555 - DNA, 20 bp, Artificial Sequence
  Synthetic oligonucleotide; CGG chr2 60528768 60528787 60528771 -
attccatcccacaacaacct

SEQ ID NO: 174556 - DNA, 20 bp, Artificial Sequence
  Synthetic oligonucleotide; AAG chr2 60528764 60528783 60528767 -
catcccacaacaacctcgga

SEQ ID NO: 174557 - DNA, 20 bp, Artificial Sequence
  Synthetic oligonucleotide; AGG chr2 60528763 60528782 60528766 -
atcccacaacaacctcggaa

SEQ ID NO: 174558 - DNA, 20 bp, Artificial Sequence
  Synthetic oligonucleotide; TAG chr2 60528748 60528767 60528751 -
cggaaaggaaacactcccat

SEQ ID NO: 174559 - DNA, 20 bp, Artificial Sequence
  Synthetic oligonucleotide; TGG chr2 60528738 60528757 60528741 -
acactcccattagcctcatt

SEQ ID NO: 174560 - DNA, 20 bp, Artificial Sequence
  Synthetic oligonucleotide; TAG chr2 60528735 60528754 60528738 -
ctcccattagcctcatttgg

SEQ ID NO: 174561 - DNA, 20 bp, Artificial Sequence
  Synthetic oligonucleotide; GAG chr2 60528733 60528752 60528736 -
cccattagcctcatttggta

SEQ ID NO: 174562 - DNA, 20 bp, Artificial Sequence
  Synthetic oligonucleotide; AGG chr2 60528732 60528751 60528735 -
ccattagcctcatttggtag

SEQ ID NO: 174563 - DNA, 20 bp, Artificial Sequence
  Synthetic oligonucleotide; GAG chr2 60528730 60528749 60528733 -
attagcctcatttggtagag

SEQ ID NO: 174564 - DNA, 20 bp, Artificial Sequence
  Synthetic oligonucleotide; AGG chr2 60528729 60528748 60528732 -
ttagcctcatttggtagagg

SEQ ID NO: 174565 - DNA, 20 bp, Artificial Sequence
  Synthetic oligonucleotide; TGG chr2 60528722 60528741 60528725 -
catttggtagaggaggaaat

SEQ ID NO: 174566 - DNA, 20 bp, Artificial Sequence
  Synthetic oligonucleotide; GGG chr2 60528721 60528740 60528724 -
atttggtagaggaggaaatt

SEQ ID NO: 174567 - DNA, 20 bp, Artificial Sequence
  Synthetic oligonucleotide; GGG chr2 60528720 60528739 60528723 -
tttggtagaggaggaaattg

SEQ ID NO: 174568 - DNA, 20 bp, Artificial Sequence
  Synthetic oligonucleotide; AAG chr2 60528711 60528730 60528714 -
ggaggaaattggggttcatc

SEQ ID NO: 174569 - DNA, 20 bp, Artificial Sequence
  Synthetic oligonucleotide; AGG chr2 60528710 60528729 60528713 -
gaggaaattggggttcatca

SEQ ID NO: 174570 - DNA, 20 bp, Artificial Sequence
  Synthetic oligonucleotide; GGG chr2 60528709 60528728 60528712 -
aggaaattggggttcatcaa

SEQ ID NO: 174571 - DNA, 20 bp, Artificial Sequence
  Synthetic oligonucleotide; GAG chr2 60528691 60528710 60528694 -
aagggttaaatgacttccct

SEQ ID NO: 174572 - DNA, 20 bp, Artificial Sequence
  Synthetic oligonucleotide; AGG chr2 60528690 60528709 60528693 -
agggttaaatgacttccctg

SEQ ID NO: 174573 - DNA, 20 bp, Artificial Sequence
  Synthetic oligonucleotide; GGG chr2 60528689 60528708 60528692 -
gggttaaatgacttccctga

SEQ ID NO: 174574 - DNA, 20 bp, Artificial Sequence
  Synthetic oligonucleotide; CAG chr2 60528682 60528701 60528685 -
atgacttccctgagggtcca

SEQ ID NO: 174575 - DNA, 20 bp, Artificial Sequence
  Synthetic oligonucleotide; TGG chr2 60528666 60528685 60528669 -
tccacagttgttcaatcctt

SEQ ID NO: 174576 - DNA, 20 bp, Artificial Sequence
  Synthetic oligonucleotide; CGG chr2 60528659 60528678 60528662 -
ttgttcaatcctttggcctg

SEQ ID NO: 174577 - DNA, 20 bp, Artificial Sequence
  Synthetic oligonucleotide; CAG chr2 60528634 60528653 60528637 -
gccaccctctgctacctctt

SEQ ID NO: 174578 - DNA, 20 bp, Artificial Sequence
  Synthetic oligonucleotide; CAG chr2 60528623 60528642 60528626 -
ctacctcttcagtacgtttg

SEQ ID NO: 174579 - DNA, 20 bp, Artificial Sequence
  Synthetic oligonucleotide; CAG chr2 60528613 60528632 60528616 -
agtacgtttgcagctttctt

SEQ ID NO: 174580 - DNA, 20 bp, Artificial Sequence
  Synthetic oligonucleotide; CGG chr2 60528610 60528629 60528613 -
acgtttgcagctttcttcag

SEQ ID NO: 174581 - DNA, 20 bp, Artificial Sequence
  Synthetic oligonucleotide; CAG chr2 60528604 60528623 60528607 -
gcagctttcttcagcggtgc

SEQ ID NO: 174582 - DNA, 20 bp, Artificial Sequence
  Synthetic oligonucleotide; AGG chr2 60528603 60528622 60528606 -
cagctttcttcagcggtgcc

SEQ ID NO: 174583 - DNA, 20 bp, Artificial Sequence
  Synthetic oligonucleotide; TGG chr2 60528593 60528612 60528596 -
cagcggtgccaggcaacaac

SEQ ID NO: 174584 - DNA, 20 bp, Artificial Sequence
  Synthetic oligonucleotide; GGG chr2 60528592 60528611 60528595 -
agcggtgccaggcaacaact

SEQ ID NO: 174585 - DNA, 20 bp, Artificial Sequence
  Synthetic oligonucleotide; CAG chr2 60528589 60528608 60528592 -
ggtgccaggcaacaactggg

SEQ ID NO: 174586 - DNA, 20 bp, Artificial Sequence
  Synthetic oligonucleotide; AGG chr2 60528588 60528607 60528591 -
gtgccaggcaacaactgggc

SEQ ID NO: 174587 - DNA, 20 bp, Artificial Sequence
  Synthetic oligonucleotide; AAG chr2 60528585 60528604 60528588 -
ccaggcaacaactgggcagg

SEQ ID NO: 174588 - DNA, 20 bp, Artificial Sequence
  Synthetic oligonucleotide; TGG chr2 60528579 60528598 60528582 -
aacaactgggcaggaagctc

SEQ ID NO: 174589 - DNA, 20 bp, Artificial Sequence
  Synthetic oligonucleotide; TGG chr2 60528573 60528592 60528576 -
tgggcaggaagctctggtgc

SEQ ID NO: 174590 - DNA, 20 bp, Artificial Sequence
  Synthetic oligonucleotide; CAG chr2 60528569 60528588 60528572 -
caggaagctctggtgctgga

SEQ ID NO: 174591 - DNA, 20 bp, Artificial Sequence
  Synthetic oligonucleotide; TGG chr2 60528554 60528573 60528557 -
ctggacagttgtccctccca

SEQ ID NO: 174592 - DNA, 20 bp, Artificial Sequence
  Synthetic oligonucleotide; GGG chr2 60528553 60528572 60528556 -
tggacagttgtccctcccat

SEQ ID NO: 174593 - DNA, 20 bp, Artificial Sequence
  Synthetic oligonucleotide; TGG chr2 60528545 60528564 60528548 -
tgtccctcccatgggttctg

SEQ ID NO: 174594 - DNA, 20 bp, Artificial Sequence
  Synthetic oligonucleotide; AAG chr2 60528540 60528559 60528543 -
ctcccatgggttctgtggtc

SEQ ID NO: 174595 - DNA, 20 bp, Artificial Sequence
  Synthetic oligonucleotide; TGG chr2 60528524 60528543 60528527 -
ggtcaagtttttcaatcttc

SEQ ID NO: 174596 - DNA, 20 bp, Artificial Sequence
  Synthetic oligonucleotide; GGG chr2 60528523 60528542 60528526 -
gtcaagtttttcaatcttct

SEQ ID NO: 174597 - DNA, 20 bp, Artificial Sequence
  Synthetic oligonucleotide; AAG chr2 60528519 60528538 60528522 -
agtttttcaatcttctggga

SEQ ID NO: 174598 - DNA, 20 bp, Artificial Sequence
  Synthetic oligonucleotide; GAG chr2 60528517 60528536 60528520 -
tttttcaatcttctgggaaa

SEQ ID NO: 174599 - DNA, 20 bp, Artificial Sequence
  Synthetic oligonucleotide; AAG chr2 60528514 60528533 60528517 -
ttcaatcttctgggaaagag

SEQ ID NO: 174600 - DNA, 20 bp, Artificial Sequence
  Synthetic oligonucleotide; CAG chr2 60528499 60528518 60528502 -
aagagaagaatgttcccctc

SEQ ID NO: 174601 - DNA, 20 bp, Artificial Sequence
  Synthetic oligonucleotide; TGG chr2 60528493 60528512 60528496 -
agaatgttcccctccagttc

SEQ ID NO: 174602 - DNA, 20 bp, Artificial Sequence
  Synthetic oligonucleotide; GGG chr2 60528492 60528511 60528495 -
gaatgttcccctccagttct

SEQ ID NO: 174603 - DNA, 20 bp, Artificial Sequence
  Synthetic oligonucleotide; AAG chr2 60528482 60528501 60528485 -
ctccagttctgggcatattg

SEQ ID NO: 174604 - DNA, 20 bp, Artificial Sequence
  Synthetic oligonucleotide; AGG chr2 60528481 60528500 60528484 -
tccagttctgggcatattga

SEQ ID NO: 174605 - DNA, 20 bp, Artificial Sequence
  Synthetic oligonucleotide; GAG chr2 60528479 60528498 60528482 -
cagttctgggcatattgaag

SEQ ID NO: 174606 - DNA, 20 bp, Artificial Sequence
  Synthetic oligonucleotide; CGG chr2 60528474 60528493 60528477 -
ctgggcatattgaaggagca

SEQ ID NO: 174607 - DNA, 20 bp, Artificial Sequence
  Synthetic oligonucleotide; GAG chr2 60528472 60528491 60528475 -
gggcatattgaaggagcacg

SEQ ID NO: 174608 - DNA, 20 bp, Artificial Sequence
  Synthetic oligonucleotide; TGG chr2 60528465 60528484 60528468 -
ttgaaggagcacggagctgt

SEQ ID NO: 174609 - DNA, 20 bp, Artificial Sequence
  Synthetic oligonucleotide; GGG chr2 60528464 60528483 60528467 -
tgaaggagcacggagctgtt

SEQ ID NO: 174610 - DNA, 20 bp, Artificial Sequence
  Synthetic oligonucleotide; AAG chr2 60528459 60528478 60528462 -
gagcacggagctgttgggaa

SEQ ID NO: 174611 - DNA, 20 bp, Artificial Sequence
  Synthetic oligonucleotide; AAG chr2 60528447 60528466 60528450 -
gttgggaaaagttgcaatgt

SEQ ID NO: 174612 - DNA, 20 bp, Artificial Sequence
  Synthetic oligonucleotide; AGG chr2 60528446 60528465 60528449 -
ttgggaaaagttgcaatgta

SEQ ID NO: 174613 - DNA, 20 bp, Artificial Sequence
  Synthetic oligonucleotide; AAG chr2 60528430 60528449 60528433 -
tgtaaggaatcctgctttgc

SEQ ID NO: 174614 - DNA, 20 bp, Artificial Sequence
  Synthetic oligonucleotide; TAG chr2 60528427 60528446 60528430 -
aaggaatcctgctttgcaag

SEQ ID NO: 174615 - DNA, 20 bp, Artificial Sequence
  Synthetic oligonucleotide; CAG chr2 60528407 60528426 60528410 -
tagtcatttccccatctgtc

SEQ ID NO: 174616 - DNA, 20 bp, Artificial Sequence
  Synthetic oligonucleotide; GAG chr2 60528401 60528420 60528404 -
tttccccatctgtccagaat

SEQ ID NO: 174617 - DNA, 20 bp, Artificial Sequence
  Synthetic oligonucleotide; AAG chr2 60528389 60528408 60528392 -
tccagaatgagcctgaaatc

SEQ ID NO: 174618 - DNA, 20 bp, Artificial Sequence
  Synthetic oligonucleotide; GAG chr2 60528385 60528404 60528388 -
gaatgagcctgaaatcaagt

SEQ ID NO: 174619 - DNA, 20 bp, Artificial Sequence
  Synthetic oligonucleotide; AGG chr2 60528384 60528403 60528387 -
aatgagcctgaaatcaagtg

SEQ ID NO: 174620 - DNA, 20 bp, Artificial Sequence
  Synthetic oligonucleotide; GGG chr2 60528383 60528402 60528386 -
atgagcctgaaatcaagtga

SEQ ID NO: 174621 - DNA, 20 bp, Artificial Sequence
  Synthetic oligonucleotide; GAG chr2 60528376 60528395 60528379 -
tgaaatcaagtgagggtcct

SEQ ID NO: 174622 - DNA, 20 bp, Artificial Sequence
  Synthetic oligonucleotide; CAG chr2 60528370 60528389 60528373 -
caagtgagggtcctgagaaa

SEQ ID NO: 174623 - DNA, 20 bp, Artificial Sequence
  Synthetic oligonucleotide; GAG chr2 60528368 60528387 60528371 -
agtgagggtcctgagaaaca

SEQ ID NO: 174624 - DNA, 20 bp, Artificial Sequence
  Synthetic oligonucleotide; AGG chr2 60528367 60528386 60528370 -
gtgagggtcctgagaaacag

SEQ ID NO: 174625 - DNA, 20 bp, Artificial Sequence
  Synthetic oligonucleotide; GGG chr2 60528366 60528385 60528369 -
tgagggtcctgagaaacaga

SEQ ID NO: 174626 - DNA, 20 bp, Artificial Sequence
  Synthetic oligonucleotide; GAG chr2 60528364 60528383 60528367 -
agggtcctgagaaacagagg

SEQ ID NO: 174627 - DNA, 20 bp, Artificial Sequence
  Synthetic oligonucleotide; AGG chr2 60528363 60528382 60528366 -
gggtcctgagaaacagaggg

SEQ ID NO: 174628 - DNA, 20 bp, Artificial Sequence
  Synthetic oligonucleotide; GAG chr2 60528361 60528380 60528364 -
gtcctgagaaacagagggag

SEQ ID NO: 174629 - DNA, 20 bp, Artificial Sequence
  Synthetic oligonucleotide; AGG chr2 60528360 60528379 60528363 -
tcctgagaaacagagggagg

SEQ ID NO: 174630 - DNA, 20 bp, Artificial Sequence
  Synthetic oligonucleotide; TGG chr2 60528341 60528360 60528344 -
gaggttttactgtttgtgtg

SEQ ID NO: 174631 - DNA, 20 bp, Artificial Sequence
  Synthetic oligonucleotide; TGG chr2 60528336 60528355 60528339 -
tttactgtttgtgtgtggct

SEQ ID NO: 174632 - DNA, 20 bp, Artificial Sequence
  Synthetic oligonucleotide; CAG chr2 60528332 60528351 60528335 -
ctgtttgtgtgtggcttggt

SEQ ID NO: 174633 - DNA, 20 bp, Artificial Sequence
  Synthetic oligonucleotide; AGG chr2 60528331 60528350 60528334 -
tgtttgtgtgtggcttggtc

SEQ ID NO: 174634 - DNA, 20 bp, Artificial Sequence
  Synthetic oligonucleotide; GAG chr2 60528329 60528348 60528332 -
tttgtgtgtggcttggtcag

SEQ ID NO: 174635 - DNA, 20 bp, Artificial Sequence
  Synthetic oligonucleotide; CAG chr2 60528322 60528341 60528325 -
gtggcttggtcaggagactg

SEQ ID NO: 174636 - DNA, 20 bp, Artificial Sequence
  Synthetic oligonucleotide; TGG chr2 60528319 60528338 60528322 -
gcttggtcaggagactgcag

SEQ ID NO: 174637 - DNA, 20 bp, Artificial Sequence
  Synthetic oligonucleotide; GGG chr2 60528318 60528337 60528321 -
cttggtcaggagactgcagt

SEQ ID NO: 174638 - DNA, 20 bp, Artificial Sequence
  Synthetic oligonucleotide; GAG chr2 60528309 60528328 60528312 -
gagactgcagtgggctgaat

SEQ ID NO: 174639 - DNA, 20 bp, Artificial Sequence
  Synthetic oligonucleotide; AAG chr2 60528301 60528320 60528304 -
agtgggctgaatgagaaact

SEQ ID NO: 174640 - DNA, 20 bp, Artificial Sequence
  Synthetic oligonucleotide; CGG chr2 60528296 60528315 60528299 -
gctgaatgagaaactaagct

SEQ ID NO: 174641 - DNA, 20 bp, Artificial Sequence
  Synthetic oligonucleotide; AAG chr2 60528287 60528306 60528290 -
gaaactaagctcggactttt

SEQ ID NO: 174642 - DNA, 20 bp, Artificial Sequence
  Synthetic oligonucleotide; AAG chr2 60528284 60528303 60528287 -
actaagctcggacttttaag

SEQ ID NO: 174643 - DNA, 20 bp, Artificial Sequence
  Synthetic oligonucleotide; TGG chr2 60528281 60528300 60528284 -
aagctcggacttttaagaag

SEQ ID NO: 174644 - DNA, 20 bp, Artificial Sequence
  Synthetic oligonucleotide; GAG chr2 60528277 60528296 60528280 -
tcggacttttaagaagtggt

SEQ ID NO: 174645 - DNA, 20 bp, Artificial Sequence
  Synthetic oligonucleotide; AGG chr2 60528276 60528295 60528279 -
cggacttttaagaagtggtg

SEQ ID NO: 174646 - DNA, 20 bp, Artificial Sequence
  Synthetic oligonucleotide; TGG chr2 60528271 60528290 60528274 -
ttttaagaagtggtgaggct

SEQ ID NO: 174647 - DNA, 20 bp, Artificial Sequence
  Synthetic oligonucleotide; CAG chr2 60528264 60528283 60528267 -
aagtggtgaggcttggcctg

SEQ ID NO: 174648 - DNA, 20 bp, Artificial Sequence
  Synthetic oligonucleotide; CAG chr2 60528261 60528280 60528264 -
tggtgaggcttggcctgcag

SEQ ID NO: 174649 - DNA, 20 bp, Artificial Sequence
  Synthetic oligonucleotide; TGG chr2 60528240 60528259 60528243 -
agttctgtgtgttgtctctg

SEQ ID NO: 174650 - DNA, 20 bp, Artificial Sequence
  Synthetic oligonucleotide; CGG chr2 60528226 60528245 60528229 -
tctctgtggcatttacttct

SEQ ID NO: 174651 - DNA, 20 bp, Artificial Sequence
  Synthetic oligonucleotide; AAG chr2 60528211 60528230 60528214 -
cttctcggatcgtaccttca

SEQ ID NO: 174652 - DNA, 20 bp, Artificial Sequence
  Synthetic oligonucleotide; AGG chr2 60528210 60528229 60528213 -
ttctcggatcgtaccttcaa

SEQ ID NO: 174653 - DNA, 20 bp, Artificial Sequence
  Synthetic oligonucleotide; TGG chr2 60528206 60528225 60528209 -
cggatcgtaccttcaaaggc

SEQ ID NO: 174654 - DNA, 20 bp, Artificial Sequence
  Synthetic oligonucleotide; GGG chr2 60528205 60528224 60528208 -
ggatcgtaccttcaaaggct

SEQ ID NO: 174655 - DNA, 20 bp, Artificial Sequence
  Synthetic oligonucleotide; GGG chr2 60528204 60528223 60528207 -
gatcgtaccttcaaaggctg

SEQ ID NO: 174656 - DNA, 20 bp, Artificial Sequence
  Synthetic oligonucleotide; GAG chr2 60528202 60528221 60528205 -
tcgtaccttcaaaggctggg

SEQ ID NO: 174657 - DNA, 20 bp, Artificial Sequence
  Synthetic oligonucleotide; CAG chr2 60528196 60528215 60528199 -
cttcaaaggctggggagaat

SEQ ID NO: 174658 - DNA, 20 bp, Artificial Sequence
  Synthetic oligonucleotide; CAG chr2 60528186 60528205 60528189 -
tggggagaatcagaattata

SEQ ID NO: 174659 - DNA, 20 bp, Artificial Sequence
  Synthetic oligonucleotide; AGG chr2 60528185 60528204 60528188 -
ggggagaatcagaattatac

SEQ ID NO: 174660 - DNA, 20 bp, Artificial Sequence
  Synthetic oligonucleotide; GGG chr2 60528184 60528203 60528187 -
gggagaatcagaattataca

SEQ ID NO: 174661 - DNA, 20 bp, Artificial Sequence
  Synthetic oligonucleotide; GAG chr2 60528182 60528201 60528185 -
gagaatcagaattatacagg

SEQ ID NO: 174662 - DNA, 20 bp, Artificial Sequence
  Synthetic oligonucleotide; AGG chr2 60528181 60528200 60528184 -
agaatcagaattatacaggg

SEQ ID NO: 174663 - DNA, 20 bp, Artificial Sequence
  Synthetic oligonucleotide; GGG chr2 60528180 60528199 60528183 -
gaatcagaattatacaggga

SEQ ID NO: 174664 - DNA, 20 bp, Artificial Sequence
  Synthetic oligonucleotide; GAG chr2 60528178 60528197 60528181 -
atcagaattatacagggagg

SEQ ID NO: 174665 - DNA, 20 bp, Artificial Sequence
  Synthetic oligonucleotide; GAG chr2 60528176 60528195 60528179 -
cagaattatacagggaggga

SEQ ID NO: 174666 - DNA, 20 bp, Artificial Sequence
  Synthetic oligonucleotide; GAG chr2 60528170 60528189 60528173 -
tatacagggagggagagact

SEQ ID NO: 174667 - DNA, 20 bp, Artificial Sequence
  Synthetic oligonucleotide; GAG chr2 60528164 60528183 60528167 -
gggagggagagactgagtgt

SEQ ID NO: 174668 - DNA, 20 bp, Artificial Sequence
  Synthetic oligonucleotide; GAG chr2 60528160 60528179 60528163 -
gggagagactgagtgtgagt

SEQ ID NO: 174669 - DNA, 20 bp, Artificial Sequence
  Synthetic oligonucleotide; TGG chr2 60528151 60528170 60528154 -
tgagtgtgagtgagtgtgcg

SEQ ID NO: 174670 - DNA, 20 bp, Artificial Sequence
  Synthetic oligonucleotide; CAG chr2 60528148 60528167 60528151 -
gtgtgagtgagtgtgcgtgg

SEQ ID NO: 174671 - DNA, 20 bp, Artificial Sequence
  Synthetic oligonucleotide; TGG chr2 60528145 60528164 60528148 -
tgagtgagtgtgcgtggcag

SEQ ID NO: 174672 - DNA, 20 bp, Artificial Sequence
  Synthetic oligonucleotide; TAG chr2 60528135 60528154 60528138 -
tgcgtggcagtggtgtttct

SEQ ID NO: 174673 - DNA, 20 bp, Artificial Sequence
  Synthetic oligonucleotide; AGG chr2 60528134 60528153 60528137 -
gcgtggcagtggtgtttctt

SEQ ID NO: 174674 - DNA, 20 bp, Artificial Sequence
  Synthetic oligonucleotide; TGG chr2 60528127 60528146 60528130 -
agtggtgtttcttaggacga

SEQ ID NO: 174675 - DNA, 20 bp, Artificial Sequence
  Synthetic oligonucleotide; GGG chr2 60528126 60528145 60528129 -
gtggtgtttcttaggacgat

SEQ ID NO: 174676 - DNA, 20 bp, Artificial Sequence
  Synthetic oligonucleotide; TGG chr2 60528120 60528139 60528123 -
tttcttaggacgatgggttc

SEQ ID NO: 174677 - DNA, 20 bp, Artificial Sequence
  Synthetic oligonucleotide; GGG chr2 60528119 60528138 60528122 -
ttcttaggacgatgggttct

SEQ ID NO: 174678 - DNA, 20 bp, Artificial Sequence
  Synthetic oligonucleotide; GGG chr2 60528118 60528137 60528121 -
tcttaggacgatgggttctg

SEQ ID NO: 174679 - DNA, 20 bp, Artificial Sequence
  Synthetic oligonucleotide; GGG chr2 60528117 60528136 60528120 -
cttaggacgatgggttctgg

SEQ ID NO: 174680 - DNA, 20 bp, Artificial Sequence
  Synthetic oligonucleotide; GGG chr2 60528116 60528135 60528119 -
ttaggacgatgggttctggg

SEQ ID NO: 174681 - DNA, 20 bp, Artificial Sequence
  Synthetic oligonucleotide; GAG chr2 60528099 60528118 60528102 -
ggggggtcataatctgcttc

SEQ ID NO: 174682 - DNA, 20 bp, Artificial Sequence
  Synthetic oligonucleotide; AGG chr2 60528098 60528117 60528101 -
gggggtcataatctgcttcg

SEQ ID NO: 174683 - DNA, 20 bp, Artificial Sequence
  Synthetic oligonucleotide; GAG chr2 60528096 60528115 60528099 -
gggtcataatctgcttcgag

SEQ ID NO: 174684 - DNA, 20 bp, Artificial Sequence
  Synthetic oligonucleotide; AGG chr2 60528095 60528114 60528098 -
ggtcataatctgcttcgagg

SEQ ID NO: 174685 - DNA, 20 bp, Artificial Sequence
  Synthetic oligonucleotide; TGG chr2 60528082 60528101 60528085 -
ttcgaggaggttttcatttc

SEQ ID NO: 174686 - DNA, 20 bp, Artificial Sequence
  Synthetic oligonucleotide; AAG chr2 60528073 60528092 60528076 -
gttttcatttctggctgaac

SEQ ID NO: 174687 - DNA, 20 bp, Artificial Sequence
  Synthetic oligonucleotide; AGG chr2 60528072 60528091 60528075 -
ttttcatttctggctgaaca

SEQ ID NO: 174688 - DNA, 20 bp, Artificial Sequence
  Synthetic oligonucleotide; TGG chr2 60528066 60528085 60528069 -
tttctggctgaacaaggctg

SEQ ID NO: 174689 - DNA, 20 bp, Artificial Sequence
  Synthetic oligonucleotide; AAG chr2 60528062 60528081 60528065 -
tggctgaacaaggctgtggt

SEQ ID NO: 174690 - DNA, 20 bp, Artificial Sequence
  Synthetic oligonucleotide; AGG chr2 60528061 60528080 60528064 -
ggctgaacaaggctgtggta

SEQ ID NO: 174691 - DNA, 20 bp, Artificial Sequence
  Synthetic oligonucleotide; AAG chr2 60528057 60528076 60528060 -
gaacaaggctgtggtaaggc

SEQ ID NO: 174692 - DNA, 20 bp, Artificial Sequence
  Synthetic oligonucleotide; CGG chr2 60528052 60528071 60528055 -
aggctgtggtaaggcaagtc

SEQ ID NO: 174693 - DNA, 20 bp, Artificial Sequence
  Synthetic oligonucleotide; AAG chr2 60528049 60528068 60528052 -
ctgtggtaaggcaagtccgg

SEQ ID NO: 174694 - DNA, 20 bp, Artificial Sequence
  Synthetic oligonucleotide; AGG chr2 60528048 60528067 60528051 -
tgtggtaaggcaagtccgga

SEQ ID NO: 174695 - DNA, 20 bp, Artificial Sequence
  Synthetic oligonucleotide; TGG chr2 60528040 60528059 60528043 -
ggcaagtccggaaggcatgc

SEQ ID NO: 174696 - DNA, 20 bp, Artificial Sequence
  Synthetic oligonucleotide; GAG chr2 60528031 60528050 60528034 -
ggaaggcatgctggaaactt

SEQ ID NO: 174697 - DNA, 20 bp, Artificial Sequence
  Synthetic oligonucleotide; AGG chr2 60528030 60528049 60528033 -
gaaggcatgctggaaacttg

SEQ ID NO: 174698 - DNA, 20 bp, Artificial Sequence
  Synthetic oligonucleotide; GGG chr2 60528029 60528048 60528032 -
aaggcatgctggaaacttga

SEQ ID NO: 174699 - DNA, 20 bp, Artificial Sequence
  Synthetic oligonucleotide; AAG chr2 60528026 60528045 60528029 -
gcatgctggaaacttgaggg

SEQ ID NO: 174700 - DNA, 20 bp, Artificial Sequence
  Synthetic oligonucleotide; TGG chr2 60528016 60528035 60528019 -
aacttgagggaagttttgaa

SEQ ID NO: 174701 - DNA, 20 bp, Artificial Sequence
  Synthetic oligonucleotide; CAG chr2 60528007 60528026 60528010 -
gaagttttgaatggaaactg

SEQ ID NO: 174702 - DNA, 20 bp, Artificial Sequence
  Synthetic oligonucleotide; CAG chr2 60528000 60528019 60528003 -
tgaatggaaactgcagtcaa

SEQ ID NO: 174703 - DNA, 20 bp, Artificial Sequence
  Synthetic oligonucleotide; TGG chr2 60527979 60527998 60527982 -
agctccatatgatccgcatg

SEQ ID NO: 174704 - DNA, 20 bp, Artificial Sequence
  Synthetic oligonucleotide; CAG chr2 60527970 60527989 60527973 -
tgatccgcatgtggcttccc

SEQ ID NO: 174705 - DNA, 20 bp, Artificial Sequence
  Synthetic oligonucleotide; GAG chr2 60527968 60527987 60527971 -
atccgcatgtggcttcccca

SEQ ID NO: 174706 - DNA, 20 bp, Artificial Sequence
  Synthetic oligonucleotide; AGG chr2 60527967 60527986 60527970 -
tccgcatgtggcttccccag

SEQ ID NO: 174707 - DNA, 20 bp, Artificial Sequence
  Synthetic oligonucleotide; AAG chr2 60527963 60527982 60527966 -
catgtggcttccccagaggc

SEQ ID NO: 174708 - DNA, 20 bp, Artificial Sequence
  Synthetic oligonucleotide; CAG chr2 60527956 60527975 60527959 -
cttccccagaggcaagtttt

SEQ ID NO: 174709 - DNA, 20 bp, Artificial Sequence
  Synthetic oligonucleotide; TGG chr2 60527948 60527967 60527951 -
gaggcaagttttcagctgcg

SEQ ID NO: 174710 - DNA, 20 bp, Artificial Sequence
  Synthetic oligonucleotide; TGG chr2 60527945 60527964 60527948 -
gcaagttttcagctgcgtgg

SEQ ID NO: 174711 - DNA, 20 bp, Artificial Sequence
  Synthetic oligonucleotide; CAG chr2 60527935 60527954 60527938 -
agctgcgtggtggcctctcc

SEQ ID NO: 174712 - DNA, 20 bp, Artificial Sequence
  Synthetic oligonucleotide; CAG chr2 60527924 60527943 60527927 -
ggcctctcccagtcactcca

SEQ ID NO: 174713 - DNA, 20 bp, Artificial Sequence
  Synthetic oligonucleotide; AGG chr2 60527923 60527942 60527926 -
gcctctcccagtcactccac

SEQ ID NO: 174714 - DNA, 20 bp, Artificial Sequence
  Synthetic oligonucleotide; AAG chr2 60527893 60527912 60527896 -
gacgctattaatatttgctg

SEQ ID NO: 174715 - DNA, 20 bp, Artificial Sequence
  Synthetic oligonucleotide; AAG chr2 60527889 60527908 60527892 -
ctattaatatttgctgaagc

SEQ ID NO: 174716 - DNA, 20 bp, Artificial Sequence
  Synthetic oligonucleotide; GAG chr2 60527882 60527901 60527885 -
tatttgctgaagcaagacct

SEQ ID NO: 174717 - DNA, 20 bp, Artificial Sequence
  Synthetic oligonucleotide; AGG chr2 60527881 60527900 60527884 -
atttgctgaagcaagacctg

SEQ ID NO: 174718 - DNA, 20 bp, Artificial Sequence
  Synthetic oligonucleotide; CAG chr2 60527871 60527890 60527874 -
gcaagacctgaggttcgttg

SEQ ID NO: 174719 - DNA, 20 bp, Artificial Sequence
  Synthetic oligonucleotide; TGG chr2 60527867 60527886 60527870 -
gacctgaggttcgttgcaga

SEQ ID NO: 174720 - DNA, 20 bp, Artificial Sequence
  Synthetic oligonucleotide; TGG chr2 60527802 60527821 60527805 -
tattctccatcctttcaaat

SEQ ID NO: 174721 - DNA, 20 bp, Artificial Sequence
  Synthetic oligonucleotide; CAG chr2 60527798 60527817 60527801 -
ctccatcctttcaaattggc

SEQ ID NO: 174722 - DNA, 20 bp, Artificial Sequence
  Synthetic oligonucleotide; AGG chr2 60527797 60527816 60527800 -
tccatcctttcaaattggcc

SEQ ID NO: 174723 - DNA, 20 bp, Artificial Sequence
  Synthetic oligonucleotide; TAG chr2 60527788 60527807 60527791 -
tcaaattggccaggctaaca

SEQ ID NO: 174724 - DNA, 20 bp, Artificial Sequence
  Synthetic oligonucleotide; GAG chr2 60527776 60527795 60527779 -
ggctaacatagacctccact

SEQ ID NO: 174725 - DNA, 20 bp, Artificial Sequence
  Synthetic oligonucleotide; GAG chr2 60527774 60527793 60527777 -
ctaacatagacctccactga

SEQ ID NO: 174726 - DNA, 20 bp, Artificial Sequence
  Synthetic oligonucleotide; CAG chr2 60527766 60527785 60527769 -
gacctccactgagagaattt

SEQ ID NO: 174727 - DNA, 20 bp, Artificial Sequence
  Synthetic oligonucleotide; TGG chr2 60527756 60527775 60527759 -
gagagaatttcagaatcatt

SEQ ID NO: 174728 - DNA, 20 bp, Artificial Sequence
  Synthetic oligonucleotide; TAG chr2 60527753 60527772 60527756 -
agaatttcagaatcatttgg

SEQ ID NO: 174729 - DNA, 20 bp, Artificial Sequence
  Synthetic oligonucleotide; GAG chr2 60527748 60527767 60527751 -
ttcagaatcatttggtagtt

SEQ ID NO: 174730 - DNA, 20 bp, Artificial Sequence
  Synthetic oligonucleotide; AAG chr2 60527745 60527764 60527748 -
agaatcatttggtagttgag

SEQ ID NO: 174731 - DNA, 20 bp, Artificial Sequence
  Synthetic oligonucleotide; CGG chr2 60527729 60527748 60527732 -
tgagaagcgcctacttcatg

SEQ ID NO: 174732 - DNA, 20 bp, Artificial Sequence
  Synthetic oligonucleotide; GAG chr2 60527727 60527746 60527730 -
agaagcgcctacttcatgcg

SEQ ID NO: 174733 - DNA, 20 bp, Artificial Sequence
  Synthetic oligonucleotide; AGG chr2 60527726 60527745 60527729 -
gaagcgcctacttcatgcgg

SEQ ID NO: 174734 - DNA, 20 bp, Artificial Sequence
  Synthetic oligonucleotide; TGG chr2 60527718 60527737 60527721 -
tacttcatgcggaggccccg

SEQ ID NO: 174735 - DNA, 20 bp, Artificial Sequence
  Synthetic oligonucleotide; GGG chr2 60527717 60527736 60527720 -
acttcatgcggaggccccgt

SEQ ID NO: 174736 - DNA, 20 bp, Artificial Sequence
  Synthetic oligonucleotide; GAG chr2 60527715 60527734 60527718 -
ttcatgcggaggccccgtgg

SEQ ID NO: 174737 - DNA, 20 bp, Artificial Sequence
  Synthetic oligonucleotide; AGG chr2 60527714 60527733 60527717 -
tcatgcggaggccccgtggg

SEQ ID NO: 174738 - DNA, 20 bp, Artificial Sequence
  Synthetic oligonucleotide; GAG chr2 60527712 60527731 60527715 -
atgcggaggccccgtgggag

SEQ ID NO: 174739 - DNA, 20 bp, Artificial Sequence
  Synthetic oligonucleotide; TGG chr2 60527709 60527728 60527712 -
cggaggccccgtgggaggag

SEQ ID NO: 174740 - DNA, 20 bp, Artificial Sequence
  Synthetic oligonucleotide; AAG chr2 60527706 60527725 60527709 -
aggccccgtgggaggagtgg

SEQ ID NO: 174741 - DNA, 20 bp, Artificial Sequence
  Synthetic oligonucleotide; GAG chr2 60527704 60527723 60527707 -
gccccgtgggaggagtggaa

SEQ ID NO: 174742 - DNA, 20 bp, Artificial Sequence
  Synthetic oligonucleotide; TGG chr2 60527700 60527719 60527703 -
cgtgggaggagtggaagagt

SEQ ID NO: 174743 - DNA, 20 bp, Artificial Sequence
  Synthetic oligonucleotide; CAG chr2 60527694 60527713 60527697 -
aggagtggaagagttggcct

SEQ ID NO: 174744 - DNA, 20 bp, Artificial Sequence
  Synthetic oligonucleotide; TGG chr2 60527688 60527707 60527691 -
ggaagagttggcctcagcac

SEQ ID NO: 174745 - DNA, 20 bp, Artificial Sequence
  Synthetic oligonucleotide; GAG chr2 60527684 60527703 60527687 -
gagttggcctcagcactggc

SEQ ID NO: 174746 - DNA, 20 bp, Artificial Sequence
  Synthetic oligonucleotide; CGG chr2 60527678 60527697 60527681 -
gcctcagcactggcgagtat

SEQ ID NO: 174747 - DNA, 20 bp, Artificial Sequence
  Synthetic oligonucleotide; TGG chr2 60527674 60527693 60527677 -
cagcactggcgagtatcgga

SEQ ID NO: 174748 - DNA, 20 bp, Artificial Sequence
  Synthetic oligonucleotide; GGG chr2 60527673 60527692 60527676 -
agcactggcgagtatcggat

SEQ ID NO: 174749 - DNA, 20 bp, Artificial Sequence
  Synthetic oligonucleotide; GAG chr2 60527671 60527690 60527674 -
cactggcgagtatcggatgg

SEQ ID NO: 174750 - DNA, 20 bp, Artificial Sequence
  Synthetic oligonucleotide; TGG chr2 60527657 60527676 60527660 -
ggatgggagctctgctcact

SEQ ID NO: 174751 - DNA, 20 bp, Artificial Sequence
  Synthetic oligonucleotide; AAG chr2 60527653 60527672 60527656 -
gggagctctgctcacttggt

SEQ ID NO: 174752 - DNA, 20 bp, Artificial Sequence
  Synthetic oligonucleotide; TAG chr2 60527641 60527660 60527644 -
cacttggtaagtccttctgc

SEQ ID NO: 174753 - DNA, 20 bp, Artificial Sequence
  Synthetic oligonucleotide; AAG chr2 60527634 60527653 60527637 -
taagtccttctgctagaacc

SEQ ID NO: 174754 - DNA, 20 bp, Artificial Sequence
  Synthetic oligonucleotide; AGG chr2 60527633 60527652 60527636 -
aagtccttctgctagaacca

SEQ ID NO: 174755 - DNA, 20 bp, Artificial Sequence
  Synthetic oligonucleotide; GGG chr2 60527632 60527651 60527635 -
agtccttctgctagaaccaa

SEQ ID NO: 174756 - DNA, 20 bp, Artificial Sequence
  Synthetic oligonucleotide; GAG chr2 60527630 60527649 60527633 -
tccttctgctagaaccaagg

SEQ ID NO: 174757 - DNA, 20 bp, Artificial Sequence
  Synthetic oligonucleotide; AGG chr2 60527629 60527648 60527632 -
ccttctgctagaaccaaggg

SEQ ID NO: 174758 - DNA, 20 bp, Artificial Sequence
  Synthetic oligonucleotide; CAG chr2 60527621 60527640 60527624 -
tagaaccaagggaggctgtt

SEQ ID NO: 174759 - DNA, 20 bp, Artificial Sequence
  Synthetic oligonucleotide; AAG chr2 60527608 60527627 60527611 -
ggctgttcagatccatcaca

SEQ ID NO: 174760 - DNA, 20 bp, Artificial Sequence
  Synthetic oligonucleotide; AAG chr2 60527605 60527624 60527608 -
tgttcagatccatcacaaag

SEQ ID NO: 174761 - DNA, 20 bp, Artificial Sequence
  Synthetic oligonucleotide; CGG chr2 60527598 60527617 60527601 -
atccatcacaaagaagttgt

SEQ ID NO: 174762 - DNA, 20 bp, Artificial Sequence
  Synthetic oligonucleotide; CAG chr2 60527588 60527607 60527591 -
aagaagttgtcggtcacatc

SEQ ID NO: 174763 - DNA, 20 bp, Artificial Sequence
  Synthetic oligonucleotide; AGG chr2 60527587 60527606 60527590 -
agaagttgtcggtcacatcc

SEQ ID NO: 174764 - DNA, 20 bp, Artificial Sequence
  Synthetic oligonucleotide; GAG chr2 60527575 60527594 60527578 -
tcacatccaggttgtcttct

SEQ ID NO: 174765 - DNA, 20 bp, Artificial Sequence
  Synthetic oligonucleotide; GAG chr2 60527569 60527588 60527572 -
ccaggttgtcttctgagttt

SEQ ID NO: 174766 - DNA, 20 bp, Artificial Sequence
  Synthetic oligonucleotide; AGG chr2 60527568 60527587 60527571 -
caggttgtcttctgagtttg

SEQ ID NO: 174767 - DNA, 20 bp, Artificial Sequence
  Synthetic oligonucleotide; TGG chr2 60527565 60527584 60527568 -
gttgtcttctgagtttgagg

SEQ ID NO: 174768 - DNA, 20 bp, Artificial Sequence
  Synthetic oligonucleotide; GGG chr2 60527564 60527583 60527567 -
ttgtcttctgagtttgaggt

SEQ ID NO: 174769 - DNA, 20 bp, Artificial Sequence
  Synthetic oligonucleotide; TGG chr2 60527560 60527579 60527563 -
cttctgagtttgaggtggga

SEQ ID NO: 174770 - DNA, 20 bp, Artificial Sequence
  Synthetic oligonucleotide; GAG chr2 60527558 60527577 60527561 -
tctgagtttgaggtgggatg

SEQ ID NO: 174771 - DNA, 20 bp, Artificial Sequence
  Synthetic oligonucleotide; AGG chr2 60527557 60527576 60527560 -
ctgagtttgaggtgggatgg

SEQ ID NO: 174772 - DNA, 20 bp, Artificial Sequence
  Synthetic oligonucleotide; TGG chr2 60527554 60527573 60527557 -
agtttgaggtgggatggagg

SEQ ID NO: 174773 - DNA, 20 bp, Artificial Sequence
  Synthetic oligonucleotide; GAG chr2 60527546 60527565 60527549 -
gtgggatggaggtggctgct

SEQ ID NO: 174774 - DNA, 20 bp, Artificial Sequence
  Synthetic oligonucleotide; TGG chr2 60527535 60527554 60527538 -
gtggctgctgagaatccatg

SEQ ID NO: 174775 - DNA, 20 bp, Artificial Sequence
  Synthetic oligonucleotide; GGG chr2 60527534 60527553 60527537 -
tggctgctgagaatccatgt

SEQ ID NO: 174776 - DNA, 20 bp, Artificial Sequence
  Synthetic oligonucleotide; AAG chr2 60527529 60527548 60527532 -
gctgagaatccatgtgggtc

SEQ ID NO: 174777 - DNA, 20 bp, Artificial Sequence
  Synthetic oligonucleotide; GAG chr2 60527527 60527546 60527530 -
tgagaatccatgtgggtcaa

SEQ ID NO: 174778 - DNA, 20 bp, Artificial Sequence
  Synthetic oligonucleotide; AAG chr2 60527519 60527538 60527522 -
catgtgggtcaagagctcca

SEQ ID NO: 174779 - DNA, 20 bp, Artificial Sequence
  Synthetic oligonucleotide; CGG chr2 60527490 60527509 60527493 -
ttttacttcgcactctgtcc

SEQ ID NO: 174780 - DNA, 20 bp, Artificial Sequence
  Synthetic oligonucleotide; GGG chr2 60527489 60527508 60527492 -
tttacttcgcactctgtccc

SEQ ID NO: 174781 - DNA, 20 bp, Artificial Sequence
  Synthetic oligonucleotide; GGG chr2 60527488 60527507 60527491 -
ttacttcgcactctgtcccg

SEQ ID NO: 174782 - DNA, 20 bp, Artificial Sequence
  Synthetic oligonucleotide; TGG chr2 60527483 60527502 60527486 -
tcgcactctgtcccggggca

SEQ ID NO: 174783 - DNA, 20 bp, Artificial Sequence
  Synthetic oligonucleotide; TGG chr2 60527470 60527489 60527473 -
cggggcatggacgtcctcaa

SEQ ID NO: 174784 - DNA, 20 bp, Artificial Sequence
  Synthetic oligonucleotide; GAG chr2 60527468 60527487 60527471 -
gggcatggacgtcctcaatg

SEQ ID NO: 174785 - DNA, 20 bp, Artificial Sequence
  Synthetic oligonucleotide; AGG chr2 60527467 60527486 60527470 -
ggcatggacgtcctcaatgg

SEQ ID NO: 174786 - DNA, 20 bp, Artificial Sequence
  Synthetic oligonucleotide; AAG chr2 60527458 60527477 60527461 -
gtcctcaatggaggtcatgc

SEQ ID NO: 174787 - DNA, 20 bp, Artificial Sequence
  Synthetic oligonucleotide; TGG chr2 60527432 60527451 60527435 -
ttccccctcaccccttctct

SEQ ID NO: 174788 - DNA, 20 bp, Artificial Sequence
  Synthetic oligonucleotide; TGG chr2 60527403 60527422 60527406 -
tcattgtctctacataccct

SEQ ID NO: 174789 - DNA, 20 bp, Artificial Sequence
  Synthetic oligonucleotide; GGG chr2 60527402 60527421 60527405 -
cattgtctctacataccctt

SEQ ID NO: 174790 - DNA, 20 bp, Artificial Sequence
  Synthetic oligonucleotide; AAG chr2 60527397 60527416 60527400 -
tctctacatacccttgggtc

SEQ ID NO: 174791 - DNA, 20 bp, Artificial Sequence
  Synthetic oligonucleotide; GAG chr2 60527395 60527414 60527398 -
tctacatacccttgggtcaa

SEQ ID NO: 174792 - DNA, 20 bp, Artificial Sequence
  Synthetic oligonucleotide; TAG chr2 60527390 60527409 60527393 -
atacccttgggtcaagagtg

SEQ ID NO: 174793 - DNA, 20 bp, Artificial Sequence
  Synthetic oligonucleotide; TGG chr2 60527387 60527406 60527390 -
cccttgggtcaagagtgtag

SEQ ID NO: 174794 - DNA, 20 bp, Artificial Sequence
  Synthetic oligonucleotide; TGG chr2 60527368 60527387 60527371 -
gtggttctcccttgtcaccc

SEQ ID NO: 174795 - DNA, 20 bp, Artificial Sequence
  Synthetic oligonucleotide; AAG chr2 60527365 60527384 60527368 -
gttctcccttgtcaccctgg

SEQ ID NO: 174796 - DNA, 20 bp, Artificial Sequence
  Synthetic oligonucleotide; GAG chr2 60527363 60527382 60527366 -
tctcccttgtcaccctggaa

SEQ ID NO: 174797 - DNA, 20 bp, Artificial Sequence
  Synthetic oligonucleotide; AAG chr2 60527360 60527379 60527363 -
cccttgtcaccctggaagag

SEQ ID NO: 174798 - DNA, 20 bp, Artificial Sequence
  Synthetic oligonucleotide; TAG chr2 60527353 60527372 60527356 -
caccctggaagagaagctct

SEQ ID NO: 174799 - DNA, 20 bp, Artificial Sequence
  Synthetic oligonucleotide; TGG chr2 60527340 60527359 60527343 -
aagctcttagttttatttgc

SEQ ID NO: 174800 - DNA, 20 bp, Artificial Sequence
  Synthetic oligonucleotide; GGG chr2 60527339 60527358 60527342 -
agctcttagttttatttgct

SEQ ID NO: 174801 - DNA, 20 bp, Artificial Sequence
  Synthetic oligonucleotide; TAG chr2 60527331 60527350 60527334 -
gttttatttgctgggtctcc

SEQ ID NO: 174802 - DNA, 20 bp, Artificial Sequence
  Synthetic oligonucleotide; AAG chr2 60527316 60527335 60527319 -
tctcctagactgaaatgata

SEQ ID NO: 174803 - DNA, 20 bp, Artificial Sequence
  Synthetic oligonucleotide; AAG chr2 60527301 60527320 60527304 -
tgataaagctgaaatgataa

SEQ ID NO: 174804 - DNA, 20 bp, Artificial Sequence
  Synthetic oligonucleotide; AGG chr2 60527300 60527319 60527303 -
gataaagctgaaatgataaa

SEQ ID NO: 174805 - DNA, 20 bp, Artificial Sequence
  Synthetic oligonucleotide; TGG chr2 60527290 60527309 60527293 -
aaatgataaaaggcgtatca

SEQ ID NO: 174806 - DNA, 20 bp, Artificial Sequence
  Synthetic oligonucleotide; TAG chr2 60527284 60527303 60527287 -
taaaaggcgtatcatggctt

SEQ ID NO: 174807 - DNA, 20 bp, Artificial Sequence
  Synthetic oligonucleotide; TAG chr2 60527250 60527269 60527253 -
tttccctcgctcgcaccccc

SEQ ID NO: 174808 - DNA, 20 bp, Artificial Sequence
  Synthetic oligonucleotide; CAG chr2 60527223 60527242 60527226 -
ccttctcttcccttgaaaat

SEQ ID NO: 174809 - DNA, 20 bp, Artificial Sequence
  Synthetic oligonucleotide; CAG chr2 60527213 60527232 60527216 -
ccttgaaaatcagtgaaaat

SEQ ID NO: 174810 - DNA, 20 bp, Artificial Sequence
  Synthetic oligonucleotide; AGG chr2 60527212 60527231 60527215 -
cttgaaaatcagtgaaaatc

SEQ ID NO: 174811 - DNA, 20 bp, Artificial Sequence
  Synthetic oligonucleotide; TGG chr2 60527194 60527213 60527197 -
tcaggccacatctctgatga

SEQ ID NO: 174812 - DNA, 20 bp, Artificial Sequence
  Synthetic oligonucleotide; TAG chr2 60527153 60527172 60527156 -
ttttctgtttctgccttcgt

SEQ ID NO: 174813 - DNA, 20 bp, Artificial Sequence
  Synthetic oligonucleotide; AGG chr2 60527152 60527171 60527155 -
tttctgtttctgccttcgtt

SEQ ID NO: 174814 - DNA, 20 bp, Artificial Sequence
  Synthetic oligonucleotide; AAG chr2 60527148 60527167 60527151 -
tgtttctgccttcgttaggt

SEQ ID NO: 174815 - DNA, 20 bp, Artificial Sequence
  Synthetic oligonucleotide; AAG chr2 60527128 60527147 60527131 -
aagcacaaatttgatgtccc

SEQ ID NO: 174816 - DNA, 20 bp, Artificial Sequence
  Synthetic oligonucleotide; GAG chr2 60527126 60527145 60527129 -
gcacaaatttgatgtcccaa

SEQ ID NO: 174817 - DNA, 20 bp, Artificial Sequence
  Synthetic oligonucleotide; AGG chr2 60527125 60527144 60527128 -
cacaaatttgatgtcccaag

SEQ ID NO: 174818 - DNA, 20 bp, Artificial Sequence
  Synthetic oligonucleotide; CAG chr2 60527122 60527141 60527125 -
aaatttgatgtcccaagagg

SEQ ID NO: 174819 - DNA, 20 bp, Artificial Sequence
  Synthetic oligonucleotide; AGG chr2 60527121 60527140 60527124 -
aatttgatgtcccaagaggc

SEQ ID NO: 174820 - DNA, 20 bp, Artificial Sequence
  Synthetic oligonucleotide; CGG chr2 60527117 60527136 60527120 -
tgatgtcccaagaggcaggc

SEQ ID NO: 174821 - DNA, 20 bp, Artificial Sequence
  Synthetic oligonucleotide; CAG chr2 60527106 60527125 60527109 -
gaggcaggccggtgaccctt

SEQ ID NO: 174822 - DNA, 20 bp, Artificial Sequence
  Synthetic oligonucleotide; AGG chr2 60527105 60527124 60527108 -
aggcaggccggtgacccttc

SEQ ID NO: 174823 - DNA, 20 bp, Artificial Sequence
  Synthetic oligonucleotide; AAG chr2 60527100 60527119 60527103 -
ggccggtgacccttcaggcc

SEQ ID NO: 174824 - DNA, 20 bp, Artificial Sequence
  Synthetic oligonucleotide; TGG chr2 60527093 60527112 60527096 -
gacccttcaggccaagtgcc

SEQ ID NO: 174825 - DNA, 20 bp, Artificial Sequence
  Synthetic oligonucleotide; TGG chr2 60527087 60527106 60527090 -
tcaggccaagtgcctggatg

SEQ ID NO: 174826 - DNA, 20 bp, Artificial Sequence
  Synthetic oligonucleotide; AAG chr2 60527082 60527101 60527085 -
ccaagtgcctggatgtggca

SEQ ID NO: 174827 - DNA, 20 bp, Artificial Sequence
  Synthetic oligonucleotide; TGG chr2 60527062 60527081 60527065 -
aagctacaataaatatcgaa

SEQ ID NO: 174828 - DNA, 20 bp, Artificial Sequence
  Synthetic oligonucleotide; GAG chr2 60527058 60527077 60527061 -
tacaataaatatcgaatggt

SEQ ID NO: 174829 - DNA, 20 bp, Artificial Sequence
  Synthetic oligonucleotide; GAG chr2 60527056 60527075 60527059 -
caataaatatcgaatggtga

SEQ ID NO: 174830 - DNA, 20 bp, Artificial Sequence
  Synthetic oligonucleotide; TGG chr2 60527050 60527069 60527053 -
atatcgaatggtgagagcaa

SEQ ID NO: 174831 - DNA, 20 bp, Artificial Sequence
  Synthetic oligonucleotide; TAG chr2 60527042 60527061 60527045 -
tggtgagagcaatggaaatt

SEQ ID NO: 174832 - DNA, 20 bp, Artificial Sequence
  Synthetic oligonucleotide; AAG chr2 60527037 60527056 60527040 -
agagcaatggaaatttagca

SEQ ID NO: 174833 - DNA, 20 bp, Artificial Sequence
  Synthetic oligonucleotide; CGG chr2 60527027 60527046 60527030 -
aaatttagcaaagccataac

SEQ ID NO: 174834 - DNA, 20 bp, Artificial Sequence
  Synthetic oligonucleotide; GGG chr2 60527026 60527045 60527029 -
aatttagcaaagccataacc

SEQ ID NO: 174835 - DNA, 20 bp, Artificial Sequence
  Synthetic oligonucleotide; GGG chr2 60527025 60527044 60527028 -
atttagcaaagccataaccg

SEQ ID NO: 174836 - DNA, 20 bp, Artificial Sequence
  Synthetic oligonucleotide; GAG chr2 60527023 60527042 60527026 -
ttagcaaagccataaccggg

SEQ ID NO: 174837 - DNA, 20 bp, Artificial Sequence
  Synthetic oligonucleotide; CAG chr2 60527016 60527035 60527019 -
agccataaccggggagacct

SEQ ID NO: 174838 - DNA, 20 bp, Artificial Sequence
  Synthetic oligonucleotide; GAG chr2 60527014 60527033 60527017 -
ccataaccggggagacctca

SEQ ID NO: 174839 - DNA, 20 bp, Artificial Sequence
  Synthetic oligonucleotide; AGG chr2 60527013 60527032 60527016 -
cataaccggggagacctcag

SEQ ID NO: 174840 - DNA, 20 bp, Artificial Sequence
  Synthetic oligonucleotide; GGG chr2 60527012 60527031 60527015 -
ataaccggggagacctcaga

SEQ ID NO: 174841 - DNA, 20 bp, Artificial Sequence
  Synthetic oligonucleotide; GGG chr2 60527011 60527030 60527014 -
taaccggggagacctcagag

SEQ ID NO: 174842 - DNA, 20 bp, Artificial Sequence
  Synthetic oligonucleotide; CAG chr2 60527008 60527027 60527011 -
ccggggagacctcagagggg

SEQ ID NO: 174843 - DNA, 20 bp, Artificial Sequence
  Synthetic oligonucleotide; TGG chr2 60527005 60527024 60527008 -
gggagacctcagaggggcag

SEQ ID NO: 174844 - DNA, 20 bp, Artificial Sequence
  Synthetic oligonucleotide; TGG chr2 60527000 60527019 60527003 -
acctcagaggggcagtggac

SEQ ID NO: 174845 - DNA, 20 bp, Artificial Sequence
  Synthetic oligonucleotide; AAG chr2 60526995 60527014 60526998 -
agaggggcagtggactggtt

SEQ ID NO: 174846 - DNA, 20 bp, Artificial Sequence
  Synthetic oligonucleotide; GAG chr2 60526993 60527012 60526996 -
aggggcagtggactggttaa

SEQ ID NO: 174847 - DNA, 20 bp, Artificial Sequence
  Synthetic oligonucleotide; AGG chr2 60526992 60527011 60526995 -
ggggcagtggactggttaag

SEQ ID NO: 174848 - DNA, 20 bp, Artificial Sequence
  Synthetic oligonucleotide; TGG chr2 60526985 60527004 60526988 -
tggactggttaagaggctgt

SEQ ID NO: 174849 - DNA, 20 bp, Artificial Sequence
  Synthetic oligonucleotide; GAG chr2 60526980 60526999 60526983 -
tggttaagaggctgttggat

SEQ ID NO: 174850 - DNA, 20 bp, Artificial Sequence
  Synthetic oligonucleotide; CGG chr2 60526976 60526995 60526979 -
taagaggctgttggatgagc

SEQ ID NO: 174851 - DNA, 20 bp, Artificial Sequence
  Synthetic oligonucleotide; GGG chr2 60526975 60526994 60526978 -
aagaggctgttggatgagcc

SEQ ID NO: 174852 - DNA, 20 bp, Artificial Sequence
  Synthetic oligonucleotide; TAG chr2 60526972 60526991 60526975 -
aggctgttggatgagccggg

SEQ ID NO: 174853 - DNA, 20 bp, Artificial Sequence
  Synthetic oligonucleotide; TAG chr2 60526917 60526936 60526920 -
taaaaatcaatgctgttgac

SEQ ID NO: 174854 - DNA, 20 bp, Artificial Sequence
  Synthetic oligonucleotide; TGG chr2 60526895 60526914 60526898 -
gtgataatttacaacgttcc

SEQ ID NO: 174855 - DNA, 20 bp, Artificial Sequence
  Synthetic oligonucleotide; AAG chr2 60526888 60526907 60526891 -
tttacaacgttcctggtgct

SEQ ID NO: 174856 - DNA, 20 bp, Artificial Sequence
  Synthetic oligonucleotide; TAG chr2 60526885 60526904 60526888 -
acaacgttcctggtgctaag

SEQ ID NO: 174857 - DNA, 20 bp, Artificial Sequence
  Synthetic oligonucleotide; AAG chr2 60526872 60526891 60526875 -
tgctaagtagttccccgctt

SEQ ID NO: 174858 - DNA, 20 bp, Artificial Sequence
  Synthetic oligonucleotide; TGG chr2 60526862 60526881 60526865 -
ttccccgcttaagaatgcgt

SEQ ID NO: 174859 - DNA, 20 bp, Artificial Sequence
  Synthetic oligonucleotide; TGG chr2 60526858 60526877 60526861 -
ccgcttaagaatgcgttggc

SEQ ID NO: 174860 - DNA, 20 bp, Artificial Sequence
  Synthetic oligonucleotide; GGG chr2 60526857 60526876 60526860 -
cgcttaagaatgcgttggct

SEQ ID NO: 174861 - DNA, 20 bp, Artificial Sequence
  Synthetic oligonucleotide; CAG chr2 60526854 60526873 60526857 -
ttaagaatgcgttggctggg

SEQ ID NO: 174862 - DNA, 20 bp, Artificial Sequence
  Synthetic oligonucleotide; GAG chr2 60526852 60526871 60526855 -
aagaatgcgttggctgggca

SEQ ID NO: 174863 - DNA, 20 bp, Artificial Sequence
  Synthetic oligonucleotide; TAG chr2 60526847 60526866 60526850 -
tgcgttggctgggcagagat

SEQ ID NO: 174864 - DNA, 20 bp, Artificial Sequence
  Synthetic oligonucleotide; CAG chr2 60526842 60526861 60526845 -
tggctgggcagagattagcg

SEQ ID NO: 174865 - DNA, 20 bp, Artificial Sequence
  Synthetic oligonucleotide; AGG chr2 60526841 60526860 60526844 -
ggctgggcagagattagcgc

SEQ ID NO: 174866 - DNA, 20 bp, Artificial Sequence
  Synthetic oligonucleotide; GGG chr2 60526840 60526859 60526843 -
gctgggcagagattagcgca

SEQ ID NO: 174867 - DNA, 20 bp, Artificial Sequence
  Synthetic oligonucleotide; GAG chr2 60526838 60526857 60526841 -
tgggcagagattagcgcagg

SEQ ID NO: 174868 - DNA, 20 bp, Artificial Sequence
  Synthetic oligonucleotide; CAG chr2 60526815 60526834 60526818 -
ttgtgtgtgtcacaatgaat

SEQ ID NO: 174869 - DNA, 20 bp, Artificial Sequence
  Synthetic oligonucleotide; TAG chr2 60526804 60526823 60526807 -
acaatgaatcagacgcatta

SEQ ID NO: 174870 - DNA, 20 bp, Artificial Sequence
  Synthetic oligonucleotide; AGG chr2 60526803 60526822 60526806 -
caatgaatcagacgcattat

SEQ ID NO: 174871 - DNA, 20 bp, Artificial Sequence
  Synthetic oligonucleotide; CAG chr2 60526799 60526818 60526802 -
gaatcagacgcattataggt

SEQ ID NO: 174872 - DNA, 20 bp, Artificial Sequence
  Synthetic oligonucleotide; CAG chr2 60526766 60526785 60526769 -
gtttcatcatgacttttaca

SEQ ID NO: 174873 - DNA, 20 bp, Artificial Sequence
  Synthetic oligonucleotide; TGG chr2 60526748 60526767 60526751 -
cacagttgtcatgtaattta

SEQ ID NO: 174874 - DNA, 20 bp, Artificial Sequence
  Synthetic oligonucleotide; TAG chr2 60526687 60526706 60526690 -
tctttaacaccctcctgaca

SEQ ID NO: 174875 - DNA, 20 bp, Artificial Sequence
  Synthetic oligonucleotide; AAG chr2 60526670 60526689 60526673 -
acatagacacactgcacttg

SEQ ID NO: 174876 - DNA, 20 bp, Artificial Sequence
  Synthetic oligonucleotide; AGG chr2 60526669 60526688 60526672 -
catagacacactgcacttga

SEQ ID NO: 174877 - DNA, 20 bp, Artificial Sequence
  Synthetic oligonucleotide; TGG chr2 60526664 60526683 60526667 -
acacactgcacttgaaggct

SEQ ID NO: 174878 - DNA, 20 bp, Artificial Sequence
  Synthetic oligonucleotide; GAG chr2 60526645 60526664 60526648 -
ttggtattgtttcataatcc

SEQ ID NO: 174879 - DNA, 20 bp, Artificial Sequence
  Synthetic oligonucleotide; GAG chr2 60526643 60526662 60526646 -
ggtattgtttcataatccga

SEQ ID NO: 174880 - DNA, 20 bp, Artificial Sequence
  Synthetic oligonucleotide; AGG chr2 60526642 60526661 60526645 -
gtattgtttcataatccgag

SEQ ID NO: 174881 - DNA, 20 bp, Artificial Sequence
  Synthetic oligonucleotide; GAG chr2 60526640 60526659 60526643 -
attgtttcataatccgagag

SEQ ID NO: 174882 - DNA, 20 bp, Artificial Sequence
  Synthetic oligonucleotide; AGG chr2 60526639 60526658 60526642 -
ttgtttcataatccgagagg

SEQ ID NO: 174883 - DNA, 20 bp, Artificial Sequence
  Synthetic oligonucleotide; TGG chr2 60526608 60526627 60526611 -
ccatcaaattacactatctt

SEQ ID NO: 174884 - DNA, 20 bp, Artificial Sequence
  Synthetic oligonucleotide; GGG chr2 60526607 60526626 60526610 -
catcaaattacactatcttt

SEQ ID NO: 174885 - DNA, 20 bp, Artificial Sequence
  Synthetic oligonucleotide; CAG chr2 60526587 60526606 60526590 -
gggctaatctaaatgcgctg

SEQ ID NO: 174886 - DNA, 20 bp, Artificial Sequence
  Synthetic oligonucleotide; CAG chr2 60526576 60526595 60526579 -
aatgcgctgcagattaaaat

SEQ ID NO: 174887 - DNA, 20 bp, Artificial Sequence
  Synthetic oligonucleotide; GAG chr2 60526574 60526593 60526577 -
tgcgctgcagattaaaatca

SEQ ID NO: 174888 - DNA, 20 bp, Artificial Sequence
  Synthetic oligonucleotide; AAG chr2 60526545 60526564 60526548 -
tgtccctgatgcaaattatt

SEQ ID NO: 174889 - DNA, 20 bp, Artificial Sequence
  Synthetic oligonucleotide; CGG chr2 60526495 60526514 60526498 -
cccgacacatttttattttg

SEQ ID NO: 174890 - DNA, 20 bp, Artificial Sequence
  Synthetic oligonucleotide; GAG chr2 60526484 60526503 60526487 -
tttattttgcggaccctttt

SEQ ID NO: 174891 - DNA, 20 bp, Artificial Sequence
  Synthetic oligonucleotide; CAG chr2 60526464 60526483 60526467 -
gagcactgctgtctgcgatg

SEQ ID NO: 174892 - DNA, 20 bp, Artificial Sequence
  Synthetic oligonucleotide; GAG chr2 60526462 60526481 60526465 -
gcactgctgtctgcgatgca

SEQ ID NO: 174893 - DNA, 20 bp, Artificial Sequence
  Synthetic oligonucleotide; AGG chr2 60526461 60526480 60526464 -
cactgctgtctgcgatgcag

SEQ ID NO: 174894 - DNA, 20 bp, Artificial Sequence
  Synthetic oligonucleotide; GGG chr2 60526460 60526479 60526463 -
actgctgtctgcgatgcaga

SEQ ID NO: 174895 - DNA, 20 bp, Artificial Sequence
  Synthetic oligonucleotide; GGG chr2 60526459 60526478 60526462 -
ctgctgtctgcgatgcagag

SEQ ID NO: 174896 - DNA, 20 bp, Artificial Sequence
  Synthetic oligonucleotide; GGG chr2 60526458 60526477 60526461 -
tgctgtctgcgatgcagagg

SEQ ID NO: 174897 - DNA, 20 bp, Artificial Sequence
  Synthetic oligonucleotide; TGG chr2 60526455 60526474 60526458 -
tgtctgcgatgcagaggggg

SEQ ID NO: 174898 - DNA, 20 bp, Artificial Sequence
  Synthetic oligonucleotide; GGG chr2 60526454 60526473 60526457 -
gtctgcgatgcagagggggt

SEQ ID NO: 174899 - DNA, 20 bp, Artificial Sequence
  Synthetic oligonucleotide; GGG chr2 60526453 60526472 60526456 -
tctgcgatgcagagggggtg

SEQ ID NO: 174900 - DNA, 20 bp, Artificial Sequence
  Synthetic oligonucleotide; GGG chr2 60526452 60526471 60526455 -
ctgcgatgcagagggggtgg

SEQ ID NO: 174901 - DNA, 20 bp, Artificial Sequence
  Synthetic oligonucleotide; GGG chr2 60526451 60526470 60526454 -
tgcgatgcagagggggtggg

SEQ ID NO: 174902 - DNA, 20 bp, Artificial Sequence
  Synthetic oligonucleotide; GAG chr2 60526449 60526468 60526452 -
cgatgcagagggggtggggg

SEQ ID NO: 174903 - DNA, 20 bp, Artificial Sequence
  Synthetic oligonucleotide; TAG chr2 60526441 60526460 60526444 -
agggggtggggggagatgca

SEQ ID NO: 174904 - DNA, 20 bp, Artificial Sequence
  Synthetic oligonucleotide; AGG chr2 60526440 60526459 60526443 -
gggggtggggggagatgcat

SEQ ID NO: 174905 - DNA, 20 bp, Artificial Sequence
  Synthetic oligonucleotide; GAG chr2 60526438 60526457 60526441 -
gggtggggggagatgcatag

SEQ ID NO: 174906 - DNA, 20 bp, Artificial Sequence
  Synthetic oligonucleotide; CAG chr2 60526427 60526446 60526430 -
gatgcataggagacaatctg

SEQ ID NO: 174907 - DNA, 20 bp, Artificial Sequence
  Synthetic oligonucleotide; TGG chr2 60526402 60526421 60526405 -
attaatgtacacttcccaaa

SEQ ID NO: 174908 - DNA, 20 bp, Artificial Sequence
  Synthetic oligonucleotide; AAG chr2 60526397 60526416 60526400 -
tgtacacttcccaaatggta

SEQ ID NO: 174909 - DNA, 20 bp, Artificial Sequence
  Synthetic oligonucleotide; AGG chr2 60526396 60526415 60526399 -
gtacacttcccaaatggtaa

SEQ ID NO: 174910 - DNA, 20 bp, Artificial Sequence
  Synthetic oligonucleotide; TAG chr2 60526352 60526371 60526355 -
tgtcttatttatttattgat

SEQ ID NO: 174911 - DNA, 20 bp, Artificial Sequence
  Synthetic oligonucleotide; TAG chr2 60526344 60526363 60526347 -
ttatttattgattagatgta

SEQ ID NO: 174912 - DNA, 20 bp, Artificial Sequence
  Synthetic oligonucleotide; GAG chr2 60526342 60526361 60526345 -
atttattgattagatgtata

SEQ ID NO: 174913 - DNA, 20 bp, Artificial Sequence
  Synthetic oligonucleotide; TGG chr2 60526335 60526354 60526338 -
gattagatgtatagagactt

SEQ ID NO: 174914 - DNA, 20 bp, Artificial Sequence
  Synthetic oligonucleotide; TGG chr2 60526330 60526349 60526333 -
gatgtatagagactttggcg

SEQ ID NO: 174915 - DNA, 20 bp, Artificial Sequence
  Synthetic oligonucleotide; GGG chr2 60526329 60526348 60526332 -
atgtatagagactttggcgt

SEQ ID NO: 174916 - DNA, 20 bp, Artificial Sequence
  Synthetic oligonucleotide; AAG chr2 60526317 60526336 60526320 -
tttggcgtgggcacaatctg

SEQ ID NO: 174917 - DNA, 20 bp, Artificial Sequence
  Synthetic oligonucleotide; AAG chr2 60526300 60526319 60526303 -
ctgaagttgaaatcctttta

SEQ ID NO: 174918 - DNA, 20 bp, Artificial Sequence
  Synthetic oligonucleotide; TGG chr2 60526274 60526293 60526277 -
aaaactatttaaaaatcttt

SEQ ID NO: 174919 - DNA, 20 bp, Artificial Sequence
  Synthetic oligonucleotide; GGG chr2 60526273 60526292 60526276 -
aaactatttaaaaatctttt

SEQ ID NO: 174920 - DNA, 20 bp, Artificial Sequence
  Synthetic oligonucleotide; GGG chr2 60526272 60526291 60526275 -
aactatttaaaaatcttttg

SEQ ID NO: 174921 - DNA, 20 bp, Artificial Sequence
  Synthetic oligonucleotide; AAG chr2 60526269 60526288 60526272 -
tatttaaaaatcttttgggg

SEQ ID NO: 174922 - DNA, 20 bp, Artificial Sequence
  Synthetic oligonucleotide; AAG chr2 60526265 60526284 60526268 -
taaaaatcttttggggaaga

SEQ ID NO: 174923 - DNA, 20 bp, Artificial Sequence
  Synthetic oligonucleotide; GAG chr2 60526263 60526282 60526266 -
aaaatcttttggggaagaaa

SEQ ID NO: 174924 - DNA, 20 bp, Artificial Sequence
  Synthetic oligonucleotide; TAG chr2 60526253 60526272 60526256 -
ggggaagaaagagcaaaata

SEQ ID NO: 174925 - DNA, 20 bp, Artificial Sequence
  Synthetic oligonucleotide; TAG chr2 60526242 60526261 60526245 -
agcaaaatatagccaaccaa

SEQ ID NO: 174926 - DNA, 20 bp, Artificial Sequence
  Synthetic oligonucleotide; TAG chr2 60526231 60526250 60526234 -
gccaaccaatagctttctgc

SEQ ID NO: 174927 - DNA, 20 bp, Artificial Sequence
  Synthetic oligonucleotide; TGG chr2 60526209 60526228 60526212 -
gaacacatcatcccaaaata

SEQ ID NO: 174928 - DNA, 20 bp, Artificial Sequence
  Synthetic oligonucleotide; GGG chr2 60526208 60526227 60526211 -
aacacatcatcccaaaatat

SEQ ID NO: 174929 - DNA, 20 bp, Artificial Sequence
  Synthetic oligonucleotide; CAG chr2 60526183 60526202 60526186 -
tctgaatttgatcaaatcac

SEQ ID NO: 174930 - DNA, 20 bp, Artificial Sequence
  Synthetic oligonucleotide; TAG chr2 60526160 60526179 60526163 -
tttctgaatttgatcaaatc

SEQ ID NO: 174931 - DNA, 20 bp, Artificial Sequence
  Synthetic oligonucleotide; CAG chr2 60526151 60526170 60526154 -
ttgatcaaatctagattttg

SEQ ID NO: 174932 - DNA, 20 bp, Artificial Sequence
  Synthetic oligonucleotide; AAG chr2 60526148 60526167 60526151 -
atcaaatctagattttgcag

SEQ ID NO: 174933 - DNA, 20 bp, Artificial Sequence
  Synthetic oligonucleotide; CAG chr2 60526143 60526162 60526146 -
atctagattttgcagaagtt

SEQ ID NO: 174934 - DNA, 20 bp, Artificial Sequence
  Synthetic oligonucleotide; AGG chr2 60526142 60526161 60526145 -
tctagattttgcagaagttc

SEQ ID NO: 174935 - DNA, 20 bp, Artificial Sequence
  Synthetic oligonucleotide; GGG chr2 60526141 60526160 60526144 -
ctagattttgcagaagttca

SEQ ID NO: 174936 - DNA, 20 bp, Artificial Sequence
  Synthetic oligonucleotide; GAG chr2 60526137 60526156 60526140 -
attttgcagaagttcagggt

SEQ ID NO: 174937 - DNA, 20 bp, Artificial Sequence
  Synthetic oligonucleotide; GAG chr2 60526135 60526154 60526138 -
tttgcagaagttcagggtga

SEQ ID NO: 174938 - DNA, 20 bp, Artificial Sequence
  Synthetic oligonucleotide; TAG chr2 60526111 60526130 60526114 -
aaccatgcctgttttatatc

SEQ ID NO: 174939 - DNA, 20 bp, Artificial Sequence
  Synthetic oligonucleotide; AAG chr2 60526107 60526126 60526110 -
atgcctgttttatatctaga

SEQ ID NO: 174940 - DNA, 20 bp, Artificial Sequence
  Synthetic oligonucleotide; TAG chr2 60526090 60526109 60526093 -
agaaagtgaaatcattgtta

SEQ ID NO: 174941 - DNA, 20 bp, Artificial Sequence
  Synthetic oligonucleotide; TGG chr2 60526074 60526093 60526077 -
gttatagaaaaaacctactg

SEQ ID NO: 174942 - DNA, 20 bp, Artificial Sequence
  Synthetic oligonucleotide; TAG chr2 60526070 60526089 60526073 -
tagaaaaaacctactgtggt

SEQ ID NO: 174943 - DNA, 20 bp, Artificial Sequence
  Synthetic oligonucleotide; CAG chr2 60526044 60526063 60526047 -
aaaaccacattcttttttcc

SEQ ID NO: 174944 - DNA, 20 bp, Artificial Sequence
  Synthetic oligonucleotide; CAG chr2 60526022 60526041 60526025 -
gccctgctgccatcctctac

SEQ ID NO: 174945 - DNA, 20 bp, Artificial Sequence
  Synthetic oligonucleotide; CAG chr2 60526012 60526031 60526015 -
catcctctaccagaaaataa

SEQ ID NO: 174946 - DNA, 20 bp, Artificial Sequence
  Synthetic oligonucleotide; TAG chr2 60525999 60526018 60526002 -
aaaataacagtatctgcctg

SEQ ID NO: 174947 - DNA, 20 bp, Artificial Sequence
  Synthetic oligonucleotide; AAG chr2 60525992 60526011 60525995 -
cagtatctgcctgtagtatg

SEQ ID NO: 174948 - DNA, 20 bp, Artificial Sequence
  Synthetic oligonucleotide; GAG chr2 60525978 60525997 60525981 -
agtatgaagaccttccaatt

SEQ ID NO: 174949 - DNA, 20 bp, Artificial Sequence
  Synthetic oligonucleotide; GAG chr2 60525976 60525995 60525979 -
tatgaagaccttccaattga

SEQ ID NO: 174950 - DNA, 20 bp, Artificial Sequence
  Synthetic oligonucleotide; AAG chr2 60525935 60525954 60525938 -
ttgattaccaaacacgaatg

SEQ ID NO: 174951 - DNA, 20 bp, Artificial Sequence
  Synthetic oligonucleotide; AGG chr2 60525934 60525953 60525937 -
tgattaccaaacacgaatga

SEQ ID NO: 174952 - DNA, 20 bp, Artificial Sequence
  Synthetic oligonucleotide; AAG chr2 60525931 60525950 60525934 -
ttaccaaacacgaatgaagg

SEQ ID NO: 174953 - DNA, 20 bp, Artificial Sequence
  Synthetic oligonucleotide; AAG chr2 60525928 60525947 60525931 -
ccaaacacgaatgaaggaag

SEQ ID NO: 174954 - DNA, 20 bp, Artificial Sequence
  Synthetic oligonucleotide; TAG chr2 60525912 60525931 60525915 -
gaagaagataacataaaaat

SEQ ID NO: 174955 - DNA, 20 bp, Artificial Sequence
  Synthetic oligonucleotide; AAG chr2 60525907 60525926 60525910 -
agataacataaaaattagta

SEQ ID NO: 174956 - DNA, 20 bp, Artificial Sequence
  Synthetic oligonucleotide; AGG chr2 60525906 60525925 60525909 -
gataacataaaaattagtaa

SEQ ID NO: 174957 - DNA, 20 bp, Artificial Sequence
  Synthetic oligonucleotide; AAG chr2 60525897 60525916 60525900 -
aaaattagtaaaggccttcc

SEQ ID NO: 174958 - DNA, 20 bp, Artificial Sequence
  Synthetic oligonucleotide; TAG chr2 60525894 60525913 60525897 -
attagtaaaggccttccaag

SEQ ID NO: 174959 - DNA, 20 bp, Artificial Sequence
  Synthetic oligonucleotide; AAG chr2 60525873 60525892 60525876 -
agacatttacccttctgtga

SEQ ID NO: 174960 - DNA, 20 bp, Artificial Sequence
  Synthetic oligonucleotide; TGG chr2 60525867 60525886 60525870 -
ttacccttctgtgaaagcca

SEQ ID NO: 174961 - DNA, 20 bp, Artificial Sequence
  Synthetic oligonucleotide; GAG chr2 60525865 60525884 60525868 -
acccttctgtgaaagccatg

SEQ ID NO: 174962 - DNA, 20 bp, Artificial Sequence
  Synthetic oligonucleotide; AAG chr2 60525854 60525873 60525857 -
aaagccatggagaaattacc

SEQ ID NO: 174963 - DNA, 20 bp, Artificial Sequence
  Synthetic oligonucleotide; TGG chr2 60525849 60525868 60525852 -
catggagaaattaccaagac

SEQ ID NO: 174964 - DNA, 20 bp, Artificial Sequence
  Synthetic oligonucleotide; TGG chr2 60525844 60525863 60525847 -
agaaattaccaagactggtt

SEQ ID NO: 174965 - DNA, 20 bp, Artificial Sequence
  Synthetic oligonucleotide; GGG chr2 60525843 60525862 60525846 -
gaaattaccaagactggttt

SEQ ID NO: 174966 - DNA, 20 bp, Artificial Sequence
  Synthetic oligonucleotide; GGG chr2 60525842 60525861 60525845 -
aaattaccaagactggtttg

SEQ ID NO: 174967 - DNA, 20 bp, Artificial Sequence
  Synthetic oligonucleotide; GGG chr2 60525841 60525860 60525844 -
aattaccaagactggtttgg

SEQ ID NO: 174968 - DNA, 20 bp, Artificial Sequence
  Synthetic oligonucleotide; GGG chr2 60525840 60525859 60525843 -
attaccaagactggtttggg

SEQ ID NO: 174969 - DNA, 20 bp, Artificial Sequence
  Synthetic oligonucleotide; GAG chr2 60525838 60525857 60525841 -
taccaagactggtttggggg

SEQ ID NO: 174970 - DNA, 20 bp, Artificial Sequence
  Synthetic oligonucleotide; AGG chr2 60525837 60525856 60525840 -
accaagactggtttgggggg

SEQ ID NO: 174971 - DNA, 20 bp, Artificial Sequence
  Synthetic oligonucleotide; GGG chr2 60525836 60525855 60525839 -
ccaagactggtttgggggga

SEQ ID NO: 174972 - DNA, 20 bp, Artificial Sequence
  Synthetic oligonucleotide; AAG chr2 60525828 60525847 60525831 -
ggtttggggggagggcattt

SEQ ID NO: 174973 - DNA, 20 bp, Artificial Sequence
  Synthetic oligonucleotide; AGG chr2 60525827 60525846 60525830 -
gtttggggggagggcattta

SEQ ID NO: 174974 - DNA, 20 bp, Artificial Sequence
  Synthetic oligonucleotide; TGG chr2 60525819 60525838 60525822 -
ggagggcatttaaggtcttt

SEQ ID NO: 174975 - DNA, 20 bp, Artificial Sequence
  Synthetic oligonucleotide; GGG chr2 60525818 60525837 60525821 -
gagggcatttaaggtctttt

SEQ ID NO: 174976 - DNA, 20 bp, Artificial Sequence
  Synthetic oligonucleotide; CAG chr2 60525810 60525829 60525813 -
ttaaggtcttttgggcatta

SEQ ID NO: 174977 - DNA, 20 bp, Artificial Sequence
  Synthetic oligonucleotide; CAG chr2 60525801 60525820 60525804 -
tttgggcattacagattttc

SEQ ID NO: 174978 - DNA, 20 bp, Artificial Sequence
  Synthetic oligonucleotide; TAG chr2 60525781 60525800 60525784 -
cagaaccaaactttgacttt

SEQ ID NO: 174979 - DNA, 20 bp, Artificial Sequence
  Synthetic oligonucleotide; CAG chr2 60525772 60525791 60525775 -
actttgacttttagtgttaa

SEQ ID NO: 174980 - DNA, 20 bp, Artificial Sequence
  Synthetic oligonucleotide; GAG chr2 60525770 60525789 60525773 -
tttgacttttagtgttaaca

SEQ ID NO: 174981 - DNA, 20 bp, Artificial Sequence
  Synthetic oligonucleotide; GAG chr2 60525768 60525787 60525771 -
tgacttttagtgttaacaga

SEQ ID NO: 174982 - DNA, 20 bp, Artificial Sequence
  Synthetic oligonucleotide; CAG chr2 60525749 60525768 60525752 -
agagacactgatctgaaaac

SEQ ID NO: 174983 - DNA, 20 bp, Artificial Sequence
  Synthetic oligonucleotide; AGG chr2 60525748 60525767 60525751 -
gagacactgatctgaaaacc

SEQ ID NO: 174984 - DNA, 20 bp, Artificial Sequence
  Synthetic oligonucleotide; TGG chr2 60525740 60525759 60525743 -
gatctgaaaaccaggacacc

SEQ ID NO: 174985 - DNA, 20 bp, Artificial Sequence
  Synthetic oligonucleotide; GGG chr2 60525739 60525758 60525742 -
atctgaaaaccaggacacct

SEQ ID NO: 174986 - DNA, 20 bp, Artificial Sequence
  Synthetic oligonucleotide; GAG chr2 60525710 60525729 60525713 -
cccttattgtatcatgctgt

SEQ ID NO: 174987 - DNA, 20 bp, Artificial Sequence
  Synthetic oligonucleotide; TGG chr2 60525703 60525722 60525706 -
tgtatcatgctgtgagattt

SEQ ID NO: 174988 - DNA, 20 bp, Artificial Sequence
  Synthetic oligonucleotide; GGG chr2 60525702 60525721 60525705 -
gtatcatgctgtgagatttt

SEQ ID NO: 174989 - DNA, 20 bp, Artificial Sequence
  Synthetic oligonucleotide; TAG chr2 60525685 60525704 60525688 -
tttgggctcccttcacctgt

SEQ ID NO: 174990 - DNA, 20 bp, Artificial Sequence
  Synthetic oligonucleotide; AAG chr2 60525661 60525680 60525664 -
atttgtttccttgtcttgta

SEQ ID NO: 174991 - DNA, 20 bp, Artificial Sequence
  Synthetic oligonucleotide; TAG chr2 60525658 60525677 60525661 -
tgtttccttgtcttgtaaag

SEQ ID NO: 174992 - DNA, 20 bp, Artificial Sequence
  Synthetic oligonucleotide; AGG chr2 60525657 60525676 60525660 -
gtttccttgtcttgtaaagt

SEQ ID NO: 174993 - DNA, 20 bp, Artificial Sequence
  Synthetic oligonucleotide; TAG chr2 60525649 60525668 60525652 -
gtcttgtaaagtaggtaaaa

SEQ ID NO: 174994 - DNA, 20 bp, Artificial Sequence
  Synthetic oligonucleotide; TAG chr2 60525645 60525664 60525648 -
tgtaaagtaggtaaaataga

SEQ ID NO: 174995 - DNA, 20 bp, Artificial Sequence
  Synthetic oligonucleotide; TGG chr2 60525640 60525659 60525643 -
agtaggtaaaatagatagtt

SEQ ID NO: 174996 - DNA, 20 bp, Artificial Sequence
  Synthetic oligonucleotide; TGG chr2 60525635 60525654 60525638 -
gtaaaatagatagtttggac

SEQ ID NO: 174997 - DNA, 20 bp, Artificial Sequence
  Synthetic oligonucleotide; GGG chr2 60525634 60525653 60525637 -
taaaatagatagtttggact

SEQ ID NO: 174998 - DNA, 20 bp, Artificial Sequence
  Synthetic oligonucleotide; TGG chr2 60525631 60525650 60525634 -
aatagatagtttggactggg

SEQ ID NO: 174999 - DNA, 20 bp, Artificial Sequence
  Synthetic oligonucleotide; GGG chr2 60525630 60525649 60525633 -
atagatagtttggactgggt

SEQ ID NO: 175000 - DNA, 20 bp, Artificial Sequence
  Synthetic oligonucleotide; AAG chr2 60525622 60525641 60525625 -
tttggactgggtgggtctct

SEQ ID NO: 175001 - DNA, 20 bp, Artificial Sequence
  Synthetic oligonucleotide; TAG chr2 60525605 60525624 60525608 -
tctaagtccccatgatgttc

SEQ ID NO: 175002 - DNA, 20 bp, Artificial Sequence
  Synthetic oligonucleotide; TAG chr2 60525600 60525619 60525603 -
gtccccatgatgttctagca

SEQ ID NO: 175003 - DNA, 20 bp, Artificial Sequence
  Synthetic oligonucleotide; CAG chr2 60525581 60525600 60525584 -
atagtatgaacaccactgac

SEQ ID NO: 175004 - DNA, 20 bp, Artificial Sequence
  Synthetic oligonucleotide; TGG chr2 60525559 60525578 60525562 -
gttttctccctgctattttt

SEQ ID NO: 175005 - DNA, 20 bp, Artificial Sequence
  Synthetic oligonucleotide; TAG chr2 60525552 60525571 60525555 -
ccctgctattttttggaatc

SEQ ID NO: 175006 - DNA, 20 bp, Artificial Sequence
  Synthetic oligonucleotide; TGG chr2 60525541 60525560 60525544 -
tttggaatctagttgctgaa

SEQ ID NO: 175007 - DNA, 20 bp, Artificial Sequence
  Synthetic oligonucleotide; GGG chr2 60525540 60525559 60525543 -
ttggaatctagttgctgaat

SEQ ID NO: 175008 - DNA, 20 bp, Artificial Sequence
  Synthetic oligonucleotide; GGG chr2 60525539 60525558 60525542 -
tggaatctagttgctgaatg

SEQ ID NO: 175009 - DNA, 20 bp, Artificial Sequence
  Synthetic oligonucleotide; AAG chr2 60525526 60525545 60525529 -
ctgaatggggctcacctgca

SEQ ID NO: 175010 - DNA, 20 bp, Artificial Sequence
  Synthetic oligonucleotide; CAG chr2 60525522 60525541 60525525 -
atggggctcacctgcaaaga

SEQ ID NO: 175011 - DNA, 20 bp, Artificial Sequence
  Synthetic oligonucleotide; CAG chr2 60525519 60525538 60525522 -
gggctcacctgcaaagacag

SEQ ID NO: 175012 - DNA, 20 bp, Artificial Sequence
  Synthetic oligonucleotide; AAG chr2 60525491 60525510 60525494 -
tattttcttgatttgcctca

SEQ ID NO: 175013 - DNA, 20 bp, Artificial Sequence
  Synthetic oligonucleotide; TGG chr2 60525487 60525506 60525490 -
ttcttgatttgcctcaaaga

SEQ ID NO: 175014 - DNA, 20 bp, Artificial Sequence
  Synthetic oligonucleotide; AAG chr2 60525484 60525503 60525487 -
ttgatttgcctcaaagatgg

SEQ ID NO: 175015 - DNA, 20 bp, Artificial Sequence
  Synthetic oligonucleotide; TGG chr2 60525478 60525497 60525481 -
tgcctcaaagatggaagcta

SEQ ID NO: 175016 - DNA, 20 bp, Artificial Sequence
  Synthetic oligonucleotide; TGG chr2 60525475 60525494 60525478 -
ctcaaagatggaagctatgg

SEQ ID NO: 175017 - DNA, 20 bp, Artificial Sequence
  Synthetic oligonucleotide; GAG chr2 60525473 60525492 60525476 -
caaagatggaagctatggtg

SEQ ID NO: 175018 - DNA, 20 bp, Artificial Sequence
  Synthetic oligonucleotide; AAG chr2 60525467 60525486 60525470 -
tggaagctatggtggagatt

SEQ ID NO: 175019 - DNA, 20 bp, Artificial Sequence
  Synthetic oligonucleotide; AGG chr2 60525466 60525485 60525469 -
ggaagctatggtggagatta

SEQ ID NO: 175020 - DNA, 20 bp, Artificial Sequence
  Synthetic oligonucleotide; TGG chr2 60525461 60525480 60525464 -
ctatggtggagattaaggct

SEQ ID NO: 175021 - DNA, 20 bp, Artificial Sequence
  Synthetic oligonucleotide; CAG chr2 60525442 60525461 60525445 -
ttggattcgtgattccccaa

SEQ ID NO: 175022 - DNA, 20 bp, Artificial Sequence
  Synthetic oligonucleotide; AAG chr2 60525438 60525457 60525441 -
attcgtgattccccaacaga

SEQ ID NO: 175023 - DNA, 20 bp, Artificial Sequence
  Synthetic oligonucleotide; AAG chr2 60525431 60525450 60525434 -
attccccaacagaaagctta

SEQ ID NO: 175024 - DNA, 20 bp, Artificial Sequence
  Synthetic oligonucleotide; AGG chr2 60525430 60525449 60525433 -
ttccccaacagaaagcttaa

SEQ ID NO: 175025 - DNA, 20 bp, Artificial Sequence
  Synthetic oligonucleotide; TGG chr2 60525412 60525431 60525415 -
aaaggcatctttcaaattgc

SEQ ID NO: 175026 - DNA, 20 bp, Artificial Sequence
  Synthetic oligonucleotide; AAG chr2 60525409 60525428 60525412 -
ggcatctttcaaattgctgg

SEQ ID NO: 175027 - DNA, 20 bp, Artificial Sequence
  Synthetic oligonucleotide; AAG chr2 60525398 60525417 60525401 -
aattgctggaagcaaaattg

SEQ ID NO: 175028 - DNA, 20 bp, Artificial Sequence
  Synthetic oligonucleotide; CAG chr2 60525393 60525412 60525396 -
ctggaagcaaaattgaagtg

SEQ ID NO: 175029 - DNA, 20 bp, Artificial Sequence
  Synthetic oligonucleotide; TGG chr2 60525385 60525404 60525388 -
aaaattgaagtgcagtataa

SEQ ID NO: 175030 - DNA, 20 bp, Artificial Sequence
  Synthetic oligonucleotide; TGG chr2 60525380 60525399 60525383 -
tgaagtgcagtataatggaa

SEQ ID NO: 175031 - DNA, 20 bp, Artificial Sequence
  Synthetic oligonucleotide; CAG chr2 60525367 60525386 60525370 -
aatggaatggtgataattca

SEQ ID NO: 175032 - DNA, 20 bp, Artificial Sequence
  Synthetic oligonucleotide; AAG chr2 60525364 60525383 60525367 -
ggaatggtgataattcacag

SEQ ID NO: 175033 - DNA, 20 bp, Artificial Sequence
  Synthetic oligonucleotide; CAG chr2 60525357 60525376 60525360 -
tgataattcacagaagtttc

SEQ ID NO: 175034 - DNA, 20 bp, Artificial Sequence
  Synthetic oligonucleotide; AAG chr2 60525348 60525367 60525351 -
acagaagtttccagccttat

SEQ ID NO: 175035 - DNA, 20 bp, Artificial Sequence
  Synthetic oligonucleotide; AAG chr2 60525321 60525340 60525324 -
ctccatcttttaattgttgc

SEQ ID NO: 175036 - DNA, 20 bp, Artificial Sequence
  Synthetic oligonucleotide; AAG chr2 60525296 60525315 60525299 -
gttttttttgaaaaactcca

SEQ ID NO: 175037 - DNA, 20 bp, Artificial Sequence
  Synthetic oligonucleotide; AAG chr2 60525272 60525291 60525275 -
atgtaatgtgtattttctcc

SEQ ID NO: 175038 - DNA, 20 bp, Artificial Sequence
  Synthetic oligonucleotide; TGG chr2 60525259 60525278 60525262 -
tttctccaagtttgcttttt

SEQ ID NO: 175039 - DNA, 20 bp, Artificial Sequence
  Synthetic oligonucleotide; GGG chr2 60525258 60525277 60525261 -
ttctccaagtttgctttttt

SEQ ID NO: 175040 - DNA, 20 bp, Artificial Sequence
  Synthetic oligonucleotide; TAG chr2 60525235 60525254 60525238 -
caaatgtaactacatcaaaa

SEQ ID NO: 175041 - DNA, 20 bp, Artificial Sequence
  Synthetic oligonucleotide; AAG chr2 60525232 60525251 60525235 -
atgtaactacatcaaaatag

SEQ ID NO: 175042 - DNA, 20 bp, Artificial Sequence
  Synthetic oligonucleotide; AAG chr2 60525216 60525235 60525219 -
atagaagtacgtttttgaaa

SEQ ID NO: 175043 - DNA, 20 bp, Artificial Sequence
  Synthetic oligonucleotide; TAG chr2 60525210 60525229 60525213 -
gtacgtttttgaaaaagaaa

SEQ ID NO: 175044 - DNA, 20 bp, Artificial Sequence
  Synthetic oligonucleotide; CAG chr2 60525192 60525211 60525195 -
aatagttgaattcaaacaac

SEQ ID NO: 175045 - DNA, 20 bp, Artificial Sequence
  Synthetic oligonucleotide; AGG chr2 60525191 60525210 60525194 -
atagttgaattcaaacaacc

SEQ ID NO: 175046 - DNA, 20 bp, Artificial Sequence
  Synthetic oligonucleotide; CAG chr2 60525159 60525178 60525162 -
ttcaattaactgactgaatt

SEQ ID NO: 175047 - DNA, 20 bp, Artificial Sequence
  Synthetic oligonucleotide; AAG chr2 60525129 60525148 60525132 -
ttcctccttcctcctcccaa

SEQ ID NO: 175048 - DNA, 20 bp, Artificial Sequence
  Synthetic oligonucleotide; TGG chr2 60525125 60525144 60525128 -
tccttcctcctcccaaaagc

SEQ ID NO: 175049 - DNA, 20 bp, Artificial Sequence
  Synthetic oligonucleotide; TGG chr2 60525112 60525131 60525115 -
caaaagctggtttctctgta

SEQ ID NO: 175050 - DNA, 20 bp, Artificial Sequence
  Synthetic oligonucleotide; TAG chr2 60525106 60525125 60525109 -
ctggtttctctgtatggaca

SEQ ID NO: 175051 - DNA, 20 bp, Artificial Sequence
  Synthetic oligonucleotide; GAG chr2 60525091 60525110 60525094 -
ggacatagcctacatatgct

SEQ ID NO: 175052 - DNA, 20 bp, Artificial Sequence
  Synthetic oligonucleotide; TGG chr2 60525084 60525103 60525087 -
gcctacatatgctgagtccc

SEQ ID NO: 175053 - DNA, 20 bp, Artificial Sequence
  Synthetic oligonucleotide; GAG chr2 60525082 60525101 60525085 -
ctacatatgctgagtccctg

SEQ ID NO: 175054 - DNA, 20 bp, Artificial Sequence
  Synthetic oligonucleotide; TAG chr2 60525078 60525097 60525081 -
atatgctgagtccctggagt

SEQ ID NO: 175055 - DNA, 20 bp, Artificial Sequence
  Synthetic oligonucleotide; AGG chr2 60525077 60525096 60525080 -
tatgctgagtccctggagtt

SEQ ID NO: 175056 - DNA, 20 bp, Artificial Sequence
  Synthetic oligonucleotide; AAG chr2 60525059 60525078 60525062 -
ttaggaatttttgcttgtta

SEQ ID NO: 175057 - DNA, 20 bp, Artificial Sequence
  Synthetic oligonucleotide; AGG chr2 60525058 60525077 60525061 -
taggaatttttgcttgttaa

SEQ ID NO: 175058 - DNA, 20 bp, Artificial Sequence
  Synthetic oligonucleotide; TAG chr2 60525037 60525056 60525040 -
ggcatccgatgcaacatgtt

SEQ ID NO: 175059 - DNA, 20 bp, Artificial Sequence
  Synthetic oligonucleotide; AAG chr2 60525034 60525053 60525037 -
atccgatgcaacatgtttag

SEQ ID NO: 175060 - DNA, 20 bp, Artificial Sequence
  Synthetic oligonucleotide; TAG chr2 60525017 60525036 60525020 -
tagaagaactctccctctgt

SEQ ID NO: 175061 - DNA, 20 bp, Artificial Sequence
  Synthetic oligonucleotide; AAG chr2 60525009 60525028 60525012 -
ctctccctctgttagtgttg

SEQ ID NO: 175062 - DNA, 20 bp, Artificial Sequence
  Synthetic oligonucleotide; CAG chr2 60525005 60525024 60525008 -
ccctctgttagtgttgaaga

SEQ ID NO: 175063 - DNA, 20 bp, Artificial Sequence
  Synthetic oligonucleotide; GAG chr2 60524994 60525013 60524997 -
tgttgaagacagcataaatt

SEQ ID NO: 175064 - DNA, 20 bp, Artificial Sequence
  Synthetic oligonucleotide; AGG chr2 60524993 60525012 60524996 -
gttgaagacagcataaattg

SEQ ID NO: 175065 - DNA, 20 bp, Artificial Sequence
  Synthetic oligonucleotide; GGG chr2 60524992 60525011 60524995 -
ttgaagacagcataaattga

SEQ ID NO: 175066 - DNA, 20 bp, Artificial Sequence
  Synthetic oligonucleotide; TAG chr2 60524963 60524982 60524966 -
ttctttttttattcatcatg

SEQ ID NO: 175067 - DNA, 20 bp, Artificial Sequence
  Synthetic oligonucleotide; AGG chr2 60524962 60524981 60524965 -
tctttttttattcatcatgt

SEQ ID NO: 175068 - DNA, 20 bp, Artificial Sequence
  Synthetic oligonucleotide; AAG chr2 60524956 60524975 60524959 -
tttattcatcatgtaggtaa

SEQ ID NO: 175069 - DNA, 20 bp, Artificial Sequence
  Synthetic oligonucleotide; TGG chr2 60524949 60524968 60524952 -
atcatgtaggtaaaagcata

SEQ ID NO: 175070 - DNA, 20 bp, Artificial Sequence
  Synthetic oligonucleotide; TGG chr2 60524939 60524958 60524942 -
taaaagcatatggcctgttc

SEQ ID NO: 175071 - DNA, 20 bp, Artificial Sequence
  Synthetic oligonucleotide; GGG chr2 60524938 60524957 60524941 -
aaaagcatatggcctgttct

SEQ ID NO: 175072 - DNA, 20 bp, Artificial Sequence
  Synthetic oligonucleotide; TGG chr2 60524903 60524922 60524906 -
tgcaatccattttttaaact

SEQ ID NO: 175073 - DNA, 20 bp, Artificial Sequence
  Synthetic oligonucleotide; TGG chr2 60524890 60524909 60524893 -
ttaaacttggtgtttaccat

SEQ ID NO: 175074 - DNA, 20 bp, Artificial Sequence
  Synthetic oligonucleotide; TAG chr2 60524883 60524902 60524886 -
tggtgtttaccattggcttt

SEQ ID NO: 175075 - DNA, 20 bp, Artificial Sequence
  Synthetic oligonucleotide; CGG chr2 60524878 60524897 60524881 -
tttaccattggcttttagca

SEQ ID NO: 175076 - DNA, 20 bp, Artificial Sequence
  Synthetic oligonucleotide; CAG chr2 60524852 60524871 60524855 -
tttctgttttccacactgtc

SEQ ID NO: 175077 - DNA, 20 bp, Artificial Sequence
  Synthetic oligonucleotide; TGG chr2 60524832 60524851 60524835 -
cagcaaataccatttatatg

SEQ ID NO: 175078 - DNA, 20 bp, Artificial Sequence
  Synthetic oligonucleotide; GAG chr2 60524821 60524840 60524824 -
atttatatgtggcattgaat

SEQ ID NO: 175079 - DNA, 20 bp, Artificial Sequence
  Synthetic oligonucleotide; CAG chr2 60524804 60524823 60524807 -
aatgagatatgaaatgtttt

SEQ ID NO: 175080 - DNA, 20 bp, Artificial Sequence
  Synthetic oligonucleotide; AAG chr2 60524801 60524820 60524804 -
gagatatgaaatgttttcag

SEQ ID NO: 175081 - DNA, 20 bp, Artificial Sequence
  Synthetic oligonucleotide; AAG chr2 60524788 60524807 60524791 -
ttttcagaagcatgctgaaa

SEQ ID NO: 175082 - DNA, 20 bp, Artificial Sequence
  Synthetic oligonucleotide; AGG chr2 60524787 60524806 60524790 -
tttcagaagcatgctgaaaa

SEQ ID NO: 175083 - DNA, 20 bp, Artificial Sequence
  Synthetic oligonucleotide; GGG chr2 60524786 60524805 60524789 -
ttcagaagcatgctgaaaaa

SEQ ID NO: 175084 - DNA, 20 bp, Artificial Sequence
  Synthetic oligonucleotide; AAG chr2 60524777 60524796 60524780 -
atgctgaaaaagggcattca

SEQ ID NO: 175085 - DNA, 20 bp, Artificial Sequence
  Synthetic oligonucleotide; TGG chr2 60524766 60524785 60524769 -
gggcattcaaagttatcctt

SEQ ID NO: 175086 - DNA, 20 bp, Artificial Sequence
  Synthetic oligonucleotide; CAG chr2 60524722 60524741 60524725 -
cttttattatcccatgtgct

SEQ ID NO: 175087 - DNA, 20 bp, Artificial Sequence
  Synthetic oligonucleotide; GAG chr2 60524720 60524739 60524723 -
tttattatcccatgtgctca

SEQ ID NO: 175088 - DNA, 20 bp, Artificial Sequence
  Synthetic oligonucleotide; AAG chr2 60524716 60524735 60524719 -
ttatcccatgtgctcagagt

SEQ ID NO: 175089 - DNA, 20 bp, Artificial Sequence
  Synthetic oligonucleotide; AGG chr2 60524715 60524734 60524718 -
tatcccatgtgctcagagta

SEQ ID NO: 175090 - DNA, 20 bp, Artificial Sequence
  Synthetic oligonucleotide; GGG chr2 60524714 60524733 60524717 -
atcccatgtgctcagagtaa

SEQ ID NO: 175091 - DNA, 20 bp, Artificial Sequence
  Synthetic oligonucleotide; GGG chr2 60524713 60524732 60524716 -
tcccatgtgctcagagtaag

SEQ ID NO: 175092 - DNA, 20 bp, Artificial Sequence
  Synthetic oligonucleotide; CAG chr2 60524701 60524720 60524704 -
agagtaaggggcaaatgaat

SEQ ID NO: 175093 - DNA, 20 bp, Artificial Sequence
  Synthetic oligonucleotide; TAG chr2 60524677 60524696 60524680 -
tgtgaaatatgtgttccttg

SEQ ID NO: 175094 - DNA, 20 bp, Artificial Sequence
  Synthetic oligonucleotide; AGG chr2 60524676 60524695 60524679 -
gtgaaatatgtgttccttgt

SEQ ID NO: 175095 - DNA, 20 bp, Artificial Sequence
  Synthetic oligonucleotide; CAG chr2 60524670 60524689 60524673 -
tatgtgttccttgtaggaca

SEQ ID NO: 175096 - DNA, 20 bp, Artificial Sequence
  Synthetic oligonucleotide; AGG chr2 60524669 60524688 60524672 -
atgtgttccttgtaggacac

SEQ ID NO: 175097 - DNA, 20 bp, Artificial Sequence
  Synthetic oligonucleotide; GAG chr2 60524659 60524678 60524662 -
tgtaggacacaggcactctt

SEQ ID NO: 175098 - DNA, 20 bp, Artificial Sequence
  Synthetic oligonucleotide; TAG chr2 60524651 60524670 60524654 -
acaggcactcttgagatcta

SEQ ID NO: 175099 - DNA, 20 bp, Artificial Sequence
  Synthetic oligonucleotide; AAG chr2 60524638 60524657 60524641 -
agatctatagcttcaataaa

SEQ ID NO: 175100 - DNA, 20 bp, Artificial Sequence
  Synthetic oligonucleotide; AGG chr2 60524637 60524656 60524640 -
gatctatagcttcaataaaa

SEQ ID NO: 175101 - DNA, 20 bp, Artificial Sequence
  Synthetic oligonucleotide; TGG chr2 60524594 60524613 60524597 -
ctctttaatttataatgttt

SEQ ID NO: 175102 - DNA, 20 bp, Artificial Sequence
  Synthetic oligonucleotide; GGG chr2 60524593 60524612 60524596 -
tctttaatttataatgtttt

SEQ ID NO: 175103 - DNA, 20 bp, Artificial Sequence
  Synthetic oligonucleotide; GGG chr2 60524592 60524611 60524595 -
ctttaatttataatgttttg

SEQ ID NO: 175104 - DNA, 20 bp, Artificial Sequence
  Synthetic oligonucleotide; TAG chr2 60524581 60524600 60524584 -
aatgttttggggatttttaa

SEQ ID NO: 175105 - DNA, 20 bp, Artificial Sequence
  Synthetic oligonucleotide; AGG chr2 60524580 60524599 60524583 -
atgttttggggatttttaat

SEQ ID NO: 175106 - DNA, 20 bp, Artificial Sequence
  Synthetic oligonucleotide; AAG chr2 60524567 60524586 60524570 -
ttttaataggcatgctctgt

SEQ ID NO: 175107 - DNA, 20 bp, Artificial Sequence
  Synthetic oligonucleotide; AGG chr2 60524566 60524585 60524569 -
tttaataggcatgctctgta

SEQ ID NO: 175108 - DNA, 20 bp, Artificial Sequence
  Synthetic oligonucleotide; GGG chr2 60524565 60524584 60524568 -
ttaataggcatgctctgtaa

SEQ ID NO: 175109 - DNA, 20 bp, Artificial Sequence
  Synthetic oligonucleotide; TGG chr2 60524559 60524578 60524562 -
ggcatgctctgtaagggcac

SEQ ID NO: 175110 - DNA, 20 bp, Artificial Sequence
  Synthetic oligonucleotide; CAG chr2 60524552 60524571 60524555 -
tctgtaagggcactggtaat

SEQ ID NO: 175111 - DNA, 20 bp, Artificial Sequence
  Synthetic oligonucleotide; TGG chr2 60524518 60524537 60524521 -
tttgcatgctcttctatctc

SEQ ID NO: 175112 - DNA, 20 bp, Artificial Sequence
  Synthetic oligonucleotide; AAG chr2 60524491 60524510 60524494 -
aaaataaaatcttaaaaaac

SEQ ID NO: 175113 - DNA, 20 bp, Artificial Sequence
  Synthetic oligonucleotide; AAG chr2 60524484 60524503 60524487 -
aatcttaaaaaacaagaaaa

SEQ ID NO: 175114 - DNA, 20 bp, Artificial Sequence
  Synthetic oligonucleotide; AAG chr2 60524459 60524478 60524462 -
aaaaaaacaaaaacaaaaac

SEQ ID NO: 175115 - DNA, 20 bp, Artificial Sequence
  Synthetic oligonucleotide; AGG chr2 60524458 60524477 60524461 -
aaaaaacaaaaacaaaaaca

SEQ ID NO: 175116 - DNA, 20 bp, Artificial Sequence
  Synthetic oligonucleotide; AAG chr2 60524449 60524468 60524452 -
aaacaaaaacaaggaacata

SEQ ID NO: 175117 - DNA, 20 bp, Artificial Sequence
  Synthetic oligonucleotide; TAG chr2 60524444 60524463 60524447 -
aaaacaaggaacataaagtt

SEQ ID NO: 175118 - DNA, 20 bp, Artificial Sequence
  Synthetic oligonucleotide; AAG chr2 60524425 60524444 60524428 -
ttagccctaacccaacccaa

SEQ ID NO: 175119 - DNA, 20 bp, Artificial Sequence
  Synthetic oligonucleotide; CAG chr2 60524415 60524434 60524418 -
cccaacccaaaagcaaataa

SEQ ID NO: 175120 - DNA, 20 bp, Artificial Sequence
  Synthetic oligonucleotide; AGG chr2 60524414 60524433 60524417 -
ccaacccaaaagcaaataac

SEQ ID NO: 175121 - DNA, 20 bp, Artificial Sequence
  Synthetic oligonucleotide; TGG chr2 60524402 60524421 60524405 -
caaataacaggccgaatgaa

SEQ ID NO: 175122 - DNA, 20 bp, Artificial Sequence
  Synthetic oligonucleotide; CAG chr2 60524399 60524418 60524402 -
ataacaggccgaatgaatgg

SEQ ID NO: 175123 - DNA, 20 bp, Artificial Sequence
  Synthetic oligonucleotide; CAG chr2 60524391 60524410 60524394 -
ccgaatgaatggcagccccc

SEQ ID NO: 175124 - DNA, 20 bp, Artificial Sequence
  Synthetic oligonucleotide; GAG chr2 60524389 60524408 60524392 -
gaatgaatggcagcccccca

SEQ ID NO: 175125 - DNA, 20 bp, Artificial Sequence
  Synthetic oligonucleotide; AGG chr2 60524388 60524407 60524391 -
aatgaatggcagccccccag

SEQ ID NO: 175126 - DNA, 20 bp, Artificial Sequence
  Synthetic oligonucleotide; AAG chr2 60524351 60524370 60524354 -
tccattattacctgaaataa

SEQ ID NO: 175127 - DNA, 20 bp, Artificial Sequence
  Synthetic oligonucleotide; CAG chr2 60524331 60524350 60524334 -
aagcatgataacattcatgc

SEQ ID NO: 175128 - DNA, 20 bp, Artificial Sequence
  Synthetic oligonucleotide; GAG chr2 60524329 60524348 60524332 -
gcatgataacattcatgcca

SEQ ID NO: 175129 - DNA, 20 bp, Artificial Sequence
  Synthetic oligonucleotide; TAG chr2 60524325 60524344 60524328 -
gataacattcatgccagaga

SEQ ID NO: 175130 - DNA, 20 bp, Artificial Sequence
  Synthetic oligonucleotide; AGG chr2 60524324 60524343 60524327 -
ataacattcatgccagagat

SEQ ID NO: 175131 - DNA, 20 bp, Artificial Sequence
  Synthetic oligonucleotide; CAG chr2 60524304 60524323 60524307 -
aggtgacaaaattatgtatt

SEQ ID NO: 175132 - DNA, 20 bp, Artificial Sequence
  Synthetic oligonucleotide; AAG chr2 60524296 60524315 60524299 -
aaattatgtattcagacatg

SEQ ID NO: 175133 - DNA, 20 bp, Artificial Sequence
  Synthetic oligonucleotide; TAG chr2 60524291 60524310 60524294 -
atgtattcagacatgaagtt

SEQ ID NO: 175134 - DNA, 20 bp, Artificial Sequence
  Synthetic oligonucleotide; AGG chr2 60524290 60524309 60524293 -
tgtattcagacatgaagttt

SEQ ID NO: 175135 - DNA, 20 bp, Artificial Sequence
  Synthetic oligonucleotide; TAG chr2 60524281 60524300 60524284 -
acatgaagtttaggatttca

SEQ ID NO: 175136 - DNA, 20 bp, Artificial Sequence
  Synthetic oligonucleotide; CAG chr2 60524228 60524247 60524231 -
attgtgttgtgcaaatgtat

SEQ ID NO: 175137 - DNA, 20 bp, Artificial Sequence
  Synthetic oligonucleotide; TAG chr2 60524203 60524222 60524206 -
gttgtattgttaatgcatga

SEQ ID NO: 175138 - DNA, 20 bp, Artificial Sequence
  Synthetic oligonucleotide; AGG chr2 60524202 60524221 60524205 -
ttgtattgttaatgcatgat

SEQ ID NO: 175139 - DNA, 20 bp, Artificial Sequence
  Synthetic oligonucleotide; AAG chr2 60524199 60524218 60524202 -
tattgttaatgcatgatagg

SEQ ID NO: 175140 - DNA, 20 bp, Artificial Sequence
  Synthetic oligonucleotide; TAG chr2 60524189 60524208 60524192 -
gcatgataggaagctgccgc

SEQ ID NO: 175141 - DNA, 20 bp, Artificial Sequence
  Synthetic oligonucleotide; AGG chr2 60524188 60524207 60524191 -
catgataggaagctgccgct

SEQ ID NO: 175142 - DNA, 20 bp, Artificial Sequence
  Synthetic oligonucleotide; CAG chr2 60524184 60524203 60524187 -
ataggaagctgccgctagga

SEQ ID NO: 175143 - DNA, 20 bp, Artificial Sequence
  Synthetic oligonucleotide; TGG chr2 60524178 60524197 60524181 -
agctgccgctaggacagtct

SEQ ID NO: 175144 - DNA, 20 bp, Artificial Sequence
  Synthetic oligonucleotide; CGG chr2 60524165 60524184 60524168 -
acagtcttggctcactaatg

SEQ ID NO: 175145 - DNA, 20 bp, Artificial Sequence
  Synthetic oligonucleotide; CAG chr2 60524161 60524180 60524164 -
tcttggctcactaatgcggt

SEQ ID NO: 175146 - DNA, 20 bp, Artificial Sequence
  Synthetic oligonucleotide; TAG chr2 60524138 60524157 60524141 -
ctgtgtcacaatgtgatata

SEQ ID NO: 175147 - DNA, 20 bp, Artificial Sequence
  Synthetic oligonucleotide; TGG chr2 60524122 60524141 60524125 -
tatatagattatatttacca

SEQ ID NO: 175148 - DNA, 20 bp, Artificial Sequence
  Synthetic oligonucleotide; TGG chr2 60524101 60524120 60524104 -
ggcatattttgtttgcgaaa

SEQ ID NO: 175149 - DNA, 20 bp, Artificial Sequence
  Synthetic oligonucleotide; GGG chr2 60524100 60524119 60524103 -
gcatattttgtttgcgaaat

SEQ ID NO: 175150 - DNA, 20 bp, Artificial Sequence
  Synthetic oligonucleotide; GAG chr2 60524098 60524117 60524101 -
atattttgtttgcgaaatgg

SEQ ID NO: 175151 - DNA, 20 bp, Artificial Sequence
  Synthetic oligonucleotide; CGG chr2 60524095 60524114 60524098 -
ttttgtttgcgaaatgggag

SEQ ID NO: 175152 - DNA, 20 bp, Artificial Sequence
  Synthetic oligonucleotide; AAG chr2 60524082 60524101 60524085 -
atgggagcggatgataaatg

SEQ ID NO: 175153 - DNA, 20 bp, Artificial Sequence
  Synthetic oligonucleotide; CAG chr2 60524071 60524090 60524074 -
tgataaatgaagataccctc

SEQ ID NO: 175154 - DNA, 20 bp, Artificial Sequence
  Synthetic oligonucleotide; TAG chr2 60524059 60524078 60524062 -
ataccctccagttttcacac

SEQ ID NO: 175155 - DNA, 20 bp, Artificial Sequence
  Synthetic oligonucleotide; TGG chr2 60524050 60524069 60524053 -
agttttcacactagttcctg

SEQ ID NO: 175156 - DNA, 20 bp, Artificial Sequence
  Synthetic oligonucleotide; CGG chr2 60524045 60524064 60524048 -
tcacactagttcctgtggtc

SEQ ID NO: 175157 - DNA, 20 bp, Artificial Sequence
  Synthetic oligonucleotide; GAG chr2 60524043 60524062 60524046 -
acactagttcctgtggtccg

SEQ ID NO: 175158 - DNA, 20 bp, Artificial Sequence
  Synthetic oligonucleotide; AAG chr2 60524026 60524045 60524029 -
ccggagtctctcaaacaata

SEQ ID NO: 175159 - DNA, 20 bp, Artificial Sequence
  Synthetic oligonucleotide; TGG chr2 60524011 60524030 60524014 -
caataaagcacccctgataa

SEQ ID NO: 175160 - DNA, 20 bp, Artificial Sequence
  Synthetic oligonucleotide; GAG chr2 60524009 60524028 60524012 -
ataaagcacccctgataatg

SEQ ID NO: 175161 - DNA, 20 bp, Artificial Sequence
  Synthetic oligonucleotide; GAG chr2 60524007 60524026 60524010 -
aaagcacccctgataatgga

SEQ ID NO: 175162 - DNA, 20 bp, Artificial Sequence
  Synthetic oligonucleotide; AGG chr2 60524006 60524025 60524009 -
aagcacccctgataatggag

SEQ ID NO: 175163 - DNA, 20 bp, Artificial Sequence
  Synthetic oligonucleotide; TGG chr2 60523997 60524016 60524000 -
tgataatggagaggtattta

SEQ ID NO: 175164 - DNA, 20 bp, Artificial Sequence
  Synthetic oligonucleotide; GGG chr2 60523996 60524015 60523999 -
gataatggagaggtatttat

SEQ ID NO: 175165 - DNA, 20 bp, Artificial Sequence
  Synthetic oligonucleotide; AAG chr2 60523977 60523996 60523980 -
tgggaacataattgacttca

SEQ ID NO: 175166 - DNA, 20 bp, Artificial Sequence
  Synthetic oligonucleotide; TAG chr2 60523971 60523990 60523974 -
cataattgacttcaaagttt

SEQ ID NO: 175167 - DNA, 20 bp, Artificial Sequence
  Synthetic oligonucleotide; TGG chr2 60523963 60523982 60523966 -
acttcaaagttttagatctc

SEQ ID NO: 175168 - DNA, 20 bp, Artificial Sequence
  Synthetic oligonucleotide; AAG chr2 60523957 60523976 60523960 -
aagttttagatctctggctg

SEQ ID NO: 175169 - DNA, 20 bp, Artificial Sequence
  Synthetic oligonucleotide; AAG chr2 60523951 60523970 60523954 -
tagatctctggctgaagttt

SEQ ID NO: 175170 - DNA, 20 bp, Artificial Sequence
  Synthetic oligonucleotide; TGG chr2 60523947 60523966 60523950 -
tctctggctgaagtttaaga

SEQ ID NO: 175171 - DNA, 20 bp, Artificial Sequence
  Synthetic oligonucleotide; GGG chr2 60523946 60523965 60523949 -
ctctggctgaagtttaagat

SEQ ID NO: 175172 - DNA, 20 bp, Artificial Sequence
  Synthetic oligonucleotide; TAG chr2 60523942 60523961 60523945 -
ggctgaagtttaagatggga

SEQ ID NO: 175173 - DNA, 20 bp, Artificial Sequence
  Synthetic oligonucleotide; AAG chr2 60523914 60523933 60523917 -
tacattaatgtctgtgctta

SEQ ID NO: 175174 - DNA, 20 bp, Artificial Sequence
  Synthetic oligonucleotide; TGG chr2 60523903 60523922 60523906 -
ctgtgcttaaagctcctatt

SEQ ID NO: 175175 - DNA, 20 bp, Artificial Sequence
  Synthetic oligonucleotide; TAG chr2 60523885 60523904 60523888 -
tttggcttaaataaattatt

SEQ ID NO: 175176 - DNA, 20 bp, Artificial Sequence
  Synthetic oligonucleotide; AGG chr2 60523884 60523903 60523887 -
ttggcttaaataaattattt

SEQ ID NO: 175177 - DNA, 20 bp, Artificial Sequence
  Synthetic oligonucleotide; GGG chr2 60523883 60523902 60523886 -
tggcttaaataaattattta

SEQ ID NO: 175178 - DNA, 20 bp, Artificial Sequence
  Synthetic oligonucleotide; TGG chr2 60523864 60523883 60523867 -
agggtttactgcttaaacct

SEQ ID NO: 175179 - DNA, 20 bp, Artificial Sequence
  Synthetic oligonucleotide; TGG chr2 60523845 60523864 60523848 -
ttggtcaattcttgaacgtt

SEQ ID NO: 175180 - DNA, 20 bp, Artificial Sequence
  Synthetic oligonucleotide; GGG chr2 60523844 60523863 60523847 -
tggtcaattcttgaacgttt

SEQ ID NO: 175181 - DNA, 20 bp, Artificial Sequence
  Synthetic oligonucleotide; TAG chr2 60523840 60523859 60523843 -
caattcttgaacgtttgggc

SEQ ID NO: 175182 - DNA, 20 bp, Artificial Sequence
  Synthetic oligonucleotide; AAG chr2 60523835 60523854 60523838 -
cttgaacgtttgggctagtt

SEQ ID NO: 175183 - DNA, 20 bp, Artificial Sequence
  Synthetic oligonucleotide; CAG chr2 60523824 60523843 60523827 -
gggctagttaagtaattttc

SEQ ID NO: 175184 - DNA, 20 bp, Artificial Sequence
  Synthetic oligonucleotide; TGG chr2 60523806 60523825 60523809 -
tccagtgactttctgtgcct

SEQ ID NO: 175185 - DNA, 20 bp, Artificial Sequence
  Synthetic oligonucleotide; GAG chr2 60523785 60523804 60523788 -
ggtgattcatttacttgatt

SEQ ID NO: 175186 - DNA, 20 bp, Artificial Sequence
  Synthetic oligonucleotide; AAG chr2 60523745 60523764 60523748 -
gatttctaaatgtatttctc

SEQ ID NO: 175187 - DNA, 20 bp, Artificial Sequence
  Synthetic oligonucleotide; TGG chr2 60523735 60523754 60523738 -
tgtatttctcaagttttgcc

SEQ ID NO: 175188 - DNA, 20 bp, Artificial Sequence
  Synthetic oligonucleotide; TGG chr2 60523712 60523731 60523715 -
caatgaatgattttgcttac

SEQ ID NO: 175189 - DNA, 20 bp, Artificial Sequence
  Synthetic oligonucleotide; GAG chr2 60523710 60523729 60523713 -
atgaatgattttgcttactg

SEQ ID NO: 175190 - DNA, 20 bp, Artificial Sequence
  Synthetic oligonucleotide; TGG chr2 60523700 60523719 60523703 -
ttgcttactggagtcttgtg

SEQ ID NO: 175191 - DNA, 20 bp, Artificial Sequence
  Synthetic oligonucleotide; AAG chr2 60523686 60523705 60523689 -
cttgtgtggtacacctataa

SEQ ID NO: 175192 - DNA, 20 bp, Artificial Sequence
  Synthetic oligonucleotide; AGG chr2 60523685 60523704 60523688 -
ttgtgtggtacacctataaa

SEQ ID NO: 175193 - DNA, 20 bp, Artificial Sequence
  Synthetic oligonucleotide; AAG chr2 60523624 60523643 60523627 -
cacatcaacactgtcatcat

SEQ ID NO: 175194 - DNA, 20 bp, Artificial Sequence
  Synthetic oligonucleotide; AAG chr2 60523618 60523637 60523621 -
aacactgtcatcataagata

SEQ ID NO: 175195 - DNA, 20 bp, Artificial Sequence
  Synthetic oligonucleotide; TAG chr2 60523530 60523549 60523533 -
tgcatgtatgaatatatata

SEQ ID NO: 175196 - DNA, 20 bp, Artificial Sequence
  Synthetic oligonucleotide; TAG chr2 60523508 60523527 60523511 -
gttgtgtgcctgtgtgtgtg

SEQ ID NO: 175197 - DNA, 20 bp, Artificial Sequence
  Synthetic oligonucleotide; AAG chr2 60523504 60523523 60523507 -
tgtgcctgtgtgtgtgtaga

SEQ ID NO: 175198 - DNA, 20 bp, Artificial Sequence
  Synthetic oligonucleotide; AGG chr2 60523503 60523522 60523506 -
gtgcctgtgtgtgtgtagaa

SEQ ID NO: 175199 - DNA, 20 bp, Artificial Sequence
  Synthetic oligonucleotide; GGG chr2 60523502 60523521 60523505 -
tgcctgtgtgtgtgtagaaa

SEQ ID NO: 175200 - DNA, 20 bp, Artificial Sequence
  Synthetic oligonucleotide; GAG chr2 60523500 60523519 60523503 -
cctgtgtgtgtgtagaaagg

SEQ ID NO: 175201 - DNA, 20 bp, Artificial Sequence
  Synthetic oligonucleotide; GAG chr2 60523498 60523517 60523501 -
tgtgtgtgtgtagaaaggga

SEQ ID NO: 175202 - DNA, 20 bp, Artificial Sequence
  Synthetic oligonucleotide; GAG chr2 60523496 60523515 60523499 -
tgtgtgtgtagaaagggaga

SEQ ID NO: 175203 - DNA, 20 bp, Artificial Sequence
  Synthetic oligonucleotide; GAG chr2 60523494 60523513 60523497 -
tgtgtgtagaaagggagaga

SEQ ID NO: 175204 - DNA, 20 bp, Artificial Sequence
  Synthetic oligonucleotide; GAG chr2 60523492 60523511 60523495 -
tgtgtagaaagggagagaga

SEQ ID NO: 175205 - DNA, 20 bp, Artificial Sequence
  Synthetic oligonucleotide; TAG chr2 60523487 60523506 60523490 -
agaaagggagagagagagaa

SEQ ID NO: 175206 - DNA, 20 bp, Artificial Sequence
  Synthetic oligonucleotide; AGG chr2 60523486 60523505 60523489 -
gaaagggagagagagagaat

SEQ ID NO: 175207 - DNA, 20 bp, Artificial Sequence
  Synthetic oligonucleotide; AAG chr2 60523482 60523501 60523485 -
gggagagagagagaatagga

SEQ ID NO: 175208 - DNA, 20 bp, Artificial Sequence
  Synthetic oligonucleotide; TAG chr2 60523475 60523494 60523478 -
agagagaataggaaagtctt

SEQ ID NO: 175209 - DNA, 20 bp, Artificial Sequence
  Synthetic oligonucleotide; TAG chr2 60523444 60523463 60523447 -
atgattccatcaaatcaata

SEQ ID NO: 175210 - DNA, 20 bp, Artificial Sequence
  Synthetic oligonucleotide; AAG chr2 60523441 60523460 60523444 -
attccatcaaatcaatatag

SEQ ID NO: 175211 - DNA, 20 bp, Artificial Sequence
  Synthetic oligonucleotide; AAG chr2 60523431 60523450 60523434 -
atcaatatagaagtttttga

SEQ ID NO: 175212 - DNA, 20 bp, Artificial Sequence
  Synthetic oligonucleotide; TAG chr2 60523419 60523438 60523422 -
gtttttgaaagctatccatg

SEQ ID NO: 175213 - DNA, 20 bp, Artificial Sequence
  Synthetic oligonucleotide; AAG chr2 60523389 60523408 60523392 -
ttttcatcaaaatctgactt

SEQ ID NO: 175214 - DNA, 20 bp, Artificial Sequence
  Synthetic oligonucleotide; AAG chr2 60523359 60523378 60523362 -
tctccatactatttatctga

SEQ ID NO: 175215 - DNA, 20 bp, Artificial Sequence
  Synthetic oligonucleotide; TAG chr2 60523343 60523362 60523346 -
ctgaaagtctgttgttcaca

SEQ ID NO: 175216 - DNA, 20 bp, Artificial Sequence
  Synthetic oligonucleotide; TGG chr2 60523337 60523356 60523340 -
gtctgttgttcacatagcgc

SEQ ID NO: 175217 - DNA, 20 bp, Artificial Sequence
  Synthetic oligonucleotide; GAG chr2 60523331 60523350 60523334 -
tgttcacatagcgctggatt

SEQ ID NO: 175218 - DNA, 20 bp, Artificial Sequence
  Synthetic oligonucleotide; AGG chr2 60523330 60523349 60523333 -
gttcacatagcgctggattg

SEQ ID NO: 175219 - DNA, 20 bp, Artificial Sequence
  Synthetic oligonucleotide; TAG chr2 60523323 60523342 60523326 -
tagcgctggattgaggatca

SEQ ID NO: 175220 - DNA, 20 bp, Artificial Sequence
  Synthetic oligonucleotide; TGG chr2 60523320 60523339 60523323 -
cgctggattgaggatcatag

SEQ ID NO: 175221 - DNA, 20 bp, Artificial Sequence
  Synthetic oligonucleotide; TAG chr2 60523311 60523330 60523314 -
gaggatcatagtggcaaatt

SEQ ID NO: 175222 - DNA, 20 bp, Artificial Sequence
  Synthetic oligonucleotide; AGG chr2 60523310 60523329 60523313 -
aggatcatagtggcaaattt

SEQ ID NO: 175223 - DNA, 20 bp, Artificial Sequence
  Synthetic oligonucleotide; GAG chr2 60523308 60523327 60523311 -
gatcatagtggcaaatttag

SEQ ID NO: 175224 - DNA, 20 bp, Artificial Sequence
  Synthetic oligonucleotide; CAG chr2 60523302 60523321 60523305 -
agtggcaaatttaggagcaa

SEQ ID NO: 175225 - DNA, 20 bp, Artificial Sequence
  Synthetic oligonucleotide; AAG chr2 60523295 60523314 60523298 -
aatttaggagcaacagtccc

SEQ ID NO: 175226 - DNA, 20 bp, Artificial Sequence
  Synthetic oligonucleotide; CAG chr2 60523292 60523311 60523295 -
ttaggagcaacagtcccaag

SEQ ID NO: 175227 - DNA, 20 bp, Artificial Sequence
  Synthetic oligonucleotide; AGG chr2 60523291 60523310 60523294 -
taggagcaacagtcccaagc

SEQ ID NO: 175228 - DNA, 20 bp, Artificial Sequence
  Synthetic oligonucleotide; TGG chr2 60523283 60523302 60523286 -
acagtcccaagcaggaatcc

SEQ ID NO: 175229 - DNA, 20 bp, Artificial Sequence
  Synthetic oligonucleotide; TGG chr2 60523279 60523298 60523282 -
tcccaagcaggaatcctgga

SEQ ID NO: 175230 - DNA, 20 bp, Artificial Sequence
  Synthetic oligonucleotide; CAG chr2 60523276 60523295 60523279 -
caagcaggaatcctggatgg

SEQ ID NO: 175231 - DNA, 20 bp, Artificial Sequence
  Synthetic oligonucleotide; AGG chr2 60523275 60523294 60523278 -
aagcaggaatcctggatggc

SEQ ID NO: 175232 - DNA, 20 bp, Artificial Sequence
  Synthetic oligonucleotide; GAG chr2 60523252 60523271 60523255 -
ctgtcctttgtgcctcccct

SEQ ID NO: 175233 - DNA, 20 bp, Artificial Sequence
  Synthetic oligonucleotide; GAG chr2 60523247 60523266 60523250 -
ctttgtgcctcccctgagtt

SEQ ID NO: 175234 - DNA, 20 bp, Artificial Sequence
  Synthetic oligonucleotide; AAG chr2 60523244 60523263 60523247 -
tgtgcctcccctgagttgag

SEQ ID NO: 175235 - DNA, 20 bp, Artificial Sequence
  Synthetic oligonucleotide; TGG chr2 60523239 60523258 60523242 -
ctcccctgagttgagaagac

SEQ ID NO: 175236 - DNA, 20 bp, Artificial Sequence
  Synthetic oligonucleotide; TAG chr2 60523221 60523240 60523224 -
actggtgtttattctttctc

SEQ ID NO: 175237 - DNA, 20 bp, Artificial Sequence
  Synthetic oligonucleotide; AGG chr2 60523220 60523239 60523223 -
ctggtgtttattctttctct

SEQ ID NO: 175238 - DNA, 20 bp, Artificial Sequence
  Synthetic oligonucleotide; CGG chr2 60523181 60523200 60523184 -
cttgaaatctcccttcttta

SEQ ID NO: 175239 - DNA, 20 bp, Artificial Sequence
  Synthetic oligonucleotide; GAG chr2 60523169 60523188 60523172 -
cttctttacggttctgccat

SEQ ID NO: 175240 - DNA, 20 bp, Artificial Sequence
  Synthetic oligonucleotide; TGG chr2 60523138 60523157 60523141 -
ctgtgacctgcctctgcatc

SEQ ID NO: 175241 - DNA, 20 bp, Artificial Sequence
  Synthetic oligonucleotide; TGG chr2 60523130 60523149 60523133 -
tgcctctgcatctggttaaa

SEQ ID NO: 175242 - DNA, 20 bp, Artificial Sequence
  Synthetic oligonucleotide; CAG chr2 60523123 60523142 60523126 -
gcatctggttaaatggactt

SEQ ID NO: 175243 - DNA, 20 bp, Artificial Sequence
  Synthetic oligonucleotide; CAG chr2 60523109 60523128 60523112 -
ggacttcagtaatctgtaca

SEQ ID NO: 175244 - DNA, 20 bp, Artificial Sequence
  Synthetic oligonucleotide; AAG chr2 60523079 60523098 60523082 -
ttacttattttatatcctga

SEQ ID NO: 175245 - DNA, 20 bp, Artificial Sequence
  Synthetic oligonucleotide; AAG chr2 60523071 60523090 60523074 -
tttatatcctgaaagatatt

SEQ ID NO: 175246 - DNA, 20 bp, Artificial Sequence
  Synthetic oligonucleotide; AAG chr2 60523062 60523081 60523065 -
tgaaagatattaagtccaac

SEQ ID NO: 175247 - DNA, 20 bp, Artificial Sequence
  Synthetic oligonucleotide; CAG chr2 60523049 60523068 60523052 -
gtccaacaagcttttaccca

SEQ ID NO: 175248 - DNA, 20 bp, Artificial Sequence
  Synthetic oligonucleotide; GAG chr2 60523047 60523066 60523050 -
ccaacaagcttttacccaca

SEQ ID NO: 175249 - DNA, 20 bp, Artificial Sequence
  Synthetic oligonucleotide; CAG chr2 60523040 60523059 60523043 -
gcttttacccacagagtcta

SEQ ID NO: 175250 - DNA, 20 bp, Artificial Sequence
  Synthetic oligonucleotide; GAG chr2 60523038 60523057 60523041 -
ttttacccacagagtctaca

SEQ ID NO: 175251 - DNA, 20 bp, Artificial Sequence
  Synthetic oligonucleotide; CGG chr2 60523031 60523050 60523034 -
cacagagtctacagagaaaa

SEQ ID NO: 175252 - DNA, 20 bp, Artificial Sequence
  Synthetic oligonucleotide; CAG chr2 60523027 60523046 60523030 -
gagtctacagagaaaacggc

SEQ ID NO: 175253 - DNA, 20 bp, Artificial Sequence
  Synthetic oligonucleotide; AGG chr2 60523026 60523045 60523029 -
agtctacagagaaaacggcc

SEQ ID NO: 175254 - DNA, 20 bp, Artificial Sequence
  Synthetic oligonucleotide; TGG chr2 60522994 60523013 60522997 -
tttcaatctctgtgtctctc

SEQ ID NO: 175255 - DNA, 20 bp, Artificial Sequence
  Synthetic oligonucleotide; GAG chr2 60522992 60523011 60522995 -
tcaatctctgtgtctctctg

SEQ ID NO: 175256 - DNA, 20 bp, Artificial Sequence
  Synthetic oligonucleotide; TAG chr2 60522986 60523005 60522989 -
tctgtgtctctctggagcac

SEQ ID NO: 175257 - DNA, 20 bp, Artificial Sequence
  Synthetic oligonucleotide; CAG chr2 60522980 60522999 60522983 -
tctctctggagcactagttc

SEQ ID NO: 175258 - DNA, 20 bp, Artificial Sequence
  Synthetic oligonucleotide; GAG chr2 60522978 60522997 60522981 -
tctctggagcactagttcca

SEQ ID NO: 175259 - DNA, 20 bp, Artificial Sequence
  Synthetic oligonucleotide; AGG chr2 60522977 60522996 60522980 -
ctctggagcactagttccag

SEQ ID NO: 175260 - DNA, 20 bp, Artificial Sequence
  Synthetic oligonucleotide; TAG chr2 60522966 60522985 60522969 -
tagttccagaggctgatcaa

SEQ ID NO: 175261 - DNA, 20 bp, Artificial Sequence
  Synthetic oligonucleotide; AGG chr2 60522965 60522984 60522968 -
agttccagaggctgatcaat

SEQ ID NO: 175262 - DNA, 20 bp, Artificial Sequence
  Synthetic oligonucleotide; TAG chr2 60522954 60522973 60522957 -
ctgatcaataggttttattg

SEQ ID NO: 175263 - DNA, 20 bp, Artificial Sequence
  Synthetic oligonucleotide; AAG chr2 60522935 60522954 60522938 -
gtagacctcactgtctctaa

SEQ ID NO: 175264 - DNA, 20 bp, Artificial Sequence
  Synthetic oligonucleotide; TAG chr2 60522906 60522925 60522909 -
gaccttatcctgtctaaaaa

SEQ ID NO: 175265 - DNA, 20 bp, Artificial Sequence
  Synthetic oligonucleotide; CAG chr2 60522887 60522906 60522890 -
atagtatttgctcttgcctg

SEQ ID NO: 175266 - DNA, 20 bp, Artificial Sequence
  Synthetic oligonucleotide; TGG chr2 60522860 60522879 60522863 -
ttgacctgtgaaaacccatt

SEQ ID NO: 175267 - DNA, 20 bp, Artificial Sequence
  Synthetic oligonucleotide; TAG chr2 60522840 60522859 60522843 -
tggaacataactgacatatc

SEQ ID NO: 175268 - DNA, 20 bp, Artificial Sequence
  Synthetic oligonucleotide; CAG chr2 60522836 60522855 60522839 -
acataactgacatatctagt

SEQ ID NO: 175269 - DNA, 20 bp, Artificial Sequence
  Synthetic oligonucleotide; AAG chr2 60522823 60522842 60522826 -
atctagtcagctgtatatcc

SEQ ID NO: 175270 - DNA, 20 bp, Artificial Sequence
  Synthetic oligonucleotide; CAG chr2 60522795 60522814 60522798 -
ctctgtgaatgaattctgtg

SEQ ID NO: 175271 - DNA, 20 bp, Artificial Sequence
  Synthetic oligonucleotide; CAG chr2 60522785 60522804 60522788 -
gaattctgtgcagaaccgtc

SEQ ID NO: 175272 - DNA, 20 bp, Artificial Sequence
  Synthetic oligonucleotide; AGG chr2 60522784 60522803 60522787 -
aattctgtgcagaaccgtcc

SEQ ID NO: 175273 - DNA, 20 bp, Artificial Sequence
  Synthetic oligonucleotide; GAG chr2 60522782 60522801 60522785 -
ttctgtgcagaaccgtccag

SEQ ID NO: 175274 - DNA, 20 bp, Artificial Sequence
  Synthetic oligonucleotide; AAG chr2 60522766 60522785 60522769 -
ccaggagaacactttcttcc

SEQ ID NO: 175275 - DNA, 20 bp, Artificial Sequence
  Synthetic oligonucleotide; CAG chr2 60522751 60522770 60522754 -
cttccaagacaaatgaattc

SEQ ID NO: 175276 - DNA, 20 bp, Artificial Sequence
  Synthetic oligonucleotide; TGG chr2 60522738 60522757 60522741 -
tgaattccagttctgaacac

SEQ ID NO: 175277 - DNA, 20 bp, Artificial Sequence
  Synthetic oligonucleotide; GGG chr2 60522737 60522756 60522740 -
gaattccagttctgaacact

SEQ ID NO: 175278 - DNA, 20 bp, Artificial Sequence
  Synthetic oligonucleotide; GAG chr2 60522735 60522754 60522738 -
attccagttctgaacactgg

SEQ ID NO: 175279 - DNA, 20 bp, Artificial Sequence
  Synthetic oligonucleotide; CGG chr2 60522719 60522738 60522722 -
ctgggagtgcacctgcttgt

SEQ ID NO: 175280 - DNA, 20 bp, Artificial Sequence
  Synthetic oligonucleotide; TGG chr2 60522713 60522732 60522716 -
gtgcacctgcttgtcggatg

SEQ ID NO: 175281 - DNA, 20 bp, Artificial Sequence
  Synthetic oligonucleotide; TGG chr2 60522707 60522726 60522710 -
ctgcttgtcggatgtggtga

SEQ ID NO: 175282 - DNA, 20 bp, Artificial Sequence
  Synthetic oligonucleotide; GGG chr2 60522706 60522725 60522709 -
tgcttgtcggatgtggtgat

SEQ ID NO: 175283 - DNA, 20 bp, Artificial Sequence
  Synthetic oligonucleotide; TGG chr2 60522698 60522717 60522701 -
ggatgtggtgatgggccaca

SEQ ID NO: 175284 - DNA, 20 bp, Artificial Sequence
  Synthetic oligonucleotide; TGG chr2 60522695 60522714 60522698 -
tgtggtgatgggccacatgg

SEQ ID NO: 175285 - DNA, 20 bp, Artificial Sequence
  Synthetic oligonucleotide; GGG chr2 60522694 60522713 60522697 -
gtggtgatgggccacatggt

SEQ ID NO: 175286 - DNA, 20 bp, Artificial Sequence
  Synthetic oligonucleotide; GGG chr2 60522693 60522712 60522696 -
tggtgatgggccacatggtg

SEQ ID NO: 175287 - DNA, 20 bp, Artificial Sequence
  Synthetic oligonucleotide; GAG chr2 60522691 60522710 60522694 -
gtgatgggccacatggtggg

SEQ ID NO: 175288 - DNA, 20 bp, Artificial Sequence
  Synthetic oligonucleotide; GAG chr2 60522687 60522706 60522690 -
tgggccacatggtggggagt

SEQ ID NO: 175289 - DNA, 20 bp, Artificial Sequence
  Synthetic oligonucleotide; AGG chr2 60522686 60522705 60522689 -
gggccacatggtggggagtg

SEQ ID NO: 175290 - DNA, 20 bp, Artificial Sequence
  Synthetic oligonucleotide; GGG chr2 60522685 60522704 60522688 -
ggccacatggtggggagtga

SEQ ID NO: 175291 - DNA, 20 bp, Artificial Sequence
  Synthetic oligonucleotide; GAG chr2 60522683 60522702 60522686 -
ccacatggtggggagtgagg

SEQ ID NO: 175292 - DNA, 20 bp, Artificial Sequence
  Synthetic oligonucleotide; CAG chr2 60522677 60522696 60522680 -
ggtggggagtgagggagact

SEQ ID NO: 175293 - DNA, 20 bp, Artificial Sequence
  Synthetic oligonucleotide; AGG chr2 60522676 60522695 60522679 -
gtggggagtgagggagactc

SEQ ID NO: 175294 - DNA, 20 bp, Artificial Sequence
  Synthetic oligonucleotide; GGG chr2 60522675 60522694 60522678 -
tggggagtgagggagactca

SEQ ID NO: 175295 - DNA, 20 bp, Artificial Sequence
  Synthetic oligonucleotide; TGG chr2 60522668 60522687 60522671 -
tgagggagactcagggcctg

SEQ ID NO: 175296 - DNA, 20 bp, Artificial Sequence
  Synthetic oligonucleotide; GGG chr2 60522667 60522686 60522670 -
gagggagactcagggcctgt

SEQ ID NO: 175297 - DNA, 20 bp, Artificial Sequence
  Synthetic oligonucleotide; GGG chr2 60522666 60522685 60522669 -
agggagactcagggcctgtg

SEQ ID NO: 175298 - DNA, 20 bp, Artificial Sequence
  Synthetic oligonucleotide; CAG chr2 60522663 60522682 60522666 -
gagactcagggcctgtgggg

SEQ ID NO: 175299 - DNA, 20 bp, Artificial Sequence
  Synthetic oligonucleotide; TGG chr2 60522654 60522673 60522657 -
ggcctgtggggcagtcgatg

SEQ ID NO: 175300 - DNA, 20 bp, Artificial Sequence
  Synthetic oligonucleotide; GGG chr2 60522653 60522672 60522656 -
gcctgtggggcagtcgatgt

SEQ ID NO: 175301 - DNA, 20 bp, Artificial Sequence
  Synthetic oligonucleotide; GAG chr2 60522651 60522670 60522654 -
ctgtggggcagtcgatgtgg

SEQ ID NO: 175302 - DNA, 20 bp, Artificial Sequence
  Synthetic oligonucleotide; AGG chr2 60522650 60522669 60522653 -
tgtggggcagtcgatgtggg

SEQ ID NO: 175303 - DNA, 20 bp, Artificial Sequence
  Synthetic oligonucleotide; CAG chr2 60522640 60522659 60522643 -
tcgatgtgggaggactgtca

SEQ ID NO: 175304 - DNA, 20 bp, Artificial Sequence
  Synthetic oligonucleotide; GAG chr2 60522638 60522657 60522641 -
gatgtgggaggactgtcaca

SEQ ID NO: 175305 - DNA, 20 bp, Artificial Sequence
  Synthetic oligonucleotide; CAG chr2 60522630 60522649 60522633 -
aggactgtcacagagactct

SEQ ID NO: 175306 - DNA, 20 bp, Artificial Sequence
  Synthetic oligonucleotide; GAG chr2 60522628 60522647 60522631 -
gactgtcacagagactctca

SEQ ID NO: 175307 - DNA, 20 bp, Artificial Sequence
  Synthetic oligonucleotide; AGG chr2 60522627 60522646 60522630 -
actgtcacagagactctcag

SEQ ID NO: 175308 - DNA, 20 bp, Artificial Sequence
  Synthetic oligonucleotide; GGG chr2 60522626 60522645 60522629 -
ctgtcacagagactctcaga

SEQ ID NO: 175309 - DNA, 20 bp, Artificial Sequence
  Synthetic oligonucleotide; CAG chr2 60522617 60522636 60522620 -
agactctcagagggtgcatt

SEQ ID NO: 175310 - DNA, 20 bp, Artificial Sequence
  Synthetic oligonucleotide; CAG chr2 60522607 60522626 60522610 -
agggtgcattcagccctgaa

SEQ ID NO: 175311 - DNA, 20 bp, Artificial Sequence
  Synthetic oligonucleotide; AGG chr2 60522606 60522625 60522609 -
gggtgcattcagccctgaac

SEQ ID NO: 175312 - DNA, 20 bp, Artificial Sequence
  Synthetic oligonucleotide; GGG chr2 60522605 60522624 60522608 -
ggtgcattcagccctgaaca

SEQ ID NO: 175313 - DNA, 20 bp, Artificial Sequence
  Synthetic oligonucleotide; AAG chr2 60522600 60522619 60522603 -
attcagccctgaacagggca

SEQ ID NO: 175314 - DNA, 20 bp, Artificial Sequence
  Synthetic oligonucleotide; AGG chr2 60522599 60522618 60522602 -
ttcagccctgaacagggcaa

SEQ ID NO: 175315 - DNA, 20 bp, Artificial Sequence
  Synthetic oligonucleotide; AAG chr2 60522591 60522610 60522594 -
tgaacagggcaaaggactgc

SEQ ID NO: 175316 - DNA, 20 bp, Artificial Sequence
  Synthetic oligonucleotide; AGG chr2 60522590 60522609 60522593 -
gaacagggcaaaggactgca

SEQ ID NO: 175317 - DNA, 20 bp, Artificial Sequence
  Synthetic oligonucleotide; GGG chr2 60522589 60522608 60522592 -
aacagggcaaaggactgcaa

SEQ ID NO: 175318 - DNA, 20 bp, Artificial Sequence
  Synthetic oligonucleotide; GGG chr2 60522588 60522607 60522591 -
acagggcaaaggactgcaag

SEQ ID NO: 175319 - DNA, 20 bp, Artificial Sequence
  Synthetic oligonucleotide; CAG chr2 60522585 60522604 60522588 -
gggcaaaggactgcaagggg

SEQ ID NO: 175320 - DNA, 20 bp, Artificial Sequence
  Synthetic oligonucleotide; AGG chr2 60522584 60522603 60522587 -
ggcaaaggactgcaaggggc

SEQ ID NO: 175321 - DNA, 20 bp, Artificial Sequence
  Synthetic oligonucleotide; GAG chr2 60522582 60522601 60522585 -
caaaggactgcaaggggcag

SEQ ID NO: 175322 - DNA, 20 bp, Artificial Sequence
  Synthetic oligonucleotide; TGG chr2 60522577 60522596 60522580 -
gactgcaaggggcaggagct

SEQ ID NO: 175323 - DNA, 20 bp, Artificial Sequence
  Synthetic oligonucleotide; GGG chr2 60522576 60522595 60522579 -
actgcaaggggcaggagctt

SEQ ID NO: 175324 - DNA, 20 bp, Artificial Sequence
  Synthetic oligonucleotide; AAG chr2 60522564 60522583 60522567 -
aggagcttgggctgacatgc

SEQ ID NO: 175325 - DNA, 20 bp, Artificial Sequence
  Synthetic oligonucleotide; AGG chr2 60522563 60522582 60522566 -
ggagcttgggctgacatgca

SEQ ID NO: 175326 - DNA, 20 bp, Artificial Sequence
  Synthetic oligonucleotide; TGG chr2 60522560 60522579 60522563 -
gcttgggctgacatgcaagg

SEQ ID NO: 175327 - DNA, 20 bp, Artificial Sequence
  Synthetic oligonucleotide; AAG chr2 60522549 60522568 60522552 -
catgcaaggtggctttacac

SEQ ID NO: 175328 - DNA, 20 bp, Artificial Sequence
  Synthetic oligonucleotide; AGG chr2 60522548 60522567 60522551 -
atgcaaggtggctttacaca

SEQ ID NO: 175329 - DNA, 20 bp, Artificial Sequence
  Synthetic oligonucleotide; TAG chr2 60522538 60522557 60522541 -
gctttacacaaggccctttt

SEQ ID NO: 175330 - DNA, 20 bp, Artificial Sequence
  Synthetic oligonucleotide; GAG chr2 60522536 60522555 60522539 -
tttacacaaggcccttttta

SEQ ID NO: 175331 - DNA, 20 bp, Artificial Sequence
  Synthetic oligonucleotide; GAG chr2 60522534 60522553 60522537 -
tacacaaggccctttttaga

SEQ ID NO: 175332 - DNA, 20 bp, Artificial Sequence
  Synthetic oligonucleotide; AAG chr2 60522519 60522538 60522522 -
ttagagagtgtgattctctg

SEQ ID NO: 175333 - DNA, 20 bp, Artificial Sequence
  Synthetic oligonucleotide; TGG chr2 60522509 60522528 60522512 -
tgattctctgaagcttttct

SEQ ID NO: 175334 - DNA, 20 bp, Artificial Sequence
  Synthetic oligonucleotide; CAG chr2 60522506 60522525 60522509 -
ttctctgaagcttttcttgg

SEQ ID NO: 175335 - DNA, 20 bp, Artificial Sequence
  Synthetic oligonucleotide; CAG chr2 60522500 60522519 60522503 -
gaagcttttcttggcagctt

SEQ ID NO: 175336 - DNA, 20 bp, Artificial Sequence
  Synthetic oligonucleotide; TGG chr2 60522484 60522503 60522487 -
gcttcagtcttgaacctcac

SEQ ID NO: 175337 - DNA, 20 bp, Artificial Sequence
  Synthetic oligonucleotide; AAG chr2 60522481 60522500 60522484 -
tcagtcttgaacctcactgg

SEQ ID NO: 175338 - DNA, 20 bp, Artificial Sequence
  Synthetic oligonucleotide; AGG chr2 60522480 60522499 60522483 -
cagtcttgaacctcactgga

SEQ ID NO: 175339 - DNA, 20 bp, Artificial Sequence
  Synthetic oligonucleotide; GGG chr2 60522479 60522498 60522482 -
agtcttgaacctcactggaa

SEQ ID NO: 175340 - DNA, 20 bp, Artificial Sequence
  Synthetic oligonucleotide; CAG chr2 60522458 60522477 60522461 -
ggatcctccaaaacatgacc

SEQ ID NO: 175341 - DNA, 20 bp, Artificial Sequence
  Synthetic oligonucleotide; TGG chr2 60522454 60522473 60522457 -
cctccaaaacatgacccaga

SEQ ID NO: 175342 - DNA, 20 bp, Artificial Sequence
  Synthetic oligonucleotide; AAG chr2 60522450 60522469 60522453 -
caaaacatgacccagatgga

SEQ ID NO: 175343 - DNA, 20 bp, Artificial Sequence
  Synthetic oligonucleotide; AAG chr2 60522447 60522466 60522450 -
aacatgacccagatggaaag

SEQ ID NO: 175344 - DNA, 20 bp, Artificial Sequence
  Synthetic oligonucleotide; GAG chr2 60522437 60522456 60522440 -
agatggaaagaagtatttct

SEQ ID NO: 175345 - DNA, 20 bp, Artificial Sequence
  Synthetic oligonucleotide; TGG chr2 60522414 60522433 60522417 -
tttaaaataactcccctatt

SEQ ID NO: 175346 - DNA, 20 bp, Artificial Sequence
  Synthetic oligonucleotide; CGG chr2 60522406 60522425 60522409 -
aactcccctatttggtaata

SEQ ID NO: 175347 - DNA, 20 bp, Artificial Sequence
  Synthetic oligonucleotide; GGG chr2 60522405 60522424 60522408 -
actcccctatttggtaatac

SEQ ID NO: 175348 - DNA, 20 bp, Artificial Sequence
  Synthetic oligonucleotide; TAG chr2 60522377 60522396 60522380 -
atttgtgactttattatttt

SEQ ID NO: 175349 - DNA, 20 bp, Artificial Sequence
  Synthetic oligonucleotide; AGG chr2 60522376 60522395 60522379 -
tttgtgactttattattttt

SEQ ID NO: 175350 - DNA, 20 bp, Artificial Sequence
  Synthetic oligonucleotide; TGG chr2 60522365 60522384 60522368 -
attatttttaggtgtgataa

SEQ ID NO: 175351 - DNA, 20 bp, Artificial Sequence
  Synthetic oligonucleotide; CAG chr2 60522357 60522376 60522360 -
taggtgtgataatggttttg

SEQ ID NO: 175352 - DNA, 20 bp, Artificial Sequence
  Synthetic oligonucleotide; AAG chr2 60522344 60522363 60522347 -
ggttttgcagttgtatttaa

SEQ ID NO: 175353 - DNA, 20 bp, Artificial Sequence
  Synthetic oligonucleotide; GAG chr2 60522332 60522351 60522335 -
gtatttaaaagaaaaaaaac

SEQ ID NO: 175354 - DNA, 20 bp, Artificial Sequence
  Synthetic oligonucleotide; CAG chr2 60522306 60522325 60522309 -
ctatgtttaaaaaatacata

SEQ ID NO: 175355 - DNA, 20 bp, Artificial Sequence
  Synthetic oligonucleotide; GAG chr2 60522304 60522323 60522307 -
atgtttaaaaaatacataca

SEQ ID NO: 175356 - DNA, 20 bp, Artificial Sequence
  Synthetic oligonucleotide; AGG chr2 60522303 60522322 60522306 -
tgtttaaaaaatacatacag

SEQ ID NO: 175357 - DNA, 20 bp, Artificial Sequence
  Synthetic oligonucleotide; TGG chr2 60522273 60522292 60522276 -
tgatgaaatgatatgacgtc

SEQ ID NO: 175358 - DNA, 20 bp, Artificial Sequence
  Synthetic oligonucleotide; GGG chr2 60522272 60522291 60522275 -
gatgaaatgatatgacgtct

SEQ ID NO: 175359 - DNA, 20 bp, Artificial Sequence
  Synthetic oligonucleotide; TGG chr2 60522250 60522269 60522253 -
gatcaacttaaataataaaa

SEQ ID NO: 175360 - DNA, 20 bp, Artificial Sequence
  Synthetic oligonucleotide; GGG chr2 60522249 60522268 60522252 -
atcaacttaaataataaaat

SEQ ID NO: 175361 - DNA, 20 bp, Artificial Sequence
  Synthetic oligonucleotide; TAG chr2 60522245 60522264 60522248 -
acttaaataataaaatgggc

SEQ ID NO: 175362 - DNA, 20 bp, Artificial Sequence
  Synthetic oligonucleotide; AGG chr2 60522244 60522263 60522247 -
cttaaataataaaatgggct

SEQ ID NO: 175363 - DNA, 20 bp, Artificial Sequence
  Synthetic oligonucleotide; GGG chr2 60522243 60522262 60522246 -
ttaaataataaaatgggcta

SEQ ID NO: 175364 - DNA, 20 bp, Artificial Sequence
  Synthetic oligonucleotide; GAG chr2 60522241 60522260 60522244 -
aaataataaaatgggctagg

SEQ ID NO: 175365 - DNA, 20 bp, Artificial Sequence
  Synthetic oligonucleotide; AGG chr2 60522240 60522259 60522243 -
aataataaaatgggctaggg

SEQ ID NO: 175366 - DNA, 20 bp, Artificial Sequence
  Synthetic oligonucleotide; TAG chr2 60522234 60522253 60522237 -
aaaatgggctagggaggcga

SEQ ID NO: 175367 - DNA, 20 bp, Artificial Sequence
  Synthetic oligonucleotide; AGG chr2 60522233 60522252 60522236 -
aaatgggctagggaggcgat

SEQ ID NO: 175368 - DNA, 20 bp, Artificial Sequence
  Synthetic oligonucleotide; GGG chr2 60522232 60522251 60522235 -
aatgggctagggaggcgata

SEQ ID NO: 175369 - DNA, 20 bp, Artificial Sequence
  Synthetic oligonucleotide; CAG chr2 60522226 60522245 60522229 -
ctagggaggcgatagggtta

SEQ ID NO: 175370 - DNA, 20 bp, Artificial Sequence
  Synthetic oligonucleotide; AAG chr2 60522223 60522242 60522226 -
gggaggcgatagggttacag

SEQ ID NO: 175371 - DNA, 20 bp, Artificial Sequence
  Synthetic oligonucleotide; AAG chr2 60522218 60522237 60522221 -
gcgatagggttacagaagac

SEQ ID NO: 175372 - DNA, 20 bp, Artificial Sequence
  Synthetic oligonucleotide; GAG chr2 60522206 60522225 60522209 -
cagaagacaagaatgactgt

SEQ ID NO: 175373 - DNA, 20 bp, Artificial Sequence
  Synthetic oligonucleotide; TGG chr2 60522200 60522219 60522203 -
acaagaatgactgtgagctg

SEQ ID NO: 175374 - DNA, 20 bp, Artificial Sequence
  Synthetic oligonucleotide; TGG chr2 60522197 60522216 60522200 -
agaatgactgtgagctgtgg

SEQ ID NO: 175375 - DNA, 20 bp, Artificial Sequence
  Synthetic oligonucleotide; TGG chr2 60522193 60522212 60522196 -
tgactgtgagctgtggtggt

SEQ ID NO: 175376 - DNA, 20 bp, Artificial Sequence
  Synthetic oligonucleotide; GAG chr2 60522191 60522210 60522194 -
actgtgagctgtggtggttg

SEQ ID NO: 175377 - DNA, 20 bp, Artificial Sequence
  Synthetic oligonucleotide; TGG chr2 60522187 60522206 60522190 -
tgagctgtggtggttggagc

SEQ ID NO: 175378 - DNA, 20 bp, Artificial Sequence
  Synthetic oligonucleotide; AAG chr2 60522184 60522203 60522187 -
gctgtggtggttggagctgg

SEQ ID NO: 175379 - DNA, 20 bp, Artificial Sequence
  Synthetic oligonucleotide; TGG chr2 60522178 60522197 60522181 -
gtggttggagctggaagatg

SEQ ID NO: 175380 - DNA, 20 bp, Artificial Sequence
  Synthetic oligonucleotide; TGG chr2 60522172 60522191 60522175 -
ggagctggaagatgtggact

SEQ ID NO: 175381 - DNA, 20 bp, Artificial Sequence
  Synthetic oligonucleotide; GGG chr2 60522171 60522190 60522174 -
gagctggaagatgtggactt

SEQ ID NO: 175382 - DNA, 20 bp, Artificial Sequence
  Synthetic oligonucleotide; GGG chr2 60522170 60522189 60522173 -
agctggaagatgtggacttg

SEQ ID NO: 175383 - DNA, 20 bp, Artificial Sequence
  Synthetic oligonucleotide; TAG chr2 60522138 60522157 60522141 -
taacattctctctacttttg

SEQ ID NO: 175384 - DNA, 20 bp, Artificial Sequence
  Synthetic oligonucleotide; GAG chr2 60522130 60522149 60522133 -
tctctacttttgtagtattt

SEQ ID NO: 175385 - DNA, 20 bp, Artificial Sequence
  Synthetic oligonucleotide; CAG chr2 60522120 60522139 60522123 -
tgtagtatttgagatttttc

SEQ ID NO: 175386 - DNA, 20 bp, Artificial Sequence
  Synthetic oligonucleotide; AAG chr2 60522111 60522130 60522114 -
tgagatttttccagaaaata

SEQ ID NO: 175387 - DNA, 20 bp, Artificial Sequence
  Synthetic oligonucleotide; AGG chr2 60522110 60522129 60522113 -
gagatttttccagaaaataa

SEQ ID NO: 175388 - DNA, 20 bp, Artificial Sequence
  Synthetic oligonucleotide; TGG chr2 60522096 60522115 60522099 -
aaataaaggtattgcctgac

SEQ ID NO: 175389 - DNA, 20 bp, Artificial Sequence
  Synthetic oligonucleotide; TGG chr2 60522093 60522112 60522096 -
taaaggtattgcctgactgg

SEQ ID NO: 175390 - DNA, 20 bp, Artificial Sequence
  Synthetic oligonucleotide; GAG chr2 60522091 60522110 60522094 -
aaggtattgcctgactggtg

SEQ ID NO: 175391 - DNA, 20 bp, Artificial Sequence
  Synthetic oligonucleotide; GAG chr2 60522089 60522108 60522092 -
ggtattgcctgactggtgga

SEQ ID NO: 175392 - DNA, 20 bp, Artificial Sequence
  Synthetic oligonucleotide; CAG chr2 60522086 60522105 60522089 -
attgcctgactggtggagag

SEQ ID NO: 175393 - DNA, 20 bp, Artificial Sequence
  Synthetic oligonucleotide; TGG chr2 60522081 60522100 60522084 -
ctgactggtggagagcagta

SEQ ID NO: 175394 - DNA, 20 bp, Artificial Sequence
  Synthetic oligonucleotide; TAG chr2 60522071 60522090 60522074 -
gagagcagtatggccttgtt

SEQ ID NO: 175395 - DNA, 20 bp, Artificial Sequence
  Synthetic oligonucleotide; CGG chr2 60522067 60522086 60522070 -
gcagtatggccttgtttagt

SEQ ID NO: 175396 - DNA, 20 bp, Artificial Sequence
  Synthetic oligonucleotide; AAG chr2 60522049 60522068 60522052 -
gtcggtgttgtttcttcacc

SEQ ID NO: 175397 - DNA, 20 bp, Artificial Sequence
  Synthetic oligonucleotide; AGG chr2 60522048 60522067 60522051 -
tcggtgttgtttcttcacca

SEQ ID NO: 175398 - DNA, 20 bp, Artificial Sequence
  Synthetic oligonucleotide; GGG chr2 60522047 60522066 60522050 -
cggtgttgtttcttcaccaa

SEQ ID NO: 175399 - DNA, 20 bp, Artificial Sequence
  Synthetic oligonucleotide; TGG chr2 60522042 60522061 60522045 -
ttgtttcttcaccaagggtt

SEQ ID NO: 175400 - DNA, 20 bp, Artificial Sequence
  Synthetic oligonucleotide; CAG chr2 60522037 60522056 60522040 -
tcttcaccaagggtttggct

SEQ ID NO: 175401 - DNA, 20 bp, Artificial Sequence
  Synthetic oligonucleotide; GAG chr2 60522035 60522054 60522038 -
ttcaccaagggtttggctca

SEQ ID NO: 175402 - DNA, 20 bp, Artificial Sequence
  Synthetic oligonucleotide; AGG chr2 60522034 60522053 60522037 -
tcaccaagggtttggctcag

SEQ ID NO: 175403 - DNA, 20 bp, Artificial Sequence
  Synthetic oligonucleotide; TAG chr2 60522031 60522050 60522034 -
ccaagggtttggctcagagg

SEQ ID NO: 175404 - DNA, 20 bp, Artificial Sequence
  Synthetic oligonucleotide; AAG chr2 60522027 60522046 60522030 -
gggtttggctcagaggtagc

SEQ ID NO: 175405 - DNA, 20 bp, Artificial Sequence
  Synthetic oligonucleotide; AGG chr2 60522026 60522045 60522029 -
ggtttggctcagaggtagca

SEQ ID NO: 175406 - DNA, 20 bp, Artificial Sequence
  Synthetic oligonucleotide; GGG chr2 60522025 60522044 60522028 -
gtttggctcagaggtagcaa

SEQ ID NO: 175407 - DNA, 20 bp, Artificial Sequence
  Synthetic oligonucleotide; GGG chr2 60522024 60522043 60522027 -
tttggctcagaggtagcaag

SEQ ID NO: 175408 - DNA, 20 bp, Artificial Sequence
  Synthetic oligonucleotide; AAG chr2 60522019 60522038 60522022 -
ctcagaggtagcaaggggac

SEQ ID NO: 175409 - DNA, 20 bp, Artificial Sequence
  Synthetic oligonucleotide; TGG chr2 60522009 60522028 60522012 -
gcaaggggacaagtgtccta

SEQ ID NO: 175410 - DNA, 20 bp, Artificial Sequence
  Synthetic oligonucleotide; GGG chr2 60522008 60522027 60522011 -
caaggggacaagtgtcctat

SEQ ID NO: 175411 - DNA, 20 bp, Artificial Sequence
  Synthetic oligonucleotide; AAG chr2 60522004 60522023 60522007 -
gggacaagtgtcctatgggc

SEQ ID NO: 175412 - DNA, 20 bp, Artificial Sequence
  Synthetic oligonucleotide; AAG chr2 60522000 60522019 60522003 -
caagtgtcctatgggcaaga

SEQ ID NO: 175413 - DNA, 20 bp, Artificial Sequence
  Synthetic oligonucleotide; GAG chr2 60521990 60522009 60521993 -
atgggcaagaaagtacctgt

SEQ ID NO: 175414 - DNA, 20 bp, Artificial Sequence
  Synthetic oligonucleotide; AAG chr2 60521984 60522003 60521987 -
aagaaagtacctgtgagctc

SEQ ID NO: 175415 - DNA, 20 bp, Artificial Sequence
  Synthetic oligonucleotide; TGG chr2 60521972 60521991 60521975 -
gtgagctcaagtcttgtatc

SEQ ID NO: 175416 - DNA, 20 bp, Artificial Sequence
  Synthetic oligonucleotide; GGG chr2 60521971 60521990 60521974 -
tgagctcaagtcttgtatct

SEQ ID NO: 175417 - DNA, 20 bp, Artificial Sequence
  Synthetic oligonucleotide; AAG chr2 60521968 60521987 60521971 -
gctcaagtcttgtatctggg

SEQ ID NO: 175418 - DNA, 20 bp, Artificial Sequence
  Synthetic oligonucleotide; AAG chr2 60521956 60521975 60521959 -
tatctgggaagttcattgtg

SEQ ID NO: 175419 - DNA, 20 bp, Artificial Sequence
  Synthetic oligonucleotide; AGG chr2 60521955 60521974 60521958 -
atctgggaagttcattgtga

SEQ ID NO: 175420 - DNA, 20 bp, Artificial Sequence
  Synthetic oligonucleotide; GGG chr2 60521954 60521973 60521957 -
tctgggaagttcattgtgaa

SEQ ID NO: 175421 - DNA, 20 bp, Artificial Sequence
  Synthetic oligonucleotide; GGG chr2 60521953 60521972 60521956 -
ctgggaagttcattgtgaag

SEQ ID NO: 175422 - DNA, 20 bp, Artificial Sequence
  Synthetic oligonucleotide; AAG chr2 60521944 60521963 60521947 -
tcattgtgaaggggtcattt

SEQ ID NO: 175423 - DNA, 20 bp, Artificial Sequence
  Synthetic oligonucleotide; AGG chr2 60521943 60521962 60521946 -
cattgtgaaggggtcattta

SEQ ID NO: 175424 - DNA, 20 bp, Artificial Sequence
  Synthetic oligonucleotide; GGG chr2 60521942 60521961 60521945 -
attgtgaaggggtcatttaa

SEQ ID NO: 175425 - DNA, 20 bp, Artificial Sequence
  Synthetic oligonucleotide; TGG chr2 60521910 60521929 60521913 -
tgcactgtcccccattctcc

SEQ ID NO: 175426 - DNA, 20 bp, Artificial Sequence
  Synthetic oligonucleotide; AAG chr2 60521907 60521926 60521910 -
actgtcccccattctcctgg

SEQ ID NO: 175427 - DNA, 20 bp, Artificial Sequence
  Synthetic oligonucleotide; CAG chr2 60521902 60521921 60521905 -
cccccattctcctggaagaa

SEQ ID NO: 175428 - DNA, 20 bp, Artificial Sequence
  Synthetic oligonucleotide; GAG chr2 60521900 60521919 60521903 -
cccattctcctggaagaaca

SEQ ID NO: 175429 - DNA, 20 bp, Artificial Sequence
  Synthetic oligonucleotide; CAG chr2 60521882 60521901 60521885 -
cagagatcccttgtcttttt

SEQ ID NO: 175430 - DNA, 20 bp, Artificial Sequence
  Synthetic oligonucleotide; GAG chr2 60521874 60521893 60521877 -
ccttgtctttttcagtgcat

SEQ ID NO: 175431 - DNA, 20 bp, Artificial Sequence
  Synthetic oligonucleotide; AGG chr2 60521873 60521892 60521876 -
cttgtctttttcagtgcatg

SEQ ID NO: 175432 - DNA, 20 bp, Artificial Sequence
  Synthetic oligonucleotide; CAG chr2 60521870 60521889 60521873 -
gtctttttcagtgcatgagg

SEQ ID NO: 175433 - DNA, 20 bp, Artificial Sequence
  Synthetic oligonucleotide; GAG chr2 60521868 60521887 60521871 -
ctttttcagtgcatgaggca

SEQ ID NO: 175434 - DNA, 20 bp, Artificial Sequence
  Synthetic oligonucleotide; CAG chr2 60521864 60521883 60521867 -
ttcagtgcatgaggcagagt

SEQ ID NO: 175435 - DNA, 20 bp, Artificial Sequence
  Synthetic oligonucleotide; TGG chr2 60521858 60521877 60521861 -
gcatgaggcagagtcagatg

SEQ ID NO: 175436 - DNA, 20 bp, Artificial Sequence
  Synthetic oligonucleotide; GAG chr2 60521846 60521865 60521849 -
gtcagatgtggcgtttgctt

SEQ ID NO: 175437 - DNA, 20 bp, Artificial Sequence
  Synthetic oligonucleotide; CAG chr2 60521840 60521859 60521843 -
tgtggcgtttgcttgagttt

SEQ ID NO: 175438 - DNA, 20 bp, Artificial Sequence
  Synthetic oligonucleotide; CAG chr2 60521835 60521854 60521838 -
cgtttgcttgagtttcagca

SEQ ID NO: 175439 - DNA, 20 bp, Artificial Sequence
  Synthetic oligonucleotide; AGG chr2 60521834 60521853 60521837 -
gtttgcttgagtttcagcac

SEQ ID NO: 175440 - DNA, 20 bp, Artificial Sequence
  Synthetic oligonucleotide; TGG chr2 60521816 60521835 60521819 -
acaggtgcctctgtgcctcg

SEQ ID NO: 175441 - DNA, 20 bp, Artificial Sequence
  Synthetic oligonucleotide; GAG chr2 60521812 60521831 60521815 -
gtgcctctgtgcctcgtggt

SEQ ID NO: 175442 - DNA, 20 bp, Artificial Sequence
  Synthetic oligonucleotide; AGG chr2 60521811 60521830 60521814 -
tgcctctgtgcctcgtggtg

SEQ ID NO: 175443 - DNA, 20 bp, Artificial Sequence
  Synthetic oligonucleotide; GGG chr2 60521810 60521829 60521813 -
gcctctgtgcctcgtggtga

SEQ ID NO: 175444 - DNA, 20 bp, Artificial Sequence
  Synthetic oligonucleotide; CAG chr2 60521806 60521825 60521809 -
ctgtgcctcgtggtgagggt

SEQ ID NO: 175445 - DNA, 20 bp, Artificial Sequence
  Synthetic oligonucleotide; AGG chr2 60521805 60521824 60521808 -
tgtgcctcgtggtgagggtc

SEQ ID NO: 175446 - DNA, 20 bp, Artificial Sequence
  Synthetic oligonucleotide; AAG chr2 60521802 60521821 60521805 -
gcctcgtggtgagggtcagg

SEQ ID NO: 175447 - DNA, 20 bp, Artificial Sequence
  Synthetic oligonucleotide; AAG chr2 60521799 60521818 60521802 -
tcgtggtgagggtcaggaag

SEQ ID NO: 175448 - DNA, 20 bp, Artificial Sequence
  Synthetic oligonucleotide; CAG chr2 60521796 60521815 60521799 -
tggtgagggtcaggaagaag

SEQ ID NO: 175449 - DNA, 20 bp, Artificial Sequence
  Synthetic oligonucleotide; TGG chr2 60521792 60521811 60521795 -
gagggtcaggaagaagcagc

SEQ ID NO: 175450 - DNA, 20 bp, Artificial Sequence
  Synthetic oligonucleotide; GGG chr2 60521791 60521810 60521794 -
agggtcaggaagaagcagct

SEQ ID NO: 175451 - DNA, 20 bp, Artificial Sequence
  Synthetic oligonucleotide; TGG chr2 60521777 60521796 60521780 -
gcagctgggacgtgctcacg

SEQ ID NO: 175452 - DNA, 20 bp, Artificial Sequence
  Synthetic oligonucleotide; TGG chr2 60521773 60521792 60521776 -
ctgggacgtgctcacgtggc

SEQ ID NO: 175453 - DNA, 20 bp, Artificial Sequence
  Synthetic oligonucleotide; TAG chr2 60521770 60521789 60521773 -
ggacgtgctcacgtggctgg

SEQ ID NO: 175454 - DNA, 20 bp, Artificial Sequence
  Synthetic oligonucleotide; AAG chr2 60521760 60521779 60521763 -
acgtggctggtagtgttatg

SEQ ID NO: 175455 - DNA, 20 bp, Artificial Sequence
  Synthetic oligonucleotide; AAG chr2 60521755 60521774 60521758 -
gctggtagtgttatgaagac

SEQ ID NO: 175456 - DNA, 20 bp, Artificial Sequence
  Synthetic oligonucleotide; AGG chr2 60521754 60521773 60521757 -
ctggtagtgttatgaagaca

SEQ ID NO: 175457 - DNA, 20 bp, Artificial Sequence
  Synthetic oligonucleotide; TGG chr2 60521748 60521767 60521751 -
gtgttatgaagacaaggctt

SEQ ID NO: 175458 - DNA, 20 bp, Artificial Sequence
  Synthetic oligonucleotide; GGG chr2 60521747 60521766 60521750 -
tgttatgaagacaaggcttt

SEQ ID NO: 175459 - DNA, 20 bp, Artificial Sequence
  Synthetic oligonucleotide; TGG chr2 60521735 60521754 60521738 -
aaggctttgggacctttctt

SEQ ID NO: 175460 - DNA, 20 bp, Artificial Sequence
  Synthetic oligonucleotide; GAG chr2 60521726 60521745 60521729 -
ggacctttctttggccattt

SEQ ID NO: 175461 - DNA, 20 bp, Artificial Sequence
  Synthetic oligonucleotide; TGG chr2 60521720 60521739 60521723 -
ttctttggccatttgagccc

SEQ ID NO: 175462 - DNA, 20 bp, Artificial Sequence
  Synthetic oligonucleotide; TAG chr2 60521713 60521732 60521716 -
gccatttgagccctggctat

SEQ ID NO: 175463 - DNA, 20 bp, Artificial Sequence
  Synthetic oligonucleotide; GAG chr2 60521711 60521730 60521714 -
catttgagccctggctatta

SEQ ID NO: 175464 - DNA, 20 bp, Artificial Sequence
  Synthetic oligonucleotide; AAG chr2 60521707 60521726 60521710 -
tgagccctggctattagaga

SEQ ID NO: 175465 - DNA, 20 bp, Artificial Sequence
  Synthetic oligonucleotide; GAG chr2 60521693 60521712 60521696 -
tagagaaagatgatttgcct

SEQ ID NO: 175466 - DNA, 20 bp, Artificial Sequence
  Synthetic oligonucleotide; GAG chr2 60521691 60521710 60521694 -
gagaaagatgatttgcctga

SEQ ID NO: 175467 - DNA, 20 bp, Artificial Sequence
  Synthetic oligonucleotide; AGG chr2 60521690 60521709 60521693 -
agaaagatgatttgcctgag

SEQ ID NO: 175468 - DNA, 20 bp, Artificial Sequence
  Synthetic oligonucleotide; GAG chr2 60521688 60521707 60521691 -
aaagatgatttgcctgagag

SEQ ID NO: 175469 - DNA, 20 bp, Artificial Sequence
  Synthetic oligonucleotide; CAG chr2 60521671 60521690 60521674 -
gaggagattgaccacactct

SEQ ID NO: 175470 - DNA, 20 bp, Artificial Sequence
  Synthetic oligonucleotide; AAG chr2 60521667 60521686 60521670 -
agattgaccacactctcaga

SEQ ID NO: 175471 - DNA, 20 bp, Artificial Sequence
  Synthetic oligonucleotide; AAG chr2 60521664 60521683 60521667 -
ttgaccacactctcagaaag

SEQ ID NO: 175472 - DNA, 20 bp, Artificial Sequence
  Synthetic oligonucleotide; AGG chr2 60521663 60521682 60521666 -
tgaccacactctcagaaaga

SEQ ID NO: 175473 - DNA, 20 bp, Artificial Sequence
  Synthetic oligonucleotide; GGG chr2 60521662 60521681 60521665 -
gaccacactctcagaaagaa

SEQ ID NO: 175474 - DNA, 20 bp, Artificial Sequence
  Synthetic oligonucleotide; GGG chr2 60521661 60521680 60521664 -
accacactctcagaaagaag

SEQ ID NO: 175475 - DNA, 20 bp, Artificial Sequence
  Synthetic oligonucleotide; AAG chr2 60521655 60521674 60521658 -
ctctcagaaagaaggggaca

SEQ ID NO: 175476 - DNA, 20 bp, Artificial Sequence
  Synthetic oligonucleotide; AAG chr2 60521644 60521663 60521647 -
aaggggacaaagaacacgtc

SEQ ID NO: 175477 - DNA, 20 bp, Artificial Sequence
  Synthetic oligonucleotide; AGG chr2 60521643 60521662 60521646 -
aggggacaaagaacacgtca

SEQ ID NO: 175478 - DNA, 20 bp, Artificial Sequence
  Synthetic oligonucleotide; GGG chr2 60521642 60521661 60521645 -
ggggacaaagaacacgtcaa

SEQ ID NO: 175479 - DNA, 20 bp, Artificial Sequence
  Synthetic oligonucleotide; AAG chr2 60521637 60521656 60521640 -
caaagaacacgtcaagggtt

SEQ ID NO: 175480 - DNA, 20 bp, Artificial Sequence
  Synthetic oligonucleotide; CAG chr2 60521634 60521653 60521637 -
agaacacgtcaagggttaag

SEQ ID NO: 175481 - DNA, 20 bp, Artificial Sequence
  Synthetic oligonucleotide; AAG chr2 60521621 60521640 60521624 -
ggttaagcagccttcccttt

SEQ ID NO: 175482 - DNA, 20 bp, Artificial Sequence
  Synthetic oligonucleotide; AGG chr2 60521620 60521639 60521623 -
gttaagcagccttcccttta

SEQ ID NO: 175483 - DNA, 20 bp, Artificial Sequence
  Synthetic oligonucleotide; GGG chr2 60521619 60521638 60521622 -
ttaagcagccttccctttaa

SEQ ID NO: 175484 - DNA, 20 bp, Artificial Sequence
  Synthetic oligonucleotide; GAG chr2 60521617 60521636 60521620 -
aagcagccttccctttaagg

SEQ ID NO: 175485 - DNA, 20 bp, Artificial Sequence
  Synthetic oligonucleotide; AGG chr2 60521616 60521635 60521619 -
agcagccttccctttaaggg

SEQ ID NO: 175486 - DNA, 20 bp, Artificial Sequence
  Synthetic oligonucleotide; TGG chr2 60521611 60521630 60521614 -
ccttccctttaagggaggac

SEQ ID NO: 175487 - DNA, 20 bp, Artificial Sequence
  Synthetic oligonucleotide; GGG chr2 60521610 60521629 60521613 -
cttccctttaagggaggact

SEQ ID NO: 175488 - DNA, 20 bp, Artificial Sequence
  Synthetic oligonucleotide; GGG chr2 60521609 60521628 60521612 -
ttccctttaagggaggactg

SEQ ID NO: 175489 - DNA, 20 bp, Artificial Sequence
  Synthetic oligonucleotide; AAG chr2 60521603 60521622 60521606 -
ttaagggaggactggggcac

SEQ ID NO: 175490 - DNA, 20 bp, Artificial Sequence
  Synthetic oligonucleotide; TGG chr2 60521599 60521618 60521602 -
gggaggactggggcacaaga

SEQ ID NO: 175491 - DNA, 20 bp, Artificial Sequence
  Synthetic oligonucleotide; AAG chr2 60521596 60521615 60521599 -
aggactggggcacaagatgg

SEQ ID NO: 175492 - DNA, 20 bp, Artificial Sequence
  Synthetic oligonucleotide; AAG chr2 60521589 60521608 60521592 -
gggcacaagatggaagatga

SEQ ID NO: 175493 - DNA, 20 bp, Artificial Sequence
  Synthetic oligonucleotide; AGG chr2 60521588 60521607 60521591 -
ggcacaagatggaagatgaa

SEQ ID NO: 175494 - DNA, 20 bp, Artificial Sequence
  Synthetic oligonucleotide; GGG chr2 60521587 60521606 60521590 -
gcacaagatggaagatgaaa

SEQ ID NO: 175495 - DNA, 20 bp, Artificial Sequence
  Synthetic oligonucleotide; GAG chr2 60521585 60521604 60521588 -
acaagatggaagatgaaagg

SEQ ID NO: 175496 - DNA, 20 bp, Artificial Sequence
  Synthetic oligonucleotide; CAG chr2 60521582 60521601 60521585 -
agatggaagatgaaagggag

SEQ ID NO: 175497 - DNA, 20 bp, Artificial Sequence
  Synthetic oligonucleotide; GAG chr2 60521580 60521599 60521583 -
atggaagatgaaagggagca

SEQ ID NO: 175498 - DNA, 20 bp, Artificial Sequence
  Synthetic oligonucleotide; TGG chr2 60521577 60521596 60521580 -
gaagatgaaagggagcagag

SEQ ID NO: 175499 - DNA, 20 bp, Artificial Sequence
  Synthetic oligonucleotide; CAG chr2 60521568 60521587 60521571 -
agggagcagagtggcaattg

SEQ ID NO: 175500 - DNA, 20 bp, Artificial Sequence
  Synthetic oligonucleotide; GAG chr2 60521566 60521585 60521569 -
ggagcagagtggcaattgca

SEQ ID NO: 175501 - DNA, 20 bp, Artificial Sequence
  Synthetic oligonucleotide; TGG chr2 60521562 60521581 60521565 -
cagagtggcaattgcagagc

SEQ ID NO: 175502 - DNA, 20 bp, Artificial Sequence
  Synthetic oligonucleotide; AAG chr2 60521558 60521577 60521561 -
gtggcaattgcagagctgga

SEQ ID NO: 175503 - DNA, 20 bp, Artificial Sequence
  Synthetic oligonucleotide; AGG chr2 60521557 60521576 60521560 -
tggcaattgcagagctggaa

SEQ ID NO: 175504 - DNA, 20 bp, Artificial Sequence
  Synthetic oligonucleotide; GGG chr2 60521556 60521575 60521559 -
ggcaattgcagagctggaaa

SEQ ID NO: 175505 - DNA, 20 bp, Artificial Sequence
  Synthetic oligonucleotide; GGG chr2 60521555 60521574 60521558 -
gcaattgcagagctggaaag

SEQ ID NO: 175506 - DNA, 20 bp, Artificial Sequence
  Synthetic oligonucleotide; TAG chr2 60521539 60521558 60521542 -
aaaggggaattttgttcttc

SEQ ID NO: 175507 - DNA, 20 bp, Artificial Sequence
  Synthetic oligonucleotide; TAG chr2 60521535 60521554 60521538 -
gggaattttgttcttctaga

SEQ ID NO: 175508 - DNA, 20 bp, Artificial Sequence
  Synthetic oligonucleotide; AAG chr2 60521529 60521548 60521532 -
tttgttcttctagatagcaa

SEQ ID NO: 175509 - DNA, 20 bp, Artificial Sequence
  Synthetic oligonucleotide; CAG chr2 60521525 60521544 60521528 -
ttcttctagatagcaaaagc

SEQ ID NO: 175510 - DNA, 20 bp, Artificial Sequence
  Synthetic oligonucleotide; AGG chr2 60521524 60521543 60521527 -
tcttctagatagcaaaagcc

SEQ ID NO: 175511 - DNA, 20 bp, Artificial Sequence
  Synthetic oligonucleotide; AAG chr2 60521501 60521520 60521504 -
actgtcgctgtgtgacttga

SEQ ID NO: 175512 - DNA, 20 bp, Artificial Sequence
  Synthetic oligonucleotide; TAG chr2 60521497 60521516 60521500 -
tcgctgtgtgacttgaaagc

SEQ ID NO: 175513 - DNA, 20 bp, Artificial Sequence
  Synthetic oligonucleotide; AGG chr2 60521496 60521515 60521499 -
cgctgtgtgacttgaaagct

SEQ ID NO: 175514 - DNA, 20 bp, Artificial Sequence
  Synthetic oligonucleotide; TGG chr2 60521489 60521508 60521492 -
tgacttgaaagctaggtcac

SEQ ID NO: 175515 - DNA, 20 bp, Artificial Sequence
  Synthetic oligonucleotide; TGG chr2 60521486 60521505 60521489 -
cttgaaagctaggtcactgg

SEQ ID NO: 175516 - DNA, 20 bp, Artificial Sequence
  Synthetic oligonucleotide; GGG chr2 60521485 60521504 60521488 -
ttgaaagctaggtcactggt

SEQ ID NO: 175517 - DNA, 20 bp, Artificial Sequence
  Synthetic oligonucleotide; CAG chr2 60521475 60521494 60521478 -
ggtcactggtgggcttcgtg

SEQ ID NO: 175518 - DNA, 20 bp, Artificial Sequence
  Synthetic oligonucleotide; CAG chr2 60521465 60521484 60521468 -
gggcttcgtgcagcccgtca

SEQ ID NO: 175519 - DNA, 20 bp, Artificial Sequence
  Synthetic oligonucleotide; AGG chr2 60521464 60521483 60521467 -
ggcttcgtgcagcccgtcac

SEQ ID NO: 175520 - DNA, 20 bp, Artificial Sequence
  Synthetic oligonucleotide; GGG chr2 60521463 60521482 60521466 -
gcttcgtgcagcccgtcaca

SEQ ID NO: 175521 - DNA, 20 bp, Artificial Sequence
  Synthetic oligonucleotide; GGG chr2 60521462 60521481 60521465 -
cttcgtgcagcccgtcacag

SEQ ID NO: 175522 - DNA, 20 bp, Artificial Sequence
  Synthetic oligonucleotide; GAG chr2 60521460 60521479 60521463 -
tcgtgcagcccgtcacaggg

SEQ ID NO: 175523 - DNA, 20 bp, Artificial Sequence
  Synthetic oligonucleotide; TGG chr2 60521454 60521473 60521457 -
agcccgtcacaggggagcca

SEQ ID NO: 175524 - DNA, 20 bp, Artificial Sequence
  Synthetic oligonucleotide; TGG chr2 60521451 60521470 60521454 -
ccgtcacaggggagccatgg

SEQ ID NO: 175525 - DNA, 20 bp, Artificial Sequence
  Synthetic oligonucleotide; GGG chr2 60521450 60521469 60521453 -
cgtcacaggggagccatggt

SEQ ID NO: 175526 - DNA, 20 bp, Artificial Sequence
  Synthetic oligonucleotide; TGG chr2 60521422 60521441 60521425 -
tctctgccgtatctgctgcc

SEQ ID NO: 175527 - DNA, 20 bp, Artificial Sequence
  Synthetic oligonucleotide; AAG chr2 60521419 60521438 60521422 -
ctgccgtatctgctgcctgg

SEQ ID NO: 175528 - DNA, 20 bp, Artificial Sequence
  Synthetic oligonucleotide; GAG chr2 60521414 60521433 60521417 -
gtatctgctgcctggaagct

SEQ ID NO: 175529 - DNA, 20 bp, Artificial Sequence
  Synthetic oligonucleotide; TGG chr2 60521409 60521428 60521412 -
tgctgcctggaagctgagac

SEQ ID NO: 175530 - DNA, 20 bp, Artificial Sequence
  Synthetic oligonucleotide; CAG chr2 60521384 60521403 60521387 -
taaccacatcacaccattcc

SEQ ID NO: 175531 - DNA, 20 bp, Artificial Sequence
  Synthetic oligonucleotide; CAG chr2 60521378 60521397 60521381 -
catcacaccattcccagacc

SEQ ID NO: 175532 - DNA, 20 bp, Artificial Sequence
  Synthetic oligonucleotide; AGG chr2 60521377 60521396 60521380 -
atcacaccattcccagaccc

SEQ ID NO: 175533 - DNA, 20 bp, Artificial Sequence
  Synthetic oligonucleotide; CAG chr2 60521372 60521391 60521375 -
accattcccagacccaggcc

SEQ ID NO: 175534 - DNA, 20 bp, Artificial Sequence
  Synthetic oligonucleotide; AGG chr2 60521371 60521390 60521374 -
ccattcccagacccaggccc

SEQ ID NO: 175535 - DNA, 20 bp, Artificial Sequence
  Synthetic oligonucleotide; CAG chr2 60521366 60521385 60521369 -
cccagacccaggcccaggcc

SEQ ID NO: 175536 - DNA, 20 bp, Artificial Sequence
  Synthetic oligonucleotide; AGG chr2 60521365 60521384 60521368 -
ccagacccaggcccaggccc

SEQ ID NO: 175537 - DNA, 20 bp, Artificial Sequence
  Synthetic oligonucleotide; CGG chr2 60521360 60521379 60521363 -
cccaggcccaggcccaggcc

SEQ ID NO: 175538 - DNA, 20 bp, Artificial Sequence
  Synthetic oligonucleotide; GGG chr2 60521359 60521378 60521362 -
ccaggcccaggcccaggccc

SEQ ID NO: 175539 - DNA, 20 bp, Artificial Sequence
  Synthetic oligonucleotide; TGG chr2 60521350 60521369 60521353 -
ggcccaggcccgggtccctc

SEQ ID NO: 175540 - DNA, 20 bp, Artificial Sequence
  Synthetic oligonucleotide; CAG chr2 60521314 60521333 60521317 -
ccgctctctctcgcttcaca

SEQ ID NO: 175541 - DNA, 20 bp, Artificial Sequence
  Synthetic oligonucleotide; GAG chr2 60521312 60521331 60521315 -
gctctctctcgcttcacaca

SEQ ID NO: 175542 - DNA, 20 bp, Artificial Sequence
  Synthetic oligonucleotide; AGG chr2 60521311 60521330 60521314 -
ctctctctcgcttcacacag

SEQ ID NO: 175543 - DNA, 20 bp, Artificial Sequence
  Synthetic oligonucleotide; TAG chr2 60521301 60521320 60521304 -
cttcacacagaggctattat

SEQ ID NO: 175544 - DNA, 20 bp, Artificial Sequence
  Synthetic oligonucleotide; AAG chr2 60521297 60521316 60521300 -
acacagaggctattattagc

SEQ ID NO: 175545 - DNA, 20 bp, Artificial Sequence
  Synthetic oligonucleotide; CAG chr2 60521287 60521306 60521290 -
tattattagcaagtgtcact

SEQ ID NO: 175546 - DNA, 20 bp, Artificial Sequence
  Synthetic oligonucleotide; GAG chr2 60521278 60521297 60521281 -
caagtgtcactcagttatct

SEQ ID NO: 175547 - DNA, 20 bp, Artificial Sequence
  Synthetic oligonucleotide; GAG chr2 60521276 60521295 60521279 -
agtgtcactcagttatctga

SEQ ID NO: 175548 - DNA, 20 bp, Artificial Sequence
  Synthetic oligonucleotide; TGG chr2 60521273 60521292 60521276 -
gtcactcagttatctgagag

SEQ ID NO: 175549 - DNA, 20 bp, Artificial Sequence
  Synthetic oligonucleotide; TAG chr2 60521264 60521283 60521267 -
ttatctgagagtggcgcttt

SEQ ID NO: 175550 - DNA, 20 bp, Artificial Sequence
  Synthetic oligonucleotide; AAG chr2 60521252 60521271 60521255 -
ggcgcttttagctgccatct

SEQ ID NO: 175551 - DNA, 20 bp, Artificial Sequence
  Synthetic oligonucleotide; TGG chr2 60521238 60521257 60521241 -
ccatctaagtgcctgatact

SEQ ID NO: 175552 - DNA, 20 bp, Artificial Sequence
  Synthetic oligonucleotide; GGG chr2 60521237 60521256 60521240 -
catctaagtgcctgatactt

SEQ ID NO: 175553 - DNA, 20 bp, Artificial Sequence
  Synthetic oligonucleotide; CAG chr2 60521230 60521249 60521233 -
gtgcctgatacttgggttta

SEQ ID NO: 175554 - DNA, 20 bp, Artificial Sequence
  Synthetic oligonucleotide; CAG chr2 60521227 60521246 60521230 -
cctgatacttgggtttacag

SEQ ID NO: 175555 - DNA, 20 bp, Artificial Sequence
  Synthetic oligonucleotide; TAG chr2 60521210 60521229 60521213 -
cagcagattaaattaaattt

SEQ ID NO: 175556 - DNA, 20 bp, Artificial Sequence
  Synthetic oligonucleotide; AGG chr2 60521209 60521228 60521212 -
agcagattaaattaaatttt

SEQ ID NO: 175557 - DNA, 20 bp, Artificial Sequence
  Synthetic oligonucleotide; TGG chr2 60521205 60521224 60521208 -
gattaaattaaattttaggc

SEQ ID NO: 175558 - DNA, 20 bp, Artificial Sequence
  Synthetic oligonucleotide; TGG chr2 60521200 60521219 60521203 -
aattaaattttaggctggtt

SEQ ID NO: 175559 - DNA, 20 bp, Artificial Sequence
  Synthetic oligonucleotide; TGG chr2 60521191 60521210 60521194 -
ttaggctggtttggcttcac

SEQ ID NO: 175560 - DNA, 20 bp, Artificial Sequence
  Synthetic oligonucleotide; CAG chr2 60521188 60521207 60521191 -
ggctggtttggcttcactgg

SEQ ID NO: 175561 - DNA, 20 bp, Artificial Sequence
  Synthetic oligonucleotide; TAG chr2 60521185 60521204 60521188 -
tggtttggcttcactggcag

SEQ ID NO: 175562 - DNA, 20 bp, Artificial Sequence
  Synthetic oligonucleotide; TGG chr2 60521178 60521197 60521181 -
gcttcactggcagtagacaa

SEQ ID NO: 175563 - DNA, 20 bp, Artificial Sequence
  Synthetic oligonucleotide; AAG chr2 60521175 60521194 60521178 -
tcactggcagtagacaatgg

SEQ ID NO: 175564 - DNA, 20 bp, Artificial Sequence
  Synthetic oligonucleotide; AGG chr2 60521174 60521193 60521177 -
cactggcagtagacaatgga

SEQ ID NO: 175565 - DNA, 20 bp, Artificial Sequence
  Synthetic oligonucleotide; CAG chr2 60521171 60521190 60521174 -
tggcagtagacaatggaagg

SEQ ID NO: 175566 - DNA, 20 bp, Artificial Sequence
  Synthetic oligonucleotide; TAG chr2 60521162 60521181 60521165 -
acaatggaaggcagctgttg

SEQ ID NO: 175567 - DNA, 20 bp, Artificial Sequence
  Synthetic oligonucleotide; TGG chr2 60521149 60521168 60521152 -
gctgttgtagaaatgtaacc

SEQ ID NO: 175568 - DNA, 20 bp, Artificial Sequence
  Synthetic oligonucleotide; AAG chr2 60521139 60521158 60521142 -
aaatgtaacctggcaccctc

SEQ ID NO: 175569 - DNA, 20 bp, Artificial Sequence
  Synthetic oligonucleotide; AGG chr2 60521138 60521157 60521141 -
aatgtaacctggcaccctca

SEQ ID NO: 175570 - DNA, 20 bp, Artificial Sequence
  Synthetic oligonucleotide; GAG chr2 60521127 60521146 60521130 -
gcaccctcaaggatttgtgt

SEQ ID NO: 175571 - DNA, 20 bp, Artificial Sequence
  Synthetic oligonucleotide; GAG chr2 60521103 60521122 60521106 -
gtgtgtgtgtgtgtgtgtgt

SEQ ID NO: 175572 - DNA, 20 bp, Artificial Sequence
  Synthetic oligonucleotide; TAG chr2 60521060 60521079 60521063 -
tgtgtgtgtgtgctgaccac

SEQ ID NO: 175573 - DNA, 20 bp, Artificial Sequence
  Synthetic oligonucleotide; AGG chr2 60521059 60521078 60521062 -
gtgtgtgtgtgctgaccact

SEQ ID NO: 175574 - DNA, 20 bp, Artificial Sequence
  Synthetic oligonucleotide; AAG chr2 60521012 60521031 60521015 -
ccatttcatccctttccaaa

SEQ ID NO: 175575 - DNA, 20 bp, Artificial Sequence
  Synthetic oligonucleotide; TAG chr2 60521005 60521024 60521008 -
atccctttccaaaaagtgtt

SEQ ID NO: 175576 - DNA, 20 bp, Artificial Sequence
  Synthetic oligonucleotide; TAG chr2 60520997 60521016 60521000 -
ccaaaaagtgtttagacaaa

SEQ ID NO: 175577 - DNA, 20 bp, Artificial Sequence
  Synthetic oligonucleotide; CAG chr2 60520989 60521008 60520992 -
tgtttagacaaatagtttcc

SEQ ID NO: 175578 - DNA, 20 bp, Artificial Sequence
  Synthetic oligonucleotide; TGG chr2 60520983 60521002 60520986 -
gacaaatagtttcccagact

SEQ ID NO: 175579 - DNA, 20 bp, Artificial Sequence
  Synthetic oligonucleotide; TGG chr2 60520969 60520988 60520972 -
cagacttggttttatcatgc

SEQ ID NO: 175580 - DNA, 20 bp, Artificial Sequence
  Synthetic oligonucleotide; GGG chr2 60520968 60520987 60520971 -
agacttggttttatcatgct

SEQ ID NO: 175581 - DNA, 20 bp, Artificial Sequence
  Synthetic oligonucleotide; AAG chr2 60520959 60520978 60520962 -
tttatcatgctgggttgaca

SEQ ID NO: 175582 - DNA, 20 bp, Artificial Sequence
  Synthetic oligonucleotide; AGG chr2 60520958 60520977 60520961 -
ttatcatgctgggttgacaa

SEQ ID NO: 175583 - DNA, 20 bp, Artificial Sequence
  Synthetic oligonucleotide; CAG chr2 60520948 60520967 60520951 -
gggttgacaaaggttgtgta

SEQ ID NO: 175584 - DNA, 20 bp, Artificial Sequence
  Synthetic oligonucleotide; GAG chr2 60520946 60520965 60520949 -
gttgacaaaggttgtgtaca

SEQ ID NO: 175585 - DNA, 20 bp, Artificial Sequence
  Synthetic oligonucleotide; TGG chr2 60520942 60520961 60520945 -
acaaaggttgtgtacagagc

SEQ ID NO: 175586 - DNA, 20 bp, Artificial Sequence
  Synthetic oligonucleotide; TGG chr2 60520914 60520933 60520917 -
ttttttcttctttctactgt

SEQ ID NO: 175587 - DNA, 20 bp, Artificial Sequence
  Synthetic oligonucleotide; AAG chr2 60520887 60520906 60520890 -
tcaatatctttttttctgca

SEQ ID NO: 175588 - DNA, 20 bp, Artificial Sequence
  Synthetic oligonucleotide; AAG chr2 60520884 60520903 60520887 -
atatctttttttctgcaaag

SEQ ID NO: 175589 - DNA, 20 bp, Artificial Sequence
  Synthetic oligonucleotide; AGG chr2 60520883 60520902 60520886 -
tatctttttttctgcaaaga

SEQ ID NO: 175590 - DNA, 20 bp, Artificial Sequence
  Synthetic oligonucleotide; GGG chr2 60520882 60520901 60520885 -
atctttttttctgcaaagaa

SEQ ID NO: 175591 - DNA, 20 bp, Artificial Sequence
  Synthetic oligonucleotide; GGG chr2 60520881 60520900 60520884 -
tctttttttctgcaaagaag

SEQ ID NO: 175592 - DNA, 20 bp, Artificial Sequence
  Synthetic oligonucleotide; AAG chr2 60520876 60520895 60520879 -
ttttctgcaaagaaggggct

SEQ ID NO: 175593 - DNA, 20 bp, Artificial Sequence
  Synthetic oligonucleotide; CGG chr2 60520858 60520877 60520861 -
ctaagcttgcacgaaaacac

SEQ ID NO: 175594 - DNA, 20 bp, Artificial Sequence
  Synthetic oligonucleotide; TGG chr2 60520855 60520874 60520858 -
agcttgcacgaaaacaccgg

SEQ ID NO: 175595 - DNA, 20 bp, Artificial Sequence
  Synthetic oligonucleotide; GGG chr2 60520854 60520873 60520857 -
gcttgcacgaaaacaccggt

SEQ ID NO: 175596 - DNA, 20 bp, Artificial Sequence
  Synthetic oligonucleotide; TGG chr2 60520844 60520863 60520847 -
aaacaccggtgggaacccac

SEQ ID NO: 175597 - DNA, 20 bp, Artificial Sequence
  Synthetic oligonucleotide; GAG chr2 60520842 60520861 60520845 -
acaccggtgggaacccactg

SEQ ID NO: 175598 - DNA, 20 bp, Artificial Sequence
  Synthetic oligonucleotide; AAG chr2 60520839 60520858 60520842 -
ccggtgggaacccactggag

SEQ ID NO: 175599 - DNA, 20 bp, Artificial Sequence
  Synthetic oligonucleotide; AGG chr2 60520838 60520857 60520841 -
cggtgggaacccactggaga

SEQ ID NO: 175600 - DNA, 20 bp, Artificial Sequence
  Synthetic oligonucleotide; GGG chr2 60520837 60520856 60520840 -
ggtgggaacccactggagaa

SEQ ID NO: 175601 - DNA, 20 bp, Artificial Sequence
  Synthetic oligonucleotide; TGG chr2 60520832 60520851 60520835 -
gaacccactggagaagggca

SEQ ID NO: 175602 - DNA, 20 bp, Artificial Sequence
  Synthetic oligonucleotide; GGG chr2 60520831 60520850 60520834 -
aacccactggagaagggcat

SEQ ID NO: 175603 - DNA, 20 bp, Artificial Sequence
  Synthetic oligonucleotide; TGG chr2 60520828 60520847 60520831 -
ccactggagaagggcatggg

SEQ ID NO: 175604 - DNA, 20 bp, Artificial Sequence
  Synthetic oligonucleotide; TGG chr2 60520821 60520840 60520824 -
agaagggcatgggtggtttt

SEQ ID NO: 175605 - DNA, 20 bp, Artificial Sequence
  Synthetic oligonucleotide; CGG chr2 60520816 60520835 60520819 -
ggcatgggtggtttttggtt

SEQ ID NO: 175606 - DNA, 20 bp, Artificial Sequence
  Synthetic oligonucleotide; TGG chr2 60520812 60520831 60520815 -
tgggtggtttttggttcggt

SEQ ID NO: 175607 - DNA, 20 bp, Artificial Sequence
  Synthetic oligonucleotide; TGG chr2 60520809 60520828 60520812 -
gtggtttttggttcggttgg

SEQ ID NO: 175608 - DNA, 20 bp, Artificial Sequence
  Synthetic oligonucleotide; TGG chr2 60520797 60520816 60520800 -
tcggttggtggctgatctga

SEQ ID NO: 175609 - DNA, 20 bp, Artificial Sequence
  Synthetic oligonucleotide; GGG chr2 60520796 60520815 60520799 -
cggttggtggctgatctgat

SEQ ID NO: 175610 - DNA, 20 bp, Artificial Sequence
  Synthetic oligonucleotide; TGG chr2 60520793 60520812 60520796 -
ttggtggctgatctgatggg

SEQ ID NO: 175611 - DNA, 20 bp, Artificial Sequence
  Synthetic oligonucleotide; TAG chr2 60520788 60520807 60520791 -
ggctgatctgatgggtggta

SEQ ID NO: 175612 - DNA, 20 bp, Artificial Sequence
  Synthetic oligonucleotide; AGG chr2 60520787 60520806 60520790 -
gctgatctgatgggtggtat

SEQ ID NO: 175613 - DNA, 20 bp, Artificial Sequence
  Synthetic oligonucleotide; CAG chr2 60520784 60520803 60520787 -
gatctgatgggtggtatagg

SEQ ID NO: 175614 - DNA, 20 bp, Artificial Sequence
  Synthetic oligonucleotide; TGG chr2 60520775 60520794 60520778 -
ggtggtataggcagaatgtc

SEQ ID NO: 175615 - DNA, 20 bp, Artificial Sequence
  Synthetic oligonucleotide; CAG chr2 60520763 60520782 60520766 -
agaatgtctggctgcccctt

SEQ ID NO: 175616 - DNA, 20 bp, Artificial Sequence
  Synthetic oligonucleotide; TAG chr2 60520753 60520772 60520756 -
gctgccccttcagattcctg

SEQ ID NO: 175617 - DNA, 20 bp, Artificial Sequence
  Synthetic oligonucleotide; TAG chr2 60520744 60520763 60520747 -
tcagattcctgtagattccg

SEQ ID NO: 175618 - DNA, 20 bp, Artificial Sequence
  Synthetic oligonucleotide; AGG chr2 60520743 60520762 60520746 -
cagattcctgtagattccgt

SEQ ID NO: 175619 - DNA, 20 bp, Artificial Sequence
  Synthetic oligonucleotide; TGG chr2 60520731 60520750 60520734 -
gattccgtaggcgaccaaca

SEQ ID NO: 175620 - DNA, 20 bp, Artificial Sequence
  Synthetic oligonucleotide; GGG chr2 60520730 60520749 60520733 -
attccgtaggcgaccaacat

SEQ ID NO: 175621 - DNA, 20 bp, Artificial Sequence
  Synthetic oligonucleotide; GGG chr2 60520729 60520748 60520732 -
ttccgtaggcgaccaacatg

SEQ ID NO: 175622 - DNA, 20 bp, Artificial Sequence
  Synthetic oligonucleotide; TGG chr2 60520726 60520745 60520729 -
cgtaggcgaccaacatgggg

SEQ ID NO: 175623 - DNA, 20 bp, Artificial Sequence
  Synthetic oligonucleotide; GGG chr2 60520725 60520744 60520728 -
gtaggcgaccaacatggggt

SEQ ID NO: 175624 - DNA, 20 bp, Artificial Sequence
  Synthetic oligonucleotide; GGG chr2 60520724 60520743 60520727 -
taggcgaccaacatggggtg

SEQ ID NO: 175625 - DNA, 20 bp, Artificial Sequence
  Synthetic oligonucleotide; GGG chr2 60520723 60520742 60520726 -
aggcgaccaacatggggtgg

SEQ ID NO: 175626 - DNA, 20 bp, Artificial Sequence
  Synthetic oligonucleotide; TGG chr2 60520720 60520739 60520723 -
cgaccaacatggggtggggg

SEQ ID NO: 175627 - DNA, 20 bp, Artificial Sequence
  Synthetic oligonucleotide; GGG chr2 60520719 60520738 60520722 -
gaccaacatggggtgggggt

SEQ ID NO: 175628 - DNA, 20 bp, Artificial Sequence
  Synthetic oligonucleotide; GGG chr2 60520718 60520737 60520721 -
accaacatggggtgggggtg

SEQ ID NO: 175629 - DNA, 20 bp, Artificial Sequence
  Synthetic oligonucleotide; GGG chr2 60520717 60520736 60520720 -
ccaacatggggtgggggtgg

SEQ ID NO: 175630 - DNA, 20 bp, Artificial Sequence
  Synthetic oligonucleotide; TGG chr2 60520675 60520694 60520678 -
gcaaatatcttcactctcct

SEQ ID NO: 175631 - DNA, 20 bp, Artificial Sequence
  Synthetic oligonucleotide; TGG chr2 60520664 60520683 60520667 -
cactctccttggtgcttctg

SEQ ID NO: 175632 - DNA, 20 bp, Artificial Sequence
  Synthetic oligonucleotide; TAG chr2 60520646 60520665 60520649 -
tgtggttgtgcctatgaatt

SEQ ID NO: 175633 - DNA, 20 bp, Artificial Sequence
  Synthetic oligonucleotide; AGG chr2 60520645 60520664 60520648 -
gtggttgtgcctatgaattt

SEQ ID NO: 175634 - DNA, 20 bp, Artificial Sequence
  Synthetic oligonucleotide; TAG chr2 60520629 60520648 60520632 -
atttaggaccttatgcctca

SEQ ID NO: 175635 - DNA, 20 bp, Artificial Sequence
  Synthetic oligonucleotide; GAG chr2 60520622 60520641 60520625 -
accttatgcctcatagtgtt

SEQ ID NO: 175636 - DNA, 20 bp, Artificial Sequence
  Synthetic oligonucleotide; CAG chr2 60520618 60520637 60520621 -
tatgcctcatagtgttgagt

SEQ ID NO: 175637 - DNA, 20 bp, Artificial Sequence
  Synthetic oligonucleotide; GAG chr2 60520616 60520635 60520619 -
tgcctcatagtgttgagtca

SEQ ID NO: 175638 - DNA, 20 bp, Artificial Sequence
  Synthetic oligonucleotide; CAG chr2 60520608 60520627 60520611 -
agtgttgagtcagagcaaaa

SEQ ID NO: 175639 - DNA, 20 bp, Artificial Sequence
  Synthetic oligonucleotide; AAG chr2 60520596 60520615 60520599 -
gagcaaaacagtttacatca

SEQ ID NO: 175640 - DNA, 20 bp, Artificial Sequence
  Synthetic oligonucleotide; AGG chr2 60520595 60520614 60520598 -
agcaaaacagtttacatcaa

SEQ ID NO: 175641 - DNA, 20 bp, Artificial Sequence
  Synthetic oligonucleotide; CAG chr2 60520573 60520592 60520576 -
gccacttatttaattttcct

SEQ ID NO: 175642 - DNA, 20 bp, Artificial Sequence
  Synthetic oligonucleotide; GAG chr2 60520560 60520579 60520563 -
ttttcctcagaaaactctgt

SEQ ID NO: 175643 - DNA, 20 bp, Artificial Sequence
  Synthetic oligonucleotide; AGG chr2 60520559 60520578 60520562 -
tttcctcagaaaactctgtg

SEQ ID NO: 175644 - DNA, 20 bp, Artificial Sequence
  Synthetic oligonucleotide; CGG chr2 60520535 60520554 60520538 -
taatttctccttcttataaa

SEQ ID NO: 175645 - DNA, 20 bp, Artificial Sequence
  Synthetic oligonucleotide; AAG chr2 60520493 60520512 60520496 -
atgtgtacattatcccaccg

SEQ ID NO: 175646 - DNA, 20 bp, Artificial Sequence
  Synthetic oligonucleotide; AGG chr2 60520492 60520511 60520495 -
tgtgtacattatcccaccga

SEQ ID NO: 175647 - DNA, 20 bp, Artificial Sequence
  Synthetic oligonucleotide; GGG chr2 60520491 60520510 60520494 -
gtgtacattatcccaccgaa

SEQ ID NO: 175648 - DNA, 20 bp, Artificial Sequence
  Synthetic oligonucleotide; TAG chr2 60520465 60520484 60520468 -
tgctctttacttttataatc

SEQ ID NO: 175649 - DNA, 20 bp, Artificial Sequence
  Synthetic oligonucleotide; TGG chr2 60520449 60520468 60520452 -
aatctagattttaaaaaatt

SEQ ID NO: 175650 - DNA, 20 bp, Artificial Sequence
  Synthetic oligonucleotide; TGG chr2 60520446 60520465 60520449 -
ctagattttaaaaaatttgg

SEQ ID NO: 175651 - DNA, 20 bp, Artificial Sequence
  Synthetic oligonucleotide; CAG chr2 60520433 60520452 60520436 -
aatttggtggcacttgattt

SEQ ID NO: 175652 - DNA, 20 bp, Artificial Sequence
  Synthetic oligonucleotide; AGG chr2 60520432 60520451 60520435 -
atttggtggcacttgatttc

SEQ ID NO: 175653 - DNA, 20 bp, Artificial Sequence
  Synthetic oligonucleotide; CAG chr2 60520425 60520444 60520428 -
ggcacttgatttcaggtcct

SEQ ID NO: 175654 - DNA, 20 bp, Artificial Sequence
  Synthetic oligonucleotide; CAG chr2 60520418 60520437 60520421 -
gatttcaggtcctcagactc

SEQ ID NO: 175655 - DNA, 20 bp, Artificial Sequence
  Synthetic oligonucleotide; TAG chr2 60520398 60520417 60520401 -
cagaatttatactcactgat

SEQ ID NO: 175656 - DNA, 20 bp, Artificial Sequence
  Synthetic oligonucleotide; CAG chr2 60520374 60520393 60520377 -
aatgcattatgcaaataatt

SEQ ID NO: 175657 - DNA, 20 bp, Artificial Sequence
  Synthetic oligonucleotide; AAG chr2 60520317 60520336 60520320 -
acctcatgtcttgaaaaaaa

SEQ ID NO: 175658 - DNA, 20 bp, Artificial Sequence
  Synthetic oligonucleotide; CAG chr2 60520283 60520302 60520286 -
ctcaaaataaacaaaacctg

SEQ ID NO: 175659 - DNA, 20 bp, Artificial Sequence
  Synthetic oligonucleotide; AAG chr2 60520280 60520299 60520283 -
aaaataaacaaaacctgcag

SEQ ID NO: 175660 - DNA, 20 bp, Artificial Sequence
  Synthetic oligonucleotide; GAG chr2 60520278 60520297 60520281 -
aataaacaaaacctgcagaa

SEQ ID NO: 175661 - DNA, 20 bp, Artificial Sequence
  Synthetic oligonucleotide; AAG chr2 60520267 60520286 60520270 -
cctgcagaagagtttattgt

SEQ ID NO: 175662 - DNA, 20 bp, Artificial Sequence
  Synthetic oligonucleotide; AGG chr2 60520266 60520285 60520269 -
ctgcagaagagtttattgta

SEQ ID NO: 175663 - DNA, 20 bp, Artificial Sequence
  Synthetic oligonucleotide; GGG chr2 60520265 60520284 60520268 -
tgcagaagagtttattgtaa

SEQ ID NO: 175664 - DNA, 20 bp, Artificial Sequence
  Synthetic oligonucleotide; AAG chr2 60520253 60520272 60520256 -
tattgtaagggtgaaaatta

SEQ ID NO: 175665 - DNA, 20 bp, Artificial Sequence
  Synthetic oligonucleotide; GAG chr2 60520251 60520270 60520254 -
ttgtaagggtgaaaattaaa

SEQ ID NO: 175666 - DNA, 20 bp, Artificial Sequence
  Synthetic oligonucleotide; AGG chr2 60520250 60520269 60520253 -
tgtaagggtgaaaattaaag

SEQ ID NO: 175667 - DNA, 20 bp, Artificial Sequence
  Synthetic oligonucleotide; TGG chr2 60520235 60520254 60520238 -
taaagaggaacccatttgcc

SEQ ID NO: 175668 - DNA, 20 bp, Artificial Sequence
  Synthetic oligonucleotide; GGG chr2 60520234 60520253 60520237 -
aaagaggaacccatttgcct

SEQ ID NO: 175669 - DNA, 20 bp, Artificial Sequence
  Synthetic oligonucleotide; GAG chr2 60520224 60520243 60520227 -
ccatttgcctgggaactttt

SEQ ID NO: 175670 - DNA, 20 bp, Artificial Sequence
  Synthetic oligonucleotide; AGG chr2 60520223 60520242 60520226 -
catttgcctgggaacttttg

SEQ ID NO: 175671 - DNA, 20 bp, Artificial Sequence
  Synthetic oligonucleotide; AAG chr2 60520145 60520164 60520148 -
atcaatataccttgccacgc

SEQ ID NO: 175672 - DNA, 20 bp, Artificial Sequence
  Synthetic oligonucleotide; AGG chr2 60520144 60520163 60520147 -
tcaatataccttgccacgca

SEQ ID NO: 175673 - DNA, 20 bp, Artificial Sequence
  Synthetic oligonucleotide; TGG chr2 60520125 60520144 60520128 -
aaggtatattctattatctt

SEQ ID NO: 175674 - DNA, 20 bp, Artificial Sequence
  Synthetic oligonucleotide; CAG chr2 60520101 60520120 60520104 -
tttctgaatttttcaatttt

SEQ ID NO: 175675 - DNA, 20 bp, Artificial Sequence
  Synthetic oligonucleotide; AAG chr2 60520095 60520114 60520098 -
aatttttcaattttcagaaa

SEQ ID NO: 175676 - DNA, 20 bp, Artificial Sequence
  Synthetic oligonucleotide; AAG chr2 60520092 60520111 60520095 -
ttttcaattttcagaaaaag

SEQ ID NO: 175677 - DNA, 20 bp, Artificial Sequence
  Synthetic oligonucleotide; CAG chr2 60520049 60520068 60520052 -
cacatttgtgcataaataca

SEQ ID NO: 175678 - DNA, 20 bp, Artificial Sequence
  Synthetic oligonucleotide; AGG chr2 60520048 60520067 60520051 -
acatttgtgcataaatacac

SEQ ID NO: 175679 - DNA, 20 bp, Artificial Sequence
  Synthetic oligonucleotide; TAG chr2 60520031 60520050 60520034 -
cacaggcataaatgaaaatt

SEQ ID NO: 175680 - DNA, 20 bp, Artificial Sequence
  Synthetic oligonucleotide; AGG chr2 60520030 60520049 60520033 -
acaggcataaatgaaaattt

SEQ ID NO: 175681 - DNA, 20 bp, Artificial Sequence
  Synthetic oligonucleotide; AAG chr2 60520015 60520034 60520018 -
aatttaggccgaattatttg

SEQ ID NO: 175682 - DNA, 20 bp, Artificial Sequence
  Synthetic oligonucleotide; GAG chr2 60520013 60520032 60520016 -
tttaggccgaattatttgaa

SEQ ID NO: 175683 - DNA, 20 bp, Artificial Sequence
  Synthetic oligonucleotide; AGG chr2 60520012 60520031 60520015 -
ttaggccgaattatttgaag

SEQ ID NO: 175684 - DNA, 20 bp, Artificial Sequence
  Synthetic oligonucleotide; CAG chr2 60519992 60520011 60519995 -
aggatacaataattgcttgc

SEQ ID NO: 175685 - DNA, 20 bp, Artificial Sequence
  Synthetic oligonucleotide; CAG chr2 60519972 60519991 60519975 -
cagtgacatgattctcctgc

SEQ ID NO: 175686 - DNA, 20 bp, Artificial Sequence
  Synthetic oligonucleotide; GAG chr2 60519970 60519989 60519973 -
gtgacatgattctcctgcca

SEQ ID NO: 175687 - DNA, 20 bp, Artificial Sequence
  Synthetic oligonucleotide; GAG chr2 60519968 60519987 60519971 -
gacatgattctcctgccaga

SEQ ID NO: 175688 - DNA, 20 bp, Artificial Sequence
  Synthetic oligonucleotide; GAG chr2 60519966 60519985 60519969 -
catgattctcctgccagaga

SEQ ID NO: 175689 - DNA, 20 bp, Artificial Sequence
  Synthetic oligonucleotide; AGG chr2 60519965 60519984 60519968 -
atgattctcctgccagagag

SEQ ID NO: 175690 - DNA, 20 bp, Artificial Sequence
  Synthetic oligonucleotide; GGG chr2 60519964 60519983 60519967 -
tgattctcctgccagagaga

SEQ ID NO: 175691 - DNA, 20 bp, Artificial Sequence
  Synthetic oligonucleotide; GGG chr2 60519963 60519982 60519966 -
gattctcctgccagagagag

SEQ ID NO: 175692 - DNA, 20 bp, Artificial Sequence
  Synthetic oligonucleotide; GAG chr2 60519961 60519980 60519964 -
ttctcctgccagagagaggg

SEQ ID NO: 175693 - DNA, 20 bp, Artificial Sequence
  Synthetic oligonucleotide; TAG chr2 60519952 60519971 60519955 -
cagagagaggggagaataac

SEQ ID NO: 175694 - DNA, 20 bp, Artificial Sequence
  Synthetic oligonucleotide; AGG chr2 60519951 60519970 60519954 -
agagagaggggagaataact

SEQ ID NO: 175695 - DNA, 20 bp, Artificial Sequence
  Synthetic oligonucleotide; AAG chr2 60519929 60519948 60519932 -
gtgcaaacttttaacactcc

SEQ ID NO: 175696 - DNA, 20 bp, Artificial Sequence
  Synthetic oligonucleotide; TAG chr2 60519924 60519943 60519927 -
aacttttaacactccaagtc

SEQ ID NO: 175697 - DNA, 20 bp, Artificial Sequence
  Synthetic oligonucleotide; GAG chr2 60519922 60519941 60519925 -
cttttaacactccaagtcta

SEQ ID NO: 175698 - DNA, 20 bp, Artificial Sequence
  Synthetic oligonucleotide; GAG chr2 60519920 60519939 60519923 -
tttaacactccaagtctaga

SEQ ID NO: 175699 - DNA, 20 bp, Artificial Sequence
  Synthetic oligonucleotide; AAG chr2 60519909 60519928 60519912 -
aagtctagagagaattatcc

SEQ ID NO: 175700 - DNA, 20 bp, Artificial Sequence
  Synthetic oligonucleotide; TAG chr2 60519904 60519923 60519907 -
tagagagaattatccaagca

SEQ ID NO: 175701 - DNA, 20 bp, Artificial Sequence
  Synthetic oligonucleotide; GAG chr2 60519889 60519908 60519892 -
aagcatagccatgaattcct

SEQ ID NO: 175702 - DNA, 20 bp, Artificial Sequence
  Synthetic oligonucleotide; TGG chr2 60519883 60519902 60519886 -
agccatgaattcctgagtta

SEQ ID NO: 175703 - DNA, 20 bp, Artificial Sequence
  Synthetic oligonucleotide; TGG chr2 60519878 60519897 60519881 -
tgaattcctgagttatggat

SEQ ID NO: 175704 - DNA, 20 bp, Artificial Sequence
  Synthetic oligonucleotide; GAG chr2 60519834 60519853 60519837 -
acgatctctttgtcttcact

SEQ ID NO: 175705 - DNA, 20 bp, Artificial Sequence
  Synthetic oligonucleotide; TGG chr2 60519818 60519837 60519821 -
cactgagttttctttgtcat

SEQ ID NO: 175706 - DNA, 20 bp, Artificial Sequence
  Synthetic oligonucleotide; GAG chr2 60519816 60519835 60519819 -
ctgagttttctttgtcattg

SEQ ID NO: 175707 - DNA, 20 bp, Artificial Sequence
  Synthetic oligonucleotide; TAG chr2 60519808 60519827 60519811 -
tctttgtcattggagtaatt

SEQ ID NO: 175708 - DNA, 20 bp, Artificial Sequence
  Synthetic oligonucleotide; AGG chr2 60519807 60519826 60519810 -
ctttgtcattggagtaattt

SEQ ID NO: 175709 - DNA, 20 bp, Artificial Sequence
  Synthetic oligonucleotide; GAG chr2 60519805 60519824 60519808 -
ttgtcattggagtaatttag

SEQ ID NO: 175710 - DNA, 20 bp, Artificial Sequence
  Synthetic oligonucleotide; CAG chr2 60519798 60519817 60519801 -
tggagtaatttaggagaata

SEQ ID NO: 175711 - DNA, 20 bp, Artificial Sequence
  Synthetic oligonucleotide; AGG chr2 60519797 60519816 60519800 -
ggagtaatttaggagaatac

SEQ ID NO: 175712 - DNA, 20 bp, Artificial Sequence
  Synthetic oligonucleotide; TGG chr2 60519787 60519806 60519790 -
aggagaatacaggatgtgac

SEQ ID NO: 175713 - DNA, 20 bp, Artificial Sequence
  Synthetic oligonucleotide; GGG chr2 60519786 60519805 60519789 -
ggagaatacaggatgtgact

SEQ ID NO: 175714 - DNA, 20 bp, Artificial Sequence
  Synthetic oligonucleotide; GAG chr2 60519784 60519803 60519787 -
agaatacaggatgtgactgg

SEQ ID NO: 175715 - DNA, 20 bp, Artificial Sequence
  Synthetic oligonucleotide; AAG chr2 60519769 60519788 60519772 -
actgggagccctttctgaat

SEQ ID NO: 175716 - DNA, 20 bp, Artificial Sequence
  Synthetic oligonucleotide; CAG chr2 60519764 60519783 60519767 -
gagccctttctgaataagca

SEQ ID NO: 175717 - DNA, 20 bp, Artificial Sequence
  Synthetic oligonucleotide; CAG chr2 60519735 60519754 60519738 -
gcccacgtgaattcctaaac

SEQ ID NO: 175718 - DNA, 20 bp, Artificial Sequence
  Synthetic oligonucleotide; TGG chr2 60519732 60519751 60519735 -
cacgtgaattcctaaaccag

SEQ ID NO: 175719 - DNA, 20 bp, Artificial Sequence
  Synthetic oligonucleotide; CAG chr2 60519725 60519744 60519728 -
attcctaaaccagtggctcc

SEQ ID NO: 175720 - DNA, 20 bp, Artificial Sequence
  Synthetic oligonucleotide; CAG chr2 60519712 60519731 60519715 -
tggctcccagctgcatgtgt

SEQ ID NO: 175721 - DNA, 20 bp, Artificial Sequence
  Synthetic oligonucleotide; CAG chr2 60519707 60519726 60519710 -
cccagctgcatgtgtcagaa

SEQ ID NO: 175722 - DNA, 20 bp, Artificial Sequence
  Synthetic oligonucleotide; TGG chr2 60519701 60519720 60519704 -
tgcatgtgtcagaacagaac

SEQ ID NO: 175723 - DNA, 20 bp, Artificial Sequence
  Synthetic oligonucleotide; CAG chr2 60519695 60519714 60519698 -
tgtcagaacagaactggcct

SEQ ID NO: 175724 - DNA, 20 bp, Artificial Sequence
  Synthetic oligonucleotide; AAG chr2 60519684 60519703 60519687 -
aactggcctcagaaatctac

SEQ ID NO: 175725 - DNA, 20 bp, Artificial Sequence
  Synthetic oligonucleotide; CAG chr2 60519677 60519696 60519680 -
ctcagaaatctacaagattc

SEQ ID NO: 175726 - DNA, 20 bp, Artificial Sequence
  Synthetic oligonucleotide; TGG chr2 60519674 60519693 60519677 -
agaaatctacaagattccag

SEQ ID NO: 175727 - DNA, 20 bp, Artificial Sequence
  Synthetic oligonucleotide; CAG chr2 60519668 60519687 60519671 -
ctacaagattccagtggttc

SEQ ID NO: 175728 - DNA, 20 bp, Artificial Sequence
  Synthetic oligonucleotide; CAG chr2 60519653 60519672 60519656 -
ggttccagcctcactttctc

SEQ ID NO: 175729 - DNA, 20 bp, Artificial Sequence
  Synthetic oligonucleotide; TGG chr2 60519650 60519669 60519653 -
tccagcctcactttctccag

SEQ ID NO: 175730 - DNA, 20 bp, Artificial Sequence
  Synthetic oligonucleotide; AAG chr2 60519628 60519647 60519631 -
gtcaacttactgctgttgca

SEQ ID NO: 175731 - DNA, 20 bp, Artificial Sequence
  Synthetic oligonucleotide; CAG chr2 60519620 60519639 60519623 -
actgctgttgcaaagcacgt

SEQ ID NO: 175732 - DNA, 20 bp, Artificial Sequence
  Synthetic oligonucleotide; CAG chr2 60519613 60519632 60519616 -
ttgcaaagcacgtcagattt

SEQ ID NO: 175733 - DNA, 20 bp, Artificial Sequence
  Synthetic oligonucleotide; AGG chr2 60519612 60519631 60519615 -
tgcaaagcacgtcagatttc

SEQ ID NO: 175734 - DNA, 20 bp, Artificial Sequence
  Synthetic oligonucleotide; GAG chr2 60519610 60519629 60519613 -
caaagcacgtcagatttcag

SEQ ID NO: 175735 - DNA, 20 bp, Artificial Sequence
  Synthetic oligonucleotide; AAG chr2 60519594 60519613 60519597 -
tcaggagcgatttctcttgt

SEQ ID NO: 175736 - DNA, 20 bp, Artificial Sequence
  Synthetic oligonucleotide; AGG chr2 60519593 60519612 60519596 -
caggagcgatttctcttgta

SEQ ID NO: 175737 - DNA, 20 bp, Artificial Sequence
  Synthetic oligonucleotide; AAG chr2 60519589 60519608 60519592 -
agcgatttctcttgtaagga

SEQ ID NO: 175738 - DNA, 20 bp, Artificial Sequence
  Synthetic oligonucleotide; AAG chr2 60519586 60519605 60519589 -
gatttctcttgtaaggaaag

SEQ ID NO: 175739 - DNA, 20 bp, Artificial Sequence
  Synthetic oligonucleotide; AGG chr2 60519585 60519604 60519588 -
atttctcttgtaaggaaaga

SEQ ID NO: 175740 - DNA, 20 bp, Artificial Sequence
  Synthetic oligonucleotide; CAG chr2 60519582 60519601 60519585 -
tctcttgtaaggaaagaagg

SEQ ID NO: 175741 - DNA, 20 bp, Artificial Sequence
  Synthetic oligonucleotide; AGG chr2 60519581 60519600 60519584 -
ctcttgtaaggaaagaaggc

SEQ ID NO: 175742 - DNA, 20 bp, Artificial Sequence
  Synthetic oligonucleotide; CAG chr2 60519578 60519597 60519581 -
ttgtaaggaaagaaggcagg

SEQ ID NO: 175743 - DNA, 20 bp, Artificial Sequence
  Synthetic oligonucleotide; AGG chr2 60519577 60519596 60519580 -
tgtaaggaaagaaggcaggc

SEQ ID NO: 175744 - DNA, 20 bp, Artificial Sequence
  Synthetic oligonucleotide; CAG chr2 60519574 60519593 60519577 -
aaggaaagaaggcaggcagg

SEQ ID NO: 175745 - DNA, 20 bp, Artificial Sequence
  Synthetic oligonucleotide; AGG chr2 60519573 60519592 60519576 -
aggaaagaaggcaggcaggc

SEQ ID NO: 175746 - DNA, 20 bp, Artificial Sequence
  Synthetic oligonucleotide; CAG chr2 60519570 60519589 60519573 -
aaagaaggcaggcaggcagg

SEQ ID NO: 175747 - DNA, 20 bp, Artificial Sequence
  Synthetic oligonucleotide; AGG chr2 60519569 60519588 60519572 -
aagaaggcaggcaggcaggc

SEQ ID NO: 175748 - DNA, 20 bp, Artificial Sequence
  Synthetic oligonucleotide; CAG chr2 60519566 60519585 60519569 -
aaggcaggcaggcaggcagg

SEQ ID NO: 175749 - DNA, 20 bp, Artificial Sequence
  Synthetic oligonucleotide; AGG chr2 60519565 60519584 60519568 -
aggcaggcaggcaggcaggc

SEQ ID NO: 175750 - DNA, 20 bp, Artificial Sequence
  Synthetic oligonucleotide; CAG chr2 60519562 60519581 60519565 -
caggcaggcaggcaggcagg

SEQ ID NO: 175751 - DNA, 20 bp, Artificial Sequence
  Synthetic oligonucleotide; AGG chr2 60519561 60519580 60519564 -
aggcaggcaggcaggcaggc

SEQ ID NO: 175752 - DNA, 20 bp, Artificial Sequence
  Synthetic oligonucleotide; CAG chr2 60519558 60519577 60519561 -
caggcaggcaggcaggcagg

SEQ ID NO: 175753 - DNA, 20 bp, Artificial Sequence
  Synthetic oligonucleotide; AGG chr2 60519557 60519576 60519560 -
aggcaggcaggcaggcaggc

SEQ ID NO: 175754 - DNA, 20 bp, Artificial Sequence
  Synthetic oligonucleotide; CAG chr2 60519554 60519573 60519557 -
caggcaggcaggcaggcagg

SEQ ID NO: 175755 - DNA, 20 bp, Artificial Sequence
  Synthetic oligonucleotide; AGG chr2 60519553 60519572 60519556 -
aggcaggcaggcaggcaggc

SEQ ID NO: 175756 - DNA, 20 bp, Artificial Sequence
  Synthetic oligonucleotide; CAG chr2 60519550 60519569 60519553 -
caggcaggcaggcaggcagg

SEQ ID NO: 175757 - DNA, 20 bp, Artificial Sequence
  Synthetic oligonucleotide; AGG chr2 60519549 60519568 60519552 -
aggcaggcaggcaggcaggc

SEQ ID NO: 175758 - DNA, 20 bp, Artificial Sequence
  Synthetic oligonucleotide; CAG chr2 60519546 60519565 60519549 -
caggcaggcaggcaggcagg

SEQ ID NO: 175759 - DNA, 20 bp, Artificial Sequence
  Synthetic oligonucleotide; AGG chr2 60519545 60519564 60519548 -
aggcaggcaggcaggcaggc

SEQ ID NO: 175760 - DNA, 20 bp, Artificial Sequence
  Synthetic oligonucleotide; AAG chr2 60519541 60519560 60519544 -
aggcaggcaggcaggcaggc

SEQ ID NO: 175761 - DNA, 20 bp, Artificial Sequence
  Synthetic oligonucleotide; GAG chr2 60519537 60519556 60519540 -
aggcaggcaggcaggcaagt

SEQ ID NO: 175762 - DNA, 20 bp, Artificial Sequence
  Synthetic oligonucleotide; AGG chr2 60519536 60519555 60519539 -
ggcaggcaggcaggcaagtg

SEQ ID NO: 175763 - DNA, 20 bp, Artificial Sequence
  Synthetic oligonucleotide; CAG chr2 60519516 60519535 60519519 -
aggaccttattttttctctg

SEQ ID NO: 175764 - DNA, 20 bp, Artificial Sequence
  Synthetic oligonucleotide; GAG chr2 60519510 60519529 60519513 -
ttattttttctctgcagcat

SEQ ID NO: 175765 - DNA, 20 bp, Artificial Sequence
  Synthetic oligonucleotide; CAG chr2 60519505 60519524 60519508 -
ttttctctgcagcatgagtg

SEQ ID NO: 175766 - DNA, 20 bp, Artificial Sequence
  Synthetic oligonucleotide; CAG chr2 60519462 60519481 60519465 -
tccacacccatctctcctta

SEQ ID NO: 175767 - DNA, 20 bp, Artificial Sequence
  Synthetic oligonucleotide; AGG chr2 60519461 60519480 60519464 -
ccacacccatctctccttac

SEQ ID NO: 175768 - DNA, 20 bp, Artificial Sequence
  Synthetic oligonucleotide; TAG chr2 60519455 60519474 60519458 -
ccatctctccttacaggtta

SEQ ID NO: 175769 - DNA, 20 bp, Artificial Sequence
  Synthetic oligonucleotide; TGG chr2 60519443 60519462 60519446 -
acaggttatagacacatttt

SEQ ID NO: 175770 - DNA, 20 bp, Artificial Sequence
  Synthetic oligonucleotide; AAG chr2 60519431 60519450 60519434 -
cacatttttggcactgcata

SEQ ID NO: 175771 - DNA, 20 bp, Artificial Sequence
  Synthetic oligonucleotide; AAG chr2 60519427 60519446 60519430 -
tttttggcactgcataaagt

SEQ ID NO: 175772 - DNA, 20 bp, Artificial Sequence
  Synthetic oligonucleotide; AAG chr2 60519382 60519401 60519385 -
ttaactttcacatcattaaa

SEQ ID NO: 175773 - DNA, 20 bp, Artificial Sequence
  Synthetic oligonucleotide; CAG chr2 60519363 60519382 60519366 -
aaagctgatgtactgacttt

SEQ ID NO: 175774 - DNA, 20 bp, Artificial Sequence
  Synthetic oligonucleotide; TGG chr2 60519355 60519374 60519358 -
tgtactgactttcagctgcc

SEQ ID NO: 175775 - DNA, 20 bp, Artificial Sequence
  Synthetic oligonucleotide; GAG chr2 60519353 60519372 60519356 -
tactgactttcagctgcctg

SEQ ID NO: 175776 - DNA, 20 bp, Artificial Sequence
  Synthetic oligonucleotide; TAG chr2 60519349 60519368 60519352 -
gactttcagctgcctggaga

SEQ ID NO: 175777 - DNA, 20 bp, Artificial Sequence
  Synthetic oligonucleotide; CAG chr2 60519344 60519363 60519347 -
tcagctgcctggagatagtt

SEQ ID NO: 175778 - DNA, 20 bp, Artificial Sequence
  Synthetic oligonucleotide; AGG chr2 60519343 60519362 60519346 -
cagctgcctggagatagttc

SEQ ID NO: 175779 - DNA, 20 bp, Artificial Sequence
  Synthetic oligonucleotide; GGG chr2 60519342 60519361 60519345 -
agctgcctggagatagttca

SEQ ID NO: 175780 - DNA, 20 bp, Artificial Sequence
  Synthetic oligonucleotide; CAG chr2 60519337 60519356 60519340 -
cctggagatagttcagggcc

SEQ ID NO: 175781 - DNA, 20 bp, Artificial Sequence
  Synthetic oligonucleotide; CAG chr2 60519327 60519346 60519330 -
gttcagggcccagcacctga

SEQ ID NO: 175782 - DNA, 20 bp, Artificial Sequence
  Synthetic oligonucleotide; AGG chr2 60519326 60519345 60519329 -
ttcagggcccagcacctgac

SEQ ID NO: 175783 - DNA, 20 bp, Artificial Sequence
  Synthetic oligonucleotide; TGG chr2 60519292 60519311 60519295 -
gtgttttatgtctctcaata

SEQ ID NO: 175784 - DNA, 20 bp, Artificial Sequence
  Synthetic oligonucleotide; GAG chr2 60519290 60519309 60519293 -
gttttatgtctctcaatatg

SEQ ID NO: 175785 - DNA, 20 bp, Artificial Sequence
  Synthetic oligonucleotide; AGG chr2 60519289 60519308 60519292 -
ttttatgtctctcaatatgg

SEQ ID NO: 175786 - DNA, 20 bp, Artificial Sequence
  Synthetic oligonucleotide; TAG chr2 60519283 60519302 60519286 -
gtctctcaatatggaggtta

SEQ ID NO: 175787 - DNA, 20 bp, Artificial Sequence
  Synthetic oligonucleotide; AAG chr2 60519273 60519292 60519276 -
atggaggttatagaatcaaa

SEQ ID NO: 175788 - DNA, 20 bp, Artificial Sequence
  Synthetic oligonucleotide; AAG chr2 60519254 60519273 60519257 -
aaagaccgcaaaatgcctta

SEQ ID NO: 175789 - DNA, 20 bp, Artificial Sequence
  Synthetic oligonucleotide; AGG chr2 60519253 60519272 60519256 -
aagaccgcaaaatgccttaa

SEQ ID NO: 175790 - DNA, 20 bp, Artificial Sequence
  Synthetic oligonucleotide; TAG chr2 60519238 60519257 60519241 -
cttaaaggtgttgataccca

SEQ ID NO: 175791 - DNA, 20 bp, Artificial Sequence
  Synthetic oligonucleotide; CAG chr2 60519234 60519253 60519237 -
aaggtgttgatacccataga

SEQ ID NO: 175792 - DNA, 20 bp, Artificial Sequence
  Synthetic oligonucleotide; GAG chr2 60519232 60519251 60519235 -
ggtgttgatacccatagaca

SEQ ID NO: 175793 - DNA, 20 bp, Artificial Sequence
  Synthetic oligonucleotide; TAG chr2 60519223 60519242 60519226 -
acccatagacagagcatgca

SEQ ID NO: 175794 - DNA, 20 bp, Artificial Sequence
  Synthetic oligonucleotide; CAG chr2 60519216 60519235 60519219 -
gacagagcatgcatagtcct

SEQ ID NO: 175795 - DNA, 20 bp, Artificial Sequence
  Synthetic oligonucleotide; AGG chr2 60519215 60519234 60519218 -
acagagcatgcatagtcctc

SEQ ID NO: 175796 - DNA, 20 bp, Artificial Sequence
  Synthetic oligonucleotide; TAG chr2 60519171 60519190 60519174 -
cacacctatttctttttttg

SEQ ID NO: 175797 - DNA, 20 bp, Artificial Sequence
  Synthetic oligonucleotide; AAG chr2 60519155 60519174 60519158 -
tttgtagcgcctgtatttga

SEQ ID NO: 175798 - DNA, 20 bp, Artificial Sequence
  Synthetic oligonucleotide; AGG chr2 60519154 60519173 60519157 -
ttgtagcgcctgtatttgaa

SEQ ID NO: 175799 - DNA, 20 bp, Artificial Sequence
  Synthetic oligonucleotide; GGG chr2 60519153 60519172 60519156 -
tgtagcgcctgtatttgaaa

SEQ ID NO: 175800 - DNA, 20 bp, Artificial Sequence
  Synthetic oligonucleotide; GGG chr2 60519152 60519171 60519155 -
gtagcgcctgtatttgaaag

SEQ ID NO: 175801 - DNA, 20 bp, Artificial Sequence
  Synthetic oligonucleotide; TGG chr2 60519145 60519164 60519148 -
ctgtatttgaaaggggttcc

SEQ ID NO: 175802 - DNA, 20 bp, Artificial Sequence
  Synthetic oligonucleotide; TGG chr2 60519136 60519155 60519139 -
aaaggggttcctggtgtact

SEQ ID NO: 175803 - DNA, 20 bp, Artificial Sequence
  Synthetic oligonucleotide; GGG chr2 60519135 60519154 60519138 -
aaggggttcctggtgtactt

SEQ ID NO: 175804 - DNA, 20 bp, Artificial Sequence
  Synthetic oligonucleotide; GAG chr2 60519133 60519152 60519136 -
ggggttcctggtgtacttgg

SEQ ID NO: 175805 - DNA, 20 bp, Artificial Sequence
  Synthetic oligonucleotide; AAG chr2 60519128 60519147 60519131 -
tcctggtgtacttgggagaa

SEQ ID NO: 175806 - DNA, 20 bp, Artificial Sequence
  Synthetic oligonucleotide; AAG chr2 60519125 60519144 60519128 -
tggtgtacttgggagaaaag

SEQ ID NO: 175807 - DNA, 20 bp, Artificial Sequence
  Synthetic oligonucleotide; TGG chr2 60519117 60519136 60519120 -
ttgggagaaaagaagcttct

SEQ ID NO: 175808 - DNA, 20 bp, Artificial Sequence
  Synthetic oligonucleotide; TGG chr2 60519112 60519131 60519115 -
agaaaagaagcttcttggtt

SEQ ID NO: 175809 - DNA, 20 bp, Artificial Sequence
  Synthetic oligonucleotide; TAG chr2 60519109 60519128 60519112 -
aaagaagcttcttggtttgg

SEQ ID NO: 175810 - DNA, 20 bp, Artificial Sequence
  Synthetic oligonucleotide; CAG chr2 60519099 60519118 60519102 -
cttggtttggtagtacctac

SEQ ID NO: 175811 - DNA, 20 bp, Artificial Sequence
  Synthetic oligonucleotide; GAG chr2 60519097 60519116 60519100 -
tggtttggtagtacctacca

SEQ ID NO: 175812 - DNA, 20 bp, Artificial Sequence
  Synthetic oligonucleotide; TGG chr2 60519078 60519097 60519081 -
agagactccctgtttcctgc

SEQ ID NO: 175813 - DNA, 20 bp, Artificial Sequence
  Synthetic oligonucleotide; CAG chr2 60519072 60519091 60519075 -
tccctgtttcctgctggtat

SEQ ID NO: 175814 - DNA, 20 bp, Artificial Sequence
  Synthetic oligonucleotide; AGG chr2 60519071 60519090 60519074 -
ccctgtttcctgctggtatc

SEQ ID NO: 175815 - DNA, 20 bp, Artificial Sequence
  Synthetic oligonucleotide; AAG chr2 60519035 60519054 60519038 -
acttctgtccattttctctc

SEQ ID NO: 175816 - DNA, 20 bp, Artificial Sequence
  Synthetic oligonucleotide; GAG chr2 60519033 60519052 60519036 -
ttctgtccattttctctcaa

SEQ ID NO: 175817 - DNA, 20 bp, Artificial Sequence
  Synthetic oligonucleotide; GAG chr2 60519028 60519047 60519031 -
tccattttctctcaagagtt

SEQ ID NO: 175818 - DNA, 20 bp, Artificial Sequence
  Synthetic oligonucleotide; GAG chr2 60519026 60519045 60519029 -
cattttctctcaagagttga

SEQ ID NO: 175819 - DNA, 20 bp, Artificial Sequence
  Synthetic oligonucleotide; AAG chr2 60519002 60519021 60519005 -
tgtgtgccatcgctctttaa

SEQ ID NO: 175820 - DNA, 20 bp, Artificial Sequence
  Synthetic oligonucleotide; AAG chr2 60518999 60519018 60519002 -
gtgccatcgctctttaaaag

SEQ ID NO: 175821 - DNA, 20 bp, Artificial Sequence
  Synthetic oligonucleotide; AGG chr2 60518998 60519017 60519001 -
tgccatcgctctttaaaaga

SEQ ID NO: 175822 - DNA, 20 bp, Artificial Sequence
  Synthetic oligonucleotide; TGG chr2 60518979 60518998 60518982 -
aaggaactctccttttgctg

SEQ ID NO: 175823 - DNA, 20 bp, Artificial Sequence
  Synthetic oligonucleotide; TAG chr2 60518972 60518991 60518975 -
tctccttttgctgtggattg

SEQ ID NO: 175824 - DNA, 20 bp, Artificial Sequence
  Synthetic oligonucleotide; AGG chr2 60518971 60518990 60518974 -
ctccttttgctgtggattgt

SEQ ID NO: 175825 - DNA, 20 bp, Artificial Sequence
  Synthetic oligonucleotide; GGG chr2 60518970 60518989 60518973 -
tccttttgctgtggattgta

SEQ ID NO: 175826 - DNA, 20 bp, Artificial Sequence
  Synthetic oligonucleotide; GAG chr2 60518968 60518987 60518971 -
cttttgctgtggattgtagg

SEQ ID NO: 175827 - DNA, 20 bp, Artificial Sequence
  Synthetic oligonucleotide; CAG chr2 60518965 60518984 60518968 -
ttgctgtggattgtagggag

SEQ ID NO: 175828 - DNA, 20 bp, Artificial Sequence
  Synthetic oligonucleotide; TGG chr2 60518959 60518978 60518962 -
tggattgtagggagcagatt

SEQ ID NO: 175829 - DNA, 20 bp, Artificial Sequence
  Synthetic oligonucleotide; TGG chr2 60518947 60518966 60518950 -
agcagatttggtgcttactg

SEQ ID NO: 175830 - DNA, 20 bp, Artificial Sequence
  Synthetic oligonucleotide; CAG chr2 60518941 60518960 60518944 -
tttggtgcttactgtggctt

SEQ ID NO: 175831 - DNA, 20 bp, Artificial Sequence
  Synthetic oligonucleotide; AGG chr2 60518940 60518959 60518943 -
ttggtgcttactgtggcttc

SEQ ID NO: 175832 - DNA, 20 bp, Artificial Sequence
  Synthetic oligonucleotide; CAG chr2 60518922 60518941 60518925 -
tcaggacccaccttgaatga

SEQ ID NO: 175833 - DNA, 20 bp, Artificial Sequence
  Synthetic oligonucleotide; CAG chr2 60518914 60518933 60518917 -
caccttgaatgacagaatgt

SEQ ID NO: 175834 - DNA, 20 bp, Artificial Sequence
  Synthetic oligonucleotide; AAG chr2 60518907 60518926 60518910 -
aatgacagaatgtcagtaac

SEQ ID NO: 175835 - DNA, 20 bp, Artificial Sequence
  Synthetic oligonucleotide; CAG chr2 60518904 60518923 60518907 -
gacagaatgtcagtaacaag

SEQ ID NO: 175836 - DNA, 20 bp, Artificial Sequence
  Synthetic oligonucleotide; CAG chr2 60518898 60518917 60518901 -
atgtcagtaacaagcagccc

SEQ ID NO: 175837 - DNA, 20 bp, Artificial Sequence
  Synthetic oligonucleotide; AGG chr2 60518897 60518916 60518900 -
tgtcagtaacaagcagcccc

SEQ ID NO: 175838 - DNA, 20 bp, Artificial Sequence
  Synthetic oligonucleotide; CGG chr2 60518889 60518908 60518892 -
acaagcagccccaggaaata

SEQ ID NO: 175839 - DNA, 20 bp, Artificial Sequence
  Synthetic oligonucleotide; TGG chr2 60518885 60518904 60518888 -
gcagccccaggaaatacggc

SEQ ID NO: 175840 - DNA, 20 bp, Artificial Sequence
  Synthetic oligonucleotide; TGG chr2 60518882 60518901 60518885 -
gccccaggaaatacggctgg

SEQ ID NO: 175841 - DNA, 20 bp, Artificial Sequence
  Synthetic oligonucleotide; GAG chr2 60518849 60518868 60518852 -
cctcttgatctttgcccatc

SEQ ID NO: 175842 - DNA, 20 bp, Artificial Sequence
  Synthetic oligonucleotide; TGG chr2 60518836 60518855 60518839 -
gcccatcgagcaacaccatg

SEQ ID NO: 175843 - DNA, 20 bp, Artificial Sequence
  Synthetic oligonucleotide; TGG chr2 60518832 60518851 60518835 -
atcgagcaacaccatgtgga

SEQ ID NO: 175844 - DNA, 20 bp, Artificial Sequence
  Synthetic oligonucleotide; CAG chr2 60518821 60518840 60518824 -
ccatgtggatggtgtccatc

SEQ ID NO: 175845 - DNA, 20 bp, Artificial Sequence
  Synthetic oligonucleotide; CAG chr2 60518801 60518820 60518804 -
cagcttgacctgaacttgaa

SEQ ID NO: 175846 - DNA, 20 bp, Artificial Sequence
  Synthetic oligonucleotide; GAG chr2 60518790 60518809 60518793 -
gaacttgaacagtaattgat

SEQ ID NO: 175847 - DNA, 20 bp, Artificial Sequence
  Synthetic oligonucleotide; CGG chr2 60518770 60518789 60518773 -
gagtccttaaaatccacgcc

SEQ ID NO: 175848 - DNA, 20 bp, Artificial Sequence
  Synthetic oligonucleotide; CAG chr2 60518763 60518782 60518766 -
taaaatccacgcccggcccc

SEQ ID NO: 175849 - DNA, 20 bp, Artificial Sequence
  Synthetic oligonucleotide; AGG chr2 60518762 60518781 60518765 -
aaaatccacgcccggccccc

SEQ ID NO: 175850 - DNA, 20 bp, Artificial Sequence
  Synthetic oligonucleotide; TGG chr2 60518752 60518771 60518755 -
cccggcccccaggaatgcct

SEQ ID NO: 175851 - DNA, 20 bp, Artificial Sequence
  Synthetic oligonucleotide; GGG chr2 60518751 60518770 60518754 -
ccggcccccaggaatgcctt

SEQ ID NO: 175852 - DNA, 20 bp, Artificial Sequence
  Synthetic oligonucleotide; GGG chr2 60518750 60518769 60518753 -
cggcccccaggaatgccttg

SEQ ID NO: 175853 - DNA, 20 bp, Artificial Sequence
  Synthetic oligonucleotide; TGG chr2 60518724 60518743 60518727 -
cccatcccacgttctgattc

SEQ ID NO: 175854 - DNA, 20 bp, Artificial Sequence
  Synthetic oligonucleotide; TGG chr2 60518720 60518739 60518723 -
tcccacgttctgattctgga

SEQ ID NO: 175855 - DNA, 20 bp, Artificial Sequence
  Synthetic oligonucleotide; AAG chr2 60518711 60518730 60518714 -
ctgattctggatggactttt

SEQ ID NO: 175856 - DNA, 20 bp, Artificial Sequence
  Synthetic oligonucleotide; GAG chr2 60518694 60518713 60518697 -
tttaagtgaactctgatgat

SEQ ID NO: 175857 - DNA, 20 bp, Artificial Sequence
  Synthetic oligonucleotide; TAG chr2 60518691 60518710 60518694 -
aagtgaactctgatgatgag

SEQ ID NO: 175858 - DNA, 20 bp, Artificial Sequence
  Synthetic oligonucleotide; AGG chr2 60518690 60518709 60518693 -
agtgaactctgatgatgagt

SEQ ID NO: 175859 - DNA, 20 bp, Artificial Sequence
  Synthetic oligonucleotide; TGG chr2 60518657 60518676 60518660 -
tctttctcaacgttctctgc

SEQ ID NO: 175860 - DNA, 20 bp, Artificial Sequence
  Synthetic oligonucleotide; GGG chr2 60518656 60518675 60518659 -
ctttctcaacgttctctgct

SEQ ID NO: 175861 - DNA, 20 bp, Artificial Sequence
  Synthetic oligonucleotide; TGG chr2 60518626 60518645 60518629 -
gtcacctcccatgccctctc

SEQ ID NO: 175862 - DNA, 20 bp, Artificial Sequence
  Synthetic oligonucleotide; TGG chr2 60518619 60518638 60518622 -
cccatgccctctctggtgtg

SEQ ID NO: 175863 - DNA, 20 bp, Artificial Sequence
  Synthetic oligonucleotide; CAG chr2 60518609 60518628 60518612 -
ctctggtgtgtggtgattct

SEQ ID NO: 175864 - DNA, 20 bp, Artificial Sequence
  Synthetic oligonucleotide; TAG chr2 60518603 60518622 60518606 -
tgtgtggtgattctcagatc

SEQ ID NO: 175865 - DNA, 20 bp, Artificial Sequence
  Synthetic oligonucleotide; GAG chr2 60518601 60518620 60518604 -
tgtggtgattctcagatcta

SEQ ID NO: 175866 - DNA, 20 bp, Artificial Sequence
  Synthetic oligonucleotide; TGG chr2 60518561 60518580 60518564 -
tccccccatgcctttgcgtg

SEQ ID NO: 175867 - DNA, 20 bp, Artificial Sequence
  Synthetic oligonucleotide; GGG chr2 60518560 60518579 60518563 -
ccccccatgcctttgcgtgt

SEQ ID NO: 175868 - DNA, 20 bp, Artificial Sequence
  Synthetic oligonucleotide; AAG chr2 60518557 60518576 60518560 -
cccatgcctttgcgtgtggg

SEQ ID NO: 175869 - DNA, 20 bp, Artificial Sequence
  Synthetic oligonucleotide; TGG chr2 60518510 60518529 60518513 -
tcccatgtgccatttttacc

SEQ ID NO: 175870 - DNA, 20 bp, Artificial Sequence
  Synthetic oligonucleotide; CAG chr2 60518473 60518492 60518476 -
tctttattcatatttaaatg

SEQ ID NO: 175871 - DNA, 20 bp, Artificial Sequence
  Synthetic oligonucleotide; AGG chr2 60518472 60518491 60518475 -
ctttattcatatttaaatgc

SEQ ID NO: 175872 - DNA, 20 bp, Artificial Sequence
  Synthetic oligonucleotide; GAG chr2 60518468 60518487 60518471 -
attcatatttaaatgcaggt

SEQ ID NO: 175873 - DNA, 20 bp, Artificial Sequence
  Synthetic oligonucleotide; TGG chr2 60518464 60518483 60518467 -
atatttaaatgcaggtgagt

SEQ ID NO: 175874 - DNA, 20 bp, Artificial Sequence
  Synthetic oligonucleotide; CAG chr2 60518449 60518468 60518452 -
tgagttggaatgtcatctta

SEQ ID NO: 175875 - DNA, 20 bp, Artificial Sequence
  Synthetic oligonucleotide; AGG chr2 60518448 60518467 60518451 -
gagttggaatgtcatcttac

SEQ ID NO: 175876 - DNA, 20 bp, Artificial Sequence
  Synthetic oligonucleotide; CAG chr2 60518421 60518440 60518424 -
atcctgaatctgctctatcg

SEQ ID NO: 175877 - DNA, 20 bp, Artificial Sequence
  Synthetic oligonucleotide; TAG chr2 60518394 60518413 60518397 -
tttaaaactaaattaaatgt

SEQ ID NO: 175878 - DNA, 20 bp, Artificial Sequence
  Synthetic oligonucleotide; AAG chr2 60518387 60518406 60518390 -
ctaaattaaatgttagtact

SEQ ID NO: 175879 - DNA, 20 bp, Artificial Sequence
  Synthetic oligonucleotide; TAG chr2 60518384 60518403 60518387 -
aattaaatgttagtactaag

SEQ ID NO: 175880 - DNA, 20 bp, Artificial Sequence
  Synthetic oligonucleotide; TAG chr2 60518381 60518400 60518384 -
taaatgttagtactaagtag

SEQ ID NO: 175881 - DNA, 20 bp, Artificial Sequence
  Synthetic oligonucleotide; GAG chr2 60518367 60518386 60518370 -
aagtagtagccaaattctct

SEQ ID NO: 175882 - DNA, 20 bp, Artificial Sequence
  Synthetic oligonucleotide; CAG chr2 60518352 60518371 60518355 -
tctctgagtctgcttcatga

SEQ ID NO: 175883 - DNA, 20 bp, Artificial Sequence
  Synthetic oligonucleotide; AGG chr2 60518351 60518370 60518354 -
ctctgagtctgcttcatgac

SEQ ID NO: 175884 - DNA, 20 bp, Artificial Sequence
  Synthetic oligonucleotide; TGG chr2 60518337 60518356 60518340 -
catgacaggctgtaacacac

SEQ ID NO: 175885 - DNA, 20 bp, Artificial Sequence
  Synthetic oligonucleotide; TGG chr2 60518332 60518351 60518335 -
caggctgtaacacactggta

SEQ ID NO: 175886 - DNA, 20 bp, Artificial Sequence
  Synthetic oligonucleotide; CGG chr2 60518327 60518346 60518330 -
tgtaacacactggtatggaa

SEQ ID NO: 175887 - DNA, 20 bp, Artificial Sequence
  Synthetic oligonucleotide; TAG chr2 60518324 60518343 60518327 -
aacacactggtatggaacgg

SEQ ID NO: 175888 - DNA, 20 bp, Artificial Sequence
  Synthetic oligonucleotide; AGG chr2 60518323 60518342 60518326 -
acacactggtatggaacggt

SEQ ID NO: 175889 - DNA, 20 bp, Artificial Sequence
  Synthetic oligonucleotide; GAG chr2 60518277 60518296 60518280 -
tatgatgttttatgtattat

SEQ ID NO: 175890 - DNA, 20 bp, Artificial Sequence
  Synthetic oligonucleotide; GAG chr2 60518275 60518294 60518278 -
tgatgttttatgtattatga

SEQ ID NO: 175891 - DNA, 20 bp, Artificial Sequence
  Synthetic oligonucleotide; CAG chr2 60518270 60518289 60518273 -
ttttatgtattatgagagct

SEQ ID NO: 175892 - DNA, 20 bp, Artificial Sequence
  Synthetic oligonucleotide; CAG chr2 60518267 60518286 60518270 -
tatgtattatgagagctcag

SEQ ID NO: 175893 - DNA, 20 bp, Artificial Sequence
  Synthetic oligonucleotide; CAG chr2 60518257 60518276 60518260 -
gagagctcagcagatgttga

SEQ ID NO: 175894 - DNA, 20 bp, Artificial Sequence
  Synthetic oligonucleotide; GAG chr2 60518255 60518274 60518258 -
gagctcagcagatgttgaca

SEQ ID NO: 175895 - DNA, 20 bp, Artificial Sequence
  Synthetic oligonucleotide; AGG chr2 60518254 60518273 60518257 -
agctcagcagatgttgacag

SEQ ID NO: 175896 - DNA, 20 bp, Artificial Sequence
  Synthetic oligonucleotide; GGG chr2 60518253 60518272 60518256 -
gctcagcagatgttgacaga

SEQ ID NO: 175897 - DNA, 20 bp, Artificial Sequence
  Synthetic oligonucleotide; GAG chr2 60518247 60518266 60518250 -
cagatgttgacagagggaat

SEQ ID NO: 175898 - DNA, 20 bp, Artificial Sequence
  Synthetic oligonucleotide; AAG chr2 60518242 60518261 60518245 -
gttgacagagggaatgagac

SEQ ID NO: 175899 - DNA, 20 bp, Artificial Sequence
  Synthetic oligonucleotide; TAG chr2 60518232 60518251 60518235 -
ggaatgagacaagatgattt

SEQ ID NO: 175900 - DNA, 20 bp, Artificial Sequence
  Synthetic oligonucleotide; AGG chr2 60518231 60518250 60518234 -
gaatgagacaagatgatttt

SEQ ID NO: 175901 - DNA, 20 bp, Artificial Sequence
  Synthetic oligonucleotide; TAG chr2 60518226 60518245 60518229 -
agacaagatgattttaggtc

SEQ ID NO: 175902 - DNA, 20 bp, Artificial Sequence
  Synthetic oligonucleotide; AGG chr2 60518225 60518244 60518228 -
gacaagatgattttaggtct

SEQ ID NO: 175903 - DNA, 20 bp, Artificial Sequence
  Synthetic oligonucleotide; TAG chr2 60518217 60518236 60518220 -
gattttaggtctaggtttga

SEQ ID NO: 175904 - DNA, 20 bp, Artificial Sequence
  Synthetic oligonucleotide; TGG chr2 60518205 60518224 60518208 -
aggtttgatagataaaaaac

SEQ ID NO: 175905 - DNA, 20 bp, Artificial Sequence
  Synthetic oligonucleotide; GGG chr2 60518204 60518223 60518207 -
ggtttgatagataaaaaact

SEQ ID NO: 175906 - DNA, 20 bp, Artificial Sequence
  Synthetic oligonucleotide; AAG chr2 60518178 60518197 60518181 -
aattttatattttctttgaa

SEQ ID NO: 175907 - DNA, 20 bp, Artificial Sequence
  Synthetic oligonucleotide; TAG chr2 60518174 60518193 60518177 -
ttatattttctttgaaaaga

SEQ ID NO: 175908 - DNA, 20 bp, Artificial Sequence
  Synthetic oligonucleotide; CAG chr2 60518163 60518182 60518166 -
ttgaaaagatagctaaatct

SEQ ID NO: 175909 - DNA, 20 bp, Artificial Sequence
  Synthetic oligonucleotide; AAG chr2 60518138 60518157 60518141 -
attattttattttatttatt

SEQ ID NO: 175910 - DNA, 20 bp, Artificial Sequence
  Synthetic oligonucleotide; TAG chr2 60518128 60518147 60518131 -
tttatttattaagctttttg

SEQ ID NO: 175911 - DNA, 20 bp, Artificial Sequence
  Synthetic oligonucleotide; GAG chr2 60518126 60518145 60518129 -
tatttattaagctttttgta

SEQ ID NO: 175912 - DNA, 20 bp, Artificial Sequence
  Synthetic oligonucleotide; CAG chr2 60518122 60518141 60518125 -
tattaagctttttgtagaga

SEQ ID NO: 175913 - DNA, 20 bp, Artificial Sequence
  Synthetic oligonucleotide; AGG chr2 60518121 60518140 60518124 -
attaagctttttgtagagac

SEQ ID NO: 175914 - DNA, 20 bp, Artificial Sequence
  Synthetic oligonucleotide; GGG chr2 60518120 60518139 60518123 -
ttaagctttttgtagagaca

SEQ ID NO: 175915 - DNA, 20 bp, Artificial Sequence
  Synthetic oligonucleotide; CAG chr2 60518102 60518121 60518105 -
cagggttttgctatgttgcc

SEQ ID NO: 175916 - DNA, 20 bp, Artificial Sequence
  Synthetic oligonucleotide; AGG chr2 60518101 60518120 60518104 -
agggttttgctatgttgccc

SEQ ID NO: 175917 - DNA, 20 bp, Artificial Sequence
  Synthetic oligonucleotide; TGG chr2 60518097 60518116 60518100 -
ttttgctatgttgcccaggc

SEQ ID NO: 175918 - DNA, 20 bp, Artificial Sequence
  Synthetic oligonucleotide; TAG chr2 60518083 60518102 60518086 -
ccaggctggtcttgaactcc

SEQ ID NO: 175919 - DNA, 20 bp, Artificial Sequence
  Synthetic oligonucleotide; AAG chr2 60518076 60518095 60518079 -
ggtcttgaactcctagcttc

SEQ ID NO: 175920 - DNA, 20 bp, Artificial Sequence
  Synthetic oligonucleotide; TGG chr2 60518059 60518078 60518062 -
ttcaagcaatcttccctctg

SEQ ID NO: 175921 - DNA, 20 bp, Artificial Sequence
  Synthetic oligonucleotide; GAG chr2 60518042 60518061 60518045 -
ctgtggccttccaaatttct

SEQ ID NO: 175922 - DNA, 20 bp, Artificial Sequence
  Synthetic oligonucleotide; TAG chr2 60518035 60518054 60518038 -
cttccaaatttctgagatta

SEQ ID NO: 175923 - DNA, 20 bp, Artificial Sequence
  Synthetic oligonucleotide; AGG chr2 60518034 60518053 60518037 -
ttccaaatttctgagattat

SEQ ID NO: 175924 - DNA, 20 bp, Artificial Sequence
  Synthetic oligonucleotide; AAG chr2 60518028 60518047 60518031 -
atttctgagattataggcat

SEQ ID NO: 175925 - DNA, 20 bp, Artificial Sequence
  Synthetic oligonucleotide; TGG chr2 60518015 60518034 60518018 -
taggcataagcaaatgcctc

SEQ ID NO: 175926 - DNA, 20 bp, Artificial Sequence
  Synthetic oligonucleotide; AAG chr2 60518007 60518026 60518010 -
agcaaatgcctctggccttc

SEQ ID NO: 175927 - DNA, 20 bp, Artificial Sequence
  Synthetic oligonucleotide; AAG chr2 60517993 60518012 60517996 -
gccttcaagtaattaattta

SEQ ID NO: 175928 - DNA, 20 bp, Artificial Sequence
  Synthetic oligonucleotide; TGG chr2 60517958 60517977 60517961 -
tttctctcctcccctaaaat

SEQ ID NO: 175929 - DNA, 20 bp, Artificial Sequence
  Synthetic oligonucleotide; GGG chr2 60517957 60517976 60517960 -
ttctctcctcccctaaaatt

SEQ ID NO: 175930 - DNA, 20 bp, Artificial Sequence
  Synthetic oligonucleotide; TAG chr2 60517951 60517970 60517954 -
cctcccctaaaattgggttt

SEQ ID NO: 175931 - DNA, 20 bp, Artificial Sequence
  Synthetic oligonucleotide; GAG chr2 60517949 60517968 60517952 -
tcccctaaaattgggtttta

SEQ ID NO: 175932 - DNA, 20 bp, Artificial Sequence
  Synthetic oligonucleotide; AAG chr2 60517945 60517964 60517948 -
ctaaaattgggttttagagt

SEQ ID NO: 175933 - DNA, 20 bp, Artificial Sequence
  Synthetic oligonucleotide; AGG chr2 60517944 60517963 60517947 -
taaaattgggttttagagta

SEQ ID NO: 175934 - DNA, 20 bp, Artificial Sequence
  Synthetic oligonucleotide; TAG chr2 60517929 60517948 60517932 -
gagtaaggttcttgttcctc

SEQ ID NO: 175935 - DNA, 20 bp, Artificial Sequence
  Synthetic oligonucleotide; AAG chr2 60517921 60517940 60517924 -
ttcttgttcctctagtcgac

SEQ ID NO: 175936 - DNA, 20 bp, Artificial Sequence
  Synthetic oligonucleotide; GAG chr2 60517919 60517938 60517922 -
cttgttcctctagtcgacaa

SEQ ID NO: 175937 - DNA, 20 bp, Artificial Sequence
  Synthetic oligonucleotide; GAG chr2 60517911 60517930 60517914 -
tctagtcgacaagagtttct

SEQ ID NO: 175938 - DNA, 20 bp, Artificial Sequence
  Synthetic oligonucleotide; AGG chr2 60517910 60517929 60517913 -
ctagtcgacaagagtttctg

SEQ ID NO: 175939 - DNA, 20 bp, Artificial Sequence
  Synthetic oligonucleotide; TAG chr2 60517902 60517921 60517905 -
caagagtttctgaggaatca

SEQ ID NO: 175940 - DNA, 20 bp, Artificial Sequence
  Synthetic oligonucleotide; AAG chr2 60517899 60517918 60517902 -
gagtttctgaggaatcatag

SEQ ID NO: 175941 - DNA, 20 bp, Artificial Sequence
  Synthetic oligonucleotide; AAG chr2 60517895 60517914 60517898 -
ttctgaggaatcatagaaga

SEQ ID NO: 175942 - DNA, 20 bp, Artificial Sequence
  Synthetic oligonucleotide; CAG chr2 60517890 60517909 60517893 -
aggaatcatagaagaaagca

SEQ ID NO: 175943 - DNA, 20 bp, Artificial Sequence
  Synthetic oligonucleotide; GAG chr2 60517881 60517900 60517884 -
agaagaaagcacagctcttt

SEQ ID NO: 175944 - DNA, 20 bp, Artificial Sequence
  Synthetic oligonucleotide; TAG chr2 60517876 60517895 60517879 -
aaagcacagctctttgagca

SEQ ID NO: 175945 - DNA, 20 bp, Artificial Sequence
  Synthetic oligonucleotide; TAG chr2 60517872 60517891 60517875 -
cacagctctttgagcataga

SEQ ID NO: 175946 - DNA, 20 bp, Artificial Sequence
  Synthetic oligonucleotide; TGG chr2 60517860 60517879 60517863 -
agcatagatagtttccttcg

SEQ ID NO: 175947 - DNA, 20 bp, Artificial Sequence
  Synthetic oligonucleotide; AAG chr2 60517856 60517875 60517859 -
tagatagtttccttcgtgga

SEQ ID NO: 175948 - DNA, 20 bp, Artificial Sequence
  Synthetic oligonucleotide; AAG chr2 60517850 60517869 60517853 -
gtttccttcgtggaaagcca

SEQ ID NO: 175949 - DNA, 20 bp, Artificial Sequence
  Synthetic oligonucleotide; GAG chr2 60517835 60517854 60517838 -
agccaaagtgaatacttatt

SEQ ID NO: 175950 - DNA, 20 bp, Artificial Sequence
  Synthetic oligonucleotide; TAG chr2 60517821 60517840 60517824 -
cttattgagcatcttctatg

SEQ ID NO: 175951 - DNA, 20 bp, Artificial Sequence
  Synthetic oligonucleotide; TAG chr2 60517815 60517834 60517818 -
gagcatcttctatgtagaca

SEQ ID NO: 175952 - DNA, 20 bp, Artificial Sequence
  Synthetic oligonucleotide; AAG chr2 60517805 60517824 60517808 -
tatgtagacatagacttgtg

SEQ ID NO: 175953 - DNA, 20 bp, Artificial Sequence
  Synthetic oligonucleotide; CAG chr2 60517777 60517796 60517780 -
tcattaaccctgtcatttta

SEQ ID NO: 175954 - DNA, 20 bp, Artificial Sequence
  Synthetic oligonucleotide; GAG chr2 60517772 60517791 60517775 -
aaccctgtcattttacagat

SEQ ID NO: 175955 - DNA, 20 bp, Artificial Sequence
  Synthetic oligonucleotide; AAG chr2 60517768 60517787 60517771 -
ctgtcattttacagatgaga

SEQ ID NO: 175956 - DNA, 20 bp, Artificial Sequence
  Synthetic oligonucleotide; AGG chr2 60517767 60517786 60517770 -
tgtcattttacagatgagaa

SEQ ID NO: 175957 - DNA, 20 bp, Artificial Sequence
  Synthetic oligonucleotide; GAG chr2 60517762 60517781 60517765 -
ttttacagatgagaaaggtt

SEQ ID NO: 175958 - DNA, 20 bp, Artificial Sequence
  Synthetic oligonucleotide; AGG chr2 60517761 60517780 60517764 -
tttacagatgagaaaggttg

SEQ ID NO: 175959 - DNA, 20 bp, Artificial Sequence
  Synthetic oligonucleotide; AAG chr2 60517756 60517775 60517759 -
agatgagaaaggttgaggct

SEQ ID NO: 175960 - DNA, 20 bp, Artificial Sequence
  Synthetic oligonucleotide; GAG chr2 60517754 60517773 60517757 -
atgagaaaggttgaggctaa

SEQ ID NO: 175961 - DNA, 20 bp, Artificial Sequence
  Synthetic oligonucleotide; AGG chr2 60517753 60517772 60517756 -
tgagaaaggttgaggctaag

SEQ ID NO: 175962 - DNA, 20 bp, Artificial Sequence
  Synthetic oligonucleotide; GGG chr2 60517752 60517771 60517755 -
gagaaaggttgaggctaaga

SEQ ID NO: 175963 - DNA, 20 bp, Artificial Sequence
  Synthetic oligonucleotide; GGG chr2 60517751 60517770 60517754 -
agaaaggttgaggctaagag

SEQ ID NO: 175964 - DNA, 20 bp, Artificial Sequence
  Synthetic oligonucleotide; GAG chr2 60517749 60517768 60517752 -
aaaggttgaggctaagaggg

SEQ ID NO: 175965 - DNA, 20 bp, Artificial Sequence
  Synthetic oligonucleotide; GAG chr2 60517745 60517764 60517748 -
gttgaggctaagaggggagt

SEQ ID NO: 175966 - DNA, 20 bp, Artificial Sequence
  Synthetic oligonucleotide; CAG chr2 60517739 60517758 60517742 -
gctaagaggggagtgagtgc

SEQ ID NO: 175967 - DNA, 20 bp, Artificial Sequence
  Synthetic oligonucleotide; GAG chr2 60517737 60517756 60517740 -
taagaggggagtgagtgcca

SEQ ID NO: 175968 - DNA, 20 bp, Artificial Sequence
  Synthetic oligonucleotide; TAG chr2 60517725 60517744 60517728 -
gagtgccagagtctacttgc

SEQ ID NO: 175969 - DNA, 20 bp, Artificial Sequence
  Synthetic oligonucleotide; AGG chr2 60517724 60517743 60517727 -
agtgccagagtctacttgct

SEQ ID NO: 175970 - DNA, 20 bp, Artificial Sequence
  Synthetic oligonucleotide; CAG chr2 60517721 60517740 60517724 -
gccagagtctacttgctagg

SEQ ID NO: 175971 - DNA, 20 bp, Artificial Sequence
  Synthetic oligonucleotide; TGG chr2 60517718 60517737 60517721 -
agagtctacttgctaggcag

SEQ ID NO: 175972 - DNA, 20 bp, Artificial Sequence
  Synthetic oligonucleotide; TAG chr2 60517715 60517734 60517718 -
gtctacttgctaggcagtgg

SEQ ID NO: 175973 - DNA, 20 bp, Artificial Sequence
  Synthetic oligonucleotide; TGG chr2 60517709 60517728 60517712 -
ttgctaggcagtggtagact

SEQ ID NO: 175974 - DNA, 20 bp, Artificial Sequence
  Synthetic oligonucleotide; CAG chr2 60517704 60517723 60517707 -
aggcagtggtagacttggcc

SEQ ID NO: 175975 - DNA, 20 bp, Artificial Sequence
  Synthetic oligonucleotide; GAG chr2 60517702 60517721 60517705 -
gcagtggtagacttggccca

SEQ ID NO: 175976 - DNA, 20 bp, Artificial Sequence
  Synthetic oligonucleotide; TGG chr2 60517697 60517716 60517700 -
ggtagacttggcccagagcc

SEQ ID NO: 175977 - DNA, 20 bp, Artificial Sequence
  Synthetic oligonucleotide; GGG chr2 60517696 60517715 60517699 -
gtagacttggcccagagcct

SEQ ID NO: 175978 - DNA, 20 bp, Artificial Sequence
  Synthetic oligonucleotide; GGG chr2 60517695 60517714 60517698 -
tagacttggcccagagcctg

SEQ ID NO: 175979 - DNA, 20 bp, Artificial Sequence
  Synthetic oligonucleotide; TGG chr2 60517675 60517694 60517678 -
gggcttcccactttcattcc

SEQ ID NO: 175980 - DNA, 20 bp, Artificial Sequence
  Synthetic oligonucleotide; TGG chr2 60517652 60517671 60517655 -
ctgactgtaccaatcgcaca

SEQ ID NO: 175981 - DNA, 20 bp, Artificial Sequence
  Synthetic oligonucleotide; TGG chr2 60517641 60517660 60517644 -
aatcgcacatggcctctcca

SEQ ID NO: 175982 - DNA, 20 bp, Artificial Sequence
  Synthetic oligonucleotide; CAG chr2 60517637 60517656 60517640 -
gcacatggcctctccatggc

SEQ ID NO: 175983 - DNA, 20 bp, Artificial Sequence
  Synthetic oligonucleotide; CAG chr2 60517634 60517653 60517637 -
catggcctctccatggccag

SEQ ID NO: 175984 - DNA, 20 bp, Artificial Sequence
  Synthetic oligonucleotide; AGG chr2 60517633 60517652 60517636 -
atggcctctccatggccagc

SEQ ID NO: 175985 - DNA, 20 bp, Artificial Sequence
  Synthetic oligonucleotide; GAG chr2 60517631 60517650 60517634 -
ggcctctccatggccagcag

SEQ ID NO: 175986 - DNA, 20 bp, Artificial Sequence
  Synthetic oligonucleotide; CAG chr2 60517627 60517646 60517630 -
tctccatggccagcaggagc

SEQ ID NO: 175987 - DNA, 20 bp, Artificial Sequence
  Synthetic oligonucleotide; GAG chr2 60517625 60517644 60517628 -
tccatggccagcaggagcca

SEQ ID NO: 175988 - DNA, 20 bp, Artificial Sequence
  Synthetic oligonucleotide; AGG chr2 60517624 60517643 60517627 -
ccatggccagcaggagccag

SEQ ID NO: 175989 - DNA, 20 bp, Artificial Sequence
  Synthetic oligonucleotide; TGG chr2 60517621 60517640 60517624 -
tggccagcaggagccagagg

SEQ ID NO: 175990 - DNA, 20 bp, Artificial Sequence
  Synthetic oligonucleotide; CAG chr2 60517603 60517622 60517606 -
ggtggcccgcatgtgctttg

SEQ ID NO: 175991 - DNA, 20 bp, Artificial Sequence
  Synthetic oligonucleotide; GAG chr2 60517601 60517620 60517604 -
tggcccgcatgtgctttgca

SEQ ID NO: 175992 - DNA, 20 bp, Artificial Sequence
  Synthetic oligonucleotide; AGG chr2 60517600 60517619 60517603 -
ggcccgcatgtgctttgcag

SEQ ID NO: 175993 - DNA, 20 bp, Artificial Sequence
  Synthetic oligonucleotide; CGG chr2 60517576 60517595 60517579 -
acttgcacccacgcttttat

SEQ ID NO: 175994 - DNA, 20 bp, Artificial Sequence
  Synthetic oligonucleotide; TGG chr2 60517570 60517589 60517573 -
acccacgcttttatcggtga

SEQ ID NO: 175995 - DNA, 20 bp, Artificial Sequence
  Synthetic oligonucleotide; TGG chr2 60517566 60517585 60517569 -
acgcttttatcggtgatggc

SEQ ID NO: 175996 - DNA, 20 bp, Artificial Sequence
  Synthetic oligonucleotide; TGG chr2 60517548 60517567 60517551 -
gctggaatgcttttcttaac

SEQ ID NO: 175997 - DNA, 20 bp, Artificial Sequence
  Synthetic oligonucleotide; GAG chr2 60517546 60517565 60517549 -
tggaatgcttttcttaactg

SEQ ID NO: 175998 - DNA, 20 bp, Artificial Sequence
  Synthetic oligonucleotide; AAG chr2 60517535 60517554 60517538 -
tcttaactggagctttgttg

SEQ ID NO: 175999 - DNA, 20 bp, Artificial Sequence
  Synthetic oligonucleotide; GAG chr2 60517533 60517552 60517536 -
ttaactggagctttgttgaa

SEQ ID NO: 176000 - DNA, 20 bp, Artificial Sequence
  Synthetic oligonucleotide; TGG chr2 60517528 60517547 60517531 -
tggagctttgttgaagagcc

SEQ ID NO: 176001 - DNA, 20 bp, Artificial Sequence
  Synthetic oligonucleotide; TGG chr2 60517517 60517536 60517520 -
tgaagagcctggtgcttttg

SEQ ID NO: 176002 - DNA, 20 bp, Artificial Sequence
  Synthetic oligonucleotide; CAG chr2 60517514 60517533 60517517 -
agagcctggtgcttttgtgg

SEQ ID NO: 176003 - DNA, 20 bp, Artificial Sequence
  Synthetic oligonucleotide; TGG chr2 60517503 60517522 60517506 -
cttttgtggcagtgctaacc

SEQ ID NO: 176004 - DNA, 20 bp, Artificial Sequence
  Synthetic oligonucleotide; GGG chr2 60517502 60517521 60517505 -
ttttgtggcagtgctaacct

SEQ ID NO: 176005 - DNA, 20 bp, Artificial Sequence
  Synthetic oligonucleotide; GGG chr2 60517501 60517520 60517504 -
tttgtggcagtgctaacctg

SEQ ID NO: 176006 - DNA, 20 bp, Artificial Sequence
  Synthetic oligonucleotide; GAG chr2 60517499 60517518 60517502 -
tgtggcagtgctaacctggg

SEQ ID NO: 176007 - DNA, 20 bp, Artificial Sequence
  Synthetic oligonucleotide; TGG chr2 60517492 60517511 60517495 -
gtgctaacctggggagccca

SEQ ID NO: 176008 - DNA, 20 bp, Artificial Sequence
  Synthetic oligonucleotide; AAG chr2 60517481 60517500 60517484 -
gggagcccatggtaaaaccc

SEQ ID NO: 176009 - DNA, 20 bp, Artificial Sequence
  Synthetic oligonucleotide; CAG chr2 60517444 60517463 60517447 -
cccaatcacctgtgctgttg

SEQ ID NO: 176010 - DNA, 20 bp, Artificial Sequence
  Synthetic oligonucleotide; GAG chr2 60517442 60517461 60517445 -
caatcacctgtgctgttgca

SEQ ID NO: 176011 - DNA, 20 bp, Artificial Sequence
  Synthetic oligonucleotide; TGG chr2 60517437 60517456 60517440 -
acctgtgctgttgcagagaa

SEQ ID NO: 176012 - DNA, 20 bp, Artificial Sequence
  Synthetic oligonucleotide; CGG chr2 60517380 60517399 60517383 -
ctgttttctctgcccttttt

SEQ ID NO: 176013 - DNA, 20 bp, Artificial Sequence
  Synthetic oligonucleotide; GGG chr2 60517379 60517398 60517382 -
tgttttctctgccctttttc

SEQ ID NO: 176014 - DNA, 20 bp, Artificial Sequence
  Synthetic oligonucleotide; GGG chr2 60517378 60517397 60517381 -
gttttctctgccctttttcg

SEQ ID NO: 176015 - DNA, 20 bp, Artificial Sequence
  Synthetic oligonucleotide; TGG chr2 60517374 60517393 60517377 -
tctctgccctttttcggggc

SEQ ID NO: 176016 - DNA, 20 bp, Artificial Sequence
  Synthetic oligonucleotide; TAG chr2 60517350 60517369 60517353 -
cttcctaccacctttcctgc

SEQ ID NO: 176017 - DNA, 20 bp, Artificial Sequence
  Synthetic oligonucleotide; AGG chr2 60517349 60517368 60517352 -
ttcctaccacctttcctgct

SEQ ID NO: 176018 - DNA, 20 bp, Artificial Sequence
  Synthetic oligonucleotide; GGG chr2 60517348 60517367 60517351 -
tcctaccacctttcctgcta

SEQ ID NO: 176019 - DNA, 20 bp, Artificial Sequence
  Synthetic oligonucleotide; AAG chr2 60517339 60517358 60517342 -
ctttcctgctagggctccca

SEQ ID NO: 176020 - DNA, 20 bp, Artificial Sequence
  Synthetic oligonucleotide; TGG chr2 60517334 60517353 60517337 -
ctgctagggctcccaaagtg

SEQ ID NO: 176021 - DNA, 20 bp, Artificial Sequence
  Synthetic oligonucleotide; TGG chr2 60517325 60517344 60517328 -
ctcccaaagtgtggcccttc

SEQ ID NO: 176022 - DNA, 20 bp, Artificial Sequence
  Synthetic oligonucleotide; GGG chr2 60517324 60517343 60517327 -
tcccaaagtgtggcccttct

SEQ ID NO: 176023 - DNA, 20 bp, Artificial Sequence
  Synthetic oligonucleotide; GGG chr2 60517323 60517342 60517326 -
cccaaagtgtggcccttctg

SEQ ID NO: 176024 - DNA, 20 bp, Artificial Sequence
  Synthetic oligonucleotide; TGG chr2 60517314 60517333 60517317 -
tggcccttctggggtttaca

SEQ ID NO: 176025 - DNA, 20 bp, Artificial Sequence
  Synthetic oligonucleotide; CAG chr2 60517305 60517324 60517308 -
tggggtttacatggtgtgcc

SEQ ID NO: 176026 - DNA, 20 bp, Artificial Sequence
  Synthetic oligonucleotide; AGG chr2 60517304 60517323 60517307 -
ggggtttacatggtgtgccc

SEQ ID NO: 176027 - DNA, 20 bp, Artificial Sequence
  Synthetic oligonucleotide; GGG chr2 60517303 60517322 60517306 -
gggtttacatggtgtgccca

SEQ ID NO: 176028 - DNA, 20 bp, Artificial Sequence
  Synthetic oligonucleotide; TAG chr2 60517298 60517317 60517301 -
tacatggtgtgcccagggaa

SEQ ID NO: 176029 - DNA, 20 bp, Artificial Sequence
  Synthetic oligonucleotide; TGG chr2 60517293 60517312 60517296 -
ggtgtgcccagggaatagct

SEQ ID NO: 176030 - DNA, 20 bp, Artificial Sequence
  Synthetic oligonucleotide; CAG chr2 60517280 60517299 60517283 -
aatagcttggcttttttatt

SEQ ID NO: 176031 - DNA, 20 bp, Artificial Sequence
  Synthetic oligonucleotide; TGG chr2 60517272 60517291 60517275 -
ggcttttttattcagataac

SEQ ID NO: 176032 - DNA, 20 bp, Artificial Sequence
  Synthetic oligonucleotide; GAG chr2 60517270 60517289 60517273 -
cttttttattcagataactg

SEQ ID NO: 176033 - DNA, 20 bp, Artificial Sequence
  Synthetic oligonucleotide; TGG chr2 60517263 60517282 60517266 -
attcagataactggagataa

SEQ ID NO: 176034 - DNA, 20 bp, Artificial Sequence
  Synthetic oligonucleotide; GAG chr2 60517261 60517280 60517264 -
tcagataactggagataatg

SEQ ID NO: 176035 - DNA, 20 bp, Artificial Sequence
  Synthetic oligonucleotide; TAG chr2 60517258 60517277 60517261 -
gataactggagataatggag

SEQ ID NO: 176036 - DNA, 20 bp, Artificial Sequence
  Synthetic oligonucleotide; TGG chr2 60517254 60517273 60517257 -
actggagataatggagtaga

SEQ ID NO: 176037 - DNA, 20 bp, Artificial Sequence
  Synthetic oligonucleotide; GAG chr2 60517252 60517271 60517255 -
tggagataatggagtagatg

SEQ ID NO: 176038 - DNA, 20 bp, Artificial Sequence
  Synthetic oligonucleotide; TGG chr2 60517248 60517267 60517251 -
gataatggagtagatggagt

SEQ ID NO: 176039 - DNA, 20 bp, Artificial Sequence
  Synthetic oligonucleotide; GGG chr2 60517247 60517266 60517250 -
ataatggagtagatggagtt

SEQ ID NO: 176040 - DNA, 20 bp, Artificial Sequence
  Synthetic oligonucleotide; GGG chr2 60517246 60517265 60517249 -
taatggagtagatggagttg

SEQ ID NO: 176041 - DNA, 20 bp, Artificial Sequence
  Synthetic oligonucleotide; TGG chr2 60517243 60517262 60517246 -
tggagtagatggagttgggg

SEQ ID NO: 176042 - DNA, 20 bp, Artificial Sequence
  Synthetic oligonucleotide; AAG chr2 60517238 60517257 60517241 -
tagatggagttggggtggtg

SEQ ID NO: 176043 - DNA, 20 bp, Artificial Sequence
  Synthetic oligonucleotide; AGG chr2 60517237 60517256 60517240 -
agatggagttggggtggtga

SEQ ID NO: 176044 - DNA, 20 bp, Artificial Sequence
  Synthetic oligonucleotide; CAG chr2 60517220 60517239 60517223 -
tgaaggaacgtgtaccctct

SEQ ID NO: 176045 - DNA, 20 bp, Artificial Sequence
  Synthetic oligonucleotide; AGG chr2 60517219 60517238 60517222 -
gaaggaacgtgtaccctctc

SEQ ID NO: 176046 - DNA, 20 bp, Artificial Sequence
  Synthetic oligonucleotide; GGG chr2 60517218 60517237 60517221 -
aaggaacgtgtaccctctca

SEQ ID NO: 176047 - DNA, 20 bp, Artificial Sequence
  Synthetic oligonucleotide; GGG chr2 60517217 60517236 60517220 -
aggaacgtgtaccctctcag

SEQ ID NO: 176048 - DNA, 20 bp, Artificial Sequence
  Synthetic oligonucleotide; CAG chr2 60517214 60517233 60517217 -
aacgtgtaccctctcagggg

SEQ ID NO: 176049 - DNA, 20 bp, Artificial Sequence
  Synthetic oligonucleotide; TGG chr2 60517210 60517229 60517213 -
tgtaccctctcaggggcaga

SEQ ID NO: 176050 - DNA, 20 bp, Artificial Sequence
  Synthetic oligonucleotide; CAG chr2 60517202 60517221 60517205 -
ctcaggggcagatggccctc

SEQ ID NO: 176051 - DNA, 20 bp, Artificial Sequence
  Synthetic oligonucleotide; TGG chr2 60517196 60517215 60517199 -
ggcagatggccctccagaat

SEQ ID NO: 176052 - DNA, 20 bp, Artificial Sequence
  Synthetic oligonucleotide; CAG chr2 60517192 60517211 60517195 -
gatggccctccagaattggc

SEQ ID NO: 176053 - DNA, 20 bp, Artificial Sequence
  Synthetic oligonucleotide; TAG chr2 60517167 60517186 60517170 -
caacctcttcctcaccaccc

SEQ ID NO: 176054 - DNA, 20 bp, Artificial Sequence
  Synthetic oligonucleotide; AAG chr2 60517153 60517172 60517156 -
ccaccctagttctattttta

SEQ ID NO: 176055 - DNA, 20 bp, Artificial Sequence
  Synthetic oligonucleotide; CAG chr2 60517136 60517155 60517139 -
ttaaagacacctctcaatcg

SEQ ID NO: 176056 - DNA, 20 bp, Artificial Sequence
  Synthetic oligonucleotide; AGG chr2 60517135 60517154 60517138 -
taaagacacctctcaatcgc

SEQ ID NO: 176057 - DNA, 20 bp, Artificial Sequence
  Synthetic oligonucleotide; CAG chr2 60517067 60517086 60517070 -
aacccatttcctcttcattc

SEQ ID NO: 176058 - DNA, 20 bp, Artificial Sequence
  Synthetic oligonucleotide; GAG chr2 60517065 60517084 60517068 -
cccatttcctcttcattcca

SEQ ID NO: 176059 - DNA, 20 bp, Artificial Sequence
  Synthetic oligonucleotide; AAG chr2 60517056 60517075 60517059 -
tcttcattccagagacgaca

SEQ ID NO: 176060 - DNA, 20 bp, Artificial Sequence
  Synthetic oligonucleotide; CAG chr2 60517042 60517061 60517045 -
acgacaaagtatctcatcac

SEQ ID NO: 176061 - DNA, 20 bp, Artificial Sequence
  Synthetic oligonucleotide; TGG chr2 60517036 60517055 60517039 -
aagtatctcatcaccagctt

SEQ ID NO: 176062 - DNA, 20 bp, Artificial Sequence
  Synthetic oligonucleotide; GGG chr2 60517035 60517054 60517038 -
agtatctcatcaccagcttt

SEQ ID NO: 176063 - DNA, 20 bp, Artificial Sequence
  Synthetic oligonucleotide; TGG chr2 60516947 60516966 60516950 -
ctttcctgaacctgaactca

SEQ ID NO: 176064 - DNA, 20 bp, Artificial Sequence
  Synthetic oligonucleotide; TAG chr2 60516901 60516920 60516904 -
attgtttctatgcctctctt

SEQ ID NO: 176065 - DNA, 20 bp, Artificial Sequence
  Synthetic oligonucleotide; TGG chr2 60516891 60516910 60516894 -
tgcctctctttagaatctgc

SEQ ID NO: 176066 - DNA, 20 bp, Artificial Sequence
  Synthetic oligonucleotide; CAG chr2 60516883 60516902 60516886 -
tttagaatctgctggttttc

SEQ ID NO: 176067 - DNA, 20 bp, Artificial Sequence
  Synthetic oligonucleotide; TAG chr2 60516863 60516882 60516866 -
cagctcttttactcaaacat

SEQ ID NO: 176068 - DNA, 20 bp, Artificial Sequence
  Synthetic oligonucleotide; CAG chr2 60516849 60516868 60516852 -
aaacattagtctgataacta

SEQ ID NO: 176069 - DNA, 20 bp, Artificial Sequence
  Synthetic oligonucleotide; GAG chr2 60516847 60516866 60516850 -
acattagtctgataactaca

SEQ ID NO: 176070 - DNA, 20 bp, Artificial Sequence
  Synthetic oligonucleotide; TGG chr2 60516839 60516858 60516842 -
ctgataactacagagtccaa

SEQ ID NO: 176071 - DNA, 20 bp, Artificial Sequence
  Synthetic oligonucleotide; AAG chr2 60516835 60516854 60516838 -
taactacagagtccaatggc

SEQ ID NO: 176072 - DNA, 20 bp, Artificial Sequence
  Synthetic oligonucleotide; TAG chr2 60516826 60516845 60516829 -
agtccaatggcaagatatct

SEQ ID NO: 176073 - DNA, 20 bp, Artificial Sequence
  Synthetic oligonucleotide; TAG chr2 60516807 60516826 60516810 -
ttagtgttttccacattctt

SEQ ID NO: 176074 - DNA, 20 bp, Artificial Sequence
  Synthetic oligonucleotide; CAG chr2 60516761 60516780 60516764 -
ctgcttgcttttttaaaaac

SEQ ID NO: 176075 - DNA, 20 bp, Artificial Sequence
  Synthetic oligonucleotide; CAG chr2 60516736 60516755 60516739 -
cttcattgatgactcatgct

SEQ ID NO: 176076 - DNA, 20 bp, Artificial Sequence
  Synthetic oligonucleotide; TGG chr2 60516731 60516750 60516734 -
ttgatgactcatgctcagct

SEQ ID NO: 176077 - DNA, 20 bp, Artificial Sequence
  Synthetic oligonucleotide; TAG chr2 60516721 60516740 60516724 -
atgctcagcttggtgtccac

SEQ ID NO: 176078 - DNA, 20 bp, Artificial Sequence
  Synthetic oligonucleotide; AGG chr2 60516720 60516739 60516723 -
tgctcagcttggtgtccact

SEQ ID NO: 176079 - DNA, 20 bp, Artificial Sequence
  Synthetic oligonucleotide; TAG chr2 60516712 60516731 60516715 -
ttggtgtccactaggaatgc

SEQ ID NO: 176080 - DNA, 20 bp, Artificial Sequence
  Synthetic oligonucleotide; CAG chr2 60516701 60516720 60516704 -
taggaatgctagatctttgt

SEQ ID NO: 176081 - DNA, 20 bp, Artificial Sequence
  Synthetic oligonucleotide; GAG chr2 60516690 60516709 60516693 -
gatctttgtcagccatcttt

SEQ ID NO: 176082 - DNA, 20 bp, Artificial Sequence
  Synthetic oligonucleotide; AGG chr2 60516689 60516708 60516692 -
atctttgtcagccatctttg

SEQ ID NO: 176083 - DNA, 20 bp, Artificial Sequence
  Synthetic oligonucleotide; GGG chr2 60516688 60516707 60516691 -
tctttgtcagccatctttga

SEQ ID NO: 176084 - DNA, 20 bp, Artificial Sequence
  Synthetic oligonucleotide; CAG chr2 60516685 60516704 60516688 -
ttgtcagccatctttgaggg

SEQ ID NO: 176085 - DNA, 20 bp, Artificial Sequence
  Synthetic oligonucleotide; CAG chr2 60516667 60516686 60516670 -
ggcagttaaactttcactcc

SEQ ID NO: 176086 - DNA, 20 bp, Artificial Sequence
  Synthetic oligonucleotide; CAG chr2 60516636 60516655 60516639 -
atgccacatttctcccatcc

SEQ ID NO: 176087 - DNA, 20 bp, Artificial Sequence
  Synthetic oligonucleotide; AGG chr2 60516635 60516654 60516638 -
tgccacatttctcccatccc

SEQ ID NO: 176088 - DNA, 20 bp, Artificial Sequence
  Synthetic oligonucleotide; GAG chr2 60516606 60516625 60516609 -
tctctgtccttgtccatatt

SEQ ID NO: 176089 - DNA, 20 bp, Artificial Sequence
  Synthetic oligonucleotide; TAG chr2 60516601 60516620 60516604 -
gtccttgtccatattgagct

SEQ ID NO: 176090 - DNA, 20 bp, Artificial Sequence
  Synthetic oligonucleotide; GAG chr2 60516581 60516600 60516584 -
tagctctccactcctgacac

SEQ ID NO: 176091 - DNA, 20 bp, Artificial Sequence
  Synthetic oligonucleotide; CGG chr2 60516553 60516572 60516556 -
tgacttcctctccacttccc

SEQ ID NO: 176092 - DNA, 20 bp, Artificial Sequence
  Synthetic oligonucleotide; CGG chr2 60516546 60516565 60516549 -
ctctccacttccccggatga

SEQ ID NO: 176093 - DNA, 20 bp, Artificial Sequence
  Synthetic oligonucleotide; GAG chr2 60516542 60516561 60516545 -
ccacttccccggatgacggt

SEQ ID NO: 176094 - DNA, 20 bp, Artificial Sequence
  Synthetic oligonucleotide; AAG chr2 60516522 60516541 60516525 -
gagttacgatcttgtctcct

SEQ ID NO: 176095 - DNA, 20 bp, Artificial Sequence
  Synthetic oligonucleotide; AGG chr2 60516521 60516540 60516524 -
agttacgatcttgtctccta

SEQ ID NO: 176096 - DNA, 20 bp, Artificial Sequence
  Synthetic oligonucleotide; TGG chr2 60516504 60516523 60516507 -
ctaaggtgccccctccctct

SEQ ID NO: 176097 - DNA, 20 bp, Artificial Sequence
  Synthetic oligonucleotide; CAG chr2 60516492 60516511 60516495 -
ctccctcttggctcctctcc

SEQ ID NO: 176098 - DNA, 20 bp, Artificial Sequence
  Synthetic oligonucleotide; TGG chr2 60516478 60516497 60516481 -
ctctcccagtgacgacttca

SEQ ID NO: 176099 - DNA, 20 bp, Artificial Sequence
  Synthetic oligonucleotide; GAG chr2 60516476 60516495 60516479 -
ctcccagtgacgacttcatg

SEQ ID NO: 176100 - DNA, 20 bp, Artificial Sequence
  Synthetic oligonucleotide; AGG chr2 60516475 60516494 60516478 -
tcccagtgacgacttcatgg

SEQ ID NO: 176101 - DNA, 20 bp, Artificial Sequence
  Synthetic oligonucleotide; GAG chr2 60516470 60516489 60516473 -
gtgacgacttcatggaggct

SEQ ID NO: 176102 - DNA, 20 bp, Artificial Sequence
  Synthetic oligonucleotide; TAG chr2 60516462 60516481 60516465 -
ttcatggaggctgagaaata

SEQ ID NO: 176103 - DNA, 20 bp, Artificial Sequence
  Synthetic oligonucleotide; GAG chr2 60516458 60516477 60516461 -
tggaggctgagaaatatagt

SEQ ID NO: 176104 - DNA, 20 bp, Artificial Sequence
  Synthetic oligonucleotide; TGG chr2 60516455 60516474 60516458 -
aggctgagaaatatagtgag

SEQ ID NO: 176105 - DNA, 20 bp, Artificial Sequence
  Synthetic oligonucleotide; CGG chr2 60516429 60516448 60516432 -
ttcttgcctcacttactgct

SEQ ID NO: 176106 - DNA, 20 bp, Artificial Sequence
  Synthetic oligonucleotide; AAG chr2 60516425 60516444 60516428 -
tgcctcacttactgctcggt

SEQ ID NO: 176107 - DNA, 20 bp, Artificial Sequence
  Synthetic oligonucleotide; TAG chr2 60516421 60516440 60516424 -
tcacttactgctcggtaagt

SEQ ID NO: 176108 - DNA, 20 bp, Artificial Sequence
  Synthetic oligonucleotide; CAG chr2 60516416 60516435 60516419 -
tactgctcggtaagttagct

SEQ ID NO: 176109 - DNA, 20 bp, Artificial Sequence
  Synthetic oligonucleotide; AGG chr2 60516415 60516434 60516418 -
actgctcggtaagttagctc

SEQ ID NO: 176110 - DNA, 20 bp, Artificial Sequence
  Synthetic oligonucleotide; GGG chr2 60516414 60516433 60516417 -
ctgctcggtaagttagctca

SEQ ID NO: 176111 - DNA, 20 bp, Artificial Sequence
  Synthetic oligonucleotide; GGG chr2 60516413 60516432 60516416 -
tgctcggtaagttagctcag

SEQ ID NO: 176112 - DNA, 20 bp, Artificial Sequence
  Synthetic oligonucleotide; GGG chr2 60516412 60516431 60516415 -
gctcggtaagttagctcagg

SEQ ID NO: 176113 - DNA, 20 bp, Artificial Sequence
  Synthetic oligonucleotide; GAG chr2 60516410 60516429 60516413 -
tcggtaagttagctcagggg

SEQ ID NO: 176114 - DNA, 20 bp, Artificial Sequence
  Synthetic oligonucleotide; GAG chr2 60516408 60516427 60516411 -
ggtaagttagctcaggggga

SEQ ID NO: 176115 - DNA, 20 bp, Artificial Sequence
  Synthetic oligonucleotide; TGG chr2 60516380 60516399 60516383 -
cataactttgcactgacatc

SEQ ID NO: 176116 - DNA, 20 bp, Artificial Sequence
  Synthetic oligonucleotide; GAG chr2 60516378 60516397 60516381 -
taactttgcactgacatctg

SEQ ID NO: 176117 - DNA, 20 bp, Artificial Sequence
  Synthetic oligonucleotide; AAG chr2 60516371 60516390 60516374 -
gcactgacatctggagaaca

SEQ ID NO: 176118 - DNA, 20 bp, Artificial Sequence
  Synthetic oligonucleotide; AGG chr2 60516370 60516389 60516373 -
cactgacatctggagaacaa

SEQ ID NO: 176119 - DNA, 20 bp, Artificial Sequence
  Synthetic oligonucleotide; TGG chr2 60516364 60516383 60516367 -
catctggagaacaaaggttt

SEQ ID NO: 176120 - DNA, 20 bp, Artificial Sequence
  Synthetic oligonucleotide; AAG chr2 60516361 60516380 60516364 -
ctggagaacaaaggttttgg

SEQ ID NO: 176121 - DNA, 20 bp, Artificial Sequence
  Synthetic oligonucleotide; GAG chr2 60516359 60516378 60516362 -
ggagaacaaaggttttggaa

SEQ ID NO: 176122 - DNA, 20 bp, Artificial Sequence
  Synthetic oligonucleotide; CGG chr2 60516356 60516375 60516359 -
gaacaaaggttttggaagag

SEQ ID NO: 176123 - DNA, 20 bp, Artificial Sequence
  Synthetic oligonucleotide; GAG chr2 60516354 60516373 60516357 -
acaaaggttttggaagagcg

SEQ ID NO: 176124 - DNA, 20 bp, Artificial Sequence
  Synthetic oligonucleotide; CAG chr2 60516349 60516368 60516352 -
ggttttggaagagcggagcc

SEQ ID NO: 176125 - DNA, 20 bp, Artificial Sequence
  Synthetic oligonucleotide; GAG chr2 60516337 60516356 60516340 -
gcggagcccagattccctgt

SEQ ID NO: 176126 - DNA, 20 bp, Artificial Sequence
  Synthetic oligonucleotide; CAG chr2 60516333 60516352 60516336 -
agcccagattccctgtgagc

SEQ ID NO: 176127 - DNA, 20 bp, Artificial Sequence
  Synthetic oligonucleotide; CAG chr2 60516330 60516349 60516333 -
ccagattccctgtgagccag

SEQ ID NO: 176128 - DNA, 20 bp, Artificial Sequence
  Synthetic oligonucleotide; GAG chr2 60516328 60516347 60516331 -
agattccctgtgagccagca

SEQ ID NO: 176129 - DNA, 20 bp, Artificial Sequence
  Synthetic oligonucleotide; AAG chr2 60516323 60516342 60516326 -
ccctgtgagccagcagagcc

SEQ ID NO: 176130 - DNA, 20 bp, Artificial Sequence
  Synthetic oligonucleotide; GAG chr2 60516312 60516331 60516315 -
agcagagccaagtctttttt

SEQ ID NO: 176131 - DNA, 20 bp, Artificial Sequence
  Synthetic oligonucleotide; CAG chr2 60516305 60516324 60516308 -
ccaagtcttttttgagtttc

SEQ ID NO: 176132 - DNA, 20 bp, Artificial Sequence
  Synthetic oligonucleotide; TAG chr2 60516282 60516301 60516285 -
caaaacctgtgttttaataa

SEQ ID NO: 176133 - DNA, 20 bp, Artificial Sequence
  Synthetic oligonucleotide; AGG chr2 60516281 60516300 60516284 -
aaaacctgtgttttaataat

SEQ ID NO: 176134 - DNA, 20 bp, Artificial Sequence
  Synthetic oligonucleotide; GAG chr2 60516279 60516298 60516282 -
aacctgtgttttaataatag

SEQ ID NO: 176135 - DNA, 20 bp, Artificial Sequence
  Synthetic oligonucleotide; TGG chr2 60516276 60516295 60516279 -
ctgtgttttaataataggag

SEQ ID NO: 176136 - DNA, 20 bp, Artificial Sequence
  Synthetic oligonucleotide; GGG chr2 60516275 60516294 60516278 -
tgtgttttaataataggagt

SEQ ID NO: 176137 - DNA, 20 bp, Artificial Sequence
  Synthetic oligonucleotide; TAG chr2 60516259 60516278 60516262 -
gagtgggtcattgtgtttaa

SEQ ID NO: 176138 - DNA, 20 bp, Artificial Sequence
  Synthetic oligonucleotide; AAG chr2 60516243 60516262 60516246 -
ttaatagtacaacaaaacct

SEQ ID NO: 176139 - DNA, 20 bp, Artificial Sequence
  Synthetic oligonucleotide; AAG chr2 60516230 60516249 60516233 -
aaaacctaagtgcacataat

SEQ ID NO: 176140 - DNA, 20 bp, Artificial Sequence
  Synthetic oligonucleotide; TGG chr2 60516209 60516228 60516212 -
agcacatcttttctgtgtgc

SEQ ID NO: 176141 - DNA, 20 bp, Artificial Sequence
  Synthetic oligonucleotide; GGG chr2 60516208 60516227 60516211 -
gcacatcttttctgtgtgct

SEQ ID NO: 176142 - DNA, 20 bp, Artificial Sequence
  Synthetic oligonucleotide; GGG chr2 60516207 60516226 60516210 -
cacatcttttctgtgtgctg

SEQ ID NO: 176143 - DNA, 20 bp, Artificial Sequence
  Synthetic oligonucleotide; GAG chr2 60516203 60516222 60516206 -
tcttttctgtgtgctggggt

SEQ ID NO: 176144 - DNA, 20 bp, Artificial Sequence
  Synthetic oligonucleotide; AGG chr2 60516202 60516221 60516205 -
cttttctgtgtgctggggtg

SEQ ID NO: 176145 - DNA, 20 bp, Artificial Sequence
  Synthetic oligonucleotide; GAG chr2 60516200 60516219 60516203 -
tttctgtgtgctggggtgag

SEQ ID NO: 176146 - DNA, 20 bp, Artificial Sequence
  Synthetic oligonucleotide; GAG chr2 60516198 60516217 60516201 -
tctgtgtgctggggtgagga

SEQ ID NO: 176147 - DNA, 20 bp, Artificial Sequence
  Synthetic oligonucleotide; AGG chr2 60516197 60516216 60516200 -
ctgtgtgctggggtgaggag

SEQ ID NO: 176148 - DNA, 20 bp, Artificial Sequence
  Synthetic oligonucleotide; CAG chr2 60516191 60516210 60516194 -
gctggggtgaggagaggtga

SEQ ID NO: 176149 - DNA, 20 bp, Artificial Sequence
  Synthetic oligonucleotide; GAG chr2 60516187 60516206 60516190 -
gggtgaggagaggtgacagt

SEQ ID NO: 176150 - DNA, 20 bp, Artificial Sequence
  Synthetic oligonucleotide; TAG chr2 60516180 60516199 60516183 -
gagaggtgacagtgagtgtg

SEQ ID NO: 176151 - DNA, 20 bp, Artificial Sequence
  Synthetic oligonucleotide; AGG chr2 60516179 60516198 60516182 -
agaggtgacagtgagtgtgt

SEQ ID NO: 176152 - DNA, 20 bp, Artificial Sequence
  Synthetic oligonucleotide; AAG chr2 60516166 60516185 60516169 -
agtgtgtaggatgatatgaa

SEQ ID NO: 176153 - DNA, 20 bp, Artificial Sequence
  Synthetic oligonucleotide; CAG chr2 60516158 60516177 60516161 -
ggatgatatgaaaagcatta

SEQ ID NO: 176154 - DNA, 20 bp, Artificial Sequence
  Synthetic oligonucleotide; TGG chr2 60516152 60516171 60516155 -
tatgaaaagcattacagaca

SEQ ID NO: 176155 - DNA, 20 bp, Artificial Sequence
  Synthetic oligonucleotide; GGG chr2 60516151 60516170 60516154 -
atgaaaagcattacagacat

SEQ ID NO: 176156 - DNA, 20 bp, Artificial Sequence
  Synthetic oligonucleotide; AAG chr2 60516147 60516166 60516150 -
aaagcattacagacatggga

SEQ ID NO: 176157 - DNA, 20 bp, Artificial Sequence
  Synthetic oligonucleotide; TAG chr2 60516139 60516158 60516142 -
acagacatgggaaagcatct

SEQ ID NO: 176158 - DNA, 20 bp, Artificial Sequence
  Synthetic oligonucleotide; GAG chr2 60516137 60516156 60516140 -
agacatgggaaagcatctta

SEQ ID NO: 176159 - DNA, 20 bp, Artificial Sequence
  Synthetic oligonucleotide; AAG chr2 60516128 60516147 60516131 -
aaagcatcttagagcaccca

SEQ ID NO: 176160 - DNA, 20 bp, Artificial Sequence
  Synthetic oligonucleotide; TGG chr2 60516124 60516143 60516127 -
catcttagagcacccaaagc

SEQ ID NO: 176161 - DNA, 20 bp, Artificial Sequence
  Synthetic oligonucleotide; GAG chr2 60516118 60516137 60516121 -
agagcacccaaagctggcat

SEQ ID NO: 176162 - DNA, 20 bp, Artificial Sequence
  Synthetic oligonucleotide; CAG chr2 60516109 60516128 60516112 -
aaagctggcatgagtcatca

SEQ ID NO: 176163 - DNA, 20 bp, Artificial Sequence
  Synthetic oligonucleotide; AGG chr2 60516108 60516127 60516111 -
aagctggcatgagtcatcac

SEQ ID NO: 176164 - DNA, 20 bp, Artificial Sequence
  Synthetic oligonucleotide; TGG chr2 60516101 60516120 60516104 -
catgagtcatcacaggctta

SEQ ID NO: 176165 - DNA, 20 bp, Artificial Sequence
  Synthetic oligonucleotide; AAG chr2 60516094 60516113 60516097 -
catcacaggcttatggccac

SEQ ID NO: 176166 - DNA, 20 bp, Artificial Sequence
  Synthetic oligonucleotide; AGG chr2 60516093 60516112 60516096 -
atcacaggcttatggccaca

SEQ ID NO: 176167 - DNA, 20 bp, Artificial Sequence
  Synthetic oligonucleotide; TAG chr2 60516089 60516108 60516092 -
caggcttatggccacaaggc

SEQ ID NO: 176168 - DNA, 20 bp, Artificial Sequence
  Synthetic oligonucleotide; CAG chr2 60516054 60516073 60516057 -
tgcttccctttttcataacc

SEQ ID NO: 176169 - DNA, 20 bp, Artificial Sequence
  Synthetic oligonucleotide; AAG chr2 60516044 60516063 60516047 -
tttcataacccagttcaatg

SEQ ID NO: 176170 - DNA, 20 bp, Artificial Sequence
  Synthetic oligonucleotide; AAG chr2 60516032 60516051 60516035 -
gttcaatgaagacataattg

SEQ ID NO: 176171 - DNA, 20 bp, Artificial Sequence
  Synthetic oligonucleotide; TGG chr2 60516029 60516048 60516032 -
caatgaagacataattgaag

SEQ ID NO: 176172 - DNA, 20 bp, Artificial Sequence
  Synthetic oligonucleotide; GAG chr2 60516025 60516044 60516028 -
gaagacataattgaagtggt

SEQ ID NO: 176173 - DNA, 20 bp, Artificial Sequence
  Synthetic oligonucleotide; AAG chr2 60516022 60516041 60516025 -
gacataattgaagtggtgag

SEQ ID NO: 176174 - DNA, 20 bp, Artificial Sequence
  Synthetic oligonucleotide; GAG chr2 60516020 60516039 60516023 -
cataattgaagtggtgagaa

SEQ ID NO: 176175 - DNA, 20 bp, Artificial Sequence
  Synthetic oligonucleotide; AGG chr2 60516019 60516038 60516022 -
ataattgaagtggtgagaag

SEQ ID NO: 176176 - DNA, 20 bp, Artificial Sequence
  Synthetic oligonucleotide; GGG chr2 60516018 60516037 60516021 -
taattgaagtggtgagaaga

SEQ ID NO: 176177 - DNA, 20 bp, Artificial Sequence
  Synthetic oligonucleotide; GGG chr2 60516017 60516036 60516020 -
aattgaagtggtgagaagag

SEQ ID NO: 176178 - DNA, 20 bp, Artificial Sequence
  Synthetic oligonucleotide; CAG chr2 60516003 60516022 60516006 -
gaagaggggccaccgccctt

SEQ ID NO: 176179 - DNA, 20 bp, Artificial Sequence
  Synthetic oligonucleotide; CAG chr2 60515996 60516015 60515999 -
ggccaccgcccttcagactc

SEQ ID NO: 176180 - DNA, 20 bp, Artificial Sequence
  Synthetic oligonucleotide; AGG chr2 60515995 60516014 60515998 -
gccaccgcccttcagactcc

SEQ ID NO: 176181 - DNA, 20 bp, Artificial Sequence
  Synthetic oligonucleotide; GGG chr2 60515994 60516013 60515997 -
ccaccgcccttcagactcca

SEQ ID NO: 176182 - DNA, 20 bp, Artificial Sequence
  Synthetic oligonucleotide; CAG chr2 60515980 60515999 60515983 -
actccagggtatttgtattc

SEQ ID NO: 176183 - DNA, 20 bp, Artificial Sequence
  Synthetic oligonucleotide; AGG chr2 60515979 60515998 60515982 -
ctccagggtatttgtattcc

SEQ ID NO: 176184 - DNA, 20 bp, Artificial Sequence
  Synthetic oligonucleotide; TGG chr2 60515967 60515986 60515970 -
tgtattccaggacccctccg

SEQ ID NO: 176185 - DNA, 20 bp, Artificial Sequence
  Synthetic oligonucleotide; GGG chr2 60515966 60515985 60515969 -
gtattccaggacccctccgt

SEQ ID NO: 176186 - DNA, 20 bp, Artificial Sequence
  Synthetic oligonucleotide; TGG chr2 60515960 60515979 60515963 -
caggacccctccgtgggtgt

SEQ ID NO: 176187 - DNA, 20 bp, Artificial Sequence
  Synthetic oligonucleotide; CAG chr2 60515955 60515974 60515958 -
cccctccgtgggtgttggcc

SEQ ID NO: 176188 - DNA, 20 bp, Artificial Sequence
  Synthetic oligonucleotide; CGG chr2 60515952 60515971 60515955 -
ctccgtgggtgttggcccag

SEQ ID NO: 176189 - DNA, 20 bp, Artificial Sequence
  Synthetic oligonucleotide; CAG chr2 60515945 60515964 60515948 -
ggtgttggcccagcggtgcc

SEQ ID NO: 176190 - DNA, 20 bp, Artificial Sequence
  Synthetic oligonucleotide; GAG chr2 60515943 60515962 60515946 -
tgttggcccagcggtgccca

SEQ ID NO: 176191 - DNA, 20 bp, Artificial Sequence
  Synthetic oligonucleotide; TGG chr2 60515927 60515946 60515930 -
cccagagaatattcccttat

SEQ ID NO: 176192 - DNA, 20 bp, Artificial Sequence
  Synthetic oligonucleotide; CAG chr2 60515891 60515910 60515894 -
tgacttgttcacttcctgtt

SEQ ID NO: 176193 - DNA, 20 bp, Artificial Sequence
  Synthetic oligonucleotide; CAG chr2 60515886 60515905 60515889 -
tgttcacttcctgttcagcg

SEQ ID NO: 176194 - DNA, 20 bp, Artificial Sequence
  Synthetic oligonucleotide; TGG chr2 60515881 60515900 60515884 -
acttcctgttcagcgcagcc

SEQ ID NO: 176195 - DNA, 20 bp, Artificial Sequence
  Synthetic oligonucleotide; TGG chr2 60515878 60515897 60515881 -
tcctgttcagcgcagcctgg

SEQ ID NO: 176196 - DNA, 20 bp, Artificial Sequence
  Synthetic oligonucleotide; CGG chr2 60515870 60515889 60515873 -
agcgcagcctggtggtgact

SEQ ID NO: 176197 - DNA, 20 bp, Artificial Sequence
  Synthetic oligonucleotide; CAG chr2 60515858 60515877 60515861 -
tggtgactcggtaatcccca

SEQ ID NO: 176198 - DNA, 20 bp, Artificial Sequence
  Synthetic oligonucleotide; AAG chr2 60515854 60515873 60515857 -
gactcggtaatccccacagt

SEQ ID NO: 176199 - DNA, 20 bp, Artificial Sequence
  Synthetic oligonucleotide; CAG chr2 60515845 60515864 60515848 -
atccccacagtaagacctca

SEQ ID NO: 176200 - DNA, 20 bp, Artificial Sequence
  Synthetic oligonucleotide; TGG chr2 60515842 60515861 60515845 -
cccacagtaagacctcacag

SEQ ID NO: 176201 - DNA, 20 bp, Artificial Sequence
  Synthetic oligonucleotide; GGG chr2 60515841 60515860 60515844 -
ccacagtaagacctcacagt

SEQ ID NO: 176202 - DNA, 20 bp, Artificial Sequence
  Synthetic oligonucleotide; GAG chr2 60515836 60515855 60515839 -
gtaagacctcacagtgggtt

SEQ ID NO: 176203 - DNA, 20 bp, Artificial Sequence
  Synthetic oligonucleotide; TGG chr2 60515833 60515852 60515836 -
agacctcacagtgggttgag

SEQ ID NO: 176204 - DNA, 20 bp, Artificial Sequence
  Synthetic oligonucleotide; TGG chr2 60515828 60515847 60515831 -
tcacagtgggttgagtggcc

SEQ ID NO: 176205 - DNA, 20 bp, Artificial Sequence
  Synthetic oligonucleotide; GGG chr2 60515827 60515846 60515830 -
cacagtgggttgagtggcct

SEQ ID NO: 176206 - DNA, 20 bp, Artificial Sequence
  Synthetic oligonucleotide; GAG chr2 60515825 60515844 60515828 -
cagtgggttgagtggcctgg

SEQ ID NO: 176207 - DNA, 20 bp, Artificial Sequence
  Synthetic oligonucleotide; AAG chr2 60515819 60515838 60515822 -
gttgagtggcctgggagctc

SEQ ID NO: 176208 - DNA, 20 bp, Artificial Sequence
  Synthetic oligonucleotide; CAG chr2 60515815 60515834 60515818 -
agtggcctgggagctcaagt

SEQ ID NO: 176209 - DNA, 20 bp, Artificial Sequence
  Synthetic oligonucleotide; AGG chr2 60515814 60515833 60515817 -
gtggcctgggagctcaagtc

SEQ ID NO: 176210 - DNA, 20 bp, Artificial Sequence
  Synthetic oligonucleotide; GGG chr2 60515813 60515832 60515816 -
tggcctgggagctcaagtca

SEQ ID NO: 176211 - DNA, 20 bp, Artificial Sequence
  Synthetic oligonucleotide; GGG chr2 60515812 60515831 60515815 -
ggcctgggagctcaagtcag

SEQ ID NO: 176212 - DNA, 20 bp, Artificial Sequence
  Synthetic oligonucleotide; CAG chr2 60515809 60515828 60515812 -
ctgggagctcaagtcagggg

SEQ ID NO: 176213 - DNA, 20 bp, Artificial Sequence
  Synthetic oligonucleotide; TGG chr2 60515803 60515822 60515806 -
gctcaagtcaggggcagaaa

SEQ ID NO: 176214 - DNA, 20 bp, Artificial Sequence
  Synthetic oligonucleotide; GGG chr2 60515802 60515821 60515805 -
ctcaagtcaggggcagaaat

SEQ ID NO: 176215 - DNA, 20 bp, Artificial Sequence
  Synthetic oligonucleotide; GGG chr2 60515801 60515820 60515804 -
tcaagtcaggggcagaaatg

SEQ ID NO: 176216 - DNA, 20 bp, Artificial Sequence
  Synthetic oligonucleotide; AAG chr2 60515798 60515817 60515801 -
agtcaggggcagaaatgggg

SEQ ID NO: 176217 - DNA, 20 bp, Artificial Sequence
  Synthetic oligonucleotide; TGG chr2 60515794 60515813 60515797 -
aggggcagaaatggggaagc

SEQ ID NO: 176218 - DNA, 20 bp, Artificial Sequence
  Synthetic oligonucleotide; AAG chr2 60515790 60515809 60515793 -
gcagaaatggggaagctgga

SEQ ID NO: 176219 - DNA, 20 bp, Artificial Sequence
  Synthetic oligonucleotide; TGG chr2 60515786 60515805 60515789 -
aaatggggaagctggaaagt

SEQ ID NO: 176220 - DNA, 20 bp, Artificial Sequence
  Synthetic oligonucleotide; GGG chr2 60515785 60515804 60515788 -
aatggggaagctggaaagtt

SEQ ID NO: 176221 - DNA, 20 bp, Artificial Sequence
  Synthetic oligonucleotide; AAG chr2 60515777 60515796 60515780 -
agctggaaagttgggtgatc

SEQ ID NO: 176222 - DNA, 20 bp, Artificial Sequence
  Synthetic oligonucleotide; GAG chr2 60515775 60515794 60515778 -
ctggaaagttgggtgatcaa

SEQ ID NO: 176223 - DNA, 20 bp, Artificial Sequence
  Synthetic oligonucleotide; TGG chr2 60515767 60515786 60515770 -
ttgggtgatcaagagtcatt

SEQ ID NO: 176224 - DNA, 20 bp, Artificial Sequence
  Synthetic oligonucleotide; AAG chr2 60515764 60515783 60515767 -
ggtgatcaagagtcatttgg

SEQ ID NO: 176225 - DNA, 20 bp, Artificial Sequence
  Synthetic oligonucleotide; CAG chr2 60515746 60515765 60515749 -
ggaagcccccatgtctgtgt

SEQ ID NO: 176226 - DNA, 20 bp, Artificial Sequence
  Synthetic oligonucleotide; AAG chr2 60515694 60515713 60515697 -
accactttctccctgcctga

SEQ ID NO: 176227 - DNA, 20 bp, Artificial Sequence
  Synthetic oligonucleotide; TGG chr2 60515688 60515707 60515691 -
ttctccctgcctgaaagcac

SEQ ID NO: 176228 - DNA, 20 bp, Artificial Sequence
  Synthetic oligonucleotide; GGG chr2 60515687 60515706 60515690 -
tctccctgcctgaaagcact

SEQ ID NO: 176229 - DNA, 20 bp, Artificial Sequence
  Synthetic oligonucleotide; CAG chr2 60515676 60515695 60515679 -
gaaagcactgggctgtgttt

SEQ ID NO: 176230 - DNA, 20 bp, Artificial Sequence
  Synthetic oligonucleotide; GAG chr2 60515674 60515693 60515677 -
aagcactgggctgtgtttca

SEQ ID NO: 176231 - DNA, 20 bp, Artificial Sequence
  Synthetic oligonucleotide; GAG chr2 60515672 60515691 60515675 -
gcactgggctgtgtttcaga

SEQ ID NO: 176232 - DNA, 20 bp, Artificial Sequence
  Synthetic oligonucleotide; AGG chr2 60515671 60515690 60515674 -
cactgggctgtgtttcagag

SEQ ID NO: 176233 - DNA, 20 bp, Artificial Sequence
  Synthetic oligonucleotide; TAG chr2 60515668 60515687 60515671 -
tgggctgtgtttcagagagg

SEQ ID NO: 176234 - DNA, 20 bp, Artificial Sequence
  Synthetic oligonucleotide; TGG chr2 60515664 60515683 60515667 -
ctgtgtttcagagaggtagc

SEQ ID NO: 176235 - DNA, 20 bp, Artificial Sequence
  Synthetic oligonucleotide; GGG chr2 60515663 60515682 60515666 -
tgtgtttcagagaggtagct

SEQ ID NO: 176236 - DNA, 20 bp, Artificial Sequence
  Synthetic oligonucleotide; CAG chr2 60515655 60515674 60515658 -
agagaggtagctgggtccca

SEQ ID NO: 176237 - DNA, 20 bp, Artificial Sequence
  Synthetic oligonucleotide; TGG chr2 60515645 60515664 60515648 -
ctgggtcccacagatattta

SEQ ID NO: 176238 - DNA, 20 bp, Artificial Sequence
  Synthetic oligonucleotide; GAG chr2 60515643 60515662 60515646 -
gggtcccacagatatttatg

SEQ ID NO: 176239 - DNA, 20 bp, Artificial Sequence
  Synthetic oligonucleotide; AGG chr2 60515642 60515661 60515645 -
ggtcccacagatatttatgg

SEQ ID NO: 176240 - DNA, 20 bp, Artificial Sequence
  Synthetic oligonucleotide; GGG chr2 60515641 60515660 60515644 -
gtcccacagatatttatgga

SEQ ID NO: 176241 - DNA, 20 bp, Artificial Sequence
  Synthetic oligonucleotide; TAG chr2 60515618 60515637 60515621 -
cttgtttctgtatctccttc

SEQ ID NO: 176242 - DNA, 20 bp, Artificial Sequence
  Synthetic oligonucleotide; TGG chr2 60515615 60515634 60515618 -
gtttctgtatctccttctag

SEQ ID NO: 176243 - DNA, 20 bp, Artificial Sequence
  Synthetic oligonucleotide; GGG chr2 60515614 60515633 60515617 -
tttctgtatctccttctagt

SEQ ID NO: 176244 - DNA, 20 bp, Artificial Sequence
  Synthetic oligonucleotide; TGG chr2 60515610 60515629 60515613 -
tgtatctccttctagtgggc

SEQ ID NO: 176245 - DNA, 20 bp, Artificial Sequence
  Synthetic oligonucleotide; CAG chr2 60515600 60515619 60515603 -
tctagtgggctggacctccc

SEQ ID NO: 176246 - DNA, 20 bp, Artificial Sequence
  Synthetic oligonucleotide; AGG chr2 60515599 60515618 60515602 -
ctagtgggctggacctcccc

SEQ ID NO: 176247 - DNA, 20 bp, Artificial Sequence
  Synthetic oligonucleotide; TAG chr2 60515587 60515606 60515590 -
acctccccaggccatttttc

SEQ ID NO: 176248 - DNA, 20 bp, Artificial Sequence
  Synthetic oligonucleotide; AGG chr2 60515586 60515605 60515589 -
cctccccaggccatttttct

SEQ ID NO: 176249 - DNA, 20 bp, Artificial Sequence
  Synthetic oligonucleotide; TAG chr2 60515579 60515598 60515582 -
aggccatttttctaggtaac

SEQ ID NO: 176250 - DNA, 20 bp, Artificial Sequence
  Synthetic oligonucleotide; AGG chr2 60515578 60515597 60515581 -
ggccatttttctaggtaact

SEQ ID NO: 176251 - DNA, 20 bp, Artificial Sequence
  Synthetic oligonucleotide; AAG chr2 60515575 60515594 60515578 -
catttttctaggtaactagg

SEQ ID NO: 176252 - DNA, 20 bp, Artificial Sequence
  Synthetic oligonucleotide; AGG chr2 60515574 60515593 60515577 -
atttttctaggtaactagga

SEQ ID NO: 176253 - DNA, 20 bp, Artificial Sequence
  Synthetic oligonucleotide; CAG chr2 60515560 60515579 60515563 -
ctaggaaggcctgactctgt

SEQ ID NO: 176254 - DNA, 20 bp, Artificial Sequence
  Synthetic oligonucleotide; TGG chr2 60515552 60515571 60515555 -
gcctgactctgtcagcaact

SEQ ID NO: 176255 - DNA, 20 bp, Artificial Sequence
  Synthetic oligonucleotide; TGG chr2 60515542 60515561 60515545 -
gtcagcaacttggctttctt

SEQ ID NO: 176256 - DNA, 20 bp, Artificial Sequence
  Synthetic oligonucleotide; GAG chr2 60515540 60515559 60515543 -
cagcaacttggctttctttg

SEQ ID NO: 176257 - DNA, 20 bp, Artificial Sequence
  Synthetic oligonucleotide; AGG chr2 60515539 60515558 60515542 -
agcaacttggctttctttgg

SEQ ID NO: 176258 - DNA, 20 bp, Artificial Sequence
  Synthetic oligonucleotide; GAG chr2 60515537 60515556 60515540 -
caacttggctttctttggag

SEQ ID NO: 176259 - DNA, 20 bp, Artificial Sequence
  Synthetic oligonucleotide; AGG chr2 60515536 60515555 60515539 -
aacttggctttctttggagg

SEQ ID NO: 176260 - DNA, 20 bp, Artificial Sequence
  Synthetic oligonucleotide; TGG chr2 60515525 60515544 60515528 -
ctttggaggaggtgtcactc

SEQ ID NO: 176261 - DNA, 20 bp, Artificial Sequence
  Synthetic oligonucleotide; GGG chr2 60515524 60515543 60515527 -
tttggaggaggtgtcactct

SEQ ID NO: 176262 - DNA, 20 bp, Artificial Sequence
  Synthetic oligonucleotide; TAG chr2 60515519 60515538 60515522 -
aggaggtgtcactctgggat

SEQ ID NO: 176263 - DNA, 20 bp, Artificial Sequence
  Synthetic oligonucleotide; AAG chr2 60515512 60515531 60515515 -
gtcactctgggattagttaa

SEQ ID NO: 176264 - DNA, 20 bp, Artificial Sequence
  Synthetic oligonucleotide; AGG chr2 60515511 60515530 60515514 -
tcactctgggattagttaaa

SEQ ID NO: 176265 - DNA, 20 bp, Artificial Sequence
  Synthetic oligonucleotide; GGG chr2 60515510 60515529 60515513 -
cactctgggattagttaaaa

SEQ ID NO: 176266 - DNA, 20 bp, Artificial Sequence
  Synthetic oligonucleotide; GGG chr2 60515509 60515528 60515512 -
actctgggattagttaaaag

SEQ ID NO: 176267 - DNA, 20 bp, Artificial Sequence
  Synthetic oligonucleotide; CAG chr2 60515504 60515523 60515507 -
gggattagttaaaaggggat

SEQ ID NO: 176268 - DNA, 20 bp, Artificial Sequence
  Synthetic oligonucleotide; TGG chr2 60515501 60515520 60515504 -
attagttaaaaggggatcag

SEQ ID NO: 176269 - DNA, 20 bp, Artificial Sequence
  Synthetic oligonucleotide; TGG chr2 60515489 60515508 60515492 -
gggatcagtggtattcacat

SEQ ID NO: 176270 - DNA, 20 bp, Artificial Sequence
  Synthetic oligonucleotide; TGG chr2 60515482 60515501 60515485 -
gtggtattcacattggctcg

SEQ ID NO: 176271 - DNA, 20 bp, Artificial Sequence
  Synthetic oligonucleotide; GGG chr2 60515481 60515500 60515484 -
tggtattcacattggctcgt

SEQ ID NO: 176272 - DNA, 20 bp, Artificial Sequence
  Synthetic oligonucleotide; TGG chr2 60515447 60515466 60515450 -
ctcctcaaattataaccttt

SEQ ID NO: 176273 - DNA, 20 bp, Artificial Sequence
  Synthetic oligonucleotide; GAG chr2 60515445 60515464 60515448 -
cctcaaattataaccttttg

SEQ ID NO: 176274 - DNA, 20 bp, Artificial Sequence
  Synthetic oligonucleotide; AGG chr2 60515444 60515463 60515447 -
ctcaaattataaccttttgg

SEQ ID NO: 176275 - DNA, 20 bp, Artificial Sequence
  Synthetic oligonucleotide; GGG chr2 60515443 60515462 60515446 -
tcaaattataaccttttgga

SEQ ID NO: 176276 - DNA, 20 bp, Artificial Sequence
  Synthetic oligonucleotide; CAG chr2 60515440 60515459 60515443 -
aattataaccttttggaggg

SEQ ID NO: 176277 - DNA, 20 bp, Artificial Sequence
  Synthetic oligonucleotide; AGG chr2 60515439 60515458 60515442 -
attataaccttttggagggc

SEQ ID NO: 176278 - DNA, 20 bp, Artificial Sequence
  Synthetic oligonucleotide; GAG chr2 60515437 60515456 60515440 -
tataaccttttggagggcag

SEQ ID NO: 176279 - DNA, 20 bp, Artificial Sequence
  Synthetic oligonucleotide; TGG chr2 60515409 60515428 60515412 -
ttttattttttgtgccttct

SEQ ID NO: 176280 - DNA, 20 bp, Artificial Sequence
  Synthetic oligonucleotide; TGG chr2 60515391 60515410 60515394 -
cttggtgcctaacataatgc

SEQ ID NO: 176281 - DNA, 20 bp, Artificial Sequence
  Synthetic oligonucleotide; TAG chr2 60515380 60515399 60515383 -
acataatgctggttcatatg

SEQ ID NO: 176282 - DNA, 20 bp, Artificial Sequence
  Synthetic oligonucleotide; CAG chr2 60515340 60515359 60515343 -
gctcacgctgcttgattgaa

SEQ ID NO: 176283 - DNA, 20 bp, Artificial Sequence
  Synthetic oligonucleotide; GAG chr2 60515338 60515357 60515341 -
tcacgctgcttgattgaaca

SEQ ID NO: 176284 - DNA, 20 bp, Artificial Sequence
  Synthetic oligonucleotide; AAG chr2 60515334 60515353 60515337 -
gctgcttgattgaacagaga

SEQ ID NO: 176285 - DNA, 20 bp, Artificial Sequence
  Synthetic oligonucleotide; CGG chr2 60515329 60515348 60515332 -
ttgattgaacagagaaagac

SEQ ID NO: 176286 - DNA, 20 bp, Artificial Sequence
  Synthetic oligonucleotide; GGG chr2 60515328 60515347 60515331 -
tgattgaacagagaaagacc

SEQ ID NO: 176287 - DNA, 20 bp, Artificial Sequence
  Synthetic oligonucleotide; TGG chr2 60515318 60515337 60515321 -
gagaaagaccgggctttgaa

SEQ ID NO: 176288 - DNA, 20 bp, Artificial Sequence
  Synthetic oligonucleotide; CAG chr2 60515310 60515329 60515313 -
ccgggctttgaatggatccc

SEQ ID NO: 176289 - DNA, 20 bp, Artificial Sequence
  Synthetic oligonucleotide; CAG chr2 60515298 60515317 60515301 -
tggatccccagctccctgtc

SEQ ID NO: 176290 - DNA, 20 bp, Artificial Sequence
  Synthetic oligonucleotide; AGG chr2 60515297 60515316 60515300 -
ggatccccagctccctgtcc

SEQ ID NO: 176291 - DNA, 20 bp, Artificial Sequence
  Synthetic oligonucleotide; GGG chr2 60515296 60515315 60515299 -
gatccccagctccctgtcca

SEQ ID NO: 176292 - DNA, 20 bp, Artificial Sequence
  Synthetic oligonucleotide; AAG chr2 60515293 60515312 60515296 -
ccccagctccctgtccaggg

SEQ ID NO: 176293 - DNA, 20 bp, Artificial Sequence
  Synthetic oligonucleotide; AGG chr2 60515292 60515311 60515295 -
cccagctccctgtccaggga

SEQ ID NO: 176294 - DNA, 20 bp, Artificial Sequence
  Synthetic oligonucleotide; GAG chr2 60515286 60515305 60515289 -
tccctgtccagggaaggtgt

SEQ ID NO: 176295 - DNA, 20 bp, Artificial Sequence
  Synthetic oligonucleotide; AGG chr2 60515285 60515304 60515288 -
ccctgtccagggaaggtgtg

SEQ ID NO: 176296 - DNA, 20 bp, Artificial Sequence
  Synthetic oligonucleotide; TGG chr2 60515281 60515300 60515284 -
gtccagggaaggtgtgaggc

SEQ ID NO: 176297 - DNA, 20 bp, Artificial Sequence
  Synthetic oligonucleotide; GGG chr2 60515280 60515299 60515283 -
tccagggaaggtgtgaggct

SEQ ID NO: 176298 - DNA, 20 bp, Artificial Sequence
  Synthetic oligonucleotide; AAG chr2 60515276 60515295 60515279 -
gggaaggtgtgaggctgggc

SEQ ID NO: 176299 - DNA, 20 bp, Artificial Sequence
  Synthetic oligonucleotide; TGG chr2 60515253 60515272 60515256 -
tttatttcccccttcctccc

SEQ ID NO: 176300 - DNA, 20 bp, Artificial Sequence
  Synthetic oligonucleotide; GGG chr2 60515252 60515271 60515255 -
ttatttcccccttcctccct

SEQ ID NO: 176301 - DNA, 20 bp, Artificial Sequence
  Synthetic oligonucleotide; GGG chr2 60515251 60515270 60515254 -
tatttcccccttcctccctg

SEQ ID NO: 176302 - DNA, 20 bp, Artificial Sequence
  Synthetic oligonucleotide; GAG chr2 60515249 60515268 60515252 -
tttcccccttcctccctggg

SEQ ID NO: 176303 - DNA, 20 bp, Artificial Sequence
  Synthetic oligonucleotide; AAG chr2 60515245 60515264 60515248 -
ccccttcctccctggggaga

SEQ ID NO: 176304 - DNA, 20 bp, Artificial Sequence
  Synthetic oligonucleotide; AAG chr2 60515237 60515256 60515240 -
tccctggggagaaagtgaaa

SEQ ID NO: 176305 - DNA, 20 bp, Artificial Sequence
  Synthetic oligonucleotide; AAG chr2 60515231 60515250 60515234 -
gggagaaagtgaaaaagtga

SEQ ID NO: 176306 - DNA, 20 bp, Artificial Sequence
  Synthetic oligonucleotide; TGG chr2 60515225 60515244 60515228 -
aagtgaaaaagtgaaagtgc

SEQ ID NO: 176307 - DNA, 20 bp, Artificial Sequence
  Synthetic oligonucleotide; GGG chr2 60515224 60515243 60515227 -
agtgaaaaagtgaaagtgct

SEQ ID NO: 176308 - DNA, 20 bp, Artificial Sequence
  Synthetic oligonucleotide; GGG chr2 60515223 60515242 60515226 -
gtgaaaaagtgaaagtgctg

SEQ ID NO: 176309 - DNA, 20 bp, Artificial Sequence
  Synthetic oligonucleotide; TGG chr2 60515219 60515238 60515222 -
aaaagtgaaagtgctggggt

SEQ ID NO: 176310 - DNA, 20 bp, Artificial Sequence
  Synthetic oligonucleotide; GGG chr2 60515218 60515237 60515221 -
aaagtgaaagtgctggggtt

SEQ ID NO: 176311 - DNA, 20 bp, Artificial Sequence
  Synthetic oligonucleotide; TAG chr2 60515214 60515233 60515217 -
tgaaagtgctggggttggga

SEQ ID NO: 176312 - DNA, 20 bp, Artificial Sequence
  Synthetic oligonucleotide; TGG chr2 60515210 60515229 60515213 -
agtgctggggttgggatagc

SEQ ID NO: 176313 - DNA, 20 bp, Artificial Sequence
  Synthetic oligonucleotide; TGG chr2 60515207 60515226 60515210 -
gctggggttgggatagctgg

SEQ ID NO: 176314 - DNA, 20 bp, Artificial Sequence
  Synthetic oligonucleotide; TGG chr2 60515196 60515215 60515199 -
gatagctggtggtgtctttg

SEQ ID NO: 176315 - DNA, 20 bp, Artificial Sequence
  Synthetic oligonucleotide; TGG chr2 60515182 60515201 60515185 -
tctttgtggctttcacccca

SEQ ID NO: 176316 - DNA, 20 bp, Artificial Sequence
  Synthetic oligonucleotide; AAG chr2 60515177 60515196 60515180 -
gtggctttcaccccatggtc

SEQ ID NO: 176317 - DNA, 20 bp, Artificial Sequence
  Synthetic oligonucleotide; CAG chr2 60515174 60515193 60515177 -
gctttcaccccatggtcaag

SEQ ID NO: 176318 - DNA, 20 bp, Artificial Sequence
  Synthetic oligonucleotide; CAG chr2 60515158 60515177 60515161 -
caagcagtgaactctgcttg

SEQ ID NO: 176319 - DNA, 20 bp, Artificial Sequence
  Synthetic oligonucleotide; TGG chr2 60515138 60515157 60515141 -
cagattctgtctcgctcacc

SEQ ID NO: 176320 - DNA, 20 bp, Artificial Sequence
  Synthetic oligonucleotide; AAG chr2 60515135 60515154 60515138 -
attctgtctcgctcacctgg

SEQ ID NO: 176321 - DNA, 20 bp, Artificial Sequence
  Synthetic oligonucleotide; CAG chr2 60515131 60515150 60515134 -
tgtctcgctcacctggaagc

SEQ ID NO: 176322 - DNA, 20 bp, Artificial Sequence
  Synthetic oligonucleotide; TGG chr2 60515125 60515144 60515128 -
gctcacctggaagccagtgt

SEQ ID NO: 176323 - DNA, 20 bp, Artificial Sequence
  Synthetic oligonucleotide; GGG chr2 60515124 60515143 60515127 -
ctcacctggaagccagtgtt

SEQ ID NO: 176324 - DNA, 20 bp, Artificial Sequence
  Synthetic oligonucleotide; GGG chr2 60515123 60515142 60515126 -
tcacctggaagccagtgttg

SEQ ID NO: 176325 - DNA, 20 bp, Artificial Sequence
  Synthetic oligonucleotide; AAG chr2 60515120 60515139 60515123 -
cctggaagccagtgttgggg

SEQ ID NO: 176326 - DNA, 20 bp, Artificial Sequence
  Synthetic oligonucleotide; AGG chr2 60515119 60515138 60515122 -
ctggaagccagtgttgggga

SEQ ID NO: 176327 - DNA, 20 bp, Artificial Sequence
  Synthetic oligonucleotide; GAG chr2 60515117 60515136 60515120 -
ggaagccagtgttggggaag

SEQ ID NO: 176328 - DNA, 20 bp, Artificial Sequence
  Synthetic oligonucleotide; TGG chr2 60515110 60515129 60515113 -
agtgttggggaaggagcacg

SEQ ID NO: 176329 - DNA, 20 bp, Artificial Sequence
  Synthetic oligonucleotide; GGG chr2 60515109 60515128 60515112 -
gtgttggggaaggagcacgt

SEQ ID NO: 176330 - DNA, 20 bp, Artificial Sequence
  Synthetic oligonucleotide; GGG chr2 60515108 60515127 60515111 -
tgttggggaaggagcacgtg

SEQ ID NO: 176331 - DNA, 20 bp, Artificial Sequence
  Synthetic oligonucleotide; GGG chr2 60515107 60515126 60515110 -
gttggggaaggagcacgtgg

SEQ ID NO: 176332 - DNA, 20 bp, Artificial Sequence
  Synthetic oligonucleotide; GAG chr2 60515105 60515124 60515108 -
tggggaaggagcacgtgggg

SEQ ID NO: 176333 - DNA, 20 bp, Artificial Sequence
  Synthetic oligonucleotide; AGG chr2 60515104 60515123 60515107 -
ggggaaggagcacgtggggg

SEQ ID NO: 176334 - DNA, 20 bp, Artificial Sequence
  Synthetic oligonucleotide; TAG chr2 60515096 60515115 60515099 -
agcacgtgggggaggatcct

SEQ ID NO: 176335 - DNA, 20 bp, Artificial Sequence
  Synthetic oligonucleotide; AGG chr2 60515095 60515114 60515098 -
gcacgtgggggaggatcctt

SEQ ID NO: 176336 - DNA, 20 bp, Artificial Sequence
  Synthetic oligonucleotide; TGG chr2 60515090 60515109 60515093 -
tgggggaggatccttaggtc

SEQ ID NO: 176337 - DNA, 20 bp, Artificial Sequence
  Synthetic oligonucleotide; GGG chr2 60515089 60515108 60515092 -
gggggaggatccttaggtct

SEQ ID NO: 176338 - DNA, 20 bp, Artificial Sequence
  Synthetic oligonucleotide; TGG chr2 60515078 60515097 60515081 -
cttaggtctgggcaacactt

SEQ ID NO: 176339 - DNA, 20 bp, Artificial Sequence
  Synthetic oligonucleotide; GAG chr2 60515076 60515095 60515079 -
taggtctgggcaacactttg

SEQ ID NO: 176340 - DNA, 20 bp, Artificial Sequence
  Synthetic oligonucleotide; TAG chr2 60515072 60515091 60515075 -
tctgggcaacactttggagt

SEQ ID NO: 176341 - DNA, 20 bp, Artificial Sequence
  Synthetic oligonucleotide; AGG chr2 60515071 60515090 60515074 -
ctgggcaacactttggagtt

SEQ ID NO: 176342 - DNA, 20 bp, Artificial Sequence
  Synthetic oligonucleotide; GGG chr2 60515070 60515089 60515073 -
tgggcaacactttggagtta

SEQ ID NO: 176343 - DNA, 20 bp, Artificial Sequence
  Synthetic oligonucleotide; GGG chr2 60515069 60515088 60515072 -
gggcaacactttggagttag

SEQ ID NO: 176344 - DNA, 20 bp, Artificial Sequence
  Synthetic oligonucleotide; GGG chr2 60515068 60515087 60515071 -
ggcaacactttggagttagg

SEQ ID NO: 176345 - DNA, 20 bp, Artificial Sequence
  Synthetic oligonucleotide; TGG chr2 60515060 60515079 60515063 -
tttggagttagggggtcccc

SEQ ID NO: 176346 - DNA, 20 bp, Artificial Sequence
  Synthetic oligonucleotide; GAG chr2 60515058 60515077 60515061 -
tggagttagggggtcccctg

SEQ ID NO: 176347 - DNA, 20 bp, Artificial Sequence
  Synthetic oligonucleotide; AGG chr2 60515057 60515076 60515060 -
ggagttagggggtcccctgg

SEQ ID NO: 176348 - DNA, 20 bp, Artificial Sequence
  Synthetic oligonucleotide; TGG chr2 60515052 60515071 60515055 -
tagggggtcccctggaggtg

SEQ ID NO: 176349 - DNA, 20 bp, Artificial Sequence
  Synthetic oligonucleotide; GGG chr2 60515051 60515070 60515054 -
agggggtcccctggaggtgt

SEQ ID NO: 176350 - DNA, 20 bp, Artificial Sequence
  Synthetic oligonucleotide; AAG chr2 60515048 60515067 60515051 -
gggtcccctggaggtgtggg

SEQ ID NO: 176351 - DNA, 20 bp, Artificial Sequence
  Synthetic oligonucleotide; TGG chr2 60515044 60515063 60515047 -
cccctggaggtgtgggaagc

SEQ ID NO: 176352 - DNA, 20 bp, Artificial Sequence
  Synthetic oligonucleotide; TAG chr2 60515041 60515060 60515044 -
ctggaggtgtgggaagctgg

SEQ ID NO: 176353 - DNA, 20 bp, Artificial Sequence
  Synthetic oligonucleotide; TGG chr2 60515038 60515057 60515041 -
gaggtgtgggaagctggtag

SEQ ID NO: 176354 - DNA, 20 bp, Artificial Sequence
  Synthetic oligonucleotide; TGG chr2 60515030 60515049 60515033 -
ggaagctggtagtggcattc

SEQ ID NO: 176355 - DNA, 20 bp, Artificial Sequence
  Synthetic oligonucleotide; AAG chr2 60515023 60515042 60515026 -
ggtagtggcattctggaaac

SEQ ID NO: 176356 - DNA, 20 bp, Artificial Sequence
  Synthetic oligonucleotide; TAG chr2 60515019 60515038 60515022 -
gtggcattctggaaacaagc

SEQ ID NO: 176357 - DNA, 20 bp, Artificial Sequence
  Synthetic oligonucleotide; GAG chr2 60515017 60515036 60515020 -
ggcattctggaaacaagcta

SEQ ID NO: 176358 - DNA, 20 bp, Artificial Sequence
  Synthetic oligonucleotide; CAG chr2 60515004 60515023 60515007 -
caagctagagcctgtctcac

SEQ ID NO: 176359 - DNA, 20 bp, Artificial Sequence
  Synthetic oligonucleotide; GAG chr2 60515002 60515021 60515005 -
agctagagcctgtctcacca

SEQ ID NO: 176360 - DNA, 20 bp, Artificial Sequence
  Synthetic oligonucleotide; AGG chr2 60515001 60515020 60515004 -
gctagagcctgtctcaccag

SEQ ID NO: 176361 - DNA, 20 bp, Artificial Sequence
  Synthetic oligonucleotide; GGG chr2 60515000 60515019 60515003 -
ctagagcctgtctcaccaga

SEQ ID NO: 176362 - DNA, 20 bp, Artificial Sequence
  Synthetic oligonucleotide; GAG chr2 60514998 60515017 60515001 -
agagcctgtctcaccagagg

SEQ ID NO: 176363 - DNA, 20 bp, Artificial Sequence
  Synthetic oligonucleotide; CGG chr2 60514993 60515012 60514996 -
ctgtctcaccagagggagaa

SEQ ID NO: 176364 - DNA, 20 bp, Artificial Sequence
  Synthetic oligonucleotide; GAG chr2 60514988 60515007 60514991 -
tcaccagagggagaacggct

SEQ ID NO: 176365 - DNA, 20 bp, Artificial Sequence
  Synthetic oligonucleotide; CGG chr2 60514983 60515002 60514986 -
agagggagaacggctgagtt

SEQ ID NO: 176366 - DNA, 20 bp, Artificial Sequence
  Synthetic oligonucleotide; AAG chr2 60514980 60514999 60514983 -
gggagaacggctgagttcgg

SEQ ID NO: 176367 - DNA, 20 bp, Artificial Sequence
  Synthetic oligonucleotide; AGG chr2 60514979 60514998 60514982 -
ggagaacggctgagttcgga

SEQ ID NO: 176368 - DNA, 20 bp, Artificial Sequence
  Synthetic oligonucleotide; GGG chr2 60514978 60514997 60514981 -
gagaacggctgagttcggaa

SEQ ID NO: 176369 - DNA, 20 bp, Artificial Sequence
  Synthetic oligonucleotide; TGG chr2 60514973 60514992 60514976 -
cggctgagttcggaagggac

SEQ ID NO: 176370 - DNA, 20 bp, Artificial Sequence
  Synthetic oligonucleotide; GGG chr2 60514972 60514991 60514975 -
ggctgagttcggaagggact

SEQ ID NO: 176371 - DNA, 20 bp, Artificial Sequence
  Synthetic oligonucleotide; GGG chr2 60514971 60514990 60514974 -
gctgagttcggaagggactg

SEQ ID NO: 176372 - DNA, 20 bp, Artificial Sequence
  Synthetic oligonucleotide; TGG chr2 60514956 60514975 60514959 -
gactggggcctgctttcctt

SEQ ID NO: 176373 - DNA, 20 bp, Artificial Sequence
  Synthetic oligonucleotide; GGG chr2 60514955 60514974 60514958 -
actggggcctgctttccttt

SEQ ID NO: 176374 - DNA, 20 bp, Artificial Sequence
  Synthetic oligonucleotide; TGG chr2 60514952 60514971 60514955 -
ggggcctgctttcctttggg

SEQ ID NO: 176375 - DNA, 20 bp, Artificial Sequence
  Synthetic oligonucleotide; TGG chr2 60514942 60514961 60514945 -
ttcctttgggtggctttgac

SEQ ID NO: 176376 - DNA, 20 bp, Artificial Sequence
  Synthetic oligonucleotide; TGG chr2 60514935 60514954 60514938 -
gggtggctttgactggctct

SEQ ID NO: 176377 - DNA, 20 bp, Artificial Sequence
  Synthetic oligonucleotide; GAG chr2 60514930 60514949 60514933 -
gctttgactggctcttggat

SEQ ID NO: 176378 - DNA, 20 bp, Artificial Sequence
  Synthetic oligonucleotide; AAG chr2 60514922 60514941 60514925 -
tggctcttggatgagtttaa

SEQ ID NO: 176379 - DNA, 20 bp, Artificial Sequence
  Synthetic oligonucleotide; AGG chr2 60514921 60514940 60514924 -
ggctcttggatgagtttaaa

SEQ ID NO: 176380 - DNA, 20 bp, Artificial Sequence
  Synthetic oligonucleotide; TAG chr2 60514861 60514880 60514864 -
tttttttcttttttctgttt

SEQ ID NO: 176381 - DNA, 20 bp, Artificial Sequence
  Synthetic oligonucleotide; AAG chr2 60514845 60514864 60514848 -
gttttagtgtatgtgtatgc

SEQ ID NO: 176382 - DNA, 20 bp, Artificial Sequence
  Synthetic oligonucleotide; GAG chr2 60514829 60514848 60514832 -
atgcaagacctttgatattt

SEQ ID NO: 176383 - DNA, 20 bp, Artificial Sequence
  Synthetic oligonucleotide; TAG chr2 60514826 60514845 60514829 -
caagacctttgatatttgag

SEQ ID NO: 176384 - DNA, 20 bp, Artificial Sequence
  Synthetic oligonucleotide; AGG chr2 60514825 60514844 60514828 -
aagacctttgatatttgagt

SEQ ID NO: 176385 - DNA, 20 bp, Artificial Sequence
  Synthetic oligonucleotide; GGG chr2 60514824 60514843 60514827 -
agacctttgatatttgagta

SEQ ID NO: 176386 - DNA, 20 bp, Artificial Sequence
  Synthetic oligonucleotide; TGG chr2 60514804 60514823 60514807 -
gggaaatcctctcttatcaa

SEQ ID NO: 176387 - DNA, 20 bp, Artificial Sequence
  Synthetic oligonucleotide; CAG chr2 60514795 60514814 60514798 -
tctcttatcaatggaattca

SEQ ID NO: 176388 - DNA, 20 bp, Artificial Sequence
  Synthetic oligonucleotide; TGG chr2 60514785 60514804 60514788 -
atggaattcacagcctctta

SEQ ID NO: 176389 - DNA, 20 bp, Artificial Sequence
  Synthetic oligonucleotide; AAG chr2 60514757 60514776 60514760 -
taccctttcattgtgttgta

SEQ ID NO: 176390 - DNA, 20 bp, Artificial Sequence
  Synthetic oligonucleotide; CAG chr2 60514753 60514772 60514756 -
ctttcattgtgttgtaaaga

SEQ ID NO: 176391 - DNA, 20 bp, Artificial Sequence
  Synthetic oligonucleotide; CAG chr2 60514749 60514768 60514752 -
cattgtgttgtaaagacagt

SEQ ID NO: 176392 - DNA, 20 bp, Artificial Sequence
  Synthetic oligonucleotide; TAG chr2 60514740 60514759 60514743 -
gtaaagacagtcagaccaac

SEQ ID NO: 176393 - DNA, 20 bp, Artificial Sequence
  Synthetic oligonucleotide; AAG chr2 60514707 60514726 60514710 -
acaactctgatttttttcct

SEQ ID NO: 176394 - DNA, 20 bp, Artificial Sequence
  Synthetic oligonucleotide; GAG chr2 60514668 60514687 60514671 -
tttaattttttttttttttt

SEQ ID NO: 176395 - DNA, 20 bp, Artificial Sequence
  Synthetic oligonucleotide; TGG chr2 60514664 60514683 60514667 -
atttttttttttttttgaga

SEQ ID NO: 176396 - DNA, 20 bp, Artificial Sequence
  Synthetic oligonucleotide; GAG chr2 60514662 60514681 60514665 -
ttttttttttttttgagatg

SEQ ID NO: 176397 - DNA, 20 bp, Artificial Sequence
  Synthetic oligonucleotide; CAG chr2 60514644 60514663 60514647 -
tggagtctcgctctgtcgcc

SEQ ID NO: 176398 - DNA, 20 bp, Artificial Sequence
  Synthetic oligonucleotide; AGG chr2 60514643 60514662 60514646 -
ggagtctcgctctgtcgccc

SEQ ID NO: 176399 - DNA, 20 bp, Artificial Sequence
  Synthetic oligonucleotide; TGG chr2 60514639 60514658 60514642 -
tctcgctctgtcgcccaggc

SEQ ID NO: 176400 - DNA, 20 bp, Artificial Sequence
  Synthetic oligonucleotide; GAG chr2 60514637 60514656 60514640 -
tcgctctgtcgcccaggctg

SEQ ID NO: 176401 - DNA, 20 bp, Artificial Sequence
  Synthetic oligonucleotide; CAG chr2 60514632 60514651 60514635 -
ctgtcgcccaggctggagtg

SEQ ID NO: 176402 - DNA, 20 bp, Artificial Sequence
  Synthetic oligonucleotide; CGG chr2 60514618 60514637 60514621 -
ggagtgcagtgctacgatct

SEQ ID NO: 176403 - DNA, 20 bp, Artificial Sequence
  Synthetic oligonucleotide; CAG chr2 60514608 60514627 60514611 -
gctacgatctcggctcattg

SEQ ID NO: 176404 - DNA, 20 bp, Artificial Sequence
  Synthetic oligonucleotide; CAG chr2 60514594 60514613 60514597 -
tcattgcagcctccgcctcc

SEQ ID NO: 176405 - DNA, 20 bp, Artificial Sequence
  Synthetic oligonucleotide; AGG chr2 60514593 60514612 60514596 -
cattgcagcctccgcctccc

SEQ ID NO: 176406 - DNA, 20 bp, Artificial Sequence
  Synthetic oligonucleotide; AAG chr2 60514587 60514606 60514590 -
agcctccgcctcccaggttc

SEQ ID NO: 176407 - DNA, 20 bp, Artificial Sequence
  Synthetic oligonucleotide; CAG chr2 60514570 60514589 60514573 -
ttcaagtgattctcctgcct

SEQ ID NO: 176408 - DNA, 20 bp, Artificial Sequence
  Synthetic oligonucleotide; AAG chr2 60514561 60514580 60514564 -
ttctcctgcctcagcctccc

SEQ ID NO: 176409 - DNA, 20 bp, Artificial Sequence
  Synthetic oligonucleotide; TAG chr2 60514558 60514577 60514561 -
tcctgcctcagcctcccaag

SEQ ID NO: 176410 - DNA, 20 bp, Artificial Sequence
  Synthetic oligonucleotide; TGG chr2 60514554 60514573 60514557 -
gcctcagcctcccaagtagc

SEQ ID NO: 176411 - DNA, 20 bp, Artificial Sequence
  Synthetic oligonucleotide; GGG chr2 60514553 60514572 60514556 -
cctcagcctcccaagtagct

SEQ ID NO: 176412 - DNA, 20 bp, Artificial Sequence
  Synthetic oligonucleotide; TAG chr2 60514546 60514565 60514549 -
ctcccaagtagctgggatta

SEQ ID NO: 176413 - DNA, 20 bp, Artificial Sequence
  Synthetic oligonucleotide; AGG chr2 60514545 60514564 60514548 -
tcccaagtagctgggattat

SEQ ID NO: 176414 - DNA, 20 bp, Artificial Sequence
  Synthetic oligonucleotide; TGG chr2 60514526 60514545 60514529 -
taggtgcatgccatcacacc

SEQ ID NO: 176415 - DNA, 20 bp, Artificial Sequence
  Synthetic oligonucleotide; AAG chr2 60514496 60514515 60514499 -
tttttttttttttttttttt

SEQ ID NO: 176416 - DNA, 20 bp, Artificial Sequence
  Synthetic oligonucleotide; TAG chr2 60514493 60514512 60514496 -
tttttttttttttttttaag

SEQ ID NO: 176417 - DNA, 20 bp, Artificial Sequence
  Synthetic oligonucleotide; GAG chr2 60514491 60514510 60514494 -
tttttttttttttttaagta

SEQ ID NO: 176418 - DNA, 20 bp, Artificial Sequence
  Synthetic oligonucleotide; TGG chr2 60514487 60514506 60514490 -
tttttttttttaagtagaga

SEQ ID NO: 176419 - DNA, 20 bp, Artificial Sequence
  Synthetic oligonucleotide; GGG chr2 60514486 60514505 60514489 -
ttttttttttaagtagagat

SEQ ID NO: 176420 - DNA, 20 bp, Artificial Sequence
  Synthetic oligonucleotide; GGG chr2 60514485 60514504 60514488 -
tttttttttaagtagagatg

SEQ ID NO: 176421 - DNA, 20 bp, Artificial Sequence
  Synthetic oligonucleotide; TGG chr2 60514471 60514490 60514474 -
gagatggggtttcaccatgt

SEQ ID NO: 176422 - DNA, 20 bp, Artificial Sequence
  Synthetic oligonucleotide; TAG chr2 60514467 60514486 60514470 -
tggggtttcaccatgttggc

SEQ ID NO: 176423 - DNA, 20 bp, Artificial Sequence
  Synthetic oligonucleotide; AGG chr2 60514466 60514485 60514469 -
ggggtttcaccatgttggct

SEQ ID NO: 176424 - DNA, 20 bp, Artificial Sequence
  Synthetic oligonucleotide; TGG chr2 60514462 60514481 60514465 -
tttcaccatgttggctaggc

SEQ ID NO: 176425 - DNA, 20 bp, Artificial Sequence
  Synthetic oligonucleotide; CAG chr2 60514442 60514461 60514445 -
tggtcttgaactcctgacct

SEQ ID NO: 176426 - DNA, 20 bp, Artificial Sequence
  Synthetic oligonucleotide; AGG chr2 60514441 60514460 60514444 -
ggtcttgaactcctgacctc

SEQ ID NO: 176427 - DNA, 20 bp, Artificial Sequence
  Synthetic oligonucleotide; CGG chr2 60514424 60514443 60514427 -
ctcaggtgacccacacgcct

SEQ ID NO: 176428 - DNA, 20 bp, Artificial Sequence
  Synthetic oligonucleotide; GAG chr2 60514407 60514426 60514410 -
cctcggcctcccaaaatgct

SEQ ID NO: 176429 - DNA, 20 bp, Artificial Sequence
  Synthetic oligonucleotide; CAG chr2 60514400 60514419 60514403 -
ctcccaaaatgctgagatta

SEQ ID NO: 176430 - DNA, 20 bp, Artificial Sequence
  Synthetic oligonucleotide; AGG chr2 60514399 60514418 60514402 -
tcccaaaatgctgagattac

SEQ ID NO: 176431 - DNA, 20 bp, Artificial Sequence
  Synthetic oligonucleotide; GAG chr2 60514393 60514412 60514396 -
aatgctgagattacaggtgt

SEQ ID NO: 176432 - DNA, 20 bp, Artificial Sequence
  Synthetic oligonucleotide; TGG chr2 60514380 60514399 60514383 -
caggtgtgagccaccgcacc

SEQ ID NO: 176433 - DNA, 20 bp, Artificial Sequence
  Synthetic oligonucleotide; CAG chr2 60514360 60514379 60514363 -
tggctatttaattctatttt

SEQ ID NO: 176434 - DNA, 20 bp, Artificial Sequence
  Synthetic oligonucleotide; TGG chr2 60514356 60514375 60514359 -
tatttaattctattttcaga

SEQ ID NO: 176435 - DNA, 20 bp, Artificial Sequence
  Synthetic oligonucleotide; AAG chr2 60514343 60514362 60514346 -
tttcagatggcttgttctcc

SEQ ID NO: 176436 - DNA, 20 bp, Artificial Sequence
  Synthetic oligonucleotide; TGG chr2 60514337 60514356 60514340 -
atggcttgttctccaagtct

SEQ ID NO: 176437 - DNA, 20 bp, Artificial Sequence
  Synthetic oligonucleotide; GGG chr2 60514336 60514355 60514339 -
tggcttgttctccaagtctt

SEQ ID NO: 176438 - DNA, 20 bp, Artificial Sequence
  Synthetic oligonucleotide; CAG chr2 60514327 60514346 60514330 -
ctccaagtcttgggactgcc

SEQ ID NO: 176439 - DNA, 20 bp, Artificial Sequence
  Synthetic oligonucleotide; TGG chr2 60514321 60514340 60514324 -
gtcttgggactgcccagaaa

SEQ ID NO: 176440 - DNA, 20 bp, Artificial Sequence
  Synthetic oligonucleotide; GGG chr2 60514320 60514339 60514323 -
tcttgggactgcccagaaat

SEQ ID NO: 176441 - DNA, 20 bp, Artificial Sequence
  Synthetic oligonucleotide; TGG chr2 60514312 60514331 60514315 -
ctgcccagaaatgggttgcc

SEQ ID NO: 176442 - DNA, 20 bp, Artificial Sequence
  Synthetic oligonucleotide; TAG chr2 60514309 60514328 60514312 -
cccagaaatgggttgcctgg

SEQ ID NO: 176443 - DNA, 20 bp, Artificial Sequence
  Synthetic oligonucleotide; AGG chr2 60514308 60514327 60514311 -
ccagaaatgggttgcctggt

SEQ ID NO: 176444 - DNA, 20 bp, Artificial Sequence
  Synthetic oligonucleotide; GGG chr2 60514307 60514326 60514310 -
cagaaatgggttgcctggta

SEQ ID NO: 176445 - DNA, 20 bp, Artificial Sequence
  Synthetic oligonucleotide; TGG chr2 60514300 60514319 60514303 -
gggttgcctggtagggctca

SEQ ID NO: 176446 - DNA, 20 bp, Artificial Sequence
  Synthetic oligonucleotide; CAG chr2 60514295 60514314 60514298 -
gcctggtagggctcatggct

SEQ ID NO: 176447 - DNA, 20 bp, Artificial Sequence
  Synthetic oligonucleotide; CAG chr2 60514278 60514297 60514281 -
gctcagcactgcgatcccac

SEQ ID NO: 176448 - DNA, 20 bp, Artificial Sequence
  Synthetic oligonucleotide; TGG chr2 60514275 60514294 60514278 -
cagcactgcgatcccaccag

SEQ ID NO: 176449 - DNA, 20 bp, Artificial Sequence
  Synthetic oligonucleotide; CGG chr2 60514271 60514290 60514274 -
actgcgatcccaccagtggc

SEQ ID NO: 176450 - DNA, 20 bp, Artificial Sequence
  Synthetic oligonucleotide; GGG chr2 60514270 60514289 60514273 -
ctgcgatcccaccagtggcc

SEQ ID NO: 176451 - DNA, 20 bp, Artificial Sequence
  Synthetic oligonucleotide; GGG chr2 60514269 60514288 60514272 -
tgcgatcccaccagtggccg

SEQ ID NO: 176452 - DNA, 20 bp, Artificial Sequence
  Synthetic oligonucleotide; TAG chr2 60514259 60514278 60514262 -
ccagtggccggggtgttcct

SEQ ID NO: 176453 - DNA, 20 bp, Artificial Sequence
  Synthetic oligonucleotide; TAG chr2 60514251 60514270 60514254 -
cggggtgttccttagccttc

SEQ ID NO: 176454 - DNA, 20 bp, Artificial Sequence
  Synthetic oligonucleotide; CAG chr2 60514246 60514265 60514249 -
tgttccttagccttctagtt

SEQ ID NO: 176455 - DNA, 20 bp, Artificial Sequence
  Synthetic oligonucleotide; TGG chr2 60514240 60514259 60514243 -
ttagccttctagttcagttg

SEQ ID NO: 176456 - DNA, 20 bp, Artificial Sequence
  Synthetic oligonucleotide; TGG chr2 60514231 60514250 60514234 -
tagttcagttgtggcccttc

SEQ ID NO: 176457 - DNA, 20 bp, Artificial Sequence
  Synthetic oligonucleotide; GGG chr2 60514230 60514249 60514233 -
agttcagttgtggcccttct

SEQ ID NO: 176458 - DNA, 20 bp, Artificial Sequence
  Synthetic oligonucleotide; CAG chr2 60514214 60514233 60514217 -
ttctgggcttcctttgctac

SEQ ID NO: 176459 - DNA, 20 bp, Artificial Sequence
  Synthetic oligonucleotide; TGG chr2 60514200 60514219 60514203 -
tgctaccagtttccaccaca

SEQ ID NO: 176460 - DNA, 20 bp, Artificial Sequence
  Synthetic oligonucleotide; TGG chr2 60514196 60514215 60514199 -
accagtttccaccacatggc

SEQ ID NO: 176461 - DNA, 20 bp, Artificial Sequence
  Synthetic oligonucleotide; GAG chr2 60514194 60514213 60514197 -
cagtttccaccacatggctg

SEQ ID NO: 176462 - DNA, 20 bp, Artificial Sequence
  Synthetic oligonucleotide; AGG chr2 60514193 60514212 60514196 -
agtttccaccacatggctgg

SEQ ID NO: 176463 - DNA, 20 bp, Artificial Sequence
  Synthetic oligonucleotide; TAG chr2 60514190 60514209 60514193 -
ttccaccacatggctggagg

SEQ ID NO: 176464 - DNA, 20 bp, Artificial Sequence
  Synthetic oligonucleotide; CAG chr2 60514185 60514204 60514188 -
ccacatggctggaggtagcc

SEQ ID NO: 176465 - DNA, 20 bp, Artificial Sequence
  Synthetic oligonucleotide; TGG chr2 60514180 60514199 60514183 -
tggctggaggtagcccagcc

SEQ ID NO: 176466 - DNA, 20 bp, Artificial Sequence
  Synthetic oligonucleotide; AAG chr2 60514177 60514196 60514180 -
ctggaggtagcccagcctgg

SEQ ID NO: 176467 - DNA, 20 bp, Artificial Sequence
  Synthetic oligonucleotide; CAG chr2 60514169 60514188 60514172 -
agcccagcctggaagcctct

SEQ ID NO: 176468 - DNA, 20 bp, Artificial Sequence
  Synthetic oligonucleotide; GAG chr2 60514167 60514186 60514170 -
cccagcctggaagcctctca

SEQ ID NO: 176469 - DNA, 20 bp, Artificial Sequence
  Synthetic oligonucleotide; CAG chr2 60514161 60514180 60514164 -
ctggaagcctctcagagctc

SEQ ID NO: 176470 - DNA, 20 bp, Artificial Sequence
  Synthetic oligonucleotide; TGG chr2 60514156 60514175 60514159 -
agcctctcagagctccagcc

SEQ ID NO: 176471 - DNA, 20 bp, Artificial Sequence
  Synthetic oligonucleotide; AAG chr2 60514153 60514172 60514156 -
ctctcagagctccagcctgg

SEQ ID NO: 176472 - DNA, 20 bp, Artificial Sequence
  Synthetic oligonucleotide; CAG chr2 60514145 60514164 60514148 -
gctccagcctggaagcctct

SEQ ID NO: 176473 - DNA, 20 bp, Artificial Sequence
  Synthetic oligonucleotide; GAG chr2 60514143 60514162 60514146 -
tccagcctggaagcctctca

SEQ ID NO: 176474 - DNA, 20 bp, Artificial Sequence
  Synthetic oligonucleotide; GAG chr2 60514141 60514160 60514144 -
cagcctggaagcctctcaga

SEQ ID NO: 176475 - DNA, 20 bp, Artificial Sequence
  Synthetic oligonucleotide; TGG chr2 60514134 60514153 60514137 -
gaagcctctcagagagtgct

SEQ ID NO: 176476 - DNA, 20 bp, Artificial Sequence
  Synthetic oligonucleotide; GAG chr2 60514132 60514151 60514135 -
agcctctcagagagtgcttg

SEQ ID NO: 176477 - DNA, 20 bp, Artificial Sequence
  Synthetic oligonucleotide; TAG chr2 60514123 60514142 60514126 -
gagagtgcttggagcactgc

SEQ ID NO: 176478 - DNA, 20 bp, Artificial Sequence
  Synthetic oligonucleotide; CAG chr2 60514107 60514126 60514110 -
ctgctagctgcacgtgctct

SEQ ID NO: 176479 - DNA, 20 bp, Artificial Sequence
  Synthetic oligonucleotide; AGG chr2 60514106 60514125 60514109 -
tgctagctgcacgtgctctc

SEQ ID NO: 176480 - DNA, 20 bp, Artificial Sequence
  Synthetic oligonucleotide; AAG chr2 60514102 60514121 60514105 -
agctgcacgtgctctcagga

SEQ ID NO: 176481 - DNA, 20 bp, Artificial Sequence
  Synthetic oligonucleotide; AAG chr2 60514094 60514113 60514097 -
gtgctctcaggaaagtccac

SEQ ID NO: 176482 - DNA, 20 bp, Artificial Sequence
  Synthetic oligonucleotide; AGG chr2 60514093 60514112 60514096 -
tgctctcaggaaagtccaca

SEQ ID NO: 176483 - DNA, 20 bp, Artificial Sequence
  Synthetic oligonucleotide; GAG chr2 60514091 60514110 60514094 -
ctctcaggaaagtccacaag

SEQ ID NO: 176484 - DNA, 20 bp, Artificial Sequence
  Synthetic oligonucleotide; TGG chr2 60514087 60514106 60514090 -
caggaaagtccacaaggaga

SEQ ID NO: 176485 - DNA, 20 bp, Artificial Sequence
  Synthetic oligonucleotide; TGG chr2 60514083 60514102 60514086 -
aaagtccacaaggagatggc

SEQ ID NO: 176486 - DNA, 20 bp, Artificial Sequence
  Synthetic oligonucleotide; TGG chr2 60514078 60514097 60514081 -
ccacaaggagatggctggtg

SEQ ID NO: 176487 - DNA, 20 bp, Artificial Sequence
  Synthetic oligonucleotide; CAG chr2 60514073 60514092 60514076 -
aggagatggctggtgtggct

SEQ ID NO: 176488 - DNA, 20 bp, Artificial Sequence
  Synthetic oligonucleotide; GAG chr2 60514071 60514090 60514074 -
gagatggctggtgtggctca

SEQ ID NO: 176489 - DNA, 20 bp, Artificial Sequence
  Synthetic oligonucleotide; CAG chr2 60514052 60514071 60514055 -
agagtccttgtgtgctgcct

SEQ ID NO: 176490 - DNA, 20 bp, Artificial Sequence
  Synthetic oligonucleotide; CAG chr2 60514042 60514061 60514045 -
tgtgctgcctcagcccatgc

SEQ ID NO: 176491 - DNA, 20 bp, Artificial Sequence
  Synthetic oligonucleotide; AGG chr2 60514041 60514060 60514044 -
gtgctgcctcagcccatgcc

SEQ ID NO: 176492 - DNA, 20 bp, Artificial Sequence
  Synthetic oligonucleotide; TGG chr2 60514031 60514050 60514034 -
agcccatgccaggccacctg

SEQ ID NO: 176493 - DNA, 20 bp, Artificial Sequence
  Synthetic oligonucleotide; AAG chr2 60514016 60514035 60514019 -
acctgtggctgtctgccctc

SEQ ID NO: 176494 - DNA, 20 bp, Artificial Sequence
  Synthetic oligonucleotide; GAG chr2 60514000 60514019 60514003 -
cctcaagtctgtccttctct

SEQ ID NO: 176495 - DNA, 20 bp, Artificial Sequence
  Synthetic oligonucleotide; AGG chr2 60513999 60514018 60514002 -
ctcaagtctgtccttctctg

SEQ ID NO: 176496 - DNA, 20 bp, Artificial Sequence
  Synthetic oligonucleotide; TAG chr2 60513993 60514012 60513996 -
tctgtccttctctgaggatt

SEQ ID NO: 176497 - DNA, 20 bp, Artificial Sequence
  Synthetic oligonucleotide; AGG chr2 60513992 60514011 60513995 -
ctgtccttctctgaggattt

SEQ ID NO: 176498 - DNA, 20 bp, Artificial Sequence
  Synthetic oligonucleotide; TAG chr2 60513979 60513998 60513982 -
aggatttaggactgtgaacc

SEQ ID NO: 176499 - DNA, 20 bp, Artificial Sequence
  Synthetic oligonucleotide; GAG chr2 60513977 60513996 60513980 -
gatttaggactgtgaaccta

SEQ ID NO: 176500 - DNA, 20 bp, Artificial Sequence
  Synthetic oligonucleotide; AAG chr2 60513968 60513987 60513971 -
ctgtgaacctagagaattca

SEQ ID NO: 176501 - DNA, 20 bp, Artificial Sequence
  Synthetic oligonucleotide; TAG chr2 60513965 60513984 60513968 -
tgaacctagagaattcaaag

SEQ ID NO: 176502 - DNA, 20 bp, Artificial Sequence
  Synthetic oligonucleotide; TGG chr2 60513962 60513981 60513965 -
acctagagaattcaaagtag

SEQ ID NO: 176503 - DNA, 20 bp, Artificial Sequence
  Synthetic oligonucleotide; TAG chr2 60513956 60513975 60513959 -
agaattcaaagtagtggaac

SEQ ID NO: 176504 - DNA, 20 bp, Artificial Sequence
  Synthetic oligonucleotide; CAG chr2 60513949 60513968 60513952 -
aaagtagtggaactagaatc

SEQ ID NO: 176505 - DNA, 20 bp, Artificial Sequence
  Synthetic oligonucleotide; AGG chr2 60513948 60513967 60513951 -
aagtagtggaactagaatcc

SEQ ID NO: 176506 - DNA, 20 bp, Artificial Sequence
  Synthetic oligonucleotide; CAG chr2 60513932 60513951 60513935 -
atccaggtctcgactcaatc

SEQ ID NO: 176507 - DNA, 20 bp, Artificial Sequence
  Synthetic oligonucleotide; AGG chr2 60513931 60513950 60513934 -
tccaggtctcgactcaatcc

SEQ ID NO: 176508 - DNA, 20 bp, Artificial Sequence
  Synthetic oligonucleotide; GGG chr2 60513930 60513949 60513933 -
ccaggtctcgactcaatcca

SEQ ID NO: 176509 - DNA, 20 bp, Artificial Sequence
  Synthetic oligonucleotide; GAG chr2 60513928 60513947 60513931 -
aggtctcgactcaatccagg

SEQ ID NO: 176510 - DNA, 20 bp, Artificial Sequence
  Synthetic oligonucleotide; AAG chr2 60513912 60513931 60513915 -
cagggagttttgctcaccac

SEQ ID NO: 176511 - DNA, 20 bp, Artificial Sequence
  Synthetic oligonucleotide; CAG chr2 60513908 60513927 60513911 -
gagttttgctcaccacaagc

SEQ ID NO: 176512 - DNA, 20 bp, Artificial Sequence
  Synthetic oligonucleotide; AGG chr2 60513907 60513926 60513910 -
agttttgctcaccacaagcc

SEQ ID NO: 176513 - DNA, 20 bp, Artificial Sequence
  Synthetic oligonucleotide; CAG chr2 60513902 60513921 60513905 -
tgctcaccacaagccaggaa

SEQ ID NO: 176514 - DNA, 20 bp, Artificial Sequence
  Synthetic oligonucleotide; TGG chr2 60513889 60513908 60513892 -
ccaggaacagcttctcttca

SEQ ID NO: 176515 - DNA, 20 bp, Artificial Sequence
  Synthetic oligonucleotide; GAG chr2 60513887 60513906 60513890 -
aggaacagcttctcttcatg

SEQ ID NO: 176516 - DNA, 20 bp, Artificial Sequence
  Synthetic oligonucleotide; AGG chr2 60513886 60513905 60513889 -
ggaacagcttctcttcatgg

SEQ ID NO: 176517 - DNA, 20 bp, Artificial Sequence
  Synthetic oligonucleotide; TGG chr2 60513875 60513894 60513878 -
tcttcatggaggtgcctgtc

SEQ ID NO: 176518 - DNA, 20 bp, Artificial Sequence
  Synthetic oligonucleotide; AAG chr2 60513872 60513891 60513875 -
tcatggaggtgcctgtctgg

SEQ ID NO: 176519 - DNA, 20 bp, Artificial Sequence
  Synthetic oligonucleotide; AGG chr2 60513871 60513890 60513874 -
catggaggtgcctgtctgga

SEQ ID NO: 176520 - DNA, 20 bp, Artificial Sequence
  Synthetic oligonucleotide; CAG chr2 60513868 60513887 60513871 -
ggaggtgcctgtctggaagg

SEQ ID NO: 176521 - DNA, 20 bp, Artificial Sequence
  Synthetic oligonucleotide; GAG chr2 60513866 60513885 60513869 -
aggtgcctgtctggaaggca

SEQ ID NO: 176522 - DNA, 20 bp, Artificial Sequence
  Synthetic oligonucleotide; TGG chr2 60513857 60513876 60513860 -
tctggaaggcagagaatctc

SEQ ID NO: 176523 - DNA, 20 bp, Artificial Sequence
  Synthetic oligonucleotide; GAG chr2 60513848 60513867 60513851 -
cagagaatctctggcttgtt

SEQ ID NO: 176524 - DNA, 20 bp, Artificial Sequence
  Synthetic oligonucleotide; AAG chr2 60513845 60513864 60513848 -
agaatctctggcttgttgag

SEQ ID NO: 176525 - DNA, 20 bp, Artificial Sequence
  Synthetic oligonucleotide; GAG chr2 60513843 60513862 60513846 -
aatctctggcttgttgagaa

SEQ ID NO: 176526 - DNA, 20 bp, Artificial Sequence
  Synthetic oligonucleotide; GAG chr2 60513841 60513860 60513844 -
tctctggcttgttgagaaga

SEQ ID NO: 176527 - DNA, 20 bp, Artificial Sequence
  Synthetic oligonucleotide; GAG chr2 60513839 60513858 60513842 -
tctggcttgttgagaagaga

SEQ ID NO: 176528 - DNA, 20 bp, Artificial Sequence
  Synthetic oligonucleotide; CAG chr2 60513827 60513846 60513830 -
agaagagagagtctgccctt

SEQ ID NO: 176529 - DNA, 20 bp, Artificial Sequence
  Synthetic oligonucleotide; AAG chr2 60513819 60513838 60513822 -
gagtctgcccttcagactgc

SEQ ID NO: 176530 - DNA, 20 bp, Artificial Sequence
  Synthetic oligonucleotide; AGG chr2 60513818 60513837 60513821 -
agtctgcccttcagactgca

SEQ ID NO: 176531 - DNA, 20 bp, Artificial Sequence
  Synthetic oligonucleotide; TAG chr2 60513804 60513823 60513807 -
actgcaaggtgttcactgca

SEQ ID NO: 176532 - DNA, 20 bp, Artificial Sequence
  Synthetic oligonucleotide; AGG chr2 60513803 60513822 60513806 -
ctgcaaggtgttcactgcat

SEQ ID NO: 176533 - DNA, 20 bp, Artificial Sequence
  Synthetic oligonucleotide; TAG chr2 60513792 60513811 60513795 -
tcactgcataggacccttcg

SEQ ID NO: 176534 - DNA, 20 bp, Artificial Sequence
  Synthetic oligonucleotide; AGG chr2 60513791 60513810 60513794 -
cactgcataggacccttcgt

SEQ ID NO: 176535 - DNA, 20 bp, Artificial Sequence
  Synthetic oligonucleotide; CAG chr2 60513780 60513799 60513783 -
acccttcgtaggtgctgacc

SEQ ID NO: 176536 - DNA, 20 bp, Artificial Sequence
  Synthetic oligonucleotide; CAG chr2 60513770 60513789 60513773 -
ggtgctgacccagctgtgcc

SEQ ID NO: 176537 - DNA, 20 bp, Artificial Sequence
  Synthetic oligonucleotide; TAG chr2 60513764 60513783 60513767 -
gacccagctgtgcccagtgc

SEQ ID NO: 176538 - DNA, 20 bp, Artificial Sequence
  Synthetic oligonucleotide; GAG chr2 60513762 60513781 60513765 -
cccagctgtgcccagtgcta

SEQ ID NO: 176539 - DNA, 20 bp, Artificial Sequence
  Synthetic oligonucleotide; TAG chr2 60513758 60513777 60513761 -
gctgtgcccagtgctagagc

SEQ ID NO: 176540 - DNA, 20 bp, Artificial Sequence
  Synthetic oligonucleotide; AGG chr2 60513757 60513776 60513760 -
ctgtgcccagtgctagagct

SEQ ID NO: 176541 - DNA, 20 bp, Artificial Sequence
  Synthetic oligonucleotide; CAG chr2 60513751 60513770 60513754 -
ccagtgctagagctaggact

SEQ ID NO: 176542 - DNA, 20 bp, Artificial Sequence
  Synthetic oligonucleotide; CAG chr2 60513737 60513756 60513740 -
aggactcagttctattttcc

SEQ ID NO: 176543 - DNA, 20 bp, Artificial Sequence
  Synthetic oligonucleotide; GAG chr2 60513735 60513754 60513738 -
gactcagttctattttccca

SEQ ID NO: 176544 - DNA, 20 bp, Artificial Sequence
  Synthetic oligonucleotide; GAG chr2 60513733 60513752 60513736 -
ctcagttctattttcccaga

SEQ ID NO: 176545 - DNA, 20 bp, Artificial Sequence
  Synthetic oligonucleotide; TGG chr2 60513730 60513749 60513733 -
agttctattttcccagagag

SEQ ID NO: 176546 - DNA, 20 bp, Artificial Sequence
  Synthetic oligonucleotide; TGG chr2 60513722 60513741 60513725 -
tttcccagagagtggtgtga

SEQ ID NO: 176547 - DNA, 20 bp, Artificial Sequence
  Synthetic oligonucleotide; GGG chr2 60513721 60513740 60513724 -
ttcccagagagtggtgtgat

SEQ ID NO: 176548 - DNA, 20 bp, Artificial Sequence
  Synthetic oligonucleotide; GAG chr2 60513719 60513738 60513722 -
cccagagagtggtgtgatgg

SEQ ID NO: 176549 - DNA, 20 bp, Artificial Sequence
  Synthetic oligonucleotide; AGG chr2 60513718 60513737 60513721 -
ccagagagtggtgtgatggg

SEQ ID NO: 176550 - DNA, 20 bp, Artificial Sequence
  Synthetic oligonucleotide; CAG chr2 60513696 60513715 60513699 -
gctatttctttttctttttt

SEQ ID NO: 176551 - DNA, 20 bp, Artificial Sequence
  Synthetic oligonucleotide; CAG chr2 60513686 60513705 60513689 -
tttcttttttcagtcctgat

SEQ ID NO: 176552 - DNA, 20 bp, Artificial Sequence
  Synthetic oligonucleotide; AGG chr2 60513685 60513704 60513688 -
ttcttttttcagtcctgatc

SEQ ID NO: 176553 - DNA, 20 bp, Artificial Sequence
  Synthetic oligonucleotide; GGG chr2 60513684 60513703 60513687 -
tcttttttcagtcctgatca

SEQ ID NO: 176554 - DNA, 20 bp, Artificial Sequence
  Synthetic oligonucleotide; GAG chr2 60513679 60513698 60513682 -
tttcagtcctgatcagggat

SEQ ID NO: 176555 - DNA, 20 bp, Artificial Sequence
  Synthetic oligonucleotide; TGG chr2 60513666 60513685 60513669 -
cagggatgagtccgtgctgt

SEQ ID NO: 176556 - DNA, 20 bp, Artificial Sequence
  Synthetic oligonucleotide; GGG chr2 60513665 60513684 60513668 -
agggatgagtccgtgctgtt

SEQ ID NO: 176557 - DNA, 20 bp, Artificial Sequence
  Synthetic oligonucleotide; TAG chr2 60513647 60513666 60513650 -
ttgggtttattcatttactt

SEQ ID NO: 176558 - DNA, 20 bp, Artificial Sequence
  Synthetic oligonucleotide; GAG chr2 60513639 60513658 60513642 -
attcatttactttagcgtgt

SEQ ID NO: 176559 - DNA, 20 bp, Artificial Sequence
  Synthetic oligonucleotide; TGG chr2 60513636 60513655 60513639 -
catttactttagcgtgtgag

SEQ ID NO: 176560 - DNA, 20 bp, Artificial Sequence
  Synthetic oligonucleotide; GGG chr2 60513635 60513654 60513638 -
atttactttagcgtgtgagt

SEQ ID NO: 176561 - DNA, 20 bp, Artificial Sequence
  Synthetic oligonucleotide; GGG chr2 60513634 60513653 60513637 -
tttactttagcgtgtgagtg

SEQ ID NO: 176562 - DNA, 20 bp, Artificial Sequence
  Synthetic oligonucleotide; GAG chr2 60513632 60513651 60513635 -
tactttagcgtgtgagtggg

SEQ ID NO: 176563 - DNA, 20 bp, Artificial Sequence
  Synthetic oligonucleotide; TGG chr2 60513628 60513647 60513631 -
ttagcgtgtgagtggggaga

SEQ ID NO: 176564 - DNA, 20 bp, Artificial Sequence
  Synthetic oligonucleotide; TAG chr2 60513623 60513642 60513626 -
gtgtgagtggggagatggat

SEQ ID NO: 176565 - DNA, 20 bp, Artificial Sequence
  Synthetic oligonucleotide; AGG chr2 60513622 60513641 60513625 -
tgtgagtggggagatggatt

SEQ ID NO: 176566 - DNA, 20 bp, Artificial Sequence
  Synthetic oligonucleotide; CAG chr2 60513619 60513638 60513622 -
gagtggggagatggattagg

SEQ ID NO: 176567 - DNA, 20 bp, Artificial Sequence
  Synthetic oligonucleotide; CAG chr2 60513616 60513635 60513619 -
tggggagatggattaggcag

SEQ ID NO: 176568 - DNA, 20 bp, Artificial Sequence
  Synthetic oligonucleotide; AGG chr2 60513615 60513634 60513618 -
ggggagatggattaggcagc

SEQ ID NO: 176569 - DNA, 20 bp, Artificial Sequence
  Synthetic oligonucleotide; TGG chr2 60513608 60513627 60513611 -
tggattaggcagcaggccct

SEQ ID NO: 176570 - DNA, 20 bp, Artificial Sequence
  Synthetic oligonucleotide; AAG chr2 60513605 60513624 60513608 -
attaggcagcaggcccttgg

SEQ ID NO: 176571 - DNA, 20 bp, Artificial Sequence
  Synthetic oligonucleotide; AGG chr2 60513604 60513623 60513607 -
ttaggcagcaggcccttgga

SEQ ID NO: 176572 - DNA, 20 bp, Artificial Sequence
  Synthetic oligonucleotide; GGG chr2 60513603 60513622 60513606 -
taggcagcaggcccttggaa

SEQ ID NO: 176573 - DNA, 20 bp, Artificial Sequence
  Synthetic oligonucleotide; TGG chr2 60513600 60513619 60513603 -
gcagcaggcccttggaaggg

SEQ ID NO: 176574 - DNA, 20 bp, Artificial Sequence
  Synthetic oligonucleotide; GGG chr2 60513599 60513618 60513602 -
cagcaggcccttggaagggt

SEQ ID NO: 176575 - DNA, 20 bp, Artificial Sequence
  Synthetic oligonucleotide; AAG chr2 60513596 60513615 60513599 -
caggcccttggaagggtggg

SEQ ID NO: 176576 - DNA, 20 bp, Artificial Sequence
  Synthetic oligonucleotide; CAG chr2 60513590 60513609 60513593 -
cttggaagggtgggaagatt

SEQ ID NO: 176577 - DNA, 20 bp, Artificial Sequence
  Synthetic oligonucleotide; AAG chr2 60513587 60513606 60513590 -
ggaagggtgggaagattcag

SEQ ID NO: 176578 - DNA, 20 bp, Artificial Sequence
  Synthetic oligonucleotide; GAG chr2 60513585 60513604 60513588 -
aagggtgggaagattcagaa

SEQ ID NO: 176579 - DNA, 20 bp, Artificial Sequence
  Synthetic oligonucleotide; GAG chr2 60513583 60513602 60513586 -
gggtgggaagattcagaaga

SEQ ID NO: 176580 - DNA, 20 bp, Artificial Sequence
  Synthetic oligonucleotide; GAG chr2 60513581 60513600 60513584 -
gtgggaagattcagaagaga

SEQ ID NO: 176581 - DNA, 20 bp, Artificial Sequence
  Synthetic oligonucleotide; AGG chr2 60513580 60513599 60513583 -
tgggaagattcagaagagag

SEQ ID NO: 176582 - DNA, 20 bp, Artificial Sequence
  Synthetic oligonucleotide; GGG chr2 60513579 60513598 60513582 -
gggaagattcagaagagaga

SEQ ID NO: 176583 - DNA, 20 bp, Artificial Sequence
  Synthetic oligonucleotide; CAG chr2 60513576 60513595 60513579 -
aagattcagaagagagaggg

SEQ ID NO: 176584 - DNA, 20 bp, Artificial Sequence
  Synthetic oligonucleotide; AGG chr2 60513575 60513594 60513578 -
agattcagaagagagagggc

SEQ ID NO: 176585 - DNA, 20 bp, Artificial Sequence
  Synthetic oligonucleotide; TGG chr2 60513570 60513589 60513573 -
cagaagagagagggcaggac

SEQ ID NO: 176586 - DNA, 20 bp, Artificial Sequence
  Synthetic oligonucleotide; GGG chr2 60513569 60513588 60513572 -
agaagagagagggcaggact

SEQ ID NO: 176587 - DNA, 20 bp, Artificial Sequence
  Synthetic oligonucleotide; AAG chr2 60513566 60513585 60513569 -
agagagagggcaggactggg

SEQ ID NO: 176588 - DNA, 20 bp, Artificial Sequence
  Synthetic oligonucleotide; CAG chr2 60513560 60513579 60513563 -
agggcaggactgggaagatc

SEQ ID NO: 176589 - DNA, 20 bp, Artificial Sequence
  Synthetic oligonucleotide; CAG chr2 60513556 60513575 60513559 -
caggactgggaagatccaga

SEQ ID NO: 176590 - DNA, 20 bp, Artificial Sequence
  Synthetic oligonucleotide; AGG chr2 60513555 60513574 60513558 -
aggactgggaagatccagac

SEQ ID NO: 176591 - DNA, 20 bp, Artificial Sequence
  Synthetic oligonucleotide; AAG chr2 60513547 60513566 60513550 -
gaagatccagacaggacatg

SEQ ID NO: 176592 - DNA, 20 bp, Artificial Sequence
  Synthetic oligonucleotide; AAG chr2 60513532 60513551 60513535 -
acatgaagatttgctccaca

SEQ ID NO: 176593 - DNA, 20 bp, Artificial Sequence
  Synthetic oligonucleotide; GAG chr2 60513530 60513549 60513533 -
atgaagatttgctccacaaa

SEQ ID NO: 176594 - DNA, 20 bp, Artificial Sequence
  Synthetic oligonucleotide; GAG chr2 60513528 60513547 60513531 -
gaagatttgctccacaaaga

SEQ ID NO: 176595 - DNA, 20 bp, Artificial Sequence
  Synthetic oligonucleotide; AAG chr2 60513525 60513544 60513528 -
gatttgctccacaaagagag

SEQ ID NO: 176596 - DNA, 20 bp, Artificial Sequence
  Synthetic oligonucleotide; CAG chr2 60513522 60513541 60513525 -
ttgctccacaaagagagaag

SEQ ID NO: 176597 - DNA, 20 bp, Artificial Sequence
  Synthetic oligonucleotide; CAG chr2 60513519 60513538 60513522 -
ctccacaaagagagaagcag

SEQ ID NO: 176598 - DNA, 20 bp, Artificial Sequence
  Synthetic oligonucleotide; AGG chr2 60513518 60513537 60513521 -
tccacaaagagagaagcagc

SEQ ID NO: 176599 - DNA, 20 bp, Artificial Sequence
  Synthetic oligonucleotide; GAG chr2 60513516 60513535 60513519 -
cacaaagagagaagcagcag

SEQ ID NO: 176600 - DNA, 20 bp, Artificial Sequence
  Synthetic oligonucleotide; TGG chr2 60513510 60513529 60513513 -
gagagaagcagcaggagttc

SEQ ID NO: 176601 - DNA, 20 bp, Artificial Sequence
  Synthetic oligonucleotide; TAG chr2 60513506 60513525 60513509 -
gaagcagcaggagttctggc

SEQ ID NO: 176602 - DNA, 20 bp, Artificial Sequence
  Synthetic oligonucleotide; GAG chr2 60513504 60513523 60513507 -
agcagcaggagttctggcta

SEQ ID NO: 176603 - DNA, 20 bp, Artificial Sequence
  Synthetic oligonucleotide; AGG chr2 60513503 60513522 60513506 -
gcagcaggagttctggctag

SEQ ID NO: 176604 - DNA, 20 bp, Artificial Sequence
  Synthetic oligonucleotide; AAG chr2 60513476 60513495 60513479 -
cccaacacccacacctgcca

SEQ ID NO: 176605 - DNA, 20 bp, Artificial Sequence
  Synthetic oligonucleotide; AGG chr2 60513475 60513494 60513478 -
ccaacacccacacctgccaa

SEQ ID NO: 176606 - DNA, 20 bp, Artificial Sequence
  Synthetic oligonucleotide; GGG chr2 60513474 60513493 60513477 -
caacacccacacctgccaaa

SEQ ID NO: 176607 - DNA, 20 bp, Artificial Sequence
  Synthetic oligonucleotide; GGG chr2 60513473 60513492 60513476 -
aacacccacacctgccaaag

SEQ ID NO: 176608 - DNA, 20 bp, Artificial Sequence
  Synthetic oligonucleotide; TGG chr2 60513464 60513483 60513467 -
acctgccaaaggggttccca

SEQ ID NO: 176609 - DNA, 20 bp, Artificial Sequence
  Synthetic oligonucleotide; GGG chr2 60513463 60513482 60513466 -
cctgccaaaggggttcccat

SEQ ID NO: 176610 - DNA, 20 bp, Artificial Sequence
  Synthetic oligonucleotide; GGG chr2 60513462 60513481 60513465 -
ctgccaaaggggttcccatg

SEQ ID NO: 176611 - DNA, 20 bp, Artificial Sequence
  Synthetic oligonucleotide; TGG chr2 60513459 60513478 60513462 -
ccaaaggggttcccatgggg

SEQ ID NO: 176612 - DNA, 20 bp, Artificial Sequence
  Synthetic oligonucleotide; TGG chr2 60513455 60513474 60513458 -
aggggttcccatggggtggc

SEQ ID NO: 176613 - DNA, 20 bp, Artificial Sequence
  Synthetic oligonucleotide; GAG chr2 60513449 60513468 60513452 -
tcccatggggtggctggctt

SEQ ID NO: 176614 - DNA, 20 bp, Artificial Sequence
  Synthetic oligonucleotide; AGG chr2 60513448 60513467 60513451 -
cccatggggtggctggcttg

SEQ ID NO: 176615 - DNA, 20 bp, Artificial Sequence
  Synthetic oligonucleotide; GGG chr2 60513447 60513466 60513450 -
ccatggggtggctggcttga

SEQ ID NO: 176616 - DNA, 20 bp, Artificial Sequence
  Synthetic oligonucleotide; GGG chr2 60513446 60513465 60513449 -
catggggtggctggcttgag

SEQ ID NO: 176617 - DNA, 20 bp, Artificial Sequence
  Synthetic oligonucleotide; TGG chr2 60513440 60513459 60513443 -
gtggctggcttgaggggatc

SEQ ID NO: 176618 - DNA, 20 bp, Artificial Sequence
  Synthetic oligonucleotide; GGG chr2 60513439 60513458 60513442 -
tggctggcttgaggggatct

SEQ ID NO: 176619 - DNA, 20 bp, Artificial Sequence
  Synthetic oligonucleotide; TGG chr2 60513433 60513452 60513436 -
gcttgaggggatctgggcgc

SEQ ID NO: 176620 - DNA, 20 bp, Artificial Sequence
  Synthetic oligonucleotide; TGG chr2 60513421 60513440 60513424 -
ctgggcgctggtttctgctg

SEQ ID NO: 176621 - DNA, 20 bp, Artificial Sequence
  Synthetic oligonucleotide; CAG chr2 60513417 60513436 60513420 -
gcgctggtttctgctgtgga

SEQ ID NO: 176622 - DNA, 20 bp, Artificial Sequence
  Synthetic oligonucleotide; AAG chr2 60513410 60513429 60513413 -
tttctgctgtggacagcctc

SEQ ID NO: 176623 - DNA, 20 bp, Artificial Sequence
  Synthetic oligonucleotide; TGG chr2 60513407 60513426 60513410 -
ctgctgtggacagcctcaag

SEQ ID NO: 176624 - DNA, 20 bp, Artificial Sequence
  Synthetic oligonucleotide; GGG chr2 60513406 60513425 60513409 -
tgctgtggacagcctcaagt

SEQ ID NO: 176625 - DNA, 20 bp, Artificial Sequence
  Synthetic oligonucleotide; GGG chr2 60513405 60513424 60513408 -
gctgtggacagcctcaagtg

SEQ ID NO: 176626 - DNA, 20 bp, Artificial Sequence
  Synthetic oligonucleotide; TGG chr2 60513400 60513419 60513403 -
ggacagcctcaagtggggcg

SEQ ID NO: 176627 - DNA, 20 bp, Artificial Sequence
  Synthetic oligonucleotide; GAG chr2 60513398 60513417 60513401 -
acagcctcaagtggggcgtg

SEQ ID NO: 176628 - DNA, 20 bp, Artificial Sequence
  Synthetic oligonucleotide; AGG chr2 60513397 60513416 60513400 -
cagcctcaagtggggcgtgg

SEQ ID NO: 176629 - DNA, 20 bp, Artificial Sequence
  Synthetic oligonucleotide; CAG chr2 60513394 60513413 60513397 -
cctcaagtggggcgtggagg

SEQ ID NO: 176630 - DNA, 20 bp, Artificial Sequence
  Synthetic oligonucleotide; CAG chr2 60513385 60513404 60513388 -
gggcgtggaggcagcatctc

SEQ ID NO: 176631 - DNA, 20 bp, Artificial Sequence
  Synthetic oligonucleotide; AAG chr2 60513382 60513401 60513385 -
cgtggaggcagcatctccag

SEQ ID NO: 176632 - DNA, 20 bp, Artificial Sequence
  Synthetic oligonucleotide; CGG chr2 60513375 60513394 60513378 -
gcagcatctccagaagcacc

SEQ ID NO: 176633 - DNA, 20 bp, Artificial Sequence
  Synthetic oligonucleotide; CAG chr2 60513372 60513391 60513375 -
gcatctccagaagcacccgg

SEQ ID NO: 176634 - DNA, 20 bp, Artificial Sequence
  Synthetic oligonucleotide; TGG chr2 60513368 60513387 60513371 -
ctccagaagcacccggcaga

SEQ ID NO: 176635 - DNA, 20 bp, Artificial Sequence
  Synthetic oligonucleotide; GAG chr2 60513360 60513379 60513363 -
gcacccggcagatggctcct

SEQ ID NO: 176636 - DNA, 20 bp, Artificial Sequence
  Synthetic oligonucleotide; AGG chr2 60513359 60513378 60513362 -
cacccggcagatggctcctg

SEQ ID NO: 176637 - DNA, 20 bp, Artificial Sequence
  Synthetic oligonucleotide; GGG chr2 60513358 60513377 60513361 -
acccggcagatggctcctga

SEQ ID NO: 176638 - DNA, 20 bp, Artificial Sequence
  Synthetic oligonucleotide; GAG chr2 60513356 60513375 60513359 -
ccggcagatggctcctgagg

SEQ ID NO: 176639 - DNA, 20 bp, Artificial Sequence
  Synthetic oligonucleotide; CAG chr2 60513353 60513372 60513356 -
gcagatggctcctgagggag

SEQ ID NO: 176640 - DNA, 20 bp, Artificial Sequence
  Synthetic oligonucleotide; AGG chr2 60513352 60513371 60513355 -
cagatggctcctgagggagc

SEQ ID NO: 176641 - DNA, 20 bp, Artificial Sequence
  Synthetic oligonucleotide; GGG chr2 60513351 60513370 60513354 -
agatggctcctgagggagca

SEQ ID NO: 176642 - DNA, 20 bp, Artificial Sequence
  Synthetic oligonucleotide; TAG chr2 60513340 60513359 60513343 -
gagggagcagggactccttc

SEQ ID NO: 176643 - DNA, 20 bp, Artificial Sequence
  Synthetic oligonucleotide; TGG chr2 60513328 60513347 60513331 -
actccttctagtgccactcc

SEQ ID NO: 176644 - DNA, 20 bp, Artificial Sequence
  Synthetic oligonucleotide; GGG chr2 60513327 60513346 60513330 -
ctccttctagtgccactcct

SEQ ID NO: 176645 - DNA, 20 bp, Artificial Sequence
  Synthetic oligonucleotide; TAG chr2 60513291 60513310 60513294 -
tcccctccttgtctcatatt

SEQ ID NO: 176646 - DNA, 20 bp, Artificial Sequence
  Synthetic oligonucleotide; TGG chr2 60513283 60513302 60513286 -
ttgtctcatatttagcatct

SEQ ID NO: 176647 - DNA, 20 bp, Artificial Sequence
  Synthetic oligonucleotide; GAG chr2 60513281 60513300 60513284 -
gtctcatatttagcatcttg

SEQ ID NO: 176648 - DNA, 20 bp, Artificial Sequence
  Synthetic oligonucleotide; CAG chr2 60513272 60513291 60513275 -
ttagcatcttggagccgtgt

SEQ ID NO: 176649 - DNA, 20 bp, Artificial Sequence
  Synthetic oligonucleotide; CAG chr2 60513266 60513285 60513269 -
tcttggagccgtgtcagctg

SEQ ID NO: 176650 - DNA, 20 bp, Artificial Sequence
  Synthetic oligonucleotide; GAG chr2 60513264 60513283 60513267 -
ttggagccgtgtcagctgca

SEQ ID NO: 176651 - DNA, 20 bp, Artificial Sequence
  Synthetic oligonucleotide; TGG chr2 60513259 60513278 60513262 -
gccgtgtcagctgcagagac

SEQ ID NO: 176652 - DNA, 20 bp, Artificial Sequence
  Synthetic oligonucleotide; GAG chr2 60513257 60513276 60513260 -
cgtgtcagctgcagagactg

SEQ ID NO: 176653 - DNA, 20 bp, Artificial Sequence
  Synthetic oligonucleotide; CGG chr2 60513252 60513271 60513255 -
cagctgcagagactggagtc

SEQ ID NO: 176654 - DNA, 20 bp, Artificial Sequence
  Synthetic oligonucleotide; GGG chr2 60513251 60513270 60513254 -
agctgcagagactggagtcc

SEQ ID NO: 176655 - DNA, 20 bp, Artificial Sequence
  Synthetic oligonucleotide; GGG chr2 60513250 60513269 60513253 -
gctgcagagactggagtccg

SEQ ID NO: 176656 - DNA, 20 bp, Artificial Sequence
  Synthetic oligonucleotide; TGG chr2 60513242 60513261 60513245 -
gactggagtccggggcatga

SEQ ID NO: 176657 - DNA, 20 bp, Artificial Sequence
  Synthetic oligonucleotide; GGG chr2 60513241 60513260 60513244 -
actggagtccggggcatgat

SEQ ID NO: 176658 - DNA, 20 bp, Artificial Sequence
  Synthetic oligonucleotide; GGG chr2 60513240 60513259 60513243 -
ctggagtccggggcatgatg

SEQ ID NO: 176659 - DNA, 20 bp, Artificial Sequence
  Synthetic oligonucleotide; TAG chr2 60513223 60513242 60513226 -
atggggatgtacctgaaacc

SEQ ID NO: 176660 - DNA, 20 bp, Artificial Sequence
  Synthetic oligonucleotide; GAG chr2 60513219 60513238 60513222 -
ggatgtacctgaaacctagt

SEQ ID NO: 176661 - DNA, 20 bp, Artificial Sequence
  Synthetic oligonucleotide; GAG chr2 60513217 60513236 60513220 -
atgtacctgaaacctagtga

SEQ ID NO: 176662 - DNA, 20 bp, Artificial Sequence
  Synthetic oligonucleotide; TGG chr2 60513202 60513221 60513205 -
agtgagagtcatcctgactc

SEQ ID NO: 176663 - DNA, 20 bp, Artificial Sequence
  Synthetic oligonucleotide; GGG chr2 60513201 60513220 60513204 -
gtgagagtcatcctgactct

SEQ ID NO: 176664 - DNA, 20 bp, Artificial Sequence
  Synthetic oligonucleotide; GGG chr2 60513200 60513219 60513203 -
tgagagtcatcctgactctg

SEQ ID NO: 176665 - DNA, 20 bp, Artificial Sequence
  Synthetic oligonucleotide; AAG chr2 60513197 60513216 60513200 -
gagtcatcctgactctgggg

SEQ ID NO: 176666 - DNA, 20 bp, Artificial Sequence
  Synthetic oligonucleotide; GAG chr2 60513195 60513214 60513198 -
gtcatcctgactctggggaa

SEQ ID NO: 176667 - DNA, 20 bp, Artificial Sequence
  Synthetic oligonucleotide; AAG chr2 60513185 60513204 60513188 -
ctctggggaagagccgctca

SEQ ID NO: 176668 - DNA, 20 bp, Artificial Sequence
  Synthetic oligonucleotide; GAG chr2 60513180 60513199 60513183 -
gggaagagccgctcaaagat

SEQ ID NO: 176669 - DNA, 20 bp, Artificial Sequence
  Synthetic oligonucleotide; AAG chr2 60513176 60513195 60513179 -
agagccgctcaaagatgaga

SEQ ID NO: 176670 - DNA, 20 bp, Artificial Sequence
  Synthetic oligonucleotide; AAG chr2 60513170 60513189 60513173 -
gctcaaagatgagaaagata

SEQ ID NO: 176671 - DNA, 20 bp, Artificial Sequence
  Synthetic oligonucleotide; CAG chr2 60513143 60513162 60513146 -
ttgccacccccaacccctca

SEQ ID NO: 176672 - DNA, 20 bp, Artificial Sequence
  Synthetic oligonucleotide; AGG chr2 60513142 60513161 60513145 -
tgccacccccaacccctcac

SEQ ID NO: 176673 - DNA, 20 bp, Artificial Sequence
  Synthetic oligonucleotide; TAG chr2 60513138 60513157 60513141 -
acccccaacccctcacaggc

SEQ ID NO: 176674 - DNA, 20 bp, Artificial Sequence
  Synthetic oligonucleotide; TGG chr2 60513127 60513146 60513130 -
ctcacaggctagactatcca

SEQ ID NO: 176675 - DNA, 20 bp, Artificial Sequence
  Synthetic oligonucleotide; CAG chr2 60513120 60513139 60513123 -
gctagactatccatggattt

SEQ ID NO: 176676 - DNA, 20 bp, Artificial Sequence
  Synthetic oligonucleotide; TGG chr2 60513117 60513136 60513120 -
agactatccatggatttcag

SEQ ID NO: 176677 - DNA, 20 bp, Artificial Sequence
  Synthetic oligonucleotide; GGG chr2 60513116 60513135 60513119 -
gactatccatggatttcagt

SEQ ID NO: 176678 - DNA, 20 bp, Artificial Sequence
  Synthetic oligonucleotide; GGG chr2 60513115 60513134 60513118 -
actatccatggatttcagtg

SEQ ID NO: 176679 - DNA, 20 bp, Artificial Sequence
  Synthetic oligonucleotide; TGG chr2 60513112 60513131 60513115 -
atccatggatttcagtgggg

SEQ ID NO: 176680 - DNA, 20 bp, Artificial Sequence
  Synthetic oligonucleotide; GAG chr2 60513108 60513127 60513111 -
atggatttcagtggggtggt

SEQ ID NO: 176681 - DNA, 20 bp, Artificial Sequence
  Synthetic oligonucleotide; TGG chr2 60513076 60513095 60513079 -
tccctgaacctctcctcaaa

SEQ ID NO: 176682 - DNA, 20 bp, Artificial Sequence
  Synthetic oligonucleotide; TGG chr2 60513064 60513083 60513067 -
tcctcaaatggtgactgttc

SEQ ID NO: 176683 - DNA, 20 bp, Artificial Sequence
  Synthetic oligonucleotide; GGG chr2 60513063 60513082 60513066 -
cctcaaatggtgactgttct

SEQ ID NO: 176684 - DNA, 20 bp, Artificial Sequence
  Synthetic oligonucleotide; GGG chr2 60513062 60513081 60513065 -
ctcaaatggtgactgttctg

SEQ ID NO: 176685 - DNA, 20 bp, Artificial Sequence
  Synthetic oligonucleotide; GGG chr2 60513061 60513080 60513064 -
tcaaatggtgactgttctgg

SEQ ID NO: 176686 - DNA, 20 bp, Artificial Sequence
  Synthetic oligonucleotide; CAG chr2 60513040 60513059 60513043 -
ggtcctttctctgcctttct

SEQ ID NO: 176687 - DNA, 20 bp, Artificial Sequence
  Synthetic oligonucleotide; AGG chr2 60513039 60513058 60513042 -
gtcctttctctgcctttctc

SEQ ID NO: 176688 - DNA, 20 bp, Artificial Sequence
  Synthetic oligonucleotide; GGG chr2 60513038 60513057 60513041 -
tcctttctctgcctttctca

SEQ ID NO: 176689 - DNA, 20 bp, Artificial Sequence
  Synthetic oligonucleotide; GGG chr2 60513037 60513056 60513040 -
cctttctctgcctttctcag

SEQ ID NO: 176690 - DNA, 20 bp, Artificial Sequence
  Synthetic oligonucleotide; GGG chr2 60513036 60513055 60513039 -
ctttctctgcctttctcagg

SEQ ID NO: 176691 - DNA, 20 bp, Artificial Sequence
  Synthetic oligonucleotide; CAG chr2 60513029 60513048 60513032 -
tgcctttctcagggggtaac

SEQ ID NO: 176692 - DNA, 20 bp, Artificial Sequence
  Synthetic oligonucleotide; GAG chr2 60513027 60513046 60513030 -
cctttctcagggggtaacca

SEQ ID NO: 176693 - DNA, 20 bp, Artificial Sequence
  Synthetic oligonucleotide; AGG chr2 60513026 60513045 60513029 -
ctttctcagggggtaaccag

SEQ ID NO: 176694 - DNA, 20 bp, Artificial Sequence
  Synthetic oligonucleotide; TGG chr2 60513023 60513042 60513026 -
tctcagggggtaaccagagg

SEQ ID NO: 176695 - DNA, 20 bp, Artificial Sequence
  Synthetic oligonucleotide; TGG chr2 60513020 60513039 60513023 -
cagggggtaaccagaggtgg

SEQ ID NO: 176696 - DNA, 20 bp, Artificial Sequence
  Synthetic oligonucleotide; TGG chr2 60513015 60513034 60513018 -
ggtaaccagaggtggtggtg

SEQ ID NO: 176697 - DNA, 20 bp, Artificial Sequence
  Synthetic oligonucleotide; CAG chr2 60512997 60513016 60513000 -
tgtggtccactgtgactcgt

SEQ ID NO: 176698 - DNA, 20 bp, Artificial Sequence
  Synthetic oligonucleotide; GAG chr2 60512970 60512989 60512973 -
tgctctgtgtgttcattttt

SEQ ID NO: 176699 - DNA, 20 bp, Artificial Sequence
  Synthetic oligonucleotide; GAG chr2 60512952 60512971 60512955 -
ttgagaaaatgttaatctct

SEQ ID NO: 176700 - DNA, 20 bp, Artificial Sequence
  Synthetic oligonucleotide; AAG chr2 60512943 60512962 60512946 -
tgttaatctctgagacgtct

SEQ ID NO: 176701 - DNA, 20 bp, Artificial Sequence
  Synthetic oligonucleotide; GAG chr2 60512941 60512960 60512944 -
ttaatctctgagacgtctaa

SEQ ID NO: 176702 - DNA, 20 bp, Artificial Sequence
  Synthetic oligonucleotide; AGG chr2 60512940 60512959 60512943 -
taatctctgagacgtctaag

SEQ ID NO: 176703 - DNA, 20 bp, Artificial Sequence
  Synthetic oligonucleotide; TGG chr2 60512907 60512926 60512910 -
ttctctgtgtctcctccaaa

SEQ ID NO: 176704 - DNA, 20 bp, Artificial Sequence
  Synthetic oligonucleotide; TGG chr2 60512896 60512915 60512899 -
tcctccaaatggatgccatg

SEQ ID NO: 176705 - DNA, 20 bp, Artificial Sequence
  Synthetic oligonucleotide; GGG chr2 60512895 60512914 60512898 -
cctccaaatggatgccatgt

SEQ ID NO: 176706 - DNA, 20 bp, Artificial Sequence
  Synthetic oligonucleotide; TGG chr2 60512892 60512911 60512895 -
ccaaatggatgccatgtggg

SEQ ID NO: 176707 - DNA, 20 bp, Artificial Sequence
  Synthetic oligonucleotide; GGG chr2 60512891 60512910 60512894 -
caaatggatgccatgtgggt

SEQ ID NO: 176708 - DNA, 20 bp, Artificial Sequence
  Synthetic oligonucleotide; AAG chr2 60512886 60512905 60512889 -
ggatgccatgtgggtgggca

SEQ ID NO: 176709 - DNA, 20 bp, Artificial Sequence
  Synthetic oligonucleotide; TGG chr2 60512883 60512902 60512886 -
tgccatgtgggtgggcaaag

SEQ ID NO: 176710 - DNA, 20 bp, Artificial Sequence
  Synthetic oligonucleotide; TGG chr2 60512879 60512898 60512882 -
atgtgggtgggcaaagtggt

SEQ ID NO: 176711 - DNA, 20 bp, Artificial Sequence
  Synthetic oligonucleotide; GGG chr2 60512878 60512897 60512881 -
tgtgggtgggcaaagtggtt

SEQ ID NO: 176712 - DNA, 20 bp, Artificial Sequence
  Synthetic oligonucleotide; TAG chr2 60512860 60512879 60512863 -
ttgggtttattcatttactt

SEQ ID NO: 176713 - DNA, 20 bp, Artificial Sequence
  Synthetic oligonucleotide; AGG chr2 60512859 60512878 60512862 -
tgggtttattcatttacttt

SEQ ID NO: 176714 - DNA, 20 bp, Artificial Sequence
  Synthetic oligonucleotide; TAG chr2 60512847 60512866 60512850 -
tttactttaggtgtgtattg

SEQ ID NO: 176715 - DNA, 20 bp, Artificial Sequence
  Synthetic oligonucleotide; CAG chr2 60512815 60512834 60512818 -
cttgttctcctatccgtcat

SEQ ID NO: 176716 - DNA, 20 bp, Artificial Sequence
  Synthetic oligonucleotide; GAG chr2 60512813 60512832 60512816 -
tgttctcctatccgtcatca

SEQ ID NO: 176717 - DNA, 20 bp, Artificial Sequence
  Synthetic oligonucleotide; AGG chr2 60512812 60512831 60512815 -
gttctcctatccgtcatcag

SEQ ID NO: 176718 - DNA, 20 bp, Artificial Sequence
  Synthetic oligonucleotide; GAG chr2 60512797 60512816 60512800 -
atcagaggtgactcatactt

SEQ ID NO: 176719 - DNA, 20 bp, Artificial Sequence
  Synthetic oligonucleotide; AAG chr2 60512787 60512806 60512790 -
actcatacttgagacactaa

SEQ ID NO: 176720 - DNA, 20 bp, Artificial Sequence
  Synthetic oligonucleotide; GAG chr2 60512785 60512804 60512788 -
tcatacttgagacactaaaa

SEQ ID NO: 176721 - DNA, 20 bp, Artificial Sequence
  Synthetic oligonucleotide; AAG chr2 60512766 60512785 60512769 -
agagaataaactgtcttcat

SEQ ID NO: 176722 - DNA, 20 bp, Artificial Sequence
  Synthetic oligonucleotide; AGG chr2 60512765 60512784 60512768 -
gagaataaactgtcttcata

SEQ ID NO: 176723 - DNA, 20 bp, Artificial Sequence
  Synthetic oligonucleotide; CAG chr2 60512749 60512768 60512752 -
cataaggctgtgaacgtcgc

SEQ ID NO: 176724 - DNA, 20 bp, Artificial Sequence
  Synthetic oligonucleotide; AAG chr2 60512730 60512749 60512733 -
ccagattatgaaccaacttc

SEQ ID NO: 176725 - DNA, 20 bp, Artificial Sequence
  Synthetic oligonucleotide; TAG chr2 60512722 60512741 60512725 -
tgaaccaacttcaagtaacg

SEQ ID NO: 176726 - DNA, 20 bp, Artificial Sequence
  Synthetic oligonucleotide; AGG chr2 60512721 60512740 60512724 -
gaaccaacttcaagtaacgt

SEQ ID NO: 176727 - DNA, 20 bp, Artificial Sequence
  Synthetic oligonucleotide; GGG chr2 60512720 60512739 60512723 -
aaccaacttcaagtaacgta

SEQ ID NO: 176728 - DNA, 20 bp, Artificial Sequence
  Synthetic oligonucleotide; TAG chr2 60512680 60512699 60512683 -
ttattgaaaccatctccaat

SEQ ID NO: 176729 - DNA, 20 bp, Artificial Sequence
  Synthetic oligonucleotide; TGG chr2 60512667 60512686 60512670 -
ctccaattagatatgcaaaa

SEQ ID NO: 176730 - DNA, 20 bp, Artificial Sequence
  Synthetic oligonucleotide; GAG chr2 60512665 60512684 60512668 -
ccaattagatatgcaaaatg

SEQ ID NO: 176731 - DNA, 20 bp, Artificial Sequence
  Synthetic oligonucleotide; TGG chr2 60512658 60512677 60512661 -
gatatgcaaaatggagttgc

SEQ ID NO: 176732 - DNA, 20 bp, Artificial Sequence
  Synthetic oligonucleotide; GGG chr2 60512657 60512676 60512660 -
atatgcaaaatggagttgct

SEQ ID NO: 176733 - DNA, 20 bp, Artificial Sequence
  Synthetic oligonucleotide; GGG chr2 60512656 60512675 60512659 -
tatgcaaaatggagttgctg

SEQ ID NO: 176734 - DNA, 20 bp, Artificial Sequence
  Synthetic oligonucleotide; GGG chr2 60512655 60512674 60512658 -
atgcaaaatggagttgctgg

SEQ ID NO: 176735 - DNA, 20 bp, Artificial Sequence
  Synthetic oligonucleotide; CAG chr2 60512649 60512668 60512652 -
aatggagttgctgggggctt

SEQ ID NO: 176736 - DNA, 20 bp, Artificial Sequence
  Synthetic oligonucleotide; TAG chr2 60512639 60512658 60512642 -
ctgggggcttcagttttctt

SEQ ID NO: 176737 - DNA, 20 bp, Artificial Sequence
  Synthetic oligonucleotide; TAG chr2 60512625 60512644 60512628 -
tttctttagaccaaataatt

SEQ ID NO: 176738 - DNA, 20 bp, Artificial Sequence
  Synthetic oligonucleotide; GAG chr2 60512623 60512642 60512626 -
tctttagaccaaataattta

SEQ ID NO: 176739 - DNA, 20 bp, Artificial Sequence
  Synthetic oligonucleotide; GAG chr2 60512618 60512637 60512621 -
agaccaaataatttagagct

SEQ ID NO: 176740 - DNA, 20 bp, Artificial Sequence
  Synthetic oligonucleotide; GAG chr2 60512616 60512635 60512619 -
accaaataatttagagctga

SEQ ID NO: 176741 - DNA, 20 bp, Artificial Sequence
  Synthetic oligonucleotide; AGG chr2 60512615 60512634 60512618 -
ccaaataatttagagctgag

SEQ ID NO: 176742 - DNA, 20 bp, Artificial Sequence
  Synthetic oligonucleotide; GAG chr2 60512613 60512632 60512616 -
aaataatttagagctgagag

SEQ ID NO: 176743 - DNA, 20 bp, Artificial Sequence
  Synthetic oligonucleotide; GAG chr2 60512611 60512630 60512614 -
ataatttagagctgagagga

SEQ ID NO: 176744 - DNA, 20 bp, Artificial Sequence
  Synthetic oligonucleotide; AGG chr2 60512610 60512629 60512613 -
taatttagagctgagaggag

SEQ ID NO: 176745 - DNA, 20 bp, Artificial Sequence
  Synthetic oligonucleotide; CAG chr2 60512607 60512626 60512610 -
tttagagctgagaggagagg

SEQ ID NO: 176746 - DNA, 20 bp, Artificial Sequence
  Synthetic oligonucleotide; TAG chr2 60512596 60512615 60512599 -
gaggagaggcagataccatc

SEQ ID NO: 176747 - DNA, 20 bp, Artificial Sequence
  Synthetic oligonucleotide; TAG chr2 60512576 60512595 60512579 -
tagtctcactttttacaatt

SEQ ID NO: 176748 - DNA, 20 bp, Artificial Sequence
  Synthetic oligonucleotide; TGG chr2 60512570 60512589 60512573 -
cactttttacaatttagcat

SEQ ID NO: 176749 - DNA, 20 bp, Artificial Sequence
  Synthetic oligonucleotide; GAG chr2 60512560 60512579 60512563 -
aatttagcattggatttgtt

SEQ ID NO: 176750 - DNA, 20 bp, Artificial Sequence
  Synthetic oligonucleotide; CAG chr2 60512544 60512563 60512547 -
tgttgagcatgtactctctg

SEQ ID NO: 176751 - DNA, 20 bp, Artificial Sequence
  Synthetic oligonucleotide; GAG chr2 60512542 60512561 60512545 -
ttgagcatgtactctctgca

SEQ ID NO: 176752 - DNA, 20 bp, Artificial Sequence
  Synthetic oligonucleotide; TAG chr2 60512531 60512550 60512534 -
ctctctgcagagcattgtga

SEQ ID NO: 176753 - DNA, 20 bp, Artificial Sequence
  Synthetic oligonucleotide; AGG chr2 60512530 60512549 60512533 -
tctctgcagagcattgtgat

SEQ ID NO: 176754 - DNA, 20 bp, Artificial Sequence
  Synthetic oligonucleotide; TGG chr2 60512524 60512543 60512527 -
cagagcattgtgataggttc

SEQ ID NO: 176755 - DNA, 20 bp, Artificial Sequence
  Synthetic oligonucleotide; GGG chr2 60512523 60512542 60512526 -
agagcattgtgataggttct

SEQ ID NO: 176756 - DNA, 20 bp, Artificial Sequence
  Synthetic oligonucleotide; TGG chr2 60512519 60512538 60512522 -
cattgtgataggttctgggt

SEQ ID NO: 176757 - DNA, 20 bp, Artificial Sequence
  Synthetic oligonucleotide; GGG chr2 60512518 60512537 60512521 -
attgtgataggttctgggtt

SEQ ID NO: 176758 - DNA, 20 bp, Artificial Sequence
  Synthetic oligonucleotide; GAG chr2 60512516 60512535 60512519 -
tgtgataggttctgggttgg

SEQ ID NO: 176759 - DNA, 20 bp, Artificial Sequence
  Synthetic oligonucleotide; AGG chr2 60512515 60512534 60512518 -
gtgataggttctgggttggg

SEQ ID NO: 176760 - DNA, 20 bp, Artificial Sequence
  Synthetic oligonucleotide; GGG chr2 60512514 60512533 60512517 -
tgataggttctgggttggga

SEQ ID NO: 176761 - DNA, 20 bp, Artificial Sequence
  Synthetic oligonucleotide; GGG chr2 60512513 60512532 60512516 -
gataggttctgggttgggag

SEQ ID NO: 176762 - DNA, 20 bp, Artificial Sequence
  Synthetic oligonucleotide; GAG chr2 60512511 60512530 60512514 -
taggttctgggttgggaggg

SEQ ID NO: 176763 - DNA, 20 bp, Artificial Sequence
  Synthetic oligonucleotide; CGG chr2 60512507 60512526 60512510 -
ttctgggttgggaggggagc

SEQ ID NO: 176764 - DNA, 20 bp, Artificial Sequence
  Synthetic oligonucleotide; GGG chr2 60512506 60512525 60512509 -
tctgggttgggaggggagcc

SEQ ID NO: 176765 - DNA, 20 bp, Artificial Sequence
  Synthetic oligonucleotide; AAG chr2 60512503 60512522 60512506 -
gggttgggaggggagccggg

SEQ ID NO: 176766 - DNA, 20 bp, Artificial Sequence
  Synthetic oligonucleotide; AGG chr2 60512502 60512521 60512505 -
ggttgggaggggagccggga

SEQ ID NO: 176767 - DNA, 20 bp, Artificial Sequence
  Synthetic oligonucleotide; AAG chr2 60512498 60512517 60512501 -
gggaggggagccgggaaggc

SEQ ID NO: 176768 - DNA, 20 bp, Artificial Sequence
  Synthetic oligonucleotide; AAG chr2 60512483 60512502 60512486 -
aaggcaagcatcctctctca

SEQ ID NO: 176769 - DNA, 20 bp, Artificial Sequence
  Synthetic oligonucleotide; GAG chr2 60512465 60512484 60512468 -
caaagctgcctttctcattt

SEQ ID NO: 176770 - DNA, 20 bp, Artificial Sequence
  Synthetic oligonucleotide; GAG chr2 60512463 60512482 60512466 -
aagctgcctttctcatttga

SEQ ID NO: 176771 - DNA, 20 bp, Artificial Sequence
  Synthetic oligonucleotide; AGG chr2 60512462 60512481 60512465 -
agctgcctttctcatttgag

SEQ ID NO: 176772 - DNA, 20 bp, Artificial Sequence
  Synthetic oligonucleotide; GAG chr2 60512458 60512477 60512461 -
gcctttctcatttgagaggc

SEQ ID NO: 176773 - DNA, 20 bp, Artificial Sequence
  Synthetic oligonucleotide; TGG chr2 60512449 60512468 60512452 -
atttgagaggcgagtgtgtg

SEQ ID NO: 176774 - DNA, 20 bp, Artificial Sequence
  Synthetic oligonucleotide; CAG chr2 60512444 60512463 60512447 -
agaggcgagtgtgtgtggca

SEQ ID NO: 176775 - DNA, 20 bp, Artificial Sequence
  Synthetic oligonucleotide; AGG chr2 60512443 60512462 60512446 -
gaggcgagtgtgtgtggcac

SEQ ID NO: 176776 - DNA, 20 bp, Artificial Sequence
  Synthetic oligonucleotide; GGG chr2 60512442 60512461 60512445 -
aggcgagtgtgtgtggcaca

SEQ ID NO: 176777 - DNA, 20 bp, Artificial Sequence
  Synthetic oligonucleotide; GGG chr2 60512441 60512460 60512444 -
ggcgagtgtgtgtggcacag

SEQ ID NO: 176778 - DNA, 20 bp, Artificial Sequence
  Synthetic oligonucleotide; CAG chr2 60512438 60512457 60512441 -
gagtgtgtgtggcacagggg

SEQ ID NO: 176779 - DNA, 20 bp, Artificial Sequence
  Synthetic oligonucleotide; AGG chr2 60512437 60512456 60512440 -
agtgtgtgtggcacaggggc

SEQ ID NO: 176780 - DNA, 20 bp, Artificial Sequence
  Synthetic oligonucleotide; TAG chr2 60512434 60512453 60512437 -
gtgtgtggcacaggggcagg

SEQ ID NO: 176781 - DNA, 20 bp, Artificial Sequence
  Synthetic oligonucleotide; AAG chr2 60512431 60512450 60512434 -
tgtggcacaggggcaggtag

SEQ ID NO: 176782 - DNA, 20 bp, Artificial Sequence
  Synthetic oligonucleotide; AGG chr2 60512430 60512449 60512433 -
gtggcacaggggcaggtaga

SEQ ID NO: 176783 - DNA, 20 bp, Artificial Sequence
  Synthetic oligonucleotide; GAG chr2 60512428 60512447 60512431 -
ggcacaggggcaggtagaag

SEQ ID NO: 176784 - DNA, 20 bp, Artificial Sequence
  Synthetic oligonucleotide; CAG chr2 60512424 60512443 60512427 -
caggggcaggtagaaggaga

SEQ ID NO: 176785 - DNA, 20 bp, Artificial Sequence
  Synthetic oligonucleotide; GAG chr2 60512408 60512427 60512411 -
gagacagatcctttatacct

SEQ ID NO: 176786 - DNA, 20 bp, Artificial Sequence
  Synthetic oligonucleotide; GAG chr2 60512406 60512425 60512409 -
gacagatcctttatacctga

SEQ ID NO: 176787 - DNA, 20 bp, Artificial Sequence
  Synthetic oligonucleotide; AAG chr2 60512402 60512421 60512405 -
gatcctttatacctgagagc

SEQ ID NO: 176788 - DNA, 20 bp, Artificial Sequence
  Synthetic oligonucleotide; CAG chr2 60512394 60512413 60512397 -
atacctgagagcaagatgtg

SEQ ID NO: 176789 - DNA, 20 bp, Artificial Sequence
  Synthetic oligonucleotide; CAG chr2 60512390 60512409 60512393 -
ctgagagcaagatgtgcagc

SEQ ID NO: 176790 - DNA, 20 bp, Artificial Sequence
  Synthetic oligonucleotide; AGG chr2 60512389 60512408 60512392 -
tgagagcaagatgtgcagcc

SEQ ID NO: 176791 - DNA, 20 bp, Artificial Sequence
  Synthetic oligonucleotide; AAG chr2 60512385 60512404 60512388 -
agcaagatgtgcagccagga

SEQ ID NO: 176792 - DNA, 20 bp, Artificial Sequence
  Synthetic oligonucleotide; AAG chr2 60512379 60512398 60512382 -
atgtgcagccaggaaagctc

SEQ ID NO: 176793 - DNA, 20 bp, Artificial Sequence
  Synthetic oligonucleotide; AGG chr2 60512378 60512397 60512381 -
tgtgcagccaggaaagctca

SEQ ID NO: 176794 - DNA, 20 bp, Artificial Sequence
  Synthetic oligonucleotide; CAG chr2 60512372 60512391 60512375 -
gccaggaaagctcaaggaca

SEQ ID NO: 176795 - DNA, 20 bp, Artificial Sequence
  Synthetic oligonucleotide; AGG chr2 60512371 60512390 60512374 -
ccaggaaagctcaaggacac

SEQ ID NO: 176796 - DNA, 20 bp, Artificial Sequence
  Synthetic oligonucleotide; AAG chr2 60512366 60512385 60512369 -
aaagctcaaggacacaggcc

SEQ ID NO: 176797 - DNA, 20 bp, Artificial Sequence
  Synthetic oligonucleotide; AGG chr2 60512365 60512384 60512368 -
aagctcaaggacacaggcca

SEQ ID NO: 176798 - DNA, 20 bp, Artificial Sequence
  Synthetic oligonucleotide; GGG chr2 60512364 60512383 60512367 -
agctcaaggacacaggccaa

SEQ ID NO: 176799 - DNA, 20 bp, Artificial Sequence
  Synthetic oligonucleotide; GAG chr2 60512362 60512381 60512365 -
ctcaaggacacaggccaagg

SEQ ID NO: 176800 - DNA, 20 bp, Artificial Sequence
  Synthetic oligonucleotide; AGG chr2 60512361 60512380 60512364 -
tcaaggacacaggccaaggg

SEQ ID NO: 176801 - DNA, 20 bp, Artificial Sequence
  Synthetic oligonucleotide; AAG chr2 60512356 60512375 60512359 -
gacacaggccaagggaggtg

SEQ ID NO: 176802 - DNA, 20 bp, Artificial Sequence
  Synthetic oligonucleotide; CAG chr2 60512344 60512363 60512347 -
gggaggtgaagtgacttgcc

SEQ ID NO: 176803 - DNA, 20 bp, Artificial Sequence
  Synthetic oligonucleotide; AGG chr2 60512343 60512362 60512346 -
ggaggtgaagtgacttgccc

SEQ ID NO: 176804 - DNA, 20 bp, Artificial Sequence
  Synthetic oligonucleotide; CAG chr2 60512335 60512354 60512338 -
agtgacttgcccaggccacc

SEQ ID NO: 176805 - DNA, 20 bp, Artificial Sequence
  Synthetic oligonucleotide; TAG chr2 60512327 60512346 60512330 -
gcccaggccacccagttacc

SEQ ID NO: 176806 - DNA, 20 bp, Artificial Sequence
  Synthetic oligonucleotide; CAG chr2 60512322 60512341 60512325 -
ggccacccagttacctagca

SEQ ID NO: 176807 - DNA, 20 bp, Artificial Sequence
  Synthetic oligonucleotide; CAG chr2 60512317 60512336 60512320 -
cccagttacctagcacagct

SEQ ID NO: 176808 - DNA, 20 bp, Artificial Sequence
  Synthetic oligonucleotide; AAG chr2 60512310 60512329 60512313 -
acctagcacagctcagccac

SEQ ID NO: 176809 - DNA, 20 bp, Artificial Sequence
  Synthetic oligonucleotide; GAG chr2 60512290 60512309 60512293 -
aagcccaaatgaatgattct

SEQ ID NO: 176810 - DNA, 20 bp, Artificial Sequence
  Synthetic oligonucleotide; CAG chr2 60512279 60512298 60512282 -
aatgattctgagttccacat

SEQ ID NO: 176811 - DNA, 20 bp, Artificial Sequence
  Synthetic oligonucleotide; CGG chr2 60512271 60512290 60512274 -
tgagttccacatcagcgcat

SEQ ID NO: 176812 - DNA, 20 bp, Artificial Sequence
  Synthetic oligonucleotide; GGG chr2 60512270 60512289 60512273 -
gagttccacatcagcgcatc

SEQ ID NO: 176813 - DNA, 20 bp, Artificial Sequence
  Synthetic oligonucleotide; CAG chr2 60512267 60512286 60512270 -
ttccacatcagcgcatcggg

SEQ ID NO: 176814 - DNA, 20 bp, Artificial Sequence
  Synthetic oligonucleotide; GAG chr2 60512257 60512276 60512260 -
gcgcatcgggcagccaccat

SEQ ID NO: 176815 - DNA, 20 bp, Artificial Sequence
  Synthetic oligonucleotide; CAG chr2 60512254 60512273 60512257 -
catcgggcagccaccatgag

SEQ ID NO: 176816 - DNA, 20 bp, Artificial Sequence
  Synthetic oligonucleotide; CAG chr2 60512246 60512265 60512249 -
agccaccatgagcagttcca

SEQ ID NO: 176817 - DNA, 20 bp, Artificial Sequence
  Synthetic oligonucleotide; CAG chr2 60512240 60512259 60512243 -
catgagcagttccacagtga

SEQ ID NO: 176818 - DNA, 20 bp, Artificial Sequence
  Synthetic oligonucleotide; AGG chr2 60512239 60512258 60512242 -
atgagcagttccacagtgac

SEQ ID NO: 176819 - DNA, 20 bp, Artificial Sequence
  Synthetic oligonucleotide; TGG chr2 60512236 60512255 60512239 -
agcagttccacagtgacagg

SEQ ID NO: 176820 - DNA, 20 bp, Artificial Sequence
  Synthetic oligonucleotide; GGG chr2 60512235 60512254 60512238 -
gcagttccacagtgacaggt

SEQ ID NO: 176821 - DNA, 20 bp, Artificial Sequence
  Synthetic oligonucleotide; GGG chr2 60512234 60512253 60512237 -
cagttccacagtgacaggtg

SEQ ID NO: 176822 - DNA, 20 bp, Artificial Sequence
  Synthetic oligonucleotide; TAG chr2 60512228 60512247 60512231 -
cacagtgacaggtggggctc

SEQ ID NO: 176823 - DNA, 20 bp, Artificial Sequence
  Synthetic oligonucleotide; AGG chr2 60512227 60512246 60512230 -
acagtgacaggtggggctct

SEQ ID NO: 176824 - DNA, 20 bp, Artificial Sequence
  Synthetic oligonucleotide; TGG chr2 60512224 60512243 60512227 -
gtgacaggtggggctctagg

SEQ ID NO: 176825 - DNA, 20 bp, Artificial Sequence
  Synthetic oligonucleotide; GAG chr2 60512204 60512223 60512207 -
tggcttcctttaaaacatct

SEQ ID NO: 176826 - DNA, 20 bp, Artificial Sequence
  Synthetic oligonucleotide; AGG chr2 60512203 60512222 60512206 -
ggcttcctttaaaacatctg

SEQ ID NO: 176827 - DNA, 20 bp, Artificial Sequence
  Synthetic oligonucleotide; AAG chr2 60512199 60512218 60512202 -
tcctttaaaacatctgagga

SEQ ID NO: 176828 - DNA, 20 bp, Artificial Sequence
  Synthetic oligonucleotide; CAG chr2 60512196 60512215 60512199 -
tttaaaacatctgaggaaag

SEQ ID NO: 176829 - DNA, 20 bp, Artificial Sequence
  Synthetic oligonucleotide; AGG chr2 60512195 60512214 60512198 -
ttaaaacatctgaggaaagc

SEQ ID NO: 176830 - DNA, 20 bp, Artificial Sequence
  Synthetic oligonucleotide; CAG chr2 60512172 60512191 60512175 -
cttcctctctgactgctctc

SEQ ID NO: 176831 - DNA, 20 bp, Artificial Sequence
  Synthetic oligonucleotide; AGG chr2 60512171 60512190 60512174 -
ttcctctctgactgctctcc

SEQ ID NO: 176832 - DNA, 20 bp, Artificial Sequence
  Synthetic oligonucleotide; GGG chr2 60512170 60512189 60512173 -
tcctctctgactgctctcca

SEQ ID NO: 176833 - DNA, 20 bp, Artificial Sequence
  Synthetic oligonucleotide; GGG chr2 60512169 60512188 60512172 -
cctctctgactgctctccag

SEQ ID NO: 176834 - DNA, 20 bp, Artificial Sequence
  Synthetic oligonucleotide; TGG chr2 60512166 60512185 60512169 -
ctctgactgctctccagggg

SEQ ID NO: 176835 - DNA, 20 bp, Artificial Sequence
  Synthetic oligonucleotide; GAG chr2 60512162 60512181 60512165 -
gactgctctccaggggtggt

SEQ ID NO: 176836 - DNA, 20 bp, Artificial Sequence
  Synthetic oligonucleotide; CAG chr2 60512157 60512176 60512160 -
ctctccaggggtggtgagca

SEQ ID NO: 176837 - DNA, 20 bp, Artificial Sequence
  Synthetic oligonucleotide; AGG chr2 60512156 60512175 60512159 -
tctccaggggtggtgagcac

SEQ ID NO: 176838 - DNA, 20 bp, Artificial Sequence
  Synthetic oligonucleotide; GGG chr2 60512155 60512174 60512158 -
ctccaggggtggtgagcaca

SEQ ID NO: 176839 - DNA, 20 bp, Artificial Sequence
  Synthetic oligonucleotide; GGG chr2 60512154 60512173 60512157 -
tccaggggtggtgagcacag

SEQ ID NO: 176840 - DNA, 20 bp, Artificial Sequence
  Synthetic oligonucleotide; CAG chr2 60512143 60512162 60512146 -
tgagcacaggggttcatctg

SEQ ID NO: 176841 - DNA, 20 bp, Artificial Sequence
  Synthetic oligonucleotide; CAG chr2 60512135 60512154 60512138 -
ggggttcatctgcagctccc

SEQ ID NO: 176842 - DNA, 20 bp, Artificial Sequence
  Synthetic oligonucleotide; CAG chr2 60512129 60512148 60512132 -
catctgcagctccccagctc

SEQ ID NO: 176843 - DNA, 20 bp, Artificial Sequence
  Synthetic oligonucleotide; TAG chr2 60512119 60512138 60512122 -
tccccagctccagtgctcct

SEQ ID NO: 176844 - DNA, 20 bp, Artificial Sequence
  Synthetic oligonucleotide; AAG chr2 60512110 60512129 60512113 -
ccagtgctccttagccttcc

SEQ ID NO: 176845 - DNA, 20 bp, Artificial Sequence
  Synthetic oligonucleotide; AAG chr2 60512096 60512115 60512099 -
ccttccaagttgtttgaatt

SEQ ID NO: 176846 - DNA, 20 bp, Artificial Sequence
  Synthetic oligonucleotide; AAG chr2 60512089 60512108 60512092 -
agttgtttgaattaagttgc

SEQ ID NO: 176847 - DNA, 20 bp, Artificial Sequence
  Synthetic oligonucleotide; CAG chr2 60512084 60512103 60512087 -
tttgaattaagttgcaagcc

SEQ ID NO: 176848 - DNA, 20 bp, Artificial Sequence
  Synthetic oligonucleotide; AGG chr2 60512083 60512102 60512086 -
ttgaattaagttgcaagccc

SEQ ID NO: 176849 - DNA, 20 bp, Artificial Sequence
  Synthetic oligonucleotide; TGG chr2 60512080 60512099 60512083 -
aattaagttgcaagcccagg

SEQ ID NO: 176850 - DNA, 20 bp, Artificial Sequence
  Synthetic oligonucleotide; TGG chr2 60512059 60512078 60512062 -
ggctgcacacatattcattt

SEQ ID NO: 176851 - DNA, 20 bp, Artificial Sequence
  Synthetic oligonucleotide; GAG chr2 60512057 60512076 60512060 -
ctgcacacatattcattttg

SEQ ID NO: 176852 - DNA, 20 bp, Artificial Sequence
  Synthetic oligonucleotide; TGG chr2 60512032 60512051 60512035 -
actgtgacacttgtatttcc

SEQ ID NO: 176853 - DNA, 20 bp, Artificial Sequence
  Synthetic oligonucleotide; GGG chr2 60512031 60512050 60512034 -
ctgtgacacttgtatttcct

SEQ ID NO: 176854 - DNA, 20 bp, Artificial Sequence
  Synthetic oligonucleotide; AAG chr2 60512028 60512047 60512031 -
tgacacttgtatttcctggg

SEQ ID NO: 176855 - DNA, 20 bp, Artificial Sequence
  Synthetic oligonucleotide; TGG chr2 60512011 60512030 60512014 -
gggaagcgttactatgtctt

SEQ ID NO: 176856 - DNA, 20 bp, Artificial Sequence
  Synthetic oligonucleotide; GAG chr2 60512006 60512025 60512009 -
gcgttactatgtctttggcc

SEQ ID NO: 176857 - DNA, 20 bp, Artificial Sequence
  Synthetic oligonucleotide; AAG chr2 60512002 60512021 60512005 -
tactatgtctttggccgagc

SEQ ID NO: 176858 - DNA, 20 bp, Artificial Sequence
  Synthetic oligonucleotide; GAG chr2 60511988 60512007 60511991 -
ccgagcaagtattacgccat

SEQ ID NO: 176859 - DNA, 20 bp, Artificial Sequence
  Synthetic oligonucleotide; TGG chr2 60511984 60512003 60511987 -
gcaagtattacgccatgagc

SEQ ID NO: 176860 - DNA, 20 bp, Artificial Sequence
  Synthetic oligonucleotide; TGG chr2 60511947 60511966 60511950 -
cctttgaacacctacattgc

SEQ ID NO: 176861 - DNA, 20 bp, Artificial Sequence
  Synthetic oligonucleotide; GGG chr2 60511946 60511965 60511949 -
ctttgaacacctacattgct

SEQ ID NO: 176862 - DNA, 20 bp, Artificial Sequence
  Synthetic oligonucleotide; GAG chr2 60511944 60511963 60511947 -
ttgaacacctacattgctgg

SEQ ID NO: 176863 - DNA, 20 bp, Artificial Sequence
  Synthetic oligonucleotide; AGG chr2 60511943 60511962 60511946 -
tgaacacctacattgctggg

SEQ ID NO: 176864 - DNA, 20 bp, Artificial Sequence
  Synthetic oligonucleotide; TAG chr2 60511934 60511953 60511937 -
acattgctgggaggatacct

SEQ ID NO: 176865 - DNA, 20 bp, Artificial Sequence
  Synthetic oligonucleotide; GAG chr2 60511930 60511949 60511933 -
tgctgggaggataccttagt

SEQ ID NO: 176866 - DNA, 20 bp, Artificial Sequence
  Synthetic oligonucleotide; GAG chr2 60511928 60511947 60511931 -
ctgggaggataccttagtga

SEQ ID NO: 176867 - DNA, 20 bp, Artificial Sequence
  Synthetic oligonucleotide; TGG chr2 60511921 60511940 60511924 -
gataccttagtgagagtgcc

SEQ ID NO: 176868 - DNA, 20 bp, Artificial Sequence
  Synthetic oligonucleotide; GGG chr2 60511920 60511939 60511923 -
ataccttagtgagagtgcct

SEQ ID NO: 176869 - DNA, 20 bp, Artificial Sequence
  Synthetic oligonucleotide; TGG chr2 60511913 60511932 60511916 -
agtgagagtgcctgggccac

SEQ ID NO: 176870 - DNA, 20 bp, Artificial Sequence
  Synthetic oligonucleotide; GGG chr2 60511912 60511931 60511915 -
gtgagagtgcctgggccact

SEQ ID NO: 176871 - DNA, 20 bp, Artificial Sequence
  Synthetic oligonucleotide; TAG chr2 60511907 60511926 60511910 -
agtgcctgggccactgggcg

SEQ ID NO: 176872 - DNA, 20 bp, Artificial Sequence
  Synthetic oligonucleotide; CAG chr2 60511904 60511923 60511907 -
gcctgggccactgggcgtag

SEQ ID NO: 176873 - DNA, 20 bp, Artificial Sequence
  Synthetic oligonucleotide; GAG chr2 60511902 60511921 60511905 -
ctgggccactgggcgtagca

SEQ ID NO: 176874 - DNA, 20 bp, Artificial Sequence
  Synthetic oligonucleotide; AGG chr2 60511901 60511920 60511904 -
tgggccactgggcgtagcag

SEQ ID NO: 176875 - DNA, 20 bp, Artificial Sequence
  Synthetic oligonucleotide; AAG chr2 60511898 60511917 60511901 -
gccactgggcgtagcagagg

SEQ ID NO: 176876 - DNA, 20 bp, Artificial Sequence
  Synthetic oligonucleotide; AAG chr2 60511867 60511886 60511870 -
cattttactgatttatttga

SEQ ID NO: 176877 - DNA, 20 bp, Artificial Sequence
  Synthetic oligonucleotide; AAG chr2 60511860 60511879 60511863 -
ctgatttatttgaaagaaaa

SEQ ID NO: 176878 - DNA, 20 bp, Artificial Sequence
  Synthetic oligonucleotide; TAG chr2 60511835 60511854 60511838 -
ccctccaacccttgccttca

SEQ ID NO: 176879 - DNA, 20 bp, Artificial Sequence
  Synthetic oligonucleotide; CAG chr2 60511829 60511848 60511832 -
aacccttgccttcatagaaa

SEQ ID NO: 176880 - DNA, 20 bp, Artificial Sequence
  Synthetic oligonucleotide; GAG chr2 60511827 60511846 60511830 -
cccttgccttcatagaaaca

SEQ ID NO: 176881 - DNA, 20 bp, Artificial Sequence
  Synthetic oligonucleotide; AAG chr2 60511818 60511837 60511821 -
tcatagaaacagagtgttga

SEQ ID NO: 176882 - DNA, 20 bp, Artificial Sequence
  Synthetic oligonucleotide; TGG chr2 60511813 60511832 60511816 -
gaaacagagtgttgaaagct

SEQ ID NO: 176883 - DNA, 20 bp, Artificial Sequence
  Synthetic oligonucleotide; GAG chr2 60511811 60511830 60511814 -
aacagagtgttgaaagcttg

SEQ ID NO: 176884 - DNA, 20 bp, Artificial Sequence
  Synthetic oligonucleotide; AAG chr2 60511808 60511827 60511811 -
agagtgttgaaagcttggag

SEQ ID NO: 176885 - DNA, 20 bp, Artificial Sequence
  Synthetic oligonucleotide; TAG chr2 60511783 60511802 60511786 -
ttaatgactcccctgcccct

SEQ ID NO: 176886 - DNA, 20 bp, Artificial Sequence
  Synthetic oligonucleotide; TAG chr2 60511767 60511786 60511770 -
cccttagtgtcttacatgac

SEQ ID NO: 176887 - DNA, 20 bp, Artificial Sequence
  Synthetic oligonucleotide; TGG chr2 60511716 60511735 60511719 -
ttatttcaacttattttctg

SEQ ID NO: 176888 - DNA, 20 bp, Artificial Sequence
  Synthetic oligonucleotide; TGG chr2 60511711 60511730 60511714 -
tcaacttattttctgtggct

SEQ ID NO: 176889 - DNA, 20 bp, Artificial Sequence
  Synthetic oligonucleotide; GAG chr2 60511694 60511713 60511697 -
gcttggaaaatacgttgact

SEQ ID NO: 176890 - DNA, 20 bp, Artificial Sequence
  Synthetic oligonucleotide; TGG chr2 60511671 60511690 60511674 -
tgatgattgttttcatgaaa

SEQ ID NO: 176891 - DNA, 20 bp, Artificial Sequence
  Synthetic oligonucleotide; AAG chr2 60511657 60511676 60511660 -
atgaaatggtgcaacatgta

SEQ ID NO: 176892 - DNA, 20 bp, Artificial Sequence
  Synthetic oligonucleotide; TGG chr2 60511651 60511670 60511654 -
tggtgcaacatgtaaagcaa

SEQ ID NO: 176893 - DNA, 20 bp, Artificial Sequence
  Synthetic oligonucleotide; TAG chr2 60511638 60511657 60511641 -
aaagcaatggttgtcattaa

SEQ ID NO: 176894 - DNA, 20 bp, Artificial Sequence
  Synthetic oligonucleotide; CAG chr2 60511633 60511652 60511636 -
aatggttgtcattaatagtg

SEQ ID NO: 176895 - DNA, 20 bp, Artificial Sequence
  Synthetic oligonucleotide; TAG chr2 60511625 60511644 60511628 -
tcattaatagtgcagttatg

SEQ ID NO: 176896 - DNA, 20 bp, Artificial Sequence
  Synthetic oligonucleotide; GAG chr2 60511623 60511642 60511626 -
attaatagtgcagttatgta

SEQ ID NO: 176897 - DNA, 20 bp, Artificial Sequence
  Synthetic oligonucleotide; TAG chr2 60511618 60511637 60511621 -
tagtgcagttatgtagagtg

SEQ ID NO: 176898 - DNA, 20 bp, Artificial Sequence
  Synthetic oligonucleotide; GAG chr2 60511609 60511628 60511612 -
tatgtagagtgtagctcttt

SEQ ID NO: 176899 - DNA, 20 bp, Artificial Sequence
  Synthetic oligonucleotide; CAG chr2 60511602 60511621 60511605 -
agtgtagctctttgagtctt

SEQ ID NO: 176900 - DNA, 20 bp, Artificial Sequence
  Synthetic oligonucleotide; CAG chr2 60511591 60511610 60511594 -
ttgagtcttcagttttgaat

SEQ ID NO: 176901 - DNA, 20 bp, Artificial Sequence
  Synthetic oligonucleotide; TAG chr2 60511586 60511605 60511589 -
tcttcagttttgaatcagat

SEQ ID NO: 176902 - DNA, 20 bp, Artificial Sequence
  Synthetic oligonucleotide; TAG chr2 60511565 60511584 60511568 -
agcgctctgttaacttaaaa

SEQ ID NO: 176903 - DNA, 20 bp, Artificial Sequence
  Synthetic oligonucleotide; AAG chr2 60511554 60511573 60511557 -
aacttaaaatagccccaaaa

SEQ ID NO: 176904 - DNA, 20 bp, Artificial Sequence
  Synthetic oligonucleotide; AAG chr2 60511551 60511570 60511554 -
ttaaaatagccccaaaaaag

SEQ ID NO: 176905 - DNA, 20 bp, Artificial Sequence
  Synthetic oligonucleotide; AAG chr2 60511548 60511567 60511551 -
aaatagccccaaaaaagaag

SEQ ID NO: 176906 - DNA, 20 bp, Artificial Sequence
  Synthetic oligonucleotide; AGG chr2 60511547 60511566 60511550 -
aatagccccaaaaaagaaga

SEQ ID NO: 176907 - DNA, 20 bp, Artificial Sequence
  Synthetic oligonucleotide; AAG chr2 60511537 60511556 60511540 -
aaaaagaagaaggaaaaaaa

SEQ ID NO: 176908 - DNA, 20 bp, Artificial Sequence
  Synthetic oligonucleotide; CAG chr2 60511528 60511547 60511531 -
aaggaaaaaaaaagaactgt

SEQ ID NO: 176909 - DNA, 20 bp, Artificial Sequence
  Synthetic oligonucleotide; CAG chr2 60511521 60511540 60511524 -
aaaaaagaactgtcagaaat

SEQ ID NO: 176910 - DNA, 20 bp, Artificial Sequence
  Synthetic oligonucleotide; GAG chr2 60511519 60511538 60511522 -
aaaagaactgtcagaaatca

SEQ ID NO: 176911 - DNA, 20 bp, Artificial Sequence
  Synthetic oligonucleotide; AGG chr2 60511518 60511537 60511521 -
aaagaactgtcagaaatcag

SEQ ID NO: 176912 - DNA, 20 bp, Artificial Sequence
  Synthetic oligonucleotide; GGG chr2 60511517 60511536 60511520 -
aagaactgtcagaaatcaga

SEQ ID NO: 176913 - DNA, 20 bp, Artificial Sequence
  Synthetic oligonucleotide; TAG chr2 60511508 60511527 60511511 -
cagaaatcagagggaaatat

SEQ ID NO: 176914 - DNA, 20 bp, Artificial Sequence
  Synthetic oligonucleotide; TGG chr2 60511493 60511512 60511496 -
aatattagcattatgaaaca

SEQ ID NO: 176915 - DNA, 20 bp, Artificial Sequence
  Synthetic oligonucleotide; AAG chr2 60511486 60511505 60511489 -
gcattatgaaacatggtaac

SEQ ID NO: 176916 - DNA, 20 bp, Artificial Sequence
  Synthetic oligonucleotide; TGG chr2 60511483 60511502 60511486 -
ttatgaaacatggtaacaag

SEQ ID NO: 176917 - DNA, 20 bp, Artificial Sequence
  Synthetic oligonucleotide; TAG chr2 60511476 60511495 60511479 -
acatggtaacaagtggccat

SEQ ID NO: 176918 - DNA, 20 bp, Artificial Sequence
  Synthetic oligonucleotide; TAG chr2 60511454 60511473 60511457 -
gcactttatgtctgcatgaa

SEQ ID NO: 176919 - DNA, 20 bp, Artificial Sequence
  Synthetic oligonucleotide; AAG chr2 60511444 60511463 60511447 -
tctgcatgaatagcatcttt

SEQ ID NO: 176920 - DNA, 20 bp, Artificial Sequence
  Synthetic oligonucleotide; TGG chr2 60511433 60511452 60511436 -
agcatctttaagtgttttat

SEQ ID NO: 176921 - DNA, 20 bp, Artificial Sequence
  Synthetic oligonucleotide; CGG chr2 60511427 60511446 60511430 -
tttaagtgttttattggtaa

SEQ ID NO: 176922 - DNA, 20 bp, Artificial Sequence
  Synthetic oligonucleotide; AAG chr2 60511422 60511441 60511425 -
gtgttttattggtaacggaa

SEQ ID NO: 176923 - DNA, 20 bp, Artificial Sequence
  Synthetic oligonucleotide; GAG chr2 60511420 60511439 60511423 -
gttttattggtaacggaaaa

SEQ ID NO: 176924 - DNA, 20 bp, Artificial Sequence
  Synthetic oligonucleotide; TGG chr2 60511417 60511436 60511420 -
ttattggtaacggaaaagag

SEQ ID NO: 176925 - DNA, 20 bp, Artificial Sequence
  Synthetic oligonucleotide; GAG chr2 60511415 60511434 60511418 -
attggtaacggaaaagagtg

SEQ ID NO: 176926 - DNA, 20 bp, Artificial Sequence
  Synthetic oligonucleotide; TAG chr2 60511407 60511426 60511410 -
cggaaaagagtggagtcaca

SEQ ID NO: 176927 - DNA, 20 bp, Artificial Sequence
  Synthetic oligonucleotide; TGG chr2 60511384 60511403 60511387 -
aatgacattacttcccaaat

SEQ ID NO: 176928 - DNA, 20 bp, Artificial Sequence
  Synthetic oligonucleotide; GAG chr2 60511380 60511399 60511383 -
acattacttcccaaattggc

SEQ ID NO: 176929 - DNA, 20 bp, Artificial Sequence
  Synthetic oligonucleotide; CAG chr2 60511366 60511385 60511369 -
attggcgagttcttttaatt

SEQ ID NO: 176930 - DNA, 20 bp, Artificial Sequence
  Synthetic oligonucleotide; TGG chr2 60511341 60511360 60511344 -
ttctccttgttattgcctac

SEQ ID NO: 176931 - DNA, 20 bp, Artificial Sequence
  Synthetic oligonucleotide; GGG chr2 60511340 60511359 60511343 -
tctccttgttattgcctact

SEQ ID NO: 176932 - DNA, 20 bp, Artificial Sequence
  Synthetic oligonucleotide; GGG chr2 60511339 60511358 60511342 -
ctccttgttattgcctactg

SEQ ID NO: 176933 - DNA, 20 bp, Artificial Sequence
  Synthetic oligonucleotide; GAG chr2 60511337 60511356 60511340 -
ccttgttattgcctactggg

SEQ ID NO: 176934 - DNA, 20 bp, Artificial Sequence
  Synthetic oligonucleotide; TAG chr2 60511307 60511326 60511310 -
tcacctgtcaaattgtatgc

SEQ ID NO: 176935 - DNA, 20 bp, Artificial Sequence
  Synthetic oligonucleotide; AGG chr2 60511306 60511325 60511309 -
cacctgtcaaattgtatgct

SEQ ID NO: 176936 - DNA, 20 bp, Artificial Sequence
  Synthetic oligonucleotide; GGG chr2 60511305 60511324 60511308 -
acctgtcaaattgtatgcta

SEQ ID NO: 176937 - DNA, 20 bp, Artificial Sequence
  Synthetic oligonucleotide; TGG chr2 60511302 60511321 60511305 -
tgtcaaattgtatgctaggg

SEQ ID NO: 176938 - DNA, 20 bp, Artificial Sequence
  Synthetic oligonucleotide; GGG chr2 60511301 60511320 60511304 -
gtcaaattgtatgctagggt

SEQ ID NO: 176939 - DNA, 20 bp, Artificial Sequence
  Synthetic oligonucleotide; AAG chr2 60511297 60511316 60511300 -
aattgtatgctagggtggga

SEQ ID NO: 176940 - DNA, 20 bp, Artificial Sequence
  Synthetic oligonucleotide; AGG chr2 60511296 60511315 60511299 -
attgtatgctagggtgggaa

SEQ ID NO: 176941 - DNA, 20 bp, Artificial Sequence
  Synthetic oligonucleotide; GGG chr2 60511295 60511314 60511298 -
ttgtatgctagggtgggaaa

SEQ ID NO: 176942 - DNA, 20 bp, Artificial Sequence
  Synthetic oligonucleotide; TAG chr2 60511287 60511306 60511290 -
tagggtgggaaagggtattt

SEQ ID NO: 176943 - DNA, 20 bp, Artificial Sequence
  Synthetic oligonucleotide; TGG chr2 60511278 60511297 60511281 -
aaagggtattttagcttttc

SEQ ID NO: 176944 - DNA, 20 bp, Artificial Sequence
  Synthetic oligonucleotide; CGG chr2 60511267 60511286 60511270 -
tagcttttctggctgcatcc

SEQ ID NO: 176945 - DNA, 20 bp, Artificial Sequence
  Synthetic oligonucleotide; GGG chr2 60511266 60511285 60511269 -
agcttttctggctgcatccc

SEQ ID NO: 176946 - DNA, 20 bp, Artificial Sequence
  Synthetic oligonucleotide; CAG chr2 60511259 60511278 60511262 -
ctggctgcatcccgggctct

SEQ ID NO: 176947 - DNA, 20 bp, Artificial Sequence
  Synthetic oligonucleotide; AGG chr2 60511258 60511277 60511261 -
tggctgcatcccgggctctc

SEQ ID NO: 176948 - DNA, 20 bp, Artificial Sequence
  Synthetic oligonucleotide; TAG chr2 60511255 60511274 60511258 -
ctgcatcccgggctctcagg

SEQ ID NO: 176949 - DNA, 20 bp, Artificial Sequence
  Synthetic oligonucleotide; AAG chr2 60511252 60511271 60511255 -
catcccgggctctcaggtag

SEQ ID NO: 176950 - DNA, 20 bp, Artificial Sequence
  Synthetic oligonucleotide; AGG chr2 60511251 60511270 60511254 -
atcccgggctctcaggtaga

SEQ ID NO: 176951 - DNA, 20 bp, Artificial Sequence
  Synthetic oligonucleotide; GGG chr2 60511250 60511269 60511253 -
tcccgggctctcaggtagaa

SEQ ID NO: 176952 - DNA, 20 bp, Artificial Sequence
  Synthetic oligonucleotide; TGG chr2 60511231 60511250 60511234 -
agggatttgtccctttgcca

SEQ ID NO: 176953 - DNA, 20 bp, Artificial Sequence
  Synthetic oligonucleotide; CAG chr2 60511206 60511225 60511209 -
tccttctctcctgccctccc

SEQ ID NO: 176954 - DNA, 20 bp, Artificial Sequence
  Synthetic oligonucleotide; CAG chr2 60511194 60511213 60511197 -
gccctccccagtgcccctgc

SEQ ID NO: 176955 - DNA, 20 bp, Artificial Sequence
  Synthetic oligonucleotide; AGG chr2 60511193 60511212 60511196 -
ccctccccagtgcccctgcc

SEQ ID NO: 176956 - DNA, 20 bp, Artificial Sequence
  Synthetic oligonucleotide; GAG chr2 60511191 60511210 60511194 -
ctccccagtgcccctgccag

SEQ ID NO: 176957 - DNA, 20 bp, Artificial Sequence
  Synthetic oligonucleotide; AGG chr2 60511190 60511209 60511193 -
tccccagtgcccctgccagg

SEQ ID NO: 176958 - DNA, 20 bp, Artificial Sequence
  Synthetic oligonucleotide; GAG chr2 60511188 60511207 60511191 -
cccagtgcccctgccaggag

SEQ ID NO: 176959 - DNA, 20 bp, Artificial Sequence
  Synthetic oligonucleotide; AGG chr2 60511187 60511206 60511190 -
ccagtgcccctgccaggagg

SEQ ID NO: 176960 - DNA, 20 bp, Artificial Sequence
  Synthetic oligonucleotide; GGG chr2 60511186 60511205 60511189 -
cagtgcccctgccaggagga

SEQ ID NO: 176961 - DNA, 20 bp, Artificial Sequence
  Synthetic oligonucleotide; GAG chr2 60511184 60511203 60511187 -
gtgcccctgccaggaggagg

SEQ ID NO: 176962 - DNA, 20 bp, Artificial Sequence
  Synthetic oligonucleotide; AAG chr2 60511174 60511193 60511177 -
caggaggagggagaatctga

SEQ ID NO: 176963 - DNA, 20 bp, Artificial Sequence
  Synthetic oligonucleotide; AAG chr2 60511170 60511189 60511173 -
aggagggagaatctgaaagc

SEQ ID NO: 176964 - DNA, 20 bp, Artificial Sequence
  Synthetic oligonucleotide; TGG chr2 60511165 60511184 60511168 -
ggagaatctgaaagcaagaa

SEQ ID NO: 176965 - DNA, 20 bp, Artificial Sequence
  Synthetic oligonucleotide; GAG chr2 60511163 60511182 60511166 -
agaatctgaaagcaagaatg

SEQ ID NO: 176966 - DNA, 20 bp, Artificial Sequence
  Synthetic oligonucleotide; AGG chr2 60511162 60511181 60511165 -
gaatctgaaagcaagaatgg

SEQ ID NO: 176967 - DNA, 20 bp, Artificial Sequence
  Synthetic oligonucleotide; GGG chr2 60511161 60511180 60511164 -
aatctgaaagcaagaatgga

SEQ ID NO: 176968 - DNA, 20 bp, Artificial Sequence
  Synthetic oligonucleotide; GAG chr2 60511159 60511178 60511162 -
tctgaaagcaagaatggagg

SEQ ID NO: 176969 - DNA, 20 bp, Artificial Sequence
  Synthetic oligonucleotide; GAG chr2 60511157 60511176 60511160 -
tgaaagcaagaatggaggga

SEQ ID NO: 176970 - DNA, 20 bp, Artificial Sequence
  Synthetic oligonucleotide; TGG chr2 60511146 60511165 60511149 -
atggagggagagtaatgccg

SEQ ID NO: 176971 - DNA, 20 bp, Artificial Sequence
  Synthetic oligonucleotide; GAG chr2 60511144 60511163 60511147 -
ggagggagagtaatgccgtg

SEQ ID NO: 176972 - DNA, 20 bp, Artificial Sequence
  Synthetic oligonucleotide; AGG chr2 60511143 60511162 60511146 -
gagggagagtaatgccgtgg

SEQ ID NO: 176973 - DNA, 20 bp, Artificial Sequence
  Synthetic oligonucleotide; CAG chr2 60511140 60511159 60511143 -
ggagagtaatgccgtggagg

SEQ ID NO: 176974 - DNA, 20 bp, Artificial Sequence
  Synthetic oligonucleotide; TGG chr2 60511136 60511155 60511139 -
agtaatgccgtggaggcagc

SEQ ID NO: 176975 - DNA, 20 bp, Artificial Sequence
  Synthetic oligonucleotide; GGG chr2 60511135 60511154 60511138 -
gtaatgccgtggaggcagct

SEQ ID NO: 176976 - DNA, 20 bp, Artificial Sequence
  Synthetic oligonucleotide; TGG chr2 60511123 60511142 60511126 -
aggcagctgggatttgtgcc

SEQ ID NO: 176977 - DNA, 20 bp, Artificial Sequence
  Synthetic oligonucleotide; CAG chr2 60511119 60511138 60511122 -
agctgggatttgtgcctggc

SEQ ID NO: 176978 - DNA, 20 bp, Artificial Sequence
  Synthetic oligonucleotide; CAG chr2 60511106 60511125 60511109 -
gcctggccagtgcccctgca

SEQ ID NO: 176979 - DNA, 20 bp, Artificial Sequence
  Synthetic oligonucleotide; TGG chr2 60511100 60511119 60511103 -
ccagtgcccctgcacagtat

SEQ ID NO: 176980 - DNA, 20 bp, Artificial Sequence
  Synthetic oligonucleotide; GAG chr2 60511093 60511112 60511096 -
ccctgcacagtattggatat

SEQ ID NO: 176981 - DNA, 20 bp, Artificial Sequence
  Synthetic oligonucleotide; TGG chr2 60511088 60511107 60511091 -
cacagtattggatatgagta

SEQ ID NO: 176982 - DNA, 20 bp, Artificial Sequence
  Synthetic oligonucleotide; GGG chr2 60511087 60511106 60511090 -
acagtattggatatgagtat

SEQ ID NO: 176983 - DNA, 20 bp, Artificial Sequence
  Synthetic oligonucleotide; CAG chr2 60511079 60511098 60511082 -
ggatatgagtatgggcatct

SEQ ID NO: 176984 - DNA, 20 bp, Artificial Sequence
  Synthetic oligonucleotide; TGG chr2 60511070 60511089 60511073 -
tatgggcatctcagtgtgcc

SEQ ID NO: 176985 - DNA, 20 bp, Artificial Sequence
  Synthetic oligonucleotide; CAG chr2 60511062 60511081 60511065 -
tctcagtgtgcctggaaacg

SEQ ID NO: 176986 - DNA, 20 bp, Artificial Sequence
  Synthetic oligonucleotide; TGG chr2 60511058 60511077 60511061 -
agtgtgcctggaaacgcagt

SEQ ID NO: 176987 - DNA, 20 bp, Artificial Sequence
  Synthetic oligonucleotide; CAG chr2 60511050 60511069 60511053 -
tggaaacgcagttggctgca

SEQ ID NO: 176988 - DNA, 20 bp, Artificial Sequence
  Synthetic oligonucleotide; CAG chr2 60511044 60511063 60511047 -
cgcagttggctgcacagccc

SEQ ID NO: 176989 - DNA, 20 bp, Artificial Sequence
  Synthetic oligonucleotide; TGG chr2 60511041 60511060 60511044 -
agttggctgcacagccccag

SEQ ID NO: 176990 - DNA, 20 bp, Artificial Sequence
  Synthetic oligonucleotide; GGG chr2 60511040 60511059 60511043 -
gttggctgcacagccccagt

SEQ ID NO: 176991 - DNA, 20 bp, Artificial Sequence
  Synthetic oligonucleotide; AAG chr2 60511037 60511056 60511040 -
ggctgcacagccccagtggg

SEQ ID NO: 176992 - DNA, 20 bp, Artificial Sequence
  Synthetic oligonucleotide; GAG chr2 60511028 60511047 60511031 -
gccccagtgggaagaactct

SEQ ID NO: 176993 - DNA, 20 bp, Artificial Sequence
  Synthetic oligonucleotide; AGG chr2 60511027 60511046 60511030 -
ccccagtgggaagaactctg

SEQ ID NO: 176994 - DNA, 20 bp, Artificial Sequence
  Synthetic oligonucleotide; TGG chr2 60511018 60511037 60511021 -
gaagaactctgaggaactgc

SEQ ID NO: 176995 - DNA, 20 bp, Artificial Sequence
  Synthetic oligonucleotide; TGG chr2 60511015 60511034 60511018 -
gaactctgaggaactgctgg

SEQ ID NO: 176996 - DNA, 20 bp, Artificial Sequence
  Synthetic oligonucleotide; TGG chr2 60511011 60511030 60511014 -
tctgaggaactgctggtggt

SEQ ID NO: 176997 - DNA, 20 bp, Artificial Sequence
  Synthetic oligonucleotide; CAG chr2 60511000 60511019 60511003 -
gctggtggttggctcttccc

SEQ ID NO: 176998 - DNA, 20 bp, Artificial Sequence
  Synthetic oligonucleotide; AGG chr2 60510999 60511018 60511002 -
ctggtggttggctcttcccc

SEQ ID NO: 176999 - DNA, 20 bp, Artificial Sequence
  Synthetic oligonucleotide; CAG chr2 60510992 60511011 60510995 -
ttggctcttccccaggctct

SEQ ID NO: 177000 - DNA, 20 bp, Artificial Sequence
  Synthetic oligonucleotide; TAG chr2 60510979 60510998 60510982 -
aggctctcagcccctctttc

SEQ ID NO: 177001 - DNA, 20 bp, Artificial Sequence
  Synthetic oligonucleotide; GAG chr2 60510977 60510996 60510980 -
gctctcagcccctctttcta

SEQ ID NO: 177002 - DNA, 20 bp, Artificial Sequence
  Synthetic oligonucleotide; AGG chr2 60510976 60510995 60510979 -
ctctcagcccctctttctag

SEQ ID NO: 177003 - DNA, 20 bp, Artificial Sequence
  Synthetic oligonucleotide; AAG chr2 60510965 60510984 60510968 -
tctttctagaggctccacct

SEQ ID NO: 177004 - DNA, 20 bp, Artificial Sequence
  Synthetic oligonucleotide; TAG chr2 60510959 60510978 60510962 -
tagaggctccacctaagcct

SEQ ID NO: 177005 - DNA, 20 bp, Artificial Sequence
  Synthetic oligonucleotide; AGG chr2 60510958 60510977 60510961 -
agaggctccacctaagcctt

SEQ ID NO: 177006 - DNA, 20 bp, Artificial Sequence
  Synthetic oligonucleotide; AAG chr2 60510954 60510973 60510957 -
gctccacctaagccttagga

SEQ ID NO: 177007 - DNA, 20 bp, Artificial Sequence
  Synthetic oligonucleotide; TGG chr2 60510942 60510961 60510945 -
ccttaggaaagactttcgtt

SEQ ID NO: 177008 - DNA, 20 bp, Artificial Sequence
  Synthetic oligonucleotide; TGG chr2 60510932 60510951 60510935 -
gactttcgtttggttttaac

SEQ ID NO: 177009 - DNA, 20 bp, Artificial Sequence
  Synthetic oligonucleotide; AAG chr2 60510921 60510940 60510924 -
ggttttaactggctcctgtc

SEQ ID NO: 177010 - DNA, 20 bp, Artificial Sequence
  Synthetic oligonucleotide; AGG chr2 60510920 60510939 60510923 -
gttttaactggctcctgtca

SEQ ID NO: 177011 - DNA, 20 bp, Artificial Sequence
  Synthetic oligonucleotide; GGG chr2 60510919 60510938 60510922 -
ttttaactggctcctgtcaa

SEQ ID NO: 177012 - DNA, 20 bp, Artificial Sequence
  Synthetic oligonucleotide; CAG chr2 60510905 60510924 60510908 -
tgtcaagggttcccccaaac

SEQ ID NO: 177013 - DNA, 20 bp, Artificial Sequence
  Synthetic oligonucleotide; AAG chr2 60510872 60510891 60510875 -
ccatttacattataatgcaa

SEQ ID NO: 177014 - DNA, 20 bp, Artificial Sequence
  Synthetic oligonucleotide; TGG chr2 60510859 60510878 60510862 -
aatgcaaaagctcttccctg

SEQ ID NO: 177015 - DNA, 20 bp, Artificial Sequence
  Synthetic oligonucleotide; GGG chr2 60510858 60510877 60510861 -
atgcaaaagctcttccctgt

SEQ ID NO: 177016 - DNA, 20 bp, Artificial Sequence
  Synthetic oligonucleotide; CAG chr2 60510852 60510871 60510855 -
aagctcttccctgtgggtct

SEQ ID NO: 177017 - DNA, 20 bp, Artificial Sequence
  Synthetic oligonucleotide; AGG chr2 60510851 60510870 60510854 -
agctcttccctgtgggtctc

SEQ ID NO: 177018 - DNA, 20 bp, Artificial Sequence
  Synthetic oligonucleotide; GGG chr2 60510850 60510869 60510853 -
gctcttccctgtgggtctca

SEQ ID NO: 177019 - DNA, 20 bp, Artificial Sequence
  Synthetic oligonucleotide; TGG chr2 60510843 60510862 60510846 -
cctgtgggtctcagggcctg

SEQ ID NO: 177020 - DNA, 20 bp, Artificial Sequence
  Synthetic oligonucleotide; GGG chr2 60510842 60510861 60510845 -
ctgtgggtctcagggcctgt

SEQ ID NO: 177021 - DNA, 20 bp, Artificial Sequence
  Synthetic oligonucleotide; GGG chr2 60510841 60510860 60510844 -
tgtgggtctcagggcctgtg

SEQ ID NO: 177022 - DNA, 20 bp, Artificial Sequence
  Synthetic oligonucleotide; TGG chr2 60510834 60510853 60510837 -
ctcagggcctgtggggaaaa

SEQ ID NO: 177023 - DNA, 20 bp, Artificial Sequence
  Synthetic oligonucleotide; TGG chr2 60510827 60510846 60510830 -
cctgtggggaaaatggaatc

SEQ ID NO: 177024 - DNA, 20 bp, Artificial Sequence
  Synthetic oligonucleotide; AAG chr2 60510815 60510834 60510818 -
atggaatctggctcaaaccc

SEQ ID NO: 177025 - DNA, 20 bp, Artificial Sequence
  Synthetic oligonucleotide; AAG chr2 60510807 60510826 60510810 -
tggctcaaacccaagatcca

SEQ ID NO: 177026 - DNA, 20 bp, Artificial Sequence
  Synthetic oligonucleotide; AAG chr2 60510801 60510820 60510804 -
aaacccaagatccaaagcta

SEQ ID NO: 177027 - DNA, 20 bp, Artificial Sequence
  Synthetic oligonucleotide; CAG chr2 60510792 60510811 60510795 -
atccaaagctaaagtgcccc

SEQ ID NO: 177028 - DNA, 20 bp, Artificial Sequence
  Synthetic oligonucleotide; AGG chr2 60510791 60510810 60510794 -
tccaaagctaaagtgccccc

SEQ ID NO: 177029 - DNA, 20 bp, Artificial Sequence
  Synthetic oligonucleotide; TGG chr2 60510787 60510806 60510790 -
aagctaaagtgcccccaggt

SEQ ID NO: 177030 - DNA, 20 bp, Artificial Sequence
  Synthetic oligonucleotide; GGG chr2 60510786 60510805 60510789 -
agctaaagtgcccccaggtt

SEQ ID NO: 177031 - DNA, 20 bp, Artificial Sequence
  Synthetic oligonucleotide; CAG chr2 60510775 60510794 60510778 -
ccccaggttgggctgcctga

SEQ ID NO: 177032 - DNA, 20 bp, Artificial Sequence
  Synthetic oligonucleotide; TAG chr2 60510767 60510786 60510770 -
tgggctgcctgacagtttta

SEQ ID NO: 177033 - DNA, 20 bp, Artificial Sequence
  Synthetic oligonucleotide; TGG chr2 60510761 60510780 60510764 -
gcctgacagttttatagata

SEQ ID NO: 177034 - DNA, 20 bp, Artificial Sequence
  Synthetic oligonucleotide; GAG chr2 60510754 60510773 60510757 -
agttttatagatatggcatt

SEQ ID NO: 177035 - DNA, 20 bp, Artificial Sequence
  Synthetic oligonucleotide; TGG chr2 60510751 60510770 60510754 -
tttatagatatggcattgag

SEQ ID NO: 177036 - DNA, 20 bp, Artificial Sequence
  Synthetic oligonucleotide; TGG chr2 60510743 60510762 60510746 -
tatggcattgagtggcctcc

SEQ ID NO: 177037 - DNA, 20 bp, Artificial Sequence
  Synthetic oligonucleotide; CAG chr2 60510740 60510759 60510743 -
ggcattgagtggcctcctgg

SEQ ID NO: 177038 - DNA, 20 bp, Artificial Sequence
  Synthetic oligonucleotide; TGG chr2 60510735 60510754 60510738 -
tgagtggcctcctggcagtt

SEQ ID NO: 177039 - DNA, 20 bp, Artificial Sequence
  Synthetic oligonucleotide; AAG chr2 60510725 60510744 60510728 -
cctggcagtttggaattgtg

SEQ ID NO: 177040 - DNA, 20 bp, Artificial Sequence
  Synthetic oligonucleotide; AGG chr2 60510724 60510743 60510727 -
ctggcagtttggaattgtga

SEQ ID NO: 177041 - DNA, 20 bp, Artificial Sequence
  Synthetic oligonucleotide; TGG chr2 60510674 60510693 60510677 -
tttgaacacctgccacatgc

SEQ ID NO: 177042 - DNA, 20 bp, Artificial Sequence
  Synthetic oligonucleotide; GGG chr2 60510673 60510692 60510676 -
ttgaacacctgccacatgct

SEQ ID NO: 177043 - DNA, 20 bp, Artificial Sequence
  Synthetic oligonucleotide; CGG chr2 60510668 60510687 60510671 -
cacctgccacatgctgggaa

SEQ ID NO: 177044 - DNA, 20 bp, Artificial Sequence
  Synthetic oligonucleotide; TGG chr2 60510661 60510680 60510664 -
cacatgctgggaacggttct

SEQ ID NO: 177045 - DNA, 20 bp, Artificial Sequence
  Synthetic oligonucleotide; TGG chr2 60510655 60510674 60510658 -
ctgggaacggttcttggtgt

SEQ ID NO: 177046 - DNA, 20 bp, Artificial Sequence
  Synthetic oligonucleotide; GGG chr2 60510654 60510673 60510657 -
tgggaacggttcttggtgtt

SEQ ID NO: 177047 - DNA, 20 bp, Artificial Sequence
  Synthetic oligonucleotide; TAG chr2 60510649 60510668 60510652 -
acggttcttggtgttgggca

SEQ ID NO: 177048 - DNA, 20 bp, Artificial Sequence
  Synthetic oligonucleotide; AAG chr2 60510645 60510664 60510648 -
ttcttggtgttgggcataga

SEQ ID NO: 177049 - DNA, 20 bp, Artificial Sequence
  Synthetic oligonucleotide; TGG chr2 60510620 60510639 60510623 -
ttaaaaactccctgctcttg

SEQ ID NO: 177050 - DNA, 20 bp, Artificial Sequence
  Synthetic oligonucleotide; TAG chr2 60510606 60510625 60510609 -
ctcttgtggcaccccctttc

SEQ ID NO: 177051 - DNA, 20 bp, Artificial Sequence
  Synthetic oligonucleotide; TGG chr2 60510602 60510621 60510605 -
tgtggcaccccctttctagc

SEQ ID NO: 177052 - DNA, 20 bp, Artificial Sequence
  Synthetic oligonucleotide; GGG chr2 60510601 60510620 60510604 -
gtggcaccccctttctagct

SEQ ID NO: 177053 - DNA, 20 bp, Artificial Sequence
  Synthetic oligonucleotide; GGG chr2 60510600 60510619 60510603 -
tggcaccccctttctagctg

SEQ ID NO: 177054 - DNA, 20 bp, Artificial Sequence
  Synthetic oligonucleotide; GAG chr2 60510598 60510617 60510601 -
gcaccccctttctagctggg

SEQ ID NO: 177055 - DNA, 20 bp, Artificial Sequence
  Synthetic oligonucleotide; GAG chr2 60510596 60510615 60510599 -
accccctttctagctgggga

SEQ ID NO: 177056 - DNA, 20 bp, Artificial Sequence
  Synthetic oligonucleotide; CAG chr2 60510592 60510611 60510595 -
cctttctagctggggagaga

SEQ ID NO: 177057 - DNA, 20 bp, Artificial Sequence
  Synthetic oligonucleotide; AAG chr2 60510589 60510608 60510592 -
ttctagctggggagagacag

SEQ ID NO: 177058 - DNA, 20 bp, Artificial Sequence
  Synthetic oligonucleotide; TAG chr2 60510560 60510579 60510563 -
caataaatatgtgaattata

SEQ ID NO: 177059 - DNA, 20 bp, Artificial Sequence
  Synthetic oligonucleotide; TGG chr2 60510555 60510574 60510558 -
aatatgtgaattatatagta

SEQ ID NO: 177060 - DNA, 20 bp, Artificial Sequence
  Synthetic oligonucleotide; AAG chr2 60510551 60510570 60510554 -
tgtgaattatatagtatggc

SEQ ID NO: 177061 - DNA, 20 bp, Artificial Sequence
  Synthetic oligonucleotide; GAG chr2 60510549 60510568 60510552 -
tgaattatatagtatggcaa

SEQ ID NO: 177062 - DNA, 20 bp, Artificial Sequence
  Synthetic oligonucleotide; AAG chr2 60510546 60510565 60510549 -
attatatagtatggcaagag

SEQ ID NO: 177063 - DNA, 20 bp, Artificial Sequence
  Synthetic oligonucleotide; AAG chr2 60510521 60510540 60510524 -
caaactgcctgcacgaaaat

SEQ ID NO: 177064 - DNA, 20 bp, Artificial Sequence
  Synthetic oligonucleotide; AGG chr2 60510520 60510539 60510523 -
aaactgcctgcacgaaaata

SEQ ID NO: 177065 - DNA, 20 bp, Artificial Sequence
  Synthetic oligonucleotide; TGG chr2 60510517 60510536 60510520 -
ctgcctgcacgaaaataagg

SEQ ID NO: 177066 - DNA, 20 bp, Artificial Sequence
  Synthetic oligonucleotide; GGG chr2 60510516 60510535 60510519 -
tgcctgcacgaaaataaggt

SEQ ID NO: 177067 - DNA, 20 bp, Artificial Sequence
  Synthetic oligonucleotide; GGG chr2 60510515 60510534 60510518 -
gcctgcacgaaaataaggtg

SEQ ID NO: 177068 - DNA, 20 bp, Artificial Sequence
  Synthetic oligonucleotide; AAG chr2 60510512 60510531 60510515 -
tgcacgaaaataaggtgggg

SEQ ID NO: 177069 - DNA, 20 bp, Artificial Sequence
  Synthetic oligonucleotide; GAG chr2 60510510 60510529 60510513 -
cacgaaaataaggtggggaa

SEQ ID NO: 177070 - DNA, 20 bp, Artificial Sequence
  Synthetic oligonucleotide; AGG chr2 60510509 60510528 60510512 -
acgaaaataaggtggggaag

SEQ ID NO: 177071 - DNA, 20 bp, Artificial Sequence
  Synthetic oligonucleotide; GGG chr2 60510508 60510527 60510511 -
cgaaaataaggtggggaaga

SEQ ID NO: 177072 - DNA, 20 bp, Artificial Sequence
  Synthetic oligonucleotide; GGG chr2 60510507 60510526 60510510 -
gaaaataaggtggggaagag

SEQ ID NO: 177073 - DNA, 20 bp, Artificial Sequence
  Synthetic oligonucleotide; AAG chr2 60510503 60510522 60510506 -
ataaggtggggaagaggggt

SEQ ID NO: 177074 - DNA, 20 bp, Artificial Sequence
  Synthetic oligonucleotide; AGG chr2 60510502 60510521 60510505 -
taaggtggggaagaggggta

SEQ ID NO: 177075 - DNA, 20 bp, Artificial Sequence
  Synthetic oligonucleotide; GGG chr2 60510501 60510520 60510504 -
aaggtggggaagaggggtaa

SEQ ID NO: 177076 - DNA, 20 bp, Artificial Sequence
  Synthetic oligonucleotide; GGG chr2 60510500 60510519 60510503 -
aggtggggaagaggggtaag

SEQ ID NO: 177077 - DNA, 20 bp, Artificial Sequence
  Synthetic oligonucleotide; TGG chr2 60510493 60510512 60510496 -
gaagaggggtaaggggtgca

SEQ ID NO: 177078 - DNA, 20 bp, Artificial Sequence
  Synthetic oligonucleotide; CAG chr2 60510486 60510505 60510489 -
ggtaaggggtgcatggtgac

SEQ ID NO: 177079 - DNA, 20 bp, Artificial Sequence
  Synthetic oligonucleotide; AGG chr2 60510485 60510504 60510488 -
gtaaggggtgcatggtgacc

SEQ ID NO: 177080 - DNA, 20 bp, Artificial Sequence
  Synthetic oligonucleotide; TAG chr2 60510474 60510493 60510477 -
atggtgaccaggcttttaaa

SEQ ID NO: 177081 - DNA, 20 bp, Artificial Sequence
  Synthetic oligonucleotide; AGG chr2 60510473 60510492 60510476 -
tggtgaccaggcttttaaat

SEQ ID NO: 177082 - DNA, 20 bp, Artificial Sequence
  Synthetic oligonucleotide; TAG chr2 60510465 60510484 60510468 -
aggcttttaaataggataat

SEQ ID NO: 177083 - DNA, 20 bp, Artificial Sequence
  Synthetic oligonucleotide; AGG chr2 60510464 60510483 60510467 -
ggcttttaaataggataatt

SEQ ID NO: 177084 - DNA, 20 bp, Artificial Sequence
  Synthetic oligonucleotide; GGG chr2 60510463 60510482 60510466 -
gcttttaaataggataatta

SEQ ID NO: 177085 - DNA, 20 bp, Artificial Sequence
  Synthetic oligonucleotide; AAG chr2 60510460 60510479 60510463 -
tttaaataggataattaggg

SEQ ID NO: 177086 - DNA, 20 bp, Artificial Sequence
  Synthetic oligonucleotide; AGG chr2 60510459 60510478 60510462 -
ttaaataggataattaggga

SEQ ID NO: 177087 - DNA, 20 bp, Artificial Sequence
  Synthetic oligonucleotide; GAG chr2 60510450 60510469 60510453 -
ataattagggaaggcccaat

SEQ ID NO: 177088 - DNA, 20 bp, Artificial Sequence
  Synthetic oligonucleotide; AAG chr2 60510447 60510466 60510450 -
attagggaaggcccaatgag

SEQ ID NO: 177089 - DNA, 20 bp, Artificial Sequence
  Synthetic oligonucleotide; AAG chr2 60510442 60510461 60510445 -
ggaaggcccaatgagaagca

SEQ ID NO: 177090 - DNA, 20 bp, Artificial Sequence
  Synthetic oligonucleotide; AGG chr2 60510441 60510460 60510444 -
gaaggcccaatgagaagcaa

SEQ ID NO: 177091 - DNA, 20 bp, Artificial Sequence
  Synthetic oligonucleotide; AAG chr2 60510433 60510452 60510436 -
aatgagaagcaaaggctcca

SEQ ID NO: 177092 - DNA, 20 bp, Artificial Sequence
  Synthetic oligonucleotide; GAG chr2 60510431 60510450 60510434 -
tgagaagcaaaggctccaaa

SEQ ID NO: 177093 - DNA, 20 bp, Artificial Sequence
  Synthetic oligonucleotide; AGG chr2 60510430 60510449 60510433 -
gagaagcaaaggctccaaag

SEQ ID NO: 177094 - DNA, 20 bp, Artificial Sequence
  Synthetic oligonucleotide; GAG chr2 60510426 60510445 60510429 -
agcaaaggctccaaagaggt

SEQ ID NO: 177095 - DNA, 20 bp, Artificial Sequence
  Synthetic oligonucleotide; AGG chr2 60510425 60510444 60510428 -
gcaaaggctccaaagaggtg

SEQ ID NO: 177096 - DNA, 20 bp, Artificial Sequence
  Synthetic oligonucleotide; AAG chr2 60510422 60510441 60510425 -
aaggctccaaagaggtgagg

SEQ ID NO: 177097 - DNA, 20 bp, Artificial Sequence
  Synthetic oligonucleotide; TGG chr2 60510418 60510437 60510421 -
ctccaaagaggtgaggaagt

SEQ ID NO: 177098 - DNA, 20 bp, Artificial Sequence
  Synthetic oligonucleotide; GAG chr2 60510411 60510430 60510414 -
gaggtgaggaagttggccat

SEQ ID NO: 177099 - DNA, 20 bp, Artificial Sequence
  Synthetic oligonucleotide; GAG chr2 60510402 60510421 60510405 -
aagttggccatgagaatttt

SEQ ID NO: 177100 - DNA, 20 bp, Artificial Sequence
  Synthetic oligonucleotide; AAG chr2 60510399 60510418 60510402 -
ttggccatgagaattttgag

SEQ ID NO: 177101 - DNA, 20 bp, Artificial Sequence
  Synthetic oligonucleotide; TGG chr2 60510395 60510414 60510398 -
ccatgagaattttgagaaga

SEQ ID NO: 177102 - DNA, 20 bp, Artificial Sequence
  Synthetic oligonucleotide; CAG chr2 60510389 60510408 60510392 -
gaattttgagaagatggttc

SEQ ID NO: 177103 - DNA, 20 bp, Artificial Sequence
  Synthetic oligonucleotide; AGG chr2 60510388 60510407 60510391 -
aattttgagaagatggttcc

SEQ ID NO: 177104 - DNA, 20 bp, Artificial Sequence
  Synthetic oligonucleotide; AAG chr2 60510385 60510404 60510388 -
tttgagaagatggttccagg

SEQ ID NO: 177105 - DNA, 20 bp, Artificial Sequence
  Synthetic oligonucleotide; GAG chr2 60510383 60510402 60510386 -
tgagaagatggttccaggaa

SEQ ID NO: 177106 - DNA, 20 bp, Artificial Sequence
  Synthetic oligonucleotide; TAG chr2 60510376 60510395 60510379 -
atggttccaggaagagtgtg

SEQ ID NO: 177107 - DNA, 20 bp, Artificial Sequence
  Synthetic oligonucleotide; GAG chr2 60510374 60510393 60510377 -
ggttccaggaagagtgtgta

SEQ ID NO: 177108 - DNA, 20 bp, Artificial Sequence
  Synthetic oligonucleotide; GAG chr2 60510372 60510391 60510375 -
ttccaggaagagtgtgtaga

SEQ ID NO: 177109 - DNA, 20 bp, Artificial Sequence
  Synthetic oligonucleotide; CAG chr2 60510369 60510388 60510372 -
caggaagagtgtgtagagag

SEQ ID NO: 177110 - DNA, 20 bp, Artificial Sequence
  Synthetic oligonucleotide; GAG chr2 60510367 60510386 60510370 -
ggaagagtgtgtagagagca

SEQ ID NO: 177111 - DNA, 20 bp, Artificial Sequence
  Synthetic oligonucleotide; TGG chr2 60510345 60510364 60510348 -
gaccttgtgtgtaatacgcc

SEQ ID NO: 177112 - DNA, 20 bp, Artificial Sequence
  Synthetic oligonucleotide; TGG chr2 60510338 60510357 60510341 -
tgtgtaatacgcctggctac

SEQ ID NO: 177113 - DNA, 20 bp, Artificial Sequence
  Synthetic oligonucleotide; GAG chr2 60510336 60510355 60510339 -
tgtaatacgcctggctactg

SEQ ID NO: 177114 - DNA, 20 bp, Artificial Sequence
  Synthetic oligonucleotide; AGG chr2 60510335 60510354 60510338 -
gtaatacgcctggctactgg

SEQ ID NO: 177115 - DNA, 20 bp, Artificial Sequence
  Synthetic oligonucleotide; GAG chr2 60510333 60510352 60510336 -
aatacgcctggctactggag

SEQ ID NO: 177116 - DNA, 20 bp, Artificial Sequence
  Synthetic oligonucleotide; AGG chr2 60510332 60510351 60510335 -
atacgcctggctactggagg

SEQ ID NO: 177117 - DNA, 20 bp, Artificial Sequence
  Synthetic oligonucleotide; GAG chr2 60510330 60510349 60510333 -
acgcctggctactggaggag

SEQ ID NO: 177118 - DNA, 20 bp, Artificial Sequence
  Synthetic oligonucleotide; AAG chr2 60510326 60510345 60510329 -
ctggctactggaggaggagc

SEQ ID NO: 177119 - DNA, 20 bp, Artificial Sequence
  Synthetic oligonucleotide; AGG chr2 60510325 60510344 60510328 -
tggctactggaggaggagca

SEQ ID NO: 177120 - DNA, 20 bp, Artificial Sequence
  Synthetic oligonucleotide; GGG chr2 60510324 60510343 60510327 -
ggctactggaggaggagcaa

SEQ ID NO: 177121 - DNA, 20 bp, Artificial Sequence
  Synthetic oligonucleotide; GGG chr2 60510323 60510342 60510326 -
gctactggaggaggagcaag

SEQ ID NO: 177122 - DNA, 20 bp, Artificial Sequence
  Synthetic oligonucleotide; GAG chr2 60510316 60510335 60510319 -
gaggaggagcaaggggccct

SEQ ID NO: 177123 - DNA, 20 bp, Artificial Sequence
  Synthetic oligonucleotide; AGG chr2 60510315 60510334 60510318 -
aggaggagcaaggggccctg

SEQ ID NO: 177124 - DNA, 20 bp, Artificial Sequence
  Synthetic oligonucleotide; CAG chr2 60510311 60510330 60510314 -
ggagcaaggggccctgaggt

SEQ ID NO: 177125 - DNA, 20 bp, Artificial Sequence
  Synthetic oligonucleotide; GAG chr2 60510309 60510328 60510312 -
agcaaggggccctgaggtca

SEQ ID NO: 177126 - DNA, 20 bp, Artificial Sequence
  Synthetic oligonucleotide; TGG chr2 60510306 60510325 60510309 -
aaggggccctgaggtcagag

SEQ ID NO: 177127 - DNA, 20 bp, Artificial Sequence
  Synthetic oligonucleotide; AAG chr2 60510302 60510321 60510305 -
ggccctgaggtcagagtgga

SEQ ID NO: 177128 - DNA, 20 bp, Artificial Sequence
  Synthetic oligonucleotide; GAG chr2 60510300 60510319 60510303 -
ccctgaggtcagagtggaaa

SEQ ID NO: 177129 - DNA, 20 bp, Artificial Sequence
  Synthetic oligonucleotide; CAG chr2 60510295 60510314 60510298 -
aggtcagagtggaaagagtg

SEQ ID NO: 177130 - DNA, 20 bp, Artificial Sequence
  Synthetic oligonucleotide; AGG chr2 60510294 60510313 60510297 -
ggtcagagtggaaagagtgc

SEQ ID NO: 177131 - DNA, 20 bp, Artificial Sequence
  Synthetic oligonucleotide; GAG chr2 60510292 60510311 60510295 -
tcagagtggaaagagtgcag

SEQ ID NO: 177132 - DNA, 20 bp, Artificial Sequence
  Synthetic oligonucleotide; AGG chr2 60510291 60510310 60510294 -
cagagtggaaagagtgcagg

SEQ ID NO: 177133 - DNA, 20 bp, Artificial Sequence
  Synthetic oligonucleotide; GAG chr2 60510289 60510308 60510292 -
gagtggaaagagtgcaggag

SEQ ID NO: 177134 - DNA, 20 bp, Artificial Sequence
  Synthetic oligonucleotide; AGG chr2 60510288 60510307 60510291 -
agtggaaagagtgcaggagg

SEQ ID NO: 177135 - DNA, 20 bp, Artificial Sequence
  Synthetic oligonucleotide; GAG chr2 60510286 60510305 60510289 -
tggaaagagtgcaggaggag

SEQ ID NO: 177136 - DNA, 20 bp, Artificial Sequence
  Synthetic oligonucleotide; AGG chr2 60510285 60510304 60510288 -
ggaaagagtgcaggaggagg

SEQ ID NO: 177137 - DNA, 20 bp, Artificial Sequence
  Synthetic oligonucleotide; GAG chr2 60510283 60510302 60510286 -
aaagagtgcaggaggaggag

SEQ ID NO: 177138 - DNA, 20 bp, Artificial Sequence
  Synthetic oligonucleotide; GAG chr2 60510281 60510300 60510284 -
agagtgcaggaggaggagga

SEQ ID NO: 177139 - DNA, 20 bp, Artificial Sequence
  Synthetic oligonucleotide; AGG chr2 60510280 60510299 60510283 -
gagtgcaggaggaggaggag

SEQ ID NO: 177140 - DNA, 20 bp, Artificial Sequence
  Synthetic oligonucleotide; GAG chr2 60510278 60510297 60510281 -
gtgcaggaggaggaggagag

SEQ ID NO: 177141 - DNA, 20 bp, Artificial Sequence
  Synthetic oligonucleotide; CAG chr2 60510273 60510292 60510276 -
ggaggaggaggagaggagac

SEQ ID NO: 177142 - DNA, 20 bp, Artificial Sequence
  Synthetic oligonucleotide; TGG chr2 60510269 60510288 60510272 -
gaggaggagaggagaccagc

SEQ ID NO: 177143 - DNA, 20 bp, Artificial Sequence
  Synthetic oligonucleotide; AAG chr2 60510259 60510278 60510262 -
ggagaccagctggctccttg

SEQ ID NO: 177144 - DNA, 20 bp, Artificial Sequence
  Synthetic oligonucleotide; AGG chr2 60510258 60510277 60510261 -
gagaccagctggctccttga

SEQ ID NO: 177145 - DNA, 20 bp, Artificial Sequence
  Synthetic oligonucleotide; TAG chr2 60510252 60510271 60510255 -
agctggctccttgaaggacg

SEQ ID NO: 177146 - DNA, 20 bp, Artificial Sequence
  Synthetic oligonucleotide; GAG chr2 60510250 60510269 60510253 -
ctggctccttgaaggacgta

SEQ ID NO: 177147 - DNA, 20 bp, Artificial Sequence
  Synthetic oligonucleotide; CAG chr2 60510247 60510266 60510250 -
gctccttgaaggacgtagag

SEQ ID NO: 177148 - DNA, 20 bp, Artificial Sequence
  Synthetic oligonucleotide; AGG chr2 60510246 60510265 60510249 -
ctccttgaaggacgtagagc

SEQ ID NO: 177149 - DNA, 20 bp, Artificial Sequence
  Synthetic oligonucleotide; GGG chr2 60510245 60510264 60510248 -
tccttgaaggacgtagagca

SEQ ID NO: 177150 - DNA, 20 bp, Artificial Sequence
  Synthetic oligonucleotide; TGG chr2 60510237 60510256 60510240 -
ggacgtagagcagggatttt

SEQ ID NO: 177151 - DNA, 20 bp, Artificial Sequence
  Synthetic oligonucleotide; AAG chr2 60510224 60510243 60510227 -
ggatttttggctctgactcc

SEQ ID NO: 177152 - DNA, 20 bp, Artificial Sequence
  Synthetic oligonucleotide; AGG chr2 60510223 60510242 60510226 -
gatttttggctctgactcca

SEQ ID NO: 177153 - DNA, 20 bp, Artificial Sequence
  Synthetic oligonucleotide; GGG chr2 60510222 60510241 60510225 -
atttttggctctgactccaa

SEQ ID NO: 177154 - DNA, 20 bp, Artificial Sequence
  Synthetic oligonucleotide; GAG chr2 60510220 60510239 60510223 -
ttttggctctgactccaagg

SEQ ID NO: 177155 - DNA, 20 bp, Artificial Sequence
  Synthetic oligonucleotide; TGG chr2 60510216 60510235 60510219 -
ggctctgactccaagggaga

SEQ ID NO: 177156 - DNA, 20 bp, Artificial Sequence
  Synthetic oligonucleotide; AAG chr2 60510213 60510232 60510216 -
tctgactccaagggagatgg

SEQ ID NO: 177157 - DNA, 20 bp, Artificial Sequence
  Synthetic oligonucleotide; TGG chr2 60510206 60510225 60510209 -
ccaagggagatggaagccac

SEQ ID NO: 177158 - DNA, 20 bp, Artificial Sequence
  Synthetic oligonucleotide; GAG chr2 60510204 60510223 60510207 -
aagggagatggaagccactg

SEQ ID NO: 177159 - DNA, 20 bp, Artificial Sequence
  Synthetic oligonucleotide; AGG chr2 60510203 60510222 60510206 -
agggagatggaagccactgg

SEQ ID NO: 177160 - DNA, 20 bp, Artificial Sequence
  Synthetic oligonucleotide; GAG chr2 60510201 60510220 60510204 -
ggagatggaagccactggag

SEQ ID NO: 177161 - DNA, 20 bp, Artificial Sequence
  Synthetic oligonucleotide; CAG chr2 60510175 60510194 60510178 -
tgtcatatgacttgcgcttc

SEQ ID NO: 177162 - DNA, 20 bp, Artificial Sequence
  Synthetic oligonucleotide; GAG chr2 60510173 60510192 60510176 -
tcatatgacttgcgcttcca

SEQ ID NO: 177163 - DNA, 20 bp, Artificial Sequence
  Synthetic oligonucleotide; GAG chr2 60510171 60510190 60510174 -
atatgacttgcgcttccaga

SEQ ID NO: 177164 - DNA, 20 bp, Artificial Sequence
  Synthetic oligonucleotide; TGG chr2 60510163 60510182 60510166 -
tgcgcttccagagagtctct

SEQ ID NO: 177165 - DNA, 20 bp, Artificial Sequence
  Synthetic oligonucleotide; GGG chr2 60510162 60510181 60510165 -
gcgcttccagagagtctctt

SEQ ID NO: 177166 - DNA, 20 bp, Artificial Sequence
  Synthetic oligonucleotide; GAG chr2 60510150 60510169 60510153 -
agtctcttgggccgcatttt

SEQ ID NO: 177167 - DNA, 20 bp, Artificial Sequence
  Synthetic oligonucleotide; AAG chr2 60510143 60510162 60510146 -
tgggccgcattttgagactc

SEQ ID NO: 177168 - DNA, 20 bp, Artificial Sequence
  Synthetic oligonucleotide; TGG chr2 60510138 60510157 60510141 -
cgcattttgagactcaagca

SEQ ID NO: 177169 - DNA, 20 bp, Artificial Sequence
  Synthetic oligonucleotide; GGG chr2 60510137 60510156 60510140 -
gcattttgagactcaagcat

SEQ ID NO: 177170 - DNA, 20 bp, Artificial Sequence
  Synthetic oligonucleotide; AAG chr2 60510133 60510152 60510136 -
tttgagactcaagcatggga

SEQ ID NO: 177171 - DNA, 20 bp, Artificial Sequence
  Synthetic oligonucleotide; GAG chr2 60510129 60510148 60510132 -
agactcaagcatgggaaagt

SEQ ID NO: 177172 - DNA, 20 bp, Artificial Sequence
  Synthetic oligonucleotide; AGG chr2 60510128 60510147 60510131 -
gactcaagcatgggaaagtg

SEQ ID NO: 177173 - DNA, 20 bp, Artificial Sequence
  Synthetic oligonucleotide; CAG chr2 60510125 60510144 60510128 -
tcaagcatgggaaagtgagg

SEQ ID NO: 177174 - DNA, 20 bp, Artificial Sequence
  Synthetic oligonucleotide; AAG chr2 60510122 60510141 60510125 -
agcatgggaaagtgaggcag

SEQ ID NO: 177175 - DNA, 20 bp, Artificial Sequence
  Synthetic oligonucleotide; CAG chr2 60510119 60510138 60510122 -
atgggaaagtgaggcagaag

SEQ ID NO: 177176 - DNA, 20 bp, Artificial Sequence
  Synthetic oligonucleotide; CAG chr2 60510115 60510134 60510118 -
gaaagtgaggcagaagcagt

SEQ ID NO: 177177 - DNA, 20 bp, Artificial Sequence
  Synthetic oligonucleotide; AAG chr2 60510112 60510131 60510115 -
agtgaggcagaagcagtcag

SEQ ID NO: 177178 - DNA, 20 bp, Artificial Sequence
  Synthetic oligonucleotide; AGG chr2 60510111 60510130 60510114 -
gtgaggcagaagcagtcaga

SEQ ID NO: 177179 - DNA, 20 bp, Artificial Sequence
  Synthetic oligonucleotide; TAG chr2 60510101 60510120 60510104 -
agcagtcagaaggcaaattt

SEQ ID NO: 177180 - DNA, 20 bp, Artificial Sequence
  Synthetic oligonucleotide; AGG chr2 60510100 60510119 60510103 -
gcagtcagaaggcaaatttt

SEQ ID NO: 177181 - DNA, 20 bp, Artificial Sequence
  Synthetic oligonucleotide; AAG chr2 60510096 60510115 60510099 -
tcagaaggcaaattttaggc

SEQ ID NO: 177182 - DNA, 20 bp, Artificial Sequence
  Synthetic oligonucleotide; TGG chr2 60510090 60510109 60510093 -
ggcaaattttaggcaagtga

SEQ ID NO: 177183 - DNA, 20 bp, Artificial Sequence
  Synthetic oligonucleotide; TGG chr2 60510087 60510106 60510090 -
aaattttaggcaagtgatgg

SEQ ID NO: 177184 - DNA, 20 bp, Artificial Sequence
  Synthetic oligonucleotide; TGG chr2 60510082 60510101 60510085 -
ttaggcaagtgatggtggcg

SEQ ID NO: 177185 - DNA, 20 bp, Artificial Sequence
  Synthetic oligonucleotide; CAG chr2 60510077 60510096 60510080 -
caagtgatggtggcgtggac

SEQ ID NO: 177186 - DNA, 20 bp, Artificial Sequence
  Synthetic oligonucleotide; AGG chr2 60510076 60510095 60510079 -
aagtgatggtggcgtggacc

SEQ ID NO: 177187 - DNA, 20 bp, Artificial Sequence
  Synthetic oligonucleotide; GGG chr2 60510075 60510094 60510078 -
agtgatggtggcgtggacca

SEQ ID NO: 177188 - DNA, 20 bp, Artificial Sequence
  Synthetic oligonucleotide; TGG chr2 60510072 60510091 60510075 -
gatggtggcgtggaccaggg

SEQ ID NO: 177189 - DNA, 20 bp, Artificial Sequence
  Synthetic oligonucleotide; TGG chr2 60510069 60510088 60510072 -
ggtggcgtggaccagggtgg

SEQ ID NO: 177190 - DNA, 20 bp, Artificial Sequence
  Synthetic oligonucleotide; GGG chr2 60510068 60510087 60510071 -
gtggcgtggaccagggtggt

SEQ ID NO: 177191 - DNA, 20 bp, Artificial Sequence
  Synthetic oligonucleotide; GGG chr2 60510067 60510086 60510070 -
tggcgtggaccagggtggtg

SEQ ID NO: 177192 - DNA, 20 bp, Artificial Sequence
  Synthetic oligonucleotide; GAG chr2 60510060 60510079 60510063 -
gaccagggtggtggggacgt

SEQ ID NO: 177193 - DNA, 20 bp, Artificial Sequence
  Synthetic oligonucleotide; AAG chr2 60510057 60510076 60510060 -
cagggtggtggggacgtgag

SEQ ID NO: 177194 - DNA, 20 bp, Artificial Sequence
  Synthetic oligonucleotide; AGG chr2 60510056 60510075 60510059 -
agggtggtggggacgtgaga

SEQ ID NO: 177195 - DNA, 20 bp, Artificial Sequence
  Synthetic oligonucleotide; GGG chr2 60510055 60510074 60510058 -
gggtggtggggacgtgagaa

SEQ ID NO: 177196 - DNA, 20 bp, Artificial Sequence
  Synthetic oligonucleotide; GGG chr2 60510054 60510073 60510057 -
ggtggtggggacgtgagaag

SEQ ID NO: 177197 - DNA, 20 bp, Artificial Sequence
  Synthetic oligonucleotide; TGG chr2 60510050 60510069 60510053 -
gtggggacgtgagaaggggc

SEQ ID NO: 177198 - DNA, 20 bp, Artificial Sequence
  Synthetic oligonucleotide; TGG chr2 60510043 60510062 60510046 -
cgtgagaaggggctggattc

SEQ ID NO: 177199 - DNA, 20 bp, Artificial Sequence
  Synthetic oligonucleotide; AAG chr2 60510030 60510049 60510033 -
tggattctggacatacttcg

SEQ ID NO: 177200 - DNA, 20 bp, Artificial Sequence
  Synthetic oligonucleotide; AGG chr2 60510029 60510048 60510032 -
ggattctggacatacttcga

SEQ ID NO: 177201 - DNA, 20 bp, Artificial Sequence
  Synthetic oligonucleotide; GGG chr2 60510028 60510047 60510031 -
gattctggacatacttcgaa

SEQ ID NO: 177202 - DNA, 20 bp, Artificial Sequence
  Synthetic oligonucleotide; CGG chr2 60510020 60510039 60510023 -
acatacttcgaagggaaaac

SEQ ID NO: 177203 - DNA, 20 bp, Artificial Sequence
  Synthetic oligonucleotide; CAG chr2 60510017 60510036 60510020 -
tacttcgaagggaaaaccgg

SEQ ID NO: 177204 - DNA, 20 bp, Artificial Sequence
  Synthetic oligonucleotide; AGG chr2 60510016 60510035 60510019 -
acttcgaagggaaaaccggc

SEQ ID NO: 177205 - DNA, 20 bp, Artificial Sequence
  Synthetic oligonucleotide; TGG chr2 60510003 60510022 60510006 -
aaccggcaggatttgctgac

SEQ ID NO: 177206 - DNA, 20 bp, Artificial Sequence
  Synthetic oligonucleotide; TGG chr2 60510000 60510019 60510003 -
cggcaggatttgctgactgg

SEQ ID NO: 177207 - DNA, 20 bp, Artificial Sequence
  Synthetic oligonucleotide; GGG chr2 60509999 60510018 60510002 -
ggcaggatttgctgactggt

SEQ ID NO: 177208 - DNA, 20 bp, Artificial Sequence
  Synthetic oligonucleotide; TGG chr2 60509995 60510014 60509998 -
ggatttgctgactggtggga

SEQ ID NO: 177209 - DNA, 20 bp, Artificial Sequence
  Synthetic oligonucleotide; GGG chr2 60509994 60510013 60509997 -
gatttgctgactggtgggat

SEQ ID NO: 177210 - DNA, 20 bp, Artificial Sequence
  Synthetic oligonucleotide; AAG chr2 60509983 60510002 60509986 -
tggtgggatgggttgtatga

SEQ ID NO: 177211 - DNA, 20 bp, Artificial Sequence
  Synthetic oligonucleotide; AGG chr2 60509982 60510001 60509985 -
ggtgggatgggttgtatgaa

SEQ ID NO: 177212 - DNA, 20 bp, Artificial Sequence
  Synthetic oligonucleotide; AAG chr2 60509979 60509998 60509982 -
gggatgggttgtatgaaagg

SEQ ID NO: 177213 - DNA, 20 bp, Artificial Sequence
  Synthetic oligonucleotide; AGG chr2 60509978 60509997 60509981 -
ggatgggttgtatgaaagga

SEQ ID NO: 177214 - DNA, 20 bp, Artificial Sequence
  Synthetic oligonucleotide; GGG chr2 60509977 60509996 60509980 -
gatgggttgtatgaaaggaa

SEQ ID NO: 177215 - DNA, 20 bp, Artificial Sequence
  Synthetic oligonucleotide; GAG chr2 60509975 60509994 60509978 -
tgggttgtatgaaaggaagg

SEQ ID NO: 177216 - DNA, 20 bp, Artificial Sequence
  Synthetic oligonucleotide; AGG chr2 60509974 60509993 60509977 -
gggttgtatgaaaggaaggg

SEQ ID NO: 177217 - DNA, 20 bp, Artificial Sequence
  Synthetic oligonucleotide; GAG chr2 60509972 60509991 60509975 -
gttgtatgaaaggaagggag

SEQ ID NO: 177218 - DNA, 20 bp, Artificial Sequence
  Synthetic oligonucleotide; AAG chr2 60509967 60509986 60509970 -
atgaaaggaagggaggagtc

SEQ ID NO: 177219 - DNA, 20 bp, Artificial Sequence
  Synthetic oligonucleotide; TGG chr2 60509963 60509982 60509966 -
aaggaagggaggagtcaaga

SEQ ID NO: 177220 - DNA, 20 bp, Artificial Sequence
  Synthetic oligonucleotide; TGG chr2 60509947 60509966 60509950 -
aagatggaccccaaaatgtg

SEQ ID NO: 177221 - DNA, 20 bp, Artificial Sequence
  Synthetic oligonucleotide; CGG chr2 60509942 60509961 60509945 -
ggaccccaaaatgtgtggct

SEQ ID NO: 177222 - DNA, 20 bp, Artificial Sequence
  Synthetic oligonucleotide; TGG chr2 60509935 60509954 60509938 -
aaaatgtgtggctcggtgac

SEQ ID NO: 177223 - DNA, 20 bp, Artificial Sequence
  Synthetic oligonucleotide; GGG chr2 60509934 60509953 60509937 -
aaatgtgtggctcggtgact

SEQ ID NO: 177224 - DNA, 20 bp, Artificial Sequence
  Synthetic oligonucleotide; GAG chr2 60509932 60509951 60509935 -
atgtgtggctcggtgactgg

SEQ ID NO: 177225 - DNA, 20 bp, Artificial Sequence
  Synthetic oligonucleotide; TAG chr2 60509927 60509946 60509930 -
tggctcggtgactgggagaa

SEQ ID NO: 177226 - DNA, 20 bp, Artificial Sequence
  Synthetic oligonucleotide; TGG chr2 60509911 60509930 60509914 -
agaatagaattgctgtttat

SEQ ID NO: 177227 - DNA, 20 bp, Artificial Sequence
  Synthetic oligonucleotide; GGG chr2 60509910 60509929 60509913 -
gaatagaattgctgtttatt

SEQ ID NO: 177228 - DNA, 20 bp, Artificial Sequence
  Synthetic oligonucleotide; TGG chr2 60509906 60509925 60509909 -
agaattgctgtttattggga

SEQ ID NO: 177229 - DNA, 20 bp, Artificial Sequence
  Synthetic oligonucleotide; GGG chr2 60509905 60509924 60509908 -
gaattgctgtttattgggat

SEQ ID NO: 177230 - DNA, 20 bp, Artificial Sequence
  Synthetic oligonucleotide; CAG chr2 60509901 60509920 60509904 -
tgctgtttattgggatgggc

SEQ ID NO: 177231 - DNA, 20 bp, Artificial Sequence
  Synthetic oligonucleotide; AAG chr2 60509897 60509916 60509900 -
gtttattgggatgggccaga

SEQ ID NO: 177232 - DNA, 20 bp, Artificial Sequence
  Synthetic oligonucleotide; AGG chr2 60509896 60509915 60509899 -
tttattgggatgggccagaa

SEQ ID NO: 177233 - DNA, 20 bp, Artificial Sequence
  Synthetic oligonucleotide; TGG chr2 60509890 60509909 60509893 -
gggatgggccagaaaggctg

SEQ ID NO: 177234 - DNA, 20 bp, Artificial Sequence
  Synthetic oligonucleotide; GAG chr2 60509888 60509907 60509891 -
gatgggccagaaaggctgtg

SEQ ID NO: 177235 - DNA, 20 bp, Artificial Sequence
  Synthetic oligonucleotide; AGG chr2 60509887 60509906 60509890 -
atgggccagaaaggctgtgg

SEQ ID NO: 177236 - DNA, 20 bp, Artificial Sequence
  Synthetic oligonucleotide; CAG chr2 60509880 60509899 60509883 -
agaaaggctgtggaggtgct

SEQ ID NO: 177237 - DNA, 20 bp, Artificial Sequence
  Synthetic oligonucleotide; GAG chr2 60509878 60509897 60509881 -
aaaggctgtggaggtgctca

SEQ ID NO: 177238 - DNA, 20 bp, Artificial Sequence
  Synthetic oligonucleotide; AGG chr2 60509877 60509896 60509880 -
aaggctgtggaggtgctcag

SEQ ID NO: 177239 - DNA, 20 bp, Artificial Sequence
  Synthetic oligonucleotide; TGG chr2 60509873 60509892 60509876 -
ctgtggaggtgctcagagga

SEQ ID NO: 177240 - DNA, 20 bp, Artificial Sequence
  Synthetic oligonucleotide; GGG chr2 60509872 60509891 60509875 -
tgtggaggtgctcagaggat

SEQ ID NO: 177241 - DNA, 20 bp, Artificial Sequence
  Synthetic oligonucleotide; TGG chr2 60509863 60509882 60509866 -
gctcagaggatgggtgtgtc

SEQ ID NO: 177242 - DNA, 20 bp, Artificial Sequence
  Synthetic oligonucleotide; GGG chr2 60509862 60509881 60509865 -
ctcagaggatgggtgtgtct

SEQ ID NO: 177243 - DNA, 20 bp, Artificial Sequence
  Synthetic oligonucleotide; GGG chr2 60509861 60509880 60509864 -
tcagaggatgggtgtgtctg

SEQ ID NO: 177244 - DNA, 20 bp, Artificial Sequence
  Synthetic oligonucleotide; CAG chr2 60509844 60509863 60509847 -
ctggggctccttcaccactt

SEQ ID NO: 177245 - DNA, 20 bp, Artificial Sequence
  Synthetic oligonucleotide; AGG chr2 60509843 60509862 60509846 -
tggggctccttcaccacttc

SEQ ID NO: 177246 - DNA, 20 bp, Artificial Sequence
  Synthetic oligonucleotide; CAG chr2 60509836 60509855 60509839 -
ccttcaccacttcaggactt

SEQ ID NO: 177247 - DNA, 20 bp, Artificial Sequence
  Synthetic oligonucleotide; TGG chr2 60509833 60509852 60509836 -
tcaccacttcaggacttcag

SEQ ID NO: 177248 - DNA, 20 bp, Artificial Sequence
  Synthetic oligonucleotide; TAG chr2 60509826 60509845 60509829 -
ttcaggacttcagtggatgc

SEQ ID NO: 177249 - DNA, 20 bp, Artificial Sequence
  Synthetic oligonucleotide; CAG chr2 60509809 60509828 60509812 -
tgctagactactgccctgtt

SEQ ID NO: 177250 - DNA, 20 bp, Artificial Sequence
  Synthetic oligonucleotide; AGG chr2 60509808 60509827 60509811 -
gctagactactgccctgttc

SEQ ID NO: 177251 - DNA, 20 bp, Artificial Sequence
  Synthetic oligonucleotide; AAG chr2 60509805 60509824 60509808 -
agactactgccctgttcagg

SEQ ID NO: 177252 - DNA, 20 bp, Artificial Sequence
  Synthetic oligonucleotide; GAG chr2 60509797 60509816 60509800 -
gccctgttcaggaagatcgt

SEQ ID NO: 177253 - DNA, 20 bp, Artificial Sequence
  Synthetic oligonucleotide; AGG chr2 60509796 60509815 60509799 -
ccctgttcaggaagatcgtg

SEQ ID NO: 177254 - DNA, 20 bp, Artificial Sequence
  Synthetic oligonucleotide; GGG chr2 60509795 60509814 60509798 -
cctgttcaggaagatcgtga

SEQ ID NO: 177255 - DNA, 20 bp, Artificial Sequence
  Synthetic oligonucleotide; GGG chr2 60509794 60509813 60509797 -
ctgttcaggaagatcgtgag

SEQ ID NO: 177256 - DNA, 20 bp, Artificial Sequence
  Synthetic oligonucleotide; AAG chr2 60509790 60509809 60509793 -
tcaggaagatcgtgagggga

SEQ ID NO: 177257 - DNA, 20 bp, Artificial Sequence
  Synthetic oligonucleotide; GAG chr2 60509788 60509807 60509791 -
aggaagatcgtgaggggaaa

SEQ ID NO: 177258 - DNA, 20 bp, Artificial Sequence
  Synthetic oligonucleotide; GAG chr2 60509786 60509805 60509789 -
gaagatcgtgaggggaaaga

SEQ ID NO: 177259 - DNA, 20 bp, Artificial Sequence
  Synthetic oligonucleotide; TAG chr2 60509783 60509802 60509786 -
gatcgtgaggggaaagagag

SEQ ID NO: 177260 - DNA, 20 bp, Artificial Sequence
  Synthetic oligonucleotide; TGG chr2 60509769 60509788 60509772 -
agagagtagccccccgattg

SEQ ID NO: 177261 - DNA, 20 bp, Artificial Sequence
  Synthetic oligonucleotide; CGG chr2 60509761 60509780 60509764 -
gccccccgattgtggctgtt

SEQ ID NO: 177262 - DNA, 20 bp, Artificial Sequence
  Synthetic oligonucleotide; GAG chr2 60509759 60509778 60509762 -
cccccgattgtggctgttcg

SEQ ID NO: 177263 - DNA, 20 bp, Artificial Sequence
  Synthetic oligonucleotide; GAG chr2 60509757 60509776 60509760 -
cccgattgtggctgttcgga

SEQ ID NO: 177264 - DNA, 20 bp, Artificial Sequence
  Synthetic oligonucleotide; CAG chr2 60509751 60509770 60509754 -
tgtggctgttcggagagccc

SEQ ID NO: 177265 - DNA, 20 bp, Artificial Sequence
  Synthetic oligonucleotide; TAG chr2 60509737 60509756 60509740 -
gagccccagttgactgccta

SEQ ID NO: 177266 - DNA, 20 bp, Artificial Sequence
  Synthetic oligonucleotide; GAG chr2 60509732 60509751 60509735 -
ccagttgactgcctatagct

SEQ ID NO: 177267 - DNA, 20 bp, Artificial Sequence
  Synthetic oligonucleotide; AAG chr2 60509722 60509741 60509725 -
gcctatagctgagatgattt

SEQ ID NO: 177268 - DNA, 20 bp, Artificial Sequence
  Synthetic oligonucleotide; GAG chr2 60509717 60509736 60509720 -
tagctgagatgatttaagtc

SEQ ID NO: 177269 - DNA, 20 bp, Artificial Sequence
  Synthetic oligonucleotide; TGG chr2 60509709 60509728 60509712 -
atgatttaagtcgagttctt

SEQ ID NO: 177270 - DNA, 20 bp, Artificial Sequence
  Synthetic oligonucleotide; GGG chr2 60509708 60509727 60509711 -
tgatttaagtcgagttcttt

SEQ ID NO: 177271 - DNA, 20 bp, Artificial Sequence
  Synthetic oligonucleotide; GGG chr2 60509707 60509726 60509710 -
gatttaagtcgagttctttg

SEQ ID NO: 177272 - DNA, 20 bp, Artificial Sequence
  Synthetic oligonucleotide; GAG chr2 60509705 60509724 60509708 -
tttaagtcgagttctttggg

SEQ ID NO: 177273 - DNA, 20 bp, Artificial Sequence
  Synthetic oligonucleotide; AGG chr2 60509704 60509723 60509707 -
ttaagtcgagttctttgggg

SEQ ID NO: 177274 - DNA, 20 bp, Artificial Sequence
  Synthetic oligonucleotide; GGG chr2 60509703 60509722 60509706 -
taagtcgagttctttgggga

SEQ ID NO: 177275 - DNA, 20 bp, Artificial Sequence
  Synthetic oligonucleotide; CAG chr2 60509699 60509718 60509702 -
tcgagttctttggggagggc

SEQ ID NO: 177276 - DNA, 20 bp, Artificial Sequence
  Synthetic oligonucleotide; AGG chr2 60509698 60509717 60509701 -
cgagttctttggggagggcc

SEQ ID NO: 177277 - DNA, 20 bp, Artificial Sequence
  Synthetic oligonucleotide; TAG chr2 60509642 60509661 60509645 -
tttccttctctgttgttctt

SEQ ID NO: 177278 - DNA, 20 bp, Artificial Sequence
  Synthetic oligonucleotide; AAG chr2 60509633 60509652 60509636 -
ctgttgttctttagctacca

SEQ ID NO: 177279 - DNA, 20 bp, Artificial Sequence
  Synthetic oligonucleotide; CAG chr2 60509611 60509630 60509614 -
gacaacttgatcttttgatc

SEQ ID NO: 177280 - DNA, 20 bp, Artificial Sequence
  Synthetic oligonucleotide; AAG chr2 60509607 60509626 60509610 -
acttgatcttttgatccaga

SEQ ID NO: 177281 - DNA, 20 bp, Artificial Sequence
  Synthetic oligonucleotide; CAG chr2 60509561 60509580 60509564 -
tttcccttcgtttgttttct

SEQ ID NO: 177282 - DNA, 20 bp, Artificial Sequence
  Synthetic oligonucleotide; AGG chr2 60509560 60509579 60509563 -
ttcccttcgtttgttttctc

SEQ ID NO: 177283 - DNA, 20 bp, Artificial Sequence
  Synthetic oligonucleotide; CAG chr2 60509554 60509573 60509557 -
tcgtttgttttctcaggtct

SEQ ID NO: 177284 - DNA, 20 bp, Artificial Sequence
  Synthetic oligonucleotide; AGG chr2 60509553 60509572 60509556 -
cgtttgttttctcaggtctc

SEQ ID NO: 177285 - DNA, 20 bp, Artificial Sequence
  Synthetic oligonucleotide; TAG chr2 60509550 60509569 60509553 -
ttgttttctcaggtctcagg

SEQ ID NO: 177286 - DNA, 20 bp, Artificial Sequence
  Synthetic oligonucleotide; GAG chr2 60509541 60509560 60509544 -
caggtctcaggtagaccatc

SEQ ID NO: 177287 - DNA, 20 bp, Artificial Sequence
  Synthetic oligonucleotide; TGG chr2 60509527 60509546 60509530 -
accatcgagctgctgttaat

SEQ ID NO: 177288 - DNA, 20 bp, Artificial Sequence
  Synthetic oligonucleotide; TAG chr2 60509517 60509536 60509520 -
tgctgttaattggtgatatt

SEQ ID NO: 177289 - DNA, 20 bp, Artificial Sequence
  Synthetic oligonucleotide; AGG chr2 60509516 60509535 60509519 -
gctgttaattggtgatattt

SEQ ID NO: 177290 - DNA, 20 bp, Artificial Sequence
  Synthetic oligonucleotide; TGG chr2 60509511 60509530 60509514 -
taattggtgatatttaggaa

SEQ ID NO: 177291 - DNA, 20 bp, Artificial Sequence
  Synthetic oligonucleotide; GGG chr2 60509510 60509529 60509513 -
aattggtgatatttaggaat

SEQ ID NO: 177292 - DNA, 20 bp, Artificial Sequence
  Synthetic oligonucleotide; TGG chr2 60509506 60509525 60509509 -
ggtgatatttaggaatgggt

SEQ ID NO: 177293 - DNA, 20 bp, Artificial Sequence
  Synthetic oligonucleotide; AAG chr2 60509503 60509522 60509506 -
gatatttaggaatgggttgg

SEQ ID NO: 177294 - DNA, 20 bp, Artificial Sequence
  Synthetic oligonucleotide; TGG chr2 60509487 60509506 60509490 -
ttggaagctgcatcttttcc

SEQ ID NO: 177295 - DNA, 20 bp, Artificial Sequence
  Synthetic oligonucleotide; CAG chr2 60509478 60509497 60509481 -
gcatcttttcctggacttct

SEQ ID NO: 177296 - DNA, 20 bp, Artificial Sequence
  Synthetic oligonucleotide; AGG chr2 60509477 60509496 60509480 -
catcttttcctggacttctc

SEQ ID NO: 177297 - DNA, 20 bp, Artificial Sequence
  Synthetic oligonucleotide; CAG chr2 60509444 60509463 60509447 -
ccacgtgtcttgtgcttcca

SEQ ID NO: 177298 - DNA, 20 bp, Artificial Sequence
  Synthetic oligonucleotide; GAG chr2 60509430 60509449 60509433 -
cttccacagaaccgttttct

SEQ ID NO: 177299 - DNA, 20 bp, Artificial Sequence
  Synthetic oligonucleotide; TGG chr2 60509418 60509437 60509421 -
cgttttctgagacgtccgtg

SEQ ID NO: 177300 - DNA, 20 bp, Artificial Sequence
  Synthetic oligonucleotide; CAG chr2 60509403 60509422 60509406 -
ccgtgtggctctgctgtgct

SEQ ID NO: 177301 - DNA, 20 bp, Artificial Sequence
  Synthetic oligonucleotide; AGG chr2 60509402 60509421 60509405 -
cgtgtggctctgctgtgctc

SEQ ID NO: 177302 - DNA, 20 bp, Artificial Sequence
  Synthetic oligonucleotide; CGG chr2 60509395 60509414 60509398 -
ctctgctgtgctcaggtcca

SEQ ID NO: 177303 - DNA, 20 bp, Artificial Sequence
  Synthetic oligonucleotide; TAG chr2 60509391 60509410 60509394 -
gctgtgctcaggtccacggt

SEQ ID NO: 177304 - DNA, 20 bp, Artificial Sequence
  Synthetic oligonucleotide; TGG chr2 60509384 60509403 60509387 -
tcaggtccacggttagcccc

SEQ ID NO: 177305 - DNA, 20 bp, Artificial Sequence
  Synthetic oligonucleotide; TGG chr2 60509379 60509398 60509382 -
tccacggttagcccctggct

SEQ ID NO: 177306 - DNA, 20 bp, Artificial Sequence
  Synthetic oligonucleotide; CGG chr2 60509367 60509386 60509370 -
ccctggcttggaatttcttc

SEQ ID NO: 177307 - DNA, 20 bp, Artificial Sequence
  Synthetic oligonucleotide; CAG chr2 60509342 60509361 60509345 -
atccgttgtcctcttttcca

SEQ ID NO: 177308 - DNA, 20 bp, Artificial Sequence
  Synthetic oligonucleotide; AGG chr2 60509341 60509360 60509344 -
tccgttgtcctcttttccac

SEQ ID NO: 177309 - DNA, 20 bp, Artificial Sequence
  Synthetic oligonucleotide; TGG chr2 60509313 60509332 60509316 -
ctcctccctttccccatttc

SEQ ID NO: 177310 - DNA, 20 bp, Artificial Sequence
  Synthetic oligonucleotide; AAG chr2 60509309 60509328 60509312 -
tccctttccccatttctgga

SEQ ID NO: 177311 - DNA, 20 bp, Artificial Sequence
  Synthetic oligonucleotide; AAG chr2 60509306 60509325 60509309 -
ctttccccatttctggaaag

SEQ ID NO: 177312 - DNA, 20 bp, Artificial Sequence
  Synthetic oligonucleotide; TGG chr2 60509303 60509322 60509306 -
tccccatttctggaaagaag

SEQ ID NO: 177313 - DNA, 20 bp, Artificial Sequence
  Synthetic oligonucleotide; GGG chr2 60509302 60509321 60509305 -
ccccatttctggaaagaagt

SEQ ID NO: 177314 - DNA, 20 bp, Artificial Sequence
  Synthetic oligonucleotide; TGG chr2 60509298 60509317 60509301 -
atttctggaaagaagtgggc

SEQ ID NO: 177315 - DNA, 20 bp, Artificial Sequence
  Synthetic oligonucleotide; TAG chr2 60509291 60509310 60509294 -
gaaagaagtgggctggcaca

SEQ ID NO: 177316 - DNA, 20 bp, Artificial Sequence
  Synthetic oligonucleotide; GAG chr2 60509289 60509308 60509292 -
aagaagtgggctggcacata

SEQ ID NO: 177317 - DNA, 20 bp, Artificial Sequence
  Synthetic oligonucleotide; AAG chr2 60509273 60509292 60509276 -
catagagcctttttccttga

SEQ ID NO: 177318 - DNA, 20 bp, Artificial Sequence
  Synthetic oligonucleotide; AGG chr2 60509272 60509291 60509275 -
atagagcctttttccttgaa

SEQ ID NO: 177319 - DNA, 20 bp, Artificial Sequence
  Synthetic oligonucleotide; GAG chr2 60509270 60509289 60509273 -
agagcctttttccttgaaag

SEQ ID NO: 177320 - DNA, 20 bp, Artificial Sequence
  Synthetic oligonucleotide; GAG chr2 60509268 60509287 60509271 -
agcctttttccttgaaagga

SEQ ID NO: 177321 - DNA, 20 bp, Artificial Sequence
  Synthetic oligonucleotide; CAG chr2 60509263 60509282 60509266 -
ttttccttgaaaggagagtg

SEQ ID NO: 177322 - DNA, 20 bp, Artificial Sequence
  Synthetic oligonucleotide; GAG chr2 60509261 60509280 60509264 -
ttccttgaaaggagagtgca

SEQ ID NO: 177323 - DNA, 20 bp, Artificial Sequence
  Synthetic oligonucleotide; TGG chr2 60509250 60509269 60509253 -
gagagtgcagagccctctaa

SEQ ID NO: 177324 - DNA, 20 bp, Artificial Sequence
  Synthetic oligonucleotide; AAG chr2 60509245 60509264 60509248 -
tgcagagccctctaatggaa

SEQ ID NO: 177325 - DNA, 20 bp, Artificial Sequence
  Synthetic oligonucleotide; TGG chr2 60509230 60509249 60509233 -
tggaaaagtaaaaaaattct

SEQ ID NO: 177326 - DNA, 20 bp, Artificial Sequence
  Synthetic oligonucleotide; AAG chr2 60509211 60509230 60509214 -
ttggaatcctcataacatcc

SEQ ID NO: 177327 - DNA, 20 bp, Artificial Sequence
  Synthetic oligonucleotide; CAG chr2 60509207 60509226 60509210 -
aatcctcataacatccaagc

SEQ ID NO: 177328 - DNA, 20 bp, Artificial Sequence
  Synthetic oligonucleotide; AAG chr2 60509201 60509220 60509204 -
cataacatccaagccagcca

SEQ ID NO: 177329 - DNA, 20 bp, Artificial Sequence
  Synthetic oligonucleotide; GAG chr2 60509196 60509215 60509199 -
catccaagccagccaaagct

SEQ ID NO: 177330 - DNA, 20 bp, Artificial Sequence
  Synthetic oligonucleotide; AAG chr2 60509190 60509209 60509193 -
agccagccaaagctgagacc

SEQ ID NO: 177331 - DNA, 20 bp, Artificial Sequence
  Synthetic oligonucleotide; TGG chr2 60509179 60509198 60509182 -
gctgagaccaagtaaattat

SEQ ID NO: 177332 - DNA, 20 bp, Artificial Sequence
  Synthetic oligonucleotide; GGG chr2 60509178 60509197 60509181 -
ctgagaccaagtaaattatt

SEQ ID NO: 177333 - DNA, 20 bp, Artificial Sequence
  Synthetic oligonucleotide; GGG chr2 60509177 60509196 60509180 -
tgagaccaagtaaattattg

SEQ ID NO: 177334 - DNA, 20 bp, Artificial Sequence
  Synthetic oligonucleotide; GGG chr2 60509176 60509195 60509179 -
gagaccaagtaaattattgg

SEQ ID NO: 177335 - DNA, 20 bp, Artificial Sequence
  Synthetic oligonucleotide; GGG chr2 60509175 60509194 60509178 -
agaccaagtaaattattggg

SEQ ID NO: 177336 - DNA, 20 bp, Artificial Sequence
  Synthetic oligonucleotide; AAG chr2 60509164 60509183 60509167 -
attattggggggtaatttgc

SEQ ID NO: 177337 - DNA, 20 bp, Artificial Sequence
  Synthetic oligonucleotide; AGG chr2 60509163 60509182 60509166 -
ttattggggggtaatttgca

SEQ ID NO: 177338 - DNA, 20 bp, Artificial Sequence
  Synthetic oligonucleotide; GGG chr2 60509162 60509181 60509165 -
tattggggggtaatttgcaa

SEQ ID NO: 177339 - DNA, 20 bp, Artificial Sequence
  Synthetic oligonucleotide; CAG chr2 60509128 60509147 60509131 -
caaattgctttcttgtttct

SEQ ID NO: 177340 - DNA, 20 bp, Artificial Sequence
  Synthetic oligonucleotide; TAG chr2 60509115 60509134 60509118 -
tgtttctcagcttgaatctt

SEQ ID NO: 177341 - DNA, 20 bp, Artificial Sequence
  Synthetic oligonucleotide; CAG chr2 60509110 60509129 60509113 -
ctcagcttgaatctttagac

SEQ ID NO: 177342 - DNA, 20 bp, Artificial Sequence
  Synthetic oligonucleotide; AAG chr2 60509107 60509126 60509110 -
agcttgaatctttagaccag

SEQ ID NO: 177343 - DNA, 20 bp, Artificial Sequence
  Synthetic oligonucleotide; CGG chr2 60509094 60509113 60509097 -
agaccagaagcctgtgattt

SEQ ID NO: 177344 - DNA, 20 bp, Artificial Sequence
  Synthetic oligonucleotide; GAG chr2 60509092 60509111 60509095 -
accagaagcctgtgatttcg

SEQ ID NO: 177345 - DNA, 20 bp, Artificial Sequence
  Synthetic oligonucleotide; GAG chr2 60509083 60509102 60509086 -
ctgtgatttcggagtctgat

SEQ ID NO: 177346 - DNA, 20 bp, Artificial Sequence
  Synthetic oligonucleotide; AAG chr2 60509076 60509095 60509079 -
ttcggagtctgatgagaaat

SEQ ID NO: 177347 - DNA, 20 bp, Artificial Sequence
  Synthetic oligonucleotide; GAG chr2 60509074 60509093 60509077 -
cggagtctgatgagaaataa

SEQ ID NO: 177348 - DNA, 20 bp, Artificial Sequence
  Synthetic oligonucleotide; CAG chr2 60509070 60509089 60509073 -
gtctgatgagaaataagagt

SEQ ID NO: 177349 - DNA, 20 bp, Artificial Sequence
  Synthetic oligonucleotide; GAG chr2 60509056 60509075 60509059 -
aagagtcagtgtttctgtct

SEQ ID NO: 177350 - DNA, 20 bp, Artificial Sequence
  Synthetic oligonucleotide; TGG chr2 60509042 60509061 60509045 -
ctgtctgagccacttttctt

SEQ ID NO: 177351 - DNA, 20 bp, Artificial Sequence
  Synthetic oligonucleotide; GAG chr2 60509040 60509059 60509043 -
gtctgagccacttttctttg

SEQ ID NO: 177352 - DNA, 20 bp, Artificial Sequence
  Synthetic oligonucleotide; AGG chr2 60509039 60509058 60509042 -
tctgagccacttttctttgg

SEQ ID NO: 177353 - DNA, 20 bp, Artificial Sequence
  Synthetic oligonucleotide; GAG chr2 60509037 60509056 60509040 -
tgagccacttttctttggag

SEQ ID NO: 177354 - DNA, 20 bp, Artificial Sequence
  Synthetic oligonucleotide; AGG chr2 60509036 60509055 60509039 -
gagccacttttctttggagg

SEQ ID NO: 177355 - DNA, 20 bp, Artificial Sequence
  Synthetic oligonucleotide; TAG chr2 60509028 60509047 60509031 -
tttctttggaggaggtcctc

SEQ ID NO: 177356 - DNA, 20 bp, Artificial Sequence
  Synthetic oligonucleotide; AGG chr2 60509027 60509046 60509030 -
ttctttggaggaggtcctct

SEQ ID NO: 177357 - DNA, 20 bp, Artificial Sequence
  Synthetic oligonucleotide; TAG chr2 60509021 60509040 60509024 -
ggaggaggtcctctaggctt

SEQ ID NO: 177358 - DNA, 20 bp, Artificial Sequence
  Synthetic oligonucleotide; CAG chr2 60509012 60509031 60509015 -
cctctaggctttagcaatca

SEQ ID NO: 177359 - DNA, 20 bp, Artificial Sequence
  Synthetic oligonucleotide; AAG chr2 60509009 60509028 60509012 -
ctaggctttagcaatcacag

SEQ ID NO: 177360 - DNA, 20 bp, Artificial Sequence
  Synthetic oligonucleotide; CAG chr2 60509003 60509022 60509006 -
tttagcaatcacagaagaac

SEQ ID NO: 177361 - DNA, 20 bp, Artificial Sequence
  Synthetic oligonucleotide; CAG chr2 60508997 60509016 60509000 -
aatcacagaagaaccagtga

SEQ ID NO: 177362 - DNA, 20 bp, Artificial Sequence
  Synthetic oligonucleotide; AGG chr2 60508996 60509015 60508999 -
atcacagaagaaccagtgac

SEQ ID NO: 177363 - DNA, 20 bp, Artificial Sequence
  Synthetic oligonucleotide; TAG chr2 60508983 60509002 60508986 -
cagtgacaggttccttgtca

SEQ ID NO: 177364 - DNA, 20 bp, Artificial Sequence
  Synthetic oligonucleotide; AGG chr2 60508982 60509001 60508985 -
agtgacaggttccttgtcat

SEQ ID NO: 177365 - DNA, 20 bp, Artificial Sequence
  Synthetic oligonucleotide; GAG chr2 60508980 60508999 60508983 -
tgacaggttccttgtcatag

SEQ ID NO: 177366 - DNA, 20 bp, Artificial Sequence
  Synthetic oligonucleotide; GAG chr2 60508978 60508997 60508981 -
acaggttccttgtcatagga

SEQ ID NO: 177367 - DNA, 20 bp, Artificial Sequence
  Synthetic oligonucleotide; TGG chr2 60508970 60508989 60508973 -
cttgtcataggagagctcct

SEQ ID NO: 177368 - DNA, 20 bp, Artificial Sequence
  Synthetic oligonucleotide; CAG chr2 60508963 60508982 60508966 -
taggagagctccttggtcct

SEQ ID NO: 177369 - DNA, 20 bp, Artificial Sequence
  Synthetic oligonucleotide; AGG chr2 60508962 60508981 60508965 -
aggagagctccttggtcctc

SEQ ID NO: 177370 - DNA, 20 bp, Artificial Sequence
  Synthetic oligonucleotide; AAG chr2 60508953 60508972 60508956 -
ccttggtcctcaggattcaa

SEQ ID NO: 177371 - DNA, 20 bp, Artificial Sequence
  Synthetic oligonucleotide; AAG chr2 60508943 60508962 60508946 -
caggattcaaaagacacctt

SEQ ID NO: 177372 - DNA, 20 bp, Artificial Sequence
  Synthetic oligonucleotide; TAG chr2 60508940 60508959 60508943 -
gattcaaaagacaccttaag

SEQ ID NO: 177373 - DNA, 20 bp, Artificial Sequence
  Synthetic oligonucleotide; CAG chr2 60508937 60508956 60508940 -
tcaaaagacaccttaagtag

SEQ ID NO: 177374 - DNA, 20 bp, Artificial Sequence
  Synthetic oligonucleotide; TGG chr2 60508934 60508953 60508937 -
aaagacaccttaagtagcag

SEQ ID NO: 177375 - DNA, 20 bp, Artificial Sequence
  Synthetic oligonucleotide; GGG chr2 60508933 60508952 60508936 -
aagacaccttaagtagcagt

SEQ ID NO: 177376 - DNA, 20 bp, Artificial Sequence
  Synthetic oligonucleotide; TAG chr2 60508930 60508949 60508933 -
acaccttaagtagcagtggg

SEQ ID NO: 177377 - DNA, 20 bp, Artificial Sequence
  Synthetic oligonucleotide; AGG chr2 60508929 60508948 60508932 -
caccttaagtagcagtgggt

SEQ ID NO: 177378 - DNA, 20 bp, Artificial Sequence
  Synthetic oligonucleotide; GGG chr2 60508928 60508947 60508931 -
accttaagtagcagtgggta

SEQ ID NO: 177379 - DNA, 20 bp, Artificial Sequence
  Synthetic oligonucleotide; AAG chr2 60508922 60508941 60508925 -
agtagcagtgggtagggcgt

SEQ ID NO: 177380 - DNA, 20 bp, Artificial Sequence
  Synthetic oligonucleotide; AAG chr2 60508906 60508925 60508909 -
gcgtaagtttaacatccctc

SEQ ID NO: 177381 - DNA, 20 bp, Artificial Sequence
  Synthetic oligonucleotide; AGG chr2 60508905 60508924 60508908 -
cgtaagtttaacatccctca

SEQ ID NO: 177382 - DNA, 20 bp, Artificial Sequence
  Synthetic oligonucleotide; TAG chr2 60508902 60508921 60508905 -
aagtttaacatccctcaagg

SEQ ID NO: 177383 - DNA, 20 bp, Artificial Sequence
  Synthetic oligonucleotide; AGG chr2 60508901 60508920 60508904 -
agtttaacatccctcaaggt

SEQ ID NO: 177384 - DNA, 20 bp, Artificial Sequence
  Synthetic oligonucleotide; TAG chr2 60508895 60508914 60508898 -
acatccctcaaggtaggcct

SEQ ID NO: 177385 - DNA, 20 bp, Artificial Sequence
  Synthetic oligonucleotide; AGG chr2 60508894 60508913 60508897 -
catccctcaaggtaggcctt

SEQ ID NO: 177386 - DNA, 20 bp, Artificial Sequence
  Synthetic oligonucleotide; TGG chr2 60508872 60508891 60508875 -
gtttccctctgtcccctcta

SEQ ID NO: 177387 - DNA, 20 bp, Artificial Sequence
  Synthetic oligonucleotide; TGG chr2 60508866 60508885 60508869 -
ctctgtcccctctatggtgc

SEQ ID NO: 177388 - DNA, 20 bp, Artificial Sequence
  Synthetic oligonucleotide; TAG chr2 60508851 60508870 60508854 -
ggtgctggctttgccacatg

SEQ ID NO: 177389 - DNA, 20 bp, Artificial Sequence
  Synthetic oligonucleotide; TGG chr2 60508836 60508855 60508839 -
acatgtagaacaaactcttc

SEQ ID NO: 177390 - DNA, 20 bp, Artificial Sequence
  Synthetic oligonucleotide; TAG chr2 60508828 60508847 60508831 -
aacaaactcttctggaatca

SEQ ID NO: 177391 - DNA, 20 bp, Artificial Sequence
  Synthetic oligonucleotide; AGG chr2 60508827 60508846 60508830 -
acaaactcttctggaatcat

SEQ ID NO: 177392 - DNA, 20 bp, Artificial Sequence
  Synthetic oligonucleotide; AAG chr2 60508818 60508837 60508821 -
tctggaatcataggtaaccc

SEQ ID NO: 177393 - DNA, 20 bp, Artificial Sequence
  Synthetic oligonucleotide; AGG chr2 60508817 60508836 60508820 -
ctggaatcataggtaaccca

SEQ ID NO: 177394 - DNA, 20 bp, Artificial Sequence
  Synthetic oligonucleotide; GGG chr2 60508816 60508835 60508819 -
tggaatcataggtaacccaa

SEQ ID NO: 177395 - DNA, 20 bp, Artificial Sequence
  Synthetic oligonucleotide; GGG chr2 60508815 60508834 60508818 -
ggaatcataggtaacccaag

SEQ ID NO: 177396 - DNA, 20 bp, Artificial Sequence
  Synthetic oligonucleotide; GGG chr2 60508814 60508833 60508817 -
gaatcataggtaacccaagg

SEQ ID NO: 177397 - DNA, 20 bp, Artificial Sequence
  Synthetic oligonucleotide; GAG chr2 60508812 60508831 60508815 -
atcataggtaacccaagggg

SEQ ID NO: 177398 - DNA, 20 bp, Artificial Sequence
  Synthetic oligonucleotide; CAG chr2 60508807 60508826 60508810 -
aggtaacccaagggggagct

SEQ ID NO: 177399 - DNA, 20 bp, Artificial Sequence
  Synthetic oligonucleotide; GAG chr2 60508805 60508824 60508808 -
gtaacccaagggggagctca

SEQ ID NO: 177400 - DNA, 20 bp, Artificial Sequence
  Synthetic oligonucleotide; AAG chr2 60508802 60508821 60508805 -
acccaagggggagctcagag

SEQ ID NO: 177401 - DNA, 20 bp, Artificial Sequence
  Synthetic oligonucleotide; GAG chr2 60508800 60508819 60508803 -
ccaagggggagctcagagaa

SEQ ID NO: 177402 - DNA, 20 bp, Artificial Sequence
  Synthetic oligonucleotide; CAG chr2 60508795 60508814 60508798 -
ggggagctcagagaagagtc

SEQ ID NO: 177403 - DNA, 20 bp, Artificial Sequence
  Synthetic oligonucleotide; AGG chr2 60508794 60508813 60508797 -
gggagctcagagaagagtcc

SEQ ID NO: 177404 - DNA, 20 bp, Artificial Sequence
  Synthetic oligonucleotide; CAG chr2 60508787 60508806 60508790 -
cagagaagagtccaggctgc

SEQ ID NO: 177405 - DNA, 20 bp, Artificial Sequence
  Synthetic oligonucleotide; AAG chr2 60508780 60508799 60508783 -
gagtccaggctgccagtgca

SEQ ID NO: 177406 - DNA, 20 bp, Artificial Sequence
  Synthetic oligonucleotide; AGG chr2 60508779 60508798 60508782 -
agtccaggctgccagtgcaa

SEQ ID NO: 177407 - DNA, 20 bp, Artificial Sequence
  Synthetic oligonucleotide; CAG chr2 60508774 60508793 60508777 -
aggctgccagtgcaaaggtc

SEQ ID NO: 177408 - DNA, 20 bp, Artificial Sequence
  Synthetic oligonucleotide; AAG chr2 60508761 60508780 60508764 -
aaaggtccagccctgtcgcc

SEQ ID NO: 177409 - DNA, 20 bp, Artificial Sequence
  Synthetic oligonucleotide; AGG chr2 60508760 60508779 60508763 -
aaggtccagccctgtcgcca

SEQ ID NO: 177410 - DNA, 20 bp, Artificial Sequence
  Synthetic oligonucleotide; GAG chr2 60508758 60508777 60508761 -
ggtccagccctgtcgccaag

SEQ ID NO: 177411 - DNA, 20 bp, Artificial Sequence
  Synthetic oligonucleotide; CAG chr2 60508750 60508769 60508753 -
cctgtcgccaaggagaccct

SEQ ID NO: 177412 - DNA, 20 bp, Artificial Sequence
  Synthetic oligonucleotide; AGG chr2 60508749 60508768 60508752 -
ctgtcgccaaggagaccctc

SEQ ID NO: 177413 - DNA, 20 bp, Artificial Sequence
  Synthetic oligonucleotide; GGG chr2 60508748 60508767 60508751 -
tgtcgccaaggagaccctca

SEQ ID NO: 177414 - DNA, 20 bp, Artificial Sequence
  Synthetic oligonucleotide; CAG chr2 60508738 60508757 60508741 -
gagaccctcagggaaatgca

SEQ ID NO: 177415 - DNA, 20 bp, Artificial Sequence
  Synthetic oligonucleotide; AGG chr2 60508737 60508756 60508740 -
agaccctcagggaaatgcac

SEQ ID NO: 177416 - DNA, 20 bp, Artificial Sequence
  Synthetic oligonucleotide; CAG chr2 60508730 60508749 60508733 -
cagggaaatgcacaggcctc

SEQ ID NO: 177417 - DNA, 20 bp, Artificial Sequence
  Synthetic oligonucleotide; CGG chr2 60508718 60508737 60508721 -
caggcctccagctattccca

SEQ ID NO: 177418 - DNA, 20 bp, Artificial Sequence
  Synthetic oligonucleotide; TAG chr2 60508709 60508728 60508712 -
agctattcccacggcccctg

SEQ ID NO: 177419 - DNA, 20 bp, Artificial Sequence
  Synthetic oligonucleotide; GAG chr2 60508704 60508723 60508707 -
ttcccacggcccctgtagct

SEQ ID NO: 177420 - DNA, 20 bp, Artificial Sequence
  Synthetic oligonucleotide; CAG chr2 60508698 60508717 60508701 -
cggcccctgtagctgagcgc

SEQ ID NO: 177421 - DNA, 20 bp, Artificial Sequence
  Synthetic oligonucleotide; TGG chr2 60508687 60508706 60508690 -
gctgagcgccagcttcttcc

SEQ ID NO: 177422 - DNA, 20 bp, Artificial Sequence
  Synthetic oligonucleotide; GGG chr2 60508686 60508705 60508689 -
ctgagcgccagcttcttcct

SEQ ID NO: 177423 - DNA, 20 bp, Artificial Sequence
  Synthetic oligonucleotide; AAG chr2 60508681 60508700 60508684 -
cgccagcttcttcctgggcc

SEQ ID NO: 177424 - DNA, 20 bp, Artificial Sequence
  Synthetic oligonucleotide; GAG chr2 60508676 60508695 60508679 -
gcttcttcctgggccaagct

SEQ ID NO: 177425 - DNA, 20 bp, Artificial Sequence
  Synthetic oligonucleotide; AGG chr2 60508675 60508694 60508678 -
cttcttcctgggccaagctg

SEQ ID NO: 177426 - DNA, 20 bp, Artificial Sequence
  Synthetic oligonucleotide; TAG chr2 60508647 60508666 60508650 -
tcctgccgtgtccattctcc

SEQ ID NO: 177427 - DNA, 20 bp, Artificial Sequence
  Synthetic oligonucleotide; TGG chr2 60508631 60508650 60508634 -
ctcctagcaacgcttctctt

SEQ ID NO: 177428 - DNA, 20 bp, Artificial Sequence
  Synthetic oligonucleotide; CAG chr2 60508627 60508646 60508630 -
tagcaacgcttctctttggc

SEQ ID NO: 177429 - DNA, 20 bp, Artificial Sequence
  Synthetic oligonucleotide; TAG chr2 60508617 60508636 60508620 -
tctctttggccagtttgcca

SEQ ID NO: 177430 - DNA, 20 bp, Artificial Sequence
  Synthetic oligonucleotide; GAG chr2 60508609 60508628 60508612 -
gccagtttgccatagtacct

SEQ ID NO: 177431 - DNA, 20 bp, Artificial Sequence
  Synthetic oligonucleotide; AGG chr2 60508608 60508627 60508611 -
ccagtttgccatagtacctg

SEQ ID NO: 177432 - DNA, 20 bp, Artificial Sequence
  Synthetic oligonucleotide; AAG chr2 60508604 60508623 60508607 -
tttgccatagtacctgaggt

SEQ ID NO: 177433 - DNA, 20 bp, Artificial Sequence
  Synthetic oligonucleotide; CGG chr2 60508568 60508587 60508571 -
ctgccaaatgctttacatcc

SEQ ID NO: 177434 - DNA, 20 bp, Artificial Sequence
  Synthetic oligonucleotide; GAG chr2 60508566 60508585 60508569 -
gccaaatgctttacatcccg

SEQ ID NO: 177435 - DNA, 20 bp, Artificial Sequence
  Synthetic oligonucleotide; AGG chr2 60508565 60508584 60508568 -
ccaaatgctttacatcccgg

SEQ ID NO: 177436 - DNA, 20 bp, Artificial Sequence
  Synthetic oligonucleotide; AAG chr2 60508561 60508580 60508564 -
atgctttacatcccggagga

SEQ ID NO: 177437 - DNA, 20 bp, Artificial Sequence
  Synthetic oligonucleotide; AAG chr2 60508556 60508575 60508559 -
ttacatcccggaggaaagca

SEQ ID NO: 177438 - DNA, 20 bp, Artificial Sequence
  Synthetic oligonucleotide; CAG chr2 60508546 60508565 60508549 -
gaggaaagcaaagtcctctt

SEQ ID NO: 177439 - DNA, 20 bp, Artificial Sequence
  Synthetic oligonucleotide; CAG chr2 60508541 60508560 60508544 -
aagcaaagtcctcttcagaa

SEQ ID NO: 177440 - DNA, 20 bp, Artificial Sequence
  Synthetic oligonucleotide; AGG chr2 60508540 60508559 60508543 -
agcaaagtcctcttcagaac

SEQ ID NO: 177441 - DNA, 20 bp, Artificial Sequence
  Synthetic oligonucleotide; AAG chr2 60508535 60508554 60508538 -
agtcctcttcagaacaggaa

SEQ ID NO: 177442 - DNA, 20 bp, Artificial Sequence
  Synthetic oligonucleotide; CAG chr2 60508530 60508549 60508533 -
tcttcagaacaggaaaagtc

SEQ ID NO: 177443 - DNA, 20 bp, Artificial Sequence
  Synthetic oligonucleotide; CAG chr2 60508525 60508544 60508528 -
agaacaggaaaagtccagtg

SEQ ID NO: 177444 - DNA, 20 bp, Artificial Sequence
  Synthetic oligonucleotide; CAG chr2 60508504 60508523 60508507 -
agttccacactgtgctattc

SEQ ID NO: 177445 - DNA, 20 bp, Artificial Sequence
  Synthetic oligonucleotide; CAG chr2 60508494 60508513 60508497 -
tgtgctattccagaacctcc

SEQ ID NO: 177446 - DNA, 20 bp, Artificial Sequence
  Synthetic oligonucleotide; TAG chr2 60508473 60508492 60508476 -
agttgcattcctttgccaac

SEQ ID NO: 177447 - DNA, 20 bp, Artificial Sequence
  Synthetic oligonucleotide; AGG chr2 60508472 60508491 60508475 -
gttgcattcctttgccaact

SEQ ID NO: 177448 - DNA, 20 bp, Artificial Sequence
  Synthetic oligonucleotide; TAG chr2 60508461 60508480 60508464 -
ttgccaactaggtaatgtgc

SEQ ID NO: 177449 - DNA, 20 bp, Artificial Sequence
  Synthetic oligonucleotide; AGG chr2 60508460 60508479 60508463 -
tgccaactaggtaatgtgct

SEQ ID NO: 177450 - DNA, 20 bp, Artificial Sequence
  Synthetic oligonucleotide; GGG chr2 60508459 60508478 60508462 -
gccaactaggtaatgtgcta

SEQ ID NO: 177451 - DNA, 20 bp, Artificial Sequence
  Synthetic oligonucleotide; CAG chr2 60508444 60508463 60508447 -
tgctagggatatttgtctcg

SEQ ID NO: 177452 - DNA, 20 bp, Artificial Sequence
  Synthetic oligonucleotide; TGG chr2 60508437 60508456 60508440 -
gatatttgtctcgcagcaac

SEQ ID NO: 177453 - DNA, 20 bp, Artificial Sequence
  Synthetic oligonucleotide; TGG chr2 60508422 60508441 60508425 -
gcaactggcaaccccctgtt

SEQ ID NO: 177454 - DNA, 20 bp, Artificial Sequence
  Synthetic oligonucleotide; GGG chr2 60508421 60508440 60508424 -
caactggcaaccccctgttt

SEQ ID NO: 177455 - DNA, 20 bp, Artificial Sequence
  Synthetic oligonucleotide; AAG chr2 60508415 60508434 60508418 -
gcaaccccctgtttgggtaa

SEQ ID NO: 177456 - DNA, 20 bp, Artificial Sequence
  Synthetic oligonucleotide; CAG chr2 60508411 60508430 60508414 -
ccccctgtttgggtaaaagt

SEQ ID NO: 177457 - DNA, 20 bp, Artificial Sequence
  Synthetic oligonucleotide; CAG chr2 60508405 60508424 60508408 -
gtttgggtaaaagtcagact

SEQ ID NO: 177458 - DNA, 20 bp, Artificial Sequence
  Synthetic oligonucleotide; AGG chr2 60508404 60508423 60508407 -
tttgggtaaaagtcagactc

SEQ ID NO: 177459 - DNA, 20 bp, Artificial Sequence
  Synthetic oligonucleotide; GGG chr2 60508403 60508422 60508406 -
ttgggtaaaagtcagactca

SEQ ID NO: 177460 - DNA, 20 bp, Artificial Sequence
  Synthetic oligonucleotide; CGG chr2 60508397 60508416 60508400 -
aaaagtcagactcagggacc

SEQ ID NO: 177461 - DNA, 20 bp, Artificial Sequence
  Synthetic oligonucleotide; CAG chr2 60508391 60508410 60508394 -
cagactcagggacccggctg

SEQ ID NO: 177462 - DNA, 20 bp, Artificial Sequence
  Synthetic oligonucleotide; TGG chr2 60508376 60508395 60508379 -
ggctgcagtgcttgctcctg

SEQ ID NO: 177463 - DNA, 20 bp, Artificial Sequence
  Synthetic oligonucleotide; CAG chr2 60508367 60508386 60508370 -
gcttgctcctgtggcccctg

SEQ ID NO: 177464 - DNA, 20 bp, Artificial Sequence
  Synthetic oligonucleotide; AGG chr2 60508366 60508385 60508369 -
cttgctcctgtggcccctgc

SEQ ID NO: 177465 - DNA, 20 bp, Artificial Sequence
  Synthetic oligonucleotide; GGG chr2 60508365 60508384 60508368 -
ttgctcctgtggcccctgca

SEQ ID NO: 177466 - DNA, 20 bp, Artificial Sequence
  Synthetic oligonucleotide; GAG chr2 60508363 60508382 60508366 -
gctcctgtggcccctgcagg

SEQ ID NO: 177467 - DNA, 20 bp, Artificial Sequence
  Synthetic oligonucleotide; TGG chr2 60508358 60508377 60508361 -
tgtggcccctgcagggagtg

SEQ ID NO: 177468 - DNA, 20 bp, Artificial Sequence
  Synthetic oligonucleotide; TGG chr2 60508353 60508372 60508356 -
cccctgcagggagtgtggcc

SEQ ID NO: 177469 - DNA, 20 bp, Artificial Sequence
  Synthetic oligonucleotide; GGG chr2 60508352 60508371 60508355 -
ccctgcagggagtgtggcct

SEQ ID NO: 177470 - DNA, 20 bp, Artificial Sequence
  Synthetic oligonucleotide; GGG chr2 60508351 60508370 60508354 -
cctgcagggagtgtggcctg

SEQ ID NO: 177471 - DNA, 20 bp, Artificial Sequence
  Synthetic oligonucleotide; CAG chr2 60508332 60508351 60508335 -
ggggtgtaattctgcacacc

SEQ ID NO: 177472 - DNA, 20 bp, Artificial Sequence
  Synthetic oligonucleotide; AGG chr2 60508331 60508350 60508334 -
gggtgtaattctgcacaccc

SEQ ID NO: 177473 - DNA, 20 bp, Artificial Sequence
  Synthetic oligonucleotide; AAG chr2 60508328 60508347 60508331 -
tgtaattctgcacacccagg

SEQ ID NO: 177474 - DNA, 20 bp, Artificial Sequence
  Synthetic oligonucleotide; CAG chr2 60508302 60508321 60508305 -
ctctgtctcctctttcacat

SEQ ID NO: 177475 - DNA, 20 bp, Artificial Sequence
  Synthetic oligonucleotide; AGG chr2 60508301 60508320 60508304 -
tctgtctcctctttcacatc

SEQ ID NO: 177476 - DNA, 20 bp, Artificial Sequence
  Synthetic oligonucleotide; AAG chr2 60508278 60508297 60508281 -
ccttccctgtgtcctgaacc

SEQ ID NO: 177477 - DNA, 20 bp, Artificial Sequence
  Synthetic oligonucleotide; TGG chr2 60508273 60508292 60508276 -
cctgtgtcctgaaccaagtg

SEQ ID NO: 177478 - DNA, 20 bp, Artificial Sequence
  Synthetic oligonucleotide; GAG chr2 60508268 60508287 60508271 -
gtcctgaaccaagtgtggat

SEQ ID NO: 177479 - DNA, 20 bp, Artificial Sequence
  Synthetic oligonucleotide; GAG chr2 60508262 60508281 60508265 -
aaccaagtgtggatgagttt

SEQ ID NO: 177480 - DNA, 20 bp, Artificial Sequence
  Synthetic oligonucleotide; TAG chr2 60508251 60508270 60508254 -
gatgagtttgagcttcctcc

SEQ ID NO: 177481 - DNA, 20 bp, Artificial Sequence
  Synthetic oligonucleotide; TGG chr2 60508212 60508231 60508215 -
ttgttgttgttgttgttgtt

SEQ ID NO: 177482 - DNA, 20 bp, Artificial Sequence
  Synthetic oligonucleotide; GGG chr2 60508211 60508230 60508214 -
tgttgttgttgttgttgttt

SEQ ID NO: 177483 - DNA, 20 bp, Artificial Sequence
  Synthetic oligonucleotide; GGG chr2 60508210 60508229 60508213 -
gttgttgttgttgttgtttg

SEQ ID NO: 177484 - DNA, 20 bp, Artificial Sequence
  Synthetic oligonucleotide; GGG chr2 60508209 60508228 60508212 -
ttgttgttgttgttgtttgg

SEQ ID NO: 177485 - DNA, 20 bp, Artificial Sequence
  Synthetic oligonucleotide; TGG chr2 60508206 60508225 60508209 -
ttgttgttgttgtttggggg

SEQ ID NO: 177486 - DNA, 20 bp, Artificial Sequence
  Synthetic oligonucleotide; GGG chr2 60508205 60508224 60508208 -
tgttgttgttgtttgggggt

SEQ ID NO: 177487 - DNA, 20 bp, Artificial Sequence
  Synthetic oligonucleotide; GGG chr2 60508204 60508223 60508207 -
gttgttgttgtttgggggtg

SEQ ID NO: 177488 - DNA, 20 bp, Artificial Sequence
  Synthetic oligonucleotide; GGG chr2 60508203 60508222 60508206 -
ttgttgttgtttgggggtgg

SEQ ID NO: 177489 - DNA, 20 bp, Artificial Sequence
  Synthetic oligonucleotide; TAG chr2 60508200 60508219 60508203 -
ttgttgtttgggggtggggg

SEQ ID NO: 177490 - DNA, 20 bp, Artificial Sequence
  Synthetic oligonucleotide; CAG chr2 60508196 60508215 60508199 -
tgtttgggggtgggggtaga

SEQ ID NO: 177491 - DNA, 20 bp, Artificial Sequence
  Synthetic oligonucleotide; TGG chr2 60508190 60508209 60508193 -
ggggtgggggtagacagtgc

SEQ ID NO: 177492 - DNA, 20 bp, Artificial Sequence
  Synthetic oligonucleotide; GGG chr2 60508189 60508208 60508192 -
gggtgggggtagacagtgct

SEQ ID NO: 177493 - DNA, 20 bp, Artificial Sequence
  Synthetic oligonucleotide; CAG chr2 60508181 60508200 60508184 -
gtagacagtgctgggcctgt

SEQ ID NO: 177494 - DNA, 20 bp, Artificial Sequence
  Synthetic oligonucleotide; TAG chr2 60508173 60508192 60508176 -
tgctgggcctgtcagaattt

SEQ ID NO: 177495 - DNA, 20 bp, Artificial Sequence
  Synthetic oligonucleotide; AGG chr2 60508172 60508191 60508175 -
gctgggcctgtcagaatttt

SEQ ID NO: 177496 - DNA, 20 bp, Artificial Sequence
  Synthetic oligonucleotide; TGG chr2 60508168 60508187 60508171 -
ggcctgtcagaattttaggt

SEQ ID NO: 177497 - DNA, 20 bp, Artificial Sequence
  Synthetic oligonucleotide; GAG chr2 60508159 60508178 60508162 -
gaattttaggttggttcttt

SEQ ID NO: 177498 - DNA, 20 bp, Artificial Sequence
  Synthetic oligonucleotide; TAG chr2 60508143 60508162 60508146 -
ctttgagatgaataactact

SEQ ID NO: 177499 - DNA, 20 bp, Artificial Sequence
  Synthetic oligonucleotide; AAG chr2 60508113 60508132 60508116 -
tcaactacttttgtttgtga

SEQ ID NO: 177500 - DNA, 20 bp, Artificial Sequence
  Synthetic oligonucleotide; AAG chr2 60508109 60508128 60508112 -
ctacttttgtttgtgaaaga

SEQ ID NO: 177501 - DNA, 20 bp, Artificial Sequence
  Synthetic oligonucleotide; AGG chr2 60508108 60508127 60508111 -
tacttttgtttgtgaaagaa

SEQ ID NO: 177502 - DNA, 20 bp, Artificial Sequence
  Synthetic oligonucleotide; GGG chr2 60508107 60508126 60508110 -
acttttgtttgtgaaagaaa

SEQ ID NO: 177503 - DNA, 20 bp, Artificial Sequence
  Synthetic oligonucleotide; CAG chr2 60508104 60508123 60508107 -
tttgtttgtgaaagaaaggg

SEQ ID NO: 177504 - DNA, 20 bp, Artificial Sequence
  Synthetic oligonucleotide; AAG chr2 60508100 60508119 60508103 -
tttgtgaaagaaagggcagt

SEQ ID NO: 177505 - DNA, 20 bp, Artificial Sequence
  Synthetic oligonucleotide; GAG chr2 60508086 60508105 60508089 -
ggcagtaagcaccatgacat

SEQ ID NO: 177506 - DNA, 20 bp, Artificial Sequence
  Synthetic oligonucleotide; GAG chr2 60508084 60508103 60508087 -
cagtaagcaccatgacatga

SEQ ID NO: 177507 - DNA, 20 bp, Artificial Sequence
  Synthetic oligonucleotide; CAG chr2 60508076 60508095 60508079 -
accatgacatgagagaattt

SEQ ID NO: 177508 - DNA, 20 bp, Artificial Sequence
  Synthetic oligonucleotide; AGG chr2 60508075 60508094 60508078 -
ccatgacatgagagaatttc

SEQ ID NO: 177509 - DNA, 20 bp, Artificial Sequence
  Synthetic oligonucleotide; CAG chr2 60508032 60508051 60508035 -
gtgtttgcatctgtcgtgct

SEQ ID NO: 177510 - DNA, 20 bp, Artificial Sequence
  Synthetic oligonucleotide; TAG chr2 60508028 60508047 60508031 -
ttgcatctgtcgtgctcagt

SEQ ID NO: 177511 - DNA, 20 bp, Artificial Sequence
  Synthetic oligonucleotide; AGG chr2 60508027 60508046 60508030 -
tgcatctgtcgtgctcagtt

SEQ ID NO: 177512 - DNA, 20 bp, Artificial Sequence
  Synthetic oligonucleotide; GGG chr2 60508026 60508045 60508029 -
gcatctgtcgtgctcagtta

SEQ ID NO: 177513 - DNA, 20 bp, Artificial Sequence
  Synthetic oligonucleotide; TAG chr2 60508006 60508025 60508009 -
gggcattatccgtaacccca

SEQ ID NO: 177514 - DNA, 20 bp, Artificial Sequence
  Synthetic oligonucleotide; AGG chr2 60508005 60508024 60508008 -
ggcattatccgtaaccccat

SEQ ID NO: 177515 - DNA, 20 bp, Artificial Sequence
  Synthetic oligonucleotide; AAG chr2 60507991 60508010 60507994 -
ccccataggaaccaacaccg

SEQ ID NO: 177516 - DNA, 20 bp, Artificial Sequence
  Synthetic oligonucleotide; AAG chr2 60507974 60507993 60507977 -
ccgaagaccatatgatttta

SEQ ID NO: 177517 - DNA, 20 bp, Artificial Sequence
  Synthetic oligonucleotide; TAG chr2 60507968 60507987 60507971 -
accatatgattttaaagctt

SEQ ID NO: 177518 - DNA, 20 bp, Artificial Sequence
  Synthetic oligonucleotide; TAG chr2 60507913 60507932 60507916 -
ttttttttgttcttttgctt

SEQ ID NO: 177519 - DNA, 20 bp, Artificial Sequence
  Synthetic oligonucleotide; TAG chr2 60507891 60507910 60507894 -
gaaactgtaataataatcca

SEQ ID NO: 177520 - DNA, 20 bp, Artificial Sequence
  Synthetic oligonucleotide; TAG chr2 60507877 60507896 60507880 -
aatccatagtaattatccca

SEQ ID NO: 177521 - DNA, 20 bp, Artificial Sequence
  Synthetic oligonucleotide; CAG chr2 60507857 60507876 60507860 -
tagtatgctgtcctttgtta

SEQ ID NO: 177522 - DNA, 20 bp, Artificial Sequence
  Synthetic oligonucleotide; AGG chr2 60507856 60507875 60507859 -
agtatgctgtcctttgttac

SEQ ID NO: 177523 - DNA, 20 bp, Artificial Sequence
  Synthetic oligonucleotide; GAG chr2 60507854 60507873 60507857 -
tatgctgtcctttgttacag

SEQ ID NO: 177524 - DNA, 20 bp, Artificial Sequence
  Synthetic oligonucleotide; TGG chr2 60507848 60507867 60507851 -
gtcctttgttacaggagcat

SEQ ID NO: 177525 - DNA, 20 bp, Artificial Sequence
  Synthetic oligonucleotide; AAG chr2 60507836 60507855 60507839 -
aggagcattggattactgtg

SEQ ID NO: 177526 - DNA, 20 bp, Artificial Sequence
  Synthetic oligonucleotide; CAG chr2 60507819 60507838 60507822 -
gtgaagacgtgtcctgtata

SEQ ID NO: 177527 - DNA, 20 bp, Artificial Sequence
  Synthetic oligonucleotide; CAG chr2 60507810 60507829 60507813 -
tgtcctgtatacagtttcaa

SEQ ID NO: 177528 - DNA, 20 bp, Artificial Sequence
  Synthetic oligonucleotide; TGG chr2 60507735 60507754 60507738 -
gctttctgtcttgtgctgtt

SEQ ID NO: 177529 - DNA, 20 bp, Artificial Sequence
  Synthetic oligonucleotide; AAG chr2 60507732 60507751 60507735 -
ttctgtcttgtgctgtttgg

SEQ ID NO: 177530 - DNA, 20 bp, Artificial Sequence
  Synthetic oligonucleotide; TAG chr2 60507701 60507720 60507704 -
cacatttctgccatatgtct

SEQ ID NO: 177531 - DNA, 20 bp, Artificial Sequence
  Synthetic oligonucleotide; AAG chr2 60507696 60507715 60507699 -
ttctgccatatgtcttagaa

SEQ ID NO: 177532 - DNA, 20 bp, Artificial Sequence
  Synthetic oligonucleotide; TGG chr2 60507692 60507711 60507695 -
gccatatgtcttagaaaagc

SEQ ID NO: 177533 - DNA, 20 bp, Artificial Sequence
  Synthetic oligonucleotide; GGG chr2 60507691 60507710 60507694 -
ccatatgtcttagaaaagct

SEQ ID NO: 177534 - DNA, 20 bp, Artificial Sequence
  Synthetic oligonucleotide; GGG chr2 60507690 60507709 60507693 -
catatgtcttagaaaagctg

SEQ ID NO: 177535 - DNA, 20 bp, Artificial Sequence
  Synthetic oligonucleotide; TAG chr2 60507684 60507703 60507687 -
tcttagaaaagctggggact

SEQ ID NO: 177536 - DNA, 20 bp, Artificial Sequence
  Synthetic oligonucleotide; AAG chr2 60507681 60507700 60507684 -
tagaaaagctggggacttag

SEQ ID NO: 177537 - DNA, 20 bp, Artificial Sequence
  Synthetic oligonucleotide; CAG chr2 60507678 60507697 60507681 -
aaaagctggggacttagaag

SEQ ID NO: 177538 - DNA, 20 bp, Artificial Sequence
  Synthetic oligonucleotide; TAG chr2 60507675 60507694 60507678 -
agctggggacttagaagcag

SEQ ID NO: 177539 - DNA, 20 bp, Artificial Sequence
  Synthetic oligonucleotide; TAG chr2 60507666 60507685 60507669 -
cttagaagcagtagccgact

SEQ ID NO: 177540 - DNA, 20 bp, Artificial Sequence
  Synthetic oligonucleotide; AGG chr2 60507665 60507684 60507668 -
ttagaagcagtagccgactt

SEQ ID NO: 177541 - DNA, 20 bp, Artificial Sequence
  Synthetic oligonucleotide; CAG chr2 60507661 60507680 60507664 -
aagcagtagccgacttagga

SEQ ID NO: 177542 - DNA, 20 bp, Artificial Sequence
  Synthetic oligonucleotide; AAG chr2 60507657 60507676 60507660 -
agtagccgacttaggacagc

SEQ ID NO: 177543 - DNA, 20 bp, Artificial Sequence
  Synthetic oligonucleotide; CAG chr2 60507652 60507671 60507655 -
ccgacttaggacagcaagct

SEQ ID NO: 177544 - DNA, 20 bp, Artificial Sequence
  Synthetic oligonucleotide; CAG chr2 60507647 60507666 60507650 -
ttaggacagcaagctcagct

SEQ ID NO: 177545 - DNA, 20 bp, Artificial Sequence
  Synthetic oligonucleotide; AGG chr2 60507646 60507665 60507649 -
taggacagcaagctcagctc

SEQ ID NO: 177546 - DNA, 20 bp, Artificial Sequence
  Synthetic oligonucleotide; CGG chr2 60507641 60507660 60507644 -
cagcaagctcagctcaggtg

SEQ ID NO: 177547 - DNA, 20 bp, Artificial Sequence
  Synthetic oligonucleotide; GAG chr2 60507639 60507658 60507642 -
gcaagctcagctcaggtgcg

SEQ ID NO: 177548 - DNA, 20 bp, Artificial Sequence
  Synthetic oligonucleotide; AGG chr2 60507638 60507657 60507641 -
caagctcagctcaggtgcgg

SEQ ID NO: 177549 - DNA, 20 bp, Artificial Sequence
  Synthetic oligonucleotide; CAG chr2 60507635 60507654 60507638 -
gctcagctcaggtgcggagg

SEQ ID NO: 177550 - DNA, 20 bp, Artificial Sequence
  Synthetic oligonucleotide; AAG chr2 60507624 60507643 60507627 -
gtgcggaggcagccctgtgt

SEQ ID NO: 177551 - DNA, 20 bp, Artificial Sequence
  Synthetic oligonucleotide; GAG chr2 60507622 60507641 60507625 -
gcggaggcagccctgtgtaa

SEQ ID NO: 177552 - DNA, 20 bp, Artificial Sequence
  Synthetic oligonucleotide; CAG chr2 60507608 60507627 60507611 -
gtgtaagagactctgttatg

SEQ ID NO: 177553 - DNA, 20 bp, Artificial Sequence
  Synthetic oligonucleotide; GAG chr2 60507604 60507623 60507607 -
aagagactctgttatgcagt

SEQ ID NO: 177554 - DNA, 20 bp, Artificial Sequence
  Synthetic oligonucleotide; CAG chr2 60507592 60507611 60507595 -
tatgcagtgagctgttgaaa

SEQ ID NO: 177555 - DNA, 20 bp, Artificial Sequence
  Synthetic oligonucleotide; TGG chr2 60507582 60507601 60507585 -
gctgttgaaacagctgcatg

SEQ ID NO: 177556 - DNA, 20 bp, Artificial Sequence
  Synthetic oligonucleotide; CAG chr2 60507576 60507595 60507579 -
gaaacagctgcatgtggaaa

SEQ ID NO: 177557 - DNA, 20 bp, Artificial Sequence
  Synthetic oligonucleotide; GAG chr2 60507545 60507564 60507548 -
cttgcctgtcctcatttctt

SEQ ID NO: 177558 - DNA, 20 bp, Artificial Sequence
  Synthetic oligonucleotide; GAG chr2 60507543 60507562 60507546 -
tgcctgtcctcatttcttga

SEQ ID NO: 177559 - DNA, 20 bp, Artificial Sequence
  Synthetic oligonucleotide; AAG chr2 60507516 60507535 60507519 -
caaaacatctgaaaatgtaa

SEQ ID NO: 177560 - DNA, 20 bp, Artificial Sequence
  Synthetic oligonucleotide; AAG chr2 60507505 60507524 60507508 -
aaaatgtaaaagcacttcac

SEQ ID NO: 177561 - DNA, 20 bp, Artificial Sequence
  Synthetic oligonucleotide; AGG chr2 60507504 60507523 60507507 -
aaatgtaaaagcacttcaca

SEQ ID NO: 177562 - DNA, 20 bp, Artificial Sequence
  Synthetic oligonucleotide; TGG chr2 60507489 60507508 60507492 -
tcacaaggttttaacttttc

SEQ ID NO: 177563 - DNA, 20 bp, Artificial Sequence
  Synthetic oligonucleotide; CGG chr2 60507480 60507499 60507483 -
tttaacttttctggcttgaa

SEQ ID NO: 177564 - DNA, 20 bp, Artificial Sequence
  Synthetic oligonucleotide; AAG chr2 60507477 60507496 60507480 -
aacttttctggcttgaacgg

SEQ ID NO: 177565 - DNA, 20 bp, Artificial Sequence
  Synthetic oligonucleotide; CAG chr2 60507474 60507493 60507477 -
ttttctggcttgaacggaag

SEQ ID NO: 177566 - DNA, 20 bp, Artificial Sequence
  Synthetic oligonucleotide; AAG chr2 60507467 60507486 60507470 -
gcttgaacggaagcagcttc

SEQ ID NO: 177567 - DNA, 20 bp, Artificial Sequence
  Synthetic oligonucleotide; AAG chr2 60507459 60507478 60507462 -
ggaagcagcttcaagtcaac

SEQ ID NO: 177568 - DNA, 20 bp, Artificial Sequence
  Synthetic oligonucleotide; GAG chr2 60507457 60507476 60507460 -
aagcagcttcaagtcaacaa

SEQ ID NO: 177569 - DNA, 20 bp, Artificial Sequence
  Synthetic oligonucleotide; TAG chr2 60507449 60507468 60507452 -
tcaagtcaacaagagcacaa

SEQ ID NO: 177570 - DNA, 20 bp, Artificial Sequence
  Synthetic oligonucleotide; TAG chr2 60507440 60507459 60507443 -
caagagcacaatagtctttg

SEQ ID NO: 177571 - DNA, 20 bp, Artificial Sequence
  Synthetic oligonucleotide; AGG chr2 60507439 60507458 60507442 -
aagagcacaatagtctttgt

SEQ ID NO: 177572 - DNA, 20 bp, Artificial Sequence
  Synthetic oligonucleotide; TGG chr2 60507433 60507452 60507436 -
acaatagtctttgtaggttt

SEQ ID NO: 177573 - DNA, 20 bp, Artificial Sequence
  Synthetic oligonucleotide; CAG chr2 60507427 60507446 60507430 -
gtctttgtaggttttggaca

SEQ ID NO: 177574 - DNA, 20 bp, Artificial Sequence
  Synthetic oligonucleotide; TAG chr2 60507419 60507438 60507422 -
aggttttggacacagttttc

SEQ ID NO: 177575 - DNA, 20 bp, Artificial Sequence
  Synthetic oligonucleotide; AAG chr2 60507410 60507429 60507413 -
acacagttttctagcttttc

SEQ ID NO: 177576 - DNA, 20 bp, Artificial Sequence
  Synthetic oligonucleotide; AAG chr2 60507406 60507425 60507409 -
agttttctagcttttcaaga

SEQ ID NO: 177577 - DNA, 20 bp, Artificial Sequence
  Synthetic oligonucleotide; AGG chr2 60507405 60507424 60507408 -
gttttctagcttttcaagaa

SEQ ID NO: 177578 - DNA, 20 bp, Artificial Sequence
  Synthetic oligonucleotide; AAG chr2 60507401 60507420 60507404 -
tctagcttttcaagaaaggc

SEQ ID NO: 177579 - DNA, 20 bp, Artificial Sequence
  Synthetic oligonucleotide; AGG chr2 60507400 60507419 60507403 -
ctagcttttcaagaaaggca

SEQ ID NO: 177580 - DNA, 20 bp, Artificial Sequence
  Synthetic oligonucleotide; GGG chr2 60507399 60507418 60507402 -
tagcttttcaagaaaggcaa

SEQ ID NO: 177581 - DNA, 20 bp, Artificial Sequence
  Synthetic oligonucleotide; CAG chr2 60507182 60507201 60507185 -
ttgtcttgctttgcattctg

SEQ ID NO: 177582 - DNA, 20 bp, Artificial Sequence
  Synthetic oligonucleotide; GAG chr2 60507180 60507199 60507183 -
gtcttgctttgcattctgca

SEQ ID NO: 177583 - DNA, 20 bp, Artificial Sequence
  Synthetic oligonucleotide; TAG chr2 60507176 60507195 60507179 -
tgctttgcattctgcagagc

SEQ ID NO: 177584 - DNA, 20 bp, Artificial Sequence
  Synthetic oligonucleotide; AAG chr2 60507173 60507192 60507176 -
tttgcattctgcagagctag

SEQ ID NO: 177585 - DNA, 20 bp, Artificial Sequence
  Synthetic oligonucleotide; GAG chr2 60507171 60507190 60507174 -
tgcattctgcagagctagaa

SEQ ID NO: 177586 - DNA, 20 bp, Artificial Sequence
  Synthetic oligonucleotide; TGG chr2 60507157 60507176 60507160 -
ctagaagagcatttaatcct

SEQ ID NO: 177587 - DNA, 20 bp, Artificial Sequence
  Synthetic oligonucleotide; TGG chr2 60507142 60507161 60507145 -
atccttggccctctgtctgt

SEQ ID NO: 177588 - DNA, 20 bp, Artificial Sequence
  Synthetic oligonucleotide; GGG chr2 60507141 60507160 60507144 -
tccttggccctctgtctgtt

SEQ ID NO: 177589 - DNA, 20 bp, Artificial Sequence
  Synthetic oligonucleotide; TAG chr2 60507121 60507140 60507124 -
gggatattatgtttttttaa

SEQ ID NO: 177590 - DNA, 20 bp, Artificial Sequence
  Synthetic oligonucleotide; AAG chr2 60507103 60507122 60507106 -
aatagtgcttgtttatgact

SEQ ID NO: 177591 - DNA, 20 bp, Artificial Sequence
  Synthetic oligonucleotide; AGG chr2 60507102 60507121 60507105 -
atagtgcttgtttatgacta

SEQ ID NO: 177592 - DNA, 20 bp, Artificial Sequence
  Synthetic oligonucleotide; AAG chr2 60507096 60507115 60507099 -
cttgtttatgactaaggtca

SEQ ID NO: 177593 - DNA, 20 bp, Artificial Sequence
  Synthetic oligonucleotide; CAG chr2 60507092 60507111 60507095 -
tttatgactaaggtcaaaga

SEQ ID NO: 177594 - DNA, 20 bp, Artificial Sequence
  Synthetic oligonucleotide; CAG chr2 60507084 60507103 60507087 -
taaggtcaaagacagtattt

SEQ ID NO: 177595 - DNA, 20 bp, Artificial Sequence
  Synthetic oligonucleotide; TAG chr2 60507072 60507091 60507075 -
cagtatttcagaacaaaaat

SEQ ID NO: 177596 - DNA, 20 bp, Artificial Sequence
  Synthetic oligonucleotide; GAG chr2 60507070 60507089 60507073 -
gtatttcagaacaaaaatta

SEQ ID NO: 177597 - DNA, 20 bp, Artificial Sequence
  Synthetic oligonucleotide; TAG chr2 60507066 60507085 60507069 -
ttcagaacaaaaattagagt

SEQ ID NO: 177598 - DNA, 20 bp, Artificial Sequence
  Synthetic oligonucleotide; GAG chr2 60507054 60507073 60507057 -
attagagttagttcataatt

SEQ ID NO: 177599 - DNA, 20 bp, Artificial Sequence
  Synthetic oligonucleotide; TAG chr2 60507023 60507042 60507026 -
tacgttactgtttattttta

SEQ ID NO: 177600 - DNA, 20 bp, Artificial Sequence
  Synthetic oligonucleotide; CAG chr2 60507000 60507019 60507003 -
tttgctaatttatttttaaa

SEQ ID NO: 177601 - DNA, 20 bp, Artificial Sequence
  Synthetic oligonucleotide; CAG chr2 60506995 60507014 60506998 -
taatttatttttaaacagct

SEQ ID NO: 177602 - DNA, 20 bp, Artificial Sequence
  Synthetic oligonucleotide; TAG chr2 60506975 60506994 60506978 -
cagttacgccaacatgttta

SEQ ID NO: 177603 - DNA, 20 bp, Artificial Sequence
  Synthetic oligonucleotide; CAG chr2 60506950 60506969 60506953 -
ctgttcatcacatgccttac

SEQ ID NO: 177604 - DNA, 20 bp, Artificial Sequence
  Synthetic oligonucleotide; CAG chr2 60506946 60506965 60506949 -
tcatcacatgccttaccagt

SEQ ID NO: 177605 - DNA, 20 bp, Artificial Sequence
  Synthetic oligonucleotide; AGG chr2 60506945 60506964 60506948 -
catcacatgccttaccagtc

SEQ ID NO: 177606 - DNA, 20 bp, Artificial Sequence
  Synthetic oligonucleotide; GGG chr2 60506944 60506963 60506947 -
atcacatgccttaccagtca

SEQ ID NO: 177607 - DNA, 20 bp, Artificial Sequence
  Synthetic oligonucleotide; AAG chr2 60506935 60506954 60506938 -
cttaccagtcagggtgttaa

SEQ ID NO: 177608 - DNA, 20 bp, Artificial Sequence
  Synthetic oligonucleotide; AGG chr2 60506934 60506953 60506937 -
ttaccagtcagggtgttaaa

SEQ ID NO: 177609 - DNA, 20 bp, Artificial Sequence
  Synthetic oligonucleotide; TAG chr2 60506917 60506936 60506920 -
aaaaggcacatgcttttcaa

SEQ ID NO: 177610 - DNA, 20 bp, Artificial Sequence
  Synthetic oligonucleotide; TGG chr2 60506912 60506931 60506915 -
gcacatgcttttcaatagtt

SEQ ID NO: 177611 - DNA, 20 bp, Artificial Sequence
  Synthetic oligonucleotide; AAG chr2 60506904 60506923 60506907 -
ttttcaatagtttggatccc

SEQ ID NO: 177612 - DNA, 20 bp, Artificial Sequence
  Synthetic oligonucleotide; TAG chr2 60506895 60506914 60506898 -
gtttggatcccaagttaaat

SEQ ID NO: 177613 - DNA, 20 bp, Artificial Sequence
  Synthetic oligonucleotide; CAG chr2 60506882 60506901 60506885 -
gttaaattagataatgccat

SEQ ID NO: 177614 - DNA, 20 bp, Artificial Sequence
  Synthetic oligonucleotide; AGG chr2 60506881 60506900 60506884 -
ttaaattagataatgccatc

SEQ ID NO: 177615 - DNA, 20 bp, Artificial Sequence
  Synthetic oligonucleotide; TAG chr2 60506878 60506897 60506881 -
aattagataatgccatcagg

SEQ ID NO: 177616 - DNA, 20 bp, Artificial Sequence
  Synthetic oligonucleotide; TAG chr2 60506849 60506868 60506852 -
aattacattaattgaatgtt

SEQ ID NO: 177617 - DNA, 20 bp, Artificial Sequence
  Synthetic oligonucleotide; AGG chr2 60506848 60506867 60506851 -
attacattaattgaatgttt

SEQ ID NO: 177618 - DNA, 20 bp, Artificial Sequence
  Synthetic oligonucleotide; CGG chr2 60506845 60506864 60506848 -
acattaattgaatgtttagg

SEQ ID NO: 177619 - DNA, 20 bp, Artificial Sequence
  Synthetic oligonucleotide; AAG chr2 60506841 60506860 60506844 -
taattgaatgtttaggcgga

SEQ ID NO: 177620 - DNA, 20 bp, Artificial Sequence
  Synthetic oligonucleotide; AGG chr2 60506840 60506859 60506843 -
aattgaatgtttaggcggaa

SEQ ID NO: 177621 - DNA, 20 bp, Artificial Sequence
  Synthetic oligonucleotide; TAG chr2 60506837 60506856 60506840 -
tgaatgtttaggcggaaagg

SEQ ID NO: 177622 - DNA, 20 bp, Artificial Sequence
  Synthetic oligonucleotide; CAG chr2 60506829 60506848 60506832 -
taggcggaaaggtagttttg

SEQ ID NO: 177623 - DNA, 20 bp, Artificial Sequence
  Synthetic oligonucleotide; GAG chr2 60506827 60506846 60506830 -
ggcggaaaggtagttttgca

SEQ ID NO: 177624 - DNA, 20 bp, Artificial Sequence
  Synthetic oligonucleotide; AGG chr2 60506826 60506845 60506829 -
gcggaaaggtagttttgcag

SEQ ID NO: 177625 - DNA, 20 bp, Artificial Sequence
  Synthetic oligonucleotide; AAG chr2 60506802 60506821 60506805 -
tataatgaaatcacatttat

SEQ ID NO: 177626 - DNA, 20 bp, Artificial Sequence
  Synthetic oligonucleotide; CAG chr2 60506782 60506801 60506785 -
aagtacccatgtataaatct

SEQ ID NO: 177627 - DNA, 20 bp, Artificial Sequence
  Synthetic oligonucleotide; TAG chr2 60506774 60506793 60506777 -
atgtataaatctcagcatta

SEQ ID NO: 177628 - DNA, 20 bp, Artificial Sequence
  Synthetic oligonucleotide; GAG chr2 60506762 60506781 60506765 -
cagcattatagacattattt

SEQ ID NO: 177629 - DNA, 20 bp, Artificial Sequence
  Synthetic oligonucleotide; AGG chr2 60506761 60506780 60506764 -
agcattatagacattatttg

SEQ ID NO: 177630 - DNA, 20 bp, Artificial Sequence
  Synthetic oligonucleotide; CAG chr2 60506751 60506770 60506754 -
acattatttgaggttgctga

SEQ ID NO: 177631 - DNA, 20 bp, Artificial Sequence
  Synthetic oligonucleotide; TGG chr2 60506743 60506762 60506746 -
tgaggttgctgacagaaaaa

SEQ ID NO: 177632 - DNA, 20 bp, Artificial Sequence
  Synthetic oligonucleotide; CAG chr2 60506732 60506751 60506735 -
acagaaaaatggatatatat

SEQ ID NO: 177633 - DNA, 20 bp, Artificial Sequence
  Synthetic oligonucleotide; AGG chr2 60506731 60506750 60506734 -
cagaaaaatggatatatatc

SEQ ID NO: 177634 - DNA, 20 bp, Artificial Sequence
  Synthetic oligonucleotide; TAG chr2 60506724 60506743 60506727 -
atggatatatatcaggcgtt

SEQ ID NO: 177635 - DNA, 20 bp, Artificial Sequence
  Synthetic oligonucleotide; AGG chr2 60506723 60506742 60506726 -
tggatatatatcaggcgttt

SEQ ID NO: 177636 - DNA, 20 bp, Artificial Sequence
  Synthetic oligonucleotide; GAG chr2 60506721 60506740 60506724 -
gatatatatcaggcgtttag

SEQ ID NO: 177637 - DNA, 20 bp, Artificial Sequence
  Synthetic oligonucleotide; AGG chr2 60506720 60506739 60506723 -
atatatatcaggcgtttagg

SEQ ID NO: 177638 - DNA, 20 bp, Artificial Sequence
  Synthetic oligonucleotide; CGG chr2 60506710 60506729 60506713 -
ggcgtttaggaggaaacatg

SEQ ID NO: 177639 - DNA, 20 bp, Artificial Sequence
  Synthetic oligonucleotide; GGG chr2 60506709 60506728 60506712 -
gcgtttaggaggaaacatgc

SEQ ID NO: 177640 - DNA, 20 bp, Artificial Sequence
  Synthetic oligonucleotide; GGG chr2 60506708 60506727 60506711 -
cgtttaggaggaaacatgcg

SEQ ID NO: 177641 - DNA, 20 bp, Artificial Sequence
  Synthetic oligonucleotide; GGG chr2 60506707 60506726 60506710 -
gtttaggaggaaacatgcgg

SEQ ID NO: 177642 - DNA, 20 bp, Artificial Sequence
  Synthetic oligonucleotide; GGG chr2 60506706 60506725 60506709 -
tttaggaggaaacatgcggg

SEQ ID NO: 177643 - DNA, 20 bp, Artificial Sequence
  Synthetic oligonucleotide; CAG chr2 60506696 60506715 60506699 -
aacatgcggggggctgtcat

SEQ ID NO: 177644 - DNA, 20 bp, Artificial Sequence
  Synthetic oligonucleotide; TGG chr2 60506693 60506712 60506696 -
atgcggggggctgtcatcag

SEQ ID NO: 177645 - DNA, 20 bp, Artificial Sequence
  Synthetic oligonucleotide; TAG chr2 60506670 60506689 60506673 -
taaatgctgccttcgccatt

SEQ ID NO: 177646 - DNA, 20 bp, Artificial Sequence
  Synthetic oligonucleotide; AGG chr2 60506669 60506688 60506672 -
aaatgctgccttcgccattt

SEQ ID NO: 177647 - DNA, 20 bp, Artificial Sequence
  Synthetic oligonucleotide; GAG chr2 60506667 60506686 60506670 -
atgctgccttcgccatttag

SEQ ID NO: 177648 - DNA, 20 bp, Artificial Sequence
  Synthetic oligonucleotide; TGG chr2 60506659 60506678 60506662 -
ttcgccatttaggagactgc

SEQ ID NO: 177649 - DNA, 20 bp, Artificial Sequence
  Synthetic oligonucleotide; GGG chr2 60506658 60506677 60506661 -
tcgccatttaggagactgct

SEQ ID NO: 177650 - DNA, 20 bp, Artificial Sequence
  Synthetic oligonucleotide; CGG chr2 60506653 60506672 60506656 -
atttaggagactgctgggca

SEQ ID NO: 177651 - DNA, 20 bp, Artificial Sequence
  Synthetic oligonucleotide; TAG chr2 60506641 60506660 60506644 -
gctgggcacggtcgttttct

SEQ ID NO: 177652 - DNA, 20 bp, Artificial Sequence
  Synthetic oligonucleotide; GAG chr2 60506637 60506656 60506640 -
ggcacggtcgttttcttagt

SEQ ID NO: 177653 - DNA, 20 bp, Artificial Sequence
  Synthetic oligonucleotide; TAG chr2 60506621 60506640 60506624 -
tagtgagctgcctttatcat

SEQ ID NO: 177654 - DNA, 20 bp, Artificial Sequence
  Synthetic oligonucleotide; AAG chr2 60506612 60506631 60506615 -
gcctttatcattagccctct

SEQ ID NO: 177655 - DNA, 20 bp, Artificial Sequence
  Synthetic oligonucleotide; CAG chr2 60506609 60506628 60506612 -
tttatcattagccctctaag

SEQ ID NO: 177656 - DNA, 20 bp, Artificial Sequence
  Synthetic oligonucleotide; AAG chr2 60506597 60506616 60506600 -
cctctaagcagccatgcaca

SEQ ID NO: 177657 - DNA, 20 bp, Artificial Sequence
  Synthetic oligonucleotide; AGG chr2 60506596 60506615 60506599 -
ctctaagcagccatgcacaa

SEQ ID NO: 177658 - DNA, 20 bp, Artificial Sequence
  Synthetic oligonucleotide; TGG chr2 60506589 60506608 60506592 -
cagccatgcacaaaggcacg

SEQ ID NO: 177659 - DNA, 20 bp, Artificial Sequence
  Synthetic oligonucleotide; GGG chr2 60506588 60506607 60506591 -
agccatgcacaaaggcacgt

SEQ ID NO: 177660 - DNA, 20 bp, Artificial Sequence
  Synthetic oligonucleotide; TAG chr2 60506571 60506590 60506574 -
cgtgggtgctgtgttttgta

SEQ ID NO: 177661 - DNA, 20 bp, Artificial Sequence
  Synthetic oligonucleotide; CAG chr2 60506567 60506586 60506570 -
ggtgctgtgttttgtatagc

SEQ ID NO: 177662 - DNA, 20 bp, Artificial Sequence
  Synthetic oligonucleotide; AGG chr2 60506566 60506585 60506569 -
gtgctgtgttttgtatagcc

SEQ ID NO: 177663 - DNA, 20 bp, Artificial Sequence
  Synthetic oligonucleotide; GGG chr2 60506565 60506584 60506568 -
tgctgtgttttgtatagcca

SEQ ID NO: 177664 - DNA, 20 bp, Artificial Sequence
  Synthetic oligonucleotide; TGG chr2 60506556 60506575 60506559 -
ttgtatagccagggctttcc

SEQ ID NO: 177665 - DNA, 20 bp, Artificial Sequence
  Synthetic oligonucleotide; CAG chr2 60506550 60506569 60506553 -
agccagggctttcctggact

SEQ ID NO: 177666 - DNA, 20 bp, Artificial Sequence
  Synthetic oligonucleotide; CAG chr2 60506542 60506561 60506545 -
ctttcctggactcagcatgc

SEQ ID NO: 177667 - DNA, 20 bp, Artificial Sequence
  Synthetic oligonucleotide; TGG chr2 60506538 60506557 60506541 -
cctggactcagcatgccagc

SEQ ID NO: 177668 - DNA, 20 bp, Artificial Sequence
  Synthetic oligonucleotide; GGG chr2 60506537 60506556 60506540 -
ctggactcagcatgccagct

SEQ ID NO: 177669 - DNA, 20 bp, Artificial Sequence
  Synthetic oligonucleotide; GGG chr2 60506536 60506555 60506539 -
tggactcagcatgccagctg

SEQ ID NO: 177670 - DNA, 20 bp, Artificial Sequence
  Synthetic oligonucleotide; CGG chr2 60506532 60506551 60506535 -
ctcagcatgccagctggggc

SEQ ID NO: 177671 - DNA, 20 bp, Artificial Sequence
  Synthetic oligonucleotide; GAG chr2 60506523 60506542 60506526 -
ccagctggggccggctcact

SEQ ID NO: 177672 - DNA, 20 bp, Artificial Sequence
  Synthetic oligonucleotide; AGG chr2 60506522 60506541 60506525 -
cagctggggccggctcactg

SEQ ID NO: 177673 - DNA, 20 bp, Artificial Sequence
  Synthetic oligonucleotide; TGG chr2 60506518 60506537 60506521 -
tggggccggctcactgaggc

SEQ ID NO: 177674 - DNA, 20 bp, Artificial Sequence
  Synthetic oligonucleotide; GAG chr2 60506509 60506528 60506512 -
ctcactgaggctggaaaaat

SEQ ID NO: 177675 - DNA, 20 bp, Artificial Sequence
  Synthetic oligonucleotide; CAG chr2 60506503 60506522 60506506 -
gaggctggaaaaatgagata

SEQ ID NO: 177676 - DNA, 20 bp, Artificial Sequence
  Synthetic oligonucleotide; TAG chr2 60506498 60506517 60506501 -
tggaaaaatgagatacagtc

SEQ ID NO: 177677 - DNA, 20 bp, Artificial Sequence
  Synthetic oligonucleotide; GAG chr2 60506494 60506513 60506497 -
aaaatgagatacagtctagt

SEQ ID NO: 177678 - DNA, 20 bp, Artificial Sequence
  Synthetic oligonucleotide; AGG chr2 60506493 60506512 60506496 -
aaatgagatacagtctagtg

SEQ ID NO: 177679 - DNA, 20 bp, Artificial Sequence
  Synthetic oligonucleotide; TGG chr2 60506478 60506497 60506481 -
tagtgaggtctttgtcacct

SEQ ID NO: 177680 - DNA, 20 bp, Artificial Sequence
  Synthetic oligonucleotide; GAG chr2 60506476 60506495 60506479 -
gtgaggtctttgtcaccttg

SEQ ID NO: 177681 - DNA, 20 bp, Artificial Sequence
  Synthetic oligonucleotide; AGG chr2 60506475 60506494 60506478 -
tgaggtctttgtcaccttgg

SEQ ID NO: 177682 - DNA, 20 bp, Artificial Sequence
  Synthetic oligonucleotide; GGG chr2 60506474 60506493 60506477 -
gaggtctttgtcaccttgga

SEQ ID NO: 177683 - DNA, 20 bp, Artificial Sequence
  Synthetic oligonucleotide; GAG chr2 60506468 60506487 60506471 -
tttgtcaccttggagggtct

SEQ ID NO: 177684 - DNA, 20 bp, Artificial Sequence
  Synthetic oligonucleotide; AGG chr2 60506467 60506486 60506470 -
ttgtcaccttggagggtctg

SEQ ID NO: 177685 - DNA, 20 bp, Artificial Sequence
  Synthetic oligonucleotide; TGG chr2 60506462 60506481 60506465 -
accttggagggtctgaggac

SEQ ID NO: 177686 - DNA, 20 bp, Artificial Sequence
  Synthetic oligonucleotide; CGG chr2 60506453 60506472 60506456 -
ggtctgaggactggtgcgct

SEQ ID NO: 177687 - DNA, 20 bp, Artificial Sequence
  Synthetic oligonucleotide; GGG chr2 60506452 60506471 60506455 -
gtctgaggactggtgcgctc

SEQ ID NO: 177688 - DNA, 20 bp, Artificial Sequence
  Synthetic oligonucleotide; TGG chr2 60506439 60506458 60506442 -
tgcgctcgggttgacccatg

SEQ ID NO: 177689 - DNA, 20 bp, Artificial Sequence
  Synthetic oligonucleotide; GAG chr2 60506430 60506449 60506433 -
gttgacccatgtggcgtcct

SEQ ID NO: 177690 - DNA, 20 bp, Artificial Sequence
  Synthetic oligonucleotide; CAG chr2 60506426 60506445 60506429 -
acccatgtggcgtcctgagc

SEQ ID NO: 177691 - DNA, 20 bp, Artificial Sequence
  Synthetic oligonucleotide; TGG chr2 60506415 60506434 60506418 -
gtcctgagccagctctgtcc

SEQ ID NO: 177692 - DNA, 20 bp, Artificial Sequence
  Synthetic oligonucleotide; GAG chr2 60506408 60506427 60506411 -
gccagctctgtcctggatct

SEQ ID NO: 177693 - DNA, 20 bp, Artificial Sequence
  Synthetic oligonucleotide; AGG chr2 60506407 60506426 60506410 -
ccagctctgtcctggatctg

SEQ ID NO: 177694 - DNA, 20 bp, Artificial Sequence
  Synthetic oligonucleotide; AAG chr2 60506393 60506412 60506396 -
gatctgaggaacactgtctg

SEQ ID NO: 177695 - DNA, 20 bp, Artificial Sequence
  Synthetic oligonucleotide; CAG chr2 60506385 60506404 60506388 -
gaacactgtctgaagttttc

SEQ ID NO: 177696 - DNA, 20 bp, Artificial Sequence
  Synthetic oligonucleotide; AGG chr2 60506384 60506403 60506387 -
aacactgtctgaagttttcc

SEQ ID NO: 177697 - DNA, 20 bp, Artificial Sequence
  Synthetic oligonucleotide; GGG chr2 60506383 60506402 60506386 -
acactgtctgaagttttcca

SEQ ID NO: 177698 - DNA, 20 bp, Artificial Sequence
  Synthetic oligonucleotide; GGG chr2 60506382 60506401 60506385 -
cactgtctgaagttttccag

SEQ ID NO: 177699 - DNA, 20 bp, Artificial Sequence
  Synthetic oligonucleotide; CAG chr2 60506374 60506393 60506377 -
gaagttttccaggggtttga

SEQ ID NO: 177700 - DNA, 20 bp, Artificial Sequence
  Synthetic oligonucleotide; CAG chr2 60506369 60506388 60506372 -
tttccaggggtttgacagac

SEQ ID NO: 177701 - DNA, 20 bp, Artificial Sequence
  Synthetic oligonucleotide; TGG chr2 60506364 60506383 60506367 -
aggggtttgacagaccagaa

SEQ ID NO: 177702 - DNA, 20 bp, Artificial Sequence
  Synthetic oligonucleotide; GGG chr2 60506363 60506382 60506366 -
ggggtttgacagaccagaat

SEQ ID NO: 177703 - DNA, 20 bp, Artificial Sequence
  Synthetic oligonucleotide; GGG chr2 60506362 60506381 60506365 -
gggtttgacagaccagaatg

SEQ ID NO: 177704 - DNA, 20 bp, Artificial Sequence
  Synthetic oligonucleotide; GGG chr2 60506361 60506380 60506364 -
ggtttgacagaccagaatgg

SEQ ID NO: 177705 - DNA, 20 bp, Artificial Sequence
  Synthetic oligonucleotide; TGG chr2 60506354 60506373 60506357 -
cagaccagaatgggggccgc

SEQ ID NO: 177706 - DNA, 20 bp, Artificial Sequence
  Synthetic oligonucleotide; CAG chr2 60506351 60506370 60506354 -
accagaatgggggccgctgg

SEQ ID NO: 177707 - DNA, 20 bp, Artificial Sequence
  Synthetic oligonucleotide; AGG chr2 60506350 60506369 60506353 -
ccagaatgggggccgctggc

SEQ ID NO: 177708 - DNA, 20 bp, Artificial Sequence
  Synthetic oligonucleotide; GGG chr2 60506349 60506368 60506352 -
cagaatgggggccgctggca

SEQ ID NO: 177709 - DNA, 20 bp, Artificial Sequence
  Synthetic oligonucleotide; TGG chr2 60506344 60506363 60506347 -
tgggggccgctggcagggcc

SEQ ID NO: 177710 - DNA, 20 bp, Artificial Sequence
  Synthetic oligonucleotide; TGG chr2 60506341 60506360 60506344 -
gggccgctggcagggcctgg

SEQ ID NO: 177711 - DNA, 20 bp, Artificial Sequence
  Synthetic oligonucleotide; TAG chr2 60506335 60506354 60506338 -
ctggcagggcctggtggcat

SEQ ID NO: 177712 - DNA, 20 bp, Artificial Sequence
  Synthetic oligonucleotide; TGG chr2 60506329 60506348 60506332 -
gggcctggtggcattagatg

SEQ ID NO: 177713 - DNA, 20 bp, Artificial Sequence
  Synthetic oligonucleotide; AAG chr2 60506325 60506344 60506328 -
ctggtggcattagatgtggc

SEQ ID NO: 177714 - DNA, 20 bp, Artificial Sequence
  Synthetic oligonucleotide; CAG chr2 60506321 60506340 60506324 -
tggcattagatgtggcaagt

SEQ ID NO: 177715 - DNA, 20 bp, Artificial Sequence
  Synthetic oligonucleotide; CAG chr2 60506314 60506333 60506317 -
agatgtggcaagtcagacca

SEQ ID NO: 177716 - DNA, 20 bp, Artificial Sequence
  Synthetic oligonucleotide; TGG chr2 60506310 60506329 60506313 -
gtggcaagtcagaccacagc

SEQ ID NO: 177717 - DNA, 20 bp, Artificial Sequence
  Synthetic oligonucleotide; AAG chr2 60506301 60506320 60506304 -
cagaccacagctggcctgtg

SEQ ID NO: 177718 - DNA, 20 bp, Artificial Sequence
  Synthetic oligonucleotide; AGG chr2 60506300 60506319 60506303 -
agaccacagctggcctgtga

SEQ ID NO: 177719 - DNA, 20 bp, Artificial Sequence
  Synthetic oligonucleotide; CAG chr2 60506280 60506299 60506283 -
aggtgactcttcctctgatg

SEQ ID NO: 177720 - DNA, 20 bp, Artificial Sequence
  Synthetic oligonucleotide; GAG chr2 60506278 60506297 60506281 -
gtgactcttcctctgatgca

SEQ ID NO: 177721 - DNA, 20 bp, Artificial Sequence
  Synthetic oligonucleotide; GAG chr2 60506276 60506295 60506279 -
gactcttcctctgatgcaga

SEQ ID NO: 177722 - DNA, 20 bp, Artificial Sequence
  Synthetic oligonucleotide; GAG chr2 60506265 60506284 60506268 -
tgatgcagagagaattaaat

SEQ ID NO: 177723 - DNA, 20 bp, Artificial Sequence
  Synthetic oligonucleotide; AGG chr2 60506264 60506283 60506267 -
gatgcagagagaattaaatg

SEQ ID NO: 177724 - DNA, 20 bp, Artificial Sequence
  Synthetic oligonucleotide; GAG chr2 60506262 60506281 60506265 -
tgcagagagaattaaatgag

SEQ ID NO: 177725 - DNA, 20 bp, Artificial Sequence
  Synthetic oligonucleotide; AGG chr2 60506261 60506280 60506264 -
gcagagagaattaaatgagg

SEQ ID NO: 177726 - DNA, 20 bp, Artificial Sequence
  Synthetic oligonucleotide; CAG chr2 60506257 60506276 60506260 -
agagaattaaatgaggaggc

SEQ ID NO: 177727 - DNA, 20 bp, Artificial Sequence
  Synthetic oligonucleotide; GAG chr2 60506255 60506274 60506258 -
agaattaaatgaggaggcca

SEQ ID NO: 177728 - DNA, 20 bp, Artificial Sequence
  Synthetic oligonucleotide; TAG chr2 60506249 60506268 60506252 -
aaatgaggaggccagagccc

SEQ ID NO: 177729 - DNA, 20 bp, Artificial Sequence
  Synthetic oligonucleotide; CAG chr2 60506223 60506242 60506226 -
ctgcctcccctccatgccct

SEQ ID NO: 177730 - DNA, 20 bp, Artificial Sequence
  Synthetic oligonucleotide; GAG chr2 60506221 60506240 60506224 -
gcctcccctccatgccctca

SEQ ID NO: 177731 - DNA, 20 bp, Artificial Sequence
  Synthetic oligonucleotide; AAG chr2 60506217 60506236 60506220 -
cccctccatgccctcagaga

SEQ ID NO: 177732 - DNA, 20 bp, Artificial Sequence
  Synthetic oligonucleotide; TGG chr2 60506214 60506233 60506217 -
ctccatgccctcagagaaag

SEQ ID NO: 177733 - DNA, 20 bp, Artificial Sequence
  Synthetic oligonucleotide; GGG chr2 60506213 60506232 60506216 -
tccatgccctcagagaaagt

SEQ ID NO: 177734 - DNA, 20 bp, Artificial Sequence
  Synthetic oligonucleotide; GAG chr2 60506211 60506230 60506214 -
catgccctcagagaaagtgg

SEQ ID NO: 177735 - DNA, 20 bp, Artificial Sequence
  Synthetic oligonucleotide; TGG chr2 60506205 60506224 60506208 -
ctcagagaaagtgggagtgc

SEQ ID NO: 177736 - DNA, 20 bp, Artificial Sequence
  Synthetic oligonucleotide; TGG chr2 60506198 60506217 60506201 -
aaagtgggagtgctggcatt

SEQ ID NO: 177737 - DNA, 20 bp, Artificial Sequence
  Synthetic oligonucleotide; CAG chr2 60506191 60506210 60506194 -
gagtgctggcatttggctaa

SEQ ID NO: 177738 - DNA, 20 bp, Artificial Sequence
  Synthetic oligonucleotide; AGG chr2 60506190 60506209 60506193 -
agtgctggcatttggctaac

SEQ ID NO: 177739 - DNA, 20 bp, Artificial Sequence
  Synthetic oligonucleotide; CAG chr2 60506186 60506205 60506189 -
ctggcatttggctaacagga

SEQ ID NO: 177740 - DNA, 20 bp, Artificial Sequence
  Synthetic oligonucleotide; AGG chr2 60506185 60506204 60506188 -
tggcatttggctaacaggac

SEQ ID NO: 177741 - DNA, 20 bp, Artificial Sequence
  Synthetic oligonucleotide; TGG chr2 60506176 60506195 60506179 -
gctaacaggacaggctattt

SEQ ID NO: 177742 - DNA, 20 bp, Artificial Sequence
  Synthetic oligonucleotide; GGG chr2 60506175 60506194 60506178 -
ctaacaggacaggctatttt

SEQ ID NO: 177743 - DNA, 20 bp, Artificial Sequence
  Synthetic oligonucleotide; CAG chr2 60506170 60506189 60506173 -
aggacaggctattttgggcc

SEQ ID NO: 177744 - DNA, 20 bp, Artificial Sequence
  Synthetic oligonucleotide; AGG chr2 60506169 60506188 60506172 -
ggacaggctattttgggccc

SEQ ID NO: 177745 - DNA, 20 bp, Artificial Sequence
  Synthetic oligonucleotide; TGG chr2 60506137 60506156 60506140 -
tgacctctctgtgatttcta

SEQ ID NO: 177746 - DNA, 20 bp, Artificial Sequence
  Synthetic oligonucleotide; TGG chr2 60506134 60506153 60506137 -
cctctctgtgatttctatgg

SEQ ID NO: 177747 - DNA, 20 bp, Artificial Sequence
  Synthetic oligonucleotide; GGG chr2 60506133 60506152 60506136 -
ctctctgtgatttctatggt

SEQ ID NO: 177748 - DNA, 20 bp, Artificial Sequence
  Synthetic oligonucleotide; AAG chr2 60506125 60506144 60506128 -
gatttctatggtgggtgtca

SEQ ID NO: 177749 - DNA, 20 bp, Artificial Sequence
  Synthetic oligonucleotide; AGG chr2 60506124 60506143 60506127 -
atttctatggtgggtgtcaa

SEQ ID NO: 177750 - DNA, 20 bp, Artificial Sequence
  Synthetic oligonucleotide; TGG chr2 60506120 60506139 60506123 -
ctatggtgggtgtcaaagga

SEQ ID NO: 177751 - DNA, 20 bp, Artificial Sequence
  Synthetic oligonucleotide; TGG chr2 60506116 60506135 60506119 -
ggtgggtgtcaaaggatggc

SEQ ID NO: 177752 - DNA, 20 bp, Artificial Sequence
  Synthetic oligonucleotide; GGG chr2 60506115 60506134 60506118 -
gtgggtgtcaaaggatggct

SEQ ID NO: 177753 - DNA, 20 bp, Artificial Sequence
  Synthetic oligonucleotide; AAG chr2 60506111 60506130 60506114 -
gtgtcaaaggatggctggga

SEQ ID NO: 177754 - DNA, 20 bp, Artificial Sequence
  Synthetic oligonucleotide; AGG chr2 60506110 60506129 60506113 -
tgtcaaaggatggctgggaa

SEQ ID NO: 177755 - DNA, 20 bp, Artificial Sequence
  Synthetic oligonucleotide; GGG chr2 60506109 60506128 60506112 -
gtcaaaggatggctgggaaa

SEQ ID NO: 177756 - DNA, 20 bp, Artificial Sequence
  Synthetic oligonucleotide; GGG chr2 60506108 60506127 60506111 -
tcaaaggatggctgggaaag

SEQ ID NO: 177757 - DNA, 20 bp, Artificial Sequence
  Synthetic oligonucleotide; TAG chr2 60506100 60506119 60506103 -
tggctgggaaaggggatttt

SEQ ID NO: 177758 - DNA, 20 bp, Artificial Sequence
  Synthetic oligonucleotide; AGG chr2 60506099 60506118 60506102 -
ggctgggaaaggggattttt

SEQ ID NO: 177759 - DNA, 20 bp, Artificial Sequence
  Synthetic oligonucleotide; GAG chr2 60506074 60506093 60506077 -
tgctaacatcccttgcctat

SEQ ID NO: 177760 - DNA, 20 bp, Artificial Sequence
  Synthetic oligonucleotide; TGG chr2 60506046 60506065 60506049 -
cactatcttctcgcaccatc

SEQ ID NO: 177761 - DNA, 20 bp, Artificial Sequence
  Synthetic oligonucleotide; CGG chr2 60506036 60506055 60506039 -
tcgcaccatctggtttcacc

SEQ ID NO: 177762 - DNA, 20 bp, Artificial Sequence
  Synthetic oligonucleotide; GGG chr2 60506035 60506054 60506038 -
cgcaccatctggtttcaccc

SEQ ID NO: 177763 - DNA, 20 bp, Artificial Sequence
  Synthetic oligonucleotide; AAG chr2 60506027 60506046 60506030 -
ctggtttcacccgggctgca

SEQ ID NO: 177764 - DNA, 20 bp, Artificial Sequence
  Synthetic oligonucleotide; TAG chr2 60506022 60506041 60506025 -
ttcacccgggctgcaaagcc

SEQ ID NO: 177765 - DNA, 20 bp, Artificial Sequence
  Synthetic oligonucleotide; TGG chr2 60506017 60506036 60506020 -
ccgggctgcaaagcctagtg

SEQ ID NO: 177766 - DNA, 20 bp, Artificial Sequence
  Synthetic oligonucleotide; AAG chr2 60505998 60506017 60506001 -
gtggtgtcccataccctgca

SEQ ID NO: 177767 - DNA, 20 bp, Artificial Sequence
  Synthetic oligonucleotide; TGG chr2 60505988 60506007 60505991 -
ataccctgcaaagccctatt

SEQ ID NO: 177768 - DNA, 20 bp, Artificial Sequence
  Synthetic oligonucleotide; GGG chr2 60505987 60506006 60505990 -
taccctgcaaagccctattt

SEQ ID NO: 177769 - DNA, 20 bp, Artificial Sequence
  Synthetic oligonucleotide; CAG chr2 60505953 60505972 60505956 -
atgccaccatgccatctcca

SEQ ID NO: 177770 - DNA, 20 bp, Artificial Sequence
  Synthetic oligonucleotide; TGG chr2 60505946 60505965 60505949 -
catgccatctccacagcatc

SEQ ID NO: 177771 - DNA, 20 bp, Artificial Sequence
  Synthetic oligonucleotide; CAG chr2 60505943 60505962 60505946 -
gccatctccacagcatctgg

SEQ ID NO: 177772 - DNA, 20 bp, Artificial Sequence
  Synthetic oligonucleotide; CAG chr2 60505934 60505953 60505937 -
acagcatctggcagacgaac

SEQ ID NO: 177773 - DNA, 20 bp, Artificial Sequence
  Synthetic oligonucleotide; AGG chr2 60505933 60505952 60505936 -
cagcatctggcagacgaacc

SEQ ID NO: 177774 - DNA, 20 bp, Artificial Sequence
  Synthetic oligonucleotide; TGG chr2 60505930 60505949 60505933 -
catctggcagacgaaccagg

SEQ ID NO: 177775 - DNA, 20 bp, Artificial Sequence
  Synthetic oligonucleotide; GGG chr2 60505929 60505948 60505932 -
atctggcagacgaaccaggt

SEQ ID NO: 177776 - DNA, 20 bp, Artificial Sequence
  Synthetic oligonucleotide; GGG chr2 60505928 60505947 60505931 -
tctggcagacgaaccaggtg

SEQ ID NO: 177777 - DNA, 20 bp, Artificial Sequence
  Synthetic oligonucleotide; TGG chr2 60505912 60505931 60505915 -
ggtggggctgctattgcttc

SEQ ID NO: 177778 - DNA, 20 bp, Artificial Sequence
  Synthetic oligonucleotide; GGG chr2 60505911 60505930 60505914 -
gtggggctgctattgcttct

SEQ ID NO: 177779 - DNA, 20 bp, Artificial Sequence
  Synthetic oligonucleotide; CGG chr2 60505902 60505921 60505905 -
ctattgcttctgggtattta

SEQ ID NO: 177780 - DNA, 20 bp, Artificial Sequence
  Synthetic oligonucleotide; GGG chr2 60505901 60505920 60505904 -
tattgcttctgggtatttac

SEQ ID NO: 177781 - DNA, 20 bp, Artificial Sequence
  Synthetic oligonucleotide; CAG chr2 60505895 60505914 60505898 -
ttctgggtatttacgggatg

SEQ ID NO: 177782 - DNA, 20 bp, Artificial Sequence
  Synthetic oligonucleotide; TGG chr2 60505870 60505889 60505873 -
ttttctgcccaccgttgttt

SEQ ID NO: 177783 - DNA, 20 bp, Artificial Sequence
  Synthetic oligonucleotide; GGG chr2 60505869 60505888 60505872 -
tttctgcccaccgttgtttt

SEQ ID NO: 177784 - DNA, 20 bp, Artificial Sequence
  Synthetic oligonucleotide; GAG chr2 60505867 60505886 60505870 -
tctgcccaccgttgttttgg

SEQ ID NO: 177785 - DNA, 20 bp, Artificial Sequence
  Synthetic oligonucleotide; AGG chr2 60505866 60505885 60505869 -
ctgcccaccgttgttttggg

SEQ ID NO: 177786 - DNA, 20 bp, Artificial Sequence
  Synthetic oligonucleotide; GGG chr2 60505865 60505884 60505868 -
tgcccaccgttgttttggga

SEQ ID NO: 177787 - DNA, 20 bp, Artificial Sequence
  Synthetic oligonucleotide; CAG chr2 60505848 60505867 60505851 -
ggagggatttccccctccct

SEQ ID NO: 177788 - DNA, 20 bp, Artificial Sequence
  Synthetic oligonucleotide; AGG chr2 60505847 60505866 60505850 -
gagggatttccccctccctc

SEQ ID NO: 177789 - DNA, 20 bp, Artificial Sequence
  Synthetic oligonucleotide; TAG chr2 60505844 60505863 60505847 -
ggatttccccctccctcagg

SEQ ID NO: 177790 - DNA, 20 bp, Artificial Sequence
  Synthetic oligonucleotide; GAG chr2 60505842 60505861 60505845 -
atttccccctccctcaggta

SEQ ID NO: 177791 - DNA, 20 bp, Artificial Sequence
  Synthetic oligonucleotide; CAG chr2 60505832 60505851 60505835 -
ccctcaggtagagttgttct

SEQ ID NO: 177792 - DNA, 20 bp, Artificial Sequence
  Synthetic oligonucleotide; GAG chr2 60505830 60505849 60505833 -
ctcaggtagagttgttctca

SEQ ID NO: 177793 - DNA, 20 bp, Artificial Sequence
  Synthetic oligonucleotide; TGG chr2 60505816 60505835 60505819 -
ttctcagagatatctgtaat

SEQ ID NO: 177794 - DNA, 20 bp, Artificial Sequence
  Synthetic oligonucleotide; AAG chr2 60505801 60505820 60505804 -
gtaattggcccttcccattt

SEQ ID NO: 177795 - DNA, 20 bp, Artificial Sequence
  Synthetic oligonucleotide; GAG chr2 60505799 60505818 60505802 -
aattggcccttcccatttaa

SEQ ID NO: 177796 - DNA, 20 bp, Artificial Sequence
  Synthetic oligonucleotide; CAG chr2 60505795 60505814 60505798 -
ggcccttcccatttaagagt

SEQ ID NO: 177797 - DNA, 20 bp, Artificial Sequence
  Synthetic oligonucleotide; TAG chr2 60505767 60505786 60505770 -
aatgatttattctaaaatga

SEQ ID NO: 177798 - DNA, 20 bp, Artificial Sequence
  Synthetic oligonucleotide; CAG chr2 60505761 60505780 60505764 -
ttattctaaaatgatagacc

SEQ ID NO: 177799 - DNA, 20 bp, Artificial Sequence
  Synthetic oligonucleotide; AGG chr2 60505760 60505779 60505763 -
tattctaaaatgatagaccc

SEQ ID NO: 177800 - DNA, 20 bp, Artificial Sequence
  Synthetic oligonucleotide; TAG chr2 60505757 60505776 60505760 -
tctaaaatgatagacccagg

SEQ ID NO: 177801 - DNA, 20 bp, Artificial Sequence
  Synthetic oligonucleotide; GAG chr2 60505755 60505774 60505758 -
taaaatgatagacccaggta

SEQ ID NO: 177802 - DNA, 20 bp, Artificial Sequence
  Synthetic oligonucleotide; GAG chr2 60505753 60505772 60505756 -
aaatgatagacccaggtaga

SEQ ID NO: 177803 - DNA, 20 bp, Artificial Sequence
  Synthetic oligonucleotide; AGG chr2 60505752 60505771 60505755 -
aatgatagacccaggtagag

SEQ ID NO: 177804 - DNA, 20 bp, Artificial Sequence
  Synthetic oligonucleotide; CAG chr2 60505732 60505751 60505735 -
aggttacccaccctccgtca

SEQ ID NO: 177805 - DNA, 20 bp, Artificial Sequence
  Synthetic oligonucleotide; GAG chr2 60505730 60505749 60505733 -
gttacccaccctccgtcaca

SEQ ID NO: 177806 - DNA, 20 bp, Artificial Sequence
  Synthetic oligonucleotide; TGG chr2 60505727 60505746 60505730 -
acccaccctccgtcacagag

SEQ ID NO: 177807 - DNA, 20 bp, Artificial Sequence
  Synthetic oligonucleotide; CAG chr2 60505723 60505742 60505726 -
accctccgtcacagagtggc

SEQ ID NO: 177808 - DNA, 20 bp, Artificial Sequence
  Synthetic oligonucleotide; CGG chr2 60505704 60505723 60505707 -
ccagctgtgtcccctgcttc

SEQ ID NO: 177809 - DNA, 20 bp, Artificial Sequence
  Synthetic oligonucleotide; GGG chr2 60505703 60505722 60505706 -
cagctgtgtcccctgcttcc

SEQ ID NO: 177810 - DNA, 20 bp, Artificial Sequence
  Synthetic oligonucleotide; GAG chr2 60505701 60505720 60505704 -
gctgtgtcccctgcttccgg

SEQ ID NO: 177811 - DNA, 20 bp, Artificial Sequence
  Synthetic oligonucleotide; AGG chr2 60505700 60505719 60505703 -
ctgtgtcccctgcttccggg

SEQ ID NO: 177812 - DNA, 20 bp, Artificial Sequence
  Synthetic oligonucleotide; TGG chr2 60505697 60505716 60505700 -
tgtcccctgcttccgggagg

SEQ ID NO: 177813 - DNA, 20 bp, Artificial Sequence
  Synthetic oligonucleotide; GGG chr2 60505696 60505715 60505699 -
gtcccctgcttccgggaggt

SEQ ID NO: 177814 - DNA, 20 bp, Artificial Sequence
  Synthetic oligonucleotide; TGG chr2 60505685 60505704 60505688 -
ccgggaggtgggaatgcatg

SEQ ID NO: 177815 - DNA, 20 bp, Artificial Sequence
  Synthetic oligonucleotide; GAG chr2 60505683 60505702 60505686 -
gggaggtgggaatgcatgtg

SEQ ID NO: 177816 - DNA, 20 bp, Artificial Sequence
  Synthetic oligonucleotide; AGG chr2 60505682 60505701 60505685 -
ggaggtgggaatgcatgtgg

SEQ ID NO: 177817 - DNA, 20 bp, Artificial Sequence
  Synthetic oligonucleotide; GGG chr2 60505681 60505700 60505684 -
gaggtgggaatgcatgtgga

SEQ ID NO: 177818 - DNA, 20 bp, Artificial Sequence
  Synthetic oligonucleotide; GGG chr2 60505680 60505699 60505683 -
aggtgggaatgcatgtggag

SEQ ID NO: 177819 - DNA, 20 bp, Artificial Sequence
  Synthetic oligonucleotide; TGG chr2 60505652 60505671 60505655 -
atttcctaactctcttgctc

SEQ ID NO: 177820 - DNA, 20 bp, Artificial Sequence
  Synthetic oligonucleotide; CAG chr2 60505649 60505668 60505652 -
tcctaactctcttgctctgg

SEQ ID NO: 177821 - DNA, 20 bp, Artificial Sequence
  Synthetic oligonucleotide; AAG chr2 60505642 60505661 60505645 -
tctcttgctctggcagcctg

SEQ ID NO: 177822 - DNA, 20 bp, Artificial Sequence
  Synthetic oligonucleotide; GAG chr2 60505640 60505659 60505643 -
tcttgctctggcagcctgaa

SEQ ID NO: 177823 - DNA, 20 bp, Artificial Sequence
  Synthetic oligonucleotide; CAG chr2 60505618 60505637 60505621 -
gctgtctgtgccctgaacaa

SEQ ID NO: 177824 - DNA, 20 bp, Artificial Sequence
  Synthetic oligonucleotide; TAG chr2 60505613 60505632 60505616 -
ctgtgccctgaacaacagct

SEQ ID NO: 177825 - DNA, 20 bp, Artificial Sequence
  Synthetic oligonucleotide; AGG chr2 60505612 60505631 60505615 -
tgtgccctgaacaacagctt

SEQ ID NO: 177826 - DNA, 20 bp, Artificial Sequence
  Synthetic oligonucleotide; GGG chr2 60505611 60505630 60505614 -
gtgccctgaacaacagctta

SEQ ID NO: 177827 - DNA, 20 bp, Artificial Sequence
  Synthetic oligonucleotide; GAG chr2 60505609 60505628 60505612 -
gccctgaacaacagcttagg

SEQ ID NO: 177828 - DNA, 20 bp, Artificial Sequence
  Synthetic oligonucleotide; TGG chr2 60505605 60505624 60505608 -
tgaacaacagcttagggagc

SEQ ID NO: 177829 - DNA, 20 bp, Artificial Sequence
  Synthetic oligonucleotide; GAG chr2 60505603 60505622 60505606 -
aacaacagcttagggagctg

SEQ ID NO: 177830 - DNA, 20 bp, Artificial Sequence
  Synthetic oligonucleotide; AGG chr2 60505602 60505621 60505605 -
acaacagcttagggagctgg

SEQ ID NO: 177831 - DNA, 20 bp, Artificial Sequence
  Synthetic oligonucleotide; AAG chr2 60505598 60505617 60505601 -
cagcttagggagctggagga

SEQ ID NO: 177832 - DNA, 20 bp, Artificial Sequence
  Synthetic oligonucleotide; GAG chr2 60505596 60505615 60505599 -
gcttagggagctggaggaaa

SEQ ID NO: 177833 - DNA, 20 bp, Artificial Sequence
  Synthetic oligonucleotide; AAG chr2 60505593 60505612 60505596 -
tagggagctggaggaaagag

SEQ ID NO: 177834 - DNA, 20 bp, Artificial Sequence
  Synthetic oligonucleotide; AGG chr2 60505592 60505611 60505595 -
agggagctggaggaaagaga

SEQ ID NO: 177835 - DNA, 20 bp, Artificial Sequence
  Synthetic oligonucleotide; GAG chr2 60505590 60505609 60505593 -
ggagctggaggaaagagaag

SEQ ID NO: 177836 - DNA, 20 bp, Artificial Sequence
  Synthetic oligonucleotide; AGG chr2 60505589 60505608 60505592 -
gagctggaggaaagagaagg

SEQ ID NO: 177837 - DNA, 20 bp, Artificial Sequence
  Synthetic oligonucleotide; GAG chr2 60505577 60505596 60505580 -
agagaaggaggtatgcattt

SEQ ID NO: 177838 - DNA, 20 bp, Artificial Sequence
  Synthetic oligonucleotide; AGG chr2 60505576 60505595 60505579 -
gagaaggaggtatgcatttg

SEQ ID NO: 177839 - DNA, 20 bp, Artificial Sequence
  Synthetic oligonucleotide; GGG chr2 60505575 60505594 60505578 -
agaaggaggtatgcatttga

SEQ ID NO: 177840 - DNA, 20 bp, Artificial Sequence
  Synthetic oligonucleotide; GAG chr2 60505573 60505592 60505576 -
aaggaggtatgcatttgagg

SEQ ID NO: 177841 - DNA, 20 bp, Artificial Sequence
  Synthetic oligonucleotide; GAG chr2 60505571 60505590 60505574 -
ggaggtatgcatttgaggga

SEQ ID NO: 177842 - DNA, 20 bp, Artificial Sequence
  Synthetic oligonucleotide; GAG chr2 60505569 60505588 60505572 -
aggtatgcatttgagggaga

SEQ ID NO: 177843 - DNA, 20 bp, Artificial Sequence
  Synthetic oligonucleotide; AGG chr2 60505568 60505587 60505571 -
ggtatgcatttgagggagag

SEQ ID NO: 177844 - DNA, 20 bp, Artificial Sequence
  Synthetic oligonucleotide; TGG chr2 60505560 60505579 60505563 -
tttgagggagagaggcccac

SEQ ID NO: 177845 - DNA, 20 bp, Artificial Sequence
  Synthetic oligonucleotide; GGG chr2 60505559 60505578 60505562 -
ttgagggagagaggcccact

SEQ ID NO: 177846 - DNA, 20 bp, Artificial Sequence
  Synthetic oligonucleotide; TGG chr2 60505555 60505574 60505558 -
gggagagaggcccactgggt

SEQ ID NO: 177847 - DNA, 20 bp, Artificial Sequence
  Synthetic oligonucleotide; AAG chr2 60505550 60505569 60505553 -
agaggcccactgggttggac

SEQ ID NO: 177848 - DNA, 20 bp, Artificial Sequence
  Synthetic oligonucleotide; AAG chr2 60505547 60505566 60505550 -
ggcccactgggttggacaag

SEQ ID NO: 177849 - DNA, 20 bp, Artificial Sequence
  Synthetic oligonucleotide; AGG chr2 60505546 60505565 60505549 -
gcccactgggttggacaaga

SEQ ID NO: 177850 - DNA, 20 bp, Artificial Sequence
  Synthetic oligonucleotide; AAG chr2 60505540 60505559 60505543 -
tgggttggacaagaaggtaa

SEQ ID NO: 177851 - DNA, 20 bp, Artificial Sequence
  Synthetic oligonucleotide; GAG chr2 60505538 60505557 60505541 -
ggttggacaagaaggtaaaa

SEQ ID NO: 177852 - DNA, 20 bp, Artificial Sequence
  Synthetic oligonucleotide; AGG chr2 60505537 60505556 60505540 -
gttggacaagaaggtaaaag

SEQ ID NO: 177853 - DNA, 20 bp, Artificial Sequence
  Synthetic oligonucleotide; GGG chr2 60505536 60505555 60505539 -
ttggacaagaaggtaaaaga

SEQ ID NO: 177854 - DNA, 20 bp, Artificial Sequence
  Synthetic oligonucleotide; TGG chr2 60505532 60505551 60505535 -
acaagaaggtaaaagagggc

SEQ ID NO: 177855 - DNA, 20 bp, Artificial Sequence
  Synthetic oligonucleotide; TGG chr2 60505527 60505546 60505530 -
aaggtaaaagagggctggtt

SEQ ID NO: 177856 - DNA, 20 bp, Artificial Sequence
  Synthetic oligonucleotide; AAG chr2 60505519 60505538 60505522 -
agagggctggtttggcccct

SEQ ID NO: 177857 - DNA, 20 bp, Artificial Sequence
  Synthetic oligonucleotide; AGG chr2 60505518 60505537 60505521 -
gagggctggtttggccccta

SEQ ID NO: 177858 - DNA, 20 bp, Artificial Sequence
  Synthetic oligonucleotide; GGG chr2 60505517 60505536 60505520 -
agggctggtttggcccctaa

SEQ ID NO: 177859 - DNA, 20 bp, Artificial Sequence
  Synthetic oligonucleotide; AAG chr2 60505514 60505533 60505517 -
gctggtttggcccctaaggg

SEQ ID NO: 177860 - DNA, 20 bp, Artificial Sequence
  Synthetic oligonucleotide; AGG chr2 60505513 60505532 60505516 -
ctggtttggcccctaaggga

SEQ ID NO: 177861 - DNA, 20 bp, Artificial Sequence
  Synthetic oligonucleotide; CAG chr2 60505509 60505528 60505512 -
tttggcccctaagggaagga

SEQ ID NO: 177862 - DNA, 20 bp, Artificial Sequence
  Synthetic oligonucleotide; AGG chr2 60505508 60505527 60505511 -
ttggcccctaagggaaggac

SEQ ID NO: 177863 - DNA, 20 bp, Artificial Sequence
  Synthetic oligonucleotide; AAG chr2 60505504 60505523 60505507 -
cccctaagggaaggacagga

SEQ ID NO: 177864 - DNA, 20 bp, Artificial Sequence
  Synthetic oligonucleotide; TGG chr2 60505482 60505501 60505485 -
gcacccgcttgttccctgtg

SEQ ID NO: 177865 - DNA, 20 bp, Artificial Sequence
  Synthetic oligonucleotide; CAG chr2 60505476 60505495 60505479 -
gcttgttccctgtgtggatg

SEQ ID NO: 177866 - DNA, 20 bp, Artificial Sequence
  Synthetic oligonucleotide; CAG chr2 60505465 60505484 60505468 -
gtgtggatgcagtgtttgtc

SEQ ID NO: 177867 - DNA, 20 bp, Artificial Sequence
  Synthetic oligonucleotide; AAG chr2 60505459 60505478 60505462 -
atgcagtgtttgtccagctg

SEQ ID NO: 177868 - DNA, 20 bp, Artificial Sequence
  Synthetic oligonucleotide; AGG chr2 60505458 60505477 60505461 -
tgcagtgtttgtccagctga

SEQ ID NO: 177869 - DNA, 20 bp, Artificial Sequence
  Synthetic oligonucleotide; CAG chr2 60505455 60505474 60505458 -
agtgtttgtccagctgaagg

SEQ ID NO: 177870 - DNA, 20 bp, Artificial Sequence
  Synthetic oligonucleotide; CGG chr2 60505445 60505464 60505448 -
cagctgaaggcagcctcact

SEQ ID NO: 177871 - DNA, 20 bp, Artificial Sequence
  Synthetic oligonucleotide; GAG chr2 60505429 60505448 60505432 -
cactcggctgactacctgat

SEQ ID NO: 177872 - DNA, 20 bp, Artificial Sequence
  Synthetic oligonucleotide; AAG chr2 60505415 60505434 60505418 -
cctgatgagtgattttcccc

SEQ ID NO: 177873 - DNA, 20 bp, Artificial Sequence
  Synthetic oligonucleotide; CAG chr2 60505408 60505427 60505411 -
agtgattttccccaagctga

SEQ ID NO: 177874 - DNA, 20 bp, Artificial Sequence
  Synthetic oligonucleotide; AAG chr2 60505382 60505401 60505385 -
ctccaacacatttcacctac

SEQ ID NO: 177875 - DNA, 20 bp, Artificial Sequence
  Synthetic oligonucleotide; AAG chr2 60505371 60505390 60505374 -
ttcacctacaagtcctgaca

SEQ ID NO: 177876 - DNA, 20 bp, Artificial Sequence
  Synthetic oligonucleotide; TGG chr2 60505368 60505387 60505371 -
acctacaagtcctgacaaag

SEQ ID NO: 177877 - DNA, 20 bp, Artificial Sequence
  Synthetic oligonucleotide; TGG chr2 60505355 60505374 60505358 -
gacaaagtggtgtgttcttt

SEQ ID NO: 177878 - DNA, 20 bp, Artificial Sequence
  Synthetic oligonucleotide; GGG chr2 60505354 60505373 60505357 -
acaaagtggtgtgttctttt

SEQ ID NO: 177879 - DNA, 20 bp, Artificial Sequence
  Synthetic oligonucleotide; GGG chr2 60505353 60505372 60505356 -
caaagtggtgtgttcttttg

SEQ ID NO: 177880 - DNA, 20 bp, Artificial Sequence
  Synthetic oligonucleotide; CAG chr2 60505338 60505357 60505341 -
ttttggggctgttattactg

SEQ ID NO: 177881 - DNA, 20 bp, Artificial Sequence
  Synthetic oligonucleotide; CAG chr2 60505335 60505354 60505338 -
tggggctgttattactgcag

SEQ ID NO: 177882 - DNA, 20 bp, Artificial Sequence
  Synthetic oligonucleotide; AGG chr2 60505334 60505353 60505337 -
ggggctgttattactgcagc

SEQ ID NO: 177883 - DNA, 20 bp, Artificial Sequence
  Synthetic oligonucleotide; TGG chr2 60505327 60505346 60505330 -
ttattactgcagcaggcatt

SEQ ID NO: 177884 - DNA, 20 bp, Artificial Sequence
  Synthetic oligonucleotide; TGG chr2 60505317 60505336 60505320 -
agcaggcatttggaacaatc

SEQ ID NO: 177885 - DNA, 20 bp, Artificial Sequence
  Synthetic oligonucleotide; AAG chr2 60505314 60505333 60505317 -
aggcatttggaacaatctgg

SEQ ID NO: 177886 - DNA, 20 bp, Artificial Sequence
  Synthetic oligonucleotide; TGG chr2 60505309 60505328 60505312 -
tttggaacaatctggaagaa

SEQ ID NO: 177887 - DNA, 20 bp, Artificial Sequence
  Synthetic oligonucleotide; GGG chr2 60505308 60505327 60505311 -
ttggaacaatctggaagaat

SEQ ID NO: 177888 - DNA, 20 bp, Artificial Sequence
  Synthetic oligonucleotide; GGG chr2 60505307 60505326 60505310 -
tggaacaatctggaagaatg

SEQ ID NO: 177889 - DNA, 20 bp, Artificial Sequence
  Synthetic oligonucleotide; AAG chr2 60505299 60505318 60505302 -
tctggaagaatggggtgcca

SEQ ID NO: 177890 - DNA, 20 bp, Artificial Sequence
  Synthetic oligonucleotide; AGG chr2 60505298 60505317 60505301 -
ctggaagaatggggtgccaa

SEQ ID NO: 177891 - DNA, 20 bp, Artificial Sequence
  Synthetic oligonucleotide; AAG chr2 60505286 60505305 60505289 -
ggtgccaaaggacacccttg

SEQ ID NO: 177892 - DNA, 20 bp, Artificial Sequence
  Synthetic oligonucleotide; GAG chr2 60505275 60505294 60505278 -
acacccttgaagccgtttct

SEQ ID NO: 177893 - DNA, 20 bp, Artificial Sequence
  Synthetic oligonucleotide; TAG chr2 60505242 60505261 60505245 -
ttcttttctctccgatcctc

SEQ ID NO: 177894 - DNA, 20 bp, Artificial Sequence
  Synthetic oligonucleotide; TGG chr2 60505233 60505252 60505236 -
ctccgatcctctagcttttt

SEQ ID NO: 177895 - DNA, 20 bp, Artificial Sequence
  Synthetic oligonucleotide; TGG chr2 60505218 60505237 60505221 -
ttttttggcttatgaaaaat

SEQ ID NO: 177896 - DNA, 20 bp, Artificial Sequence
  Synthetic oligonucleotide; GGG chr2 60505217 60505236 60505220 -
tttttggcttatgaaaaatt

SEQ ID NO: 177897 - DNA, 20 bp, Artificial Sequence
  Synthetic oligonucleotide; TAG chr2 60505184 60505203 60505187 -
tcgaatgtccattgtgctgt

SEQ ID NO: 177898 - DNA, 20 bp, Artificial Sequence
  Synthetic oligonucleotide; GAG chr2 60505177 60505196 60505180 -
tccattgtgctgttagtaat

SEQ ID NO: 177899 - DNA, 20 bp, Artificial Sequence
  Synthetic oligonucleotide; AGG chr2 60505176 60505195 60505179 -
ccattgtgctgttagtaatg

SEQ ID NO: 177900 - DNA, 20 bp, Artificial Sequence
  Synthetic oligonucleotide; CGG chr2 60505170 60505189 60505173 -
tgctgttagtaatgaggata

SEQ ID NO: 177901 - DNA, 20 bp, Artificial Sequence
  Synthetic oligonucleotide; GAG chr2 60505146 60505165 60505149 -
taaaatcacatttttttttt

SEQ ID NO: 177902 - DNA, 20 bp, Artificial Sequence
  Synthetic oligonucleotide; AAG chr2 60505142 60505161 60505145 -
atcacattttttttttgagt

SEQ ID NO: 177903 - DNA, 20 bp, Artificial Sequence
  Synthetic oligonucleotide; GAG chr2 60505133 60505152 60505136 -
tttttttgagtaagcccttt

SEQ ID NO: 177904 - DNA, 20 bp, Artificial Sequence
  Synthetic oligonucleotide; AGG chr2 60505132 60505151 60505135 -
ttttttgagtaagccctttg

SEQ ID NO: 177905 - DNA, 20 bp, Artificial Sequence
  Synthetic oligonucleotide; GAG chr2 60505130 60505149 60505133 -
ttttgagtaagccctttgag

SEQ ID NO: 177906 - DNA, 20 bp, Artificial Sequence
  Synthetic oligonucleotide; GAG chr2 60505115 60505134 60505118 -
ttgaggagtattgtcaaatt

SEQ ID NO: 177907 - DNA, 20 bp, Artificial Sequence
  Synthetic oligonucleotide; GAG chr2 60505101 60505120 60505104 -
caaattgagactcacctcat

SEQ ID NO: 177908 - DNA, 20 bp, Artificial Sequence
  Synthetic oligonucleotide; AAG chr2 60505088 60505107 60505091 -
acctcatgagtaaccctgtg

SEQ ID NO: 177909 - DNA, 20 bp, Artificial Sequence
  Synthetic oligonucleotide; GAG chr2 60505086 60505105 60505089 -
ctcatgagtaaccctgtgaa

SEQ ID NO: 177910 - DNA, 20 bp, Artificial Sequence
  Synthetic oligonucleotide; AGG chr2 60505085 60505104 60505088 -
tcatgagtaaccctgtgaag

SEQ ID NO: 177911 - DNA, 20 bp, Artificial Sequence
  Synthetic oligonucleotide; CAG chr2 60505082 60505101 60505085 -
tgagtaaccctgtgaagagg

SEQ ID NO: 177912 - DNA, 20 bp, Artificial Sequence
  Synthetic oligonucleotide; AGG chr2 60505081 60505100 60505084 -
gagtaaccctgtgaagaggc

SEQ ID NO: 177913 - DNA, 20 bp, Artificial Sequence
  Synthetic oligonucleotide; GAG chr2 60505079 60505098 60505082 -
gtaaccctgtgaagaggcag

SEQ ID NO: 177914 - DNA, 20 bp, Artificial Sequence
  Synthetic oligonucleotide; AAG chr2 60505075 60505094 60505078 -
ccctgtgaagaggcaggaga

SEQ ID NO: 177915 - DNA, 20 bp, Artificial Sequence
  Synthetic oligonucleotide; AGG chr2 60505074 60505093 60505077 -
cctgtgaagaggcaggagaa

SEQ ID NO: 177916 - DNA, 20 bp, Artificial Sequence
  Synthetic oligonucleotide; GGG chr2 60505073 60505092 60505076 -
ctgtgaagaggcaggagaaa

SEQ ID NO: 177917 - DNA, 20 bp, Artificial Sequence
  Synthetic oligonucleotide; TAG chr2 60505070 60505089 60505073 -
tgaagaggcaggagaaaggg

SEQ ID NO: 177918 - DNA, 20 bp, Artificial Sequence
  Synthetic oligonucleotide; AAG chr2 60505064 60505083 60505067 -
ggcaggagaaagggtagttg

SEQ ID NO: 177919 - DNA, 20 bp, Artificial Sequence
  Synthetic oligonucleotide; TAG chr2 60505059 60505078 60505062 -
gagaaagggtagttgaagct

SEQ ID NO: 177920 - DNA, 20 bp, Artificial Sequence
  Synthetic oligonucleotide; GAG chr2 60505057 60505076 60505060 -
gaaagggtagttgaagctta

SEQ ID NO: 177921 - DNA, 20 bp, Artificial Sequence
  Synthetic oligonucleotide; GAG chr2 60505055 60505074 60505058 -
aagggtagttgaagcttaga

SEQ ID NO: 177922 - DNA, 20 bp, Artificial Sequence
  Synthetic oligonucleotide; AGG chr2 60505054 60505073 60505057 -
agggtagttgaagcttagag

SEQ ID NO: 177923 - DNA, 20 bp, Artificial Sequence
  Synthetic oligonucleotide; TGG chr2 60505046 60505065 60505049 -
tgaagcttagagaggttaaa

SEQ ID NO: 177924 - DNA, 20 bp, Artificial Sequence
  Synthetic oligonucleotide; CAG chr2 60505043 60505062 60505046 -
agcttagagaggttaaatgg

SEQ ID NO: 177925 - DNA, 20 bp, Artificial Sequence
  Synthetic oligonucleotide; AGG chr2 60505042 60505061 60505045 -
gcttagagaggttaaatggc

SEQ ID NO: 177926 - DNA, 20 bp, Artificial Sequence
  Synthetic oligonucleotide; TGG chr2 60505037 60505056 60505040 -
gagaggttaaatggcaggtc

SEQ ID NO: 177927 - DNA, 20 bp, Artificial Sequence
  Synthetic oligonucleotide; CAG chr2 60505027 60505046 60505030 -
atggcaggtctggtctcatg

SEQ ID NO: 177928 - DNA, 20 bp, Artificial Sequence
  Synthetic oligonucleotide; CAG chr2 60505021 60505040 60505024 -
ggtctggtctcatgcagccg

SEQ ID NO: 177929 - DNA, 20 bp, Artificial Sequence
  Synthetic oligonucleotide; AGG chr2 60505020 60505039 60505023 -
gtctggtctcatgcagccgc

SEQ ID NO: 177930 - DNA, 20 bp, Artificial Sequence
  Synthetic oligonucleotide; GGG chr2 60505019 60505038 60505022 -
tctggtctcatgcagccgca

SEQ ID NO: 177931 - DNA, 20 bp, Artificial Sequence
  Synthetic oligonucleotide; GGG chr2 60505018 60505037 60505021 -
ctggtctcatgcagccgcag

SEQ ID NO: 177932 - DNA, 20 bp, Artificial Sequence
  Synthetic oligonucleotide; TAG chr2 60505015 60505034 60505018 -
gtctcatgcagccgcagggg

SEQ ID NO: 177933 - DNA, 20 bp, Artificial Sequence
  Synthetic oligonucleotide; TAG chr2 60505010 60505029 60505013 -
atgcagccgcaggggtagac

SEQ ID NO: 177934 - DNA, 20 bp, Artificial Sequence
  Synthetic oligonucleotide; AGG chr2 60505009 60505028 60505012 -
tgcagccgcaggggtagact

SEQ ID NO: 177935 - DNA, 20 bp, Artificial Sequence
  Synthetic oligonucleotide; GGG chr2 60505008 60505027 60505011 -
gcagccgcaggggtagacta

SEQ ID NO: 177936 - DNA, 20 bp, Artificial Sequence
  Synthetic oligonucleotide; CAG chr2 60504996 60505015 60504999 -
gtagactagggattctgatc

SEQ ID NO: 177937 - DNA, 20 bp, Artificial Sequence
  Synthetic oligonucleotide; TGG chr2 60504978 60504997 60504981 -
tccagaactccttatacttc

SEQ ID NO: 177938 - DNA, 20 bp, Artificial Sequence
  Synthetic oligonucleotide; GGG chr2 60504977 60504996 60504980 -
ccagaactccttatacttct

SEQ ID NO: 177939 - DNA, 20 bp, Artificial Sequence
  Synthetic oligonucleotide; CAG chr2 60504957 60504976 60504960 -
gggtccaccccacgcttcca

SEQ ID NO: 177940 - DNA, 20 bp, Artificial Sequence
  Synthetic oligonucleotide; CAG chr2 60504946 60504965 60504949 -
acgcttccacagcctgcaca

SEQ ID NO: 177941 - DNA, 20 bp, Artificial Sequence
  Synthetic oligonucleotide; AGG chr2 60504945 60504964 60504948 -
cgcttccacagcctgcacac

SEQ ID NO: 177942 - DNA, 20 bp, Artificial Sequence
  Synthetic oligonucleotide; GGG chr2 60504944 60504963 60504947 -
gcttccacagcctgcacaca

SEQ ID NO: 177943 - DNA, 20 bp, Artificial Sequence
  Synthetic oligonucleotide; TAG chr2 60504941 60504960 60504944 -
tccacagcctgcacacaggg

SEQ ID NO: 177944 - DNA, 20 bp, Artificial Sequence
  Synthetic oligonucleotide; AGG chr2 60504940 60504959 60504943 -
ccacagcctgcacacagggt

SEQ ID NO: 177945 - DNA, 20 bp, Artificial Sequence
  Synthetic oligonucleotide; GGG chr2 60504939 60504958 60504942 -
cacagcctgcacacagggta

SEQ ID NO: 177946 - DNA, 20 bp, Artificial Sequence
  Synthetic oligonucleotide; AAG chr2 60504936 60504955 60504939 -
agcctgcacacagggtaggg

SEQ ID NO: 177947 - DNA, 20 bp, Artificial Sequence
  Synthetic oligonucleotide; TGG chr2 60504930 60504949 60504933 -
cacacagggtagggaagttg

SEQ ID NO: 177948 - DNA, 20 bp, Artificial Sequence
  Synthetic oligonucleotide; CAG chr2 60504923 60504942 60504926 -
ggtagggaagttgtggcttg

SEQ ID NO: 177949 - DNA, 20 bp, Artificial Sequence
  Synthetic oligonucleotide; AAG chr2 60504920 60504939 60504923 -
agggaagttgtggcttgcag

SEQ ID NO: 177950 - DNA, 20 bp, Artificial Sequence
  Synthetic oligonucleotide; AGG chr2 60504919 60504938 60504922 -
gggaagttgtggcttgcaga

SEQ ID NO: 177951 - DNA, 20 bp, Artificial Sequence
  Synthetic oligonucleotide; TGG chr2 60504907 60504926 60504910 -
cttgcagaaggctgtttttt

SEQ ID NO: 177952 - DNA, 20 bp, Artificial Sequence
  Synthetic oligonucleotide; GGG chr2 60504906 60504925 60504909 -
ttgcagaaggctgttttttt

SEQ ID NO: 177953 - DNA, 20 bp, Artificial Sequence
  Synthetic oligonucleotide; GGG chr2 60504905 60504924 60504908 -
tgcagaaggctgtttttttg

SEQ ID NO: 177954 - DNA, 20 bp, Artificial Sequence
  Synthetic oligonucleotide; GGG chr2 60504904 60504923 60504907 -
gcagaaggctgtttttttgg

SEQ ID NO: 177955 - DNA, 20 bp, Artificial Sequence
  Synthetic oligonucleotide; GGG chr2 60504903 60504922 60504906 -
cagaaggctgtttttttggg

SEQ ID NO: 177956 - DNA, 20 bp, Artificial Sequence
  Synthetic oligonucleotide; TAG chr2 60504886 60504905 60504889 -
ggggggacgctctgttttaa

SEQ ID NO: 177957 - DNA, 20 bp, Artificial Sequence
  Synthetic oligonucleotide; TGG chr2 60504881 60504900 60504884 -
gacgctctgttttaatagtt

SEQ ID NO: 177958 - DNA, 20 bp, Artificial Sequence
  Synthetic oligonucleotide; GAG chr2 60504879 60504898 60504882 -
cgctctgttttaatagtttg

SEQ ID NO: 177959 - DNA, 20 bp, Artificial Sequence
  Synthetic oligonucleotide; AAG chr2 60504875 60504894 60504878 -
ctgttttaatagtttggagc

SEQ ID NO: 177960 - DNA, 20 bp, Artificial Sequence
  Synthetic oligonucleotide; AGG chr2 60504874 60504893 60504877 -
tgttttaatagtttggagca

SEQ ID NO: 177961 - DNA, 20 bp, Artificial Sequence
  Synthetic oligonucleotide; AAG chr2 60504871 60504890 60504874 -
tttaatagtttggagcaagg

SEQ ID NO: 177962 - DNA, 20 bp, Artificial Sequence
  Synthetic oligonucleotide; TAG chr2 60504867 60504886 60504870 -
atagtttggagcaaggaagc

SEQ ID NO: 177963 - DNA, 20 bp, Artificial Sequence
  Synthetic oligonucleotide; TGG chr2 60504864 60504883 60504867 -
gtttggagcaaggaagctag

SEQ ID NO: 177964 - DNA, 20 bp, Artificial Sequence
  Synthetic oligonucleotide; TGG chr2 60504861 60504880 60504864 -
tggagcaaggaagctagtgg

SEQ ID NO: 177965 - DNA, 20 bp, Artificial Sequence
  Synthetic oligonucleotide; GGG chr2 60504860 60504879 60504863 -
ggagcaaggaagctagtggt

SEQ ID NO: 177966 - DNA, 20 bp, Artificial Sequence
  Synthetic oligonucleotide; TGG chr2 60504850 60504869 60504853 -
agctagtggtgggcgctcac

SEQ ID NO: 177967 - DNA, 20 bp, Artificial Sequence
  Synthetic oligonucleotide; TAG chr2 60504847 60504866 60504850 -
tagtggtgggcgctcactgg

SEQ ID NO: 177968 - DNA, 20 bp, Artificial Sequence
  Synthetic oligonucleotide; AGG chr2 60504846 60504865 60504849 -
agtggtgggcgctcactggt

SEQ ID NO: 177969 - DNA, 20 bp, Artificial Sequence
  Synthetic oligonucleotide; GGG chr2 60504845 60504864 60504848 -
gtggtgggcgctcactggta

SEQ ID NO: 177970 - DNA, 20 bp, Artificial Sequence
  Synthetic oligonucleotide; GGG chr2 60504844 60504863 60504847 -
tggtgggcgctcactggtag

SEQ ID NO: 177971 - DNA, 20 bp, Artificial Sequence
  Synthetic oligonucleotide; GAG chr2 60504842 60504861 60504845 -
gtgggcgctcactggtaggg

SEQ ID NO: 177972 - DNA, 20 bp, Artificial Sequence
  Synthetic oligonucleotide; AGG chr2 60504841 60504860 60504844 -
tgggcgctcactggtagggg

SEQ ID NO: 177973 - DNA, 20 bp, Artificial Sequence
  Synthetic oligonucleotide; TAG chr2 60504831 60504850 60504834 -
ctggtaggggaggcatgtga

SEQ ID NO: 177974 - DNA, 20 bp, Artificial Sequence
  Synthetic oligonucleotide; AGG chr2 60504830 60504849 60504833 -
tggtaggggaggcatgtgat

SEQ ID NO: 177975 - DNA, 20 bp, Artificial Sequence
  Synthetic oligonucleotide; CAG chr2 60504824 60504843 60504827 -
gggaggcatgtgataggaat

SEQ ID NO: 177976 - DNA, 20 bp, Artificial Sequence
  Synthetic oligonucleotide; AAG chr2 60504810 60504829 60504813 -
aggaatcagtttgatctttt

SEQ ID NO: 177977 - DNA, 20 bp, Artificial Sequence
  Synthetic oligonucleotide; CAG chr2 60504801 60504820 60504804 -
tttgatcttttaagcatttt

SEQ ID NO: 177978 - DNA, 20 bp, Artificial Sequence
  Synthetic oligonucleotide; AGG chr2 60504800 60504819 60504803 -
ttgatcttttaagcattttc

SEQ ID NO: 177979 - DNA, 20 bp, Artificial Sequence
  Synthetic oligonucleotide; GGG chr2 60504799 60504818 60504802 -
tgatcttttaagcattttca

SEQ ID NO: 177980 - DNA, 20 bp, Artificial Sequence
  Synthetic oligonucleotide; CAG chr2 60504795 60504814 60504798 -
cttttaagcattttcaggga

SEQ ID NO: 177981 - DNA, 20 bp, Artificial Sequence
  Synthetic oligonucleotide; AAG chr2 60504756 60504775 60504759 -
ccacctctctatataatttc

SEQ ID NO: 177982 - DNA, 20 bp, Artificial Sequence
  Synthetic oligonucleotide; TGG chr2 60504746 60504765 60504749 -
atataatttcaagacttgat

SEQ ID NO: 177983 - DNA, 20 bp, Artificial Sequence
  Synthetic oligonucleotide; AAG chr2 60504733 60504752 60504736 -
acttgattggcattgtccct

SEQ ID NO: 177984 - DNA, 20 bp, Artificial Sequence
  Synthetic oligonucleotide; CAG chr2 60504727 60504746 60504730 -
ttggcattgtccctaagcac

SEQ ID NO: 177985 - DNA, 20 bp, Artificial Sequence
  Synthetic oligonucleotide; TAG chr2 60504724 60504743 60504727 -
gcattgtccctaagcaccag

SEQ ID NO: 177986 - DNA, 20 bp, Artificial Sequence
  Synthetic oligonucleotide; AAG chr2 60504720 60504739 60504723 -
tgtccctaagcaccagtaga

SEQ ID NO: 177987 - DNA, 20 bp, Artificial Sequence
  Synthetic oligonucleotide; AAG chr2 60504713 60504732 60504716 -
aagcaccagtagaaagcttg

SEQ ID NO: 177988 - DNA, 20 bp, Artificial Sequence
  Synthetic oligonucleotide; AAG chr2 60504710 60504729 60504713 -
caccagtagaaagcttgaag

SEQ ID NO: 177989 - DNA, 20 bp, Artificial Sequence
  Synthetic oligonucleotide; CAG chr2 60504702 60504721 60504705 -
gaaagcttgaagaagcttct

SEQ ID NO: 177990 - DNA, 20 bp, Artificial Sequence
  Synthetic oligonucleotide; CAG chr2 60504690 60504709 60504693 -
aagcttctcagtaaatacat

SEQ ID NO: 177991 - DNA, 20 bp, Artificial Sequence
  Synthetic oligonucleotide; CAG chr2 60504678 60504697 60504681 -
aaatacatcagctgtatttc

SEQ ID NO: 177992 - DNA, 20 bp, Artificial Sequence
  Synthetic oligonucleotide; AGG chr2 60504677 60504696 60504680 -
aatacatcagctgtatttcc

SEQ ID NO: 177993 - DNA, 20 bp, Artificial Sequence
  Synthetic oligonucleotide; GAG chr2 60504673 60504692 60504676 -
catcagctgtatttccaggt

SEQ ID NO: 177994 - DNA, 20 bp, Artificial Sequence
  Synthetic oligonucleotide; CAG chr2 60504670 60504689 60504673 -
cagctgtatttccaggtgag

SEQ ID NO: 177995 - DNA, 20 bp, Artificial Sequence
  Synthetic oligonucleotide; GAG chr2 60504651 60504670 60504654 -
gcagtacctgctgaaatgct

SEQ ID NO: 177996 - DNA, 20 bp, Artificial Sequence
  Synthetic oligonucleotide; GAG chr2 60504649 60504668 60504652 -
agtacctgctgaaatgctga

SEQ ID NO: 177997 - DNA, 20 bp, Artificial Sequence
  Synthetic oligonucleotide; TAG chr2 60504635 60504654 60504638 -
tgctgagagaacgttctgac

SEQ ID NO: 177998 - DNA, 20 bp, Artificial Sequence
  Synthetic oligonucleotide; AGG chr2 60504634 60504653 60504637 -
gctgagagaacgttctgact

SEQ ID NO: 177999 - DNA, 20 bp, Artificial Sequence
  Synthetic oligonucleotide; GAG chr2 60504632 60504651 60504635 -
tgagagaacgttctgactag

SEQ ID NO: 178000 - DNA, 20 bp, Artificial Sequence
  Synthetic oligonucleotide; AGG chr2 60504631 60504650 60504634 -
gagagaacgttctgactagg

SEQ ID NO: 178001 - DNA, 20 bp, Artificial Sequence
  Synthetic oligonucleotide; GGG chr2 60504630 60504649 60504633 -
agagaacgttctgactagga

SEQ ID NO: 178002 - DNA, 20 bp, Artificial Sequence
  Synthetic oligonucleotide; TGG chr2 60504625 60504644 60504628 -
acgttctgactaggagggct

SEQ ID NO: 178003 - DNA, 20 bp, Artificial Sequence
  Synthetic oligonucleotide; GGG chr2 60504624 60504643 60504627 -
cgttctgactaggagggctt

SEQ ID NO: 178004 - DNA, 20 bp, Artificial Sequence
  Synthetic oligonucleotide; GGG chr2 60504623 60504642 60504626 -
gttctgactaggagggcttg

SEQ ID NO: 178005 - DNA, 20 bp, Artificial Sequence
  Synthetic oligonucleotide; GGG chr2 60504622 60504641 60504625 -
ttctgactaggagggcttgg

SEQ ID NO: 178006 - DNA, 20 bp, Artificial Sequence
  Synthetic oligonucleotide; GAG chr2 60504620 60504639 60504623 -
ctgactaggagggcttgggg

SEQ ID NO: 178007 - DNA, 20 bp, Artificial Sequence
  Synthetic oligonucleotide; CAG chr2 60504616 60504635 60504619 -
ctaggagggcttgggggaga

SEQ ID NO: 178008 - DNA, 20 bp, Artificial Sequence
  Synthetic oligonucleotide; GAG chr2 60504614 60504633 60504617 -
aggagggcttgggggagaca

SEQ ID NO: 178009 - DNA, 20 bp, Artificial Sequence
  Synthetic oligonucleotide; CAG chr2 60504610 60504629 60504613 -
gggcttgggggagacagaga

SEQ ID NO: 178010 - DNA, 20 bp, Artificial Sequence
  Synthetic oligonucleotide; GAG chr2 60504608 60504627 60504611 -
gcttgggggagacagagaca

SEQ ID NO: 178011 - DNA, 20 bp, Artificial Sequence
  Synthetic oligonucleotide; TGG chr2 60504604 60504623 60504607 -
gggggagacagagacagagt

SEQ ID NO: 178012 - DNA, 20 bp, Artificial Sequence
  Synthetic oligonucleotide; CAG chr2 60504595 60504614 60504598 -
agagacagagttggctgttt

SEQ ID NO: 178013 - DNA, 20 bp, Artificial Sequence
  Synthetic oligonucleotide; CAG chr2 60504592 60504611 60504595 -
gacagagttggctgtttcag

SEQ ID NO: 178014 - DNA, 20 bp, Artificial Sequence
  Synthetic oligonucleotide; TGG chr2 60504562 60504581 60504565 -
ctgctatttgctttttgcct

SEQ ID NO: 178015 - DNA, 20 bp, Artificial Sequence
  Synthetic oligonucleotide; GAG chr2 60504560 60504579 60504563 -
gctatttgctttttgccttg

SEQ ID NO: 178016 - DNA, 20 bp, Artificial Sequence
  Synthetic oligonucleotide; TGG chr2 60504546 60504565 60504549 -
gccttggagattattttttc

SEQ ID NO: 178017 - DNA, 20 bp, Artificial Sequence
  Synthetic oligonucleotide; GGG chr2 60504545 60504564 60504548 -
ccttggagattattttttct

SEQ ID NO: 178018 - DNA, 20 bp, Artificial Sequence
  Synthetic oligonucleotide; GAG chr2 60504530 60504549 60504533 -
tttctgggtgtcccgatgct

SEQ ID NO: 178019 - DNA, 20 bp, Artificial Sequence
  Synthetic oligonucleotide; AAG chr2 60504517 60504536 60504520 -
cgatgctgagctcccacttc

SEQ ID NO: 178020 - DNA, 20 bp, Artificial Sequence
  Synthetic oligonucleotide; AAG chr2 60504514 60504533 60504517 -
tgctgagctcccacttcaag

SEQ ID NO: 178021 - DNA, 20 bp, Artificial Sequence
  Synthetic oligonucleotide; TGG chr2 60504506 60504525 60504509 -
tcccacttcaagaagaacat

SEQ ID NO: 178022 - DNA, 20 bp, Artificial Sequence
  Synthetic oligonucleotide; CAG chr2 60504488 60504507 60504491 -
attggtataaatttacaaac

SEQ ID NO: 178023 - DNA, 20 bp, Artificial Sequence
  Synthetic oligonucleotide; AAG chr2 60504485 60504504 60504488 -
ggtataaatttacaaaccag

SEQ ID NO: 178024 - DNA, 20 bp, Artificial Sequence
  Synthetic oligonucleotide; TAG chr2 60504482 60504501 60504485 -
ataaatttacaaaccagaag

SEQ ID NO: 178025 - DNA, 20 bp, Artificial Sequence
  Synthetic oligonucleotide; CAG chr2 60504478 60504497 60504481 -
atttacaaaccagaagtagt

SEQ ID NO: 178026 - DNA, 20 bp, Artificial Sequence
  Synthetic oligonucleotide; GAG chr2 60504476 60504495 60504479 -
ttacaaaccagaagtagtca

SEQ ID NO: 178027 - DNA, 20 bp, Artificial Sequence
  Synthetic oligonucleotide; AGG chr2 60504475 60504494 60504478 -
tacaaaccagaagtagtcag

SEQ ID NO: 178028 - DNA, 20 bp, Artificial Sequence
  Synthetic oligonucleotide; TGG chr2 60504443 60504462 60504446 -
ttgttctgttattccttctt

SEQ ID NO: 178029 - DNA, 20 bp, Artificial Sequence
  Synthetic oligonucleotide; GGG chr2 60504442 60504461 60504445 -
tgttctgttattccttcttt

SEQ ID NO: 178030 - DNA, 20 bp, Artificial Sequence
  Synthetic oligonucleotide; GAG chr2 60504440 60504459 60504443 -
ttctgttattccttctttgg

SEQ ID NO: 178031 - DNA, 20 bp, Artificial Sequence
  Synthetic oligonucleotide; GAG chr2 60504438 60504457 60504441 -
ctgttattccttctttggga

SEQ ID NO: 178032 - DNA, 20 bp, Artificial Sequence
  Synthetic oligonucleotide; CAG chr2 60504435 60504454 60504438 -
ttattccttctttgggagag

SEQ ID NO: 178033 - DNA, 20 bp, Artificial Sequence
  Synthetic oligonucleotide; AGG chr2 60504434 60504453 60504437 -
tattccttctttgggagagc

SEQ ID NO: 178034 - DNA, 20 bp, Artificial Sequence
  Synthetic oligonucleotide; TGG chr2 60504430 60504449 60504433 -
ccttctttgggagagcaggc

SEQ ID NO: 178035 - DNA, 20 bp, Artificial Sequence
  Synthetic oligonucleotide; CAG chr2 60504426 60504445 60504429 -
ctttgggagagcaggctggc

SEQ ID NO: 178036 - DNA, 20 bp, Artificial Sequence
  Synthetic oligonucleotide; AGG chr2 60504425 60504444 60504428 -
tttgggagagcaggctggcc

SEQ ID NO: 178037 - DNA, 20 bp, Artificial Sequence
  Synthetic oligonucleotide; GAG chr2 60504423 60504442 60504426 -
tgggagagcaggctggccag

SEQ ID NO: 178038 - DNA, 20 bp, Artificial Sequence
  Synthetic oligonucleotide; AGG chr2 60504422 60504441 60504425 -
gggagagcaggctggccagg

SEQ ID NO: 178039 - DNA, 20 bp, Artificial Sequence
  Synthetic oligonucleotide; AAG chr2 60504419 60504438 60504422 -
agagcaggctggccaggagg

SEQ ID NO: 178040 - DNA, 20 bp, Artificial Sequence
  Synthetic oligonucleotide; AGG chr2 60504418 60504437 60504421 -
gagcaggctggccaggagga

SEQ ID NO: 178041 - DNA, 20 bp, Artificial Sequence
  Synthetic oligonucleotide; AAG chr2 60504412 60504431 60504415 -
gctggccaggaggaaggttc

SEQ ID NO: 178042 - DNA, 20 bp, Artificial Sequence
  Synthetic oligonucleotide; TAG chr2 60504397 60504416 60504400 -
ggttcaagtgtgtcatatcc

SEQ ID NO: 178043 - DNA, 20 bp, Artificial Sequence
  Synthetic oligonucleotide; CAG chr2 60504390 60504409 60504393 -
gtgtgtcatatcctagcatt

SEQ ID NO: 178044 - DNA, 20 bp, Artificial Sequence
  Synthetic oligonucleotide; TAG chr2 60504386 60504405 60504389 -
gtcatatcctagcattcaga

SEQ ID NO: 178045 - DNA, 20 bp, Artificial Sequence
  Synthetic oligonucleotide; AGG chr2 60504385 60504404 60504388 -
tcatatcctagcattcagat

SEQ ID NO: 178046 - DNA, 20 bp, Artificial Sequence
  Synthetic oligonucleotide; TGG chr2 60504382 60504401 60504385 -
tatcctagcattcagatagg

SEQ ID NO: 178047 - DNA, 20 bp, Artificial Sequence
  Synthetic oligonucleotide; CAG chr2 60504364 60504383 60504367 -
ggtggcctcctctgcctttt

SEQ ID NO: 178048 - DNA, 20 bp, Artificial Sequence
  Synthetic oligonucleotide; TGG chr2 60504361 60504380 60504364 -
ggcctcctctgccttttcag

SEQ ID NO: 178049 - DNA, 20 bp, Artificial Sequence
  Synthetic oligonucleotide; GGG chr2 60504360 60504379 60504363 -
gcctcctctgccttttcagt

SEQ ID NO: 178050 - DNA, 20 bp, Artificial Sequence
  Synthetic oligonucleotide; TGG chr2 60504357 60504376 60504360 -
tcctctgccttttcagtggg

SEQ ID NO: 178051 - DNA, 20 bp, Artificial Sequence
  Synthetic oligonucleotide; TGG chr2 60504353 60504372 60504356 -
ctgccttttcagtgggtggc

SEQ ID NO: 178052 - DNA, 20 bp, Artificial Sequence
  Synthetic oligonucleotide; GGG chr2 60504352 60504371 60504355 -
tgccttttcagtgggtggct

SEQ ID NO: 178053 - DNA, 20 bp, Artificial Sequence
  Synthetic oligonucleotide; TGG chr2 60504348 60504367 60504351 -
ttttcagtgggtggctgggc

SEQ ID NO: 178054 - DNA, 20 bp, Artificial Sequence
  Synthetic oligonucleotide; GGG chr2 60504347 60504366 60504350 -
tttcagtgggtggctgggct

SEQ ID NO: 178055 - DNA, 20 bp, Artificial Sequence
  Synthetic oligonucleotide; CAG chr2 60504334 60504353 60504337 -
ctgggctgggtgaaatcttg

SEQ ID NO: 178056 - DNA, 20 bp, Artificial Sequence
  Synthetic oligonucleotide; AAG chr2 60504326 60504345 60504329 -
ggtgaaatcttgcagtgact

SEQ ID NO: 178057 - DNA, 20 bp, Artificial Sequence
  Synthetic oligonucleotide; AAG chr2 60504322 60504341 60504325 -
aaatcttgcagtgactaaga

SEQ ID NO: 178058 - DNA, 20 bp, Artificial Sequence
  Synthetic oligonucleotide; AGG chr2 60504321 60504340 60504324 -
aatcttgcagtgactaagaa

SEQ ID NO: 178059 - DNA, 20 bp, Artificial Sequence
  Synthetic oligonucleotide; AAG chr2 60504318 60504337 60504321 -
cttgcagtgactaagaaagg

SEQ ID NO: 178060 - DNA, 20 bp, Artificial Sequence
  Synthetic oligonucleotide; AGG chr2 60504317 60504336 60504320 -
ttgcagtgactaagaaagga

SEQ ID NO: 178061 - DNA, 20 bp, Artificial Sequence
  Synthetic oligonucleotide; GGG chr2 60504316 60504335 60504319 -
tgcagtgactaagaaaggaa

SEQ ID NO: 178062 - DNA, 20 bp, Artificial Sequence
  Synthetic oligonucleotide; TGG chr2 60504313 60504332 60504316 -
agtgactaagaaaggaaggg

SEQ ID NO: 178063 - DNA, 20 bp, Artificial Sequence
  Synthetic oligonucleotide; CAG chr2 60504307 60504326 60504310 -
taagaaaggaagggtggacc

SEQ ID NO: 178064 - DNA, 20 bp, Artificial Sequence
  Synthetic oligonucleotide; AGG chr2 60504306 60504325 60504309 -
aagaaaggaagggtggaccc

SEQ ID NO: 178065 - DNA, 20 bp, Artificial Sequence
  Synthetic oligonucleotide; CAG chr2 60504303 60504322 60504306 -
aaaggaagggtggacccagg

SEQ ID NO: 178066 - DNA, 20 bp, Artificial Sequence
  Synthetic oligonucleotide; CAG chr2 60504297 60504316 60504300 -
agggtggacccaggcagacc

SEQ ID NO: 178067 - DNA, 20 bp, Artificial Sequence
  Synthetic oligonucleotide; AAG chr2 60504294 60504313 60504297 -
gtggacccaggcagacccag

SEQ ID NO: 178068 - DNA, 20 bp, Artificial Sequence
  Synthetic oligonucleotide; AGG chr2 60504293 60504312 60504296 -
tggacccaggcagacccaga

SEQ ID NO: 178069 - DNA, 20 bp, Artificial Sequence
  Synthetic oligonucleotide; CGG chr2 60504256 60504275 60504259 -
cattgatcctgcatgcgtgc

SEQ ID NO: 178070 - DNA, 20 bp, Artificial Sequence
  Synthetic oligonucleotide; TAG chr2 60504253 60504272 60504256 -
tgatcctgcatgcgtgccgg

SEQ ID NO: 178071 - DNA, 20 bp, Artificial Sequence
  Synthetic oligonucleotide; AGG chr2 60504252 60504271 60504255 -
gatcctgcatgcgtgccggt

SEQ ID NO: 178072 - DNA, 20 bp, Artificial Sequence
  Synthetic oligonucleotide; CAG chr2 60504249 60504268 60504252 -
cctgcatgcgtgccggtagg

SEQ ID NO: 178073 - DNA, 20 bp, Artificial Sequence
  Synthetic oligonucleotide; CAG chr2 60504246 60504265 60504249 -
gcatgcgtgccggtaggcag

SEQ ID NO: 178074 - DNA, 20 bp, Artificial Sequence
  Synthetic oligonucleotide; TGG chr2 60504240 60504259 60504243 -
gtgccggtaggcagcagttc

SEQ ID NO: 178075 - DNA, 20 bp, Artificial Sequence
  Synthetic oligonucleotide; TGG chr2 60504231 60504250 60504234 -
ggcagcagttctggaattgc

SEQ ID NO: 178076 - DNA, 20 bp, Artificial Sequence
  Synthetic oligonucleotide; GGG chr2 60504230 60504249 60504233 -
gcagcagttctggaattgct

SEQ ID NO: 178077 - DNA, 20 bp, Artificial Sequence
  Synthetic oligonucleotide; GGG chr2 60504229 60504248 60504232 -
cagcagttctggaattgctg

SEQ ID NO: 178078 - DNA, 20 bp, Artificial Sequence
  Synthetic oligonucleotide; CAG chr2 60504220 60504239 60504223 -
tggaattgctggggaaacca

SEQ ID NO: 178079 - DNA, 20 bp, Artificial Sequence
  Synthetic oligonucleotide; CAG chr2 60504215 60504234 60504218 -
ttgctggggaaaccacagtg

SEQ ID NO: 178080 - DNA, 20 bp, Artificial Sequence
  Synthetic oligonucleotide; GAG chr2 60504209 60504228 60504212 -
gggaaaccacagtgcagcat

SEQ ID NO: 178081 - DNA, 20 bp, Artificial Sequence
  Synthetic oligonucleotide; TGG chr2 60504203 60504222 60504206 -
ccacagtgcagcatgagccc

SEQ ID NO: 178082 - DNA, 20 bp, Artificial Sequence
  Synthetic oligonucleotide; GGG chr2 60504202 60504221 60504205 -
cacagtgcagcatgagccct

SEQ ID NO: 178083 - DNA, 20 bp, Artificial Sequence
  Synthetic oligonucleotide; GGG chr2 60504201 60504220 60504204 -
acagtgcagcatgagccctg

SEQ ID NO: 178084 - DNA, 20 bp, Artificial Sequence
  Synthetic oligonucleotide; CGG chr2 60504182 60504201 60504185 -
ggggcctgctctcttgtgcc

SEQ ID NO: 178085 - DNA, 20 bp, Artificial Sequence
  Synthetic oligonucleotide; GAG chr2 60504177 60504196 60504180 -
ctgctctcttgtgcccggct

SEQ ID NO: 178086 - DNA, 20 bp, Artificial Sequence
  Synthetic oligonucleotide; TGG chr2 60504159 60504178 60504162 -
ctgagcatctctgttctgtt

SEQ ID NO: 178087 - DNA, 20 bp, Artificial Sequence
  Synthetic oligonucleotide; GGG chr2 60504158 60504177 60504161 -
tgagcatctctgttctgttt

SEQ ID NO: 178088 - DNA, 20 bp, Artificial Sequence
  Synthetic oligonucleotide; GGG chr2 60504157 60504176 60504160 -
gagcatctctgttctgtttg

SEQ ID NO: 178089 - DNA, 20 bp, Artificial Sequence
  Synthetic oligonucleotide; GAG chr2 60504155 60504174 60504158 -
gcatctctgttctgtttggg

SEQ ID NO: 178090 - DNA, 20 bp, Artificial Sequence
  Synthetic oligonucleotide; CAG chr2 60504146 60504165 60504149 -
ttctgtttggggagtcctgc

SEQ ID NO: 178091 - DNA, 20 bp, Artificial Sequence
  Synthetic oligonucleotide; AGG chr2 60504145 60504164 60504148 -
tctgtttggggagtcctgcc

SEQ ID NO: 178092 - DNA, 20 bp, Artificial Sequence
  Synthetic oligonucleotide; AAG chr2 60504141 60504160 60504144 -
tttggggagtcctgccaggc

SEQ ID NO: 178093 - DNA, 20 bp, Artificial Sequence
  Synthetic oligonucleotide; GAG chr2 60504135 60504154 60504138 -
gagtcctgccaggcaagtgt

SEQ ID NO: 178094 - DNA, 20 bp, Artificial Sequence
  Synthetic oligonucleotide; AAG chr2 60504129 60504148 60504132 -
tgccaggcaagtgtgagtca

SEQ ID NO: 178095 - DNA, 20 bp, Artificial Sequence
  Synthetic oligonucleotide; GAG chr2 60504127 60504146 60504130 -
ccaggcaagtgtgagtcaaa

SEQ ID NO: 178096 - DNA, 20 bp, Artificial Sequence
  Synthetic oligonucleotide; AGG chr2 60504126 60504145 60504129 -
caggcaagtgtgagtcaaag

SEQ ID NO: 178097 - DNA, 20 bp, Artificial Sequence
  Synthetic oligonucleotide; GAG chr2 60504124 60504143 60504127 -
ggcaagtgtgagtcaaagag

SEQ ID NO: 178098 - DNA, 20 bp, Artificial Sequence
  Synthetic oligonucleotide; CAG chr2 60504119 60504138 60504122 -
gtgtgagtcaaagaggagac

SEQ ID NO: 178099 - DNA, 20 bp, Artificial Sequence
  Synthetic oligonucleotide; AGG chr2 60504118 60504137 60504121 -
tgtgagtcaaagaggagacc

SEQ ID NO: 178100 - DNA, 20 bp, Artificial Sequence
  Synthetic oligonucleotide; GGG chr2 60504117 60504136 60504120 -
gtgagtcaaagaggagacca

SEQ ID NO: 178101 - DNA, 20 bp, Artificial Sequence
  Synthetic oligonucleotide; TGG chr2 60504104 60504123 60504107 -
gagaccagggccctatgtca

SEQ ID NO: 178102 - DNA, 20 bp, Artificial Sequence
  Synthetic oligonucleotide; GGG chr2 60504103 60504122 60504106 -
agaccagggccctatgtcat

SEQ ID NO: 178103 - DNA, 20 bp, Artificial Sequence
  Synthetic oligonucleotide; GGG chr2 60504102 60504121 60504105 -
gaccagggccctatgtcatg

SEQ ID NO: 178104 - DNA, 20 bp, Artificial Sequence
  Synthetic oligonucleotide; GGG chr2 60504101 60504120 60504104 -
accagggccctatgtcatgg

SEQ ID NO: 178105 - DNA, 20 bp, Artificial Sequence
  Synthetic oligonucleotide; CAG chr2 60504098 60504117 60504101 -
agggccctatgtcatggggg

SEQ ID NO: 178106 - DNA, 20 bp, Artificial Sequence
  Synthetic oligonucleotide; CGG chr2 60504092 60504111 60504095 -
ctatgtcatgggggcagtgt

SEQ ID NO: 178107 - DNA, 20 bp, Artificial Sequence
  Synthetic oligonucleotide; GAG chr2 60504087 60504106 60504090 -
tcatgggggcagtgtcggct

SEQ ID NO: 178108 - DNA, 20 bp, Artificial Sequence
  Synthetic oligonucleotide; TGG chr2 60504084 60504103 60504087 -
tgggggcagtgtcggctgag

SEQ ID NO: 178109 - DNA, 20 bp, Artificial Sequence
  Synthetic oligonucleotide; CAG chr2 60504074 60504093 60504077 -
gtcggctgagtggtactctt

SEQ ID NO: 178110 - DNA, 20 bp, Artificial Sequence
  Synthetic oligonucleotide; GAG chr2 60504072 60504091 60504075 -
cggctgagtggtactcttca

SEQ ID NO: 178111 - DNA, 20 bp, Artificial Sequence
  Synthetic oligonucleotide; CAG chr2 60504065 60504084 60504068 -
gtggtactcttcagagttct

SEQ ID NO: 178112 - DNA, 20 bp, Artificial Sequence
  Synthetic oligonucleotide; AAG chr2 60504049 60504068 60504052 -
ttctcagaatgtgccgctcg

SEQ ID NO: 178113 - DNA, 20 bp, Artificial Sequence
  Synthetic oligonucleotide; TAG chr2 60504041 60504060 60504044 -
atgtgccgctcgaagccatg

SEQ ID NO: 178114 - DNA, 20 bp, Artificial Sequence
  Synthetic oligonucleotide; AGG chr2 60504040 60504059 60504043 -
tgtgccgctcgaagccatgt

SEQ ID NO: 178115 - DNA, 20 bp, Artificial Sequence
  Synthetic oligonucleotide; CAG chr2 60504033 60504052 60504036 -
ctcgaagccatgtaggcttc

SEQ ID NO: 178116 - DNA, 20 bp, Artificial Sequence
  Synthetic oligonucleotide; CAG chr2 60504030 60504049 60504033 -
gaagccatgtaggcttccag

SEQ ID NO: 178117 - DNA, 20 bp, Artificial Sequence
  Synthetic oligonucleotide; AGG chr2 60504029 60504048 60504032 -
aagccatgtaggcttccagc

SEQ ID NO: 178118 - DNA, 20 bp, Artificial Sequence
  Synthetic oligonucleotide; TAG chr2 60504022 60504041 60504025 -
gtaggcttccagcaggcttc

SEQ ID NO: 178119 - DNA, 20 bp, Artificial Sequence
  Synthetic oligonucleotide; CAG chr2 60504019 60504038 60504022 -
ggcttccagcaggcttctag

SEQ ID NO: 178120 - DNA, 20 bp, Artificial Sequence
  Synthetic oligonucleotide; TGG chr2 60504015 60504034 60504018 -
tccagcaggcttctagcaga

SEQ ID NO: 178121 - DNA, 20 bp, Artificial Sequence
  Synthetic oligonucleotide; GGG chr2 60504014 60504033 60504017 -
ccagcaggcttctagcagat

SEQ ID NO: 178122 - DNA, 20 bp, Artificial Sequence
  Synthetic oligonucleotide; GGG chr2 60504013 60504032 60504016 -
cagcaggcttctagcagatg

SEQ ID NO: 178123 - DNA, 20 bp, Artificial Sequence
  Synthetic oligonucleotide; TGG chr2 60504007 60504026 60504010 -
gcttctagcagatggggttt

SEQ ID NO: 178124 - DNA, 20 bp, Artificial Sequence
  Synthetic oligonucleotide; TGG chr2 60504003 60504022 60504006 -
ctagcagatggggttttggc

SEQ ID NO: 178125 - DNA, 20 bp, Artificial Sequence
  Synthetic oligonucleotide; GGG chr2 60504002 60504021 60504005 -
tagcagatggggttttggct

SEQ ID NO: 178126 - DNA, 20 bp, Artificial Sequence
  Synthetic oligonucleotide; TGG chr2 60503998 60504017 60504001 -
agatggggttttggctgggt

SEQ ID NO: 178127 - DNA, 20 bp, Artificial Sequence
  Synthetic oligonucleotide; GGG chr2 60503997 60504016 60504000 -
gatggggttttggctgggtt

SEQ ID NO: 178128 - DNA, 20 bp, Artificial Sequence
  Synthetic oligonucleotide; CAG chr2 60503984 60504003 60503987 -
ctgggttgggccttaatact

SEQ ID NO: 178129 - DNA, 20 bp, Artificial Sequence
  Synthetic oligonucleotide; TAG chr2 60503919 60503938 60503922 -
ttcttgctttcttttttttc

SEQ ID NO: 178130 - DNA, 20 bp, Artificial Sequence
  Synthetic oligonucleotide; AAG chr2 60503908 60503927 60503911 -
ttttttttctagaatcaacg

SEQ ID NO: 178131 - DNA, 20 bp, Artificial Sequence
  Synthetic oligonucleotide; CAG chr2 60503905 60503924 60503908 -
tttttctagaatcaacgaag

SEQ ID NO: 178132 - DNA, 20 bp, Artificial Sequence
  Synthetic oligonucleotide; CAG chr2 60503887 60503906 60503890 -
agcagccaataaccaatttt

SEQ ID NO: 178133 - DNA, 20 bp, Artificial Sequence
  Synthetic oligonucleotide; AGG chr2 60503886 60503905 60503889 -
gcagccaataaccaattttc

SEQ ID NO: 178134 - DNA, 20 bp, Artificial Sequence
  Synthetic oligonucleotide; GAG chr2 60503884 60503903 60503887 -
agccaataaccaattttcag

SEQ ID NO: 178135 - DNA, 20 bp, Artificial Sequence
  Synthetic oligonucleotide; AGG chr2 60503883 60503902 60503886 -
gccaataaccaattttcagg

SEQ ID NO: 178136 - DNA, 20 bp, Artificial Sequence
  Synthetic oligonucleotide; TAG chr2 60503878 60503897 60503881 -
taaccaattttcaggaggtt

SEQ ID NO: 178137 - DNA, 20 bp, Artificial Sequence
  Synthetic oligonucleotide; AAG chr2 60503829 60503848 60503832 -
aaaattttattaaaataata

SEQ ID NO: 178138 - DNA, 20 bp, Artificial Sequence
  Synthetic oligonucleotide; AAG chr2 60503817 60503836 60503820 -
aaataataaagctctgacaa

SEQ ID NO: 178139 - DNA, 20 bp, Artificial Sequence
  Synthetic oligonucleotide; CAG chr2 60503811 60503830 60503814 -
taaagctctgacaaaagatc

SEQ ID NO: 178140 - DNA, 20 bp, Artificial Sequence
  Synthetic oligonucleotide; CAG chr2 60503794 60503813 60503797 -
atccagaatattgtcccttg

SEQ ID NO: 178141 - DNA, 20 bp, Artificial Sequence
  Synthetic oligonucleotide; TGG chr2 60503791 60503810 60503794 -
cagaatattgtcccttgcag

SEQ ID NO: 178142 - DNA, 20 bp, Artificial Sequence
  Synthetic oligonucleotide; GGG chr2 60503790 60503809 60503793 -
agaatattgtcccttgcagt

SEQ ID NO: 178143 - DNA, 20 bp, Artificial Sequence
  Synthetic oligonucleotide; TAG chr2 60503784 60503803 60503787 -
ttgtcccttgcagtgggctt

SEQ ID NO: 178144 - DNA, 20 bp, Artificial Sequence
  Synthetic oligonucleotide; AGG chr2 60503783 60503802 60503786 -
tgtcccttgcagtgggcttt

SEQ ID NO: 178145 - DNA, 20 bp, Artificial Sequence
  Synthetic oligonucleotide; GGG chr2 60503782 60503801 60503785 -
gtcccttgcagtgggcttta

SEQ ID NO: 178146 - DNA, 20 bp, Artificial Sequence
  Synthetic oligonucleotide; TGG chr2 60503771 60503790 60503774 -
tgggctttagggttgcatct

SEQ ID NO: 178147 - DNA, 20 bp, Artificial Sequence
  Synthetic oligonucleotide; TAG chr2 60503755 60503774 60503758 -
atcttggctcctaaatcttc

SEQ ID NO: 178148 - DNA, 20 bp, Artificial Sequence
  Synthetic oligonucleotide; AGG chr2 60503754 60503773 60503757 -
tcttggctcctaaatcttct

SEQ ID NO: 178149 - DNA, 20 bp, Artificial Sequence
  Synthetic oligonucleotide; CGG chr2 60503751 60503770 60503754 -
tggctcctaaatcttctagg

SEQ ID NO: 178150 - DNA, 20 bp, Artificial Sequence
  Synthetic oligonucleotide; GGG chr2 60503750 60503769 60503753 -
ggctcctaaatcttctaggc

SEQ ID NO: 178151 - DNA, 20 bp, Artificial Sequence
  Synthetic oligonucleotide; TAG chr2 60503741 60503760 60503744 -
atcttctaggcgggttaaat

SEQ ID NO: 178152 - DNA, 20 bp, Artificial Sequence
  Synthetic oligonucleotide; TGG chr2 60503714 60503733 60503717 -
cacaaaatgtcacatttccc

SEQ ID NO: 178153 - DNA, 20 bp, Artificial Sequence
  Synthetic oligonucleotide; CAG chr2 60503711 60503730 60503714 -
aaaatgtcacatttccctgg

SEQ ID NO: 178154 - DNA, 20 bp, Artificial Sequence
  Synthetic oligonucleotide; TAG chr2 60503705 60503724 60503708 -
tcacatttccctggcagcta

SEQ ID NO: 178155 - DNA, 20 bp, Artificial Sequence
  Synthetic oligonucleotide; AGG chr2 60503704 60503723 60503707 -
cacatttccctggcagctat

SEQ ID NO: 178156 - DNA, 20 bp, Artificial Sequence
  Synthetic oligonucleotide; CAG chr2 60503697 60503716 60503700 -
ccctggcagctataggtttc

SEQ ID NO: 178157 - DNA, 20 bp, Artificial Sequence
  Synthetic oligonucleotide; AGG chr2 60503696 60503715 60503699 -
cctggcagctataggtttcc

SEQ ID NO: 178158 - DNA, 20 bp, Artificial Sequence
  Synthetic oligonucleotide; GAG chr2 60503694 60503713 60503697 -
tggcagctataggtttccag

SEQ ID NO: 178159 - DNA, 20 bp, Artificial Sequence
  Synthetic oligonucleotide; AGG chr2 60503693 60503712 60503696 -
ggcagctataggtttccagg

SEQ ID NO: 178160 - DNA, 20 bp, Artificial Sequence
  Synthetic oligonucleotide; GGG chr2 60503692 60503711 60503695 -
gcagctataggtttccagga

SEQ ID NO: 178161 - DNA, 20 bp, Artificial Sequence
  Synthetic oligonucleotide; AAG chr2 60503684 60503703 60503687 -
aggtttccaggagggtgaac

SEQ ID NO: 178162 - DNA, 20 bp, Artificial Sequence
  Synthetic oligonucleotide; AGG chr2 60503683 60503702 60503686 -
ggtttccaggagggtgaaca

SEQ ID NO: 178163 - DNA, 20 bp, Artificial Sequence
  Synthetic oligonucleotide; GGG chr2 60503682 60503701 60503685 -
gtttccaggagggtgaacaa

SEQ ID NO: 178164 - DNA, 20 bp, Artificial Sequence
  Synthetic oligonucleotide; TGG chr2 60503674 60503693 60503677 -
gagggtgaacaagggccatc

SEQ ID NO: 178165 - DNA, 20 bp, Artificial Sequence
  Synthetic oligonucleotide; GGG chr2 60503673 60503692 60503676 -
agggtgaacaagggccatct

SEQ ID NO: 178166 - DNA, 20 bp, Artificial Sequence
  Synthetic oligonucleotide; GAG chr2 60503662 60503681 60503665 -
gggccatctgggtgtttgct

SEQ ID NO: 178167 - DNA, 20 bp, Artificial Sequence
  Synthetic oligonucleotide; AGG chr2 60503661 60503680 60503664 -
ggccatctgggtgtttgctg

SEQ ID NO: 178168 - DNA, 20 bp, Artificial Sequence
  Synthetic oligonucleotide; GGG chr2 60503660 60503679 60503663 -
gccatctgggtgtttgctga

SEQ ID NO: 178169 - DNA, 20 bp, Artificial Sequence
  Synthetic oligonucleotide; CAG chr2 60503652 60503671 60503655 -
ggtgtttgctgagggcttct

SEQ ID NO: 178170 - DNA, 20 bp, Artificial Sequence
  Synthetic oligonucleotide; TGG chr2 60503646 60503665 60503649 -
tgctgagggcttctcagtcc

SEQ ID NO: 178171 - DNA, 20 bp, Artificial Sequence
  Synthetic oligonucleotide; GGG chr2 60503645 60503664 60503648 -
gctgagggcttctcagtcct

SEQ ID NO: 178172 - DNA, 20 bp, Artificial Sequence
  Synthetic oligonucleotide; TAG chr2 60503642 60503661 60503645 -
gagggcttctcagtcctggg

SEQ ID NO: 178173 - DNA, 20 bp, Artificial Sequence
  Synthetic oligonucleotide; AGG chr2 60503641 60503660 60503644 -
agggcttctcagtcctgggt

SEQ ID NO: 178174 - DNA, 20 bp, Artificial Sequence
  Synthetic oligonucleotide; TGG chr2 60503632 60503651 60503635 -
cagtcctgggtaggaactgc

SEQ ID NO: 178175 - DNA, 20 bp, Artificial Sequence
  Synthetic oligonucleotide; GGG chr2 60503631 60503650 60503634 -
agtcctgggtaggaactgct

SEQ ID NO: 178176 - DNA, 20 bp, Artificial Sequence
  Synthetic oligonucleotide; TGG chr2 60503626 60503645 60503629 -
tgggtaggaactgctgggtg

SEQ ID NO: 178177 - DNA, 20 bp, Artificial Sequence
  Synthetic oligonucleotide; AAG chr2 60503615 60503634 60503618 -
tgctgggtgtggaaaccacc

SEQ ID NO: 178178 - DNA, 20 bp, Artificial Sequence
  Synthetic oligonucleotide; AGG chr2 60503614 60503633 60503617 -
gctgggtgtggaaaccacca

SEQ ID NO: 178179 - DNA, 20 bp, Artificial Sequence
  Synthetic oligonucleotide; AAG chr2 60503605 60503624 60503608 -
ggaaaccaccaaggctttgt

SEQ ID NO: 178180 - DNA, 20 bp, Artificial Sequence
  Synthetic oligonucleotide; AAG chr2 60503597 60503616 60503600 -
ccaaggctttgtaagcctga

SEQ ID NO: 178181 - DNA, 20 bp, Artificial Sequence
  Synthetic oligonucleotide; GAG chr2 60503595 60503614 60503598 -
aaggctttgtaagcctgaaa

SEQ ID NO: 178182 - DNA, 20 bp, Artificial Sequence
  Synthetic oligonucleotide; TGG chr2 60503588 60503607 60503591 -
tgtaagcctgaaagagccac

SEQ ID NO: 178183 - DNA, 20 bp, Artificial Sequence
  Synthetic oligonucleotide; TGG chr2 60503582 60503601 60503585 -
cctgaaagagccactggtat

SEQ ID NO: 178184 - DNA, 20 bp, Artificial Sequence
  Synthetic oligonucleotide; GGG chr2 60503581 60503600 60503584 -
ctgaaagagccactggtatt

SEQ ID NO: 178185 - DNA, 20 bp, Artificial Sequence
  Synthetic oligonucleotide; GAG chr2 60503579 60503598 60503582 -
gaaagagccactggtattgg

SEQ ID NO: 178186 - DNA, 20 bp, Artificial Sequence
  Synthetic oligonucleotide; TGG chr2 60503574 60503593 60503577 -
agccactggtattgggagct

SEQ ID NO: 178187 - DNA, 20 bp, Artificial Sequence
  Synthetic oligonucleotide; CAG chr2 60503563 60503582 60503566 -
ttgggagcttggtctgcact

SEQ ID NO: 178188 - DNA, 20 bp, Artificial Sequence
  Synthetic oligonucleotide; GAG chr2 60503556 60503575 60503559 -
cttggtctgcactcagacct

SEQ ID NO: 178189 - DNA, 20 bp, Artificial Sequence
  Synthetic oligonucleotide; CAG chr2 60503535 60503554 60503538 -
agcgccacacattattttcc

SEQ ID NO: 178190 - DNA, 20 bp, Artificial Sequence
  Synthetic oligonucleotide; TGG chr2 60503529 60503548 60503532 -
acacattattttcccagatt

SEQ ID NO: 178191 - DNA, 20 bp, Artificial Sequence
  Synthetic oligonucleotide; GGG chr2 60503528 60503547 60503531 -
cacattattttcccagattt

SEQ ID NO: 178192 - DNA, 20 bp, Artificial Sequence
  Synthetic oligonucleotide; TGG chr2 60503517 60503536 60503520 -
cccagatttgggcaatctaa

SEQ ID NO: 178193 - DNA, 20 bp, Artificial Sequence
  Synthetic oligonucleotide; TAG chr2 60503513 60503532 60503516 -
gatttgggcaatctaatgga

SEQ ID NO: 178194 - DNA, 20 bp, Artificial Sequence
  Synthetic oligonucleotide; AGG chr2 60503512 60503531 60503515 -
atttgggcaatctaatggat

SEQ ID NO: 178195 - DNA, 20 bp, Artificial Sequence
  Synthetic oligonucleotide; GAG chr2 60503510 60503529 60503513 -
ttgggcaatctaatggatag

SEQ ID NO: 178196 - DNA, 20 bp, Artificial Sequence
  Synthetic oligonucleotide; AGG chr2 60503509 60503528 60503512 -
tgggcaatctaatggatagg

SEQ ID NO: 178197 - DNA, 20 bp, Artificial Sequence
  Synthetic oligonucleotide; GGG chr2 60503508 60503527 60503511 -
gggcaatctaatggatagga

SEQ ID NO: 178198 - DNA, 20 bp, Artificial Sequence
  Synthetic oligonucleotide; GAG chr2 60503506 60503525 60503509 -
gcaatctaatggataggagg

SEQ ID NO: 178199 - DNA, 20 bp, Artificial Sequence
  Synthetic oligonucleotide; AGG chr2 60503505 60503524 60503508 -
caatctaatggataggaggg

SEQ ID NO: 178200 - DNA, 20 bp, Artificial Sequence
  Synthetic oligonucleotide; GGG chr2 60503504 60503523 60503507 -
aatctaatggataggaggga

SEQ ID NO: 178201 - DNA, 20 bp, Artificial Sequence
  Synthetic oligonucleotide; TAG chr2 60503483 60503502 60503486 -
ggttatgccccatctgtgaa

SEQ ID NO: 178202 - DNA, 20 bp, Artificial Sequence
  Synthetic oligonucleotide; AGG chr2 60503482 60503501 60503485 -
gttatgccccatctgtgaat

SEQ ID NO: 178203 - DNA, 20 bp, Artificial Sequence
  Synthetic oligonucleotide; TGG chr2 60503479 60503498 60503482 -
atgccccatctgtgaatagg

SEQ ID NO: 178204 - DNA, 20 bp, Artificial Sequence
  Synthetic oligonucleotide; GAG chr2 60503477 60503496 60503480 -
gccccatctgtgaataggtg

SEQ ID NO: 178205 - DNA, 20 bp, Artificial Sequence
  Synthetic oligonucleotide; AGG chr2 60503476 60503495 60503479 -
ccccatctgtgaataggtgg

SEQ ID NO: 178206 - DNA, 20 bp, Artificial Sequence
  Synthetic oligonucleotide; GAG chr2 60503474 60503493 60503477 -
ccatctgtgaataggtggag

SEQ ID NO: 178207 - DNA, 20 bp, Artificial Sequence
  Synthetic oligonucleotide; GAG chr2 60503472 60503491 60503475 -
atctgtgaataggtggagga

SEQ ID NO: 178208 - DNA, 20 bp, Artificial Sequence
  Synthetic oligonucleotide; AGG chr2 60503471 60503490 60503474 -
tctgtgaataggtggaggag

SEQ ID NO: 178209 - DNA, 20 bp, Artificial Sequence
  Synthetic oligonucleotide; GGG chr2 60503470 60503489 60503473 -
ctgtgaataggtggaggaga

SEQ ID NO: 178210 - DNA, 20 bp, Artificial Sequence
  Synthetic oligonucleotide; CAG chr2 60503465 60503484 60503468 -
aataggtggaggagagggtc

SEQ ID NO: 178211 - DNA, 20 bp, Artificial Sequence
  Synthetic oligonucleotide; GAG chr2 60503463 60503482 60503466 -
taggtggaggagagggtcca

SEQ ID NO: 178212 - DNA, 20 bp, Artificial Sequence
  Synthetic oligonucleotide; CAG chr2 60503450 60503469 60503453 -
gggtccagagaaaattgttg

SEQ ID NO: 178213 - DNA, 20 bp, Artificial Sequence
  Synthetic oligonucleotide; CAG chr2 60503443 60503462 60503446 -
gagaaaattgttgcagtgct

SEQ ID NO: 178214 - DNA, 20 bp, Artificial Sequence
  Synthetic oligonucleotide; GAG chr2 60503441 60503460 60503444 -
gaaaattgttgcagtgctca

SEQ ID NO: 178215 - DNA, 20 bp, Artificial Sequence
  Synthetic oligonucleotide; AGG chr2 60503440 60503459 60503443 -
aaaattgttgcagtgctcag

SEQ ID NO: 178216 - DNA, 20 bp, Artificial Sequence
  Synthetic oligonucleotide; AAG chr2 60503437 60503456 60503440 -
attgttgcagtgctcagagg

SEQ ID NO: 178217 - DNA, 20 bp, Artificial Sequence
  Synthetic oligonucleotide; TAG chr2 60503431 60503450 60503434 -
gcagtgctcagaggaagcaa

SEQ ID NO: 178218 - DNA, 20 bp, Artificial Sequence
  Synthetic oligonucleotide; CAG chr2 60503416 60503435 60503419 -
agcaatagcctactgtcttc

SEQ ID NO: 178219 - DNA, 20 bp, Artificial Sequence
  Synthetic oligonucleotide; AGG chr2 60503415 60503434 60503418 -
gcaatagcctactgtcttcc

SEQ ID NO: 178220 - DNA, 20 bp, Artificial Sequence
  Synthetic oligonucleotide; GGG chr2 60503414 60503433 60503417 -
caatagcctactgtcttcca

SEQ ID NO: 178221 - DNA, 20 bp, Artificial Sequence
  Synthetic oligonucleotide; TGG chr2 60503404 60503423 60503407 -
ctgtcttccagggacatgtc

SEQ ID NO: 178222 - DNA, 20 bp, Artificial Sequence
  Synthetic oligonucleotide; TGG chr2 60503397 60503416 60503400 -
ccagggacatgtctggctcc

SEQ ID NO: 178223 - DNA, 20 bp, Artificial Sequence
  Synthetic oligonucleotide; CAG chr2 60503384 60503403 60503387 -
tggctcctggaatgcctgtc

SEQ ID NO: 178224 - DNA, 20 bp, Artificial Sequence
  Synthetic oligonucleotide; AGG chr2 60503383 60503402 60503386 -
ggctcctggaatgcctgtcc

SEQ ID NO: 178225 - DNA, 20 bp, Artificial Sequence
  Synthetic oligonucleotide; CGG chr2 60503377 60503396 60503380 -
tggaatgcctgtccaggctg

SEQ ID NO: 178226 - DNA, 20 bp, Artificial Sequence
  Synthetic oligonucleotide; TGG chr2 60503374 60503393 60503377 -
aatgcctgtccaggctgcgg

SEQ ID NO: 178227 - DNA, 20 bp, Artificial Sequence
  Synthetic oligonucleotide; GGG chr2 60503373 60503392 60503376 -
atgcctgtccaggctgcggt

SEQ ID NO: 178228 - DNA, 20 bp, Artificial Sequence
  Synthetic oligonucleotide; TGG chr2 60503370 60503389 60503373 -
cctgtccaggctgcggtggg

SEQ ID NO: 178229 - DNA, 20 bp, Artificial Sequence
  Synthetic oligonucleotide; TGG chr2 60503365 60503384 60503368 -
ccaggctgcggtgggtggca

SEQ ID NO: 178230 - DNA, 20 bp, Artificial Sequence
  Synthetic oligonucleotide; GGG chr2 60503364 60503383 60503367 -
caggctgcggtgggtggcat

SEQ ID NO: 178231 - DNA, 20 bp, Artificial Sequence
  Synthetic oligonucleotide; AAG chr2 60503360 60503379 60503363 -
ctgcggtgggtggcatgggt

SEQ ID NO: 178232 - DNA, 20 bp, Artificial Sequence
  Synthetic oligonucleotide; AGG chr2 60503359 60503378 60503362 -
tgcggtgggtggcatgggta

SEQ ID NO: 178233 - DNA, 20 bp, Artificial Sequence
  Synthetic oligonucleotide; GGG chr2 60503358 60503377 60503361 -
gcggtgggtggcatgggtaa

SEQ ID NO: 178234 - DNA, 20 bp, Artificial Sequence
  Synthetic oligonucleotide; AAG chr2 60503344 60503363 60503347 -
gggtaagggtttttaataaa

SEQ ID NO: 178235 - DNA, 20 bp, Artificial Sequence
  Synthetic oligonucleotide; TGG chr2 60503331 60503350 60503334 -
taataaaaagtcacaatgcc

SEQ ID NO: 178236 - DNA, 20 bp, Artificial Sequence
  Synthetic oligonucleotide; GAG chr2 60503329 60503348 60503332 -
ataaaaagtcacaatgcctg

SEQ ID NO: 178237 - DNA, 20 bp, Artificial Sequence
  Synthetic oligonucleotide; AAG chr2 60503326 60503345 60503329 -
aaaagtcacaatgcctggag

SEQ ID NO: 178238 - DNA, 20 bp, Artificial Sequence
  Synthetic oligonucleotide; GAG chr2 60503322 60503341 60503325 -
gtcacaatgcctggagaagt

SEQ ID NO: 178239 - DNA, 20 bp, Artificial Sequence
  Synthetic oligonucleotide; AGG chr2 60503321 60503340 60503324 -
tcacaatgcctggagaagtg

SEQ ID NO: 178240 - DNA, 20 bp, Artificial Sequence
  Synthetic oligonucleotide; CAG chr2 60503311 60503330 60503314 -
tggagaagtgaggctccttg

SEQ ID NO: 178241 - DNA, 20 bp, Artificial Sequence
  Synthetic oligonucleotide; TGG chr2 60503289 60503308 60503292 -
gccacctgccttttctgtct

SEQ ID NO: 178242 - DNA, 20 bp, Artificial Sequence
  Synthetic oligonucleotide; GGG chr2 60503288 60503307 60503291 -
ccacctgccttttctgtctt

SEQ ID NO: 178243 - DNA, 20 bp, Artificial Sequence
  Synthetic oligonucleotide; TGG chr2 60503280 60503299 60503283 -
cttttctgtcttgggtctcc

SEQ ID NO: 178244 - DNA, 20 bp, Artificial Sequence
  Synthetic oligonucleotide; TGG chr2 60503276 60503295 60503279 -
tctgtcttgggtctcctggt

SEQ ID NO: 178245 - DNA, 20 bp, Artificial Sequence
  Synthetic oligonucleotide; TGG chr2 60503264 60503283 60503267 -
ctcctggttggaccccattc

SEQ ID NO: 178246 - DNA, 20 bp, Artificial Sequence
  Synthetic oligonucleotide; TGG chr2 60503252 60503271 60503255 -
ccccattctggctttccacc

SEQ ID NO: 178247 - DNA, 20 bp, Artificial Sequence
  Synthetic oligonucleotide; CAG chr2 60503248 60503267 60503251 -
attctggctttccacctggt

SEQ ID NO: 178248 - DNA, 20 bp, Artificial Sequence
  Synthetic oligonucleotide; GAG chr2 60503246 60503265 60503249 -
tctggctttccacctggtca

SEQ ID NO: 178249 - DNA, 20 bp, Artificial Sequence
  Synthetic oligonucleotide; GAG chr2 60503237 60503256 60503240 -
ccacctggtcagagcctcct

SEQ ID NO: 178250 - DNA, 20 bp, Artificial Sequence
  Synthetic oligonucleotide; AGG chr2 60503236 60503255 60503239 -
cacctggtcagagcctcctg

SEQ ID NO: 178251 - DNA, 20 bp, Artificial Sequence
  Synthetic oligonucleotide; CAG chr2 60503230 60503249 60503233 -
gtcagagcctcctgaggctg

SEQ ID NO: 178252 - DNA, 20 bp, Artificial Sequence
  Synthetic oligonucleotide; TGG chr2 60503225 60503244 60503228 -
agcctcctgaggctgcagaa

SEQ ID NO: 178253 - DNA, 20 bp, Artificial Sequence
  Synthetic oligonucleotide; GGG chr2 60503224 60503243 60503227 -
gcctcctgaggctgcagaat

SEQ ID NO: 178254 - DNA, 20 bp, Artificial Sequence
  Synthetic oligonucleotide; GGG chr2 60503223 60503242 60503226 -
cctcctgaggctgcagaatg

SEQ ID NO: 178255 - DNA, 20 bp, Artificial Sequence
  Synthetic oligonucleotide; AAG chr2 60503209 60503228 60503212 -
agaatggggctaacatgatc

SEQ ID NO: 178256 - DNA, 20 bp, Artificial Sequence
  Synthetic oligonucleotide; AGG chr2 60503208 60503227 60503211 -
gaatggggctaacatgatca

SEQ ID NO: 178257 - DNA, 20 bp, Artificial Sequence
  Synthetic oligonucleotide; GGG chr2 60503207 60503226 60503210 -
aatggggctaacatgatcaa

SEQ ID NO: 178258 - DNA, 20 bp, Artificial Sequence
  Synthetic oligonucleotide; TGG chr2 60503199 60503218 60503202 -
taacatgatcaagggtgatg

SEQ ID NO: 178259 - DNA, 20 bp, Artificial Sequence
  Synthetic oligonucleotide; TGG chr2 60503185 60503204 60503188 -
gtgatgtggcttctccatct

SEQ ID NO: 178260 - DNA, 20 bp, Artificial Sequence
  Synthetic oligonucleotide; GGG chr2 60503184 60503203 60503187 -
tgatgtggcttctccatctt

SEQ ID NO: 178261 - DNA, 20 bp, Artificial Sequence
  Synthetic oligonucleotide; TAG chr2 60503179 60503198 60503182 -
tggcttctccatcttgggac

SEQ ID NO: 178262 - DNA, 20 bp, Artificial Sequence
  Synthetic oligonucleotide; AGG chr2 60503178 60503197 60503181 -
ggcttctccatcttgggact

SEQ ID NO: 178263 - DNA, 20 bp, Artificial Sequence
  Synthetic oligonucleotide; GAG chr2 60503176 60503195 60503179 -
cttctccatcttgggactag

SEQ ID NO: 178264 - DNA, 20 bp, Artificial Sequence
  Synthetic oligonucleotide; CAG chr2 60503169 60503188 60503172 -
atcttgggactaggagtgac

SEQ ID NO: 178265 - DNA, 20 bp, Artificial Sequence
  Synthetic oligonucleotide; AGG chr2 60503168 60503187 60503171 -
tcttgggactaggagtgacc

SEQ ID NO: 178266 - DNA, 20 bp, Artificial Sequence
  Synthetic oligonucleotide; TAG chr2 60503163 60503182 60503166 -
ggactaggagtgaccaggtt

SEQ ID NO: 178267 - DNA, 20 bp, Artificial Sequence
  Synthetic oligonucleotide; GAG chr2 60503161 60503180 60503164 -
actaggagtgaccaggttta

SEQ ID NO: 178268 - DNA, 20 bp, Artificial Sequence
  Synthetic oligonucleotide; AAG chr2 60503158 60503177 60503161 -
aggagtgaccaggtttagag

SEQ ID NO: 178269 - DNA, 20 bp, Artificial Sequence
  Synthetic oligonucleotide; AGG chr2 60503157 60503176 60503160 -
ggagtgaccaggtttagaga

SEQ ID NO: 178270 - DNA, 20 bp, Artificial Sequence
  Synthetic oligonucleotide; TGG chr2 60503154 60503173 60503157 -
gtgaccaggtttagagaagg

SEQ ID NO: 178271 - DNA, 20 bp, Artificial Sequence
  Synthetic oligonucleotide; CAG chr2 60503130 60503149 60503133 -
ctcattcctgctcccattgc

SEQ ID NO: 178272 - DNA, 20 bp, Artificial Sequence
  Synthetic oligonucleotide; AGG chr2 60503129 60503148 60503132 -
tcattcctgctcccattgcc

SEQ ID NO: 178273 - DNA, 20 bp, Artificial Sequence
  Synthetic oligonucleotide; CAG chr2 60503119 60503138 60503122 -
tcccattgccaggacaaatg

SEQ ID NO: 178274 - DNA, 20 bp, Artificial Sequence
  Synthetic oligonucleotide; GAG chr2 60503117 60503136 60503120 -
ccattgccaggacaaatgca

SEQ ID NO: 178275 - DNA, 20 bp, Artificial Sequence
  Synthetic oligonucleotide; TGG chr2 60503114 60503133 60503117 -
ttgccaggacaaatgcagag

SEQ ID NO: 178276 - DNA, 20 bp, Artificial Sequence
  Synthetic oligonucleotide; TGG chr2 60503108 60503127 60503111 -
ggacaaatgcagagtggatc

SEQ ID NO: 178277 - DNA, 20 bp, Artificial Sequence
  Synthetic oligonucleotide; GGG chr2 60503107 60503126 60503110 -
gacaaatgcagagtggatct

SEQ ID NO: 178278 - DNA, 20 bp, Artificial Sequence
  Synthetic oligonucleotide; CAG chr2 60503089 60503108 60503092 -
ctgggtctgtcccttccaca

SEQ ID NO: 178279 - DNA, 20 bp, Artificial Sequence
  Synthetic oligonucleotide; AAG chr2 60503054 60503073 60503057 -
caacacattccgtgtgtatt

SEQ ID NO: 178280 - DNA, 20 bp, Artificial Sequence
  Synthetic oligonucleotide; CAG chr2 60503047 60503066 60503050 -
ttccgtgtgtattaagatga

SEQ ID NO: 178281 - DNA, 20 bp, Artificial Sequence
  Synthetic oligonucleotide; TGG chr2 60503038 60503057 60503041 -
tattaagatgacagacacgt

SEQ ID NO: 178282 - DNA, 20 bp, Artificial Sequence
  Synthetic oligonucleotide; AAG chr2 60503026 60503045 60503029 -
agacacgttggttttgctcc

SEQ ID NO: 178283 - DNA, 20 bp, Artificial Sequence
  Synthetic oligonucleotide; CAG chr2 60503022 60503041 60503025 -
acgttggttttgctccaagc

SEQ ID NO: 178284 - DNA, 20 bp, Artificial Sequence
  Synthetic oligonucleotide; TAG chr2 60503019 60503038 60503022 -
ttggttttgctccaagccag

SEQ ID NO: 178285 - DNA, 20 bp, Artificial Sequence
  Synthetic oligonucleotide; TAG chr2 60503007 60503026 60503010 -
caagccagtagccatccccc

SEQ ID NO: 178286 - DNA, 20 bp, Artificial Sequence
  Synthetic oligonucleotide; CAG chr2 60503003 60503022 60503006 -
ccagtagccatccccctaga

SEQ ID NO: 178287 - DNA, 20 bp, Artificial Sequence
  Synthetic oligonucleotide; CAG chr2 60502998 60503017 60503001 -
agccatccccctagacagcc

SEQ ID NO: 178288 - DNA, 20 bp, Artificial Sequence
  Synthetic oligonucleotide; AGG chr2 60502997 60503016 60503000 -
gccatccccctagacagccc

SEQ ID NO: 178289 - DNA, 20 bp, Artificial Sequence
  Synthetic oligonucleotide; AAG chr2 60502988 60503007 60502991 -
ctagacagcccaggccttaa

SEQ ID NO: 178290 - DNA, 20 bp, Artificial Sequence
  Synthetic oligonucleotide; AAG chr2 60502983 60503002 60502986 -
cagcccaggccttaaaagac

SEQ ID NO: 178291 - DNA, 20 bp, Artificial Sequence
  Synthetic oligonucleotide; AGG chr2 60502982 60503001 60502985 -
agcccaggccttaaaagaca

SEQ ID NO: 178292 - DNA, 20 bp, Artificial Sequence
  Synthetic oligonucleotide; GAG chr2 60502980 60502999 60502983 -
cccaggccttaaaagacaag

SEQ ID NO: 178293 - DNA, 20 bp, Artificial Sequence
  Synthetic oligonucleotide; AGG chr2 60502979 60502998 60502982 -
ccaggccttaaaagacaagg

SEQ ID NO: 178294 - DNA, 20 bp, Artificial Sequence
  Synthetic oligonucleotide; TGG chr2 60502972 60502991 60502975 -
ttaaaagacaaggaggtgtt

SEQ ID NO: 178295 - DNA, 20 bp, Artificial Sequence
  Synthetic oligonucleotide; AAG chr2 60502967 60502986 60502970 -
agacaaggaggtgtttggac

SEQ ID NO: 178296 - DNA, 20 bp, Artificial Sequence
  Synthetic oligonucleotide; GAG chr2 60502965 60502984 60502968 -
acaaggaggtgtttggacaa

SEQ ID NO: 178297 - DNA, 20 bp, Artificial Sequence
  Synthetic oligonucleotide; AAG chr2 60502961 60502980 60502964 -
ggaggtgtttggacaagagc

SEQ ID NO: 178298 - DNA, 20 bp, Artificial Sequence
  Synthetic oligonucleotide; AAG chr2 60502957 60502976 60502960 -
gtgtttggacaagagcaaga

SEQ ID NO: 178299 - DNA, 20 bp, Artificial Sequence
  Synthetic oligonucleotide; AAG chr2 60502954 60502973 60502957 -
tttggacaagagcaagaaag

SEQ ID NO: 178300 - DNA, 20 bp, Artificial Sequence
  Synthetic oligonucleotide; TGG chr2 60502949 60502968 60502952 -
acaagagcaagaaagaagtc

SEQ ID NO: 178301 - DNA, 20 bp, Artificial Sequence
  Synthetic oligonucleotide; TGG chr2 60502936 60502955 60502939 -
agaagtctggctgtgtcttc

SEQ ID NO: 178302 - DNA, 20 bp, Artificial Sequence
  Synthetic oligonucleotide; GGG chr2 60502935 60502954 60502938 -
gaagtctggctgtgtcttct

SEQ ID NO: 178303 - DNA, 20 bp, Artificial Sequence
  Synthetic oligonucleotide; GAG chr2 60502933 60502952 60502936 -
agtctggctgtgtcttctgg

SEQ ID NO: 178304 - DNA, 20 bp, Artificial Sequence
  Synthetic oligonucleotide; CAG chr2 60502927 60502946 60502930 -
gctgtgtcttctgggagccc

SEQ ID NO: 178305 - DNA, 20 bp, Artificial Sequence
  Synthetic oligonucleotide; CAG chr2 60502923 60502942 60502926 -
tgtcttctgggagccccaga

SEQ ID NO: 178306 - DNA, 20 bp, Artificial Sequence
  Synthetic oligonucleotide; CAG chr2 60502918 60502937 60502921 -
tctgggagccccagacagac

SEQ ID NO: 178307 - DNA, 20 bp, Artificial Sequence
  Synthetic oligonucleotide; TGG chr2 60502902 60502921 60502905 -
agaccagtgttctttctcac

SEQ ID NO: 178308 - DNA, 20 bp, Artificial Sequence
  Synthetic oligonucleotide; CAG chr2 60502886 60502905 60502889 -
tcactggttcactccttccc

SEQ ID NO: 178309 - DNA, 20 bp, Artificial Sequence
  Synthetic oligonucleotide; GAG chr2 60502867 60502886 60502870 -
ccagctcattttacccactc

SEQ ID NO: 178310 - DNA, 20 bp, Artificial Sequence
  Synthetic oligonucleotide; TAG chr2 60502852 60502871 60502855 -
cactcgagacttgattctct

SEQ ID NO: 178311 - DNA, 20 bp, Artificial Sequence
  Synthetic oligonucleotide; GAG chr2 60502850 60502869 60502853 -
ctcgagacttgattctctta

SEQ ID NO: 178312 - DNA, 20 bp, Artificial Sequence
  Synthetic oligonucleotide; AAG chr2 60502844 60502863 60502847 -
acttgattctcttagagatt

SEQ ID NO: 178313 - DNA, 20 bp, Artificial Sequence
  Synthetic oligonucleotide; TGG chr2 60502832 60502851 60502835 -
tagagattaagtacctcccc

SEQ ID NO: 178314 - DNA, 20 bp, Artificial Sequence
  Synthetic oligonucleotide; TAG chr2 60502824 60502843 60502827 -
aagtacctcccctggtcaca

SEQ ID NO: 178315 - DNA, 20 bp, Artificial Sequence
  Synthetic oligonucleotide; TGG chr2 60502817 60502836 60502820 -
tcccctggtcacatagtttc

SEQ ID NO: 178316 - DNA, 20 bp, Artificial Sequence
  Synthetic oligonucleotide; GGG chr2 60502816 60502835 60502819 -
cccctggtcacatagtttct

SEQ ID NO: 178317 - DNA, 20 bp, Artificial Sequence
  Synthetic oligonucleotide; CAG chr2 60502810 60502829 60502813 -
gtcacatagtttctgggtga

SEQ ID NO: 178318 - DNA, 20 bp, Artificial Sequence
  Synthetic oligonucleotide; AGG chr2 60502809 60502828 60502812 -
tcacatagtttctgggtgac

SEQ ID NO: 178319 - DNA, 20 bp, Artificial Sequence
  Synthetic oligonucleotide; TAG chr2 60502804 60502823 60502807 -
tagtttctgggtgacaggac

SEQ ID NO: 178320 - DNA, 20 bp, Artificial Sequence
  Synthetic oligonucleotide; GAG chr2 60502776 60502795 60502779 -
atttcttttgatcaccaatt

SEQ ID NO: 178321 - DNA, 20 bp, Artificial Sequence
  Synthetic oligonucleotide; CAG chr2 60502742 60502761 60502745 -
ctctactgtgctaccatgat

SEQ ID NO: 178322 - DNA, 20 bp, Artificial Sequence
  Synthetic oligonucleotide; GAG chr2 60502740 60502759 60502743 -
ctactgtgctaccatgatca

SEQ ID NO: 178323 - DNA, 20 bp, Artificial Sequence
  Synthetic oligonucleotide; AGG chr2 60502739 60502758 60502742 -
tactgtgctaccatgatcag

SEQ ID NO: 178324 - DNA, 20 bp, Artificial Sequence
  Synthetic oligonucleotide; CAG chr2 60502704 60502723 60502707 -
tctctgatgatgattgaaaa

SEQ ID NO: 178325 - DNA, 20 bp, Artificial Sequence
  Synthetic oligonucleotide; AAG chr2 60502686 60502705 60502689 -
aacagttttattaacatatc

SEQ ID NO: 178326 - DNA, 20 bp, Artificial Sequence
  Synthetic oligonucleotide; AAG chr2 60502669 60502688 60502672 -
atcaagaacattacaacaca

SEQ ID NO: 178327 - DNA, 20 bp, Artificial Sequence
  Synthetic oligonucleotide; GAG chr2 60502667 60502686 60502670 -
caagaacattacaacacaaa

SEQ ID NO: 178328 - DNA, 20 bp, Artificial Sequence
  Synthetic oligonucleotide; TGG chr2 60502660 60502679 60502663 -
attacaacacaaagagtttc

SEQ ID NO: 178329 - DNA, 20 bp, Artificial Sequence
  Synthetic oligonucleotide; TGG chr2 60502637 60502656 60502640 -
tttaaaaaatctcttttcac

SEQ ID NO: 178330 - DNA, 20 bp, Artificial Sequence
  Synthetic oligonucleotide; TAG chr2 60502608 60502627 60502611 -
ttaaattcatattttaatat

SEQ ID NO: 178331 - DNA, 20 bp, Artificial Sequence
  Synthetic oligonucleotide; AAG chr2 60502604 60502623 60502607 -
attcatattttaatattaga

SEQ ID NO: 178332 - DNA, 20 bp, Artificial Sequence
  Synthetic oligonucleotide; TGG chr2 60502599 60502618 60502602 -
tattttaatattagaaagca

SEQ ID NO: 178333 - DNA, 20 bp, Artificial Sequence
  Synthetic oligonucleotide; GGG chr2 60502598 60502617 60502601 -
attttaatattagaaagcat

SEQ ID NO: 178334 - DNA, 20 bp, Artificial Sequence
  Synthetic oligonucleotide; TGG chr2 60502593 60502612 60502596 -
aatattagaaagcatgggat

SEQ ID NO: 178335 - DNA, 20 bp, Artificial Sequence
  Synthetic oligonucleotide; GGG chr2 60502592 60502611 60502595 -
atattagaaagcatgggatt

SEQ ID NO: 178336 - DNA, 20 bp, Artificial Sequence
  Synthetic oligonucleotide; TGG chr2 60502574 60502593 60502577 -
ttgggtgtgaacactgcttt

SEQ ID NO: 178337 - DNA, 20 bp, Artificial Sequence
  Synthetic oligonucleotide; TGG chr2 60502567 60502586 60502570 -
tgaacactgcttttggatgt

SEQ ID NO: 178338 - DNA, 20 bp, Artificial Sequence
  Synthetic oligonucleotide; GAG chr2 60502565 60502584 60502568 -
aacactgcttttggatgttg

SEQ ID NO: 178339 - DNA, 20 bp, Artificial Sequence
  Synthetic oligonucleotide; AGG chr2 60502564 60502583 60502567 -
acactgcttttggatgttgg

SEQ ID NO: 178340 - DNA, 20 bp, Artificial Sequence
  Synthetic oligonucleotide; AAG chr2 60502561 60502580 60502564 -
ctgcttttggatgttggagg

SEQ ID NO: 178341 - DNA, 20 bp, Artificial Sequence
  Synthetic oligonucleotide; AAG chr2 60502556 60502575 60502559 -
tttggatgttggaggaagat

SEQ ID NO: 178342 - DNA, 20 bp, Artificial Sequence
  Synthetic oligonucleotide; GAG chr2 60502554 60502573 60502557 -
tggatgttggaggaagataa

SEQ ID NO: 178343 - DNA, 20 bp, Artificial Sequence
  Synthetic oligonucleotide; AAG chr2 60502551 60502570 60502554 -
atgttggaggaagataagag

SEQ ID NO: 178344 - DNA, 20 bp, Artificial Sequence
  Synthetic oligonucleotide; AGG chr2 60502550 60502569 60502553 -
tgttggaggaagataagaga

SEQ ID NO: 178345 - DNA, 20 bp, Artificial Sequence
  Synthetic oligonucleotide; AAG chr2 60502547 60502566 60502550 -
tggaggaagataagagaagg

SEQ ID NO: 178346 - DNA, 20 bp, Artificial Sequence
  Synthetic oligonucleotide; TGG chr2 60502543 60502562 60502546 -
ggaagataagagaaggaagc

SEQ ID NO: 178347 - DNA, 20 bp, Artificial Sequence
  Synthetic oligonucleotide; TAG chr2 60502531 60502550 60502534 -
aaggaagctggctctttctt

SEQ ID NO: 178348 - DNA, 20 bp, Artificial Sequence
  Synthetic oligonucleotide; AGG chr2 60502530 60502549 60502533 -
aggaagctggctctttcttt

SEQ ID NO: 178349 - DNA, 20 bp, Artificial Sequence
  Synthetic oligonucleotide; GAG chr2 60502528 60502547 60502531 -
gaagctggctctttctttag

SEQ ID NO: 178350 - DNA, 20 bp, Artificial Sequence
  Synthetic oligonucleotide; GAG chr2 60502517 60502536 60502520 -
tttctttaggagcaatacct

SEQ ID NO: 178351 - DNA, 20 bp, Artificial Sequence
  Synthetic oligonucleotide; CAG chr2 60502510 60502529 60502513 -
aggagcaatacctgagatcc

SEQ ID NO: 178352 - DNA, 20 bp, Artificial Sequence
  Synthetic oligonucleotide; AAG chr2 60502494 60502513 60502497 -
atcccagaattgtatgtaca

SEQ ID NO: 178353 - DNA, 20 bp, Artificial Sequence
  Synthetic oligonucleotide; TGG chr2 60502484 60502503 60502487 -
tgtatgtacaaagtgtgtga

SEQ ID NO: 178354 - DNA, 20 bp, Artificial Sequence
  Synthetic oligonucleotide; CAG chr2 60502481 60502500 60502484 -
atgtacaaagtgtgtgatgg

SEQ ID NO: 178355 - DNA, 20 bp, Artificial Sequence
  Synthetic oligonucleotide; GAG chr2 60502479 60502498 60502482 -
gtacaaagtgtgtgatggca

SEQ ID NO: 178356 - DNA, 20 bp, Artificial Sequence
  Synthetic oligonucleotide; TAG chr2 60502463 60502482 60502466 -
ggcagagctcaaatctgtgc

SEQ ID NO: 178357 - DNA, 20 bp, Artificial Sequence
  Synthetic oligonucleotide; GAG chr2 60502459 60502478 60502462 -
gagctcaaatctgtgctagc

SEQ ID NO: 178358 - DNA, 20 bp, Artificial Sequence
  Synthetic oligonucleotide; AAG chr2 60502426 60502445 60502429 -
ctactcttctgaatctgatg

SEQ ID NO: 178359 - DNA, 20 bp, Artificial Sequence
  Synthetic oligonucleotide; AAG chr2 60502423 60502442 60502426 -
ctcttctgaatctgatgaag

SEQ ID NO: 178360 - DNA, 20 bp, Artificial Sequence
  Synthetic oligonucleotide; CAG chr2 60502406 60502425 60502409 -
aagaagttattctgtctgtg

SEQ ID NO: 178361 - DNA, 20 bp, Artificial Sequence
  Synthetic oligonucleotide; TAG chr2 60502397 60502416 60502400 -
ttctgtctgtgcagttttat

SEQ ID NO: 178362 - DNA, 20 bp, Artificial Sequence
  Synthetic oligonucleotide; AGG chr2 60502396 60502415 60502399 -
tctgtctgtgcagttttatt

SEQ ID NO: 178363 - DNA, 20 bp, Artificial Sequence
  Synthetic oligonucleotide; GAG chr2 60502391 60502410 60502394 -
ctgtgcagttttattaggct

SEQ ID NO: 178364 - DNA, 20 bp, Artificial Sequence
  Synthetic oligonucleotide; TGG chr2 60502377 60502396 60502380 -
taggctgagactttttccga

SEQ ID NO: 178365 - DNA, 20 bp, Artificial Sequence
  Synthetic oligonucleotide; CAG chr2 60502354 60502373 60502357 -
tttatttttccgtttgctca

SEQ ID NO: 178366 - DNA, 20 bp, Artificial Sequence
  Synthetic oligonucleotide; TAG chr2 60502347 60502366 60502350 -
ttccgtttgctcacagaatg

SEQ ID NO: 178367 - DNA, 20 bp, Artificial Sequence
  Synthetic oligonucleotide; GAG chr2 60502345 60502364 60502348 -
ccgtttgctcacagaatgta

SEQ ID NO: 178368 - DNA, 20 bp, Artificial Sequence
  Synthetic oligonucleotide; AGG chr2 60502344 60502363 60502347 -
cgtttgctcacagaatgtag

SEQ ID NO: 178369 - DNA, 20 bp, Artificial Sequence
  Synthetic oligonucleotide; GAG chr2 60502342 60502361 60502345 -
tttgctcacagaatgtagag

SEQ ID NO: 178370 - DNA, 20 bp, Artificial Sequence
  Synthetic oligonucleotide; GAG chr2 60502340 60502359 60502343 -
tgctcacagaatgtagagga

SEQ ID NO: 178371 - DNA, 20 bp, Artificial Sequence
  Synthetic oligonucleotide; CAG chr2 60502336 60502355 60502339 -
cacagaatgtagaggagagc

SEQ ID NO: 178372 - DNA, 20 bp, Artificial Sequence
  Synthetic oligonucleotide; AGG chr2 60502335 60502354 60502338 -
acagaatgtagaggagagcc

SEQ ID NO: 178373 - DNA, 20 bp, Artificial Sequence
  Synthetic oligonucleotide; GAG chr2 60502333 60502352 60502336 -
agaatgtagaggagagccag

SEQ ID NO: 178374 - DNA, 20 bp, Artificial Sequence
  Synthetic oligonucleotide; AGG chr2 60502332 60502351 60502335 -
gaatgtagaggagagccagg

SEQ ID NO: 178375 - DNA, 20 bp, Artificial Sequence
  Synthetic oligonucleotide; GGG chr2 60502331 60502350 60502334 -
aatgtagaggagagccagga

SEQ ID NO: 178376 - DNA, 20 bp, Artificial Sequence
  Synthetic oligonucleotide; GAG chr2 60502329 60502348 60502332 -
tgtagaggagagccaggagg

SEQ ID NO: 178377 - DNA, 20 bp, Artificial Sequence
  Synthetic oligonucleotide; TGG chr2 60502290 60502309 60502293 -
gtttacctactccctgactt

SEQ ID NO: 178378 - DNA, 20 bp, Artificial Sequence
  Synthetic oligonucleotide; GAG chr2 60502288 60502307 60502291 -
ttacctactccctgactttg

SEQ ID NO: 178379 - DNA, 20 bp, Artificial Sequence
  Synthetic oligonucleotide; CAG chr2 60502283 60502302 60502286 -
tactccctgactttggagct

SEQ ID NO: 178380 - DNA, 20 bp, Artificial Sequence
  Synthetic oligonucleotide; CAG chr2 60502251 60502270 60502254 -
tatccatcattttgtttcac

SEQ ID NO: 178381 - DNA, 20 bp, Artificial Sequence
  Synthetic oligonucleotide; AAG chr2 60502240 60502259 60502243 -
ttgtttcaccagcttttaca

SEQ ID NO: 178382 - DNA, 20 bp, Artificial Sequence
  Synthetic oligonucleotide; CAG chr2 60502237 60502256 60502240 -
tttcaccagcttttacaaag

SEQ ID NO: 178383 - DNA, 20 bp, Artificial Sequence
  Synthetic oligonucleotide; AGG chr2 60502236 60502255 60502239 -
ttcaccagcttttacaaagc

SEQ ID NO: 178384 - DNA, 20 bp, Artificial Sequence
  Synthetic oligonucleotide; AAG chr2 60502221 60502240 60502224 -
aaagcaggatcataaactgt

SEQ ID NO: 178385 - DNA, 20 bp, Artificial Sequence
  Synthetic oligonucleotide; TGG chr2 60502212 60502231 60502215 -
tcataaactgtaagctcatt

SEQ ID NO: 178386 - DNA, 20 bp, Artificial Sequence
  Synthetic oligonucleotide; GAG chr2 60502210 60502229 60502213 -
ataaactgtaagctcatttg

SEQ ID NO: 178387 - DNA, 20 bp, Artificial Sequence
  Synthetic oligonucleotide; AGG chr2 60502209 60502228 60502212 -
taaactgtaagctcatttgg

SEQ ID NO: 178388 - DNA, 20 bp, Artificial Sequence
  Synthetic oligonucleotide; GGG chr2 60502208 60502227 60502211 -
aaactgtaagctcatttgga

SEQ ID NO: 178389 - DNA, 20 bp, Artificial Sequence
  Synthetic oligonucleotide; AAG chr2 60502179 60502198 60502182 -
tctctgattgttgctttgat

SEQ ID NO: 178390 - DNA, 20 bp, Artificial Sequence
  Synthetic oligonucleotide; TAG chr2 60502147 60502166 60502150 -
aaatattcatatcattctga

SEQ ID NO: 178391 - DNA, 20 bp, Artificial Sequence
  Synthetic oligonucleotide; GAG chr2 60502140 60502159 60502143 -
catatcattctgatagtctt

SEQ ID NO: 178392 - DNA, 20 bp, Artificial Sequence
  Synthetic oligonucleotide; CAG chr2 60502110 60502129 60502113 -
gttacaacatgcaaacctct

SEQ ID NO: 178393 - DNA, 20 bp, Artificial Sequence
  Synthetic oligonucleotide; CAG chr2 60502102 60502121 60502105 -
atgcaaacctctcagttttc

SEQ ID NO: 178394 - DNA, 20 bp, Artificial Sequence
  Synthetic oligonucleotide; AGG chr2 60502101 60502120 60502104 -
tgcaaacctctcagttttcc

SEQ ID NO: 178395 - DNA, 20 bp, Artificial Sequence
  Synthetic oligonucleotide; TGG chr2 60502093 60502112 60502096 -
tctcagttttccaggacttc

SEQ ID NO: 178396 - DNA, 20 bp, Artificial Sequence
  Synthetic oligonucleotide; TGG chr2 60502090 60502109 60502093 -
cagttttccaggacttctgg

SEQ ID NO: 178397 - DNA, 20 bp, Artificial Sequence
  Synthetic oligonucleotide; CAG chr2 60502085 60502104 60502088 -
ttccaggacttctggtggta

SEQ ID NO: 178398 - DNA, 20 bp, Artificial Sequence
  Synthetic oligonucleotide; TGG chr2 60502074 60502093 60502077 -
ctggtggtacagcttctctg

SEQ ID NO: 178399 - DNA, 20 bp, Artificial Sequence
  Synthetic oligonucleotide; GAG chr2 60502072 60502091 60502075 -
ggtggtacagcttctctgtg

SEQ ID NO: 178400 - DNA, 20 bp, Artificial Sequence
  Synthetic oligonucleotide; GAG chr2 60502068 60502087 60502071 -
gtacagcttctctgtggagt

SEQ ID NO: 178401 - DNA, 20 bp, Artificial Sequence
  Synthetic oligonucleotide; AGG chr2 60502067 60502086 60502070 -
tacagcttctctgtggagtg

SEQ ID NO: 178402 - DNA, 20 bp, Artificial Sequence
  Synthetic oligonucleotide; TGG chr2 60502056 60502075 60502059 -
tgtggagtgaggcatatttt

SEQ ID NO: 178403 - DNA, 20 bp, Artificial Sequence
  Synthetic oligonucleotide; TGG chr2 60502051 60502070 60502054 -
agtgaggcatatttttggtc

SEQ ID NO: 178404 - DNA, 20 bp, Artificial Sequence
  Synthetic oligonucleotide; AAG chr2 60502035 60502054 60502038 -
ggtctggcctttcctccctg

SEQ ID NO: 178405 - DNA, 20 bp, Artificial Sequence
  Synthetic oligonucleotide; TAG chr2 60502026 60502045 60502029 -
tttcctccctgaagctctgt

SEQ ID NO: 178406 - DNA, 20 bp, Artificial Sequence
  Synthetic oligonucleotide; GAG chr2 60502020 60502039 60502023 -
ccctgaagctctgttagcct

SEQ ID NO: 178407 - DNA, 20 bp, Artificial Sequence
  Synthetic oligonucleotide; TAG chr2 60502009 60502028 60502012 -
tgttagcctgagatttcacc

SEQ ID NO: 178408 - DNA, 20 bp, Artificial Sequence
  Synthetic oligonucleotide; AAG chr2 60501998 60502017 60502001 -
gatttcacctagtgcaacac

SEQ ID NO: 178409 - DNA, 20 bp, Artificial Sequence
  Synthetic oligonucleotide; TAG chr2 60501990 60502009 60501993 -
ctagtgcaacacaagttgtg

SEQ ID NO: 178410 - DNA, 20 bp, Artificial Sequence
  Synthetic oligonucleotide; AAG chr2 60501986 60502005 60501989 -
tgcaacacaagttgtgtaga

SEQ ID NO: 178411 - DNA, 20 bp, Artificial Sequence
  Synthetic oligonucleotide; TAG chr2 60501952 60501971 60501955 -
tactttattccataattcac

SEQ ID NO: 178412 - DNA, 20 bp, Artificial Sequence
  Synthetic oligonucleotide; TAG chr2 60501940 60501959 60501943 -
taattcactagtaaaataat

SEQ ID NO: 178413 - DNA, 20 bp, Artificial Sequence
  Synthetic oligonucleotide; AAG chr2 60501932 60501951 60501935 -
tagtaaaataattagaataa

SEQ ID NO: 178414 - DNA, 20 bp, Artificial Sequence
  Synthetic oligonucleotide; AGG chr2 60501931 60501950 60501934 -
agtaaaataattagaataaa

SEQ ID NO: 178415 - DNA, 20 bp, Artificial Sequence
  Synthetic oligonucleotide; TGG chr2 60501922 60501941 60501925 -
attagaataaaaggctgttt

SEQ ID NO: 178416 - DNA, 20 bp, Artificial Sequence
  Synthetic oligonucleotide; TAG chr2 60501915 60501934 60501918 -
taaaaggctgttttggaatg

SEQ ID NO: 178417 - DNA, 20 bp, Artificial Sequence
  Synthetic oligonucleotide; GAG chr2 60501913 60501932 60501916 -
aaaggctgttttggaatgta

SEQ ID NO: 178418 - DNA, 20 bp, Artificial Sequence
  Synthetic oligonucleotide; GAG chr2 60501911 60501930 60501914 -
aggctgttttggaatgtaga

SEQ ID NO: 178419 - DNA, 20 bp, Artificial Sequence
  Synthetic oligonucleotide; AGG chr2 60501910 60501929 60501913 -
ggctgttttggaatgtagag

SEQ ID NO: 178420 - DNA, 20 bp, Artificial Sequence
  Synthetic oligonucleotide; CAG chr2 60501907 60501926 60501910 -
tgttttggaatgtagagagg

SEQ ID NO: 178421 - DNA, 20 bp, Artificial Sequence
  Synthetic oligonucleotide; GAG chr2 60501905 60501924 60501908 -
ttttggaatgtagagaggca

SEQ ID NO: 178422 - DNA, 20 bp, Artificial Sequence
  Synthetic oligonucleotide; AGG chr2 60501904 60501923 60501907 -
tttggaatgtagagaggcag

SEQ ID NO: 178423 - DNA, 20 bp, Artificial Sequence
  Synthetic oligonucleotide; GGG chr2 60501903 60501922 60501906 -
ttggaatgtagagaggcaga

SEQ ID NO: 178424 - DNA, 20 bp, Artificial Sequence
  Synthetic oligonucleotide; GGG chr2 60501902 60501921 60501905 -
tggaatgtagagaggcagag

SEQ ID NO: 178425 - DNA, 20 bp, Artificial Sequence
  Synthetic oligonucleotide; CAG chr2 60501885 60501904 60501888 -
gaggggctgatataacttct

SEQ ID NO: 178426 - DNA, 20 bp, Artificial Sequence
  Synthetic oligonucleotide; GAG chr2 60501844 60501863 60501847 -
cccgtcttaaatttttatgt

SEQ ID NO: 178427 - DNA, 20 bp, Artificial Sequence
  Synthetic oligonucleotide; GAG chr2 60501839 60501858 60501842 -
cttaaatttttatgtgagat

SEQ ID NO: 178428 - DNA, 20 bp, Artificial Sequence
  Synthetic oligonucleotide; AAG chr2 60501821 60501840 60501824 -
atgagcacactgctgtaatt

SEQ ID NO: 178429 - DNA, 20 bp, Artificial Sequence
  Synthetic oligonucleotide; AAG chr2 60501817 60501836 60501820 -
gcacactgctgtaattaaga

SEQ ID NO: 178430 - DNA, 20 bp, Artificial Sequence
  Synthetic oligonucleotide; CAG chr2 60501814 60501833 60501817 -
cactgctgtaattaagaaag

SEQ ID NO: 178431 - DNA, 20 bp, Artificial Sequence
  Synthetic oligonucleotide; AAG chr2 60501808 60501827 60501811 -
tgtaattaagaaagcagtgt

SEQ ID NO: 178432 - DNA, 20 bp, Artificial Sequence
  Synthetic oligonucleotide; AGG chr2 60501807 60501826 60501810 -
gtaattaagaaagcagtgta

SEQ ID NO: 178433 - DNA, 20 bp, Artificial Sequence
  Synthetic oligonucleotide; TGG chr2 60501803 60501822 60501806 -
ttaagaaagcagtgtaaggc

SEQ ID NO: 178434 - DNA, 20 bp, Artificial Sequence
  Synthetic oligonucleotide; GGG chr2 60501802 60501821 60501805 -
taagaaagcagtgtaaggct

SEQ ID NO: 178435 - DNA, 20 bp, Artificial Sequence
  Synthetic oligonucleotide; CAG chr2 60501797 60501816 60501800 -
aagcagtgtaaggctgggcg

SEQ ID NO: 178436 - DNA, 20 bp, Artificial Sequence
  Synthetic oligonucleotide; TGG chr2 60501794 60501813 60501797 -
cagtgtaaggctgggcgcag

SEQ ID NO: 178437 - DNA, 20 bp, Artificial Sequence
  Synthetic oligonucleotide; CAG chr2 60501775 60501794 60501778 -
gtggctcacgtctgtaattc

SEQ ID NO: 178438 - DNA, 20 bp, Artificial Sequence
  Synthetic oligonucleotide; TGG chr2 60501767 60501786 60501770 -
cgtctgtaattccagcactt

SEQ ID NO: 178439 - DNA, 20 bp, Artificial Sequence
  Synthetic oligonucleotide; GGG chr2 60501766 60501785 60501769 -
gtctgtaattccagcacttt

SEQ ID NO: 178440 - DNA, 20 bp, Artificial Sequence
  Synthetic oligonucleotide; GAG chr2 60501764 60501783 60501767 -
ctgtaattccagcactttgg

SEQ ID NO: 178441 - DNA, 20 bp, Artificial Sequence
  Synthetic oligonucleotide; AGG chr2 60501763 60501782 60501766 -
tgtaattccagcactttggg

SEQ ID NO: 178442 - DNA, 20 bp, Artificial Sequence
  Synthetic oligonucleotide; GAG chr2 60501758 60501777 60501761 -
ttccagcactttgggaggcc

SEQ ID NO: 178443 - DNA, 20 bp, Artificial Sequence
  Synthetic oligonucleotide; AGG chr2 60501757 60501776 60501760 -
tccagcactttgggaggccg

SEQ ID NO: 178444 - DNA, 20 bp, Artificial Sequence
  Synthetic oligonucleotide; TGG chr2 60501754 60501773 60501757 -
agcactttgggaggccgagg

SEQ ID NO: 178445 - DNA, 20 bp, Artificial Sequence
  Synthetic oligonucleotide; GGG chr2 60501753 60501772 60501756 -
gcactttgggaggccgaggt

SEQ ID NO: 178446 - DNA, 20 bp, Artificial Sequence
  Synthetic oligonucleotide; TAG chr2 60501750 60501769 60501753 -
ctttgggaggccgaggtggg

SEQ ID NO: 178447 - DNA, 20 bp, Artificial Sequence
  Synthetic oligonucleotide; GAG chr2 60501740 60501759 60501743 -
ccgaggtgggtagatcacct

SEQ ID NO: 178448 - DNA, 20 bp, Artificial Sequence
  Synthetic oligonucleotide; AGG chr2 60501739 60501758 60501742 -
cgaggtgggtagatcacctg

SEQ ID NO: 178449 - DNA, 20 bp, Artificial Sequence
  Synthetic oligonucleotide; AAG chr2 60501734 60501753 60501737 -
tgggtagatcacctgaggtc

SEQ ID NO: 178450 - DNA, 20 bp, Artificial Sequence
  Synthetic oligonucleotide; GAG chr2 60501732 60501751 60501735 -
ggtagatcacctgaggtcaa

SEQ ID NO: 178451 - DNA, 20 bp, Artificial Sequence
  Synthetic oligonucleotide; GAG chr2 60501726 60501745 60501729 -
tcacctgaggtcaagagttt

SEQ ID NO: 178452 - DNA, 20 bp, Artificial Sequence
  Synthetic oligonucleotide; CAG chr2 60501721 60501740 60501724 -
tgaggtcaagagtttgagac

SEQ ID NO: 178453 - DNA, 20 bp, Artificial Sequence
  Synthetic oligonucleotide; TGG chr2 60501707 60501726 60501710 -
tgagaccagcctgaccaaca

SEQ ID NO: 178454 - DNA, 20 bp, Artificial Sequence
  Synthetic oligonucleotide; GAG chr2 60501705 60501724 60501708 -
agaccagcctgaccaacatg

SEQ ID NO: 178455 - DNA, 20 bp, Artificial Sequence
  Synthetic oligonucleotide; TAG chr2 60501673 60501692 60501676 -
ctctattaaaaatataaact

SEQ ID NO: 178456 - DNA, 20 bp, Artificial Sequence
  Synthetic oligonucleotide; CAG chr2 60501669 60501688 60501672 -
attaaaaatataaacttagc

SEQ ID NO: 178457 - DNA, 20 bp, Artificial Sequence
  Synthetic oligonucleotide; AGG chr2 60501668 60501687 60501671 -
ttaaaaatataaacttagcc

SEQ ID NO: 178458 - DNA, 20 bp, Artificial Sequence
  Synthetic oligonucleotide; TGG chr2 60501663 60501682 60501666 -
aatataaacttagccaggca

SEQ ID NO: 178459 - DNA, 20 bp, Artificial Sequence
  Synthetic oligonucleotide; CAG chr2 60501641 60501660 60501644 -
gtcgcacatgcctgtaatcc

SEQ ID NO: 178460 - DNA, 20 bp, Artificial Sequence
  Synthetic oligonucleotide; CAG chr2 60501633 60501652 60501636 -
tgcctgtaatcccagctact

SEQ ID NO: 178461 - DNA, 20 bp, Artificial Sequence
  Synthetic oligonucleotide; AGG chr2 60501632 60501651 60501635 -
gcctgtaatcccagctactc

SEQ ID NO: 178462 - DNA, 20 bp, Artificial Sequence
  Synthetic oligonucleotide; GAG chr2 60501630 60501649 60501633 -
ctgtaatcccagctactcag

SEQ ID NO: 178463 - DNA, 20 bp, Artificial Sequence
  Synthetic oligonucleotide; AGG chr2 60501629 60501648 60501632 -
tgtaatcccagctactcagg

SEQ ID NO: 178464 - DNA, 20 bp, Artificial Sequence
  Synthetic oligonucleotide; GAG chr2 60501624 60501643 60501627 -
tcccagctactcaggaggct

SEQ ID NO: 178465 - DNA, 20 bp, Artificial Sequence
  Synthetic oligonucleotide; AGG chr2 60501623 60501642 60501626 -
cccagctactcaggaggctg

SEQ ID NO: 178466 - DNA, 20 bp, Artificial Sequence
  Synthetic oligonucleotide; GGG chr2 60501622 60501641 60501625 -
ccagctactcaggaggctga

SEQ ID NO: 178467 - DNA, 20 bp, Artificial Sequence
  Synthetic oligonucleotide; GAG chr2 60501620 60501639 60501623 -
agctactcaggaggctgagg

SEQ ID NO: 178468 - DNA, 20 bp, Artificial Sequence
  Synthetic oligonucleotide; AGG chr2 60501619 60501638 60501622 -
gctactcaggaggctgaggg

SEQ ID NO: 178469 - DNA, 20 bp, Artificial Sequence
  Synthetic oligonucleotide; GAG chr2 60501617 60501636 60501620 -
tactcaggaggctgagggag

SEQ ID NO: 178470 - DNA, 20 bp, Artificial Sequence
  Synthetic oligonucleotide; CAG chr2 60501601 60501620 60501604 -
ggaggagaattgcttgaacc

SEQ ID NO: 178471 - DNA, 20 bp, Artificial Sequence
  Synthetic oligonucleotide; AGG chr2 60501600 60501619 60501603 -
gaggagaattgcttgaaccc

SEQ ID NO: 178472 - DNA, 20 bp, Artificial Sequence
  Synthetic oligonucleotide; GAG chr2 60501598 60501617 60501601 -
ggagaattgcttgaacccag

SEQ ID NO: 178473 - DNA, 20 bp, Artificial Sequence
  Synthetic oligonucleotide; AGG chr2 60501597 60501616 60501600 -
gagaattgcttgaacccagg

SEQ ID NO: 178474 - DNA, 20 bp, Artificial Sequence
  Synthetic oligonucleotide; CAG chr2 60501594 60501613 60501597 -
aattgcttgaacccaggagg

SEQ ID NO: 178475 - DNA, 20 bp, Artificial Sequence
  Synthetic oligonucleotide; GAG chr2 60501592 60501611 60501595 -
ttgcttgaacccaggaggca

SEQ ID NO: 178476 - DNA, 20 bp, Artificial Sequence
  Synthetic oligonucleotide; AGG chr2 60501591 60501610 60501594 -
tgcttgaacccaggaggcag

SEQ ID NO: 178477 - DNA, 20 bp, Artificial Sequence
  Synthetic oligonucleotide; TGG chr2 60501588 60501607 60501591 -
ttgaacccaggaggcagagg

SEQ ID NO: 178478 - DNA, 20 bp, Artificial Sequence
  Synthetic oligonucleotide; GAG chr2 60501584 60501603 60501587 -
acccaggaggcagaggtggt

SEQ ID NO: 178479 - DNA, 20 bp, Artificial Sequence
  Synthetic oligonucleotide; GAG chr2 60501579 60501598 60501582 -
ggaggcagaggtggtgagcc

SEQ ID NO: 178480 - DNA, 20 bp, Artificial Sequence
  Synthetic oligonucleotide; CAG chr2 60501559 60501578 60501562 -
gagatcacaccattgcaccc

SEQ ID NO: 178481 - DNA, 20 bp, Artificial Sequence
  Synthetic oligonucleotide; TGG chr2 60501554 60501573 60501557 -
cacaccattgcaccccagcc

SEQ ID NO: 178482 - DNA, 20 bp, Artificial Sequence
  Synthetic oligonucleotide; GGG chr2 60501553 60501572 60501556 -
acaccattgcaccccagcct

SEQ ID NO: 178483 - DNA, 20 bp, Artificial Sequence
  Synthetic oligonucleotide; AAG chr2 60501546 60501565 60501549 -
tgcaccccagcctgggcaac

SEQ ID NO: 178484 - DNA, 20 bp, Artificial Sequence
  Synthetic oligonucleotide; GAG chr2 60501544 60501563 60501547 -
caccccagcctgggcaacaa

SEQ ID NO: 178485 - DNA, 20 bp, Artificial Sequence
  Synthetic oligonucleotide; AAG chr2 60501508 60501527 60501511 -
caaaaaaaaaaaaaaaaaaa

SEQ ID NO: 178486 - DNA, 20 bp, Artificial Sequence
  Synthetic oligonucleotide; AAG chr2 60501504 60501523 60501507 -
aaaaaaaaaaaaaaaaaaga

SEQ ID NO: 178487 - DNA, 20 bp, Artificial Sequence
  Synthetic oligonucleotide; CGG chr2 60501501 60501520 60501504 -
aaaaaaaaaaaaaaagaaag

SEQ ID NO: 178488 - DNA, 20 bp, Artificial Sequence
  Synthetic oligonucleotide; CAG chr2 60501495 60501514 60501498 -
aaaaaaaaagaaagcggtgt

SEQ ID NO: 178489 - DNA, 20 bp, Artificial Sequence
  Synthetic oligonucleotide; AAG chr2 60501483 60501502 60501486 -
agcggtgtcagtacttgcaa

SEQ ID NO: 178490 - DNA, 20 bp, Artificial Sequence
  Synthetic oligonucleotide; AGG chr2 60501482 60501501 60501485 -
gcggtgtcagtacttgcaaa

SEQ ID NO: 178491 - DNA, 20 bp, Artificial Sequence
  Synthetic oligonucleotide; CAG chr2 60501461 60501480 60501464 -
ggcctttccctcttgccact

SEQ ID NO: 178492 - DNA, 20 bp, Artificial Sequence
  Synthetic oligonucleotide; AGG chr2 60501460 60501479 60501463 -
gcctttccctcttgccactc

SEQ ID NO: 178493 - DNA, 20 bp, Artificial Sequence
  Synthetic oligonucleotide; GGG chr2 60501459 60501478 60501462 -
cctttccctcttgccactca

SEQ ID NO: 178494 - DNA, 20 bp, Artificial Sequence
  Synthetic oligonucleotide; AAG chr2 60501456 60501475 60501459 -
ttccctcttgccactcaggg

SEQ ID NO: 178495 - DNA, 20 bp, Artificial Sequence
  Synthetic oligonucleotide; AAG chr2 60501446 60501465 60501449 -
ccactcagggaagcacccga

SEQ ID NO: 178496 - DNA, 20 bp, Artificial Sequence
  Synthetic oligonucleotide; GAG chr2 60501444 60501463 60501447 -
actcagggaagcacccgaaa

SEQ ID NO: 178497 - DNA, 20 bp, Artificial Sequence
  Synthetic oligonucleotide; CAG chr2 60501430 60501449 60501433 -
ccgaaagagaacttacaaac

SEQ ID NO: 178498 - DNA, 20 bp, Artificial Sequence
  Synthetic oligonucleotide; AGG chr2 60501429 60501448 60501432 -
cgaaagagaacttacaaacc

SEQ ID NO: 178499 - DNA, 20 bp, Artificial Sequence
  Synthetic oligonucleotide; AAG chr2 60501424 60501443 60501427 -
gagaacttacaaaccaggta

SEQ ID NO: 178500 - DNA, 20 bp, Artificial Sequence
  Synthetic oligonucleotide; TGG chr2 60501417 60501436 60501420 -
tacaaaccaggtaaagtatt

SEQ ID NO: 178501 - DNA, 20 bp, Artificial Sequence
  Synthetic oligonucleotide; AAG chr2 60501414 60501433 60501417 -
aaaccaggtaaagtatttgg

SEQ ID NO: 178502 - DNA, 20 bp, Artificial Sequence
  Synthetic oligonucleotide; AAG chr2 60501395 60501414 60501398 -
gaagtgattaatcatattac

SEQ ID NO: 178503 - DNA, 20 bp, Artificial Sequence
  Synthetic oligonucleotide; GAG chr2 60501393 60501412 60501396 -
agtgattaatcatattacaa

SEQ ID NO: 178504 - DNA, 20 bp, Artificial Sequence
  Synthetic oligonucleotide; AAG chr2 60501372 60501391 60501375 -
agtgttcttcatttccccca

SEQ ID NO: 178505 - DNA, 20 bp, Artificial Sequence
  Synthetic oligonucleotide; AGG chr2 60501371 60501390 60501374 -
gtgttcttcatttcccccaa

SEQ ID NO: 178506 - DNA, 20 bp, Artificial Sequence
  Synthetic oligonucleotide; TGG chr2 60501364 60501383 60501367 -
tcatttcccccaaaggacca

SEQ ID NO: 178507 - DNA, 20 bp, Artificial Sequence
  Synthetic oligonucleotide; TAG chr2 60501333 60501352 60501336 -
gacacttacctgtgctctta

SEQ ID NO: 178508 - DNA, 20 bp, Artificial Sequence
  Synthetic oligonucleotide; AAG chr2 60501324 60501343 60501327 -
ctgtgctcttatagatatta

SEQ ID NO: 178509 - DNA, 20 bp, Artificial Sequence
  Synthetic oligonucleotide; CAG chr2 60501320 60501339 60501323 -
gctcttatagatattaaaga

SEQ ID NO: 178510 - DNA, 20 bp, Artificial Sequence
  Synthetic oligonucleotide; GAG chr2 60501318 60501337 60501321 -
tcttatagatattaaagaca

SEQ ID NO: 178511 - DNA, 20 bp, Artificial Sequence
  Synthetic oligonucleotide; TGG chr2 60501311 60501330 60501314 -
gatattaaagacagagccac

SEQ ID NO: 178512 - DNA, 20 bp, Artificial Sequence
  Synthetic oligonucleotide; GAG chr2 60501303 60501322 60501306 -
agacagagccactggactgt

SEQ ID NO: 178513 - DNA, 20 bp, Artificial Sequence
  Synthetic oligonucleotide; GAG chr2 60501294 60501313 60501297 -
cactggactgtgagctcctt

SEQ ID NO: 178514 - DNA, 20 bp, Artificial Sequence
  Synthetic oligonucleotide; AGG chr2 60501293 60501312 60501296 -
actggactgtgagctccttg

SEQ ID NO: 178515 - DNA, 20 bp, Artificial Sequence
  Synthetic oligonucleotide; GGG chr2 60501292 60501311 60501295 -
ctggactgtgagctccttga

SEQ ID NO: 178516 - DNA, 20 bp, Artificial Sequence
  Synthetic oligonucleotide; CAG chr2 60501289 60501308 60501292 -
gactgtgagctccttgaggg

SEQ ID NO: 178517 - DNA, 20 bp, Artificial Sequence
  Synthetic oligonucleotide; AGG chr2 60501288 60501307 60501291 -
actgtgagctccttgagggc

SEQ ID NO: 178518 - DNA, 20 bp, Artificial Sequence
  Synthetic oligonucleotide; GGG chr2 60501287 60501306 60501290 -
ctgtgagctccttgagggca

SEQ ID NO: 178519 - DNA, 20 bp, Artificial Sequence
  Synthetic oligonucleotide; GAG chr2 60501281 60501300 60501284 -
gctccttgagggcagggaat

SEQ ID NO: 178520 - DNA, 20 bp, Artificial Sequence
  Synthetic oligonucleotide; AGG chr2 60501280 60501299 60501283 -
ctccttgagggcagggaatg

SEQ ID NO: 178521 - DNA, 20 bp, Artificial Sequence
  Synthetic oligonucleotide; TGG chr2 60501260 60501279 60501263 -
aggctcattccattttgttc

SEQ ID NO: 178522 - DNA, 20 bp, Artificial Sequence
  Synthetic oligonucleotide; AAG chr2 60501256 60501275 60501259 -
tcattccattttgttctggc

SEQ ID NO: 178523 - DNA, 20 bp, Artificial Sequence
  Synthetic oligonucleotide; TAG chr2 60501253 60501272 60501256 -
ttccattttgttctggcaag

SEQ ID NO: 178524 - DNA, 20 bp, Artificial Sequence
  Synthetic oligonucleotide; CAG chr2 60501245 60501264 60501248 -
tgttctggcaagtagcacta

SEQ ID NO: 178525 - DNA, 20 bp, Artificial Sequence
  Synthetic oligonucleotide; AGG chr2 60501244 60501263 60501247 -
gttctggcaagtagcactac

SEQ ID NO: 178526 - DNA, 20 bp, Artificial Sequence
  Synthetic oligonucleotide; TGG chr2 60501239 60501258 60501242 -
ggcaagtagcactacaggtt

SEQ ID NO: 178527 - DNA, 20 bp, Artificial Sequence
  Synthetic oligonucleotide; TGG chr2 60501220 60501239 60501223 -
ttggaccaaatgaattaaat

SEQ ID NO: 178528 - DNA, 20 bp, Artificial Sequence
  Synthetic oligonucleotide; AAG chr2 60501203 60501222 60501206 -
aattggctgccattgaatca

SEQ ID NO: 178529 - DNA, 20 bp, Artificial Sequence
  Synthetic oligonucleotide; CAG chr2 60501200 60501219 60501203 -
tggctgccattgaatcaaag

SEQ ID NO: 178530 - DNA, 20 bp, Artificial Sequence
  Synthetic oligonucleotide; AAG chr2 60501193 60501212 60501196 -
cattgaatcaaagcagaatg

SEQ ID NO: 178531 - DNA, 20 bp, Artificial Sequence
  Synthetic oligonucleotide; AGG chr2 60501192 60501211 60501195 -
attgaatcaaagcagaatga

SEQ ID NO: 178532 - DNA, 20 bp, Artificial Sequence
  Synthetic oligonucleotide; TAG chr2 60501189 60501208 60501192 -
gaatcaaagcagaatgaagg

SEQ ID NO: 178533 - DNA, 20 bp, Artificial Sequence
  Synthetic oligonucleotide; AAG chr2 60501162 60501181 60501165 -
tctgaaacaataatataaat

SEQ ID NO: 178534 - DNA, 20 bp, Artificial Sequence
  Synthetic oligonucleotide; TGG chr2 60501151 60501170 60501154 -
aatataaataagtgcaaaat

SEQ ID NO: 178535 - DNA, 20 bp, Artificial Sequence
  Synthetic oligonucleotide; CAG chr2 60501129 60501148 60501132 -
gatgtttaccaacaactttc

SEQ ID NO: 178536 - DNA, 20 bp, Artificial Sequence
  Synthetic oligonucleotide; CAG chr2 60501123 60501142 60501126 -
taccaacaactttccagaaa

SEQ ID NO: 178537 - DNA, 20 bp, Artificial Sequence
  Synthetic oligonucleotide; AGG chr2 60501122 60501141 60501125 -
accaacaactttccagaaac

SEQ ID NO: 178538 - DNA, 20 bp, Artificial Sequence
  Synthetic oligonucleotide; CAG chr2 60501111 60501130 60501114 -
tccagaaacaggtcttgttt

SEQ ID NO: 178539 - DNA, 20 bp, Artificial Sequence
  Synthetic oligonucleotide; AAG chr2 60501108 60501127 60501111 -
agaaacaggtcttgtttcag

SEQ ID NO: 178540 - DNA, 20 bp, Artificial Sequence
  Synthetic oligonucleotide; AAG chr2 60501097 60501116 60501100 -
ttgtttcagaagatgtgcca

SEQ ID NO: 178541 - DNA, 20 bp, Artificial Sequence
  Synthetic oligonucleotide; TGG chr2 60501084 60501103 60501087 -
tgtgccaaagatgtctcatg

SEQ ID NO: 178542 - DNA, 20 bp, Artificial Sequence
  Synthetic oligonucleotide; GGG chr2 60501083 60501102 60501086 -
gtgccaaagatgtctcatgt

SEQ ID NO: 178543 - DNA, 20 bp, Artificial Sequence
  Synthetic oligonucleotide; CAG chr2 60501080 60501099 60501083 -
ccaaagatgtctcatgtggg

SEQ ID NO: 178544 - DNA, 20 bp, Artificial Sequence
  Synthetic oligonucleotide; AGG chr2 60501079 60501098 60501082 -
caaagatgtctcatgtgggc

SEQ ID NO: 178545 - DNA, 20 bp, Artificial Sequence
  Synthetic oligonucleotide; GGG chr2 60501078 60501097 60501081 -
aaagatgtctcatgtgggca

SEQ ID NO: 178546 - DNA, 20 bp, Artificial Sequence
  Synthetic oligonucleotide; TGG chr2 60501069 60501088 60501072 -
tcatgtgggcagggctcctg

SEQ ID NO: 178547 - DNA, 20 bp, Artificial Sequence
  Synthetic oligonucleotide; GAG chr2 60501067 60501086 60501070 -
atgtgggcagggctcctgtg

SEQ ID NO: 178548 - DNA, 20 bp, Artificial Sequence
  Synthetic oligonucleotide; GAG chr2 60501052 60501071 60501055 -
ctgtggagacctctgttgct

SEQ ID NO: 178549 - DNA, 20 bp, Artificial Sequence
  Synthetic oligonucleotide; GAG chr2 60501048 60501067 60501051 -
ggagacctctgttgctgagt

SEQ ID NO: 178550 - DNA, 20 bp, Artificial Sequence
  Synthetic oligonucleotide; GAG chr2 60501037 60501056 60501040 -
ttgctgagtgagtcaaccat

SEQ ID NO: 178551 - DNA, 20 bp, Artificial Sequence
  Synthetic oligonucleotide; AGG chr2 60501036 60501055 60501039 -
tgctgagtgagtcaaccatg

SEQ ID NO: 178552 - DNA, 20 bp, Artificial Sequence
  Synthetic oligonucleotide; CGG chr2 60501032 60501051 60501035 -
gagtgagtcaaccatgaggt

SEQ ID NO: 178553 - DNA, 20 bp, Artificial Sequence
  Synthetic oligonucleotide; GAG chr2 60501027 60501046 60501030 -
agtcaaccatgaggtcggct

SEQ ID NO: 178554 - DNA, 20 bp, Artificial Sequence
  Synthetic oligonucleotide; CAG chr2 60501024 60501043 60501027 -
caaccatgaggtcggctgag

SEQ ID NO: 178555 - DNA, 20 bp, Artificial Sequence
  Synthetic oligonucleotide; CAG chr2 60501019 60501038 60501022 -
atgaggtcggctgagcagtt

SEQ ID NO: 178556 - DNA, 20 bp, Artificial Sequence
  Synthetic oligonucleotide; AGG chr2 60501018 60501037 60501021 -
tgaggtcggctgagcagttc

SEQ ID NO: 178557 - DNA, 20 bp, Artificial Sequence
  Synthetic oligonucleotide; GGG chr2 60501017 60501036 60501020 -
gaggtcggctgagcagttca

SEQ ID NO: 178558 - DNA, 20 bp, Artificial Sequence
  Synthetic oligonucleotide; CAG chr2 60501001 60501020 60501004 -
ttcagggttctcccatttta

SEQ ID NO: 178559 - DNA, 20 bp, Artificial Sequence
  Synthetic oligonucleotide; GAG chr2 60500999 60501018 60501002 -
cagggttctcccattttaca

SEQ ID NO: 178560 - DNA, 20 bp, Artificial Sequence
  Synthetic oligonucleotide; AGG chr2 60500998 60501017 60501001 -
agggttctcccattttacag

SEQ ID NO: 178561 - DNA, 20 bp, Artificial Sequence
  Synthetic oligonucleotide; GAG chr2 60500996 60501015 60500999 -
ggttctcccattttacagag

SEQ ID NO: 178562 - DNA, 20 bp, Artificial Sequence
  Synthetic oligonucleotide; AGG chr2 60500995 60501014 60500998 -
gttctcccattttacagagg

SEQ ID NO: 178563 - DNA, 20 bp, Artificial Sequence
  Synthetic oligonucleotide; CAG chr2 60500989 60501008 60500992 -
ccattttacagaggaggatg

SEQ ID NO: 178564 - DNA, 20 bp, Artificial Sequence
  Synthetic oligonucleotide; CAG chr2 60500981 60501000 60500984 -
cagaggaggatgcagcgacc

SEQ ID NO: 178565 - DNA, 20 bp, Artificial Sequence
  Synthetic oligonucleotide; AAG chr2 60500968 60500987 60500971 -
agcgacccagaaatgcttgc

SEQ ID NO: 178566 - DNA, 20 bp, Artificial Sequence
  Synthetic oligonucleotide; CAG chr2 60500959 60500978 60500962 -
gaaatgcttgcaagcccacc

SEQ ID NO: 178567 - DNA, 20 bp, Artificial Sequence
  Synthetic oligonucleotide; TAG chr2 60500955 60500974 60500958 -
tgcttgcaagcccacccagc

SEQ ID NO: 178568 - DNA, 20 bp, Artificial Sequence
  Synthetic oligonucleotide; AGG chr2 60500954 60500973 60500957 -
gcttgcaagcccacccagct

SEQ ID NO: 178569 - DNA, 20 bp, Artificial Sequence
  Synthetic oligonucleotide; CAG chr2 60500942 60500961 60500945 -
acccagctaggcttgcttca

SEQ ID NO: 178570 - DNA, 20 bp, Artificial Sequence
  Synthetic oligonucleotide; TAG chr2 60500926 60500945 60500929 -
ttcacagacactcttttaac

SEQ ID NO: 178571 - DNA, 20 bp, Artificial Sequence
  Synthetic oligonucleotide; CAG chr2 60500917 60500936 60500920 -
actcttttaactagttccat

SEQ ID NO: 178572 - DNA, 20 bp, Artificial Sequence
  Synthetic oligonucleotide; CAG chr2 60500908 60500927 60500911 -
actagttccatcagcaaccc

SEQ ID NO: 178573 - DNA, 20 bp, Artificial Sequence
  Synthetic oligonucleotide; AGG chr2 60500907 60500926 60500910 -
ctagttccatcagcaacccc

SEQ ID NO: 178574 - DNA, 20 bp, Artificial Sequence
  Synthetic oligonucleotide; TGG chr2 60500903 60500922 60500906 -
ttccatcagcaaccccaggt

SEQ ID NO: 178575 - DNA, 20 bp, Artificial Sequence
  Synthetic oligonucleotide; CAG chr2 60500872 60500891 60500875 -
tgtcatcatacacattttac

SEQ ID NO: 178576 - DNA, 20 bp, Artificial Sequence
  Synthetic oligonucleotide; AAG chr2 60500867 60500886 60500870 -
tcatacacattttaccagtg

SEQ ID NO: 178577 - DNA, 20 bp, Artificial Sequence
  Synthetic oligonucleotide; GAG chr2 60500859 60500878 60500862 -
attttaccagtgaagaaact

SEQ ID NO: 178578 - DNA, 20 bp, Artificial Sequence
  Synthetic oligonucleotide; AGG chr2 60500858 60500877 60500861 -
ttttaccagtgaagaaactg

SEQ ID NO: 178579 - DNA, 20 bp, Artificial Sequence
  Synthetic oligonucleotide; TGG chr2 60500853 60500872 60500856 -
ccagtgaagaaactgaggct

SEQ ID NO: 178580 - DNA, 20 bp, Artificial Sequence
  Synthetic oligonucleotide; GAG chr2 60500851 60500870 60500854 -
agtgaagaaactgaggcttg

SEQ ID NO: 178581 - DNA, 20 bp, Artificial Sequence
  Synthetic oligonucleotide; GAG chr2 60500849 60500868 60500852 -
tgaagaaactgaggcttgga

SEQ ID NO: 178582 - DNA, 20 bp, Artificial Sequence
  Synthetic oligonucleotide; AGG chr2 60500848 60500867 60500851 -
gaagaaactgaggcttggag

SEQ ID NO: 178583 - DNA, 20 bp, Artificial Sequence
  Synthetic oligonucleotide; AAG chr2 60500842 60500861 60500845 -
actgaggcttggagaggtta

SEQ ID NO: 178584 - DNA, 20 bp, Artificial Sequence
  Synthetic oligonucleotide; GAG chr2 60500840 60500859 60500843 -
tgaggcttggagaggttaaa

SEQ ID NO: 178585 - DNA, 20 bp, Artificial Sequence
  Synthetic oligonucleotide; CAG chr2 60500830 60500849 60500833 -
agaggttaaagagctgctcc

SEQ ID NO: 178586 - DNA, 20 bp, Artificial Sequence
  Synthetic oligonucleotide; CAG chr2 60500822 60500841 60500825 -
aagagctgctcccagacaca

SEQ ID NO: 178587 - DNA, 20 bp, Artificial Sequence
  Synthetic oligonucleotide; CAG chr2 60500818 60500837 60500821 -
gctgctcccagacacacagc

SEQ ID NO: 178588 - DNA, 20 bp, Artificial Sequence
  Synthetic oligonucleotide; AGG chr2 60500817 60500836 60500820 -
ctgctcccagacacacagcc

SEQ ID NO: 178589 - DNA, 20 bp, Artificial Sequence
  Synthetic oligonucleotide; TGG chr2 60500810 60500829 60500813 -
cagacacacagccaggaaat

SEQ ID NO: 178590 - DNA, 20 bp, Artificial Sequence
  Synthetic oligonucleotide; TGG chr2 60500807 60500826 60500810 -
acacacagccaggaaattgg

SEQ ID NO: 178591 - DNA, 20 bp, Artificial Sequence
  Synthetic oligonucleotide; TAG chr2 60500804 60500823 60500807 -
cacagccaggaaattggtgg

SEQ ID NO: 178592 - DNA, 20 bp, Artificial Sequence
  Synthetic oligonucleotide; AAG chr2 60500798 60500817 60500801 -
caggaaattggtggtagatg

SEQ ID NO: 178593 - DNA, 20 bp, Artificial Sequence
  Synthetic oligonucleotide; AGG chr2 60500797 60500816 60500800 -
aggaaattggtggtagatga

SEQ ID NO: 178594 - DNA, 20 bp, Artificial Sequence
  Synthetic oligonucleotide; CAG chr2 60500791 60500810 60500794 -
ttggtggtagatgaaggatc

SEQ ID NO: 178595 - DNA, 20 bp, Artificial Sequence
  Synthetic oligonucleotide; TGG chr2 60500773 60500792 60500776 -
tccagctcatctgtctaact

SEQ ID NO: 178596 - DNA, 20 bp, Artificial Sequence
  Synthetic oligonucleotide; GGG chr2 60500772 60500791 60500775 -
ccagctcatctgtctaactt

SEQ ID NO: 178597 - DNA, 20 bp, Artificial Sequence
  Synthetic oligonucleotide; GAG chr2 60500770 60500789 60500773 -
agctcatctgtctaacttgg

SEQ ID NO: 178598 - DNA, 20 bp, Artificial Sequence
  Synthetic oligonucleotide; GAG chr2 60500764 60500783 60500767 -
tctgtctaacttgggagcct

SEQ ID NO: 178599 - DNA, 20 bp, Artificial Sequence
  Synthetic oligonucleotide; AAG chr2 60500740 60500759 60500743 -
gttcatcttacctatccacc

SEQ ID NO: 178600 - DNA, 20 bp, Artificial Sequence
  Synthetic oligonucleotide; AGG chr2 60500739 60500758 60500742 -
ttcatcttacctatccacca

SEQ ID NO: 178601 - DNA, 20 bp, Artificial Sequence
  Synthetic oligonucleotide; AAG chr2 60500732 60500751 60500735 -
tacctatccaccaaggcttg

SEQ ID NO: 178602 - DNA, 20 bp, Artificial Sequence
  Synthetic oligonucleotide; GAG chr2 60500728 60500747 60500731 -
tatccaccaaggcttgaagt

SEQ ID NO: 178603 - DNA, 20 bp, Artificial Sequence
  Synthetic oligonucleotide; AGG chr2 60500727 60500746 60500730 -
atccaccaaggcttgaagtg

SEQ ID NO: 178604 - DNA, 20 bp, Artificial Sequence
  Synthetic oligonucleotide; GAG chr2 60500712 60500731 60500715 -
aagtgaggtgccccgactgt

SEQ ID NO: 178605 - DNA, 20 bp, Artificial Sequence
  Synthetic oligonucleotide; CAG chr2 60500706 60500725 60500709 -
ggtgccccgactgtgagttc

SEQ ID NO: 178606 - DNA, 20 bp, Artificial Sequence
  Synthetic oligonucleotide; AGG chr2 60500705 60500724 60500708 -
gtgccccgactgtgagttcc

SEQ ID NO: 178607 - DNA, 20 bp, Artificial Sequence
  Synthetic oligonucleotide; CAG chr2 60500691 60500710 60500694 -
agttccaggtttgatgccta

SEQ ID NO: 178608 - DNA, 20 bp, Artificial Sequence
  Synthetic oligonucleotide; CAG chr2 60500683 60500702 60500686 -
gtttgatgcctacagcccat

SEQ ID NO: 178609 - DNA, 20 bp, Artificial Sequence
  Synthetic oligonucleotide; TGG chr2 60500654 60500673 60500657 -
accttgtcttataccttaac

SEQ ID NO: 178610 - DNA, 20 bp, Artificial Sequence
  Synthetic oligonucleotide; TGG chr2 60500651 60500670 60500654 -
ttgtcttataccttaactgg

SEQ ID NO: 178611 - DNA, 20 bp, Artificial Sequence
  Synthetic oligonucleotide; GAG chr2 60500649 60500668 60500652 -
gtcttataccttaactggtg

SEQ ID NO: 178612 - DNA, 20 bp, Artificial Sequence
  Synthetic oligonucleotide; AGG chr2 60500648 60500667 60500651 -
tcttataccttaactggtgg

SEQ ID NO: 178613 - DNA, 20 bp, Artificial Sequence
  Synthetic oligonucleotide; GGG chr2 60500647 60500666 60500650 -
cttataccttaactggtgga

SEQ ID NO: 178614 - DNA, 20 bp, Artificial Sequence
  Synthetic oligonucleotide; TAG chr2 60500631 60500650 60500634 -
tggagggtgctgtctctgtg

SEQ ID NO: 178615 - DNA, 20 bp, Artificial Sequence
  Synthetic oligonucleotide; CAG chr2 60500628 60500647 60500631 -
agggtgctgtctctgtgtag

SEQ ID NO: 178616 - DNA, 20 bp, Artificial Sequence
  Synthetic oligonucleotide; CAG chr2 60500621 60500640 60500624 -
tgtctctgtgtagcagccac

SEQ ID NO: 178617 - DNA, 20 bp, Artificial Sequence
  Synthetic oligonucleotide; TAG chr2 60500616 60500635 60500619 -
ctgtgtagcagccaccagcc

SEQ ID NO: 178618 - DNA, 20 bp, Artificial Sequence
  Synthetic oligonucleotide; GAG chr2 60500597 60500616 60500600 -
ctagctctgaaccctgtcct

SEQ ID NO: 178619 - DNA, 20 bp, Artificial Sequence
  Synthetic oligonucleotide; AGG chr2 60500596 60500615 60500599 -
tagctctgaaccctgtcctg

SEQ ID NO: 178620 - DNA, 20 bp, Artificial Sequence
  Synthetic oligonucleotide; GAG chr2 60500594 60500613 60500597 -
gctctgaaccctgtcctgag

SEQ ID NO: 178621 - DNA, 20 bp, Artificial Sequence
  Synthetic oligonucleotide; TGG chr2 60500590 60500609 60500593 -
tgaaccctgtcctgaggagt

SEQ ID NO: 178622 - DNA, 20 bp, Artificial Sequence
  Synthetic oligonucleotide; GGG chr2 60500589 60500608 60500592 -
gaaccctgtcctgaggagtt

SEQ ID NO: 178623 - DNA, 20 bp, Artificial Sequence
  Synthetic oligonucleotide; AAG chr2 60500586 60500605 60500589 -
ccctgtcctgaggagttggg

SEQ ID NO: 178624 - DNA, 20 bp, Artificial Sequence
  Synthetic oligonucleotide; TGG chr2 60500581 60500600 60500584 -
tcctgaggagttgggaagtg

SEQ ID NO: 178625 - DNA, 20 bp, Artificial Sequence
  Synthetic oligonucleotide; GGG chr2 60500580 60500599 60500583 -
cctgaggagttgggaagtgt

SEQ ID NO: 178626 - DNA, 20 bp, Artificial Sequence
  Synthetic oligonucleotide; GGG chr2 60500579 60500598 60500582 -
ctgaggagttgggaagtgtg

SEQ ID NO: 178627 - DNA, 20 bp, Artificial Sequence
  Synthetic oligonucleotide; TGG chr2 60500572 60500591 60500575 -
gttgggaagtgtggggtgtc

SEQ ID NO: 178628 - DNA, 20 bp, Artificial Sequence
  Synthetic oligonucleotide; TAG chr2 60500550 60500569 60500553 -
gtttattccatcaatacacg

SEQ ID NO: 178629 - DNA, 20 bp, Artificial Sequence
  Synthetic oligonucleotide; CAG chr2 60500519 60500538 60500522 -
attcttctgccattttttct

SEQ ID NO: 178630 - DNA, 20 bp, Artificial Sequence
  Synthetic oligonucleotide; AGG chr2 60500518 60500537 60500521 -
ttcttctgccattttttctc

SEQ ID NO: 178631 - DNA, 20 bp, Artificial Sequence
  Synthetic oligonucleotide; GGG chr2 60500517 60500536 60500520 -
tcttctgccattttttctca

SEQ ID NO: 178632 - DNA, 20 bp, Artificial Sequence
  Synthetic oligonucleotide; GGG chr2 60500516 60500535 60500519 -
cttctgccattttttctcag

SEQ ID NO: 178633 - DNA, 20 bp, Artificial Sequence
  Synthetic oligonucleotide; TGG chr2 60500498 60500517 60500501 -
aggggctctccttccttccc

SEQ ID NO: 178634 - DNA, 20 bp, Artificial Sequence
  Synthetic oligonucleotide; TGG chr2 60500491 60500510 60500494 -
ctccttccttccctggctct

SEQ ID NO: 178635 - DNA, 20 bp, Artificial Sequence
  Synthetic oligonucleotide; GGG chr2 60500490 60500509 60500493 -
tccttccttccctggctctt

SEQ ID NO: 178636 - DNA, 20 bp, Artificial Sequence
  Synthetic oligonucleotide; TAG chr2 60500487 60500506 60500490 -
ttccttccctggctcttggg

SEQ ID NO: 178637 - DNA, 20 bp, Artificial Sequence
  Synthetic oligonucleotide; AGG chr2 60500486 60500505 60500489 -
tccttccctggctcttgggt

SEQ ID NO: 178638 - DNA, 20 bp, Artificial Sequence
  Synthetic oligonucleotide; AAG chr2 60500467 60500486 60500470 -
taggctgcctgctctgatgt

SEQ ID NO: 178639 - DNA, 20 bp, Artificial Sequence
  Synthetic oligonucleotide; TGG chr2 60500457 60500476 60500460 -
gctctgatgtaagttcctgc

SEQ ID NO: 178640 - DNA, 20 bp, Artificial Sequence
  Synthetic oligonucleotide; GGG chr2 60500456 60500475 60500459 -
ctctgatgtaagttcctgct

SEQ ID NO: 178641 - DNA, 20 bp, Artificial Sequence
  Synthetic oligonucleotide; TGG chr2 60500443 60500462 60500446 -
tcctgctgggatgattgctc

SEQ ID NO: 178642 - DNA, 20 bp, Artificial Sequence
  Synthetic oligonucleotide; CAG chr2 60500439 60500458 60500442 -
gctgggatgattgctctggc

SEQ ID NO: 178643 - DNA, 20 bp, Artificial Sequence
  Synthetic oligonucleotide; AGG chr2 60500438 60500457 60500441 -
ctgggatgattgctctggcc

SEQ ID NO: 178644 - DNA, 20 bp, Artificial Sequence
  Synthetic oligonucleotide; CAG chr2 60500431 60500450 60500434 -
gattgctctggccaggcccc

SEQ ID NO: 178645 - DNA, 20 bp, Artificial Sequence
  Synthetic oligonucleotide; AAG chr2 60500408 60500427 60500411 -
ctgctccctgcccttctctg

SEQ ID NO: 178646 - DNA, 20 bp, Artificial Sequence
  Synthetic oligonucleotide; AGG chr2 60500407 60500426 60500410 -
tgctccctgcccttctctga

SEQ ID NO: 178647 - DNA, 20 bp, Artificial Sequence
  Synthetic oligonucleotide; CAG chr2 60500395 60500414 60500398 -
ttctctgaaggcacatctgt

SEQ ID NO: 178648 - DNA, 20 bp, Artificial Sequence
  Synthetic oligonucleotide; CAG chr2 60500388 60500407 60500391 -
aaggcacatctgtcagccca

SEQ ID NO: 178649 - DNA, 20 bp, Artificial Sequence
  Synthetic oligonucleotide; GAG chr2 60500386 60500405 60500389 -
ggcacatctgtcagcccaca

SEQ ID NO: 178650 - DNA, 20 bp, Artificial Sequence
  Synthetic oligonucleotide; AGG chr2 60500385 60500404 60500388 -
gcacatctgtcagcccacag

SEQ ID NO: 178651 - DNA, 20 bp, Artificial Sequence
  Synthetic oligonucleotide; CGG chr2 60500380 60500399 60500383 -
tctgtcagcccacagaggca

SEQ ID NO: 178652 - DNA, 20 bp, Artificial Sequence
  Synthetic oligonucleotide; TGG chr2 60500373 60500392 60500376 -
gcccacagaggcacggttaa

SEQ ID NO: 178653 - DNA, 20 bp, Artificial Sequence
  Synthetic oligonucleotide; TGG chr2 60500370 60500389 60500373 -
cacagaggcacggttaatgg

SEQ ID NO: 178654 - DNA, 20 bp, Artificial Sequence
  Synthetic oligonucleotide; CGG chr2 60500367 60500386 60500370 -
agaggcacggttaatggtgg

SEQ ID NO: 178655 - DNA, 20 bp, Artificial Sequence
  Synthetic oligonucleotide; GGG chr2 60500366 60500385 60500369 -
gaggcacggttaatggtggc

SEQ ID NO: 178656 - DNA, 20 bp, Artificial Sequence
  Synthetic oligonucleotide; GGG chr2 60500365 60500384 60500368 -
aggcacggttaatggtggcg

SEQ ID NO: 178657 - DNA, 20 bp, Artificial Sequence
  Synthetic oligonucleotide; AAG chr2 60500362 60500381 60500365 -
cacggttaatggtggcgggg

SEQ ID NO: 178658 - DNA, 20 bp, Artificial Sequence
  Synthetic oligonucleotide; CAG chr2 60500359 60500378 60500362 -
ggttaatggtggcggggaag

SEQ ID NO: 178659 - DNA, 20 bp, Artificial Sequence
  Synthetic oligonucleotide; GAG chr2 60500357 60500376 60500360 -
ttaatggtggcggggaagca

SEQ ID NO: 178660 - DNA, 20 bp, Artificial Sequence
  Synthetic oligonucleotide; AGG chr2 60500356 60500375 60500359 -
taatggtggcggggaagcag

SEQ ID NO: 178661 - DNA, 20 bp, Artificial Sequence
  Synthetic oligonucleotide; CAG chr2 60500353 60500372 60500356 -
tggtggcggggaagcagagg

SEQ ID NO: 178662 - DNA, 20 bp, Artificial Sequence
  Synthetic oligonucleotide; TGG chr2 60500343 60500362 60500346 -
gaagcagaggcagtgcataa

SEQ ID NO: 178663 - DNA, 20 bp, Artificial Sequence
  Synthetic oligonucleotide; GGG chr2 60500342 60500361 60500345 -
aagcagaggcagtgcataat

SEQ ID NO: 178664 - DNA, 20 bp, Artificial Sequence
  Synthetic oligonucleotide; GGG chr2 60500341 60500360 60500344 -
agcagaggcagtgcataatg

SEQ ID NO: 178665 - DNA, 20 bp, Artificial Sequence
  Synthetic oligonucleotide; GGG chr2 60500340 60500359 60500343 -
gcagaggcagtgcataatgg

SEQ ID NO: 178666 - DNA, 20 bp, Artificial Sequence
  Synthetic oligonucleotide; TGG chr2 60500334 60500353 60500337 -
gcagtgcataatgggggaac

SEQ ID NO: 178667 - DNA, 20 bp, Artificial Sequence
  Synthetic oligonucleotide; CGG chr2 60500328 60500347 60500331 -
cataatgggggaactggccc

SEQ ID NO: 178668 - DNA, 20 bp, Artificial Sequence
  Synthetic oligonucleotide; GGG chr2 60500327 60500346 60500330 -
ataatgggggaactggcccc

SEQ ID NO: 178669 - DNA, 20 bp, Artificial Sequence
  Synthetic oligonucleotide; TGG chr2 60500278 60500297 60500281 -
ccccctgtcccctccccgcc

SEQ ID NO: 178670 - DNA, 20 bp, Artificial Sequence
  Synthetic oligonucleotide; GGG chr2 60500277 60500296 60500280 -
cccctgtcccctccccgcct

SEQ ID NO: 178671 - DNA, 20 bp, Artificial Sequence
  Synthetic oligonucleotide; AAG chr2 60500250 60500269 60500253 -
acttgtccactttcactctc

SEQ ID NO: 178672 - DNA, 20 bp, Artificial Sequence
  Synthetic oligonucleotide; CAG chr2 60500230 60500249 60500233 -
aagaccaccgctctcacaca

SEQ ID NO: 178673 - DNA, 20 bp, Artificial Sequence
  Synthetic oligonucleotide; AGG chr2 60500229 60500248 60500232 -
agaccaccgctctcacacac

SEQ ID NO: 178674 - DNA, 20 bp, Artificial Sequence
  Synthetic oligonucleotide; CAG chr2 60500210 60500229 60500213 -
caggtcctgtgctgccccca

SEQ ID NO: 178675 - DNA, 20 bp, Artificial Sequence
  Synthetic oligonucleotide; CAG chr2 60500202 60500221 60500205 -
gtgctgcccccacagctttg

SEQ ID NO: 178676 - DNA, 20 bp, Artificial Sequence
  Synthetic oligonucleotide; AGG chr2 60500201 60500220 60500204 -
tgctgcccccacagctttgc

SEQ ID NO: 178677 - DNA, 20 bp, Artificial Sequence
  Synthetic oligonucleotide; TGG chr2 60500194 60500213 60500197 -
cccacagctttgcaggctgc

SEQ ID NO: 178678 - DNA, 20 bp, Artificial Sequence
  Synthetic oligonucleotide; CAG chr2 60500182 60500201 60500185 -
caggctgctggttttccatc

SEQ ID NO: 178679 - DNA, 20 bp, Artificial Sequence
  Synthetic oligonucleotide; AGG chr2 60500181 60500200 60500184 -
aggctgctggttttccatcc

SEQ ID NO: 178680 - DNA, 20 bp, Artificial Sequence
  Synthetic oligonucleotide; GGG chr2 60500180 60500199 60500183 -
ggctgctggttttccatcca

SEQ ID NO: 178681 - DNA, 20 bp, Artificial Sequence
  Synthetic oligonucleotide; CAG chr2 60500175 60500194 60500178 -
ctggttttccatccagggca

SEQ ID NO: 178682 - DNA, 20 bp, Artificial Sequence
  Synthetic oligonucleotide; CAG chr2 60500169 60500188 60500172 -
ttccatccagggcacagccg

SEQ ID NO: 178683 - DNA, 20 bp, Artificial Sequence
  Synthetic oligonucleotide; AGG chr2 60500168 60500187 60500171 -
tccatccagggcacagccgc

SEQ ID NO: 178684 - DNA, 20 bp, Artificial Sequence
  Synthetic oligonucleotide; TGG chr2 60500161 60500180 60500164 -
agggcacagccgcaggcctc

SEQ ID NO: 178685 - DNA, 20 bp, Artificial Sequence
  Synthetic oligonucleotide; GGG chr2 60500160 60500179 60500163 -
gggcacagccgcaggcctct

SEQ ID NO: 178686 - DNA, 20 bp, Artificial Sequence
  Synthetic oligonucleotide; TAG chr2 60500152 60500171 60500155 -
ccgcaggcctctgggcaccc

SEQ ID NO: 178687 - DNA, 20 bp, Artificial Sequence
  Synthetic oligonucleotide; CAG chr2 60500145 60500164 60500148 -
cctctgggcaccctagccct

SEQ ID NO: 178688 - DNA, 20 bp, Artificial Sequence
  Synthetic oligonucleotide; CAG chr2 60500138 60500157 60500141 -
gcaccctagccctcagtgcc

SEQ ID NO: 178689 - DNA, 20 bp, Artificial Sequence
  Synthetic oligonucleotide; AGG chr2 60500137 60500156 60500140 -
caccctagccctcagtgccc

SEQ ID NO: 178690 - DNA, 20 bp, Artificial Sequence
  Synthetic oligonucleotide; GGG chr2 60500136 60500155 60500139 -
accctagccctcagtgccca

SEQ ID NO: 178691 - DNA, 20 bp, Artificial Sequence
  Synthetic oligonucleotide; AAG chr2 60500131 60500150 60500134 -
agccctcagtgcccagggca

SEQ ID NO: 178692 - DNA, 20 bp, Artificial Sequence
  Synthetic oligonucleotide; TGG chr2 60500109 60500128 60500112 -
gccctgacatgcaatctcac

SEQ ID NO: 178693 - DNA, 20 bp, Artificial Sequence
  Synthetic oligonucleotide; CAG chr2 60500106 60500125 60500109 -
ctgacatgcaatctcactgg

SEQ ID NO: 178694 - DNA, 20 bp, Artificial Sequence
  Synthetic oligonucleotide; AGG chr2 60500105 60500124 60500108 -
tgacatgcaatctcactggc

SEQ ID NO: 178695 - DNA, 20 bp, Artificial Sequence
  Synthetic oligonucleotide; CAG chr2 60500102 60500121 60500105 -
catgcaatctcactggcagg

SEQ ID NO: 178696 - DNA, 20 bp, Artificial Sequence
  Synthetic oligonucleotide; CAG chr2 60500096 60500115 60500099 -
atctcactggcaggcagcct

SEQ ID NO: 178697 - DNA, 20 bp, Artificial Sequence
  Synthetic oligonucleotide; AGG chr2 60500095 60500114 60500098 -
tctcactggcaggcagcctc

SEQ ID NO: 178698 - DNA, 20 bp, Artificial Sequence
  Synthetic oligonucleotide; CAG chr2 60500092 60500111 60500095 -
cactggcaggcagcctcagg

SEQ ID NO: 178699 - DNA, 20 bp, Artificial Sequence
  Synthetic oligonucleotide; AGG chr2 60500091 60500110 60500094 -
actggcaggcagcctcaggc

SEQ ID NO: 178700 - DNA, 20 bp, Artificial Sequence
  Synthetic oligonucleotide; TGG chr2 60500086 60500105 60500089 -
caggcagcctcaggcaggcc

SEQ ID NO: 178701 - DNA, 20 bp, Artificial Sequence
  Synthetic oligonucleotide; GGG chr2 60500085 60500104 60500088 -
aggcagcctcaggcaggcct

SEQ ID NO: 178702 - DNA, 20 bp, Artificial Sequence
  Synthetic oligonucleotide; CAG chr2 60500082 60500101 60500085 -
cagcctcaggcaggcctggg

SEQ ID NO: 178703 - DNA, 20 bp, Artificial Sequence
  Synthetic oligonucleotide; GAG chr2 60500080 60500099 60500083 -
gcctcaggcaggcctgggca

SEQ ID NO: 178704 - DNA, 20 bp, Artificial Sequence
  Synthetic oligonucleotide; AGG chr2 60500079 60500098 60500082 -
cctcaggcaggcctgggcag

SEQ ID NO: 178705 - DNA, 20 bp, Artificial Sequence
  Synthetic oligonucleotide; AAG chr2 60500071 60500090 60500074 -
aggcctgggcagaggaccga

SEQ ID NO: 178706 - DNA, 20 bp, Artificial Sequence
  Synthetic oligonucleotide; AGG chr2 60500070 60500089 60500073 -
ggcctgggcagaggaccgaa

SEQ ID NO: 178707 - DNA, 20 bp, Artificial Sequence
  Synthetic oligonucleotide; GAG chr2 60500068 60500087 60500071 -
cctgggcagaggaccgaaag

SEQ ID NO: 178708 - DNA, 20 bp, Artificial Sequence
  Synthetic oligonucleotide; AGG chr2 60500067 60500086 60500070 -
ctgggcagaggaccgaaagg

SEQ ID NO: 178709 - DNA, 20 bp, Artificial Sequence
  Synthetic oligonucleotide; GAG chr2 60500065 60500084 60500068 -
gggcagaggaccgaaaggag

SEQ ID NO: 178710 - DNA, 20 bp, Artificial Sequence
  Synthetic oligonucleotide; GAG chr2 60500063 60500082 60500066 -
gcagaggaccgaaaggagga

SEQ ID NO: 178711 - DNA, 20 bp, Artificial Sequence
  Synthetic oligonucleotide; AGG chr2 60500062 60500081 60500065 -
cagaggaccgaaaggaggag

SEQ ID NO: 178712 - DNA, 20 bp, Artificial Sequence
  Synthetic oligonucleotide; GAG chr2 60500060 60500079 60500063 -
gaggaccgaaaggaggagag

SEQ ID NO: 178713 - DNA, 20 bp, Artificial Sequence
  Synthetic oligonucleotide; AGG chr2 60500059 60500078 60500062 -
aggaccgaaaggaggagagg

SEQ ID NO: 178714 - DNA, 20 bp, Artificial Sequence
  Synthetic oligonucleotide; GGG chr2 60500058 60500077 60500061 -
ggaccgaaaggaggagagga

SEQ ID NO: 178715 - DNA, 20 bp, Artificial Sequence
  Synthetic oligonucleotide; GAG chr2 60500056 60500075 60500059 -
accgaaaggaggagaggagg

SEQ ID NO: 178716 - DNA, 20 bp, Artificial Sequence
  Synthetic oligonucleotide; AGG chr2 60500055 60500074 60500058 -
ccgaaaggaggagaggaggg

SEQ ID NO: 178717 - DNA, 20 bp, Artificial Sequence
  Synthetic oligonucleotide; GGG chr2 60500054 60500073 60500057 -
cgaaaggaggagaggaggga

SEQ ID NO: 178718 - DNA, 20 bp, Artificial Sequence
  Synthetic oligonucleotide; GAG chr2 60500052 60500071 60500055 -
aaaggaggagaggagggagg

SEQ ID NO: 178719 - DNA, 20 bp, Artificial Sequence
  Synthetic oligonucleotide; CAG chr2 60500046 60500065 60500049 -
ggagaggagggagggagcta

SEQ ID NO: 178720 - DNA, 20 bp, Artificial Sequence
  Synthetic oligonucleotide; TAG chr2 60500043 60500062 60500046 -
gaggagggagggagctacag

SEQ ID NO: 178721 - DNA, 20 bp, Artificial Sequence
  Synthetic oligonucleotide; GAG chr2 60500041 60500060 60500044 -
ggagggagggagctacagta

SEQ ID NO: 178722 - DNA, 20 bp, Artificial Sequence
  Synthetic oligonucleotide; CAG chr2 60500038 60500057 60500041 -
gggagggagctacagtagag

SEQ ID NO: 178723 - DNA, 20 bp, Artificial Sequence
  Synthetic oligonucleotide; CAG chr2 60500034 60500053 60500037 -
gggagctacagtagagcaga

SEQ ID NO: 178724 - DNA, 20 bp, Artificial Sequence
  Synthetic oligonucleotide; AGG chr2 60500033 60500052 60500036 -
ggagctacagtagagcagac

SEQ ID NO: 178725 - DNA, 20 bp, Artificial Sequence
  Synthetic oligonucleotide; GAG chr2 60500031 60500050 60500034 -
agctacagtagagcagacag

SEQ ID NO: 178726 - DNA, 20 bp, Artificial Sequence
  Synthetic oligonucleotide; CAG chr2 60500020 60500039 60500023 -
agcagacaggagacaaacac

SEQ ID NO: 178727 - DNA, 20 bp, Artificial Sequence
  Synthetic oligonucleotide; AAG chr2 60500015 60500034 60500018 -
acaggagacaaacaccagct

SEQ ID NO: 178728 - DNA, 20 bp, Artificial Sequence
  Synthetic oligonucleotide; GAG chr2 60500013 60500032 60500016 -
aggagacaaacaccagctaa

SEQ ID NO: 178729 - DNA, 20 bp, Artificial Sequence
  Synthetic oligonucleotide; CAG chr2 60500006 60500025 60500009 -
aaacaccagctaagagtaaa

SEQ ID NO: 178730 - DNA, 20 bp, Artificial Sequence
  Synthetic oligonucleotide; TGG chr2 60500001 60500020 60500004 -
ccagctaagagtaaacagcc

SEQ ID NO: 178731 - DNA, 20 bp, Artificial Sequence
  Synthetic oligonucleotide; CAG chr2 60499998 60500017 60500001 -
gctaagagtaaacagcctgg

SEQ ID NO: 178732 - DNA, 20 bp, Artificial Sequence
  Synthetic oligonucleotide; TGG chr2 60499995 60500014 60499998 -
aagagtaaacagcctggcag

SEQ ID NO: 178733 - DNA, 20 bp, Artificial Sequence
  Synthetic oligonucleotide; GGG chr2 60499994 60500013 60499997 -
agagtaaacagcctggcagt

SEQ ID NO: 178734 - DNA, 20 bp, Artificial Sequence
  Synthetic oligonucleotide; GGG chr2 60499993 60500012 60499996 -
gagtaaacagcctggcagtg

SEQ ID NO: 178735 - DNA, 20 bp, Artificial Sequence
  Synthetic oligonucleotide; GAG chr2 60499989 60500008 60499992 -
aaacagcctggcagtggggt

SEQ ID NO: 178736 - DNA, 20 bp, Artificial Sequence
  Synthetic oligonucleotide; TGG chr2 60499982 60500001 60499985 -
ctggcagtggggtgagtgcc

SEQ ID NO: 178737 - DNA, 20 bp, Artificial Sequence
  Synthetic oligonucleotide; TGG chr2 60499978 60499997 60499981 -
cagtggggtgagtgcctggc

SEQ ID NO: 178738 - DNA, 20 bp, Artificial Sequence
  Synthetic oligonucleotide; GAG chr2 60499976 60499995 60499979 -
gtggggtgagtgcctggctg

SEQ ID NO: 178739 - DNA, 20 bp, Artificial Sequence
  Synthetic oligonucleotide; AGG chr2 60499975 60499994 60499978 -
tggggtgagtgcctggctgg

SEQ ID NO: 178740 - DNA, 20 bp, Artificial Sequence
  Synthetic oligonucleotide; GGG chr2 60499974 60499993 60499977 -
ggggtgagtgcctggctgga

SEQ ID NO: 178741 - DNA, 20 bp, Artificial Sequence
  Synthetic oligonucleotide; GGG chr2 60499973 60499992 60499976 -
gggtgagtgcctggctggag

SEQ ID NO: 178742 - DNA, 20 bp, Artificial Sequence
  Synthetic oligonucleotide; TGG chr2 60499964 60499983 60499967 -
cctggctggaggggctcacc

SEQ ID NO: 178743 - DNA, 20 bp, Artificial Sequence
  Synthetic oligonucleotide; GGG chr2 60499963 60499982 60499966 -
ctggctggaggggctcacct

SEQ ID NO: 178744 - DNA, 20 bp, Artificial Sequence
  Synthetic oligonucleotide; TGG chr2 60499959 60499978 60499962 -
ctggaggggctcacctgggc

SEQ ID NO: 178745 - DNA, 20 bp, Artificial Sequence
  Synthetic oligonucleotide; TGG chr2 60499950 60499969 60499953 -
ctcacctgggctggcctgcc

SEQ ID NO: 178746 - DNA, 20 bp, Artificial Sequence
  Synthetic oligonucleotide; GGG chr2 60499949 60499968 60499952 -
tcacctgggctggcctgcct

SEQ ID NO: 178747 - DNA, 20 bp, Artificial Sequence
  Synthetic oligonucleotide; GAG chr2 60499947 60499966 60499950 -
acctgggctggcctgcctgg

SEQ ID NO: 178748 - DNA, 20 bp, Artificial Sequence
  Synthetic oligonucleotide; AGG chr2 60499946 60499965 60499949 -
cctgggctggcctgcctggg

SEQ ID NO: 178749 - DNA, 20 bp, Artificial Sequence
  Synthetic oligonucleotide; GAG chr2 60499944 60499963 60499947 -
tgggctggcctgcctgggag

SEQ ID NO: 178750 - DNA, 20 bp, Artificial Sequence
  Synthetic oligonucleotide; CAG chr2 60499940 60499959 60499943 -
ctggcctgcctgggaggagc

SEQ ID NO: 178751 - DNA, 20 bp, Artificial Sequence
  Synthetic oligonucleotide; AGG chr2 60499939 60499958 60499942 -
tggcctgcctgggaggagcc

SEQ ID NO: 178752 - DNA, 20 bp, Artificial Sequence
  Synthetic oligonucleotide; CGG chr2 60499935 60499954 60499938 -
ctgcctgggaggagccaggt

SEQ ID NO: 178753 - DNA, 20 bp, Artificial Sequence
  Synthetic oligonucleotide; TGG chr2 60499932 60499951 60499935 -
cctgggaggagccaggtcgg

SEQ ID NO: 178754 - DNA, 20 bp, Artificial Sequence
  Synthetic oligonucleotide; TAG chr2 60499912 60499931 60499915 -
tggctgctctctccgaatct

SEQ ID NO: 178755 - DNA, 20 bp, Artificial Sequence
  Synthetic oligonucleotide; GAG chr2 60499901 60499920 60499904 -
tccgaatcttagtcctgctt

SEQ ID NO: 178756 - DNA, 20 bp, Artificial Sequence
  Synthetic oligonucleotide; AGG chr2 60499900 60499919 60499903 -
ccgaatcttagtcctgcttg

SEQ ID NO: 178757 - DNA, 20 bp, Artificial Sequence
  Synthetic oligonucleotide; TAG chr2 60499895 60499914 60499898 -
tcttagtcctgcttgaggtc

SEQ ID NO: 178758 - DNA, 20 bp, Artificial Sequence
  Synthetic oligonucleotide; CAG chr2 60499892 60499911 60499895 -
tagtcctgcttgaggtctag

SEQ ID NO: 178759 - DNA, 20 bp, Artificial Sequence
  Synthetic oligonucleotide; CGG chr2 60499885 60499904 60499888 -
gcttgaggtctagcagcttc

SEQ ID NO: 178760 - DNA, 20 bp, Artificial Sequence
  Synthetic oligonucleotide; GAG chr2 60499883 60499902 60499886 -
ttgaggtctagcagcttccg

SEQ ID NO: 178761 - DNA, 20 bp, Artificial Sequence
  Synthetic oligonucleotide; TGG chr2 60499873 60499892 60499876 -
gcagcttccggagctgcaca

SEQ ID NO: 178762 - DNA, 20 bp, Artificial Sequence
  Synthetic oligonucleotide; GGG chr2 60499872 60499891 60499875 -
cagcttccggagctgcacat

SEQ ID NO: 178763 - DNA, 20 bp, Artificial Sequence
  Synthetic oligonucleotide; GGG chr2 60499871 60499890 60499874 -
agcttccggagctgcacatg

SEQ ID NO: 178764 - DNA, 20 bp, Artificial Sequence
  Synthetic oligonucleotide; GAG chr2 60499865 60499884 60499868 -
cggagctgcacatggggctt

SEQ ID NO: 178765 - DNA, 20 bp, Artificial Sequence
  Synthetic oligonucleotide; AGG chr2 60499864 60499883 60499867 -
ggagctgcacatggggcttg

SEQ ID NO: 178766 - DNA, 20 bp, Artificial Sequence
  Synthetic oligonucleotide; TGG chr2 60499859 60499878 60499862 -
tgcacatggggcttgaggtc

SEQ ID NO: 178767 - DNA, 20 bp, Artificial Sequence
  Synthetic oligonucleotide; TGG chr2 60499850 60499869 60499853 -
ggcttgaggtctggtgctta

SEQ ID NO: 178768 - DNA, 20 bp, Artificial Sequence
  Synthetic oligonucleotide; TAG chr2 60499845 60499864 60499848 -
gaggtctggtgcttatggat

SEQ ID NO: 178769 - DNA, 20 bp, Artificial Sequence
  Synthetic oligonucleotide; AGG chr2 60499844 60499863 60499847 -
aggtctggtgcttatggatt

SEQ ID NO: 178770 - DNA, 20 bp, Artificial Sequence
  Synthetic oligonucleotide; GAG chr2 60499842 60499861 60499845 -
gtctggtgcttatggattag

SEQ ID NO: 178771 - DNA, 20 bp, Artificial Sequence
  Synthetic oligonucleotide; AGG chr2 60499841 60499860 60499844 -
tctggtgcttatggattagg

SEQ ID NO: 178772 - DNA, 20 bp, Artificial Sequence
  Synthetic oligonucleotide; AAG chr2 60499838 60499857 60499841 -
ggtgcttatggattaggagg

SEQ ID NO: 178773 - DNA, 20 bp, Artificial Sequence
  Synthetic oligonucleotide; GAG chr2 60499836 60499855 60499839 -
tgcttatggattaggaggaa

SEQ ID NO: 178774 - DNA, 20 bp, Artificial Sequence
  Synthetic oligonucleotide; AAG chr2 60499833 60499852 60499836 -
ttatggattaggaggaagag

SEQ ID NO: 178775 - DNA, 20 bp, Artificial Sequence
  Synthetic oligonucleotide; CAG chr2 60499829 60499848 60499832 -
ggattaggaggaagagaaga

SEQ ID NO: 178776 - DNA, 20 bp, Artificial Sequence
  Synthetic oligonucleotide; TGG chr2 60499825 60499844 60499828 -
taggaggaagagaagacaga

SEQ ID NO: 178777 - DNA, 20 bp, Artificial Sequence
  Synthetic oligonucleotide; CAG chr2 60499822 60499841 60499825 -
gaggaagagaagacagatgg

SEQ ID NO: 178778 - DNA, 20 bp, Artificial Sequence
  Synthetic oligonucleotide; GAG chr2 60499820 60499839 60499823 -
ggaagagaagacagatggca

SEQ ID NO: 178779 - DNA, 20 bp, Artificial Sequence
  Synthetic oligonucleotide; CAG chr2 60499814 60499833 60499817 -
gaagacagatggcagagtac

SEQ ID NO: 178780 - DNA, 20 bp, Artificial Sequence
  Synthetic oligonucleotide; AGG chr2 60499813 60499832 60499816 -
aagacagatggcagagtacc

SEQ ID NO: 178781 - DNA, 20 bp, Artificial Sequence
  Synthetic oligonucleotide; CAG chr2 60499810 60499829 60499813 -
acagatggcagagtaccagg

SEQ ID NO: 178782 - DNA, 20 bp, Artificial Sequence
  Synthetic oligonucleotide; TAG chr2 60499805 60499824 60499808 -
tggcagagtaccaggcagct

SEQ ID NO: 178783 - DNA, 20 bp, Artificial Sequence
  Synthetic oligonucleotide; AGG chr2 60499804 60499823 60499807 -
ggcagagtaccaggcagctt

SEQ ID NO: 178784 - DNA, 20 bp, Artificial Sequence
  Synthetic oligonucleotide; TGG chr2 60499778 60499797 60499781 -
atgtctccttccacatgctg

SEQ ID NO: 178785 - DNA, 20 bp, Artificial Sequence
  Synthetic oligonucleotide; CAG chr2 60499773 60499792 60499776 -
tccttccacatgctgtggcc

SEQ ID NO: 178786 - DNA, 20 bp, Artificial Sequence
  Synthetic oligonucleotide; AGG chr2 60499772 60499791 60499775 -
ccttccacatgctgtggccc

SEQ ID NO: 178787 - DNA, 20 bp, Artificial Sequence
  Synthetic oligonucleotide; CAG chr2 60499762 60499781 60499765 -
gctgtggcccaggtgctgcc

SEQ ID NO: 178788 - DNA, 20 bp, Artificial Sequence
  Synthetic oligonucleotide; GAG chr2 60499760 60499779 60499763 -
tgtggcccaggtgctgccca

SEQ ID NO: 178789 - DNA, 20 bp, Artificial Sequence
  Synthetic oligonucleotide; CAG chr2 60499749 60499768 60499752 -
tgctgcccagagctgtttca

SEQ ID NO: 178790 - DNA, 20 bp, Artificial Sequence
  Synthetic oligonucleotide; CAG chr2 60499746 60499765 60499749 -
tgcccagagctgtttcacag

SEQ ID NO: 178791 - DNA, 20 bp, Artificial Sequence
  Synthetic oligonucleotide; AAG chr2 60499732 60499751 60499735 -
tcacagcagcctctccactc

SEQ ID NO: 178792 - DNA, 20 bp, Artificial Sequence
  Synthetic oligonucleotide; AGG chr2 60499731 60499750 60499734 -
cacagcagcctctccactca

SEQ ID NO: 178793 - DNA, 20 bp, Artificial Sequence
  Synthetic oligonucleotide; GAG chr2 60499726 60499745 60499729 -
cagcctctccactcaaggtt

SEQ ID NO: 178794 - DNA, 20 bp, Artificial Sequence
  Synthetic oligonucleotide; CGG chr2 60499723 60499742 60499726 -
cctctccactcaaggttgag

SEQ ID NO: 178795 - DNA, 20 bp, Artificial Sequence
  Synthetic oligonucleotide; CAG chr2 60499713 60499732 60499716 -
caaggttgagcggtttcctt

SEQ ID NO: 178796 - DNA, 20 bp, Artificial Sequence
  Synthetic oligonucleotide; TGG chr2 60499695 60499714 60499698 -
ttcagtgctgtccacccctt

SEQ ID NO: 178797 - DNA, 20 bp, Artificial Sequence
  Synthetic oligonucleotide; CGG chr2 60499690 60499709 60499693 -
tgctgtccacccctttggtc

SEQ ID NO: 178798 - DNA, 20 bp, Artificial Sequence
  Synthetic oligonucleotide; GGG chr2 60499689 60499708 60499692 -
gctgtccacccctttggtcc

SEQ ID NO: 178799 - DNA, 20 bp, Artificial Sequence
  Synthetic oligonucleotide; GGG chr2 60499688 60499707 60499691 -
ctgtccacccctttggtccg

SEQ ID NO: 178800 - DNA, 20 bp, Artificial Sequence
  Synthetic oligonucleotide; GAG chr2 60499686 60499705 60499689 -
gtccacccctttggtccggg

SEQ ID NO: 178801 - DNA, 20 bp, Artificial Sequence
  Synthetic oligonucleotide; TGG chr2 60499672 60499691 60499675 -
tccggggagcttcatgttcc

SEQ ID NO: 178802 - DNA, 20 bp, Artificial Sequence
  Synthetic oligonucleotide; GGG chr2 60499671 60499690 60499674 -
ccggggagcttcatgttcct

SEQ ID NO: 178803 - DNA, 20 bp, Artificial Sequence
  Synthetic oligonucleotide; TGG chr2 60499651 60499670 60499654 -
gggcctcactgacacctgca

SEQ ID NO: 178804 - DNA, 20 bp, Artificial Sequence
  Synthetic oligonucleotide; GGG chr2 60499650 60499669 60499653 -
ggcctcactgacacctgcat

SEQ ID NO: 178805 - DNA, 20 bp, Artificial Sequence
  Synthetic oligonucleotide; GGG chr2 60499649 60499668 60499652 -
gcctcactgacacctgcatg

SEQ ID NO: 178806 - DNA, 20 bp, Artificial Sequence
  Synthetic oligonucleotide; TGG chr2 60499645 60499664 60499648 -
cactgacacctgcatggggt

SEQ ID NO: 178807 - DNA, 20 bp, Artificial Sequence
  Synthetic oligonucleotide; TGG chr2 60499642 60499661 60499645 -
tgacacctgcatggggttgg

SEQ ID NO: 178808 - DNA, 20 bp, Artificial Sequence
  Synthetic oligonucleotide; GGG chr2 60499641 60499660 60499644 -
gacacctgcatggggttggt

SEQ ID NO: 178809 - DNA, 20 bp, Artificial Sequence
  Synthetic oligonucleotide; GGG chr2 60499640 60499659 60499643 -
acacctgcatggggttggtg

SEQ ID NO: 178810 - DNA, 20 bp, Artificial Sequence
  Synthetic oligonucleotide; GAG chr2 60499638 60499657 60499641 -
acctgcatggggttggtggg

SEQ ID NO: 178811 - DNA, 20 bp, Artificial Sequence
  Synthetic oligonucleotide; AGG chr2 60499637 60499656 60499640 -
cctgcatggggttggtgggg

SEQ ID NO: 178812 - DNA, 20 bp, Artificial Sequence
  Synthetic oligonucleotide; GAG chr2 60499631 60499650 60499634 -
tggggttggtggggaggtat

SEQ ID NO: 178813 - DNA, 20 bp, Artificial Sequence
  Synthetic oligonucleotide; AGG chr2 60499630 60499649 60499633 -
ggggttggtggggaggtatg

SEQ ID NO: 178814 - DNA, 20 bp, Artificial Sequence
  Synthetic oligonucleotide; GGG chr2 60499629 60499648 60499632 -
gggttggtggggaggtatga

SEQ ID NO: 178815 - DNA, 20 bp, Artificial Sequence
  Synthetic oligonucleotide; GGG chr2 60499628 60499647 60499631 -
ggttggtggggaggtatgag

SEQ ID NO: 178816 - DNA, 20 bp, Artificial Sequence
  Synthetic oligonucleotide; TGG chr2 60499624 60499643 60499627 -
ggtggggaggtatgaggggt
